United States Patent 12,606,847 (ENGINEERED VIRAL CAPSID POLYPEPTIDES AND USES THEREOF) - sequence listing, part 8

SEQ ID NO: 155725 - protein, 35 aa, Artificial Sequence
  Description of Artificial Sequence: Synthetic polypeptide
DEEEIRTTNPVATEQYGSYCYSPTEVLAAMVEVVG

SEQ ID NO: 155726 - protein, 30 aa, Artificial Sequence
  Description of Artificial Sequence: Synthetic polypeptide
DENEIRTTNPVCTEQWGDVSEIEMNAAEDA

SEQ ID NO: 155727 - protein, 32 aa, Artificial Sequence
  Description of Artificial Sequence: Synthetic polypeptide
DENEIRTTNPVCTEPYGYISMEDIQQQQNGNH

SEQ ID NO: 155728 - protein, 33 aa, Artificial Sequence
  Description of Artificial Sequence: Synthetic polypeptide
DENEIRTTNPVCTEPYGWISVMEDIQQQQNGNH

SEQ ID NO: 155729 - protein, 36 aa, Artificial Sequence
  Description of Artificial Sequence: Synthetic polypeptide
DEEEISTTNPVATEQYGQCVCSWGLDHQNFGSDNQS

SEQ ID NO: 155730 - protein, 38 aa, Artificial Sequence
  Description of Artificial Sequence: Synthetic polypeptide
DEEEIRTTNPVATEQYGVVSTVVTNQQGNQAGNDTEGS

SEQ ID NO: 155731 - protein, 32 aa, Artificial Sequence
  Description of Artificial Sequence: Synthetic polypeptide
DENEIRTTNPVCTEPYGTISMEDIQQQQNGNH

SEQ ID NO: 155732 - protein, 32 aa, Artificial Sequence
  Description of Artificial Sequence: Synthetic polypeptide
DENEIRTTNPVCTEPYGTISMEDIQAQQNGNH

SEQ ID NO: 155733 - protein, 32 aa, Artificial Sequence
  Description of Artificial Sequence: Synthetic polypeptide
DENEIRTTNPVCTEPYGTIIMESIQQQQNGNH

SEQ ID NO: 155734 - protein, 38 aa, Artificial Sequence
  Description of Artificial Sequence: Synthetic polypeptide
DEEEIRTTNPVATEQYGVVSTVVTNQNQQQGNNTTEND

SEQ ID NO: 155735 - protein, 35 aa, Artificial Sequence
  Description of Artificial Sequence: Synthetic polypeptide
DEAEIRTTNPVATEQYGSTPTDNLPHEPIWQESDY

SEQ ID NO: 155736 - protein, 36 aa, Artificial Sequence
  Description of Artificial Sequence: Synthetic polypeptide
DEAEIRTTNPVATEQYGSTVLTAELEVESRQQEDRI

SEQ ID NO: 155737 - protein, 30 aa, Artificial Sequence
  Description of Artificial Sequence: Synthetic polypeptide
DENEIRTTNPVGTEQWGDMASIEMNAAGDI

SEQ ID NO: 155738 - protein, 32 aa, Artificial Sequence
  Description of Artificial Sequence: Synthetic polypeptide
DENEIRTTNPVSMEPYGTISMEDNQQQQNGNH

SEQ ID NO: 155739 - protein, 31 aa, Artificial Sequence
  Description of Artificial Sequence: Synthetic polypeptide
DENEIASTNPVATEGWGDVAANTIQSRAGDA

SEQ ID NO: 155740 - protein, 31 aa, Artificial Sequence
  Description of Artificial Sequence: Synthetic polypeptide
DENEIASTNPVATEGWGNVAANTIQSRAGDA

SEQ ID NO: 155741 - protein, 30 aa, Artificial Sequence
  Description of Artificial Sequence: Synthetic polypeptide
DENEIASTNPVATEGWGVVSSTEMNAAGDA

SEQ ID NO: 155742 - protein, 32 aa, Artificial Sequence
  Description of Artificial Sequence: Synthetic polypeptide
DENEIRTTNPVSMEPYGTISMEDINQQQNGNH

SEQ ID NO: 155743 - protein, 32 aa, Artificial Sequence
  Description of Artificial Sequence: Synthetic polypeptide
DENEIRTTNPVSIEPYGQISYESIQQQQNGNH

SEQ ID NO: 155744 - protein, 33 aa, Artificial Sequence
  Description of Artificial Sequence: Synthetic polypeptide
DEEEIRTTNPVATEQYGSYGAPNGNEDATQAVL

SEQ ID NO: 155745 - protein, 29 aa, Artificial Sequence
  Description of Artificial Sequence: Synthetic peptide
DENEIASTNPVGTEGWGDMASTLQHAGDI

SEQ ID NO: 155746 - protein, 31 aa, Artificial Sequence
  Description of Artificial Sequence: Synthetic polypeptide
DENEIRTTNPVSSEPYGTISMDIQQQSNGNH

SEQ ID NO: 155747 - protein, 29 aa, Artificial Sequence
  Description of Artificial Sequence: Synthetic peptide
DENEIASTNPVGTEGWGDVAETLQAAGDA

SEQ ID NO: 155748 - protein, 37 aa, Artificial Sequence
  Description of Artificial Sequence: Synthetic polypeptide
DEEEIRTTNPVATEQYGVVSTVVTNQNQEQGTTEEED

SEQ ID NO: 155749 - protein, 32 aa, Artificial Sequence
  Description of Artificial Sequence: Synthetic polypeptide
DENEIASTNPVSTEGYGTIANETIQQQRNGNR

SEQ ID NO: 155750 - protein, 32 aa, Artificial Sequence
  Description of Artificial Sequence: Synthetic polypeptide
DENEIASTNPVSTEGYGTISNETIQQQQNGNR

SEQ ID NO: 155751 - protein, 29 aa, Artificial Sequence
  Description of Artificial Sequence: Synthetic peptide
DENEIASTNPVSTEPYGTMASDLQHNGDI

SEQ ID NO: 155752 - protein, 30 aa, Artificial Sequence
  Description of Artificial Sequence: Synthetic polypeptide
DENEIASTNPVSTEPYGTMASTLQQQQGDI

SEQ ID NO: 155753 - protein, 30 aa, Artificial Sequence
  Description of Artificial Sequence: Synthetic polypeptide
DENEIRTTNPVGTEQWGDVSEVEMNAAEDA

SEQ ID NO: 155754 - protein, 30 aa, Artificial Sequence
  Description of Artificial Sequence: Synthetic polypeptide
DENEIRTTNPVGTEQWGDVSEIEMNPAEDA

SEQ ID NO: 155755 - protein, 30 aa, Artificial Sequence
  Description of Artificial Sequence: Synthetic polypeptide
DENEIRTTNPVGTEQWGDVSEIEMNAAEDA

SEQ ID NO: 155756 - protein, 38 aa, Artificial Sequence
  Description of Artificial Sequence: Synthetic polypeptide
DEEEIRTTNPVATEQYGVVSTVVTNQNNQQGTNDEEED

SEQ ID NO: 155757 - protein, 36 aa, Artificial Sequence
  Description of Artificial Sequence: Synthetic polypeptide
DENEIRTTNPVATEQYGSVCSVTWPINIDRFVHEEG

SEQ ID NO: 155758 - protein, 36 aa, Artificial Sequence
  Description of Artificial Sequence: Synthetic polypeptide
DENEIRTTNPVATEQYGSVCSVTWPINEDRFVQEGP

SEQ ID NO: 155759 - protein, 36 aa, Artificial Sequence
  Description of Artificial Sequence: Synthetic polypeptide
DENEIRTTNPVATEQYGSVCSVTWPINADRFVHEGV

SEQ ID NO: 155760 - protein, 34 aa, Artificial Sequence
  Description of Artificial Sequence: Synthetic polypeptide
DENEIRTTNPVATEQWGNVDSNIGEMNGQEGDED

SEQ ID NO: 155761 - protein, 36 aa, Artificial Sequence
  Description of Artificial Sequence: Synthetic polypeptide
DEGEIRTTNPVATEQYGSNSTVLDANEDEGMQDGQI

SEQ ID NO: 155762 - protein, 33 aa, Artificial Sequence
  Description of Artificial Sequence: Synthetic polypeptide
DEAEIRCTNPVATEQYGCSAWAFLTRIQENEQG

SEQ ID NO: 155763 - protein, 31 aa, Artificial Sequence
  Description of Artificial Sequence: Synthetic polypeptide
DENEIRTTNPVATEQWGNVAAEIIQSAVEDA

SEQ ID NO: 155764 - protein, 31 aa, Artificial Sequence
  Description of Artificial Sequence: Synthetic polypeptide
DENEIRTTNPVATEQWGNVAAEIIQNAVEDA

SEQ ID NO: 155765 - protein, 36 aa, Artificial Sequence
  Description of Artificial Sequence: Synthetic polypeptide
DENEIATTNPVATEQYGSVCASNDLPQEHQDGNEHH

SEQ ID NO: 155766 - protein, 38 aa, Artificial Sequence
  Description of Artificial Sequence: Synthetic polypeptide
DEEEIRTTNPVAVEQYGSVSTVVNNQQLGNNNNNEGDG

SEQ ID NO: 155767 - protein, 38 aa, Artificial Sequence
  Description of Artificial Sequence: Synthetic polypeptide
DEEEIRTTNPVAVEQYGSVSTVVNNQQLGNNGNNENDT

SEQ ID NO: 155768 - protein, 33 aa, Artificial Sequence
  Description of Artificial Sequence: Synthetic polypeptide
DEEQIACTNPVATEQYGSVATHGPLGAPGGETT

SEQ ID NO: 155769 - protein, 31 aa, Artificial Sequence
  Description of Artificial Sequence: Synthetic polypeptide
DENEIRTTNPVATEQWGNDVSEIEMNAHEDA

SEQ ID NO: 155770 - protein, 32 aa, Artificial Sequence
  Description of Artificial Sequence: Synthetic polypeptide
DENEIRTTNPVATEQWGNDVSEIEMNAAEDHA

SEQ ID NO: 155771 - protein, 31 aa, Artificial Sequence
  Description of Artificial Sequence: Synthetic polypeptide
DENEIRTTNPVATEQWGNDVSEIEMNAAEDA

SEQ ID NO: 155772 - protein, 35 aa, Artificial Sequence
  Description of Artificial Sequence: Synthetic polypeptide
DENEIATTNPVATEQYGSVCATNNQENTDDGGEQM

SEQ ID NO: 155773 - protein, 37 aa, Artificial Sequence
  Description of Artificial Sequence: Synthetic polypeptide
DEEEIRTTNPVAVEQYGSVSTVVNNNNNQENDEQGTE

SEQ ID NO: 155774 - protein, 36 aa, Artificial Sequence
  Description of Artificial Sequence: Synthetic polypeptide
DENEIATTNPVATEQYGSVCATNPQLNPDDQMGGTD

SEQ ID NO: 155775 - protein, 33 aa, Artificial Sequence
  Description of Artificial Sequence: Synthetic polypeptide
DENEIRTTNPVATEQWGNCVSEVTEMNIAEDEA

SEQ ID NO: 155776 - protein, 31 aa, Artificial Sequence
  Description of Artificial Sequence: Synthetic polypeptide
DENEIRTTNPVATEQWGMVSEIEIMNAAEDA

SEQ ID NO: 155777 - protein, 34 aa, Artificial Sequence
  Description of Artificial Sequence: Synthetic polypeptide
DENEIRTTNPVATEQWGNVSCEIESMNAAEGDNA

SEQ ID NO: 155778 - protein, 32 aa, Artificial Sequence
  Description of Artificial Sequence: Synthetic polypeptide
DEEQIACTNPVATAQWGSVASHGPLGAPGGNA

SEQ ID NO: 155779 - protein, 31 aa, Artificial Sequence
  Description of Artificial Sequence: Synthetic polypeptide
DENEIRTTNPVATEQWGNVSEIAEMNAAEDA

SEQ ID NO: 155780 - protein, 36 aa, Artificial Sequence
  Description of Artificial Sequence: Synthetic polypeptide
DENEIATTNPVATEQYGSVCAMTNHGEQTLDGMARI

SEQ ID NO: 155781 - protein, 35 aa, Artificial Sequence
  Description of Artificial Sequence: Synthetic polypeptide
DEGEIRTTNPVATEQYGSTISWTDFMQQFSGQEFQ

SEQ ID NO: 155782 - protein, 36 aa, Artificial Sequence
  Description of Artificial Sequence: Synthetic polypeptide
DEEPIRTTNPVATEDYGSVSSTTPAGPNMRNGMNPV

SEQ ID NO: 155783 - protein, 37 aa, Artificial Sequence
  Description of Artificial Sequence: Synthetic polypeptide
DEEEIRTTNPVAWEQWGSVVSCTGNENATPRGGQNHG

SEQ ID NO: 155784 - protein, 34 aa, Artificial Sequence
  Description of Artificial Sequence: Synthetic polypeptide
DENEIATTNPVATEQYGSVCAATGEEAGDEMNNP

SEQ ID NO: 155785 - protein, 35 aa, Artificial Sequence
  Description of Artificial Sequence: Synthetic polypeptide
DEAEAEIRTTNPVAYEQWGSVAWTDQLDQDQGGDG

SEQ ID NO: 155786 - protein, 35 aa, Artificial Sequence
  Description of Artificial Sequence: Synthetic polypeptide
DEAEAEIRTTNPVAYEQWGSVAWTDQLNQDHGGDS

SEQ ID NO: 155787 - protein, 31 aa, Artificial Sequence
  Description of Artificial Sequence: Synthetic polypeptide
DDEEVASTNPVATEGYGNVAANTIQSRVEQR

SEQ ID NO: 155788 - protein, 36 aa, Artificial Sequence
  Description of Artificial Sequence: Synthetic polypeptide
DEEPIRTTNPVATEQYGSVSSTTPAGPNMRNHMNPV

SEQ ID NO: 155789 - protein, 31 aa, Artificial Sequence
  Description of Artificial Sequence: Synthetic polypeptide
DENEIRTTNPVATEQWGMDVSSIEMNAAEDA

SEQ ID NO: 155790 - protein, 36 aa, Artificial Sequence
  Description of Artificial Sequence: Synthetic polypeptide
DEEPIRTTNPVATEQYGSVSSTTPAGPPMHNGMNPV

SEQ ID NO: 155791 - protein, 35 aa, Artificial Sequence
  Description of Artificial Sequence: Synthetic polypeptide
DEEPIRTTNPVAYEQWRWETVSCCGNELSQIVGNR

SEQ ID NO: 155792 - protein, 31 aa, Artificial Sequence
  Description of Artificial Sequence: Synthetic polypeptide
DEAEIAATNGCYYMPMYGSVSTNLQDGDNSM

SEQ ID NO: 155793 - protein, 33 aa, Artificial Sequence
  Description of Artificial Sequence: Synthetic polypeptide
DEEPISTTNPVAYEQWGYVRHIEDLQRRGTDMR

SEQ ID NO: 155794 - protein, 35 aa, Artificial Sequence
  Description of Artificial Sequence: Synthetic polypeptide
DENEIATTNPVATEQYGSVCAMNNGLNATDGNPES

SEQ ID NO: 155795 - protein, 33 aa, Artificial Sequence
  Description of Artificial Sequence: Synthetic polypeptide
DENEIRTTNPVATEQWGNVSTVVIGTNNAEDEA

SEQ ID NO: 155796 - protein, 36 aa, Artificial Sequence
  Description of Artificial Sequence: Synthetic polypeptide
DENEIATTNPVATEQYGSVCAMTNHGEATLDGENRN

SEQ ID NO: 155797 - protein, 34 aa, Artificial Sequence
  Description of Artificial Sequence: Synthetic polypeptide
DEAEIRTTNPVATEQYGCVCSWEDHQNFGSETQS

SEQ ID NO: 155798 - protein, 34 aa, Artificial Sequence
  Description of Artificial Sequence: Synthetic polypeptide
DEAEIRTTNPVATEQYGCVCSWEDHNANFNSNQA

SEQ ID NO: 155799 - protein, 30 aa, Artificial Sequence
  Description of Artificial Sequence: Synthetic polypeptide
DENEIRTTNPVATEQWGQCSEIEMNAAEDA

SEQ ID NO: 155800 - protein, 32 aa, Artificial Sequence
  Description of Artificial Sequence: Synthetic polypeptide
DENEIRTTNPVATEQWGQCVSSAEANAFNSDA

SEQ ID NO: 155801 - protein, 34 aa, Artificial Sequence
  Description of Artificial Sequence: Synthetic polypeptide
DENEIATTNPVATEQYGSVCSAANNLPLDSEEEN

SEQ ID NO: 155802 - protein, 34 aa, Artificial Sequence
  Description of Artificial Sequence: Synthetic polypeptide
DENEIATTNPVATEQYGSVCSAANNLPLDSETDE

SEQ ID NO: 155803 - protein, 37 aa, Artificial Sequence
  Description of Artificial Sequence: Synthetic polypeptide
DEEQIRTTNPVATEQYGSAVSSTTPAGPNMRNGMNPV

SEQ ID NO: 155804 - protein, 35 aa, Artificial Sequence
  Description of Artificial Sequence: Synthetic polypeptide
DEEEIRTTNPVATEQYGSVYPPPLLEETMGPGEQV

SEQ ID NO: 155805 - protein, 37 aa, Artificial Sequence
  Description of Artificial Sequence: Synthetic polypeptide
DENEIATTNPVATEQYGSVCSMTNNLPQDHQDDNSNM

SEQ ID NO: 155806 - protein, 36 aa, Artificial Sequence
  Description of Artificial Sequence: Synthetic polypeptide
DEEQIRTTNPVATEQYGSFSSTTPAGPNMRNGMNPI

SEQ ID NO: 155807 - protein, 33 aa, Artificial Sequence
  Description of Artificial Sequence: Synthetic polypeptide
DEAEIRCTNPVGTMCWGSVSVINEPQDREGENG

SEQ ID NO: 155808 - protein, 34 aa, Artificial Sequence
  Description of Artificial Sequence: Synthetic polypeptide
DEGEIRTTNPVATEQYGSCISVLNGQDQTYDSKI

SEQ ID NO: 155809 - protein, 36 aa, Artificial Sequence
  Description of Artificial Sequence: Synthetic polypeptide
DEGEIRTTNPVATEQYGSCGSVLVNGWDQSTYDGNI

SEQ ID NO: 155810 - protein, 36 aa, Artificial Sequence
  Description of Artificial Sequence: Synthetic polypeptide
DENEIATTNPVATEQYGSVCSPTGNNNDQTAAGMGL

SEQ ID NO: 155811 - protein, 37 aa, Artificial Sequence
  Description of Artificial Sequence: Synthetic polypeptide
DENEIATTNPVATEQYGSVCSPTGNNNDQTAGGGNQD

SEQ ID NO: 155812 - protein, 35 aa, Artificial Sequence
  Description of Artificial Sequence: Synthetic polypeptide
DEEEIRTTNPVATEQYGSVYPGPEVQQQPENSLLE

SEQ ID NO: 155813 - protein, 33 aa, Artificial Sequence
  Description of Artificial Sequence: Synthetic polypeptide
DENEIATTNPVATEQYGSVCSVGNGDNEMPDDN

SEQ ID NO: 155814 - protein, 36 aa, Artificial Sequence
  Description of Artificial Sequence: Synthetic polypeptide
DEEEIRTTNPVATEQYGSVYPELDHIEQFQVVGMTL

SEQ ID NO: 155815 - protein, 35 aa, Artificial Sequence
  Description of Artificial Sequence: Synthetic polypeptide
DEEEIRTTNPVATEQYGSVYNWLPDEDPTMNPVTQ

SEQ ID NO: 155816 - protein, 35 aa, Artificial Sequence
  Description of Artificial Sequence: Synthetic polypeptide
DENEIATTNPVATEQYGSVSAINNPEETGGGVENN

SEQ ID NO: 155817 - protein, 36 aa, Artificial Sequence
  Description of Artificial Sequence: Synthetic polypeptide
DEGEIRTTNPVATEQYGIVWPTLNLHVIEGSNEDVE

SEQ ID NO: 155818 - protein, 36 aa, Artificial Sequence
  Description of Artificial Sequence: Synthetic polypeptide
DEEEIRTTNPVATEQYGSVYMLMQGGEQMIMNAEEL

SEQ ID NO: 155819 - protein, 34 aa, Artificial Sequence
  Description of Artificial Sequence: Synthetic polypeptide
DEAEIRTTNCVAYCHYGSTVPSTNELSQTTGGDE

SEQ ID NO: 155820 - protein, 33 aa, Artificial Sequence
  Description of Artificial Sequence: Synthetic polypeptide
DENEIRTTNPVATEQWGKVPSEGASMNAAEGPA

SEQ ID NO: 155821 - protein, 33 aa, Artificial Sequence
  Description of Artificial Sequence: Synthetic polypeptide
DENEIRTTNPVATEQWGKVPSEGDSMNKAEGDA

SEQ ID NO: 155822 - protein, 33 aa, Artificial Sequence
  Description of Artificial Sequence: Synthetic polypeptide
DENEIRTTNPVATEQWGKVPSEGESANAAEGDA

SEQ ID NO: 155823 - protein, 33 aa, Artificial Sequence
  Description of Artificial Sequence: Synthetic polypeptide
DENEIRTTNPVATEQWGKVPSEGESMNNNEGDA

SEQ ID NO: 155824 - protein, 37 aa, Artificial Sequence
  Description of Artificial Sequence: Synthetic polypeptide
DEEEIRTTNPVAVEQYGSVSTVTNNNNLQQNEEEEED

SEQ ID NO: 155825 - protein, 35 aa, Artificial Sequence
  Description of Artificial Sequence: Synthetic polypeptide
DENEIATTNPVATEQYGSVCSAANNLPLDSGEGEH

SEQ ID NO: 155826 - protein, 32 aa, Artificial Sequence
  Description of Artificial Sequence: Synthetic polypeptide
DENEIRTTNPVATEQWGLVSEVEMNIPEDEAD

SEQ ID NO: 155827 - protein, 31 aa, Artificial Sequence
  Description of Artificial Sequence: Synthetic polypeptide
DENEIRTTNPVATEQWGLVCSEMEMNIAEDA

SEQ ID NO: 155828 - protein, 33 aa, Artificial Sequence
  Description of Artificial Sequence: Synthetic polypeptide
DENEIRTTNPVATEQWGLSWSEVETMNIPEDQA

SEQ ID NO: 155829 - protein, 31 aa, Artificial Sequence
  Description of Artificial Sequence: Synthetic polypeptide
DENEIRTTNPVATEQWGLIVSEIEMNAAEDA

SEQ ID NO: 155830 - protein, 36 aa, Artificial Sequence
  Description of Artificial Sequence: Synthetic polypeptide
DENEIATTNPVATEQYGSVCSAANNLPLDSGEMDNT

SEQ ID NO: 155831 - protein, 32 aa, Artificial Sequence
  Description of Artificial Sequence: Synthetic polypeptide
DEGEIRTTNPVATEQYGSCTIWDWEQENELQQ

SEQ ID NO: 155832 - protein, 34 aa, Artificial Sequence
  Description of Artificial Sequence: Synthetic polypeptide
DENEIATTNPVATEQYGSVCSAANNLPLDSEMHN

SEQ ID NO: 155833 - protein, 35 aa, Artificial Sequence
  Description of Artificial Sequence: Synthetic polypeptide
DEAEIRTTNPVATEQYGCVCSTGEPQENFNSDFQS

SEQ ID NO: 155834 - protein, 34 aa, Artificial Sequence
  Description of Artificial Sequence: Synthetic polypeptide
DENEIRTTNPVATEQWGKVPSVEGASMNAAEGDK

SEQ ID NO: 155835 - protein, 33 aa, Artificial Sequence
  Description of Artificial Sequence: Synthetic polypeptide
DENEIRTTNPVATEQWGKVPSSSHSMNAAEGDA

SEQ ID NO: 155836 - protein, 34 aa, Artificial Sequence
  Description of Artificial Sequence: Synthetic polypeptide
DENEIRTTNPVATEQWGKVPSNGESMNAAEGDPR

SEQ ID NO: 155837 - protein, 33 aa, Artificial Sequence
  Description of Artificial Sequence: Synthetic polypeptide
DENEIRTTNPVATEQWGKVPSEPHSMNAAEGDH

SEQ ID NO: 155838 - protein, 33 aa, Artificial Sequence
  Description of Artificial Sequence: Synthetic polypeptide
DENEIRTTNPVATEQWGKVPSEIESMNAAVGDA

SEQ ID NO: 155839 - protein, 35 aa, Artificial Sequence
  Description of Artificial Sequence: Synthetic polypeptide
DEAEIRCTNPVATEQYGSVGENDLDFTGFNENDQD

SEQ ID NO: 155840 - protein, 35 aa, Artificial Sequence
  Description of Artificial Sequence: Synthetic polypeptide
DENEIATTNPVATEQYGSVCSATLAGTNHQDDIAE

SEQ ID NO: 155841 - protein, 36 aa, Artificial Sequence
  Description of Artificial Sequence: Synthetic polypeptide
DEAEIRCTNPVATEQYGSVSSTTPAGPNMRNGMNPV

SEQ ID NO: 155842 - protein, 34 aa, Artificial Sequence
  Description of Artificial Sequence: Synthetic polypeptide
DENEIRTTNPVATEQWGKVPSWQIHSTNAAEGDA

SEQ ID NO: 155843 - protein, 34 aa, Artificial Sequence
  Description of Artificial Sequence: Synthetic polypeptide
DEAEIRTTNCVAYCQYGCTVPSTNEQSQRTGGDE

SEQ ID NO: 155844 - protein, 36 aa, Artificial Sequence
  Description of Artificial Sequence: Synthetic polypeptide
DEEEIRTTNPVAWEQYGCVCSNTNEHNQENFNSEQA

SEQ ID NO: 155845 - protein, 34 aa, Artificial Sequence
  Description of Artificial Sequence: Synthetic polypeptide
DEEEIRTTNPVAWEQYGCVCSTGEHNQNFISEQS

SEQ ID NO: 155846 - protein, 37 aa, Artificial Sequence
  Description of Artificial Sequence: Synthetic polypeptide
DEENIRTTNPVATEQYGSVSSTTPAGPNMRNGMNPVE

SEQ ID NO: 155847 - protein, 31 aa, Artificial Sequence
  Description of Artificial Sequence: Synthetic polypeptide
DENEIRTTNPVATEQWGTVSCEIHMNAAEDA

SEQ ID NO: 155848 - protein, 31 aa, Artificial Sequence
  Description of Artificial Sequence: Synthetic polypeptide
DENEIRTTNPVATEQWGTVFSEIEMNAAEDA

SEQ ID NO: 155849 - protein, 33 aa, Artificial Sequence
  Description of Artificial Sequence: Synthetic polypeptide
DENEIRTTNPVATEQWGTVCSATGPVMNFEGDA

SEQ ID NO: 155850 - protein, 34 aa, Artificial Sequence
  Description of Artificial Sequence: Synthetic polypeptide
DDETIRTTNPVATEFYGSVSTGGEEGGGGGNTNV

SEQ ID NO: 155851 - protein, 34 aa, Artificial Sequence
  Description of Artificial Sequence: Synthetic polypeptide
DDEPIRTTNPMAYEAYGKVSTGNMHQRAVGNNPV

SEQ ID NO: 155852 - protein, 34 aa, Artificial Sequence
  Description of Artificial Sequence: Synthetic polypeptide
DDEPIRTTNPCAYEAYGKVSTGNMHQRDVGVNPC

SEQ ID NO: 155853 - protein, 36 aa, Artificial Sequence
  Description of Artificial Sequence: Synthetic polypeptide
DEAEIRCTNPVATECYGEVSTGNGNQQLDQGGNEDN

SEQ ID NO: 155854 - protein, 35 aa, Artificial Sequence
  Description of Artificial Sequence: Synthetic polypeptide
DDEEIRTTNPVATDQYGSVSVDQQGGEQNEGGQGE

SEQ ID NO: 155855 - protein, 33 aa, Artificial Sequence
  Description of Artificial Sequence: Synthetic polypeptide
DENEIRTTNPVATEQWGTVATEQYGNTNAAEDA

SEQ ID NO: 155856 - protein, 32 aa, Artificial Sequence
  Description of Artificial Sequence: Synthetic polypeptide
CEHEISTVNPVATEQYGSVSDDQAFQGAVNEE

SEQ ID NO: 155857 - protein, 31 aa, Artificial Sequence
  Description of Artificial Sequence: Synthetic polypeptide
DENEIRTTNPVATEQWGTQVSEIEMNAAEDA

SEQ ID NO: 155858 - protein, 36 aa, Artificial Sequence
  Description of Artificial Sequence: Synthetic polypeptide
DEAEIRCTNPVATECYGSVSTGNGNQQLDQGGKGDS

SEQ ID NO: 155859 - protein, 31 aa, Artificial Sequence
  Description of Artificial Sequence: Synthetic polypeptide
DENEIRTTNPVATEQWGTGVSEIEMNAAEDA

SEQ ID NO: 155860 - protein, 32 aa, Artificial Sequence
  Description of Artificial Sequence: Synthetic polypeptide
DENEIRTTNPVATEQWGTDVSEIQEMNAAEDA

SEQ ID NO: 155861 - protein, 32 aa, Artificial Sequence
  Description of Artificial Sequence: Synthetic polypeptide
DENEIRTTNPVATEQWGTDVSEIEMNAAELDA

SEQ ID NO: 155862 - protein, 31 aa, Artificial Sequence
  Description of Artificial Sequence: Synthetic polypeptide
DENEIRTTNPVATEQWGTDVSEIEMNAAEDA

SEQ ID NO: 155863 - protein, 35 aa, Artificial Sequence
  Description of Artificial Sequence: Synthetic polypeptide
DEAEIRTTNPVATEQYGCVSVEVPDEQLQGGIEVG

SEQ ID NO: 155864 - protein, 34 aa, Artificial Sequence
  Description of Artificial Sequence: Synthetic polypeptide
DEAEIRTTNPVATEQYGCVSVEVPDEQQGFDGVG

SEQ ID NO: 155865 - protein, 31 aa, Artificial Sequence
  Description of Artificial Sequence: Synthetic polypeptide
DENEIRTTNPVATEQWGTVSEGIEMNAAEDA

SEQ ID NO: 155866 - protein, 35 aa, Artificial Sequence
  Description of Artificial Sequence: Synthetic polypeptide
DEEEIRTTNPVAYDQYGKTVSCANMFTRTGDNELF

SEQ ID NO: 155867 - protein, 34 aa, Artificial Sequence
  Description of Artificial Sequence: Synthetic polypeptide
DDETIRTTNPVATEQYGDVVGSTGGQDGGQGQTT

SEQ ID NO: 155868 - protein, 35 aa, Artificial Sequence
  Description of Artificial Sequence: Synthetic polypeptide
DDETIRTTNPVATEQYGAVVITTGNGQRGQSEEGQ

SEQ ID NO: 155869 - protein, 35 aa, Artificial Sequence
  Description of Artificial Sequence: Synthetic polypeptide
DDETIRTTNPVATEQYGAVVITDNNEQRGQFDEGQ

SEQ ID NO: 155870 - protein, 35 aa, Artificial Sequence
  Description of Artificial Sequence: Synthetic polypeptide
DDETIRTTNPVATEQYGAVVDTNEGQENGQDNEDV

SEQ ID NO: 155871 - protein, 35 aa, Artificial Sequence
  Description of Artificial Sequence: Synthetic polypeptide
DDETIRTTNPVATEQYGAVVDTNEGGQFGQDNEGG

SEQ ID NO: 155872 - protein, 35 aa, Artificial Sequence
  Description of Artificial Sequence: Synthetic polypeptide
DDETIRTTNPVATEQYGAVVDLNNEGQRGQNNEGG

SEQ ID NO: 155873 - protein, 33 aa, Artificial Sequence
  Description of Artificial Sequence: Synthetic polypeptide
DENEIATTNPVATEQYGSVASNDANRNPMDAQP

SEQ ID NO: 155874 - protein, 35 aa, Artificial Sequence
  Description of Artificial Sequence: Synthetic polypeptide
DDETIRTTNPVATEQYGAVVDGTNEGQRNQDNEGG

SEQ ID NO: 155875 - protein, 36 aa, Artificial Sequence
  Description of Artificial Sequence: Synthetic polypeptide
DDEEIRTTNPVATDQYGSVSVGNQGGEQNEGGNGNL

SEQ ID NO: 155876 - protein, 34 aa, Artificial Sequence
  Description of Artificial Sequence: Synthetic polypeptide
DEGEIRTTNPVATEQYGSVCEMLNEHVEGSIEDV

SEQ ID NO: 155877 - protein, 35 aa, Artificial Sequence
  Description of Artificial Sequence: Synthetic polypeptide
DEAEIRTTNPVATEQYGCVSYDKTENQTRPQFDIF

SEQ ID NO: 155878 - protein, 35 aa, Artificial Sequence
  Description of Artificial Sequence: Synthetic polypeptide
DEGEIRTTNPVATEQYGSVCAYNDTWEIFLQDHMI

SEQ ID NO: 155879 - protein, 36 aa, Artificial Sequence
  Description of Artificial Sequence: Synthetic polypeptide
DEEEIRTTNPVATEQYGSVTSPELEDNMGIGQLQID

SEQ ID NO: 155880 - protein, 31 aa, Artificial Sequence
  Description of Artificial Sequence: Synthetic polypeptide
DENEIRTTNPVATEQWGTVSEIEVENAEEDA

SEQ ID NO: 155881 - protein, 35 aa, Artificial Sequence
  Description of Artificial Sequence: Synthetic polypeptide
DEEEIRTTNPVAYEAFGQSVVVCTYALDERGGNSF

SEQ ID NO: 155882 - protein, 35 aa, Artificial Sequence
  Description of Artificial Sequence: Synthetic polypeptide
DEACISTTNPVAYEQYGQSTVCCVDNELAQRGGER

SEQ ID NO: 155883 - protein, 35 aa, Artificial Sequence
  Description of Artificial Sequence: Synthetic polypeptide
DEAEIRTTNPVATEQYGCVSWGNDEQQGIGIEDQA

SEQ ID NO: 155884 - protein, 37 aa, Artificial Sequence
  Description of Artificial Sequence: Synthetic polypeptide
DEENIRTTNPVATEQYGSSVSSTTPAGPNMRNGMNPV

SEQ ID NO: 155885 - protein, 36 aa, Artificial Sequence
  Description of Artificial Sequence: Synthetic polypeptide
DEEEIRTTNPVAYEAWGHCTVSYTNALSHRPGSNFV

SEQ ID NO: 155886 - protein, 32 aa, Artificial Sequence
  Description of Artificial Sequence: Synthetic polypeptide
DENEIRTTNPVATEQWGQDVSEIEMNAAEDKA

SEQ ID NO: 155887 - protein, 33 aa, Artificial Sequence
  Description of Artificial Sequence: Synthetic polypeptide
DENEIATTNPVATEQYGSVCAAANNLPLDSEDN

SEQ ID NO: 155888 - protein, 34 aa, Artificial Sequence
  Description of Artificial Sequence: Synthetic polypeptide
DEADEIATTNPVAYEQWGSVSGNPNGQTDGGNEV

SEQ ID NO: 155889 - protein, 33 aa, Artificial Sequence
  Description of Artificial Sequence: Synthetic polypeptide
DEEPIRCTNPVATEQYGCVTTQNDCMFDGQSCI

SEQ ID NO: 155890 - protein, 33 aa, Artificial Sequence
  Description of Artificial Sequence: Synthetic polypeptide
DEAEIRTTNPVATEQYGCVCSWGPDANFNSNQA

SEQ ID NO: 155891 - protein, 36 aa, Artificial Sequence
  Description of Artificial Sequence: Synthetic polypeptide
DDEEIRTTNPVATDQYGSVVITNNNGEQTNEGGNNG

SEQ ID NO: 155892 - protein, 34 aa, Artificial Sequence
  Description of Artificial Sequence: Synthetic polypeptide
DEAEIRTTNPVATEQYGCVCSWGEHQENFNSDQM

SEQ ID NO: 155893 - protein, 34 aa, Artificial Sequence
  Description of Artificial Sequence: Synthetic polypeptide
DEAEIRTTNPVATEQYGCVCSWGEHQENFGSDQA

SEQ ID NO: 155894 - protein, 33 aa, Artificial Sequence
  Description of Artificial Sequence: Synthetic polypeptide
DENEIRTTNPVATEQWGSVSCIIEPMDRAEEDA

SEQ ID NO: 155895 - protein, 34 aa, Artificial Sequence
  Description of Artificial Sequence: Synthetic polypeptide
DEAEIRTTNPVATEQYGCVCSWEHNANFNSENQA

SEQ ID NO: 155896 - protein, 33 aa, Artificial Sequence
  Description of Artificial Sequence: Synthetic polypeptide
DENEIRTTNPVATEQWGSDVVSTEIEMNAMEEA

SEQ ID NO: 155897 - protein, 33 aa, Artificial Sequence
  Description of Artificial Sequence: Synthetic polypeptide
DENEIRTTNPVATEQWGSDVSSEIEMNAMEEAI

SEQ ID NO: 155898 - protein, 31 aa, Artificial Sequence
  Description of Artificial Sequence: Synthetic polypeptide
DENEIRTTNPVATEQWGSDVHELEMNAMEEA

SEQ ID NO: 155899 - protein, 30 aa, Artificial Sequence
  Description of Artificial Sequence: Synthetic polypeptide
DENEIRTTNPVATEQWGRVWEIEMNSAEDA

SEQ ID NO: 155900 - protein, 31 aa, Artificial Sequence
  Description of Artificial Sequence: Synthetic polypeptide
DENEIRTTNPVATEQWGRVSECIEMNAAEDA

SEQ ID NO: 155901 - protein, 31 aa, Artificial Sequence
  Description of Artificial Sequence: Synthetic polypeptide
DENEIRTTNPVATEQWGRCVSEIEMNAAEDA

SEQ ID NO: 155902 - protein, 33 aa, Artificial Sequence
  Description of Artificial Sequence: Synthetic polypeptide
DENEIRTTNPVATEQWGQVYSIEIEMNQAEGDA

SEQ ID NO: 155903 - protein, 31 aa, Artificial Sequence
  Description of Artificial Sequence: Synthetic polypeptide
DENEIRTTNPVATEQWGQVVSNIEMNAAEDA

SEQ ID NO: 155904 - protein, 31 aa, Artificial Sequence
  Description of Artificial Sequence: Synthetic polypeptide
DENEIRTTNPVATEQWGQVSEIEPENAAEDA

SEQ ID NO: 155905 - protein, 33 aa, Artificial Sequence
  Description of Artificial Sequence: Synthetic polypeptide
DEEPIRTTNPCATEWYSEEVVSTNELHIGGQTP

SEQ ID NO: 155906 - protein, 34 aa, Artificial Sequence
  Description of Artificial Sequence: Synthetic polypeptide
DEAEIRTTNPVATEQYGCVEWIDPLEIIAGNNFQ

SEQ ID NO: 155907 - protein, 37 aa, Artificial Sequence
  Description of Artificial Sequence: Synthetic polypeptide
DEGEIRTTNPVATEQYGSVASTVLDANEDEGMGNGQI

SEQ ID NO: 155908 - protein, 35 aa, Artificial Sequence
  Description of Artificial Sequence: Synthetic polypeptide
DEAEIRTTNPVATEQYGCVGENALDLTGFNENDQD

SEQ ID NO: 155909 - protein, 34 aa, Artificial Sequence
  Description of Artificial Sequence: Synthetic polypeptide
DEAEIRTTNPVATEQYGCVNTDWNDTHESGQEIG

SEQ ID NO: 155910 - protein, 34 aa, Artificial Sequence
  Description of Artificial Sequence: Synthetic polypeptide
DENEIATTNPVATEQYGSVCAAANNQPLDSEGEN

SEQ ID NO: 155911 - protein, 34 aa, Artificial Sequence
  Description of Artificial Sequence: Synthetic polypeptide
DENEIATTNPVATEQYGSVCAADNGDENGMDINN

SEQ ID NO: 155912 - protein, 35 aa, Artificial Sequence
  Description of Artificial Sequence: Synthetic polypeptide
DENEIATTNPVATEQYGSVCAADNGDEQGMDIANR

SEQ ID NO: 155913 - protein, 34 aa, Artificial Sequence
  Description of Artificial Sequence: Synthetic polypeptide
DENEIATTNPVATEQYGSVCAADNHGQDSDINDN

SEQ ID NO: 155914 - protein, 35 aa, Artificial Sequence
  Description of Artificial Sequence: Synthetic polypeptide
DEEEIRTTNPVAWEQYGSVGNCTRASSNNGGNNET

SEQ ID NO: 155915 - protein, 33 aa, Artificial Sequence
  Description of Artificial Sequence: Synthetic polypeptide
DENEIATTNPVATEQYGSVCAAMGHGQDSDIND

SEQ ID NO: 155916 - protein, 35 aa, Artificial Sequence
  Description of Artificial Sequence: Synthetic polypeptide
CEEEISTTNPVATEQYGCVCSNTEHQENFGSNNAS

SEQ ID NO: 155917 - protein, 35 aa, Artificial Sequence
  Description of Artificial Sequence: Synthetic polypeptide
DDEEIRTTNPVATDQYGSVSVTNNGGETNEGGGGT

SEQ ID NO: 155918 - protein, 34 aa, Artificial Sequence
  Description of Artificial Sequence: Synthetic polypeptide
DENEIATTNPVATEQYGSVCAAANNLPLDSEGTD

SEQ ID NO: 155919 - protein, 36 aa, Artificial Sequence
  Description of Artificial Sequence: Synthetic polypeptide
DEEEIRTTNPVAWEQYGQCVCSNTGEHQYFGSENQS

SEQ ID NO: 155920 - protein, 33 aa, Artificial Sequence
  Description of Artificial Sequence: Synthetic polypeptide
DEAEIRTTNPVATEQYGCVSSEGTARYSIEVFN

SEQ ID NO: 155921 - protein, 36 aa, Artificial Sequence
  Description of Artificial Sequence: Synthetic polypeptide
DEAEIRTTNPVATEQYGCVSETDHYELQGIGIEDTA

SEQ ID NO: 155922 - protein, 34 aa, Artificial Sequence
  Description of Artificial Sequence: Synthetic polypeptide
DEAEIRTTNPVATEQYGCVSEHYELQGISIEDTA

SEQ ID NO: 155923 - protein, 34 aa, Artificial Sequence
  Description of Artificial Sequence: Synthetic polypeptide
DEAEIRTTNPVATEQYGCVSDHYEEQGIGIEDTA

SEQ ID NO: 155924 - protein, 34 aa, Artificial Sequence
  Description of Artificial Sequence: Synthetic polypeptide
DENEIATTNPVATEQYGSVCAAMMHGQNEMGNDL

SEQ ID NO: 155925 - protein, 34 aa, Artificial Sequence
  Description of Artificial Sequence: Synthetic polypeptide
DEEEIRTTNPVAWEQYGQCVCSNSEHQHFGSEQS

SEQ ID NO: 155926 - protein, 34 aa, Artificial Sequence
  Description of Artificial Sequence: Synthetic polypeptide
DEAEIRTTNPVATEQYGCVSASEVEDEVQGGIVS

SEQ ID NO: 155927 - protein, 33 aa, Artificial Sequence
  Description of Artificial Sequence: Synthetic polypeptide
DEAEIRTTNPVATEQYGCVQTLYLTLDSTIEQP

SEQ ID NO: 155928 - protein, 36 aa, Artificial Sequence
  Description of Artificial Sequence: Synthetic polypeptide
DEAEIRTTNPVATEQYGCVSSTENDEQQGIGIEDQA

SEQ ID NO: 155929 - protein, 35 aa, Artificial Sequence
  Description of Artificial Sequence: Synthetic polypeptide
DDETIRTTNPVATEQYGSVSSTGGEIGGGDGGNET

SEQ ID NO: 155930 - protein, 34 aa, Artificial Sequence
  Description of Artificial Sequence: Synthetic polypeptide
DDEEISTTNPVATEQYGCVCSWGNHQNFGSETQA

SEQ ID NO: 155931 - protein, 36 aa, Artificial Sequence
  Description of Artificial Sequence: Synthetic polypeptide
DEEEIRTTNPVATEQYGSVYLSPYEVQQQPENSETE

SEQ ID NO: 155932 - protein, 32 aa, Artificial Sequence
  Description of Artificial Sequence: Synthetic polypeptide
DENEIRTTNPVATEQWGDVSWEIKEMNAAEDA

SEQ ID NO: 155933 - protein, 32 aa, Artificial Sequence
  Description of Artificial Sequence: Synthetic polypeptide
DENEIRTTNPVATEQWGDVSWEIIEMNAAEDA

SEQ ID NO: 155934 - protein, 31 aa, Artificial Sequence
  Description of Artificial Sequence: Synthetic polypeptide
DENEIRTTNPVATEQWGDVSWEIEMNAAEDA

SEQ ID NO: 155935 - protein, 31 aa, Artificial Sequence
  Description of Artificial Sequence: Synthetic polypeptide
DENEIRTTNPVATEQWGDVSWEIEDNAAEDA

SEQ ID NO: 155936 - protein, 31 aa, Artificial Sequence
  Description of Artificial Sequence: Synthetic polypeptide
DENEIRTTNPVATEQWGDVSWECEMNAAEDA

SEQ ID NO: 155937 - protein, 31 aa, Artificial Sequence
  Description of Artificial Sequence: Synthetic polypeptide
DENEIRTTNPVATEQWGDVSVEVEENIAEDA

SEQ ID NO: 155938 - protein, 32 aa, Artificial Sequence
  Description of Artificial Sequence: Synthetic polypeptide
DENEIRTTNPVATEQWGDVSVEIKEMNAAEDA

SEQ ID NO: 155939 - protein, 36 aa, Artificial Sequence
  Description of Artificial Sequence: Synthetic polypeptide
DEAEIRTTNCVAYCQYGSTVPSTNEGSQRTGGDNEL

SEQ ID NO: 155940 - protein, 31 aa, Artificial Sequence
  Description of Artificial Sequence: Synthetic polypeptide
DENEIRTTNPVATEQWGDVSVEIEMNAAEDA

SEQ ID NO: 155941 - protein, 31 aa, Artificial Sequence
  Description of Artificial Sequence: Synthetic polypeptide
DENEIRTTNPVATEQWGDVSVEIEMIAVEDA

SEQ ID NO: 155942 - protein, 32 aa, Artificial Sequence
  Description of Artificial Sequence: Synthetic polypeptide
DENEIRTTNPVATEQWGDVSVEIEEMNAAEDA

SEQ ID NO: 155943 - protein, 31 aa, Artificial Sequence
  Description of Artificial Sequence: Synthetic polypeptide
DEGEIRTTNPVATEQWGVDVSEIEMNAAEDA

SEQ ID NO: 155944 - protein, 31 aa, Artificial Sequence
  Description of Artificial Sequence: Synthetic polypeptide
DENEIRTTNPVATEQWGDVSVAIEMNAAEDA

SEQ ID NO: 155945 - protein, 34 aa, Artificial Sequence
  Description of Artificial Sequence: Synthetic polypeptide
DENEIRTTNPVATEQWGDVSTTAGPNMANGMDPV

SEQ ID NO: 155946 - protein, 34 aa, Artificial Sequence
  Description of Artificial Sequence: Synthetic polypeptide
DENEIRTTNPVATEQWGDVSTTAEPNMANGMDPV

SEQ ID NO: 155947 - protein, 33 aa, Artificial Sequence
  Description of Artificial Sequence: Synthetic polypeptide
DEGEIRTTNPVATEQWGKVSEHEHSMNAYEGDD

SEQ ID NO: 155948 - protein, 33 aa, Artificial Sequence
  Description of Artificial Sequence: Synthetic polypeptide
DEGEIRTTNPVATEQWGKVSEHEESMNFPEGDD

SEQ ID NO: 155949 - protein, 32 aa, Artificial Sequence
  Description of Artificial Sequence: Synthetic polypeptide
DENEIRTTNPVATEQWGDVSWIMEVMNAAEDA

SEQ ID NO: 155950 - protein, 31 aa, Artificial Sequence
  Description of Artificial Sequence: Synthetic polypeptide
DENEIRTTNPVATEQWGDVSYEIEMMAAEDA

SEQ ID NO: 155951 - protein, 31 aa, Artificial Sequence
  Description of Artificial Sequence: Synthetic polypeptide
DENEIRTTNPVATEQWGDVSYEIEMNAAEDA

SEQ ID NO: 155952 - protein, 32 aa, Artificial Sequence
  Description of Artificial Sequence: Synthetic polypeptide
DENEIRTTNPVATEQWGDVSYEIPEMNAAEDA

SEQ ID NO: 155953 - protein, 30 aa, Artificial Sequence
  Description of Artificial Sequence: Synthetic polypeptide
DENEIRTTNPVATEQWGDVVEIEMNAAEDA

SEQ ID NO: 155954 - protein, 30 aa, Artificial Sequence
  Description of Artificial Sequence: Synthetic polypeptide
DENEIRTTNPVATEQWGDVVEIEINAAEDA

SEQ ID NO: 155955 - protein, 30 aa, Artificial Sequence
  Description of Artificial Sequence: Synthetic polypeptide
DENEIRTTNPVATEQWGDVVEIEDNAAEDA

SEQ ID NO: 155956 - protein, 32 aa, Artificial Sequence
  Description of Artificial Sequence: Synthetic polypeptide
DENEIRTTNPVATEQWGDVVEDIGEGNATEDA

SEQ ID NO: 155957 - protein, 31 aa, Artificial Sequence
  Description of Artificial Sequence: Synthetic polypeptide
DENEIRTTNPVATEQWGDVVEDIEGNDAEDA

SEQ ID NO: 155958 - protein, 31 aa, Artificial Sequence
  Description of Artificial Sequence: Synthetic polypeptide
DENEIRTTNPVATEQWGDVVEAIEMNAAEDN

SEQ ID NO: 155959 - protein, 32 aa, Artificial Sequence
  Description of Artificial Sequence: Synthetic polypeptide
DENEIRTTNPVATEQWGDVVDQIEQRNAAEDA

SEQ ID NO: 155960 - protein, 31 aa, Artificial Sequence
  Description of Artificial Sequence: Synthetic polypeptide
DENEIRTTNPVATEQWGDVTSEIEMNFAEDA

SEQ ID NO: 155961 - protein, 33 aa, Artificial Sequence
  Description of Artificial Sequence: Synthetic polypeptide
DENEIRTTNPVATEQWGDVSTEAEPMMAAGMDV

SEQ ID NO: 155962 - protein, 36 aa, Artificial Sequence
  Description of Artificial Sequence: Synthetic polypeptide
DEGEIRTTNPVATEQYGCCSVTTVNQQDFTQFNEDY

SEQ ID NO: 155963 - protein, 34 aa, Artificial Sequence
  Description of Artificial Sequence: Synthetic polypeptide
DENEIATTNPVATEQYGSVSSTTPAGPNMHGMEL

SEQ ID NO: 155964 - protein, 36 aa, Artificial Sequence
  Description of Artificial Sequence: Synthetic polypeptide
DENEIATTNPVATEQYGSVSSTWAAGPNMRMGGNPV

SEQ ID NO: 155965 - protein, 36 aa, Artificial Sequence
  Description of Artificial Sequence: Synthetic polypeptide
DEEEIRTTNPVATEQYGSVYLFENQHQPQIQTIEDR

SEQ ID NO: 155966 - protein, 32 aa, Artificial Sequence
  Description of Artificial Sequence: Synthetic polypeptide
DENEIRTTNPVATEQWGDVTSEIEMNAAEDTA

SEQ ID NO: 155967 - protein, 31 aa, Artificial Sequence
  Description of Artificial Sequence: Synthetic polypeptide
DENEIRTTNPVATEQWGDVTSEIEMNAAEDA

SEQ ID NO: 155968 - protein, 30 aa, Artificial Sequence
  Description of Artificial Sequence: Synthetic polypeptide
DENEIRTTNPVATEQWGDVTEIEMNAAEDA

SEQ ID NO: 155969 - protein, 34 aa, Artificial Sequence
  Description of Artificial Sequence: Synthetic polypeptide
DEAEIRTTNPVATEQYGCVCSTEDHQEHFMSIQS

SEQ ID NO: 155970 - protein, 31 aa, Artificial Sequence
  Description of Artificial Sequence: Synthetic polypeptide
DENEIRTTNPVATEQWGDVSYIEIMNAAEDA

SEQ ID NO: 155971 - protein, 36 aa, Artificial Sequence
  Description of Artificial Sequence: Synthetic polypeptide
DEGEIRTTNPVATEQYGCCSVTLVNIQDFTGFNEDQ

SEQ ID NO: 155972 - protein, 31 aa, Artificial Sequence
  Description of Artificial Sequence: Synthetic polypeptide
DENEIRTTNPVATEQWGDVVLIEMNAGEDAE

SEQ ID NO: 155973 - protein, 33 aa, Artificial Sequence
  Description of Artificial Sequence: Synthetic polypeptide
DEAEIRTTNCVAYDQYGSVSATHHAFPRGIDVP

SEQ ID NO: 155974 - protein, 34 aa, Artificial Sequence
  Description of Artificial Sequence: Synthetic polypeptide
DENEIRTTNPVATEQWGDVSSTTPAGPMMRAENV

SEQ ID NO: 155975 - protein, 31 aa, Artificial Sequence
  Description of Artificial Sequence: Synthetic polypeptide
DENEIRTTNPVATEQWGDVSQEIEYNAAEDA

SEQ ID NO: 155976 - protein, 31 aa, Artificial Sequence
  Description of Artificial Sequence: Synthetic polypeptide
DENEIRTTNPVATEQWGDVSQEIEMNAAEDA

SEQ ID NO: 155977 - protein, 31 aa, Artificial Sequence
  Description of Artificial Sequence: Synthetic polypeptide
DENEIRTTNPVATEQWGDVSPEIEVNAAEDA

SEQ ID NO: 155978 - protein, 31 aa, Artificial Sequence
  Description of Artificial Sequence: Synthetic polypeptide
DENEIRTTNPVATEQWGDVSPEIEMNAAEDA

SEQ ID NO: 155979 - protein, 35 aa, Artificial Sequence
  Description of Artificial Sequence: Synthetic polypeptide
DEAEIRTTNPVATEQYGCVCSMWGELQENFGSEQS

SEQ ID NO: 155980 - protein, 32 aa, Artificial Sequence
  Description of Artificial Sequence: Synthetic polypeptide
DENEIRTTNPVATEQWGDVSNGMEMNAAEMDA

SEQ ID NO: 155981 - protein, 32 aa, Artificial Sequence
  Description of Artificial Sequence: Synthetic polypeptide
DENEIRTTNPVATEQWGDVSNEEDEANAKEDA

SEQ ID NO: 155982 - protein, 33 aa, Artificial Sequence
  Description of Artificial Sequence: Synthetic polypeptide
DENEIRTTNPVATEQWGDVSNEAIEMNAGEGDA

SEQ ID NO: 155983 - protein, 32 aa, Artificial Sequence
  Description of Artificial Sequence: Synthetic polypeptide
DENEIRTTNPVATEQWGDVSNEAIEMNAAEDA

SEQ ID NO: 155984 - protein, 32 aa, Artificial Sequence
  Description of Artificial Sequence: Synthetic polypeptide
DENEIRTTNPVATEQWGDVSNEAIEMGAAEDA

SEQ ID NO: 155985 - protein, 32 aa, Artificial Sequence
  Description of Artificial Sequence: Synthetic polypeptide
DENEIRTTNPVATEQWGDVSNDIGEMNNAEDA

SEQ ID NO: 155986 - protein, 32 aa, Artificial Sequence
  Description of Artificial Sequence: Synthetic polypeptide
DENEIRTTNPVATEQWGDVSNDIEMNGAEQDA

SEQ ID NO: 155987 - protein, 32 aa, Artificial Sequence
  Description of Artificial Sequence: Synthetic polypeptide
DENEIRTTNPVATEQWGDVSMIEEMNAAEDRA

SEQ ID NO: 155988 - protein, 32 aa, Artificial Sequence
  Description of Artificial Sequence: Synthetic polypeptide
DENEIRTTNPVATEQWGDVSMEIEYMNAAEDA

SEQ ID NO: 155989 - protein, 31 aa, Artificial Sequence
  Description of Artificial Sequence: Synthetic polypeptide
DENEIRTTNPVATEQWGDVSMEIEMNAAMDA

SEQ ID NO: 155990 - protein, 32 aa, Artificial Sequence
  Description of Artificial Sequence: Synthetic polypeptide
DENEIRTTNPVATEQWGDVSMEIEMNAAEDHA

SEQ ID NO: 155991 - protein, 31 aa, Artificial Sequence
  Description of Artificial Sequence: Synthetic polypeptide
DENEIRTTNPVATEQWGDVSMEIEMNAAEDA

SEQ ID NO: 155992 - protein, 31 aa, Artificial Sequence
  Description of Artificial Sequence: Synthetic polypeptide
DENEIRTTNPVATEQWGDVSQEKEMNAAEDA

SEQ ID NO: 155993 - protein, 39 aa, Artificial Sequence
  Description of Artificial Sequence: Synthetic polypeptide
DEEEIRTTNPVATEQYGVVSVTVNNGNLQQGTNEEEEDE

SEQ ID NO: 155994 - protein, 31 aa, Artificial Sequence
  Description of Artificial Sequence: Synthetic polypeptide
DEGEIRTTNPVATEQWGCVSEGVEMNAALDM

SEQ ID NO: 155995 - protein, 31 aa, Artificial Sequence
  Description of Artificial Sequence: Synthetic polypeptide
DENEIRTTNPVATEQWGDVSREFEMNAAELA

SEQ ID NO: 155996 - protein, 36 aa, Artificial Sequence
  Description of Artificial Sequence: Synthetic polypeptide
DEEEIRTTNPVATEQYGSVYIVTTGQPIEREQESLL

SEQ ID NO: 155997 - protein, 34 aa, Artificial Sequence
  Description of Artificial Sequence: Synthetic polypeptide
DENEIRTTNPVATEQWGDVSSTTPAEPMMRAENV

SEQ ID NO: 155998 - protein, 34 aa, Artificial Sequence
  Description of Artificial Sequence: Synthetic polypeptide
DENEIRTTNPVATEQWGDVSSTPIEPNNRNGMDV

SEQ ID NO: 155999 - protein, 38 aa, Artificial Sequence
  Description of Artificial Sequence: Synthetic polypeptide
DEEEIRTTNPVATEQYGVVSVTTVNNQEQGNIGTNTAE

SEQ ID NO: 156000 - protein, 31 aa, Artificial Sequence
  Description of Artificial Sequence: Synthetic polypeptide
DENEIRTTNPVATEQWGDVSSIEEMNAAEDA

SEQ ID NO: 156001 - protein, 32 aa, Artificial Sequence
  Description of Artificial Sequence: Synthetic polypeptide
DENEIRTTNPVATEQWGDVSSEKIEMNAAEDA

SEQ ID NO: 156002 - protein, 32 aa, Artificial Sequence
  Description of Artificial Sequence: Synthetic polypeptide
DENEIRTTNPVATEQWGDVSSEIGMNAAEMDA

SEQ ID NO: 156003 - protein, 33 aa, Artificial Sequence
  Description of Artificial Sequence: Synthetic polypeptide
DENEIRTTNPVATEQWGDVSSEIEPNNRNGMDV

SEQ ID NO: 156004 - protein, 35 aa, Artificial Sequence
  Description of Artificial Sequence: Synthetic polypeptide
DENEIRTTNPVATEQWGDVSSTTPAGPMMRAGMNV

SEQ ID NO: 156005 - protein, 32 aa, Artificial Sequence
  Description of Artificial Sequence: Synthetic polypeptide
DENEIRTTNPVATEQWGDVSSEIEPMNAAGDA

SEQ ID NO: 156006 - protein, 31 aa, Artificial Sequence
  Description of Artificial Sequence: Synthetic polypeptide
DENEIRTTNPVATEQWGDVSSEIEMNAWEDA

SEQ ID NO: 156007 - protein, 39 aa, Artificial Sequence
  Description of Artificial Sequence: Synthetic polypeptide
DEEEIRTTNPVATEQYGVVSVTTVNQNLQQGNNDEDEDT

SEQ ID NO: 156008 - protein, 32 aa, Artificial Sequence
  Description of Artificial Sequence: Synthetic polypeptide
DENEIRTTNPVATEQWGDVSSEIEMNAAENPA

SEQ ID NO: 156009 - protein, 31 aa, Artificial Sequence
  Description of Artificial Sequence: Synthetic polypeptide
DENEIRTTNPVATEQWGDVSSEIEMNAAEDA

SEQ ID NO: 156010 - protein, 35 aa, Artificial Sequence
  Description of Artificial Sequence: Synthetic polypeptide
DEAEIRTTNPVATEQYGCVCSNTEEHNQNFGSEQS

SEQ ID NO: 156011 - protein, 33 aa, Artificial Sequence
  Description of Artificial Sequence: Synthetic polypeptide
DENEIRTTNPVATEQWGDVSSEAGPMNRAEMDA

SEQ ID NO: 156012 - protein, 31 aa, Artificial Sequence
  Description of Artificial Sequence: Synthetic polypeptide
DENEIRTTNPVATEQWGDVSRVIEMNAAEDA

SEQ ID NO: 156013 - protein, 31 aa, Artificial Sequence
  Description of Artificial Sequence: Synthetic polypeptide
DENEIRTTNPVATEQWGDVSREIEMNAAEDA

SEQ ID NO: 156014 - protein, 32 aa, Artificial Sequence
  Description of Artificial Sequence: Synthetic polypeptide
DENEIRTTNPVATEQWGDVSSEIEPMNAAEDA

SEQ ID NO: 156015 - protein, 38 aa, Artificial Sequence
  Description of Artificial Sequence: Synthetic polypeptide
DEEEIRTTNPVATEQYGVVSTVVVVNQQQGTNNEDEDE

SEQ ID NO: 156016 - protein, 37 aa, Artificial Sequence
  Description of Artificial Sequence: Synthetic polypeptide
DEEEIRTTNPVAVEQYGSVSTVNNNNDEQGNNNVTDS

SEQ ID NO: 156017 - protein, 31 aa, Artificial Sequence
  Description of Artificial Sequence: Synthetic polypeptide
DENEIRTTNPVATEQWGDVVSEIEGNAAEDA

SEQ ID NO: 156018 - protein, 34 aa, Artificial Sequence
  Description of Artificial Sequence: Synthetic polypeptide
DEEQIRTTNPVAYEVYGSTVNTTGNGSQQPSNNE

SEQ ID NO: 156019 - protein, 36 aa, Artificial Sequence
  Description of Artificial Sequence: Synthetic polypeptide
DEEEIRTTNPVATEQYGVVSVNVATEQYGSTEQQQE

SEQ ID NO: 156020 - protein, 31 aa, Artificial Sequence
  Description of Artificial Sequence: Synthetic polypeptide
DENEIRTTNPVATEQWGHVSEIEGMNAAEDA

SEQ ID NO: 156021 - protein, 34 aa, Artificial Sequence
  Description of Artificial Sequence: Synthetic polypeptide
DDEEISTTNPVATEQYGCVCSTGEHTNFLSQNQS

SEQ ID NO: 156022 - protein, 37 aa, Artificial Sequence
  Description of Artificial Sequence: Synthetic polypeptide
DENEIRTTNPVATEQWGHSNVSYTWNMLQHGPEGKFE

SEQ ID NO: 156023 - protein, 30 aa, Artificial Sequence
  Description of Artificial Sequence: Synthetic polypeptide
DENEIRTTNPVATEQWGHQSEIEMNAAEDA

SEQ ID NO: 156024 - protein, 31 aa, Artificial Sequence
  Description of Artificial Sequence: Synthetic polypeptide
DENEIRTTNPVATEQWGGVSEIEGMNAAKDA

SEQ ID NO: 156025 - protein, 31 aa, Artificial Sequence
  Description of Artificial Sequence: Synthetic polypeptide
DENEIRTTNPVATEQWGGVSEAIEMNAAEDA

SEQ ID NO: 156026 - protein, 37 aa, Artificial Sequence
  Description of Artificial Sequence: Synthetic polypeptide
DEEEIRTTNPVAVEQYGSVSTVNNNNNNNQNDEQGTE

SEQ ID NO: 156027 - protein, 31 aa, Artificial Sequence
  Description of Artificial Sequence: Synthetic polypeptide
DENEIRTTNPVATEQWGEWVSNMEMNAAEVA

SEQ ID NO: 156028 - protein, 31 aa, Artificial Sequence
  Description of Artificial Sequence: Synthetic polypeptide
DENEIRTTNPVATEQWGEVVSEYEMNAAEDA

SEQ ID NO: 156029 - protein, 35 aa, Artificial Sequence
  Description of Artificial Sequence: Synthetic polypeptide
DEAEIRTTNPVATEQYGCVCSTGEDQENFNSDNQA

SEQ ID NO: 156030 - protein, 35 aa, Artificial Sequence
  Description of Artificial Sequence: Synthetic polypeptide
DEAEIRTTNPVATEQYGCVCSTGEDHEGFGSENQS

SEQ ID NO: 156031 - protein, 34 aa, Artificial Sequence
  Description of Artificial Sequence: Synthetic polypeptide
DEAEIRTTNPVATEQYGCVCSTEHNQNFPSDTQS

SEQ ID NO: 156032 - protein, 33 aa, Artificial Sequence
  Description of Artificial Sequence: Synthetic polypeptide
DENEIRTTNPVATEQWGEVSCEGESMNAAEGDA

SEQ ID NO: 156033 - protein, 30 aa, Artificial Sequence
  Description of Artificial Sequence: Synthetic polypeptide
DENEIRTTNPVATEQWGEVPEIEMNAAEEA

SEQ ID NO: 156034 - protein, 36 aa, Artificial Sequence
  Description of Artificial Sequence: Synthetic polypeptide
DEAEIRTTNPVATEQYGCVCSTEEHNQENFGSENQA

SEQ ID NO: 156035 - protein, 37 aa, Artificial Sequence
  Description of Artificial Sequence: Synthetic polypeptide
DEEEIRTTNPVAVEQYGSVSTVNNNNNNQTNDEIGTE

SEQ ID NO: 156036 - protein, 37 aa, Artificial Sequence
  Description of Artificial Sequence: Synthetic polypeptide
DEEEIRTTNPVAVEQYGSVSTVNNNNNQGNNEQGETE

SEQ ID NO: 156037 - protein, 34 aa, Artificial Sequence
  Description of Artificial Sequence: Synthetic polypeptide
DDEEISTTNPVATEQYGCVCSTWEEHQHFGSEQA

SEQ ID NO: 156038 - protein, 30 aa, Artificial Sequence
  Description of Artificial Sequence: Synthetic polypeptide
DENEIRTTNPVATEQWGIISEIEMNAAEDA

SEQ ID NO: 156039 - protein, 34 aa, Artificial Sequence
  Description of Artificial Sequence: Synthetic polypeptide
DEEEIRTTNPVATEQYGSVYLPIFIPTVVEQELV

SEQ ID NO: 156040 - protein, 35 aa, Artificial Sequence
  Description of Artificial Sequence: Synthetic polypeptide
DEEEIRTTNPVATEQYGSVYLMQGEEQMIMNSEEL

SEQ ID NO: 156041 - protein, 35 aa, Artificial Sequence
  Description of Artificial Sequence: Synthetic polypeptide
DEEEIRTTNPVATEQYGSVYLMNGEENMIMNAEEL

SEQ ID NO: 156042 - protein, 35 aa, Artificial Sequence
  Description of Artificial Sequence: Synthetic polypeptide
DEEEIRTTNPVATEQYGSVYLMIGEEQMIQNAEEL

SEQ ID NO: 156043 - protein, 33 aa, Artificial Sequence
  Description of Artificial Sequence: Synthetic polypeptide
DENEIRTTNPVATEQWGKVPSCGESMNAAEGDN

SEQ ID NO: 156044 - protein, 35 aa, Artificial Sequence
  Description of Artificial Sequence: Synthetic polypeptide
DEAEIRTTNCVAYCQYGSTVPSTGNEVSQRTGGDE

SEQ ID NO: 156045 - protein, 35 aa, Artificial Sequence
  Description of Artificial Sequence: Synthetic polypeptide
DEEEIRTTNPVATEQYGSVYLIWNGNEQPQMQAIV

SEQ ID NO: 156046 - protein, 35 aa, Artificial Sequence
  Description of Artificial Sequence: Synthetic polypeptide
DEEEIRTTNPVATEQYGSVYLINNMNIQEQMQEED

SEQ ID NO: 156047 - protein, 31 aa, Artificial Sequence
  Description of Artificial Sequence: Synthetic polypeptide
DENEIRTTNPVATEQWGEFVSEIEMNAAEDA

SEQ ID NO: 156048 - protein, 33 aa, Artificial Sequence
  Description of Artificial Sequence: Synthetic polypeptide
DDEEISTTNPVATEQYGCVCSWEHQNFNSDTQS

SEQ ID NO: 156049 - protein, 33 aa, Artificial Sequence
  Description of Artificial Sequence: Synthetic polypeptide
DDEEISTTNPVATEQYGCVCSWEHNTNFNSDQA

SEQ ID NO: 156050 - protein, 33 aa, Artificial Sequence
  Description of Artificial Sequence: Synthetic polypeptide
DENEIRTTNPVATEQWGKVPSAGASDNAAEGDA

SEQ ID NO: 156051 - protein, 33 aa, Artificial Sequence
  Description of Artificial Sequence: Synthetic polypeptide
DENEIRTTNPVATEQWGKTVSEHESMNAAEGDA

SEQ ID NO: 156052 - protein, 34 aa, Artificial Sequence
  Description of Artificial Sequence: Synthetic polypeptide
DENEIRTTNPVATEQWGKTVPSEGTSMNAAEGDA

SEQ ID NO: 156053 - protein, 36 aa, Artificial Sequence
  Description of Artificial Sequence: Synthetic polypeptide
DEEQIRTTNPVATMQYGSVSSTTPAGPNMRNGMNPV

SEQ ID NO: 156054 - protein, 33 aa, Artificial Sequence
  Description of Artificial Sequence: Synthetic polypeptide
DENEIRTTNPVATEQWGKIPSEGFSMNAAEGDA

SEQ ID NO: 156055 - protein, 35 aa, Artificial Sequence
  Description of Artificial Sequence: Synthetic polypeptide
DEAEIRTTNPVATEQYGCVCSTGEHQENFNSNTQA

SEQ ID NO: 156056 - protein, 31 aa, Artificial Sequence
  Description of Artificial Sequence: Synthetic polypeptide
DENEIRTTNPVATEQWGIMVSEIEMNAAEDA

SEQ ID NO: 156057 - protein, 35 aa, Artificial Sequence
  Description of Artificial Sequence: Synthetic polypeptide
DEGEIRTTNPVATEQYGCVSVTTASVTQENNNDGA

SEQ ID NO: 156058 - protein, 31 aa, Artificial Sequence
  Description of Artificial Sequence: Synthetic polypeptide
DENEIRTTNPVATEQWGDVVSEIEANAAEDA

SEQ ID NO: 156059 - protein, 33 aa, Artificial Sequence
  Description of Artificial Sequence: Synthetic polypeptide
CEEEISTTNPVATEQYGCVCSNTEPQHFISDQS

SEQ ID NO: 156060 - protein, 30 aa, Artificial Sequence
  Description of Artificial Sequence: Synthetic polypeptide
DENEIRTTNPVATEQWGEASEICMNHAEDA

SEQ ID NO: 156061 - protein, 32 aa, Artificial Sequence
  Description of Artificial Sequence: Synthetic polypeptide
DENEIRTTNPVATEQWGDVWSNEIEMNAAEDA

SEQ ID NO: 156062 - protein, 31 aa, Artificial Sequence
  Description of Artificial Sequence: Synthetic polypeptide
DENEIRTTNPVATEQWGDVWSEIEMNAAEDD

SEQ ID NO: 156063 - protein, 31 aa, Artificial Sequence
  Description of Artificial Sequence: Synthetic polypeptide
DENEIRTTNPVATEQWGDVWSEIEMNAAEDA

SEQ ID NO: 156064 - protein, 31 aa, Artificial Sequence
  Description of Artificial Sequence: Synthetic polypeptide
DENEIRTTNPVATEQWGDVWSEDEANAAEDA

SEQ ID NO: 156065 - protein, 36 aa, Artificial Sequence
  Description of Artificial Sequence: Synthetic polypeptide
DEGEIRTTNPVATEQYGCSTSFWINPLERDEHNQNE

SEQ ID NO: 156066 - protein, 31 aa, Artificial Sequence
  Description of Artificial Sequence: Synthetic polypeptide
DENEIRTTNPVATEQWGDVWEVEMNIPEDQI

SEQ ID NO: 156067 - protein, 30 aa, Artificial Sequence
  Description of Artificial Sequence: Synthetic polypeptide
DENEIRTTNPVATEQWGDVWEIEMNYAMDA

SEQ ID NO: 156068 - protein, 30 aa, Artificial Sequence
  Description of Artificial Sequence: Synthetic polypeptide
DENEIRTTNPVATEQWGDVWEIEMNAAIDA

SEQ ID NO: 156069 - protein, 30 aa, Artificial Sequence
  Description of Artificial Sequence: Synthetic polypeptide
DENEIRTTNPVATEQWGDVWEIEMNAAEDA

SEQ ID NO: 156070 - protein, 31 aa, Artificial Sequence
  Description of Artificial Sequence: Synthetic polypeptide
DENEIRTTNPVATEQWGDVVVNIEMNAAEDA

SEQ ID NO: 156071 - protein, 36 aa, Artificial Sequence
  Description of Artificial Sequence: Synthetic polypeptide
DEGEIRTTNPVATEQYGCSSFTANPLERRDEHNQNE

SEQ ID NO: 156072 - protein, 31 aa, Artificial Sequence
  Description of Artificial Sequence: Synthetic polypeptide
DENEIRTTNPVATEQWGDVVSNIEMNDAEDA

SEQ ID NO: 156073 - protein, 33 aa, Artificial Sequence
  Description of Artificial Sequence: Synthetic polypeptide
DENEIRTTNPVATEQWGDVVSETIEMNAAEDCA

SEQ ID NO: 156074 - protein, 32 aa, Artificial Sequence
  Description of Artificial Sequence: Synthetic polypeptide
DENEIRTTNPVATEQWGDVVSEIQEMNAAEDA

SEQ ID NO: 156075 - protein, 31 aa, Artificial Sequence
  Description of Artificial Sequence: Synthetic polypeptide
DENEIRTTNPVATEQWGDVVSEIEMNDAEDA

SEQ ID NO: 156076 - protein, 31 aa, Artificial Sequence
  Description of Artificial Sequence: Synthetic polypeptide
DENEIRTTNPVATEQWGDVVSEIEMNAFEDA

SEQ ID NO: 156077 - protein, 31 aa, Artificial Sequence
  Description of Artificial Sequence: Synthetic polypeptide
DENEIRTTNPVATEQWGDVVSEIEMNAAEDA

SEQ ID NO: 156078 - protein, 30 aa, Artificial Sequence
  Description of Artificial Sequence: Synthetic polypeptide
DENEIRTTNPVATEQWGDVYEIEMNAAEDA

SEQ ID NO: 156079 - protein, 30 aa, Artificial Sequence
  Description of Artificial Sequence: Synthetic polypeptide
DENEIRTTNPVATEQWGDVYEIEMNATEDA

SEQ ID NO: 156080 - protein, 30 aa, Artificial Sequence
  Description of Artificial Sequence: Synthetic polypeptide
DENEIRTTNPVATEQWGDVYEIEMNPAEDA

SEQ ID NO: 156081 - protein, 31 aa, Artificial Sequence
  Description of Artificial Sequence: Synthetic polypeptide
DENEIRTTNPVATEQWGDVYEVEMNIAEDEC

SEQ ID NO: 156082 - protein, 33 aa, Artificial Sequence
  Description of Artificial Sequence: Synthetic polypeptide
DENEIRTTNPVATEQWGDYVSVIEQMINVEGTE

SEQ ID NO: 156083 - protein, 32 aa, Artificial Sequence
  Description of Artificial Sequence: Synthetic polypeptide
DENEIRTTNPVATEQWGDYVSEIEMNAAEDAS

SEQ ID NO: 156084 - protein, 31 aa, Artificial Sequence
  Description of Artificial Sequence: Synthetic polypeptide
DENEIRTTNPVATEQWGDYVSEIEMNAAEDA

SEQ ID NO: 156085 - protein, 32 aa, Artificial Sequence
  Description of Artificial Sequence: Synthetic polypeptide
DENEIRTTNPVATEQWGDYVSEIEHNAAENDA

SEQ ID NO: 156086 - protein, 31 aa, Artificial Sequence
  Description of Artificial Sequence: Synthetic polypeptide
DENEIRTTNPVATEQWGDYVSEDEMNAAEDA

SEQ ID NO: 156087 - protein, 30 aa, Artificial Sequence
  Description of Artificial Sequence: Synthetic polypeptide
DENEIRTTNPVATEQWGDYSEIEMNAAEDA

SEQ ID NO: 156088 - protein, 31 aa, Artificial Sequence
  Description of Artificial Sequence: Synthetic polypeptide
DENEIRTTNPVATEQWGDYGSEIEMNAAEDA

SEQ ID NO: 156089 - protein, 34 aa, Artificial Sequence
  Description of Artificial Sequence: Synthetic polypeptide
DEESEIATTNPVAYEQWGSVSGGNGNHGEGNTTQ

SEQ ID NO: 156090 - protein, 30 aa, Artificial Sequence
  Description of Artificial Sequence: Synthetic polypeptide
DENEIRTTNPVATEQWGEASEIEMNAAEDA

SEQ ID NO: 156091 - protein, 34 aa, Artificial Sequence
  Description of Artificial Sequence: Synthetic polypeptide
DEGEIRTTNPVATEQYGCVATVVNEIGIIDDFRS

SEQ ID NO: 156092 - protein, 31 aa, Artificial Sequence
  Description of Artificial Sequence: Synthetic polypeptide
DENEIRTTNPVATEQWGDVYSEQEENAAEDA

SEQ ID NO: 156093 - protein, 31 aa, Artificial Sequence
  Description of Artificial Sequence: Synthetic polypeptide
DENEIRTTNPVATEQWGDVYSEIEMNIAEDA

SEQ ID NO: 156094 - protein, 37 aa, Artificial Sequence
  Description of Artificial Sequence: Synthetic polypeptide
DEEEIRTTNPVAVEQYGSVSTVNNNNNGTNDEQGTTE

SEQ ID NO: 156095 - protein, 31 aa, Artificial Sequence
  Description of Artificial Sequence: Synthetic polypeptide
DENEIRTTNPVATEQWGDVYSEIEMNAAEFA

SEQ ID NO: 156096 - protein, 31 aa, Artificial Sequence
  Description of Artificial Sequence: Synthetic polypeptide
DENEIRTTNPVATEQWGDVYSEIEMNAAEDA

SEQ ID NO: 156097 - protein, 32 aa, Artificial Sequence
  Description of Artificial Sequence: Synthetic polypeptide
DENEIRTTNPVATEQWGDVYSEIEMNAAECDA

SEQ ID NO: 156098 - protein, 31 aa, Artificial Sequence
  Description of Artificial Sequence: Synthetic polypeptide
DENEIRTTNPVATEQWGDVYSEIEGNDAEDA

SEQ ID NO: 156099 - protein, 30 aa, Artificial Sequence
  Description of Artificial Sequence: Synthetic polypeptide
DENEIRTTNPVATEQWGDVYQIEMNAAEDA

SEQ ID NO: 156100 - protein, 34 aa, Artificial Sequence
  Description of Artificial Sequence: Synthetic polypeptide
DEGEIRTTNPVATEQYGCVATDVNEIGIIEDFRH

SEQ ID NO: 156101 - protein, 33 aa, Artificial Sequence
  Description of Artificial Sequence: Synthetic polypeptide
DEEEIRTTNPVAYEAYGITTPATAEHSNRGGNM

SEQ ID NO: 156102 - protein, 31 aa, Artificial Sequence
  Description of Artificial Sequence: Synthetic polypeptide
DENEIRTTNPVATEQWGTVSEISEMNAAEDA

SEQ ID NO: 156103 - protein, 36 aa, Artificial Sequence
  Description of Artificial Sequence: Synthetic polypeptide
DENEIATTNPVATEQYGSVANTNTLPQLHQDGTEAW

SEQ ID NO: 156104 - protein, 34 aa, Artificial Sequence
  Description of Artificial Sequence: Synthetic polypeptide
DEEEISTVNPVATEQYGCVCSTEHNQEYFNSQQF

SEQ ID NO: 156105 - protein, 38 aa, Artificial Sequence
  Description of Artificial Sequence: Synthetic polypeptide
DEEEIRTTNPVATEQYGVVSTVVVTNNNQQAGNTEEGS

SEQ ID NO: 156106 - protein, 37 aa, Artificial Sequence
  Description of Artificial Sequence: Synthetic polypeptide
DEEEIRTTNPVATEQYGSVYTDTMNVNGQGENEDGQT

SEQ ID NO: 156107 - protein, 34 aa, Artificial Sequence
  Description of Artificial Sequence: Synthetic polypeptide
DEEEIRTTNPVAYEPYGQSVSINEGSTEPPVISR

SEQ ID NO: 156108 - protein, 35 aa, Artificial Sequence
  Description of Artificial Sequence: Synthetic polypeptide
DEEEIRTTNPVAYEPYGQSVSINEGSTEDPGISRC

SEQ ID NO: 156109 - protein, 37 aa, Artificial Sequence
  Description of Artificial Sequence: Synthetic polypeptide
DEEEITTTNPVATEQYGSAVSSTTPAGPNMRNGMNPV

SEQ ID NO: 156110 - protein, 37 aa, Artificial Sequence
  Description of Artificial Sequence: Synthetic polypeptide
DEEEITTTNPVATEQYGSVSQPTPAGPNEQNGMFDVV

SEQ ID NO: 156111 - protein, 31 aa, Artificial Sequence
  Description of Artificial Sequence: Synthetic polypeptide
DENEIATTNPVATEQWGSVSAEDEMDHAEEA

SEQ ID NO: 156112 - protein, 35 aa, Artificial Sequence
  Description of Artificial Sequence: Synthetic polypeptide
DEEEIRTTNPVAYEPYGQSVSIHEGSTLPPGTPRM

SEQ ID NO: 156113 - protein, 36 aa, Artificial Sequence
  Description of Artificial Sequence: Synthetic polypeptide
DEEEIRTTNPVAYEPYGQSVSIGNEGSQSPPGISQR

SEQ ID NO: 156114 - protein, 33 aa, Artificial Sequence
  Description of Artificial Sequence: Synthetic polypeptide
DENEIATTNPVATEQWGSVSEGPGIANAGHNHE

SEQ ID NO: 156115 - protein, 37 aa, Artificial Sequence
  Description of Artificial Sequence: Synthetic polypeptide
DEEEIRTTNPVATEQYGVVSTVVVTNNNQQGEEQGTE

SEQ ID NO: 156116 - protein, 37 aa, Artificial Sequence
  Description of Artificial Sequence: Synthetic polypeptide
DEEEIRTTNPVATEQYGVVSTVVVTNNNQQQATNNNE

SEQ ID NO: 156117 - protein, 36 aa, Artificial Sequence
  Description of Artificial Sequence: Synthetic polypeptide
DENEIRTTNPVATEQYGHACASVSHDLQTGESEQQY

SEQ ID NO: 156118 - protein, 33 aa, Artificial Sequence
  Description of Artificial Sequence: Synthetic polypeptide
DENEIATTNPVATEQWGSVSQGNIEPDDDMGTF

SEQ ID NO: 156119 - protein, 31 aa, Artificial Sequence
  Description of Artificial Sequence: Synthetic polypeptide
DENEIATTNPVATEQWGTVPEGEMNAAEDNA

SEQ ID NO: 156120 - protein, 30 aa, Artificial Sequence
  Description of Artificial Sequence: Synthetic polypeptide
DENEIATTNPVATEQWGTVSEAEMNKAEDA

SEQ ID NO: 156121 - protein, 38 aa, Artificial Sequence
  Description of Artificial Sequence: Synthetic polypeptide
DEEEIRTTNPVATEQYGSVTEPTTNVDEQQSMGQNQPT

SEQ ID NO: 156122 - protein, 34 aa, Artificial Sequence
  Description of Artificial Sequence: Synthetic polypeptide
DEEEISTTNPVGTEQYGCVCSTEDHNGNFGSDQA

SEQ ID NO: 156123 - protein, 32 aa, Artificial Sequence
  Description of Artificial Sequence: Synthetic polypeptide
DENEIATTNPVATEQWGSVAANPANDNPGGQP

SEQ ID NO: 156124 - protein, 36 aa, Artificial Sequence
  Description of Artificial Sequence: Synthetic polypeptide
DENEIATTNPVATEQWGSVAAGGNGLDQPRQMENRV

SEQ ID NO: 156125 - protein, 36 aa, Artificial Sequence
  Description of Artificial Sequence: Synthetic polypeptide
DENEIRTTNPVATEQYGSCASVSHDLHQTGEVEQQY

SEQ ID NO: 156126 - protein, 30 aa, Artificial Sequence
  Description of Artificial Sequence: Synthetic polypeptide
DENEIATTNPVATEQWGDVSEIEMNAEEDA

SEQ ID NO: 156127 - protein, 37 aa, Artificial Sequence
  Description of Artificial Sequence: Synthetic polypeptide
DEEEIRTTNPVATEQYGSVYTGTMNAGGQDINEDGQI

SEQ ID NO: 156128 - protein, 37 aa, Artificial Sequence
  Description of Artificial Sequence: Synthetic polypeptide
DEEEIRTTNPVATEQYGSVYTGTMNAGGQDENGDGQD

SEQ ID NO: 156129 - protein, 30 aa, Artificial Sequence
  Description of Artificial Sequence: Synthetic polypeptide
DENEIATTNPVATEQWGDVSEIKMNAAEDA

SEQ ID NO: 156130 - protein, 37 aa, Artificial Sequence
  Description of Artificial Sequence: Synthetic polypeptide
DEEEIRTTNPVATEQYGSVYTGNMNVQGQDENEDGQT

SEQ ID NO: 156131 - protein, 30 aa, Artificial Sequence
  Description of Artificial Sequence: Synthetic polypeptide
DENEIATTNPVATEQWGDVSHIEMNAAEDA

SEQ ID NO: 156132 - protein, 36 aa, Artificial Sequence
  Description of Artificial Sequence: Synthetic polypeptide
DEEEIRTTNPVATEQYGSVYTGDANEKEVIIQEEDQ

SEQ ID NO: 156133 - protein, 31 aa, Artificial Sequence
  Description of Artificial Sequence: Synthetic polypeptide
DENEIATTNPVATEQWGTVSKEIEMNMGEDA

SEQ ID NO: 156134 - protein, 35 aa, Artificial Sequence
  Description of Artificial Sequence: Synthetic polypeptide
DEEEIRTTNPVATEQYGSVTEMNQLAMNAEEEIQD

SEQ ID NO: 156135 - protein, 30 aa, Artificial Sequence
  Description of Artificial Sequence: Synthetic polypeptide
DENEIATTNPVATEQWGDVSVWEMNAAEDA

SEQ ID NO: 156136 - protein, 30 aa, Artificial Sequence
  Description of Artificial Sequence: Synthetic polypeptide
DENEIATTNPVATEQWGDVSWIEMNHAEDA

SEQ ID NO: 156137 - protein, 35 aa, Artificial Sequence
  Description of Artificial Sequence: Synthetic polypeptide
DENEIRTTNPVATEQYGQCVCSTMEHQENFGSDQS

SEQ ID NO: 156138 - protein, 30 aa, Artificial Sequence
  Description of Artificial Sequence: Synthetic polypeptide
DDSEIASTNPVATEGYGEAANTIQSRVGGR

SEQ ID NO: 156139 - protein, 35 aa, Artificial Sequence
  Description of Artificial Sequence: Synthetic polypeptide
DENEIRTTNPVATEQYGQCVCSNTEHQEYFGSDQS

SEQ ID NO: 156140 - protein, 39 aa, Artificial Sequence
  Description of Artificial Sequence: Synthetic polypeptide
DEEEIRTTNPVATEQYGVVSTVVVTNLQQLGNQDEEQEE

SEQ ID NO: 156141 - protein, 30 aa, Artificial Sequence
  Description of Artificial Sequence: Synthetic polypeptide
DENEIATTNPVATEQWGNVSEGEMNAIEDA

SEQ ID NO: 156142 - protein, 38 aa, Artificial Sequence
  Description of Artificial Sequence: Synthetic polypeptide
DEEEIRTTNPVATEQYGVVSTVVVTNNNNQQGNTEQGS

SEQ ID NO: 156143 - protein, 36 aa, Artificial Sequence
  Description of Artificial Sequence: Synthetic polypeptide
DENEIRTTNPVATEQYGSAASTFLGTEQSEQPNMLL

SEQ ID NO: 156144 - protein, 30 aa, Artificial Sequence
  Description of Artificial Sequence: Synthetic polypeptide
DENEIATTNPVATEQWGDVSEIEMNAAETA

SEQ ID NO: 156145 - protein, 36 aa, Artificial Sequence
  Description of Artificial Sequence: Synthetic polypeptide
DEEEIRTTNPVATEQYGSVTHTGEDHNDDENGEEQV

SEQ ID NO: 156146 - protein, 33 aa, Artificial Sequence
  Description of Artificial Sequence: Synthetic polypeptide
DEEEIVCTNPVATEQYGTVCSAEDGPVMFEGND

SEQ ID NO: 156147 - protein, 33 aa, Artificial Sequence
  Description of Artificial Sequence: Synthetic polypeptide
DENEIATTNPVATEQYGCVAAANNEQELGLPDS

SEQ ID NO: 156148 - protein, 37 aa, Artificial Sequence
  Description of Artificial Sequence: Synthetic polypeptide
DEAEIRTTNPVATEQYGESVVWTIMLEELRNGNEEVF

SEQ ID NO: 156149 - protein, 32 aa, Artificial Sequence
  Description of Artificial Sequence: Synthetic polypeptide
DDQEIRTTNPVATEQYGCVSMVQLENIEEPEI

SEQ ID NO: 156150 - protein, 32 aa, Artificial Sequence
  Description of Artificial Sequence: Synthetic polypeptide
DENEIATTNPVATEQYGCVAANGDATMNPGDH

SEQ ID NO: 156151 - protein, 35 aa, Artificial Sequence
  Description of Artificial Sequence: Synthetic polypeptide
DENEIATTNPVATEQYGCVAANGGLEATRDGDPRQ

SEQ ID NO: 156152 - protein, 33 aa, Artificial Sequence
  Description of Artificial Sequence: Synthetic polypeptide
DENEIATTNPVATEQYGCVAANNGDTGDGENGN

SEQ ID NO: 156153 - protein, 33 aa, Artificial Sequence
  Description of Artificial Sequence: Synthetic polypeptide
DENEIATTNPVATEQYGCVAANNGDTMDNNNPR

SEQ ID NO: 156154 - protein, 35 aa, Artificial Sequence
  Description of Artificial Sequence: Synthetic polypeptide
DEGEIRTTNPVATEQYGSVMWTTWNEEIPNNNNEN

SEQ ID NO: 156155 - protein, 36 aa, Artificial Sequence
  Description of Artificial Sequence: Synthetic polypeptide
DENEIRTTNPVATEQYGDVNTDLDEGQQEEQGNQDG

SEQ ID NO: 156156 - protein, 34 aa, Artificial Sequence
  Description of Artificial Sequence: Synthetic polypeptide
DENEIATTNPVATEQYGCVAANNGETGADNENGR

SEQ ID NO: 156157 - protein, 35 aa, Artificial Sequence
  Description of Artificial Sequence: Synthetic polypeptide
DEEEIRTTNPVAYEPFGISTVCHCTNISHNSGNRA

SEQ ID NO: 156158 - protein, 36 aa, Artificial Sequence
  Description of Artificial Sequence: Synthetic polypeptide
DEEEIVTTNPVATEQYGSVSSTTPAGPNMRNGMTPV

SEQ ID NO: 156159 - protein, 35 aa, Artificial Sequence
  Description of Artificial Sequence: Synthetic polypeptide
DEEEIRTTNPVATEQYGSVTPTGGTMMQAAAFDEN

SEQ ID NO: 156160 - protein, 32 aa, Artificial Sequence
  Description of Artificial Sequence: Synthetic polypeptide
DENEIRTTNPVATEQYGDVCSEDIPMNAAEDA

SEQ ID NO: 156161 - protein, 36 aa, Artificial Sequence
  Description of Artificial Sequence: Synthetic polypeptide
DEGEIRTTNPVATEQYGSVMPTTNMHHVIEGSNEDV

SEQ ID NO: 156162 - protein, 33 aa, Artificial Sequence
  Description of Artificial Sequence: Synthetic polypeptide
DENEIRTTNPVATEQYGDVCSAEDIPENFEEND

SEQ ID NO: 156163 - protein, 33 aa, Artificial Sequence
  Description of Artificial Sequence: Synthetic polypeptide
DENEIRTTNPVATEQYGDVCSAEDIPENFAEND

SEQ ID NO: 156164 - protein, 33 aa, Artificial Sequence
  Description of Artificial Sequence: Synthetic polypeptide
DEGEIRTTNPVATEQYGSVNNTDEVDSYTEVHS

SEQ ID NO: 156165 - protein, 37 aa, Artificial Sequence
  Description of Artificial Sequence: Synthetic polypeptide
DEEEIRTTNPVATEQYGSVTNNEQVELEVQGNPETQD

SEQ ID NO: 156166 - protein, 36 aa, Artificial Sequence
  Description of Artificial Sequence: Synthetic polypeptide
DEEEIRTTNPVATEQYGSVTNISMGNEVPEGEVPEI

SEQ ID NO: 156167 - protein, 31 aa, Artificial Sequence
  Description of Artificial Sequence: Synthetic polypeptide
DDQEVASTNPVATEGYGNVSANTLESHVGQR

SEQ ID NO: 156168 - protein, 37 aa, Artificial Sequence
  Description of Artificial Sequence: Synthetic polypeptide
DEEEIRTTNPVATEQYGSVTHTTEDHNDQENGEETGN

SEQ ID NO: 156169 - protein, 36 aa, Artificial Sequence
  Description of Artificial Sequence: Synthetic polypeptide
DEEEIRTTNPVATEQYGSVTHTTLEDHNDENGEESQ

SEQ ID NO: 156170 - protein, 36 aa, Artificial Sequence
  Description of Artificial Sequence: Synthetic polypeptide
DEEEIRTTNPVATEQYGSVTHTTLEDHNDENSEEQP

SEQ ID NO: 156171 - protein, 35 aa, Artificial Sequence
  Description of Artificial Sequence: Synthetic polypeptide
DEEEIRTTNPVATEQYGSVTHTTMEDHNDENLEEQ

SEQ ID NO: 156172 - protein, 36 aa, Artificial Sequence
  Description of Artificial Sequence: Synthetic polypeptide
DEEEIRTTNPVATEQYGSVTHTTNEDHNDEVNGEEG

SEQ ID NO: 156173 - protein, 36 aa, Artificial Sequence
  Description of Artificial Sequence: Synthetic polypeptide
DENEIRTTNPVATEQYGDVSSTTPAGPNMRNGMNPV

SEQ ID NO: 156174 - protein, 36 aa, Artificial Sequence
  Description of Artificial Sequence: Synthetic polypeptide
DENEIRTTNPVATEQYGDVSSTTPAGPNMANGMNPV

SEQ ID NO: 156175 - protein, 36 aa, Artificial Sequence
  Description of Artificial Sequence: Synthetic polypeptide
DENEIRTTNPVATEQYGDVSSTEPAGPNMANGMNPV

SEQ ID NO: 156176 - protein, 38 aa, Artificial Sequence
  Description of Artificial Sequence: Synthetic polypeptide
DEEEIRTTNPVATEQYGVVSTVVVTNNQQGNQEEEEED

SEQ ID NO: 156177 - protein, 35 aa, Artificial Sequence
  Description of Artificial Sequence: Synthetic polypeptide
DENEIRTTNPVATEQYGDVSSTEPAEPMMANGMNV

SEQ ID NO: 156178 - protein, 36 aa, Artificial Sequence
  Description of Artificial Sequence: Synthetic polypeptide
DEGEIRTTNPVATEQYGSVNNTPDHQWDEYGNEDVE

SEQ ID NO: 156179 - protein, 36 aa, Artificial Sequence
  Description of Artificial Sequence: Synthetic polypeptide
DEEEIVTTNPVATEFYGSVSSTTPAGPNHLNGHNPV

SEQ ID NO: 156180 - protein, 32 aa, Artificial Sequence
  Description of Artificial Sequence: Synthetic polypeptide
DEEEIVTTNPVATEQYGEAPATDGPVEHEENK

SEQ ID NO: 156181 - protein, 33 aa, Artificial Sequence
  Description of Artificial Sequence: Synthetic polypeptide
DEEEIVTTNPVATEQYGEVCPATDGCVEFEENK

SEQ ID NO: 156182 - protein, 34 aa, Artificial Sequence
  Description of Artificial Sequence: Synthetic polypeptide
DENEIATTNPVATEQYGCNVAATNPLEAPDNQNN

SEQ ID NO: 156183 - protein, 32 aa, Artificial Sequence
  Description of Artificial Sequence: Synthetic polypeptide
DDQEVASTNPVATEQYGSVSATTIQDHVGQDL

SEQ ID NO: 156184 - protein, 33 aa, Artificial Sequence
  Description of Artificial Sequence: Synthetic polypeptide
DEGEIRTTNPVATEQYGSVNNTPDEDEYIEVHI

SEQ ID NO: 156185 - protein, 36 aa, Artificial Sequence
  Description of Artificial Sequence: Synthetic polypeptide
DEEEIVTTNPVATEQYGSCSSTTPAGPNMRNGMNPV

SEQ ID NO: 156186 - protein, 36 aa, Artificial Sequence
  Description of Artificial Sequence: Synthetic polypeptide
DEEEIVRTTNPVAYEPWGKVSCTDCPLSTIRGEENR

SEQ ID NO: 156187 - protein, 34 aa, Artificial Sequence
  Description of Artificial Sequence: Synthetic polypeptide
DEAEIRTTNPVATEQYGCYSMVTEQFRTPQEDRF

SEQ ID NO: 156188 - protein, 35 aa, Artificial Sequence
  Description of Artificial Sequence: Synthetic polypeptide
DENEIRTTNPVATEQYGSCASVWHDLQTGEEEQQY

SEQ ID NO: 156189 - protein, 30 aa, Artificial Sequence
  Description of Artificial Sequence: Synthetic polypeptide
DENEIATTNPVATEQWGDVSEIEMNAAEDL

SEQ ID NO: 156190 - protein, 35 aa, Artificial Sequence
  Description of Artificial Sequence: Synthetic polypeptide
DENEIRTTNPVATEQYGSTIAVTHDLQTGMEEQQY

SEQ ID NO: 156191 - protein, 36 aa, Artificial Sequence
  Description of Artificial Sequence: Synthetic polypeptide
DEAEIRTTNPVATEQYGQCVCSNTGEHQYFGSDNQS

SEQ ID NO: 156192 - protein, 36 aa, Artificial Sequence
  Description of Artificial Sequence: Synthetic polypeptide
DEGEIRTTNPVATEQYGSVSDWVTVNEIERIDPSQE

SEQ ID NO: 156193 - protein, 37 aa, Artificial Sequence
  Description of Artificial Sequence: Synthetic polypeptide
DENEIRTTNPVATEQYGSSPSPNLQSIEGNEGGFESI

SEQ ID NO: 156194 - protein, 33 aa, Artificial Sequence
  Description of Artificial Sequence: Synthetic polypeptide
DEEEISTTNPVAYEQYGCVCSWGEPQNFGSDQS

SEQ ID NO: 156195 - protein, 38 aa, Artificial Sequence
  Description of Artificial Sequence: Synthetic polypeptide
DEEEIRTTNPVATEQYGVVSTVVVTNLQAGTDETTTTD

SEQ ID NO: 156196 - protein, 32 aa, Artificial Sequence
  Description of Artificial Sequence: Synthetic polypeptide
DENEIATTNPVATEQWGCVAGEGEANAEAGNA

SEQ ID NO: 156197 - protein, 35 aa, Artificial Sequence
  Description of Artificial Sequence: Synthetic polypeptide
DEGEIRTTNPVATEQYGSVSDVHYLSHIGPGEEEN

SEQ ID NO: 156198 - protein, 36 aa, Artificial Sequence
  Description of Artificial Sequence: Synthetic polypeptide
DENEIRTTNPVATEQYGSSCSVTCALDEQMTQNEEV

SEQ ID NO: 156199 - protein, 38 aa, Artificial Sequence
  Description of Artificial Sequence: Synthetic polypeptide
DEEEIRTTNPVATEQYGVVSTVVVTNLQAGTQEETEDE

SEQ ID NO: 156200 - protein, 38 aa, Artificial Sequence
  Description of Artificial Sequence: Synthetic polypeptide
DEEEIRTTNPVATEQYGVVSTVVVTNLQNQGEEEEETD

SEQ ID NO: 156201 - protein, 38 aa, Artificial Sequence
  Description of Artificial Sequence: Synthetic polypeptide
DEEEIRTTNPVATEQYGVVSTVVVTNLQQAGTTTQEDD

SEQ ID NO: 156202 - protein, 36 aa, Artificial Sequence
  Description of Artificial Sequence: Synthetic polypeptide
DENEIRTTNPVATEQYGSNCNTFVDELTQMEGNSVN

SEQ ID NO: 156203 - protein, 37 aa, Artificial Sequence
  Description of Artificial Sequence: Synthetic polypeptide
DEGEIRTTNPVATEQYGSVSATNVDWEQTFNGQIQEG

SEQ ID NO: 156204 - protein, 35 aa, Artificial Sequence
  Description of Artificial Sequence: Synthetic polypeptide
DEGEIRTTNPVATEQYGSVSAENVHTQIELFEDGD

SEQ ID NO: 156205 - protein, 34 aa, Artificial Sequence
  Description of Artificial Sequence: Synthetic polypeptide
DEGEIRTTNPVATEQYGSVSAEIDHTSEGFEDGD

SEQ ID NO: 156206 - protein, 38 aa, Artificial Sequence
  Description of Artificial Sequence: Synthetic polypeptide
DEEEIRTTNPVATEQYGVVSTVVVTNLQQGTDEEDEDE

SEQ ID NO: 156207 - protein, 33 aa, Artificial Sequence
  Description of Artificial Sequence: Synthetic polypeptide
DENEIRTTNPVATEQYGSTQVTALGILEIQEDT

SEQ ID NO: 156208 - protein, 33 aa, Artificial Sequence
  Description of Artificial Sequence: Synthetic polypeptide
DENEIRTTNPVATEQYGSTQVTALGILEIQQDF

SEQ ID NO: 156209 - protein, 37 aa, Artificial Sequence
  Description of Artificial Sequence: Synthetic polypeptide
DENEIRTTNPVATEQYGSTSTTDNNANQTEDPGSNQQ

SEQ ID NO: 156210 - protein, 35 aa, Artificial Sequence
  Description of Artificial Sequence: Synthetic polypeptide
DENEIRTTNPVATEQYGSVANTAPPLEVTINVSQQ

SEQ ID NO: 156211 - protein, 36 aa, Artificial Sequence
  Description of Artificial Sequence: Synthetic polypeptide
DENEIRTTNPVATEQYGSVCSVTWPILGEDRFVEEG

SEQ ID NO: 156212 - protein, 36 aa, Artificial Sequence
  Description of Artificial Sequence: Synthetic polypeptide
DENEIRTTNPVATEQYGSVCSVTWPILEDRFVIEGQ

SEQ ID NO: 156213 - protein, 36 aa, Artificial Sequence
  Description of Artificial Sequence: Synthetic polypeptide
DENEIRTTNPVATEQYGSVCSVTWPILEDQAFVHEG

SEQ ID NO: 156214 - protein, 35 aa, Artificial Sequence
  Description of Artificial Sequence: Synthetic polypeptide
DEGEIRTTNPVATEQYGSVSPVNYASHIGPGPEEN

SEQ ID NO: 156215 - protein, 34 aa, Artificial Sequence
  Description of Artificial Sequence: Synthetic polypeptide
DEEEISTTNPVAYEQYGCVCSTGEDQNFNSDNQS

SEQ ID NO: 156216 - protein, 36 aa, Artificial Sequence
  Description of Artificial Sequence: Synthetic polypeptide
DEGEIRTTNPVATEQYGSVSLVLDANEDEGMMDNQI

SEQ ID NO: 156217 - protein, 36 aa, Artificial Sequence
  Description of Artificial Sequence: Synthetic polypeptide
DEGEIRTTNPVATEQYGSVSIWVDVNENERIGEVQE

SEQ ID NO: 156218 - protein, 36 aa, Artificial Sequence
  Description of Artificial Sequence: Synthetic polypeptide
DEGEIRTTNPVATEQYGSVSFTTDSVEQIENNNDED

SEQ ID NO: 156219 - protein, 35 aa, Artificial Sequence
  Description of Artificial Sequence: Synthetic polypeptide
DEGEIRTTNPVATEQYGSVQTVELHQEISIESEYD

SEQ ID NO: 156220 - protein, 36 aa, Artificial Sequence
  Description of Artificial Sequence: Synthetic polypeptide
DEGEIRTTNPVATEQYGSVSFTTASVTQETNNNDED

SEQ ID NO: 156221 - protein, 36 aa, Artificial Sequence
  Description of Artificial Sequence: Synthetic polypeptide
DEGEIRTTNPVATEQYGSVSETEDNGTAEYPQNEIQ

SEQ ID NO: 156222 - protein, 37 aa, Artificial Sequence
  Description of Artificial Sequence: Synthetic polypeptide
DEGEIRTTNPVATEQYGSVSDWVWVNENERIGPENQE

SEQ ID NO: 156223 - protein, 33 aa, Artificial Sequence
  Description of Artificial Sequence: Synthetic polypeptide
DEEEISTTNPVAYEQYGCVCSWEHQHFNSNTQP

SEQ ID NO: 156224 - protein, 33 aa, Artificial Sequence
  Description of Artificial Sequence: Synthetic polypeptide
DEEEISTTNPVAYEQYGCVCSWEHQNFNSNTQS

SEQ ID NO: 156225 - protein, 34 aa, Artificial Sequence
  Description of Artificial Sequence: Synthetic polypeptide
DEEEISTTNPVAYEQYGCVCSWENHEQNFGSDQS

SEQ ID NO: 156226 - protein, 36 aa, Artificial Sequence
  Description of Artificial Sequence: Synthetic polypeptide
DENEIRTTNPVATEQYGSVCSPDNALWESIGVTIQE

SEQ ID NO: 156227 - protein, 36 aa, Artificial Sequence
  Description of Artificial Sequence: Synthetic polypeptide
DENEIRTTNPVATEQYGSVCSFTEDMINRQEVSFED

SEQ ID NO: 156228 - protein, 36 aa, Artificial Sequence
  Description of Artificial Sequence: Synthetic polypeptide
DENEIRTTNPVATEQYGSVCMPTIMLLENRNESDND

SEQ ID NO: 156229 - protein, 36 aa, Artificial Sequence
  Description of Artificial Sequence: Synthetic polypeptide
DEGEIRTTNPVATEQYGSVSFTTASVEVEGNLNDED

SEQ ID NO: 156230 - protein, 31 aa, Artificial Sequence
  Description of Artificial Sequence: Synthetic polypeptide
DENEIATTNPVATEQWGDVSEIEMNAAESDA

SEQ ID NO: 156231 - protein, 31 aa, Artificial Sequence
  Description of Artificial Sequence: Synthetic polypeptide
DENEIATTNPVATEQWGCVSEGEMNAAEDHA

SEQ ID NO: 156232 - protein, 32 aa, Artificial Sequence
  Description of Artificial Sequence: Synthetic polypeptide
DENEIATTNPVATEQWGCVSEGEMNAAEEDNN

SEQ ID NO: 156233 - protein, 30 aa, Artificial Sequence
  Description of Artificial Sequence: Synthetic polypeptide
DENEIATTNPVATEQWGDVSEIEENAAEDA

SEQ ID NO: 156234 - protein, 30 aa, Artificial Sequence
  Description of Artificial Sequence: Synthetic polypeptide
DENEIATTNPVATEQWGDVSEIEENAEEDA

SEQ ID NO: 156235 - protein, 33 aa, Artificial Sequence
  Description of Artificial Sequence: Synthetic polypeptide
DENEIRTTNPVATEQYGSCIYPVNQMETENNEM

SEQ ID NO: 156236 - protein, 34 aa, Artificial Sequence
  Description of Artificial Sequence: Synthetic polypeptide
DENEIRTTNPVATEQYGSCITVPVQDQIGFSILN

SEQ ID NO: 156237 - protein, 36 aa, Artificial Sequence
  Description of Artificial Sequence: Synthetic polypeptide
DENEIRTTNPVATEQYGSCISVTWHDLQTGYEEQQV

SEQ ID NO: 156238 - protein, 30 aa, Artificial Sequence
  Description of Artificial Sequence: Synthetic polypeptide
DENEIATTNPVATEQWGDVSEIEMDHAEEA

SEQ ID NO: 156239 - protein, 37 aa, Artificial Sequence
  Description of Artificial Sequence: Synthetic polypeptide
DEEEIRTTNPVATEQYGSVYTGTMNDNGQDTNEDGQT

SEQ ID NO: 156240 - protein, 37 aa, Artificial Sequence
  Description of Artificial Sequence: Synthetic polypeptide
DENEIRTTNPVATEQYGSCISVTWHDLQTGMENEFQY

SEQ ID NO: 156241 - protein, 35 aa, Artificial Sequence
  Description of Artificial Sequence: Synthetic polypeptide
DENEIRTTNPVATEQYGSCISVTHDVQEGMEEQQY

SEQ ID NO: 156242 - protein, 36 aa, Artificial Sequence
  Description of Artificial Sequence: Synthetic polypeptide
DENEIRTTNPVATEQYGSCISVTHDLTQTGEEEQQY

SEQ ID NO: 156243 - protein, 36 aa, Artificial Sequence
  Description of Artificial Sequence: Synthetic polypeptide
DENEIRTTNPVATEQYGSCISVTHDLPTGMENEQQY

SEQ ID NO: 156244 - protein, 30 aa, Artificial Sequence
  Description of Artificial Sequence: Synthetic polypeptide
DENEIATTNPVATEQWGDVSEIEMNAAEDA

SEQ ID NO: 156245 - protein, 36 aa, Artificial Sequence
  Description of Artificial Sequence: Synthetic polypeptide
DENEIRTTNPVATEQYGSCISVTDHDLQTGMEEAQY

SEQ ID NO: 156246 - protein, 35 aa, Artificial Sequence
  Description of Artificial Sequence: Synthetic polypeptide
DENEIRTTNPVATEQYGSCISVRHDLQTGMEEMQY

SEQ ID NO: 156247 - protein, 34 aa, Artificial Sequence
  Description of Artificial Sequence: Synthetic polypeptide
DENEIRTTNPVATEQYGSCFYPPMLQEERPESQQ

SEQ ID NO: 156248 - protein, 36 aa, Artificial Sequence
  Description of Artificial Sequence: Synthetic polypeptide
DENEIRTTNPVATEQYGSCCSPTNVPENRSGSPQVE

SEQ ID NO: 156249 - protein, 31 aa, Artificial Sequence
  Description of Artificial Sequence: Synthetic polypeptide
DENEIATTNPVATEQWGDVSEIEMNAAEDGA

SEQ ID NO: 156250 - protein, 30 aa, Artificial Sequence
  Description of Artificial Sequence: Synthetic polypeptide
DENEIATTNPVATEQWGDVSEDEMDHAEEA

SEQ ID NO: 156251 - protein, 30 aa, Artificial Sequence
  Description of Artificial Sequence: Synthetic polypeptide
DENEIATTNPVATEQWGDVSEDEMDAAEDA

SEQ ID NO: 156252 - protein, 30 aa, Artificial Sequence
  Description of Artificial Sequence: Synthetic polypeptide
DENEIATTNPVATEQWGDVSECEMNAAEDL

SEQ ID NO: 156253 - protein, 34 aa, Artificial Sequence
  Description of Artificial Sequence: Synthetic polypeptide
DENEIRTTNPVATEQYGSCPTYLNIINLSDDFQH

SEQ ID NO: 156254 - protein, 32 aa, Artificial Sequence
  Description of Artificial Sequence: Synthetic polypeptide
DENEIATTNPVATEQWGCVSEGEMNAASDNAW

SEQ ID NO: 156255 - protein, 32 aa, Artificial Sequence
  Description of Artificial Sequence: Synthetic polypeptide
DENEIATTNPVATEQWGCVSEGEMNAMLDNAE

SEQ ID NO: 156256 - protein, 37 aa, Artificial Sequence
  Description of Artificial Sequence: Synthetic polypeptide
DEEEIRTTNPVATEQYGSVTCVTMTMLQGTNESEPEV

SEQ ID NO: 156257 - protein, 35 aa, Artificial Sequence
  Description of Artificial Sequence: Synthetic polypeptide
DEEEIRTTNPVATEQYGSVTCVVDDLNQPNSQIEH

SEQ ID NO: 156258 - protein, 36 aa, Artificial Sequence
  Description of Artificial Sequence: Synthetic polypeptide
DEEEIRTTNPVATEQYGSVTCVVSNDTSELVFEEEL

SEQ ID NO: 156259 - protein, 38 aa, Artificial Sequence
  Description of Artificial Sequence: Synthetic polypeptide
DENEIRTTNPVATEQYGSIMSTVDANLEQTGGSQEPNI

SEQ ID NO: 156260 - protein, 32 aa, Artificial Sequence
  Description of Artificial Sequence: Synthetic polypeptide
DENEIATTNPVATEQWGCVSEGGGMNAAEDNA

SEQ ID NO: 156261 - protein, 35 aa, Artificial Sequence
  Description of Artificial Sequence: Synthetic polypeptide
DENEIRTTNPVATEQYGSFYTTLNGSQEWSGSQVE

SEQ ID NO: 156262 - protein, 32 aa, Artificial Sequence
  Description of Artificial Sequence: Synthetic polypeptide
DENEIATTNPVATEQWGCVSEGEMNAAEDNHE

SEQ ID NO: 156263 - protein, 33 aa, Artificial Sequence
  Description of Artificial Sequence: Synthetic polypeptide
DDEEIRTTNPEATEHYGCVCSWELNQGFNSDQS

SEQ ID NO: 156264 - protein, 34 aa, Artificial Sequence
  Description of Artificial Sequence: Synthetic polypeptide
DENEIRTTNPVATEQYGSCYPVNMNQMESENNEM

SEQ ID NO: 156265 - protein, 38 aa, Artificial Sequence
  Description of Artificial Sequence: Synthetic polypeptide
DEEEIRTTNPVATEQYGVVSTVVVTNLQQGTTEDEEDE

SEQ ID NO: 156266 - protein, 32 aa, Artificial Sequence
  Description of Artificial Sequence: Synthetic polypeptide
DENEIATTNPVATEQWGCVSGEGEMNAAVDNK

SEQ ID NO: 156267 - protein, 37 aa, Artificial Sequence
  Description of Artificial Sequence: Synthetic polypeptide
DEEEIRTTNPVATEQYGSVTDGEGNVLNSNNGGNEQE

SEQ ID NO: 156268 - protein, 30 aa, Artificial Sequence
  Description of Artificial Sequence: Synthetic polypeptide
DENEIATTNPVATEQWGDASEIEQNAAEDA

SEQ ID NO: 156269 - protein, 30 aa, Artificial Sequence
  Description of Artificial Sequence: Synthetic polypeptide
DENEIATTNPVATEQWGDMAEILQNHAEDA

SEQ ID NO: 156270 - protein, 30 aa, Artificial Sequence
  Description of Artificial Sequence: Synthetic polypeptide
DENEIATTNPVATEQWGDMSEIEQNAAEDA

SEQ ID NO: 156271 - protein, 30 aa, Artificial Sequence
  Description of Artificial Sequence: Synthetic polypeptide
DENEIATTNPVATEQWGDVSECEMNAAEDA

SEQ ID NO: 156272 - protein, 35 aa, Artificial Sequence
  Description of Artificial Sequence: Synthetic polypeptide
DENEIRTTNPVATEQYGSFCTPDCLETGYMEDMND

SEQ ID NO: 156273 - protein, 34 aa, Artificial Sequence
  Description of Artificial Sequence: Synthetic polypeptide
DENEIATTNPVATEQYGCVAANNNLTEAEGGNHL

SEQ ID NO: 156274 - protein, 36 aa, Artificial Sequence
  Description of Artificial Sequence: Synthetic polypeptide
DEEEIRTTNPVATEQYGSVTPTMMGTQMQAAAFNEN

SEQ ID NO: 156275 - protein, 33 aa, Artificial Sequence
  Description of Artificial Sequence: Synthetic polypeptide
DENEIATTNPVATEQYGCVAANNNVTTDDGNIE

SEQ ID NO: 156276 - protein, 35 aa, Artificial Sequence
  Description of Artificial Sequence: Synthetic polypeptide
DENEIATTNPVATEQYGSACSAPNLQDSPDENAHE

SEQ ID NO: 156277 - protein, 33 aa, Artificial Sequence
  Description of Artificial Sequence: Synthetic polypeptide
CEMEIVTTNPVATEQYGTVCSATDGPVEFEGND

SEQ ID NO: 156278 - protein, 35 aa, Artificial Sequence
  Description of Artificial Sequence: Synthetic polypeptide
DDMEIRTTNPVATEQYGCVSTLNASQFNGLQDAEA

SEQ ID NO: 156279 - protein, 35 aa, Artificial Sequence
  Description of Artificial Sequence: Synthetic polypeptide
DENEIATTNPVATEQYGSASSTTPAGPNRNGMNPV

SEQ ID NO: 156280 - protein, 35 aa, Artificial Sequence
  Description of Artificial Sequence: Synthetic polypeptide
DDMEIRTTNPVATEQYGCVSTALATQFNGLQDQEY

SEQ ID NO: 156281 - protein, 35 aa, Artificial Sequence
  Description of Artificial Sequence: Synthetic polypeptide
DENEIATTNPVATEQYGSCAAATHNQEGQDDGNHM

SEQ ID NO: 156282 - protein, 36 aa, Artificial Sequence
  Description of Artificial Sequence: Synthetic polypeptide
DEEGIRTTNPVAYEQYGQSVNINTNDLLQPRSIEKH

SEQ ID NO: 156283 - protein, 37 aa, Artificial Sequence
  Description of Artificial Sequence: Synthetic polypeptide
DEEEIRTTNPVATEQYGSVYSDDINDEGQGQINIDQP

SEQ ID NO: 156284 - protein, 36 aa, Artificial Sequence
  Description of Artificial Sequence: Synthetic polypeptide
DEEHEIRTTNPVAYEQYGCVVPSTGNQQEETDTNPV

SEQ ID NO: 156285 - protein, 34 aa, Artificial Sequence
  Description of Artificial Sequence: Synthetic polypeptide
DEEHIRATNPVATDQYGFVSMTDLFQTGGEIIEG

SEQ ID NO: 156286 - protein, 32 aa, Artificial Sequence
  Description of Artificial Sequence: Synthetic polypeptide
DDMEIATTNPVSTEQYGTVCSATTPVEFEGND

SEQ ID NO: 156287 - protein, 31 aa, Artificial Sequence
  Description of Artificial Sequence: Synthetic polypeptide
DDMEIATTNPVSTEQYGTVCSATTPEFEGQD

SEQ ID NO: 156288 - protein, 32 aa, Artificial Sequence
  Description of Artificial Sequence: Synthetic polypeptide
DDMEIATTNPVSTEQYGTVCSATGPVEFEGND

SEQ ID NO: 156289 - protein, 35 aa, Artificial Sequence
  Description of Artificial Sequence: Synthetic polypeptide
DEEHIRTTNPVATEGWGESGVYAPTNNLVELGVER

SEQ ID NO: 156290 - protein, 34 aa, Artificial Sequence
  Description of Artificial Sequence: Synthetic polypeptide
DDEEIRTTNPVATDQYGSVSTMGIEGEGGGEEEQ

SEQ ID NO: 156291 - protein, 37 aa, Artificial Sequence
  Description of Artificial Sequence: Synthetic polypeptide
DEEHIRTTNPVATEQYGRSVSSTTPAGPNMRNGENPV

SEQ ID NO: 156292 - protein, 35 aa, Artificial Sequence
  Description of Artificial Sequence: Synthetic polypeptide
DENEIATTNPVATEQYGSTVSVTIEDQQETQEGQQ

SEQ ID NO: 156293 - protein, 34 aa, Artificial Sequence
  Description of Artificial Sequence: Synthetic polypeptide
DENEIATTNPVATEQYGSACSANPQQEHQDGTVN

SEQ ID NO: 156294 - protein, 36 aa, Artificial Sequence
  Description of Artificial Sequence: Synthetic polypeptide
CEEEISTTNPVATEQYGCVCSNTEELQENFGSDNQS

SEQ ID NO: 156295 - protein, 33 aa, Artificial Sequence
  Description of Artificial Sequence: Synthetic polypeptide
DENEIATTNPVATEQYGSACSANPPDNMPEDNN

SEQ ID NO: 156296 - protein, 33 aa, Artificial Sequence
  Description of Artificial Sequence: Synthetic polypeptide
DDMEIVTTNPVATEQYGTVCAATDGPVERVGND

SEQ ID NO: 156297 - protein, 35 aa, Artificial Sequence
  Description of Artificial Sequence: Synthetic polypeptide
DENEIRTTNPVATEQYGCCSVVDNDVEQLEPGEDT

SEQ ID NO: 156298 - protein, 31 aa, Artificial Sequence
  Description of Artificial Sequence: Synthetic polypeptide
DDNEIATTNPVSTEPYGTVANEDIQQRNGNH

SEQ ID NO: 156299 - protein, 31 aa, Artificial Sequence
  Description of Artificial Sequence: Synthetic polypeptide
DDNEIATTNPVSTEPYGTVAMEDIQQRNGNH

SEQ ID NO: 156300 - protein, 34 aa, Artificial Sequence
  Description of Artificial Sequence: Synthetic polypeptide
DENEIRTTNPVATEQYGCCSPTPALLIDTGDEKD

SEQ ID NO: 156301 - protein, 33 aa, Artificial Sequence
  Description of Artificial Sequence: Synthetic polypeptide
DENEIRTTNPVATEQYGCCSPAVSWDISSNQQS

SEQ ID NO: 156302 - protein, 35 aa, Artificial Sequence
  Description of Artificial Sequence: Synthetic polypeptide
DENEIRTTNPVATEQYGCCSPAVEWNDIPGSNQQS

SEQ ID NO: 156303 - protein, 36 aa, Artificial Sequence
  Description of Artificial Sequence: Synthetic polypeptide
DENEIRTTNPVATEQYGCCSPAVETWNDHIGSNQQS

SEQ ID NO: 156304 - protein, 32 aa, Artificial Sequence
  Description of Artificial Sequence: Synthetic polypeptide
DEEEVASTNPVSTEGYGNVAATPTGQSRVGQR

SEQ ID NO: 156305 - protein, 33 aa, Artificial Sequence
  Description of Artificial Sequence: Synthetic polypeptide
DEEIAEIATTNPVAYEQWGCVSGWNDNHNGERM

SEQ ID NO: 156306 - protein, 34 aa, Artificial Sequence
  Description of Artificial Sequence: Synthetic polypeptide
DENEIRTTNPVATEQYGAVWTAGTDESENNEDRL

SEQ ID NO: 156307 - protein, 34 aa, Artificial Sequence
  Description of Artificial Sequence: Synthetic polypeptide
DEEEVATTNPVATEGYGNVSAATAIPQSRNGMQV

SEQ ID NO: 156308 - protein, 31 aa, Artificial Sequence
  Description of Artificial Sequence: Synthetic polypeptide
DDNEIASTNPVSTEGYGNVAANTIQQRVGQR

SEQ ID NO: 156309 - protein, 30 aa, Artificial Sequence
  Description of Artificial Sequence: Synthetic polypeptide
DEEEVATTNPVSTEGYGNVAETIQSHVGQK

SEQ ID NO: 156310 - protein, 30 aa, Artificial Sequence
  Description of Artificial Sequence: Synthetic polypeptide
DEEEVATTNPVSTEGYGNVPETIQSHVGQK

SEQ ID NO: 156311 - protein, 31 aa, Artificial Sequence
  Description of Artificial Sequence: Synthetic polypeptide
DDNEIASTNPVSTEGYGNAAAENLQSRVGGR

SEQ ID NO: 156312 - protein, 35 aa, Artificial Sequence
  Description of Artificial Sequence: Synthetic polypeptide
DENEIRTTNPVATEQYGAVVDDFNVQTGEGDENEG

SEQ ID NO: 156313 - protein, 36 aa, Artificial Sequence
  Description of Artificial Sequence: Synthetic polypeptide
DEEEVRTTNPVATEQYGNVSSTTPAGPNSRNGMNPV

SEQ ID NO: 156314 - protein, 35 aa, Artificial Sequence
  Description of Artificial Sequence: Synthetic polypeptide
DEEGIGTTNPVATEQYGSVSTGGLGDENNEQNEGD

SEQ ID NO: 156315 - protein, 35 aa, Artificial Sequence
  Description of Artificial Sequence: Synthetic polypeptide
DENEIRTTNPVATEQYGAVVVDDFNFGLGEGDEER

SEQ ID NO: 156316 - protein, 31 aa, Artificial Sequence
  Description of Artificial Sequence: Synthetic polypeptide
DDNEIATTNPVSTEPYGTVSMDIQQQQVGNH

SEQ ID NO: 156317 - protein, 31 aa, Artificial Sequence
  Description of Artificial Sequence: Synthetic polypeptide
DDMEIASTNPVSTEGYGTVAATTIQSFVGNR

SEQ ID NO: 156318 - protein, 32 aa, Artificial Sequence
  Description of Artificial Sequence: Synthetic polypeptide
DDMEIASTNPVATEQYGTVAANDTIQSRVGQD

SEQ ID NO: 156319 - protein, 36 aa, Artificial Sequence
  Description of Artificial Sequence: Synthetic polypeptide
DEENICTTNPVATEAYGVVSTTVNLQQLQAGSNQED

SEQ ID NO: 156320 - protein, 36 aa, Artificial Sequence
  Description of Artificial Sequence: Synthetic polypeptide
DEGEIRTTNPVATEQYGSVCSVNANGPQSFNSHQDK

SEQ ID NO: 156321 - protein, 32 aa, Artificial Sequence
  Description of Artificial Sequence: Synthetic polypeptide
DENEIRTTNPVATEQWGVVSEIMESMNAAEDA

SEQ ID NO: 156322 - protein, 31 aa, Artificial Sequence
  Description of Artificial Sequence: Synthetic polypeptide
DENEIRTTNPVATEQWGVVQENIEMNAEEDA

SEQ ID NO: 156323 - protein, 30 aa, Artificial Sequence
  Description of Artificial Sequence: Synthetic polypeptide
DENEIRTTNPVATEQWGVVQEIEMNAAEDA

SEQ ID NO: 156324 - protein, 36 aa, Artificial Sequence
  Description of Artificial Sequence: Synthetic polypeptide
DEENICTTNPVATEAYGVVSTVTGNQLNQQGTNEEQ

SEQ ID NO: 156325 - protein, 36 aa, Artificial Sequence
  Description of Artificial Sequence: Synthetic polypeptide
DEENICTTNPVATEAYGVVSTVTNLNQGQEGSNQED

SEQ ID NO: 156326 - protein, 36 aa, Artificial Sequence
  Description of Artificial Sequence: Synthetic polypeptide
DEENICTTNPVATEAYGVVSTVTNNNLGQQGSNLED

SEQ ID NO: 156327 - protein, 31 aa, Artificial Sequence
  Description of Artificial Sequence: Synthetic polypeptide
DENEIRTTNPVATEQWGVGVSEIEMNAAEDA

SEQ ID NO: 156328 - protein, 36 aa, Artificial Sequence
  Description of Artificial Sequence: Synthetic polypeptide
DEGEIRTTNPVATEQYGSVCSEEWPTLNEEMMENSD

SEQ ID NO: 156329 - protein, 36 aa, Artificial Sequence
  Description of Artificial Sequence: Synthetic polypeptide
DEGEIRTTNPVATEQYGSVCSEEWPSNEEQMSNEND

SEQ ID NO: 156330 - protein, 36 aa, Artificial Sequence
  Description of Artificial Sequence: Synthetic polypeptide
DEEEIRTTNPVATEQYGSVTSMPNPNPVHSEENDDI

SEQ ID NO: 156331 - protein, 35 aa, Artificial Sequence
  Description of Artificial Sequence: Synthetic polypeptide
DEENICTTNPVATEAYGVVSTVTNQNQQAGSNLED

SEQ ID NO: 156332 - protein, 33 aa, Artificial Sequence
  Description of Artificial Sequence: Synthetic polypeptide
DENEIRTTNPVATEQWGTVSTEGIGTNNATEDA

SEQ ID NO: 156333 - protein, 37 aa, Artificial Sequence
  Description of Artificial Sequence: Synthetic polypeptide
DEEEIRTTNPVATEQYGSVYPTTNYLPETREPQSVHT

SEQ ID NO: 156334 - protein, 32 aa, Artificial Sequence
  Description of Artificial Sequence: Synthetic polypeptide
DEAEIRATNPVAYEQWGMVTGDLNDHQGGGNL

SEQ ID NO: 156335 - protein, 37 aa, Artificial Sequence
  Description of Artificial Sequence: Synthetic polypeptide
DEEEIRTTNPVATEQYGSVTSNNMNNLEEDRQLEPFY

SEQ ID NO: 156336 - protein, 35 aa, Artificial Sequence
  Description of Artificial Sequence: Synthetic polypeptide
DEAEIRTTNPVATEQYGCVWTVVMQQIGNGAQEFE

SEQ ID NO: 156337 - protein, 36 aa, Artificial Sequence
  Description of Artificial Sequence: Synthetic polypeptide
DEEEIRTTNPVATEQYGSVYPTWLTDAENTMNPVLG

SEQ ID NO: 156338 - protein, 37 aa, Artificial Sequence
  Description of Artificial Sequence: Synthetic polypeptide
DEEEIRTTNPVATEQYGSVYQEAPNLEIQVNGQGQPD

SEQ ID NO: 156339 - protein, 29 aa, Artificial Sequence
  Description of Artificial Sequence: Synthetic peptide
DDGEIASTNPVSSEGYGNVAANNIQSGTR

SEQ ID NO: 156340 - protein, 37 aa, Artificial Sequence
  Description of Artificial Sequence: Synthetic polypeptide
DEEIIRTTNPVATEQYGSSVSSTTPAGPNMRNGDNPV

SEQ ID NO: 156341 - protein, 38 aa, Artificial Sequence
  Description of Artificial Sequence: Synthetic polypeptide
DEEEIRTTNPVATEQYGSVYQPTAVELDVQMIEPGNIL

SEQ ID NO: 156342 - protein, 29 aa, Artificial Sequence
  Description of Artificial Sequence: Synthetic peptide
DDGEVAPTNPCSTEQYGNVACTIQSRGQR

SEQ ID NO: 156343 - protein, 36 aa, Artificial Sequence
  Description of Artificial Sequence: Synthetic polypeptide
DEELIRTTNPVATEQYGSVSSTTPAGPNMRNGMFPV

SEQ ID NO: 156344 - protein, 36 aa, Artificial Sequence
  Description of Artificial Sequence: Synthetic polypeptide
DEEEIRTTNPVATEQYGSVYQEMDLIEQAQGVGVTL

SEQ ID NO: 156345 - protein, 34 aa, Artificial Sequence
  Description of Artificial Sequence: Synthetic polypeptide
DDGEIRTTNPVATEQYGSCIVTWANLESFQENQF

SEQ ID NO: 156346 - protein, 34 aa, Artificial Sequence
  Description of Artificial Sequence: Synthetic polypeptide
DEENIATTNPVATEIYGQSVCTTGSLERFQSNMF

SEQ ID NO: 156347 - protein, 31 aa, Artificial Sequence
  Description of Artificial Sequence: Synthetic polypeptide
DENEIRTTNPVATEQWGYDVSEIEMNAPEDA

SEQ ID NO: 156348 - protein, 31 aa, Artificial Sequence
  Description of Artificial Sequence: Synthetic polypeptide
DDMEIASTNPVSTEGYGTVAANTIQSRVGQR

SEQ ID NO: 156349 - protein, 31 aa, Artificial Sequence
  Description of Artificial Sequence: Synthetic polypeptide
DENEIRTTNPVATEQWGYDVSEIEMNAAEDA

SEQ ID NO: 156350 - protein, 30 aa, Artificial Sequence
  Description of Artificial Sequence: Synthetic polypeptide
DENEIRTTNPVATEQWGVVYEIEMNAAEDA

SEQ ID NO: 156351 - protein, 32 aa, Artificial Sequence
  Description of Artificial Sequence: Synthetic polypeptide
DENEIRTTNPVATEQWGVVVSVVVNNNAAEDA

SEQ ID NO: 156352 - protein, 31 aa, Artificial Sequence
  Description of Artificial Sequence: Synthetic polypeptide
DENEIRTTNPVATEQWGVVTVVVENNAAEDA

SEQ ID NO: 156353 - protein, 36 aa, Artificial Sequence
  Description of Artificial Sequence: Synthetic polypeptide
DDEEIRTTNPVATDQYGSVSTMGQGGEGNDGENDDT

SEQ ID NO: 156354 - protein, 35 aa, Artificial Sequence
  Description of Artificial Sequence: Synthetic polypeptide
DEENICTTNPVATEAYGSVATVNNDQQGTEENEES

SEQ ID NO: 156355 - protein, 33 aa, Artificial Sequence
  Description of Artificial Sequence: Synthetic polypeptide
DENEIATTNPVATEQYGSVAGANPANPNPGAQP

SEQ ID NO: 156356 - protein, 32 aa, Artificial Sequence
  Description of Artificial Sequence: Synthetic polypeptide
DENEIRTTNPVATEQWGVVSVVVNNNAAEDGA

SEQ ID NO: 156357 - protein, 36 aa, Artificial Sequence
  Description of Artificial Sequence: Synthetic polypeptide
DEEEIRTTNPVATEQYGSVTSATMEGLDELLESEGE

SEQ ID NO: 156358 - protein, 32 aa, Artificial Sequence
  Description of Artificial Sequence: Synthetic polypeptide
DENEIRTTNPVATEQWGYDVLSEIEMGAANDA

SEQ ID NO: 156359 - protein, 37 aa, Artificial Sequence
  Description of Artificial Sequence: Synthetic polypeptide
DEEEIRTTNPVATEQYGSVYSEAPNLEIFVNPQGQPD

SEQ ID NO: 156360 - protein, 30 aa, Artificial Sequence
  Description of Artificial Sequence: Synthetic polypeptide
DDNEIRSTNPVATEQWGDVSEIEMNAAGDA

SEQ ID NO: 156361 - protein, 32 aa, Artificial Sequence
  Description of Artificial Sequence: Synthetic polypeptide
DENEIATTNPVATEQYGEISMEVIQQQHNGEK

SEQ ID NO: 156362 - protein, 38 aa, Artificial Sequence
  Description of Artificial Sequence: Synthetic polypeptide
DEEEIRTTNPVATEQYGVVSTVVVTNQNNQQGNTTTDD

SEQ ID NO: 156363 - protein, 36 aa, Artificial Sequence
  Description of Artificial Sequence: Synthetic polypeptide
DENEIATTNPVATEQYGCVAATTNPEATRSGDENRG

SEQ ID NO: 156364 - protein, 35 aa, Artificial Sequence
  Description of Artificial Sequence: Synthetic polypeptide
DEGEIRTTNPVATEQYGSVISSWLDGQQDTQQSKM

SEQ ID NO: 156365 - protein, 35 aa, Artificial Sequence
  Description of Artificial Sequence: Synthetic polypeptide
DEGEIRTTNPVATEQYGSVISSWLDFQSDSQQSKM

SEQ ID NO: 156366 - protein, 35 aa, Artificial Sequence
  Description of Artificial Sequence: Synthetic polypeptide
DEEEIVTTNPVATEQYGTVCSATDGPVEMFEGNPD

SEQ ID NO: 156367 - protein, 33 aa, Artificial Sequence
  Description of Artificial Sequence: Synthetic polypeptide
DENEIATTNPVATEQYGCVATPAITQDPMPARE

SEQ ID NO: 156368 - protein, 35 aa, Artificial Sequence
  Description of Artificial Sequence: Synthetic polypeptide
DENEIATTNPVATEQYGCVTAATANGLQPADANNN

SEQ ID NO: 156369 - protein, 35 aa, Artificial Sequence
  Description of Artificial Sequence: Synthetic polypeptide
DEGEIRTTNPVATEQYGSVINVVTAETQFEGVEDQ

SEQ ID NO: 156370 - protein, 34 aa, Artificial Sequence
  Description of Artificial Sequence: Synthetic polypeptide
DEGEIRTTNPVATEQYGSVIAENDHTQEVFEDGD

SEQ ID NO: 156371 - protein, 34 aa, Artificial Sequence
  Description of Artificial Sequence: Synthetic polypeptide
DEAEIQCTNPVAYEHYGEVVQSANEQDRGGNNRQ

SEQ ID NO: 156372 - protein, 34 aa, Artificial Sequence
  Description of Artificial Sequence: Synthetic polypeptide
DEAEIQCTNPVAYEQYGEVVQSANEQDRGGNNMI

SEQ ID NO: 156373 - protein, 35 aa, Artificial Sequence
  Description of Artificial Sequence: Synthetic polypeptide
DEEEIVTTNPVATEQYGTVCSTTDGGVEMFEGNPD

SEQ ID NO: 156374 - protein, 35 aa, Artificial Sequence
  Description of Artificial Sequence: Synthetic polypeptide
DEEEIVTTNPVATEQYGTVCSTTPAGPEMFNGNPD

SEQ ID NO: 156375 - protein, 36 aa, Artificial Sequence
  Description of Artificial Sequence: Synthetic polypeptide
DEEEIVTTNPVATEQYGTVCSTTPAGPEMRNGMNPD

SEQ ID NO: 156376 - protein, 35 aa, Artificial Sequence
  Description of Artificial Sequence: Synthetic polypeptide
DEEEIVTTNPVATEQYGTVCSTTPGGPEMFNGNPD

SEQ ID NO: 156377 - protein, 35 aa, Artificial Sequence
  Description of Artificial Sequence: Synthetic polypeptide
DEEEIVTTNPVATEQYGTVCSTTPGGVEMFEGNPD

SEQ ID NO: 156378 - protein, 35 aa, Artificial Sequence
  Description of Artificial Sequence: Synthetic polypeptide
DEEEIVTTNPVATEQYGTVCSTTPGGVEMFNGNPD

SEQ ID NO: 156379 - protein, 35 aa, Artificial Sequence
  Description of Artificial Sequence: Synthetic polypeptide
DEEEIRTTNPVAYEHYGSTVVACTGNALQVVTDSF

SEQ ID NO: 156380 - protein, 35 aa, Artificial Sequence
  Description of Artificial Sequence: Synthetic polypeptide
DENEIRTTNPVATEQYGCVMTDTLTFPEDGIENNQ

SEQ ID NO: 156381 - protein, 34 aa, Artificial Sequence
  Description of Artificial Sequence: Synthetic polypeptide
DENEIRTTNPVATEQYGCVPVMDVSLDEIGENNN

SEQ ID NO: 156382 - protein, 35 aa, Artificial Sequence
  Description of Artificial Sequence: Synthetic polypeptide
DENEIATTNPVATEQYGCVAATSGNPQAEEPENRN

SEQ ID NO: 156383 - protein, 33 aa, Artificial Sequence
  Description of Artificial Sequence: Synthetic polypeptide
DENEIRTTNPVATEQYGCVYVPVDLDEDPNEHN

SEQ ID NO: 156384 - protein, 34 aa, Artificial Sequence
  Description of Artificial Sequence: Synthetic polypeptide
DENEIRTTNPVATEQYGCVYVPDTLDGRPTQENK

SEQ ID NO: 156385 - protein, 35 aa, Artificial Sequence
  Description of Artificial Sequence: Synthetic polypeptide
DENEIRTTNPVATEQYGCVYTDENGSQETSGSQGE

SEQ ID NO: 156386 - protein, 36 aa, Artificial Sequence
  Description of Artificial Sequence: Synthetic polypeptide
DEEEIRTTNPVAYEPDGKVSCTPEPGSQYRGEENRI

SEQ ID NO: 156387 - protein, 34 aa, Artificial Sequence
  Description of Artificial Sequence: Synthetic polypeptide
DENEIRTTNPVATEQYGCVWTVVPNEHEENQNYF

SEQ ID NO: 156388 - protein, 34 aa, Artificial Sequence
  Description of Artificial Sequence: Synthetic polypeptide
DDQEIATTNPVATEQYGSVSATPDLEDHEGQEDL

SEQ ID NO: 156389 - protein, 34 aa, Artificial Sequence
  Description of Artificial Sequence: Synthetic polypeptide
DENEIATTNPVATEQYGCVAATHHLDQIDENANN

SEQ ID NO: 156390 - protein, 34 aa, Artificial Sequence
  Description of Artificial Sequence: Synthetic polypeptide
DENEIATTNPVATEQYGCVAATNDATRSPMENGN

SEQ ID NO: 156391 - protein, 33 aa, Artificial Sequence
  Description of Artificial Sequence: Synthetic polypeptide
DENEIATTNPVATEQYGDVSSTTPAGNMHGMEL

SEQ ID NO: 156392 - protein, 36 aa, Artificial Sequence
  Description of Artificial Sequence: Synthetic polypeptide
DEGEIRTTNPVATEQYGSVMPTLAMLHVIEGSNEDV

SEQ ID NO: 156393 - protein, 33 aa, Artificial Sequence
  Description of Artificial Sequence: Synthetic polypeptide
DDQEIATTNPVATEQYGSTSATPDLEDHIGEDN

SEQ ID NO: 156394 - protein, 32 aa, Artificial Sequence
  Description of Artificial Sequence: Synthetic polypeptide
DDQEIATTNPVATEGYGSVAATDLEDHEGEDL

SEQ ID NO: 156395 - protein, 35 aa, Artificial Sequence
  Description of Artificial Sequence: Synthetic polypeptide
DENEIRTTNPVATEQYGCVSTEDATEIPQEGIFQN

SEQ ID NO: 156396 - protein, 36 aa, Artificial Sequence
  Description of Artificial Sequence: Synthetic polypeptide
DENEIRTTNPVATEQYGCVSSVLCNLEDTRNQNAEN

SEQ ID NO: 156397 - protein, 34 aa, Artificial Sequence
  Description of Artificial Sequence: Synthetic polypeptide
DENEIRTTNPVATEQYGCVSMPQNIEDSESQQRE

SEQ ID NO: 156398 - protein, 34 aa, Artificial Sequence
  Description of Artificial Sequence: Synthetic polypeptide
DENEIATTNPVATEQYGCVAATPLQNQANGELAW

SEQ ID NO: 156399 - protein, 34 aa, Artificial Sequence
  Description of Artificial Sequence: Synthetic polypeptide
DENEIATTNPVATEQYGCVAATQLDQTPDNNTPM

SEQ ID NO: 156400 - protein, 38 aa, Artificial Sequence
  Description of Artificial Sequence: Synthetic polypeptide
DEEEIRTTNPVATEQYGVVSTVVVTNQLNNQGTNQQNE

SEQ ID NO: 156401 - protein, 35 aa, Artificial Sequence
  Description of Artificial Sequence: Synthetic polypeptide
DENEIRTTNPVATEQYGCVSTVVALEHSNGTQQIQ

SEQ ID NO: 156402 - protein, 36 aa, Artificial Sequence
  Description of Artificial Sequence: Synthetic polypeptide
DEEEIVTTNPVATEQYGTVSSATPAGPEMRNGMNPD

SEQ ID NO: 156403 - protein, 36 aa, Artificial Sequence
  Description of Artificial Sequence: Synthetic polypeptide
DEEEIVTTNPVATEQYGTVSSATPAGPNMRNGMNPV

SEQ ID NO: 156404 - protein, 36 aa, Artificial Sequence
  Description of Artificial Sequence: Synthetic polypeptide
DEEEIVTTNPVATEQYGTVSSATPAPPNMFEGMNPV

SEQ ID NO: 156405 - protein, 38 aa, Artificial Sequence
  Description of Artificial Sequence: Synthetic polypeptide
DEEEIRTTNPVATEQYGVVSTVVVTNQQQGNNEEEEDE

SEQ ID NO: 156406 - protein, 34 aa, Artificial Sequence
  Description of Artificial Sequence: Synthetic polypeptide
CEEEISTTNPVATEQYGCVCSNTEDQENFGSEQS

SEQ ID NO: 156407 - protein, 35 aa, Artificial Sequence
  Description of Artificial Sequence: Synthetic polypeptide
DENEIRTTNPVATEQYGCVCSNTGEHQEYFGSDQS

SEQ ID NO: 156408 - protein, 31 aa, Artificial Sequence
  Description of Artificial Sequence: Synthetic polypeptide
DDNEIRTTNPVSTEPYGTISMEDIQQQNGNH

SEQ ID NO: 156409 - protein, 35 aa, Artificial Sequence
  Description of Artificial Sequence: Synthetic polypeptide
DENEIRTTNPVATEQYGCVCSNTEHQEFFGSDTQA

SEQ ID NO: 156410 - protein, 31 aa, Artificial Sequence
  Description of Artificial Sequence: Synthetic polypeptide
DDNEIRTTNPVSTEPYGTISMDIQQQQVGNH

SEQ ID NO: 156411 - protein, 30 aa, Artificial Sequence
  Description of Artificial Sequence: Synthetic polypeptide
DDNEIRTTNPVSTEPYGTIAMDIQQQNGQR

SEQ ID NO: 156412 - protein, 34 aa, Artificial Sequence
  Description of Artificial Sequence: Synthetic polypeptide
CEEEISTTNPVATEQYGCVCSNTEDQNFISNTQS

SEQ ID NO: 156413 - protein, 31 aa, Artificial Sequence
  Description of Artificial Sequence: Synthetic polypeptide
DDNEIRTTNPVSTEPYGTVAAMDIQQQNGQR

SEQ ID NO: 156414 - protein, 35 aa, Artificial Sequence
  Description of Artificial Sequence: Synthetic polypeptide
CEEEISTTNPVATEQYGCVCSNTEEDLQHFGSDQS

SEQ ID NO: 156415 - protein, 35 aa, Artificial Sequence
  Description of Artificial Sequence: Synthetic polypeptide
DEGEIRTTNPVATEQYGSVEVSGWEEGTEGQQHEI

SEQ ID NO: 156416 - protein, 36 aa, Artificial Sequence
  Description of Artificial Sequence: Synthetic polypeptide
DEEELRTTNPVATEQYGTVSSTTPAGPNMRNGMNPV

SEQ ID NO: 156417 - protein, 36 aa, Artificial Sequence
  Description of Artificial Sequence: Synthetic polypeptide
DEEEIRTTNPVATEQYGSVYSIVVDLNQPNSQIDEQ

SEQ ID NO: 156418 - protein, 31 aa, Artificial Sequence
  Description of Artificial Sequence: Synthetic polypeptide
DDNEIRTTNPVATEQYGNVSAEIIMNAAEDA

SEQ ID NO: 156419 - protein, 31 aa, Artificial Sequence
  Description of Artificial Sequence: Synthetic polypeptide
DDNEIRTTNPVATEQWGDVSEINRMNAAEDA

SEQ ID NO: 156420 - protein, 35 aa, Artificial Sequence
  Description of Artificial Sequence: Synthetic polypeptide
DEEEIRTTNPVATEQYGSVYSFPLDEYAEHFVLEE

SEQ ID NO: 156421 - protein, 30 aa, Artificial Sequence
  Description of Artificial Sequence: Synthetic polypeptide
DDNEIRTTNPVATEQWGDVSEIEMNAAEDA

SEQ ID NO: 156422 - protein, 37 aa, Artificial Sequence
  Description of Artificial Sequence: Synthetic polypeptide
DEEEIRTTNPVATEQYGSVYSEAPNMEIQVNGQGQPN

SEQ ID NO: 156423 - protein, 31 aa, Artificial Sequence
  Description of Artificial Sequence: Synthetic polypeptide
DDNEIRTTNPVATEQYGNVSAEIIMNAAEQA

SEQ ID NO: 156424 - protein, 32 aa, Artificial Sequence
  Description of Artificial Sequence: Synthetic polypeptide
DENEIRTTNPVATEQWGDVSLEIEMNAAEDAM

SEQ ID NO: 156425 - protein, 31 aa, Artificial Sequence
  Description of Artificial Sequence: Synthetic polypeptide
DDNEIRTTNPVSTEPYGTVAMEDIQQQNGNH

SEQ ID NO: 156426 - protein, 35 aa, Artificial Sequence
  Description of Artificial Sequence: Synthetic polypeptide
DEEEIRTTNPVATEQYGSVTQEMLLLGEFEQIVDE

SEQ ID NO: 156427 - protein, 38 aa, Artificial Sequence
  Description of Artificial Sequence: Synthetic polypeptide
DEEEIRTTNPVATEQYGVVSTVVVTNQNQQQGNQTTND

SEQ ID NO: 156428 - protein, 36 aa, Artificial Sequence
  Description of Artificial Sequence: Synthetic polypeptide
DEEEIVTTNPVATEQYGTVSSTTPAGPNMRNGMNPV

SEQ ID NO: 156429 - protein, 31 aa, Artificial Sequence
  Description of Artificial Sequence: Synthetic polypeptide
DDNEVRTTNPVSTEPYGTVAAMTIQQQNGQR

SEQ ID NO: 156430 - protein, 34 aa, Artificial Sequence
  Description of Artificial Sequence: Synthetic polypeptide
DEEEIVTTNPVATEWYGTVCSATDGPVEAFEGND

SEQ ID NO: 156431 - protein, 30 aa, Artificial Sequence
  Description of Artificial Sequence: Synthetic polypeptide
DDNEVATTNPVSTEPYGNVANDIQQRNGNH

SEQ ID NO: 156432 - protein, 35 aa, Artificial Sequence
  Description of Artificial Sequence: Synthetic polypeptide
DEGEIRTTNPVATEQYGSVGTPDEDLNRFEEMIQE

SEQ ID NO: 156433 - protein, 36 aa, Artificial Sequence
  Description of Artificial Sequence: Synthetic polypeptide
DEEEIRTTNPVAYEEWGCSVSCTNTGESQSPEGNSA

SEQ ID NO: 156434 - protein, 37 aa, Artificial Sequence
  Description of Artificial Sequence: Synthetic polypeptide
DEEEIWTTNPVATEQYGSCVSSTTPAGPNMRNGMNPV

SEQ ID NO: 156435 - protein, 35 aa, Artificial Sequence
  Description of Artificial Sequence: Synthetic polypeptide
CEEEISTTNPVATEQYGCVCSNTEDLQNFGSQTQS

SEQ ID NO: 156436 - protein, 37 aa, Artificial Sequence
  Description of Artificial Sequence: Synthetic polypeptide
DEEEIWTTNPVATEQYGSVSSTTPAGPNMRNGMNPVT

SEQ ID NO: 156437 - protein, 35 aa, Artificial Sequence
  Description of Artificial Sequence: Synthetic polypeptide
DEGEIRTTNPVATEQYGSVFSWPWPVEQADTNEQA

SEQ ID NO: 156438 - protein, 31 aa, Artificial Sequence
  Description of Artificial Sequence: Synthetic polypeptide
DDNEVASTNPVATEGYGNVAANTIQSRVGQR

SEQ ID NO: 156439 - protein, 34 aa, Artificial Sequence
  Description of Artificial Sequence: Synthetic polypeptide
DEEEIRTTNPVATEQYGSVYSPPVDEDAEAFLIG

SEQ ID NO: 156440 - protein, 35 aa, Artificial Sequence
  Description of Artificial Sequence: Synthetic polypeptide
DEGEIRTTNPVATEQYGSVFSWPWPEDQDSTNEQA

SEQ ID NO: 156441 - protein, 34 aa, Artificial Sequence
  Description of Artificial Sequence: Synthetic polypeptide
DEEEIRTTNPVATEQYGSVYSPLDEYAEATWLEE

SEQ ID NO: 156442 - protein, 36 aa, Artificial Sequence
  Description of Artificial Sequence: Synthetic polypeptide
DEEEIRTTNPVATEQYGSVYSNPLDEYAEAFQLPEE

SEQ ID NO: 156443 - protein, 37 aa, Artificial Sequence
  Description of Artificial Sequence: Synthetic polypeptide
DEEEIRTTNPVATEQYGSVYSNMMNNLEERQLPEPFY

SEQ ID NO: 156444 - protein, 35 aa, Artificial Sequence
  Description of Artificial Sequence: Synthetic polypeptide
DEEEIRTTNPVATEQYGSVTQEMLEQGEFEQMVAE

SEQ ID NO: 156445 - protein, 38 aa, Artificial Sequence
  Description of Artificial Sequence: Synthetic polypeptide
DEEEIRTTNPVATEQYGVVSTVVVTNQQAGNQQNEEDE

SEQ ID NO: 156446 - protein, 35 aa, Artificial Sequence
  Description of Artificial Sequence: Synthetic polypeptide
DEEEIRTVNPVATEQYGQCVCSTGEHNQYFNSQQG

SEQ ID NO: 156447 - protein, 35 aa, Artificial Sequence
  Description of Artificial Sequence: Synthetic polypeptide
DEEEIRTTNPVATEQYGYSSTSVVDPGVGGGNEGQ

SEQ ID NO: 156448 - protein, 34 aa, Artificial Sequence
  Description of Artificial Sequence: Synthetic polypeptide
DEQEIATTNPVAYEQWGSVSGDNNLGDRVDNNDS

SEQ ID NO: 156449 - protein, 35 aa, Artificial Sequence
  Description of Artificial Sequence: Synthetic polypeptide
DEQEIATTNPVATEQYGSVCAAMNPLNDMDGGENN

SEQ ID NO: 156450 - protein, 33 aa, Artificial Sequence
  Description of Artificial Sequence: Synthetic polypeptide
DEHEIRTTNPVAYEQWGTISHTDNNHQREDAGP

SEQ ID NO: 156451 - protein, 38 aa, Artificial Sequence
  Description of Artificial Sequence: Synthetic polypeptide
DEEEIRTTNPVATEQYGVVSTVNNQNGNEQLGNNEQGD

SEQ ID NO: 156452 - protein, 36 aa, Artificial Sequence
  Description of Artificial Sequence: Synthetic polypeptide
DEEEIRTTNPVATEQYGSVSTPMELFMEPVSLEPDN

SEQ ID NO: 156453 - protein, 34 aa, Artificial Sequence
  Description of Artificial Sequence: Synthetic polypeptide
DEHEIRTTNPVAYEQWGTISHTDNNHQREGTGMD

SEQ ID NO: 156454 - protein, 34 aa, Artificial Sequence
  Description of Artificial Sequence: Synthetic polypeptide
DEQEIATTNPVATEQYGSVTATLDLEDHEGEEDL

SEQ ID NO: 156455 - protein, 34 aa, Artificial Sequence
  Description of Artificial Sequence: Synthetic polypeptide
DEQEIATTNPVATEQYGSVCAAMNPLNDMDINDN

SEQ ID NO: 156456 - protein, 33 aa, Artificial Sequence
  Description of Artificial Sequence: Synthetic polypeptide
DDSEVATTNPVATEGYGNVSATNTGQSRNGMQV

SEQ ID NO: 156457 - protein, 34 aa, Artificial Sequence
  Description of Artificial Sequence: Synthetic polypeptide
DEHEIRTTNPVAYECWGCVSGDNLEGDRQGDNGK

SEQ ID NO: 156458 - protein, 30 aa, Artificial Sequence
  Description of Artificial Sequence: Synthetic polypeptide
DDSEVASTNPVSTEGYGVMAASTLQRVGQR

SEQ ID NO: 156459 - protein, 33 aa, Artificial Sequence
  Description of Artificial Sequence: Synthetic polypeptide
DAEEIATTNPVGTEQWGGCCAGTNLQDDPDNRW

SEQ ID NO: 156460 - protein, 33 aa, Artificial Sequence
  Description of Artificial Sequence: Synthetic polypeptide
DEQEIATTNPVATEQYGSVTAMDLEDHFGIEDL

SEQ ID NO: 156461 - protein, 34 aa, Artificial Sequence
  Description of Artificial Sequence: Synthetic polypeptide
DEQEIATTNPVATEQYGSVCAANNGDEAGMDIDR

SEQ ID NO: 156462 - protein, 29 aa, Artificial Sequence
  Description of Artificial Sequence: Synthetic peptide
DDSEVASTNPVSTEGYGVMAANTIQRGQR

SEQ ID NO: 156463 - protein, 38 aa, Artificial Sequence
  Description of Artificial Sequence: Synthetic polypeptide
DEEEIRTTNPVATEQYGVVSTVNNQNGNQQQGTNEQGD

SEQ ID NO: 156464 - protein, 34 aa, Artificial Sequence
  Description of Artificial Sequence: Synthetic polypeptide
DEQEIATTNPVATEQYGSVCAAMNPLNDMDGGAE

SEQ ID NO: 156465 - protein, 34 aa, Artificial Sequence
  Description of Artificial Sequence: Synthetic polypeptide
DEAEISTVNPVATEQYGCVCSTEHNFYFGSDNQS

SEQ ID NO: 156466 - protein, 35 aa, Artificial Sequence
  Description of Artificial Sequence: Synthetic polypeptide
DEHEIRTTNPVAYEQWGSVTGNMNDQDERRGENQG

SEQ ID NO: 156467 - protein, 38 aa, Artificial Sequence
  Description of Artificial Sequence: Synthetic polypeptide
DEEEIRTTNPVATEQYGVVSTVNQQQGNTEQGTTNVAE

SEQ ID NO: 156468 - protein, 34 aa, Artificial Sequence
  Description of Artificial Sequence: Synthetic polypeptide
DEQEIATTNPVATEQYGSVAWTDILEDLEGDEDL

SEQ ID NO: 156469 - protein, 34 aa, Artificial Sequence
  Description of Artificial Sequence: Synthetic polypeptide
DEQEIATTNPVATEQYGSVAWTDILMEDHEGKDL

SEQ ID NO: 156470 - protein, 33 aa, Artificial Sequence
  Description of Artificial Sequence: Synthetic polypeptide
DEAEIVTTNPVANEQYGTVCSATDGPVEFEGND

SEQ ID NO: 156471 - protein, 34 aa, Artificial Sequence
  Description of Artificial Sequence: Synthetic polypeptide
DEQEIATTNPVATEQYGSVAWTDILVEDHEGDTL

SEQ ID NO: 156472 - protein, 38 aa, Artificial Sequence
  Description of Artificial Sequence: Synthetic polypeptide
DEEEIRTTNPVATEQYGVVSTVNQQQGTNNQQGTDETT

SEQ ID NO: 156473 - protein, 34 aa, Artificial Sequence
  Description of Artificial Sequence: Synthetic polypeptide
DEHEIRTTNPVAYEQWGSVSWGNDNNDQGGGHGE

SEQ ID NO: 156474 - protein, 35 aa, Artificial Sequence
  Description of Artificial Sequence: Synthetic polypeptide
DEQEIATTNPVATEQYGSVCAADNGDEQGMDINTR

SEQ ID NO: 156475 - protein, 35 aa, Artificial Sequence
  Description of Artificial Sequence: Synthetic polypeptide
DEQEIATTNPVATEQYGSVVSCTDALSEDHTGEDL

SEQ ID NO: 156476 - protein, 34 aa, Artificial Sequence
  Description of Artificial Sequence: Synthetic polypeptide
DEQEIATTNPVATEQYGSVCAADNHGQDSDIDRV

SEQ ID NO: 156477 - protein, 30 aa, Artificial Sequence
  Description of Artificial Sequence: Synthetic polypeptide
DDSEVASTNPVSTEGYGVVAADTLQSRGQR

SEQ ID NO: 156478 - protein, 35 aa, Artificial Sequence
  Description of Artificial Sequence: Synthetic polypeptide
DEQEIRTTNPVATEQYGVVSCVVDLNTPNSQIDEQ

SEQ ID NO: 156479 - protein, 34 aa, Artificial Sequence
  Description of Artificial Sequence: Synthetic polypeptide
DEQEIATTNPVATEQYGSVCAAMHGQAMAPNDRP

SEQ ID NO: 156480 - protein, 32 aa, Artificial Sequence
  Description of Artificial Sequence: Synthetic polypeptide
DEHEIRTTNPVAYEQWGSVTGGNMGDLGGDGH

SEQ ID NO: 156481 - protein, 35 aa, Artificial Sequence
  Description of Artificial Sequence: Synthetic polypeptide
DEIEIRTTNPVATECWGESVTSPINEPHERVGENG

SEQ ID NO: 156482 - protein, 35 aa, Artificial Sequence
  Description of Artificial Sequence: Synthetic polypeptide
DEQEIATTNPVATEQYGSVCAAMNHLQAMAPNQDP

SEQ ID NO: 156483 - protein, 34 aa, Artificial Sequence
  Description of Artificial Sequence: Synthetic polypeptide
DEHEIRTTNPVAYECWGCVSGGGNMGNQRGEGNM

SEQ ID NO: 156484 - protein, 34 aa, Artificial Sequence
  Description of Artificial Sequence: Synthetic polypeptide
DEQEIATTNPVATEQYGSVAWTDILEDHQGMDDL

SEQ ID NO: 156485 - protein, 32 aa, Artificial Sequence
  Description of Artificial Sequence: Synthetic polypeptide
DEAEIRTTNPVSTEPYGTISMEGIQQQQNGNH

SEQ ID NO: 156486 - protein, 38 aa, Artificial Sequence
  Description of Artificial Sequence: Synthetic polypeptide
DEEEIRTTNPVATEQYGVVSTVVNDQQGNNQQNETEDT

SEQ ID NO: 156487 - protein, 34 aa, Artificial Sequence
  Description of Artificial Sequence: Synthetic polypeptide
DEEEIRTTNPVCTEHYGCVCSWPELQEYFGSDQS

SEQ ID NO: 156488 - protein, 34 aa, Artificial Sequence
  Description of Artificial Sequence: Synthetic polypeptide
DEQEIATTNPVATEQYGSVCAATAQLDAAENGGE

SEQ ID NO: 156489 - protein, 38 aa, Artificial Sequence
  Description of Artificial Sequence: Synthetic polypeptide
DEEEIRTTNPVATEQYGVVSTVVNDQAGNQAGTEEGSE

SEQ ID NO: 156490 - protein, 34 aa, Artificial Sequence
  Description of Artificial Sequence: Synthetic polypeptide
DEEEIRTTNPVCTEHYGCVCSWPELNQENFGSDQ

SEQ ID NO: 156491 - protein, 36 aa, Artificial Sequence
  Description of Artificial Sequence: Synthetic polypeptide
DEMEIATTNPVAYEQYGTVCSYTDGPNEMQHGNTDR

SEQ ID NO: 156492 - protein, 35 aa, Artificial Sequence
  Description of Artificial Sequence: Synthetic polypeptide
DEQEIRTTNPVATEQYGSVVEAPTMMEQAEYGEEV

SEQ ID NO: 156493 - protein, 34 aa, Artificial Sequence
  Description of Artificial Sequence: Synthetic polypeptide
DEMEIATTNPVAYEQYGTVCSYTDGPDEQEGNND

SEQ ID NO: 156494 - protein, 32 aa, Artificial Sequence
  Description of Artificial Sequence: Synthetic polypeptide
DDSEVATTNPVATEGYGNVSCITIQSRVGEQR

SEQ ID NO: 156495 - protein, 38 aa, Artificial Sequence
  Description of Artificial Sequence: Synthetic polypeptide
DEEEIRTTNPVATEQYGVVSTVVNDQAGNQAGTEAGED

SEQ ID NO: 156496 - protein, 34 aa, Artificial Sequence
  Description of Artificial Sequence: Synthetic polypeptide
DEEEIRTTNPVSTEAYGSVNTFTAHLTQTEQQTK

SEQ ID NO: 156497 - protein, 35 aa, Artificial Sequence
  Description of Artificial Sequence: Synthetic polypeptide
DEQEIKTTNPVATEQYGSVSATDEGEDQEGQEDGD

SEQ ID NO: 156498 - protein, 35 aa, Artificial Sequence
  Description of Artificial Sequence: Synthetic polypeptide
DEMEIATTNPVAYEQYGTVCSYTDGNNDERGEGND

SEQ ID NO: 156499 - protein, 33 aa, Artificial Sequence
  Description of Artificial Sequence: Synthetic polypeptide
DAEEIATTNPVAYEQYGSTTAGTNDTAEGGNDE

SEQ ID NO: 156500 - protein, 29 aa, Artificial Sequence
  Description of Artificial Sequence: Synthetic peptide
DDSEVASTNPVSTEGYGDVAECIQRVGQR

SEQ ID NO: 156501 - protein, 35 aa, Artificial Sequence
  Description of Artificial Sequence: Synthetic polypeptide
DEQEIKTTNPVATEQYGSVSATGDGEDQEDEGDGD

SEQ ID NO: 156502 - protein, 38 aa, Artificial Sequence
  Description of Artificial Sequence: Synthetic polypeptide
DEEEIRTTNPVATEQYGVVSTNQNQAGNNNNQQGTEDE

SEQ ID NO: 156503 - protein, 32 aa, Artificial Sequence
  Description of Artificial Sequence: Synthetic polypeptide
DEAEIRTTNPVSTEPYGTISMEDIQQQWNGNH

SEQ ID NO: 156504 - protein, 33 aa, Artificial Sequence
  Description of Artificial Sequence: Synthetic polypeptide
DEAEIATTNPVATEQYGSVCAAMHLQAMPDDHP

SEQ ID NO: 156505 - protein, 34 aa, Artificial Sequence
  Description of Artificial Sequence: Synthetic polypeptide
DEMEIATTNPVAYEQYGTVCSYTDGPVDQDGNTD

SEQ ID NO: 156506 - protein, 32 aa, Artificial Sequence
  Description of Artificial Sequence: Synthetic polypeptide
DEMEIRTTNPVATEGYGCICSWETQNFGSDQS

SEQ ID NO: 156507 - protein, 33 aa, Artificial Sequence
  Description of Artificial Sequence: Synthetic polypeptide
DEMEIATTNPVAYEQYGTVCSYTDIPVEKEGNE

SEQ ID NO: 156508 - protein, 34 aa, Artificial Sequence
  Description of Artificial Sequence: Synthetic polypeptide
DEQEIRTTNPVATEQYGSVYVPPDLNDENPNEHM

SEQ ID NO: 156509 - protein, 38 aa, Artificial Sequence
  Description of Artificial Sequence: Synthetic polypeptide
DEEEIRTTNPVATEQYGVVSTVVNDQQGNNQQGTTEES

SEQ ID NO: 156510 - protein, 31 aa, Artificial Sequence
  Description of Artificial Sequence: Synthetic polypeptide
DDSEVASTNPVSTEGYGDVAANTLQSRVGQR

SEQ ID NO: 156511 - protein, 35 aa, Artificial Sequence
  Description of Artificial Sequence: Synthetic polypeptide
DEQEIHTTNPVATEQYGSVSATGDGEDQEGEGGGQ

SEQ ID NO: 156512 - protein, 36 aa, Artificial Sequence
  Description of Artificial Sequence: Synthetic polypeptide
DEHEIRTTNPVATEQYGSVTSALDELQWAEGGDEPL

SEQ ID NO: 156513 - protein, 36 aa, Artificial Sequence
  Description of Artificial Sequence: Synthetic polypeptide
DEAEIRTTNPVATEQYGSVWSITMWGDSQQEGGEEH

SEQ ID NO: 156514 - protein, 33 aa, Artificial Sequence
  Description of Artificial Sequence: Synthetic polypeptide
DEMEIATTNPVAYEQYGTVCSYTDIPMEEEGND

SEQ ID NO: 156515 - protein, 32 aa, Artificial Sequence
  Description of Artificial Sequence: Synthetic polypeptide
DEAEIRTTNPVSTEPYGTISMEDIQQQQNGNH

SEQ ID NO: 156516 - protein, 36 aa, Artificial Sequence
  Description of Artificial Sequence: Synthetic polypeptide
DEQEIRTTNPVATEQYGSVWTVLDANEIEGMQNGQT

SEQ ID NO: 156517 - protein, 30 aa, Artificial Sequence
  Description of Artificial Sequence: Synthetic polypeptide
DDSEVASTNPVSTEGYGTVANTIQSRVGNR

SEQ ID NO: 156518 - protein, 37 aa, Artificial Sequence
  Description of Artificial Sequence: Synthetic polypeptide
DEEEIRTTNPVATEQYGVVSTVVNDQAGTEDEEEEED

SEQ ID NO: 156519 - protein, 32 aa, Artificial Sequence
  Description of Artificial Sequence: Synthetic polypeptide
DEAEIRTTNPVSTEPYGTCSMEDIQQNQNGNH

SEQ ID NO: 156520 - protein, 32 aa, Artificial Sequence
  Description of Artificial Sequence: Synthetic polypeptide
DEAEIRTTNPVSTEPYGRISMEDIQQQQNGNH

SEQ ID NO: 156521 - protein, 31 aa, Artificial Sequence
  Description of Artificial Sequence: Synthetic polypeptide
DDSEVASTNPVSTEGYGTVANTIQQSRVGNR

SEQ ID NO: 156522 - protein, 33 aa, Artificial Sequence
  Description of Artificial Sequence: Synthetic polypeptide
DEEEIRTTNPVSTEAYGSVSMVETAQDTELEMD

SEQ ID NO: 156523 - protein, 34 aa, Artificial Sequence
  Description of Artificial Sequence: Synthetic polypeptide
DEQEIATTNPVATEQYGSVAWTDILEDHEGRTDM

SEQ ID NO: 156524 - protein, 30 aa, Artificial Sequence
  Description of Artificial Sequence: Synthetic polypeptide
DEAEIVTTNPVATEQWGDVSEIEMNAAEDA

SEQ ID NO: 156525 - protein, 36 aa, Artificial Sequence
  Description of Artificial Sequence: Synthetic polypeptide
DEEEIRTTNPVAYEQYGQSVEPVTNGYLMMRTVEQT

SEQ ID NO: 156526 - protein, 38 aa, Artificial Sequence
  Description of Artificial Sequence: Synthetic polypeptide
DEEEIRTTNPVATEQYGVVSTVNNNQQNQQGNNNNNNE

SEQ ID NO: 156527 - protein, 34 aa, Artificial Sequence
  Description of Artificial Sequence: Synthetic polypeptide
DEQEICTTNPVATEQYGSVTATWDHLEPHEGEDT

SEQ ID NO: 156528 - protein, 39 aa, Artificial Sequence
  Description of Artificial Sequence: Synthetic polypeptide
DEEEIRTTNPVATEQYGVVSTTVNNQQQLQQGNNTNNTE

SEQ ID NO: 156529 - protein, 37 aa, Artificial Sequence
  Description of Artificial Sequence: Synthetic polypeptide
DEEEIRTTNPVGTEQYGSVVSTTPDGPNMGEGENDGT

SEQ ID NO: 156530 - protein, 38 aa, Artificial Sequence
  Description of Artificial Sequence: Synthetic polypeptide
DEEEIRTTNPVATEQYGVVSTTVNNQQQQNGNNQGTED

SEQ ID NO: 156531 - protein, 30 aa, Artificial Sequence
  Description of Artificial Sequence: Synthetic polypeptide
DEMEIATTNPVGTEQYGVMAASDTPEFGDD

SEQ ID NO: 156532 - protein, 35 aa, Artificial Sequence
  Description of Artificial Sequence: Synthetic polypeptide
DEEEIRTTNPVAYEQYGQCVCSTEDHNQEYFNSEQ

SEQ ID NO: 156533 - protein, 38 aa, Artificial Sequence
  Description of Artificial Sequence: Synthetic polypeptide
DEEEIRTTNPVATEQYGSVSTTVNNQAGTEQGTEETTE

SEQ ID NO: 156534 - protein, 35 aa, Artificial Sequence
  Description of Artificial Sequence: Synthetic polypeptide
DEQEIATTNPVATEQYGTTVSCTGLSEPHEGGENF

SEQ ID NO: 156535 - protein, 28 aa, Artificial Sequence
  Description of Artificial Sequence: Synthetic peptide
CEEEICTTNPVAYEQWGEAYYVEQHEQG

SEQ ID NO: 156536 - protein, 33 aa, Artificial Sequence
  Description of Artificial Sequence: Synthetic polypeptide
DEHEIRTTNPVAYECWGSVCYNNEDQHHGGDNA

SEQ ID NO: 156537 - protein, 30 aa, Artificial Sequence
  Description of Artificial Sequence: Synthetic polypeptide
DDSEVASTNPVSTEGYGVVAANTIQRVGQR

SEQ ID NO: 156538 - protein, 34 aa, Artificial Sequence
  Description of Artificial Sequence: Synthetic polypeptide
CEEEIATVNPVATEQYGCVAGTGLQSRANEQGEN

SEQ ID NO: 156539 - protein, 38 aa, Artificial Sequence
  Description of Artificial Sequence: Synthetic polypeptide
DEEEIRTTNPVATEQYGVVSTTVNQLQQGTEAGTEEQE

SEQ ID NO: 156540 - protein, 33 aa, Artificial Sequence
  Description of Artificial Sequence: Synthetic polypeptide
DEMEIRTTNPVATECYGTVWSAADGPVAFKGND

SEQ ID NO: 156541 - protein, 33 aa, Artificial Sequence
  Description of Artificial Sequence: Synthetic polypeptide
DEQEIATTNPVATEQYGTISATEDLEDHEGEDL

SEQ ID NO: 156542 - protein, 33 aa, Artificial Sequence
  Description of Artificial Sequence: Synthetic polypeptide
DEQEIATTNPVATEQYGSVAATEDWEEHEGEDL

SEQ ID NO: 156543 - protein, 35 aa, Artificial Sequence
  Description of Artificial Sequence: Synthetic polypeptide
DEEEIRTTNPVAYEQYGQCVCSSGNDHNQNGSEQA

SEQ ID NO: 156544 - protein, 33 aa, Artificial Sequence
  Description of Artificial Sequence: Synthetic polypeptide
DEQEIATTNPVATEQYGSVAATEDWEEHEGEDI

SEQ ID NO: 156545 - protein, 34 aa, Artificial Sequence
  Description of Artificial Sequence: Synthetic polypeptide
DEHEIRTTNPVATEQYGSVSVFTMEETIEELEIP

SEQ ID NO: 156546 - protein, 35 aa, Artificial Sequence
  Description of Artificial Sequence: Synthetic polypeptide
DEQEIRTTNPVAYEQYGKTVSCTNAFDTRTMDNQL

SEQ ID NO: 156547 - protein, 38 aa, Artificial Sequence
  Description of Artificial Sequence: Synthetic polypeptide
DEEEIRTTNPVATEQYGVVSTTVNNLQQGTEQGTTDTE

SEQ ID NO: 156548 - protein, 35 aa, Artificial Sequence
  Description of Artificial Sequence: Synthetic polypeptide
DEEEIRTTNPVAYEQYGQCVCSSGEDLNQGFGSQQ

SEQ ID NO: 156549 - protein, 38 aa, Artificial Sequence
  Description of Artificial Sequence: Synthetic polypeptide
DEIEIRTTNPVATEQYGSVSSTTPANGPNMRNGMNPVK

SEQ ID NO: 156550 - protein, 37 aa, Artificial Sequence
  Description of Artificial Sequence: Synthetic polypeptide
DEEEIRTTNPVATEQYGVVSTVVNGNQQQGEETEEED

SEQ ID NO: 156551 - protein, 36 aa, Artificial Sequence
  Description of Artificial Sequence: Synthetic polypeptide
DEMEIRTTNPVATEQYGSTYSTDTMNQDTMTEELNR

SEQ ID NO: 156552 - protein, 34 aa, Artificial Sequence
  Description of Artificial Sequence: Synthetic polypeptide
DEMEIRTTNPVATECYGTVCSTIGEPEDFEGENG

SEQ ID NO: 156553 - protein, 31 aa, Artificial Sequence
  Description of Artificial Sequence: Synthetic polypeptide
DDSEVASTNPVSTEGYGNVAANLIQSRVGQR

SEQ ID NO: 156554 - protein, 31 aa, Artificial Sequence
  Description of Artificial Sequence: Synthetic polypeptide
DDSEVASTNPVSTEGYGNVAANLFQSRVGQR

SEQ ID NO: 156555 - protein, 34 aa, Artificial Sequence
  Description of Artificial Sequence: Synthetic polypeptide
DEMEIRTTNPVATECYGTVCSTIGPPEDFEGEND

SEQ ID NO: 156556 - protein, 35 aa, Artificial Sequence
  Description of Artificial Sequence: Synthetic polypeptide
DEEEIRTTNPVAYEQYGQCVCSSGNDDNQNGSDQM

SEQ ID NO: 156557 - protein, 34 aa, Artificial Sequence
  Description of Artificial Sequence: Synthetic polypeptide
DEMEIRTTNPVATECYGTVCSTIGPVEDFEGEND

SEQ ID NO: 156558 - protein, 38 aa, Artificial Sequence
  Description of Artificial Sequence: Synthetic polypeptide
DEEEIRTTNPVATEQYGVVSTTVNNQQQGNQQGTEDED

SEQ ID NO: 156559 - protein, 35 aa, Artificial Sequence
  Description of Artificial Sequence: Synthetic polypeptide
DEEEIRTTNPVSTEQYGSVTPWNNLGEQQVMQVQL

SEQ ID NO: 156560 - protein, 37 aa, Artificial Sequence
  Description of Artificial Sequence: Synthetic polypeptide
DEEEIRTTNPVATEQYGVVSTVNNQAGTEQGGTEDEE

SEQ ID NO: 156561 - protein, 33 aa, Artificial Sequence
  Description of Artificial Sequence: Synthetic polypeptide
DEQEIATTNPVATEQYGTISATEDIEDQEGEDL

SEQ ID NO: 156562 - protein, 36 aa, Artificial Sequence
  Description of Artificial Sequence: Synthetic polypeptide
DEQEIRTTNPVAWEQYGSVSSTTPAGPNMRNGMNPV

SEQ ID NO: 156563 - protein, 34 aa, Artificial Sequence
  Description of Artificial Sequence: Synthetic polypeptide
DEQEICTTNPVAYEQWGSVTGGNGNSQGNMGNDR

SEQ ID NO: 156564 - protein, 36 aa, Artificial Sequence
  Description of Artificial Sequence: Synthetic polypeptide
DEEEIRTTNPVAYEQYGSVCAAANVLMQEAAHANDS

SEQ ID NO: 156565 - protein, 35 aa, Artificial Sequence
  Description of Artificial Sequence: Synthetic polypeptide
DEEEIRTTNPVAYEQYGSVCAAANVLQEAQAADDS

SEQ ID NO: 156566 - protein, 33 aa, Artificial Sequence
  Description of Artificial Sequence: Synthetic polypeptide
DEAEISTTNPVATEQYGCVCSWNDDAYFGSDQS

SEQ ID NO: 156567 - protein, 35 aa, Artificial Sequence
  Description of Artificial Sequence: Synthetic polypeptide
DEIEIRTTNPVATECWGWSVSCIHEPQGREGENGT

SEQ ID NO: 156568 - protein, 30 aa, Artificial Sequence
  Description of Artificial Sequence: Synthetic polypeptide
DDSEVASTNPVSTEGYGVVAANNLQRVGQQ

SEQ ID NO: 156569 - protein, 35 aa, Artificial Sequence
  Description of Artificial Sequence: Synthetic polypeptide
CEEEIACTNPVATEQYGSVAITNHDENGMPGENDR

SEQ ID NO: 156570 - protein, 33 aa, Artificial Sequence
  Description of Artificial Sequence: Synthetic polypeptide
DEAEISTTNPVATEQYGCVCSWNHNAYFNSDQS

SEQ ID NO: 156571 - protein, 31 aa, Artificial Sequence
  Description of Artificial Sequence: Synthetic polypeptide
DAEEIATTNPVGTEQWGGCCATNLQDDPDPW

SEQ ID NO: 156572 - protein, 34 aa, Artificial Sequence
  Description of Artificial Sequence: Synthetic polypeptide
DEAEIVTTNPVATEQYGTVCSATDGPSEAEGGND

SEQ ID NO: 156573 - protein, 37 aa, Artificial Sequence
  Description of Artificial Sequence: Synthetic polypeptide
DEEEIRTTNPVATEQYGVVSTVNQQQNQNQGTTEEEE

SEQ ID NO: 156574 - protein, 37 aa, Artificial Sequence
  Description of Artificial Sequence: Synthetic polypeptide
DEEEIRTTNPVATEQYGVVSTVNQQQNNQQGTEDGED

SEQ ID NO: 156575 - protein, 38 aa, Artificial Sequence
  Description of Artificial Sequence: Synthetic polypeptide
DEEEIRTTNPVATEQYGVVSTNNQQQGNNNNEQGEEDQ

SEQ ID NO: 156576 - protein, 36 aa, Artificial Sequence
  Description of Artificial Sequence: Synthetic polypeptide
DEAEIATTNPVATEQYGSVCAAMNHLQAMAPDNDRM

SEQ ID NO: 156577 - protein, 38 aa, Artificial Sequence
  Description of Artificial Sequence: Synthetic polypeptide
DEEEIRTTNPVATEQYGVVSTVNNNQQQQQGTNNTEEA

SEQ ID NO: 156578 - protein, 33 aa, Artificial Sequence
  Description of Artificial Sequence: Synthetic polypeptide
DEMEIRTTNPVATEQYGSLSCVDIQQAETFDVN

SEQ ID NO: 156579 - protein, 29 aa, Artificial Sequence
  Description of Artificial Sequence: Synthetic peptide
DEMEIATTNPVGTEGYGVMAASTPEHGDD

SEQ ID NO: 156580 - protein, 33 aa, Artificial Sequence
  Description of Artificial Sequence: Synthetic polypeptide
DEMEIRTTNPVATEQYGSLSWDVDQQAETFDVN

SEQ ID NO: 156581 - protein, 38 aa, Artificial Sequence
  Description of Artificial Sequence: Synthetic polypeptide
DEEEIRTTNPVATEQYGVVSTVNNNQQQGNQQGTNEDE

SEQ ID NO: 156582 - protein, 34 aa, Artificial Sequence
  Description of Artificial Sequence: Synthetic polypeptide
DEQEICTTNPVAYEQWGSVCSTIDDHHQMGGNGP

SEQ ID NO: 156583 - protein, 34 aa, Artificial Sequence
  Description of Artificial Sequence: Synthetic polypeptide
DEQEIRTTNPVAWEQWGTVSCWNISQTAGGNNSF

SEQ ID NO: 156584 - protein, 36 aa, Artificial Sequence
  Description of Artificial Sequence: Synthetic polypeptide
DEIEIRTTNPVATEQYGSVCTPMCTLETGYMEDMND

SEQ ID NO: 156585 - protein, 34 aa, Artificial Sequence
  Description of Artificial Sequence: Synthetic polypeptide
DEAEIVTTNPVATEQYGTVCSCTDGPSEFEGNYD

SEQ ID NO: 156586 - protein, 38 aa, Artificial Sequence
  Description of Artificial Sequence: Synthetic polypeptide
DEEEIRTTNPVATEQYGVVSTVTNQGQQGNQQGTTEDE

SEQ ID NO: 156587 - protein, 36 aa, Artificial Sequence
  Description of Artificial Sequence: Synthetic polypeptide
DEEEIRTTNPVGTEWYGSVSSTTPAGPNMRNGMNPV

SEQ ID NO: 156588 - protein, 38 aa, Artificial Sequence
  Description of Artificial Sequence: Synthetic polypeptide
DEEEIRTTNPVATEQYGVVSTVVNDQQGNQQNTTNVAE

SEQ ID NO: 156589 - protein, 31 aa, Artificial Sequence
  Description of Artificial Sequence: Synthetic polypeptide
DEQEICTTNPVAYEQWGSVGWIEDLQAMDAS

SEQ ID NO: 156590 - protein, 34 aa, Artificial Sequence
  Description of Artificial Sequence: Synthetic polypeptide
DEEEIRTTNPVAYEQYGSVCAAANGLDSEHVDDE

SEQ ID NO: 156591 - protein, 32 aa, Artificial Sequence
  Description of Artificial Sequence: Synthetic polypeptide
DEMEIATTNPVCTEQYGVVCSADDGPVESGNQ

SEQ ID NO: 156592 - protein, 31 aa, Artificial Sequence
  Description of Artificial Sequence: Synthetic polypeptide
DDSEVASTNPVSTEGYGCVGTNTIQNRVGQR

SEQ ID NO: 156593 - protein, 31 aa, Artificial Sequence
  Description of Artificial Sequence: Synthetic polypeptide
DDSEVASTNPVSTEGYGNVAANTIQSRVGNR

SEQ ID NO: 156594 - protein, 37 aa, Artificial Sequence
  Description of Artificial Sequence: Synthetic polypeptide
DEEEIRTTNPVATEQYGVVSTVNQQQQQNGTEETTTE

SEQ ID NO: 156595 - protein, 36 aa, Artificial Sequence
  Description of Artificial Sequence: Synthetic polypeptide
DEEEIRTTNPVAYEQYGQCVCSTENDHNQSFGSEQA

SEQ ID NO: 156596 - protein, 31 aa, Artificial Sequence
  Description of Artificial Sequence: Synthetic polypeptide
DEIEIRTTNPVATEQWGDVSKEIEMNAAEDA

SEQ ID NO: 156597 - protein, 36 aa, Artificial Sequence
  Description of Artificial Sequence: Synthetic polypeptide
DEEEIRTTNPVAYEQYGSVCAAANVDLDQMAEANDS

SEQ ID NO: 156598 - protein, 33 aa, Artificial Sequence
  Description of Artificial Sequence: Synthetic polypeptide
DEMEIRTTNPVATEPYGTISAMEDIQEQQNGNH

SEQ ID NO: 156599 - protein, 34 aa, Artificial Sequence
  Description of Artificial Sequence: Synthetic polypeptide
DEEEIRTTNPVSTEAYGSVSTFFWHETQTEQQTK

SEQ ID NO: 156600 - protein, 33 aa, Artificial Sequence
  Description of Artificial Sequence: Synthetic polypeptide
DEMEIRTTNPVATEPYGTISAMEDIVEQQNGNH

SEQ ID NO: 156601 - protein, 37 aa, Artificial Sequence
  Description of Artificial Sequence: Synthetic polypeptide
DEEEIRTTNPVAYEQYGSVPSCTPAGPNARTGGNPVC

SEQ ID NO: 156602 - protein, 34 aa, Artificial Sequence
  Description of Artificial Sequence: Synthetic polypeptide
DEAEIRTTNPVAYEQYGTVATMNGGNGNGQTGEA

SEQ ID NO: 156603 - protein, 36 aa, Artificial Sequence
  Description of Artificial Sequence: Synthetic polypeptide
DEQEIRTTNPVATEQYGSVSVDVNTLWVAEGGEEHT

SEQ ID NO: 156604 - protein, 35 aa, Artificial Sequence
  Description of Artificial Sequence: Synthetic polypeptide
DEAEIRTTNPVATEQYGSVWWTPVMQQIGMGQEFE

SEQ ID NO: 156605 - protein, 29 aa, Artificial Sequence
  Description of Artificial Sequence: Synthetic peptide
DDSEVATTNPVSTEGYGEVPAEVCQHGQR

SEQ ID NO: 156606 - protein, 37 aa, Artificial Sequence
  Description of Artificial Sequence: Synthetic polypeptide
DEQEIRTTNPVATEQYGSVSTVLDANEIPEGMQHGQI

SEQ ID NO: 156607 - protein, 34 aa, Artificial Sequence
  Description of Artificial Sequence: Synthetic polypeptide
DEAEIRTTNPVAYEQYGSVQCTRASSNNGGNNET

SEQ ID NO: 156608 - protein, 37 aa, Artificial Sequence
  Description of Artificial Sequence: Synthetic polypeptide
DEEEIRTTNPVATEQYGVVSTNVATEQYGSVTQDTQE

SEQ ID NO: 156609 - protein, 31 aa, Artificial Sequence
  Description of Artificial Sequence: Synthetic polypeptide
DDSEVASTNPVSTEGYGNVSMTIQQSRVGQR

SEQ ID NO: 156610 - protein, 38 aa, Artificial Sequence
  Description of Artificial Sequence: Synthetic polypeptide
DEEEIRTTNPVATEQYGVVSTNVATEQYGVNTTQQQQD

SEQ ID NO: 156611 - protein, 33 aa, Artificial Sequence
  Description of Artificial Sequence: Synthetic polypeptide
DEMEIATTNPVAYEQYGTVCSWTDGPDEHEGNM

SEQ ID NO: 156612 - protein, 33 aa, Artificial Sequence
  Description of Artificial Sequence: Synthetic polypeptide
DEMEIATTNPVAYEQYGTVCSITDGVVEHEGND

SEQ ID NO: 156613 - protein, 31 aa, Artificial Sequence
  Description of Artificial Sequence: Synthetic polypeptide
DDSEVASTNPVSTEGYGNVSATTIQSRVGQR

SEQ ID NO: 156614 - protein, 34 aa, Artificial Sequence
  Description of Artificial Sequence: Synthetic polypeptide
DEMEIRTTNPVATEQYGSCSSTYGLEISTEQPQE

SEQ ID NO: 156615 - protein, 36 aa, Artificial Sequence
  Description of Artificial Sequence: Synthetic polypeptide
DEEEIRTTNPVATEQYGSVSTNMEMFMEPVSEEPDS

SEQ ID NO: 156616 - protein, 34 aa, Artificial Sequence
  Description of Artificial Sequence: Synthetic polypeptide
DEAEIRTTNPVAYEQYGTVCQTNDLHDHGGGQDN

SEQ ID NO: 156617 - protein, 32 aa, Artificial Sequence
  Description of Artificial Sequence: Synthetic polypeptide
DEMEIRTTNPVATEQWGDVSAEDIEMNAAEDA

SEQ ID NO: 156618 - protein, 35 aa, Artificial Sequence
  Description of Artificial Sequence: Synthetic polypeptide
CEEEIATTNPVATEQWGTSQSLPNMLGQHQDDNRN

SEQ ID NO: 156619 - protein, 31 aa, Artificial Sequence
  Description of Artificial Sequence: Synthetic polypeptide
CEEEIATTNPVATEQYGCAPMHGLDSEGEKH

SEQ ID NO: 156620 - protein, 38 aa, Artificial Sequence
  Description of Artificial Sequence: Synthetic polypeptide
DEEEIRTTNPVATEQYGSVSTTTQALGNNNENGTNNVN

SEQ ID NO: 156621 - protein, 35 aa, Artificial Sequence
  Description of Artificial Sequence: Synthetic polypeptide
CEEEIATTNPVATEQYGCNVATNNDENGMPMENDR

SEQ ID NO: 156622 - protein, 37 aa, Artificial Sequence
  Description of Artificial Sequence: Synthetic polypeptide
DEEEIRTTNPVATEQYGVVSTNVATEQLGSTDEQQED

SEQ ID NO: 156623 - protein, 34 aa, Artificial Sequence
  Description of Artificial Sequence: Synthetic polypeptide
DEQEIATTNPVATEQYGSVHSATDSEDHEGCEDL

SEQ ID NO: 156624 - protein, 34 aa, Artificial Sequence
  Description of Artificial Sequence: Synthetic polypeptide
CEEEIATTNPVATEQYGCIAGNNGLTQPDNQGRD

SEQ ID NO: 156625 - protein, 35 aa, Artificial Sequence
  Description of Artificial Sequence: Synthetic polypeptide
DEEEIRTTNPVSTEAYGSVTTFNHLTQTNEDQQTK

SEQ ID NO: 156626 - protein, 34 aa, Artificial Sequence
  Description of Artificial Sequence: Synthetic polypeptide
DEIAEIATTNPVAYEQWGSVAWNLDDQGQGDDER

SEQ ID NO: 156627 - protein, 31 aa, Artificial Sequence
  Description of Artificial Sequence: Synthetic polypeptide
DDSEVATTNPVSTEGWGSVANTIPQSRVGQR

SEQ ID NO: 156628 - protein, 40 aa, Artificial Sequence
  Description of Artificial Sequence: Synthetic polypeptide
DEEEIRTTNPVATEQYGSVSTTTNNNQNLNQAGTEQGNTD

SEQ ID NO: 156629 - protein, 37 aa, Artificial Sequence
  Description of Artificial Sequence: Synthetic polypeptide
DEEEIRTTNPVATEQYGVVSTNVATEQYGSTDQQQQD

SEQ ID NO: 156630 - protein, 33 aa, Artificial Sequence
  Description of Artificial Sequence: Synthetic polypeptide
DEIAEIATTNPVAYEQWGSVAWIDDQGQGDNNR

SEQ ID NO: 156631 - protein, 39 aa, Artificial Sequence
  Description of Artificial Sequence: Synthetic polypeptide
DEEEIRTTNPVATEQYGSVSTTSVNNQISTTEQGTNQGS

SEQ ID NO: 156632 - protein, 33 aa, Artificial Sequence
  Description of Artificial Sequence: Synthetic polypeptide
DEQEIATTNPVATEQYGSVSAADYEDHEGIEDL

SEQ ID NO: 156633 - protein, 32 aa, Artificial Sequence
  Description of Artificial Sequence: Synthetic polypeptide
DEEEIRTTNPVCTECWGATVSNDEDLAESGPI

SEQ ID NO: 156634 - protein, 33 aa, Artificial Sequence
  Description of Artificial Sequence: Synthetic polypeptide
DEIAEIATTNPVAYEQWGSVAITGNDHQMNGHT

SEQ ID NO: 156635 - protein, 38 aa, Artificial Sequence
  Description of Artificial Sequence: Synthetic polypeptide
DEEEIRTTNPVATEQYGSVSTTQQLQAGTEEGTEGGSE

SEQ ID NO: 156636 - protein, 33 aa, Artificial Sequence
  Description of Artificial Sequence: Synthetic polypeptide
DEEEIRTTNPVSTEAYGSVTFPHLTQTNEQQTK

SEQ ID NO: 156637 - protein, 34 aa, Artificial Sequence
  Description of Artificial Sequence: Synthetic polypeptide
DEAEIRTTNPVATEQYGSVWWWVDVTQESNQNDN

SEQ ID NO: 156638 - protein, 35 aa, Artificial Sequence
  Description of Artificial Sequence: Synthetic polypeptide
DEAEIRTTNPVATEQYGSVYENMWDFTGFNENDED

SEQ ID NO: 156639 - protein, 37 aa, Artificial Sequence
  Description of Artificial Sequence: Synthetic polypeptide
DEAEIRTTNPVATEQYGSWETPDANLNVARGFNESQQ

SEQ ID NO: 156640 - protein, 36 aa, Artificial Sequence
  Description of Artificial Sequence: Synthetic polypeptide
DEAEIRTTNPVATEQYGSWTSPNVVLQTISPNELHQ

SEQ ID NO: 156641 - protein, 38 aa, Artificial Sequence
  Description of Artificial Sequence: Synthetic polypeptide
DEEEIRTTNPVATEQYGSVSTTNTTNANEQGTTEQGSE

SEQ ID NO: 156642 - protein, 35 aa, Artificial Sequence
  Description of Artificial Sequence: Synthetic polypeptide
DEMEIRTTNPVATEQYGSASDVWQDHNNQDGQEMI

SEQ ID NO: 156643 - protein, 39 aa, Artificial Sequence
  Description of Artificial Sequence: Synthetic polypeptide
DEEEIRTTNPVATEQYGSVSTTNTNNQNNEQGNNNNTTD

SEQ ID NO: 156644 - protein, 33 aa, Artificial Sequence
  Description of Artificial Sequence: Synthetic polypeptide
DEMCIVTTNPVATEQYGTVCSATDGPVEFEGND

SEQ ID NO: 156645 - protein, 33 aa, Artificial Sequence
  Description of Artificial Sequence: Synthetic polypeptide
DEMCIVTTNPVATEQYGTVCSATIGPVEFEGND

SEQ ID NO: 156646 - protein, 33 aa, Artificial Sequence
  Description of Artificial Sequence: Synthetic polypeptide
DEMCIVTTNPVATEQYGTVCSATWGPVEFEGND

SEQ ID NO: 156647 - protein, 32 aa, Artificial Sequence
  Description of Artificial Sequence: Synthetic polypeptide
DEMEIRTTNPVATEQWGDVSAEIEMNAAEDGA

SEQ ID NO: 156648 - protein, 33 aa, Artificial Sequence
  Description of Artificial Sequence: Synthetic polypeptide
DEMCIVTTNPVATEQYGTVYSATDGPVEFEGND

SEQ ID NO: 156649 - protein, 38 aa, Artificial Sequence
  Description of Artificial Sequence: Synthetic polypeptide
DEEEIRTTNPVATEQYGVVSTVNNQQNQQQGNNDEQDE

SEQ ID NO: 156650 - protein, 33 aa, Artificial Sequence
  Description of Artificial Sequence: Synthetic polypeptide
DEMEIATTNPVAYEQYGTVCSATDGPDEFGDND

SEQ ID NO: 156651 - protein, 33 aa, Artificial Sequence
  Description of Artificial Sequence: Synthetic polypeptide
DEMEIATTNPVAYEQYGTVCSATDGPDEFEGNW

SEQ ID NO: 156652 - protein, 34 aa, Artificial Sequence
  Description of Artificial Sequence: Synthetic polypeptide
DEEEIRTTNPVAYESYGSVCCLGNHSNTAGGTRL

SEQ ID NO: 156653 - protein, 34 aa, Artificial Sequence
  Description of Artificial Sequence: Synthetic polypeptide
DEHVIATTNPVAYEQWGTVSKTWDDLGQKRGDAR

SEQ ID NO: 156654 - protein, 35 aa, Artificial Sequence
  Description of Artificial Sequence: Synthetic polypeptide
DEAEIRTTNPVATEQYGSVYWTWGSEEWGFNSNQQ

SEQ ID NO: 156655 - protein, 39 aa, Artificial Sequence
  Description of Artificial Sequence: Synthetic polypeptide
DEEEIRTTNPVATEQYGSVSTTQNNNQISTTESGTNNGN

SEQ ID NO: 156656 - protein, 35 aa, Artificial Sequence
  Description of Artificial Sequence: Synthetic polypeptide
DEAEIRTTNPVATEQYGSVYVEWNWQQDFGSDQIY

SEQ ID NO: 156657 - protein, 32 aa, Artificial Sequence
  Description of Artificial Sequence: Synthetic polypeptide
DEMEIRTTNPVATEQWGDVSAEDIEMNAAENA

SEQ ID NO: 156658 - protein, 34 aa, Artificial Sequence
  Description of Artificial Sequence: Synthetic polypeptide
DEAEIRTTNPVATEQYGSVYQCWMLNEEDGSQQE

SEQ ID NO: 156659 - protein, 35 aa, Artificial Sequence
  Description of Artificial Sequence: Synthetic polypeptide
DEAEIRTTNPVATEQYGSVYQCWTDNEEDFSNFEF

SEQ ID NO: 156660 - protein, 35 aa, Artificial Sequence
  Description of Artificial Sequence: Synthetic polypeptide
DEQEIRCTNPVATERYGKTVVSCTNALTNTGDNQS

SEQ ID NO: 156661 - protein, 34 aa, Artificial Sequence
  Description of Artificial Sequence: Synthetic polypeptide
DEHVIQTTNPVAYEQWGCVAACTDNPSQRGGNNR

SEQ ID NO: 156662 - protein, 35 aa, Artificial Sequence
  Description of Artificial Sequence: Synthetic polypeptide
DEAEIATTNPVATEQYGSVCAADNGDEQGMDINRH

SEQ ID NO: 156663 - protein, 35 aa, Artificial Sequence
  Description of Artificial Sequence: Synthetic polypeptide
DEMEIRTTNPVATEQYGSCNPSWEQYDRIGSNNQE

SEQ ID NO: 156664 - protein, 34 aa, Artificial Sequence
  Description of Artificial Sequence: Synthetic polypeptide
DEAEIRTTNPVATEQYGSVYQDWTLNEEDFSYQE

SEQ ID NO: 156665 - protein, 35 aa, Artificial Sequence
  Description of Artificial Sequence: Synthetic polypeptide
DEAEIRTTNPVATEQYGSVYQEWTLNEEDFSNQIF

SEQ ID NO: 156666 - protein, 34 aa, Artificial Sequence
  Description of Artificial Sequence: Synthetic polypeptide
DEMEIRTTNPVATEQYGSCFYTTLMEYESINDQD

SEQ ID NO: 156667 - protein, 36 aa, Artificial Sequence
  Description of Artificial Sequence: Synthetic polypeptide
DEEEIRTTNPVAYEYWGHTTVSYTNALSGRPGSNFV

SEQ ID NO: 156668 - protein, 36 aa, Artificial Sequence
  Description of Artificial Sequence: Synthetic polypeptide
DEEEIRTTNPVAYEYWGHKTVSYTNALSHRPSGNLV

SEQ ID NO: 156669 - protein, 36 aa, Artificial Sequence
  Description of Artificial Sequence: Synthetic polypeptide
DEAEIRTTNPVATEQYGSVYSDWNNQDERQSDIIQF

SEQ ID NO: 156670 - protein, 33 aa, Artificial Sequence
  Description of Artificial Sequence: Synthetic polypeptide
DEMEIATTNPVAYEQYGTVCSATDGPDEHSGND

SEQ ID NO: 156671 - protein, 38 aa, Artificial Sequence
  Description of Artificial Sequence: Synthetic polypeptide
DEEEIRTTNPVATEQYGVVSTVNNQQNQEQGNNDEGED

SEQ ID NO: 156672 - protein, 37 aa, Artificial Sequence
  Description of Artificial Sequence: Synthetic polypeptide
DEEEIRTTNPVAYEQYGSVPSTTPADSTTRNGGNPVS

SEQ ID NO: 156673 - protein, 35 aa, Artificial Sequence
  Description of Artificial Sequence: Synthetic polypeptide
DEAEIRTTNPVATEQYGSVYTINLNTVEEDEESQN

SEQ ID NO: 156674 - protein, 34 aa, Artificial Sequence
  Description of Artificial Sequence: Synthetic polypeptide
DEEEIRTTNPVSTEAYGSVTFNNHLTQTEMQQTK

SEQ ID NO: 156675 - protein, 35 aa, Artificial Sequence
  Description of Artificial Sequence: Synthetic polypeptide
DEIAEIATTNPVAYEQWGSVSTNLNQGAMGGDMSS

SEQ ID NO: 156676 - protein, 38 aa, Artificial Sequence
  Description of Artificial Sequence: Synthetic polypeptide
DEEEIRTTNPVATEQYGVVSTVNQQLQNQQGTTDETTE

SEQ ID NO: 156677 - protein, 37 aa, Artificial Sequence
  Description of Artificial Sequence: Synthetic polypeptide
DEEEIRTTNPVATEQYGVVSTVVGTNNNEQGNTEQGS

SEQ ID NO: 156678 - protein, 38 aa, Artificial Sequence
  Description of Artificial Sequence: Synthetic polypeptide
DEEEIRTTNPVATEQYGVVSTVNNQQGATEQGTNQQQD

SEQ ID NO: 156679 - protein, 33 aa, Artificial Sequence
  Description of Artificial Sequence: Synthetic polypeptide
DCEEIRATNPVAYEQWGSSYYTPEHMQRGENNH

SEQ ID NO: 156680 - protein, 37 aa, Artificial Sequence
  Description of Artificial Sequence: Synthetic polypeptide
DEEEIRTTNPVAYEQYGQCVCSTGNDLNQESFGSEQA

SEQ ID NO: 156681 - protein, 38 aa, Artificial Sequence
  Description of Artificial Sequence: Synthetic polypeptide
DEEEIRTTNPVATEQYGVVSTVNNQQGNNNQAGSEQGS

SEQ ID NO: 156682 - protein, 37 aa, Artificial Sequence
  Description of Artificial Sequence: Synthetic polypeptide
DEAEIRTTNPVAYERYGISTVSYETNELSDVRGPERR

SEQ ID NO: 156683 - protein, 35 aa, Artificial Sequence
  Description of Artificial Sequence: Synthetic polypeptide
DEQEIATTNPVATEQYGSVCAMTNNEPTGGDLEND

SEQ ID NO: 156684 - protein, 32 aa, Artificial Sequence
  Description of Artificial Sequence: Synthetic polypeptide
DDSEVATTNPVSTEQYGNVSATDLQSHVGQDL

SEQ ID NO: 156685 - protein, 38 aa, Artificial Sequence
  Description of Artificial Sequence: Synthetic polypeptide
DEEEIRTTNPVATEQYGVVSTVNNQQGNNQQGTEQGED

SEQ ID NO: 156686 - protein, 33 aa, Artificial Sequence
  Description of Artificial Sequence: Synthetic polypeptide
DEIEIATTNPVATLQYGHVSCTRACPQPDGTFM

SEQ ID NO: 156687 - protein, 34 aa, Artificial Sequence
  Description of Artificial Sequence: Synthetic polypeptide
DEQEIATTNPVATEQYGSVCATGPEPGQHDENGH

SEQ ID NO: 156688 - protein, 31 aa, Artificial Sequence
  Description of Artificial Sequence: Synthetic polypeptide
DDSEVATTNPVSTEQYGNVSATDLESHEGEL

SEQ ID NO: 156689 - protein, 33 aa, Artificial Sequence
  Description of Artificial Sequence: Synthetic polypeptide
DEHEIRTTNPVAYEQWGVVCYNNDGHHDGNVPR

SEQ ID NO: 156690 - protein, 31 aa, Artificial Sequence
  Description of Artificial Sequence: Synthetic polypeptide
DDSEVATTNPVSTEQYGNVSATDLEDHEGEL

SEQ ID NO: 156691 - protein, 31 aa, Artificial Sequence
  Description of Artificial Sequence: Synthetic polypeptide
DDSEVASTNPVSTEGYGSVAATTIQSRVGQR

SEQ ID NO: 156692 - protein, 35 aa, Artificial Sequence
  Description of Artificial Sequence: Synthetic polypeptide
DEQEIATTNPVATEQYGSVCAMNNGGLEPRDVNNM

SEQ ID NO: 156693 - protein, 38 aa, Artificial Sequence
  Description of Artificial Sequence: Synthetic polypeptide
DEEEIRTTNPVATEQYGVVSTVNQQQGNNNQQGTEEEE

SEQ ID NO: 156694 - protein, 37 aa, Artificial Sequence
  Description of Artificial Sequence: Synthetic polypeptide
DEEEIRTTNPVATEQYGVVSTVNNQNQNQQQGTEQGS

SEQ ID NO: 156695 - protein, 38 aa, Artificial Sequence
  Description of Artificial Sequence: Synthetic polypeptide
DEEEIRTTNPVATEQYGVVSTNQQQGNTEQGTNQQGED

SEQ ID NO: 156696 - protein, 34 aa, Artificial Sequence
  Description of Artificial Sequence: Synthetic polypeptide
DEHEIRTTNPVATEQYGSVTYVLDDLQAEVQDSQ

SEQ ID NO: 156697 - protein, 37 aa, Artificial Sequence
  Description of Artificial Sequence: Synthetic polypeptide
DEEEIRTTNPVATEQYGVVSTTNQQQQNNNNQQGTTE

SEQ ID NO: 156698 - protein, 34 aa, Artificial Sequence
  Description of Artificial Sequence: Synthetic polypeptide
DEQEIATTNPVATEQYGSVCAHNTEENIDNQENH

SEQ ID NO: 156699 - protein, 34 aa, Artificial Sequence
  Description of Artificial Sequence: Synthetic polypeptide
DEAEIRTTNPVGTEQYGCVCSTEDHGNFGSDNQA

SEQ ID NO: 156700 - protein, 31 aa, Artificial Sequence
  Description of Artificial Sequence: Synthetic polypeptide
DDSEVASTNPVSTEGYGTVAANLIQSRVGQR

SEQ ID NO: 156701 - protein, 30 aa, Artificial Sequence
  Description of Artificial Sequence: Synthetic polypeptide
DDSEVASTNPVSTEGYGSVSNTIQSRVGQG

SEQ ID NO: 156702 - protein, 34 aa, Artificial Sequence
  Description of Artificial Sequence: Synthetic polypeptide
DEQEIATTNPVATEQYGSVCAMHGQDSLGDNAED

SEQ ID NO: 156703 - protein, 31 aa, Artificial Sequence
  Description of Artificial Sequence: Synthetic polypeptide
DDSEVASTNPVSTEGYGSVSANTIQSRVGQG

SEQ ID NO: 156704 - protein, 33 aa, Artificial Sequence
  Description of Artificial Sequence: Synthetic polypeptide
DEQEIATTNPVATEQYGSVCAMHGQDSMPNDVH

SEQ ID NO: 156705 - protein, 32 aa, Artificial Sequence
  Description of Artificial Sequence: Synthetic polypeptide
DEAEIRTTNPVAYQQYGCVCIWINDDERGHDL

SEQ ID NO: 156706 - protein, 35 aa, Artificial Sequence
  Description of Artificial Sequence: Synthetic polypeptide
DEEEIRTTNPVAYEQYGQCVCSTGEHQHFNSDFQM

SEQ ID NO: 156707 - protein, 37 aa, Artificial Sequence
  Description of Artificial Sequence: Synthetic polypeptide
DEEEIRTTNPVAYEQYGQCVCSTGNDHNQRFGSETQA

SEQ ID NO: 156708 - protein, 34 aa, Artificial Sequence
  Description of Artificial Sequence: Synthetic polypeptide
DEQEIKTTNPVATEQYGVVVSTTDGPEEFEGGND

SEQ ID NO: 156709 - protein, 38 aa, Artificial Sequence
  Description of Artificial Sequence: Synthetic polypeptide
DEEEIRTTNPVATEQYGVVSTTNQQQQNGTEQGTNDEE

SEQ ID NO: 156710 - protein, 35 aa, Artificial Sequence
  Description of Artificial Sequence: Synthetic polypeptide
CEEEIATTNPVATEQYGSVCSVNPDQQEHQDGTMK

SEQ ID NO: 156711 - protein, 31 aa, Artificial Sequence
  Description of Artificial Sequence: Synthetic polypeptide
DDSEVASTNPVSTEGYGSVSANTINSRNGQR

SEQ ID NO: 156712 - protein, 32 aa, Artificial Sequence
  Description of Artificial Sequence: Synthetic polypeptide
DCEEIRATNPVAYEQWGSSYYTEHMQRGGEEN

SEQ ID NO: 156713 - protein, 34 aa, Artificial Sequence
  Description of Artificial Sequence: Synthetic polypeptide
DEAEIRTTNPVATEQYGSVWVIVEMHEGGGNEIE

SEQ ID NO: 156714 - protein, 38 aa, Artificial Sequence
  Description of Artificial Sequence: Synthetic polypeptide
DEEEIRTTNPVATEQYGVVSTVNQQQGNNNNEQNEEDD

SEQ ID NO: 156715 - protein, 39 aa, Artificial Sequence
  Description of Artificial Sequence: Synthetic polypeptide
DEEEIRTTNPVATEQYGSVSTTTTNNNNLEQGTNATTTD

SEQ ID NO: 156716 - protein, 33 aa, Artificial Sequence
  Description of Artificial Sequence: Synthetic polypeptide
DEEEIRTTNPVCTEGYGCVCSWPEDQNFGSDLA

SEQ ID NO: 156717 - protein, 37 aa, Artificial Sequence
  Description of Artificial Sequence: Synthetic polypeptide
DEQEIATTNPVATEQYGSVCSATNPHNVQEAGGNMEN

SEQ ID NO: 156718 - protein, 34 aa, Artificial Sequence
  Description of Artificial Sequence: Synthetic polypeptide
DEIAEIATTNPVAYEQWGTVSLTNPQGNAGENDA

SEQ ID NO: 156719 - protein, 35 aa, Artificial Sequence
  Description of Artificial Sequence: Synthetic polypeptide
DEQEIATTNPVATEQYGSVCSMNNQNEAMPGDGTN

SEQ ID NO: 156720 - protein, 32 aa, Artificial Sequence
  Description of Artificial Sequence: Synthetic polypeptide
DEMEIRTTNPVATEQWGDVCSAEGEVEFAGDD

SEQ ID NO: 156721 - protein, 33 aa, Artificial Sequence
  Description of Artificial Sequence: Synthetic polypeptide
DEIAEIATTNPVAYEQWGTVCSTENDEHNGNEQ

SEQ ID NO: 156722 - protein, 38 aa, Artificial Sequence
  Description of Artificial Sequence: Synthetic polypeptide
DEEEIRTTNPVATEQYGVVSTVTNQNLQENATTNVATE

SEQ ID NO: 156723 - protein, 35 aa, Artificial Sequence
  Description of Artificial Sequence: Synthetic polypeptide
DEQEIATTNPVATEQYGSVSTTDLNEDHEGSEDQS

SEQ ID NO: 156724 - protein, 35 aa, Artificial Sequence
  Description of Artificial Sequence: Synthetic polypeptide
DEQEIATTNPVATEQYGSVCSTTDLNEEHEGEDLA

SEQ ID NO: 156725 - protein, 35 aa, Artificial Sequence
  Description of Artificial Sequence: Synthetic polypeptide
DEQEIATTNPVATEQYGSVCSVNPHNAEEAGGNEN

SEQ ID NO: 156726 - protein, 35 aa, Artificial Sequence
  Description of Artificial Sequence: Synthetic polypeptide
CEEEIATTNPVATEQYGCVAATNLTAPDSQMGSEM

SEQ ID NO: 156727 - protein, 33 aa, Artificial Sequence
  Description of Artificial Sequence: Synthetic polypeptide
DEIAEIATTNPVAYEQWGSVYITGNDHQMNGEH

SEQ ID NO: 156728 - protein, 34 aa, Artificial Sequence
  Description of Artificial Sequence: Synthetic polypeptide
DEQEIATTNPVATEQYGSVCSYTDHEDHFGSEDL

SEQ ID NO: 156729 - protein, 39 aa, Artificial Sequence
  Description of Artificial Sequence: Synthetic polypeptide
DEEEIRTTNPVATEQYGSVSTTTQNNQISTTEQGTNQGN

SEQ ID NO: 156730 - protein, 31 aa, Artificial Sequence
  Description of Artificial Sequence: Synthetic polypeptide
DDSEVATTNPVSTECYGNVAANTIQSRVGQR

SEQ ID NO: 156731 - protein, 34 aa, Artificial Sequence
  Description of Artificial Sequence: Synthetic polypeptide
CEEEIATTNPVATEQYGCVCSTPEHQENFGSEQS

SEQ ID NO: 156732 - protein, 38 aa, Artificial Sequence
  Description of Artificial Sequence: Synthetic polypeptide
DEEEIRTTNPVATEQYGSVSTTTTNNNNNNNQQGTTTE

SEQ ID NO: 156733 - protein, 36 aa, Artificial Sequence
  Description of Artificial Sequence: Synthetic polypeptide
DEEEIRTTNPVAYEQYGSVPATTPAGPTTRNGGNPE

SEQ ID NO: 156734 - protein, 31 aa, Artificial Sequence
  Description of Artificial Sequence: Synthetic polypeptide
DCEEIRATNPVAYEQWGSSYYTEHMNQGNND

SEQ ID NO: 156735 - protein, 38 aa, Artificial Sequence
  Description of Artificial Sequence: Synthetic polypeptide
DEEEIRTTNPVATEQYGVVSTVNQQQGNNNNEQGTEDE

SEQ ID NO: 156736 - protein, 36 aa, Artificial Sequence
  Description of Artificial Sequence: Synthetic polypeptide
DEEEIRTTNPVAYEQYGQCVCSTSEEHQENFGSNQA

SEQ ID NO: 156737 - protein, 31 aa, Artificial Sequence
  Description of Artificial Sequence: Synthetic polypeptide
DDSEVASTNPVSTEGYGSVAANTIQSRVGQR

SEQ ID NO: 156738 - protein, 31 aa, Artificial Sequence
  Description of Artificial Sequence: Synthetic polypeptide
DDSEVASTNPVSTEGYGEVSANTIQSRVGQR

SEQ ID NO: 156739 - protein, 36 aa, Artificial Sequence
  Description of Artificial Sequence: Synthetic polypeptide
DEQEIATTNPVATEQYGSVCATNNPMQQGNQTQGTM

SEQ ID NO: 156740 - protein, 31 aa, Artificial Sequence
  Description of Artificial Sequence: Synthetic polypeptide
DDSEVASTNPVSTEGYGSVAANNIQSRVGQR

SEQ ID NO: 156741 - protein, 33 aa, Artificial Sequence
  Description of Artificial Sequence: Synthetic polypeptide
DEQEIATTNPVATEQYGTVSATDPVEDHEGEDL

SEQ ID NO: 156742 - protein, 38 aa, Artificial Sequence
  Description of Artificial Sequence: Synthetic polypeptide
DEEEIRTTNPVATEQYGVVSTVNQQNNQQGTEQGSTNQ

SEQ ID NO: 156743 - protein, 32 aa, Artificial Sequence
  Description of Artificial Sequence: Synthetic polypeptide
DDSEVATTNPVATEQYGNVAANTIQSHVGQDR

SEQ ID NO: 156744 - protein, 34 aa, Artificial Sequence
  Description of Artificial Sequence: Synthetic polypeptide
DEAEIRTTNPVAYERWGEVCSTNDINQNHQGNEQ

SEQ ID NO: 156745 - protein, 36 aa, Artificial Sequence
  Description of Artificial Sequence: Synthetic polypeptide
DEQEIATTNPVATEQYGSVCSAPALGQDHQDGNDHA

SEQ ID NO: 156746 - protein, 35 aa, Artificial Sequence
  Description of Artificial Sequence: Synthetic polypeptide
DEQEIATTNPVATEQYGSVCSATDDLVEDHEGEDL

SEQ ID NO: 156747 - protein, 37 aa, Artificial Sequence
  Description of Artificial Sequence: Synthetic polypeptide
DEEEIRTTNPVATEQYGVVSTVNQQNNNQQGTTDEED

SEQ ID NO: 156748 - protein, 36 aa, Artificial Sequence
  Description of Artificial Sequence: Synthetic polypeptide
DEEEIRTTNPVAYEQYGSVPATTDAGPTTRNGGNNV

SEQ ID NO: 156749 - protein, 35 aa, Artificial Sequence
  Description of Artificial Sequence: Synthetic polypeptide
DEQEIRTTNPVATEQYGSVTPTDGIDEQTQGQDLL

SEQ ID NO: 156750 - protein, 35 aa, Artificial Sequence
  Description of Artificial Sequence: Synthetic polypeptide
DEQEIATTNPVATEQYGSVCSANPHNAQEAGGSEN

SEQ ID NO: 156751 - protein, 33 aa, Artificial Sequence
  Description of Artificial Sequence: Synthetic polypeptide
DEEEIRTTNPVSTEGYGSVSREAFDERVTQFEP

SEQ ID NO: 156752 - protein, 36 aa, Artificial Sequence
  Description of Artificial Sequence: Synthetic polypeptide
DEHEIRTTNPVATEQYGSVSVEPPMNENLNMGSIVE

SEQ ID NO: 156753 - protein, 34 aa, Artificial Sequence
  Description of Artificial Sequence: Synthetic polypeptide
DEMEIRTTNPVATECYGTVCSTIGEPEDFEGEND

SEQ ID NO: 156754 - protein, 36 aa, Artificial Sequence
  Description of Artificial Sequence: Synthetic polypeptide
DEAEIRTTNPVATEQYGSVTWSPVNWLENPNTQEVG

SEQ ID NO: 156755 - protein, 35 aa, Artificial Sequence
  Description of Artificial Sequence: Synthetic polypeptide
DEMEIRTTNPVATDQYGCVTLTNNVLMTQFDQNGK

SEQ ID NO: 156756 - protein, 33 aa, Artificial Sequence
  Description of Artificial Sequence: Synthetic polypeptide
DEQEIATTNPVAYEGWGEVATNLQGDAGNNDET

SEQ ID NO: 156757 - protein, 33 aa, Artificial Sequence
  Description of Artificial Sequence: Synthetic polypeptide
DEMEICTTNPVATEQYGTVCTATDGAVEFEGND

SEQ ID NO: 156758 - protein, 33 aa, Artificial Sequence
  Description of Artificial Sequence: Synthetic polypeptide
DAEEIATTNPVATEQYGSVCAAGPEQDNASIRH

SEQ ID NO: 156759 - protein, 38 aa, Artificial Sequence
  Description of Artificial Sequence: Synthetic polypeptide
DEEEIRTTNPVATEQYGVVSTVTNGNQAGNQQGTNQEE

SEQ ID NO: 156760 - protein, 38 aa, Artificial Sequence
  Description of Artificial Sequence: Synthetic polypeptide
DEEEIRTTNPVATEQYGVVSTVVNNLQAGTEAGISTDQ

SEQ ID NO: 156761 - protein, 34 aa, Artificial Sequence
  Description of Artificial Sequence: Synthetic polypeptide
DEQEIATTNPVAYECWGVVCSTDNGQERDGDGQR

SEQ ID NO: 156762 - protein, 39 aa, Artificial Sequence
  Description of Artificial Sequence: Synthetic polypeptide
DEEEIRTTNPVATEQYGVVSTTVNNGNLQQGTNNEDESV

SEQ ID NO: 156763 - protein, 34 aa, Artificial Sequence
  Description of Artificial Sequence: Synthetic polypeptide
DEQEIVTTNPVATEQYGTVNSATDGPGEENEGND

SEQ ID NO: 156764 - protein, 34 aa, Artificial Sequence
  Description of Artificial Sequence: Synthetic polypeptide
DEQEIATTNPVAYECWGSVATGNMLGDQQGPNAE

SEQ ID NO: 156765 - protein, 36 aa, Artificial Sequence
  Description of Artificial Sequence: Synthetic polypeptide
DEMEIRTTNPVATEQYGSVCTPDEGNTTRSGEETHF

SEQ ID NO: 156766 - protein, 38 aa, Artificial Sequence
  Description of Artificial Sequence: Synthetic polypeptide
DEEEIRTTNPVATEQYGVVSTVVNNLNNLQQNENEENE

SEQ ID NO: 156767 - protein, 32 aa, Artificial Sequence
  Description of Artificial Sequence: Synthetic polypeptide
DEASIATTNPTAYEQWGSYYSDDNDGRSGNIR

SEQ ID NO: 156768 - protein, 36 aa, Artificial Sequence
  Description of Artificial Sequence: Synthetic polypeptide
DEMEIRTTNPVATEQYGSVCTMEYDVLQDQMEINDD

SEQ ID NO: 156769 - protein, 35 aa, Artificial Sequence
  Description of Artificial Sequence: Synthetic polypeptide
DEAEIATTNPVATEQYGSVCAMNNGLNQTAGPMEI

SEQ ID NO: 156770 - protein, 34 aa, Artificial Sequence
  Description of Artificial Sequence: Synthetic polypeptide
DEQEIVTTNPVATEQYGTVCSATDGPVEKFEGND

SEQ ID NO: 156771 - protein, 33 aa, Artificial Sequence
  Description of Artificial Sequence: Synthetic polypeptide
DEQEIATTNPVAYEGWGEVATNLQGDAGNNGTA

SEQ ID NO: 156772 - protein, 37 aa, Artificial Sequence
  Description of Artificial Sequence: Synthetic polypeptide
DCEEIRTTNPVATEQWGQSVPSCTAEQQAGTGTTNRH

SEQ ID NO: 156773 - protein, 39 aa, Artificial Sequence
  Description of Artificial Sequence: Synthetic polypeptide
DEEEIRTTNPVATEQYGVVSTTSVNLQAGNTEQGVTTTQ

SEQ ID NO: 156774 - protein, 39 aa, Artificial Sequence
  Description of Artificial Sequence: Synthetic polypeptide
DEEEIRTTNPVATEQYGVVSTTVNNGNLQQGTNEEGEDD

SEQ ID NO: 156775 - protein, 33 aa, Artificial Sequence
  Description of Artificial Sequence: Synthetic polypeptide
DEQEIATTNPVAYEGWGSVATNMQGDAGNGSNT

SEQ ID NO: 156776 - protein, 39 aa, Artificial Sequence
  Description of Artificial Sequence: Synthetic polypeptide
DEEEIRTTNPVATEQYGVVSTTSTNLQAGNTEQGVTTNE

SEQ ID NO: 156777 - protein, 39 aa, Artificial Sequence
  Description of Artificial Sequence: Synthetic polypeptide
DEEEIRTTNPVATEQYGVVSTTSNLQQGSNTEQGSTQDD

SEQ ID NO: 156778 - protein, 33 aa, Artificial Sequence
  Description of Artificial Sequence: Synthetic polypeptide
DEQEIATTNPVAYEGWGSVATNLQGDAGQGDQP

SEQ ID NO: 156779 - protein, 33 aa, Artificial Sequence
  Description of Artificial Sequence: Synthetic polypeptide
DEQEIATTNPVAYEGWGSVATNLQGDAGGHQQQ

SEQ ID NO: 156780 - protein, 34 aa, Artificial Sequence
  Description of Artificial Sequence: Synthetic polypeptide
DEAEIRTTNPVATEQYGSVTVSLWEHQPELEVQA

SEQ ID NO: 156781 - protein, 35 aa, Artificial Sequence
  Description of Artificial Sequence: Synthetic polypeptide
DCEEIRTTNPVATEQYGSVNDWVNIEITLETNNES

SEQ ID NO: 156782 - protein, 35 aa, Artificial Sequence
  Description of Artificial Sequence: Synthetic polypeptide
DCEEIRTTNPVATEQYGSVIDWFNIETTLETDNEA

SEQ ID NO: 156783 - protein, 34 aa, Artificial Sequence
  Description of Artificial Sequence: Synthetic polypeptide
DEQEIVTTNPVATEQYGTVSATDGPVEDHEGNDL

SEQ ID NO: 156784 - protein, 33 aa, Artificial Sequence
  Description of Artificial Sequence: Synthetic polypeptide
DEQEIATTNPVAYEGWGSVATNLQGDADNGDQY

SEQ ID NO: 156785 - protein, 34 aa, Artificial Sequence
  Description of Artificial Sequence: Synthetic polypeptide
DEAEIRTTNPVATEQYGSVTVWSNSVEVQPESQD

SEQ ID NO: 156786 - protein, 35 aa, Artificial Sequence
  Description of Artificial Sequence: Synthetic polypeptide
DCEEIRTTNPVATEQYGSCSDWVNIETILETNNES

SEQ ID NO: 156787 - protein, 33 aa, Artificial Sequence
  Description of Artificial Sequence: Synthetic polypeptide
DEQEIATTNPVAYEGWGSVATNANQGDAGQNQQ

SEQ ID NO: 156788 - protein, 35 aa, Artificial Sequence
  Description of Artificial Sequence: Synthetic polypeptide
DEMEIRTTNPVATEQYGSVFDTYDSTVQDREESED

SEQ ID NO: 156789 - protein, 32 aa, Artificial Sequence
  Description of Artificial Sequence: Synthetic polypeptide
DEQEIATTNPVAYEGWGSVCSTMDQQQGDGSP

SEQ ID NO: 156790 - protein, 31 aa, Artificial Sequence
  Description of Artificial Sequence: Synthetic polypeptide
DEQEIATTNPVGTEQYGVMATDLEDHEGDDI

SEQ ID NO: 156791 - protein, 35 aa, Artificial Sequence
  Description of Artificial Sequence: Synthetic polypeptide
DEQEIATTNPVATEQYGSHVSATCVLEDHEGFEDL

SEQ ID NO: 156792 - protein, 35 aa, Artificial Sequence
  Description of Artificial Sequence: Synthetic polypeptide
DEQEIATTNPVATEQYGSIVSMTDLFEDHEGGEDL

SEQ ID NO: 156793 - protein, 33 aa, Artificial Sequence
  Description of Artificial Sequence: Synthetic polypeptide
DEEEIRTTNPVSYEQWGSCYTIDNHQSGGGKQD

SEQ ID NO: 156794 - protein, 33 aa, Artificial Sequence
  Description of Artificial Sequence: Synthetic polypeptide
DEEEIRTTNPVSYEQWGSCYTIDNHQNGGGGQT

SEQ ID NO: 156795 - protein, 38 aa, Artificial Sequence
  Description of Artificial Sequence: Synthetic polypeptide
DEEEIRTTNPVATEQYGVVSTVNNNQQGNNQQGNTEEG

SEQ ID NO: 156796 - protein, 32 aa, Artificial Sequence
  Description of Artificial Sequence: Synthetic polypeptide
DEQEIATTNPVAYEAWGVTSTNLNGDAGNGEY

SEQ ID NO: 156797 - protein, 31 aa, Artificial Sequence
  Description of Artificial Sequence: Synthetic polypeptide
DEQEIATTNPVAYEAWGTVSTNTNGDTNDTS

SEQ ID NO: 156798 - protein, 39 aa, Artificial Sequence
  Description of Artificial Sequence: Synthetic polypeptide
DEEEIRTTNPVATEQYGVVSTVSVTNLQLNQNATEQGSE

SEQ ID NO: 156799 - protein, 39 aa, Artificial Sequence
  Description of Artificial Sequence: Synthetic polypeptide
DEEEIRTTNPVATEQYGVVSTVSTNNLNQNQNGTEQGSE

SEQ ID NO: 156800 - protein, 38 aa, Artificial Sequence
  Description of Artificial Sequence: Synthetic polypeptide
DEEEIRTTNPVATEQYGVVSTVNNNQQGNNQQGQEEET

SEQ ID NO: 156801 - protein, 39 aa, Artificial Sequence
  Description of Artificial Sequence: Synthetic polypeptide
DEEEIRTTNPVATEQYGVVSTVVNNLNGNQNQGNNEQGQ

SEQ ID NO: 156802 - protein, 33 aa, Artificial Sequence
  Description of Artificial Sequence: Synthetic polypeptide
DAEEIATTNPVATEQYGSVCSAPPDNDDNPAEM

SEQ ID NO: 156803 - protein, 34 aa, Artificial Sequence
  Description of Artificial Sequence: Synthetic polypeptide
DEAEIATTNPVATEQYGSVCAMMNHGGTGSGNPM

SEQ ID NO: 156804 - protein, 33 aa, Artificial Sequence
  Description of Artificial Sequence: Synthetic polypeptide
DEQEIATTNPVATEQYGSKCATEDLEDHEGEDK

SEQ ID NO: 156805 - protein, 38 aa, Artificial Sequence
  Description of Artificial Sequence: Synthetic polypeptide
DEEEIRTTNPVATEQYGVVSTVSNNQQGNNNDEQGETD

SEQ ID NO: 156806 - protein, 38 aa, Artificial Sequence
  Description of Artificial Sequence: Synthetic polypeptide
DEEEIRTTNPVATEQYGVVSTVSNNLQQAETTTNVATE

SEQ ID NO: 156807 - protein, 38 aa, Artificial Sequence
  Description of Artificial Sequence: Synthetic polypeptide
DEEEIRTTNPVATEQYGVVSTVNNNQQGNNQNEQTTTD

SEQ ID NO: 156808 - protein, 34 aa, Artificial Sequence
  Description of Artificial Sequence: Synthetic polypeptide
DEQEIVTTNPVATEQYGTVCSATDGPVEFEGNND

SEQ ID NO: 156809 - protein, 38 aa, Artificial Sequence
  Description of Artificial Sequence: Synthetic polypeptide
DEEEIRTTNPVATEQYGVVSTVNNNQQGNNQDEQGVTD

SEQ ID NO: 156810 - protein, 38 aa, Artificial Sequence
  Description of Artificial Sequence: Synthetic polypeptide
DEEEIRTTNPVATEQYGVVSTVNNNQQGNNEQGTTEEE

SEQ ID NO: 156811 - protein, 31 aa, Artificial Sequence
  Description of Artificial Sequence: Synthetic polypeptide
DEQEIATTNPVGTEQYGVMATDLEDHEGDDL

SEQ ID NO: 156812 - protein, 35 aa, Artificial Sequence
  Description of Artificial Sequence: Synthetic polypeptide
DEQEIVTTNPVATEQYGTVCSATDGLVEDFEGNDD

SEQ ID NO: 156813 - protein, 37 aa, Artificial Sequence
  Description of Artificial Sequence: Synthetic polypeptide
DEAEIRTTNPVATEQYGSVVDASIMLEELRNGNEEVF

SEQ ID NO: 156814 - protein, 37 aa, Artificial Sequence
  Description of Artificial Sequence: Synthetic polypeptide
DEAEIRTTNPVATEQYGSVVDFTIMLEELRNGNEEVD

SEQ ID NO: 156815 - protein, 33 aa, Artificial Sequence
  Description of Artificial Sequence: Synthetic polypeptide
DEMEICTTNPVATEQYGHVCSATDGPVEFETND

SEQ ID NO: 156816 - protein, 35 aa, Artificial Sequence
  Description of Artificial Sequence: Synthetic polypeptide
DEQEIVTTNPVATEQYGTVCSATDDLVEDFEGNDD

SEQ ID NO: 156817 - protein, 37 aa, Artificial Sequence
  Description of Artificial Sequence: Synthetic polypeptide
DEAEIRTTNPVATEQYGSVVDYTAMLEELRNGNEEQF

SEQ ID NO: 156818 - protein, 33 aa, Artificial Sequence
  Description of Artificial Sequence: Synthetic polypeptide
DEMEICTTNPVATEQYGFVCFATDGPVEFEGNS

SEQ ID NO: 156819 - protein, 34 aa, Artificial Sequence
  Description of Artificial Sequence: Synthetic polypeptide
DEQEIVTTNPVATEQYGTTVCSATLGPVEFEGND

SEQ ID NO: 156820 - protein, 34 aa, Artificial Sequence
  Description of Artificial Sequence: Synthetic polypeptide
DEMEICTTNPVATEQYGECVCSATDGPVEFEGND

SEQ ID NO: 156821 - protein, 34 aa, Artificial Sequence
  Description of Artificial Sequence: Synthetic polypeptide
DEMEICTTNPVATEQYGCVISATDGTWEFEGNKY

SEQ ID NO: 156822 - protein, 35 aa, Artificial Sequence
  Description of Artificial Sequence: Synthetic polypeptide
DEQEIVTTNPVATEQYGSVSATGDGEDQEGEGDGM

SEQ ID NO: 156823 - protein, 37 aa, Artificial Sequence
  Description of Artificial Sequence: Synthetic polypeptide
DEAEIRTTNPVATEQYGSVVDYTIMLEELRNGNEEFQ

SEQ ID NO: 156824 - protein, 38 aa, Artificial Sequence
  Description of Artificial Sequence: Synthetic polypeptide
DEEEIRTTNPVATEQYGVVSTVNNNQNQQQGTNNEEDE

SEQ ID NO: 156825 - protein, 36 aa, Artificial Sequence
  Description of Artificial Sequence: Synthetic polypeptide
DCEEIRTTNPVASEQYGSVSSTTPAGPNMRNGMNPV

SEQ ID NO: 156826 - protein, 35 aa, Artificial Sequence
  Description of Artificial Sequence: Synthetic polypeptide
DEAEIRTTNPVATEQYGSVVENMIDFTGFNEDTID

SEQ ID NO: 156827 - protein, 38 aa, Artificial Sequence
  Description of Artificial Sequence: Synthetic polypeptide
DEEEIRTTNPVATEQYGVVSTVNNNQQGNNQQGQTTDE

SEQ ID NO: 156828 - protein, 35 aa, Artificial Sequence
  Description of Artificial Sequence: Synthetic polypeptide
DEEEIRTTNPVTTECWGSVYCMPNQDDQRQGQNNL

SEQ ID NO: 156829 - protein, 33 aa, Artificial Sequence
  Description of Artificial Sequence: Synthetic polypeptide
DEQEIVTTNPVATEQYGTVSATDPVEDHEGEDL

SEQ ID NO: 156830 - protein, 34 aa, Artificial Sequence
  Description of Artificial Sequence: Synthetic polypeptide
DEHEIRTTNPVAYEQWGSVSHPLNDDRQNMNMNE

SEQ ID NO: 156831 - protein, 31 aa, Artificial Sequence
  Description of Artificial Sequence: Synthetic polypeptide
DEKEIRTTNPVATEQWGDVSDEIEMNAAEDA

SEQ ID NO: 156832 - protein, 34 aa, Artificial Sequence
  Description of Artificial Sequence: Synthetic polypeptide
DEAEIRTTNPVATEQYGSVTDWYVDLNNIGVQEV

SEQ ID NO: 156833 - protein, 32 aa, Artificial Sequence
  Description of Artificial Sequence: Synthetic polypeptide
DEQEIATTNPVATEQYGSCQATDWEDHEGEDL

SEQ ID NO: 156834 - protein, 38 aa, Artificial Sequence
  Description of Artificial Sequence: Synthetic polypeptide
DEEEIRTTNPVATEQYGVVSTTTNLQQLQQATTNVATE

SEQ ID NO: 156835 - protein, 30 aa, Artificial Sequence
  Description of Artificial Sequence: Synthetic polypeptide
DDSEVRSTNPVATEQYGNVANTEQNAAEDR

SEQ ID NO: 156836 - protein, 35 aa, Artificial Sequence
  Description of Artificial Sequence: Synthetic polypeptide
DEEEIRTTNPVAYEQYGQSVQCPVNDELVIAIPDR

SEQ ID NO: 156837 - protein, 37 aa, Artificial Sequence
  Description of Artificial Sequence: Synthetic polypeptide
DEEEIRTTNPVATEQYGVVSTVNNNNQQQGEEEEETD

SEQ ID NO: 156838 - protein, 33 aa, Artificial Sequence
  Description of Artificial Sequence: Synthetic polypeptide
DAEEIATTNPVATEQYGSVCAANPEEADNQENH

SEQ ID NO: 156839 - protein, 38 aa, Artificial Sequence
  Description of Artificial Sequence: Synthetic polypeptide
DEEEIRTTNPVATEQYGVVSTTTNLQAGTEQGTETGSE

SEQ ID NO: 156840 - protein, 35 aa, Artificial Sequence
  Description of Artificial Sequence: Synthetic polypeptide
DEASIRTTNPVAYEQYGSTVNTTGNGSQQRTSNNE

SEQ ID NO: 156841 - protein, 31 aa, Artificial Sequence
  Description of Artificial Sequence: Synthetic polypeptide
DEQEVASTNPVATEGYGNVSATTLESHVGEL

SEQ ID NO: 156842 - protein, 33 aa, Artificial Sequence
  Description of Artificial Sequence: Synthetic polypeptide
DEQEIATTNPVAYEQWGEVCSTVLGEGDGMNNM

SEQ ID NO: 156843 - protein, 38 aa, Artificial Sequence
  Description of Artificial Sequence: Synthetic polypeptide
DEEEIRTTNPVATEQYGVVSTTTNLQAGTEQGSTEEED

SEQ ID NO: 156844 - protein, 31 aa, Artificial Sequence
  Description of Artificial Sequence: Synthetic polypeptide
DEQEVASTNPVATEGYGNVSANTLESHVGQL

SEQ ID NO: 156845 - protein, 31 aa, Artificial Sequence
  Description of Artificial Sequence: Synthetic polypeptide
DDSEVASTNPVSTEGYGNVAANTIQSREGNR

SEQ ID NO: 156846 - protein, 38 aa, Artificial Sequence
  Description of Artificial Sequence: Synthetic polypeptide
DEEEIRTTNPVATEQYGVVSTVTNLNQQANATTNVATE

SEQ ID NO: 156847 - protein, 36 aa, Artificial Sequence
  Description of Artificial Sequence: Synthetic polypeptide
DEEEIRTTNPWATEQYGSVSSTTPAGPNMRNNMNPV

SEQ ID NO: 156848 - protein, 37 aa, Artificial Sequence
  Description of Artificial Sequence: Synthetic polypeptide
DEKEIRTTNPVATEQYGSVSSTTPAPGPNMRNGMNPV

SEQ ID NO: 156849 - protein, 32 aa, Artificial Sequence
  Description of Artificial Sequence: Synthetic polypeptide
DEKEIRTTNPVSTEPYGTISMEDIQQQLNGNH

SEQ ID NO: 156850 - protein, 35 aa, Artificial Sequence
  Description of Artificial Sequence: Synthetic polypeptide
DCEEIRTTNPVATEQYGSVSDWVNITETTLMSNES

SEQ ID NO: 156851 - protein, 36 aa, Artificial Sequence
  Description of Artificial Sequence: Synthetic polypeptide
DCEEIRTTNPVATEQYGSVSDWVNIRETTLEVNNEA

SEQ ID NO: 156852 - protein, 32 aa, Artificial Sequence
  Description of Artificial Sequence: Synthetic polypeptide
DEKEIRTTNPVSTEPYGTISMEDAQQQQNGNH

SEQ ID NO: 156853 - protein, 36 aa, Artificial Sequence
  Description of Artificial Sequence: Synthetic polypeptide
DEEEIRTTNPVCTEQYGSVSSTTPAGPNMRNGMWPV

SEQ ID NO: 156854 - protein, 39 aa, Artificial Sequence
  Description of Artificial Sequence: Synthetic polypeptide
DEEEIRTTNPVATEQYGVVSTVTNLQAGNQQGTTTNTNE

SEQ ID NO: 156855 - protein, 33 aa, Artificial Sequence
  Description of Artificial Sequence: Synthetic polypeptide
DEMAIVTTNPVATEQYGTVCSATDGPVEFEGND

SEQ ID NO: 156856 - protein, 34 aa, Artificial Sequence
  Description of Artificial Sequence: Synthetic polypeptide
DEHEIRTTNPVAYEQWGSVSGDNNGGQEQGGMGH

SEQ ID NO: 156857 - protein, 36 aa, Artificial Sequence
  Description of Artificial Sequence: Synthetic polypeptide
DEQEIATTNPVATEQYGSACSATNNNQEAEIGNDDF

SEQ ID NO: 156858 - protein, 34 aa, Artificial Sequence
  Description of Artificial Sequence: Synthetic polypeptide
DEAEIRTTNPVATEQYGSVSVTYESETIVEDIYN

SEQ ID NO: 156859 - protein, 33 aa, Artificial Sequence
  Description of Artificial Sequence: Synthetic polypeptide
DEHEIRTTNPVAYEQWGSVSGGGNQGADNGGQM

SEQ ID NO: 156860 - protein, 34 aa, Artificial Sequence
  Description of Artificial Sequence: Synthetic polypeptide
DAEEIATTNPVATEQYGSVCAATANDADMPPGVN

SEQ ID NO: 156861 - protein, 39 aa, Artificial Sequence
  Description of Artificial Sequence: Synthetic polypeptide
DEEEIRTTNPVATEQYGVVSTVTNLQAGNQQGTTTENTE

SEQ ID NO: 156862 - protein, 34 aa, Artificial Sequence
  Description of Artificial Sequence: Synthetic polypeptide
DEHEIRTTNPVAYEQWGSVSGGNNGGQGEGGGAI

SEQ ID NO: 156863 - protein, 35 aa, Artificial Sequence
  Description of Artificial Sequence: Synthetic polypeptide
DEHEIRTTNPVAYEQWGSVSGGNNQPGDHGQNTSL

SEQ ID NO: 156864 - protein, 31 aa, Artificial Sequence
  Description of Artificial Sequence: Synthetic polypeptide
DEKEIRTTNPVATEQWGDVSEKIEMNAAEDG

SEQ ID NO: 156865 - protein, 33 aa, Artificial Sequence
  Description of Artificial Sequence: Synthetic polypeptide
DEMEICTTNPVATEQYGTVTTVTTGGVEFEGND

SEQ ID NO: 156866 - protein, 39 aa, Artificial Sequence
  Description of Artificial Sequence: Synthetic polypeptide
DEEEIRTTNPVATEQYGVVSTTTNLQAGNQQGTTTNVEE

SEQ ID NO: 156867 - protein, 31 aa, Artificial Sequence
  Description of Artificial Sequence: Synthetic polypeptide
DEQEVASTNPVATEGYGNVSANTLESHVGEL

SEQ ID NO: 156868 - protein, 38 aa, Artificial Sequence
  Description of Artificial Sequence: Synthetic polypeptide
DEEEIRTTNPVATEQYGSVSTNTNTNNNNEEGNNNTEF

SEQ ID NO: 156869 - protein, 34 aa, Artificial Sequence
  Description of Artificial Sequence: Synthetic polypeptide
DEQEIATTNPVAYEPVWGQSVAANDLLQTRGITR

SEQ ID NO: 156870 - protein, 33 aa, Artificial Sequence
  Description of Artificial Sequence: Synthetic polypeptide
DEQEIATTNPVCTEQYGSVSAHDLEDHEGHDLD

SEQ ID NO: 156871 - protein, 36 aa, Artificial Sequence
  Description of Artificial Sequence: Synthetic polypeptide
DEMEIRTTNPVATEQYGSVISTDDNTQMEDTAFDTG

SEQ ID NO: 156872 - protein, 35 aa, Artificial Sequence
  Description of Artificial Sequence: Synthetic polypeptide
DEMEIRTTNPVATEQYGSVGVPNNLLAEEIVQESN

SEQ ID NO: 156873 - protein, 38 aa, Artificial Sequence
  Description of Artificial Sequence: Synthetic polypeptide
DEEEIRTTNPVATEQYGVVSTVVNNLQQGTEQGTEDEE

SEQ ID NO: 156874 - protein, 36 aa, Artificial Sequence
  Description of Artificial Sequence: Synthetic polypeptide
DEKEINTTNPVATEQYGSVSSTTPAGPNMRNGMNPV

SEQ ID NO: 156875 - protein, 36 aa, Artificial Sequence
  Description of Artificial Sequence: Synthetic polypeptide
DEKEIFTTNPVATEQYGSVSSTTPAGPNMRNGMNPV

SEQ ID NO: 156876 - protein, 38 aa, Artificial Sequence
  Description of Artificial Sequence: Synthetic polypeptide
DEEEIRTTNPVATEQYGSVSTNTNANNNNEQGNNNTEE

SEQ ID NO: 156877 - protein, 38 aa, Artificial Sequence
  Description of Artificial Sequence: Synthetic polypeptide
DEEEIRTTNPVATEQYGSVSTNTNANNNNEEGNNQGED

SEQ ID NO: 156878 - protein, 35 aa, Artificial Sequence
  Description of Artificial Sequence: Synthetic polypeptide
DCEEIRTTNPVATEQYGSVSDWVNIETTLEDNLES

SEQ ID NO: 156879 - protein, 34 aa, Artificial Sequence
  Description of Artificial Sequence: Synthetic polypeptide
DEMEICTTNPVATEQYGTVVVSVTDGGVEVEGND

SEQ ID NO: 156880 - protein, 38 aa, Artificial Sequence
  Description of Artificial Sequence: Synthetic polypeptide
DEEEIRTTNPVATEQYGVVSTVVNNLQQGTEEGTTQTE

SEQ ID NO: 156881 - protein, 33 aa, Artificial Sequence
  Description of Artificial Sequence: Synthetic polypeptide
DEQEIVTTNPVATEQYGTYCSATDGPVEFEGND

SEQ ID NO: 156882 - protein, 33 aa, Artificial Sequence
  Description of Artificial Sequence: Synthetic polypeptide
DEQEIATTNPVAYEKWGSTSTNPNGNGQGQNDR

SEQ ID NO: 156883 - protein, 36 aa, Artificial Sequence
  Description of Artificial Sequence: Synthetic polypeptide
DEAEIRTTNPVATEQYGSVTSTINWNTQEIDEEHQN

SEQ ID NO: 156884 - protein, 30 aa, Artificial Sequence
  Description of Artificial Sequence: Synthetic polypeptide
DDSEVRSTNPVATEGYGNVANTEQNRAEDR

SEQ ID NO: 156885 - protein, 33 aa, Artificial Sequence
  Description of Artificial Sequence: Synthetic polypeptide
DEMEIDTTNPVATEQYGTVCSATDGPVEFENND

SEQ ID NO: 156886 - protein, 35 aa, Artificial Sequence
  Description of Artificial Sequence: Synthetic polypeptide
DEAEIATTNPVATEQYGSVCAMTGVLPEDGENDFP

SEQ ID NO: 156887 - protein, 31 aa, Artificial Sequence
  Description of Artificial Sequence: Synthetic polypeptide
DDSEVRSTNPVATEGYGNVAAETIQSRVGQR

SEQ ID NO: 156888 - protein, 34 aa, Artificial Sequence
  Description of Artificial Sequence: Synthetic polypeptide
DEAEIRTTNPVATEQYGSVTPWVPHEERMINMDD

SEQ ID NO: 156889 - protein, 31 aa, Artificial Sequence
  Description of Artificial Sequence: Synthetic polypeptide
DEQEVASTNPVATEGYGNVAATDIQDHVGQR

SEQ ID NO: 156890 - protein, 34 aa, Artificial Sequence
  Description of Artificial Sequence: Synthetic polypeptide
DEMEIFTTNPVATEQYGTVCSATDGPVEFEGNDN

SEQ ID NO: 156891 - protein, 33 aa, Artificial Sequence
  Description of Artificial Sequence: Synthetic polypeptide
DEMEIFTTNPVATEAYGTVCSATDGPVEFEGND

SEQ ID NO: 156892 - protein, 31 aa, Artificial Sequence
  Description of Artificial Sequence: Synthetic polypeptide
DDSEVRSTNPVATEGYGNVAAATIQSRVGQR

SEQ ID NO: 156893 - protein, 32 aa, Artificial Sequence
  Description of Artificial Sequence: Synthetic polypeptide
DEHEIRTTNPVAYECWGVVSHPLDDRQNMNAE

SEQ ID NO: 156894 - protein, 36 aa, Artificial Sequence
  Description of Artificial Sequence: Synthetic polypeptide
DEEEIRTTNPVGTEQYGSVSSTTPAGPSHRNHMNPC

SEQ ID NO: 156895 - protein, 34 aa, Artificial Sequence
  Description of Artificial Sequence: Synthetic polypeptide
DEMEIETTNPVATEQYGTVCSATDGPVEFEGVND

SEQ ID NO: 156896 - protein, 33 aa, Artificial Sequence
  Description of Artificial Sequence: Synthetic polypeptide
DEASIATTNPTAYEQWGSYYSPDNDQNERGNAR

SEQ ID NO: 156897 - protein, 33 aa, Artificial Sequence
  Description of Artificial Sequence: Synthetic polypeptide
DEQEIATTNPVAYEQWGATVTNLQGEDAGGNQM

SEQ ID NO: 156898 - protein, 30 aa, Artificial Sequence
  Description of Artificial Sequence: Synthetic polypeptide
DDSEVASTNPVSTEGYGNVAANTIQSRGQR

SEQ ID NO: 156899 - protein, 37 aa, Artificial Sequence
  Description of Artificial Sequence: Synthetic polypeptide
DEEEIRTTNPVATEQYGVVSTVNNNNTEAGNTEAGSE

SEQ ID NO: 156900 - protein, 34 aa, Artificial Sequence
  Description of Artificial Sequence: Synthetic polypeptide
DEMEIETTNPVATEQYGTVCSATDGPVEFEGIND

SEQ ID NO: 156901 - protein, 33 aa, Artificial Sequence
  Description of Artificial Sequence: Synthetic polypeptide
DEMEIETTNPVATCQYGTVCSATDGPVEFEGND

SEQ ID NO: 156902 - protein, 34 aa, Artificial Sequence
  Description of Artificial Sequence: Synthetic polypeptide
DEMEIDTTNPVATEQYGTVCSATDGPVHFEGKND

SEQ ID NO: 156903 - protein, 36 aa, Artificial Sequence
  Description of Artificial Sequence: Synthetic polypeptide
DEMEIRTTNPVATEQYGSVCSTPPGWENVHSGQETT

SEQ ID NO: 156904 - protein, 37 aa, Artificial Sequence
  Description of Artificial Sequence: Synthetic polypeptide
DEAEIRTTNPVATEQYGSVVMTNIMSEELRNGNEEVF

SEQ ID NO: 156905 - protein, 38 aa, Artificial Sequence
  Description of Artificial Sequence: Synthetic polypeptide
DEEEIRTTNPVATEQYGVVSTVNNNQQGNNQQGSTDET

SEQ ID NO: 156906 - protein, 34 aa, Artificial Sequence
  Description of Artificial Sequence: Synthetic polypeptide
DEMEIRTTNPVATEQYGSVCPPTMLPESMEVMQG

SEQ ID NO: 156907 - protein, 34 aa, Artificial Sequence
  Description of Artificial Sequence: Synthetic polypeptide
DEMEIRTTNPVATECYGTTVCSATEGPVEFEGND

SEQ ID NO: 156908 - protein, 33 aa, Artificial Sequence
  Description of Artificial Sequence: Synthetic polypeptide
DEMEICTTNPVATEQYGAVCSATDGTVEFEHND

SEQ ID NO: 156909 - protein, 33 aa, Artificial Sequence
  Description of Artificial Sequence: Synthetic polypeptide
DEIEIRTTNPVSTEPYGTISTMEDIQQQQNGNH

SEQ ID NO: 156910 - protein, 32 aa, Artificial Sequence
  Description of Artificial Sequence: Synthetic polypeptide
DEQEIRTTNPVSTEPYGTISMEDIQQQHNGNH

SEQ ID NO: 156911 - protein, 34 aa, Artificial Sequence
  Description of Artificial Sequence: Synthetic polypeptide
DEMEIRTTNPVATECYGTTVCSATEGPVEFEGNI

SEQ ID NO: 156912 - protein, 32 aa, Artificial Sequence
  Description of Artificial Sequence: Synthetic polypeptide
DEQEIRTTNPVSTEPYGTISMEDIQIQQNGNH

SEQ ID NO: 156913 - protein, 32 aa, Artificial Sequence
  Description of Artificial Sequence: Synthetic polypeptide
DEMEIRTTNPVATECYGTVCAAADGPEPEGND

SEQ ID NO: 156914 - protein, 34 aa, Artificial Sequence
  Description of Artificial Sequence: Synthetic polypeptide
DEQEIATTNPVATEQYGSTVANTEDLADHEGEDL

SEQ ID NO: 156915 - protein, 36 aa, Artificial Sequence
  Description of Artificial Sequence: Synthetic polypeptide
DEQEIATTNPVATEQYGSTVGSCTGLSEEHEGGENL

SEQ ID NO: 156916 - protein, 33 aa, Artificial Sequence
  Description of Artificial Sequence: Synthetic polypeptide
DEQEIATTNPVATEQYGSTVSAADWADHKGEYL

SEQ ID NO: 156917 - protein, 34 aa, Artificial Sequence
  Description of Artificial Sequence: Synthetic polypeptide
DEAEIRTTNPVATEQYGSVWDVSQHIGVGPQEDM

SEQ ID NO: 156918 - protein, 35 aa, Artificial Sequence
  Description of Artificial Sequence: Synthetic polypeptide
DEQEICTTNPVATEQYGSLVSATDDLSEPHEGEDT

SEQ ID NO: 156919 - protein, 36 aa, Artificial Sequence
  Description of Artificial Sequence: Synthetic polypeptide
DEQEIATTNPVATEQYGSTVSATGALSEDIEGGENL

SEQ ID NO: 156920 - protein, 35 aa, Artificial Sequence
  Description of Artificial Sequence: Synthetic polypeptide
DEEEIRTTNPVAYEQYGQCVCSSEDDNQRFNSDQM

SEQ ID NO: 156921 - protein, 32 aa, Artificial Sequence
  Description of Artificial Sequence: Synthetic polypeptide
DEQEIRTTNPVSTEPYGTISMEDIQQQQNGNH

SEQ ID NO: 156922 - protein, 34 aa, Artificial Sequence
  Description of Artificial Sequence: Synthetic polypeptide
DEMEIRTTNPVATEQYGSVCPDMLLQEIPEDQDI

SEQ ID NO: 156923 - protein, 34 aa, Artificial Sequence
  Description of Artificial Sequence: Synthetic polypeptide
DEQEIAVTNPVATEQYGSVSATDLLEDHEGGEDL

SEQ ID NO: 156924 - protein, 33 aa, Artificial Sequence
  Description of Artificial Sequence: Synthetic polypeptide
DEAEIATTNPVATEQYGSVCAATNGEEMMMPEG

SEQ ID NO: 156925 - protein, 38 aa, Artificial Sequence
  Description of Artificial Sequence: Synthetic polypeptide
DEEEIRTTNPVATEQYGVVSTVTNNQQGNQQGTNDEEQ

SEQ ID NO: 156926 - protein, 38 aa, Artificial Sequence
  Description of Artificial Sequence: Synthetic polypeptide
DEEEIRTTNPVATEQYGVVSTVTNNQQGNQQGTNEEED

SEQ ID NO: 156927 - protein, 38 aa, Artificial Sequence
  Description of Artificial Sequence: Synthetic polypeptide
DEEEIRTTNPVATEQYGVVSTVVNLQNQQQATNNATEG

SEQ ID NO: 156928 - protein, 32 aa, Artificial Sequence
  Description of Artificial Sequence: Synthetic polypeptide
DEQEIRTTNPVSTEQYGTISMEDIQQQHNGEL

SEQ ID NO: 156929 - protein, 33 aa, Artificial Sequence
  Description of Artificial Sequence: Synthetic polypeptide
DEAEIATTNPVATEQYGSVCAAVPAQAMDPNEN

SEQ ID NO: 156930 - protein, 33 aa, Artificial Sequence
  Description of Artificial Sequence: Synthetic polypeptide
DEAEISTTNPVATEQYGCVCSWEEHQNFGSDQM

SEQ ID NO: 156931 - protein, 34 aa, Artificial Sequence
  Description of Artificial Sequence: Synthetic polypeptide
DEEEIRTTNPVAYEQYGQCVCSSEDDNQHGSQQS

SEQ ID NO: 156932 - protein, 32 aa, Artificial Sequence
  Description of Artificial Sequence: Synthetic polypeptide
DEQEIRTTNPVSTEQYGTISMEDIQQQHNGEH

SEQ ID NO: 156933 - protein, 34 aa, Artificial Sequence
  Description of Artificial Sequence: Synthetic polypeptide
DEMEICTTNPVATEQYGAVCSAVDGTVEFEGNIS

SEQ ID NO: 156934 - protein, 34 aa, Artificial Sequence
  Description of Artificial Sequence: Synthetic polypeptide
DEEEIRTTNPVAYEQYGQCVCSSEDDNQNGSDQF

SEQ ID NO: 156935 - protein, 34 aa, Artificial Sequence
  Description of Artificial Sequence: Synthetic polypeptide
DEAEIRTTNPVATEQYGSVWDVNTGVAEGGEEKT

SEQ ID NO: 156936 - protein, 33 aa, Artificial Sequence
  Description of Artificial Sequence: Synthetic polypeptide
DEAEISTTNPVATEQYGCVCSWEHNQNFGSEQA

SEQ ID NO: 156937 - protein, 35 aa, Artificial Sequence
  Description of Artificial Sequence: Synthetic polypeptide
DEAEIRTTNPVATEQYGSVWDVSQHEIGNFPQEFM

SEQ ID NO: 156938 - protein, 32 aa, Artificial Sequence
  Description of Artificial Sequence: Synthetic polypeptide
DEQEIATTNPVATESYGCVAANNNLNIDAGGH

SEQ ID NO: 156939 - protein, 32 aa, Artificial Sequence
  Description of Artificial Sequence: Synthetic polypeptide
DEQEIRTTNPVSTEPYGTISMEDLQQQHNGEH

SEQ ID NO: 156940 - protein, 35 aa, Artificial Sequence
  Description of Artificial Sequence: Synthetic polypeptide
DEAEIATTNPVATEQYGSVCAATAQLAATAEGDRN

SEQ ID NO: 156941 - protein, 33 aa, Artificial Sequence
  Description of Artificial Sequence: Synthetic polypeptide
DEMEIRTTNPVATECYGAVWAATEGWEPKGNYD

SEQ ID NO: 156942 - protein, 34 aa, Artificial Sequence
  Description of Artificial Sequence: Synthetic polypeptide
DEEEIRTTNPVAYEQYGQCVCSSEDHNQSGSQQA

SEQ ID NO: 156943 - protein, 32 aa, Artificial Sequence
  Description of Artificial Sequence: Synthetic polypeptide
DEIEIRTTNPVSTEPYGTISMEDIQQSQNGNH

SEQ ID NO: 156944 - protein, 31 aa, Artificial Sequence
  Description of Artificial Sequence: Synthetic polypeptide
DDSEVASTNPVSTEGYGNVAANNLQSRVGQR

SEQ ID NO: 156945 - protein, 34 aa, Artificial Sequence
  Description of Artificial Sequence: Synthetic polypeptide
DEMEICTTNPVATEQYGAVCSATDGPVEFEGNFD

SEQ ID NO: 156946 - protein, 39 aa, Artificial Sequence
  Description of Artificial Sequence: Synthetic polypeptide
DEEEIRTTNPVATEQYGSVSTTVTNNQQSTTEQGNNNGN

SEQ ID NO: 156947 - protein, 39 aa, Artificial Sequence
  Description of Artificial Sequence: Synthetic polypeptide
DEEEIRTTNPVATEQYGSVSTTVTNNQISTTEQGTNNGE

SEQ ID NO: 156948 - protein, 38 aa, Artificial Sequence
  Description of Artificial Sequence: Synthetic polypeptide
DEEEIRTTNPVATEQYGVVSTVNTNTEQGNNNSEQGND

SEQ ID NO: 156949 - protein, 30 aa, Artificial Sequence
  Description of Artificial Sequence: Synthetic polypeptide
DDSEVASTNPVSTEGYGNVAANNLQRVGQQ

SEQ ID NO: 156950 - protein, 34 aa, Artificial Sequence
  Description of Artificial Sequence: Synthetic polypeptide
DEMEIRTTNPVATECYGTVCSATDGPVEDFEGND

SEQ ID NO: 156951 - protein, 29 aa, Artificial Sequence
  Description of Artificial Sequence: Synthetic peptide
DDSEVASTNPVSTEGYGNVAANNIQSGTR

SEQ ID NO: 156952 - protein, 38 aa, Artificial Sequence
  Description of Artificial Sequence: Synthetic polypeptide
DEEEIRTTNPVATEQYGVVSTVNTNLQQGTEQGTEEAE

SEQ ID NO: 156953 - protein, 33 aa, Artificial Sequence
  Description of Artificial Sequence: Synthetic polypeptide
DEQEIATTNPVATEQYGSVAATDHHEDHHGEDL

SEQ ID NO: 156954 - protein, 39 aa, Artificial Sequence
  Description of Artificial Sequence: Synthetic polypeptide
DEEEIRTTNPVATEQYGSVSTTVTNLQQSATETGTTQGS

SEQ ID NO: 156955 - protein, 38 aa, Artificial Sequence
  Description of Artificial Sequence: Synthetic polypeptide
DEEEIRTTNPVATEQYGVVSTVNSNNNQQGNQQNEEDE

SEQ ID NO: 156956 - protein, 38 aa, Artificial Sequence
  Description of Artificial Sequence: Synthetic polypeptide
DEEEIRTTNPVATEQYGSVSTTVNTNNNEQGTTEQGQE

SEQ ID NO: 156957 - protein, 33 aa, Artificial Sequence
  Description of Artificial Sequence: Synthetic polypeptide
DEQEIATTNPVATEQYGSVAATDQGEDHEGEDL

SEQ ID NO: 156958 - protein, 37 aa, Artificial Sequence
  Description of Artificial Sequence: Synthetic polypeptide
DEEEIRTTNPVATEQYGVVSTVNQQQQQQATNNATEA

SEQ ID NO: 156959 - protein, 34 aa, Artificial Sequence
  Description of Artificial Sequence: Synthetic polypeptide
DEMEICTTNPVATEQYGAVCSATDGPVEFEGQNY

SEQ ID NO: 156960 - protein, 35 aa, Artificial Sequence
  Description of Artificial Sequence: Synthetic polypeptide
DEEEIRTTNPVSTEQYGTISTMPAIPQMQNGMNPH

SEQ ID NO: 156961 - protein, 36 aa, Artificial Sequence
  Description of Artificial Sequence: Synthetic polypeptide
DEQEIATTNPVATEQYGSTVSCTWLSEDHEGGENLE

SEQ ID NO: 156962 - protein, 34 aa, Artificial Sequence
  Description of Artificial Sequence: Synthetic polypeptide
DEMEICTTNPVATEQYGAVCSATDGTVEFEGNYI

SEQ ID NO: 156963 - protein, 32 aa, Artificial Sequence
  Description of Artificial Sequence: Synthetic polypeptide
DEIEIRTTNPVSTEPYGTISMEDIQQQQNGNY

SEQ ID NO: 156964 - protein, 31 aa, Artificial Sequence
  Description of Artificial Sequence: Synthetic polypeptide
DDSEVASTNPVSTEGYGVVAANTLQSRVGQR

SEQ ID NO: 156965 - protein, 33 aa, Artificial Sequence
  Description of Artificial Sequence: Synthetic polypeptide
DEMEIRTTNPVATECYGTVCAATDGPVEFEGND

SEQ ID NO: 156966 - protein, 34 aa, Artificial Sequence
  Description of Artificial Sequence: Synthetic polypeptide
DEQEICTTNPVATEQYGSLVSATDLEPHESEDTV

SEQ ID NO: 156967 - protein, 32 aa, Artificial Sequence
  Description of Artificial Sequence: Synthetic polypeptide
DEIEIRTTNPVSTEPYGTISMEDIQQQQNGNH

SEQ ID NO: 156968 - protein, 39 aa, Artificial Sequence
  Description of Artificial Sequence: Synthetic polypeptide
DEEEIRTTNPVATEQYGSVSTTVVNNQQSTTEQGTNQTN

SEQ ID NO: 156969 - protein, 33 aa, Artificial Sequence
  Description of Artificial Sequence: Synthetic polypeptide
DEAEISTTNGVAYCQYGCVCSTNLNQGFGSDQA

SEQ ID NO: 156970 - protein, 33 aa, Artificial Sequence
  Description of Artificial Sequence: Synthetic polypeptide
DEQEIATTNPVATEQYGVVSATDLEDHELEDDW

SEQ ID NO: 156971 - protein, 33 aa, Artificial Sequence
  Description of Artificial Sequence: Synthetic polypeptide
DEQEIRTTNPVSTEPYGSVSAMDIQEDQEGEDL

SEQ ID NO: 156972 - protein, 35 aa, Artificial Sequence
  Description of Artificial Sequence: Synthetic polypeptide
DEHEIRTTNPVAYECWGSVSGDNLNGDRQGQNGGK

SEQ ID NO: 156973 - protein, 36 aa, Artificial Sequence
  Description of Artificial Sequence: Synthetic polypeptide
DEQEIATTNPVATEQYGSTVSCTGLSLDHEGGENLT

SEQ ID NO: 156974 - protein, 32 aa, Artificial Sequence
  Description of Artificial Sequence: Synthetic polypeptide
DEIEIRTTNPVSTEPYGTISMEDIQMQQNGNH

SEQ ID NO: 156975 - protein, 30 aa, Artificial Sequence
  Description of Artificial Sequence: Synthetic polypeptide
DEIEIRTTNPVAYEQWGDVSEIEMNAAEDA

SEQ ID NO: 156976 - protein, 35 aa, Artificial Sequence
  Description of Artificial Sequence: Synthetic polypeptide
DEQEIATTNPVATEQYGSTVSCTLTSEDHEGGDNL

SEQ ID NO: 156977 - protein, 36 aa, Artificial Sequence
  Description of Artificial Sequence: Synthetic polypeptide
DEMEIRTTNPVATEQYGSVASPTDLLLERNDEEVMT

SEQ ID NO: 156978 - protein, 30 aa, Artificial Sequence
  Description of Artificial Sequence: Synthetic polypeptide
DDSEVASTNPVSTEGYGVVAANTLQRVGDI

SEQ ID NO: 156979 - protein, 30 aa, Artificial Sequence
  Description of Artificial Sequence: Synthetic polypeptide
DDSEVASTNPVSTEGYGVVANNIQSRVGQR

SEQ ID NO: 156980 - protein, 35 aa, Artificial Sequence
  Description of Artificial Sequence: Synthetic polypeptide
DEQEISTTNPAATEQYGSVSATGDGEDQEGNGQEF

SEQ ID NO: 156981 - protein, 33 aa, Artificial Sequence
  Description of Artificial Sequence: Synthetic polypeptide
DEMEIRTTNPVATECYGAVWAATEGPEPKGNYD

SEQ ID NO: 156982 - protein, 33 aa, Artificial Sequence
  Description of Artificial Sequence: Synthetic polypeptide
DEQEIATTNPVSTEPYGSVSAMEDLQQQHNGEH

SEQ ID NO: 156983 - protein, 34 aa, Artificial Sequence
  Description of Artificial Sequence: Synthetic polypeptide
DEANEIATTNPVAYEQYGSVAITNDTTAEGGNDD

SEQ ID NO: 156984 - protein, 34 aa, Artificial Sequence
  Description of Artificial Sequence: Synthetic polypeptide
DEAEISTTNPVATEQYGCVCSTEHNQNFGSETQL

SEQ ID NO: 156985 - protein, 34 aa, Artificial Sequence
  Description of Artificial Sequence: Synthetic polypeptide
DEAEIRTTNPVATEQYGSVVTDVSHFEISENEKQ

SEQ ID NO: 156986 - protein, 38 aa, Artificial Sequence
  Description of Artificial Sequence: Synthetic polypeptide
DEEEIRTTNPVATEQYGVVSTVQNQLQAGTEQGTTVTE

SEQ ID NO: 156987 - protein, 38 aa, Artificial Sequence
  Description of Artificial Sequence: Synthetic polypeptide
DEEEIRTTNPVATEQYGVVSTTQNLQQGTEQGGTEEEE

SEQ ID NO: 156988 - protein, 34 aa, Artificial Sequence
  Description of Artificial Sequence: Synthetic polypeptide
DEAEISTTNPVATEQYGCVCSTEHQENFNSNTQS

SEQ ID NO: 156989 - protein, 38 aa, Artificial Sequence
  Description of Artificial Sequence: Synthetic polypeptide
DEEEIRTTNPVATEQYGVVSTVNNNQQGNQAGTTDEED

SEQ ID NO: 156990 - protein, 35 aa, Artificial Sequence
  Description of Artificial Sequence: Synthetic polypeptide
DEAEISTTNPVATEQYGCVCSTENHNQENFNSDQS

SEQ ID NO: 156991 - protein, 37 aa, Artificial Sequence
  Description of Artificial Sequence: Synthetic polypeptide
DEAEIRTTNPVATEQYGSVVWTGEMLEELRNGNEEVF

SEQ ID NO: 156992 - protein, 33 aa, Artificial Sequence
  Description of Artificial Sequence: Synthetic polypeptide
DAAEIATTNPVAYEQYGSVAAANNALTADPGNN

SEQ ID NO: 156993 - protein, 35 aa, Artificial Sequence
  Description of Artificial Sequence: Synthetic polypeptide
DEQEISTTNPVATEQYGSVSATGDQEDQEGEGDGQ

SEQ ID NO: 156994 - protein, 34 aa, Artificial Sequence
  Description of Artificial Sequence: Synthetic polypeptide
DEAEISTTNPVATEQYGCVCSTEPNAYFGSDTQS

SEQ ID NO: 156995 - protein, 39 aa, Artificial Sequence
  Description of Artificial Sequence: Synthetic polypeptide
DEEEIRTTNPVATEQYGVVSTTQGNLQAGNTEQGVTTNQ

SEQ ID NO: 156996 - protein, 34 aa, Artificial Sequence
  Description of Artificial Sequence: Synthetic polypeptide
DEQEIATTNPVSTEQYGSVSAMEDLQQQHNGEDH

SEQ ID NO: 156997 - protein, 33 aa, Artificial Sequence
  Description of Artificial Sequence: Synthetic polypeptide
DEAEISTTNPVATEQYGCVCSTEHNAYFISDQS

SEQ ID NO: 156998 - protein, 33 aa, Artificial Sequence
  Description of Artificial Sequence: Synthetic polypeptide
DEIEIVTTNPVATEQYGTVCSATDGPVEFEQND

SEQ ID NO: 156999 - protein, 37 aa, Artificial Sequence
  Description of Artificial Sequence: Synthetic polypeptide
DEAEIRTTNPVATEQYGSVVSTLIMLEELENGNEEVM

SEQ ID NO: 157000 - protein, 37 aa, Artificial Sequence
  Description of Artificial Sequence: Synthetic polypeptide
DEAEIRTTNPVATEQYGSVVSTDIMCEELRNGNEEVF

SEQ ID NO: 157001 - protein, 38 aa, Artificial Sequence
  Description of Artificial Sequence: Synthetic polypeptide
DEEEIRTTNPVATEQYGVVSTVNNNQQGNNQQGTEQGS

SEQ ID NO: 157002 - protein, 39 aa, Artificial Sequence
  Description of Artificial Sequence: Synthetic polypeptide
DEEEIRTTNPVATEQYGVVSTVVNNLGGNQGIGNNEQGQ

SEQ ID NO: 157003 - protein, 33 aa, Artificial Sequence
  Description of Artificial Sequence: Synthetic polypeptide
DEIVEIATTNPVAYEPWGSVATNLGGNAGENAS

SEQ ID NO: 157004 - protein, 37 aa, Artificial Sequence
  Description of Artificial Sequence: Synthetic polypeptide
DEEEIRTTNPVATEQYGVVSTVQQAGTEAGTTNQDED

SEQ ID NO: 157005 - protein, 37 aa, Artificial Sequence
  Description of Artificial Sequence: Synthetic polypeptide
DEEEIRTTNPVATEQYGVVSTVTNNQNQATTTNVATE

SEQ ID NO: 157006 - protein, 38 aa, Artificial Sequence
  Description of Artificial Sequence: Synthetic polypeptide
DEEEIRTTNPVATEQYGVVSTVTNNQNQEQGTNQQGTD

SEQ ID NO: 157007 - protein, 33 aa, Artificial Sequence
  Description of Artificial Sequence: Synthetic polypeptide
DEQEIATTNPVATWQPYGNVSATDLEDHEGEDL

SEQ ID NO: 157008 - protein, 35 aa, Artificial Sequence
  Description of Artificial Sequence: Synthetic polypeptide
DEMEIRTTNPVATECWGCVCSWMNENQDRFGSNQS

SEQ ID NO: 157009 - protein, 39 aa, Artificial Sequence
  Description of Artificial Sequence: Synthetic polypeptide
DEEEIRTTNPVATEQYGVVSTVVNNGNLQQGTNEEDEDE

SEQ ID NO: 157010 - protein, 37 aa, Artificial Sequence
  Description of Artificial Sequence: Synthetic polypeptide
DEEEIRTTNPVATEQYGVVSTTQQQQLQQGTEQGTTE

SEQ ID NO: 157011 - protein, 37 aa, Artificial Sequence
  Description of Artificial Sequence: Synthetic polypeptide
DEAEIRTTNPVATEQYGSVVSFQIMLEELRNGNEEVF

SEQ ID NO: 157012 - protein, 39 aa, Artificial Sequence
  Description of Artificial Sequence: Synthetic polypeptide
DEEEIRTTNPVATEQYGVVSTVVNLQQGTQQGTTTNVAE

SEQ ID NO: 157013 - protein, 33 aa, Artificial Sequence
  Description of Artificial Sequence: Synthetic polypeptide
DEMEIRTTNPVATECWGSVSCIEEPQDAEGEEG

SEQ ID NO: 157014 - protein, 34 aa, Artificial Sequence
  Description of Artificial Sequence: Synthetic polypeptide
DEMEIRTTNPVATECWGSVSCIEEPQDREVENSS

SEQ ID NO: 157015 - protein, 37 aa, Artificial Sequence
  Description of Artificial Sequence: Synthetic polypeptide
DEAEIRTTNPVATEQYGSVVSSSTMLEELFNGNEEHF

SEQ ID NO: 157016 - protein, 33 aa, Artificial Sequence
  Description of Artificial Sequence: Synthetic polypeptide
DEAEISTTNPVATEQYGCVCSTEEHAHFGSDQS

SEQ ID NO: 157017 - protein, 33 aa, Artificial Sequence
  Description of Artificial Sequence: Synthetic polypeptide
DEIEIVTTNPVATEQFGTVCSATDGPVEFEGND

SEQ ID NO: 157018 - protein, 35 aa, Artificial Sequence
  Description of Artificial Sequence: Synthetic polypeptide
DEQEISTTNPVATEQYGSVSATGDGEDQEGEGDTD

SEQ ID NO: 157019 - protein, 35 aa, Artificial Sequence
  Description of Artificial Sequence: Synthetic polypeptide
DEQEISTTNPVATEQYGSVSATGDGEDLEGNGQGN

SEQ ID NO: 157020 - protein, 30 aa, Artificial Sequence
  Description of Artificial Sequence: Synthetic polypeptide
DDSEVASTNPVSTEGYGVVANTLQSRVGQR

SEQ ID NO: 157021 - protein, 34 aa, Artificial Sequence
  Description of Artificial Sequence: Synthetic polypeptide
DEQEIATTNPVATEVYGSVSSATDLVEDHEGEDL

SEQ ID NO: 157022 - protein, 29 aa, Artificial Sequence
  Description of Artificial Sequence: Synthetic peptide
DDSEVASTNPVSTEGYGVVANTIQSRGQR

SEQ ID NO: 157023 - protein, 35 aa, Artificial Sequence
  Description of Artificial Sequence: Synthetic polypeptide
DEEEIRTTNPVSTETYGSVSMVNTLLQDADEVELL

SEQ ID NO: 157024 - protein, 33 aa, Artificial Sequence
  Description of Artificial Sequence: Synthetic polypeptide
DAAEIATTNPVAYEQYGSVATNLTGTPDGSDEN

SEQ ID NO: 157025 - protein, 38 aa, Artificial Sequence
  Description of Artificial Sequence: Synthetic polypeptide
DEEEIRTTNPVATEQYGVVSTVNTNTEQGSTNTEQGNQ

SEQ ID NO: 157026 - protein, 33 aa, Artificial Sequence
  Description of Artificial Sequence: Synthetic polypeptide
DEQEIATVNPVATEAYGLSVSYTDLEDHEGEDL

SEQ ID NO: 157027 - protein, 34 aa, Artificial Sequence
  Description of Artificial Sequence: Synthetic polypeptide
DEEEIRTTNPVSTETYGSVSMVITAQITEEVGLN

SEQ ID NO: 157028 - protein, 34 aa, Artificial Sequence
  Description of Artificial Sequence: Synthetic polypeptide
DEAEISTTNPVATEQYGCVCSTVELNAYFGSDQS

SEQ ID NO: 157029 - protein, 35 aa, Artificial Sequence
  Description of Artificial Sequence: Synthetic polypeptide
DEQEISTTNPVATEFYGSVSATGDGEDQEGNGNGD

SEQ ID NO: 157030 - protein, 33 aa, Artificial Sequence
  Description of Artificial Sequence: Synthetic polypeptide
DEMEIRTTNPVATECYGAVWAATEDWEPKGNYD

SEQ ID NO: 157031 - protein, 34 aa, Artificial Sequence
  Description of Artificial Sequence: Synthetic polypeptide
DEQEIATTNPVATEVWGSVCYTNDNQDQGGQNDE

SEQ ID NO: 157032 - protein, 34 aa, Artificial Sequence
  Description of Artificial Sequence: Synthetic polypeptide
DEQEIATTNPVATEVWGSVCYTNDHQDQRGQDDG

SEQ ID NO: 157033 - protein, 33 aa, Artificial Sequence
  Description of Artificial Sequence: Synthetic polypeptide
DEMEICTTNPVATEQYGAVCSAWDVPVEFEGNY

SEQ ID NO: 157034 - protein, 33 aa, Artificial Sequence
  Description of Artificial Sequence: Synthetic polypeptide
DEQEIATTNPVATEQYGSTSAAEDLEDHEGEYL

SEQ ID NO: 157035 - protein, 34 aa, Artificial Sequence
  Description of Artificial Sequence: Synthetic polypeptide
DEMEIRTTNPVATECWGTVCSTINEPEDFEGENG

SEQ ID NO: 157036 - protein, 36 aa, Artificial Sequence
  Description of Artificial Sequence: Synthetic polypeptide
DEAEIATTNPVATEQYGSVCADTNAGQQEHGDNQAE

SEQ ID NO: 157037 - protein, 34 aa, Artificial Sequence
  Description of Artificial Sequence: Synthetic polypeptide
DEEEIRTTNPVSTETYGSVSMVSTVVTEEVNLLN

SEQ ID NO: 157038 - protein, 33 aa, Artificial Sequence
  Description of Artificial Sequence: Synthetic polypeptide
DEMEIRTTNPVATECWGTVCSCIGEPEREGENG

SEQ ID NO: 157039 - protein, 35 aa, Artificial Sequence
  Description of Artificial Sequence: Synthetic polypeptide
DEQEISTTNPVATEQYGSVSATGDGEDEEGNGQED

SEQ ID NO: 157040 - protein, 35 aa, Artificial Sequence
  Description of Artificial Sequence: Synthetic polypeptide
DEAEIATTNPVATEQYGSVCADTNPQFGALGGSFV

SEQ ID NO: 157041 - protein, 36 aa, Artificial Sequence
  Description of Artificial Sequence: Synthetic polypeptide
DEAEIATTNPVATEQYGSVCADTNPLTNADIGNVAE

SEQ ID NO: 157042 - protein, 34 aa, Artificial Sequence
  Description of Artificial Sequence: Synthetic polypeptide
DEAEIATTNPVATEQYGSVCADTNNGIEHIDNAE

SEQ ID NO: 157043 - protein, 34 aa, Artificial Sequence
  Description of Artificial Sequence: Synthetic polypeptide
DEAEISTTNPVATEQYGCVCSTGEDEGFGSENQS

SEQ ID NO: 157044 - protein, 36 aa, Artificial Sequence
  Description of Artificial Sequence: Synthetic polypeptide
DEQEISTTNPVATEQYGSVNSATGDGEDQEGNGQGD

SEQ ID NO: 157045 - protein, 37 aa, Artificial Sequence
  Description of Artificial Sequence: Synthetic polypeptide
DEEEIRTTNPVATEQYGVVSTTNVATEQYGSTDQDTD

SEQ ID NO: 157046 - protein, 33 aa, Artificial Sequence
  Description of Artificial Sequence: Synthetic polypeptide
DEQEIATTNPVATEQYGSVAATEDWEDHEGEDL

SEQ ID NO: 157047 - protein, 38 aa, Artificial Sequence
  Description of Artificial Sequence: Synthetic polypeptide
DEEEIRTTNPVATEQYGVVSTTNTNQQNGNQAGNQTDE

SEQ ID NO: 157048 - protein, 33 aa, Artificial Sequence
  Description of Artificial Sequence: Synthetic polypeptide
DEANEIATTNPVAYEAWGEVCSTNDQDGQGNQT

SEQ ID NO: 157049 - protein, 37 aa, Artificial Sequence
  Description of Artificial Sequence: Synthetic polypeptide
DEEEIRTTNPVATEQYGVVSTVQNNNQQATTTNVATE

SEQ ID NO: 157050 - protein, 34 aa, Artificial Sequence
  Description of Artificial Sequence: Synthetic polypeptide
DEQEIATTNPVATLQYGSVSATTDLGEDHEGEDL

SEQ ID NO: 157051 - protein, 38 aa, Artificial Sequence
  Description of Artificial Sequence: Synthetic polypeptide
DEEEIRTTNPVATEQYGVVSTVQNLQQGTEQGTTDEAD

SEQ ID NO: 157052 - protein, 38 aa, Artificial Sequence
  Description of Artificial Sequence: Synthetic polypeptide
DEEEIRTTNPVATEQYGVVSTVQNGNNQQGNNQQGTTE

SEQ ID NO: 157053 - protein, 32 aa, Artificial Sequence
  Description of Artificial Sequence: Synthetic polypeptide
DEMEIRTTNPVATECWGTVCANADGPEPKGND

SEQ ID NO: 157054 - protein, 34 aa, Artificial Sequence
  Description of Artificial Sequence: Synthetic polypeptide
DEAEISTTNPVATEQYGCVCSTGNLNAYFISDQS

SEQ ID NO: 157055 - protein, 35 aa, Artificial Sequence
  Description of Artificial Sequence: Synthetic polypeptide
DEAEIATTNPVATEQYGSVCADTNNGIEHGDNDAM

SEQ ID NO: 157056 - protein, 39 aa, Artificial Sequence
  Description of Artificial Sequence: Synthetic polypeptide
DEEEIRTTNPVATEQYGVVSTVTNLQAGNQQSTTTNNAE

SEQ ID NO: 157057 - protein, 38 aa, Artificial Sequence
  Description of Artificial Sequence: Synthetic polypeptide
DEEEIRTTNPVATEQYGVVSTQGTDQLIDQGEGGNAGT

SEQ ID NO: 157058 - protein, 38 aa, Artificial Sequence
  Description of Artificial Sequence: Synthetic polypeptide
DEEEIRTTNPVATEQYGVVSTVNNQQNQQQGTNDEEQE

SEQ ID NO: 157059 - protein, 37 aa, Artificial Sequence
  Description of Artificial Sequence: Synthetic polypeptide
DEQEIRTTNPVATEQYGSVPETWLNTEQGRIIVEENQ

SEQ ID NO: 157060 - protein, 36 aa, Artificial Sequence
  Description of Artificial Sequence: Synthetic polypeptide
DEEEIRTTNPVATEQYGSVSTTMMQFMEPVSLEPDN

SEQ ID NO: 157061 - protein, 33 aa, Artificial Sequence
  Description of Artificial Sequence: Synthetic polypeptide
DEMEIATTNPVATEQYGTVCSATDGPVEFEGEL

SEQ ID NO: 157062 - protein, 33 aa, Artificial Sequence
  Description of Artificial Sequence: Synthetic polypeptide
DEHEIRTTNPVAYMQWGSVPTWEDQHQGQNQDH

SEQ ID NO: 157063 - protein, 33 aa, Artificial Sequence
  Description of Artificial Sequence: Synthetic polypeptide
DEMEIRTTNPVATEQYGCVCQTATIENFMSNQS

SEQ ID NO: 157064 - protein, 38 aa, Artificial Sequence
  Description of Artificial Sequence: Synthetic polypeptide
DEEEIRTTNPVATEQYGVVSTVNQNNNQQGTNNNDEED

SEQ ID NO: 157065 - protein, 38 aa, Artificial Sequence
  Description of Artificial Sequence: Synthetic polypeptide
DEEEIRTTNPVATEQYGVVSTVNQNNNQQGTNNNEDEE

SEQ ID NO: 157066 - protein, 34 aa, Artificial Sequence
  Description of Artificial Sequence: Synthetic polypeptide
DEMEIRTTNPVATEQYGCVCQTELNINFMSDNQS

SEQ ID NO: 157067 - protein, 33 aa, Artificial Sequence
  Description of Artificial Sequence: Synthetic polypeptide
DEQEIRTTNPVATEPYGTISAMEDIQQDQNGNH

SEQ ID NO: 157068 - protein, 34 aa, Artificial Sequence
  Description of Artificial Sequence: Synthetic polypeptide
DEAEIRTTNPVAYEQWGSVCYTQDNDQHHGGGIF

SEQ ID NO: 157069 - protein, 39 aa, Artificial Sequence
  Description of Artificial Sequence: Synthetic polypeptide
DEEEIRTTNPVATEQYGVVSTTNQLQQGNNTEQGSTDDQ

SEQ ID NO: 157070 - protein, 33 aa, Artificial Sequence
  Description of Artificial Sequence: Synthetic polypeptide
DEHEIRTTNPVAYESWGVVSGGNHGNTQGGNGS

SEQ ID NO: 157071 - protein, 33 aa, Artificial Sequence
  Description of Artificial Sequence: Synthetic polypeptide
DEMEIATTNPVATEQYGTVCSATDGPVEFEGED

SEQ ID NO: 157072 - protein, 31 aa, Artificial Sequence
  Description of Artificial Sequence: Synthetic polypeptide
DEQEIRTTNPVATEQWGDTVSEIEMNAAEDA

SEQ ID NO: 157073 - protein, 35 aa, Artificial Sequence
  Description of Artificial Sequence: Synthetic polypeptide
DEEEIRTTNPVSTEQYGSVNNGFNGQSGQGEQEEV

SEQ ID NO: 157074 - protein, 38 aa, Artificial Sequence
  Description of Artificial Sequence: Synthetic polypeptide
DEEEIRTTNPVATEQYGVVSTTNQLQQNATEQGSTQSE

SEQ ID NO: 157075 - protein, 33 aa, Artificial Sequence
  Description of Artificial Sequence: Synthetic polypeptide
DEAEIRTTNPVAYEHWGEVSSNNLGEDHQNNGR

SEQ ID NO: 157076 - protein, 34 aa, Artificial Sequence
  Description of Artificial Sequence: Synthetic polypeptide
DEAEIRTTNPVAYEQWGSVSGGGPNHQGQGGGEN

SEQ ID NO: 157077 - protein, 31 aa, Artificial Sequence
  Description of Artificial Sequence: Synthetic polypeptide
DDSEVASTNPVSTEGYGNVAANTLQSRVGQR

SEQ ID NO: 157078 - protein, 34 aa, Artificial Sequence
  Description of Artificial Sequence: Synthetic polypeptide
DEEEIRTTNPVSTEQYGCVCGSEDHNQGFGSQQS

SEQ ID NO: 157079 - protein, 32 aa, Artificial Sequence
  Description of Artificial Sequence: Synthetic polypeptide
DEHEIRTTNPVAYMQWGTVPTWEDGQHQGNDH

SEQ ID NO: 157080 - protein, 32 aa, Artificial Sequence
  Description of Artificial Sequence: Synthetic polypeptide
DEHEIRTTNPVAYMQWGSVPTWEQDQHQENDH

SEQ ID NO: 157081 - protein, 33 aa, Artificial Sequence
  Description of Artificial Sequence: Synthetic polypeptide
DEQEIRTTNPVATEPYGSISAMEDIQDQNGEDL

SEQ ID NO: 157082 - protein, 33 aa, Artificial Sequence
  Description of Artificial Sequence: Synthetic polypeptide
DEHEIRTTNPVAYMQWGSVPTWEKDQGQRDGDS

SEQ ID NO: 157083 - protein, 34 aa, Artificial Sequence
  Description of Artificial Sequence: Synthetic polypeptide
DEAEIRTTNPVAYEQWGSVSHSMNDRGNDGNGPN

SEQ ID NO: 157084 - protein, 34 aa, Artificial Sequence
  Description of Artificial Sequence: Synthetic polypeptide
DEAEIRTTNPVAYEQWGSVSHGMNDRGNDGNDGN

SEQ ID NO: 157085 - protein, 32 aa, Artificial Sequence
  Description of Artificial Sequence: Synthetic polypeptide
DEHEIRTTNPVAYMQWGSVPTWEHDQQQGEDP

SEQ ID NO: 157086 - protein, 35 aa, Artificial Sequence
  Description of Artificial Sequence: Synthetic polypeptide
DEAEIRTTNPVAYEQWGSVSGNPNQGNQGGMNGGH

SEQ ID NO: 157087 - protein, 34 aa, Artificial Sequence
  Description of Artificial Sequence: Synthetic polypeptide
DAEEIATTNPVATEQWGAVTSTNHQLNTEGGTQD

SEQ ID NO: 157088 - protein, 33 aa, Artificial Sequence
  Description of Artificial Sequence: Synthetic polypeptide
DEHEIRTTNPVAYMQWGSVPTWEDQHQGRNEDD

SEQ ID NO: 157089 - protein, 35 aa, Artificial Sequence
  Description of Artificial Sequence: Synthetic polypeptide
DEQEIRTTNPVATEQYGSVPTTVLHEGTQEVQQQE

SEQ ID NO: 157090 - protein, 34 aa, Artificial Sequence
  Description of Artificial Sequence: Synthetic polypeptide
DEAEIRTTNPVAYEQWGSVSGNGNGNQGGMGGGH

SEQ ID NO: 157091 - protein, 34 aa, Artificial Sequence
  Description of Artificial Sequence: Synthetic polypeptide
DEAEIRTTNPVAYEQWGSVSGGNPDPDEGQNGHE

SEQ ID NO: 157092 - protein, 38 aa, Artificial Sequence
  Description of Artificial Sequence: Synthetic polypeptide
DEEEIRTTNPVATEQYGVVSTVTNQQQENNATEQGTNQ

SEQ ID NO: 157093 - protein, 36 aa, Artificial Sequence
  Description of Artificial Sequence: Synthetic polypeptide
DEEEIRTTNPVAYEQYGQCVCSWMNDHNQRFGSQQG

SEQ ID NO: 157094 - protein, 33 aa, Artificial Sequence
  Description of Artificial Sequence: Synthetic polypeptide
DEMEIRTTNPVATEQYGCVCQNTADINFMSDQS

SEQ ID NO: 157095 - protein, 37 aa, Artificial Sequence
  Description of Artificial Sequence: Synthetic polypeptide
DEEEIRTTNPVATEQYGVVSTVTQQAGNQAIGTDEEQ

SEQ ID NO: 157096 - protein, 34 aa, Artificial Sequence
  Description of Artificial Sequence: Synthetic polypeptide
DEAEIRTTNPVAYEQWGSVCYTGDDDGRQDKGDR

SEQ ID NO: 157097 - protein, 33 aa, Artificial Sequence
  Description of Artificial Sequence: Synthetic polypeptide
DEMEIATTNPVATEQYGTVCSATDGGVENEEND

SEQ ID NO: 157098 - protein, 34 aa, Artificial Sequence
  Description of Artificial Sequence: Synthetic polypeptide
DEMEIATTNPVATEQYGTVCSATDDPVEDFEGND

SEQ ID NO: 157099 - protein, 36 aa, Artificial Sequence
  Description of Artificial Sequence: Synthetic polypeptide
DEEEIRTTNPVATEQYGSVSTTMEMFMESVQEEPDN

SEQ ID NO: 157100 - protein, 34 aa, Artificial Sequence
  Description of Artificial Sequence: Synthetic polypeptide
DEAEIRTTNPVAYEQWGSVCSTTIDQGDEQNGGS

SEQ ID NO: 157101 - protein, 38 aa, Artificial Sequence
  Description of Artificial Sequence: Synthetic polypeptide
DEEEIRTTNPVATEQYGVVSTTVVTNPNQAGNTEEGTE

SEQ ID NO: 157102 - protein, 37 aa, Artificial Sequence
  Description of Artificial Sequence: Synthetic polypeptide
DEEEIRTTNPVATEQYGSVSTTMEMFMEPVSLEPENV

SEQ ID NO: 157103 - protein, 34 aa, Artificial Sequence
  Description of Artificial Sequence: Synthetic polypeptide
DEAEIRTTNPVAYEQWGSVCSTTDTQGDTQQGGH

SEQ ID NO: 157104 - protein, 34 aa, Artificial Sequence
  Description of Artificial Sequence: Synthetic polypeptide
DEAEIRTTNPVAYEQWGSVCSTTDRQGDEQNGGA

SEQ ID NO: 157105 - protein, 35 aa, Artificial Sequence
  Description of Artificial Sequence: Synthetic polypeptide
DEAEIRTTNPVAYEQWGSVCSTINEDGGDTQNGGA

SEQ ID NO: 157106 - protein, 36 aa, Artificial Sequence
  Description of Artificial Sequence: Synthetic polypeptide
DEEEIRTTNPVATEQYGSVSTTMEMFMEPVSLEIDN

SEQ ID NO: 157107 - protein, 36 aa, Artificial Sequence
  Description of Artificial Sequence: Synthetic polypeptide
DEEEIRTTNPVATEQYGSVSTTMEGFMEPVSEEPNN

SEQ ID NO: 157108 - protein, 32 aa, Artificial Sequence
  Description of Artificial Sequence: Synthetic polypeptide
CEEEIATTNPVATAQWGSVAAGGPDEAGGNRN

SEQ ID NO: 157109 - protein, 33 aa, Artificial Sequence
  Description of Artificial Sequence: Synthetic polypeptide
DAEEIATTNPVATEQWGCVADTWELAQDNAQNH

SEQ ID NO: 157110 - protein, 38 aa, Artificial Sequence
  Description of Artificial Sequence: Synthetic polypeptide
DEEEIRTTNPVATEQYGVVSTTNQANGNNNQQGTNEDT

SEQ ID NO: 157111 - protein, 31 aa, Artificial Sequence
  Description of Artificial Sequence: Synthetic polypeptide
DDSEVASTNPVSTEGYGNVAAENLQSRVGQR

SEQ ID NO: 157112 - protein, 39 aa, Artificial Sequence
  Description of Artificial Sequence: Synthetic polypeptide
DEEEIRTTNPVATEQYGVVSTTVVTNNLQAGNNTEEGTE

SEQ ID NO: 157113 - protein, 34 aa, Artificial Sequence
  Description of Artificial Sequence: Synthetic polypeptide
DEQEIATTNPVATEQYGSVSATIDEPEDHEGEDL

SEQ ID NO: 157114 - protein, 36 aa, Artificial Sequence
  Description of Artificial Sequence: Synthetic polypeptide
DEEEIRTTNPVATEQYGSVSTTMEMFMPNVSEEPDM

SEQ ID NO: 157115 - protein, 35 aa, Artificial Sequence
  Description of Artificial Sequence: Synthetic polypeptide
DEHEIRTTNPVAWEQWGSVSCWNSQSQTAGGNNSF

SEQ ID NO: 157116 - protein, 33 aa, Artificial Sequence
  Description of Artificial Sequence: Synthetic polypeptide
DEHEIRTTNPVAWEQWGVVSCWNISSTGGNNSF

SEQ ID NO: 157117 - protein, 36 aa, Artificial Sequence
  Description of Artificial Sequence: Synthetic polypeptide
DEEEIRTTNPVATEQYGSVSTTMEMGMEPVSLEPDT

SEQ ID NO: 157118 - protein, 34 aa, Artificial Sequence
  Description of Artificial Sequence: Synthetic polypeptide
DEMEIATTNPVATEQYGTVCSATDGPVEDFEGND

SEQ ID NO: 157119 - protein, 35 aa, Artificial Sequence
  Description of Artificial Sequence: Synthetic polypeptide
DEMEIRTTNPVATEQYGCVCSNTEEHQNFGSDFQS

SEQ ID NO: 157120 - protein, 34 aa, Artificial Sequence
  Description of Artificial Sequence: Synthetic polypeptide
DEAEIRTTNPVAYEQWGSVCYMNDGHDRGGGNIM

SEQ ID NO: 157121 - protein, 38 aa, Artificial Sequence
  Description of Artificial Sequence: Synthetic polypeptide
DEEEIRTTNPVATEQYGVVSTTVVTNLQQGTQEEDEEE

SEQ ID NO: 157122 - protein, 33 aa, Artificial Sequence
  Description of Artificial Sequence: Synthetic polypeptide
DATEIATTNPVAYEQWGSVYYTENDLDDLGMAR

SEQ ID NO: 157123 - protein, 32 aa, Artificial Sequence
  Description of Artificial Sequence: Synthetic polypeptide
DATEIATTNPVAYEQWGSVCYTENDLDDLDMR

SEQ ID NO: 157124 - protein, 38 aa, Artificial Sequence
  Description of Artificial Sequence: Synthetic polypeptide
DEEEIRTTNPVATEQYGVVSTTVVTNLQQGTTDEETTD

SEQ ID NO: 157125 - protein, 30 aa, Artificial Sequence
  Description of Artificial Sequence: Synthetic polypeptide
DDSEVASTNPVSTEGYGNVAANTPQRVGQR

SEQ ID NO: 157126 - protein, 34 aa, Artificial Sequence
  Description of Artificial Sequence: Synthetic polypeptide
DEAEIRTTNPVAYEQWGSVCVTDNNDQGQDENMN

SEQ ID NO: 157127 - protein, 38 aa, Artificial Sequence
  Description of Artificial Sequence: Synthetic polypeptide
DEEEIRTTNPVATEQYGVVSTTNQLQNNQQGTTEQGSE

SEQ ID NO: 157128 - protein, 38 aa, Artificial Sequence
  Description of Artificial Sequence: Synthetic polypeptide
DEEEIRTTNPVATEQYGVVSTVTQGNNQQGTNEEEEDE

SEQ ID NO: 157129 - protein, 35 aa, Artificial Sequence
  Description of Artificial Sequence: Synthetic polypeptide
DEHEIRTTNPVAWEQWGSVSCWQNISQQAGGNNSF

SEQ ID NO: 157130 - protein, 35 aa, Artificial Sequence
  Description of Artificial Sequence: Synthetic polypeptide
DEQEIATTNPVATEQYGSVSATGDMEDQEGGEDGG

SEQ ID NO: 157131 - protein, 34 aa, Artificial Sequence
  Description of Artificial Sequence: Synthetic polypeptide
DEEEIRTTNPVSTEQYGCVCQNWGEHQGFGSQQS

SEQ ID NO: 157132 - protein, 33 aa, Artificial Sequence
  Description of Artificial Sequence: Synthetic polypeptide
DEMEIATTNPVATEQYGTVCSAGDHPVEFEGND

SEQ ID NO: 157133 - protein, 31 aa, Artificial Sequence
  Description of Artificial Sequence: Synthetic polypeptide
DDSEVASTNPVSTEGYGNVAANTLQSRVGER

SEQ ID NO: 157134 - protein, 38 aa, Artificial Sequence
  Description of Artificial Sequence: Synthetic polypeptide
DEEEIRTTNPVATEQYGVVSTVNQNNNNQQGNGTEQGS

SEQ ID NO: 157135 - protein, 34 aa, Artificial Sequence
  Description of Artificial Sequence: Synthetic polypeptide
DEAEIRTTNPVAYEQWGSVVYAEANLGDEGTGNA

SEQ ID NO: 157136 - protein, 35 aa, Artificial Sequence
  Description of Artificial Sequence: Synthetic polypeptide
DEAEIRTTNPVAYEQWGSVVSAAPNLGDEDTGNDL

SEQ ID NO: 157137 - protein, 31 aa, Artificial Sequence
  Description of Artificial Sequence: Synthetic polypeptide
DDSEVASTNPVSTEGYGNVATNTIQIREGQR

SEQ ID NO: 157138 - protein, 33 aa, Artificial Sequence
  Description of Artificial Sequence: Synthetic polypeptide
DEAEIRTTNPVAYEQWGSVVIENDGQGHQDNQE

SEQ ID NO: 157139 - protein, 35 aa, Artificial Sequence
  Description of Artificial Sequence: Synthetic polypeptide
DEAEIRTTNPVAYEQWGSVVIAAANLGDEDRGNDL

SEQ ID NO: 157140 - protein, 32 aa, Artificial Sequence
  Description of Artificial Sequence: Synthetic polypeptide
DDSEVASTNPVSTEGYGNVATNDIQSREGQNR

SEQ ID NO: 157141 - protein, 31 aa, Artificial Sequence
  Description of Artificial Sequence: Synthetic polypeptide
DDSEVASTNPVSTEGYGNVATNDIQDRMGQR

SEQ ID NO: 157142 - protein, 34 aa, Artificial Sequence
  Description of Artificial Sequence: Synthetic polypeptide
DEAEIRTTNPVAYEEWGSVATGNMLGDAQGMNEE

SEQ ID NO: 157143 - protein, 34 aa, Artificial Sequence
  Description of Artificial Sequence: Synthetic polypeptide
DEAEIRTTNPVAYEQWGSVVHGDANLGDEGTGNL

SEQ ID NO: 157144 - protein, 29 aa, Artificial Sequence
  Description of Artificial Sequence: Synthetic peptide
DDSEVASTNPVSTEGYGNVASTIQSHGDR

SEQ ID NO: 157145 - protein, 36 aa, Artificial Sequence
  Description of Artificial Sequence: Synthetic polypeptide
DEQEIRTTNPVATEGYGSVMGQSVNGLENGNGGGQE

SEQ ID NO: 157146 - protein, 38 aa, Artificial Sequence
  Description of Artificial Sequence: Synthetic polypeptide
DEEEIRTTNPVATEQYGVVSTVTNQQLGNQGTTTEEEE

SEQ ID NO: 157147 - protein, 36 aa, Artificial Sequence
  Description of Artificial Sequence: Synthetic polypeptide
DEEEIRTTNPVATEQYGSVSTTMNMVSPPVHEEPEM

SEQ ID NO: 157148 - protein, 36 aa, Artificial Sequence
  Description of Artificial Sequence: Synthetic polypeptide
DEEEIRTTNPVATEQYGSVSTTMNMVMYPVSEEEEM

SEQ ID NO: 157149 - protein, 35 aa, Artificial Sequence
  Description of Artificial Sequence: Synthetic polypeptide
DEQEIATTNPVATEQYGSVSATSDLNEDHQGLEDG

SEQ ID NO: 157150 - protein, 33 aa, Artificial Sequence
  Description of Artificial Sequence: Synthetic polypeptide
DEAEIRTTNPVAYEEWGSVATGMPGDHQGGGDR

SEQ ID NO: 157151 - protein, 37 aa, Artificial Sequence
  Description of Artificial Sequence: Synthetic polypeptide
DEEEIRTTNPVATEQYGSVSTTMNMIMPPNSEEPDMF

SEQ ID NO: 157152 - protein, 34 aa, Artificial Sequence
  Description of Artificial Sequence: Synthetic polypeptide
DEAEIRTTNPVAYEQWGTVCSNNEQHGDGQNNGS

SEQ ID NO: 157153 - protein, 31 aa, Artificial Sequence
  Description of Artificial Sequence: Synthetic polypeptide
DDSEVASTNPVSTEGYGNVATNTIQSRVGQR

SEQ ID NO: 157154 - protein, 34 aa, Artificial Sequence
  Description of Artificial Sequence: Synthetic polypeptide
DEAEIRTTNPVAYECWGVVSGGELQEHQERGNDM

SEQ ID NO: 157155 - protein, 32 aa, Artificial Sequence
  Description of Artificial Sequence: Synthetic polypeptide
DEHEIRTTNPVSTECYGTCSMEDIQQQQNGNM

SEQ ID NO: 157156 - protein, 34 aa, Artificial Sequence
  Description of Artificial Sequence: Synthetic polypeptide
DEMEIATTNPVATEQYGTVCSATDRPVEDIEGND

SEQ ID NO: 157157 - protein, 35 aa, Artificial Sequence
  Description of Artificial Sequence: Synthetic polypeptide
DEQEIATTNPVATEQYGSVSATYDLNEDHDGLEDE

SEQ ID NO: 157158 - protein, 34 aa, Artificial Sequence
  Description of Artificial Sequence: Synthetic polypeptide
DEAEIRTTNPVAYECWGVVSNDNLGEERGGENST

SEQ ID NO: 157159 - protein, 34 aa, Artificial Sequence
  Description of Artificial Sequence: Synthetic polypeptide
DEAEIRTTNPVAYECWGVVSNDNLGEERQGEGSR

SEQ ID NO: 157160 - protein, 34 aa, Artificial Sequence
  Description of Artificial Sequence: Synthetic polypeptide
DEMEIATTNPVATEQYGTVCSATDRPDEFEGNDQ

SEQ ID NO: 157161 - protein, 31 aa, Artificial Sequence
  Description of Artificial Sequence: Synthetic polypeptide
DDSEVASTNPVSTEGYGNVATNTIQSRVGSR

SEQ ID NO: 157162 - protein, 32 aa, Artificial Sequence
  Description of Artificial Sequence: Synthetic polypeptide
DEAEIRTTNPVAYEQWGVVCGDEGNHQNGSGE

SEQ ID NO: 157163 - protein, 37 aa, Artificial Sequence
  Description of Artificial Sequence: Synthetic polypeptide
DEEEIRTTNPVATEQYGVVSTTVVNQQGNNGEEEEEE

SEQ ID NO: 157164 - protein, 34 aa, Artificial Sequence
  Description of Artificial Sequence: Synthetic polypeptide
DEAEIRTTNPVAYEQWGVVATNGNGNQGEMNDDR

SEQ ID NO: 157165 - protein, 38 aa, Artificial Sequence
  Description of Artificial Sequence: Synthetic polypeptide
DEEEIRTTNPVATEQYGVVSTTVVNTNLQQGTDEDEED

SEQ ID NO: 157166 - protein, 33 aa, Artificial Sequence
  Description of Artificial Sequence: Synthetic polypeptide
DEHEIRTTNPVATESWGNVVCWNISQTGGNNPF

SEQ ID NO: 157167 - protein, 34 aa, Artificial Sequence
  Description of Artificial Sequence: Synthetic polypeptide
DEAEIRTTNPVAYEQWGVTVTGGNGNQGEGNDDR

SEQ ID NO: 157168 - protein, 34 aa, Artificial Sequence
  Description of Artificial Sequence: Synthetic polypeptide
DEAEIRTTNPVAYEQWGVCVYSDEVNDGQRNLNT

SEQ ID NO: 157169 - protein, 31 aa, Artificial Sequence
  Description of Artificial Sequence: Synthetic polypeptide
DDSEVASTNPVSTEGYGNVATNTIQSRNGQR

SEQ ID NO: 157170 - protein, 31 aa, Artificial Sequence
  Description of Artificial Sequence: Synthetic polypeptide
DDSEVASTNPVSTEGYGNVAANTLQSRVGDR

SEQ ID NO: 157171 - protein, 35 aa, Artificial Sequence
  Description of Artificial Sequence: Synthetic polypeptide
DEQEIATTNPVATEQYGSVSATSDALIETHEGEDL

SEQ ID NO: 157172 - protein, 34 aa, Artificial Sequence
  Description of Artificial Sequence: Synthetic polypeptide
DEAEIRTTNPVAYEQWGSVSTTNGNDNHQGDQVK

SEQ ID NO: 157173 - protein, 34 aa, Artificial Sequence
  Description of Artificial Sequence: Synthetic polypeptide
DAEEIATTNPVATEQWGAVTSTNHLPLTAGGGTD

SEQ ID NO: 157174 - protein, 33 aa, Artificial Sequence
  Description of Artificial Sequence: Synthetic polypeptide
DEAAEIATTNPVAYEAWGTTVTNLQGDVGDNER

SEQ ID NO: 157175 - protein, 34 aa, Artificial Sequence
  Description of Artificial Sequence: Synthetic polypeptide
DEMEIATTNPVATEQYGTVCSATDIPVEFEGMND

SEQ ID NO: 157176 - protein, 35 aa, Artificial Sequence
  Description of Artificial Sequence: Synthetic polypeptide
DAEEIATTNPVAYEQYGSVATPHLPQDSMGGNDQM

SEQ ID NO: 157177 - protein, 39 aa, Artificial Sequence
  Description of Artificial Sequence: Synthetic polypeptide
DEEEIRTTNPVATEQYGVVSTTNQQLQNATTEQGSNEEE

SEQ ID NO: 157178 - protein, 37 aa, Artificial Sequence
  Description of Artificial Sequence: Synthetic polypeptide
DEEEIRTTNPVATEQYGVVSTTNQQAGTEQGSTEEDE

SEQ ID NO: 157179 - protein, 34 aa, Artificial Sequence
  Description of Artificial Sequence: Synthetic polypeptide
DEMEIRTTNPVATEQYGCTCSWGELQEHFGSDQS

SEQ ID NO: 157180 - protein, 39 aa, Artificial Sequence
  Description of Artificial Sequence: Synthetic polypeptide
DEEEIRTTNPVATEQYGVVSTTVVTNLQAGTEQGNEEEE

SEQ ID NO: 157181 - protein, 38 aa, Artificial Sequence
  Description of Artificial Sequence: Synthetic polypeptide
DEEEIRTTNPVATEQYGVVSTVTNQQNQEQGNNDETTE

SEQ ID NO: 157182 - protein, 29 aa, Artificial Sequence
  Description of Artificial Sequence: Synthetic peptide
DDSEVASTNPVSTEGYGNVANTIQRVGQR

SEQ ID NO: 157183 - protein, 33 aa, Artificial Sequence
  Description of Artificial Sequence: Synthetic polypeptide
DEHEIRTTNPVAYERWGSVCVNDDSGDRQGDAR

SEQ ID NO: 157184 - protein, 36 aa, Artificial Sequence
  Description of Artificial Sequence: Synthetic polypeptide
CEEEIATTNPVAYEQYGSVAGTGHLPQDQGENNDRF

SEQ ID NO: 157185 - protein, 35 aa, Artificial Sequence
  Description of Artificial Sequence: Synthetic polypeptide
DEAEIRTTNPVAYEQWGSVSHTMNDRGNDPGNNDE

SEQ ID NO: 157186 - protein, 33 aa, Artificial Sequence
  Description of Artificial Sequence: Synthetic polypeptide
DEAEIRTTNPVAYEQWGSVSHSMNDRNDGDGPG

SEQ ID NO: 157187 - protein, 30 aa, Artificial Sequence
  Description of Artificial Sequence: Synthetic polypeptide
DDSEVASTNPVSTEGYGNVANNIQSRVGQR

SEQ ID NO: 157188 - protein, 29 aa, Artificial Sequence
  Description of Artificial Sequence: Synthetic peptide
DDSEVASTNPVSTEGYGNVANTIQSRGQR

SEQ ID NO: 157189 - protein, 34 aa, Artificial Sequence
  Description of Artificial Sequence: Synthetic polypeptide
DEAEIRTTNPVAYEQWGSVSWGNNNNNDTGGGGR

SEQ ID NO: 157190 - protein, 39 aa, Artificial Sequence
  Description of Artificial Sequence: Synthetic polypeptide
DEEEIRTTNPVATEQYGVVSTTNQQLQNGNTEQGNNQEE

SEQ ID NO: 157191 - protein, 34 aa, Artificial Sequence
  Description of Artificial Sequence: Synthetic polypeptide
DAEEIATTNPVATEQWGAVTSTNHGQTEGGTQDN

SEQ ID NO: 157192 - protein, 30 aa, Artificial Sequence
  Description of Artificial Sequence: Synthetic polypeptide
DDSEVASTNPVSTEGYGNVANTLQSRVGQR

SEQ ID NO: 157193 - protein, 34 aa, Artificial Sequence
  Description of Artificial Sequence: Synthetic polypeptide
DEEEIRTTNPVSTEPYGTVSSMEDIQQQQNGNPH

SEQ ID NO: 157194 - protein, 39 aa, Artificial Sequence
  Description of Artificial Sequence: Synthetic polypeptide
DEEEIRTTNPVATEQYGVVSTVTTNLQQSATEEGVTNQQ

SEQ ID NO: 157195 - protein, 35 aa, Artificial Sequence
  Description of Artificial Sequence: Synthetic polypeptide
DEAEIRTTNPVAYEQWGSVSTTNGNDNHQGDNVQN

SEQ ID NO: 157196 - protein, 34 aa, Artificial Sequence
  Description of Artificial Sequence: Synthetic polypeptide
DEHEIRTTNPVATESWGSVSCWNISVTTGGNNPF

SEQ ID NO: 157197 - protein, 38 aa, Artificial Sequence
  Description of Artificial Sequence: Synthetic polypeptide
DEEEIRTTNPVATEQYGVVSTTVVTNLEQGNNDEDEDE

SEQ ID NO: 157198 - protein, 38 aa, Artificial Sequence
  Description of Artificial Sequence: Synthetic polypeptide
DEEEIRTTNPVATEQYGVVSTTVVTNLQAGTDEDEEDT

SEQ ID NO: 157199 - protein, 34 aa, Artificial Sequence
  Description of Artificial Sequence: Synthetic polypeptide
DEHEIRTTNPVATESWGSVSCWNPISDTGGNNPF

SEQ ID NO: 157200 - protein, 36 aa, Artificial Sequence
  Description of Artificial Sequence: Synthetic polypeptide
DEEEIRTTNPVSTEQYGSVPTPWTNNLQQQVMQPQY

SEQ ID NO: 157201 - protein, 35 aa, Artificial Sequence
  Description of Artificial Sequence: Synthetic polypeptide
DEEEIRTTNPVAYEQYGQCVSWMEDLNQNFGSQQS

SEQ ID NO: 157202 - protein, 34 aa, Artificial Sequence
  Description of Artificial Sequence: Synthetic polypeptide
DAEEIATTNPVATEQWGAVTSNNHLQTEGGTQDD

SEQ ID NO: 157203 - protein, 34 aa, Artificial Sequence
  Description of Artificial Sequence: Synthetic polypeptide
DEEEIRTTNPVAYEQYGQCVSWEDHNQNFGSEQA

SEQ ID NO: 157204 - protein, 36 aa, Artificial Sequence
  Description of Artificial Sequence: Synthetic polypeptide
DEEEIRTTNPVSTEQYGSVPTPWNEEQIQQVMQGQI

SEQ ID NO: 157205 - protein, 38 aa, Artificial Sequence
  Description of Artificial Sequence: Synthetic polypeptide
DEEEIRTTNPVATEQYGVVSTVTNQQNGNNAGGNQNDE

SEQ ID NO: 157206 - protein, 35 aa, Artificial Sequence
  Description of Artificial Sequence: Synthetic polypeptide
DEMEIATTNPVATEQYGCVCSNTGEPNEFFGSNQS

SEQ ID NO: 157207 - protein, 35 aa, Artificial Sequence
  Description of Artificial Sequence: Synthetic polypeptide
DEMEIRTTNPVATEQYGCTCSTGNDHNQNFGSDQS

SEQ ID NO: 157208 - protein, 33 aa, Artificial Sequence
  Description of Artificial Sequence: Synthetic polypeptide
DEMEIATTNPVATEQYGTVCSAEDGPVEFEGND

SEQ ID NO: 157209 - protein, 33 aa, Artificial Sequence
  Description of Artificial Sequence: Synthetic polypeptide
DEMEIATTNPVATEQYGTVCSADDGPVESEGND

SEQ ID NO: 157210 - protein, 34 aa, Artificial Sequence
  Description of Artificial Sequence: Synthetic polypeptide
DEHEIRTTNPVAYESWGSVSGDNNEGDRQGDNGK

SEQ ID NO: 157211 - protein, 35 aa, Artificial Sequence
  Description of Artificial Sequence: Synthetic polypeptide
DEQEIRTTNPVATEQYGSASDVWQDLNNQDGQEDI

SEQ ID NO: 157212 - protein, 38 aa, Artificial Sequence
  Description of Artificial Sequence: Synthetic polypeptide
DEEEIRTTNPVATEQYGVVSTVNGTNQQAGNQQGEEDE

SEQ ID NO: 157213 - protein, 35 aa, Artificial Sequence
  Description of Artificial Sequence: Synthetic polypeptide
DEQEIRTTNPVATEQYGSVEAPTMMEQAEYGQEVN

SEQ ID NO: 157214 - protein, 38 aa, Artificial Sequence
  Description of Artificial Sequence: Synthetic polypeptide
DEEEIRTTNPVATEQYGVVSTVNDQAGNTNVTEEEEQD

SEQ ID NO: 157215 - protein, 34 aa, Artificial Sequence
  Description of Artificial Sequence: Synthetic polypeptide
DAEEIATTNPVATEQYGSVCATNPEAQANQTEGT

SEQ ID NO: 157216 - protein, 33 aa, Artificial Sequence
  Description of Artificial Sequence: Synthetic polypeptide
DEMEIRTTNPVATEQYGCVCSWEHAHFNSDNQS

SEQ ID NO: 157217 - protein, 36 aa, Artificial Sequence
  Description of Artificial Sequence: Synthetic polypeptide
DEQEIRTTNPVATEQYGSCSESWEYQYDRIGSNNQE

SEQ ID NO: 157218 - protein, 38 aa, Artificial Sequence
  Description of Artificial Sequence: Synthetic polypeptide
DEEEIRTTNPVATEQYGVVSTVNDQAGSTNTTEDEEQD

SEQ ID NO: 157219 - protein, 35 aa, Artificial Sequence
  Description of Artificial Sequence: Synthetic polypeptide
DEQEIRTTNPVATEQYGSVCSVPMGHDESPFNSRF

SEQ ID NO: 157220 - protein, 38 aa, Artificial Sequence
  Description of Artificial Sequence: Synthetic polypeptide
DEEEIRTTNPVATEQYGVVSTVNDQQGNNNNQQGEEDD

SEQ ID NO: 157221 - protein, 34 aa, Artificial Sequence
  Description of Artificial Sequence: Synthetic polypeptide
CEEEIATTNPVATAQWGSVSMSGNLENTRGVGEF

SEQ ID NO: 157222 - protein, 36 aa, Artificial Sequence
  Description of Artificial Sequence: Synthetic polypeptide
DEQEIRTTNPVATEQYGSCTSTTDAQSIRGGIDQLF

SEQ ID NO: 157223 - protein, 34 aa, Artificial Sequence
  Description of Artificial Sequence: Synthetic polypeptide
DEMEIRTTNPVATEQYGCVCSWGELNTNFNSDQA

SEQ ID NO: 157224 - protein, 34 aa, Artificial Sequence
  Description of Artificial Sequence: Synthetic polypeptide
DEAEIRTTNPVAYEQWGEVCSGGNGNQGEMNDDR

SEQ ID NO: 157225 - protein, 37 aa, Artificial Sequence
  Description of Artificial Sequence: Synthetic polypeptide
DEEEIRTTNPVATEQYGVVSTTNNQQGTEQGGTTEDE

SEQ ID NO: 157226 - protein, 34 aa, Artificial Sequence
  Description of Artificial Sequence: Synthetic polypeptide
DEQEIRTTNPVATEQYGSASDVQDLNNQDTQEML

SEQ ID NO: 157227 - protein, 38 aa, Artificial Sequence
  Description of Artificial Sequence: Synthetic polypeptide
DEEEIRTTNPVATEQYGVVSTVNQQAGNQETATNVATE

SEQ ID NO: 157228 - protein, 34 aa, Artificial Sequence
  Description of Artificial Sequence: Synthetic polypeptide
DEQEIATTNPVATEQYGSVSATDLEVHELLEDLY

SEQ ID NO: 157229 - protein, 35 aa, Artificial Sequence
  Description of Artificial Sequence: Synthetic polypeptide
DEAEIRTTNPVAYEQWGESVQIQRNDDGQRGHSDR

SEQ ID NO: 157230 - protein, 38 aa, Artificial Sequence
  Description of Artificial Sequence: Synthetic polypeptide
DEEEIRTTNPVATEQYGVVSTVNLGQQNQQGTTEQGSQ

SEQ ID NO: 157231 - protein, 30 aa, Artificial Sequence
  Description of Artificial Sequence: Synthetic polypeptide
DDSEVASTNPVSTEGYGNVAANVIQRVGQR

SEQ ID NO: 157232 - protein, 30 aa, Artificial Sequence
  Description of Artificial Sequence: Synthetic polypeptide
DEMEIATTNPVATEQYGEACPEVPVEHGEK

SEQ ID NO: 157233 - protein, 31 aa, Artificial Sequence
  Description of Artificial Sequence: Synthetic polypeptide
DEMEIATTNPVATEQYGEACSTDVCEFEEEK

SEQ ID NO: 157234 - protein, 33 aa, Artificial Sequence
  Description of Artificial Sequence: Synthetic polypeptide
DEAEIRTTNPVAYEQWGCVCPNNDQMDTGGNDN

SEQ ID NO: 157235 - protein, 38 aa, Artificial Sequence
  Description of Artificial Sequence: Synthetic polypeptide
DEEEIRTTNPVATEQYGVVSTVLQAGNNTEQGTNQDED

SEQ ID NO: 157236 - protein, 38 aa, Artificial Sequence
  Description of Artificial Sequence: Synthetic polypeptide
DEEEIRTTNPVATEQYGVVSTVLQQGNQQGTTNNDEEA

SEQ ID NO: 157237 - protein, 35 aa, Artificial Sequence
  Description of Artificial Sequence: Synthetic polypeptide
DEAEIRTTNPVAYEQWGCVCTGGNDMQQDRGGNAS

SEQ ID NO: 157238 - protein, 35 aa, Artificial Sequence
  Description of Artificial Sequence: Synthetic polypeptide
DEMEIATTNPVATEQYGSVSNTDLNEEHEGSEDLG

SEQ ID NO: 157239 - protein, 34 aa, Artificial Sequence
  Description of Artificial Sequence: Synthetic polypeptide
DEMEIATTNPVATEQYGETVCSATDGPVEFEGND

SEQ ID NO: 157240 - protein, 34 aa, Artificial Sequence
  Description of Artificial Sequence: Synthetic polypeptide
DEAEIRTTNPVAYEQWGCVTGGNDMQQGRGGNAM

SEQ ID NO: 157241 - protein, 38 aa, Artificial Sequence
  Description of Artificial Sequence: Synthetic polypeptide
DEEEIRTTNPVATEQYGVVSTTNNQNNLQQGTTEQGQE

SEQ ID NO: 157242 - protein, 36 aa, Artificial Sequence
  Description of Artificial Sequence: Synthetic polypeptide
DEQEIRTTNPVATEQYGEVVPSTPSLAGMASGNNAW

SEQ ID NO: 157243 - protein, 34 aa, Artificial Sequence
  Description of Artificial Sequence: Synthetic polypeptide
DEAEIRTTNPVAYEQWGCVYNSGDNHQGQQGNVS

SEQ ID NO: 157244 - protein, 35 aa, Artificial Sequence
  Description of Artificial Sequence: Synthetic polypeptide
DEAEIRTTNPVAYEQWGESVQIQNNDDGQRGHRTR

SEQ ID NO: 157245 - protein, 35 aa, Artificial Sequence
  Description of Artificial Sequence: Synthetic polypeptide
DEQEIRTTNPVATEQYGSASDVPQDLNNQEGQEML

SEQ ID NO: 157246 - protein, 35 aa, Artificial Sequence
  Description of Artificial Sequence: Synthetic polypeptide
DEMEIATTNPVATEQYGCVTSNTDHNEEHFGSENL

SEQ ID NO: 157247 - protein, 33 aa, Artificial Sequence
  Description of Artificial Sequence: Synthetic polypeptide
DEMEIRTTNPVATEQYGCVDTTSVSQISIEEDV

SEQ ID NO: 157248 - protein, 37 aa, Artificial Sequence
  Description of Artificial Sequence: Synthetic polypeptide
DEQEIRTTNPVATEQYGSTVSTVLDAEEIEGMQNGQI

SEQ ID NO: 157249 - protein, 35 aa, Artificial Sequence
  Description of Artificial Sequence: Synthetic polypeptide
DEQEIRTTNPVATEQYGSLWYVDHNGEIRDNLIED

SEQ ID NO: 157250 - protein, 34 aa, Artificial Sequence
  Description of Artificial Sequence: Synthetic polypeptide
DEMEIATTNPVATEQYGSVSATDDPVEDHEGEDL

SEQ ID NO: 157251 - protein, 33 aa, Artificial Sequence
  Description of Artificial Sequence: Synthetic polypeptide
DEAEIRTTNPVAYEQWGEVTGDNNGDQRGTGGA

SEQ ID NO: 157252 - protein, 38 aa, Artificial Sequence
  Description of Artificial Sequence: Synthetic polypeptide
DEEEIRTTNPVATEQYGVVSTVTNQQQGNQQGGNQNDE

SEQ ID NO: 157253 - protein, 38 aa, Artificial Sequence
  Description of Artificial Sequence: Synthetic polypeptide
DEEEIRTTNPVATEQYGVVSTVNDQQGSTNVTEEEITD

SEQ ID NO: 157254 - protein, 38 aa, Artificial Sequence
  Description of Artificial Sequence: Synthetic polypeptide
DEEEIRTTNPVATEQYGVVSTVNDQQGSTNQTEEENTT

SEQ ID NO: 157255 - protein, 34 aa, Artificial Sequence
  Description of Artificial Sequence: Synthetic polypeptide
DEAEIRTTNPVAYEQWGEVTGGNGNQQGEGNASR

SEQ ID NO: 157256 - protein, 38 aa, Artificial Sequence
  Description of Artificial Sequence: Synthetic polypeptide
DEEEIRTTNPVATEQYGVVSTVTNQQQQIGTTNTEEED

SEQ ID NO: 157257 - protein, 35 aa, Artificial Sequence
  Description of Artificial Sequence: Synthetic polypeptide
DEMEIATTNPVATEQYGSVCSNTDHNEEHFGSEDL

SEQ ID NO: 157258 - protein, 38 aa, Artificial Sequence
  Description of Artificial Sequence: Synthetic polypeptide
DEEEIRTTNPVATEQYGVVSTVNDQQGSTNVTEDEEDD

SEQ ID NO: 157259 - protein, 38 aa, Artificial Sequence
  Description of Artificial Sequence: Synthetic polypeptide
DEEEIRTTNPVATEQYGVVSTVNDQQGSTNVEEEEEQD

SEQ ID NO: 157260 - protein, 38 aa, Artificial Sequence
  Description of Artificial Sequence: Synthetic polypeptide
DEEEIRTTNPVATEQYGVVSTVNDQQGSTNTTEEEQQD

SEQ ID NO: 157261 - protein, 38 aa, Artificial Sequence
  Description of Artificial Sequence: Synthetic polypeptide
DEEEIRTTNPVATEQYGVVSTVNDQQGSTNQTEEQGTD

SEQ ID NO: 157262 - protein, 38 aa, Artificial Sequence
  Description of Artificial Sequence: Synthetic polypeptide
DEEEIRTTNPVATEQYGVVSTVNDQQGSTNTTEEEGDT

SEQ ID NO: 157263 - protein, 38 aa, Artificial Sequence
  Description of Artificial Sequence: Synthetic polypeptide
DEEEIRTTNPVATEQYGVVSTVNDQQGSTNSTEEETDD

SEQ ID NO: 157264 - protein, 37 aa, Artificial Sequence
  Description of Artificial Sequence: Synthetic polypeptide
DEEEIRTTNPVATEQYGVVSTVNDQQGSTTTTEEEDD

SEQ ID NO: 157265 - protein, 36 aa, Artificial Sequence
  Description of Artificial Sequence: Synthetic polypeptide
DEQEIRTTNPVATEQYGSVAESTPNGAMNGEGSQQM

SEQ ID NO: 157266 - protein, 38 aa, Artificial Sequence
  Description of Artificial Sequence: Synthetic polypeptide
DEEEIRTTNPVATEQYGVVSTTNNQQGNNTEQGSTQDD

SEQ ID NO: 157267 - protein, 31 aa, Artificial Sequence
  Description of Artificial Sequence: Synthetic polypeptide
DDSEVATTNPVSTEGYGNVAANTIQSRVGQR

SEQ ID NO: 157268 - protein, 35 aa, Artificial Sequence
  Description of Artificial Sequence: Synthetic polypeptide
DEHEIRTTNPVAWEQWGSIVSCWNISQTAGGNNSE

SEQ ID NO: 157269 - protein, 34 aa, Artificial Sequence
  Description of Artificial Sequence: Synthetic polypeptide
DEHEIRTTNPVAWEQWGKVSCWNVSQTAGGNNSF

SEQ ID NO: 157270 - protein, 34 aa, Artificial Sequence
  Description of Artificial Sequence: Synthetic polypeptide
DAEEIATTNPVAYEQYGSVCAANNPLTDPGGNNN

SEQ ID NO: 157271 - protein, 38 aa, Artificial Sequence
  Description of Artificial Sequence: Synthetic polypeptide
DEEEIRTTNPVATEQYGVVSTTNNQNQQQGNNQQGTDD

SEQ ID NO: 157272 - protein, 36 aa, Artificial Sequence
  Description of Artificial Sequence: Synthetic polypeptide
DEEEIRTTNPVSTEQYGNVSSTTPAGPNSRNGMNPV

SEQ ID NO: 157273 - protein, 35 aa, Artificial Sequence
  Description of Artificial Sequence: Synthetic polypeptide
DEQEIRTTNPVATEQYGSSTSTWGTSQQHEGEETN

SEQ ID NO: 157274 - protein, 35 aa, Artificial Sequence
  Description of Artificial Sequence: Synthetic polypeptide
DEQEIRTTNPVATEQYGSSTSTPGHTSQQHEGETN

SEQ ID NO: 157275 - protein, 35 aa, Artificial Sequence
  Description of Artificial Sequence: Synthetic polypeptide
DEAEIRTTNPVAYEQWGEVCSTDNGNEQIGENHEQ

SEQ ID NO: 157276 - protein, 30 aa, Artificial Sequence
  Description of Artificial Sequence: Synthetic polypeptide
DDSEVASTNPVSTEGYGNVAASTLQHVGDR

SEQ ID NO: 157277 - protein, 38 aa, Artificial Sequence
  Description of Artificial Sequence: Synthetic polypeptide
DEEEIRTTNPVATEQYGVVSTVNDQQGNNVTQQGTETE

SEQ ID NO: 157278 - protein, 33 aa, Artificial Sequence
  Description of Artificial Sequence: Synthetic polypeptide
DEAEIRTTNPVAYEQWGEVMWTEHDNRGGGSVR

SEQ ID NO: 157279 - protein, 33 aa, Artificial Sequence
  Description of Artificial Sequence: Synthetic polypeptide
DEAEIRTTNPVAYEQWGEVSGGNNQGGVEGGDH

SEQ ID NO: 157280 - protein, 38 aa, Artificial Sequence
  Description of Artificial Sequence: Synthetic polypeptide
DEEEIRTTNPVATEQYGVVSTVNDQQGNTEQGTNTDED

SEQ ID NO: 157281 - protein, 34 aa, Artificial Sequence
  Description of Artificial Sequence: Synthetic polypeptide
DEAEISTTNPVATEQYGVVCSTGELNQNFPSDQS

SEQ ID NO: 157282 - protein, 34 aa, Artificial Sequence
  Description of Artificial Sequence: Synthetic polypeptide
DEAEISTTNPVATEQYGVVCSTGEHNQYFPSNQS

SEQ ID NO: 157283 - protein, 38 aa, Artificial Sequence
  Description of Artificial Sequence: Synthetic polypeptide
DEEEIRTTNPVATEQYGVVSTVNDQQGSNNTTEEENDD

SEQ ID NO: 157284 - protein, 34 aa, Artificial Sequence
  Description of Artificial Sequence: Synthetic polypeptide
DEMEIATTNPVATEQYGCVSYTGDLEDHEGSEDL

SEQ ID NO: 157285 - protein, 38 aa, Artificial Sequence
  Description of Artificial Sequence: Synthetic polypeptide
DEEEIRTTNPVATEQYGVVSTTNNQNLQQQATNVATEM

SEQ ID NO: 157286 - protein, 38 aa, Artificial Sequence
  Description of Artificial Sequence: Synthetic polypeptide
DEEEIRTTNPVATEQYGVVSTVGTLQAGTEQGTNQQQD

SEQ ID NO: 157287 - protein, 32 aa, Artificial Sequence
  Description of Artificial Sequence: Synthetic polypeptide
DEQEIRTTNPVATEQYGATAATDWEDHEGEDL

SEQ ID NO: 157288 - protein, 33 aa, Artificial Sequence
  Description of Artificial Sequence: Synthetic polypeptide
DEAEIRTTNPVAYEQWGCVCHENDQHDTGGNAP

SEQ ID NO: 157289 - protein, 32 aa, Artificial Sequence
  Description of Artificial Sequence: Synthetic polypeptide
DEQEIRTTNPVATEQYGATAATDWEEHEGEDL

SEQ ID NO: 157290 - protein, 36 aa, Artificial Sequence
  Description of Artificial Sequence: Synthetic polypeptide
DEQEIRTTNPVATEQYGSVNIPVTSLNPQEDVGEPN

SEQ ID NO: 157291 - protein, 35 aa, Artificial Sequence
  Description of Artificial Sequence: Synthetic polypeptide
DEAEIRTTNPVAYEQWGSVCPGDHNLQDDRGDQDP

SEQ ID NO: 157292 - protein, 34 aa, Artificial Sequence
  Description of Artificial Sequence: Synthetic polypeptide
DEAEIRTTNPVAYEQWGSVCNTFNRGEGHGGTER

SEQ ID NO: 157293 - protein, 38 aa, Artificial Sequence
  Description of Artificial Sequence: Synthetic polypeptide
DEEEIRTTNPVATEQYGVVSTTNNNQQGNQQGEQQGTD

SEQ ID NO: 157294 - protein, 37 aa, Artificial Sequence
  Description of Artificial Sequence: Synthetic polypeptide
DEEEIRTTNPVAYEQYGTIPSCDTNSLSQERTENQPM

SEQ ID NO: 157295 - protein, 37 aa, Artificial Sequence
  Description of Artificial Sequence: Synthetic polypeptide
DEEEIRTTNPVATEQYGVVSTTNNNQQGTEQGTEESE

SEQ ID NO: 157296 - protein, 34 aa, Artificial Sequence
  Description of Artificial Sequence: Synthetic polypeptide
DEAEIRTTNPVAYEQWGSVAISNGNDHQMNGGID

SEQ ID NO: 157297 - protein, 36 aa, Artificial Sequence
  Description of Artificial Sequence: Synthetic polypeptide
DEQEIRTTNPVATEQYGCCSVTTVNISDFTGFNEDY

SEQ ID NO: 157298 - protein, 36 aa, Artificial Sequence
  Description of Artificial Sequence: Synthetic polypeptide
DEQEIRTTNPVATEQYGSVNIPVSSLNVQEDVTGSN

SEQ ID NO: 157299 - protein, 36 aa, Artificial Sequence
  Description of Artificial Sequence: Synthetic polypeptide
DEQEIRTTNPVATEQYGCVEPVELQLGPMEGGNDAR

SEQ ID NO: 157300 - protein, 37 aa, Artificial Sequence
  Description of Artificial Sequence: Synthetic polypeptide
DEQEIRTTNPVATEQYGSVLSTVLDHNEIEGMQNGQI

SEQ ID NO: 157301 - protein, 35 aa, Artificial Sequence
  Description of Artificial Sequence: Synthetic polypeptide
DAEEIATTNPVATEQWGSVAITNPEQQGSQDNSDA

SEQ ID NO: 157302 - protein, 38 aa, Artificial Sequence
  Description of Artificial Sequence: Synthetic polypeptide
DEEEIRTTNPVATEQYGVVSTTNNNNNQQGTNNNNEED

SEQ ID NO: 157303 - protein, 32 aa, Artificial Sequence
  Description of Artificial Sequence: Synthetic polypeptide
CEEEIATTNPVATAQWGSVSAAGGPDEAPNRN

SEQ ID NO: 157304 - protein, 38 aa, Artificial Sequence
  Description of Artificial Sequence: Synthetic polypeptide
DEEEIRTTNPVATEQYGVVSTTNQAGGNNNQQGTNQDD

SEQ ID NO: 157305 - protein, 33 aa, Artificial Sequence
  Description of Artificial Sequence: Synthetic polypeptide
DEMEIATTNPVATEQYGTVCAATDTIVEFVGND

SEQ ID NO: 157306 - protein, 34 aa, Artificial Sequence
  Description of Artificial Sequence: Synthetic polypeptide
DEHEIRTTNPVAYESWGSVSGDNLNGDRQGDVGA

SEQ ID NO: 157307 - protein, 38 aa, Artificial Sequence
  Description of Artificial Sequence: Synthetic polypeptide
DEEEIRTTNPVATEQYGVVSTTNQAGNQQGTTNNDEED

SEQ ID NO: 157308 - protein, 35 aa, Artificial Sequence
  Description of Artificial Sequence: Synthetic polypeptide
DEHEIRTTNPVAYESWGSVSGDNLNGDRQGDNQGV

SEQ ID NO: 157309 - protein, 35 aa, Artificial Sequence
  Description of Artificial Sequence: Synthetic polypeptide
DEAEIRTTNPVAYEQWGSVCSTENDQGNDTQNGAA

SEQ ID NO: 157310 - protein, 36 aa, Artificial Sequence
  Description of Artificial Sequence: Synthetic polypeptide
DEAEIRTTNPVAYEQWGSVCSTDNVGNQGQQGNGGN

SEQ ID NO: 157311 - protein, 34 aa, Artificial Sequence
  Description of Artificial Sequence: Synthetic polypeptide
DEAEIRTTNPVAYEKWGEVSCTNLQLNDHDGSGM

SEQ ID NO: 157312 - protein, 34 aa, Artificial Sequence
  Description of Artificial Sequence: Synthetic polypeptide
DEAEIRTTNPVAYEQWGSVCSGENDQHDTNDESD

SEQ ID NO: 157313 - protein, 34 aa, Artificial Sequence
  Description of Artificial Sequence: Synthetic polypeptide
DEMEIATTNPVATEQYGCVCSTTDHNEDHFGETL

SEQ ID NO: 157314 - protein, 35 aa, Artificial Sequence
  Description of Artificial Sequence: Synthetic polypeptide
DEAEIRTTNPVAYEPDGKVSCAPEPLSQYRGEENR

SEQ ID NO: 157315 - protein, 32 aa, Artificial Sequence
  Description of Artificial Sequence: Synthetic polypeptide
DEMEIATTNPVATEQYGTVCPAEGPVEFEGND

SEQ ID NO: 157316 - protein, 35 aa, Artificial Sequence
  Description of Artificial Sequence: Synthetic polypeptide
DEAEIRTTNPVAYEQWGSVCSGDHNLQDQKGDQDP

SEQ ID NO: 157317 - protein, 35 aa, Artificial Sequence
  Description of Artificial Sequence: Synthetic polypeptide
DEAEIRTTNPVAYEQWGSVCSGDHNLQDDHGDQDI

SEQ ID NO: 157318 - protein, 34 aa, Artificial Sequence
  Description of Artificial Sequence: Synthetic polypeptide
DEHEIRTTNPVAYESWGSVSGDNLEGDRQGDQGE

SEQ ID NO: 157319 - protein, 38 aa, Artificial Sequence
  Description of Artificial Sequence: Synthetic polypeptide
DEEEIRTTNPVATEQYGVVSTTNNNNLQQQATTNVATE

SEQ ID NO: 157320 - protein, 35 aa, Artificial Sequence
  Description of Artificial Sequence: Synthetic polypeptide
DEQEIATTNPVATEQYGSVSATDLEEVHENDEDLF

SEQ ID NO: 157321 - protein, 36 aa, Artificial Sequence
  Description of Artificial Sequence: Synthetic polypeptide
DEQEIRTTNPVATEQYGAMSTIMTNVDQGGGGNEGI

SEQ ID NO: 157322 - protein, 35 aa, Artificial Sequence
  Description of Artificial Sequence: Synthetic polypeptide
DEAEIRTTNPVAYEQWGSVAISNGNDHQMNDGNDP

SEQ ID NO: 157323 - protein, 33 aa, Artificial Sequence
  Description of Artificial Sequence: Synthetic polypeptide
DEQEIRTTNPVATEQYGCVSNQSPETTEGSQQN

SEQ ID NO: 157324 - protein, 32 aa, Artificial Sequence
  Description of Artificial Sequence: Synthetic polypeptide
CEEEIATTNPVATAQWGSVSAGGPDEAGEIRN

SEQ ID NO: 157325 - protein, 33 aa, Artificial Sequence
  Description of Artificial Sequence: Synthetic polypeptide
DEMEIATTNPVATEQYGTVCAANNGPTEDDGND

SEQ ID NO: 157326 - protein, 38 aa, Artificial Sequence
  Description of Artificial Sequence: Synthetic polypeptide
DEEEIRTTNPVATEQYGVVSTTNNQNGNQQGTTEQGSE

SEQ ID NO: 157327 - protein, 32 aa, Artificial Sequence
  Description of Artificial Sequence: Synthetic polypeptide
CEEEIATTNPVATAQWGSVSAGPPDEAGNMNN

SEQ ID NO: 157328 - protein, 35 aa, Artificial Sequence
  Description of Artificial Sequence: Synthetic polypeptide
DEHEIRTTNPVATEVWGSVAATDNHDEKGQDGNGE

SEQ ID NO: 157329 - protein, 33 aa, Artificial Sequence
  Description of Artificial Sequence: Synthetic polypeptide
DEAEIRTTNPVAYEQWGCVCPNNDEQDTGDNEH

SEQ ID NO: 157330 - protein, 33 aa, Artificial Sequence
  Description of Artificial Sequence: Synthetic polypeptide
DEMEIATTNPVATEQYGTVCAANDGPAEAEGND

SEQ ID NO: 157331 - protein, 34 aa, Artificial Sequence
  Description of Artificial Sequence: Synthetic polypeptide
DEMEIATTNPVATEQYGTVCAANDGLPMEDDGND

SEQ ID NO: 157332 - protein, 34 aa, Artificial Sequence
  Description of Artificial Sequence: Synthetic polypeptide
DEAEISTTNPVATEQYGQCVCSTEDHQFSGSEQS

SEQ ID NO: 157333 - protein, 38 aa, Artificial Sequence
  Description of Artificial Sequence: Synthetic polypeptide
DEEEIRTTNPVATEQYGSVSTNNNANNNNEEGNNNNED

SEQ ID NO: 157334 - protein, 33 aa, Artificial Sequence
  Description of Artificial Sequence: Synthetic polypeptide
DEMEIATTNPVATEQYGCVSNTDPEDHFGEDLS

SEQ ID NO: 157335 - protein, 33 aa, Artificial Sequence
  Description of Artificial Sequence: Synthetic polypeptide
DEMEIATTNPVATEQYGTVCAANDGGVEDDGND

SEQ ID NO: 157336 - protein, 33 aa, Artificial Sequence
  Description of Artificial Sequence: Synthetic polypeptide
DEMEIATTNPVATEQYGCVSNTDPEEHFGSEDL

SEQ ID NO: 157337 - protein, 36 aa, Artificial Sequence
  Description of Artificial Sequence: Synthetic polypeptide
DEEEIRTTNPVAYEQYGSVYACTNAISQNKGDSTHV

SEQ ID NO: 157338 - protein, 35 aa, Artificial Sequence
  Description of Artificial Sequence: Synthetic polypeptide
DEAEIRTTNPVAYEQWGSCVYSDEVNDGQRNLNHG

SEQ ID NO: 157339 - protein, 38 aa, Artificial Sequence
  Description of Artificial Sequence: Synthetic polypeptide
DEEEIRTTNPVATEQYGVVSTTNNQNLQQQATNNATEE

SEQ ID NO: 157340 - protein, 36 aa, Artificial Sequence
  Description of Artificial Sequence: Synthetic polypeptide
DEEEIRTTNPVAYEQYGSVYACTQNAISQNKGSPSV

SEQ ID NO: 157341 - protein, 33 aa, Artificial Sequence
  Description of Artificial Sequence: Synthetic polypeptide
DEAEIRTTNPVAYEQWGCVCMNNDQVDTNGNAP

SEQ ID NO: 157342 - protein, 33 aa, Artificial Sequence
  Description of Artificial Sequence: Synthetic polypeptide
DEAEIRTTNPVAYEQWGCVCMNNDQSDTGGNAN

SEQ ID NO: 157343 - protein, 33 aa, Artificial Sequence
  Description of Artificial Sequence: Synthetic polypeptide
DEAEIRTTNPVAYEQWGCVCMNNDQMDSGGNNP

SEQ ID NO: 157344 - protein, 33 aa, Artificial Sequence
  Description of Artificial Sequence: Synthetic polypeptide
DEAEIRTTNPVAYEQWGSVAINDQGQHQGGQDI

SEQ ID NO: 157345 - protein, 37 aa, Artificial Sequence
  Description of Artificial Sequence: Synthetic polypeptide
DEQEIRTTNPVATEQYGSVGGPTFVQDQLMRQGEQNE

SEQ ID NO: 157346 - protein, 35 aa, Artificial Sequence
  Description of Artificial Sequence: Synthetic polypeptide
DAEEIATTNPVATEQWGSVSGTGNPPDNHGPNEAP

SEQ ID NO: 157347 - protein, 30 aa, Artificial Sequence
  Description of Artificial Sequence: Synthetic polypeptide
DDSEVATTNPVSTEGYGNVANTIQSRVGQR

SEQ ID NO: 157348 - protein, 33 aa, Artificial Sequence
  Description of Artificial Sequence: Synthetic polypeptide
DEMEIRTTNPVATEQYGCVSQLVDENIDPPTQD

SEQ ID NO: 157349 - protein, 35 aa, Artificial Sequence
  Description of Artificial Sequence: Synthetic polypeptide
DEAEIRTTNPVAYEQWGSVAGNPNGNHQNEGDNDR

SEQ ID NO: 157350 - protein, 38 aa, Artificial Sequence
  Description of Artificial Sequence: Synthetic polypeptide
DEEEIRTTNPVATEQYGVVSTTNNQLQQGTEQGTEEQD

SEQ ID NO: 157351 - protein, 35 aa, Artificial Sequence
  Description of Artificial Sequence: Synthetic polypeptide
DEHEIRTTNPVATESWGCVCSGDNLTGDRQGDNGK

SEQ ID NO: 157352 - protein, 33 aa, Artificial Sequence
  Description of Artificial Sequence: Synthetic polypeptide
DEAEIRTTNPVAYEQWGSTSGPLNDDRQNMTAN

SEQ ID NO: 157353 - protein, 39 aa, Artificial Sequence
  Description of Artificial Sequence: Synthetic polypeptide
DEEEIRTTNPVATEQYGVVSTTNNQLQQGTNEQGTNQED

SEQ ID NO: 157354 - protein, 33 aa, Artificial Sequence
  Description of Artificial Sequence: Synthetic polypeptide
DEEEIRTTNPVSTEQYGCVCQWEEPQGFGSQQS

SEQ ID NO: 157355 - protein, 35 aa, Artificial Sequence
  Description of Artificial Sequence: Synthetic polypeptide
DEAEIRTTNPVAYEQWGSCVYSDEVNDTQRINLGE

SEQ ID NO: 157356 - protein, 34 aa, Artificial Sequence
  Description of Artificial Sequence: Synthetic polypeptide
CEEEIATTNPVATEPYGVVCAGNNLADRGGDNEQ

SEQ ID NO: 157357 - protein, 35 aa, Artificial Sequence
  Description of Artificial Sequence: Synthetic polypeptide
DEAEIRTTNPVAYEQWGSCVYSDEVNDTQQHNSQR

SEQ ID NO: 157358 - protein, 35 aa, Artificial Sequence
  Description of Artificial Sequence: Synthetic polypeptide
DEQEIRTTNPVATEQYGCVYTDENGAQETGGSQVE

SEQ ID NO: 157359 - protein, 35 aa, Artificial Sequence
  Description of Artificial Sequence: Synthetic polypeptide
DEQEIATTNPVATEQYGSVSATDLNEDHQTMEDEN

SEQ ID NO: 157360 - protein, 35 aa, Artificial Sequence
  Description of Artificial Sequence: Synthetic polypeptide
DEAEIRTTNPVAYEQWGSCVYSIEVNDTQRNDSQR

SEQ ID NO: 157361 - protein, 35 aa, Artificial Sequence
  Description of Artificial Sequence: Synthetic polypeptide
DEEEIRTTNPVSTEGYGSVSRSAFLEDRVTGFEPV

SEQ ID NO: 157362 - protein, 32 aa, Artificial Sequence
  Description of Artificial Sequence: Synthetic polypeptide
DEHEIRTTNPVSTEPYGTCSMEDIQQQANGNH

SEQ ID NO: 157363 - protein, 32 aa, Artificial Sequence
  Description of Artificial Sequence: Synthetic polypeptide
DEHEIRTTNPVSTEPYGTISMEDIQQQMNGNH

SEQ ID NO: 157364 - protein, 31 aa, Artificial Sequence
  Description of Artificial Sequence: Synthetic polypeptide
DDSEVASTNPVSTEGYGNVSANTGQSRVGQR

SEQ ID NO: 157365 - protein, 36 aa, Artificial Sequence
  Description of Artificial Sequence: Synthetic polypeptide
DEEEIRTTNPVSTEPYGSISSTTPAGPQMRNGMNPV

SEQ ID NO: 157366 - protein, 32 aa, Artificial Sequence
  Description of Artificial Sequence: Synthetic polypeptide
DEMEIASTNPVSTEQYGTVCAATTIESFVGNR

SEQ ID NO: 157367 - protein, 38 aa, Artificial Sequence
  Description of Artificial Sequence: Synthetic polypeptide
DEEEIRTTNPVATEQYGVVSTVVATNQAGNQQGTNQDE

SEQ ID NO: 157368 - protein, 36 aa, Artificial Sequence
  Description of Artificial Sequence: Synthetic polypeptide
DEAEIRTTNPVATEQYGVVAATNPDGPNMRNGMNPV

SEQ ID NO: 157369 - protein, 31 aa, Artificial Sequence
  Description of Artificial Sequence: Synthetic polypeptide
DDSEVATTNPVSTEPYGNVAANDIQQRVGNH

SEQ ID NO: 157370 - protein, 33 aa, Artificial Sequence
  Description of Artificial Sequence: Synthetic polypeptide
DEMEIASVNPVATEQYGTVCSATDGLVEFEGND

SEQ ID NO: 157371 - protein, 35 aa, Artificial Sequence
  Description of Artificial Sequence: Synthetic polypeptide
DEAEIRTTNPVATEQYGVVAITNIDNDERNGQGGS

SEQ ID NO: 157372 - protein, 32 aa, Artificial Sequence
  Description of Artificial Sequence: Synthetic polypeptide
DDSEVATTNPVSTEPYGNISANEDIQQRVGNR

SEQ ID NO: 157373 - protein, 31 aa, Artificial Sequence
  Description of Artificial Sequence: Synthetic polypeptide
DDSEVATTNPVSTEGYGTVSATDTIQRVGQD

SEQ ID NO: 157374 - protein, 39 aa, Artificial Sequence
  Description of Artificial Sequence: Synthetic polypeptide
DEEEIRTTNPVATEQYGVVSTVNLQQAATEQGTNNQTDE

SEQ ID NO: 157375 - protein, 37 aa, Artificial Sequence
  Description of Artificial Sequence: Synthetic polypeptide
DEEEIRTTNPVATEQYGVVSTTNQQQNNNNQQGEEED

SEQ ID NO: 157376 - protein, 37 aa, Artificial Sequence
  Description of Artificial Sequence: Synthetic polypeptide
DEEEIRTTNPVATEQYGVVSTVTNQNQQANTTNVATE

SEQ ID NO: 157377 - protein, 37 aa, Artificial Sequence
  Description of Artificial Sequence: Synthetic polypeptide
DEEEIRTTNPVATEQYGVVSTVNQQGNNQQGTTEDED

SEQ ID NO: 157378 - protein, 39 aa, Artificial Sequence
  Description of Artificial Sequence: Synthetic polypeptide
DEEEIRTTNPVATEQYGVVSTVNLQNQNQQQGTTNNATE

SEQ ID NO: 157379 - protein, 37 aa, Artificial Sequence
  Description of Artificial Sequence: Synthetic polypeptide
DEEEIRTTNPVATEQYGVVSTVTNQNNTEQGTNQEEE

SEQ ID NO: 157380 - protein, 37 aa, Artificial Sequence
  Description of Artificial Sequence: Synthetic polypeptide
DEEEIRTTNPVATEQYGVVSTVNQQAGTEQGTTEDED

SEQ ID NO: 157381 - protein, 37 aa, Artificial Sequence
  Description of Artificial Sequence: Synthetic polypeptide
DEEEIRTTNPVAYERYGISTVSYEGDELSDQRGDVRF

SEQ ID NO: 157382 - protein, 34 aa, Artificial Sequence
  Description of Artificial Sequence: Synthetic polypeptide
DEHEIRTTNPVAYEAWGSVSGDNLNGDRQGDHGK

SEQ ID NO: 157383 - protein, 39 aa, Artificial Sequence
  Description of Artificial Sequence: Synthetic polypeptide
DEEEIRTTNPVATEQYGSVSTTNNNNQQGNQQQGTEEGD

SEQ ID NO: 157384 - protein, 38 aa, Artificial Sequence
  Description of Artificial Sequence: Synthetic polypeptide
DEEEIRTTNPVATEQYGSVSTTNNNNQNGTEQGTEESD

SEQ ID NO: 157385 - protein, 33 aa, Artificial Sequence
  Description of Artificial Sequence: Synthetic polypeptide
DEMEIASTNPVGTEQYGVVCSATDGLVEHEGND

SEQ ID NO: 157386 - protein, 31 aa, Artificial Sequence
  Description of Artificial Sequence: Synthetic polypeptide
DDSEVASTNPVSTEGYGNVSANTIQSRVGGR

SEQ ID NO: 157387 - protein, 36 aa, Artificial Sequence
  Description of Artificial Sequence: Synthetic polypeptide
DEAEIRTTNPVATEQYGSYWASLDNMLEYAIDNQRD

SEQ ID NO: 157388 - protein, 35 aa, Artificial Sequence
  Description of Artificial Sequence: Synthetic polypeptide
DEAEIRTTNPVATEQYGSYWDLDNMLEEQISTQRD

SEQ ID NO: 157389 - protein, 34 aa, Artificial Sequence
  Description of Artificial Sequence: Synthetic polypeptide
DEAEIRTTNPVATEQYGSYWSLDNMAEAISGQTD

SEQ ID NO: 157390 - protein, 35 aa, Artificial Sequence
  Description of Artificial Sequence: Synthetic polypeptide
DEAEIRTTNPVATEQYGSYWSLDNMLEEEISTQRD

SEQ ID NO: 157391 - protein, 38 aa, Artificial Sequence
  Description of Artificial Sequence: Synthetic polypeptide
DEEEIRTTNPVATEQYGVVSTTNQQQQNATEQGSTNQE

SEQ ID NO: 157392 - protein, 31 aa, Artificial Sequence
  Description of Artificial Sequence: Synthetic polypeptide
DDSEVASTNPVSTEGYGNVSANTIQSRSGQR

SEQ ID NO: 157393 - protein, 32 aa, Artificial Sequence
  Description of Artificial Sequence: Synthetic polypeptide
DEMEIRTTNPVATEQWGTVSEDGEVMNFAGDA

SEQ ID NO: 157394 - protein, 34 aa, Artificial Sequence
  Description of Artificial Sequence: Synthetic polypeptide
DEAEIRTTNPVATEQYGSYWSLDNMLEEISQQPD

SEQ ID NO: 157395 - protein, 38 aa, Artificial Sequence
  Description of Artificial Sequence: Synthetic polypeptide
DEEEIRTTNPVATEQYGVVSTVTNQNNQQQGTNNQEEE

SEQ ID NO: 157396 - protein, 30 aa, Artificial Sequence
  Description of Artificial Sequence: Synthetic polypeptide
DDSEVASTNPVSTEGYGNVSANTIQSREQR

SEQ ID NO: 157397 - protein, 38 aa, Artificial Sequence
  Description of Artificial Sequence: Synthetic polypeptide
DEEEIRTTNPVATEQYGVVSTVNQQGNQQGTTNDEEED

SEQ ID NO: 157398 - protein, 34 aa, Artificial Sequence
  Description of Artificial Sequence: Synthetic polypeptide
DEHEIRTTNPVAYEAWGSVSGDNLLGDRQGDTGI

SEQ ID NO: 157399 - protein, 35 aa, Artificial Sequence
  Description of Artificial Sequence: Synthetic polypeptide
DEQEIATTNPVATEQYGSVSATDHNEDHQGLEPEN

SEQ ID NO: 157400 - protein, 34 aa, Artificial Sequence
  Description of Artificial Sequence: Synthetic polypeptide
DEAEIRTTNPVATEQYGVVCSTEEHNQNFPSDQS

SEQ ID NO: 157401 - protein, 37 aa, Artificial Sequence
  Description of Artificial Sequence: Synthetic polypeptide
DEEEIRTTNPVATEQYGVVSTVNQQAGTEQGTEEEEE

SEQ ID NO: 157402 - protein, 38 aa, Artificial Sequence
  Description of Artificial Sequence: Synthetic polypeptide
DEEEIRTTNPVATEQYGVVSTSNLQQSATEEGSVTDDE

SEQ ID NO: 157403 - protein, 38 aa, Artificial Sequence
  Description of Artificial Sequence: Synthetic polypeptide
DEEEIRTTNPVATEQYGVVSTVVANQQNQQGNNQDEED

SEQ ID NO: 157404 - protein, 38 aa, Artificial Sequence
  Description of Artificial Sequence: Synthetic polypeptide
DEEEIRTTNPVATEQYGVVSTVNNTNQQQGTVETGNTD

SEQ ID NO: 157405 - protein, 32 aa, Artificial Sequence
  Description of Artificial Sequence: Synthetic polypeptide
DDSEVASTNPVSTEGYGNVSANDLQSRVGEDR

SEQ ID NO: 157406 - protein, 38 aa, Artificial Sequence
  Description of Artificial Sequence: Synthetic polypeptide
DEEEIRTTNPVATEQYGVVSTSVVTNLQQGTDEEEETD

SEQ ID NO: 157407 - protein, 31 aa, Artificial Sequence
  Description of Artificial Sequence: Synthetic polypeptide
DDSEVASTNPVSTEGYGNVSANDIQSRVGER

SEQ ID NO: 157408 - protein, 31 aa, Artificial Sequence
  Description of Artificial Sequence: Synthetic polypeptide
DDSEVASTNPVSTEGYGNVSANDIQSREGER

SEQ ID NO: 157409 - protein, 34 aa, Artificial Sequence
  Description of Artificial Sequence: Synthetic polypeptide
DEQEIATTNPVATEQYGSVSATDLEDHEELEDLG

SEQ ID NO: 157410 - protein, 36 aa, Artificial Sequence
  Description of Artificial Sequence: Synthetic polypeptide
DEQEIRTTNPVATEQYGSVSSVDNCNGQEFGSEEGN

SEQ ID NO: 157411 - protein, 37 aa, Artificial Sequence
  Description of Artificial Sequence: Synthetic polypeptide
DEEEIRTTNPVATEQYGVVSTTNQQQNNNNNDEEDED

SEQ ID NO: 157412 - protein, 32 aa, Artificial Sequence
  Description of Artificial Sequence: Synthetic polypeptide
DEAEIRTTNPVAYEQYGCICSWETENFPSDQA

SEQ ID NO: 157413 - protein, 37 aa, Artificial Sequence
  Description of Artificial Sequence: Synthetic polypeptide
DEQEIRTTNPVATEQYGSVSSTTPANGPNMENGMNPV

SEQ ID NO: 157414 - protein, 33 aa, Artificial Sequence
  Description of Artificial Sequence: Synthetic polypeptide
DEMEIRTTNPVATEQYGCICSSGETQHFGSDQS

SEQ ID NO: 157415 - protein, 31 aa, Artificial Sequence
  Description of Artificial Sequence: Synthetic polypeptide
DEAEIRTTNPVAYEQYGCICSWELENFPSEQ

SEQ ID NO: 157416 - protein, 36 aa, Artificial Sequence
  Description of Artificial Sequence: Synthetic polypeptide
DEEEIRTTNPVSTEPYGSVSSTTPAGPNMRNGMNPV

SEQ ID NO: 157417 - protein, 39 aa, Artificial Sequence
  Description of Artificial Sequence: Synthetic polypeptide
DEEEIRTTNPVATEQYGVVSTVVATNLQQLGNQNEEGED

SEQ ID NO: 157418 - protein, 38 aa, Artificial Sequence
  Description of Artificial Sequence: Synthetic polypeptide
DEEEIRTTNPVATEQYGVVSTVTNQNQQGNQQGTNDTE

SEQ ID NO: 157419 - protein, 30 aa, Artificial Sequence
  Description of Artificial Sequence: Synthetic polypeptide
DDSEVASTNPVSTEGYGNVSANNIMRVGQR

SEQ ID NO: 157420 - protein, 34 aa, Artificial Sequence
  Description of Artificial Sequence: Synthetic polypeptide
DEHEIVTTNPVATEQYGTTVCSCTDGPSEFEGND

SEQ ID NO: 157421 - protein, 35 aa, Artificial Sequence
  Description of Artificial Sequence: Synthetic polypeptide
DEQEIATTNPVATEQYGSVSSATPDLNMHEGMEPL

SEQ ID NO: 157422 - protein, 39 aa, Artificial Sequence
  Description of Artificial Sequence: Synthetic polypeptide
DEEEIRTTNPVATEQYGVVSTVNLQAGNTEQGTNNDTTQ

SEQ ID NO: 157423 - protein, 35 aa, Artificial Sequence
  Description of Artificial Sequence: Synthetic polypeptide
DEQEIATTNPVATEQYGSVSSATPDLEDHEGMEDV

SEQ ID NO: 157424 - protein, 34 aa, Artificial Sequence
  Description of Artificial Sequence: Synthetic polypeptide
DEAEIRTTNPVATEQYGVVCSTEHNQENFISDQS

SEQ ID NO: 157425 - protein, 35 aa, Artificial Sequence
  Description of Artificial Sequence: Synthetic polypeptide
DEAEIRTTNPVATEQYGVVCSTEHNQENFNSDTQA

SEQ ID NO: 157426 - protein, 33 aa, Artificial Sequence
  Description of Artificial Sequence: Synthetic polypeptide
DAEEIATTNPVAYEQYGSVATAGTQTANTPDEN

SEQ ID NO: 157427 - protein, 34 aa, Artificial Sequence
  Description of Artificial Sequence: Synthetic polypeptide
DEHEIVTTNPVATESWGSVSCWNTSQTTGGNNPF

SEQ ID NO: 157428 - protein, 36 aa, Artificial Sequence
  Description of Artificial Sequence: Synthetic polypeptide
DAEEIATTNPVATEQYGSVCSANPALAEEAGDGNEH

SEQ ID NO: 157429 - protein, 37 aa, Artificial Sequence
  Description of Artificial Sequence: Synthetic polypeptide
DEEEIRTTNPVATEQYGVVSTQNQQAGTEQGSTQGDE

SEQ ID NO: 157430 - protein, 33 aa, Artificial Sequence
  Description of Artificial Sequence: Synthetic polypeptide
DEHEIVTTNPVATEQYGTVCSATDGPVEFEGAD

SEQ ID NO: 157431 - protein, 33 aa, Artificial Sequence
  Description of Artificial Sequence: Synthetic polypeptide
DEHEIVTTNPVATEQYGTVCSAPDGPVEFEGND

SEQ ID NO: 157432 - protein, 34 aa, Artificial Sequence
  Description of Artificial Sequence: Synthetic polypeptide
DEMEIATTNPVATCQYGCVCSTAHNQNFGSNNQS

SEQ ID NO: 157433 - protein, 35 aa, Artificial Sequence
  Description of Artificial Sequence: Synthetic polypeptide
DEQEIATTNPVATEQYGSVSSATPDGPNDHEGEDV

SEQ ID NO: 157434 - protein, 35 aa, Artificial Sequence
  Description of Artificial Sequence: Synthetic polypeptide
DEQEIATTNPVATEQYGSVSSATPALEDHEGMEDV

SEQ ID NO: 157435 - protein, 33 aa, Artificial Sequence
  Description of Artificial Sequence: Synthetic polypeptide
DEMEIATTNPVATCQYGCVCSTEAHQNFGSDQA

SEQ ID NO: 157436 - protein, 34 aa, Artificial Sequence
  Description of Artificial Sequence: Synthetic polypeptide
DEHEISTVNPVATEQYGSVSDDQAFHQEGAVNED

SEQ ID NO: 157437 - protein, 37 aa, Artificial Sequence
  Description of Artificial Sequence: Synthetic polypeptide
DEEEIRTTNPVATEQYGVVSTTNQQQNNNNEQGTDET

SEQ ID NO: 157438 - protein, 39 aa, Artificial Sequence
  Description of Artificial Sequence: Synthetic polypeptide
DEEEIRTTNPVATEQYGSVSTTNNNNQQGTQQIGTEEND

SEQ ID NO: 157439 - protein, 38 aa, Artificial Sequence
  Description of Artificial Sequence: Synthetic polypeptide
DEEEIRTTNPVATEQYGSVSTTNNNQQQGTEQGTEEQD

SEQ ID NO: 157440 - protein, 35 aa, Artificial Sequence
  Description of Artificial Sequence: Synthetic polypeptide
DAEEIATTNPVAYEQYGSVCSAPALPQDHGGNDQM

SEQ ID NO: 157441 - protein, 33 aa, Artificial Sequence
  Description of Artificial Sequence: Synthetic polypeptide
DAEEIATTNPVAYEQYGSVCSANPADNDGDTEM

SEQ ID NO: 157442 - protein, 33 aa, Artificial Sequence
  Description of Artificial Sequence: Synthetic polypeptide
DEQEIRTTNPIATEQWGAVSNTEDLEEHEGEDI

SEQ ID NO: 157443 - protein, 34 aa, Artificial Sequence
  Description of Artificial Sequence: Synthetic polypeptide
DEMEIRTTNPVATEQWGSVCSACIGEPEDFEGND

SEQ ID NO: 157444 - protein, 33 aa, Artificial Sequence
  Description of Artificial Sequence: Synthetic polypeptide
DEEEIRTTNPVSTEHWGCVYCMPNQDQRHGMML

SEQ ID NO: 157445 - protein, 33 aa, Artificial Sequence
  Description of Artificial Sequence: Synthetic polypeptide
DEQEIRTTNPIATEQWGAVSNTEDLEEHEGEYI

SEQ ID NO: 157446 - protein, 33 aa, Artificial Sequence
  Description of Artificial Sequence: Synthetic polypeptide
DEQEIRTTNPIATEQWGAVSNTEDLEEHKGEYI

SEQ ID NO: 157447 - protein, 34 aa, Artificial Sequence
  Description of Artificial Sequence: Synthetic polypeptide
DEEEIRTTNPVSTEHWGCVYCMPNQDQRHGTNDL

SEQ ID NO: 157448 - protein, 32 aa, Artificial Sequence
  Description of Artificial Sequence: Synthetic polypeptide
DEQEIRTTNPIATEQYGATAATDLEEHKGEDL

SEQ ID NO: 157449 - protein, 31 aa, Artificial Sequence
  Description of Artificial Sequence: Synthetic polypeptide
DDSEVASTNPVSTEGYGNVSATDIQSRVGQR

SEQ ID NO: 157450 - protein, 33 aa, Artificial Sequence
  Description of Artificial Sequence: Synthetic polypeptide
DEQEIRTTNPIATEQYGAVSATEDWADHEGEDL

SEQ ID NO: 157451 - protein, 39 aa, Artificial Sequence
  Description of Artificial Sequence: Synthetic polypeptide
DEEEIRTTNPVATEQYGSVSTTNQNNQISTTEQGTNNDN

SEQ ID NO: 157452 - protein, 32 aa, Artificial Sequence
  Description of Artificial Sequence: Synthetic polypeptide
CEEEIATTNPVAYEQWGCVTGGMGQDQGDGNR

SEQ ID NO: 157453 - protein, 34 aa, Artificial Sequence
  Description of Artificial Sequence: Synthetic polypeptide
DEHEIRTTNPVAYEQYGTVATNGGNGPNGQTGEA

SEQ ID NO: 157454 - protein, 33 aa, Artificial Sequence
  Description of Artificial Sequence: Synthetic polypeptide
CEEEIACTNPVATEQYGSVSANSDEDAGGDAME

SEQ ID NO: 157455 - protein, 36 aa, Artificial Sequence
  Description of Artificial Sequence: Synthetic polypeptide
DEHEIRTTNPVATEQYGSVWTNDVTEEIFVLQDHPI

SEQ ID NO: 157456 - protein, 32 aa, Artificial Sequence
  Description of Artificial Sequence: Synthetic polypeptide
DEQEIRTTNPIATEQYGSVAAADWAEHEGEYL

SEQ ID NO: 157457 - protein, 35 aa, Artificial Sequence
  Description of Artificial Sequence: Synthetic polypeptide
DEAEIRTTNPVATEQYGSYVNIETPLWEGGSEISG

SEQ ID NO: 157458 - protein, 32 aa, Artificial Sequence
  Description of Artificial Sequence: Synthetic polypeptide
DEHELSTVNPVATEQYGSVSDDQAFQGAVNED

SEQ ID NO: 157459 - protein, 38 aa, Artificial Sequence
  Description of Artificial Sequence: Synthetic polypeptide
DEEEIRTTNPVATEQYGVVSTVNNQQNTNQQGNNNQTD

SEQ ID NO: 157460 - protein, 34 aa, Artificial Sequence
  Description of Artificial Sequence: Synthetic polypeptide
DEHSIATTNPVAYEQWGSVSHNPLDDRQNMGANH

SEQ ID NO: 157461 - protein, 35 aa, Artificial Sequence
  Description of Artificial Sequence: Synthetic polypeptide
DEAEIRTTNPVAYEQYGQSVSQENELLTFELIERF

SEQ ID NO: 157462 - protein, 39 aa, Artificial Sequence
  Description of Artificial Sequence: Synthetic polypeptide
DEEEIRTTNPVATEQYGSVSTTNQQQQNGTNEQGTTEEE

SEQ ID NO: 157463 - protein, 39 aa, Artificial Sequence
  Description of Artificial Sequence: Synthetic polypeptide
DEEEIRTTNPVATEQYGSVSTTNQQQQNATTEQGTNQTE

SEQ ID NO: 157464 - protein, 38 aa, Artificial Sequence
  Description of Artificial Sequence: Synthetic polypeptide
DEEEIRTTNPVATEQYGSVSTTNQQQQNATEQGTTEDN

SEQ ID NO: 157465 - protein, 34 aa, Artificial Sequence
  Description of Artificial Sequence: Synthetic polypeptide
CEEEIATTNPVAYEPQWGQSVATNDLMQDGIGDD

SEQ ID NO: 157466 - protein, 38 aa, Artificial Sequence
  Description of Artificial Sequence: Synthetic polypeptide
DEEEIRTTNPVATEQYGSVSTTNQQQQNATEAGTTEES

SEQ ID NO: 157467 - protein, 38 aa, Artificial Sequence
  Description of Artificial Sequence: Synthetic polypeptide
DEEEIRTTNPVATEQYGSVSTTNQQQQIGTEQGTTEDE

SEQ ID NO: 157468 - protein, 39 aa, Artificial Sequence
  Description of Artificial Sequence: Synthetic polypeptide
DEEEIRTTNPVATEQYGSVSTTNQQQLQQGTEQGTVVED

SEQ ID NO: 157469 - protein, 31 aa, Artificial Sequence
  Description of Artificial Sequence: Synthetic polypeptide
DEMEIRTTNPVATEQWGDVSEIEVMNAAEDA

SEQ ID NO: 157470 - protein, 39 aa, Artificial Sequence
  Description of Artificial Sequence: Synthetic polypeptide
DEEEIRTTNPVATEQYGSVSTTNQQNQIGTTEQGTNNGN

SEQ ID NO: 157471 - protein, 34 aa, Artificial Sequence
  Description of Artificial Sequence: Synthetic polypeptide
CEEEIACTNPVATEQYGSVCATNLPADPPMDNQM

SEQ ID NO: 157472 - protein, 33 aa, Artificial Sequence
  Description of Artificial Sequence: Synthetic polypeptide
CEEEIACTNPVATEQYGSVCATNPLHNDSLDHQ

SEQ ID NO: 157473 - protein, 35 aa, Artificial Sequence
  Description of Artificial Sequence: Synthetic polypeptide
CEEEIACTNPVATEQYGSVCATNPQLNPDDQGGED

SEQ ID NO: 157474 - protein, 35 aa, Artificial Sequence
  Description of Artificial Sequence: Synthetic polypeptide
CEEEIATTNPVAYEQYGSVSTNEGPPVENGDNEAM

SEQ ID NO: 157475 - protein, 34 aa, Artificial Sequence
  Description of Artificial Sequence: Synthetic polypeptide
DEMEIRTTNPVATEQWGTVCSATDGPVENAEGND

SEQ ID NO: 157476 - protein, 35 aa, Artificial Sequence
  Description of Artificial Sequence: Synthetic polypeptide
DEEEIRTTNPVAYERYGKTMSCTQNAFTRTGDNEK

SEQ ID NO: 157477 - protein, 33 aa, Artificial Sequence
  Description of Artificial Sequence: Synthetic polypeptide
DEMEIASTNPVATEQYGTVCAATDTIVEFVGNR

SEQ ID NO: 157478 - protein, 31 aa, Artificial Sequence
  Description of Artificial Sequence: Synthetic polypeptide
DDSEVASTNPVSTEGYGNVSANTLQSHVGQR

SEQ ID NO: 157479 - protein, 39 aa, Artificial Sequence
  Description of Artificial Sequence: Synthetic polypeptide
DEEEIRTTNPVATEQYGSVSTTNNQNQNGTTEQGTNEEE

SEQ ID NO: 157480 - protein, 37 aa, Artificial Sequence
  Description of Artificial Sequence: Synthetic polypeptide
DEEEIRTTNPVAYEQYGQSITSNTQNDLLQPRSIEKS

SEQ ID NO: 157481 - protein, 39 aa, Artificial Sequence
  Description of Artificial Sequence: Synthetic polypeptide
DEEEIRTTNPVATEQYGSVSTTNNQNQNGTNEQGSTEEE

SEQ ID NO: 157482 - protein, 33 aa, Artificial Sequence
  Description of Artificial Sequence: Synthetic polypeptide
DEMEIRTTNPVATEQYGQCICSWETQSFGSDQS

SEQ ID NO: 157483 - protein, 38 aa, Artificial Sequence
  Description of Artificial Sequence: Synthetic polypeptide
DEEEIRTTNPVATEQYGSVSTTNNQNANEQGTTEQGQE

SEQ ID NO: 157484 - protein, 31 aa, Artificial Sequence
  Description of Artificial Sequence: Synthetic polypeptide
DEMEIASTNPVGTEQYGVMCSATGPQHEGDI

SEQ ID NO: 157485 - protein, 38 aa, Artificial Sequence
  Description of Artificial Sequence: Synthetic polypeptide
DEEEIRTTNPVATEQYGVVSTVTNQNNQQGTTNNEEED

SEQ ID NO: 157486 - protein, 38 aa, Artificial Sequence
  Description of Artificial Sequence: Synthetic polypeptide
DEEEIRTTNPVATEQYGVVSTVNQQGNTEQGTNQQGEE

SEQ ID NO: 157487 - protein, 31 aa, Artificial Sequence
  Description of Artificial Sequence: Synthetic polypeptide
DDSEVASTNPVSTEGYGNVSANTIQSRVGQR

SEQ ID NO: 157488 - protein, 38 aa, Artificial Sequence
  Description of Artificial Sequence: Synthetic polypeptide
DEEEIRTTNPVATEQYGVVSTVTNQNNQQQGTNATEEN

SEQ ID NO: 157489 - protein, 33 aa, Artificial Sequence
  Description of Artificial Sequence: Synthetic polypeptide
DEMEIRTTNPVATEQWGTVCSAEIPVENAEGND

SEQ ID NO: 157490 - protein, 38 aa, Artificial Sequence
  Description of Artificial Sequence: Synthetic polypeptide
DEEEIRTTNPVATEQYGVVSTTNQQQQNATEQGTTNTD

SEQ ID NO: 157491 - protein, 35 aa, Artificial Sequence
  Description of Artificial Sequence: Synthetic polypeptide
DEQEIATTNPVATEQYGSVSATDGQEDQEGEEDED

SEQ ID NO: 157492 - protein, 31 aa, Artificial Sequence
  Description of Artificial Sequence: Synthetic polypeptide
DDSEVATTNPVSTEGYGNVAANGIQSREGQR

SEQ ID NO: 157493 - protein, 38 aa, Artificial Sequence
  Description of Artificial Sequence: Synthetic polypeptide
DEEEIRTTNPVATEQYGSVSTTNNQNQQGTEQGSTEEQ

SEQ ID NO: 157494 - protein, 31 aa, Artificial Sequence
  Description of Artificial Sequence: Synthetic polypeptide
DEMEIAPTNPCASEQYGTVCSCDNPVQFGTD

SEQ ID NO: 157495 - protein, 38 aa, Artificial Sequence
  Description of Artificial Sequence: Synthetic polypeptide
DEEEIRTTNPVATEQYGSVSTTNNQNQQGTEQGTEEQQ

SEQ ID NO: 157496 - protein, 39 aa, Artificial Sequence
  Description of Artificial Sequence: Synthetic polypeptide
DEEEIRTTNPVATEQYGSVSTTNNQNQQGTNEQGTNDED

SEQ ID NO: 157497 - protein, 30 aa, Artificial Sequence
  Description of Artificial Sequence: Synthetic polypeptide
DDSEVATTNPVSTEPYGNVANDIQQRVGNH

SEQ ID NO: 157498 - protein, 35 aa, Artificial Sequence
  Description of Artificial Sequence: Synthetic polypeptide
DEQEIATTNPVATEQYGSVSATDDGEDQEGEEDGA

SEQ ID NO: 157499 - protein, 32 aa, Artificial Sequence
  Description of Artificial Sequence: Synthetic polypeptide
DEMEIASTNPVATEQYGVMCSATGPVQHEGDI

SEQ ID NO: 157500 - protein, 35 aa, Artificial Sequence
  Description of Artificial Sequence: Synthetic polypeptide
DEMEIRTTNPVATEQWGSVCSACINEPEDFEGEND

SEQ ID NO: 157501 - protein, 29 aa, Artificial Sequence
  Description of Artificial Sequence: Synthetic peptide
CEEEIATTNPVAYEQYGEAPEVCCQHEEK

SEQ ID NO: 157502 - protein, 32 aa, Artificial Sequence
  Description of Artificial Sequence: Synthetic polypeptide
DCEEIRATNPVAYEQWGSSYYAEHNHTQRGGW

SEQ ID NO: 157503 - protein, 32 aa, Artificial Sequence
  Description of Artificial Sequence: Synthetic polypeptide
DEMEIASTNPVCTEQYGTVCSATDGPVESGND

SEQ ID NO: 157504 - protein, 38 aa, Artificial Sequence
  Description of Artificial Sequence: Synthetic polypeptide
DEEEIRTTNPVATEQYGVVSTTNQQQQNATEQGVVNDE

SEQ ID NO: 157505 - protein, 38 aa, Artificial Sequence
  Description of Artificial Sequence: Synthetic polypeptide
DEEEIRTTNPVATEQYGSVSTTNNQQQSATETGTTTTD

SEQ ID NO: 157506 - protein, 38 aa, Artificial Sequence
  Description of Artificial Sequence: Synthetic polypeptide
DEEEIRTTNPVATEQYGSVSTTNNQQQSATEEGTTDEE

SEQ ID NO: 157507 - protein, 34 aa, Artificial Sequence
  Description of Artificial Sequence: Synthetic polypeptide
DEMEIRTTNPVATEQWGTVCSACIGEPEREGENG

SEQ ID NO: 157508 - protein, 33 aa, Artificial Sequence
  Description of Artificial Sequence: Synthetic polypeptide
DEMEIRTTNPVATEQWGTVCSAEGPVENAEGND

SEQ ID NO: 157509 - protein, 31 aa, Artificial Sequence
  Description of Artificial Sequence: Synthetic polypeptide
DEMEIASTNPVCTEQYGTVCSDDGPESEGND

SEQ ID NO: 157510 - protein, 39 aa, Artificial Sequence
  Description of Artificial Sequence: Synthetic polypeptide
DEEEIRTTNPVATEQYGSVSTTNNQQQNATNEQGTNQDE

SEQ ID NO: 157511 - protein, 31 aa, Artificial Sequence
  Description of Artificial Sequence: Synthetic polypeptide
DDSEVASTNPVSTEGYGNVSANWIQSRVGQR

SEQ ID NO: 157512 - protein, 38 aa, Artificial Sequence
  Description of Artificial Sequence: Synthetic polypeptide
DEEEIRTTNPVATEQYGVVSTVTNQNNQQGNIGTNATE

SEQ ID NO: 157513 - protein, 38 aa, Artificial Sequence
  Description of Artificial Sequence: Synthetic polypeptide
DEEEIRTTNPVATEQYGVVSTTNQQQLNLGNQGTEQGQ

SEQ ID NO: 157514 - protein, 38 aa, Artificial Sequence
  Description of Artificial Sequence: Synthetic polypeptide
DEEEIRTTNPVATEQYGVVSTTAQLQQGTEQGTEQGNE

SEQ ID NO: 157515 - protein, 33 aa, Artificial Sequence
  Description of Artificial Sequence: Synthetic polypeptide
DEEEIRTTNPVSTEPYGTIHSMEDIQQQQNGNH

SEQ ID NO: 157516 - protein, 39 aa, Artificial Sequence
  Description of Artificial Sequence: Synthetic polypeptide
DEEEIRTTNPVATEQYGVVSTTVTNNQNLQQGNNDEQNE

SEQ ID NO: 157517 - protein, 35 aa, Artificial Sequence
  Description of Artificial Sequence: Synthetic polypeptide
DEEEIRTTNPVSTEPYGTISTTPAGQQMRNGMNPV

SEQ ID NO: 157518 - protein, 34 aa, Artificial Sequence
  Description of Artificial Sequence: Synthetic polypeptide
DEAEIRTTNPVAYEQWGVVTGGNGNQGIEGNVNR

SEQ ID NO: 157519 - protein, 32 aa, Artificial Sequence
  Description of Artificial Sequence: Synthetic polypeptide
DEAEISTTNPVAYEQWGSTVTNPNGNGMGNEH

SEQ ID NO: 157520 - protein, 34 aa, Artificial Sequence
  Description of Artificial Sequence: Synthetic polypeptide
DEMEIATTNPVATEQYGTVCSYTDGPVEDEGGND

SEQ ID NO: 157521 - protein, 37 aa, Artificial Sequence
  Description of Artificial Sequence: Synthetic polypeptide
DEEEIRTTNPVATEQYGVVSTTNQQNNQQGTEQGTTE

SEQ ID NO: 157522 - protein, 38 aa, Artificial Sequence
  Description of Artificial Sequence: Synthetic polypeptide
DEEEIRTTNPVATEQYGVVSTTNLQQQNATEQGTTQEE

SEQ ID NO: 157523 - protein, 39 aa, Artificial Sequence
  Description of Artificial Sequence: Synthetic polypeptide
DEEEIRTTNPVATEQYGVVSTTNLQQQNATNEQGTTNMD

SEQ ID NO: 157524 - protein, 32 aa, Artificial Sequence
  Description of Artificial Sequence: Synthetic polypeptide
DDSEVASTNPVSTEGYGNVCSANTIQSRVGNR

SEQ ID NO: 157525 - protein, 34 aa, Artificial Sequence
  Description of Artificial Sequence: Synthetic polypeptide
DEMEIATTNPVATEQYGTVCSYTDGEPSEFEGND

SEQ ID NO: 157526 - protein, 31 aa, Artificial Sequence
  Description of Artificial Sequence: Synthetic polypeptide
DDSEVASTNPVSTEGYGNVAANDLQSRVGER

SEQ ID NO: 157527 - protein, 31 aa, Artificial Sequence
  Description of Artificial Sequence: Synthetic polypeptide
DDSEVASTNPVSTEGYGNVCSANTIQRVGQR

SEQ ID NO: 157528 - protein, 33 aa, Artificial Sequence
  Description of Artificial Sequence: Synthetic polypeptide
DEAEIRTTNPVAYEQWGVVTGGNGNQGEGNVDE

SEQ ID NO: 157529 - protein, 33 aa, Artificial Sequence
  Description of Artificial Sequence: Synthetic polypeptide
DEQEIRTTNPVATECYGSTWAATDLADHKGPDI

SEQ ID NO: 157530 - protein, 38 aa, Artificial Sequence
  Description of Artificial Sequence: Synthetic polypeptide
DEEEIRTTNPVATEQYGVVSTTVTNQQAGNQAGNDEDE

SEQ ID NO: 157531 - protein, 39 aa, Artificial Sequence
  Description of Artificial Sequence: Synthetic polypeptide
DEEEIRTTNPVATEQYGVVSTTVTNLQQSTTEQGTNQDN

SEQ ID NO: 157532 - protein, 35 aa, Artificial Sequence
  Description of Artificial Sequence: Synthetic polypeptide
DCDEIRTTNPVATEQYGSVSDWVNIEETLETNNES

SEQ ID NO: 157533 - protein, 39 aa, Artificial Sequence
  Description of Artificial Sequence: Synthetic polypeptide
DEEEIRTTNPVATEQYGVVSTTVTNGNLQQGTNNEEEDE

SEQ ID NO: 157534 - protein, 34 aa, Artificial Sequence
  Description of Artificial Sequence: Synthetic polypeptide
DEAEIRTTNPVAYECWGSVCYTNIDGDLGQDGEA

SEQ ID NO: 157535 - protein, 33 aa, Artificial Sequence
  Description of Artificial Sequence: Synthetic polypeptide
DEAEIRTTNPVAYEQWGVVTGGNGNSGNGNGDR

SEQ ID NO: 157536 - protein, 34 aa, Artificial Sequence
  Description of Artificial Sequence: Synthetic polypeptide
DEAEIRTTNPVAYEQWGVVTGGNGNQTGQGNGDR

SEQ ID NO: 157537 - protein, 38 aa, Artificial Sequence
  Description of Artificial Sequence: Synthetic polypeptide
DEEEIRTTNPVATEQYGVVSTVNQNGNNQQGNNQNGND

SEQ ID NO: 157538 - protein, 34 aa, Artificial Sequence
  Description of Artificial Sequence: Synthetic polypeptide
DEAEIRTTNPVAYEAWGTVSHNPLDQNNDQNDQR

SEQ ID NO: 157539 - protein, 35 aa, Artificial Sequence
  Description of Artificial Sequence: Synthetic polypeptide
DEEEIRTTNPVAYEQYGQSASVANDALQVEITVEY

SEQ ID NO: 157540 - protein, 38 aa, Artificial Sequence
  Description of Artificial Sequence: Synthetic polypeptide
DEEEIRTTNPVATEQYGVVSTTNQQPGNNNQQGTNQDT

SEQ ID NO: 157541 - protein, 35 aa, Artificial Sequence
  Description of Artificial Sequence: Synthetic polypeptide
DEMEIRTTNPVATEQYGCVSTVVNDIEDGTSIFST

SEQ ID NO: 157542 - protein, 39 aa, Artificial Sequence
  Description of Artificial Sequence: Synthetic polypeptide
DEEEIRTTNPVATEQYGVVSTTNLQAGNTENGNNNNQND

SEQ ID NO: 157543 - protein, 33 aa, Artificial Sequence
  Description of Artificial Sequence: Synthetic polypeptide
DEEEIRTTNPVSTEPYGTISMEDYIQQQQNGNH

SEQ ID NO: 157544 - protein, 32 aa, Artificial Sequence
  Description of Artificial Sequence: Synthetic polypeptide
DEAEISTTNPVAYEQYGCICSTELENFPSNQA

SEQ ID NO: 157545 - protein, 39 aa, Artificial Sequence
  Description of Artificial Sequence: Synthetic polypeptide
DEEEIRTTNPVATEQYGVVSTTVNTQLQQGTEQGTNQTE

SEQ ID NO: 157546 - protein, 39 aa, Artificial Sequence
  Description of Artificial Sequence: Synthetic polypeptide
DEEEIRTTNPVATEQYGVVSTVNLNQLQEGTEQGTNVET

SEQ ID NO: 157547 - protein, 33 aa, Artificial Sequence
  Description of Artificial Sequence: Synthetic polypeptide
DEAEIRTTNPVAYEQWGVVTGGNGNQIEGQDDR

SEQ ID NO: 157548 - protein, 35 aa, Artificial Sequence
  Description of Artificial Sequence: Synthetic polypeptide
DEHEISTTNPVATEIYGSVCSNWNDGQDRMGDTES

SEQ ID NO: 157549 - protein, 34 aa, Artificial Sequence
  Description of Artificial Sequence: Synthetic polypeptide
DEAEIRTTNPVAYEQWGVVTGGNGNQGQHGNADR

SEQ ID NO: 157550 - protein, 34 aa, Artificial Sequence
  Description of Artificial Sequence: Synthetic polypeptide
DEMEIRTTNPVATEQYGCVSTVLLWETSAPDPSA

SEQ ID NO: 157551 - protein, 39 aa, Artificial Sequence
  Description of Artificial Sequence: Synthetic polypeptide
DEEEIRTTNPVATEQYGVVSTTNLNQLQQGTEQGTNVEQ

SEQ ID NO: 157552 - protein, 35 aa, Artificial Sequence
  Description of Artificial Sequence: Synthetic polypeptide
DCDEIRTTNPVATEQYGSVSDWVLIETTLETLNES

SEQ ID NO: 157553 - protein, 35 aa, Artificial Sequence
  Description of Artificial Sequence: Synthetic polypeptide
DEQEIRTTNPVATEQYGSVSCVVDLNQPNHQIDHQ

SEQ ID NO: 157554 - protein, 34 aa, Artificial Sequence
  Description of Artificial Sequence: Synthetic polypeptide
DEAEIRTTNPVAYECWGSVYRINENQDRRGENGI

SEQ ID NO: 157555 - protein, 38 aa, Artificial Sequence
  Description of Artificial Sequence: Synthetic polypeptide
DEEEIRTTNPVATEQYGVVSTTVTNQQQGNQQGNQQDE

SEQ ID NO: 157556 - protein, 34 aa, Artificial Sequence
  Description of Artificial Sequence: Synthetic polypeptide
DCAEIRTTNPVATEQYGCVSNYVSENGFNQDKES

SEQ ID NO: 157557 - protein, 34 aa, Artificial Sequence
  Description of Artificial Sequence: Synthetic polypeptide
DEMEIATTNPVATEQYGTVCSKTDGPDEGEGNQD

SEQ ID NO: 157558 - protein, 32 aa, Artificial Sequence
  Description of Artificial Sequence: Synthetic polypeptide
DEAEIRTTNPVAYEQWGVVSGGNTNDHPNMGE

SEQ ID NO: 157559 - protein, 34 aa, Artificial Sequence
  Description of Artificial Sequence: Synthetic polypeptide
DEAEIRTTNPVAYEQWGVVSGDNGNHQNNGDQGR

SEQ ID NO: 157560 - protein, 35 aa, Artificial Sequence
  Description of Artificial Sequence: Synthetic polypeptide
DEEEIRTTNPVSTEQYGSVSMESALPISVQQVLPW

SEQ ID NO: 157561 - protein, 33 aa, Artificial Sequence
  Description of Artificial Sequence: Synthetic polypeptide
DEAEIRTTNPVAYEQWGVVSGDNGNHQNMGSGM

SEQ ID NO: 157562 - protein, 32 aa, Artificial Sequence
  Description of Artificial Sequence: Synthetic polypeptide
DEHEIRTTNPVSTEPYGTISMEDIQQTQNGNH

SEQ ID NO: 157563 - protein, 33 aa, Artificial Sequence
  Description of Artificial Sequence: Synthetic polypeptide
DAQQIATTNPVATEQWGSVSVTHGLASGENMTD

SEQ ID NO: 157564 - protein, 34 aa, Artificial Sequence
  Description of Artificial Sequence: Synthetic polypeptide
DEAEIRTTNPVAYECWGVVCSTDNGDERDGDIRS

SEQ ID NO: 157565 - protein, 34 aa, Artificial Sequence
  Description of Artificial Sequence: Synthetic polypeptide
DEAEIRTTNPVAYECWGVVCSTDNGNERDGDKGR

SEQ ID NO: 157566 - protein, 34 aa, Artificial Sequence
  Description of Artificial Sequence: Synthetic polypeptide
DEAEIRTTNPVAYEQWGVVCSTQGINDTNDGNSG

SEQ ID NO: 157567 - protein, 35 aa, Artificial Sequence
  Description of Artificial Sequence: Synthetic polypeptide
DEAEIRTTNPVAYECWGVVCSTDNGNERDGGDDNR

SEQ ID NO: 157568 - protein, 32 aa, Artificial Sequence
  Description of Artificial Sequence: Synthetic polypeptide
DEHEIRTTNPVSTEPYGTISMEDIQQQQNGNH

SEQ ID NO: 157569 - protein, 38 aa, Artificial Sequence
  Description of Artificial Sequence: Synthetic polypeptide
DEEEIRTTNPVATEQYGVVSTTVTNQQNGNQAGNQNVE

SEQ ID NO: 157570 - protein, 38 aa, Artificial Sequence
  Description of Artificial Sequence: Synthetic polypeptide
DEEEIRTTNPVATEQYGVVSTTVTNQQAGNQAGNQQGE

SEQ ID NO: 157571 - protein, 34 aa, Artificial Sequence
  Description of Artificial Sequence: Synthetic polypeptide
DEAEIRTTNPVAYECWGSVSGGNADDSRNGNGNS

SEQ ID NO: 157572 - protein, 35 aa, Artificial Sequence
  Description of Artificial Sequence: Synthetic polypeptide
DEAEIRTTNPVAYECWGSVSGENLGEERQGGNNHM

SEQ ID NO: 157573 - protein, 32 aa, Artificial Sequence
  Description of Artificial Sequence: Synthetic polypeptide
DEHEIRTTNPVSYEQWGSCYTFDNHQNGGDQM

SEQ ID NO: 157574 - protein, 38 aa, Artificial Sequence
  Description of Artificial Sequence: Synthetic polypeptide
DEEEIRTTNPVATEQYGVVSTVNQNGNQQGTNNTEDED

SEQ ID NO: 157575 - protein, 34 aa, Artificial Sequence
  Description of Artificial Sequence: Synthetic polypeptide
DEAEIRTTNPVAYECWGSVCYTNIDQDGGQRGDN

SEQ ID NO: 157576 - protein, 34 aa, Artificial Sequence
  Description of Artificial Sequence: Synthetic polypeptide
DEAEIRTTNPVAYECWGSVCYTNIDQDLNQDGEN

SEQ ID NO: 157577 - protein, 36 aa, Artificial Sequence
  Description of Artificial Sequence: Synthetic polypeptide
DCDEIRTTNPVATEQYGSVNSCWVNIETTLETGNES

SEQ ID NO: 157578 - protein, 34 aa, Artificial Sequence
  Description of Artificial Sequence: Synthetic polypeptide
DEAEIRTTNPVAYECWGSVCYTNQDQDLGHNGEP

SEQ ID NO: 157579 - protein, 37 aa, Artificial Sequence
  Description of Artificial Sequence: Synthetic polypeptide
DEEEIRTTNPVATEQYGVVSTVTNQQGNNAGGTEEGQ

SEQ ID NO: 157580 - protein, 38 aa, Artificial Sequence
  Description of Artificial Sequence: Synthetic polypeptide
DEEEIRTTNPVATEQYGVVSTVTTNNNQAGNQNNEEDE

SEQ ID NO: 157581 - protein, 39 aa, Artificial Sequence
  Description of Artificial Sequence: Synthetic polypeptide
DEEEIRTTNPVATEQYGSVSTTNGNQLQAGTEQGTVQEE

SEQ ID NO: 157582 - protein, 33 aa, Artificial Sequence
  Description of Artificial Sequence: Synthetic polypeptide
DEHEIRTTNPVSTEQWGSCYTFDNHQNGGKQST

SEQ ID NO: 157583 - protein, 33 aa, Artificial Sequence
  Description of Artificial Sequence: Synthetic polypeptide
DEMEIATTNPVATENYGTVCSMTDGPVEFEGND

SEQ ID NO: 157584 - protein, 33 aa, Artificial Sequence
  Description of Artificial Sequence: Synthetic polypeptide
DEAEIRTTNPVAYEQWGVVTGGNGNPGNGNAGR

SEQ ID NO: 157585 - protein, 32 aa, Artificial Sequence
  Description of Artificial Sequence: Synthetic polypeptide
DEHEIRTTNPVSTEPYGTISMKDIQQHQNGNH

SEQ ID NO: 157586 - protein, 39 aa, Artificial Sequence
  Description of Artificial Sequence: Synthetic polypeptide
DEEEIRTTNPVATEQYGSVSTTNGNALQQGTEQGTEEEE

SEQ ID NO: 157587 - protein, 33 aa, Artificial Sequence
  Description of Artificial Sequence: Synthetic polypeptide
DEMEIATTNPVATEQWGTVPSCTDGPSEFEGND

SEQ ID NO: 157588 - protein, 34 aa, Artificial Sequence
  Description of Artificial Sequence: Synthetic polypeptide
DEAEIRTTNPVAYECWGSVSGENQGEERQGENSE

SEQ ID NO: 157589 - protein, 34 aa, Artificial Sequence
  Description of Artificial Sequence: Synthetic polypeptide
DEAEIRTTNPVAYEAWGSVYHTDNLQQGTGGGGT

SEQ ID NO: 157590 - protein, 34 aa, Artificial Sequence
  Description of Artificial Sequence: Synthetic polypeptide
DEAEIRTTNPVAYEQWGVVTGGNNGNQGNGNQDR

SEQ ID NO: 157591 - protein, 32 aa, Artificial Sequence
  Description of Artificial Sequence: Synthetic polypeptide
DEAEIRTTNPVAYEAWGSVVIENDQPGHQQQE

SEQ ID NO: 157592 - protein, 38 aa, Artificial Sequence
  Description of Artificial Sequence: Synthetic polypeptide
DEEEIRTTNPVATEQYGVVSTVTNQQAGNQAGTNQNDE

SEQ ID NO: 157593 - protein, 36 aa, Artificial Sequence
  Description of Artificial Sequence: Synthetic polypeptide
DEAEIRTTNPVATETYGSVGSNRENDLSETIGENNE

SEQ ID NO: 157594 - protein, 33 aa, Artificial Sequence
  Description of Artificial Sequence: Synthetic polypeptide
DEMEIRTTNPVATEQYGCICSWEETQYFGSDQS

SEQ ID NO: 157595 - protein, 39 aa, Artificial Sequence
  Description of Artificial Sequence: Synthetic polypeptide
DEEEIRTTNPVATEQYGVVSTVTVTNQNLQQGNNTTNND

SEQ ID NO: 157596 - protein, 33 aa, Artificial Sequence
  Description of Artificial Sequence: Synthetic polypeptide
DEAEIRTTNPVAYEQYGCICSTENLENFPSDQG

SEQ ID NO: 157597 - protein, 36 aa, Artificial Sequence
  Description of Artificial Sequence: Synthetic polypeptide
DEAEIRTTNPVATETYGVSGSNRENDLSQTIGEQNE

SEQ ID NO: 157598 - protein, 36 aa, Artificial Sequence
  Description of Artificial Sequence: Synthetic polypeptide
DEAEIRTTNPVATEVYGSVSSTTPAGPNMRNGMNPV

SEQ ID NO: 157599 - protein, 33 aa, Artificial Sequence
  Description of Artificial Sequence: Synthetic polypeptide
DEAEIRTTNPVATEWWGSFSCIAEQQVSDGENE

SEQ ID NO: 157600 - protein, 33 aa, Artificial Sequence
  Description of Artificial Sequence: Synthetic polypeptide
DEMEIATTNPVATTQWGCVHRTNDGEQQGTNEP

SEQ ID NO: 157601 - protein, 33 aa, Artificial Sequence
  Description of Artificial Sequence: Synthetic polypeptide
DEMEIATTNPVATQQWGCVSTWNGDENRQGDHP

SEQ ID NO: 157602 - protein, 36 aa, Artificial Sequence
  Description of Artificial Sequence: Synthetic polypeptide
DEQEIRTTNPVATEQYGSVSSATPDGPNDHEGMEDV

SEQ ID NO: 157603 - protein, 38 aa, Artificial Sequence
  Description of Artificial Sequence: Synthetic polypeptide
DEEEIRTTNPVATEQYGVVSTTVNQQLQQATTNVATES

SEQ ID NO: 157604 - protein, 35 aa, Artificial Sequence
  Description of Artificial Sequence: Synthetic polypeptide
DEQEIRTTNPVATEQYGSVSSATPAGEDHEGMEDV

SEQ ID NO: 157605 - protein, 32 aa, Artificial Sequence
  Description of Artificial Sequence: Synthetic polypeptide
DEAEIRTTNPVAYEQYGCICSTEHENFPSEQA

SEQ ID NO: 157606 - protein, 32 aa, Artificial Sequence
  Description of Artificial Sequence: Synthetic polypeptide
CEEEIASVNPVCTEQYGVVCSWNLQSFGSDQS

SEQ ID NO: 157607 - protein, 32 aa, Artificial Sequence
  Description of Artificial Sequence: Synthetic polypeptide
DEAEIRTTNPVAYEQYGCICSTNHENFPSDQI

SEQ ID NO: 157608 - protein, 34 aa, Artificial Sequence
  Description of Artificial Sequence: Synthetic polypeptide
DEAEIRTTNPVATEYWGCVSGGNADDSRGGNGNS

SEQ ID NO: 157609 - protein, 34 aa, Artificial Sequence
  Description of Artificial Sequence: Synthetic polypeptide
DEAEIRTTNPVATETWGSCSRCINEPQVRDDENE

SEQ ID NO: 157610 - protein, 35 aa, Artificial Sequence
  Description of Artificial Sequence: Synthetic polypeptide
DEQEIRTTNPVATEQYGSVSSTTAGPEDHEGMEPL

SEQ ID NO: 157611 - protein, 37 aa, Artificial Sequence
  Description of Artificial Sequence: Synthetic polypeptide
DEQEIRTTNPVATEQYGSVSSTTPAGPNMRNGMNVVL

SEQ ID NO: 157612 - protein, 34 aa, Artificial Sequence
  Description of Artificial Sequence: Synthetic polypeptide
DEMEIATTNPVAYECWGSVATGNMLGDQQGMNDP

SEQ ID NO: 157613 - protein, 34 aa, Artificial Sequence
  Description of Artificial Sequence: Synthetic polypeptide
DEEEIRTTNPVAYEQYGQSASVLNQAASVREVEE

SEQ ID NO: 157614 - protein, 35 aa, Artificial Sequence
  Description of Artificial Sequence: Synthetic polypeptide
DEEEIRTTNPVAYEQYGQCVCSWEEDLNQHGSQQA

SEQ ID NO: 157615 - protein, 30 aa, Artificial Sequence
  Description of Artificial Sequence: Synthetic polypeptide
DDSEVASTNPVSTEGYGNVSACTIQSRGQR

SEQ ID NO: 157616 - protein, 37 aa, Artificial Sequence
  Description of Artificial Sequence: Synthetic polypeptide
DEEEIRTTNPVATEQYGVVSTTDQAGNNTEQGTNQQG

SEQ ID NO: 157617 - protein, 34 aa, Artificial Sequence
  Description of Artificial Sequence: Synthetic polypeptide
DAEEIATTNPVATAQWGSVSGTGNPDNADGGANH

SEQ ID NO: 157618 - protein, 38 aa, Artificial Sequence
  Description of Artificial Sequence: Synthetic polypeptide
DEEEIRTTNPVATEQYGVVSTVNPNNLQQGEGDEEDES

SEQ ID NO: 157619 - protein, 35 aa, Artificial Sequence
  Description of Artificial Sequence: Synthetic polypeptide
DEQEIATTNPVATEQYGSVSPTDLNEDHQGLEDEH

SEQ ID NO: 157620 - protein, 37 aa, Artificial Sequence
  Description of Artificial Sequence: Synthetic polypeptide
DEEEIRTTNPVATEQYGVVSTTVNQNNQQQATNVATE

SEQ ID NO: 157621 - protein, 33 aa, Artificial Sequence
  Description of Artificial Sequence: Synthetic polypeptide
DEAEIRTTNPVAYEQYGCICSTNLEENFPSEQA

SEQ ID NO: 157622 - protein, 33 aa, Artificial Sequence
  Description of Artificial Sequence: Synthetic polypeptide
DEQEIRTTNPVATECYGSTTSNTDWEDHKGEYI

SEQ ID NO: 157623 - protein, 37 aa, Artificial Sequence
  Description of Artificial Sequence: Synthetic polypeptide
DEEEIRTTNPVATEQYGVVSTTNQQQGTEQGSTQTDE

SEQ ID NO: 157624 - protein, 36 aa, Artificial Sequence
  Description of Artificial Sequence: Synthetic polypeptide
DEMEIRTTNPVATEQYGCYFCSVTDWNDERLGDNSE

SEQ ID NO: 157625 - protein, 31 aa, Artificial Sequence
  Description of Artificial Sequence: Synthetic polypeptide
DDSEVATTNPVSTEGYGNVAANGIQSRVGQR

SEQ ID NO: 157626 - protein, 34 aa, Artificial Sequence
  Description of Artificial Sequence: Synthetic polypeptide
DEQEIATTNPVATEQYGSVSNWDLEEHFGSEDLM

SEQ ID NO: 157627 - protein, 38 aa, Artificial Sequence
  Description of Artificial Sequence: Synthetic polypeptide
DEEEIRTTNPVATEQYGVVSTVNQLQAGTEQGTEQGQE

SEQ ID NO: 157628 - protein, 33 aa, Artificial Sequence
  Description of Artificial Sequence: Synthetic polypeptide
DEAEIRTTNPVAYEQYGCICSTEDNERFNSDQS

SEQ ID NO: 157629 - protein, 38 aa, Artificial Sequence
  Description of Artificial Sequence: Synthetic polypeptide
DEEEIRTTNPVATEQYGVVSTTVNQQLQQEATNVATEQ

SEQ ID NO: 157630 - protein, 34 aa, Artificial Sequence
  Description of Artificial Sequence: Synthetic polypeptide
DEAEIRTTNPVAVECWGSVSCINEEPQSGYGENE

SEQ ID NO: 157631 - protein, 33 aa, Artificial Sequence
  Description of Artificial Sequence: Synthetic polypeptide
DEAEIRTTNPVAVECWGSVSCINEPDVSDGENE

SEQ ID NO: 157632 - protein, 38 aa, Artificial Sequence
  Description of Artificial Sequence: Synthetic polypeptide
DEEEIRTTNPVATEQYGVVSTTNDQQGNTEQGTTTTDD

SEQ ID NO: 157633 - protein, 34 aa, Artificial Sequence
  Description of Artificial Sequence: Synthetic polypeptide
DEAEIRTTNPVAYEQWGVVYGGNEGNQGHGNADR

SEQ ID NO: 157634 - protein, 32 aa, Artificial Sequence
  Description of Artificial Sequence: Synthetic polypeptide
DEMEIATTNPVATECYGTVCSATDGPVEFEND

SEQ ID NO: 157635 - protein, 35 aa, Artificial Sequence
  Description of Artificial Sequence: Synthetic polypeptide
DEAEIRTTNPVAVEQYGSVSTNKHSSETPMGSDIN

SEQ ID NO: 157636 - protein, 35 aa, Artificial Sequence
  Description of Artificial Sequence: Synthetic polypeptide
DEAEIRTTNPVAYEQWGVVVPTDNNDQERNGNGNI

SEQ ID NO: 157637 - protein, 36 aa, Artificial Sequence
  Description of Artificial Sequence: Synthetic polypeptide
DAEEIATTNPVATEQYGSVCATNPQLNPDDQMGGEM

SEQ ID NO: 157638 - protein, 35 aa, Artificial Sequence
  Description of Artificial Sequence: Synthetic polypeptide
DEAEIRTTNPVAYEQWGVVVPTDNLHDQAGNKGEG

SEQ ID NO: 157639 - protein, 33 aa, Artificial Sequence
  Description of Artificial Sequence: Synthetic polypeptide
DEAEIRTTNPVAYEQWGVVVHTDNHNTQDGSSQ

SEQ ID NO: 157640 - protein, 39 aa, Artificial Sequence
  Description of Artificial Sequence: Synthetic polypeptide
DEEEIRTTNPVATEQYGVVSTTNGQGNLQAGNNQQGTDD

SEQ ID NO: 157641 - protein, 32 aa, Artificial Sequence
  Description of Artificial Sequence: Synthetic polypeptide
DAEEIATTNPVATAQWGSVSGTGNPDNADIGH

SEQ ID NO: 157642 - protein, 35 aa, Artificial Sequence
  Description of Artificial Sequence: Synthetic polypeptide
DEQEIRTTNPVATEQYGSVSNVVDLMQPNSQIDEQ

SEQ ID NO: 157643 - protein, 33 aa, Artificial Sequence
  Description of Artificial Sequence: Synthetic polypeptide
DEMEIATTNPVATEQYGVMCSATDGPVEHEGND

SEQ ID NO: 157644 - protein, 34 aa, Artificial Sequence
  Description of Artificial Sequence: Synthetic polypeptide
DEAEIRTTNPVAYEQWGVVTGGNPGNQGEGNGDR

SEQ ID NO: 157645 - protein, 33 aa, Artificial Sequence
  Description of Artificial Sequence: Synthetic polypeptide
DEAEIRTTNPVAVECWGSVSCIEEPQNGYGENE

SEQ ID NO: 157646 - protein, 34 aa, Artificial Sequence
  Description of Artificial Sequence: Synthetic polypeptide
DEAEIRTTNPVAYEQWGVVYGGPGNQQGEGNADR

SEQ ID NO: 157647 - protein, 32 aa, Artificial Sequence
  Description of Artificial Sequence: Synthetic polypeptide
DEEEIRTTNPVSTEPYGTISMEDIQQNQNIWH

SEQ ID NO: 157648 - protein, 35 aa, Artificial Sequence
  Description of Artificial Sequence: Synthetic polypeptide
DEEEIRTTNPVAYEQYGQSASVANDALQVTTVEAY

SEQ ID NO: 157649 - protein, 36 aa, Artificial Sequence
  Description of Artificial Sequence: Synthetic polypeptide
DEAEIRTTNPVATHQYGSVSSTTPAGPNMRNGMNPV

SEQ ID NO: 157650 - protein, 36 aa, Artificial Sequence
  Description of Artificial Sequence: Synthetic polypeptide
DEEEIRTTNPVAYEQYGVVPSTTPAGSTTRYGGNPV

SEQ ID NO: 157651 - protein, 33 aa, Artificial Sequence
  Description of Artificial Sequence: Synthetic polypeptide
DEMEIRTTNPVATEQYGCICSWGETQNFISDQS

SEQ ID NO: 157652 - protein, 38 aa, Artificial Sequence
  Description of Artificial Sequence: Synthetic polypeptide
DEEEIRTTNPVATEQYGVVSTTNQQQGNNQQEGTNTTD

SEQ ID NO: 157653 - protein, 32 aa, Artificial Sequence
  Description of Artificial Sequence: Synthetic polypeptide
DEMEIATTNPVATECYGTVCSAEDGPQFEGED

SEQ ID NO: 157654 - protein, 37 aa, Artificial Sequence
  Description of Artificial Sequence: Synthetic polypeptide
DEEEIRTTNPVATEQYGVVSTTDQSGNGTEQGTNQQE

SEQ ID NO: 157655 - protein, 35 aa, Artificial Sequence
  Description of Artificial Sequence: Synthetic polypeptide
DEAEIRTTNPVAYEQWGVVYVSNNLPQDNGGGMNH

SEQ ID NO: 157656 - protein, 34 aa, Artificial Sequence
  Description of Artificial Sequence: Synthetic polypeptide
DEAEIRTTNPVAYECWGVVCSTDNGNERPGDDRR

SEQ ID NO: 157657 - protein, 39 aa, Artificial Sequence
  Description of Artificial Sequence: Synthetic polypeptide
DEEEIRTTNPVATEQYGVVSTVNQLQQGTNTEQGSTDDD

SEQ ID NO: 157658 - protein, 33 aa, Artificial Sequence
  Description of Artificial Sequence: Synthetic polypeptide
DEMEIATTNPVATECYGTVCSATDGPVEFEGNL

SEQ ID NO: 157659 - protein, 33 aa, Artificial Sequence
  Description of Artificial Sequence: Synthetic polypeptide
DEHEIRTTNPVAYERWGEVYHPINDDRQNGNTR

SEQ ID NO: 157660 - protein, 33 aa, Artificial Sequence
  Description of Artificial Sequence: Synthetic polypeptide
DEMEIATTNPVATEQYGVVCAATDGPVEFEGND

SEQ ID NO: 157661 - protein, 33 aa, Artificial Sequence
  Description of Artificial Sequence: Synthetic polypeptide
DAEEIATTNPVATAQWGSVSGTGNPDNADGGTG

SEQ ID NO: 157662 - protein, 37 aa, Artificial Sequence
  Description of Artificial Sequence: Synthetic polypeptide
DEEEIRTTNPVATEQYGVVSTTLQQQNNQATTNVATE

SEQ ID NO: 157663 - protein, 38 aa, Artificial Sequence
  Description of Artificial Sequence: Synthetic polypeptide
DEEEIRTTNPVATEQYGVVSTVNQQAGNTEQGTNQQEE

SEQ ID NO: 157664 - protein, 38 aa, Artificial Sequence
  Description of Artificial Sequence: Synthetic polypeptide
DEEEIRTTNPVATEQYGVVSTVNQQAGNTEQGTNEDED

SEQ ID NO: 157665 - protein, 33 aa, Artificial Sequence
  Description of Artificial Sequence: Synthetic polypeptide
DEMEIATTNPVATECYGTVCSATDGPVEFEGND

SEQ ID NO: 157666 - protein, 36 aa, Artificial Sequence
  Description of Artificial Sequence: Synthetic polypeptide
DEAEIATTNPVATEQYGSVCAMTNHGEQTLDGAQRN

SEQ ID NO: 157667 - protein, 33 aa, Artificial Sequence
  Description of Artificial Sequence: Synthetic polypeptide
DEQEIATTNPVATEQYGSVWSAADWAEPEGPYI

SEQ ID NO: 157668 - protein, 35 aa, Artificial Sequence
  Description of Artificial Sequence: Synthetic polypeptide
DEEEIRTTNPVCYEHYGSVVHCMPNELSQMGGNNG

SEQ ID NO: 157669 - protein, 37 aa, Artificial Sequence
  Description of Artificial Sequence: Synthetic polypeptide
DCEEIRTTNPVATEQYGSVSSTTPAEGPNMRNGMYTV

SEQ ID NO: 157670 - protein, 36 aa, Artificial Sequence
  Description of Artificial Sequence: Synthetic polypeptide
CEEEIATTNPVATEQYGSVANANNLPQEAPGENMNH

SEQ ID NO: 157671 - protein, 35 aa, Artificial Sequence
  Description of Artificial Sequence: Synthetic polypeptide
DEEEIRTVNPVATEQYGCVCSTMEHNQNFNSQTQG

SEQ ID NO: 157672 - protein, 38 aa, Artificial Sequence
  Description of Artificial Sequence: Synthetic polypeptide
DEEEIRTTNPVATEQYGVVSSTNNQQGNTEQGTNQDED

SEQ ID NO: 157673 - protein, 34 aa, Artificial Sequence
  Description of Artificial Sequence: Synthetic polypeptide
DEQEIATTNPVATEQYGCVSANGDEPTGEGNTEE

SEQ ID NO: 157674 - protein, 35 aa, Artificial Sequence
  Description of Artificial Sequence: Synthetic polypeptide
DEEEIRTTNPVAYEQYGSACATNPELNEHDDNLAG

SEQ ID NO: 157675 - protein, 35 aa, Artificial Sequence
  Description of Artificial Sequence: Synthetic polypeptide
DEQEIATTNPVAYEQWGHNNVSYWNELQHRPDGFR

SEQ ID NO: 157676 - protein, 35 aa, Artificial Sequence
  Description of Artificial Sequence: Synthetic polypeptide
DEHEIRTTNPVAYEQWGSVCYTQDNDQHTGNTNSN

SEQ ID NO: 157677 - protein, 36 aa, Artificial Sequence
  Description of Artificial Sequence: Synthetic polypeptide
DEAEIRTTNPVATEQYGSVSVTAPNMATGQGEEQES

SEQ ID NO: 157678 - protein, 34 aa, Artificial Sequence
  Description of Artificial Sequence: Synthetic polypeptide
DEEEIRTTNPVAYEQYGSACAAANGLPQSEVPDS

SEQ ID NO: 157679 - protein, 33 aa, Artificial Sequence
  Description of Artificial Sequence: Synthetic polypeptide
DEQEIATTNPVAYEQWGSCSATDNNDHEGNQDL

SEQ ID NO: 157680 - protein, 36 aa, Artificial Sequence
  Description of Artificial Sequence: Synthetic polypeptide
DEAEIRTTNPVATEQYGSVSVTAPNTHTGQGLEPES

SEQ ID NO: 157681 - protein, 34 aa, Artificial Sequence
  Description of Artificial Sequence: Synthetic polypeptide
DEQEIATTNPVATEQYGCVCSYTGDLEDHSGEDL

SEQ ID NO: 157682 - protein, 37 aa, Artificial Sequence
  Description of Artificial Sequence: Synthetic polypeptide
DEAEIRTTNPVATEQYGSVSVTAPNTPQFGQGEEVES

SEQ ID NO: 157683 - protein, 36 aa, Artificial Sequence
  Description of Artificial Sequence: Synthetic polypeptide
DEAEIRTTNPVATEQYGSVSVTAPNTTTGQDLEVES

SEQ ID NO: 157684 - protein, 39 aa, Artificial Sequence
  Description of Artificial Sequence: Synthetic polypeptide
DEEEIRTTNPVATEQYGVVSTVTNLQQGNEQGTTTQQDE

SEQ ID NO: 157685 - protein, 36 aa, Artificial Sequence
  Description of Artificial Sequence: Synthetic polypeptide
DEAEIRTTNPVATEQYGSVSVTAPNVKTGQDLEVEA

SEQ ID NO: 157686 - protein, 35 aa, Artificial Sequence
  Description of Artificial Sequence: Synthetic polypeptide
DEAEISTTNPVATEQYGCVCSMTGNHQENFGSDQA

SEQ ID NO: 157687 - protein, 38 aa, Artificial Sequence
  Description of Artificial Sequence: Synthetic polypeptide
DEEEIRTTNPVATEQYGVVSSTNNLQQGTEQGSTEDSE

SEQ ID NO: 157688 - protein, 30 aa, Artificial Sequence
  Description of Artificial Sequence: Synthetic polypeptide
DDSEVATTNPVATEGWGNVSNIIMSRVGDR

SEQ ID NO: 157689 - protein, 37 aa, Artificial Sequence
  Description of Artificial Sequence: Synthetic polypeptide
DEEEIRTTNPVATEQYGVVSTVVNNNNEQGTNQQNTE

SEQ ID NO: 157690 - protein, 33 aa, Artificial Sequence
  Description of Artificial Sequence: Synthetic polypeptide
DEQEIATTNPVATEQYGCVATNPTPDSMGDDEL

SEQ ID NO: 157691 - protein, 34 aa, Artificial Sequence
  Description of Artificial Sequence: Synthetic polypeptide
DEAEIATTNPVATEQYGSVSAGPPGANGAGMGHD

SEQ ID NO: 157692 - protein, 35 aa, Artificial Sequence
  Description of Artificial Sequence: Synthetic polypeptide
DEAEIATTNPVATEQYGSVSCTDALSEDHEGGEDL

SEQ ID NO: 157693 - protein, 35 aa, Artificial Sequence
  Description of Artificial Sequence: Synthetic polypeptide
DEEEIRTTNPVAYEQYGSVAGTNDTATAHINDEAM

SEQ ID NO: 157694 - protein, 34 aa, Artificial Sequence
  Description of Artificial Sequence: Synthetic polypeptide
DEEEIRTTNPVGTEQWGSVSTDGTGGRPIDFDAN

SEQ ID NO: 157695 - protein, 33 aa, Artificial Sequence
  Description of Artificial Sequence: Synthetic polypeptide
DEQEIATTNPVAYEQWGSTCSATDNNDHEGMNQ

SEQ ID NO: 157696 - protein, 34 aa, Artificial Sequence
  Description of Artificial Sequence: Synthetic polypeptide
DEEEIRTTNPVGTEQWGSVSTDGTGGTPIDLDAM

SEQ ID NO: 157697 - protein, 34 aa, Artificial Sequence
  Description of Artificial Sequence: Synthetic polypeptide
DEQEIATTNPVATEQYGCVATNNLNTMAPGEGTM

SEQ ID NO: 157698 - protein, 39 aa, Artificial Sequence
  Description of Artificial Sequence: Synthetic polypeptide
DEEEIRTTNPVATEQYGVVSTVTNLQQGNEQGTTTNVDD

SEQ ID NO: 157699 - protein, 38 aa, Artificial Sequence
  Description of Artificial Sequence: Synthetic polypeptide
DEEEIRTTNPVATEQYGVVSSTTNLQAGTEQGSTQDDE

SEQ ID NO: 157700 - protein, 30 aa, Artificial Sequence
  Description of Artificial Sequence: Synthetic polypeptide
DDSEVRTTNPVSTEGYGTVANTIQQQVGQH

SEQ ID NO: 157701 - protein, 39 aa, Artificial Sequence
  Description of Artificial Sequence: Synthetic polypeptide
DEEEIRTTNPVATEQYGVVSTVNLQQSATEEGTNQNTTE

SEQ ID NO: 157702 - protein, 33 aa, Artificial Sequence
  Description of Artificial Sequence: Synthetic polypeptide
DEMEIRTTNPVATCQYGCVCNTEDNQNFNSDQS

SEQ ID NO: 157703 - protein, 35 aa, Artificial Sequence
  Description of Artificial Sequence: Synthetic polypeptide
DAEEIATTNPVATEQYGSVCAGWTPAGNLDMENDM

SEQ ID NO: 157704 - protein, 34 aa, Artificial Sequence
  Description of Artificial Sequence: Synthetic polypeptide
DEAEIATTNPVATEQYGSVCDTGNNEAANGAGMK

SEQ ID NO: 157705 - protein, 32 aa, Artificial Sequence
  Description of Artificial Sequence: Synthetic polypeptide
DDSEVRTTNPVATECWGNVSACTEQDRVGENG

SEQ ID NO: 157706 - protein, 33 aa, Artificial Sequence
  Description of Artificial Sequence: Synthetic polypeptide
DEQEIATTNPVATEQYGCVAANGDATTDGDPRN

SEQ ID NO: 157707 - protein, 35 aa, Artificial Sequence
  Description of Artificial Sequence: Synthetic polypeptide
DEMEIRTTNPVATEQYGSVSIMDDTQPEEPQQETE

SEQ ID NO: 157708 - protein, 36 aa, Artificial Sequence
  Description of Artificial Sequence: Synthetic polypeptide
DEEEIRTTNPVGTEQWGSVSTANEPGGERGGDIEAM

SEQ ID NO: 157709 - protein, 34 aa, Artificial Sequence
  Description of Artificial Sequence: Synthetic polypeptide
DEQEIATTNPVATEQYGCVAANNGLTTPDAENRM

SEQ ID NO: 157710 - protein, 37 aa, Artificial Sequence
  Description of Artificial Sequence: Synthetic polypeptide
DEEEIRTTNPVAYEQYGSTVYACTNAISQNKFGSPRV

SEQ ID NO: 157711 - protein, 32 aa, Artificial Sequence
  Description of Artificial Sequence: Synthetic polypeptide
DELEIRTTNPVSTEPYGTISMEDIQQQQKGNH

SEQ ID NO: 157712 - protein, 36 aa, Artificial Sequence
  Description of Artificial Sequence: Synthetic polypeptide
DEAEIRTTNPVATEQYGSVSVTAANQDTGYGEEVFS

SEQ ID NO: 157713 - protein, 34 aa, Artificial Sequence
  Description of Artificial Sequence: Synthetic polypeptide
DEEEIRTTNPVGTEQWGSVSTDGLGGTPIDEMAM

SEQ ID NO: 157714 - protein, 39 aa, Artificial Sequence
  Description of Artificial Sequence: Synthetic polypeptide
DEEEIRTTNPVATEQYGVVSTVTNLQQGDEQGTTTNEDE

SEQ ID NO: 157715 - protein, 32 aa, Artificial Sequence
  Description of Artificial Sequence: Synthetic polypeptide
DEQEIATTNPVAYEQWGSCSVTDNNDHEGEDA

SEQ ID NO: 157716 - protein, 36 aa, Artificial Sequence
  Description of Artificial Sequence: Synthetic polypeptide
DEEEIRTTNPVGTEFYGSVNTMDNIGQMDEGGNDGD

SEQ ID NO: 157717 - protein, 32 aa, Artificial Sequence
  Description of Artificial Sequence: Synthetic polypeptide
DDSEVASTNPVSTEQYGNVSAANTIQSRVGQR

SEQ ID NO: 157718 - protein, 31 aa, Artificial Sequence
  Description of Artificial Sequence: Synthetic polypeptide
DELEIRTTNPVATEQWGDVSEIGEMNAAEDA

SEQ ID NO: 157719 - protein, 33 aa, Artificial Sequence
  Description of Artificial Sequence: Synthetic polypeptide
DAGEIATTNPVAYEQWGSVCTENHLDDLGQMDR

SEQ ID NO: 157720 - protein, 30 aa, Artificial Sequence
  Description of Artificial Sequence: Synthetic polypeptide
DDSEVASTNPVSTEQYGNVAANTPQREGQD

SEQ ID NO: 157721 - protein, 39 aa, Artificial Sequence
  Description of Artificial Sequence: Synthetic polypeptide
DEEEIRTTNPVATEQYGVVSTVNLQQQNATTEQGTTNED

SEQ ID NO: 157722 - protein, 36 aa, Artificial Sequence
  Description of Artificial Sequence: Synthetic polypeptide
DEHEIRTTNPVAYEQWGESVQIEQRNDDLQRGHDQR

SEQ ID NO: 157723 - protein, 33 aa, Artificial Sequence
  Description of Artificial Sequence: Synthetic polypeptide
DEQEIATTNPVATEQYGEVSAPPQEHGDGTEQA

SEQ ID NO: 157724 - protein, 33 aa, Artificial Sequence
  Description of Artificial Sequence: Synthetic polypeptide
DEQEIATTNPVAYEQYGSVCATNTEQDATLTDL

SEQ ID NO: 157725 - protein, 32 aa, Artificial Sequence
  Description of Artificial Sequence: Synthetic polypeptide
DEQEIATTNPVAYEQWGSCSATDNNDHEGQEV

SEQ ID NO: 157726 - protein, 31 aa, Artificial Sequence
  Description of Artificial Sequence: Synthetic polypeptide
DDSEVRTTNPVSTEPYGTVAAMTIQQQNGQR

SEQ ID NO: 157727 - protein, 32 aa, Artificial Sequence
  Description of Artificial Sequence: Synthetic polypeptide
DEMEIRTTNPVATCQYGCVCSWEDEHFGSDQA

SEQ ID NO: 157728 - protein, 37 aa, Artificial Sequence
  Description of Artificial Sequence: Synthetic polypeptide
DEEEIRTTNPVAYEQYGSDVSSTTPAGPNMRNGMNPV

SEQ ID NO: 157729 - protein, 36 aa, Artificial Sequence
  Description of Artificial Sequence: Synthetic polypeptide
DEEEIRTTNPVAYEQYGSACATNPELQEHQDDNMAG

SEQ ID NO: 157730 - protein, 30 aa, Artificial Sequence
  Description of Artificial Sequence: Synthetic polypeptide
DDSEVATTNPVATEGYGNVPANTCQRVEQK

SEQ ID NO: 157731 - protein, 31 aa, Artificial Sequence
  Description of Artificial Sequence: Synthetic polypeptide
DDSEVASTNPVSTEQYGNVAANTIQSRVGQR

SEQ ID NO: 157732 - protein, 34 aa, Artificial Sequence
  Description of Artificial Sequence: Synthetic polypeptide
DEQEIATTNPVAYEQYGSVCATNPEQDATATGDK

SEQ ID NO: 157733 - protein, 33 aa, Artificial Sequence
  Description of Artificial Sequence: Synthetic polypeptide
DEQLIVTTNPVATEQYGTVCSATDGPVEFEGND

SEQ ID NO: 157734 - protein, 39 aa, Artificial Sequence
  Description of Artificial Sequence: Synthetic polypeptide
DEEEIRTTNPVATEQYGSVSTVNGNQLQQGTEQGVVVTT

SEQ ID NO: 157735 - protein, 39 aa, Artificial Sequence
  Description of Artificial Sequence: Synthetic polypeptide
DEEEIRTTNPVATEQYGSVSTVNGNQLQQGTEQGTEDET

SEQ ID NO: 157736 - protein, 39 aa, Artificial Sequence
  Description of Artificial Sequence: Synthetic polypeptide
DEEEIRTTNPVATEQYGSVSTVNGNQLQAGTEQGTTVDN

SEQ ID NO: 157737 - protein, 39 aa, Artificial Sequence
  Description of Artificial Sequence: Synthetic polypeptide
DEEEIRTTNPVATEQYGSVSTVNGNGLQAGTEQGTTVEQ

SEQ ID NO: 157738 - protein, 35 aa, Artificial Sequence
  Description of Artificial Sequence: Synthetic polypeptide
DEHEIRTTNPVAYEQWGESVQIQRNDDLQRGHQSQ

SEQ ID NO: 157739 - protein, 38 aa, Artificial Sequence
  Description of Artificial Sequence: Synthetic polypeptide
DEEEIRTTNPVATEQYGVVSTVVNNNDEQQGTNAEQGT

SEQ ID NO: 157740 - protein, 34 aa, Artificial Sequence
  Description of Artificial Sequence: Synthetic polypeptide
DEAEISTTNPVATEQYGCVCSMWEHQENFGSNQA

SEQ ID NO: 157741 - protein, 36 aa, Artificial Sequence
  Description of Artificial Sequence: Synthetic polypeptide
DEAEIRTTNPVATEQYGSVSVLAANTNTGQGEEHES

SEQ ID NO: 157742 - protein, 34 aa, Artificial Sequence
  Description of Artificial Sequence: Synthetic polypeptide
DEHEIRTTNPVAYEQWGESVQIQRNDDQQRGHDK

SEQ ID NO: 157743 - protein, 36 aa, Artificial Sequence
  Description of Artificial Sequence: Synthetic polypeptide
DEAEIRTTNPVATEQYGSVSVTDLGNVTFEGQFQEY

SEQ ID NO: 157744 - protein, 35 aa, Artificial Sequence
  Description of Artificial Sequence: Synthetic polypeptide
DEHEIRTTNPVAYEQWGEVCSTGGNGNQGETNDDR

SEQ ID NO: 157745 - protein, 39 aa, Artificial Sequence
  Description of Artificial Sequence: Synthetic polypeptide
DEEEIRTTNPVATEQYGVVSTVTNLQQGNQQGTTTDEED

SEQ ID NO: 157746 - protein, 33 aa, Artificial Sequence
  Description of Artificial Sequence: Synthetic polypeptide
DEMAIRTTNPVATEQYGCFCSTNHIENFGSDQA

SEQ ID NO: 157747 - protein, 33 aa, Artificial Sequence
  Description of Artificial Sequence: Synthetic polypeptide
DEQEIATTNPVATEQYGCVAANGDAMPPGDPRH

SEQ ID NO: 157748 - protein, 33 aa, Artificial Sequence
  Description of Artificial Sequence: Synthetic polypeptide
DEMEIQTTNPIATEQYGTVCSATDGPVEFEGND

SEQ ID NO: 157749 - protein, 30 aa, Artificial Sequence
  Description of Artificial Sequence: Synthetic polypeptide
DDSEVASTNPVSTEQYGNVAAETIQRVGQR

SEQ ID NO: 157750 - protein, 33 aa, Artificial Sequence
  Description of Artificial Sequence: Synthetic polypeptide
DEQEIATTNPVAYEQWGSCSATDNHDHQGGETD

SEQ ID NO: 157751 - protein, 35 aa, Artificial Sequence
  Description of Artificial Sequence: Synthetic polypeptide
DEAEIATTNPVATEQYGSVCDDTPLPDDSGDGMRN

SEQ ID NO: 157752 - protein, 31 aa, Artificial Sequence
  Description of Artificial Sequence: Synthetic polypeptide
DDSEVASTNPVSTEQYGIVAANTIQSRVGQR

SEQ ID NO: 157753 - protein, 36 aa, Artificial Sequence
  Description of Artificial Sequence: Synthetic polypeptide
DEEEIRTVNPVATEAYGSVVVNGQRGLQGQNGQGQI

SEQ ID NO: 157754 - protein, 38 aa, Artificial Sequence
  Description of Artificial Sequence: Synthetic polypeptide
DEEEIRTTNPVAYEQYGQVAVSFQMNDLLQPRGQIPNT

SEQ ID NO: 157755 - protein, 35 aa, Artificial Sequence
  Description of Artificial Sequence: Synthetic polypeptide
DEATEIATTNPVAYEQWGSVYSGPNGNQGGMNGDR

SEQ ID NO: 157756 - protein, 35 aa, Artificial Sequence
  Description of Artificial Sequence: Synthetic polypeptide
DEATEIATTNPVAYEQWGSVSWGPNGNQGGGNGDR

SEQ ID NO: 157757 - protein, 33 aa, Artificial Sequence
  Description of Artificial Sequence: Synthetic polypeptide
DEQEIATTNPVATEQYGMMSATRDLEDHEGEDL

SEQ ID NO: 157758 - protein, 39 aa, Artificial Sequence
  Description of Artificial Sequence: Synthetic polypeptide
DEEEIRTTNPVATEQYGSVSTVNAQQLQQGTEQGTVVEE

SEQ ID NO: 157759 - protein, 33 aa, Artificial Sequence
  Description of Artificial Sequence: Synthetic polypeptide
DEQEIATTNPVAYEQWGSCSATDNMNDHQREDD

SEQ ID NO: 157760 - protein, 34 aa, Artificial Sequence
  Description of Artificial Sequence: Synthetic polypeptide
CEEEIATTNPVATEQYGSVCAATAQLDAAENAGQ

SEQ ID NO: 157761 - protein, 34 aa, Artificial Sequence
  Description of Artificial Sequence: Synthetic polypeptide
CEEEIATTNPVATEQYGSVAGTGNNPPAEAPNGD

SEQ ID NO: 157762 - protein, 34 aa, Artificial Sequence
  Description of Artificial Sequence: Synthetic polypeptide
DEHEIRTTNPVAYEQWGSTVTTPGNQGNMGGNGH

SEQ ID NO: 157763 - protein, 34 aa, Artificial Sequence
  Description of Artificial Sequence: Synthetic polypeptide
DEEEIRTVNPVATEQYGCVCSWEEHNQNFNSQQG

SEQ ID NO: 157764 - protein, 31 aa, Artificial Sequence
  Description of Artificial Sequence: Synthetic polypeptide
DDSEVATTNPVATEGYGNVSATDLEDHVGEL

SEQ ID NO: 157765 - protein, 34 aa, Artificial Sequence
  Description of Artificial Sequence: Synthetic polypeptide
DEMEINTTNPVATEQYGTVCSATDGPVEFEGNDY

SEQ ID NO: 157766 - protein, 35 aa, Artificial Sequence
  Description of Artificial Sequence: Synthetic polypeptide
DEQEIATTNPVATEQYGKVSYTDELSEDHEGGENL

SEQ ID NO: 157767 - protein, 32 aa, Artificial Sequence
  Description of Artificial Sequence: Synthetic polypeptide
DEQEIATTNPVAYEQWGSCSVTDNHDHQGEDD

SEQ ID NO: 157768 - protein, 35 aa, Artificial Sequence
  Description of Artificial Sequence: Synthetic polypeptide
DEHEIRTTNPVAYEQWGESVQIQRNDDLQRGHDKF

SEQ ID NO: 157769 - protein, 39 aa, Artificial Sequence
  Description of Artificial Sequence: Synthetic polypeptide
DEEEIRTTNPVATEQYGVVSTVTNLQQGNQQGTTTNATE

SEQ ID NO: 157770 - protein, 34 aa, Artificial Sequence
  Description of Artificial Sequence: Synthetic polypeptide
DEHEIRTTNPVAYEQWGESVQIQRNDDLQNGHDI

SEQ ID NO: 157771 - protein, 35 aa, Artificial Sequence
  Description of Artificial Sequence: Synthetic polypeptide
DEHEIRTTNPVAYEQWGSVCPTDGHDQQGGDGNPR

SEQ ID NO: 157772 - protein, 32 aa, Artificial Sequence
  Description of Artificial Sequence: Synthetic polypeptide
DELEIRTTNPVSTEPYGTISMEDIQQQQNGNH

SEQ ID NO: 157773 - protein, 39 aa, Artificial Sequence
  Description of Artificial Sequence: Synthetic polypeptide
DEEEIRTTNPVATEQYGSVSTVNGNQLQQGTEAGTVVET

SEQ ID NO: 157774 - protein, 37 aa, Artificial Sequence
  Description of Artificial Sequence: Synthetic polypeptide
DEAEIRTTNPVATEQYGSVSVNAANQRDTGYSEEVES

SEQ ID NO: 157775 - protein, 34 aa, Artificial Sequence
  Description of Artificial Sequence: Synthetic polypeptide
DELEIVTTNPVATEQYGTVCSATDGPVEFEGEND

SEQ ID NO: 157776 - protein, 34 aa, Artificial Sequence
  Description of Artificial Sequence: Synthetic polypeptide
DEEEIRTTNPVGTEGYGSVNDGTNMEGEGGEEDQ

SEQ ID NO: 157777 - protein, 31 aa, Artificial Sequence
  Description of Artificial Sequence: Synthetic polypeptide
DDSEVRTTNPVSTEGYGNVSAETIMNAAGDR

SEQ ID NO: 157778 - protein, 32 aa, Artificial Sequence
  Description of Artificial Sequence: Synthetic polypeptide
DEQEIATTNPVATEQYGCVAANGDATHPGDPT

SEQ ID NO: 157779 - protein, 33 aa, Artificial Sequence
  Description of Artificial Sequence: Synthetic polypeptide
DEQLIATTNPVATEQYGSVSATDQLEDHEPEDL

SEQ ID NO: 157780 - protein, 36 aa, Artificial Sequence
  Description of Artificial Sequence: Synthetic polypeptide
DEAEIATTNPVATEQYGSVCSTNSITPAPGMENGHA

SEQ ID NO: 157781 - protein, 33 aa, Artificial Sequence
  Description of Artificial Sequence: Synthetic polypeptide
DEMAIRTTNPVATEQYGCFCSTNHNINFGSDQF

SEQ ID NO: 157782 - protein, 36 aa, Artificial Sequence
  Description of Artificial Sequence: Synthetic polypeptide
DEEEIRTTNPVGTEQYGCVCSTGNDHNTNFGSDNQA

SEQ ID NO: 157783 - protein, 35 aa, Artificial Sequence
  Description of Artificial Sequence: Synthetic polypeptide
DEAEIATTNPVATEQYGSVCSQNPELQEHQDDIAK

SEQ ID NO: 157784 - protein, 34 aa, Artificial Sequence
  Description of Artificial Sequence: Synthetic polypeptide
DEMEIQTTNPVATEQYGTMVCSATDGPVEFEGND

SEQ ID NO: 157785 - protein, 31 aa, Artificial Sequence
  Description of Artificial Sequence: Synthetic polypeptide
DDSEVASTNPVSTEQYGNVAANTEQSRVGQR

SEQ ID NO: 157786 - protein, 36 aa, Artificial Sequence
  Description of Artificial Sequence: Synthetic polypeptide
DEAEIATTNPVATEQYGSVCSPTNNGLFNQASEEDN

SEQ ID NO: 157787 - protein, 32 aa, Artificial Sequence
  Description of Artificial Sequence: Synthetic polypeptide
DEQEIATTNPVAYEQYGSVAAANNEQDATVTD

SEQ ID NO: 157788 - protein, 34 aa, Artificial Sequence
  Description of Artificial Sequence: Synthetic polypeptide
DEMEIQTTNPVATEQYGTVCSATDGPVEIFEGND

SEQ ID NO: 157789 - protein, 40 aa, Artificial Sequence
  Description of Artificial Sequence: Synthetic polypeptide
DEEEIRTTNPVATEQYGSVSTVNGNQLQEATEQYGTVVNM

SEQ ID NO: 157790 - protein, 39 aa, Artificial Sequence
  Description of Artificial Sequence: Synthetic polypeptide
DEEEIRTTNPVATEQYGSVSTVNGNQLQEATEQGTVTET

SEQ ID NO: 157791 - protein, 32 aa, Artificial Sequence
  Description of Artificial Sequence: Synthetic polypeptide
DEQEIATTNPVATEQYGCVAANGDATGGGDPV

SEQ ID NO: 157792 - protein, 34 aa, Artificial Sequence
  Description of Artificial Sequence: Synthetic polypeptide
DEQEIATTNPVATEQYGHSVSATYDFKDHEGEDF

SEQ ID NO: 157793 - protein, 39 aa, Artificial Sequence
  Description of Artificial Sequence: Synthetic polypeptide
DEEEIRTTNPVATEQYGSVSTVNGNQLQAGTEQGTVEET

SEQ ID NO: 157794 - protein, 30 aa, Artificial Sequence
  Description of Artificial Sequence: Synthetic polypeptide
DDSEVATTNPVATEGYGNVAANTCQRVEQK

SEQ ID NO: 157795 - protein, 35 aa, Artificial Sequence
  Description of Artificial Sequence: Synthetic polypeptide
DEEEIRTTNPVGTEQYGCVCSTGEAHNIYFGSDQA

SEQ ID NO: 157796 - protein, 33 aa, Artificial Sequence
  Description of Artificial Sequence: Synthetic polypeptide
DEMEIQTTNPVATEQYGTVCSAFDGPVEFEGND

SEQ ID NO: 157797 - protein, 38 aa, Artificial Sequence
  Description of Artificial Sequence: Synthetic polypeptide
DEEEIRTTNPVATEQYGVVSTVTNNLQGNQNGTEQGSE

SEQ ID NO: 157798 - protein, 39 aa, Artificial Sequence
  Description of Artificial Sequence: Synthetic polypeptide
DEEEIRTTNPVATEQYGVVSTVTNLQQGNQQGTTTNVEN

SEQ ID NO: 157799 - protein, 35 aa, Artificial Sequence
  Description of Artificial Sequence: Synthetic polypeptide
DEHEIRTTNPVAYEQWGESVQIQRNDDLQNRGHDS

SEQ ID NO: 157800 - protein, 33 aa, Artificial Sequence
  Description of Artificial Sequence: Synthetic polypeptide
DEMEIQTTNPVATEQYGTVCSAWDGPVEFEGND

SEQ ID NO: 157801 - protein, 33 aa, Artificial Sequence
  Description of Artificial Sequence: Synthetic polypeptide
DEQEIATTNPVAYEQWGSTSTNPNGNGDGGNEM

SEQ ID NO: 157802 - protein, 34 aa, Artificial Sequence
  Description of Artificial Sequence: Synthetic polypeptide
DEQEIATTNPVAYEQYGSVCATNNEQDDATLTND

SEQ ID NO: 157803 - protein, 35 aa, Artificial Sequence
  Description of Artificial Sequence: Synthetic polypeptide
DEAEIATTNPVATEQYGSVCSTWEGGDDRNGGDHS

SEQ ID NO: 157804 - protein, 33 aa, Artificial Sequence
  Description of Artificial Sequence: Synthetic polypeptide
DDSEVRTTNPVATEGYGNVSANTEPQSRVGEQG

SEQ ID NO: 157805 - protein, 31 aa, Artificial Sequence
  Description of Artificial Sequence: Synthetic polypeptide
DDSEVASTNPVSTEQYGNVSANTIQSRVEQR

SEQ ID NO: 157806 - protein, 36 aa, Artificial Sequence
  Description of Artificial Sequence: Synthetic polypeptide
DEAEIRTTNPVATEQYGSVSVTAANTNTGQGEDVEM

SEQ ID NO: 157807 - protein, 36 aa, Artificial Sequence
  Description of Artificial Sequence: Synthetic polypeptide
DEAEIRTTNPVATEQYGSVSVTAANTNTGQGEEVIE

SEQ ID NO: 157808 - protein, 36 aa, Artificial Sequence
  Description of Artificial Sequence: Synthetic polypeptide
DEAEIRTTNPVATEQYGSVSVTAANTNTGQQEEVES

SEQ ID NO: 157809 - protein, 33 aa, Artificial Sequence
  Description of Artificial Sequence: Synthetic polypeptide
DEQSEIATTNPVAYEQWGSVSGGNGNSGEGNAE

SEQ ID NO: 157810 - protein, 38 aa, Artificial Sequence
  Description of Artificial Sequence: Synthetic polypeptide
DEEEIRTTNPVATEQYGSVSTNVATEQYGTTTQQQQQD

SEQ ID NO: 157811 - protein, 34 aa, Artificial Sequence
  Description of Artificial Sequence: Synthetic polypeptide
DEQEIATTNPVATEQYGCVAANGLQNAAPEGVHW

SEQ ID NO: 157812 - protein, 34 aa, Artificial Sequence
  Description of Artificial Sequence: Synthetic polypeptide
DEQEIATTNPVATEQYGCVAANGLQNAMPEGQGN

SEQ ID NO: 157813 - protein, 36 aa, Artificial Sequence
  Description of Artificial Sequence: Synthetic polypeptide
DEAEIRTTNPVATEQYGSVSVTAAYQDTGYSEEVEH

SEQ ID NO: 157814 - protein, 33 aa, Artificial Sequence
  Description of Artificial Sequence: Synthetic polypeptide
DEQEIATTNPVAYEQYGSVASAANGLDNNPPTK

SEQ ID NO: 157815 - protein, 34 aa, Artificial Sequence
  Description of Artificial Sequence: Synthetic polypeptide
DAEEIATTNPVATEQYGSVCTANPLGETDDQTAM

SEQ ID NO: 157816 - protein, 33 aa, Artificial Sequence
  Description of Artificial Sequence: Synthetic polypeptide
DEMEIRTTNPVATCQYGCVCNWEEDQNFGSNQA

SEQ ID NO: 157817 - protein, 33 aa, Artificial Sequence
  Description of Artificial Sequence: Synthetic polypeptide
DERAEIATTNPVAYEQWGVVCSTENDEHDGNEQ

SEQ ID NO: 157818 - protein, 36 aa, Artificial Sequence
  Description of Artificial Sequence: Synthetic polypeptide
DEAEIRTTNPVATEQYGSVSVTACNRDTGYDEEVES

SEQ ID NO: 157819 - protein, 30 aa, Artificial Sequence
  Description of Artificial Sequence: Synthetic polypeptide
DDSEVASTNPVSTEGYGNVAANTIQRVGQR

SEQ ID NO: 157820 - protein, 33 aa, Artificial Sequence
  Description of Artificial Sequence: Synthetic polypeptide
DEHEIRTTNPVAYEQWGMVSWTEHDNRGGGHHP

SEQ ID NO: 157821 - protein, 39 aa, Artificial Sequence
  Description of Artificial Sequence: Synthetic polypeptide
DEEEIRTTNPVATEQYGSVSTVNLNQLQAGTEQGTTVEE

SEQ ID NO: 157822 - protein, 38 aa, Artificial Sequence
  Description of Artificial Sequence: Synthetic polypeptide
DEEEIRTTNPVATEQYGVVSTVTNLQQQAETTTNVATE

SEQ ID NO: 157823 - protein, 38 aa, Artificial Sequence
  Description of Artificial Sequence: Synthetic polypeptide
DEEEIRTTNPVATEQYGVVSTVTNNNNQQQGNNNEEDE

SEQ ID NO: 157824 - protein, 39 aa, Artificial Sequence
  Description of Artificial Sequence: Synthetic polypeptide
DEEEIRTTNPVATEQYGVVSTVNLQQNATEQGTNQQSTE

SEQ ID NO: 157825 - protein, 37 aa, Artificial Sequence
  Description of Artificial Sequence: Synthetic polypeptide
DEEEIRTTNPVATEQYGVVSSVVVNNLQAGTTTEEED

SEQ ID NO: 157826 - protein, 32 aa, Artificial Sequence
  Description of Artificial Sequence: Synthetic polypeptide
DDSEVRTTNPVSTEGWGNVSANTIQSRVGENG

SEQ ID NO: 157827 - protein, 39 aa, Artificial Sequence
  Description of Artificial Sequence: Synthetic polypeptide
DEEEIRTTNPVATEQYGSVSTVNLNQLQAGTEQGTEEEQ

SEQ ID NO: 157828 - protein, 35 aa, Artificial Sequence
  Description of Artificial Sequence: Synthetic polypeptide
DEAEIATTNPVATEQYGSVCSMNNQNEAMPMDGDN

SEQ ID NO: 157829 - protein, 35 aa, Artificial Sequence
  Description of Artificial Sequence: Synthetic polypeptide
DEMEIRCTNPVATEQYGSVWVSPNDGESFLQSQIS

SEQ ID NO: 157830 - protein, 32 aa, Artificial Sequence
  Description of Artificial Sequence: Synthetic polypeptide
DEQEIATTNPVAYEQWGSCSLTDNNDHEGEGL

SEQ ID NO: 157831 - protein, 32 aa, Artificial Sequence
  Description of Artificial Sequence: Synthetic polypeptide
DEQEIATTNPVAYEQWGSCSATDNNDHQGSDV

SEQ ID NO: 157832 - protein, 35 aa, Artificial Sequence
  Description of Artificial Sequence: Synthetic polypeptide
DEEEIRTVNPVATEQYGCVCSNTEHNQEYFNSQQG

SEQ ID NO: 157833 - protein, 32 aa, Artificial Sequence
  Description of Artificial Sequence: Synthetic polypeptide
DEQEIATTNPVATEQYGDVSAEDEMDHEGEDL

SEQ ID NO: 157834 - protein, 33 aa, Artificial Sequence
  Description of Artificial Sequence: Synthetic polypeptide
DEQEIATTNPVAYEQYGCVAANTNLATPADNPM

SEQ ID NO: 157835 - protein, 33 aa, Artificial Sequence
  Description of Artificial Sequence: Synthetic polypeptide
DEAVIGTTNPVATCQHGNSYVSPTDFIQGGNNA

SEQ ID NO: 157836 - protein, 38 aa, Artificial Sequence
  Description of Artificial Sequence: Synthetic polypeptide
DEEEIRTTNPVATEQYGVVSTTTNTNLEQGNIGTEDEE

SEQ ID NO: 157837 - protein, 35 aa, Artificial Sequence
  Description of Artificial Sequence: Synthetic polypeptide
DEAEIATTNPVATEQYGSVCNPTNGLFGQDDSVED

SEQ ID NO: 157838 - protein, 38 aa, Artificial Sequence
  Description of Artificial Sequence: Synthetic polypeptide
DEEEIRTTNPVATEQYGVVSTVVNNLQQGTEQGTTQDD

SEQ ID NO: 157839 - protein, 33 aa, Artificial Sequence
  Description of Artificial Sequence: Synthetic polypeptide
DEQEIATTNPVATEQYGCVAANGDGAMPGADPR

SEQ ID NO: 157840 - protein, 34 aa, Artificial Sequence
  Description of Artificial Sequence: Synthetic polypeptide
DEMEIRTTNPVATEQYGSVSMDVSELVYTEPQTD

SEQ ID NO: 157841 - protein, 35 aa, Artificial Sequence
  Description of Artificial Sequence: Synthetic polypeptide
DEMEIRTTNPVATEQYGSVQIVTPEEVDEGEEMRI

SEQ ID NO: 157842 - protein, 36 aa, Artificial Sequence
  Description of Artificial Sequence: Synthetic polypeptide
DEMEIRTTNPVATEQYGSVQENEYDSTDDQMEINED

SEQ ID NO: 157843 - protein, 34 aa, Artificial Sequence
  Description of Artificial Sequence: Synthetic polypeptide
DEQEIATTNPVATEQYGCVSATHPLEDHGGGDLH

SEQ ID NO: 157844 - protein, 34 aa, Artificial Sequence
  Description of Artificial Sequence: Synthetic polypeptide
DEQEIATTNPVATEQYGCVSATHPLEDHGGGEDL

SEQ ID NO: 157845 - protein, 38 aa, Artificial Sequence
  Description of Artificial Sequence: Synthetic polypeptide
DEEEIRTTNPVATEQYGVVSTVNNNNNNQGNLGNVEDT

SEQ ID NO: 157846 - protein, 33 aa, Artificial Sequence
  Description of Artificial Sequence: Synthetic polypeptide
DEQEIATTNPVATEQYGCVSNTAPEDHFGSEDL

SEQ ID NO: 157847 - protein, 34 aa, Artificial Sequence
  Description of Artificial Sequence: Synthetic polypeptide
DEAEIATTNPVATEQYGSVCGPVPPLQDSDTNGF

SEQ ID NO: 157848 - protein, 38 aa, Artificial Sequence
  Description of Artificial Sequence: Synthetic polypeptide
DEEEIRTTNPVATEQYGVVSTVVNNLQQGTESGTTVVE

SEQ ID NO: 157849 - protein, 34 aa, Artificial Sequence
  Description of Artificial Sequence: Synthetic polypeptide
DEAEISTTNPVATEQYGCVCGTEHNENFGSENQS

SEQ ID NO: 157850 - protein, 36 aa, Artificial Sequence
  Description of Artificial Sequence: Synthetic polypeptide
DEEEIRTTNPVGTEQWGSVSGTANENGERGMDIEAM

SEQ ID NO: 157851 - protein, 38 aa, Artificial Sequence
  Description of Artificial Sequence: Synthetic polypeptide
DEEEIRTTNPVATEQYGVVSTVVNNLQQGTEQGTTEDS

SEQ ID NO: 157852 - protein, 35 aa, Artificial Sequence
  Description of Artificial Sequence: Synthetic polypeptide
DEHEIRTTNPVAYEQWGSVCSTNDDEERQQNGDDE

SEQ ID NO: 157853 - protein, 34 aa, Artificial Sequence
  Description of Artificial Sequence: Synthetic polypeptide
DEHEIRTTNPVAYEQWGNVSTTGPNQGLTGNDGS

SEQ ID NO: 157854 - protein, 32 aa, Artificial Sequence
  Description of Artificial Sequence: Synthetic polypeptide
DAEEIATTNPVAYEPWGSVATPQQNANPTNGR

SEQ ID NO: 157855 - protein, 33 aa, Artificial Sequence
  Description of Artificial Sequence: Synthetic polypeptide
DEQEIATTNPVATEQYGCVAANGDTNTGGNPYQ

SEQ ID NO: 157856 - protein, 39 aa, Artificial Sequence
  Description of Artificial Sequence: Synthetic polypeptide
DEEEIRTTNPVATEQYGVVSTVTNLQAGTEQGTTTNVDE

SEQ ID NO: 157857 - protein, 33 aa, Artificial Sequence
  Description of Artificial Sequence: Synthetic polypeptide
DEQEIATTNPVATEQYGCVAANGDTTTPGGDPR

SEQ ID NO: 157858 - protein, 38 aa, Artificial Sequence
  Description of Artificial Sequence: Synthetic polypeptide
DEEEIRTTNPVATEQYGVVSTVTNLQAGTEEGTEETTE

SEQ ID NO: 157859 - protein, 32 aa, Artificial Sequence
  Description of Artificial Sequence: Synthetic polypeptide
DDSEVASTNPVSTEQYGNVSTNTGNSRVGNPV

SEQ ID NO: 157860 - protein, 37 aa, Artificial Sequence
  Description of Artificial Sequence: Synthetic polypeptide
DEEEIRTTNPVGTEQWGSVSGTANELGGERGQDIGAM

SEQ ID NO: 157861 - protein, 34 aa, Artificial Sequence
  Description of Artificial Sequence: Synthetic polypeptide
DEQSIRTTNPVAYEPYGSTVNTTGNGSQYRSNNE

SEQ ID NO: 157862 - protein, 36 aa, Artificial Sequence
  Description of Artificial Sequence: Synthetic polypeptide
DEAEIRTTNPVATEQYGSVSVTAANQHTGYSEEQES

SEQ ID NO: 157863 - protein, 33 aa, Artificial Sequence
  Description of Artificial Sequence: Synthetic polypeptide
DEEEIRTTNPVGTEQYGCVCSWEDLNANFISQQ

SEQ ID NO: 157864 - protein, 34 aa, Artificial Sequence
  Description of Artificial Sequence: Synthetic polypeptide
DEQEIATTNPVATEQYGCVTSVTDLEDHSGSEDL

SEQ ID NO: 157865 - protein, 35 aa, Artificial Sequence
  Description of Artificial Sequence: Synthetic polypeptide
DEAEIATTNPVATEQYGSVCFTNEQDNNDGQHDQE

SEQ ID NO: 157866 - protein, 38 aa, Artificial Sequence
  Description of Artificial Sequence: Synthetic polypeptide
DEEEIRTTNPVATEQYGVVSTVTNNNLQNTATTNVATE

SEQ ID NO: 157867 - protein, 35 aa, Artificial Sequence
  Description of Artificial Sequence: Synthetic polypeptide
DEHEIRTTNPVAYEQWGSVCSTNQNDQGEEPNESP

SEQ ID NO: 157868 - protein, 35 aa, Artificial Sequence
  Description of Artificial Sequence: Synthetic polypeptide
DEHEIRTTNPVAYEQWGSVCYTQDNDQHTGGNMNT

SEQ ID NO: 157869 - protein, 33 aa, Artificial Sequence
  Description of Artificial Sequence: Synthetic polypeptide
DEQEIATTNPVAYEQWGSCSATDNNDHQGNDDD

SEQ ID NO: 157870 - protein, 34 aa, Artificial Sequence
  Description of Artificial Sequence: Synthetic polypeptide
DEHEIRTTNPVAYEQWGEVYWHPPNDDRMNGNTR

SEQ ID NO: 157871 - protein, 30 aa, Artificial Sequence
  Description of Artificial Sequence: Synthetic polypeptide
DDSEVASTNPVSTEGYGNVAANTIQRVGDR

SEQ ID NO: 157872 - protein, 31 aa, Artificial Sequence
  Description of Artificial Sequence: Synthetic polypeptide
DEQEIATTNPVATEQYGEASAEVCEDHGEDL

SEQ ID NO: 157873 - protein, 39 aa, Artificial Sequence
  Description of Artificial Sequence: Synthetic polypeptide
DEEEIRTTNVTTNPVATEQYGTVSTTTTANLLLQEGNNE

SEQ ID NO: 157874 - protein, 38 aa, Artificial Sequence
  Description of Artificial Sequence: Synthetic polypeptide
DEEEIRTTNPVATEQYGVVSTVTNNNNNQQNQNGTNQE

SEQ ID NO: 157875 - protein, 34 aa, Artificial Sequence
  Description of Artificial Sequence: Synthetic polypeptide
DEMEIRTTNPVATEQYGSVSNAEDQDTFPEEKSQ

SEQ ID NO: 157876 - protein, 36 aa, Artificial Sequence
  Description of Artificial Sequence: Synthetic polypeptide
DEMEIRTTNPVATEQYGSVSITEDTTETIAFNSEIR

SEQ ID NO: 157877 - protein, 38 aa, Artificial Sequence
  Description of Artificial Sequence: Synthetic polypeptide
DEEEIRTTNPVATEQYGVVSTVTNNNNQQQGTNTEEEE

SEQ ID NO: 157878 - protein, 33 aa, Artificial Sequence
  Description of Artificial Sequence: Synthetic polypeptide
DEQEIATTNPVAYEQYGSTAGNHLQDTPDGSEN

SEQ ID NO: 157879 - protein, 32 aa, Artificial Sequence
  Description of Artificial Sequence: Synthetic polypeptide
DELEIRTTNPVSTEPYGTISMEDIQQKQNGNH

SEQ ID NO: 157880 - protein, 39 aa, Artificial Sequence
  Description of Artificial Sequence: Synthetic polypeptide
DEEEIRTTNPVATEQYGVVSTVTNLQQGSEEGTTTNVAE

SEQ ID NO: 157881 - protein, 34 aa, Artificial Sequence
  Description of Artificial Sequence: Synthetic polypeptide
DEQEIATTNPVAYEQYGSVCAANNWLQGDVQNDD

SEQ ID NO: 157882 - protein, 31 aa, Artificial Sequence
  Description of Artificial Sequence: Synthetic polypeptide
DDSEVATTNPVATEGYGNVAANTIQSRVGQL

SEQ ID NO: 157883 - protein, 38 aa, Artificial Sequence
  Description of Artificial Sequence: Synthetic polypeptide
DEEEIRTTNPVATEQYGVVSTVTNNNNQQQGTTNEEEA

SEQ ID NO: 157884 - protein, 31 aa, Artificial Sequence
  Description of Artificial Sequence: Synthetic polypeptide
DDSEVRTTNPVSTEQYGNVSAETIMNAAGDA

SEQ ID NO: 157885 - protein, 38 aa, Artificial Sequence
  Description of Artificial Sequence: Synthetic polypeptide
DEEEIRTTNPVATEQYGVVSTVTNNNNQQGTDEQENDT

SEQ ID NO: 157886 - protein, 40 aa, Artificial Sequence
  Description of Artificial Sequence: Synthetic polypeptide
DEEEIRTTNPVATEQYGSVSTVNLNNLQEGTEQYGTNVEQ

SEQ ID NO: 157887 - protein, 32 aa, Artificial Sequence
  Description of Artificial Sequence: Synthetic polypeptide
DEQEIATTNPVAYEQWGSCSATDNNDHKGEGP

SEQ ID NO: 157888 - protein, 35 aa, Artificial Sequence
  Description of Artificial Sequence: Synthetic polypeptide
DEHEIRTTNPVAYEQWGSVCYTQDNDQHTGNDNDS

SEQ ID NO: 157889 - protein, 31 aa, Artificial Sequence
  Description of Artificial Sequence: Synthetic polypeptide
DDSEVASTNPVSTEQYGNVSANTEQSRVEQR

SEQ ID NO: 157890 - protein, 31 aa, Artificial Sequence
  Description of Artificial Sequence: Synthetic polypeptide
DDSEVRTTNPVSTEQYGNVSAETEMNAAGDA

SEQ ID NO: 157891 - protein, 33 aa, Artificial Sequence
  Description of Artificial Sequence: Synthetic polypeptide
DEQEIATTNPVATEQYGCVAANGDEADTGGDPR

SEQ ID NO: 157892 - protein, 33 aa, Artificial Sequence
  Description of Artificial Sequence: Synthetic polypeptide
DEQEIATTNPVAYEQWGSCSATDNNDHHGEMND

SEQ ID NO: 157893 - protein, 33 aa, Artificial Sequence
  Description of Artificial Sequence: Synthetic polypeptide
DEQEIATTNPVAYEQYGSVCATGNEQDATLTDA

SEQ ID NO: 157894 - protein, 33 aa, Artificial Sequence
  Description of Artificial Sequence: Synthetic polypeptide
DEQEIATTNPVATEQYGCVAANNGDTPDSENRD

SEQ ID NO: 157895 - protein, 32 aa, Artificial Sequence
  Description of Artificial Sequence: Synthetic polypeptide
DEQEIATTNPVAYEQWGSCSATDNNDHGGETD

SEQ ID NO: 157896 - protein, 35 aa, Artificial Sequence
  Description of Artificial Sequence: Synthetic polypeptide
DEEEIRTTNPVGTEFYGSVNIADNMEQGEGGNDGD

SEQ ID NO: 157897 - protein, 33 aa, Artificial Sequence
  Description of Artificial Sequence: Synthetic polypeptide
DEQEIATTNPVAYEQYGSVCATNDQDATLTKDQ

SEQ ID NO: 157898 - protein, 39 aa, Artificial Sequence
  Description of Artificial Sequence: Synthetic polypeptide
DEEEIRTTNPVATEQYGSVSTVNLNGLQEGTEQGTVVEE

SEQ ID NO: 157899 - protein, 37 aa, Artificial Sequence
  Description of Artificial Sequence: Synthetic polypeptide
DEEEIRTTNPVAYEQYGSTVPSTTQAGSTTRNGGNPV

SEQ ID NO: 157900 - protein, 38 aa, Artificial Sequence
  Description of Artificial Sequence: Synthetic polypeptide
DEEEIRTTNPVATEQYGVVSTVNNNLNNNNLQAGTEDE

SEQ ID NO: 157901 - protein, 37 aa, Artificial Sequence
  Description of Artificial Sequence: Synthetic polypeptide
DEEEIRTTNPVATEQYGVVSTVTNNNQQEATTNVATE

SEQ ID NO: 157902 - protein, 33 aa, Artificial Sequence
  Description of Artificial Sequence: Synthetic polypeptide
DEMEIRTTNPVATCQYGCVCNTEEHNQNFGSDQ

SEQ ID NO: 157903 - protein, 31 aa, Artificial Sequence
  Description of Artificial Sequence: Synthetic polypeptide
DEQEIATTNPVATEQYGEAPTVCQDHEEEDL

SEQ ID NO: 157904 - protein, 33 aa, Artificial Sequence
  Description of Artificial Sequence: Synthetic polypeptide
DEKEIVTTNPVATEQYGTVCSAVDGPVEFEGND

SEQ ID NO: 157905 - protein, 32 aa, Artificial Sequence
  Description of Artificial Sequence: Synthetic polypeptide
DEQEIATTNPVAYEQWGSCSATDNNDHQGEQF

SEQ ID NO: 157906 - protein, 33 aa, Artificial Sequence
  Description of Artificial Sequence: Synthetic polypeptide
DEQEIATTNPVATEQYGCVAANNDATMNPGERV

SEQ ID NO: 157907 - protein, 34 aa, Artificial Sequence
  Description of Artificial Sequence: Synthetic polypeptide
DEQEIATTNPVAYEQYGCVAANGLQAAPGPIENP

SEQ ID NO: 157908 - protein, 32 aa, Artificial Sequence
  Description of Artificial Sequence: Synthetic polypeptide
DDSEVATTNPVATECWGSVSCTEPQDREGEQG

SEQ ID NO: 157909 - protein, 36 aa, Artificial Sequence
  Description of Artificial Sequence: Synthetic polypeptide
DAEEIATTNPVATEQYGSVCSTNDAQQEHQDGTAAK

SEQ ID NO: 157910 - protein, 39 aa, Artificial Sequence
  Description of Artificial Sequence: Synthetic polypeptide
DEEEIRTTNPVATEQYGVVSTVTNLQQGAEQGTTTNVTE

SEQ ID NO: 157911 - protein, 33 aa, Artificial Sequence
  Description of Artificial Sequence: Synthetic polypeptide
DEHEIRTTNPVAYEQWGEVYHPWNDDRQNMNAR

SEQ ID NO: 157912 - protein, 34 aa, Artificial Sequence
  Description of Artificial Sequence: Synthetic polypeptide
DEMEIRTTNPVATEQYGSVPPTTLPEEFMEVMQG

SEQ ID NO: 157913 - protein, 31 aa, Artificial Sequence
  Description of Artificial Sequence: Synthetic polypeptide
DDSEVATTNPVATECWGSVSCTEQDREGEQG

SEQ ID NO: 157914 - protein, 31 aa, Artificial Sequence
  Description of Artificial Sequence: Synthetic polypeptide
DEQEIATTNPVATEQYGEAPAEDLEDHEGEK

SEQ ID NO: 157915 - protein, 33 aa, Artificial Sequence
  Description of Artificial Sequence: Synthetic polypeptide
DEQEIATTNPVAYEQWGSCSATDNNDHQGDSRD

SEQ ID NO: 157916 - protein, 32 aa, Artificial Sequence
  Description of Artificial Sequence: Synthetic polypeptide
DEQEIATTNPVATEQYGEAPATDLEDHEGEDK

SEQ ID NO: 157917 - protein, 34 aa, Artificial Sequence
  Description of Artificial Sequence: Synthetic polypeptide
DEQEIATTNPVATEQYGCVAANNDTTRHQGNETP

SEQ ID NO: 157918 - protein, 35 aa, Artificial Sequence
  Description of Artificial Sequence: Synthetic polypeptide
DEHEIRTTNPVAYEQWGCSYNSINDLDQRGHEPTH

SEQ ID NO: 157919 - protein, 36 aa, Artificial Sequence
  Description of Artificial Sequence: Synthetic polypeptide
DEEEIRTTNPVGTEQWGSVSGNANELGERGGDQTAE

SEQ ID NO: 157920 - protein, 39 aa, Artificial Sequence
  Description of Artificial Sequence: Synthetic polypeptide
DEEEIRTTNPVATEQYGVVSTVTNLQYGNEQGTTTNVEE

SEQ ID NO: 157921 - protein, 32 aa, Artificial Sequence
  Description of Artificial Sequence: Synthetic polypeptide
DEQEIATTNPVAYEQWGSCSATDNNDHMGEDK

SEQ ID NO: 157922 - protein, 34 aa, Artificial Sequence
  Description of Artificial Sequence: Synthetic polypeptide
DEHEIRTTNPVAYEQWGCVCMEQLQDVDRGDNSD

SEQ ID NO: 157923 - protein, 36 aa, Artificial Sequence
  Description of Artificial Sequence: Synthetic polypeptide
DEMEIRTTNPVATEQYGSVSLVLDANEDESMQNGQI

SEQ ID NO: 157924 - protein, 32 aa, Artificial Sequence
  Description of Artificial Sequence: Synthetic polypeptide
DEQWIATTNPVATEAYGYVSATDLEDHEGEDL

SEQ ID NO: 157925 - protein, 34 aa, Artificial Sequence
  Description of Artificial Sequence: Synthetic polypeptide
DEQEIATTNPVAYEQWGSCSPTDNMEHQDDRDNP

SEQ ID NO: 157926 - protein, 33 aa, Artificial Sequence
  Description of Artificial Sequence: Synthetic polypeptide
DEHEIRTTNPVAYEPWGEVATMDGDQRNGQNPT

SEQ ID NO: 157927 - protein, 33 aa, Artificial Sequence
  Description of Artificial Sequence: Synthetic polypeptide
DEQEIATTNPVAYEQWGSCSPTDNNDHQGGEDD

SEQ ID NO: 157928 - protein, 38 aa, Artificial Sequence
  Description of Artificial Sequence: Synthetic polypeptide
DEEEIRTTNPVATEQYGVVSTVTNNNNQQGTNNEEDED

SEQ ID NO: 157929 - protein, 33 aa, Artificial Sequence
  Description of Artificial Sequence: Synthetic polypeptide
DEQSEIATTNPVAYEGWGSVATNLQGDAGDGSQ

SEQ ID NO: 157930 - protein, 37 aa, Artificial Sequence
  Description of Artificial Sequence: Synthetic polypeptide
DEEEIRTTNPVAYEQYGQSYVTSNYKDLLQPRSIEKR

SEQ ID NO: 157931 - protein, 33 aa, Artificial Sequence
  Description of Artificial Sequence: Synthetic polypeptide
DEKHIVTTNPVATEQYGTVCSATDGPVEFEGND

SEQ ID NO: 157932 - protein, 33 aa, Artificial Sequence
  Description of Artificial Sequence: Synthetic polypeptide
DEHEIRTTNPVAYEQWGEVTGDNNGDQRGGTGA

SEQ ID NO: 157933 - protein, 37 aa, Artificial Sequence
  Description of Artificial Sequence: Synthetic polypeptide
DEEEIRTTNPVAYEQYGQVAVSDQMNDLLQPRGQIDF

SEQ ID NO: 157934 - protein, 33 aa, Artificial Sequence
  Description of Artificial Sequence: Synthetic polypeptide
DEKEIVTTNPVATYQYGTVCSATDGPVEFEGND

SEQ ID NO: 157935 - protein, 30 aa, Artificial Sequence
  Description of Artificial Sequence: Synthetic polypeptide
DEQEIATTNPVATEQYGEAPEVCQDHEEDL

SEQ ID NO: 157936 - protein, 37 aa, Artificial Sequence
  Description of Artificial Sequence: Synthetic polypeptide
DEEEIRTTNPVATEQYGVVSGTMNDGDQAEGGGEGTN

SEQ ID NO: 157937 - protein, 34 aa, Artificial Sequence
  Description of Artificial Sequence: Synthetic polypeptide
DEQEIATTNPVATEQYGCVCAGNGLQMMGDQTAH

SEQ ID NO: 157938 - protein, 33 aa, Artificial Sequence
  Description of Artificial Sequence: Synthetic polypeptide
DEQEIATTNPVATEQYGCVAANGDADTGGGDGR

SEQ ID NO: 157939 - protein, 36 aa, Artificial Sequence
  Description of Artificial Sequence: Synthetic polypeptide
DEMEIRTTNPVATEQYGSVSPTEDTTETIQFNSEKR

SEQ ID NO: 157940 - protein, 39 aa, Artificial Sequence
  Description of Artificial Sequence: Synthetic polypeptide
DEEEIRTTNPVATEQYGVVSTVTNLQQGNNQATTTNVAE

SEQ ID NO: 157941 - protein, 35 aa, Artificial Sequence
  Description of Artificial Sequence: Synthetic polypeptide
DEAEIATTNPVATEQYGSVCAMTNHGEQTLDIARI

SEQ ID NO: 157942 - protein, 36 aa, Artificial Sequence
  Description of Artificial Sequence: Synthetic polypeptide
DEAEIATTNPVATEQYGSVCATNPQLNPDDQMGGLY

SEQ ID NO: 157943 - protein, 39 aa, Artificial Sequence
  Description of Artificial Sequence: Synthetic polypeptide
DEEEIRTTNPVATEQYGSVSTVNAEQGNNQGNNGTEDEE

SEQ ID NO: 157944 - protein, 35 aa, Artificial Sequence
  Description of Artificial Sequence: Synthetic polypeptide
DEAEISTTNPVATEIYGSVCSNWNDGQDRQGGGEN

SEQ ID NO: 157945 - protein, 35 aa, Artificial Sequence
  Description of Artificial Sequence: Synthetic polypeptide
DEAEIATTNPVATEQYGSVVAAAANLPGEATGGNE

SEQ ID NO: 157946 - protein, 38 aa, Artificial Sequence
  Description of Artificial Sequence: Synthetic polypeptide
DEEEIRTTNPVATEQYGSVSTVNAEQGNNQQNQTEDEE

SEQ ID NO: 157947 - protein, 36 aa, Artificial Sequence
  Description of Artificial Sequence: Synthetic polypeptide
DEAEIATTNPVATEQYGSVCSPTGNGHVSDDPGQRN

SEQ ID NO: 157948 - protein, 33 aa, Artificial Sequence
  Description of Artificial Sequence: Synthetic polypeptide
DEQEIATTNPVATEQYGCVAATNDATPSPMENG

SEQ ID NO: 157949 - protein, 37 aa, Artificial Sequence
  Description of Artificial Sequence: Synthetic polypeptide
DEEEIRTTNPVATEQYGVVSTVVNNNDEAGNTEQGSE

SEQ ID NO: 157950 - protein, 38 aa, Artificial Sequence
  Description of Artificial Sequence: Synthetic polypeptide
DEEEIRTTNPVATEQYGSVSTVNAEQGNNQQGTTEEEQ

SEQ ID NO: 157951 - protein, 33 aa, Artificial Sequence
  Description of Artificial Sequence: Synthetic polypeptide
DEHEIRTTNPVAYEKWGEVATNLNNGDVGQNQA

SEQ ID NO: 157952 - protein, 36 aa, Artificial Sequence
  Description of Artificial Sequence: Synthetic polypeptide
DEAEIRTTNPVATEQYGSVSVTYADTQTGQGEEVES

SEQ ID NO: 157953 - protein, 33 aa, Artificial Sequence
  Description of Artificial Sequence: Synthetic polypeptide
DEQEIATTNPVAYEQWGSTSTNPNGNGMGQNGD

SEQ ID NO: 157954 - protein, 33 aa, Artificial Sequence
  Description of Artificial Sequence: Synthetic polypeptide
DEQEIATTNPVATEQYGCVAATGDQNAPEGEGW

SEQ ID NO: 157955 - protein, 33 aa, Artificial Sequence
  Description of Artificial Sequence: Synthetic polypeptide
DEQEIATTNPVAYEQWGSCSATDNNDHEGMNTQ

SEQ ID NO: 157956 - protein, 34 aa, Artificial Sequence
  Description of Artificial Sequence: Synthetic polypeptide
DEEEIRTTNPVGTEQYGCVCSTEAHAEYFGSDQA

SEQ ID NO: 157957 - protein, 31 aa, Artificial Sequence
  Description of Artificial Sequence: Synthetic polypeptide
DDSEVASTNPVSTEGYGCVATNPIQSRVGQR

SEQ ID NO: 157958 - protein, 34 aa, Artificial Sequence
  Description of Artificial Sequence: Synthetic polypeptide
DEMAIRTTNPVATEQYGCFCSTEEHNIYFGSNQS

SEQ ID NO: 157959 - protein, 35 aa, Artificial Sequence
  Description of Artificial Sequence: Synthetic polypeptide
DEAEIRTTNPVATEQYGSVSVEALLETGLGDDIQN

SEQ ID NO: 157960 - protein, 33 aa, Artificial Sequence
  Description of Artificial Sequence: Synthetic polypeptide
DEQEIATTNPVATEQYGCVAAAANGLGPDNEND

SEQ ID NO: 157961 - protein, 33 aa, Artificial Sequence
  Description of Artificial Sequence: Synthetic polypeptide
DEQEIATTNPVAYEQWGSTSTNPNGNGMGQDRG

SEQ ID NO: 157962 - protein, 35 aa, Artificial Sequence
  Description of Artificial Sequence: Synthetic polypeptide
DEAEISTTNPVATEIYGSVCSNWNDGQDRQGLGTD

SEQ ID NO: 157963 - protein, 32 aa, Artificial Sequence
  Description of Artificial Sequence: Synthetic polypeptide
DDSEVATTNPVATECWGSVSCNEPQDREGEQG

SEQ ID NO: 157964 - protein, 31 aa, Artificial Sequence
  Description of Artificial Sequence: Synthetic polypeptide
DDSEVRTTNPVSTEGYGNVAAETIQSRAGDR

SEQ ID NO: 157965 - protein, 32 aa, Artificial Sequence
  Description of Artificial Sequence: Synthetic polypeptide
DEKEIRTTNPVSTEPYGTISMEDIQQQQNGNH

SEQ ID NO: 157966 - protein, 33 aa, Artificial Sequence
  Description of Artificial Sequence: Synthetic polypeptide
DEHEIRTTNPVAYEQWGEVSHIPLDDRQNMNAE

SEQ ID NO: 157967 - protein, 33 aa, Artificial Sequence
  Description of Artificial Sequence: Synthetic polypeptide
DEQEIATTNPVATEQYGCVAAIGLEPTGEENTE

SEQ ID NO: 157968 - protein, 33 aa, Artificial Sequence
  Description of Artificial Sequence: Synthetic polypeptide
DEQEIATTNPVATEQYGCVAATTNLADPPPQPE

SEQ ID NO: 157969 - protein, 34 aa, Artificial Sequence
  Description of Artificial Sequence: Synthetic polypeptide
DEATEIATTNPVAYEQWGSVSGPNGNQGPGGGDR

SEQ ID NO: 157970 - protein, 36 aa, Artificial Sequence
  Description of Artificial Sequence: Synthetic polypeptide
DEAEIRTTNPVATEQYGSVSVGWNSLLEFGEFEQQV

SEQ ID NO: 157971 - protein, 36 aa, Artificial Sequence
  Description of Artificial Sequence: Synthetic polypeptide
DEEEIRTTNPVAYEQYGQCVCSNWENDDNQRFGSDQ

SEQ ID NO: 157972 - protein, 33 aa, Artificial Sequence
  Description of Artificial Sequence: Synthetic polypeptide
DEQEIATTNPVATEQYGCVAATEGNQNAPGGPE

SEQ ID NO: 157973 - protein, 32 aa, Artificial Sequence
  Description of Artificial Sequence: Synthetic polypeptide
DEQEIATTNPVAYEQWGSCSATDNNDHEGESS

SEQ ID NO: 157974 - protein, 35 aa, Artificial Sequence
  Description of Artificial Sequence: Synthetic polypeptide
DCEEIRTTNPVATEQYGSVSDWVVNIETTLENNES

SEQ ID NO: 157975 - protein, 34 aa, Artificial Sequence
  Description of Artificial Sequence: Synthetic polypeptide
DEMEIITTNPVATEQYGTVCSATDGCPVEFEGND

SEQ ID NO: 157976 - protein, 32 aa, Artificial Sequence
  Description of Artificial Sequence: Synthetic polypeptide
DEQEIATTNPVAYEQWGSCSATDNNDGDGEDN

SEQ ID NO: 157977 - protein, 34 aa, Artificial Sequence
  Description of Artificial Sequence: Synthetic polypeptide
DEMEIITTNPVATEQYGTVCSATDYPVEFEGNED

SEQ ID NO: 157978 - protein, 34 aa, Artificial Sequence
  Description of Artificial Sequence: Synthetic polypeptide
DEMEILTTNPVATEQYGTVCSATDGPVEFEGNDM

SEQ ID NO: 157979 - protein, 32 aa, Artificial Sequence
  Description of Artificial Sequence: Synthetic polypeptide
DEMAIRTTNPVATEQYGCFCSTEHIIFGSDQM

SEQ ID NO: 157980 - protein, 37 aa, Artificial Sequence
  Description of Artificial Sequence: Synthetic polypeptide
CEEEIATTNPVATEQYGSVAATTNAAEATRSGDENRH

SEQ ID NO: 157981 - protein, 35 aa, Artificial Sequence
  Description of Artificial Sequence: Synthetic polypeptide
DEEEIRTTNPVATEQYGVVNGTGNMTNVGGGQGGT

SEQ ID NO: 157982 - protein, 35 aa, Artificial Sequence
  Description of Artificial Sequence: Synthetic polypeptide
DEAEIATTNPVATEQYGSVSVMNEDEQNITQNGDQ

SEQ ID NO: 157983 - protein, 34 aa, Artificial Sequence
  Description of Artificial Sequence: Synthetic polypeptide
DEHEIRTTNPVAYEQWGSVCHGDQQDQSDRGNHQ

SEQ ID NO: 157984 - protein, 35 aa, Artificial Sequence
  Description of Artificial Sequence: Synthetic polypeptide
DAAEIATTNPVATEQYGSVCSPDGTGNEADGADNT

SEQ ID NO: 157985 - protein, 35 aa, Artificial Sequence
  Description of Artificial Sequence: Synthetic polypeptide
DEEEIRTVNPVATEFYGSVVNGTRGLQGFNEDEEF

SEQ ID NO: 157986 - protein, 34 aa, Artificial Sequence
  Description of Artificial Sequence: Synthetic polypeptide
DEMEIMTTNPVATEQYGTVCYATDGPPVEFRGND

SEQ ID NO: 157987 - protein, 36 aa, Artificial Sequence
  Description of Artificial Sequence: Synthetic polypeptide
DAEEIATTNPVATEQYGSVCSPDGTGNEADIGNEPA

SEQ ID NO: 157988 - protein, 38 aa, Artificial Sequence
  Description of Artificial Sequence: Synthetic polypeptide
DEEEIRTTNPVATEQYGSVSTVNAEQGNNQQGATEDGQ

SEQ ID NO: 157989 - protein, 37 aa, Artificial Sequence
  Description of Artificial Sequence: Synthetic polypeptide
DEEEIRTTNPVATEQYGVVMSTGFQGGDGENDGNPEA

SEQ ID NO: 157990 - protein, 36 aa, Artificial Sequence
  Description of Artificial Sequence: Synthetic polypeptide
DEAEIRTTNPVATEQYGSVSVTPNDETPENTNDPEV

SEQ ID NO: 157991 - protein, 34 aa, Artificial Sequence
  Description of Artificial Sequence: Synthetic polypeptide
DEEEIRTTNPVGTEIYGSVVDGTNMESGEGGEED

SEQ ID NO: 157992 - protein, 40 aa, Artificial Sequence
  Description of Artificial Sequence: Synthetic polypeptide
DEEEIRTTNPVATEQYGSVSTVNLQQGNATEQGTNQNNTE

SEQ ID NO: 157993 - protein, 35 aa, Artificial Sequence
  Description of Artificial Sequence: Synthetic polypeptide
DEAEIATTNPVATEQYGSVSTTDLNEDHFGSEDLS

SEQ ID NO: 157994 - protein, 32 aa, Artificial Sequence
  Description of Artificial Sequence: Synthetic polypeptide
DEQEIATTNPVAYEQWGSCSATDNNDHEGDVP

SEQ ID NO: 157995 - protein, 35 aa, Artificial Sequence
  Description of Artificial Sequence: Synthetic polypeptide
CEEEIACTNPVATEQYGSCAAATNLQDGAETNNQM

SEQ ID NO: 157996 - protein, 33 aa, Artificial Sequence
  Description of Artificial Sequence: Synthetic polypeptide
DEQEIATTNPVATEQYGCVAATTNLADPPEPSP

SEQ ID NO: 157997 - protein, 35 aa, Artificial Sequence
  Description of Artificial Sequence: Synthetic polypeptide
DEQEIATTNPVATEQYGQSGVSATDTLEDHEGEDL

SEQ ID NO: 157998 - protein, 32 aa, Artificial Sequence
  Description of Artificial Sequence: Synthetic polypeptide
DEQEIATTNPVAYEQWGSCSATDNNDHEGMQH

SEQ ID NO: 157999 - protein, 36 aa, Artificial Sequence
  Description of Artificial Sequence: Synthetic polypeptide
DEAEIRTTNPVATEQYGSVSVTYANQDTGYSEEVES

SEQ ID NO: 158000 - protein, 37 aa, Artificial Sequence
  Description of Artificial Sequence: Synthetic polypeptide
DEEEIRTTNPVATEQYGVVSGATMNDGDQAEGGGEMT

SEQ ID NO: 158001 - protein, 32 aa, Artificial Sequence
  Description of Artificial Sequence: Synthetic polypeptide
DEQEIATTNPVAYEQWGSCSATDNNDDDGGDL

SEQ ID NO: 158002 - protein, 33 aa, Artificial Sequence
  Description of Artificial Sequence: Synthetic polypeptide
DEMEIKTTNPVATEQYGTVCSATDGPVEFEQND

SEQ ID NO: 158003 - protein, 35 aa, Artificial Sequence
  Description of Artificial Sequence: Synthetic polypeptide
DEEEIRTTNPVGTEQYGCVCSNTMNDHGNFGSDQA

SEQ ID NO: 158004 - protein, 33 aa, Artificial Sequence
  Description of Artificial Sequence: Synthetic polypeptide
DEMEILTTNPVATECYGTVCSATDGPVEFEGND

SEQ ID NO: 158005 - protein, 33 aa, Artificial Sequence
  Description of Artificial Sequence: Synthetic polypeptide
DEQEIATTNPVATEQYGCVAANGDADTPQGDPR

SEQ ID NO: 158006 - protein, 32 aa, Artificial Sequence
  Description of Artificial Sequence: Synthetic polypeptide
DEQEIATTNPVAYEQWGSCSATDNNDHEGGDF

SEQ ID NO: 158007 - protein, 34 aa, Artificial Sequence
  Description of Artificial Sequence: Synthetic polypeptide
DEQEIATTNPVAYEQWGSTSTNPNGNGMGGNGRQ

SEQ ID NO: 158008 - protein, 32 aa, Artificial Sequence
  Description of Artificial Sequence: Synthetic polypeptide
DEQEIATTNPVAYEQWGSVSGPNGNAGEGDHK

SEQ ID NO: 158009 - protein, 33 aa, Artificial Sequence
  Description of Artificial Sequence: Synthetic polypeptide
DEQEIATTNPVATEQYGCVAGTGLAMNPDEGDP

SEQ ID NO: 158010 - protein, 33 aa, Artificial Sequence
  Description of Artificial Sequence: Synthetic polypeptide
DELEIATTNPVATEQYGSVVVMDGQEDYEGEDE

SEQ ID NO: 158011 - protein, 33 aa, Artificial Sequence
  Description of Artificial Sequence: Synthetic polypeptide
DEMEIKTTNPVATEQYGTVCSATDGPVEFEGRD

SEQ ID NO: 158012 - protein, 33 aa, Artificial Sequence
  Description of Artificial Sequence: Synthetic polypeptide
DEAVIGTTNPVATEQWGCVCSTDDHQYFGSNNQ

SEQ ID NO: 158013 - protein, 31 aa, Artificial Sequence
  Description of Artificial Sequence: Synthetic polypeptide
DDSEVASTNPVSTEQYGDVAANTIQSRVGQR

SEQ ID NO: 158014 - protein, 36 aa, Artificial Sequence
  Description of Artificial Sequence: Synthetic polypeptide
DEEEIRTTNPVAYEQYGQVPSPTPAGSTTRNGGNPV

SEQ ID NO: 158015 - protein, 37 aa, Artificial Sequence
  Description of Artificial Sequence: Synthetic polypeptide
DEEEIRSTNPVATESYGSVVTDNDDDQEGGQDENNGD

SEQ ID NO: 158016 - protein, 32 aa, Artificial Sequence
  Description of Artificial Sequence: Synthetic polypeptide
QEQEIAPTNPCSYEQWGIVSKNLEQSKGDTNR

SEQ ID NO: 158017 - protein, 34 aa, Artificial Sequence
  Description of Artificial Sequence: Synthetic polypeptide
DEQEIATTNPVAYEQYGSACATNNEQDATPTGDL

SEQ ID NO: 158018 - protein, 37 aa, Artificial Sequence
  Description of Artificial Sequence: Synthetic polypeptide
DEEEIKTTNPVAYETYGISLVACTSNLSATRSGENVD

SEQ ID NO: 158019 - protein, 35 aa, Artificial Sequence
  Description of Artificial Sequence: Synthetic polypeptide
DEQEIATTNPVAYEQYGSCSTNDLTQGTHQDEAAP

SEQ ID NO: 158020 - protein, 31 aa, Artificial Sequence
  Description of Artificial Sequence: Synthetic polypeptide
DDSEVATTNPVSTEQYGNVAAETIQSRVEQR

SEQ ID NO: 158021 - protein, 36 aa, Artificial Sequence
  Description of Artificial Sequence: Synthetic polypeptide
DEEEIRSTNPVATESYGSVVSNQNNMTIFGNTNGQD

SEQ ID NO: 158022 - protein, 36 aa, Artificial Sequence
  Description of Artificial Sequence: Synthetic polypeptide
DDETIRTTNPVATEQYGAVVITDNQGEQRGQPDEGQ

SEQ ID NO: 158023 - protein, 36 aa, Artificial Sequence
  Description of Artificial Sequence: Synthetic polypeptide
DEEEIRTTNPVATEQYGSVQPNMNGHMMTEHVNQNE

SEQ ID NO: 158024 - protein, 32 aa, Artificial Sequence
  Description of Artificial Sequence: Synthetic polypeptide
QEGEIAPTNPCSYEQYGCTVPSCNLSQSGGTR

SEQ ID NO: 158025 - protein, 36 aa, Artificial Sequence
  Description of Artificial Sequence: Synthetic polypeptide
DEEEIRTTNPVATEQYGMVSMELNMEMGEEFDDGDQ

SEQ ID NO: 158026 - protein, 32 aa, Artificial Sequence
  Description of Artificial Sequence: Synthetic polypeptide
DENEIRTTNPVSSEPYGTISMEDIQQQQNGNH

SEQ ID NO: 158027 - protein, 31 aa, Artificial Sequence
  Description of Artificial Sequence: Synthetic polypeptide
AEDEIATTNPVAYEQWGCLSCFEHDQREGES

SEQ ID NO: 158028 - protein, 31 aa, Artificial Sequence
  Description of Artificial Sequence: Synthetic polypeptide
DDSEVATTNPVSTEPYGTVSAMTIQSRNGQH

SEQ ID NO: 158029 - protein, 31 aa, Artificial Sequence
  Description of Artificial Sequence: Synthetic polypeptide
DDSEVASTNPVSTEGYGNVAANTIQSRVGYR

SEQ ID NO: 158030 - protein, 31 aa, Artificial Sequence
  Description of Artificial Sequence: Synthetic polypeptide
DDSEVATTNPVSTEGYGTVAAMTIQSQVGQR

SEQ ID NO: 158031 - protein, 34 aa, Artificial Sequence
  Description of Artificial Sequence: Synthetic polypeptide
DEMEIATTNPVAYECWGSVATGNMLGDAGGQNDE

SEQ ID NO: 158032 - protein, 39 aa, Artificial Sequence
  Description of Artificial Sequence: Synthetic polypeptide
AEEEIRTTNPVATEQYGSVSTTQANLQNATTEQGTTTVE

SEQ ID NO: 158033 - protein, 37 aa, Artificial Sequence
  Description of Artificial Sequence: Synthetic polypeptide
DEEEIRTTNPVATEQYGSVQPNLTYLVMMTEHVEQNE

SEQ ID NO: 158034 - protein, 39 aa, Artificial Sequence
  Description of Artificial Sequence: Synthetic polypeptide
DEEEIRTTNPVATEQYGVVSTVVTNQQGNQQAGNQNEGN

SEQ ID NO: 158035 - protein, 34 aa, Artificial Sequence
  Description of Artificial Sequence: Synthetic polypeptide
DEQEIATTNPVATEQYGCSAANGLATMPGGEPNE

SEQ ID NO: 158036 - protein, 32 aa, Artificial Sequence
  Description of Artificial Sequence: Synthetic polypeptide
DSEDIATTNPVATEQWGGCVAGEGHQRVMNAM

SEQ ID NO: 158037 - protein, 38 aa, Artificial Sequence
  Description of Artificial Sequence: Synthetic polypeptide
DEDEIRTTNPVATEQYGVVSTVNNNQAGNQQGNNEEND

SEQ ID NO: 158038 - protein, 32 aa, Artificial Sequence
  Description of Artificial Sequence: Synthetic polypeptide
DEEEIRTTNPIATEQWGATAANAEDWAPGPYK

SEQ ID NO: 158039 - protein, 31 aa, Artificial Sequence
  Description of Artificial Sequence: Synthetic polypeptide
NEDCIACTNPVAYEPWDYSTVASNLQRGDND

SEQ ID NO: 158040 - protein, 32 aa, Artificial Sequence
  Description of Artificial Sequence: Synthetic polypeptide
DENEIRTTNPVSTAPYGTISMEDIQQQQNGNH

SEQ ID NO: 158041 - protein, 37 aa, Artificial Sequence
  Description of Artificial Sequence: Synthetic polypeptide
DEAEIQTTNPVATEQYGRVSSTTPNVGPNMRNGMNPV

SEQ ID NO: 158042 - protein, 31 aa, Artificial Sequence
  Description of Artificial Sequence: Synthetic polypeptide
DSEDIATTNPVATEQWGGCVAGEGHQRASGL

SEQ ID NO: 158043 - protein, 37 aa, Artificial Sequence
  Description of Artificial Sequence: Synthetic polypeptide
DEEEIRTTNPVAYEAWGHSTVSYTNALSHRPGGGQFC

SEQ ID NO: 158044 - protein, 34 aa, Artificial Sequence
  Description of Artificial Sequence: Synthetic polypeptide
DEQEIRTTNPVATECYGSTTSNTEDWEEHKGPYI

SEQ ID NO: 158045 - protein, 35 aa, Artificial Sequence
  Description of Artificial Sequence: Synthetic polypeptide
DEAEIRTTNPVATEQYGCVTALEDVQNVPEENDQD

SEQ ID NO: 158046 - protein, 32 aa, Artificial Sequence
  Description of Artificial Sequence: Synthetic polypeptide
DSEDIATTNPVATEQWGGCVAGEGHQQRVNAL

SEQ ID NO: 158047 - protein, 35 aa, Artificial Sequence
  Description of Artificial Sequence: Synthetic polypeptide
DESEICTTNPVATEQYGTVCSATDGEPSESEGGND

SEQ ID NO: 158048 - protein, 37 aa, Artificial Sequence
  Description of Artificial Sequence: Synthetic polypeptide
DEEEIRTTNPVATEQYGSVSPVMGSDVLHTAGGQSTT

SEQ ID NO: 158049 - protein, 34 aa, Artificial Sequence
  Description of Artificial Sequence: Synthetic polypeptide
DEQEIRTTNPVATECYGSTTSNTEDWEEHKGEYI

SEQ ID NO: 158050 - protein, 34 aa, Artificial Sequence
  Description of Artificial Sequence: Synthetic polypeptide
DEQEIRTTNPVATECYGSTTSNTEDWEDHKGEYI

SEQ ID NO: 158051 - protein, 36 aa, Artificial Sequence
  Description of Artificial Sequence: Synthetic polypeptide
DEQEIRTTNIFVATENQYWGPSPSTKWYSRKGLNDI

SEQ ID NO: 158052 - protein, 36 aa, Artificial Sequence
  Description of Artificial Sequence: Synthetic polypeptide
SEEEIRTTNPVATESYGSVMSNGGENLVDEGGDEQQ

SEQ ID NO: 158053 - protein, 36 aa, Artificial Sequence
  Description of Artificial Sequence: Synthetic polypeptide
CEEEIRTTNPVATEQYGDVVISDEMNDGQGGETVVT

SEQ ID NO: 158054 - protein, 36 aa, Artificial Sequence
  Description of Artificial Sequence: Synthetic polypeptide
DEEEIRSTNPVATESYGSVSNQNNMTIFGNTGNNQD

SEQ ID NO: 158055 - protein, 35 aa, Artificial Sequence
  Description of Artificial Sequence: Synthetic polypeptide
DSEEIRTTNPVAYEQWGQVTVPTGTLSQNTGTNQE

SEQ ID NO: 158056 - protein, 35 aa, Artificial Sequence
  Description of Artificial Sequence: Synthetic polypeptide
DDETIRTTNPVATEQYGAVVDVNEGQQRGQDDEGG

SEQ ID NO: 158057 - protein, 35 aa, Artificial Sequence
  Description of Artificial Sequence: Synthetic polypeptide
DEEAIRTTNPVATEQYGCVMHIIDNQVGGMQEGEA

SEQ ID NO: 158058 - protein, 36 aa, Artificial Sequence
  Description of Artificial Sequence: Synthetic polypeptide
DDETIRTTNPVATEQYGAVVDTQNEGQERGQDGEDN

SEQ ID NO: 158059 - protein, 36 aa, Artificial Sequence
  Description of Artificial Sequence: Synthetic polypeptide
SEEEIRTTNPVATESYGSVMSNGGENLVGEGQDQQQ

SEQ ID NO: 158060 - protein, 35 aa, Artificial Sequence
  Description of Artificial Sequence: Synthetic polypeptide
DEEAIRTTNPVATEQYGCVCSWGELNDNFGSQTQS

SEQ ID NO: 158061 - protein, 38 aa, Artificial Sequence
  Description of Artificial Sequence: Synthetic polypeptide
DEDEIRTTNPVATEQYGVVSTVNNNQQGNTEQGTTQDE

SEQ ID NO: 158062 - protein, 36 aa, Artificial Sequence
  Description of Artificial Sequence: Synthetic polypeptide
DEEEIRTTNPVAYESYGSVPATTPADPTTRTGGNPV

SEQ ID NO: 158063 - protein, 35 aa, Artificial Sequence
  Description of Artificial Sequence: Synthetic polypeptide
CEEEIRTTNPVATEQYGDVVNGQINDEQGGGGGEE

SEQ ID NO: 158064 - protein, 32 aa, Artificial Sequence
  Description of Artificial Sequence: Synthetic polypeptide
DEEEIRTTNPIATEQWGATAANAEDWAHGPYK

SEQ ID NO: 158065 - protein, 36 aa, Artificial Sequence
  Description of Artificial Sequence: Synthetic polypeptide
DDETIRTTNPVATEQYGAVVDPTVNEGQRGQDDEGG

SEQ ID NO: 158066 - protein, 33 aa, Artificial Sequence
  Description of Artificial Sequence: Synthetic polypeptide
DEAEIRATNCVAYDQYGSVSSTHADIPRGIDVP

SEQ ID NO: 158067 - protein, 35 aa, Artificial Sequence
  Description of Artificial Sequence: Synthetic polypeptide
DDETIRTTNPVATEQYGAVVDPQEEGQRGQNNEGG

SEQ ID NO: 158068 - protein, 39 aa, Artificial Sequence
  Description of Artificial Sequence: Synthetic polypeptide
AEEEIRTTNPVATEQYGVVSTNTANLQNGNTEQGNNNVE

SEQ ID NO: 158069 - protein, 37 aa, Artificial Sequence
  Description of Artificial Sequence: Synthetic polypeptide
DEEEIRTTNPVATEQYGSVPSFEDVFEGVRIMVEVQD

SEQ ID NO: 158070 - protein, 35 aa, Artificial Sequence
  Description of Artificial Sequence: Synthetic polypeptide
DEEEIRTTNPVATEEYGQCVCSWEHEENFGSDNQP

SEQ ID NO: 158071 - protein, 38 aa, Artificial Sequence
  Description of Artificial Sequence: Synthetic polypeptide
DEEEIRTTNPVATEAYGVVSVTVVTNNNDQQGTNQNED

SEQ ID NO: 158072 - protein, 38 aa, Artificial Sequence
  Description of Artificial Sequence: Synthetic polypeptide
DEEEIRTTNPVATEQYGVVSTVVVTQAGNNDTTEEENE

SEQ ID NO: 158073 - protein, 33 aa, Artificial Sequence
  Description of Artificial Sequence: Synthetic polypeptide
YEEEIATVNPVCTEQYGVVSDPNGPNMSNGMNQ

SEQ ID NO: 158074 - protein, 31 aa, Artificial Sequence
  Description of Artificial Sequence: Synthetic polypeptide
DDSEVATTNPVSTEGYGTVAATDTIQRVGQD

SEQ ID NO: 158075 - protein, 39 aa, Artificial Sequence
  Description of Artificial Sequence: Synthetic polypeptide
DEEEIRTTNPVATEQYGVVSTVVVTNQNQQQGTNTTNND

SEQ ID NO: 158076 - protein, 35 aa, Artificial Sequence
  Description of Artificial Sequence: Synthetic polypeptide
DEVEIATTNPVAYEQYGTVCSYTDGLNEEHRGDDS

SEQ ID NO: 158077 - protein, 34 aa, Artificial Sequence
  Description of Artificial Sequence: Synthetic polypeptide
DEAEIRTTNPVATEQYGCVWGDVHWLESEDSHRD

SEQ ID NO: 158078 - protein, 32 aa, Artificial Sequence
  Description of Artificial Sequence: Synthetic polypeptide
DENEIRTTNPVSMEPYGTISMEDIQQQQNGNH

SEQ ID NO: 158079 - protein, 37 aa, Artificial Sequence
  Description of Artificial Sequence: Synthetic polypeptide
DEGEIRTTNPVATEQYGSVCSESVPNNEQQMEVNLND

SEQ ID NO: 158080 - protein, 36 aa, Artificial Sequence
  Description of Artificial Sequence: Synthetic polypeptide
DECEICTTNPVATEQYGSVSTVVANQIGTTEEEEDD

SEQ ID NO: 158081 - protein, 36 aa, Artificial Sequence
  Description of Artificial Sequence: Synthetic polypeptide
DEEEIRTTNPVATEQYGMVSIEGMGPGGQGNEGEGT

SEQ ID NO: 158082 - protein, 35 aa, Artificial Sequence
  Description of Artificial Sequence: Synthetic polypeptide
DECEICTTNPVATEQYGSVSTVVANQGDTEEDEDD

SEQ ID NO: 158083 - protein, 37 aa, Artificial Sequence
  Description of Artificial Sequence: Synthetic polypeptide
DEENICTTNPVATEAYGVVSTVTNNNLQLQNGSNNED

SEQ ID NO: 158084 - protein, 36 aa, Artificial Sequence
  Description of Artificial Sequence: Synthetic polypeptide
DEEEIRTTNPVATEQWGDVSSTEPIGPMNRNEMNPV

SEQ ID NO: 158085 - protein, 34 aa, Artificial Sequence
  Description of Artificial Sequence: Synthetic polypeptide
DESEIRTTNPIATECWGSVWANAIDWPAEREGNG

SEQ ID NO: 158086 - protein, 34 aa, Artificial Sequence
  Description of Artificial Sequence: Synthetic polypeptide
AENEIACTNPVATEQYGCSCSSNLNQYFGSDTQS

SEQ ID NO: 158087 - protein, 34 aa, Artificial Sequence
  Description of Artificial Sequence: Synthetic polypeptide
DEAEIRTTNPVATEQYGCVVNTLWEQAEYDEIDN

SEQ ID NO: 158088 - protein, 37 aa, Artificial Sequence
  Description of Artificial Sequence: Synthetic polypeptide
DEAEIRTTNPVATEQYGCVVDYTIMLEELRNGNEEPF

SEQ ID NO: 158089 - protein, 31 aa, Artificial Sequence
  Description of Artificial Sequence: Synthetic polypeptide
DDSEVATTNPVSTEPYGTVAAMTIQQQNGQR

SEQ ID NO: 158090 - protein, 37 aa, Artificial Sequence
  Description of Artificial Sequence: Synthetic polypeptide
DEGEIRTTNPVATEQYGSVCSEEWPLNEEMMEDNIRE

SEQ ID NO: 158091 - protein, 36 aa, Artificial Sequence
  Description of Artificial Sequence: Synthetic polypeptide
DEEEIRTTNPVAYEEWGCSVPCTNTSFSQSGEGNSA

SEQ ID NO: 158092 - protein, 38 aa, Artificial Sequence
  Description of Artificial Sequence: Synthetic polypeptide
DEEEIRTTNPVATEQYGVVSTVVVTQAGNNDTNEENEN

SEQ ID NO: 158093 - protein, 37 aa, Artificial Sequence
  Description of Artificial Sequence: Synthetic polypeptide
DEGEIRTTNPVATEQYGSVCSPEVPSNEQQMEENLND

SEQ ID NO: 158094 - protein, 37 aa, Artificial Sequence
  Description of Artificial Sequence: Synthetic polypeptide
DEEEIRTTNPVATEQYGSVQPPHYTEPQEEVGPLIVW

SEQ ID NO: 158095 - protein, 30 aa, Artificial Sequence
  Description of Artificial Sequence: Synthetic polypeptide
DDNEVASTNPVSTEPYGNIAMTIQSRVGNR

SEQ ID NO: 158096 - protein, 37 aa, Artificial Sequence
  Description of Artificial Sequence: Synthetic polypeptide
DEVEIATTNPVAYEQYGTVCSYTDGLNEEMQRGPNET

SEQ ID NO: 158097 - protein, 34 aa, Artificial Sequence
  Description of Artificial Sequence: Synthetic polypeptide
DEAEIRTTNPVATEQYGCVWSDHWLETTTEDSID

SEQ ID NO: 158098 - protein, 33 aa, Artificial Sequence
  Description of Artificial Sequence: Synthetic polypeptide
DEQEIRTTNPVATECWGSTWANTDLADHEGPDL

SEQ ID NO: 158099 - protein, 34 aa, Artificial Sequence
  Description of Artificial Sequence: Synthetic polypeptide
DEEAISTTNPVATEQYGCVCSWEHNAENFNSDQS

SEQ ID NO: 158100 - protein, 37 aa, Artificial Sequence
  Description of Artificial Sequence: Synthetic polypeptide
DEENICTTNPVATEAYGVVSTTVNNLQQLQQGTNQED

SEQ ID NO: 158101 - protein, 38 aa, Artificial Sequence
  Description of Artificial Sequence: Synthetic polypeptide
DEEEIRTTNPVATEQYGVVSTVVVTQAGNNDTEETEDT

SEQ ID NO: 158102 - protein, 38 aa, Artificial Sequence
  Description of Artificial Sequence: Synthetic polypeptide
DEEEIRTTNPVATEQYGVVSTVVVTQAGNNDTEETGAT

SEQ ID NO: 158103 - protein, 35 aa, Artificial Sequence
  Description of Artificial Sequence: Synthetic polypeptide
DSEEIRTTNPVATEQYGSVRPFDAEDENFEGSNQH

SEQ ID NO: 158104 - protein, 38 aa, Artificial Sequence
  Description of Artificial Sequence: Synthetic polypeptide
DEEEIRTTNPVAYEQYGYSVSPSVNDELFVRVNEPLVD

SEQ ID NO: 158105 - protein, 34 aa, Artificial Sequence
  Description of Artificial Sequence: Synthetic polypeptide
AENEIACTNPVATEQYGCSCSWALNQHFGSDNQA

SEQ ID NO: 158106 - protein, 38 aa, Artificial Sequence
  Description of Artificial Sequence: Synthetic polypeptide
AEEEIRTTNPVATEQYGSVVVTVTNNQLGNNEQGSNDE

SEQ ID NO: 158107 - protein, 35 aa, Artificial Sequence
  Description of Artificial Sequence: Synthetic polypeptide
DEEEIATTNPVATEQYGSVCAAMHLQAMAPEDDHH

SEQ ID NO: 158108 - protein, 34 aa, Artificial Sequence
  Description of Artificial Sequence: Synthetic polypeptide
NEDEIATTNPVATEMWGSVCYTNDHQDQGGQNDK

SEQ ID NO: 158109 - protein, 35 aa, Artificial Sequence
  Description of Artificial Sequence: Synthetic polypeptide
DEHEIRTTNPVAYERWGEVCSTTDNDQNRQNNGSP

SEQ ID NO: 158110 - protein, 31 aa, Artificial Sequence
  Description of Artificial Sequence: Synthetic polypeptide
DDSEVATTNPVSTEGYGTVCSANTIEFVGQR

SEQ ID NO: 158111 - protein, 36 aa, Artificial Sequence
  Description of Artificial Sequence: Synthetic polypeptide
DEENICTTNPVATEAYGVVSTVTNLQQLQTGEEDED

SEQ ID NO: 158112 - protein, 32 aa, Artificial Sequence
  Description of Artificial Sequence: Synthetic polypeptide
DENEIRTTNPVATEQWGVVDNEIEEMNAAEDG

SEQ ID NO: 158113 - protein, 37 aa, Artificial Sequence
  Description of Artificial Sequence: Synthetic polypeptide
DEENICTTNPVATEAYGVVSTVTNNLQQLQIGNDTED

SEQ ID NO: 158114 - protein, 34 aa, Artificial Sequence
  Description of Artificial Sequence: Synthetic polypeptide
AENEIACTNPVATEQYGCSCSSNLNQENFGSDQA

SEQ ID NO: 158115 - protein, 36 aa, Artificial Sequence
  Description of Artificial Sequence: Synthetic polypeptide
DEGEIRTTNPVATEQYGSVCSEEWPLEEEMMEDNTD

SEQ ID NO: 158116 - protein, 31 aa, Artificial Sequence
  Description of Artificial Sequence: Synthetic polypeptide
DENEIASTNPVATEGWGDVAANTIQSAAGDA

SEQ ID NO: 158117 - protein, 35 aa, Artificial Sequence
  Description of Artificial Sequence: Synthetic polypeptide
CEEEIRTTNPVATEQYGDVSIDGMGENGNIDEGEM

SEQ ID NO: 158118 - protein, 34 aa, Artificial Sequence
  Description of Artificial Sequence: Synthetic polypeptide
DEEAISTTNPVATEQYGCVCSWGEHQNFNSETDA

SEQ ID NO: 158119 - protein, 37 aa, Artificial Sequence
  Description of Artificial Sequence: Synthetic polypeptide
DEENICTTNPVATEAYGVVSTVTTNLQQNQNGSNNED

SEQ ID NO: 158120 - protein, 35 aa, Artificial Sequence
  Description of Artificial Sequence: Synthetic polypeptide
AEDEICATNPVATEQYGVVATNNENLQQLGNGEDD

SEQ ID NO: 158121 - protein, 35 aa, Artificial Sequence
  Description of Artificial Sequence: Synthetic polypeptide
DEEAISTTNPVATEQYGCVCSWGELHQNFNSDTQA

SEQ ID NO: 158122 - protein, 34 aa, Artificial Sequence
  Description of Artificial Sequence: Synthetic polypeptide
DENEIATTNPVATEQYGSVANMNNDEATANPNEA

SEQ ID NO: 158123 - protein, 31 aa, Artificial Sequence
  Description of Artificial Sequence: Synthetic polypeptide
SEEEIRCTNPIAYEQYGCVCSWEHANFGSDQ

SEQ ID NO: 158124 - protein, 32 aa, Artificial Sequence
  Description of Artificial Sequence: Synthetic polypeptide
AEDEIATTNPVAYEQWGSVCGDSGGWQGNNQH

SEQ ID NO: 158125 - protein, 35 aa, Artificial Sequence
  Description of Artificial Sequence: Synthetic polypeptide
DEEEIRTTNPVAYEAYGKVVHCTNMHAGTPGNNGF

SEQ ID NO: 158126 - protein, 34 aa, Artificial Sequence
  Description of Artificial Sequence: Synthetic polypeptide
DSEEIRTTNPVAYEQYGITTPSTAEHSNKGGNNA

SEQ ID NO: 158127 - protein, 36 aa, Artificial Sequence
  Description of Artificial Sequence: Synthetic polypeptide
DEGEIRTTNPVATEQYGSVCSEEVMSQEQQMENLND

SEQ ID NO: 158128 - protein, 30 aa, Artificial Sequence
  Description of Artificial Sequence: Synthetic polypeptide
QEQEIAPTNPCSYEQWGIVSCNWQSGGDTR

SEQ ID NO: 158129 - protein, 36 aa, Artificial Sequence
  Description of Artificial Sequence: Synthetic polypeptide
QEEEIRTTNPVATEQYGSVMGVGNNQINDGGGEDGF

SEQ ID NO: 158130 - protein, 35 aa, Artificial Sequence
  Description of Artificial Sequence: Synthetic polypeptide
DEEEIRTTNPVATEQYGMVSIMDGEIDEGGGEQGI

SEQ ID NO: 158131 - protein, 37 aa, Artificial Sequence
  Description of Artificial Sequence: Synthetic polypeptide
DEEEIRTTNPVATEQYGSVPSEWMILPEGDQMELLPM

SEQ ID NO: 158132 - protein, 34 aa, Artificial Sequence
  Description of Artificial Sequence: Synthetic polypeptide
DESEIRTTNPIATECWGSVWSAIDWPAEREGENG

SEQ ID NO: 158133 - protein, 36 aa, Artificial Sequence
  Description of Artificial Sequence: Synthetic polypeptide
DEEEIRTTNPVATEQYGMVSIMDGEMQEGDGGEGME

SEQ ID NO: 158134 - protein, 34 aa, Artificial Sequence
  Description of Artificial Sequence: Synthetic polypeptide
DESEICTTNPVAYEQWGSCVYSDEWNDGQRSQGS

SEQ ID NO: 158135 - protein, 34 aa, Artificial Sequence
  Description of Artificial Sequence: Synthetic polypeptide
DDFEIRTTNPVATEQYGSVIWAPNVTLEGIEDEF

SEQ ID NO: 158136 - protein, 33 aa, Artificial Sequence
  Description of Artificial Sequence: Synthetic polypeptide
DESEICTTNPVAYEQWGEVATNDGNQGQAGMAT

SEQ ID NO: 158137 - protein, 34 aa, Artificial Sequence
  Description of Artificial Sequence: Synthetic polypeptide
DESEIRTTNPIATECWGSVWANAIDWPAERKGNG

SEQ ID NO: 158138 - protein, 34 aa, Artificial Sequence
  Description of Artificial Sequence: Synthetic polypeptide
NEEEIACTNPVATEQYGSCPATHLEAPDDQMGEH

SEQ ID NO: 158139 - protein, 34 aa, Artificial Sequence
  Description of Artificial Sequence: Synthetic polypeptide
AENEIACTNPVATEQYGCSCSSENLNQNFGSDQS

SEQ ID NO: 158140 - protein, 36 aa, Artificial Sequence
  Description of Artificial Sequence: Synthetic polypeptide
DEAEIRTTNPVATEQYGCVTLTEDVQGVPEEGNDQG

SEQ ID NO: 158141 - protein, 36 aa, Artificial Sequence
  Description of Artificial Sequence: Synthetic polypeptide
DEVEIATTNPVAYEQYGTVCSYTDGIVEGQRGNGNS

SEQ ID NO: 158142 - protein, 34 aa, Artificial Sequence
  Description of Artificial Sequence: Synthetic polypeptide
DEEEIATTNPVATEQYGSVCAAMHLNAMAPDDHP

SEQ ID NO: 158143 - protein, 34 aa, Artificial Sequence
  Description of Artificial Sequence: Synthetic polypeptide
AENEIACTNPVATEQYGCSCSSNHNQNFGSDNQS

SEQ ID NO: 158144 - protein, 38 aa, Artificial Sequence
  Description of Artificial Sequence: Synthetic polypeptide
DEEEIRTTNPVATEQYGSVTSLCPNLENVSRVAPMDED

SEQ ID NO: 158145 - protein, 30 aa, Artificial Sequence
  Description of Artificial Sequence: Synthetic polypeptide
DDNEVRSTNPVATEQWGNVANTEQNAAEDR

SEQ ID NO: 158146 - protein, 39 aa, Artificial Sequence
  Description of Artificial Sequence: Synthetic polypeptide
AEEEIRTTNPVATEQYGSVVVTVTNNQLQNSEQGTNDEE

SEQ ID NO: 158147 - protein, 33 aa, Artificial Sequence
  Description of Artificial Sequence: Synthetic polypeptide
AENEIACTNPVATEQYGCSCSSNDNQHFGSDQS

SEQ ID NO: 158148 - protein, 35 aa, Artificial Sequence
  Description of Artificial Sequence: Synthetic polypeptide
AEDEICATNPVATEQYGVVATNLENLLQLGNGTDD

SEQ ID NO: 158149 - protein, 35 aa, Artificial Sequence
  Description of Artificial Sequence: Synthetic polypeptide
DEMEIATTNPVAYECWGSVCSGTDNHDRDGEQGER

SEQ ID NO: 158150 - protein, 36 aa, Artificial Sequence
  Description of Artificial Sequence: Synthetic polypeptide
DEAEIRTTNPVATEQYGCVTPTEDVQNGPEEKNDQY

SEQ ID NO: 158151 - protein, 35 aa, Artificial Sequence
  Description of Artificial Sequence: Synthetic polypeptide
AEDEICATNPVATEQYGVVATNNDNLEQLGNGNDD

SEQ ID NO: 158152 - protein, 33 aa, Artificial Sequence
  Description of Artificial Sequence: Synthetic polypeptide
DEQEIRTTNPVATECWGSTWANTDLADHKGPDI

SEQ ID NO: 158153 - protein, 31 aa, Artificial Sequence
  Description of Artificial Sequence: Synthetic polypeptide
DDSEVASTNPVSTEGYGNVAANTIQSRVGVR

SEQ ID NO: 158154 - protein, 39 aa, Artificial Sequence
  Description of Artificial Sequence: Synthetic polypeptide
DEEEIRTTNPVATEQYGVVSTVVVTNQNQQQGTNTEDEE

SEQ ID NO: 158155 - protein, 36 aa, Artificial Sequence
  Description of Artificial Sequence: Synthetic polypeptide
DEENICTTNPVATEAYGVVSTVTNTQQLQQGTDEED

SEQ ID NO: 158156 - protein, 33 aa, Artificial Sequence
  Description of Artificial Sequence: Synthetic polypeptide
AENEIACTNPVATEQYGCSCSSGELQNFGSGQA

SEQ ID NO: 158157 - protein, 36 aa, Artificial Sequence
  Description of Artificial Sequence: Synthetic polypeptide
DSEEIRTTNPVATEQYGWVAPFDAENLENFEGSNQH

SEQ ID NO: 158158 - protein, 34 aa, Artificial Sequence
  Description of Artificial Sequence: Synthetic polypeptide
DEAEIRTTNPVATEQYGCVTLVEDVLNPEENVQY

SEQ ID NO: 158159 - protein, 31 aa, Artificial Sequence
  Description of Artificial Sequence: Synthetic polypeptide
DDSEVATTNPVSTEPYGTVAAMTIQSQNGQR

SEQ ID NO: 158160 - protein, 35 aa, Artificial Sequence
  Description of Artificial Sequence: Synthetic polypeptide
DENEIATTNPVATEQYGSVANANDTPAGDPMDNAE

SEQ ID NO: 158161 - protein, 35 aa, Artificial Sequence
  Description of Artificial Sequence: Synthetic polypeptide
DEVEIATTNPVAYEQYGTVATQNGGQQNGGDRGEA

SEQ ID NO: 158162 - protein, 37 aa, Artificial Sequence
  Description of Artificial Sequence: Synthetic polypeptide
DEEEIRTTNPVATEQYGSVQPNENYLLMMTEHVEQND

SEQ ID NO: 158163 - protein, 34 aa, Artificial Sequence
  Description of Artificial Sequence: Synthetic polypeptide
DEQEIRTTNPVATECYGSTTWAATDLADHKGPDI

SEQ ID NO: 158164 - protein, 33 aa, Artificial Sequence
  Description of Artificial Sequence: Synthetic polypeptide
DENEIRTTNPVSTEAYGCISWEDINQEQFGSQQ

SEQ ID NO: 158165 - protein, 36 aa, Artificial Sequence
  Description of Artificial Sequence: Synthetic polypeptide
QEEEIRTTNPVATEQYGSVNQTDQNDEGEEGGFGEN

SEQ ID NO: 158166 - protein, 36 aa, Artificial Sequence
  Description of Artificial Sequence: Synthetic polypeptide
DENEIATTNPVATEQYGSVCAAANDGPLDSGEGENH

SEQ ID NO: 158167 - protein, 33 aa, Artificial Sequence
  Description of Artificial Sequence: Synthetic polypeptide
DSEEIRTTNPVGTEQWGCVCSWEHQEHFGSVQS

SEQ ID NO: 158168 - protein, 28 aa, Artificial Sequence
  Description of Artificial Sequence: Synthetic peptide
QEPEIATTNPVAYEQMGEAPEVCQHLEK

SEQ ID NO: 158169 - protein, 36 aa, Artificial Sequence
  Description of Artificial Sequence: Synthetic polypeptide
DEEEIRTTNPVATEQYGSVTPTVGTSQMQAAAFDEE

SEQ ID NO: 158170 - protein, 36 aa, Artificial Sequence
  Description of Artificial Sequence: Synthetic polypeptide
DSDEIATTNPLATEQWGQSVPSCTAELQVGTGTNRH

SEQ ID NO: 158171 - protein, 34 aa, Artificial Sequence
  Description of Artificial Sequence: Synthetic polypeptide
NEGEIRTTNPVATGHYGSVSDVLENLDTEGTIDM

SEQ ID NO: 158172 - protein, 36 aa, Artificial Sequence
  Description of Artificial Sequence: Synthetic polypeptide
DEEEIRSTNPVATEQYGNVVDTMNIGGQGGQEEDQG

SEQ ID NO: 158173 - protein, 33 aa, Artificial Sequence
  Description of Artificial Sequence: Synthetic polypeptide
DEVEIATTNPVAYEQYGSVAAGANNEQDATLTD

SEQ ID NO: 158174 - protein, 36 aa, Artificial Sequence
  Description of Artificial Sequence: Synthetic polypeptide
DENEIATTNPVATEQYGSVCAAANNGPLDSGEGENN

SEQ ID NO: 158175 - protein, 37 aa, Artificial Sequence
  Description of Artificial Sequence: Synthetic polypeptide
DEEEIRTTNPVATEFYGMVGSGNMNNNQDINFGNNEE

SEQ ID NO: 158176 - protein, 31 aa, Artificial Sequence
  Description of Artificial Sequence: Synthetic polypeptide
DESEIRTTNPIATECYGATAAEDWQHKGPYI

SEQ ID NO: 158177 - protein, 34 aa, Artificial Sequence
  Description of Artificial Sequence: Synthetic polypeptide
DEEEISTTNPVATEQYGQCVCSWPHNINFNSEQS

SEQ ID NO: 158178 - protein, 32 aa, Artificial Sequence
  Description of Artificial Sequence: Synthetic polypeptide
NEEEIASVNPVCTEQWGCVVCSDNGIQSGMNQ

SEQ ID NO: 158179 - protein, 35 aa, Artificial Sequence
  Description of Artificial Sequence: Synthetic polypeptide
DEVEIATTNPVAYEQYGSTVCQAANVLQEAEANDS

SEQ ID NO: 158180 - protein, 36 aa, Artificial Sequence
  Description of Artificial Sequence: Synthetic polypeptide
DEEEIRTTNPVATEQYGSIGEPINFTDNAQAPIQVL

SEQ ID NO: 158181 - protein, 36 aa, Artificial Sequence
  Description of Artificial Sequence: Synthetic polypeptide
DEVEIATTNPVAYEQYGSTVCAANDGQDSKDGNMRD

SEQ ID NO: 158182 - protein, 34 aa, Artificial Sequence
  Description of Artificial Sequence: Synthetic polypeptide
DSEEIRTTNPVGTEQWGCVCSWGEDLQNFGSVQA

SEQ ID NO: 158183 - protein, 36 aa, Artificial Sequence
  Description of Artificial Sequence: Synthetic polypeptide
DENEIATTNPVATEQYGSVCAAANNLPLDSGEGTNE

SEQ ID NO: 158184 - protein, 38 aa, Artificial Sequence
  Description of Artificial Sequence: Synthetic polypeptide
DEEEIRSTNPVATEQYGQVSTMTVNGGPTGQGGNDDGD

SEQ ID NO: 158185 - protein, 29 aa, Artificial Sequence
  Description of Artificial Sequence: Synthetic peptide
QESEIASTNPVATEGWGVMAETLQNAGDI

SEQ ID NO: 158186 - protein, 30 aa, Artificial Sequence
  Description of Artificial Sequence: Synthetic polypeptide
DENEIAPTNPCSSEQWGIVSCIEQNSAGTR

SEQ ID NO: 158187 - protein, 36 aa, Artificial Sequence
  Description of Artificial Sequence: Synthetic polypeptide
DEEEIRSTNPVATEQYGSVDNTMNFNGEFTGGTDGQ

SEQ ID NO: 158188 - protein, 37 aa, Artificial Sequence
  Description of Artificial Sequence: Synthetic polypeptide
AEEEIRTTNPVATEQYGTVVVVVTTNNNNQEQGENVD

SEQ ID NO: 158189 - protein, 32 aa, Artificial Sequence
  Description of Artificial Sequence: Synthetic polypeptide
CEHEIATTNPVAYEPYGKTVSQNHLSQHETEL

SEQ ID NO: 158190 - protein, 35 aa, Artificial Sequence
  Description of Artificial Sequence: Synthetic polypeptide
CEHCIRTTNPVATEQYGSVVVNCINMGSDSRPGND

SEQ ID NO: 158191 - protein, 39 aa, Artificial Sequence
  Description of Artificial Sequence: Synthetic polypeptide
DEEEIRTTNPVATEQYGVVSTTVGNQLQQGTEQGTTDTE

SEQ ID NO: 158192 - protein, 37 aa, Artificial Sequence
  Description of Artificial Sequence: Synthetic polypeptide
DEEEIRTTNPVATEQYGSVPPVAQMVWVENVEPEQRD

SEQ ID NO: 158193 - protein, 32 aa, Artificial Sequence
  Description of Artificial Sequence: Synthetic polypeptide
DENEIRTTNPVAYEQWGYCQEDQKRGMDRQGP

SEQ ID NO: 158194 - protein, 32 aa, Artificial Sequence
  Description of Artificial Sequence: Synthetic polypeptide
DENEIRTTNPVATEQWGTDVSAEIEMNAAEDA

SEQ ID NO: 158195 - protein, 37 aa, Artificial Sequence
  Description of Artificial Sequence: Synthetic polypeptide
DEEEIRTTNPVATEQYGSVPPVAQMVKVEGVEPEQNE

SEQ ID NO: 158196 - protein, 35 aa, Artificial Sequence
  Description of Artificial Sequence: Synthetic polypeptide
QEEEIRTTNPVATEQYGSVNQDNMIETGGGQEQGL

SEQ ID NO: 158197 - protein, 34 aa, Artificial Sequence
  Description of Artificial Sequence: Synthetic polypeptide
DEEEIATTNPVATEQYGSVCAAMGEEPADEQNNP

SEQ ID NO: 158198 - protein, 35 aa, Artificial Sequence
  Description of Artificial Sequence: Synthetic polypeptide
DEVEICTTNPVATEQYGTVVSTTDGDDEEGEGNGD

SEQ ID NO: 158199 - protein, 38 aa, Artificial Sequence
  Description of Artificial Sequence: Synthetic polypeptide
DEEEIRTTNPVATEQYGSVPPVAQMVKGENGVEPEQRD

SEQ ID NO: 158200 - protein, 32 aa, Artificial Sequence
  Description of Artificial Sequence: Synthetic polypeptide
AENEIATTNPVATEAYGCVCSWEDQHFNSELA

SEQ ID NO: 158201 - protein, 37 aa, Artificial Sequence
  Description of Artificial Sequence: Synthetic polypeptide
DEEEIRTTNPVATEQYGSYMENTSVQEINLVHENLGT

SEQ ID NO: 158202 - protein, 32 aa, Artificial Sequence
  Description of Artificial Sequence: Synthetic polypeptide
AENEIATTNPVATEAYGCVCSWELNQHFSSEL

SEQ ID NO: 158203 - protein, 35 aa, Artificial Sequence
  Description of Artificial Sequence: Synthetic polypeptide
DENEIRTTNPVATEQYGCVPPPIELLQANGQEPHI

SEQ ID NO: 158204 - protein, 37 aa, Artificial Sequence
  Description of Artificial Sequence: Synthetic polypeptide
QEEEIRTTNPVATEQYGSVNNTNFGQGQNEQGEGEDE

SEQ ID NO: 158205 - protein, 37 aa, Artificial Sequence
  Description of Artificial Sequence: Synthetic polypeptide
DEEEIRTTNPVAYEYWGQKTVSYTNALSHDRPGDNFV

SEQ ID NO: 158206 - protein, 37 aa, Artificial Sequence
  Description of Artificial Sequence: Synthetic polypeptide
AEEEIRTTNPVATEQYGTVVVVVTNNNQEQGEGNNDE

SEQ ID NO: 158207 - protein, 37 aa, Artificial Sequence
  Description of Artificial Sequence: Synthetic polypeptide
QEEEIRTTNPVATEQYGSVNSSTPEGPEMGQGENEEG

SEQ ID NO: 158208 - protein, 34 aa, Artificial Sequence
  Description of Artificial Sequence: Synthetic polypeptide
DEVEIATTNPVAYEQWGVVVPTENDGNENGENNR

SEQ ID NO: 158209 - protein, 34 aa, Artificial Sequence
  Description of Artificial Sequence: Synthetic polypeptide
DENEIATTNPVATEQYGCVAATPHPDTDSENNRQ

SEQ ID NO: 158210 - protein, 37 aa, Artificial Sequence
  Description of Artificial Sequence: Synthetic polypeptide
QEEEIRTTNPVATEQYGSVNSTAPTGPEMGQGENEET

SEQ ID NO: 158211 - protein, 34 aa, Artificial Sequence
  Description of Artificial Sequence: Synthetic polypeptide
DEMEIATTNPVAYEQYGTVCSATDGPIEHHEGND

SEQ ID NO: 158212 - protein, 32 aa, Artificial Sequence
  Description of Artificial Sequence: Synthetic polypeptide
CEEEIACTNPVATAQWGSVSAGGPDEADGGRF

SEQ ID NO: 158213 - protein, 33 aa, Artificial Sequence
  Description of Artificial Sequence: Synthetic polypeptide
SEEEIRCTNPTAYEQWGCVWGENDDEHRDGHNR

SEQ ID NO: 158214 - protein, 38 aa, Artificial Sequence
  Description of Artificial Sequence: Synthetic polypeptide
DEEEIRTTNPVATEQYGSVQSTDPSTMDEPQQEQNDEL

SEQ ID NO: 158215 - protein, 38 aa, Artificial Sequence
  Description of Artificial Sequence: Synthetic polypeptide
DEEEIRTTNPVATEQYGVVSTVVTNQNNQEDEENEEED

SEQ ID NO: 158216 - protein, 34 aa, Artificial Sequence
  Description of Artificial Sequence: Synthetic polypeptide
DENEIATTNPVATEQYGSVCAADNGDEDGMDIIH

SEQ ID NO: 158217 - protein, 37 aa, Artificial Sequence
  Description of Artificial Sequence: Synthetic polypeptide
DEEEIRTTNPVATEQYGSVPPVAQMVDVEGVEMEQRD

SEQ ID NO: 158218 - protein, 35 aa, Artificial Sequence
  Description of Artificial Sequence: Synthetic polypeptide
DEEEIRTTNPIATEQYGATWATAEAWAERNGMNYI

SEQ ID NO: 158219 - protein, 32 aa, Artificial Sequence
  Description of Artificial Sequence: Synthetic polypeptide
DENEIRTTNPVAYEQWGVVSWIEEMRALEDGA

SEQ ID NO: 158220 - protein, 32 aa, Artificial Sequence
  Description of Artificial Sequence: Synthetic polypeptide
DESEIRTTNPIATEGYGATTWANATLAEPGDI

SEQ ID NO: 158221 - protein, 35 aa, Artificial Sequence
  Description of Artificial Sequence: Synthetic polypeptide
DENEIRTTNPVATEQYGCVSQTEDAMEIPQGMIQN

SEQ ID NO: 158222 - protein, 35 aa, Artificial Sequence
  Description of Artificial Sequence: Synthetic polypeptide
DENEIATTNPVATEQYGSVCAADNGDEQGMDIDHR

SEQ ID NO: 158223 - protein, 32 aa, Artificial Sequence
  Description of Artificial Sequence: Synthetic polypeptide
CEEEIACTNPVATAQWGSVSAGGPDEAGENEN

SEQ ID NO: 158224 - protein, 37 aa, Artificial Sequence
  Description of Artificial Sequence: Synthetic polypeptide
DDEEIRTTNPVATDQYGSVSVNNLQSDEQDEGGDDET

SEQ ID NO: 158225 - protein, 32 aa, Artificial Sequence
  Description of Artificial Sequence: Synthetic polypeptide
DENEIACTNPVSTEPYGTASMENIQQQQNGNH

SEQ ID NO: 158226 - protein, 33 aa, Artificial Sequence
  Description of Artificial Sequence: Synthetic polypeptide
SEEEIRCTNPTAYEQWGCVWGENDMHRDGNGRN

SEQ ID NO: 158227 - protein, 35 aa, Artificial Sequence
  Description of Artificial Sequence: Synthetic polypeptide
DEEAIRTTNPVATEQYGCVCGNTGEHNQNFGSEQG

SEQ ID NO: 158228 - protein, 35 aa, Artificial Sequence
  Description of Artificial Sequence: Synthetic polypeptide
DENEIATTNPVATEQYGSVCAADNGDEDGMDIDRS

SEQ ID NO: 158229 - protein, 35 aa, Artificial Sequence
  Description of Artificial Sequence: Synthetic polypeptide
DENEIATTNPVATEQYGSVCAADNGDEAGMDINNP

SEQ ID NO: 158230 - protein, 33 aa, Artificial Sequence
  Description of Artificial Sequence: Synthetic polypeptide
SEEEIRCTNPTAYECWGSTVYGENDMHRGDNQR

SEQ ID NO: 158231 - protein, 37 aa, Artificial Sequence
  Description of Artificial Sequence: Synthetic polypeptide
DEEEIRTTNPVATEQYGCVSNMDNGGGQEENDEGQDT

SEQ ID NO: 158232 - protein, 34 aa, Artificial Sequence
  Description of Artificial Sequence: Synthetic polypeptide
DEEEIACTNPVATEQYGSACAATGEANDDGGTWM

SEQ ID NO: 158233 - protein, 31 aa, Artificial Sequence
  Description of Artificial Sequence: Synthetic polypeptide
DDSEIRSTNPVSTEGYGTVAMEDIQQQNGQR

SEQ ID NO: 158234 - protein, 36 aa, Artificial Sequence
  Description of Artificial Sequence: Synthetic polypeptide
DEEEIRTTNPVATEQYGSYMGAMQGNEQALTQADQG

SEQ ID NO: 158235 - protein, 32 aa, Artificial Sequence
  Description of Artificial Sequence: Synthetic polypeptide
DENEIRTTNPVSTEAYGTISMEDIQQQQNWNH

SEQ ID NO: 158236 - protein, 34 aa, Artificial Sequence
  Description of Artificial Sequence: Synthetic polypeptide
DEADEIATTNPVAYEQWGSVTGINGNQGGTNGPN

SEQ ID NO: 158237 - protein, 35 aa, Artificial Sequence
  Description of Artificial Sequence: Synthetic polypeptide
DEEEIACTNPVATEQYGSACAATGLAPGEQMEGLH

SEQ ID NO: 158238 - protein, 31 aa, Artificial Sequence
  Description of Artificial Sequence: Synthetic polypeptide
CEEEIACTNPVATAQWGSVAAGGPDEAGNPN

SEQ ID NO: 158239 - protein, 32 aa, Artificial Sequence
  Description of Artificial Sequence: Synthetic polypeptide
AENEIATTNPVATEAYGCVCSWELQHESETLA

SEQ ID NO: 158240 - protein, 35 aa, Artificial Sequence
  Description of Artificial Sequence: Synthetic polypeptide
DENEIATTNPVATEQYGSVCAAANPGLPLDSEGEN

SEQ ID NO: 158241 - protein, 35 aa, Artificial Sequence
  Description of Artificial Sequence: Synthetic polypeptide
DSEEIRTTNPVGTEQWGEVCVSATINLGEREVQQV

SEQ ID NO: 158242 - protein, 34 aa, Artificial Sequence
  Description of Artificial Sequence: Synthetic polypeptide
NEGEIRTTNPVATGHYGSVSDVLNMLNTEGTIDM

SEQ ID NO: 158243 - protein, 33 aa, Artificial Sequence
  Description of Artificial Sequence: Synthetic polypeptide
DSEEIRTTNPVGTEQWGEVCVSMINSGEREVQQ

SEQ ID NO: 158244 - protein, 35 aa, Artificial Sequence
  Description of Artificial Sequence: Synthetic polypeptide
DENEIATTNPVATEQYGSVCAAANPLPLDSGETDN

SEQ ID NO: 158245 - protein, 35 aa, Artificial Sequence
  Description of Artificial Sequence: Synthetic polypeptide
DENEIATTNPVATEQYGSVCAAANYLPLDSEGTEN

SEQ ID NO: 158246 - protein, 32 aa, Artificial Sequence
  Description of Artificial Sequence: Synthetic polypeptide
DENEIACTNPVSTEPYGTISMENIQQQQNGNH

SEQ ID NO: 158247 - protein, 35 aa, Artificial Sequence
  Description of Artificial Sequence: Synthetic polypeptide
DEEEIACTNPVATEQYGSACAATGLAPGEQMEHRA

SEQ ID NO: 158248 - protein, 36 aa, Artificial Sequence
  Description of Artificial Sequence: Synthetic polypeptide
AEEEIRTTNPVATEQYGTVVVVVTNNNQEQGEEEDD

SEQ ID NO: 158249 - protein, 32 aa, Artificial Sequence
  Description of Artificial Sequence: Synthetic polypeptide
DENEIRTTNPVATEQWGTDVSVEIEMNAAEDA

SEQ ID NO: 158250 - protein, 35 aa, Artificial Sequence
  Description of Artificial Sequence: Synthetic polypeptide
DSEEIRTTNPVGTEQWGCVCSTGNHNQENFGSDQA

SEQ ID NO: 158251 - protein, 36 aa, Artificial Sequence
  Description of Artificial Sequence: Synthetic polypeptide
DEEEISTTNPVATEQYGQCVCSWGEHNQNFGSDNQA

SEQ ID NO: 158252 - protein, 32 aa, Artificial Sequence
  Description of Artificial Sequence: Synthetic polypeptide
DEEEIRTTNPIATECWGATTWAEEDWARGNYI

SEQ ID NO: 158253 - protein, 31 aa, Artificial Sequence
  Description of Artificial Sequence: Synthetic polypeptide
DDSEVASTNPVSTEGYGNVAANTIQSRYGQR

SEQ ID NO: 158254 - protein, 31 aa, Artificial Sequence
  Description of Artificial Sequence: Synthetic polypeptide
DDSEVASTNPVSTEGYGNVAANTIQSRYGSR

SEQ ID NO: 158255 - protein, 34 aa, Artificial Sequence
  Description of Artificial Sequence: Synthetic polypeptide
DEMEIATTNPVAYEQYGTVCSATDGPDEHEGGNS

SEQ ID NO: 158256 - protein, 31 aa, Artificial Sequence
  Description of Artificial Sequence: Synthetic polypeptide
DDSEVATTNPVSTEGYGNVSATTLESHEGQL

SEQ ID NO: 158257 - protein, 32 aa, Artificial Sequence
  Description of Artificial Sequence: Synthetic polypeptide
DSEDIATTNPVATAQWGCVAGTMHQRDSNNNM

SEQ ID NO: 158258 - protein, 36 aa, Artificial Sequence
  Description of Artificial Sequence: Synthetic polypeptide
DEEEIATTNPVATEQYGSVCAAMNHDQAMAPNNDHH

SEQ ID NO: 158259 - protein, 37 aa, Artificial Sequence
  Description of Artificial Sequence: Synthetic polypeptide
SEEEIRTTNPVATEQYGSYGSVTTGDNGLGGENEGIQ

SEQ ID NO: 158260 - protein, 32 aa, Artificial Sequence
  Description of Artificial Sequence: Synthetic polypeptide
DENEIRTTNPVSTDPYGTISMEDIQPQQNGNH

SEQ ID NO: 158261 - protein, 32 aa, Artificial Sequence
  Description of Artificial Sequence: Synthetic polypeptide
DENEIRTTNPVSTDPYGQISMEDIQQQQNGNH

SEQ ID NO: 158262 - protein, 36 aa, Artificial Sequence
  Description of Artificial Sequence: Synthetic polypeptide
NEAEISTTNPVATEAWGSVCSKTNDDLDQRNTGDAA

SEQ ID NO: 158263 - protein, 33 aa, Artificial Sequence
  Description of Artificial Sequence: Synthetic polypeptide
DENEIRTTNPVATEQWGTVCSATIPVMNFEEDA

SEQ ID NO: 158264 - protein, 35 aa, Artificial Sequence
  Description of Artificial Sequence: Synthetic polypeptide
DECEICTTNPVATEQYGSVSTVTATNNEDTEEEDD

SEQ ID NO: 158265 - protein, 36 aa, Artificial Sequence
  Description of Artificial Sequence: Synthetic polypeptide
DDEEIRTTNPVATDQYGSVSVDQQGGEQENEGGNTN

SEQ ID NO: 158266 - protein, 32 aa, Artificial Sequence
  Description of Artificial Sequence: Synthetic polypeptide
DENEIRTTNPVSTDPYGTISMEDIQQQQDGNH

SEQ ID NO: 158267 - protein, 33 aa, Artificial Sequence
  Description of Artificial Sequence: Synthetic polypeptide
DENEIRTTNPVATEQWGTVCSATGPVMNFEEDA

SEQ ID NO: 158268 - protein, 34 aa, Artificial Sequence
  Description of Artificial Sequence: Synthetic polypeptide
NEEEIRTTNPVAYEQWGYYWSQRNDDLQRQDEDQ

SEQ ID NO: 158269 - protein, 35 aa, Artificial Sequence
  Description of Artificial Sequence: Synthetic polypeptide
DESEINTTNPVATEQYGTVPSATGGEPSEFEGGND

SEQ ID NO: 158270 - protein, 37 aa, Artificial Sequence
  Description of Artificial Sequence: Synthetic polypeptide
DEEEIRTTNPVATEQYGFICQCCTPNEIGEEQEALNR

SEQ ID NO: 158271 - protein, 33 aa, Artificial Sequence
  Description of Artificial Sequence: Synthetic polypeptide
SEEEIRTTNPVATEQYGSWTAPAIQDEHQFDQN

SEQ ID NO: 158272 - protein, 35 aa, Artificial Sequence
  Description of Artificial Sequence: Synthetic polypeptide
DEGEIRTTNPVATEQYGSVIEPDDLHENSISDNVE

SEQ ID NO: 158273 - protein, 36 aa, Artificial Sequence
  Description of Artificial Sequence: Synthetic polypeptide
DEENIRTTNPVATEQYGSVSPTPDNNGSPETEEDHA

SEQ ID NO: 158274 - protein, 28 aa, Artificial Sequence
  Description of Artificial Sequence: Synthetic peptide
QESEIASTNPVATEGYGEAAEVCQHEEK

SEQ ID NO: 158275 - protein, 36 aa, Artificial Sequence
  Description of Artificial Sequence: Synthetic polypeptide
DEEEIVTTNPVATEQYGTVCSTTPAGPEMFNGMNPD

SEQ ID NO: 158276 - protein, 38 aa, Artificial Sequence
  Description of Artificial Sequence: Synthetic polypeptide
DEEEIRTTNPVATEQYGVVSTTVNQNNQQQATNVATEH

SEQ ID NO: 158277 - protein, 31 aa, Artificial Sequence
  Description of Artificial Sequence: Synthetic polypeptide
DDSEVASTNPVSTEGYGNVAANTIQSRVNQR

SEQ ID NO: 158278 - protein, 32 aa, Artificial Sequence
  Description of Artificial Sequence: Synthetic polypeptide
DENEIRTTNPVSTAPYGTTSMEDGQAQTNGNH

SEQ ID NO: 158279 - protein, 38 aa, Artificial Sequence
  Description of Artificial Sequence: Synthetic polypeptide
DEEEIRTTNPVATEQYGVVSTTVNQNQQQQATNNATET

SEQ ID NO: 158280 - protein, 36 aa, Artificial Sequence
  Description of Artificial Sequence: Synthetic polypeptide
DEEEIRTTNPVATEFYGAVDDDTMNLEEDGQGQQIQ

SEQ ID NO: 158281 - protein, 37 aa, Artificial Sequence
  Description of Artificial Sequence: Synthetic polypeptide
DEEEIRTTNPVATEQYGSVQPNENYLVMMSEHVNQNQ

SEQ ID NO: 158282 - protein, 37 aa, Artificial Sequence
  Description of Artificial Sequence: Synthetic polypeptide
DEEEIRTTNPVAYEAFGQSVVSCTYALDLRSGGNNSF

SEQ ID NO: 158283 - protein, 32 aa, Artificial Sequence
  Description of Artificial Sequence: Synthetic polypeptide
DENEIRTTNPVSTCPYGTISMEDIQQQQNGNH

SEQ ID NO: 158284 - protein, 36 aa, Artificial Sequence
  Description of Artificial Sequence: Synthetic polypeptide
DEEEIRTTNPVGTEQWGCVSGNANELGGERGGDIAM

SEQ ID NO: 158285 - protein, 37 aa, Artificial Sequence
  Description of Artificial Sequence: Synthetic polypeptide
DEEEIRTTNPVATEQYGSVQPNENYLVFMTEHVEQNE

SEQ ID NO: 158286 - protein, 36 aa, Artificial Sequence
  Description of Artificial Sequence: Synthetic polypeptide
DEEEIRTTNPVAYESYGSVPATTPAGATTRNGGNPV

SEQ ID NO: 158287 - protein, 36 aa, Artificial Sequence
  Description of Artificial Sequence: Synthetic polypeptide
DEEEIRTTNPVATEFYGAVDDDTMNLGEIGQEIQIF

SEQ ID NO: 158288 - protein, 35 aa, Artificial Sequence
  Description of Artificial Sequence: Synthetic polypeptide
DEEEIRTTNPVATEQYGSVPPVMQEMLIHLEVDEF

SEQ ID NO: 158289 - protein, 37 aa, Artificial Sequence
  Description of Artificial Sequence: Synthetic polypeptide
DEEEIRTTNPVATEQYGSYMENTNVQEINSVHENLGE

SEQ ID NO: 158290 - protein, 37 aa, Artificial Sequence
  Description of Artificial Sequence: Synthetic polypeptide
DEEEIRTTNPVATEQYGFICQCTPNEIGEEQEANNRH

SEQ ID NO: 158291 - protein, 36 aa, Artificial Sequence
  Description of Artificial Sequence: Synthetic polypeptide
DEEEIRTTNPVAYESYGSVPATTPAGPTTRAGGNPS

SEQ ID NO: 158292 - protein, 31 aa, Artificial Sequence
  Description of Artificial Sequence: Synthetic polypeptide
DSEDIATTNPVATEQWGCVAGEGHQPAVGLT

SEQ ID NO: 158293 - protein, 30 aa, Artificial Sequence
  Description of Artificial Sequence: Synthetic polypeptide
DENEIASTNPVATEGWGVVSSTEMNAAEDA

SEQ ID NO: 158294 - protein, 32 aa, Artificial Sequence
  Description of Artificial Sequence: Synthetic polypeptide
DENEIRTTNPVSTDPYGTISMEDIQQQQNGNH

SEQ ID NO: 158295 - protein, 37 aa, Artificial Sequence
  Description of Artificial Sequence: Synthetic polypeptide
DEEEIRTTNPVATEQYGSYMENTNVQEINLVHENLPG

SEQ ID NO: 158296 - protein, 34 aa, Artificial Sequence
  Description of Artificial Sequence: Synthetic polypeptide
DENEIRTTNPVATEQWGTVCSATDGPVMNFEGDD

SEQ ID NO: 158297 - protein, 31 aa, Artificial Sequence
  Description of Artificial Sequence: Synthetic polypeptide
DDQEIASTNPVSTEGYGNVAANTLQSHVGEL

SEQ ID NO: 158298 - protein, 36 aa, Artificial Sequence
  Description of Artificial Sequence: Synthetic polypeptide
SEEEIRTTNPVATEQYGSVYTPTHMYSNEGTNDGEF

SEQ ID NO: 158299 - protein, 34 aa, Artificial Sequence
  Description of Artificial Sequence: Synthetic polypeptide
DEEEIRTTNPIATEQWGAVWANTPAGAEPNGPPV

SEQ ID NO: 158300 - protein, 34 aa, Artificial Sequence
  Description of Artificial Sequence: Synthetic polypeptide
DEEEIRTTNPIATEQWGAVWANTPAGAMPNGPPV

SEQ ID NO: 158301 - protein, 33 aa, Artificial Sequence
  Description of Artificial Sequence: Synthetic polypeptide
DEEEIRTTNPCATEGYGCCCSNWELANFGSDQA

SEQ ID NO: 158302 - protein, 34 aa, Artificial Sequence
  Description of Artificial Sequence: Synthetic polypeptide
DEEEIRTTNPCATEGYGCCCSTELNAEYFGSEQS

SEQ ID NO: 158303 - protein, 35 aa, Artificial Sequence
  Description of Artificial Sequence: Synthetic polypeptide
DEMEIATTNPVAYEQYGTVCSATDGPDEHFGGNDR

SEQ ID NO: 158304 - protein, 34 aa, Artificial Sequence
  Description of Artificial Sequence: Synthetic polypeptide
DESEIQTTNPVATECWGASTSCINEPQDREGEHG

SEQ ID NO: 158305 - protein, 36 aa, Artificial Sequence
  Description of Artificial Sequence: Synthetic polypeptide
DEEEIRTTNPVAYEHYGCVYACTNAISQNKGADPRV

SEQ ID NO: 158306 - protein, 34 aa, Artificial Sequence
  Description of Artificial Sequence: Synthetic polypeptide
DEMEIATTNPVAYEQYGTVCSATDGPDEHEGNTK

SEQ ID NO: 158307 - protein, 36 aa, Artificial Sequence
  Description of Artificial Sequence: Synthetic polypeptide
DDEEIRTTNPVATDQYGSVSVDQQQGEQTNEGGNGN

SEQ ID NO: 158308 - protein, 35 aa, Artificial Sequence
  Description of Artificial Sequence: Synthetic polypeptide
DEEEISTTNPVATEQYGQCVCSWMEHNQNFGSDQS

SEQ ID NO: 158309 - protein, 34 aa, Artificial Sequence
  Description of Artificial Sequence: Synthetic polypeptide
DEEEIRTTNPCATEGYGCCCSTGNHAEYFGSDQS

SEQ ID NO: 158310 - protein, 34 aa, Artificial Sequence
  Description of Artificial Sequence: Synthetic polypeptide
DENEIRTTNPVATEQWGTTVSCEIESMNAAEGDA

SEQ ID NO: 158311 - protein, 34 aa, Artificial Sequence
  Description of Artificial Sequence: Synthetic polypeptide
DEEEIRTTNPIATEQWGAVWANTPAGAMRNGPPV

SEQ ID NO: 158312 - protein, 32 aa, Artificial Sequence
  Description of Artificial Sequence: Synthetic polypeptide
DEGEIRTTNPVAYEQWGYCQEDQKRGMDNKGP

SEQ ID NO: 158313 - protein, 36 aa, Artificial Sequence
  Description of Artificial Sequence: Synthetic polypeptide
DEGEIRTTNPVATEQYGSVISVPWNNDEFPFGEDHL

SEQ ID NO: 158314 - protein, 38 aa, Artificial Sequence
  Description of Artificial Sequence: Synthetic polypeptide
QEEEIRTTNPVATEQYGSVNMSDNNVEFGQNGNGDDDS

SEQ ID NO: 158315 - protein, 35 aa, Artificial Sequence
  Description of Artificial Sequence: Synthetic polypeptide
CEEEIRTTNPVATEQYGDVVNGQSNLELGEGGGEE

SEQ ID NO: 158316 - protein, 35 aa, Artificial Sequence
  Description of Artificial Sequence: Synthetic polypeptide
NEEEIRTTNPVAYEQWGVYWSQRNDDLQRQEDVRR

SEQ ID NO: 158317 - protein, 36 aa, Artificial Sequence
  Description of Artificial Sequence: Synthetic polypeptide
DEEEIRTTNPIATEQWGAVSATTPDGPAERKGMNPV

SEQ ID NO: 158318 - protein, 36 aa, Artificial Sequence
  Description of Artificial Sequence: Synthetic polypeptide
DEEEIRTTNPVATEQYGSVQSPTITISPEEESEMQV

SEQ ID NO: 158319 - protein, 37 aa, Artificial Sequence
  Description of Artificial Sequence: Synthetic polypeptide
DDEEIRTTNPVATDQYGSVSVDQQGGEQTNEGGEGNV

SEQ ID NO: 158320 - protein, 34 aa, Artificial Sequence
  Description of Artificial Sequence: Synthetic polypeptide
NEEEIRTTNPVAYEQWGYYWSDRNDDTQRQDERD

SEQ ID NO: 158321 - protein, 32 aa, Artificial Sequence
  Description of Artificial Sequence: Synthetic polypeptide
DENEIRTTNPVSTEAWGTCSLEDIQQQQNGNH

SEQ ID NO: 158322 - protein, 36 aa, Artificial Sequence
  Description of Artificial Sequence: Synthetic polypeptide
DEEEIRTTNPVATEQYGSVPPVMLLDDIRQQVLEDL

SEQ ID NO: 158323 - protein, 36 aa, Artificial Sequence
  Description of Artificial Sequence: Synthetic polypeptide
DEEEIRTTNPVATEQYGSVQNVMEDMQEEAVAVNNE

SEQ ID NO: 158324 - protein, 36 aa, Artificial Sequence
  Description of Artificial Sequence: Synthetic polypeptide
DDEEIRTTNPVATDQYGSVSVDQQGGEQGNEFGAGN

SEQ ID NO: 158325 - protein, 34 aa, Artificial Sequence
  Description of Artificial Sequence: Synthetic polypeptide
DENEIRTTNPVATEQYGCVDTTSVSHLISIEEDS

SEQ ID NO: 158326 - protein, 37 aa, Artificial Sequence
  Description of Artificial Sequence: Synthetic polypeptide
DENEIATTNPVATEQYGCVAITGNGLDAPDAQMENRV

SEQ ID NO: 158327 - protein, 35 aa, Artificial Sequence
  Description of Artificial Sequence: Synthetic polypeptide
DECEICTTNPVATEQYGSVSTVTAQNEDTEEEEDD

SEQ ID NO: 158328 - protein, 33 aa, Artificial Sequence
  Description of Artificial Sequence: Synthetic polypeptide
DDSEVATTNPVSTEGYGNVSATNTGQSRVGMQV

SEQ ID NO: 158329 - protein, 34 aa, Artificial Sequence
  Description of Artificial Sequence: Synthetic polypeptide
DSEEIRTTNPVGTEQWGCVCSNWELQENFGSVQA

SEQ ID NO: 158330 - protein, 36 aa, Artificial Sequence
  Description of Artificial Sequence: Synthetic polypeptide
DDEEIRTTNPVATDQYGSVSVDQQGGEQGNEGGNGI

SEQ ID NO: 158331 - protein, 34 aa, Artificial Sequence
  Description of Artificial Sequence: Synthetic polypeptide
QEEEIRTTNPVATEQYGSVNLDVMIETGGGQEQG

SEQ ID NO: 158332 - protein, 35 aa, Artificial Sequence
  Description of Artificial Sequence: Synthetic polypeptide
DEEEIACTNPVATEQYGSACAANPQQEHQDGNLHD

SEQ ID NO: 158333 - protein, 33 aa, Artificial Sequence
  Description of Artificial Sequence: Synthetic polypeptide
DEEEIRTTNPIATEQWGATWANEEDWQEPGPYI

SEQ ID NO: 158334 - protein, 36 aa, Artificial Sequence
  Description of Artificial Sequence: Synthetic polypeptide
DENEIRTTNPVATEQYGCVETVWLPDEQENLQIDEI

SEQ ID NO: 158335 - protein, 39 aa, Artificial Sequence
  Description of Artificial Sequence: Synthetic polypeptide
AEEEIRTTNPVATEQYGSVVVTVTNLQAGNNEQGTNDED

SEQ ID NO: 158336 - protein, 37 aa, Artificial Sequence
  Description of Artificial Sequence: Synthetic polypeptide
DEEEIRTTNPVATEQYGSYMENTNVQGVNVVHENLGE

SEQ ID NO: 158337 - protein, 34 aa, Artificial Sequence
  Description of Artificial Sequence: Synthetic polypeptide
DENEIRTTNPVATEQWGTVCSATDGPVMNFEGDA

SEQ ID NO: 158338 - protein, 34 aa, Artificial Sequence
  Description of Artificial Sequence: Synthetic polypeptide
DENEIRTTNPVATEQWGTVCSATDGPVENFEGDD

SEQ ID NO: 158339 - protein, 35 aa, Artificial Sequence
  Description of Artificial Sequence: Synthetic polypeptide
NEEEIRTTNPVAYEQWGYYWSQANDDLQRQDERQN

SEQ ID NO: 158340 - protein, 35 aa, Artificial Sequence
  Description of Artificial Sequence: Synthetic polypeptide
DEEEIRTTNPVATEEYGQCVCSNTGEHQNFSSDQS

SEQ ID NO: 158341 - protein, 37 aa, Artificial Sequence
  Description of Artificial Sequence: Synthetic polypeptide
DEEEIRTTNPVATEQYGSVYSPTTTEGMEMEGAQFLQ

SEQ ID NO: 158342 - protein, 38 aa, Artificial Sequence
  Description of Artificial Sequence: Synthetic polypeptide
AEEEIRTTNPVATEQYGSVVVTVTNNQLGNEQGTNDEQ

SEQ ID NO: 158343 - protein, 32 aa, Artificial Sequence
  Description of Artificial Sequence: Synthetic polypeptide
DENEIRTTNPVSCEPYGTISMEDIQQAQNGNH

SEQ ID NO: 158344 - protein, 32 aa, Artificial Sequence
  Description of Artificial Sequence: Synthetic polypeptide
DENEIRTTNPVSCEPYGTISMEDIQQQQNGNH

SEQ ID NO: 158345 - protein, 39 aa, Artificial Sequence
  Description of Artificial Sequence: Synthetic polypeptide
DEEEIRTTNPVATEQYGVVSTVVVTNTNEQQGTTDENQD

SEQ ID NO: 158346 - protein, 33 aa, Artificial Sequence
  Description of Artificial Sequence: Synthetic polypeptide
AENEIACTNPVATEQYGCYCSWGNLQYFGSDQS

SEQ ID NO: 158347 - protein, 32 aa, Artificial Sequence
  Description of Artificial Sequence: Synthetic polypeptide
DENEIRTTNPVSCEPYGTISMEDIQQQQNGNP

SEQ ID NO: 158348 - protein, 35 aa, Artificial Sequence
  Description of Artificial Sequence: Synthetic polypeptide
NEDEIRTTNPVAYEQWGSVCSTENEDMGDTQNGGA

SEQ ID NO: 158349 - protein, 34 aa, Artificial Sequence
  Description of Artificial Sequence: Synthetic polypeptide
DSEEIRTTNPCAYEGYGSCSCTCELSGRGGDYEL

SEQ ID NO: 158350 - protein, 34 aa, Artificial Sequence
  Description of Artificial Sequence: Synthetic polypeptide
DSEEIRTTNPCAYEGYGSCSCTNEHSGRGGDQVL

SEQ ID NO: 158351 - protein, 34 aa, Artificial Sequence
  Description of Artificial Sequence: Synthetic polypeptide
NEDEIRTTNPVAYEQWGSVCYNQDIMGGGGNDER

SEQ ID NO: 158352 - protein, 36 aa, Artificial Sequence
  Description of Artificial Sequence: Synthetic polypeptide
DEEEIRTTNPVATEQYGIVPCEFETQVQWTVGVVVD

SEQ ID NO: 158353 - protein, 30 aa, Artificial Sequence
  Description of Artificial Sequence: Synthetic polypeptide
DENEIASTNPVSTEPYGTMAMTLQQQQGDI

SEQ ID NO: 158354 - protein, 32 aa, Artificial Sequence
  Description of Artificial Sequence: Synthetic polypeptide
AENEIACTNPVATEQYGCYCSWELQHFGSGQS

SEQ ID NO: 158355 - protein, 37 aa, Artificial Sequence
  Description of Artificial Sequence: Synthetic polypeptide
DEEEIATTNPVATEQYGSVCSPVDDLHNIDAMGMENN

SEQ ID NO: 158356 - protein, 37 aa, Artificial Sequence
  Description of Artificial Sequence: Synthetic polypeptide
DEEEIRTTNPCATEAYGSVATTTNTQQGNQQGTNNAE

SEQ ID NO: 158357 - protein, 35 aa, Artificial Sequence
  Description of Artificial Sequence: Synthetic polypeptide
DEVEIATTNPVAYERWGSVCSGTDNHDRDGRQGER

SEQ ID NO: 158358 - protein, 34 aa, Artificial Sequence
  Description of Artificial Sequence: Synthetic polypeptide
DEEEIACTNPVATEQYGSACAAANGLDAMVPDNN

SEQ ID NO: 158359 - protein, 32 aa, Artificial Sequence
  Description of Artificial Sequence: Synthetic polypeptide
DDNEIRTTNPVSTEPYGTISNEDIQQQQNGNH

SEQ ID NO: 158360 - protein, 37 aa, Artificial Sequence
  Description of Artificial Sequence: Synthetic polypeptide
DEEEIATTNPVATEQYGSVCSPVDNNHNIDAMGEGRQ

SEQ ID NO: 158361 - protein, 36 aa, Artificial Sequence
  Description of Artificial Sequence: Synthetic polypeptide
DEEEIRTTNPCATEAYGSVATVNNDQGNQQGTTEAG

SEQ ID NO: 158362 - protein, 34 aa, Artificial Sequence
  Description of Artificial Sequence: Synthetic polypeptide
NEENAEIATTNPVAYEAWGSVYCSDNDDERDGMR

SEQ ID NO: 158363 - protein, 39 aa, Artificial Sequence
  Description of Artificial Sequence: Synthetic polypeptide
AEEEIRTTNPVATEQYGSVVVTVTNNNLEQGTEGGNATE

SEQ ID NO: 158364 - protein, 35 aa, Artificial Sequence
  Description of Artificial Sequence: Synthetic polypeptide
DEEEIATTNPVATEQYGSVCAAMMHGQNEMGGQGM

SEQ ID NO: 158365 - protein, 35 aa, Artificial Sequence
  Description of Artificial Sequence: Synthetic polypeptide
DEHEIRTTNPVAYEQWGSVAGGPPGNHQNTGDNDI

SEQ ID NO: 158366 - protein, 37 aa, Artificial Sequence
  Description of Artificial Sequence: Synthetic polypeptide
DEEEIRTTNPVATEQYGIFAQPTMMEETVLENGTLNR

SEQ ID NO: 158367 - protein, 31 aa, Artificial Sequence
  Description of Artificial Sequence: Synthetic polypeptide
DENEIASTNPVSTEPYGTMSMETLQQQQGDI

SEQ ID NO: 158368 - protein, 37 aa, Artificial Sequence
  Description of Artificial Sequence: Synthetic polypeptide
DEEEIRTTNPVAYERYGISTVSYEGNELSDVKGKVRR

SEQ ID NO: 158369 - protein, 32 aa, Artificial Sequence
  Description of Artificial Sequence: Synthetic polypeptide
DDSEVRTTNPVSTECWGNVSACTIQSRVGENG

SEQ ID NO: 158370 - protein, 36 aa, Artificial Sequence
  Description of Artificial Sequence: Synthetic polypeptide
DEEEIRTTNPVATEQWGCVAGEGQDTQNHQDDGAAQ

SEQ ID NO: 158371 - protein, 31 aa, Artificial Sequence
  Description of Artificial Sequence: Synthetic polypeptide
DEMEIATTNPVAYEQWGCVSKEIEMNGKEDY

SEQ ID NO: 158372 - protein, 33 aa, Artificial Sequence
  Description of Artificial Sequence: Synthetic polypeptide
AENEIACTNPVATEQYGCYCSWNLQEHFGSDQS

SEQ ID NO: 158373 - protein, 32 aa, Artificial Sequence
  Description of Artificial Sequence: Synthetic polypeptide
DDNEIRTTNPVSTEPYGTISMLDIQQQQNGNH

SEQ ID NO: 158374 - protein, 39 aa, Artificial Sequence
  Description of Artificial Sequence: Synthetic polypeptide
AEEEIRTTNPVATEQYGSVVVTVTNNNLEQGTETGNTTV

SEQ ID NO: 158375 - protein, 35 aa, Artificial Sequence
  Description of Artificial Sequence: Synthetic polypeptide
DESEIKTTNCVATEQYGSVSIMGLRGEDPGQGGEE

SEQ ID NO: 158376 - protein, 37 aa, Artificial Sequence
  Description of Artificial Sequence: Synthetic polypeptide
DEEEIRTTNPVAYERYGQSTVNYEGNELSDVRGPVRF

SEQ ID NO: 158377 - protein, 38 aa, Artificial Sequence
  Description of Artificial Sequence: Synthetic polypeptide
DECEICTTNPVATEQYGTVATVTNLQRATNEEGVVNDS

SEQ ID NO: 158378 - protein, 36 aa, Artificial Sequence
  Description of Artificial Sequence: Synthetic polypeptide
DENEIRTTNPVATEQYGAVVTDTMGQIGQGGGGQNG

SEQ ID NO: 158379 - protein, 31 aa, Artificial Sequence
  Description of Artificial Sequence: Synthetic polypeptide
DDNEIASTNPVSTECYGNVSAECLQSRVEQL

SEQ ID NO: 158380 - protein, 31 aa, Artificial Sequence
  Description of Artificial Sequence: Synthetic polypeptide
DDNEIASTNPVSTECYGNVSAECLQSRVEEL

SEQ ID NO: 158381 - protein, 34 aa, Artificial Sequence
  Description of Artificial Sequence: Synthetic polypeptide
DSEEIKTTNPVATEPYGKVVPRTTALSHPEGNPH

SEQ ID NO: 158382 - protein, 31 aa, Artificial Sequence
  Description of Artificial Sequence: Synthetic polypeptide
DDNEIASTNPVATEGWGNVAANTIQSRAGDA

SEQ ID NO: 158383 - protein, 35 aa, Artificial Sequence
  Description of Artificial Sequence: Synthetic polypeptide
SEEEIRTTNPVATESWGSVFSNENDHEREGGDQGG

SEQ ID NO: 158384 - protein, 37 aa, Artificial Sequence
  Description of Artificial Sequence: Synthetic polypeptide
DEEEIRTTNPCATEAYGSVATTTNNDQGNQQGTNNDE

SEQ ID NO: 158385 - protein, 32 aa, Artificial Sequence
  Description of Artificial Sequence: Synthetic polypeptide
DENEIRTTNPVSCEPYGTISMEHIQQQQNGNH

SEQ ID NO: 158386 - protein, 32 aa, Artificial Sequence
  Description of Artificial Sequence: Synthetic polypeptide
DENEIRTTNPVSCEPYGTISMYDIQQQQNGNH

SEQ ID NO: 158387 - protein, 37 aa, Artificial Sequence
  Description of Artificial Sequence: Synthetic polypeptide
DEEEIRTTNPAATEQYGSVIVTTPDGPNMGNGENDGD

SEQ ID NO: 158388 - protein, 37 aa, Artificial Sequence
  Description of Artificial Sequence: Synthetic polypeptide
DEEEIRTTNPVAYERYGISTVSYEGNELSDVHGGVRF

SEQ ID NO: 158389 - protein, 34 aa, Artificial Sequence
  Description of Artificial Sequence: Synthetic polypeptide
DEEEIRTTNPCATEEYGCVCGTGPHNANFGSDAA

SEQ ID NO: 158390 - protein, 35 aa, Artificial Sequence
  Description of Artificial Sequence: Synthetic polypeptide
DECEICTTNPVATEQYGTVATVTIGTVNNDEGNTD

SEQ ID NO: 158391 - protein, 36 aa, Artificial Sequence
  Description of Artificial Sequence: Synthetic polypeptide
NEDEIRTTNPVATEQYGSVMSGMFGIDLAEEGFNII

SEQ ID NO: 158392 - protein, 35 aa, Artificial Sequence
  Description of Artificial Sequence: Synthetic polypeptide
DEEEIACTNPVATEQYGNTTIATNPQEAGMPMGER

SEQ ID NO: 158393 - protein, 35 aa, Artificial Sequence
  Description of Artificial Sequence: Synthetic polypeptide
DEEEIRTTNPVATEQWGCVAGEGDTTNHQDDLAAM

SEQ ID NO: 158394 - protein, 37 aa, Artificial Sequence
  Description of Artificial Sequence: Synthetic polypeptide
DEEEIRTTNPVAYERYGISTVSYEGNEFSDIRGPVRF

SEQ ID NO: 158395 - protein, 36 aa, Artificial Sequence
  Description of Artificial Sequence: Synthetic polypeptide
DEEEIRTTNPVATEQYGSIEVLMDDIIERSPQADNV

SEQ ID NO: 158396 - protein, 39 aa, Artificial Sequence
  Description of Artificial Sequence: Synthetic polypeptide
DEEEIRTTNPVATEQYGMETYSTPNENVEMQRMGNVELS

SEQ ID NO: 158397 - protein, 34 aa, Artificial Sequence
  Description of Artificial Sequence: Synthetic polypeptide
DEEEIRTTNPCATEEYGCVCGWEEHNAHFGSNAS

SEQ ID NO: 158398 - protein, 39 aa, Artificial Sequence
  Description of Artificial Sequence: Synthetic polypeptide
DEEEIRTTNPVATEQYGVVSTVVVTNQQNQQGNTTNNND

SEQ ID NO: 158399 - protein, 35 aa, Artificial Sequence
  Description of Artificial Sequence: Synthetic polypeptide
DEEEISTTNPVATEQYGQCVCSWGELNENFGSDQS

SEQ ID NO: 158400 - protein, 35 aa, Artificial Sequence
  Description of Artificial Sequence: Synthetic polypeptide
DEEEISTTNPVATEQYGQCVCSWGEHQNFNSDTQS

SEQ ID NO: 158401 - protein, 36 aa, Artificial Sequence
  Description of Artificial Sequence: Synthetic polypeptide
DEEEIRTTNCVATEQYGSVVVDGFGQENDQEEDNGI

SEQ ID NO: 158402 - protein, 38 aa, Artificial Sequence
  Description of Artificial Sequence: Synthetic polypeptide
DEAEIRATNPVATEQYGSVCYSDWNNLQDERGSDTQQF

SEQ ID NO: 158403 - protein, 37 aa, Artificial Sequence
  Description of Artificial Sequence: Synthetic polypeptide
DEEEIRTTNCVATEQYGSVSVQNGFNTTGTGEGEENE

SEQ ID NO: 158404 - protein, 32 aa, Artificial Sequence
  Description of Artificial Sequence: Synthetic polypeptide
DDSEVATTNPVSTEPYGTISANEDIQQRNGNH

SEQ ID NO: 158405 - protein, 37 aa, Artificial Sequence
  Description of Artificial Sequence: Synthetic polypeptide
DEEEIRTTNPVAYERYGISTVSYEGGELSHVRGPVRF

SEQ ID NO: 158406 - protein, 38 aa, Artificial Sequence
  Description of Artificial Sequence: Synthetic polypeptide
DEEEIRTTNPAATEQYGSVVDTNNMNDEFQDEGQGNIE

SEQ ID NO: 158407 - protein, 36 aa, Artificial Sequence
  Description of Artificial Sequence: Synthetic polypeptide
DEEEISTTNPVATEQYGQCVCSWGELNQNFNSNTQS

SEQ ID NO: 158408 - protein, 32 aa, Artificial Sequence
  Description of Artificial Sequence: Synthetic polypeptide
DENEIRTTNPVSGEPYGTISMEDIQQQQNGNH

SEQ ID NO: 158409 - protein, 35 aa, Artificial Sequence
  Description of Artificial Sequence: Synthetic polypeptide
NEDEIRTTNPVAYEQWGEVCSTENMDNGDTQNGGR

SEQ ID NO: 158410 - protein, 34 aa, Artificial Sequence
  Description of Artificial Sequence: Synthetic polypeptide
DEEEIRTTNPCATEEYGCVCGTGEHNAHFGSEAA

SEQ ID NO: 158411 - protein, 33 aa, Artificial Sequence
  Description of Artificial Sequence: Synthetic polypeptide
AENEIACTNPVATEQYGCYCSTWELQYFGSDQS

SEQ ID NO: 158412 - protein, 36 aa, Artificial Sequence
  Description of Artificial Sequence: Synthetic polypeptide
DEEGIETTNPVATEQYGSVSTGGDLGDENNGQEEGD

SEQ ID NO: 158413 - protein, 32 aa, Artificial Sequence
  Description of Artificial Sequence: Synthetic polypeptide
DENEIRTTNPVSFEPYGNISMEDIQQQQNGNH

SEQ ID NO: 158414 - protein, 32 aa, Artificial Sequence
  Description of Artificial Sequence: Synthetic polypeptide
DENEIRTTNPVSFEPYGTISMEDIQQQQNGNH

SEQ ID NO: 158415 - protein, 36 aa, Artificial Sequence
  Description of Artificial Sequence: Synthetic polypeptide
AEDEICATNPVATEQYGSVATVQNNNLQQLLGGNDD

SEQ ID NO: 158416 - protein, 35 aa, Artificial Sequence
  Description of Artificial Sequence: Synthetic polypeptide
DEEEIRTTNPVATEQYGSIEVAVGGEIQQALLDPT

SEQ ID NO: 158417 - protein, 38 aa, Artificial Sequence
  Description of Artificial Sequence: Synthetic polypeptide
DEEEIRTTNPVATEQYGVVSTVVVTQAGNNDETEEDTE

SEQ ID NO: 158418 - protein, 38 aa, Artificial Sequence
  Description of Artificial Sequence: Synthetic polypeptide
DEEEIRTTNPVATEQYGVVSTVVVTQAGNNDETEEEAT

SEQ ID NO: 158419 - protein, 34 aa, Artificial Sequence
  Description of Artificial Sequence: Synthetic polypeptide
NEDEIRTTNPVAYECWGSVYCTENQGGNQGNNPR

SEQ ID NO: 158420 - protein, 36 aa, Artificial Sequence
  Description of Artificial Sequence: Synthetic polypeptide
DECEICTTNPVATTQYGVVSTNLALQQGTEQGTTDT

SEQ ID NO: 158421 - protein, 33 aa, Artificial Sequence
  Description of Artificial Sequence: Synthetic polypeptide
DENEIRTTNPVSFEPYGTISMEDIQQQQNGNRH

SEQ ID NO: 158422 - protein, 36 aa, Artificial Sequence
  Description of Artificial Sequence: Synthetic polypeptide
AEDEICATNPVATEQYGSVATVNENLQALNGNGEDD

SEQ ID NO: 158423 - protein, 36 aa, Artificial Sequence
  Description of Artificial Sequence: Synthetic polypeptide
DEEEISTTNPVATEQYGQCVCSWGELNQNFNSQNQS

SEQ ID NO: 158424 - protein, 35 aa, Artificial Sequence
  Description of Artificial Sequence: Synthetic polypeptide
SEEEIRTTNPVATESWGSVFSNENDMHERNGGDQH

SEQ ID NO: 158425 - protein, 37 aa, Artificial Sequence
  Description of Artificial Sequence: Synthetic polypeptide
DEEEIRTTNPVATEQYGSVQPTPVLLNVTVGPVEVCD

SEQ ID NO: 158426 - protein, 32 aa, Artificial Sequence
  Description of Artificial Sequence: Synthetic polypeptide
DENEIRTTNPVSFEPYGTISMEDIQQQQVGNH

SEQ ID NO: 158427 - protein, 38 aa, Artificial Sequence
  Description of Artificial Sequence: Synthetic polypeptide
DEDEIRTTNPVATEQYGVVSTVSNNQNQNLQQGTTEQG

SEQ ID NO: 158428 - protein, 38 aa, Artificial Sequence
  Description of Artificial Sequence: Synthetic polypeptide
DEEEIRTTNPCATEAYGSVTVVVTTNNLQAGNTTNEEE

SEQ ID NO: 158429 - protein, 35 aa, Artificial Sequence
  Description of Artificial Sequence: Synthetic polypeptide
SEEEIRTTNPVATESWGSVFHNENDMHERNGGDVR

SEQ ID NO: 158430 - protein, 37 aa, Artificial Sequence
  Description of Artificial Sequence: Synthetic polypeptide
DEEEIRTTNPVATEQYGICVCSWEEHNAENFGSQNQS

SEQ ID NO: 158431 - protein, 37 aa, Artificial Sequence
  Description of Artificial Sequence: Synthetic polypeptide
DEEEIRTTNPCATEAYGVVATTNNLQAGTEQGTNVAE

SEQ ID NO: 158432 - protein, 33 aa, Artificial Sequence
  Description of Artificial Sequence: Synthetic polypeptide
NEECIQTTNPVAYERYGCSVNINMGSLRPGGNQ

SEQ ID NO: 158433 - protein, 36 aa, Artificial Sequence
  Description of Artificial Sequence: Synthetic polypeptide
DEGEIRTTNPVATEQYGSVEVTPWEEETENFQDHMI

SEQ ID NO: 158434 - protein, 39 aa, Artificial Sequence
  Description of Artificial Sequence: Synthetic polypeptide
AEEEIRTTNPVATEQYGSVVVTVTNNNLQQGTEGGNNTD

SEQ ID NO: 158435 - protein, 34 aa, Artificial Sequence
  Description of Artificial Sequence: Synthetic polypeptide
DEMEIATTNPVAYEQWGSVCSGENDQHLTNDHQP

SEQ ID NO: 158436 - protein, 28 aa, Artificial Sequence
  Description of Artificial Sequence: Synthetic peptide
QESEIASTNPVATEGYGVMAEVCQHEEK

SEQ ID NO: 158437 - protein, 37 aa, Artificial Sequence
  Description of Artificial Sequence: Synthetic polypeptide
DEEEIRTTNPCATEAYGVVTVTTNNNLQAGTTTNTTE

SEQ ID NO: 158438 - protein, 35 aa, Artificial Sequence
  Description of Artificial Sequence: Synthetic polypeptide
DEEEIATTNPVATEQYGSVCAAMMHGDNEMGNSND

SEQ ID NO: 158439 - protein, 28 aa, Artificial Sequence
  Description of Artificial Sequence: Synthetic peptide
QESEIASTNPVATEGYGVMAEVCQHEDK

SEQ ID NO: 158440 - protein, 34 aa, Artificial Sequence
  Description of Artificial Sequence: Synthetic polypeptide
CEMEIVTTNPVATEQYGTVCSATDGPVEFEGPND

SEQ ID NO: 158441 - protein, 38 aa, Artificial Sequence
  Description of Artificial Sequence: Synthetic polypeptide
DEEEIRTTNPVAYERYGISTVSYEGNELSDVRPGPVRF

SEQ ID NO: 158442 - protein, 36 aa, Artificial Sequence
  Description of Artificial Sequence: Synthetic polypeptide
DENEIRTTNPVATEQYGCCSVADNDVEQLEPGFDTQ

SEQ ID NO: 158443 - protein, 38 aa, Artificial Sequence
  Description of Artificial Sequence: Synthetic polypeptide
DEEEIRTTNPVATEQYGVVSTVVTNQQGNNQNQNTEDE

SEQ ID NO: 158444 - protein, 35 aa, Artificial Sequence
  Description of Artificial Sequence: Synthetic polypeptide
DENEIRTTNPVATEQYGCCSVADLDVEQLEPGEDV

SEQ ID NO: 158445 - protein, 37 aa, Artificial Sequence
  Description of Artificial Sequence: Synthetic polypeptide
DEEEIRTTNPVAYERYGISTVSYEGNELSDVRGTVGF

SEQ ID NO: 158446 - protein, 36 aa, Artificial Sequence
  Description of Artificial Sequence: Synthetic polypeptide
DEEEIRTTNPVATEQWGTCVCSWMYHNANFGSNTQS

SEQ ID NO: 158447 - protein, 37 aa, Artificial Sequence
  Description of Artificial Sequence: Synthetic polypeptide
DEEEIRTTNPVAYERYGISTVSYEGNELSDVRGDASF

SEQ ID NO: 158448 - protein, 34 aa, Artificial Sequence
  Description of Artificial Sequence: Synthetic polypeptide
DECEICTTNPVATEQYGTVNVVTDGGVEGENNDD

SEQ ID NO: 158449 - protein, 31 aa, Artificial Sequence
  Description of Artificial Sequence: Synthetic polypeptide
DDNEIATTNPVSTEPYGTVAMEDIQQQNGNH

SEQ ID NO: 158450 - protein, 35 aa, Artificial Sequence
  Description of Artificial Sequence: Synthetic polypeptide
QEEEIRTTNPVATEPYGKISQTHEFSFNRVGNQMH

SEQ ID NO: 158451 - protein, 34 aa, Artificial Sequence
  Description of Artificial Sequence: Synthetic polypeptide
DDEEIRCTNPVAYEQYGCQVCSTEHQENFGSDQS

SEQ ID NO: 158452 - protein, 34 aa, Artificial Sequence
  Description of Artificial Sequence: Synthetic polypeptide
DESEIRTTNPIATECWGAVWSCENEPQEREGPYG

SEQ ID NO: 158453 - protein, 37 aa, Artificial Sequence
  Description of Artificial Sequence: Synthetic polypeptide
CEEEIATTNPVATEQYGSVCAATNPQLNPDDQMGGTM

SEQ ID NO: 158454 - protein, 39 aa, Artificial Sequence
  Description of Artificial Sequence: Synthetic polypeptide
DEEEIRTTNPVATEAYGVVSVTVVTNNLQAGNNNDEEDD

SEQ ID NO: 158455 - protein, 34 aa, Artificial Sequence
  Description of Artificial Sequence: Synthetic polypeptide
DEEEIRTTNPCATEEYGCVCETNHNIENFGSDAA

SEQ ID NO: 158456 - protein, 36 aa, Artificial Sequence
  Description of Artificial Sequence: Synthetic polypeptide
DESEIKTTNPVATEQYGAVDDDNNGEQIGGQNRGTD

SEQ ID NO: 158457 - protein, 35 aa, Artificial Sequence
  Description of Artificial Sequence: Synthetic polypeptide
DAEEIATTNPVAYEQYGSVCSAANALEEAGDGAEA

SEQ ID NO: 158458 - protein, 35 aa, Artificial Sequence
  Description of Artificial Sequence: Synthetic polypeptide
NEEEISTTNPVATEQYGCSCSTGEDNQNFQSDTQA

SEQ ID NO: 158459 - protein, 38 aa, Artificial Sequence
  Description of Artificial Sequence: Synthetic polypeptide
DEEEIRTTNPVATEQYGHTVSSTTPAGPNMRNGMNPVI

SEQ ID NO: 158460 - protein, 37 aa, Artificial Sequence
  Description of Artificial Sequence: Synthetic polypeptide
DEAEIRATNPVATEQYGSVCYSDWGNLQDERDSDIQQ

SEQ ID NO: 158461 - protein, 35 aa, Artificial Sequence
  Description of Artificial Sequence: Synthetic polypeptide
DEEEIATTNPVATEQYGSVCAAMMHGIDEMGNSGD

SEQ ID NO: 158462 - protein, 35 aa, Artificial Sequence
  Description of Artificial Sequence: Synthetic polypeptide
DENEIRTTNPVATEQYGCCWSPTPALLDTGDEIKI

SEQ ID NO: 158463 - protein, 37 aa, Artificial Sequence
  Description of Artificial Sequence: Synthetic polypeptide
DEEEIRTTNPCATEAYGVVVVVTNLQQGNQQGTNVAE

SEQ ID NO: 158464 - protein, 33 aa, Artificial Sequence
  Description of Artificial Sequence: Synthetic polypeptide
DEQEIRTTNPIATEQYGATSATEDWADHEGEDL

SEQ ID NO: 158465 - protein, 38 aa, Artificial Sequence
  Description of Artificial Sequence: Synthetic polypeptide
DEEEIRTTNPCATEAYGVVVTVSTTNNLQAGTTTNTTE

SEQ ID NO: 158466 - protein, 31 aa, Artificial Sequence
  Description of Artificial Sequence: Synthetic polypeptide
DDNEIRSTNPVSTEPYGTISMEDIQQQNGNH

SEQ ID NO: 158467 - protein, 31 aa, Artificial Sequence
  Description of Artificial Sequence: Synthetic polypeptide
DDNEIRSTNPVATEQYGNVSAEIIMNAAEQA

SEQ ID NO: 158468 - protein, 38 aa, Artificial Sequence
  Description of Artificial Sequence: Synthetic polypeptide
DEEEIRTTNPVATEQYGVVSTVVTNQQGNNNNDENQDE

SEQ ID NO: 158469 - protein, 36 aa, Artificial Sequence
  Description of Artificial Sequence: Synthetic polypeptide
QEEEIRTTNPVATEQYGSVIGPTNNLLPMPLEIEDT

SEQ ID NO: 158470 - protein, 35 aa, Artificial Sequence
  Description of Artificial Sequence: Synthetic polypeptide
DEHEIRTTNPVAYEQWGSVAGAPNGNHQNQGDNEH

SEQ ID NO: 158471 - protein, 34 aa, Artificial Sequence
  Description of Artificial Sequence: Synthetic polypeptide
QEEEIRTTNPVATEPYGKISCTHEFSSNRVGKFG

SEQ ID NO: 158472 - protein, 38 aa, Artificial Sequence
  Description of Artificial Sequence: Synthetic polypeptide
DECEICTTNPVATEQYGTVATVVNLQRATNEEGVNNDL

SEQ ID NO: 158473 - protein, 31 aa, Artificial Sequence
  Description of Artificial Sequence: Synthetic polypeptide
DDNEIATTNPVSTEPYGTISMDIQQQQVGNH

SEQ ID NO: 158474 - protein, 36 aa, Artificial Sequence
  Description of Artificial Sequence: Synthetic polypeptide
DDMEIRTTNPVATEQYGCVSTTLQATQFNGQQDPEF

SEQ ID NO: 158475 - protein, 35 aa, Artificial Sequence
  Description of Artificial Sequence: Synthetic polypeptide
DENEIATTNPVATEQYGNTTIATNPLENGMPMGER

SEQ ID NO: 158476 - protein, 38 aa, Artificial Sequence
  Description of Artificial Sequence: Synthetic polypeptide
DEDEIRTTNPVATEQYGVVSTVTNLQQGTEQYGTTEEG

SEQ ID NO: 158477 - protein, 38 aa, Artificial Sequence
  Description of Artificial Sequence: Synthetic polypeptide
DEEEIRTTNPVATEQYGVVSTVVVTQAGNNDEEEENAT

SEQ ID NO: 158478 - protein, 38 aa, Artificial Sequence
  Description of Artificial Sequence: Synthetic polypeptide
DEDEIRTTNPVATEQYGVVSTVTNLQQEGTEQGTTEAG

SEQ ID NO: 158479 - protein, 36 aa, Artificial Sequence
  Description of Artificial Sequence: Synthetic polypeptide
DEEAIRTTNPVATEQYGSVNSTEQWDDDLRPEEELG

SEQ ID NO: 158480 - protein, 36 aa, Artificial Sequence
  Description of Artificial Sequence: Synthetic polypeptide
DEEEIRTTNPCATEAYGVVATVNNQQGNQQGTTEEG

SEQ ID NO: 158481 - protein, 37 aa, Artificial Sequence
  Description of Artificial Sequence: Synthetic polypeptide
DEEEIRTTNPVATEQYGSICTTPSSMSDNFELMVGME

SEQ ID NO: 158482 - protein, 34 aa, Artificial Sequence
  Description of Artificial Sequence: Synthetic polypeptide
DESEIRTTNPIATECWGSVSAIDEPQEREGEPYI

SEQ ID NO: 158483 - protein, 36 aa, Artificial Sequence
  Description of Artificial Sequence: Synthetic polypeptide
DEEAIRTTNPVATEQYGSVNSTEQWDDDFRVESEEG

SEQ ID NO: 158484 - protein, 32 aa, Artificial Sequence
  Description of Artificial Sequence: Synthetic polypeptide
DENEIRTTNPVCTEPYGTISMEDIQTQQNGCH

SEQ ID NO: 158485 - protein, 33 aa, Artificial Sequence
  Description of Artificial Sequence: Synthetic polypeptide
DESEIRTTNPIATECWGSVANCINWADPEGNYG

SEQ ID NO: 158486 - protein, 34 aa, Artificial Sequence
  Description of Artificial Sequence: Synthetic polypeptide
DESEIRTTNPIATECWGSVSAIDEPQERKGEPYI

SEQ ID NO: 158487 - protein, 39 aa, Artificial Sequence
  Description of Artificial Sequence: Synthetic polypeptide
AEEEIRTTNPVATEQYGSVVVTVTNNNLQGTEQGTNVNQ

SEQ ID NO: 158488 - protein, 37 aa, Artificial Sequence
  Description of Artificial Sequence: Synthetic polypeptide
DEEEIRTTNPCATEAYGVVATTTNLQQGNQQGTTNED

SEQ ID NO: 158489 - protein, 36 aa, Artificial Sequence
  Description of Artificial Sequence: Synthetic polypeptide
DEEEIRTTNPCATEAYGVVATTNNQQGNQQGTNTDE

SEQ ID NO: 158490 - protein, 35 aa, Artificial Sequence
  Description of Artificial Sequence: Synthetic polypeptide
DEEAIRTTNPVATEQYGSVNSTEQWDDDEVEEEEN

SEQ ID NO: 158491 - protein, 31 aa, Artificial Sequence
  Description of Artificial Sequence: Synthetic polypeptide
DENEIRTTNPVGTEQWGDVSEIIEMNAAEDA

SEQ ID NO: 158492 - protein, 37 aa, Artificial Sequence
  Description of Artificial Sequence: Synthetic polypeptide
DEEEIRTTNPVATEQYGSICTTPSNSDNNFQLMVGME

SEQ ID NO: 158493 - protein, 36 aa, Artificial Sequence
  Description of Artificial Sequence: Synthetic polypeptide
DEEAIRTTNPVATEQYGSVNSTEQWDDDARVEEPEG

SEQ ID NO: 158494 - protein, 32 aa, Artificial Sequence
  Description of Artificial Sequence: Synthetic polypeptide
DDNEIRTTNPVSTEPYGTISMEDIQQQQNGNH

SEQ ID NO: 158495 - protein, 32 aa, Artificial Sequence
  Description of Artificial Sequence: Synthetic polypeptide
AENEIACTNPVATEQYGCYCSWNPQNFGSDQS

SEQ ID NO: 158496 - protein, 35 aa, Artificial Sequence
  Description of Artificial Sequence: Synthetic polypeptide
QEEEIRTTNPVATEPWGKISQTHEFSPQRVGNQFH

SEQ ID NO: 158497 - protein, 35 aa, Artificial Sequence
  Description of Artificial Sequence: Synthetic polypeptide
DEGEIRTTNPVATEQYGSVEVDPWEEGTEAQDHMI

SEQ ID NO: 158498 - protein, 35 aa, Artificial Sequence
  Description of Artificial Sequence: Synthetic polypeptide
DDEEIRCTNPVATEQYGQCVCSWGELQENSGSQQA

SEQ ID NO: 158499 - protein, 38 aa, Artificial Sequence
  Description of Artificial Sequence: Synthetic polypeptide
DEEEIRTTNPCATEAYGVVSTVVVTTNNLQAGTTNTTE

SEQ ID NO: 158500 - protein, 34 aa, Artificial Sequence
  Description of Artificial Sequence: Synthetic polypeptide
DESEIRTTNPIATECWGSTVACENWPQDPEGNYI

SEQ ID NO: 158501 - protein, 33 aa, Artificial Sequence
  Description of Artificial Sequence: Synthetic polypeptide
DENEIATTNPVATEQYGSACAAANGLPLDSETN

SEQ ID NO: 158502 - protein, 34 aa, Artificial Sequence
  Description of Artificial Sequence: Synthetic polypeptide
DESEIKTTNPCAYEQWGSVYCTDNDQHRQDQNLS

SEQ ID NO: 158503 - protein, 34 aa, Artificial Sequence
  Description of Artificial Sequence: Synthetic polypeptide
NEECIRTTNPVAYEQWGCYWSDRNDDLQRQDERK

SEQ ID NO: 158504 - protein, 36 aa, Artificial Sequence
  Description of Artificial Sequence: Synthetic polypeptide
DEEEISTTNPVATEQYGQCVCSWGETNQENFNSDQN

SEQ ID NO: 158505 - protein, 34 aa, Artificial Sequence
  Description of Artificial Sequence: Synthetic polypeptide
DENEIRTTNPVATEQYGCCSPAVEWADRFSNQQS

SEQ ID NO: 158506 - protein, 35 aa, Artificial Sequence
  Description of Artificial Sequence: Synthetic polypeptide
DEEEIRTTNPVATEQWGCVAGTGPLENTPDGSAEN

SEQ ID NO: 158507 - protein, 35 aa, Artificial Sequence
  Description of Artificial Sequence: Synthetic polypeptide
QEEEIRTTNPVATEPYGKISQTIHEFSPNRVGNEG

SEQ ID NO: 158508 - protein, 36 aa, Artificial Sequence
  Description of Artificial Sequence: Synthetic polypeptide
DENEIRTTNPVATEQYGCCSPAVEDWADRPGSNQQS

SEQ ID NO: 158509 - protein, 36 aa, Artificial Sequence
  Description of Artificial Sequence: Synthetic polypeptide
DEAEIRTTNPVATEQYGSTNNIETPLWEGGNSEISG

SEQ ID NO: 158510 - protein, 37 aa, Artificial Sequence
  Description of Artificial Sequence: Synthetic polypeptide
DSEEIRSTNPVATEQYGSTVCSCTNNELSEASTVQQR

SEQ ID NO: 158511 - protein, 38 aa, Artificial Sequence
  Description of Artificial Sequence: Synthetic polypeptide
DEEEIRTTNPCATEAYGVVSTVVVTTNLQAGNTTNVTE

SEQ ID NO: 158512 - protein, 35 aa, Artificial Sequence
  Description of Artificial Sequence: Synthetic polypeptide
DEEAIRTTNPVATEQYGSVNWTEQWDDDLVEEEEG

SEQ ID NO: 158513 - protein, 35 aa, Artificial Sequence
  Description of Artificial Sequence: Synthetic polypeptide
DEGEIRTTNPVATEQYGSVEVEPWEEGTENQQHMT

SEQ ID NO: 158514 - protein, 37 aa, Artificial Sequence
  Description of Artificial Sequence: Synthetic polypeptide
DEEELRTTNPVATEQYGAVYSPTTMAGPNMRNGMNPV

SEQ ID NO: 158515 - protein, 37 aa, Artificial Sequence
  Description of Artificial Sequence: Synthetic polypeptide
DEDEIRTTNPVATEQYGVVSTVTNQQAGTEQGTTEQG

SEQ ID NO: 158516 - protein, 36 aa, Artificial Sequence
  Description of Artificial Sequence: Synthetic polypeptide
DEEAIRTTNPVATEQYGSVNSTEQWDDDMRVEEEEI

SEQ ID NO: 158517 - protein, 34 aa, Artificial Sequence
  Description of Artificial Sequence: Synthetic polypeptide
NEEAEIRTTNPVAYEQWGSVVIPGNANQDDHNAD

SEQ ID NO: 158518 - protein, 35 aa, Artificial Sequence
  Description of Artificial Sequence: Synthetic polypeptide
SEEEIRTTNPVATESWGSVFHNENDAHERQGQDGR

SEQ ID NO: 158519 - protein, 38 aa, Artificial Sequence
  Description of Artificial Sequence: Synthetic polypeptide
AEEEIRTTNPVATEQYGVVSTNTNNNNNQQGNGNNQQD

SEQ ID NO: 158520 - protein, 35 aa, Artificial Sequence
  Description of Artificial Sequence: Synthetic polypeptide
DENEIRTTNPVATEQYGCVCSSGEHNQNFNSDFQS

SEQ ID NO: 158521 - protein, 33 aa, Artificial Sequence
  Description of Artificial Sequence: Synthetic polypeptide
AENEIACTNPVATEQYGCSCSWPLNQNFGSDQM

SEQ ID NO: 158522 - protein, 35 aa, Artificial Sequence
  Description of Artificial Sequence: Synthetic polypeptide
DEENICTTNPVATEAYGSVATTNNDQQGTEETEED

SEQ ID NO: 158523 - protein, 34 aa, Artificial Sequence
  Description of Artificial Sequence: Synthetic polypeptide
NEEEIACTNPVATEQWGGCSAATHLTQPDNQGQR

SEQ ID NO: 158524 - protein, 31 aa, Artificial Sequence
  Description of Artificial Sequence: Synthetic polypeptide
QESEIASTNPVATEGYGVMCAASDTLQHGDD

SEQ ID NO: 158525 - protein, 32 aa, Artificial Sequence
  Description of Artificial Sequence: Synthetic polypeptide
DENEIRTTNPVSIEPYGTISMEDIQQQQNGNH

SEQ ID NO: 158526 - protein, 36 aa, Artificial Sequence
  Description of Artificial Sequence: Synthetic polypeptide
DEEEIRTTNPVATEQWGDVSSTEPAGPMNRNEMNPV

SEQ ID NO: 158527 - protein, 39 aa, Artificial Sequence
  Description of Artificial Sequence: Synthetic polypeptide
DEEEIRTTNPVATEQYGVVSTVNQQAGNTEQGTNTDTTE

SEQ ID NO: 158528 - protein, 33 aa, Artificial Sequence
  Description of Artificial Sequence: Synthetic polypeptide
DENEIRTTNPVATEQWGVVTVSVVVNNNAAEDA

SEQ ID NO: 158529 - protein, 31 aa, Artificial Sequence
  Description of Artificial Sequence: Synthetic polypeptide
QESEIASTNPVATEGYGVMCAASDTLQHGDI

SEQ ID NO: 158530 - protein, 38 aa, Artificial Sequence
  Description of Artificial Sequence: Synthetic polypeptide
DEEEIRTTNPVATEQYGSVTRAIATNDQASMIVFEQRE

SEQ ID NO: 158531 - protein, 34 aa, Artificial Sequence
  Description of Artificial Sequence: Synthetic polypeptide
DESEIKTTNPVAYECWGSVYRINENQDRRGENNG

SEQ ID NO: 158532 - protein, 36 aa, Artificial Sequence
  Description of Artificial Sequence: Synthetic polypeptide
DEENICTTNPVATEAYGSVATVNNDQQGNTEETEED

SEQ ID NO: 158533 - protein, 35 aa, Artificial Sequence
  Description of Artificial Sequence: Synthetic polypeptide
DSEEIRTTNPVATEQYGKVVHCATAPSHPQVTHNA

SEQ ID NO: 158534 - protein, 34 aa, Artificial Sequence
  Description of Artificial Sequence: Synthetic polypeptide
DEVEIATTNPVAYEQYGTVCSYTDGPVEDQGNND

SEQ ID NO: 158535 - protein, 33 aa, Artificial Sequence
  Description of Artificial Sequence: Synthetic polypeptide
DEMEIATTNPVAYEQYGTVCSAGDGPVDFEGND

SEQ ID NO: 158536 - protein, 34 aa, Artificial Sequence
  Description of Artificial Sequence: Synthetic polypeptide
NEGEIRTTNPVATEQYGCLGVDQLVEQIGNEEMN

SEQ ID NO: 158537 - protein, 34 aa, Artificial Sequence
  Description of Artificial Sequence: Synthetic polypeptide
DEQEIRTTNPVATECWGSFGPCINEQEAREAENG

SEQ ID NO: 158538 - protein, 33 aa, Artificial Sequence
  Description of Artificial Sequence: Synthetic polypeptide
DEQEIRTTNPVATECWGSFGQINEPEAREFENG

SEQ ID NO: 158539 - protein, 34 aa, Artificial Sequence
  Description of Artificial Sequence: Synthetic polypeptide
DEAEIRATNPVATECWGSVSRCINEPQSSDFENM

SEQ ID NO: 158540 - protein, 36 aa, Artificial Sequence
  Description of Artificial Sequence: Synthetic polypeptide
DEEEIATTNPVATEQYGSVCSPADNNHNIDAMGEGA

SEQ ID NO: 158541 - protein, 34 aa, Artificial Sequence
  Description of Artificial Sequence: Synthetic polypeptide
QEEEIRTTNPVATEGYGSVVMGVGMEGEGGQENI

SEQ ID NO: 158542 - protein, 35 aa, Artificial Sequence
  Description of Artificial Sequence: Synthetic polypeptide
DEMEIATTNPVAYEEWGSVATGNMLGDAQGGNNQE

SEQ ID NO: 158543 - protein, 34 aa, Artificial Sequence
  Description of Artificial Sequence: Synthetic polypeptide
DEENICCTTNPVAYEPYGQVCCTEEASQASGNRV

SEQ ID NO: 158544 - protein, 38 aa, Artificial Sequence
  Description of Artificial Sequence: Synthetic polypeptide
DEEAIRTTNPVATEQYGSIVNGTETLDDQTGSNFEDQI

SEQ ID NO: 158545 - protein, 34 aa, Artificial Sequence
  Description of Artificial Sequence: Synthetic polypeptide
DENEIATTNPVATEQYGSVAANHSGDNGMDPSGG

SEQ ID NO: 158546 - protein, 28 aa, Artificial Sequence
  Description of Artificial Sequence: Synthetic peptide
QESEIASTNPVATEGYGVMASVCQHEDK

SEQ ID NO: 158547 - protein, 37 aa, Artificial Sequence
  Description of Artificial Sequence: Synthetic polypeptide
DEEEIRTTNPVATEQYGSVQSCTTGTIQVPISEMEAQ

SEQ ID NO: 158548 - protein, 32 aa, Artificial Sequence
  Description of Artificial Sequence: Synthetic polypeptide
DENEIRTTNPVSHEPYGTISMEDMQQQQNGNH

SEQ ID NO: 158549 - protein, 37 aa, Artificial Sequence
  Description of Artificial Sequence: Synthetic polypeptide
DEEEIRTTNPVATEQYGSVPPWTPTMNADDTVILPRL

SEQ ID NO: 158550 - protein, 34 aa, Artificial Sequence
  Description of Artificial Sequence: Synthetic polypeptide
AEDEICATNPVATEQYGVVAVSNENLQQGTVTDT

SEQ ID NO: 158551 - protein, 36 aa, Artificial Sequence
  Description of Artificial Sequence: Synthetic polypeptide
DEEEIRTTNPVAYERYGSTVVACSGNALNVVTDDSR

SEQ ID NO: 158552 - protein, 36 aa, Artificial Sequence
  Description of Artificial Sequence: Synthetic polypeptide
DEEEIATTNPVATEQYGSVCAMNNGGEPTDSGGENN

SEQ ID NO: 158553 - protein, 36 aa, Artificial Sequence
  Description of Artificial Sequence: Synthetic polypeptide
DEEEIRTTNPVATEQYGSYGGTDDDDEGEGNQNEQE

SEQ ID NO: 158554 - protein, 36 aa, Artificial Sequence
  Description of Artificial Sequence: Synthetic polypeptide
QEEEIRTTNPVATEQYGSVMGENNQNMDEGGEGDDT

SEQ ID NO: 158555 - protein, 38 aa, Artificial Sequence
  Description of Artificial Sequence: Synthetic polypeptide
DEEEIRTTNPVATEQYGVVSTVVVTQAGNNDTEEEEEQ

SEQ ID NO: 158556 - protein, 37 aa, Artificial Sequence
  Description of Artificial Sequence: Synthetic polypeptide
DEENEIATTNPVAYEQYGTVATTNGGDQQNGNQRGEA

SEQ ID NO: 158557 - protein, 33 aa, Artificial Sequence
  Description of Artificial Sequence: Synthetic polypeptide
DEQEIRTTNPVATECWGSFGCINEPEAREEQNG

SEQ ID NO: 158558 - protein, 35 aa, Artificial Sequence
  Description of Artificial Sequence: Synthetic polypeptide
DEEAISTTNPVATEQYGCVCSNWGELQNFNSDNQA

SEQ ID NO: 158559 - protein, 37 aa, Artificial Sequence
  Description of Artificial Sequence: Synthetic polypeptide
DEEEIRSTNPVAYEQYGSVVSYELNEGAGARVGNMAT

SEQ ID NO: 158560 - protein, 37 aa, Artificial Sequence
  Description of Artificial Sequence: Synthetic polypeptide
DEEAIRTTNPVATEQYGSIVNGTETLDDMTGSNDFQI

SEQ ID NO: 158561 - protein, 35 aa, Artificial Sequence
  Description of Artificial Sequence: Synthetic polypeptide
QEEEIRTTNPVATEQYGSVMGINNMTNQGEFTDET

SEQ ID NO: 158562 - protein, 37 aa, Artificial Sequence
  Description of Artificial Sequence: Synthetic polypeptide
DEEEIATTNPVATEQYGSVCSPANTHGQMEPGGAGEN

SEQ ID NO: 158563 - protein, 32 aa, Artificial Sequence
  Description of Artificial Sequence: Synthetic polypeptide
SEEEIRCTNPIAYEQWGCVWGENDMHRDGSDR

SEQ ID NO: 158564 - protein, 32 aa, Artificial Sequence
  Description of Artificial Sequence: Synthetic polypeptide
SEEEIRCTNPIAYEQWGCVWGENDMHRDKQNR

SEQ ID NO: 158565 - protein, 36 aa, Artificial Sequence
  Description of Artificial Sequence: Synthetic polypeptide
DEVEIATTNPVAYEQYGTVCSYTDGLVEEQNGNGES

SEQ ID NO: 158566 - protein, 32 aa, Artificial Sequence
  Description of Artificial Sequence: Synthetic polypeptide
DENEIRTTNPVSMEPYGTISMEDIQFQQNGNH

SEQ ID NO: 158567 - protein, 31 aa, Artificial Sequence
  Description of Artificial Sequence: Synthetic polypeptide
QESEIASTNPVATEGYGVTTANATLAEPGDI

SEQ ID NO: 158568 - protein, 35 aa, Artificial Sequence
  Description of Artificial Sequence: Synthetic polypeptide
DECEICTTNPVATEQYGSVSTVVATQEDTEEDEDT

SEQ ID NO: 158569 - protein, 34 aa, Artificial Sequence
  Description of Artificial Sequence: Synthetic polypeptide
DENEIATTNPVATEQYGDVSSTTPAGPNMHGMEL

SEQ ID NO: 158570 - protein, 29 aa, Artificial Sequence
  Description of Artificial Sequence: Synthetic peptide
DDNEVASTNPVSTEGYGNVANTIQHVGQR

SEQ ID NO: 158571 - protein, 37 aa, Artificial Sequence
  Description of Artificial Sequence: Synthetic polypeptide
DEGEIRTTNPVATEQYGSVCSVNANGTFGFFNSHQDK

SEQ ID NO: 158572 - protein, 32 aa, Artificial Sequence
  Description of Artificial Sequence: Synthetic polypeptide
AENEIACTNPVATEQYGCSCSWEDQYFNSDQA

SEQ ID NO: 158573 - protein, 37 aa, Artificial Sequence
  Description of Artificial Sequence: Synthetic polypeptide
DEGEIRTTNPVATEQYGSVFVWINPEDQDRKMGQGDA

SEQ ID NO: 158574 - protein, 31 aa, Artificial Sequence
  Description of Artificial Sequence: Synthetic polypeptide
QESEIASTNPVATEGYGVTTANATLAEHGDI

SEQ ID NO: 158575 - protein, 32 aa, Artificial Sequence
  Description of Artificial Sequence: Synthetic polypeptide
AENEIACTNPVATEQYGCSCSWEDQNFGSEQS

SEQ ID NO: 158576 - protein, 37 aa, Artificial Sequence
  Description of Artificial Sequence: Synthetic polypeptide
DEVEIATTNPVAYEQYGTVCSYTDGLNEEQRGENNES

SEQ ID NO: 158577 - protein, 34 aa, Artificial Sequence
  Description of Artificial Sequence: Synthetic polypeptide
DEEAISTTNPVATEQYGCVCSTGEHQESFTSDQA

SEQ ID NO: 158578 - protein, 37 aa, Artificial Sequence
  Description of Artificial Sequence: Synthetic polypeptide
DEEEIRTTNPVATEQYGSVQSITVGTIQVPISEMETQ

SEQ ID NO: 158579 - protein, 36 aa, Artificial Sequence
  Description of Artificial Sequence: Synthetic polypeptide
DSEEIRTTNPVATEQYGSVAPFPDAELYNFEGSNQH

SEQ ID NO: 158580 - protein, 36 aa, Artificial Sequence
  Description of Artificial Sequence: Synthetic polypeptide
DEGEIRTTNPVATEQYGSVCSVNANGTAFFNSHQDT

SEQ ID NO: 158581 - protein, 34 aa, Artificial Sequence
  Description of Artificial Sequence: Synthetic polypeptide
DEMEIATTNPVAYEQYGTVCSATDGPDEEMEGND

SEQ ID NO: 158582 - protein, 30 aa, Artificial Sequence
  Description of Artificial Sequence: Synthetic polypeptide
QEQEIAPTNPCSYEQWGIVSCNLQSGDTSD

SEQ ID NO: 158583 - protein, 35 aa, Artificial Sequence
  Description of Artificial Sequence: Synthetic polypeptide
SEEEIRTTNPVATEQYGVVSTEMAAWEEGTQASPG

SEQ ID NO: 158584 - protein, 33 aa, Artificial Sequence
  Description of Artificial Sequence: Synthetic polypeptide
DEQEIRTTNPVATECWGSTWANADLADHKGPDI

SEQ ID NO: 158585 - protein, 38 aa, Artificial Sequence
  Description of Artificial Sequence: Synthetic polypeptide
DEEEIRTTNPVATEQYGVVSTVVVTQAGNNDTEEGTET

SEQ ID NO: 158586 - protein, 30 aa, Artificial Sequence
  Description of Artificial Sequence: Synthetic polypeptide
QEQEIAPTNPCSYEQWGIVSCNDQSGDTSR

SEQ ID NO: 158587 - protein, 35 aa, Artificial Sequence
  Description of Artificial Sequence: Synthetic polypeptide
DEEEIRTTNPVATEQYGMVNIMDGEMQEGGGEQGA

SEQ ID NO: 158588 - protein, 35 aa, Artificial Sequence
  Description of Artificial Sequence: Synthetic polypeptide
QEEEIRTTNPVATEQYGSVMGQNMEDEGGEDQQGV

SEQ ID NO: 158589 - protein, 33 aa, Artificial Sequence
  Description of Artificial Sequence: Synthetic polypeptide
NEEEIACTNPVATEQYGCSATGHLAPDQMGQEM

SEQ ID NO: 158590 - protein, 37 aa, Artificial Sequence
  Description of Artificial Sequence: Synthetic polypeptide
DEDEIRTTNPVATEQYGVVSTVTNTQQGTEQGATEEG

SEQ ID NO: 158591 - protein, 36 aa, Artificial Sequence
  Description of Artificial Sequence: Synthetic polypeptide
DEEEIRTTNPVATEQYGSICCEWQNQQQDRVVELEQ

SEQ ID NO: 158592 - protein, 32 aa, Artificial Sequence
  Description of Artificial Sequence: Synthetic polypeptide
DEEEIRTTNPVATEQWGATAWAADWQEHKEPK

SEQ ID NO: 158593 - protein, 35 aa, Artificial Sequence
  Description of Artificial Sequence: Synthetic polypeptide
DEVEIATTNPVAYEQYGTVCSYTDGLPVEHAGNDS

SEQ ID NO: 158594 - protein, 33 aa, Artificial Sequence
  Description of Artificial Sequence: Synthetic polypeptide
DESEIRTTNPIATECWGSVWAAIDWPAEREGNG

SEQ ID NO: 158595 - protein, 36 aa, Artificial Sequence
  Description of Artificial Sequence: Synthetic polypeptide
NEGEIRTTNPVATEQYGSVCSEEWPLEEEMMENIRD

SEQ ID NO: 158596 - protein, 36 aa, Artificial Sequence
  Description of Artificial Sequence: Synthetic polypeptide
DEEEIRTTNPVATEQYGSVPPWNGMNVQLMMEVSEI

SEQ ID NO: 158597 - protein, 38 aa, Artificial Sequence
  Description of Artificial Sequence: Synthetic polypeptide
DSEEIRTTNPVATEQYGSFVNSTTPAEPNMENGMNDDG

SEQ ID NO: 158598 - protein, 37 aa, Artificial Sequence
  Description of Artificial Sequence: Synthetic polypeptide
DEEEIRTTNPVATEQYGSVQPTAVEVDQQMIEPPNIL

SEQ ID NO: 158599 - protein, 38 aa, Artificial Sequence
  Description of Artificial Sequence: Synthetic polypeptide
DEDEIRTTNPVATEQYGVVSTVTNTQQGTEQGNTTEVG

SEQ ID NO: 158600 - protein, 36 aa, Artificial Sequence
  Description of Artificial Sequence: Synthetic polypeptide
QEEEIRTTNPVATEQYGSVMGQVNMTDEGGEDNFTV

SEQ ID NO: 158601 - protein, 37 aa, Artificial Sequence
  Description of Artificial Sequence: Synthetic polypeptide
DEVEIATTNPVAYEQYGTVCSYTDGLNEGMQRGMNES

SEQ ID NO: 158602 - protein, 35 aa, Artificial Sequence
  Description of Artificial Sequence: Synthetic polypeptide
CEMEISTTNPVATEQYGTVCSATPGNPVEFQGNDP

SEQ ID NO: 158603 - protein, 31 aa, Artificial Sequence
  Description of Artificial Sequence: Synthetic polypeptide
DDNEVASTNPVSTEGYGNVAANTGQPRVGQR

SEQ ID NO: 158604 - protein, 36 aa, Artificial Sequence
  Description of Artificial Sequence: Synthetic polypeptide
DSEEIRTTNPVATEQYGSNASVQDAELENFEGSNQH

SEQ ID NO: 158605 - protein, 35 aa, Artificial Sequence
  Description of Artificial Sequence: Synthetic polypeptide
DECEICTTNPVATEQYGSVSTVVATQTEDTEEEDD

SEQ ID NO: 158606 - protein, 29 aa, Artificial Sequence
  Description of Artificial Sequence: Synthetic peptide
DDNEVASTNPVSTEGYGNVANCIQHVGQR

SEQ ID NO: 158607 - protein, 35 aa, Artificial Sequence
  Description of Artificial Sequence: Synthetic polypeptide
DDGEIRTTNPVATEQYGSVIVTYANTTESFQENQF

SEQ ID NO: 158608 - protein, 35 aa, Artificial Sequence
  Description of Artificial Sequence: Synthetic polypeptide
DEEEIRTTNPVATEQWGATTWANTEDGNMPKGNYI

SEQ ID NO: 158609 - protein, 31 aa, Artificial Sequence
  Description of Artificial Sequence: Synthetic polypeptide
DDSEVASTNPVSTEGYGNVAANTIQSRVGTR

SEQ ID NO: 158610 - protein, 35 aa, Artificial Sequence
  Description of Artificial Sequence: Synthetic polypeptide
DEQEIRTTNPVATDQYGSVVVTGFGQENDQDEDGT

SEQ ID NO: 158611 - protein, 35 aa, Artificial Sequence
  Description of Artificial Sequence: Synthetic polypeptide
DDMEICTTNPVATEQYGCVSTLLATQFNGLQDQMF

SEQ ID NO: 158612 - protein, 33 aa, Artificial Sequence
  Description of Artificial Sequence: Synthetic polypeptide
AENEIACTNPVATEQYGCSCSWNHNQYFGSEQS

SEQ ID NO: 158613 - protein, 37 aa, Artificial Sequence
  Description of Artificial Sequence: Synthetic polypeptide
DEEEIRTTNPVATEQYGMSNNQITNMGNGQEGGGQGT

SEQ ID NO: 158614 - protein, 38 aa, Artificial Sequence
  Description of Artificial Sequence: Synthetic polypeptide
DEEEIRTTNPVATEQYGMSSTVMTNGFQGGDEGGDTQL

SEQ ID NO: 158615 - protein, 37 aa, Artificial Sequence
  Description of Artificial Sequence: Synthetic polypeptide
DECEICTTNPVATEQYGTVATVNLQQSATNEEGENDD

SEQ ID NO: 158616 - protein, 37 aa, Artificial Sequence
  Description of Artificial Sequence: Synthetic polypeptide
DEEEIRTTNPVATEQYGSVYSPAMSMQTIVPTQVSTG

SEQ ID NO: 158617 - protein, 38 aa, Artificial Sequence
  Description of Artificial Sequence: Synthetic polypeptide
DEEEIRTTNPVATEQYGMSTTVMNTNGFGGDEGGNTNT

SEQ ID NO: 158618 - protein, 36 aa, Artificial Sequence
  Description of Artificial Sequence: Synthetic polypeptide
DEEEIRTTNPVATEQYGSICSEWQNQQDQVVPELEQ

SEQ ID NO: 158619 - protein, 35 aa, Artificial Sequence
  Description of Artificial Sequence: Synthetic polypeptide
DESEIKTTNPVATEQYGVVITNDQNIGGEDGGQEE

SEQ ID NO: 158620 - protein, 32 aa, Artificial Sequence
  Description of Artificial Sequence: Synthetic polypeptide
DEEEIRTTNPIATECWGATVWANENWAEPGPI

SEQ ID NO: 158621 - protein, 36 aa, Artificial Sequence
  Description of Artificial Sequence: Synthetic polypeptide
DEEEIRTTNPVATEQYGMVSVIMDGEMQEGIGEQGG

SEQ ID NO: 158622 - protein, 36 aa, Artificial Sequence
  Description of Artificial Sequence: Synthetic polypeptide
DEEEIATTNPVATEQYGSVCAAMNHDEQAMNPDDNP

SEQ ID NO: 158623 - protein, 32 aa, Artificial Sequence
  Description of Artificial Sequence: Synthetic polypeptide
DENEIRTTNPVSHEPYGTISMEDIQQQQNGNH

SEQ ID NO: 158624 - protein, 32 aa, Artificial Sequence
  Description of Artificial Sequence: Synthetic polypeptide
SEEEIRCTNPIAYEAWGCVWGENDMHRDGENR

SEQ ID NO: 158625 - protein, 37 aa, Artificial Sequence
  Description of Artificial Sequence: Synthetic polypeptide
DEEEIRTTNPVATEQYGMSTTVMTNGFGGDEGGTTGQ

SEQ ID NO: 158626 - protein, 39 aa, Artificial Sequence
  Description of Artificial Sequence: Synthetic polypeptide
DEDEIRTTNPVATEQYGVVSTVNQNNQLQGIGTTNQDED

SEQ ID NO: 158627 - protein, 36 aa, Artificial Sequence
  Description of Artificial Sequence: Synthetic polypeptide
DEEEIRTTNPVATEQYGMSTTVVTDGFGDDEGGETN

SEQ ID NO: 158628 - protein, 31 aa, Artificial Sequence
  Description of Artificial Sequence: Synthetic polypeptide
DDSEVASTNPVSTEGYGNVAANTIQSRVGSR

SEQ ID NO: 158629 - protein, 36 aa, Artificial Sequence
  Description of Artificial Sequence: Synthetic polypeptide
DEEEIATTNPVATEQYGSVCAAMMHGQNEMGNNSDH

SEQ ID NO: 158630 - protein, 37 aa, Artificial Sequence
  Description of Artificial Sequence: Synthetic polypeptide
DEEEIRTTNPVAYERYGICTVSYEGNELSDVRGDVRF

SEQ ID NO: 158631 - protein, 35 aa, Artificial Sequence
  Description of Artificial Sequence: Synthetic polypeptide
DEEEIACTNPVATEQYGSACAANDLAPDAQAGEHM

SEQ ID NO: 158632 - protein, 33 aa, Artificial Sequence
  Description of Artificial Sequence: Synthetic polypeptide
AENEIACTNPVATEQYGCSCSWNLNTHFGSDQA

SEQ ID NO: 158633 - protein, 36 aa, Artificial Sequence
  Description of Artificial Sequence: Synthetic polypeptide
DAEEIATTNPVAYEQYGSVCATNPQLNPDDQMGGMA

SEQ ID NO: 158634 - protein, 35 aa, Artificial Sequence
  Description of Artificial Sequence: Synthetic polypeptide
DDMEIRTTNPVATEQYGCVSTLLATTFNGDQDQEV

SEQ ID NO: 158635 - protein, 36 aa, Artificial Sequence
  Description of Artificial Sequence: Synthetic polypeptide
DDMEIRTTNPVATEQYGCVSTDLRATQFNGLQDQEF

SEQ ID NO: 158636 - protein, 35 aa, Artificial Sequence
  Description of Artificial Sequence: Synthetic polypeptide
DEEEIRTTNPVATEQYGSIYLMAGEEQMIMNAEEL

SEQ ID NO: 158637 - protein, 37 aa, Artificial Sequence
  Description of Artificial Sequence: Synthetic polypeptide
DEEEIRTTNPVATEQYGSVPRVNALMMDSMLQESLVH

SEQ ID NO: 158638 - protein, 35 aa, Artificial Sequence
  Description of Artificial Sequence: Synthetic polypeptide
DEEEISTTNPVATEQYGQCVCSWGEHNQYFNSDQS

SEQ ID NO: 158639 - protein, 35 aa, Artificial Sequence
  Description of Artificial Sequence: Synthetic polypeptide
DEEEIACTNPVATEQYGCVATPAITQPDDGMENGM

SEQ ID NO: 158640 - protein, 35 aa, Artificial Sequence
  Description of Artificial Sequence: Synthetic polypeptide
DEEEIRATNPVATEQWGGCVAATGHLDTGMMGNHV

SEQ ID NO: 158641 - protein, 32 aa, Artificial Sequence
  Description of Artificial Sequence: Synthetic polypeptide
DENEIRTTNPVSHEPYGTISMCDIQQQQNGNH

SEQ ID NO: 158642 - protein, 35 aa, Artificial Sequence
  Description of Artificial Sequence: Synthetic polypeptide
DEEEIRATNPVATEQWGGCVAIMNHGDEQAGMENN

SEQ ID NO: 158643 - protein, 35 aa, Artificial Sequence
  Description of Artificial Sequence: Synthetic polypeptide
DENEIATTNPVATEQYGSCAAMGNGGTNTADGNDN

SEQ ID NO: 158644 - protein, 38 aa, Artificial Sequence
  Description of Artificial Sequence: Synthetic polypeptide
DEEEIRTTNPVATEQYGSVQQPTPAEGPNMQNGMVPVA

SEQ ID NO: 158645 - protein, 32 aa, Artificial Sequence
  Description of Artificial Sequence: Synthetic polypeptide
DEEEIRTTNPIATECWGATVWANANWAEPGPI

SEQ ID NO: 158646 - protein, 32 aa, Artificial Sequence
  Description of Artificial Sequence: Synthetic polypeptide
DENEIRTTNPVSHEPYGTISMEDIQFQQNGNH

SEQ ID NO: 158647 - protein, 34 aa, Artificial Sequence
  Description of Artificial Sequence: Synthetic polypeptide
DENEIATTNPVATEQYGSCPAEGPHGENRDIDRD

SEQ ID NO: 158648 - protein, 37 aa, Artificial Sequence
  Description of Artificial Sequence: Synthetic polypeptide
DEDEIRTTNPVATEQYGVVSTVTNTQNGTEQGTTELG

SEQ ID NO: 158649 - protein, 38 aa, Artificial Sequence
  Description of Artificial Sequence: Synthetic polypeptide
DEEEIRTTNPVAYERYGISTVPSYEGNELSDVRGKVRN

SEQ ID NO: 158650 - protein, 32 aa, Artificial Sequence
  Description of Artificial Sequence: Synthetic polypeptide
DDSEVATTNPVSTEPYGTISANEDIQQRVGNH

SEQ ID NO: 158651 - protein, 36 aa, Artificial Sequence
  Description of Artificial Sequence: Synthetic polypeptide
DEMEIATTNPVAYEQYGTVATENGGGQQNGNQRGEA

SEQ ID NO: 158652 - protein, 31 aa, Artificial Sequence
  Description of Artificial Sequence: Synthetic polypeptide
DEEEIRTTNPIATECWGATWAADCQPKGEYI

SEQ ID NO: 158653 - protein, 36 aa, Artificial Sequence
  Description of Artificial Sequence: Synthetic polypeptide
DAEEIATTNPVAYEQYGSVCATNPQLNPDDQTGGTM

SEQ ID NO: 158654 - protein, 33 aa, Artificial Sequence
  Description of Artificial Sequence: Synthetic polypeptide
AENEIACTNPVATEQYGCSCSWNDQNFGSGTQS

SEQ ID NO: 158655 - protein, 31 aa, Artificial Sequence
  Description of Artificial Sequence: Synthetic polypeptide
DDNEVASTNPVATECYGNVAANCIQSRVEQR

SEQ ID NO: 158656 - protein, 37 aa, Artificial Sequence
  Description of Artificial Sequence: Synthetic polypeptide
DEEEIRTTNPVATEQYGSICQTPSPNSDNFGLMVGME

SEQ ID NO: 158657 - protein, 31 aa, Artificial Sequence
  Description of Artificial Sequence: Synthetic polypeptide
DDMEIASTNPVSTEGYGTVAATTIQSFVGQR

SEQ ID NO: 158658 - protein, 36 aa, Artificial Sequence
  Description of Artificial Sequence: Synthetic polypeptide
DEEEIRTTNPVATEQYGMVGDDNGEGQNEEQEEDNQ

SEQ ID NO: 158659 - protein, 31 aa, Artificial Sequence
  Description of Artificial Sequence: Synthetic polypeptide
DDSEVATTNPVSTEGYGTVCSANTPEFVGQR

SEQ ID NO: 158660 - protein, 34 aa, Artificial Sequence
  Description of Artificial Sequence: Synthetic polypeptide
DEEEIRTTNPIATECWGSVWANAENWMEPKGPYR

SEQ ID NO: 158661 - protein, 32 aa, Artificial Sequence
  Description of Artificial Sequence: Synthetic polypeptide
DENEIRTTNPVSHEPYGTISMEDIQQQQNRNH

SEQ ID NO: 158662 - protein, 35 aa, Artificial Sequence
  Description of Artificial Sequence: Synthetic polypeptide
DEEEIATTNPVATEQYGSVCAAMNHDNAMENNEHA

SEQ ID NO: 158663 - protein, 31 aa, Artificial Sequence
  Description of Artificial Sequence: Synthetic polypeptide
DDNEVASTNPVATEGYGNVAANTIQSRVEQR

SEQ ID NO: 158664 - protein, 36 aa, Artificial Sequence
  Description of Artificial Sequence: Synthetic polypeptide
DEEEIRTTNPVATEQWGATWSTTPDGPNMPKGMNYI

SEQ ID NO: 158665 - protein, 33 aa, Artificial Sequence
  Description of Artificial Sequence: Synthetic polypeptide
AENEIACTNPVATEQYGCSCSWGEDQRFGSGQA

SEQ ID NO: 158666 - protein, 35 aa, Artificial Sequence
  Description of Artificial Sequence: Synthetic polypeptide
DEEEIRTTNPIATECWGSVWATTEAGAERKGMNYV

SEQ ID NO: 158667 - protein, 34 aa, Artificial Sequence
  Description of Artificial Sequence: Synthetic polypeptide
QESEIASTNPVATEGYGSMSSTSPAGPQRGMNPI

SEQ ID NO: 158668 - protein, 31 aa, Artificial Sequence
  Description of Artificial Sequence: Synthetic polypeptide
DDMEIASTNPVSTEGYGTVAANTIQSFVGQR

SEQ ID NO: 158669 - protein, 37 aa, Artificial Sequence
  Description of Artificial Sequence: Synthetic polypeptide
DEEAIRTTNPVATEQYGSIVNGTETQDDQTGSNEEQI

SEQ ID NO: 158670 - protein, 35 aa, Artificial Sequence
  Description of Artificial Sequence: Synthetic polypeptide
DEEEIRTTNPIATECWGSVWATTPAGAERKGMNYV

SEQ ID NO: 158671 - protein, 37 aa, Artificial Sequence
  Description of Artificial Sequence: Synthetic polypeptide
DEEEIRTTNPVATEQYGSVQRITMGEEQPEPGSVPEG

SEQ ID NO: 158672 - protein, 37 aa, Artificial Sequence
  Description of Artificial Sequence: Synthetic polypeptide
DEEEIRTCNPVATEAYGSVSVGGQRGLTQGDNGQGEI

SEQ ID NO: 158673 - protein, 38 aa, Artificial Sequence
  Description of Artificial Sequence: Synthetic polypeptide
DEEAIRTTNPVATEQYGSIVNGTETLPDDQTGSNEYQI

SEQ ID NO: 158674 - protein, 33 aa, Artificial Sequence
  Description of Artificial Sequence: Synthetic polypeptide
SEEEIRCTNPIAYEQWGCVWGENDHMHRDGNTR

SEQ ID NO: 158675 - protein, 36 aa, Artificial Sequence
  Description of Artificial Sequence: Synthetic polypeptide
DEEHIRTTNPVAYEEWGCSVSCTNTGFSQSGEGNAA

SEQ ID NO: 158676 - protein, 37 aa, Artificial Sequence
  Description of Artificial Sequence: Synthetic polypeptide
DEGEIRTTNPVATEQYGSVECETDLGLDTIYDQGQQR

SEQ ID NO: 158677 - protein, 36 aa, Artificial Sequence
  Description of Artificial Sequence: Synthetic polypeptide
DEEEIRTTNPVATEQYGMVADDDDEGDQDEGETNGT

SEQ ID NO: 158678 - protein, 36 aa, Artificial Sequence
  Description of Artificial Sequence: Synthetic polypeptide
DEEEIRTTNPVATEQYGSICSEWQNQNADRVVELEQ

SEQ ID NO: 158679 - protein, 37 aa, Artificial Sequence
  Description of Artificial Sequence: Synthetic polypeptide
DEEEIRTTNPVATEQYGSVPQVTPNPQTVPSFQVFEI

SEQ ID NO: 158680 - protein, 32 aa, Artificial Sequence
  Description of Artificial Sequence: Synthetic polypeptide
DENEIASTNPVSTEGYGTIANETIQQQQNGNR

SEQ ID NO: 158681 - protein, 34 aa, Artificial Sequence
  Description of Artificial Sequence: Synthetic polypeptide
DSEEIRTTNPVATEQWGQCTVNIGVLSMRLTNQE

SEQ ID NO: 158682 - protein, 32 aa, Artificial Sequence
  Description of Artificial Sequence: Synthetic polypeptide
DDSEVRTTNPVSTEGWGNVSACTIQSRVGENG

SEQ ID NO: 158683 - protein, 36 aa, Artificial Sequence
  Description of Artificial Sequence: Synthetic polypeptide
DEEAIRTTNPVATEQYGSVNSNENQWDDDRVEEEEG

SEQ ID NO: 158684 - protein, 35 aa, Artificial Sequence
  Description of Artificial Sequence: Synthetic polypeptide
DEEAIRTTNPVATEQYGSVNATEQWDDDRVEEEFG

SEQ ID NO: 158685 - protein, 35 aa, Artificial Sequence
  Description of Artificial Sequence: Synthetic polypeptide
DEQEIATTNPVAYEQYGSTVSCTLSSEDHEGGENL

SEQ ID NO: 158686 - protein, 31 aa, Artificial Sequence
  Description of Artificial Sequence: Synthetic polypeptide
DDNEVASTNPVATEGYGNVAANCIQSRVEQR

SEQ ID NO: 158687 - protein, 36 aa, Artificial Sequence
  Description of Artificial Sequence: Synthetic polypeptide
DEEHIRTTNPVATEGWGSGVYATNNPLVELTGVERK

SEQ ID NO: 158688 - protein, 37 aa, Artificial Sequence
  Description of Artificial Sequence: Synthetic polypeptide
AEEEIRTTNPVATEQYGVVSTTLQQQLQANTNVATEL

SEQ ID NO: 158689 - protein, 35 aa, Artificial Sequence
  Description of Artificial Sequence: Synthetic polypeptide
DSEEIRTTNPVATEQWGQVTVCTGVLSQNTGTPQE

SEQ ID NO: 158690 - protein, 35 aa, Artificial Sequence
  Description of Artificial Sequence: Synthetic polypeptide
DSEEIRTTNPVATEQWGQVTVPIQVLSQNTGTNQE

SEQ ID NO: 158691 - protein, 35 aa, Artificial Sequence
  Description of Artificial Sequence: Synthetic polypeptide
DSEEIRTTNPVATEQWGQVTVPTGVLSQNLVTNQE

SEQ ID NO: 158692 - protein, 37 aa, Artificial Sequence
  Description of Artificial Sequence: Synthetic polypeptide
DEEHIRTTNPVATEQYGAVYSPTVMAGPNMRNGMNPV

SEQ ID NO: 158693 - protein, 37 aa, Artificial Sequence
  Description of Artificial Sequence: Synthetic polypeptide
DEEEIRTTNPVATEQYGMTTIMQTNGDGQQGGENEGN

SEQ ID NO: 158694 - protein, 33 aa, Artificial Sequence
  Description of Artificial Sequence: Synthetic polypeptide
DESEIRTTNPIATECWGAVSAIDEQERKGEPYI

SEQ ID NO: 158695 - protein, 36 aa, Artificial Sequence
  Description of Artificial Sequence: Synthetic polypeptide
DEEEIRTTNPVATEQYGMTTIMQTNGGDEGGENEGN

SEQ ID NO: 158696 - protein, 29 aa, Artificial Sequence
  Description of Artificial Sequence: Synthetic peptide
DENEIASTNPVGTEGWGDMAETLQAAGDA

SEQ ID NO: 158697 - protein, 31 aa, Artificial Sequence
  Description of Artificial Sequence: Synthetic polypeptide
DEEEIRTTNPIATECWGATWAADCQPKGPYI

SEQ ID NO: 158698 - protein, 35 aa, Artificial Sequence
  Description of Artificial Sequence: Synthetic polypeptide
CEEEISTTNPVATEQYGCVCSNTEHNQYFNSDPQS

SEQ ID NO: 158699 - protein, 31 aa, Artificial Sequence
  Description of Artificial Sequence: Synthetic polypeptide
AENEIACTNPVATEQYGETTSEEDLAPKGGI

SEQ ID NO: 158700 - protein, 32 aa, Artificial Sequence
  Description of Artificial Sequence: Synthetic polypeptide
CEEEIACTNPVATAQWGSVSAGGPDEAGGNHN

SEQ ID NO: 158701 - protein, 31 aa, Artificial Sequence
  Description of Artificial Sequence: Synthetic polypeptide
QESEIASTNPVGTEGYGAVMASTLSQHGHDI

SEQ ID NO: 158702 - protein, 36 aa, Artificial Sequence
  Description of Artificial Sequence: Synthetic polypeptide
DEEEIRTTNPVATEQYGQCVCSNTGEHQENFPSEQP

SEQ ID NO: 158703 - protein, 37 aa, Artificial Sequence
  Description of Artificial Sequence: Synthetic polypeptide
DEGEIRTTNPVATEQYGCWSSFTINPLPERDEHNQNE

SEQ ID NO: 158704 - protein, 32 aa, Artificial Sequence
  Description of Artificial Sequence: Synthetic polypeptide
QENEIRTTNPVSTEPYGTISMEDIQQQQNGNL

SEQ ID NO: 158705 - protein, 33 aa, Artificial Sequence
  Description of Artificial Sequence: Synthetic polypeptide
DEECIATTNPVAYEQWGTYVYTQDSSDDRGENA

SEQ ID NO: 158706 - protein, 38 aa, Artificial Sequence
  Description of Artificial Sequence: Synthetic polypeptide
DEEEIRTTNPVATEQYGQCVCSNTGELNQEFFNSDFQA

SEQ ID NO: 158707 - protein, 30 aa, Artificial Sequence
  Description of Artificial Sequence: Synthetic polypeptide
QESEIASTNPVGTEGYGCMCQSTLNQHGDI

SEQ ID NO: 158708 - protein, 31 aa, Artificial Sequence
  Description of Artificial Sequence: Synthetic polypeptide
QESEIASTNPVGTEGYGCVFMSASTLQHGDI

SEQ ID NO: 158709 - protein, 37 aa, Artificial Sequence
  Description of Artificial Sequence: Synthetic polypeptide
DEGEIRTTNPVATEQYGCWCSVTTVNHQDFTGFVEDY

SEQ ID NO: 158710 - protein, 36 aa, Artificial Sequence
  Description of Artificial Sequence: Synthetic polypeptide
DEGEIRTTNPVATEQYGCVWSETVNDENETSQEDYQ

SEQ ID NO: 158711 - protein, 38 aa, Artificial Sequence
  Description of Artificial Sequence: Synthetic polypeptide
DEEEIRTTNPVATEAYGVVSTVVTNNNDQQGNTNQTED

SEQ ID NO: 158712 - protein, 32 aa, Artificial Sequence
  Description of Artificial Sequence: Synthetic polypeptide
QENEIRTTNPVSTEPYGTISMEDIQQQQNGNH

SEQ ID NO: 158713 - protein, 39 aa, Artificial Sequence
  Description of Artificial Sequence: Synthetic polypeptide
DEEEIRTTNPVATEQYGVVSTVVVVTNQNQNQQGTTNDD

SEQ ID NO: 158714 - protein, 28 aa, Artificial Sequence
  Description of Artificial Sequence: Synthetic peptide
QESEIASTNPVGTEGYGEMASTCQHEDI

SEQ ID NO: 158715 - protein, 32 aa, Artificial Sequence
  Description of Artificial Sequence: Synthetic polypeptide
QEGEIAPTNPCSYEQYGKVSCCNELSQSVTNR

SEQ ID NO: 158716 - protein, 34 aa, Artificial Sequence
  Description of Artificial Sequence: Synthetic polypeptide
SEEEIRTTNPVAYEQWGHNNVSYWEEQQHRPGQS

SEQ ID NO: 158717 - protein, 38 aa, Artificial Sequence
  Description of Artificial Sequence: Synthetic polypeptide
DEEEIRTTNPVATEQYGQCVCSNTGNHEQENFGSETQA

SEQ ID NO: 158718 - protein, 36 aa, Artificial Sequence
  Description of Artificial Sequence: Synthetic polypeptide
DEEEIRTTNPVATEQYGSVPPPPLLEEVPMGILEQV

SEQ ID NO: 158719 - protein, 34 aa, Artificial Sequence
  Description of Artificial Sequence: Synthetic polypeptide
DEGEIRTTNPVATEQYGCVSWEDDEIHEDFEDRA

SEQ ID NO: 158720 - protein, 36 aa, Artificial Sequence
  Description of Artificial Sequence: Synthetic polypeptide
DSYEIRTTNPVATEQYGSVCSIIMLEELGNGNEEVF

SEQ ID NO: 158721 - protein, 34 aa, Artificial Sequence
  Description of Artificial Sequence: Synthetic polypeptide
DENEIRTTNPVATEQWGKVPSAGESMNAAEGDAG

SEQ ID NO: 158722 - protein, 37 aa, Artificial Sequence
  Description of Artificial Sequence: Synthetic polypeptide
DEEEIRTTNPVATEQYGQCVCSNTGEHNQNFNSDTQA

SEQ ID NO: 158723 - protein, 34 aa, Artificial Sequence
  Description of Artificial Sequence: Synthetic polypeptide
CEEEIATTNPVATEQWGCVAGTGELAQNNSQNHP

SEQ ID NO: 158724 - protein, 34 aa, Artificial Sequence
  Description of Artificial Sequence: Synthetic polypeptide
DEVEIATTNPVAYECWGVVCSNDNGQERDGDIRR

SEQ ID NO: 158725 - protein, 37 aa, Artificial Sequence
  Description of Artificial Sequence: Synthetic polypeptide
DEEEIRTTNPVATEQYGQCVCSNTGEHNQGFGSQTQS

SEQ ID NO: 158726 - protein, 30 aa, Artificial Sequence
  Description of Artificial Sequence: Synthetic polypeptide
QESEIASTNPVGTEGWGVSASTLQHGDEAM

SEQ ID NO: 158727 - protein, 35 aa, Artificial Sequence
  Description of Artificial Sequence: Synthetic polypeptide
DEEEIACTNPVATEQWGSVACSEGLAATAGDPNEN

SEQ ID NO: 158728 - protein, 39 aa, Artificial Sequence
  Description of Artificial Sequence: Synthetic polypeptide
DEDEIRTTNPVATEQYGVVSTTNNGLLLQGIGTTNQEED

SEQ ID NO: 158729 - protein, 33 aa, Artificial Sequence
  Description of Artificial Sequence: Synthetic polypeptide
DENEIRTTNPVSTEGYGTISVEDEQQPQSGQHN

SEQ ID NO: 158730 - protein, 36 aa, Artificial Sequence
  Description of Artificial Sequence: Synthetic polypeptide
DEEEIRTTNPVATEQYGSVGEMMWELVPIAQGEEED

SEQ ID NO: 158731 - protein, 38 aa, Artificial Sequence
  Description of Artificial Sequence: Synthetic polypeptide
DEEEIRTTNPVATEQYGVVSTVVVVNNQQGTEEEEEEA

SEQ ID NO: 158732 - protein, 37 aa, Artificial Sequence
  Description of Artificial Sequence: Synthetic polypeptide
DEEEIRTTNPVATEQYGVVSTVVVVNQQGTEEEEEEE

SEQ ID NO: 158733 - protein, 36 aa, Artificial Sequence
  Description of Artificial Sequence: Synthetic polypeptide
DEAEIRTTNCVAYCQYGSTVPSCGNENSQRTEGDNE

SEQ ID NO: 158734 - protein, 35 aa, Artificial Sequence
  Description of Artificial Sequence: Synthetic polypeptide
DEEEIATTNPVATEQYGSVCAANMGEEADDNMNGN

SEQ ID NO: 158735 - protein, 36 aa, Artificial Sequence
  Description of Artificial Sequence: Synthetic polypeptide
DEEEIRTTNPVATEQYGSVYLTEFQHIQPTIQVIDT

SEQ ID NO: 158736 - protein, 36 aa, Artificial Sequence
  Description of Artificial Sequence: Synthetic polypeptide
DEEEIATTNPVATEQYGSVCAANMGEEAGDSGMENG

SEQ ID NO: 158737 - protein, 32 aa, Artificial Sequence
  Description of Artificial Sequence: Synthetic polypeptide
QENEIRTTNPVSTEPYGTISMEDLQQQQNGEH

SEQ ID NO: 158738 - protein, 36 aa, Artificial Sequence
  Description of Artificial Sequence: Synthetic polypeptide
DEEEIATTNPVATEQYGSVCAANMGEEAIDDGDNMA

SEQ ID NO: 158739 - protein, 34 aa, Artificial Sequence
  Description of Artificial Sequence: Synthetic polypeptide
NENAEIATTNPVAYEQWGSVPTLDGNLQQGDESN

SEQ ID NO: 158740 - protein, 32 aa, Artificial Sequence
  Description of Artificial Sequence: Synthetic polypeptide
QENEIRTTNPVSTEPYGTISMEDIQQQQNGNQ

SEQ ID NO: 158741 - protein, 31 aa, Artificial Sequence
  Description of Artificial Sequence: Synthetic polypeptide
DDSEVASTNPVSTEGYGNVAANTSQSRVGQR

SEQ ID NO: 158742 - protein, 31 aa, Artificial Sequence
  Description of Artificial Sequence: Synthetic polypeptide
DSSEVNSTNPVSTEGYGNVAANTIQSRVGQR

SEQ ID NO: 158743 - protein, 35 aa, Artificial Sequence
  Description of Artificial Sequence: Synthetic polypeptide
QEEEIRTTNPVATEFYGSVVNTDNMIETGGGQEQG

SEQ ID NO: 158744 - protein, 39 aa, Artificial Sequence
  Description of Artificial Sequence: Synthetic polypeptide
DEEEIRTTNPVATEQYGVVSTVVVVTNLQAGTEEEEQED

SEQ ID NO: 158745 - protein, 31 aa, Artificial Sequence
  Description of Artificial Sequence: Synthetic polypeptide
DESEIATTNPVSTEGYGTIAMDIQQQHNGNI

SEQ ID NO: 158746 - protein, 37 aa, Artificial Sequence
  Description of Artificial Sequence: Synthetic polypeptide
DEEEIRTTNPVATEQYGQCVCSNTGEHNQESFGSQQE

SEQ ID NO: 158747 - protein, 39 aa, Artificial Sequence
  Description of Artificial Sequence: Synthetic polypeptide
DEEEIRTTNPVATEQYGVVSTVVVVTNLQQGTEDEEETD

SEQ ID NO: 158748 - protein, 34 aa, Artificial Sequence
  Description of Artificial Sequence: Synthetic polypeptide
DTAEIACTNPVATEQYGCVAGTNLADAGIGENQD

SEQ ID NO: 158749 - protein, 35 aa, Artificial Sequence
  Description of Artificial Sequence: Synthetic polypeptide
MEYEIRTTNPVATEQYGSLSFVNPEGHENGNEDQN

SEQ ID NO: 158750 - protein, 33 aa, Artificial Sequence
  Description of Artificial Sequence: Synthetic polypeptide
SEEEIRTTNPVAYEQWGHTYWIDIDTQREMGHR

SEQ ID NO: 158751 - protein, 36 aa, Artificial Sequence
  Description of Artificial Sequence: Synthetic polypeptide
DEEEIATTNPVATEQYGSVCAANMGEEAPDGMENAH

SEQ ID NO: 158752 - protein, 38 aa, Artificial Sequence
  Description of Artificial Sequence: Synthetic polypeptide
AEEEIRTTNPVATEQYGSVSTVDQNGNEQGTTNVATEA

SEQ ID NO: 158753 - protein, 30 aa, Artificial Sequence
  Description of Artificial Sequence: Synthetic polypeptide
QESEIASTNPVGTEGYGFVMASTTQHGKDI

SEQ ID NO: 158754 - protein, 36 aa, Artificial Sequence
  Description of Artificial Sequence: Synthetic polypeptide
DEEEIRTTNPVATEQYGQCVCSNWEDHNQNFGSDQE

SEQ ID NO: 158755 - protein, 32 aa, Artificial Sequence
  Description of Artificial Sequence: Synthetic polypeptide
DENEIRTTNPVATEQWGHCVSSEPEMNIAEDA

SEQ ID NO: 158756 - protein, 34 aa, Artificial Sequence
  Description of Artificial Sequence: Synthetic polypeptide
DEAEIATTNPVATEQYGSVASHSGDPAMHPGEEG

SEQ ID NO: 158757 - protein, 40 aa, Artificial Sequence
  Description of Artificial Sequence: Synthetic polypeptide
DEEEIRTTNPVATEQYGVVSVTSTNLQQGTEQGSTDDEDD

SEQ ID NO: 158758 - protein, 33 aa, Artificial Sequence
  Description of Artificial Sequence: Synthetic polypeptide
DENEIRTTNPVATEQWGGVSNEIEMNAAEEDVA

SEQ ID NO: 158759 - protein, 32 aa, Artificial Sequence
  Description of Artificial Sequence: Synthetic polypeptide
AEDEIACTNPVAYEQWGEYYTIENDQAGNGER

SEQ ID NO: 158760 - protein, 31 aa, Artificial Sequence
  Description of Artificial Sequence: Synthetic polypeptide
DENEIRTTNPVATEQWGFMGSEIEMNAAEDA

SEQ ID NO: 158761 - protein, 35 aa, Artificial Sequence
  Description of Artificial Sequence: Synthetic polypeptide
DEEEIATTNPVATEQYGSVCAANMGEEAPDQAMEH

SEQ ID NO: 158762 - protein, 32 aa, Artificial Sequence
  Description of Artificial Sequence: Synthetic polypeptide
QENEIRTTNPVSTEPYGTISMECLQQQHNGEH

SEQ ID NO: 158763 - protein, 33 aa, Artificial Sequence
  Description of Artificial Sequence: Synthetic polypeptide
CEEEIATTNPVATEQWGCVAGNGEPAQNNSQNH

SEQ ID NO: 158764 - protein, 31 aa, Artificial Sequence
  Description of Artificial Sequence: Synthetic polypeptide
DDSEVASTNPVSTEGYGNVAANTTQSRVGQR

SEQ ID NO: 158765 - protein, 38 aa, Artificial Sequence
  Description of Artificial Sequence: Synthetic polypeptide
DEEEIRTTNPVATEQYGSHGEATSAGLIQIRDEVEDNI

SEQ ID NO: 158766 - protein, 34 aa, Artificial Sequence
  Description of Artificial Sequence: Synthetic polypeptide
DENEIRTTNPVSTEGYGTISWEDINAEQFGSNQS

SEQ ID NO: 158767 - protein, 31 aa, Artificial Sequence
  Description of Artificial Sequence: Synthetic polypeptide
AEDEIACTNPVAYEQWGEYYSVENDQRGGES

SEQ ID NO: 158768 - protein, 36 aa, Artificial Sequence
  Description of Artificial Sequence: Synthetic polypeptide
CEEEIATTNPVATEQWGCVAATLEGNPGAQTEGNDR

SEQ ID NO: 158769 - protein, 38 aa, Artificial Sequence
  Description of Artificial Sequence: Synthetic polypeptide
DEEEIRTTNPVATEQYGSVSQPHPAEGPNMQNGMAPVA

SEQ ID NO: 158770 - protein, 31 aa, Artificial Sequence
  Description of Artificial Sequence: Synthetic polypeptide
DDSEVRTTNPVSTEGYGNVAAETIMNAAGDR

SEQ ID NO: 158771 - protein, 34 aa, Artificial Sequence
  Description of Artificial Sequence: Synthetic polypeptide
DENEIRTTNPVSTEGYGTISWEDINQEQSGSNQM

SEQ ID NO: 158772 - protein, 39 aa, Artificial Sequence
  Description of Artificial Sequence: Synthetic polypeptide
DEEEIRTTNPVATEQYGVVSTVTNNLQQSATEEGTTAQQ

SEQ ID NO: 158773 - protein, 32 aa, Artificial Sequence
  Description of Artificial Sequence: Synthetic polypeptide
AEDEIACTNPVAYEQWGEYYTIENDQRGGERD

SEQ ID NO: 158774 - protein, 33 aa, Artificial Sequence
  Description of Artificial Sequence: Synthetic polypeptide
SEEEIRTTNPVAYEQWGHVYIIDIDKQRGMGHE

SEQ ID NO: 158775 - protein, 38 aa, Artificial Sequence
  Description of Artificial Sequence: Synthetic polypeptide
DEEEIRTTNPVAVEQYGSVSTVNNNNNNQGNDEQGSTE

SEQ ID NO: 158776 - protein, 34 aa, Artificial Sequence
  Description of Artificial Sequence: Synthetic polypeptide
DDEEISTTNPVATEQYGCVCSWEHNQENFNSQQS

SEQ ID NO: 158777 - protein, 36 aa, Artificial Sequence
  Description of Artificial Sequence: Synthetic polypeptide
DEQEIRTTNPVATEQYGAVVTTDGMNEQTGEDEQGN

SEQ ID NO: 158778 - protein, 36 aa, Artificial Sequence
  Description of Artificial Sequence: Synthetic polypeptide
DDEEIRTTNPVATEFYGNVIMGNLTGGNGQTGNGGN

SEQ ID NO: 158779 - protein, 35 aa, Artificial Sequence
  Description of Artificial Sequence: Synthetic polypeptide
DENEIRTTNPVATEQWGKTVPSEIESMNAAEGDNA

SEQ ID NO: 158780 - protein, 35 aa, Artificial Sequence
  Description of Artificial Sequence: Synthetic polypeptide
METEITTTNPVATEQYGDVSVTGEGQTGGQGNQEI

SEQ ID NO: 158781 - protein, 34 aa, Artificial Sequence
  Description of Artificial Sequence: Synthetic polypeptide
DEEEIACTNPVATEQYGSVATPAITQDQMEPADE

SEQ ID NO: 158782 - protein, 35 aa, Artificial Sequence
  Description of Artificial Sequence: Synthetic polypeptide
METEITTTNPVATEQYGDVSVTGEGQGGNQGNDEE

SEQ ID NO: 158783 - protein, 35 aa, Artificial Sequence
  Description of Artificial Sequence: Synthetic polypeptide
DEEEIACTNPVATEQYGSVATPAVITQDDLMENGD

SEQ ID NO: 158784 - protein, 33 aa, Artificial Sequence
  Description of Artificial Sequence: Synthetic polypeptide
SEEEIRTTNPVAYEQWGHTYWIDLDVVRGMGHR

SEQ ID NO: 158785 - protein, 36 aa, Artificial Sequence
  Description of Artificial Sequence: Synthetic polypeptide
DEEEIRTTNPVATEQYGSVYLINNMNEREQMQEIPL

SEQ ID NO: 158786 - protein, 28 aa, Artificial Sequence
  Description of Artificial Sequence: Synthetic peptide
QESEIASTNPVGTEGWGVMASTVQHGDL

SEQ ID NO: 158787 - protein, 37 aa, Artificial Sequence
  Description of Artificial Sequence: Synthetic polypeptide
DEEEIATTNPVATEQYGSVCAANMGEEAPDAQMEGNH

SEQ ID NO: 158788 - protein, 38 aa, Artificial Sequence
  Description of Artificial Sequence: Synthetic polypeptide
DEEEIRTTNPVATEQYGQCVCSNTNEHEQENFGSQTQS

SEQ ID NO: 158789 - protein, 34 aa, Artificial Sequence
  Description of Artificial Sequence: Synthetic polypeptide
DEQEIRTTNPVATEQYGCVSCPQNMEDSESQQDE

SEQ ID NO: 158790 - protein, 34 aa, Artificial Sequence
  Description of Artificial Sequence: Synthetic polypeptide
DEVEIATTNPVAYECWGSVATGNMLGDAQGDNVE

SEQ ID NO: 158791 - protein, 33 aa, Artificial Sequence
  Description of Artificial Sequence: Synthetic polypeptide
DENEIRTTNPVSTEGYGTISWEAIQQEQFGNQS

SEQ ID NO: 158792 - protein, 33 aa, Artificial Sequence
  Description of Artificial Sequence: Synthetic polypeptide
SEEEIRTTNPVAYEQWGHTYWVDIDVQRGMGHN

SEQ ID NO: 158793 - protein, 38 aa, Artificial Sequence
  Description of Artificial Sequence: Synthetic polypeptide
DEEEIRTTNPVATEQYGVVSTVVVVVNANTEQGTTNAD

SEQ ID NO: 158794 - protein, 35 aa, Artificial Sequence
  Description of Artificial Sequence: Synthetic polypeptide
METEIRTTNPVATEQYGVVVDDFNVGQGEGDENET

SEQ ID NO: 158795 - protein, 36 aa, Artificial Sequence
  Description of Artificial Sequence: Synthetic polypeptide
DEEEIRTTNPVATEFYGSVMGQNMEDPTGGEENEGE

SEQ ID NO: 158796 - protein, 36 aa, Artificial Sequence
  Description of Artificial Sequence: Synthetic polypeptide
DEEEIRTTNPVATEFYGSVMGQNMENENGGEENEGM

SEQ ID NO: 158797 - protein, 36 aa, Artificial Sequence
  Description of Artificial Sequence: Synthetic polypeptide
DEEEIATTNPVATEQYGSVCAANMGEEAPDAQMGQG

SEQ ID NO: 158798 - protein, 36 aa, Artificial Sequence
  Description of Artificial Sequence: Synthetic polypeptide
DECEICTTNPVATEQYGSVSTTTQNLNEDEEEEEDD

SEQ ID NO: 158799 - protein, 33 aa, Artificial Sequence
  Description of Artificial Sequence: Synthetic polypeptide
DEMEIATTNPVATEQYGTVCAATDGPVEAEIND

SEQ ID NO: 158800 - protein, 33 aa, Artificial Sequence
  Description of Artificial Sequence: Synthetic polypeptide
DENEIRTTNPVSTEGYGTISSMEDIQQQQNGNH

SEQ ID NO: 158801 - protein, 37 aa, Artificial Sequence
  Description of Artificial Sequence: Synthetic polypeptide
DEEEIRTTNPVATEAYGVVSTVVTNNNQQETNDEETD

SEQ ID NO: 158802 - protein, 39 aa, Artificial Sequence
  Description of Artificial Sequence: Synthetic polypeptide
DEDEIRTTNPVATEQYGVVSTTNNGTNLQGIGTTNQDED

SEQ ID NO: 158803 - protein, 31 aa, Artificial Sequence
  Description of Artificial Sequence: Synthetic polypeptide
DSSEVASTNPVSTEGYGNVAANPIQSRVGQR

SEQ ID NO: 158804 - protein, 38 aa, Artificial Sequence
  Description of Artificial Sequence: Synthetic polypeptide
DEEEIRTTNPVATEQYGVVSTTVVTNNQQGTDEEEDED

SEQ ID NO: 158805 - protein, 31 aa, Artificial Sequence
  Description of Artificial Sequence: Synthetic polypeptide
DSSEVASTNPVSTEGYGNVAANTIQSRVGQR

SEQ ID NO: 158806 - protein, 39 aa, Artificial Sequence
  Description of Artificial Sequence: Synthetic polypeptide
DEDEIRTTNPVATEQYGVVSTTNNGQQLQGIGTTNQEEE

SEQ ID NO: 158807 - protein, 36 aa, Artificial Sequence
  Description of Artificial Sequence: Synthetic polypeptide
DEGEIRTTNPVATEQYGSCGSVLHNGQDQSDYDGDI

SEQ ID NO: 158808 - protein, 35 aa, Artificial Sequence
  Description of Artificial Sequence: Synthetic polypeptide
NDEEIRTTNPVATEQYGVVCSWGNDHQNFGSDTQS

SEQ ID NO: 158809 - protein, 36 aa, Artificial Sequence
  Description of Artificial Sequence: Synthetic polypeptide
DEGEIRTTNPVATEQYGSCGSVLENGQDQSTYDGDI

SEQ ID NO: 158810 - protein, 38 aa, Artificial Sequence
  Description of Artificial Sequence: Synthetic polypeptide
DEEEIRTTNPVATEQYGVVSTVVTNNNNQQGTTEDTED

SEQ ID NO: 158811 - protein, 33 aa, Artificial Sequence
  Description of Artificial Sequence: Synthetic polypeptide
DENEIRTTNPVSTEGYGTISNQEDIQQQQEGNE

SEQ ID NO: 158812 - protein, 31 aa, Artificial Sequence
  Description of Artificial Sequence: Synthetic polypeptide
DSSEVASTNPVSTEHYGNVAANTIQSRTGQR

SEQ ID NO: 158813 - protein, 36 aa, Artificial Sequence
  Description of Artificial Sequence: Synthetic polypeptide
DECEICTTNPVAVEQYGSVSTNTTNNTEQGTNNEGS

SEQ ID NO: 158814 - protein, 35 aa, Artificial Sequence
  Description of Artificial Sequence: Synthetic polypeptide
DENEIATTNPVATEQYGSVCSVADTGQEDAGEGKM

SEQ ID NO: 158815 - protein, 34 aa, Artificial Sequence
  Description of Artificial Sequence: Synthetic polypeptide
DEEEIACTNPVATEQWGSVSMSGNGNPAGVPVMT

SEQ ID NO: 158816 - protein, 35 aa, Artificial Sequence
  Description of Artificial Sequence: Synthetic polypeptide
DENEIATTNPVATEQYGSVCTTPGPDDSGDGMQNN

SEQ ID NO: 158817 - protein, 36 aa, Artificial Sequence
  Description of Artificial Sequence: Synthetic polypeptide
DEGEIRTTNPVATEQYGSCGSSVLNGQDQSTYDGDI

SEQ ID NO: 158818 - protein, 37 aa, Artificial Sequence
  Description of Artificial Sequence: Synthetic polypeptide
DEEEIRATNPVATEQWGSVSGQGNPLPDDQGDGMAAD

SEQ ID NO: 158819 - protein, 36 aa, Artificial Sequence
  Description of Artificial Sequence: Synthetic polypeptide
DEEEIRTTNPVATEQYGSVYPEMDHIEQFQGVEETQ

SEQ ID NO: 158820 - protein, 36 aa, Artificial Sequence
  Description of Artificial Sequence: Synthetic polypeptide
DEEEIRTTNPVATEQYGSVYPEMDHIEQFQFVGETL

SEQ ID NO: 158821 - protein, 35 aa, Artificial Sequence
  Description of Artificial Sequence: Synthetic polypeptide
DEGEIRTTNPVATEQYGSCGPVLNGWDQGTYDGDI

SEQ ID NO: 158822 - protein, 30 aa, Artificial Sequence
  Description of Artificial Sequence: Synthetic polypeptide
QESEIASTNPVGTEFYGVMASTLQHNGDGI

SEQ ID NO: 158823 - protein, 35 aa, Artificial Sequence
  Description of Artificial Sequence: Synthetic polypeptide
DEEEIRTTNPVATEQFGQCVCSWGYLLEHFGSDQS

SEQ ID NO: 158824 - protein, 29 aa, Artificial Sequence
  Description of Artificial Sequence: Synthetic peptide
QESEIASTNPVGTEGCGVMASTLQHAGDI

SEQ ID NO: 158825 - protein, 36 aa, Artificial Sequence
  Description of Artificial Sequence: Synthetic polypeptide
DEEEIRTTNPVATEQYGQCVCSMWEDHQNFGSETQS

SEQ ID NO: 158826 - protein, 35 aa, Artificial Sequence
  Description of Artificial Sequence: Synthetic polypeptide
DEGEIRTTNPVATEQYGSCLTPDPDLNNRFEMFQE

SEQ ID NO: 158827 - protein, 39 aa, Artificial Sequence
  Description of Artificial Sequence: Synthetic polypeptide
DEDEIRTTNPVATEQYGVVSTTNNNQNLQGIGTTNQEED

SEQ ID NO: 158828 - protein, 35 aa, Artificial Sequence
  Description of Artificial Sequence: Synthetic polypeptide
DEEEIRTTNPVATEQYGSVGELPNNIPTVVEQFQV

SEQ ID NO: 158829 - protein, 35 aa, Artificial Sequence
  Description of Artificial Sequence: Synthetic polypeptide
DEGEIRTTNPVATEQYGSCNYADTYNDENLIELTV

SEQ ID NO: 158830 - protein, 38 aa, Artificial Sequence
  Description of Artificial Sequence: Synthetic polypeptide
DEEEIRTTNPVATEQYGQCVCSMTENHNQENFGSETQS

SEQ ID NO: 158831 - protein, 30 aa, Artificial Sequence
  Description of Artificial Sequence: Synthetic polypeptide
QESEIASTNPVGTECYGVVSSTEQDHEGDG

SEQ ID NO: 158832 - protein, 33 aa, Artificial Sequence
  Description of Artificial Sequence: Synthetic polypeptide
NDEEIRTTNPVAYEQYGCVCSWEHNQNFGSQQA

SEQ ID NO: 158833 - protein, 38 aa, Artificial Sequence
  Description of Artificial Sequence: Synthetic polypeptide
DEEEIRTTNPVATEQYGVVSTVVTNNNQQGEEEATEDE

SEQ ID NO: 158834 - protein, 35 aa, Artificial Sequence
  Description of Artificial Sequence: Synthetic polypeptide
DENEIATTNPVATEQYGSVCSGANDPAGDPMGEAE

SEQ ID NO: 158835 - protein, 37 aa, Artificial Sequence
  Description of Artificial Sequence: Synthetic polypeptide
DEEEIRTTNPVATEQYGQCVCSMTGEDNQENFGSDQS

SEQ ID NO: 158836 - protein, 32 aa, Artificial Sequence
  Description of Artificial Sequence: Synthetic polypeptide
DENEIRTTNPVSTEGYGTISMEDIQQQQNGQH

SEQ ID NO: 158837 - protein, 31 aa, Artificial Sequence
  Description of Artificial Sequence: Synthetic polypeptide
DDSEVASTNPVSTEGYGNVAANTPQSREGQR

SEQ ID NO: 158838 - protein, 36 aa, Artificial Sequence
  Description of Artificial Sequence: Synthetic polypeptide
DECEICTTNPVAVEQYGSVSTNTTNNSEQGTNNNGQ

SEQ ID NO: 158839 - protein, 32 aa, Artificial Sequence
  Description of Artificial Sequence: Synthetic polypeptide
QEGEIAPTNPCSYEQYGKTVSCNHQSVGTNRV

SEQ ID NO: 158840 - protein, 33 aa, Artificial Sequence
  Description of Artificial Sequence: Synthetic polypeptide
DENEIRTTNPVSTEGYGTISNEDGIQQQQNGND

SEQ ID NO: 158841 - protein, 37 aa, Artificial Sequence
  Description of Artificial Sequence: Synthetic polypeptide
DEEEIRTTNPVATEQYGSVQSWAQYLEPMLEGVEGED

SEQ ID NO: 158842 - protein, 31 aa, Artificial Sequence
  Description of Artificial Sequence: Synthetic polypeptide
DDSEVASTNPVSTEGYGNVAANTPQSRVGQR

SEQ ID NO: 158843 - protein, 31 aa, Artificial Sequence
  Description of Artificial Sequence: Synthetic polypeptide
DSSEVASTNPVSTEAYGNVAANTIQSRVGSR

SEQ ID NO: 158844 - protein, 37 aa, Artificial Sequence
  Description of Artificial Sequence: Synthetic polypeptide
DEEEIRTTNPVATEQYGQCVCSMTGEHNQGFGSETQM

SEQ ID NO: 158845 - protein, 38 aa, Artificial Sequence
  Description of Artificial Sequence: Synthetic polypeptide
DEEEIRTTNPVATEQYGQCVCSMTMEHNQENFGSDNQP

SEQ ID NO: 158846 - protein, 34 aa, Artificial Sequence
  Description of Artificial Sequence: Synthetic polypeptide
DEVEIATTNPVAYEHWGEVASGDHNGDRGGGNGR

SEQ ID NO: 158847 - protein, 31 aa, Artificial Sequence
  Description of Artificial Sequence: Synthetic polypeptide
DDSEVASTNPVSTEGYGNVAANTIQNRGGQR

SEQ ID NO: 158848 - protein, 36 aa, Artificial Sequence
  Description of Artificial Sequence: Synthetic polypeptide
DEEEIRTTNPVATEQFGQCVCSWMEDNANFGSNTQS

SEQ ID NO: 158849 - protein, 37 aa, Artificial Sequence
  Description of Artificial Sequence: Synthetic polypeptide
DEEEIRTTNPVATEQYGQCVCSNSEEHNQFFGSDNQA

SEQ ID NO: 158850 - protein, 35 aa, Artificial Sequence
  Description of Artificial Sequence: Synthetic polypeptide
DEEEIRTTNPVATEQYGQCVCSNSEHNAFFNSDQP

SEQ ID NO: 158851 - protein, 36 aa, Artificial Sequence
  Description of Artificial Sequence: Synthetic polypeptide
DEEEIRTTNPVATEQYGQCVCSNSEHNQFFNSDTQE

SEQ ID NO: 158852 - protein, 36 aa, Artificial Sequence
  Description of Artificial Sequence: Synthetic polypeptide
DEEEIRTTNPVATEQYGSVYMPIEEQIENTEEDNDM

SEQ ID NO: 158853 - protein, 37 aa, Artificial Sequence
  Description of Artificial Sequence: Synthetic polypeptide
DEEEIRTTNPVATEQYGQCVCSNTEEPEQGFGSDTQS

SEQ ID NO: 158854 - protein, 29 aa, Artificial Sequence
  Description of Artificial Sequence: Synthetic peptide
QESEIASTNPVGTEGWGVMACNEQRGEDI

SEQ ID NO: 158855 - protein, 31 aa, Artificial Sequence
  Description of Artificial Sequence: Synthetic polypeptide
DDSEVASTNPVSTEGYGNVAANTQQSRVGQR

SEQ ID NO: 158856 - protein, 35 aa, Artificial Sequence
  Description of Artificial Sequence: Synthetic polypeptide
AEDEICATNPVATEQYGVVAVSNNNNLQQGEGNDD

SEQ ID NO: 158857 - protein, 28 aa, Artificial Sequence
  Description of Artificial Sequence: Synthetic peptide
QESEIASTNPVGTEGWGVMASTEQHGDH

SEQ ID NO: 158858 - protein, 33 aa, Artificial Sequence
  Description of Artificial Sequence: Synthetic polypeptide
SEEEIRCTNPIATEQYGQCVCSWNHANFGSDQS

SEQ ID NO: 158859 - protein, 32 aa, Artificial Sequence
  Description of Artificial Sequence: Synthetic polypeptide
DEMEIATTNPVATEQYGTVCPAEGPVEHEEND

SEQ ID NO: 158860 - protein, 39 aa, Artificial Sequence
  Description of Artificial Sequence: Synthetic polypeptide
DEEEIRTTNPVATEQYGQCVCSNTGEDNNQENFGSENQS

SEQ ID NO: 158861 - protein, 37 aa, Artificial Sequence
  Description of Artificial Sequence: Synthetic polypeptide
DEEEIRTTNPVATEQYGQCVCSNTGEDNQEFFNSDQE

SEQ ID NO: 158862 - protein, 29 aa, Artificial Sequence
  Description of Artificial Sequence: Synthetic peptide
QESEIASTNPVGTEGWGVMASTLQNAGDI

SEQ ID NO: 158863 - protein, 37 aa, Artificial Sequence
  Description of Artificial Sequence: Synthetic polypeptide
DEEEIRTTNPVATEQYGQCVCSNTGEDQENFGSETQF

SEQ ID NO: 158864 - protein, 29 aa, Artificial Sequence
  Description of Artificial Sequence: Synthetic peptide
QESEIASTNPVGTEGWGVMASTLQNHGDI

SEQ ID NO: 158865 - protein, 37 aa, Artificial Sequence
  Description of Artificial Sequence: Synthetic polypeptide
DEEEIRTTNPVATEQYGQCVCSNTGEGHNQNFGSDQG

SEQ ID NO: 158866 - protein, 36 aa, Artificial Sequence
  Description of Artificial Sequence: Synthetic polypeptide
DEEEIRTTNPVATEQYGQCVCSNTGEHANFFSDTQT

SEQ ID NO: 158867 - protein, 33 aa, Artificial Sequence
  Description of Artificial Sequence: Synthetic polypeptide
DENEIRTTNPVSTEGYGTISQEDIQQQQEGNTH

SEQ ID NO: 158868 - protein, 33 aa, Artificial Sequence
  Description of Artificial Sequence: Synthetic polypeptide
DENEIRTTNPVSTEGYGTISQEDIQQQQNGNDQ

SEQ ID NO: 158869 - protein, 37 aa, Artificial Sequence
  Description of Artificial Sequence: Synthetic polypeptide
DEEEIRTTNPVATEQYGQCVCSNTGEHDQENFGSDQS

SEQ ID NO: 158870 - protein, 37 aa, Artificial Sequence
  Description of Artificial Sequence: Synthetic polypeptide
DEEEIRTTNPVATEQYGQCVCSNTGEHDQEYFNSDQG

SEQ ID NO: 158871 - protein, 28 aa, Artificial Sequence
  Description of Artificial Sequence: Synthetic peptide
QESEIASTNPVGTEGWGVMASTTQHGDI

SEQ ID NO: 158872 - protein, 36 aa, Artificial Sequence
  Description of Artificial Sequence: Synthetic polypeptide
QEEEIRTTNPVATEFYGTVSVVTQGMGQTGDNEQGN

SEQ ID NO: 158873 - protein, 31 aa, Artificial Sequence
  Description of Artificial Sequence: Synthetic polypeptide
DDSEVASTNPVSTEGYGNVAANTIQNRAGQR

SEQ ID NO: 158874 - protein, 37 aa, Artificial Sequence
  Description of Artificial Sequence: Synthetic polypeptide
DEEEIRTTNPVATEQYGQCVCSNTEEDHQEGFGSQQS

SEQ ID NO: 158875 - protein, 38 aa, Artificial Sequence
  Description of Artificial Sequence: Synthetic polypeptide
DEEEIRTTNPVATEQYGQCVCSNTEDHNQENFGSENQD

SEQ ID NO: 158876 - protein, 29 aa, Artificial Sequence
  Description of Artificial Sequence: Synthetic peptide
QESEIASTNPVGTEGWGVIASTLQHGGDQ

SEQ ID NO: 158877 - protein, 29 aa, Artificial Sequence
  Description of Artificial Sequence: Synthetic peptide
QESEIASTNPVGTEGFGVMASTLQHFGDI

SEQ ID NO: 158878 - protein, 29 aa, Artificial Sequence
  Description of Artificial Sequence: Synthetic peptide
QESEIASTNPVGTEGHGVMASTLQHGDIE

SEQ ID NO: 158879 - protein, 35 aa, Artificial Sequence
  Description of Artificial Sequence: Synthetic polypeptide
NDEEIRTTNPVATEQYGCVCSWNDHNQENFGSDQS

SEQ ID NO: 158880 - protein, 33 aa, Artificial Sequence
  Description of Artificial Sequence: Synthetic polypeptide
NDEEIRTTNPVATEQYGCVCSWEPNQNFISDQS

SEQ ID NO: 158881 - protein, 29 aa, Artificial Sequence
  Description of Artificial Sequence: Synthetic peptide
QESEIASTNPVGTEGMGVMASTLQHGDIS

SEQ ID NO: 158882 - protein, 34 aa, Artificial Sequence
  Description of Artificial Sequence: Synthetic polypeptide
NDEEIRTTNPVATEQYGCVCSWEHNQENFNSDQS

SEQ ID NO: 158883 - protein, 36 aa, Artificial Sequence
  Description of Artificial Sequence: Synthetic polypeptide
NDEEIRTTNPVATEQYGCVCSWEELNQEHFGSDNQA

SEQ ID NO: 158884 - protein, 36 aa, Artificial Sequence
  Description of Artificial Sequence: Synthetic polypeptide
NDEEIRTTNPVATEQYGCVCSTWEHNQENFGSDNQS

SEQ ID NO: 158885 - protein, 28 aa, Artificial Sequence
  Description of Artificial Sequence: Synthetic peptide
QESEIASTNPVGTEGQGVMASTLVHGDI

SEQ ID NO: 158886 - protein, 31 aa, Artificial Sequence
  Description of Artificial Sequence: Synthetic polypeptide
DDSEVASTNPVSTEGYGNVAANTIQNRDGQR

SEQ ID NO: 158887 - protein, 38 aa, Artificial Sequence
  Description of Artificial Sequence: Synthetic polypeptide
DEEEIRTTNPVATEAYGVVSTVVTNNNNQQGQTNQNED

SEQ ID NO: 158888 - protein, 36 aa, Artificial Sequence
  Description of Artificial Sequence: Synthetic polypeptide
DEGEIRTTNPVATEQYGQVCTPDPDLPNDREENNQH

SEQ ID NO: 158889 - protein, 39 aa, Artificial Sequence
  Description of Artificial Sequence: Synthetic polypeptide
DEEEIRTTNPVATEQYGVVSTTVVVNLQQGTEAGSTDTE

SEQ ID NO: 158890 - protein, 39 aa, Artificial Sequence
  Description of Artificial Sequence: Synthetic polypeptide
DEDEIRTTNPVATEQYGVVSTTNNGQNLQEIGTTNEEED

SEQ ID NO: 158891 - protein, 30 aa, Artificial Sequence
  Description of Artificial Sequence: Synthetic polypeptide
QESEIASTNPVGTEGWGSMACNEQREGEDI

SEQ ID NO: 158892 - protein, 29 aa, Artificial Sequence
  Description of Artificial Sequence: Synthetic peptide
QESEIASTNPVGTEGWGVAYSTLQHMGDA

SEQ ID NO: 158893 - protein, 39 aa, Artificial Sequence
  Description of Artificial Sequence: Synthetic polypeptide
DEDEIRTTNPVATEQYGVVSTTNNGNQLQGIGTTNEEED

SEQ ID NO: 158894 - protein, 36 aa, Artificial Sequence
  Description of Artificial Sequence: Synthetic polypeptide
DEEEIRTTNPVATEQYGQCVCSNSGEHNQNFGSEQF

SEQ ID NO: 158895 - protein, 38 aa, Artificial Sequence
  Description of Artificial Sequence: Synthetic polypeptide
DEEEIRTTNPVATEQYGQCVCSNSGEHNTENFQSDNQA

SEQ ID NO: 158896 - protein, 36 aa, Artificial Sequence
  Description of Artificial Sequence: Synthetic polypeptide
AEEEIRTTNPVATEQYGVVSTTNNQQQQSTATTTTD

SEQ ID NO: 158897 - protein, 36 aa, Artificial Sequence
  Description of Artificial Sequence: Synthetic polypeptide
DEEEIRTTNPVATEQYGQCVCSNSGYHQYFNSDNQS

SEQ ID NO: 158898 - protein, 36 aa, Artificial Sequence
  Description of Artificial Sequence: Synthetic polypeptide
DEEEIRTTNPVATEQYGQCVCSNSMEHQEFFGSDQD

SEQ ID NO: 158899 - protein, 35 aa, Artificial Sequence
  Description of Artificial Sequence: Synthetic polypeptide
NDEEIRTTNPVATEQYGCVCSNWELNQNFNSDTQS

SEQ ID NO: 158900 - protein, 33 aa, Artificial Sequence
  Description of Artificial Sequence: Synthetic polypeptide
DEECIATTNPVAYEQYSEEVTTTGDNHQGGGAM

SEQ ID NO: 158901 - protein, 38 aa, Artificial Sequence
  Description of Artificial Sequence: Synthetic polypeptide
DEDEIRTTNPVATEQYGVVSTTANQQAGNQQGTNTTDE

SEQ ID NO: 158902 - protein, 35 aa, Artificial Sequence
  Description of Artificial Sequence: Synthetic polypeptide
DEEEIATTNPVATEQYGSVCAANMGEEAPDQMEHH

SEQ ID NO: 158903 - protein, 39 aa, Artificial Sequence
  Description of Artificial Sequence: Synthetic polypeptide
DEDEIRTTNPVATEQYGVVSTSNQGGNLQGIGTTNQNED

SEQ ID NO: 158904 - protein, 34 aa, Artificial Sequence
  Description of Artificial Sequence: Synthetic polypeptide
SEEEIRCTNPIATEQYGCVCSWELAENFGSDNQA

SEQ ID NO: 158905 - protein, 32 aa, Artificial Sequence
  Description of Artificial Sequence: Synthetic polypeptide
DENEIRTTNPVSTEPWGDISMEDIQQQQNGNH

SEQ ID NO: 158906 - protein, 30 aa, Artificial Sequence
  Description of Artificial Sequence: Synthetic polypeptide
DENEIRTTNPVSTEPWGDISMIEMNQNEDA

SEQ ID NO: 158907 - protein, 36 aa, Artificial Sequence
  Description of Artificial Sequence: Synthetic polypeptide
DEEEIRTTNPVATEQYGSVYLINNMGEQEQMQEIPP

SEQ ID NO: 158908 - protein, 33 aa, Artificial Sequence
  Description of Artificial Sequence: Synthetic polypeptide
AEDEIACTNPVAYEQWGEAYSIENLHQDRGGER

SEQ ID NO: 158909 - protein, 31 aa, Artificial Sequence
  Description of Artificial Sequence: Synthetic polypeptide
DDSEVRTTNPVSTEGYGNVAAETIQSAAGDR

SEQ ID NO: 158910 - protein, 32 aa, Artificial Sequence
  Description of Artificial Sequence: Synthetic polypeptide
AEDEIACTNPVAYEQWGEAYSIENDQRGGERK

SEQ ID NO: 158911 - protein, 31 aa, Artificial Sequence
  Description of Artificial Sequence: Synthetic polypeptide
QENEIRTTNPVSTEPYGTAPMEDCQQQQGNH

SEQ ID NO: 158912 - protein, 36 aa, Artificial Sequence
  Description of Artificial Sequence: Synthetic polypeptide
DEEEIRTTNPVATEQYGSVYLGIEEQIENTEEDNFM

SEQ ID NO: 158913 - protein, 33 aa, Artificial Sequence
  Description of Artificial Sequence: Synthetic polypeptide
DEGEIRTTNPVATEQYGCCSNAVPLEMPISPQI

SEQ ID NO: 158914 - protein, 36 aa, Artificial Sequence
  Description of Artificial Sequence: Synthetic polypeptide
DECEICTTNPVAVEQYGSVSTVVNNVNEQGSTNVED

SEQ ID NO: 158915 - protein, 33 aa, Artificial Sequence
  Description of Artificial Sequence: Synthetic polypeptide
SEEEIRCTNPIATEQYGCVCSWEDAENFGSNQA

SEQ ID NO: 158916 - protein, 35 aa, Artificial Sequence
  Description of Artificial Sequence: Synthetic polypeptide
DEEEISTTNPVATEQYGQCVCSWEDHNQNFGSDQA

SEQ ID NO: 158917 - protein, 37 aa, Artificial Sequence
  Description of Artificial Sequence: Synthetic polypeptide
DEEEIRTTNPVATEFYGSVQSGQGDPEQEENDQGGGN

SEQ ID NO: 158918 - protein, 34 aa, Artificial Sequence
  Description of Artificial Sequence: Synthetic polypeptide
DEEEISTTNPVATEQYGQCVCSWEDHINFGSDQA

SEQ ID NO: 158919 - protein, 36 aa, Artificial Sequence
  Description of Artificial Sequence: Synthetic polypeptide
SEEEIRTTNPVAYEQWGQVVISCTNMWSADVGGNRA

SEQ ID NO: 158920 - protein, 36 aa, Artificial Sequence
  Description of Artificial Sequence: Synthetic polypeptide
DEAEIRTTNPVATEQYGSVCFPHVDNQETFNGGIRT

SEQ ID NO: 158921 - protein, 32 aa, Artificial Sequence
  Description of Artificial Sequence: Synthetic polypeptide
DEEEIACTNPVATEQWGCVANPNDPAEANPED

SEQ ID NO: 158922 - protein, 31 aa, Artificial Sequence
  Description of Artificial Sequence: Synthetic polypeptide
DDSEVASTNPVSTEGYGNVAANWIQSRVGQR

SEQ ID NO: 158923 - protein, 35 aa, Artificial Sequence
  Description of Artificial Sequence: Synthetic polypeptide
DEGEIRTTNPVATEQYGCCGSVLNGWDQSTYDGDI

SEQ ID NO: 158924 - protein, 33 aa, Artificial Sequence
  Description of Artificial Sequence: Synthetic polypeptide
SEEEIRCTNPIATEQYGCVCSWELAENFGSEQS

SEQ ID NO: 158925 - protein, 30 aa, Artificial Sequence
  Description of Artificial Sequence: Synthetic polypeptide
QENEIRTTNPVSTEPYGEIPMVIQQQNEEH

SEQ ID NO: 158926 - protein, 29 aa, Artificial Sequence
  Description of Artificial Sequence: Synthetic peptide
QESEIASTNPVGTEGYGNMASTIQSHGDI

SEQ ID NO: 158927 - protein, 30 aa, Artificial Sequence
  Description of Artificial Sequence: Synthetic polypeptide
DENEIRTTNPVSTEPWGDISMDEMNQNEDA

SEQ ID NO: 158928 - protein, 32 aa, Artificial Sequence
  Description of Artificial Sequence: Synthetic polypeptide
DESEIATTNPVGTECWGVMACINEPQDREGNI

SEQ ID NO: 158929 - protein, 37 aa, Artificial Sequence
  Description of Artificial Sequence: Synthetic polypeptide
DENEIATTNPVATEQYGSVSSMTPAGGTNQRNGMEPV

SEQ ID NO: 158930 - protein, 32 aa, Artificial Sequence
  Description of Artificial Sequence: Synthetic polypeptide
DENEIRTTNPVSTEPFGTISMEDIQQKQNGNH

SEQ ID NO: 158931 - protein, 33 aa, Artificial Sequence
  Description of Artificial Sequence: Synthetic polypeptide
DENEIRTTNPVATEQWGDVVDQIEQMNAGEDAF

SEQ ID NO: 158932 - protein, 32 aa, Artificial Sequence
  Description of Artificial Sequence: Synthetic polypeptide
DENEIRTTNPVSTEPFGTISMEDIQQQQKGNH

SEQ ID NO: 158933 - protein, 32 aa, Artificial Sequence
  Description of Artificial Sequence: Synthetic polypeptide
DENEIRTTNPVSTEPFGTISMEDIQQQQNGNH

SEQ ID NO: 158934 - protein, 37 aa, Artificial Sequence
  Description of Artificial Sequence: Synthetic polypeptide
DDEEIRCTNPVATEQYGQCQVCSTELNQENFGSDNQS

SEQ ID NO: 158935 - protein, 36 aa, Artificial Sequence
  Description of Artificial Sequence: Synthetic polypeptide
SEEEIRTTNPVAYEQWGKVVSSCTNMCSADYGGNRA

SEQ ID NO: 158936 - protein, 36 aa, Artificial Sequence
  Description of Artificial Sequence: Synthetic polypeptide
MESEIRTTNPVATEQYGSVSWPGGLNNQFDNNQENF

SEQ ID NO: 158937 - protein, 31 aa, Artificial Sequence
  Description of Artificial Sequence: Synthetic polypeptide
DDSEVASTNPVSTEGYGNVAANTIQHRVGQR

SEQ ID NO: 158938 - protein, 31 aa, Artificial Sequence
  Description of Artificial Sequence: Synthetic polypeptide
DDSEVASTNPVSTEGYGNVAANTIQGRVGQR

SEQ ID NO: 158939 - protein, 31 aa, Artificial Sequence
  Description of Artificial Sequence: Synthetic polypeptide
DENEIRTTNPVSTEPWGAISMEDIQQQNGPH

SEQ ID NO: 158940 - protein, 33 aa, Artificial Sequence
  Description of Artificial Sequence: Synthetic polypeptide
DENEIRTTNPVATEQWGDVVDNEIEEMNAAEDA

SEQ ID NO: 158941 - protein, 32 aa, Artificial Sequence
  Description of Artificial Sequence: Synthetic polypeptide
DENEIRTTNPVSTEPWGAISMEDWQQQQNGNI

SEQ ID NO: 158942 - protein, 31 aa, Artificial Sequence
  Description of Artificial Sequence: Synthetic polypeptide
NENEIRTTNPVATEQWGDVSEISEMNAAEDA

SEQ ID NO: 158943 - protein, 36 aa, Artificial Sequence
  Description of Artificial Sequence: Synthetic polypeptide
MESEIRTTNPVATEQYGSVSWPGGIQNQFDNNQERG

SEQ ID NO: 158944 - protein, 29 aa, Artificial Sequence
  Description of Artificial Sequence: Synthetic peptide
QESEIASTNPVGTEGYGNMAANTIQHGQI

SEQ ID NO: 158945 - protein, 36 aa, Artificial Sequence
  Description of Artificial Sequence: Synthetic polypeptide
DEEEISTTNPVATEQYGQCVCSWEDHQEHFGSDNQI

SEQ ID NO: 158946 - protein, 29 aa, Artificial Sequence
  Description of Artificial Sequence: Synthetic peptide
QESEIASTNPVGTEGYGNMAASTIQHGQI

SEQ ID NO: 158947 - protein, 37 aa, Artificial Sequence
  Description of Artificial Sequence: Synthetic polypeptide
MESEIRTTNPVATEQYGSVSPWDTGLEQEFNSSGHPG

SEQ ID NO: 158948 - protein, 33 aa, Artificial Sequence
  Description of Artificial Sequence: Synthetic polypeptide
DEGEIRTTNPVATEQYGCFCYPVNDTIEGGQQP

SEQ ID NO: 158949 - protein, 31 aa, Artificial Sequence
  Description of Artificial Sequence: Synthetic polypeptide
DEESIACTNPVATASWGCVAGNGELQDNSNM

SEQ ID NO: 158950 - protein, 31 aa, Artificial Sequence
  Description of Artificial Sequence: Synthetic polypeptide
DDSEVASTNPVSTEGYGNVAANWIQSRVGSR

SEQ ID NO: 158951 - protein, 32 aa, Artificial Sequence
  Description of Artificial Sequence: Synthetic polypeptide
DENEIRTTNPVATEQWGDVTSEHIVMNAAEDA

SEQ ID NO: 158952 - protein, 35 aa, Artificial Sequence
  Description of Artificial Sequence: Synthetic polypeptide
DEEEIACTNPVATEQWGCVAGTNSHQEADMEINRE

SEQ ID NO: 158953 - protein, 34 aa, Artificial Sequence
  Description of Artificial Sequence: Synthetic polypeptide
DEECIQTTNPVAYERYGCSVNINMESLRPGGNAH

SEQ ID NO: 158954 - protein, 31 aa, Artificial Sequence
  Description of Artificial Sequence: Synthetic polypeptide
AENEIATTNPVATEGYGCVCSWADQHFESEL

SEQ ID NO: 158955 - protein, 34 aa, Artificial Sequence
  Description of Artificial Sequence: Synthetic polypeptide
DEECIQTTNPVAYERYGCSVNINMGSDRPGGNSV

SEQ ID NO: 158956 - protein, 36 aa, Artificial Sequence
  Description of Artificial Sequence: Synthetic polypeptide
DEMEIATTNPVATEQYGSVCSNTELNEDHEGSEDLS

SEQ ID NO: 158957 - protein, 38 aa, Artificial Sequence
  Description of Artificial Sequence: Synthetic polypeptide
DTEEIRATNPVATEQYGSVSTNNTNNNNQQQIGTNNNE

SEQ ID NO: 158958 - protein, 33 aa, Artificial Sequence
  Description of Artificial Sequence: Synthetic polypeptide
DEECIQTTNPVAYERYGCSVNINMGSDWPGGNA

SEQ ID NO: 158959 - protein, 38 aa, Artificial Sequence
  Description of Artificial Sequence: Synthetic polypeptide
DEEEIRTTNPVATEQYGSVYLENSTAVEPNMLLVEVST

SEQ ID NO: 158960 - protein, 38 aa, Artificial Sequence
  Description of Artificial Sequence: Synthetic polypeptide
DTEEIRATNPVATEQYGSVSTNQNNNNNNQQQGTNNNE

SEQ ID NO: 158961 - protein, 38 aa, Artificial Sequence
  Description of Artificial Sequence: Synthetic polypeptide
DTEEIRATNPVATEQYGSVSTNQNQNNQNNQQGTNANE

SEQ ID NO: 158962 - protein, 35 aa, Artificial Sequence
  Description of Artificial Sequence: Synthetic polypeptide
DEEEIATTNPVATEQYGSVCAANNGDTIDPDENNH

SEQ ID NO: 158963 - protein, 38 aa, Artificial Sequence
  Description of Artificial Sequence: Synthetic polypeptide
DTEEIRATNPVATEQYGSVSTNQNQNQNNNQQGTNNNE

SEQ ID NO: 158964 - protein, 34 aa, Artificial Sequence
  Description of Artificial Sequence: Synthetic polypeptide
DEECIQTTNPVAYERYGCSVNINMVSDRPGGNNA

SEQ ID NO: 158965 - protein, 39 aa, Artificial Sequence
  Description of Artificial Sequence: Synthetic polypeptide
DEDEIRTTNPVATEQYGVVSTSNNLNQLQGIGTTNQQED

SEQ ID NO: 158966 - protein, 38 aa, Artificial Sequence
  Description of Artificial Sequence: Synthetic polypeptide
DEDEIRTTNPVATEQYGVVSTSNNGNQQQGIGTTNQED

SEQ ID NO: 158967 - protein, 34 aa, Artificial Sequence
  Description of Artificial Sequence: Synthetic polypeptide
DESEIATTNPVAYEQYGTVCHTENDQQDQGDDGA

SEQ ID NO: 158968 - protein, 38 aa, Artificial Sequence
  Description of Artificial Sequence: Synthetic polypeptide
DEDEIRTTNPVATEQYGVVSTSNNGNQQGIGTTDQNED

SEQ ID NO: 158969 - protein, 33 aa, Artificial Sequence
  Description of Artificial Sequence: Synthetic polypeptide
DEECIQTTNPVAYERYGCSVNINMVSDRPGGVK

SEQ ID NO: 158970 - protein, 35 aa, Artificial Sequence
  Description of Artificial Sequence: Synthetic polypeptide
DEAEIRTTNPVATEQYGCVCSSGEHQENFNSDTQS

SEQ ID NO: 158971 - protein, 34 aa, Artificial Sequence
  Description of Artificial Sequence: Synthetic polypeptide
DEECIQTTNPVAYERYGCSVNNINMHSDRPGGNA

SEQ ID NO: 158972 - protein, 32 aa, Artificial Sequence
  Description of Artificial Sequence: Synthetic polypeptide
AENEIATTNPVATEGYGCVCSWAHQHFNSELA

SEQ ID NO: 158973 - protein, 30 aa, Artificial Sequence
  Description of Artificial Sequence: Synthetic polypeptide
AEDEIACTNPVAYEQWGEAYIENDQDGGER

SEQ ID NO: 158974 - protein, 33 aa, Artificial Sequence
  Description of Artificial Sequence: Synthetic polypeptide
DEECIQTTNPVAYERYGCSVNIHWGSDRPGGNA

SEQ ID NO: 158975 - protein, 34 aa, Artificial Sequence
  Description of Artificial Sequence: Synthetic polypeptide
DEECIQTTNPVAYERYGCSVNIANMGSHRPGGNA

SEQ ID NO: 158976 - protein, 34 aa, Artificial Sequence
  Description of Artificial Sequence: Synthetic polypeptide
DEECIQTTNPVAYERYGCSVNCINMVSDRPGGNG

SEQ ID NO: 158977 - protein, 34 aa, Artificial Sequence
  Description of Artificial Sequence: Synthetic polypeptide
DEECIQTTNPVAYERYGCSVHINNMVSDRPGGNA

SEQ ID NO: 158978 - protein, 32 aa, Artificial Sequence
  Description of Artificial Sequence: Synthetic polypeptide
DENEIACTNPVATEQYGETTWSEEDLAPKGGI

SEQ ID NO: 158979 - protein, 32 aa, Artificial Sequence
  Description of Artificial Sequence: Synthetic polypeptide
DENEIRTTNPVSTEPWGTCSYEDGQQQQNGNH

SEQ ID NO: 158980 - protein, 36 aa, Artificial Sequence
  Description of Artificial Sequence: Synthetic polypeptide
CEQEIRTTNPVATDQYGSVVDTTAGDLGQRNQGEGG

SEQ ID NO: 158981 - protein, 34 aa, Artificial Sequence
  Description of Artificial Sequence: Synthetic polypeptide
DEEEIACTNPVATEQWGCVAGTNSHQEADILIRD

SEQ ID NO: 158982 - protein, 32 aa, Artificial Sequence
  Description of Artificial Sequence: Synthetic polypeptide
DEECINTVNPVATEWYGCSVLSDNNMEAVATD

SEQ ID NO: 158983 - protein, 32 aa, Artificial Sequence
  Description of Artificial Sequence: Synthetic polypeptide
NENEIRTTNPVSTEPYGTISMEDIQQQQNGNH

SEQ ID NO: 158984 - protein, 39 aa, Artificial Sequence
  Description of Artificial Sequence: Synthetic polypeptide
DEDEIRTTNPVATEQYGVVSTSNNNNQLQGIGTTNQNEQ

SEQ ID NO: 158985 - protein, 32 aa, Artificial Sequence
  Description of Artificial Sequence: Synthetic polypeptide
AENEIATTNPVATEGYGCVCSTWEHQHISELA

SEQ ID NO: 158986 - protein, 33 aa, Artificial Sequence
  Description of Artificial Sequence: Synthetic polypeptide
DEECIQCTNPVAYERYGCSVNINMSSDRPGGNA

SEQ ID NO: 158987 - protein, 32 aa, Artificial Sequence
  Description of Artificial Sequence: Synthetic polypeptide
NENEIRTTNPVSTEPYGTISMEDRQQQQNGNH

SEQ ID NO: 158988 - protein, 32 aa, Artificial Sequence
  Description of Artificial Sequence: Synthetic polypeptide
SEEEIRCTNPIATEQYGCVCSWGETANFGSDQ

SEQ ID NO: 158989 - protein, 31 aa, Artificial Sequence
  Description of Artificial Sequence: Synthetic polypeptide
DDSEVASTNPVSTEGYGNVAANYIQSRVGQR

SEQ ID NO: 158990 - protein, 33 aa, Artificial Sequence
  Description of Artificial Sequence: Synthetic polypeptide
DEECIQTTNPVAYEQYGTVPSCDGTLTAVTINA

SEQ ID NO: 158991 - protein, 33 aa, Artificial Sequence
  Description of Artificial Sequence: Synthetic polypeptide
DEECIQTTNPVAYERYGCCVNINMGSMRPGGNA

SEQ ID NO: 158992 - protein, 33 aa, Artificial Sequence
  Description of Artificial Sequence: Synthetic polypeptide
DEECIQTTNPVAYERYGCEVNINMGSDRNGGNA

SEQ ID NO: 158993 - protein, 34 aa, Artificial Sequence
  Description of Artificial Sequence: Synthetic polypeptide
DEECIQTTNPVAYERYGCSVHANMVSDRPGGNYA

SEQ ID NO: 158994 - protein, 34 aa, Artificial Sequence
  Description of Artificial Sequence: Synthetic polypeptide
DEECIQTTNPVAYERYGCSVHINMESDRPGGNMA

SEQ ID NO: 158995 - protein, 34 aa, Artificial Sequence
  Description of Artificial Sequence: Synthetic polypeptide
DEECIQTTNPVAYERYGCSVHINMVSDNRPGGNN

SEQ ID NO: 158996 - protein, 32 aa, Artificial Sequence
  Description of Artificial Sequence: Synthetic polypeptide
AEDEIACTNPVAYEQWGEAYIENLQRDGEGDR

SEQ ID NO: 158997 - protein, 37 aa, Artificial Sequence
  Description of Artificial Sequence: Synthetic polypeptide
YEEEIRSTNPVATEQYGSVDTDNNTNNFQGENGNDDG

SEQ ID NO: 158998 - protein, 34 aa, Artificial Sequence
  Description of Artificial Sequence: Synthetic polypeptide
DEECIQTTNPVAYERYGCSVHINMVSDRPGGNDK

SEQ ID NO: 158999 - protein, 33 aa, Artificial Sequence
  Description of Artificial Sequence: Synthetic polypeptide
DEECIQTTNPVAYERYGCSVHINMVSDRPGGPS

SEQ ID NO: 159000 - protein, 32 aa, Artificial Sequence
  Description of Artificial Sequence: Synthetic polypeptide
QENEIRTTNPVSSEPYGTISMENIQQQQNGNH

SEQ ID NO: 159001 - protein, 36 aa, Artificial Sequence
  Description of Artificial Sequence: Synthetic polypeptide
MESEIRTTNPVATEQYGSVSWPSMGLNQFDNNQEYF

SEQ ID NO: 159002 - protein, 32 aa, Artificial Sequence
  Description of Artificial Sequence: Synthetic polypeptide
DENEIRTTNPVATEQWGDVVEAIEMNADEEDA

SEQ ID NO: 159003 - protein, 37 aa, Artificial Sequence
  Description of Artificial Sequence: Synthetic polypeptide
DEEEIRTTNPVATEFYGSVNVMDGTFGQNIGGNDDQD

SEQ ID NO: 159004 - protein, 37 aa, Artificial Sequence
  Description of Artificial Sequence: Synthetic polypeptide
DEEEIRTTNPVAVEQYGSVSTVNNNNNNANDEQGATE

SEQ ID NO: 159005 - protein, 36 aa, Artificial Sequence
  Description of Artificial Sequence: Synthetic polypeptide
DEEEIRTTNPVATEQYGSVYLINNMNEQPQMQEIQW

SEQ ID NO: 159006 - protein, 31 aa, Artificial Sequence
  Description of Artificial Sequence: Synthetic polypeptide
QESEIASTNPVGTEGYGIVIASTLSQHGGDI

SEQ ID NO: 159007 - protein, 35 aa, Artificial Sequence
  Description of Artificial Sequence: Synthetic polypeptide
DEAEISTTNPVATEQYGQCVCSTGEDDQNFGSDQA

SEQ ID NO: 159008 - protein, 35 aa, Artificial Sequence
  Description of Artificial Sequence: Synthetic polypeptide
DEAEISTTNPVATEQYGQCVCSTGEHNQNFISNQS

SEQ ID NO: 159009 - protein, 34 aa, Artificial Sequence
  Description of Artificial Sequence: Synthetic polypeptide
DEVEIATTNPVAYDPWGMVPSCTAEHSQRGNVRH

SEQ ID NO: 159010 - protein, 33 aa, Artificial Sequence
  Description of Artificial Sequence: Synthetic polypeptide
DEVEIATTNPVAYDPWGMVPSCTAEHSQARGSR

SEQ ID NO: 159011 - protein, 36 aa, Artificial Sequence
  Description of Artificial Sequence: Synthetic polypeptide
DEEEIRTTNPVATEQYGSVYLINNMNEQPQMQEIHM

SEQ ID NO: 159012 - protein, 34 aa, Artificial Sequence
  Description of Artificial Sequence: Synthetic polypeptide
DEVEIATTNPVAYDPWGMIVPSCTAEHSQRGQNR

SEQ ID NO: 159013 - protein, 35 aa, Artificial Sequence
  Description of Artificial Sequence: Synthetic polypeptide
MESEIRTTNPVATETWGSVDCINEPQDREGEENGQ

SEQ ID NO: 159014 - protein, 32 aa, Artificial Sequence
  Description of Artificial Sequence: Synthetic polypeptide
DENEIRTTNPVSTEHYGTISMEDIQQQQNGPH

SEQ ID NO: 159015 - protein, 38 aa, Artificial Sequence
  Description of Artificial Sequence: Synthetic polypeptide
DEEEIRTTNPVATEQYGVVSTVDQQGNTEQGTNQEGED

SEQ ID NO: 159016 - protein, 32 aa, Artificial Sequence
  Description of Artificial Sequence: Synthetic polypeptide
DDSEVATTNPVSTEGYGNVAATTIQSREGQDR

SEQ ID NO: 159017 - protein, 32 aa, Artificial Sequence
  Description of Artificial Sequence: Synthetic polypeptide
DENEIRTTNPVATEQWGDVYSEIEDMNAAEDA

SEQ ID NO: 159018 - protein, 33 aa, Artificial Sequence
  Description of Artificial Sequence: Synthetic polypeptide
DESEIATTNPVGTEGYGVMSATPTGNMRGMNPI

SEQ ID NO: 159019 - protein, 31 aa, Artificial Sequence
  Description of Artificial Sequence: Synthetic polypeptide
DDSEVASTNPVSTEGYGNVAANTYQSRVGQR

SEQ ID NO: 159020 - protein, 38 aa, Artificial Sequence
  Description of Artificial Sequence: Synthetic polypeptide
DEEEIRTTNPVATEQYGVVSTVVTNNNNDEQGGTEEED

SEQ ID NO: 159021 - protein, 32 aa, Artificial Sequence
  Description of Artificial Sequence: Synthetic polypeptide
DESEIRTTNPVAHNHYGTCVWTVNQNEFDTNN

SEQ ID NO: 159022 - protein, 31 aa, Artificial Sequence
  Description of Artificial Sequence: Synthetic polypeptide
QENEIRTTNPVSTEPYGTISMCIQQQQNENH

SEQ ID NO: 159023 - protein, 35 aa, Artificial Sequence
  Description of Artificial Sequence: Synthetic polypeptide
QEEEIRTTNPVATEFYGSVSDGLGGGEGQGEQQGL

SEQ ID NO: 159024 - protein, 34 aa, Artificial Sequence
  Description of Artificial Sequence: Synthetic polypeptide
DEMEIRTTNPVATCHYGCVCSTGEDNQYFNSDQA

SEQ ID NO: 159025 - protein, 33 aa, Artificial Sequence
  Description of Artificial Sequence: Synthetic polypeptide
DEVEIATTNPVAYDPWGMVPSCTGAEHSQRGNW

SEQ ID NO: 159026 - protein, 36 aa, Artificial Sequence
  Description of Artificial Sequence: Synthetic polypeptide
DECEICTTNPVAVEQYGSVSTTVNNLEQGSTQDEED

SEQ ID NO: 159027 - protein, 36 aa, Artificial Sequence
  Description of Artificial Sequence: Synthetic polypeptide
DEAEISTTNPVATEIYGSVCSNWNDGQDRQGIGGEV

SEQ ID NO: 159028 - protein, 30 aa, Artificial Sequence
  Description of Artificial Sequence: Synthetic polypeptide
DENEIRTTNPVATEQWGDYTEIEMNAAEDA

SEQ ID NO: 159029 - protein, 32 aa, Artificial Sequence
  Description of Artificial Sequence: Synthetic polypeptide
QENEIRTTNPVSTEPYGTISMECIQQQQNGNH

SEQ ID NO: 159030 - protein, 33 aa, Artificial Sequence
  Description of Artificial Sequence: Synthetic polypeptide
DEECIATTNPVAYEQYSEEVTTTGDNHQGGGKS

SEQ ID NO: 159031 - protein, 31 aa, Artificial Sequence
  Description of Artificial Sequence: Synthetic polypeptide
DDSEVASTNPVSTEGYGNVAANTVQSRHGQR

SEQ ID NO: 159032 - protein, 34 aa, Artificial Sequence
  Description of Artificial Sequence: Synthetic polypeptide
DEGEIRTTNPVATEQYGCVETEVNEIGITVDFHH

SEQ ID NO: 159033 - protein, 34 aa, Artificial Sequence
  Description of Artificial Sequence: Synthetic polypeptide
METEIKTTNPVATEQYGDVSVTGEGQGGQGADEE

SEQ ID NO: 159034 - protein, 36 aa, Artificial Sequence
  Description of Artificial Sequence: Synthetic polypeptide
DEGEIRTTNPVATEQYGCVCSEWVYLQQEENNTDGP

SEQ ID NO: 159035 - protein, 38 aa, Artificial Sequence
  Description of Artificial Sequence: Synthetic polypeptide
DEDEIRTTNPVATEQYGVVSTSNQGNNQGIGTTNQEEQ

SEQ ID NO: 159036 - protein, 33 aa, Artificial Sequence
  Description of Artificial Sequence: Synthetic polypeptide
DENEIRTTNPVSTEGYGTISWEEDNQEQFGSDQ

SEQ ID NO: 159037 - protein, 31 aa, Artificial Sequence
  Description of Artificial Sequence: Synthetic polypeptide
DDSEVASTNPVSTEGYGNVAANTVQSRVGQR

SEQ ID NO: 159038 - protein, 32 aa, Artificial Sequence
  Description of Artificial Sequence: Synthetic polypeptide
QEGEIAPTNPCSYEQYGKVSCCNLSQSGTTNK

SEQ ID NO: 159039 - protein, 33 aa, Artificial Sequence
  Description of Artificial Sequence: Synthetic polypeptide
DENEIRTTNPVSTEIYGRISMEDIQHQQNGNHY

SEQ ID NO: 159040 - protein, 36 aa, Artificial Sequence
  Description of Artificial Sequence: Synthetic polypeptide
DEEEIRTTNPVATEQYGSGYVGIEEQIENTEEDNDM

SEQ ID NO: 159041 - protein, 30 aa, Artificial Sequence
  Description of Artificial Sequence: Synthetic polypeptide
DENEIRTTNPVATEQWGEAPEIEMNAAEDK

SEQ ID NO: 159042 - protein, 35 aa, Artificial Sequence
  Description of Artificial Sequence: Synthetic polypeptide
DEECIATVNPVATEAYGSVPSCDNEPSEKGGNYRR

SEQ ID NO: 159043 - protein, 30 aa, Artificial Sequence
  Description of Artificial Sequence: Synthetic polypeptide
DENEIRTTNPVATEQWGEAPEICMNAAEDK

SEQ ID NO: 159044 - protein, 33 aa, Artificial Sequence
  Description of Artificial Sequence: Synthetic polypeptide
SEEEIRTTNPVAYEQWGHVYWIDIDVQRGHGAG

SEQ ID NO: 159045 - protein, 31 aa, Artificial Sequence
  Description of Artificial Sequence: Synthetic polypeptide
DDSEVASTNPVSTEGYGNVAANTWQSRVGQR

SEQ ID NO: 159046 - protein, 31 aa, Artificial Sequence
  Description of Artificial Sequence: Synthetic polypeptide
DEVEIATTNPVAYEAWGCTTTNQQGNDNDKS

SEQ ID NO: 159047 - protein, 32 aa, Artificial Sequence
  Description of Artificial Sequence: Synthetic polypeptide
DENEIRTTNPVSTEGYGTIYMEDIQQQQNGNH

SEQ ID NO: 159048 - protein, 35 aa, Artificial Sequence
  Description of Artificial Sequence: Synthetic polypeptide
CEEEIATTNPVATEPYGIPVVPLEGNGQDQIGNRA

SEQ ID NO: 159049 - protein, 31 aa, Artificial Sequence
  Description of Artificial Sequence: Synthetic polypeptide
DDSEVASTNPVSTEGYGNVAANTIQMRVGQR

SEQ ID NO: 159050 - protein, 32 aa, Artificial Sequence
  Description of Artificial Sequence: Synthetic polypeptide
DENEIRTTNPVATEQWGDYVQSEIEMNAAEDA

SEQ ID NO: 159051 - protein, 33 aa, Artificial Sequence
  Description of Artificial Sequence: Synthetic polypeptide
NENEIATTNPVAYEQWGVAWSLDNMEQRHDSNR

SEQ ID NO: 159052 - protein, 38 aa, Artificial Sequence
  Description of Artificial Sequence: Synthetic polypeptide
DEDEIRTTNPVATEQYGVVSTTNNNQQGNQQGTTETND

SEQ ID NO: 159053 - protein, 39 aa, Artificial Sequence
  Description of Artificial Sequence: Synthetic polypeptide
DEEEIRTTNPVATEQYGVVSTVLLQQNATEQGTNNQTTE

SEQ ID NO: 159054 - protein, 31 aa, Artificial Sequence
  Description of Artificial Sequence: Synthetic polypeptide
DDSEVASTNPVSTEGYGNVAANVIQSRVGQR

SEQ ID NO: 159055 - protein, 33 aa, Artificial Sequence
  Description of Artificial Sequence: Synthetic polypeptide
DENEIRTTNPVATEQWGDVVQSNIGEMNAAEDA

SEQ ID NO: 159056 - protein, 31 aa, Artificial Sequence
  Description of Artificial Sequence: Synthetic polypeptide
DENEIRTTNPVATEQWGDVVQIGEMNAAEDA

SEQ ID NO: 159057 - protein, 38 aa, Artificial Sequence
  Description of Artificial Sequence: Synthetic polypeptide
DEGEIRTTNPVATEQYGCNCSVTTVNIEQDFTGFNEDY

SEQ ID NO: 159058 - protein, 29 aa, Artificial Sequence
  Description of Artificial Sequence: Synthetic peptide
QESEIASTNPVGTEGYGKMASTLEHGLDI

SEQ ID NO: 159059 - protein, 31 aa, Artificial Sequence
  Description of Artificial Sequence: Synthetic polypeptide
DESEIATTNPVGTECYGVTTAAETLAPKGDI

SEQ ID NO: 159060 - protein, 32 aa, Artificial Sequence
  Description of Artificial Sequence: Synthetic polypeptide
QESEIASTNPVGTEGYGKVMASYTHLQAHGDI

SEQ ID NO: 159061 - protein, 35 aa, Artificial Sequence
  Description of Artificial Sequence: Synthetic polypeptide
MESEIRTTNPVATEQYGSVVVTNTPETNSISPQTQ

SEQ ID NO: 159062 - protein, 36 aa, Artificial Sequence
  Description of Artificial Sequence: Synthetic polypeptide
DECEICTTNPVAVEQYGSVSTVTNNNEQGSTNNNED

SEQ ID NO: 159063 - protein, 31 aa, Artificial Sequence
  Description of Artificial Sequence: Synthetic polypeptide
QESEIASTNPVGTEGYGLVGMASTQPQFGDI

SEQ ID NO: 159064 - protein, 36 aa, Artificial Sequence
  Description of Artificial Sequence: Synthetic polypeptide
DEEEIRTTNPVATEQYGSVYLINNMNEIPQMQEIPY

SEQ ID NO: 159065 - protein, 33 aa, Artificial Sequence
  Description of Artificial Sequence: Synthetic polypeptide
DTEEICATNPVAYEQWGHSYYTEHMQKRGDNND

SEQ ID NO: 159066 - protein, 36 aa, Artificial Sequence
  Description of Artificial Sequence: Synthetic polypeptide
MESEIRTTNPVATEQYGSVSWPVGGLNQFDNNQEEP

SEQ ID NO: 159067 - protein, 32 aa, Artificial Sequence
  Description of Artificial Sequence: Synthetic polypeptide
QENEIRTTNPVSTEPYGTISEEDIQQQQNGNL

SEQ ID NO: 159068 - protein, 31 aa, Artificial Sequence
  Description of Artificial Sequence: Synthetic polypeptide
DENEIRTTNPVATEQWGDVVLDIEMNAAEDA

SEQ ID NO: 159069 - protein, 33 aa, Artificial Sequence
  Description of Artificial Sequence: Synthetic polypeptide
AEDEIACTNPVAYEQWGESASIENDDDQRGGER

SEQ ID NO: 159070 - protein, 32 aa, Artificial Sequence
  Description of Artificial Sequence: Synthetic polypeptide
AEDEIACTNPVAYEQWGECASIENDQHRGGER

SEQ ID NO: 159071 - protein, 35 aa, Artificial Sequence
  Description of Artificial Sequence: Synthetic polypeptide
DEECIATVNPVATECYGSVVCIDNQDDENRGGNSR

SEQ ID NO: 159072 - protein, 32 aa, Artificial Sequence
  Description of Artificial Sequence: Synthetic polypeptide
DENEIRTTNPVSTEPFGTISMEAIQQQQNGNH

SEQ ID NO: 159073 - protein, 34 aa, Artificial Sequence
  Description of Artificial Sequence: Synthetic polypeptide
DEECIATVNPVATECYGSVVCIDNQDGERQGNTD

SEQ ID NO: 159074 - protein, 35 aa, Artificial Sequence
  Description of Artificial Sequence: Synthetic polypeptide
DEECIATVNPVATECYGSVVCIDNQDGERQGSNQR

SEQ ID NO: 159075 - protein, 35 aa, Artificial Sequence
  Description of Artificial Sequence: Synthetic polypeptide
DEECIATVNPVATECYGSVVCIDNQDQERQGMNST

SEQ ID NO: 159076 - protein, 32 aa, Artificial Sequence
  Description of Artificial Sequence: Synthetic polypeptide
DENEIRTTNPVSTEPFGNISMEDIQQQQNGNH

SEQ ID NO: 159077 - protein, 34 aa, Artificial Sequence
  Description of Artificial Sequence: Synthetic polypeptide
DENEIRTTNPVSTENYGTVCSGMEGIQQQQNGNS

SEQ ID NO: 159078 - protein, 36 aa, Artificial Sequence
  Description of Artificial Sequence: Synthetic polypeptide
DTEEIATTNPVATTQWGSVAWTENGDRQDQRGNGSQ

SEQ ID NO: 159079 - protein, 38 aa, Artificial Sequence
  Description of Artificial Sequence: Synthetic polypeptide
DEEEIRTTNPVATEQYGVVSTVNDEQGSTNQTEEEQTD

SEQ ID NO: 159080 - protein, 39 aa, Artificial Sequence
  Description of Artificial Sequence: Synthetic polypeptide
DEEEIRTTNPVATEAYGVVSTVVSTNNQAGTNQQGTTDM

SEQ ID NO: 159081 - protein, 33 aa, Artificial Sequence
  Description of Artificial Sequence: Synthetic polypeptide
YEEEIRCTNPAATEQYGSVVYEGGMGDGQGGET

SEQ ID NO: 159082 - protein, 39 aa, Artificial Sequence
  Description of Artificial Sequence: Synthetic polypeptide
DEEEIRTTNPVATEAYGVVSTVVSTNNQAGGNEQGTDDD

SEQ ID NO: 159083 - protein, 31 aa, Artificial Sequence
  Description of Artificial Sequence: Synthetic polypeptide
DDSEVASTNPVSTEGYGNVAANTIQMRDGQR

SEQ ID NO: 159084 - protein, 38 aa, Artificial Sequence
  Description of Artificial Sequence: Synthetic polypeptide
DEEEIRTTNPVATEQYGVVSTVLQQNATEQGTTEQGSE

SEQ ID NO: 159085 - protein, 31 aa, Artificial Sequence
  Description of Artificial Sequence: Synthetic polypeptide
DDSEVASTNPVSTEGYGNVAANTIQLRVGQR

SEQ ID NO: 159086 - protein, 36 aa, Artificial Sequence
  Description of Artificial Sequence: Synthetic polypeptide
DEEEIATTNPVATEQYGSVCAANMGLEATDSPGSDM

SEQ ID NO: 159087 - protein, 33 aa, Artificial Sequence
  Description of Artificial Sequence: Synthetic polypeptide
DENEIRTTNPVSTEKYGTISMEDIQQQQNGNHQ

SEQ ID NO: 159088 - protein, 32 aa, Artificial Sequence
  Description of Artificial Sequence: Synthetic polypeptide
QEGEIAPTNPCSYEQYGKVSCNELSQSEGTNF

SEQ ID NO: 159089 - protein, 37 aa, Artificial Sequence
  Description of Artificial Sequence: Synthetic polypeptide
DECEICTTNPVAVEQYGSVSTVNNNNLEQGSTNNVED

SEQ ID NO: 159090 - protein, 36 aa, Artificial Sequence
  Description of Artificial Sequence: Synthetic polypeptide
DEECIATVNPVATEAYGSVVTSCDNEPSERGGNNLR

SEQ ID NO: 159091 - protein, 31 aa, Artificial Sequence
  Description of Artificial Sequence: Synthetic polypeptide
DDSEVASTNPVSTEGYGNVAANTIQIRVGQR

SEQ ID NO: 159092 - protein, 32 aa, Artificial Sequence
  Description of Artificial Sequence: Synthetic polypeptide
AEDEIACTNPVAYEQWGEYYSIENDGRGNGER

SEQ ID NO: 159093 - protein, 34 aa, Artificial Sequence
  Description of Artificial Sequence: Synthetic polypeptide
DEECIATVNPVATECYGSVVCIDNDHERQGTNQE

SEQ ID NO: 159094 - protein, 33 aa, Artificial Sequence
  Description of Artificial Sequence: Synthetic polypeptide
DENEIRTTNPVSTEMYGTISMEDIQQQQNGNHG

SEQ ID NO: 159095 - protein, 32 aa, Artificial Sequence
  Description of Artificial Sequence: Synthetic polypeptide
DENEIRTTNPVSTENYGTICMEDIQQQQNGNH

SEQ ID NO: 159096 - protein, 32 aa, Artificial Sequence
  Description of Artificial Sequence: Synthetic polypeptide
DENEIRTTNPVATEQWGDVVSKEIEMNAAEDA

SEQ ID NO: 159097 - protein, 31 aa, Artificial Sequence
  Description of Artificial Sequence: Synthetic polypeptide
DDSEVRTTNPVSTEGYGNVAAETIMSAAGDR

SEQ ID NO: 159098 - protein, 39 aa, Artificial Sequence
  Description of Artificial Sequence: Synthetic polypeptide
DEEEIRTTNPVATEAYGVVSTVVSTNLQAGTTEQGTDDN

SEQ ID NO: 159099 - protein, 38 aa, Artificial Sequence
  Description of Artificial Sequence: Synthetic polypeptide
DEEEIRTTNPVATEQYGVVSTVNAEQGNNQQGTTEDEE

SEQ ID NO: 159100 - protein, 38 aa, Artificial Sequence
  Description of Artificial Sequence: Synthetic polypeptide
DEEEIRTTNPVATEQYGVVSTVNDEQGSTNGTEEEEDD

SEQ ID NO: 159101 - protein, 33 aa, Artificial Sequence
  Description of Artificial Sequence: Synthetic polypeptide
DENEIRTTNPVSTENYGTISMEDIQQQQNGNHK

SEQ ID NO: 159102 - protein, 30 aa, Artificial Sequence
  Description of Artificial Sequence: Synthetic polypeptide
DDSEVASTNPVSTEGYGNVAANTIQHVGQR

SEQ ID NO: 159103 - protein, 35 aa, Artificial Sequence
  Description of Artificial Sequence: Synthetic polypeptide
DENEIATTNPVATEQYGSVCAAINGEEAGAEMENN

SEQ ID NO: 159104 - protein, 32 aa, Artificial Sequence
  Description of Artificial Sequence: Synthetic polypeptide
DENEIRTTNPVSTEGYGTISGEDIQQQQNPNH

SEQ ID NO: 159105 - protein, 36 aa, Artificial Sequence
  Description of Artificial Sequence: Synthetic polypeptide
DEAEIRCTNPVATEQYGSVSVDVNLEEESYGFEKSD

SEQ ID NO: 159106 - protein, 38 aa, Artificial Sequence
  Description of Artificial Sequence: Synthetic polypeptide
CEEEIATTNPVATEQYGSVCAMTNGELTNPDDGMENRM

SEQ ID NO: 159107 - protein, 32 aa, Artificial Sequence
  Description of Artificial Sequence: Synthetic polypeptide
DEECIATTNPVAYEEYSEEVTTGDNHQGGGKM

SEQ ID NO: 159108 - protein, 35 aa, Artificial Sequence
  Description of Artificial Sequence: Synthetic polypeptide
DENEIATTNPVATEQYGSVCAATAHQEADMPPGEN

SEQ ID NO: 159109 - protein, 39 aa, Artificial Sequence
  Description of Artificial Sequence: Synthetic polypeptide
DEEEIRTTNPVATEQYGVVSTTVVNNLQQGTEQGTTDQQ

SEQ ID NO: 159110 - protein, 36 aa, Artificial Sequence
  Description of Artificial Sequence: Synthetic polypeptide
DEGEIRTTNPVATEQYGSTNCTPLWEQMEYDEIDND

SEQ ID NO: 159111 - protein, 32 aa, Artificial Sequence
  Description of Artificial Sequence: Synthetic polypeptide
DENEIRTTNPVSTEEYGTISWEEIQQEQFGQQ

SEQ ID NO: 159112 - protein, 39 aa, Artificial Sequence
  Description of Artificial Sequence: Synthetic polypeptide
DEEEIRTTNPVATEQYGVVSTTVVNNLQQGTEQGTTQDE

SEQ ID NO: 159113 - protein, 34 aa, Artificial Sequence
  Description of Artificial Sequence: Synthetic polypeptide
DEQEIATTNPVAYEQWGVVSGGNMQQLNDQHGGH

SEQ ID NO: 159114 - protein, 35 aa, Artificial Sequence
  Description of Artificial Sequence: Synthetic polypeptide
DEEEIRTTNPVATEFYGNVVVDDNMTMEFDGENGA

SEQ ID NO: 159115 - protein, 38 aa, Artificial Sequence
  Description of Artificial Sequence: Synthetic polypeptide
DEEEIRTTNPVATEQYGNVMSDGVNDQDEGGQETNGQF

SEQ ID NO: 159116 - protein, 36 aa, Artificial Sequence
  Description of Artificial Sequence: Synthetic polypeptide
QEEEIRTTNPVATEQYGSVPEYVSNLSQFQEVELEV

SEQ ID NO: 159117 - protein, 33 aa, Artificial Sequence
  Description of Artificial Sequence: Synthetic polypeptide
DEVEIATTNPVAYEQWGSVCVNWEHQEQDMHQR

SEQ ID NO: 159118 - protein, 37 aa, Artificial Sequence
  Description of Artificial Sequence: Synthetic polypeptide
DEEEIRTTNPVATEQYGNVMSDGVNDQNEGGQEEDGQ

SEQ ID NO: 159119 - protein, 38 aa, Artificial Sequence
  Description of Artificial Sequence: Synthetic polypeptide
DEEEIRTTNPVATEAYGVVSTVVVNNQQQGNNNTEDEE

SEQ ID NO: 159120 - protein, 35 aa, Artificial Sequence
  Description of Artificial Sequence: Synthetic polypeptide
DEEEIRTTNPVAWEPYGSVCFMQNAGSTDTGGNPT

SEQ ID NO: 159121 - protein, 36 aa, Artificial Sequence
  Description of Artificial Sequence: Synthetic polypeptide
DEVEIATTNPVAYEQWGSVCSTTNGNQDEHQGDDVR

SEQ ID NO: 159122 - protein, 32 aa, Artificial Sequence
  Description of Artificial Sequence: Synthetic polypeptide
AEDEIAPTNPVAYEQWGEAYIINDQDRGNGER

SEQ ID NO: 159123 - protein, 34 aa, Artificial Sequence
  Description of Artificial Sequence: Synthetic polypeptide
DEQEIATTNPVAYEQWGVTSTNPNGNGMRGGNNM

SEQ ID NO: 159124 - protein, 34 aa, Artificial Sequence
  Description of Artificial Sequence: Synthetic polypeptide
DENEIATTNPVATEQYGSVCAATGEEAIDEMNEN

SEQ ID NO: 159125 - protein, 37 aa, Artificial Sequence
  Description of Artificial Sequence: Synthetic polypeptide
DEEEIRTTNPVATEQYGNVMTDDNIENNIQEGGGDGE

SEQ ID NO: 159126 - protein, 36 aa, Artificial Sequence
  Description of Artificial Sequence: Synthetic polypeptide
DEEEIRTTNPVATEQYGNVMTDDNVENIDEGGGDGE

SEQ ID NO: 159127 - protein, 34 aa, Artificial Sequence
  Description of Artificial Sequence: Synthetic polypeptide
DENEIATTNPVATEQYGSVCAATAGEEMMGMPED

SEQ ID NO: 159128 - protein, 35 aa, Artificial Sequence
  Description of Artificial Sequence: Synthetic polypeptide
CENEIRTTNPVATEQYGSISLTFEETEIREMPLRI

SEQ ID NO: 159129 - protein, 36 aa, Artificial Sequence
  Description of Artificial Sequence: Synthetic polypeptide
DEEEIATTNPVATEQYGSVCAAMNHLNAMAPENDHH

SEQ ID NO: 159130 - protein, 30 aa, Artificial Sequence
  Description of Artificial Sequence: Synthetic polypeptide
QESEIASTNPVGMEPYGVVMASTLQPHGDI

SEQ ID NO: 159131 - protein, 35 aa, Artificial Sequence
  Description of Artificial Sequence: Synthetic polypeptide
DEMEIATTNPVATEQYGTVCSNTEEPNEFFGSDDA

SEQ ID NO: 159132 - protein, 35 aa, Artificial Sequence
  Description of Artificial Sequence: Synthetic polypeptide
DENEIRTTNPVATEQWGQVTVSEIESMNAAEGDNA

SEQ ID NO: 159133 - protein, 33 aa, Artificial Sequence
  Description of Artificial Sequence: Synthetic polypeptide
DENEIRTTNPVSTEEYGTIHSMEDIQQQQNGNH

SEQ ID NO: 159134 - protein, 29 aa, Artificial Sequence
  Description of Artificial Sequence: Synthetic peptide
QESEIASTNPVGFEGYGVMASTLQQHGDI

SEQ ID NO: 159135 - protein, 36 aa, Artificial Sequence
  Description of Artificial Sequence: Synthetic polypeptide
DEEEIRTTNPVATEQYGSVPPTLEAQQEDEIVLDHE

SEQ ID NO: 159136 - protein, 34 aa, Artificial Sequence
  Description of Artificial Sequence: Synthetic polypeptide
DENEIRTTNPVATEQWGQTVSCCIESMNAAEDNA

SEQ ID NO: 159137 - protein, 33 aa, Artificial Sequence
  Description of Artificial Sequence: Synthetic polypeptide
DEECIATTNPVAYEEWGQCTTDGGDHQRGRNMR

SEQ ID NO: 159138 - protein, 36 aa, Artificial Sequence
  Description of Artificial Sequence: Synthetic polypeptide
DEEEIATTNPVATEQYGSVCAAMNHDQAMVPDDGRP

SEQ ID NO: 159139 - protein, 35 aa, Artificial Sequence
  Description of Artificial Sequence: Synthetic polypeptide
DEHEIRTTNPVAYEQWGHNNVSYWEELQHRPGGGQ

SEQ ID NO: 159140 - protein, 35 aa, Artificial Sequence
  Description of Artificial Sequence: Synthetic polypeptide
DECEICTTNPVATTQYGVVSTTLLQQGTEQGTEDT

SEQ ID NO: 159141 - protein, 36 aa, Artificial Sequence
  Description of Artificial Sequence: Synthetic polypeptide
DEGEIRTTNPVATEQYGSTVSAENDHTQAELFEDGD

SEQ ID NO: 159142 - protein, 35 aa, Artificial Sequence
  Description of Artificial Sequence: Synthetic polypeptide
DENEIATTNPVATEQYGSVCAANNGDENGMDMNSN

SEQ ID NO: 159143 - protein, 35 aa, Artificial Sequence
  Description of Artificial Sequence: Synthetic polypeptide
DEEEIRTTNPVAWEQYGCVCSWGEHNQNFNSENQA

SEQ ID NO: 159144 - protein, 38 aa, Artificial Sequence
  Description of Artificial Sequence: Synthetic polypeptide
DEEEIRTTNPVATEQYGVVSTTVTQAGNQAGTTEQGSE

SEQ ID NO: 159145 - protein, 35 aa, Artificial Sequence
  Description of Artificial Sequence: Synthetic polypeptide
DDEEIRTTNPVATDQYGVVNDNSIGQNGQEDNNDF

SEQ ID NO: 159146 - protein, 36 aa, Artificial Sequence
  Description of Artificial Sequence: Synthetic polypeptide
DEEEIRTTNPVATEQYGSVPPTLEAQEMFEIVLLQE

SEQ ID NO: 159147 - protein, 34 aa, Artificial Sequence
  Description of Artificial Sequence: Synthetic polypeptide
DSEEIRTTNPVGYEQWGCVRHNDDQQDRRGGVMR

SEQ ID NO: 159148 - protein, 34 aa, Artificial Sequence
  Description of Artificial Sequence: Synthetic polypeptide
DSEEIRTTNPVGYEQWGCVRHNDKQQDDRGGSRN

SEQ ID NO: 159149 - protein, 36 aa, Artificial Sequence
  Description of Artificial Sequence: Synthetic polypeptide
DEEEIATTNPVATEQYGSVCAAMNHLNAMAPADDNP

SEQ ID NO: 159150 - protein, 33 aa, Artificial Sequence
  Description of Artificial Sequence: Synthetic polypeptide
DSEEIRTTNPVGYEQWGCVRHNDQQQDRRGGEE

SEQ ID NO: 159151 - protein, 28 aa, Artificial Sequence
  Description of Artificial Sequence: Synthetic peptide
QESEIASTNPVGIEGYGVMASTLQHTDN

SEQ ID NO: 159152 - protein, 33 aa, Artificial Sequence
  Description of Artificial Sequence: Synthetic polypeptide
DEVEIATTNPVAYEQWGSVSHTGAPGDHGGDDH

SEQ ID NO: 159153 - protein, 36 aa, Artificial Sequence
  Description of Artificial Sequence: Synthetic polypeptide
DEEEIRTTNPVATEFYGQVMEVDITNDGGQGDGGDQ

SEQ ID NO: 159154 - protein, 32 aa, Artificial Sequence
  Description of Artificial Sequence: Synthetic polypeptide
DEECIATTNPVAYEGWGQCTTGGDHDRGTNGR

SEQ ID NO: 159155 - protein, 36 aa, Artificial Sequence
  Description of Artificial Sequence: Synthetic polypeptide
DEAEAEIRTTNPVAYEQWGSVAWTDQLNQDQGGGDM

SEQ ID NO: 159156 - protein, 36 aa, Artificial Sequence
  Description of Artificial Sequence: Synthetic polypeptide
DEEEIRTTNPVATEQYGNVYVGIEEQIENTEGDNDI

SEQ ID NO: 159157 - protein, 28 aa, Artificial Sequence
  Description of Artificial Sequence: Synthetic peptide
QESEIASTNPVGTCGYGVMASTLQHKDI

SEQ ID NO: 159158 - protein, 33 aa, Artificial Sequence
  Description of Artificial Sequence: Synthetic polypeptide
DEVEIATTNPVAYEQWGSVCSTNDHDHPMEDHQ

SEQ ID NO: 159159 - protein, 36 aa, Artificial Sequence
  Description of Artificial Sequence: Synthetic polypeptide
DEEEIRTTNPVATEQYGNVYVSIEEQIENTEEDNDM

SEQ ID NO: 159160 - protein, 36 aa, Artificial Sequence
  Description of Artificial Sequence: Synthetic polypeptide
DEEEIRTTNPVATEFYGQVVDGGGNATNDDEDGNQG

SEQ ID NO: 159161 - protein, 36 aa, Artificial Sequence
  Description of Artificial Sequence: Synthetic polypeptide
DECEICTTNPVAVEQYGSVSTNNTNNDEQGTNNTGT

SEQ ID NO: 159162 - protein, 38 aa, Artificial Sequence
  Description of Artificial Sequence: Synthetic polypeptide
DEEEIRTTNPVATEAYGVVSTVVTTNNDQQGETNQNED

SEQ ID NO: 159163 - protein, 36 aa, Artificial Sequence
  Description of Artificial Sequence: Synthetic polypeptide
DEEEISTTNPVATEQYGQCVCSWGEHAENFQSDNQE

SEQ ID NO: 159164 - protein, 34 aa, Artificial Sequence
  Description of Artificial Sequence: Synthetic polypeptide
DEECIATTNPVAYEGWGSVATTNLEGNDQQGDGE

SEQ ID NO: 159165 - protein, 36 aa, Artificial Sequence
  Description of Artificial Sequence: Synthetic polypeptide
DEEEIRTTNPVATEQYGSYQVAMEEQIENEEEANDM

SEQ ID NO: 159166 - protein, 36 aa, Artificial Sequence
  Description of Artificial Sequence: Synthetic polypeptide
DECEICTTNPVAVEQYGSVSTNNTNNTEQGTTNAGT

SEQ ID NO: 159167 - protein, 37 aa, Artificial Sequence
  Description of Artificial Sequence: Synthetic polypeptide
DEEEIRTTNPVATEQYGSYSINEYTLQIEQMVELTEE

SEQ ID NO: 159168 - protein, 32 aa, Artificial Sequence
  Description of Artificial Sequence: Synthetic polypeptide
DDSEVRTTNPVSTEGWGNVSANTIQSRVGEQG

SEQ ID NO: 159169 - protein, 33 aa, Artificial Sequence
  Description of Artificial Sequence: Synthetic polypeptide
DEECIATTNPVAYEGWGSVATTNLGGDTQGDGA

SEQ ID NO: 159170 - protein, 39 aa, Artificial Sequence
  Description of Artificial Sequence: Synthetic polypeptide
DEEEIRTTNPVATEAYGVVSTVVTTNLQAGTNTQGNDDA

SEQ ID NO: 159171 - protein, 34 aa, Artificial Sequence
  Description of Artificial Sequence: Synthetic polypeptide
DSEEISTTNPVAYQQWGSTVVSTNPSMHGGNMGT

SEQ ID NO: 159172 - protein, 38 aa, Artificial Sequence
  Description of Artificial Sequence: Synthetic polypeptide
DEEEIRTTNPVATEQYGVVSTVVVTQAGNNVTEENTEA

SEQ ID NO: 159173 - protein, 35 aa, Artificial Sequence
  Description of Artificial Sequence: Synthetic polypeptide
NEMEIRTTNPVATEQYGSVWAWNLGDEDFMSSQRP

SEQ ID NO: 159174 - protein, 38 aa, Artificial Sequence
  Description of Artificial Sequence: Synthetic polypeptide
DEEEIRTTNPVATEQYGQCAVCSTGEHNQENFGSDNQS

SEQ ID NO: 159175 - protein, 33 aa, Artificial Sequence
  Description of Artificial Sequence: Synthetic polypeptide
DEVEIATTNPVAYEQWGSVCSTDDHDHPMGDHV

SEQ ID NO: 159176 - protein, 38 aa, Artificial Sequence
  Description of Artificial Sequence: Synthetic polypeptide
DEEEIRTTNPVATEQYGVVSTVVVTQAGTNDTEEENEV

SEQ ID NO: 159177 - protein, 36 aa, Artificial Sequence
  Description of Artificial Sequence: Synthetic polypeptide
DENEIATTNPVATEQYGSVCAMNNGELIQDSDENGH

SEQ ID NO: 159178 - protein, 34 aa, Artificial Sequence
  Description of Artificial Sequence: Synthetic polypeptide
DEVEIATTNPVAYEQWGSVCSTNDHDHPNAGQEE

SEQ ID NO: 159179 - protein, 35 aa, Artificial Sequence
  Description of Artificial Sequence: Synthetic polypeptide
NEMEIRTTNPVATEQYGSVTVTPDIDTRPGSDGTM

SEQ ID NO: 159180 - protein, 36 aa, Artificial Sequence
  Description of Artificial Sequence: Synthetic polypeptide
DEEEIRTTNPVATEQYGSVPPTLAAQEEFEIVLDQE

SEQ ID NO: 159181 - protein, 32 aa, Artificial Sequence
  Description of Artificial Sequence: Synthetic polypeptide
DEECIATTNPVAYEGWGQCTTGGDHQRGSNEE

SEQ ID NO: 159182 - protein, 36 aa, Artificial Sequence
  Description of Artificial Sequence: Synthetic polypeptide
DEQEIRTTNPVATEGYGSVMGQFNTGGQENGNEGIE

SEQ ID NO: 159183 - protein, 35 aa, Artificial Sequence
  Description of Artificial Sequence: Synthetic polypeptide
DENEIATTNPVATEQYGSVCAATNPEEAEAEINSN

SEQ ID NO: 159184 - protein, 33 aa, Artificial Sequence
  Description of Artificial Sequence: Synthetic polypeptide
DSEEIRTTNPVSYEQYGKTIPCFNLSQGNGGQT

SEQ ID NO: 159185 - protein, 36 aa, Artificial Sequence
  Description of Artificial Sequence: Synthetic polypeptide
DENEIATTNPVATEQYGSVCAATNPEEAEAEMGNNQ

SEQ ID NO: 159186 - protein, 34 aa, Artificial Sequence
  Description of Artificial Sequence: Synthetic polypeptide
DEEEIRSTNPVATEFYGVVVDNVDDNNEFGVNEG

SEQ ID NO: 159187 - protein, 34 aa, Artificial Sequence
  Description of Artificial Sequence: Synthetic polypeptide
DENEIATTNPVATEQYGSVCAHNNEENPDNQENH

SEQ ID NO: 159188 - protein, 38 aa, Artificial Sequence
  Description of Artificial Sequence: Synthetic polypeptide
DEEEIRTTNPVATEAYGVVSTVVVNNNDQQGVTNQNED

SEQ ID NO: 159189 - protein, 33 aa, Artificial Sequence
  Description of Artificial Sequence: Synthetic polypeptide
DENEIRTTNPVSTEFYGTISGEEDIQQQENGNH

SEQ ID NO: 159190 - protein, 35 aa, Artificial Sequence
  Description of Artificial Sequence: Synthetic polypeptide
DEEEIACTNPVATEQYGCVAATANEPTQGGGMEAH

SEQ ID NO: 159191 - protein, 33 aa, Artificial Sequence
  Description of Artificial Sequence: Synthetic polypeptide
DSEEIRTTNPVGYECWGMVPHWNDLGQDHGDER

SEQ ID NO: 159192 - protein, 35 aa, Artificial Sequence
  Description of Artificial Sequence: Synthetic polypeptide
DEEEIRSTNPVATEAYGSVCIWVNDQDQRDSDKAG

SEQ ID NO: 159193 - protein, 31 aa, Artificial Sequence
  Description of Artificial Sequence: Synthetic polypeptide
DEQEIATTNPVAYEQWGTVSKEIEMNGKEDA

SEQ ID NO: 159194 - protein, 36 aa, Artificial Sequence
  Description of Artificial Sequence: Synthetic polypeptide
DEEEIRSTNPVATDQYGTVVMQDTNMLIREGMGGGN

SEQ ID NO: 159195 - protein, 37 aa, Artificial Sequence
  Description of Artificial Sequence: Synthetic polypeptide
DECEICTTNPVAVEQYGSVSTNNQNNGSEQGTTNVGE

SEQ ID NO: 159196 - protein, 35 aa, Artificial Sequence
  Description of Artificial Sequence: Synthetic polypeptide
NEMEIRTTNPVATEQYGSVSVTEENGGEWSFSQMP

SEQ ID NO: 159197 - protein, 35 aa, Artificial Sequence
  Description of Artificial Sequence: Synthetic polypeptide
DEEPIRTTNPVAYEQWRWETVSCTGNEASQIGGNP

SEQ ID NO: 159198 - protein, 36 aa, Artificial Sequence
  Description of Artificial Sequence: Synthetic polypeptide
DEEEIRPTNPVATERYGSVSSTTPAGPNMRNGMTKV

SEQ ID NO: 159199 - protein, 28 aa, Artificial Sequence
  Description of Artificial Sequence: Synthetic peptide
QESEIASTNPVGTAGYGVMASTLQHPDI

SEQ ID NO: 159200 - protein, 36 aa, Artificial Sequence
  Description of Artificial Sequence: Synthetic polypeptide
DENEIATTNPVATEQYGSVCAMNGNLEPGADIPNDA

SEQ ID NO: 159201 - protein, 36 aa, Artificial Sequence
  Description of Artificial Sequence: Synthetic polypeptide
DEEEIATTNPVATEQYGSVCAAMNHLTAMAPDNDHP

SEQ ID NO: 159202 - protein, 35 aa, Artificial Sequence
  Description of Artificial Sequence: Synthetic polypeptide
NEMEIRTTNPVATEQYGSVSVTEPNGGDEWSSVDP

SEQ ID NO: 159203 - protein, 33 aa, Artificial Sequence
  Description of Artificial Sequence: Synthetic polypeptide
DENEIRTTNPVSTEFYGTISLMEDIQQQQNGNH

SEQ ID NO: 159204 - protein, 39 aa, Artificial Sequence
  Description of Artificial Sequence: Synthetic polypeptide
DEEEIRTTNPVATEQYGVVSTTVVSNLQQGTEQGTVEEE

SEQ ID NO: 159205 - protein, 33 aa, Artificial Sequence
  Description of Artificial Sequence: Synthetic polypeptide
DSEEIRTTNPVGYECWGMVPHWNDLGQDAGMVR

SEQ ID NO: 159206 - protein, 39 aa, Artificial Sequence
  Description of Artificial Sequence: Synthetic polypeptide
DEEEIRTTNPVATEAYGVVSTVVVTNLQAGNNQQGNDDE

SEQ ID NO: 159207 - protein, 33 aa, Artificial Sequence
  Description of Artificial Sequence: Synthetic polypeptide
NEAEIRTTNPVAYECWGCTSTNLPGNEGGDGRG

SEQ ID NO: 159208 - protein, 34 aa, Artificial Sequence
  Description of Artificial Sequence: Synthetic polypeptide
DEAEIRTTNPVATEQYGSTYTSLMMSLESIEDQC

SEQ ID NO: 159209 - protein, 35 aa, Artificial Sequence
  Description of Artificial Sequence: Synthetic polypeptide
DESEICTTNPVATEQYGITVCSCTDGPSEFEGNND

SEQ ID NO: 159210 - protein, 32 aa, Artificial Sequence
  Description of Artificial Sequence: Synthetic polypeptide
NEAEIRTTNPVAYEAWGSVVIDNDGQQNMGQK

SEQ ID NO: 159211 - protein, 35 aa, Artificial Sequence
  Description of Artificial Sequence: Synthetic polypeptide
DEECEICTTNPVAYEQWGEVATGGNTNDHQGGNTM

SEQ ID NO: 159212 - protein, 35 aa, Artificial Sequence
  Description of Artificial Sequence: Synthetic polypeptide
DEAEIRTTNPVATEQYGCVSCWDSLEQPEPQQDYI

SEQ ID NO: 159213 - protein, 36 aa, Artificial Sequence
  Description of Artificial Sequence: Synthetic polypeptide
QEEEIRTTNPVATEQYGSVNTDNMIETDGGGQETGQ

SEQ ID NO: 159214 - protein, 34 aa, Artificial Sequence
  Description of Artificial Sequence: Synthetic polypeptide
CEEEISTTNPVATEQYGCVCSNTEHTNFFSETAA

SEQ ID NO: 159215 - protein, 31 aa, Artificial Sequence
  Description of Artificial Sequence: Synthetic polypeptide
DENEIACTNPVSTEPYGTASEENIQQQQGGH

SEQ ID NO: 159216 - protein, 33 aa, Artificial Sequence
  Description of Artificial Sequence: Synthetic polypeptide
DENEIRTTNPVSTECYGTISCIDEPQDQNGENG

SEQ ID NO: 159217 - protein, 35 aa, Artificial Sequence
  Description of Artificial Sequence: Synthetic polypeptide
CEEEISTTNPVATEQYGCVCSNTELAENFGSDTQS

SEQ ID NO: 159218 - protein, 35 aa, Artificial Sequence
  Description of Artificial Sequence: Synthetic polypeptide
DECEICTTNPVATEQYGSVSTVTANQGDTEEAETD

SEQ ID NO: 159219 - protein, 34 aa, Artificial Sequence
  Description of Artificial Sequence: Synthetic polypeptide
DEAEIRTTNPVATEQYGCVNRELWEQMEYDEIDN

SEQ ID NO: 159220 - protein, 33 aa, Artificial Sequence
  Description of Artificial Sequence: Synthetic polypeptide
DENEIRTTNPVSTECYGTISCIDIQQQQNGENG

SEQ ID NO: 159221 - protein, 34 aa, Artificial Sequence
  Description of Artificial Sequence: Synthetic polypeptide
DEAEIRTTNPVATEQYGCVNHALWEQMEYDEIDN

SEQ ID NO: 159222 - protein, 35 aa, Artificial Sequence
  Description of Artificial Sequence: Synthetic polypeptide
DENEIATTNPVATEQYGSVCAAMMHGQNEMGNSGN

SEQ ID NO: 159223 - protein, 33 aa, Artificial Sequence
  Description of Artificial Sequence: Synthetic polypeptide
DEHEIRTTNPVAYEQWGNVCMEQLQDMQNGDHE

SEQ ID NO: 159224 - protein, 36 aa, Artificial Sequence
  Description of Artificial Sequence: Synthetic polypeptide
DENEIATTNPVATEQYGSVCAAMNHAQAMAPDNDRP

SEQ ID NO: 159225 - protein, 35 aa, Artificial Sequence
  Description of Artificial Sequence: Synthetic polypeptide
DENEIATTNPVATEQYGSVCAAMNHDEAGMPPDNN

SEQ ID NO: 159226 - protein, 34 aa, Artificial Sequence
  Description of Artificial Sequence: Synthetic polypeptide
DEVEIATTNPVAYEQWGTSSSVTNDIGQHMIAER

SEQ ID NO: 159227 - protein, 34 aa, Artificial Sequence
  Description of Artificial Sequence: Synthetic polypeptide
DENEIATTNPVATEQYGSVCAAMNHDNAMENNSH

SEQ ID NO: 159228 - protein, 38 aa, Artificial Sequence
  Description of Artificial Sequence: Synthetic polypeptide
DEEEIRTTNPVATEQYGSVGDSEMSNMGQPELGQVEDP

SEQ ID NO: 159229 - protein, 35 aa, Artificial Sequence
  Description of Artificial Sequence: Synthetic polypeptide
DECEICTTNPVATTQYGVVSTTALQQGTEQGTTDS

SEQ ID NO: 159230 - protein, 34 aa, Artificial Sequence
  Description of Artificial Sequence: Synthetic polypeptide
DEECEIATTNPVAYEQWGSVSGGNGNEDGEGDTS

SEQ ID NO: 159231 - protein, 36 aa, Artificial Sequence
  Description of Artificial Sequence: Synthetic polypeptide
DEAEIRTTNPVATEQYGSTYSDWCLQDERHFDIQQV

SEQ ID NO: 159232 - protein, 32 aa, Artificial Sequence
  Description of Artificial Sequence: Synthetic polypeptide
NEAEIRTTNPVAYEQWGCVPTDGNDTNHGGTP

SEQ ID NO: 159233 - protein, 38 aa, Artificial Sequence
  Description of Artificial Sequence: Synthetic polypeptide
DEEEIRTTNPVATEQYGSVGDSEMFNETQPELGQVEDP

SEQ ID NO: 159234 - protein, 35 aa, Artificial Sequence
  Description of Artificial Sequence: Synthetic polypeptide
DENEIATTNPVATEQYGSVCAAINGEEAGDEMNNN

SEQ ID NO: 159235 - protein, 37 aa, Artificial Sequence
  Description of Artificial Sequence: Synthetic polypeptide
QEEEIRTTNPVATEQYGSVNSTTPTGPEMGQGENEQD

SEQ ID NO: 159236 - protein, 32 aa, Artificial Sequence
  Description of Artificial Sequence: Synthetic polypeptide
NEAEIRTTNPVAYEKWGSVCWIELNQADHKNN

SEQ ID NO: 159237 - protein, 35 aa, Artificial Sequence
  Description of Artificial Sequence: Synthetic polypeptide
DEEEIRTTNPVATEQYGMVVIMGNDIMEDEFTGIF

SEQ ID NO: 159238 - protein, 33 aa, Artificial Sequence
  Description of Artificial Sequence: Synthetic polypeptide
AENEIACTNPVATEQYGCACSWNLQNFGSETQS

SEQ ID NO: 159239 - protein, 35 aa, Artificial Sequence
  Description of Artificial Sequence: Synthetic polypeptide
DENEIATTNPVATEQYGSVCAAMMHGNNEMGNSDD

SEQ ID NO: 159240 - protein, 35 aa, Artificial Sequence
  Description of Artificial Sequence: Synthetic polypeptide
DEEEIRTTNPVATEQYGMVVIMNNDNMEGEFTGIG

SEQ ID NO: 159241 - protein, 34 aa, Artificial Sequence
  Description of Artificial Sequence: Synthetic polypeptide
DEVEIATTNPVAYEQWGVCSVDNGNHQLGMGNQN

SEQ ID NO: 159242 - protein, 36 aa, Artificial Sequence
  Description of Artificial Sequence: Synthetic polypeptide
DEEEIRTTNPVATEQWGTNVCAGTMGLAHQMDNESA

SEQ ID NO: 159243 - protein, 38 aa, Artificial Sequence
  Description of Artificial Sequence: Synthetic polypeptide
DEEEIRTTNPVATEAYGVVSVTNDQAGNTEQGSTTTDD

SEQ ID NO: 159244 - protein, 33 aa, Artificial Sequence
  Description of Artificial Sequence: Synthetic polypeptide
CEDVIACTNPVATEQYGSVAMNNNQTAGGPNSN

SEQ ID NO: 159245 - protein, 32 aa, Artificial Sequence
  Description of Artificial Sequence: Synthetic polypeptide
AENEIACTNPVATEQYGCACSWNHQNFGSDQM

SEQ ID NO: 159246 - protein, 36 aa, Artificial Sequence
  Description of Artificial Sequence: Synthetic polypeptide
DEEPIATTNPVAYEQWGEVCSTNDLHDQNEGQNHSN

SEQ ID NO: 159247 - protein, 32 aa, Artificial Sequence
  Description of Artificial Sequence: Synthetic polypeptide
AENEIACTNPVATEQYGCACSNWNDQNFGSDQ

SEQ ID NO: 159248 - protein, 35 aa, Artificial Sequence
  Description of Artificial Sequence: Synthetic polypeptide
DECEICTTNPVATTQYGVVSTTALQQGTEQGSEDG

SEQ ID NO: 159249 - protein, 39 aa, Artificial Sequence
  Description of Artificial Sequence: Synthetic polypeptide
DEEEIRTTNPVATEQYGVVSTTVNVNLQQGTEQGTEEDE

SEQ ID NO: 159250 - protein, 35 aa, Artificial Sequence
  Description of Artificial Sequence: Synthetic polypeptide
DECEICTTNPVATTQYGVVSTTALQQGTEQGTETM

SEQ ID NO: 159251 - protein, 36 aa, Artificial Sequence
  Description of Artificial Sequence: Synthetic polypeptide
DEEPIATTNPVAYEQWGTVCSTNDLHDQNEGQNHGG

SEQ ID NO: 159252 - protein, 31 aa, Artificial Sequence
  Description of Artificial Sequence: Synthetic polypeptide
DDSEVASTNPVSTEGYGNVAANTIQTRVGQR

SEQ ID NO: 159253 - protein, 35 aa, Artificial Sequence
  Description of Artificial Sequence: Synthetic polypeptide
DEEPIATTNPVAYEQWGTVCSTNDLHDQNEHNNHS

SEQ ID NO: 159254 - protein, 36 aa, Artificial Sequence
  Description of Artificial Sequence: Synthetic polypeptide
DENEIATTNPVATEQYGSVCAAMNHLQAMAPDNDHG

SEQ ID NO: 159255 - protein, 38 aa, Artificial Sequence
  Description of Artificial Sequence: Synthetic polypeptide
DEEEIRTTNPVATEAYGVVSTVVVTNLQQGTTTEEEDD

SEQ ID NO: 159256 - protein, 31 aa, Artificial Sequence
  Description of Artificial Sequence: Synthetic polypeptide
DDSEVASTNPVSTEGYGNVAANTIQVRVGQR

SEQ ID NO: 159257 - protein, 36 aa, Artificial Sequence
  Description of Artificial Sequence: Synthetic polypeptide
DEEEIRTTNPVATEQYGSIYVAIEEQIENTEEDKDM

SEQ ID NO: 159258 - protein, 35 aa, Artificial Sequence
  Description of Artificial Sequence: Synthetic polypeptide
DEEEIRTTNPVATEFYGMVTIMNGFEGGGGQEGET

SEQ ID NO: 159259 - protein, 33 aa, Artificial Sequence
  Description of Artificial Sequence: Synthetic polypeptide
SEEEIRCTNPTAYEQWGCVWGENDMHRDGQNMR

SEQ ID NO: 159260 - protein, 35 aa, Artificial Sequence
  Description of Artificial Sequence: Synthetic polypeptide
DEEEIRTTNPVATEFYGNVMTGMTGGDGNGQNTGF

SEQ ID NO: 159261 - protein, 34 aa, Artificial Sequence
  Description of Artificial Sequence: Synthetic polypeptide
DEEEIACTNPVATEQYGCVAGTNSHQEADIPIEH

SEQ ID NO: 159262 - protein, 35 aa, Artificial Sequence
  Description of Artificial Sequence: Synthetic polypeptide
DEVEIATTNPVAYEQWGSVSTTNGNDEHQGDDGRG

SEQ ID NO: 159263 - protein, 36 aa, Artificial Sequence
  Description of Artificial Sequence: Synthetic polypeptide
DEEEIKTTNPVAYETYGISLVACTGNSQTRSTDNVD

SEQ ID NO: 159264 - protein, 38 aa, Artificial Sequence
  Description of Artificial Sequence: Synthetic polypeptide
DEEEIRTTNPVATEQYGVVSTVVTNQAGTEQGTNQQDD

SEQ ID NO: 159265 - protein, 36 aa, Artificial Sequence
  Description of Artificial Sequence: Synthetic polypeptide
DEEEISTTNPVATEQYGQCVCSWGEHNIGFGSDNQS

SEQ ID NO: 159266 - protein, 35 aa, Artificial Sequence
  Description of Artificial Sequence: Synthetic polypeptide
DENEIRTTNPVATEQWGSSFTDSMNGEEGDENAED

SEQ ID NO: 159267 - protein, 38 aa, Artificial Sequence
  Description of Artificial Sequence: Synthetic polypeptide
DEEEIRTTNPVATEQYGVVSTTVTNQQGNNQQGSEEGS

SEQ ID NO: 159268 - protein, 34 aa, Artificial Sequence
  Description of Artificial Sequence: Synthetic polypeptide
DEGEIRTTNPVSTEHWGCVYCMPNQDQRHGKNML

SEQ ID NO: 159269 - protein, 34 aa, Artificial Sequence
  Description of Artificial Sequence: Synthetic polypeptide
DENEIRTTNPVATEQWGSDVTSEIQEMNGMEEYA

SEQ ID NO: 159270 - protein, 36 aa, Artificial Sequence
  Description of Artificial Sequence: Synthetic polypeptide
DEEEIRTTNPVATEQYGSYPENQSNLPQFQEVELEV

SEQ ID NO: 159271 - protein, 36 aa, Artificial Sequence
  Description of Artificial Sequence: Synthetic polypeptide
DEEEISTTNPVATEQYGQCVCSWGEHNASFGSENQP

SEQ ID NO: 159272 - protein, 32 aa, Artificial Sequence
  Description of Artificial Sequence: Synthetic polypeptide
AENEIATTNPVATECYGCVCSSELNQHFISEL

SEQ ID NO: 159273 - protein, 38 aa, Artificial Sequence
  Description of Artificial Sequence: Synthetic polypeptide
DEEEIRTTNPVATEAYGVVSTVVVTNLQAGTTDTEEED

SEQ ID NO: 159274 - protein, 39 aa, Artificial Sequence
  Description of Artificial Sequence: Synthetic polypeptide
DEEEIRTTNPVATEAYGVVSTVVVTNLQAGTNEQGNDDD

SEQ ID NO: 159275 - protein, 38 aa, Artificial Sequence
  Description of Artificial Sequence: Synthetic polypeptide
DEEEIRTTNPVATEQYGVVSTTVTNQQGNNQQGTEEGS

SEQ ID NO: 159276 - protein, 33 aa, Artificial Sequence
  Description of Artificial Sequence: Synthetic polypeptide
DDSEVATTNPVSTEGYGNVSATNTGQSRNGMQV

SEQ ID NO: 159277 - protein, 37 aa, Artificial Sequence
  Description of Artificial Sequence: Synthetic polypeptide
DEEEIRTTNPVGTEQWGSVSITAPELGGERGGDIEAM

SEQ ID NO: 159278 - protein, 34 aa, Artificial Sequence
  Description of Artificial Sequence: Synthetic polypeptide
DEVEIATTNPVAYEQWGSVTGENENDRGNMGNQI

SEQ ID NO: 159279 - protein, 35 aa, Artificial Sequence
  Description of Artificial Sequence: Synthetic polypeptide
DENEIATTNPVATEQYGSVCAANNGDENGMDIERN

SEQ ID NO: 159280 - protein, 33 aa, Artificial Sequence
  Description of Artificial Sequence: Synthetic polypeptide
DEECIATTNPVAYECWGSVATTNLGGDTQGDED

SEQ ID NO: 159281 - protein, 35 aa, Artificial Sequence
  Description of Artificial Sequence: Synthetic polypeptide
DEAEIRTTNPVATEQYGCVCSWGEDHQNFNSDFQS

SEQ ID NO: 159282 - protein, 36 aa, Artificial Sequence
  Description of Artificial Sequence: Synthetic polypeptide
QEEEIRTTNPVATEQYGSVNTDNMIETGGGGEEQGQ

SEQ ID NO: 159283 - protein, 36 aa, Artificial Sequence
  Description of Artificial Sequence: Synthetic polypeptide
DEEEIRTTNPVATEQYGSVSPWIAAEGVSQMETEVT

SEQ ID NO: 159284 - protein, 36 aa, Artificial Sequence
  Description of Artificial Sequence: Synthetic polypeptide
DEEEIRATNPVATEQWGGCVAITNTGDEQAGMENNM

SEQ ID NO: 159285 - protein, 32 aa, Artificial Sequence
  Description of Artificial Sequence: Synthetic polypeptide
QEPEIATTNPVATEQYGAVAGPEVGQGENEGQ

SEQ ID NO: 159286 - protein, 33 aa, Artificial Sequence
  Description of Artificial Sequence: Synthetic polypeptide
DEEPIRCTNPVATEQYGCVTPQNDCQFMIQSCI

SEQ ID NO: 159287 - protein, 34 aa, Artificial Sequence
  Description of Artificial Sequence: Synthetic polypeptide
DEQEIATTNPVAYEQYGCVAANTNLAVTPGGDPN

SEQ ID NO: 159288 - protein, 32 aa, Artificial Sequence
  Description of Artificial Sequence: Synthetic polypeptide
QEPEIATTNPVATEQYGAVAGPEGDGQGEEND

SEQ ID NO: 159289 - protein, 34 aa, Artificial Sequence
  Description of Artificial Sequence: Synthetic polypeptide
DEEEIACTNPVATEQYGCVAMPLDNGAPGGENGN

SEQ ID NO: 159290 - protein, 39 aa, Artificial Sequence
  Description of Artificial Sequence: Synthetic polypeptide
DEEEIRTTNPVATEQYGVVSTVVTNQNGNQQGTNQQEED

SEQ ID NO: 159291 - protein, 36 aa, Artificial Sequence
  Description of Artificial Sequence: Synthetic polypeptide
DEEEIATTNPVATEQYGSVCAAMNHDQAMPPNADNH

SEQ ID NO: 159292 - protein, 33 aa, Artificial Sequence
  Description of Artificial Sequence: Synthetic polypeptide
DENEIRTTNPVSTEEYGCISWEDIQQEQFGNQS

SEQ ID NO: 159293 - protein, 37 aa, Artificial Sequence
  Description of Artificial Sequence: Synthetic polypeptide
NEAEIRTTNPVATEQYGSVSVTGLGNDTEREGSFQEG

SEQ ID NO: 159294 - protein, 36 aa, Artificial Sequence
  Description of Artificial Sequence: Synthetic polypeptide
DEEEIRTTNPVATEFYGMVSVEGMGLGQGQEGEDGT

SEQ ID NO: 159295 - protein, 33 aa, Artificial Sequence
  Description of Artificial Sequence: Synthetic polypeptide
DENEIRTTNPVSTECYGTTISMEDIQQQQNGNH

SEQ ID NO: 159296 - protein, 35 aa, Artificial Sequence
  Description of Artificial Sequence: Synthetic polypeptide
DEAEIRTTNPVATEQYGCVCSWGEHNQYFNSDTQS

SEQ ID NO: 159297 - protein, 29 aa, Artificial Sequence
  Description of Artificial Sequence: Synthetic peptide
QESEIASTNPVGFEGYGVMASRTLQHGDI

SEQ ID NO: 159298 - protein, 35 aa, Artificial Sequence
  Description of Artificial Sequence: Synthetic polypeptide
DEEEIACTNPVATEQYGCVAGTNSHQEADMLIGRE

SEQ ID NO: 159299 - protein, 34 aa, Artificial Sequence
  Description of Artificial Sequence: Synthetic polypeptide
DEECIATTNPVAWEQYGSVSCTGPAPVMTVQNNE

SEQ ID NO: 159300 - protein, 35 aa, Artificial Sequence
  Description of Artificial Sequence: Synthetic polypeptide
DEAEIRTTNPVATEQYGCVCSWGEHNAEYFNSDQS

SEQ ID NO: 159301 - protein, 35 aa, Artificial Sequence
  Description of Artificial Sequence: Synthetic polypeptide
DEAEIRTTNPVATEQYGCVCSWGEHEEGFNSENQA

SEQ ID NO: 159302 - protein, 35 aa, Artificial Sequence
  Description of Artificial Sequence: Synthetic polypeptide
DEAEIRTTNPVATEQYGCVCSWGEHDQENFNSDQS

SEQ ID NO: 159303 - protein, 35 aa, Artificial Sequence
  Description of Artificial Sequence: Synthetic polypeptide
DEQEIATTNPVAYEQYGCVAANTNLADTPGNNLHY

SEQ ID NO: 159304 - protein, 35 aa, Artificial Sequence
  Description of Artificial Sequence: Synthetic polypeptide
DENEIATTNPVATEQYGSVCAANNGDENGMDIDNE

SEQ ID NO: 159305 - protein, 36 aa, Artificial Sequence
  Description of Artificial Sequence: Synthetic polypeptide
DEEEIRTTNPVATEQYGSVPPTLAAQEEFEHVLLQE

SEQ ID NO: 159306 - protein, 34 aa, Artificial Sequence
  Description of Artificial Sequence: Synthetic polypeptide
DSEEISTTNPVAYTHWGSTVSPTNAPSMRGGNGI

SEQ ID NO: 159307 - protein, 36 aa, Artificial Sequence
  Description of Artificial Sequence: Synthetic polypeptide
NEAEIRTTNPVATEAWGSVCSKTPDDLDQRNGGDAS

SEQ ID NO: 159308 - protein, 37 aa, Artificial Sequence
  Description of Artificial Sequence: Synthetic polypeptide
AEEEIRTTNPVATEQYGVVSTTNNQLNGSEAGTTDEE

SEQ ID NO: 159309 - protein, 31 aa, Artificial Sequence
  Description of Artificial Sequence: Synthetic polypeptide
DDSEVASTNPVSTEGYGNVAANTLSSRVGQR

SEQ ID NO: 159310 - protein, 38 aa, Artificial Sequence
  Description of Artificial Sequence: Synthetic polypeptide
DEDEIRTTNPVATEQYGVVSTTNNQQNGNQQGTSNTTD

SEQ ID NO: 159311 - protein, 36 aa, Artificial Sequence
  Description of Artificial Sequence: Synthetic polypeptide
DECEICTTNPVATEQYGSVSTVNAEQGSTEEEEETS

SEQ ID NO: 159312 - protein, 32 aa, Artificial Sequence
  Description of Artificial Sequence: Synthetic polypeptide
DENEIRTTNPVSTEGYGTINQEDIQQQGNGNV

SEQ ID NO: 159313 - protein, 31 aa, Artificial Sequence
  Description of Artificial Sequence: Synthetic polypeptide
DDSEVASTNPVSTEGYGNVAANTMQSRVGQR

SEQ ID NO: 159314 - protein, 37 aa, Artificial Sequence
  Description of Artificial Sequence: Synthetic polypeptide
DEEEIRTTNPVATEQYGSLTNVLMDDIIERSPQADNG

SEQ ID NO: 159315 - protein, 33 aa, Artificial Sequence
  Description of Artificial Sequence: Synthetic polypeptide
DENEIRTTNPVSTEGYGTISAMEDIQQQQNGNH

SEQ ID NO: 159316 - protein, 37 aa, Artificial Sequence
  Description of Artificial Sequence: Synthetic polypeptide
DEEEIRTTNPVATEQYGQCVCSDTGEDNQNFSSDNQS

SEQ ID NO: 159317 - protein, 38 aa, Artificial Sequence
  Description of Artificial Sequence: Synthetic polypeptide
DEEEIRTTNPVATEQYGVVSTVVVTQNQQGTNEEEEED

SEQ ID NO: 159318 - protein, 36 aa, Artificial Sequence
  Description of Artificial Sequence: Synthetic polypeptide
DECEICTTNPVATEQYGSVSTVNAEQGSTEEDEEDT

SEQ ID NO: 159319 - protein, 36 aa, Artificial Sequence
  Description of Artificial Sequence: Synthetic polypeptide
DENEIATTNPVATEQYGSVCSAANNLPLDSGEGFDN

SEQ ID NO: 159320 - protein, 37 aa, Artificial Sequence
  Description of Artificial Sequence: Synthetic polypeptide
DENEIATTNPVATEQYGSVCSAANNLPLDSGEGMGNK

SEQ ID NO: 159321 - protein, 37 aa, Artificial Sequence
  Description of Artificial Sequence: Synthetic polypeptide
DEEEIRTTNPVATEQYGQCVCSDWEEHNQNFGSDNQP

SEQ ID NO: 159322 - protein, 36 aa, Artificial Sequence
  Description of Artificial Sequence: Synthetic polypeptide
DEEEIRTTNPVATEQYGQCVCSDWEHNIENFNSDQS

SEQ ID NO: 159323 - protein, 38 aa, Artificial Sequence
  Description of Artificial Sequence: Synthetic polypeptide
AEEEIRTTNPVATEQYGSVSTTTQNGTEQGTTNVATED

SEQ ID NO: 159324 - protein, 29 aa, Artificial Sequence
  Description of Artificial Sequence: Synthetic peptide
QESEIASTNPVGTECYGVMAAETLQPGDI

SEQ ID NO: 159325 - protein, 38 aa, Artificial Sequence
  Description of Artificial Sequence: Synthetic polypeptide
AEEEIRTTNPVATEQYGSVSTTTQNNMEQGTNNVATES

SEQ ID NO: 159326 - protein, 35 aa, Artificial Sequence
  Description of Artificial Sequence: Synthetic polypeptide
DEEEIRTTNPVATEQYGQCVCSDWEHNQNFSSDQM

SEQ ID NO: 159327 - protein, 35 aa, Artificial Sequence
  Description of Artificial Sequence: Synthetic polypeptide
DSNEIRTTNPVATEQYGSVFTDVDNEQEHSDEFKN

SEQ ID NO: 159328 - protein, 37 aa, Artificial Sequence
  Description of Artificial Sequence: Synthetic polypeptide
DECEICTTNPVATEQYGSVSTVNAEQGANTEENEDED

SEQ ID NO: 159329 - protein, 35 aa, Artificial Sequence
  Description of Artificial Sequence: Synthetic polypeptide
DEEEISTTNPVATEQYGQCVCSWEEHQNFGSQTQS

SEQ ID NO: 159330 - protein, 37 aa, Artificial Sequence
  Description of Artificial Sequence: Synthetic polypeptide
DECEICTTNPVATEQYGSVSTVNADQQGTTDEEEEDE

SEQ ID NO: 159331 - protein, 37 aa, Artificial Sequence
  Description of Artificial Sequence: Synthetic polypeptide
DEAEIRCTNPVATEQYGSVCSVDVSLEEDRYGFENSL

SEQ ID NO: 159332 - protein, 37 aa, Artificial Sequence
  Description of Artificial Sequence: Synthetic polypeptide
DECEICTTNPVATEQYGSVSTVNAEQYGSTEEQEDEE

SEQ ID NO: 159333 - protein, 33 aa, Artificial Sequence
  Description of Artificial Sequence: Synthetic polypeptide
AENEIATTNPVATECYGCVCSWGELQHFNSELA

SEQ ID NO: 159334 - protein, 39 aa, Artificial Sequence
  Description of Artificial Sequence: Synthetic polypeptide
DEEEIRTTNPVATEQYGVVSTVVVTQNQLQGTEENEEED

SEQ ID NO: 159335 - protein, 36 aa, Artificial Sequence
  Description of Artificial Sequence: Synthetic polypeptide
DEEEIRTTNPVATEQYGQCVCGNTGEHNQNFGSDQS

SEQ ID NO: 159336 - protein, 36 aa, Artificial Sequence
  Description of Artificial Sequence: Synthetic polypeptide
DEEEISTTNPVATEQYGQCVCSWEELNQNFNSDTQA

SEQ ID NO: 159337 - protein, 36 aa, Artificial Sequence
  Description of Artificial Sequence: Synthetic polypeptide
DEEEIRTTNPVATEQYGQCVCGNTGNHIENFGSQQS

SEQ ID NO: 159338 - protein, 31 aa, Artificial Sequence
  Description of Artificial Sequence: Synthetic polypeptide
DSNEIRTTNPVATEQWGDVSEIFEMNAAEDA

SEQ ID NO: 159339 - protein, 31 aa, Artificial Sequence
  Description of Artificial Sequence: Synthetic polypeptide
DSNEIRTTNPVATEQWGDVSEQIEMNAAEDA

SEQ ID NO: 159340 - protein, 31 aa, Artificial Sequence
  Description of Artificial Sequence: Synthetic polypeptide
DSNEIRTTNPVATEQWGDVSEWIEMNAAEDA

SEQ ID NO: 159341 - protein, 38 aa, Artificial Sequence
  Description of Artificial Sequence: Synthetic polypeptide
DEEEIRTTNPVATEQYGVVSTVVTNNNQQGTTEEETEA

SEQ ID NO: 159342 - protein, 34 aa, Artificial Sequence
  Description of Artificial Sequence: Synthetic polypeptide
DSNEIRTTNPVATEQYGCFCSPTDPERIMVNSQD

SEQ ID NO: 159343 - protein, 33 aa, Artificial Sequence
  Description of Artificial Sequence: Synthetic polypeptide
QESEIASTNPVGTECWGSVSCINEPQDREGENG

SEQ ID NO: 159344 - protein, 34 aa, Artificial Sequence
  Description of Artificial Sequence: Synthetic polypeptide
DENEIRTTNPVSTEGYGTICSWEDINQNQFGNQS

SEQ ID NO: 159345 - protein, 34 aa, Artificial Sequence
  Description of Artificial Sequence: Synthetic polypeptide
DSNEIRTTNPVATEQYGMLSFANENQMTDNSDQY

SEQ ID NO: 159346 - protein, 29 aa, Artificial Sequence
  Description of Artificial Sequence: Synthetic peptide
QESEIASTNPVGTECWGVAASTLQHGDAI

SEQ ID NO: 159347 - protein, 34 aa, Artificial Sequence
  Description of Artificial Sequence: Synthetic polypeptide
DEVEIATTNPVAYEPWGSVYCTNLHEDMGNNGGA

SEQ ID NO: 159348 - protein, 35 aa, Artificial Sequence
  Description of Artificial Sequence: Synthetic polypeptide
DEEEISTTNPVATEQYGQCVCSWEEHQYFGSETQA

SEQ ID NO: 159349 - protein, 30 aa, Artificial Sequence
  Description of Artificial Sequence: Synthetic polypeptide
QENEVASTNPVATECYGDVAECLQSHVEQR

SEQ ID NO: 159350 - protein, 28 aa, Artificial Sequence
  Description of Artificial Sequence: Synthetic peptide
QESEIASTNPVGTECWGVMAQTLQHGDI

SEQ ID NO: 159351 - protein, 34 aa, Artificial Sequence
  Description of Artificial Sequence: Synthetic polypeptide
DSNEIRTTNPVATEQYGSLSSVNENNMTDNSIQD

SEQ ID NO: 159352 - protein, 35 aa, Artificial Sequence
  Description of Artificial Sequence: Synthetic polypeptide
DSNEIRTTNPVATEQYGSLSYLNTENQMIDNSDQE

SEQ ID NO: 159353 - protein, 38 aa, Artificial Sequence
  Description of Artificial Sequence: Synthetic polypeptide
DEEEIRTTNPVATEQYGSVQSVRDTLEEEARQLQTVTP

SEQ ID NO: 159354 - protein, 37 aa, Artificial Sequence
  Description of Artificial Sequence: Synthetic polypeptide
DENEIATTNPVATEQYGSVCSAANILPLDSGEGTDNT

SEQ ID NO: 159355 - protein, 33 aa, Artificial Sequence
  Description of Artificial Sequence: Synthetic polypeptide
DENEIRTTNPVSTEGYGTISAQEDDQQQQNGNE

SEQ ID NO: 159356 - protein, 36 aa, Artificial Sequence
  Description of Artificial Sequence: Synthetic polypeptide
NEAEIATTNPVATEQYGSVAITENDQDDQRQGGDHP

SEQ ID NO: 159357 - protein, 33 aa, Artificial Sequence
  Description of Artificial Sequence: Synthetic polypeptide
DENEIRTTNPVATEQWGLSWSAEGVCMNIPEDA

SEQ ID NO: 159358 - protein, 39 aa, Artificial Sequence
  Description of Artificial Sequence: Synthetic polypeptide
DEDEIRTTNPVATEQYGVVSTTNNQNNLQGIGTTNQDED

SEQ ID NO: 159359 - protein, 39 aa, Artificial Sequence
  Description of Artificial Sequence: Synthetic polypeptide
DEEEIRTTNPVATEQYGVVSTVVVTSNQQQLGIGTNNTD

SEQ ID NO: 159360 - protein, 35 aa, Artificial Sequence
  Description of Artificial Sequence: Synthetic polypeptide
NDMEIRTTNPVATEQYGCVSTGLLATQFNGLQDQE

SEQ ID NO: 159361 - protein, 38 aa, Artificial Sequence
  Description of Artificial Sequence: Synthetic polypeptide
DEEEIRTTNPVATEQYGSVGDSEMYNPTQPEPGQVEDP

SEQ ID NO: 159362 - protein, 30 aa, Artificial Sequence
  Description of Artificial Sequence: Synthetic polypeptide
QESEIASTNPVGTECYGVTCSIELQHDGDI

SEQ ID NO: 159363 - protein, 35 aa, Artificial Sequence
  Description of Artificial Sequence: Synthetic polypeptide
NDETTEIATTNPVAYEQWGSVSGENSNGGQMGGND

SEQ ID NO: 159364 - protein, 34 aa, Artificial Sequence
  Description of Artificial Sequence: Synthetic polypeptide
DEVEIATTNPVAYEHWGSVYCTNLMEDMGGNGGS

SEQ ID NO: 159365 - protein, 37 aa, Artificial Sequence
  Description of Artificial Sequence: Synthetic polypeptide
DEEEIRTTNPVATEAYGVVSTVVTNQQNQNNTTNVTE

SEQ ID NO: 159366 - protein, 38 aa, Artificial Sequence
  Description of Artificial Sequence: Synthetic polypeptide
DEDEIRTTNPVATEQYGVVSTTNNNQQGNQQGTVNTNG

SEQ ID NO: 159367 - protein, 33 aa, Artificial Sequence
  Description of Artificial Sequence: Synthetic polypeptide
DENEIRTTNPVSTEGYGTISDQEDIQQQGNGQQ

SEQ ID NO: 159368 - protein, 34 aa, Artificial Sequence
  Description of Artificial Sequence: Synthetic polypeptide
DENEIRTTNPVSTEGYGTISDQTDIQQQGEGGND

SEQ ID NO: 159369 - protein, 32 aa, Artificial Sequence
  Description of Artificial Sequence: Synthetic polypeptide
DDSEVASTNPVSTEGYGNVAANTNIQSRVGQR

SEQ ID NO: 159370 - protein, 34 aa, Artificial Sequence
  Description of Artificial Sequence: Synthetic polypeptide
DENEIRTTNPVATEQWGKVPSEGQSMNAAEGDAP

SEQ ID NO: 159371 - protein, 31 aa, Artificial Sequence
  Description of Artificial Sequence: Synthetic polypeptide
DDSEVASTNPVSTEGYGNVAANTNQSRVGQR

SEQ ID NO: 159372 - protein, 39 aa, Artificial Sequence
  Description of Artificial Sequence: Synthetic polypeptide
DEEEIRTTNPVATEQYGVVSTTVVTNLQQGTEQGTDEDE

SEQ ID NO: 159373 - protein, 36 aa, Artificial Sequence
  Description of Artificial Sequence: Synthetic polypeptide
DENEIATTNPVATEQYGSVCSATLALQNHSDDAEAK

SEQ ID NO: 159374 - protein, 39 aa, Artificial Sequence
  Description of Artificial Sequence: Synthetic polypeptide
DEEEIRTTNPVATEQYGVVSTTVVTNLQQGTEQGTEDTE

SEQ ID NO: 159375 - protein, 31 aa, Artificial Sequence
  Description of Artificial Sequence: Synthetic polypeptide
DDSEVATTNPVSTEGYGNVSATDLESHEGEL

SEQ ID NO: 159376 - protein, 34 aa, Artificial Sequence
  Description of Artificial Sequence: Synthetic polypeptide
DENEIRTTNPVATEQWGKVPSEGESMNGAEGDAY

SEQ ID NO: 159377 - protein, 34 aa, Artificial Sequence
  Description of Artificial Sequence: Synthetic polypeptide
DENEIRTTNPVATEQWGKVPSEGESMNAAPGDAS

SEQ ID NO: 159378 - protein, 38 aa, Artificial Sequence
  Description of Artificial Sequence: Synthetic polypeptide
DEDEIRTTNPVATEQYGVVSTTNNNQQGNQQGTTNQED

SEQ ID NO: 159379 - protein, 37 aa, Artificial Sequence
  Description of Artificial Sequence: Synthetic polypeptide
DEEEIRTTNPVATEQYGSLTSVSDIANVSEVQEELQD

SEQ ID NO: 159380 - protein, 38 aa, Artificial Sequence
  Description of Artificial Sequence: Synthetic polypeptide
DEDEIRTTNPVATEQYGVVSTTNNQQLGNQQGTATTDE

SEQ ID NO: 159381 - protein, 36 aa, Artificial Sequence
  Description of Artificial Sequence: Synthetic polypeptide
DENEIATTNPVATEQYGSVCSAANPLPLDSGEGTGN

SEQ ID NO: 159382 - protein, 32 aa, Artificial Sequence
  Description of Artificial Sequence: Synthetic polypeptide
DDEEISTTNPVAYCQYGCVCSTEPINFGSDQA

SEQ ID NO: 159383 - protein, 32 aa, Artificial Sequence
  Description of Artificial Sequence: Synthetic polypeptide
DSNEIRTTNPVSTEAYGTISMEDISQQQNGNH

SEQ ID NO: 159384 - protein, 37 aa, Artificial Sequence
  Description of Artificial Sequence: Synthetic polypeptide
DENEIATTNPVATEQYGSVCSAANNLPLDSGEGTHND

SEQ ID NO: 159385 - protein, 32 aa, Artificial Sequence
  Description of Artificial Sequence: Synthetic polypeptide
DSNEIRTTNPVSTEPYGTISMEDFQQQQNGNH

SEQ ID NO: 159386 - protein, 32 aa, Artificial Sequence
  Description of Artificial Sequence: Synthetic polypeptide
DSNEIRTTNPVSTEPYGTISMEDIQQQQNGNA

SEQ ID NO: 159387 - protein, 32 aa, Artificial Sequence
  Description of Artificial Sequence: Synthetic polypeptide
DSNEIRTTNPVSTEPYGTISMEDIQQQQNGNH

SEQ ID NO: 159388 - protein, 36 aa, Artificial Sequence
  Description of Artificial Sequence: Synthetic polypeptide
DEEEISTTNPVATEQYGQCVCSWEEHNQGFGSDNQA

SEQ ID NO: 159389 - protein, 35 aa, Artificial Sequence
  Description of Artificial Sequence: Synthetic polypeptide
DEEEIATTNPVATEQYGSVCAAMNPEEAEAEMNNN

SEQ ID NO: 159390 - protein, 32 aa, Artificial Sequence
  Description of Artificial Sequence: Synthetic polypeptide
DDSEVASTNPVSTEGYGNVAANTNDQSREGQR

SEQ ID NO: 159391 - protein, 38 aa, Artificial Sequence
  Description of Artificial Sequence: Synthetic polypeptide
AEEEIRTTNPVATEQYGSVSTTTQQQMEQGTTNVATED

SEQ ID NO: 159392 - protein, 34 aa, Artificial Sequence
  Description of Artificial Sequence: Synthetic polypeptide
NEAEIATTNPVATEHYGSVCINIENDQHGHQQNE

SEQ ID NO: 159393 - protein, 39 aa, Artificial Sequence
  Description of Artificial Sequence: Synthetic polypeptide
DEEEIRTTNPVATEQYGVVSTVVVTQLQQLGNQDEEDED

SEQ ID NO: 159394 - protein, 36 aa, Artificial Sequence
  Description of Artificial Sequence: Synthetic polypeptide
DEEEIRTTNPVATEQYGQCVCSMSEEHNANFGSDQS

SEQ ID NO: 159395 - protein, 37 aa, Artificial Sequence
  Description of Artificial Sequence: Synthetic polypeptide
DEEEIRTTNPVATEQYGSVSQHSPAGPTMQNGMQDVV

SEQ ID NO: 159396 - protein, 36 aa, Artificial Sequence
  Description of Artificial Sequence: Synthetic polypeptide
DEEEIRTTNPVATEQYGQCVCSMSEHNQENFGSQQP

SEQ ID NO: 159397 - protein, 34 aa, Artificial Sequence
  Description of Artificial Sequence: Synthetic polypeptide
DDSEVATTNPVSTEGYGNVSATNPTIQSRNGMNV

SEQ ID NO: 159398 - protein, 31 aa, Artificial Sequence
  Description of Artificial Sequence: Synthetic polypeptide
NEAEIAPTNPVAYEQYGEASCENSSHRVGGS

SEQ ID NO: 159399 - protein, 36 aa, Artificial Sequence
  Description of Artificial Sequence: Synthetic polypeptide
DENEIATTNPVATEQYGSVCSAANNLPLDSGETDQF

SEQ ID NO: 159400 - protein, 31 aa, Artificial Sequence
  Description of Artificial Sequence: Synthetic polypeptide
DDSEVATTNPVSTEGYGNVSATDLESHEGQL

SEQ ID NO: 159401 - protein, 32 aa, Artificial Sequence
  Description of Artificial Sequence: Synthetic polypeptide
DDSEVASTNPVSTEGYGNVAANTNGQSRVGQR

SEQ ID NO: 159402 - protein, 36 aa, Artificial Sequence
  Description of Artificial Sequence: Synthetic polypeptide
DEEEIRTTNPVATEQYGQCVCSMSGEHNQNFGSDQA

SEQ ID NO: 159403 - protein, 32 aa, Artificial Sequence
  Description of Artificial Sequence: Synthetic polypeptide
DEQEIRTTNPVATEQWGATAATDWEEHEGEDL

SEQ ID NO: 159404 - protein, 35 aa, Artificial Sequence
  Description of Artificial Sequence: Synthetic polypeptide
NDTEIRTTNPVATEQYGCVSTLLATQFNGLQDQEV

SEQ ID NO: 159405 - protein, 37 aa, Artificial Sequence
  Description of Artificial Sequence: Synthetic polypeptide
DEEEIRTTNPVATEQYGQCVCSMSEHNQENFGSDNQA

SEQ ID NO: 159406 - protein, 33 aa, Artificial Sequence
  Description of Artificial Sequence: Synthetic polypeptide
DSMEIVTTNPVATEQYGTVCSAQDGPVEFEGND

SEQ ID NO: 159407 - protein, 30 aa, Artificial Sequence
  Description of Artificial Sequence: Synthetic polypeptide
QESEIASTNPVGTEAYGVMASTLSQHTGDI

SEQ ID NO: 159408 - protein, 34 aa, Artificial Sequence
  Description of Artificial Sequence: Synthetic polypeptide
NEAEIATTNPVAYEQWGEVVPTDNLDQGEGNNNV

SEQ ID NO: 159409 - protein, 35 aa, Artificial Sequence
  Description of Artificial Sequence: Synthetic polypeptide
DEEEIRTTNPVATEQYGSLPPPLIEEVPMGPEEQG

SEQ ID NO: 159410 - protein, 33 aa, Artificial Sequence
  Description of Artificial Sequence: Synthetic polypeptide
DEGEIRTTNPVSTEPYGTISMEDIQQQQNGNHV

SEQ ID NO: 159411 - protein, 33 aa, Artificial Sequence
  Description of Artificial Sequence: Synthetic polypeptide
DENEIRTTNPVSTEGYGCISWEDHNQEQFGSDQ

SEQ ID NO: 159412 - protein, 34 aa, Artificial Sequence
  Description of Artificial Sequence: Synthetic polypeptide
NEAEIQCTNPVAYERYGVSVVQSANEQDRGGENV

SEQ ID NO: 159413 - protein, 37 aa, Artificial Sequence
  Description of Artificial Sequence: Synthetic polypeptide
DEEEIRTTNPVATEFYGQVVNMDTDNQDQQRIINGDD

SEQ ID NO: 159414 - protein, 34 aa, Artificial Sequence
  Description of Artificial Sequence: Synthetic polypeptide
NEAEIQCTNPVAYEQYGSVVQSCEEQVDRVGNNV

SEQ ID NO: 159415 - protein, 35 aa, Artificial Sequence
  Description of Artificial Sequence: Synthetic polypeptide
NEAEIQCTNPVAYEQYGSVVQSAANEQSDRGGNNV

SEQ ID NO: 159416 - protein, 33 aa, Artificial Sequence
  Description of Artificial Sequence: Synthetic polypeptide
DEEQIACTNPVATAQWGSVASGHGPLGAPPGNK

SEQ ID NO: 159417 - protein, 35 aa, Artificial Sequence
  Description of Artificial Sequence: Synthetic polypeptide
NEAEIQCTNPVAYEQYGSVVPSCNEQVDRGGNNVM

SEQ ID NO: 159418 - protein, 34 aa, Artificial Sequence
  Description of Artificial Sequence: Synthetic polypeptide
DEVEIATTNPVAYEQWGSTVTGNDSQNGGGMQNG

SEQ ID NO: 159419 - protein, 34 aa, Artificial Sequence
  Description of Artificial Sequence: Synthetic polypeptide
DSFEICTVNPVAYEQYGKVSTGNELSTEFVGNNH

SEQ ID NO: 159420 - protein, 33 aa, Artificial Sequence
  Description of Artificial Sequence: Synthetic polypeptide
DDSEVATTNPVSTEGYGNVSATNPTIQSRVGQV

SEQ ID NO: 159421 - protein, 33 aa, Artificial Sequence
  Description of Artificial Sequence: Synthetic polypeptide
DENEIRTTNPVSTEGYGCISWEDINQEQFGDQS

SEQ ID NO: 159422 - protein, 33 aa, Artificial Sequence
  Description of Artificial Sequence: Synthetic polypeptide
DENEIRTTNPVSTEGYGCISWEDIQQEQSGSNH

SEQ ID NO: 159423 - protein, 32 aa, Artificial Sequence
  Description of Artificial Sequence: Synthetic polypeptide
DDSEVASTNPVSTEGYGNVAANTIVQSREGNR

SEQ ID NO: 159424 - protein, 34 aa, Artificial Sequence
  Description of Artificial Sequence: Synthetic polypeptide
DEGEIRTTNPVSTEPYGTVCHCMEDNQQQQNGNH

SEQ ID NO: 159425 - protein, 34 aa, Artificial Sequence
  Description of Artificial Sequence: Synthetic polypeptide
NEMEIVTTNPVATEQYGTVCSATDGPVESFEGND

SEQ ID NO: 159426 - protein, 35 aa, Artificial Sequence
  Description of Artificial Sequence: Synthetic polypeptide
DEEEISTTNPVATEQYGQCVCSWEPPNQNFNSDQS

SEQ ID NO: 159427 - protein, 38 aa, Artificial Sequence
  Description of Artificial Sequence: Synthetic polypeptide
DEEEIRTTNPVATEQYGVVSTVVTNNQNQQQGTTEEEE

SEQ ID NO: 159428 - protein, 38 aa, Artificial Sequence
  Description of Artificial Sequence: Synthetic polypeptide
DEEEIRTTNPVATEQYGVVSTVVTNNQNNQGTEEEEEA

SEQ ID NO: 159429 - protein, 34 aa, Artificial Sequence
  Description of Artificial Sequence: Synthetic polypeptide
NEAEIQCTNPVAYEQYGISVVQSANEQDMGGNNV

SEQ ID NO: 159430 - protein, 29 aa, Artificial Sequence
  Description of Artificial Sequence: Synthetic peptide
QESEIASTNPVGTDGYGVMASTLQHGDIK

SEQ ID NO: 159431 - protein, 35 aa, Artificial Sequence
  Description of Artificial Sequence: Synthetic polypeptide
DEGEIRTTNPVATEQYGSNVCPDDGNQDRDESQQE

SEQ ID NO: 159432 - protein, 34 aa, Artificial Sequence
  Description of Artificial Sequence: Synthetic polypeptide
DEECIATTNPVAYEGWGSVATTNLGGNDTQGGVA

SEQ ID NO: 159433 - protein, 36 aa, Artificial Sequence
  Description of Artificial Sequence: Synthetic polypeptide
DEAEIRTTNPVATEQYGCVCSTWEEDNAENFNSDQA

SEQ ID NO: 159434 - protein, 36 aa, Artificial Sequence
  Description of Artificial Sequence: Synthetic polypeptide
DENEIATTNPVATEQYGSVCAMNNGVLPEDDMGNDQ

SEQ ID NO: 159435 - protein, 36 aa, Artificial Sequence
  Description of Artificial Sequence: Synthetic polypeptide
NEAEIRTTNPVATEAWGSVCSKTNDDLDNRNGGDAA

SEQ ID NO: 159436 - protein, 34 aa, Artificial Sequence
  Description of Artificial Sequence: Synthetic polypeptide
DEVEIATTNPVAYEQWGSVCQTFEDRTTRDGNSQ

SEQ ID NO: 159437 - protein, 34 aa, Artificial Sequence
  Description of Artificial Sequence: Synthetic polypeptide
NEMEIRTTNPVATEQYGSVWAWPTHEDEFMSSQR

SEQ ID NO: 159438 - protein, 35 aa, Artificial Sequence
  Description of Artificial Sequence: Synthetic polypeptide
DSEEISTTNPVAYTQWGSTVQSTENPSMRGGNNGT

SEQ ID NO: 159439 - protein, 34 aa, Artificial Sequence
  Description of Artificial Sequence: Synthetic polypeptide
NEMEIRTTNPVATEQYGSVWCWNHEDEFMSSQRS

SEQ ID NO: 159440 - protein, 35 aa, Artificial Sequence
  Description of Artificial Sequence: Synthetic polypeptide
DEAEIRTTNPVATEQYGCVCSWEEHNANFPSDNQS

SEQ ID NO: 159441 - protein, 37 aa, Artificial Sequence
  Description of Artificial Sequence: Synthetic polypeptide
AEEEIRTTNPVATEQYGVVSTTNNNTEQGTDEANNED

SEQ ID NO: 159442 - protein, 34 aa, Artificial Sequence
  Description of Artificial Sequence: Synthetic polypeptide
DEECIATTNPVAYEGWGSVATTNLGGNDMQGDNH

SEQ ID NO: 159443 - protein, 39 aa, Artificial Sequence
  Description of Artificial Sequence: Synthetic polypeptide
DEEEIRTTNPVATEAYGVVSTVVTTNLQAGSNNQGNDDT

SEQ ID NO: 159444 - protein, 38 aa, Artificial Sequence
  Description of Artificial Sequence: Synthetic polypeptide
DEEEIRTTNPVATEQYGVVSTVVTNNQEQGEEEEEEDT

SEQ ID NO: 159445 - protein, 32 aa, Artificial Sequence
  Description of Artificial Sequence: Synthetic polypeptide
CENEIRTTNPVSTEPYGTISMEDIQIQQNGNH

SEQ ID NO: 159446 - protein, 35 aa, Artificial Sequence
  Description of Artificial Sequence: Synthetic polypeptide
NEAEIRTTNPCATEQYGCVAWTDNGEQDGQGGGNA

SEQ ID NO: 159447 - protein, 29 aa, Artificial Sequence
  Description of Artificial Sequence: Synthetic peptide
QESEIASTNPVGTDGYGVMASTLQDHGDI

SEQ ID NO: 159448 - protein, 32 aa, Artificial Sequence
  Description of Artificial Sequence: Synthetic polypeptide
CENEIRTTNPVSTEPYGTISMEDIQQQQNGNH

SEQ ID NO: 159449 - protein, 33 aa, Artificial Sequence
  Description of Artificial Sequence: Synthetic polypeptide
CENEIRTTNPVSTEPYGTISMEDTIQQQQNGNH

SEQ ID NO: 159450 - protein, 35 aa, Artificial Sequence
  Description of Artificial Sequence: Synthetic polypeptide
NEAEIRCTNPVATEQYGSCFYSVTNQERQMENNQV

SEQ ID NO: 159451 - protein, 35 aa, Artificial Sequence
  Description of Artificial Sequence: Synthetic polypeptide
DEVEIATTNPVAYEQWGSVCGDQRNDLQHGGGDQR

SEQ ID NO: 159452 - protein, 36 aa, Artificial Sequence
  Description of Artificial Sequence: Synthetic polypeptide
DEEEIRTTNPVATEQYGQCICSTGEHQESFGSETQL

SEQ ID NO: 159453 - protein, 36 aa, Artificial Sequence
  Description of Artificial Sequence: Synthetic polypeptide
NEAEIRCTNPVATEQYGSCFYSVDTNQERQGEINQH

SEQ ID NO: 159454 - protein, 37 aa, Artificial Sequence
  Description of Artificial Sequence: Synthetic polypeptide
DEEEIRTTNPVATEQYGSLCVSPAPNLLPEVDMFESD

SEQ ID NO: 159455 - protein, 31 aa, Artificial Sequence
  Description of Artificial Sequence: Synthetic polypeptide
DDSEVASTNPVSTEGYGNVAANTIQNRVGAR

SEQ ID NO: 159456 - protein, 34 aa, Artificial Sequence
  Description of Artificial Sequence: Synthetic polypeptide
DEECIATTNPVAYEGWGSVATTNLGGNDQQGDQP

SEQ ID NO: 159457 - protein, 34 aa, Artificial Sequence
  Description of Artificial Sequence: Synthetic polypeptide
DENEIRTTNPVATEQWGKVPSEGESMNAAEGDTE

SEQ ID NO: 159458 - protein, 35 aa, Artificial Sequence
  Description of Artificial Sequence: Synthetic polypeptide
DSGEICTTNPVAYEQYGSVVCNTHMLSQNTGMTRL

SEQ ID NO: 159459 - protein, 35 aa, Artificial Sequence
  Description of Artificial Sequence: Synthetic polypeptide
DEVEIATTNPVAYEQWGEVVPTENDGHRNGDNNRE

SEQ ID NO: 159460 - protein, 35 aa, Artificial Sequence
  Description of Artificial Sequence: Synthetic polypeptide
DEEQIACTNPVATEQYGSVCAATGLAPGEQMEGTH

SEQ ID NO: 159461 - protein, 33 aa, Artificial Sequence
  Description of Artificial Sequence: Synthetic polypeptide
DDSEVATTNPVSTEGYGNVSATNPTIQSRNGQV

SEQ ID NO: 159462 - protein, 35 aa, Artificial Sequence
  Description of Artificial Sequence: Synthetic polypeptide
DEEQIATTNPVATAQWGSVAGTNHGPLASGEGNGT

SEQ ID NO: 159463 - protein, 37 aa, Artificial Sequence
  Description of Artificial Sequence: Synthetic polypeptide
DEEEIRTTNPVATEQYGQCTCSNWNEHNQNFGSDNQS

SEQ ID NO: 159464 - protein, 36 aa, Artificial Sequence
  Description of Artificial Sequence: Synthetic polypeptide
DEEEIRTTNPVATEQYGQCTCSSNEHNQENFGSDQA

SEQ ID NO: 159465 - protein, 37 aa, Artificial Sequence
  Description of Artificial Sequence: Synthetic polypeptide
DEEEIRTTNPVATEFYGSVMGDQVNNGQNQEGNNGDD

SEQ ID NO: 159466 - protein, 37 aa, Artificial Sequence
  Description of Artificial Sequence: Synthetic polypeptide
DEEEIKTTNPVATEQYGSVVTTGDNNVTGETGGGNET

SEQ ID NO: 159467 - protein, 35 aa, Artificial Sequence
  Description of Artificial Sequence: Synthetic polypeptide
DEEEIRTTNPVATEFYGSVMGEVDNEGEGGEGFTS

SEQ ID NO: 159468 - protein, 37 aa, Artificial Sequence
  Description of Artificial Sequence: Synthetic polypeptide
DEEEIKTTNPVATEQYGSVVTTGDENETFETGEGNET

SEQ ID NO: 159469 - protein, 32 aa, Artificial Sequence
  Description of Artificial Sequence: Synthetic polypeptide
DENEIRTTNPVATEQWGNDVFSEIEMNAAEDA

SEQ ID NO: 159470 - protein, 35 aa, Artificial Sequence
  Description of Artificial Sequence: Synthetic polypeptide
DEEEISTTNPVATEQYGQCVCSWEEPQYFNSDTQD

SEQ ID NO: 159471 - protein, 32 aa, Artificial Sequence
  Description of Artificial Sequence: Synthetic polypeptide
SEEEIRTTNPVAYEHWGCFSWIDDLDRQGQQQ

SEQ ID NO: 159472 - protein, 34 aa, Artificial Sequence
  Description of Artificial Sequence: Synthetic polypeptide
DEEQIATTNPVATEQWGCVAINNNLENGMGGVGR

SEQ ID NO: 159473 - protein, 32 aa, Artificial Sequence
  Description of Artificial Sequence: Synthetic polypeptide
DENEIRTTNPVSTEGYGTIAMEDIQQQHNGNI

SEQ ID NO: 159474 - protein, 32 aa, Artificial Sequence
  Description of Artificial Sequence: Synthetic polypeptide
DEECIATTNPVAYEQWGCVYQPNDWQDHNNIH

SEQ ID NO: 159475 - protein, 31 aa, Artificial Sequence
  Description of Artificial Sequence: Synthetic polypeptide
DDSEVASTNPVSTEGYGNVAANTLQSRVGQQ

SEQ ID NO: 159476 - protein, 35 aa, Artificial Sequence
  Description of Artificial Sequence: Synthetic polypeptide
DEEQIATTNPVATEQWGGCVAITNGLENGMGGVGR

SEQ ID NO: 159477 - protein, 37 aa, Artificial Sequence
  Description of Artificial Sequence: Synthetic polypeptide
DSHEIRTTNPVATEQWGQIVPSCTAELQAGTGTTNRH

SEQ ID NO: 159478 - protein, 38 aa, Artificial Sequence
  Description of Artificial Sequence: Synthetic polypeptide
DEDEIRTTNPVATEQYGVVSTTNQGNNQEIGTTQQNED

SEQ ID NO: 159479 - protein, 34 aa, Artificial Sequence
  Description of Artificial Sequence: Synthetic polypeptide
DENEIRTTNPVATEQWGNCVSEAVEMNIAEGDEA

SEQ ID NO: 159480 - protein, 29 aa, Artificial Sequence
  Description of Artificial Sequence: Synthetic peptide
QENEVASTNPVSTECYGNVANTLQSREQL

SEQ ID NO: 159481 - protein, 35 aa, Artificial Sequence
  Description of Artificial Sequence: Synthetic polypeptide
DEAEIRCTNPVATEQYGCVSWVYNHEQEGFIVQMN

SEQ ID NO: 159482 - protein, 39 aa, Artificial Sequence
  Description of Artificial Sequence: Synthetic polypeptide
DEDEIRTTNPVATEQYGVVSTTNQGQLLQGIGTTQQNED

SEQ ID NO: 159483 - protein, 36 aa, Artificial Sequence
  Description of Artificial Sequence: Synthetic polypeptide
DEEEIRTTNPVATEQYGQCSCSWPEMLNQNFDSEQS

SEQ ID NO: 159484 - protein, 32 aa, Artificial Sequence
  Description of Artificial Sequence: Synthetic polypeptide
DENEIRTTNPVATEQWGNDVSEIIEMNAAEDA

SEQ ID NO: 159485 - protein, 36 aa, Artificial Sequence
  Description of Artificial Sequence: Synthetic polypeptide
DEEEIRTTNPVATEQFGTCVCSNTGYHNAHFGSDQA

SEQ ID NO: 159486 - protein, 34 aa, Artificial Sequence
  Description of Artificial Sequence: Synthetic polypeptide
DEVEIATTNPVAYEQWGEVVPTENDGARNGDNNT

SEQ ID NO: 159487 - protein, 34 aa, Artificial Sequence
  Description of Artificial Sequence: Synthetic polypeptide
NEAEIQCTNPVAYEQWGSVVQSANEQDRGGENVL

SEQ ID NO: 159488 - protein, 37 aa, Artificial Sequence
  Description of Artificial Sequence: Synthetic polypeptide
DEEEIRTTNPVATEQYGQCSCSTGEPHNQEYFNSDQS

SEQ ID NO: 159489 - protein, 37 aa, Artificial Sequence
  Description of Artificial Sequence: Synthetic polypeptide
DEEEIATTNPVATEQYGSVCAAMNPAEEAGDSGENRN

SEQ ID NO: 159490 - protein, 36 aa, Artificial Sequence
  Description of Artificial Sequence: Synthetic polypeptide
QEEEIRTTNPVATEQYGSVQVSVDEQIENTEEANIM

SEQ ID NO: 159491 - protein, 35 aa, Artificial Sequence
  Description of Artificial Sequence: Synthetic polypeptide
DEGEIRTTNPVATEQYGSNMGTLMFDSRIDVENEE

SEQ ID NO: 159492 - protein, 39 aa, Artificial Sequence
  Description of Artificial Sequence: Synthetic polypeptide
DEDEIRTTNPVATEQYGVVSTTQNGGNLQGIGTTNQEED

SEQ ID NO: 159493 - protein, 33 aa, Artificial Sequence
  Description of Artificial Sequence: Synthetic polypeptide
DEEQIACTNPVATAQWGSVSTHGPLGAPMGQAT

SEQ ID NO: 159494 - protein, 37 aa, Artificial Sequence
  Description of Artificial Sequence: Synthetic polypeptide
DEEEIRTTNPVATEFYGSVDTVMTGNQGGEDNEDGQE

SEQ ID NO: 159495 - protein, 35 aa, Artificial Sequence
  Description of Artificial Sequence: Synthetic polypeptide
QEEEIRTTNPVATEGYGMVNGQGTFGQEGGGDNTG

SEQ ID NO: 159496 - protein, 32 aa, Artificial Sequence
  Description of Artificial Sequence: Synthetic polypeptide
DENEIRTTNPVATEQWGNDVVSEIEMNAAEDA

SEQ ID NO: 159497 - protein, 34 aa, Artificial Sequence
  Description of Artificial Sequence: Synthetic polypeptide
DEEQIACTNPVATAQWGSVSTPHGPLGAPGGNDV

SEQ ID NO: 159498 - protein, 32 aa, Artificial Sequence
  Description of Artificial Sequence: Synthetic polypeptide
DENEIRTTNPVATEQWGNDVSMEIEMNAAEDA

SEQ ID NO: 159499 - protein, 34 aa, Artificial Sequence
  Description of Artificial Sequence: Synthetic polypeptide
DEEQIACTNPVATEQWGSVAITNNLENGMGGVGH

SEQ ID NO: 159500 - protein, 36 aa, Artificial Sequence
  Description of Artificial Sequence: Synthetic polypeptide
DEGEIRTTNPVATEQYGSIVNYTENYEDVNQMEDIA

SEQ ID NO: 159501 - protein, 36 aa, Artificial Sequence
  Description of Artificial Sequence: Synthetic polypeptide
DEEEIRTTNPVATEFYGSVIDTTNDGENEEGEDGGT

SEQ ID NO: 159502 - protein, 37 aa, Artificial Sequence
  Description of Artificial Sequence: Synthetic polypeptide
DEEEIATTNPVATEQYGSVCAAMNPAEEAGISMENRD

SEQ ID NO: 159503 - protein, 32 aa, Artificial Sequence
  Description of Artificial Sequence: Synthetic polypeptide
DDSEVASTNPVSTEGYGNVAANTLIQSRVGQR

SEQ ID NO: 159504 - protein, 34 aa, Artificial Sequence
  Description of Artificial Sequence: Synthetic polypeptide
DEEQIACTNPVATEQYGSVATTHGPLGAPGGETH

SEQ ID NO: 159505 - protein, 34 aa, Artificial Sequence
  Description of Artificial Sequence: Synthetic polypeptide
AEDEICATNPVATEQYGVVAVSNENNLQQGEGDE

SEQ ID NO: 159506 - protein, 33 aa, Artificial Sequence
  Description of Artificial Sequence: Synthetic polypeptide
DEECIATTNPVAYEGWGSVATVNNGGDTQGDSR

SEQ ID NO: 159507 - protein, 39 aa, Artificial Sequence
  Description of Artificial Sequence: Synthetic polypeptide
DEEEIRTTNPVATEQYGVVSTVVTNNQAGTQNNETEEDD

SEQ ID NO: 159508 - protein, 34 aa, Artificial Sequence
  Description of Artificial Sequence: Synthetic polypeptide
DEMEIATTNPVAYEQYGTVCSATDGPMEFEGNDM

SEQ ID NO: 159509 - protein, 29 aa, Artificial Sequence
  Description of Artificial Sequence: Synthetic peptide
QESEIASTNPIGTEGYGVMFASTLQHGDI

SEQ ID NO: 159510 - protein, 33 aa, Artificial Sequence
  Description of Artificial Sequence: Synthetic polypeptide
DEHEIRTTNPVAYEQWGSVAWNNENDNHNGGES

SEQ ID NO: 159511 - protein, 33 aa, Artificial Sequence
  Description of Artificial Sequence: Synthetic polypeptide
SEEEIRTTNPVATEQYGSFCNEHHDERPEDVQQ

SEQ ID NO: 159512 - protein, 33 aa, Artificial Sequence
  Description of Artificial Sequence: Synthetic polypeptide
SEEEIRTTNPVATEQYGSFCNEHDENSPEDSQE

SEQ ID NO: 159513 - protein, 37 aa, Artificial Sequence
  Description of Artificial Sequence: Synthetic polypeptide
DEEEIRTTNPVATEQYGSVFGSFEDDEGGNQEENNIV

SEQ ID NO: 159514 - protein, 34 aa, Artificial Sequence
  Description of Artificial Sequence: Synthetic polypeptide
DESEIRSTNPVATEQYGDMSTTATGQGGGGQSGD

SEQ ID NO: 159515 - protein, 36 aa, Artificial Sequence
  Description of Artificial Sequence: Synthetic polypeptide
DEDEIRTTNPVAYDQYGQVSCTGNMQSQWTGTKNGV

SEQ ID NO: 159516 - protein, 36 aa, Artificial Sequence
  Description of Artificial Sequence: Synthetic polypeptide
DEDEIRTTNPVAYDQYGQSVQCTGNQSQWTGTANGV

SEQ ID NO: 159517 - protein, 33 aa, Artificial Sequence
  Description of Artificial Sequence: Synthetic polypeptide
SEEEIRTTNPVATEQYGSFCNEHDELFPEDSQM

SEQ ID NO: 159518 - protein, 31 aa, Artificial Sequence
  Description of Artificial Sequence: Synthetic polypeptide
DDSEIASTNPVSTEGYGNVAANTIQSRVGQL

SEQ ID NO: 159519 - protein, 30 aa, Artificial Sequence
  Description of Artificial Sequence: Synthetic polypeptide
DENEIATTNPIATECYGATWSECWQEPEEL

SEQ ID NO: 159520 - protein, 35 aa, Artificial Sequence
  Description of Artificial Sequence: Synthetic polypeptide
DEDEIRTTNPVAYEQWGSVSGGDGGNHQGGEGGHQ

SEQ ID NO: 159521 - protein, 30 aa, Artificial Sequence
  Description of Artificial Sequence: Synthetic polypeptide
DENEIATTNPVATEGWGDVSNIEMNAAEDA

SEQ ID NO: 159522 - protein, 37 aa, Artificial Sequence
  Description of Artificial Sequence: Synthetic polypeptide
DEEEIRTTNPVATEQYGCVTSTTPAGNAEHFGSEPQA

SEQ ID NO: 159523 - protein, 30 aa, Artificial Sequence
  Description of Artificial Sequence: Synthetic polypeptide
DDSEVASTNPVSTEGYGNVAANTIQSKGQR

SEQ ID NO: 159524 - protein, 35 aa, Artificial Sequence
  Description of Artificial Sequence: Synthetic polypeptide
DEDEIRTTNPVATTQYGVVSTVQAGTEQYGSTEDE

SEQ ID NO: 159525 - protein, 34 aa, Artificial Sequence
  Description of Artificial Sequence: Synthetic polypeptide
DEAEIRTTNPVATEQYGSFYTWLMESEESIEDVC

SEQ ID NO: 159526 - protein, 30 aa, Artificial Sequence
  Description of Artificial Sequence: Synthetic polypeptide
DENEIATTNPVATEGWGDVSSIEMNAAEDA

SEQ ID NO: 159527 - protein, 30 aa, Artificial Sequence
  Description of Artificial Sequence: Synthetic polypeptide
DENEIATTNPVATEGWGVVSSIEMNAAEDA

SEQ ID NO: 159528 - protein, 31 aa, Artificial Sequence
  Description of Artificial Sequence: Synthetic polypeptide
DDSEVASTNPVSTEGYGNVAANTIQSRVGER

SEQ ID NO: 159529 - protein, 37 aa, Artificial Sequence
  Description of Artificial Sequence: Synthetic polypeptide
DEEEIRTTNPVATEQYGCVTSTTPAHNAEYFGSDPQM

SEQ ID NO: 159530 - protein, 38 aa, Artificial Sequence
  Description of Artificial Sequence: Synthetic polypeptide
DEEEIRTTNPVATEQYGVVSTVQNGNQQSATEEGTTVE

SEQ ID NO: 159531 - protein, 35 aa, Artificial Sequence
  Description of Artificial Sequence: Synthetic polypeptide
DEDEIRTTNPVAYEQWGSVSGGGGNHQAGEGGGEV

SEQ ID NO: 159532 - protein, 36 aa, Artificial Sequence
  Description of Artificial Sequence: Synthetic polypeptide
DENEIRTTNPVATEQYGSVSNTSVVTMETFLSEQIV

SEQ ID NO: 159533 - protein, 30 aa, Artificial Sequence
  Description of Artificial Sequence: Synthetic polypeptide
DENEIATTNPIATECYGATWSACWQEPEEL

SEQ ID NO: 159534 - protein, 34 aa, Artificial Sequence
  Description of Artificial Sequence: Synthetic polypeptide
DEAEIRTTNPVATEQYGSFYTWLEMESESIEDQC

SEQ ID NO: 159535 - protein, 36 aa, Artificial Sequence
  Description of Artificial Sequence: Synthetic polypeptide
DECEICTTNPVATEQYGVVSTVNDQQGSTDEAETDE

SEQ ID NO: 159536 - protein, 30 aa, Artificial Sequence
  Description of Artificial Sequence: Synthetic polypeptide
DENEIATTNPVATEGWGDVSEIEMNAAEDA

SEQ ID NO: 159537 - protein, 35 aa, Artificial Sequence
  Description of Artificial Sequence: Synthetic polypeptide
DEAEIRTTNPVATEQYGSHPTNWEPHEPISQESDY

SEQ ID NO: 159538 - protein, 35 aa, Artificial Sequence
  Description of Artificial Sequence: Synthetic polypeptide
DENEIRTTNPVATEQYGSVSQWADSMHEHIQGSQS

SEQ ID NO: 159539 - protein, 35 aa, Artificial Sequence
  Description of Artificial Sequence: Synthetic polypeptide
SEEEIRTTNPVATEQYGSNYTPTHMYSEGTNDDEF

SEQ ID NO: 159540 - protein, 38 aa, Artificial Sequence
  Description of Artificial Sequence: Synthetic polypeptide
AEEEIRTTNPVATEQYGSVVVVVNTNTEQGSEGGNTDD

SEQ ID NO: 159541 - protein, 38 aa, Artificial Sequence
  Description of Artificial Sequence: Synthetic polypeptide
AEEEIRTTNPVATEQYGSVVVVVNTNTEQGSEGGSNLT

SEQ ID NO: 159542 - protein, 35 aa, Artificial Sequence
  Description of Artificial Sequence: Synthetic polypeptide
DEAEIRTTNPVATEQYGSHFYTWLMESGESIEPQM

SEQ ID NO: 159543 - protein, 39 aa, Artificial Sequence
  Description of Artificial Sequence: Synthetic polypeptide
DEEEIRTTNPVATEQYGVVSTVVVNTTNLQQGTTDEGQD

SEQ ID NO: 159544 - protein, 33 aa, Artificial Sequence
  Description of Artificial Sequence: Synthetic polypeptide
DEDEIRTTNPVAYEAWGSVCPEDILNQQNGDDQ

SEQ ID NO: 159545 - protein, 32 aa, Artificial Sequence
  Description of Artificial Sequence: Synthetic polypeptide
DEYEIRTTNPVSIEPYGTISMEDIQQQQNGNH

SEQ ID NO: 159546 - protein, 37 aa, Artificial Sequence
  Description of Artificial Sequence: Synthetic polypeptide
DEQEIATTNPVAYEQYGSVCSPTNAGPQEAEIGNENT

SEQ ID NO: 159547 - protein, 36 aa, Artificial Sequence
  Description of Artificial Sequence: Synthetic polypeptide
DECEICTTNPVATEQYGVVSTVNDQQGSTDEDEDEE

SEQ ID NO: 159548 - protein, 33 aa, Artificial Sequence
  Description of Artificial Sequence: Synthetic polypeptide
DDEEIRTTNPCATEAYGCVCSWEHNQNFNSDQA

SEQ ID NO: 159549 - protein, 37 aa, Artificial Sequence
  Description of Artificial Sequence: Synthetic polypeptide
DECEICTTNPVATEQYGVVSTVNDQQLGNTEEGEDDT

SEQ ID NO: 159550 - protein, 33 aa, Artificial Sequence
  Description of Artificial Sequence: Synthetic polypeptide
DEYEIRTTNPVSTEPYGTISMEDIQQQQNGNHY

SEQ ID NO: 159551 - protein, 34 aa, Artificial Sequence
  Description of Artificial Sequence: Synthetic polypeptide
DEAEIRTTNPVATEQYGSFYTWQLMESESIESQC

SEQ ID NO: 159552 - protein, 32 aa, Artificial Sequence
  Description of Artificial Sequence: Synthetic polypeptide
DEYEIRTTNPVSTSPYGTISMEDIQQQQNGNH

SEQ ID NO: 159553 - protein, 36 aa, Artificial Sequence
  Description of Artificial Sequence: Synthetic polypeptide
DEAEICTTNPVAYECWGSVATDNGLLQDDRGQNGTH

SEQ ID NO: 159554 - protein, 37 aa, Artificial Sequence
  Description of Artificial Sequence: Synthetic polypeptide
SEEEIRTTNPVATEQYGSIVNGTMSLDDILGSNNQQI

SEQ ID NO: 159555 - protein, 37 aa, Artificial Sequence
  Description of Artificial Sequence: Synthetic polypeptide
DEEEIRTTNPVATEQYGCVTSTTPADNIEYFNSNPVS

SEQ ID NO: 159556 - protein, 35 aa, Artificial Sequence
  Description of Artificial Sequence: Synthetic polypeptide
DEAEIRTTNPVATEQYGSFYTWNLMESEASIEDQM

SEQ ID NO: 159557 - protein, 36 aa, Artificial Sequence
  Description of Artificial Sequence: Synthetic polypeptide
DECEICTTNPVATEQYGVVSTVNDQQGSTEESEEEE

SEQ ID NO: 159558 - protein, 36 aa, Artificial Sequence
  Description of Artificial Sequence: Synthetic polypeptide
DECEICTTNPVATEQYGVVSTVNDQQGSTEEQEDED

SEQ ID NO: 159559 - protein, 39 aa, Artificial Sequence
  Description of Artificial Sequence: Synthetic polypeptide
AEEEIRTTNPVATEQYGSVVVTVTTNNLEQGTEEGNTTN

SEQ ID NO: 159560 - protein, 36 aa, Artificial Sequence
  Description of Artificial Sequence: Synthetic polypeptide
DENEIRTTNPVATEQYGVVVFDDFNVGQGEGDENET

SEQ ID NO: 159561 - protein, 39 aa, Artificial Sequence
  Description of Artificial Sequence: Synthetic polypeptide
DEEEIRTTNPVATEQYGVVSTVNTQAGNQQGTTEQGTSE

SEQ ID NO: 159562 - protein, 34 aa, Artificial Sequence
  Description of Artificial Sequence: Synthetic polypeptide
DEAEIRTTNPVATEQYGSFYTSLMESLESIEDTA

SEQ ID NO: 159563 - protein, 37 aa, Artificial Sequence
  Description of Artificial Sequence: Synthetic polypeptide
DESEIRSTNPVATEPYGSVCIWVQNDQRDQRDGGNTR

SEQ ID NO: 159564 - protein, 35 aa, Artificial Sequence
  Description of Artificial Sequence: Synthetic polypeptide
DEDEIRTTNPVAYEQWGSVSGGLGPNHQGQGGGKN

SEQ ID NO: 159565 - protein, 34 aa, Artificial Sequence
  Description of Artificial Sequence: Synthetic polypeptide
DEMEICTTNPVATEQYGAVCTATDGSPVEFEGNE

SEQ ID NO: 159566 - protein, 36 aa, Artificial Sequence
  Description of Artificial Sequence: Synthetic polypeptide
DENEIRTTNPVATEQYGSVSFTEDTTETIADNSEKM

SEQ ID NO: 159567 - protein, 34 aa, Artificial Sequence
  Description of Artificial Sequence: Synthetic polypeptide
DEMEICTTNPVATEQYGAVCTATDGPVEFEGNYN

SEQ ID NO: 159568 - protein, 38 aa, Artificial Sequence
  Description of Artificial Sequence: Synthetic polypeptide
DEEEIRTTNPVATEQYGVVSTVVTNTNNNNQQGTDETA

SEQ ID NO: 159569 - protein, 35 aa, Artificial Sequence
  Description of Artificial Sequence: Synthetic polypeptide
DEDEIRTTNPVAYEQWGSVSGGQGNHQEGEGGGEN

SEQ ID NO: 159570 - protein, 32 aa, Artificial Sequence
  Description of Artificial Sequence: Synthetic polypeptide
DDSEIASTNPVSTEGYGNVAATTIQSRVGQDR

SEQ ID NO: 159571 - protein, 35 aa, Artificial Sequence
  Description of Artificial Sequence: Synthetic polypeptide
DEAEISTTNPVATEQYGCVCSTTELNAEYFGSDQS

SEQ ID NO: 159572 - protein, 35 aa, Artificial Sequence
  Description of Artificial Sequence: Synthetic polypeptide
DEDEIRTTNPVAYEQWGSVSGMGGENHQGEGGGEQ

SEQ ID NO: 159573 - protein, 37 aa, Artificial Sequence
  Description of Artificial Sequence: Synthetic polypeptide
DENEIRTTNPVATEQYGSVSFVDNNNDQFEYNQFDHN

SEQ ID NO: 159574 - protein, 36 aa, Artificial Sequence
  Description of Artificial Sequence: Synthetic polypeptide
DEEEIRTTNPVATEQYGSVSPPPLMEDVPMVPLEQG

SEQ ID NO: 159575 - protein, 37 aa, Artificial Sequence
  Description of Artificial Sequence: Synthetic polypeptide
DENEIRTTNPVATEQYGSVSFNDNNNTQEEGVQFDHN

SEQ ID NO: 159576 - protein, 34 aa, Artificial Sequence
  Description of Artificial Sequence: Synthetic polypeptide
DDEEIRTTNPCATEHYGCVCSNWELNQYFNSDQS

SEQ ID NO: 159577 - protein, 38 aa, Artificial Sequence
  Description of Artificial Sequence: Synthetic polypeptide
AEEEIRTTNPVATEQYGSVVVTVTTNNGNLQQGTEGID

SEQ ID NO: 159578 - protein, 35 aa, Artificial Sequence
  Description of Artificial Sequence: Synthetic polypeptide
DEQEIATTNPVAYEQYGSVCATNNEQPDATATGDQ

SEQ ID NO: 159579 - protein, 37 aa, Artificial Sequence
  Description of Artificial Sequence: Synthetic polypeptide
DECEICTTNPVATEQYGVVSTVNAQQGGNTEENEDDT

SEQ ID NO: 159580 - protein, 37 aa, Artificial Sequence
  Description of Artificial Sequence: Synthetic polypeptide
CEEEIRTTNPVATEQYGQCVCSTMEHNQENFGSDNQS

SEQ ID NO: 159581 - protein, 33 aa, Artificial Sequence
  Description of Artificial Sequence: Synthetic polypeptide
DEMEIRCTNPVATEQYGCVCQTGAHINFMSDQS

SEQ ID NO: 159582 - protein, 36 aa, Artificial Sequence
  Description of Artificial Sequence: Synthetic polypeptide
NEEEIRTTNPVATEQYGMVSVNGMGLGGQGQEAEGE

SEQ ID NO: 159583 - protein, 34 aa, Artificial Sequence
  Description of Artificial Sequence: Synthetic polypeptide
CEEEIRTTNPVAYEQYGCVCSWEHQENFNSDPQS

SEQ ID NO: 159584 - protein, 37 aa, Artificial Sequence
  Description of Artificial Sequence: Synthetic polypeptide
DECEICTTNPVATEQYGVVSVTTNQQAGNQQGNQDDE

SEQ ID NO: 159585 - protein, 36 aa, Artificial Sequence
  Description of Artificial Sequence: Synthetic polypeptide
DENEIRTTNPVATEQYGSVSFPDSMINSRQEVSFED

SEQ ID NO: 159586 - protein, 35 aa, Artificial Sequence
  Description of Artificial Sequence: Synthetic polypeptide
DEAEISTTNPVATEQYGCVCSTGEHNAYFGSDPQS

SEQ ID NO: 159587 - protein, 36 aa, Artificial Sequence
  Description of Artificial Sequence: Synthetic polypeptide
DENEIRTTNPVATEQYGSVSFVDNNNTQEYLEFDHN

SEQ ID NO: 159588 - protein, 35 aa, Artificial Sequence
  Description of Artificial Sequence: Synthetic polypeptide
DENEIRTTNPVATEQYGVVVMNGMNGEGGFDENTQ

SEQ ID NO: 159589 - protein, 38 aa, Artificial Sequence
  Description of Artificial Sequence: Synthetic polypeptide
SEEEIRTTNPVATEQYGSCGQVTTGDNGLGGEQEGDIQ

SEQ ID NO: 159590 - protein, 34 aa, Artificial Sequence
  Description of Artificial Sequence: Synthetic polypeptide
DEAEIRTTNPVATEQYGSFYTGLMESEYMIEDQM

SEQ ID NO: 159591 - protein, 34 aa, Artificial Sequence
  Description of Artificial Sequence: Synthetic polypeptide
DEAEIRTTNPVATEQYGSFYTDLMESTESIEDQC

SEQ ID NO: 159592 - protein, 31 aa, Artificial Sequence
  Description of Artificial Sequence: Synthetic polypeptide
DESEIRSTNPVATEQWGNVAAETIQSAVEDA

SEQ ID NO: 159593 - protein, 34 aa, Artificial Sequence
  Description of Artificial Sequence: Synthetic polypeptide
DEMEICTTNPVATEQYGAVCTATDVPVEPFEGNE

SEQ ID NO: 159594 - protein, 32 aa, Artificial Sequence
  Description of Artificial Sequence: Synthetic polypeptide
DEEEIRTTNPCAYEPYTSCAGTNHMNPQNEAM

SEQ ID NO: 159595 - protein, 37 aa, Artificial Sequence
  Description of Artificial Sequence: Synthetic polypeptide
DECEICTTNPVATEQYGVVSTVNAQQIGNTEEGVDDT

SEQ ID NO: 159596 - protein, 37 aa, Artificial Sequence
  Description of Artificial Sequence: Synthetic polypeptide
DECEICTTNPVATEQYGVVSTVNAQQGNQQQATNATD

SEQ ID NO: 159597 - protein, 36 aa, Artificial Sequence
  Description of Artificial Sequence: Synthetic polypeptide
DENEIRTTNPVATEQYGSVSITSMQFTTESIQESFP

SEQ ID NO: 159598 - protein, 36 aa, Artificial Sequence
  Description of Artificial Sequence: Synthetic polypeptide
DENEIRTTNPVATEQYGSVSITSMQFQTESIQESGM

SEQ ID NO: 159599 - protein, 31 aa, Artificial Sequence
  Description of Artificial Sequence: Synthetic polypeptide
AENEIACTNPVATEQYGEASEPAGPNRGGPV

SEQ ID NO: 159600 - protein, 36 aa, Artificial Sequence
  Description of Artificial Sequence: Synthetic polypeptide
DEEEIRTTNPVATEQYGSVSPSELEGPVPVMTTDVP

SEQ ID NO: 159601 - protein, 34 aa, Artificial Sequence
  Description of Artificial Sequence: Synthetic polypeptide
DEAEIRTTNPVATEQYGSFYTALMWSLESIEDQC

SEQ ID NO: 159602 - protein, 34 aa, Artificial Sequence
  Description of Artificial Sequence: Synthetic polypeptide
DEAEIRTTNPVATEQYGSFYTALGMESESYEDQM

SEQ ID NO: 159603 - protein, 36 aa, Artificial Sequence
  Description of Artificial Sequence: Synthetic polypeptide
DENEIRTTNPVATEQYGSVSITDMQFQTESMQESGP

SEQ ID NO: 159604 - protein, 35 aa, Artificial Sequence
  Description of Artificial Sequence: Synthetic polypeptide
DEDEIRTTNPVATTQYGVVSTTNNNANEQGSTDDE

SEQ ID NO: 159605 - protein, 36 aa, Artificial Sequence
  Description of Artificial Sequence: Synthetic polypeptide
DENEIRTTNPVATEQYGSVSFYDPMMNSRQEVSFED

SEQ ID NO: 159606 - protein, 36 aa, Artificial Sequence
  Description of Artificial Sequence: Synthetic polypeptide
DENEIRTTNPVATEQYGSVSFVWNNNTWEYNQFDHN

SEQ ID NO: 159607 - protein, 33 aa, Artificial Sequence
  Description of Artificial Sequence: Synthetic polypeptide
DDSEVRTTNPVATECWGNVSACITEQDRVGENG

SEQ ID NO: 159608 - protein, 36 aa, Artificial Sequence
  Description of Artificial Sequence: Synthetic polypeptide
DENEIRTTNPVATEQYGSVSFVRNNNTQEYDQFSHN

SEQ ID NO: 159609 - protein, 35 aa, Artificial Sequence
  Description of Artificial Sequence: Synthetic polypeptide
DEDEIRTTNPVAYEQWGSVSGGGPNHDQGQGGGEN

SEQ ID NO: 159610 - protein, 37 aa, Artificial Sequence
  Description of Artificial Sequence: Synthetic polypeptide
DESEIRSTNPVATEPYGSVCIWVQNDQRDQREGSNDR

SEQ ID NO: 159611 - protein, 37 aa, Artificial Sequence
  Description of Artificial Sequence: Synthetic polypeptide
DESEIRSTNPVATEPYGSVCIWVQNDQRDQRRGENNR

SEQ ID NO: 159612 - protein, 30 aa, Artificial Sequence
  Description of Artificial Sequence: Synthetic polypeptide
DENEIRTTNPVATERWGDVMEIEMNAAEDA

SEQ ID NO: 159613 - protein, 36 aa, Artificial Sequence
  Description of Artificial Sequence: Synthetic polypeptide
DEAEIRTTNPVATEQYGSHTTNWTLPHEPISQESDY

SEQ ID NO: 159614 - protein, 39 aa, Artificial Sequence
  Description of Artificial Sequence: Synthetic polypeptide
AEEEIRTTNPVATEQYGSVVVTVTTNNLEQGTEGGNVTD

SEQ ID NO: 159615 - protein, 38 aa, Artificial Sequence
  Description of Artificial Sequence: Synthetic polypeptide
DEEEIRTTNPVATEQYGSIVIGPTNNLLQMPVLEIEDT

SEQ ID NO: 159616 - protein, 31 aa, Artificial Sequence
  Description of Artificial Sequence: Synthetic polypeptide
DDSEIASTNPVSTEGYGNVAANTCQSHVGER

SEQ ID NO: 159617 - protein, 37 aa, Artificial Sequence
  Description of Artificial Sequence: Synthetic polypeptide
CEEEIRTTNPVATEQYGVVSILIATGQNDQEGGDIGD

SEQ ID NO: 159618 - protein, 36 aa, Artificial Sequence
  Description of Artificial Sequence: Synthetic polypeptide
DEEEIACTNPVATEQYGSACSAANPLAEAEMGNGSD

SEQ ID NO: 159619 - protein, 37 aa, Artificial Sequence
  Description of Artificial Sequence: Synthetic polypeptide
CEEEIRTTNPVATEQYGVVSILIATGVNDQGTGGDGD

SEQ ID NO: 159620 - protein, 36 aa, Artificial Sequence
  Description of Artificial Sequence: Synthetic polypeptide
DEAEIRTTNPVATEQYGSIPWTPPLEENQHQSENHY

SEQ ID NO: 159621 - protein, 35 aa, Artificial Sequence
  Description of Artificial Sequence: Synthetic polypeptide
DEDEIRTTNPVAYECWGSVAWTDDGLDQRGQGESN

SEQ ID NO: 159622 - protein, 37 aa, Artificial Sequence
  Description of Artificial Sequence: Synthetic polypeptide
CEEEIRTTNPVATEQYGVVSILIDTGDNDQEDGGDGD

SEQ ID NO: 159623 - protein, 33 aa, Artificial Sequence
  Description of Artificial Sequence: Synthetic polypeptide
DEDEIRTTNPVAYECWGSVAWTDDGDDRNGEQS

SEQ ID NO: 159624 - protein, 33 aa, Artificial Sequence
  Description of Artificial Sequence: Synthetic polypeptide
DEDEIRTTNPVAYECWGSVAWNEGQQQQPNMDQ

SEQ ID NO: 159625 - protein, 38 aa, Artificial Sequence
  Description of Artificial Sequence: Synthetic polypeptide
AEEEIRTTNPVATEQYGSVVVTVTTNQGNNQQGTNQID

SEQ ID NO: 159626 - protein, 35 aa, Artificial Sequence
  Description of Artificial Sequence: Synthetic polypeptide
DESEIRSTNPVAYEAYGSTVQVTYLSSNGEVNTER

SEQ ID NO: 159627 - protein, 38 aa, Artificial Sequence
  Description of Artificial Sequence: Synthetic polypeptide
DEEEIRTTNPVATEQYGVVSTVVVNQNNQQGTTTEEEE

SEQ ID NO: 159628 - protein, 34 aa, Artificial Sequence
  Description of Artificial Sequence: Synthetic polypeptide
DEDEIRTTNPVAYECWGSVATGNMLGDADGMDPE

SEQ ID NO: 159629 - protein, 37 aa, Artificial Sequence
  Description of Artificial Sequence: Synthetic polypeptide
CEEEIRTTNPVATEQYGVVSNLIATGDNDQDEGGDGD

SEQ ID NO: 159630 - protein, 37 aa, Artificial Sequence
  Description of Artificial Sequence: Synthetic polypeptide
DEEEIRTTNPVATEQYGVVSTVVVNQQGTEDEEEEED

SEQ ID NO: 159631 - protein, 31 aa, Artificial Sequence
  Description of Artificial Sequence: Synthetic polypeptide
DDSEIASTNPVSTEGYGNVAANTIESRVGQR

SEQ ID NO: 159632 - protein, 38 aa, Artificial Sequence
  Description of Artificial Sequence: Synthetic polypeptide
DEEEIRTTNPVATEQYGVVSTVQNQNATEQGTTEQGQE

SEQ ID NO: 159633 - protein, 36 aa, Artificial Sequence
  Description of Artificial Sequence: Synthetic polypeptide
DEEEISTTNPVAYEQYGASVQMETIPDELDWRGIEG

SEQ ID NO: 159634 - protein, 32 aa, Artificial Sequence
  Description of Artificial Sequence: Synthetic polypeptide
AENEIACTNPVATEQYGEASSEPAGPNRGNPV

SEQ ID NO: 159635 - protein, 36 aa, Artificial Sequence
  Description of Artificial Sequence: Synthetic polypeptide
DEEEIRTTNPCATEQYGSVIEPTTQHQQITGVMPAP

SEQ ID NO: 159636 - protein, 34 aa, Artificial Sequence
  Description of Artificial Sequence: Synthetic polypeptide
DEDEIRTTNPVAYECWGCVSGGNMGNQEGEGGRR

SEQ ID NO: 159637 - protein, 38 aa, Artificial Sequence
  Description of Artificial Sequence: Synthetic polypeptide
DEAEIRTTNPVATEQYGSSWEVPDANLNVARGFNESMM

SEQ ID NO: 159638 - protein, 35 aa, Artificial Sequence
  Description of Artificial Sequence: Synthetic polypeptide
AEDEICATNPVATEQYGVVATVNENNLQQLGGNDD

SEQ ID NO: 159639 - protein, 30 aa, Artificial Sequence
  Description of Artificial Sequence: Synthetic polypeptide
CENEIATTNPVAYEPYGKVSEESSQHETEL

SEQ ID NO: 159640 - protein, 36 aa, Artificial Sequence
  Description of Artificial Sequence: Synthetic polypeptide
DEEEIRTTNPVATEQYGSVQCPSASIDDQHAPEVGV

SEQ ID NO: 159641 - protein, 38 aa, Artificial Sequence
  Description of Artificial Sequence: Synthetic polypeptide
AEEEIRTTNPVATEQYGSVVVVTTNNQLGTEAGTNNVD

SEQ ID NO: 159642 - protein, 36 aa, Artificial Sequence
  Description of Artificial Sequence: Synthetic polypeptide
DEEEISTTNPVAYEQWGSTVPSTPELSQTQEQDNED

SEQ ID NO: 159643 - protein, 31 aa, Artificial Sequence
  Description of Artificial Sequence: Synthetic polypeptide
QEQEIATTNPVGTEGYGVVSASDLEHEGEDL

SEQ ID NO: 159644 - protein, 31 aa, Artificial Sequence
  Description of Artificial Sequence: Synthetic polypeptide
QEQEIATTNPVGTEGYGVVSASTLEHEGEDL

SEQ ID NO: 159645 - protein, 36 aa, Artificial Sequence
  Description of Artificial Sequence: Synthetic polypeptide
CEEEIRTTNPVATEQYGQCVCSWEEHNQNFGSNNQE

SEQ ID NO: 159646 - protein, 37 aa, Artificial Sequence
  Description of Artificial Sequence: Synthetic polypeptide
DECEICTTNPVATEQYGVVSTVNNQQGNQQQGTNATE

SEQ ID NO: 159647 - protein, 34 aa, Artificial Sequence
  Description of Artificial Sequence: Synthetic polypeptide
DEDEIRTTNPVAYECWGSVAWTDNVERQNGGGDM

SEQ ID NO: 159648 - protein, 37 aa, Artificial Sequence
  Description of Artificial Sequence: Synthetic polypeptide
DEYEIRTTNPVATEQYGSVGIWTENYGQAPEIENEVD

SEQ ID NO: 159649 - protein, 38 aa, Artificial Sequence
  Description of Artificial Sequence: Synthetic polypeptide
AEEEIRTTNPVATEQYGSVVVTVTTNQLGGTEQGSNNQ

SEQ ID NO: 159650 - protein, 35 aa, Artificial Sequence
  Description of Artificial Sequence: Synthetic polypeptide
DEEEIRTTNPVATECYGSTSANTEAWPAEPNGPYV

SEQ ID NO: 159651 - protein, 37 aa, Artificial Sequence
  Description of Artificial Sequence: Synthetic polypeptide
CEEEIRTTNPVATEQYGVVSILIATGDNDQVEGGEGD

SEQ ID NO: 159652 - protein, 36 aa, Artificial Sequence
  Description of Artificial Sequence: Synthetic polypeptide
DEEEIRTTNPVATEQYGSVQCNTMGEQPEMVEVASN

SEQ ID NO: 159653 - protein, 36 aa, Artificial Sequence
  Description of Artificial Sequence: Synthetic polypeptide
DEYEIRTTNPVATEQYGSVIYAVWLETEGNHENQQE

SEQ ID NO: 159654 - protein, 36 aa, Artificial Sequence
  Description of Artificial Sequence: Synthetic polypeptide
DEYEIRTTNPVATEQYGSVMPYNGPDETTQSMQDNQ

SEQ ID NO: 159655 - protein, 38 aa, Artificial Sequence
  Description of Artificial Sequence: Synthetic polypeptide
CEEEIRTTNPVATEQYGVVSILIATGDNDQGEGGTNGD

SEQ ID NO: 159656 - protein, 37 aa, Artificial Sequence
  Description of Artificial Sequence: Synthetic polypeptide
CEEEIRTTNPVATEQYGVVSILIATGDNDQVEGGDGD

SEQ ID NO: 159657 - protein, 36 aa, Artificial Sequence
  Description of Artificial Sequence: Synthetic polypeptide
DEAEIRTTNPVATEQYGSIPWTPPLEGNQHSQEERQ

SEQ ID NO: 159658 - protein, 36 aa, Artificial Sequence
  Description of Artificial Sequence: Synthetic polypeptide
DEYEIRTTNPVATEQYGSVNYAVWLETEGNMMVQQE

SEQ ID NO: 159659 - protein, 33 aa, Artificial Sequence
  Description of Artificial Sequence: Synthetic polypeptide
DEEEIRTTNPCAYEPYGSCAGTNHMNAGQGEAD

SEQ ID NO: 159660 - protein, 37 aa, Artificial Sequence
  Description of Artificial Sequence: Synthetic polypeptide
DEEEIRTTNPVATECYGSTTSSNTPDGPNMRKGMNYV

SEQ ID NO: 159661 - protein, 36 aa, Artificial Sequence
  Description of Artificial Sequence: Synthetic polypeptide
DEEEIRTTNPVATEQYGSVQCPPTTVHDNIGDQSLE

SEQ ID NO: 159662 - protein, 37 aa, Artificial Sequence
  Description of Artificial Sequence: Synthetic polypeptide
DEEEIRTTNPVATECYGSTTSSTTPDGPNMRKGMNYV

SEQ ID NO: 159663 - protein, 36 aa, Artificial Sequence
  Description of Artificial Sequence: Synthetic polypeptide
DEEEIRTTNPCATEQYGSVIEPVNHQQITQGDQPAI

SEQ ID NO: 159664 - protein, 35 aa, Artificial Sequence
  Description of Artificial Sequence: Synthetic polypeptide
DEEEISTTNPVAYEQYGCVCSNTEEHNANFGSDQA

SEQ ID NO: 159665 - protein, 37 aa, Artificial Sequence
  Description of Artificial Sequence: Synthetic polypeptide
CEEEIRTTNPVATEQYGVVTMFTDGDNGQRFNANGQT

SEQ ID NO: 159666 - protein, 31 aa, Artificial Sequence
  Description of Artificial Sequence: Synthetic polypeptide
CENEIATTNPVAYEPYGKVSAHLSQHETDDL

SEQ ID NO: 159667 - protein, 35 aa, Artificial Sequence
  Description of Artificial Sequence: Synthetic polypeptide
DEAEIRTTNPVATEQYGSIPWTAPLEENQHQSEEQ

SEQ ID NO: 159668 - protein, 35 aa, Artificial Sequence
  Description of Artificial Sequence: Synthetic polypeptide
DEEEIRATNPVATDQYGVVNDNSIGQNGGQEDNDT

SEQ ID NO: 159669 - protein, 38 aa, Artificial Sequence
  Description of Artificial Sequence: Synthetic polypeptide
AEEEIRTTNPVATEQYGSVVVVVNTNATEQGSEGGNTL

SEQ ID NO: 159670 - protein, 33 aa, Artificial Sequence
  Description of Artificial Sequence: Synthetic polypeptide
QEEEIRTTNPVATEQYGDVMGGIGGNGEGEEFG

SEQ ID NO: 159671 - protein, 37 aa, Artificial Sequence
  Description of Artificial Sequence: Synthetic polypeptide
DEEEIRTTNPVATEQYGCVTSTTPADNAENFGSEPQM

SEQ ID NO: 159672 - protein, 37 aa, Artificial Sequence
  Description of Artificial Sequence: Synthetic polypeptide
DEDEIRTTNPVAYEQWGSVCYTTDNGDDGKQGGNERG

SEQ ID NO: 159673 - protein, 38 aa, Artificial Sequence
  Description of Artificial Sequence: Synthetic polypeptide
DEEEIRTTNPVATEQYGSIVNGTEECDDQTGSNEDWQI

SEQ ID NO: 159674 - protein, 36 aa, Artificial Sequence
  Description of Artificial Sequence: Synthetic polypeptide
SEEEIRTTNPVATEQYGSSCSPTALSVETTIEQEDN

SEQ ID NO: 159675 - protein, 31 aa, Artificial Sequence
  Description of Artificial Sequence: Synthetic polypeptide
DDSEIASTNPVSTEGYGNVAANTIQSRVGEL

SEQ ID NO: 159676 - protein, 34 aa, Artificial Sequence
  Description of Artificial Sequence: Synthetic polypeptide
DEDEIRTTNPVAYECWGCVASDGNHGNQQGEGRR

SEQ ID NO: 159677 - protein, 37 aa, Artificial Sequence
  Description of Artificial Sequence: Synthetic polypeptide
DEEEIRTTNPVATEQYGCVTSTTMADNIEYFGSEPVS

SEQ ID NO: 159678 - protein, 36 aa, Artificial Sequence
  Description of Artificial Sequence: Synthetic polypeptide
DESEIRSTNPVATEQYGSVITDNNAGNDEGEGGNGS

SEQ ID NO: 159679 - protein, 36 aa, Artificial Sequence
  Description of Artificial Sequence: Synthetic polypeptide
DEAEIRTTNPVATEQYGSIMWTPPLEENQDHQSENP

SEQ ID NO: 159680 - protein, 36 aa, Artificial Sequence
  Description of Artificial Sequence: Synthetic polypeptide
DEAEIRTTNPVATEQYGSIFWGSENLMDEIIEDNQQ

SEQ ID NO: 159681 - protein, 37 aa, Artificial Sequence
  Description of Artificial Sequence: Synthetic polypeptide
NEEEIRTTNPVATEQYGSVVTAGVNDNNGQGEFGEID

SEQ ID NO: 159682 - protein, 35 aa, Artificial Sequence
  Description of Artificial Sequence: Synthetic polypeptide
DENEIRTTNPVATEQYGSVSSSVPEEIHRDEEVVQ

SEQ ID NO: 159683 - protein, 37 aa, Artificial Sequence
  Description of Artificial Sequence: Synthetic polypeptide
DEEEIRTTNPVATEQYGCVTSTTPADNIEYFGSQPQS

SEQ ID NO: 159684 - protein, 34 aa, Artificial Sequence
  Description of Artificial Sequence: Synthetic polypeptide
DEEEIRTTNPCAYEPYGSNCAGTNHMNAQPGEAM

SEQ ID NO: 159685 - protein, 35 aa, Artificial Sequence
  Description of Artificial Sequence: Synthetic polypeptide
CEEEIRTTNPVATEQYGVVVINQDGQEQGGQGEGQ

SEQ ID NO: 159686 - protein, 38 aa, Artificial Sequence
  Description of Artificial Sequence: Synthetic polypeptide
AEEEIRTTNPVATEQYGSVVVVVNTNLEQGSEGGVTVS

SEQ ID NO: 159687 - protein, 36 aa, Artificial Sequence
  Description of Artificial Sequence: Synthetic polypeptide
DENEIRTTNPVATEQYGVVVDDFNSGQGEGDGENEG

SEQ ID NO: 159688 - protein, 33 aa, Artificial Sequence
  Description of Artificial Sequence: Synthetic polypeptide
SEEEIRTTNPVATEQYGSSAPAHIQEMKQFDQF

SEQ ID NO: 159689 - protein, 32 aa, Artificial Sequence
  Description of Artificial Sequence: Synthetic polypeptide
CEEAICTTNPVAYEQWGYVRHIEDNQRTGNSI

SEQ ID NO: 159690 - protein, 34 aa, Artificial Sequence
  Description of Artificial Sequence: Synthetic polypeptide
DEEEISTTNPVAYEQYGCVCENTEHQFFNSEFQS

SEQ ID NO: 159691 - protein, 34 aa, Artificial Sequence
  Description of Artificial Sequence: Synthetic polypeptide
DEDEIRTTNPVAYECWGCVASDGNMGNERGEVGR

SEQ ID NO: 159692 - protein, 35 aa, Artificial Sequence
  Description of Artificial Sequence: Synthetic polypeptide
DEAEIRTTNPVATEQYGSIPWTPLLWNNQHQSEHQ

SEQ ID NO: 159693 - protein, 35 aa, Artificial Sequence
  Description of Artificial Sequence: Synthetic polypeptide
DEAEIRTTNPVATEQYGSIPWTPPLEENGHQSEIP

SEQ ID NO: 159694 - protein, 35 aa, Artificial Sequence
  Description of Artificial Sequence: Synthetic polypeptide
DEDEIRTTNPVAYECWGCVSGGGNMGNQRGEEGMR

SEQ ID NO: 159695 - protein, 34 aa, Artificial Sequence
  Description of Artificial Sequence: Synthetic polypeptide
DEDEIRTTNPVAYEQWGSVCYNQDIMGGGGDGER

SEQ ID NO: 159696 - protein, 34 aa, Artificial Sequence
  Description of Artificial Sequence: Synthetic polypeptide
DEAEICTTNPVATEQYGCVSGGNGNEAGGEGDTQ

SEQ ID NO: 159697 - protein, 34 aa, Artificial Sequence
  Description of Artificial Sequence: Synthetic polypeptide
DEDEIRTTNPVAYECWGCVSGGGNMGNGRGEGSR

SEQ ID NO: 159698 - protein, 34 aa, Artificial Sequence
  Description of Artificial Sequence: Synthetic polypeptide
DEDEIRTTNPVAYEQWGSVCYNQDIMGGGGNDPN

SEQ ID NO: 159699 - protein, 34 aa, Artificial Sequence
  Description of Artificial Sequence: Synthetic polypeptide
DEDEIRTTNPVAYEQWGSVCYNQDIMGIGGGDER

SEQ ID NO: 159700 - protein, 37 aa, Artificial Sequence
  Description of Artificial Sequence: Synthetic polypeptide
DEEEIRTTNPVATEQYGCVTSTTGADNAENFGSDPVG

SEQ ID NO: 159701 - protein, 36 aa, Artificial Sequence
  Description of Artificial Sequence: Synthetic polypeptide
CEEEIRTTNPVATEQYGQCVCSWEDHNQNFGSENQS

SEQ ID NO: 159702 - protein, 36 aa, Artificial Sequence
  Description of Artificial Sequence: Synthetic polypeptide
CEEEIRTTNPVATEQYGQCVCSTWGEHNQSFGSEQS

SEQ ID NO: 159703 - protein, 35 aa, Artificial Sequence
  Description of Artificial Sequence: Synthetic polypeptide
DEAEIRTTNPVATEQYGSIPWTPLLEENQHQSEPF

SEQ ID NO: 159704 - protein, 37 aa, Artificial Sequence
  Description of Artificial Sequence: Synthetic polypeptide
DEEEIRTTNPVATEQYGVVSTVVVNQQGTTTEEDEED

SEQ ID NO: 159705 - protein, 31 aa, Artificial Sequence
  Description of Artificial Sequence: Synthetic polypeptide
DDSEIASTNPVSTEGYGNVAANTIMSRAGDR

SEQ ID NO: 159706 - protein, 33 aa, Artificial Sequence
  Description of Artificial Sequence: Synthetic polypeptide
DEEEIRTTNPCAYEPYGSCAGTNHMNRQPDEAM

SEQ ID NO: 159707 - protein, 31 aa, Artificial Sequence
  Description of Artificial Sequence: Synthetic polypeptide
DDSEIASTNPVSTEGYGNVAANTIQSPVGQR

SEQ ID NO: 159708 - protein, 34 aa, Artificial Sequence
  Description of Artificial Sequence: Synthetic polypeptide
DEQEIATTNPVSTEPYGSVSAMEDLQQQHNGEDH

SEQ ID NO: 159709 - protein, 31 aa, Artificial Sequence
  Description of Artificial Sequence: Synthetic polypeptide
DDSEVASTNPVSTEGYGNVAANTIQSRVGDR

SEQ ID NO: 159710 - protein, 36 aa, Artificial Sequence
  Description of Artificial Sequence: Synthetic polypeptide
DEAEIRTTNPVATEQYGSTIPTTAPLEENQHQSERQ

SEQ ID NO: 159711 - protein, 36 aa, Artificial Sequence
  Description of Artificial Sequence: Synthetic polypeptide
CEEEIRTTNPVATEQYGQCVCSTMEHNQNFNSNNQE

SEQ ID NO: 159712 - protein, 34 aa, Artificial Sequence
  Description of Artificial Sequence: Synthetic polypeptide
QEEEIRTTNPVATEQYGDVMGSMGMNGEGEMDGG

SEQ ID NO: 159713 - protein, 34 aa, Artificial Sequence
  Description of Artificial Sequence: Synthetic polypeptide
DEDEIRTTNPVAYEQWGSVCYNTDQMQQQGESDM

SEQ ID NO: 159714 - protein, 35 aa, Artificial Sequence
  Description of Artificial Sequence: Synthetic polypeptide
DEDEIRTTNPVAYECWGCVASGGGNAGNQRGEGSR

SEQ ID NO: 159715 - protein, 30 aa, Artificial Sequence
  Description of Artificial Sequence: Synthetic polypeptide
QEQEIATTNPVGTEQYGVMAASDLEDHGDL

SEQ ID NO: 159716 - protein, 33 aa, Artificial Sequence
  Description of Artificial Sequence: Synthetic polypeptide
DEAEIRTTNPVATEQYGSFYDWLMESESIEPQP

SEQ ID NO: 159717 - protein, 31 aa, Artificial Sequence
  Description of Artificial Sequence: Synthetic polypeptide
DENEIRTTNPVATERWGDVSEIECMNAAEDA

SEQ ID NO: 159718 - protein, 35 aa, Artificial Sequence
  Description of Artificial Sequence: Synthetic polypeptide
DEEEIRTTNPVATECYGSVDNFDLIGEEGEGEEQT

SEQ ID NO: 159719 - protein, 36 aa, Artificial Sequence
  Description of Artificial Sequence: Synthetic polypeptide
DECEICTTNPVATEQYGVVSTTQQQQNNQQGTTEDE

SEQ ID NO: 159720 - protein, 37 aa, Artificial Sequence
  Description of Artificial Sequence: Synthetic polypeptide
DEEEIRTTNPVATEQYGSVFGNFEDDEGGNDQVEGIV

SEQ ID NO: 159721 - protein, 35 aa, Artificial Sequence
  Description of Artificial Sequence: Synthetic polypeptide
NEEEIRTTNPVATEQYGCVCSAGEHAEFFGSDNQA

SEQ ID NO: 159722 - protein, 34 aa, Artificial Sequence
  Description of Artificial Sequence: Synthetic polypeptide
DEEEIRTTNPVATEQYGCYCSWPEDDQNFDSDQS

SEQ ID NO: 159723 - protein, 36 aa, Artificial Sequence
  Description of Artificial Sequence: Synthetic polypeptide
DEEEIRTTNPVATEQWGSTWATTPAGPNMRNGMNYV

SEQ ID NO: 159724 - protein, 35 aa, Artificial Sequence
  Description of Artificial Sequence: Synthetic polypeptide
DECEICTTNPVATTQYGVVATTANLQQGTEAGTTD

SEQ ID NO: 159725 - protein, 35 aa, Artificial Sequence
  Description of Artificial Sequence: Synthetic polypeptide
AEDEICATNPVATEQYGVVATSQQNLLQLGNGEDD

SEQ ID NO: 159726 - protein, 36 aa, Artificial Sequence
  Description of Artificial Sequence: Synthetic polypeptide
SEEEIRTTNPVATEQYGCVSEDWNEGPQFSFNSSQQ

SEQ ID NO: 159727 - protein, 35 aa, Artificial Sequence
  Description of Artificial Sequence: Synthetic polypeptide
DEAEISTTNPVATEQYGCVCSWGEHNQEGFNSDQL

SEQ ID NO: 159728 - protein, 37 aa, Artificial Sequence
  Description of Artificial Sequence: Synthetic polypeptide
DECEICTTNPVATEQYGVVSTTNQQQQNNQQGTNATE

SEQ ID NO: 159729 - protein, 36 aa, Artificial Sequence
  Description of Artificial Sequence: Synthetic polypeptide
DEEEIRTTNPCATEQYGSVIEPPNQHQQITGVGPTP

SEQ ID NO: 159730 - protein, 35 aa, Artificial Sequence
  Description of Artificial Sequence: Synthetic polypeptide
DEEEIRTTNPVATEQWGSTWATTPAGPAMRNGPYV

SEQ ID NO: 159731 - protein, 36 aa, Artificial Sequence
  Description of Artificial Sequence: Synthetic polypeptide
DENEIRTTNPVATEQYGSVIYAVWLETEQNMMNQQE

SEQ ID NO: 159732 - protein, 37 aa, Artificial Sequence
  Description of Artificial Sequence: Synthetic polypeptide
AEEEIRTTNPVATEQYGSVVVTVTTNGNNQEQGETED

SEQ ID NO: 159733 - protein, 36 aa, Artificial Sequence
  Description of Artificial Sequence: Synthetic polypeptide
DENEIRTTNPVATEQYGSVIYAVLTETEGNMMNQQE

SEQ ID NO: 159734 - protein, 36 aa, Artificial Sequence
  Description of Artificial Sequence: Synthetic polypeptide
DENEIRTTNPVATEQYGSVIYAVDLETEGNMMGQQE

SEQ ID NO: 159735 - protein, 34 aa, Artificial Sequence
  Description of Artificial Sequence: Synthetic polypeptide
DEQEIATTNPVAYEQYGSVCAAANGLQDSEVDDD

SEQ ID NO: 159736 - protein, 36 aa, Artificial Sequence
  Description of Artificial Sequence: Synthetic polypeptide
DEEEIRTTNPVATEQWGSTWATTPAGPAMRNGMNYV

SEQ ID NO: 159737 - protein, 32 aa, Artificial Sequence
  Description of Artificial Sequence: Synthetic polypeptide
DDSEIASTNPVSTEGYGSVACINEQSRVGEQG

SEQ ID NO: 159738 - protein, 39 aa, Artificial Sequence
  Description of Artificial Sequence: Synthetic polypeptide
DEEEIRTTNPVATEQYGVVSTVVTNQQQGTEQGTENEEQ

SEQ ID NO: 159739 - protein, 31 aa, Artificial Sequence
  Description of Artificial Sequence: Synthetic polypeptide
DENEIRTTNPVATEWWGDVSEGIEMNAAEDA

SEQ ID NO: 159740 - protein, 34 aa, Artificial Sequence
  Description of Artificial Sequence: Synthetic polypeptide
NEEEIRTTNPVATEQYGCSCSWGEDHQYFQSDQA

SEQ ID NO: 159741 - protein, 35 aa, Artificial Sequence
  Description of Artificial Sequence: Synthetic polypeptide
DENEIRTTNPVATEQYGSVIYQTDEEDSTPSIERP

SEQ ID NO: 159742 - protein, 35 aa, Artificial Sequence
  Description of Artificial Sequence: Synthetic polypeptide
DENEIRTTNPVATEQYGSVISPAMGEEQLEMPEVG

SEQ ID NO: 159743 - protein, 28 aa, Artificial Sequence
  Description of Artificial Sequence: Synthetic peptide
QESDIASTNPVGTEGYGVMASVLQHGDI

SEQ ID NO: 159744 - protein, 36 aa, Artificial Sequence
  Description of Artificial Sequence: Synthetic polypeptide
DEVEIRTTNPVATEQYGSVGDGINDDEGEGEGNNIN

SEQ ID NO: 159745 - protein, 36 aa, Artificial Sequence
  Description of Artificial Sequence: Synthetic polypeptide
DENEIRTTNPVATEQYGSVNYAVWLETLGNMMNQQE

SEQ ID NO: 159746 - protein, 33 aa, Artificial Sequence
  Description of Artificial Sequence: Synthetic polypeptide
DDSEVRTTNPVATEGWGNVSANTEPQSRVGEQG

SEQ ID NO: 159747 - protein, 35 aa, Artificial Sequence
  Description of Artificial Sequence: Synthetic polypeptide
NEEEIRTTNPVATEQYGCVCSNSGNHDEFFGSDQA

SEQ ID NO: 159748 - protein, 35 aa, Artificial Sequence
  Description of Artificial Sequence: Synthetic polypeptide
DENEIRTTNPVATEQYGSVNTWNMGVTESSEEHTQ

SEQ ID NO: 159749 - protein, 35 aa, Artificial Sequence
  Description of Artificial Sequence: Synthetic polypeptide
DECEICTTNPVATTQYGVVATNLQLQQGTESGSTD

SEQ ID NO: 159750 - protein, 31 aa, Artificial Sequence
  Description of Artificial Sequence: Synthetic polypeptide
DLSEVASTNPVSTEGYGNVAANTIQSRVGQR

SEQ ID NO: 159751 - protein, 38 aa, Artificial Sequence
  Description of Artificial Sequence: Synthetic polypeptide
AEEEIRTTNPVATEQYGSVVVTVTTNLGGTEQGSVTNQ

SEQ ID NO: 159752 - protein, 35 aa, Artificial Sequence
  Description of Artificial Sequence: Synthetic polypeptide
DEAEIRTTNPVATEQYGSCNETLNVHQQEIQESDQ

SEQ ID NO: 159753 - protein, 35 aa, Artificial Sequence
  Description of Artificial Sequence: Synthetic polypeptide
DEAEICTTNPVAYEQWGEVVPTDNLDDQMGNKGEG

SEQ ID NO: 159754 - protein, 37 aa, Artificial Sequence
  Description of Artificial Sequence: Synthetic polypeptide
DEEEIRTTNPCATEQYGSVIEPTGNQHQQITEVNPTP

SEQ ID NO: 159755 - protein, 34 aa, Artificial Sequence
  Description of Artificial Sequence: Synthetic polypeptide
DEAEISTTNPVATEQYGCVCSWGEHEGFGSENQA

SEQ ID NO: 159756 - protein, 35 aa, Artificial Sequence
  Description of Artificial Sequence: Synthetic polypeptide
DENEIRTTNPVATEQYGSVNNNAPPYEVTHGVSEQ

SEQ ID NO: 159757 - protein, 34 aa, Artificial Sequence
  Description of Artificial Sequence: Synthetic polypeptide
DDEEIRTTNPCATEHYGCVCSWELNQNFNSQTQS

SEQ ID NO: 159758 - protein, 35 aa, Artificial Sequence
  Description of Artificial Sequence: Synthetic polypeptide
DENEIRTTNPVATEQYGSVMYINELTNTITESSQT

SEQ ID NO: 159759 - protein, 37 aa, Artificial Sequence
  Description of Artificial Sequence: Synthetic polypeptide
DECEICTTNPVATEQYGVVSTTVNLQQQQNIGTEEAE

SEQ ID NO: 159760 - protein, 37 aa, Artificial Sequence
  Description of Artificial Sequence: Synthetic polypeptide
DEEEIRTTNPVATEQYGSVGCEPTNNETPFGQGELQV

SEQ ID NO: 159761 - protein, 29 aa, Artificial Sequence
  Description of Artificial Sequence: Synthetic peptide
QESDIASTNPVGTEGYGVMASTLQMHGDI

SEQ ID NO: 159762 - protein, 36 aa, Artificial Sequence
  Description of Artificial Sequence: Synthetic polypeptide
DEAEIRTTNPVATEQYGSCIYADDTYWEQQSGQDRV

SEQ ID NO: 159763 - protein, 31 aa, Artificial Sequence
  Description of Artificial Sequence: Synthetic polypeptide
DDSEVASTNPVSTEGYGNVAANTIQSRVGGR

SEQ ID NO: 159764 - protein, 36 aa, Artificial Sequence
  Description of Artificial Sequence: Synthetic polypeptide
DEAEIRTTNPVATEQYGSCEVWHPALQDTRPEESQF

SEQ ID NO: 159765 - protein, 37 aa, Artificial Sequence
  Description of Artificial Sequence: Synthetic polypeptide
DECEICTTNPVATEQYGVVSTTTNQQQGNQQGTTDDE

SEQ ID NO: 159766 - protein, 34 aa, Artificial Sequence
  Description of Artificial Sequence: Synthetic polypeptide
DEAEISTTNPVATEQYGCVCSWGEDQENFNSNQS

SEQ ID NO: 159767 - protein, 35 aa, Artificial Sequence
  Description of Artificial Sequence: Synthetic polypeptide
DEAEIRTTNPVATEQYGSCNETLNVDQQEIQEMDI

SEQ ID NO: 159768 - protein, 37 aa, Artificial Sequence
  Description of Artificial Sequence: Synthetic polypeptide
DENEIRTTNPVATEQYGSVPSDNLVSSEGAEGGFESI

SEQ ID NO: 159769 - protein, 34 aa, Artificial Sequence
  Description of Artificial Sequence: Synthetic polypeptide
DEAEICTTNPVAYEQWGTVVPTDNDDQQNGGDGR

SEQ ID NO: 159770 - protein, 36 aa, Artificial Sequence
  Description of Artificial Sequence: Synthetic polypeptide
DEVEIRTTNPVATEQYGSVDDGGNNDEGEGELNNIT

SEQ ID NO: 159771 - protein, 38 aa, Artificial Sequence
  Description of Artificial Sequence: Synthetic polypeptide
DEEEIRTTNPVATEQYGVVSTVNTNNQNNQQGEEDEED

SEQ ID NO: 159772 - protein, 36 aa, Artificial Sequence
  Description of Artificial Sequence: Synthetic polypeptide
DENEIRTTNPVATEQYGSVFSVSIKAQEFRAPHIDN

SEQ ID NO: 159773 - protein, 31 aa, Artificial Sequence
  Description of Artificial Sequence: Synthetic polypeptide
DENEIRTTNPVATEWWGDVSEIFEMNAAEDA

SEQ ID NO: 159774 - protein, 32 aa, Artificial Sequence
  Description of Artificial Sequence: Synthetic polypeptide
DDSEIASTNPVSTEGYGSVANINEQSRVGEQG

SEQ ID NO: 159775 - protein, 34 aa, Artificial Sequence
  Description of Artificial Sequence: Synthetic polypeptide
DEEEISTTNPVAYEQYGCVCSNWGEHQHFGSQQS

SEQ ID NO: 159776 - protein, 36 aa, Artificial Sequence
  Description of Artificial Sequence: Synthetic polypeptide
DEEEIRTTNPVATEQYGDVGCPTPLVWEQQLVMEHV

SEQ ID NO: 159777 - protein, 36 aa, Artificial Sequence
  Description of Artificial Sequence: Synthetic polypeptide
DEEEIRTTNPVATEQYGDVGCPTPLVWEQQLVTEEY

SEQ ID NO: 159778 - protein, 39 aa, Artificial Sequence
  Description of Artificial Sequence: Synthetic polypeptide
DEEEIRTTNPVATEQYGVVSTVNTNNLGQEQGTTEQGSD

SEQ ID NO: 159779 - protein, 36 aa, Artificial Sequence
  Description of Artificial Sequence: Synthetic polypeptide
DEEEIRTTNPVATEQYGDVGNNVDTVGELGPGGQGE

SEQ ID NO: 159780 - protein, 32 aa, Artificial Sequence
  Description of Artificial Sequence: Synthetic polypeptide
DDSEIASTNPVSTEGYGSVANINIQSRVGEQG

SEQ ID NO: 159781 - protein, 36 aa, Artificial Sequence
  Description of Artificial Sequence: Synthetic polypeptide
DEEEIRTTNPVATEQYGDVGCPTPLVWEMNQLVTEH

SEQ ID NO: 159782 - protein, 36 aa, Artificial Sequence
  Description of Artificial Sequence: Synthetic polypeptide
QEEEIRTTNPVATEQYGAVVDVNMNIIQTGNGNPGE

SEQ ID NO: 159783 - protein, 36 aa, Artificial Sequence
  Description of Artificial Sequence: Synthetic polypeptide
CEEEIRTTNPVATEQYGQCVCSTEEDQEYFGSETQS

SEQ ID NO: 159784 - protein, 36 aa, Artificial Sequence
  Description of Artificial Sequence: Synthetic polypeptide
DEEEIRTTNPVATEQYGDVICPTPLRVIEQQLVTEH

SEQ ID NO: 159785 - protein, 31 aa, Artificial Sequence
  Description of Artificial Sequence: Synthetic polypeptide
DENEIRTTNPVATEYWGDVSEIKEMNAAEDA

SEQ ID NO: 159786 - protein, 31 aa, Artificial Sequence
  Description of Artificial Sequence: Synthetic polypeptide
DENEIRTTNPVATEYWGDVSHIEGMNAAEDA

SEQ ID NO: 159787 - protein, 37 aa, Artificial Sequence
  Description of Artificial Sequence: Synthetic polypeptide
DENEIRTTNPVATEQYGSVFSPAASAPEQRAGSSQEE

SEQ ID NO: 159788 - protein, 34 aa, Artificial Sequence
  Description of Artificial Sequence: Synthetic polypeptide
DDEEIRTTNPCATEHYGCVCSWMELNQNFNSNQS

SEQ ID NO: 159789 - protein, 35 aa, Artificial Sequence
  Description of Artificial Sequence: Synthetic polypeptide
AEDEICATNPVATEQYGVVATSNQNLNQLGNGNDD

SEQ ID NO: 159790 - protein, 36 aa, Artificial Sequence
  Description of Artificial Sequence: Synthetic polypeptide
DAEEIATTNPVATEQYGSVCAMNNGVLPEADMGNDQ

SEQ ID NO: 159791 - protein, 39 aa, Artificial Sequence
  Description of Artificial Sequence: Synthetic polypeptide
DEEEIRTTNPVATEQYGVVSTTVNNNLQQGTEQGSTVVD

SEQ ID NO: 159792 - protein, 32 aa, Artificial Sequence
  Description of Artificial Sequence: Synthetic polypeptide
DMNEIRTTNPVSTEPYGTISMEDIQQQQGGNH

SEQ ID NO: 159793 - protein, 34 aa, Artificial Sequence
  Description of Artificial Sequence: Synthetic polypeptide
DDSEIASTNPVSTEGYGSVSACINIPQSRVGEQR

SEQ ID NO: 159794 - protein, 37 aa, Artificial Sequence
  Description of Artificial Sequence: Synthetic polypeptide
DEEEIRTTNPVATEQYGSVQDNTNMTNEMGGGEDEQL

SEQ ID NO: 159795 - protein, 31 aa, Artificial Sequence
  Description of Artificial Sequence: Synthetic polypeptide
DDSEVASTNPVSTEGYGNVAANTIQSRVGLR

SEQ ID NO: 159796 - protein, 36 aa, Artificial Sequence
  Description of Artificial Sequence: Synthetic polypeptide
SEEEIRTTNPVATEQYGCVCSTGNHDAENFGSDTQS

SEQ ID NO: 159797 - protein, 31 aa, Artificial Sequence
  Description of Artificial Sequence: Synthetic polypeptide
DDSEVASTNPVSTEGYGNVAANTIQSRVGHR

SEQ ID NO: 159798 - protein, 36 aa, Artificial Sequence
  Description of Artificial Sequence: Synthetic polypeptide
NEEEIRTTNPVATEQYGCSCSTTGEHNQEHFQSDQA

SEQ ID NO: 159799 - protein, 35 aa, Artificial Sequence
  Description of Artificial Sequence: Synthetic polypeptide
SEEEIRTTNPVATEQYGCVCSWGEHNAHFNSDNQA

SEQ ID NO: 159800 - protein, 34 aa, Artificial Sequence
  Description of Artificial Sequence: Synthetic polypeptide
DEQEIATTNPVAYEQYGSVATHGQQAVPGDSVDG

SEQ ID NO: 159801 - protein, 35 aa, Artificial Sequence
  Description of Artificial Sequence: Synthetic polypeptide
DEMEICTTNPVATEQYGAVCSATDGDTVEFEGDNK

SEQ ID NO: 159802 - protein, 36 aa, Artificial Sequence
  Description of Artificial Sequence: Synthetic polypeptide
SEEEIRTTNPVATEQYGCVCSWGEDHDQNFGSNTQA

SEQ ID NO: 159803 - protein, 36 aa, Artificial Sequence
  Description of Artificial Sequence: Synthetic polypeptide
DEEEIRTTNPVATEQYGDCVGDNGDLEDDEGQTEQG

SEQ ID NO: 159804 - protein, 35 aa, Artificial Sequence
  Description of Artificial Sequence: Synthetic polypeptide
DENEIATTNPVATEPYGSVSGPNPEQAHQDGTVME

SEQ ID NO: 159805 - protein, 34 aa, Artificial Sequence
  Description of Artificial Sequence: Synthetic polypeptide
DEAEICTTNPVAYEQWGVCSTNDGQHHGGGGTNS

SEQ ID NO: 159806 - protein, 31 aa, Artificial Sequence
  Description of Artificial Sequence: Synthetic polypeptide
DENEIATTNPVATEPYGTAPMEDIQQQNGEH

SEQ ID NO: 159807 - protein, 37 aa, Artificial Sequence
  Description of Artificial Sequence: Synthetic polypeptide
DEEEIRTTNPVATEQYGDVFGNNMNANIQGGGNDGDD

SEQ ID NO: 159808 - protein, 36 aa, Artificial Sequence
  Description of Artificial Sequence: Synthetic polypeptide
DEEEIRTTNPVATEQYGSVSPIMMDDMWRQLPEQVE

SEQ ID NO: 159809 - protein, 36 aa, Artificial Sequence
  Description of Artificial Sequence: Synthetic polypeptide
DEEEIRTTNPVATEQYGSVQEAGEEQIENTEEQNIM

SEQ ID NO: 159810 - protein, 38 aa, Artificial Sequence
  Description of Artificial Sequence: Synthetic polypeptide
DEEEIRTTNPVATEQYGVVSTVNTNQQQGTEQGTTEDE

SEQ ID NO: 159811 - protein, 35 aa, Artificial Sequence
  Description of Artificial Sequence: Synthetic polypeptide
SEEEIRTTNPVATEQYGCVCSTMEHDQYFISDTQS

SEQ ID NO: 159812 - protein, 33 aa, Artificial Sequence
  Description of Artificial Sequence: Synthetic polypeptide
DEAEICTTNPVAYEQWGVCSTNDQQHNGGGGTN

SEQ ID NO: 159813 - protein, 36 aa, Artificial Sequence
  Description of Artificial Sequence: Synthetic polypeptide
DEEEIRTTNPVATEQYGDVCTHITQSEQTQAIMNEV

SEQ ID NO: 159814 - protein, 37 aa, Artificial Sequence
  Description of Artificial Sequence: Synthetic polypeptide
DEEEIRTTNPVATEQWGSTVSANAEAWPNMRNGMPYI

SEQ ID NO: 159815 - protein, 39 aa, Artificial Sequence
  Description of Artificial Sequence: Synthetic polypeptide
DEEEIRTTNPVATEQYGVVSTVNTNQLQQNQNGTEQGSE

SEQ ID NO: 159816 - protein, 36 aa, Artificial Sequence
  Description of Artificial Sequence: Synthetic polypeptide
DEEEIRTTNPVATEQYGDVDEGVNMGTGGGGENVGT

SEQ ID NO: 159817 - protein, 36 aa, Artificial Sequence
  Description of Artificial Sequence: Synthetic polypeptide
DEEEIRTTNPVATEQYGDVDSGNNMDNGEGGEDDTG

SEQ ID NO: 159818 - protein, 35 aa, Artificial Sequence
  Description of Artificial Sequence: Synthetic polypeptide
NEEEIRTTNPVATEQYGCSCSSGELNQENFQSDQA

SEQ ID NO: 159819 - protein, 31 aa, Artificial Sequence
  Description of Artificial Sequence: Synthetic polypeptide
DDSEVASTNPVSTEGYGNVAANTIQSRVGIR

SEQ ID NO: 159820 - protein, 33 aa, Artificial Sequence
  Description of Artificial Sequence: Synthetic polypeptide
DDSEVRTTNPVATEGWGNVSANNEPQSRVGEQG

SEQ ID NO: 159821 - protein, 35 aa, Artificial Sequence
  Description of Artificial Sequence: Synthetic polypeptide
NEEEIRTTNPVATEQYGCVCSSENHNDEFFGSDQS

SEQ ID NO: 159822 - protein, 37 aa, Artificial Sequence
  Description of Artificial Sequence: Synthetic polypeptide
DENEIRTTNPVATEQYGSVPSDWLASLEGNGGFESIS

SEQ ID NO: 159823 - protein, 35 aa, Artificial Sequence
  Description of Artificial Sequence: Synthetic polypeptide
DEAEISTTNPVATEQYGCVCSWEEHQEYFGSDNQS

SEQ ID NO: 159824 - protein, 34 aa, Artificial Sequence
  Description of Artificial Sequence: Synthetic polypeptide
DDEEIRTTNPCATEHYGCVCSTWEHNQNFNSDQS

SEQ ID NO: 159825 - protein, 36 aa, Artificial Sequence
  Description of Artificial Sequence: Synthetic polypeptide
DEAEIRTTNPVATEQYGSFCETPNHDEGPETNDPEV

SEQ ID NO: 159826 - protein, 35 aa, Artificial Sequence
  Description of Artificial Sequence: Synthetic polypeptide
SEEEIRTTNPVATEQYGQCVCGTAHNQENFGSDQA

SEQ ID NO: 159827 - protein, 36 aa, Artificial Sequence
  Description of Artificial Sequence: Synthetic polypeptide
DEAEIRTTNPVATEQYGSDCTPTVGWNEDREEQNQV

SEQ ID NO: 159828 - protein, 34 aa, Artificial Sequence
  Description of Artificial Sequence: Synthetic polypeptide
DEAEISTTNPVATEQYGCVCSWEHNAYFGSDPQA

SEQ ID NO: 159829 - protein, 38 aa, Artificial Sequence
  Description of Artificial Sequence: Synthetic polypeptide
DEAEIRTTNPVATEQYGSCYVGSGIMLEELRNGNEEVF

SEQ ID NO: 159830 - protein, 28 aa, Artificial Sequence
  Description of Artificial Sequence: Synthetic peptide
QESAIASTNPVGTEGYGVMALTLQHGDI

SEQ ID NO: 159831 - protein, 28 aa, Artificial Sequence
  Description of Artificial Sequence: Synthetic peptide
QESAIASTNPVGTEGYGVMASMLQHGDI

SEQ ID NO: 159832 - protein, 34 aa, Artificial Sequence
  Description of Artificial Sequence: Synthetic polypeptide
DEEEIRTTNPCAYEQWGSVCYNIEEVGDGLQGES

SEQ ID NO: 159833 - protein, 34 aa, Artificial Sequence
  Description of Artificial Sequence: Synthetic polypeptide
DEAEIRTTNPVATEQYGSFLTWLMESTESIEDQM

SEQ ID NO: 159834 - protein, 37 aa, Artificial Sequence
  Description of Artificial Sequence: Synthetic polypeptide
DECEICTTNPVATEQYGVVSVTVVNTQQGNNQEDEDD

SEQ ID NO: 159835 - protein, 37 aa, Artificial Sequence
  Description of Artificial Sequence: Synthetic polypeptide
DEAEIRTTNPVATEQYGSCVSSGIMLEELFNGNEEVF

SEQ ID NO: 159836 - protein, 36 aa, Artificial Sequence
  Description of Artificial Sequence: Synthetic polypeptide
CEEEIRTTNPVATEQYGQCVCSTGEHNQYFNSDTQA

SEQ ID NO: 159837 - protein, 37 aa, Artificial Sequence
  Description of Artificial Sequence: Synthetic polypeptide
CEEEIRTTNPVATEQYGQCVCSTGEDNQENFGSENQS

SEQ ID NO: 159838 - protein, 32 aa, Artificial Sequence
  Description of Artificial Sequence: Synthetic polypeptide
QEQEIATTNPCSTEQYGSVSACDLEDSEGEDL

SEQ ID NO: 159839 - protein, 30 aa, Artificial Sequence
  Description of Artificial Sequence: Synthetic polypeptide
DDSEIASTNPVSTEGYGNVANTIQSRVEQR

SEQ ID NO: 159840 - protein, 36 aa, Artificial Sequence
  Description of Artificial Sequence: Synthetic polypeptide
DEEEIRTTNPVATEQWGSVSSTTPAEPNMAAEMDPA

SEQ ID NO: 159841 - protein, 36 aa, Artificial Sequence
  Description of Artificial Sequence: Synthetic polypeptide
DEAEIRTTNPVATEQYGSCTVSNSATYTGGMYSDNI

SEQ ID NO: 159842 - protein, 36 aa, Artificial Sequence
  Description of Artificial Sequence: Synthetic polypeptide
DEEEIACTNPVATEQYGSACATNPQLNPDDQTGGTM

SEQ ID NO: 159843 - protein, 29 aa, Artificial Sequence
  Description of Artificial Sequence: Synthetic peptide
QESAIASTNPVGTEGYGVMNASTLQHGDI

SEQ ID NO: 159844 - protein, 31 aa, Artificial Sequence
  Description of Artificial Sequence: Synthetic polypeptide
DGSEVASTNPVSTEGYGNVAANTIQSRVGQR

SEQ ID NO: 159845 - protein, 29 aa, Artificial Sequence
  Description of Artificial Sequence: Synthetic peptide
QESAIASTNPVGTEGYGVMASTLQHGDIV

SEQ ID NO: 159846 - protein, 33 aa, Artificial Sequence
  Description of Artificial Sequence: Synthetic polypeptide
DEAEISTTNPVATEQYGCVCSWEHQENFFSEQS

SEQ ID NO: 159847 - protein, 30 aa, Artificial Sequence
  Description of Artificial Sequence: Synthetic polypeptide
QEREIATTNPVATEQYGERACPEVCQHEEK

SEQ ID NO: 159848 - protein, 34 aa, Artificial Sequence
  Description of Artificial Sequence: Synthetic polypeptide
DEAEISTTNPVATEQYGCVCSWEDHNQNFNSDQS

SEQ ID NO: 159849 - protein, 36 aa, Artificial Sequence
  Description of Artificial Sequence: Synthetic polypeptide
DENEIRTTNPVATEQYGSVSDYDNANNQPQTEDDSP

SEQ ID NO: 159850 - protein, 36 aa, Artificial Sequence
  Description of Artificial Sequence: Synthetic polypeptide
DECEICTTNPVATEQYGVVSTVNANQQGDTEEEEDD

SEQ ID NO: 159851 - protein, 34 aa, Artificial Sequence
  Description of Artificial Sequence: Synthetic polypeptide
DEQEIATTNPVAYEQYGSVCATNNEADATLTGDM

SEQ ID NO: 159852 - protein, 32 aa, Artificial Sequence
  Description of Artificial Sequence: Synthetic polypeptide
DENEIRTTNPVATESWGDVSEIEMNAAELDAQ

SEQ ID NO: 159853 - protein, 37 aa, Artificial Sequence
  Description of Artificial Sequence: Synthetic polypeptide
DEEEIRTTNPVATEQYGCVTSTTPAHNIEHFGSDPVI

SEQ ID NO: 159854 - protein, 32 aa, Artificial Sequence
  Description of Artificial Sequence: Synthetic polypeptide
DDSEIASTNPVSTEGYGNVAATTLQSHVGEDR

SEQ ID NO: 159855 - protein, 33 aa, Artificial Sequence
  Description of Artificial Sequence: Synthetic polypeptide
DEQEIATTNPVAYEQYGSVCATNEAPDATLTGD

SEQ ID NO: 159856 - protein, 36 aa, Artificial Sequence
  Description of Artificial Sequence: Synthetic polypeptide
DECEICTTNPVATEQYGVVSTVNAEQGNTEENEDEE

SEQ ID NO: 159857 - protein, 38 aa, Artificial Sequence
  Description of Artificial Sequence: Synthetic polypeptide
DEAEIRTTNPVATEQYGSFVTSVPNGVLQTISPNEEHQ

SEQ ID NO: 159858 - protein, 34 aa, Artificial Sequence
  Description of Artificial Sequence: Synthetic polypeptide
DEEEIRTTNPCAYEQWGSVCYNIEENRAGIQGDS

SEQ ID NO: 159859 - protein, 39 aa, Artificial Sequence
  Description of Artificial Sequence: Synthetic polypeptide
DEEEIRTTNPVATEQYGVVSTVVVTNGNNQQGNTETGSE

SEQ ID NO: 159860 - protein, 30 aa, Artificial Sequence
  Description of Artificial Sequence: Synthetic polypeptide
QEREIACTNPCSYEQYGCVSWNHQSFGSQQ

SEQ ID NO: 159861 - protein, 36 aa, Artificial Sequence
  Description of Artificial Sequence: Synthetic polypeptide
DENEIRTTNPVATESYGSVMSDQNDTDQTGGQTGQT

SEQ ID NO: 159862 - protein, 36 aa, Artificial Sequence
  Description of Artificial Sequence: Synthetic polypeptide
DECEICTTNPVATEQYGVVSTVNAEQGNTEEGEDDT

SEQ ID NO: 159863 - protein, 38 aa, Artificial Sequence
  Description of Artificial Sequence: Synthetic polypeptide
DEEEIRTTNPVATEQYGVVSTVVVTNGGTEQGTEQGQD

SEQ ID NO: 159864 - protein, 37 aa, Artificial Sequence
  Description of Artificial Sequence: Synthetic polypeptide
DEEEIRTTNPVATEQYGCVTSTWGADNAEHFQSDPQS

SEQ ID NO: 159865 - protein, 37 aa, Artificial Sequence
  Description of Artificial Sequence: Synthetic polypeptide
DEAEIRTTNPVATEQYGSFVCTPPCLVETGYMEDMND

SEQ ID NO: 159866 - protein, 35 aa, Artificial Sequence
  Description of Artificial Sequence: Synthetic polypeptide
DEDEIRTTNPVATTQYGVVSNGNVATEQYGSTEDE

SEQ ID NO: 159867 - protein, 33 aa, Artificial Sequence
  Description of Artificial Sequence: Synthetic polypeptide
DEMEICTTNPVATEQYGAVCSAWDGPVEFETNE

SEQ ID NO: 159868 - protein, 35 aa, Artificial Sequence
  Description of Artificial Sequence: Synthetic polypeptide
SEEEIRTTNPVATEQYGQCVCSTGEHNTNFNSEQN

SEQ ID NO: 159869 - protein, 36 aa, Artificial Sequence
  Description of Artificial Sequence: Synthetic polypeptide
DEEEIRTTNPVATEQYGSVFGQVIMEDEGGEDQQNV

SEQ ID NO: 159870 - protein, 36 aa, Artificial Sequence
  Description of Artificial Sequence: Synthetic polypeptide
DEAEIRTTNPVATEQYGSFSETPNHDENPETNDPLV

SEQ ID NO: 159871 - protein, 35 aa, Artificial Sequence
  Description of Artificial Sequence: Synthetic polypeptide
DEDEIRTTNPVATTQYGVVSNTQQGTEQYGSTEDE

SEQ ID NO: 159872 - protein, 35 aa, Artificial Sequence
  Description of Artificial Sequence: Synthetic polypeptide
DEAEIRTTNPVATEQYGSCTVSASATYTGSMYSDD

SEQ ID NO: 159873 - protein, 36 aa, Artificial Sequence
  Description of Artificial Sequence: Synthetic polypeptide
DEEEIRTTNPVATEQYGSVFGQFEDDEGGNVQENIE

SEQ ID NO: 159874 - protein, 35 aa, Artificial Sequence
  Description of Artificial Sequence: Synthetic polypeptide
SEEEIRTTNPVATEQYGMCGSVTGQTGQGGEQEGI

SEQ ID NO: 159875 - protein, 28 aa, Artificial Sequence
  Description of Artificial Sequence: Synthetic peptide
QESCIASTNPVGWEGYGVMASTLQHGDI

SEQ ID NO: 159876 - protein, 37 aa, Artificial Sequence
  Description of Artificial Sequence: Synthetic polypeptide
DEEEIRTTNPVATEQYGSVFGNFEDDEGGNEQEQEIV

SEQ ID NO: 159877 - protein, 35 aa, Artificial Sequence
  Description of Artificial Sequence: Synthetic polypeptide
NEEEIRTTNPVATEQYGCVCSWGEHNIEFFGSDQS

SEQ ID NO: 159878 - protein, 37 aa, Artificial Sequence
  Description of Artificial Sequence: Synthetic polypeptide
DEEEIRTTNPVATEQYGCVTSTWPADNTENFGSDPVQ

SEQ ID NO: 159879 - protein, 35 aa, Artificial Sequence
  Description of Artificial Sequence: Synthetic polypeptide
NEEEIRTTNPVATEQYGCVCSWGAHDEFFGSDNQA

SEQ ID NO: 159880 - protein, 31 aa, Artificial Sequence
  Description of Artificial Sequence: Synthetic polypeptide
DISEVASTNPVSTEGYGNVAANTIQSRVGQR

SEQ ID NO: 159881 - protein, 37 aa, Artificial Sequence
  Description of Artificial Sequence: Synthetic polypeptide
DEEEIRTTNPVATEQYGCVTSTWPAHNAEHFNSDNQS

SEQ ID NO: 159882 - protein, 34 aa, Artificial Sequence
  Description of Artificial Sequence: Synthetic polypeptide
DEAEICTTNPVAYEQWGCVYNTPDNHQGQHGNGP

SEQ ID NO: 159883 - protein, 32 aa, Artificial Sequence
  Description of Artificial Sequence: Synthetic polypeptide
QEQEIATTNPCSTEQYGSVSACDLEDHEGTDL

SEQ ID NO: 159884 - protein, 34 aa, Artificial Sequence
  Description of Artificial Sequence: Synthetic polypeptide
SEEEIRTTNPVATEQYGCYSTSVDEANMENEESI

SEQ ID NO: 159885 - protein, 35 aa, Artificial Sequence
  Description of Artificial Sequence: Synthetic polypeptide
NEEEIRTTNPVATEQYGCVCSWGNHNDEFFGSDAA

SEQ ID NO: 159886 - protein, 32 aa, Artificial Sequence
  Description of Artificial Sequence: Synthetic polypeptide
QEQEIATTNPCSTEQYGSVSACDLEDHEGEDL

SEQ ID NO: 159887 - protein, 31 aa, Artificial Sequence
  Description of Artificial Sequence: Synthetic polypeptide
DDSEIASTNPVSTEGYGNVSAECLQSRVEQL

SEQ ID NO: 159888 - protein, 37 aa, Artificial Sequence
  Description of Artificial Sequence: Synthetic polypeptide
DECEICTTNPVATEQYGVVSTTVNQQQGNQQGNNEDE

SEQ ID NO: 159889 - protein, 35 aa, Artificial Sequence
  Description of Artificial Sequence: Synthetic polypeptide
DEDEIRTTNPVAYEQWGSVSWAPNGNAGGAGGNET

SEQ ID NO: 159890 - protein, 34 aa, Artificial Sequence
  Description of Artificial Sequence: Synthetic polypeptide
DEAEICTTNPVAYEQWGEVCSTDNGNEQIGGSEQ

SEQ ID NO: 159891 - protein, 38 aa, Artificial Sequence
  Description of Artificial Sequence: Synthetic polypeptide
DEDEIRTTNPVATTQYGSVSTTQLQQLQQGTNNVATEN

SEQ ID NO: 159892 - protein, 31 aa, Artificial Sequence
  Description of Artificial Sequence: Synthetic polypeptide
DDSEIASTNPVSTEGYGNVSANCIQSRVEQL

SEQ ID NO: 159893 - protein, 37 aa, Artificial Sequence
  Description of Artificial Sequence: Synthetic polypeptide
DENEIRTTNPVATEQYGSVPSDWNASLEGEGGFESIM

SEQ ID NO: 159894 - protein, 36 aa, Artificial Sequence
  Description of Artificial Sequence: Synthetic polypeptide
DEEEIRTTNPVATEQWGSVSSTTPAGPNMAAEMDPA

SEQ ID NO: 159895 - protein, 37 aa, Artificial Sequence
  Description of Artificial Sequence: Synthetic polypeptide
DEEEIRTTNPCATEQYGSVIEPTMTQHQQITGVNPTP

SEQ ID NO: 159896 - protein, 33 aa, Artificial Sequence
  Description of Artificial Sequence: Synthetic polypeptide
DDEEIRTTNPCATEHYGCVCSWEHNQNFNSDTQ

SEQ ID NO: 159897 - protein, 38 aa, Artificial Sequence
  Description of Artificial Sequence: Synthetic polypeptide
DEEEIRTTNPVATEQYGSIVNGTEELDDMTGSNEGWQI

SEQ ID NO: 159898 - protein, 35 aa, Artificial Sequence
  Description of Artificial Sequence: Synthetic polypeptide
DEDEIRTTNPVATTQYGVVATNVATNEQYGSTEDE

SEQ ID NO: 159899 - protein, 32 aa, Artificial Sequence
  Description of Artificial Sequence: Synthetic polypeptide
CENEIATTNPVAYEPYGKVASNHLSQHETENL

SEQ ID NO: 159900 - protein, 35 aa, Artificial Sequence
  Description of Artificial Sequence: Synthetic polypeptide
DEQEICTTNPVATEFYGSVSATGDGEDQGIGEDGD

SEQ ID NO: 159901 - protein, 36 aa, Artificial Sequence
  Description of Artificial Sequence: Synthetic polypeptide
DEAEIRTTNPVATEQYGSCSSTDTGPDTGSSNDLEY

SEQ ID NO: 159902 - protein, 33 aa, Artificial Sequence
  Description of Artificial Sequence: Synthetic polypeptide
DEAEISTTNPVATEQYGCVCSWGEDAYFGSDQS

SEQ ID NO: 159903 - protein, 37 aa, Artificial Sequence
  Description of Artificial Sequence: Synthetic polypeptide
DEEEIRTTNPVATEQYGCVTSTWGATNAEHFGSQPVA

SEQ ID NO: 159904 - protein, 31 aa, Artificial Sequence
  Description of Artificial Sequence: Synthetic polypeptide
DDSEVASTNPVSTEGYGNVAANTIQSRVGFR

SEQ ID NO: 159905 - protein, 36 aa, Artificial Sequence
  Description of Artificial Sequence: Synthetic polypeptide
QEEEIRTTNPVATEQYGDVDTGIQNDEGDTGNGNDE

SEQ ID NO: 159906 - protein, 36 aa, Artificial Sequence
  Description of Artificial Sequence: Synthetic polypeptide
DEEEIACTNPVATEQYGSACATNPLEAEAEIGNDNE

SEQ ID NO: 159907 - protein, 37 aa, Artificial Sequence
  Description of Artificial Sequence: Synthetic polypeptide
DEEEIRTTNPVATECYGSVGDMEDNVDQGGNEDDEEG

SEQ ID NO: 159908 - protein, 37 aa, Artificial Sequence
  Description of Artificial Sequence: Synthetic polypeptide
DEEEIRTTNPVATEQYGCVTSTWPADNAEGFGSDPQM

SEQ ID NO: 159909 - protein, 37 aa, Artificial Sequence
  Description of Artificial Sequence: Synthetic polypeptide
DEEEIRTTNPVATEQYGCVTSTWPADNAENFGSDTVP

SEQ ID NO: 159910 - protein, 36 aa, Artificial Sequence
  Description of Artificial Sequence: Synthetic polypeptide
DEEEIRTTNPVATEQWGSVSSTTPAEPNNAAEMDPA

SEQ ID NO: 159911 - protein, 35 aa, Artificial Sequence
  Description of Artificial Sequence: Synthetic polypeptide
AEDEICATNPVATEQYGVVATSQQNNNLQLGGNDD

SEQ ID NO: 159912 - protein, 37 aa, Artificial Sequence
  Description of Artificial Sequence: Synthetic polypeptide
DEEEIRTTNPVATEQYGSVQCTTVGEELYEQIQTIET

SEQ ID NO: 159913 - protein, 36 aa, Artificial Sequence
  Description of Artificial Sequence: Synthetic polypeptide
DAEEIATTNPVATEQYGSVCAMTDDIPQDNPGENDN

SEQ ID NO: 159914 - protein, 31 aa, Artificial Sequence
  Description of Artificial Sequence: Synthetic polypeptide
DHSEVASTNPVSTEGYGNVAANTIQSRVGQR

SEQ ID NO: 159915 - protein, 29 aa, Artificial Sequence
  Description of Artificial Sequence: Synthetic peptide
QESCIASTNPVGTEGYGVMASTLQHGDAI

SEQ ID NO: 159916 - protein, 35 aa, Artificial Sequence
  Description of Artificial Sequence: Synthetic polypeptide
DEDEIRTTNPVATTQYGVVATTNNTTEEIGTNNQQ

SEQ ID NO: 159917 - protein, 37 aa, Artificial Sequence
  Description of Artificial Sequence: Synthetic polypeptide
DEEEIRTTNPVATEQYGCVTSTWPADNAEYFGSETVA

SEQ ID NO: 159918 - protein, 34 aa, Artificial Sequence
  Description of Artificial Sequence: Synthetic polypeptide
DEDEIRTTNPVATTQYGVVATQYGTEQYGSVSDE

SEQ ID NO: 159919 - protein, 37 aa, Artificial Sequence
  Description of Artificial Sequence: Synthetic polypeptide
DEEEIRTTNPVATEQYGCVTSTWPADNIEHFGSQPQA

SEQ ID NO: 159920 - protein, 34 aa, Artificial Sequence
  Description of Artificial Sequence: Synthetic polypeptide
DEDEIRTTNPVATTQYGVVATQSGTEQYGSTQDD

SEQ ID NO: 159921 - protein, 37 aa, Artificial Sequence
  Description of Artificial Sequence: Synthetic polypeptide
AEEEIRTTNPVATEQYGSVVVVVTNNAEQGATDENNE

SEQ ID NO: 159922 - protein, 37 aa, Artificial Sequence
  Description of Artificial Sequence: Synthetic polypeptide
DEEEIRTTNPVATEQYGSVSPMWDNEMSGGQIEELQD

SEQ ID NO: 159923 - protein, 37 aa, Artificial Sequence
  Description of Artificial Sequence: Synthetic polypeptide
DEEEIRTTNPVATEQYGSVSPMVNMMHQESQPEEEVM

SEQ ID NO: 159924 - protein, 35 aa, Artificial Sequence
  Description of Artificial Sequence: Synthetic polypeptide
DEAEIRTTNPVATEQYGSIPWTPPLWENQHQSEFQ

SEQ ID NO: 159925 - protein, 39 aa, Artificial Sequence
  Description of Artificial Sequence: Synthetic polypeptide
DEEEIRTTNPVATEQYGVVSTVVTNQQQGTEAGTVNQEQ

SEQ ID NO: 159926 - protein, 35 aa, Artificial Sequence
  Description of Artificial Sequence: Synthetic polypeptide
DEEEIRTTNPVATEQYGSIVGWIGIPLDEWDEDMI

SEQ ID NO: 159927 - protein, 35 aa, Artificial Sequence
  Description of Artificial Sequence: Synthetic polypeptide
DEAEIRTTNPVATEQYGSIPWTPPSEENQHQQEHQ

SEQ ID NO: 159928 - protein, 38 aa, Artificial Sequence
  Description of Artificial Sequence: Synthetic polypeptide
DEVEIRTTNPVATEQYGSVYSDMDNNGGQGGEINNEEI

SEQ ID NO: 159929 - protein, 38 aa, Artificial Sequence
  Description of Artificial Sequence: Synthetic polypeptide
DEEEIRTTNPVATEQYGVVSTVVTTNNNQNQNNTEQGS

SEQ ID NO: 159930 - protein, 36 aa, Artificial Sequence
  Description of Artificial Sequence: Synthetic polypeptide
DENEIRTTNPVATEQYGSVVTTPHMHNEFQEVSFED

SEQ ID NO: 159931 - protein, 35 aa, Artificial Sequence
  Description of Artificial Sequence: Synthetic polypeptide
DEQEIATTNPVAYERWGSVSGGNGLEDRQNDMGND

SEQ ID NO: 159932 - protein, 35 aa, Artificial Sequence
  Description of Artificial Sequence: Synthetic polypeptide
DEVEIRTTNPVATEQYGSVYTVYSMETTQKTDVED

SEQ ID NO: 159933 - protein, 34 aa, Artificial Sequence
  Description of Artificial Sequence: Synthetic polypeptide
DEEEIACTNPVATEQYGSCAQGPPQPDAQAGGRT

SEQ ID NO: 159934 - protein, 36 aa, Artificial Sequence
  Description of Artificial Sequence: Synthetic polypeptide
DENEIRTTNPVATEQYGTVTTCWLPDEQENLQMDEI

SEQ ID NO: 159935 - protein, 37 aa, Artificial Sequence
  Description of Artificial Sequence: Synthetic polypeptide
DECEICTTNPVATEQYGVVSTVTDGTNDEQGEGNNDE

SEQ ID NO: 159936 - protein, 37 aa, Artificial Sequence
  Description of Artificial Sequence: Synthetic polypeptide
DEEEIRTTNPVATEQYGSVPSVYNGSEASIQMIELVQ

SEQ ID NO: 159937 - protein, 31 aa, Artificial Sequence
  Description of Artificial Sequence: Synthetic polypeptide
DDSEVASTNPVSTEGYGNVAANTIQSRGGQR

SEQ ID NO: 159938 - protein, 36 aa, Artificial Sequence
  Description of Artificial Sequence: Synthetic polypeptide
DEAEIRTTNPVATEQYGSSCPAVAGNAERELNMEMD

SEQ ID NO: 159939 - protein, 37 aa, Artificial Sequence
  Description of Artificial Sequence: Synthetic polypeptide
AEEEIRTTNPVATEQYGSVVVVNTTNNDESGTVNNTM

SEQ ID NO: 159940 - protein, 34 aa, Artificial Sequence
  Description of Artificial Sequence: Synthetic polypeptide
DEEEIACTNPVATEQYGSCAQGPLQPDAQAGGGE

SEQ ID NO: 159941 - protein, 31 aa, Artificial Sequence
  Description of Artificial Sequence: Synthetic polypeptide
DDSEVASTNPVSTEGYGNVAANTIQSRGVQR

SEQ ID NO: 159942 - protein, 33 aa, Artificial Sequence
  Description of Artificial Sequence: Synthetic polypeptide
DEEEIACTNPVATEQYGSCAPQGGDEGEEGGRE

SEQ ID NO: 159943 - protein, 34 aa, Artificial Sequence
  Description of Artificial Sequence: Synthetic polypeptide
DEQEIATTNPVAYERWGTVAPTNLQGNDAGGNEH

SEQ ID NO: 159944 - protein, 37 aa, Artificial Sequence
  Description of Artificial Sequence: Synthetic polypeptide
DENEIRTTNPVATEQYGSVVPTWNESPEFGIASNIMQ

SEQ ID NO: 159945 - protein, 36 aa, Artificial Sequence
  Description of Artificial Sequence: Synthetic polypeptide
DENEIRTTNPVATEQYGSVVNTDVVLMETFGSEQIF

SEQ ID NO: 159946 - protein, 30 aa, Artificial Sequence
  Description of Artificial Sequence: Synthetic polypeptide
DENEIATTNPVATECWGDTTAACLQEHEEL

SEQ ID NO: 159947 - protein, 37 aa, Artificial Sequence
  Description of Artificial Sequence: Synthetic polypeptide
AEEEIRTTNPVATEQYGSVVVVNTTNDESGTVNNTTV

SEQ ID NO: 159948 - protein, 30 aa, Artificial Sequence
  Description of Artificial Sequence: Synthetic polypeptide
DENEIATTNPVATECWGDTTAACLQEHEPL

SEQ ID NO: 159949 - protein, 36 aa, Artificial Sequence
  Description of Artificial Sequence: Synthetic polypeptide
DENEIRTTNPVATEQYGSVVFTPTMHNSRQEVSFED

SEQ ID NO: 159950 - protein, 35 aa, Artificial Sequence
  Description of Artificial Sequence: Synthetic polypeptide
DEVEIRTTNPVATEQYGTVVDVTGDTGEGGGENNE

SEQ ID NO: 159951 - protein, 36 aa, Artificial Sequence
  Description of Artificial Sequence: Synthetic polypeptide
DENEIRTTNPVATEQYGTVTTVWLDDEGENLQIDEM

SEQ ID NO: 159952 - protein, 37 aa, Artificial Sequence
  Description of Artificial Sequence: Synthetic polypeptide
AEEEIRTTNPVATEQYGSVVVVNVTNDESGTVNNSTT

SEQ ID NO: 159953 - protein, 36 aa, Artificial Sequence
  Description of Artificial Sequence: Synthetic polypeptide
DEAEIRTTNPVATEQYGSSCPAVAGNAETEGNQEMN

SEQ ID NO: 159954 - protein, 35 aa, Artificial Sequence
  Description of Artificial Sequence: Synthetic polypeptide
DEEEIACTNPVATEQYGSCATGNLTNPDDEMGTEV

SEQ ID NO: 159955 - protein, 34 aa, Artificial Sequence
  Description of Artificial Sequence: Synthetic polypeptide
DEEEIACTNPVATEQYGSCATGAAINDSGEEGMW

SEQ ID NO: 159956 - protein, 38 aa, Artificial Sequence
  Description of Artificial Sequence: Synthetic polypeptide
DEVEIRTTNPVATEQYGSVVGDTGLGENDQIGDNDEGQ

SEQ ID NO: 159957 - protein, 38 aa, Artificial Sequence
  Description of Artificial Sequence: Synthetic polypeptide
DEAEIRTTNPVATEQYGSSVICSGTMLEELMNGNEEVF

SEQ ID NO: 159958 - protein, 34 aa, Artificial Sequence
  Description of Artificial Sequence: Synthetic polypeptide
DEDEIRTTNPVAYEPWGSVSGEGNGNHGNGNNKN

SEQ ID NO: 159959 - protein, 34 aa, Artificial Sequence
  Description of Artificial Sequence: Synthetic polypeptide
DEQEIATTNPVAYERWGSVATGNMLGDAQGMNGE

SEQ ID NO: 159960 - protein, 36 aa, Artificial Sequence
  Description of Artificial Sequence: Synthetic polypeptide
DECEICTTNPVATEQYGVVSTVTNGNVEEGEGNTDQ

SEQ ID NO: 159961 - protein, 39 aa, Artificial Sequence
  Description of Artificial Sequence: Synthetic polypeptide
DEEEIRTTNPVATEQYGSVSVTVVNNQQSATEQGTTQGS

SEQ ID NO: 159962 - protein, 34 aa, Artificial Sequence
  Description of Artificial Sequence: Synthetic polypeptide
DDSEIASTNPVATEQYGTVCSANDGIVESFVGNR

SEQ ID NO: 159963 - protein, 36 aa, Artificial Sequence
  Description of Artificial Sequence: Synthetic polypeptide
DEEEIACTNPVATEQYGSCASGNPLFDNQMPEEGAE

SEQ ID NO: 159964 - protein, 36 aa, Artificial Sequence
  Description of Artificial Sequence: Synthetic polypeptide
DECEICTTNPVATEQYGVVSTVTNGGNVEEGEGNND

SEQ ID NO: 159965 - protein, 37 aa, Artificial Sequence
  Description of Artificial Sequence: Synthetic polypeptide
DENEIRTTNPVATEQYGSVWSFTPVMHNSRQEVSFSD

SEQ ID NO: 159966 - protein, 36 aa, Artificial Sequence
  Description of Artificial Sequence: Synthetic polypeptide
DEEEIACTNPVATEQYGSCASGNPLFDNQEPGEGVE

SEQ ID NO: 159967 - protein, 36 aa, Artificial Sequence
  Description of Artificial Sequence: Synthetic polypeptide
DECEICTTNPVATEQYGVVSTVTNGNNDEEGEGNDQ

SEQ ID NO: 159968 - protein, 31 aa, Artificial Sequence
  Description of Artificial Sequence: Synthetic polypeptide
QEQEIATTNPVATEQYGEAPAEVLQDHEEEK

SEQ ID NO: 159969 - protein, 34 aa, Artificial Sequence
  Description of Artificial Sequence: Synthetic polypeptide
DEDEIRTTNPVAYEKWGTVASGENNGNHGNGNHR

SEQ ID NO: 159970 - protein, 36 aa, Artificial Sequence
  Description of Artificial Sequence: Synthetic polypeptide
DENEIRTTNPVATEQYGSVWSDTVDAEVGEGGMQQQ

SEQ ID NO: 159971 - protein, 37 aa, Artificial Sequence
  Description of Artificial Sequence: Synthetic polypeptide
DEVEIRTTNPVATEQYGSVVQDVDNDEGQTDDEGNDQ

SEQ ID NO: 159972 - protein, 37 aa, Artificial Sequence
  Description of Artificial Sequence: Synthetic polypeptide
DEVEIRTTNPVATEQYGSVVTDNGNDEGQTDDEDNAF

SEQ ID NO: 159973 - protein, 37 aa, Artificial Sequence
  Description of Artificial Sequence: Synthetic polypeptide
DECEICTTNPVATEQYGVVSTVTNGNLEAGTTDNEDE

SEQ ID NO: 159974 - protein, 33 aa, Artificial Sequence
  Description of Artificial Sequence: Synthetic polypeptide
DEMEIKTTNPVATEQYGTVCVATSGPVEFEHND

SEQ ID NO: 159975 - protein, 31 aa, Artificial Sequence
  Description of Artificial Sequence: Synthetic polypeptide
DDSEVASTNPVSTEGYGNVAANTIQSRFGQR

SEQ ID NO: 159976 - protein, 36 aa, Artificial Sequence
  Description of Artificial Sequence: Synthetic polypeptide
DEVEIRTTNPVATEQYGSVVNNVGNMGEFTGQDGQG

SEQ ID NO: 159977 - protein, 37 aa, Artificial Sequence
  Description of Artificial Sequence: Synthetic polypeptide
DEVEIRTTNPVATEQYGSVVFDLDQDEGQTDDEDNDQ

SEQ ID NO: 159978 - protein, 35 aa, Artificial Sequence
  Description of Artificial Sequence: Synthetic polypeptide
DEEEIACTNPVATEQYGSCAATHGPLDSMHGDDRE

SEQ ID NO: 159979 - protein, 34 aa, Artificial Sequence
  Description of Artificial Sequence: Synthetic polypeptide
DEEEIACTNPVATEQYGSCAATHGPLDSMEGDGD

SEQ ID NO: 159980 - protein, 36 aa, Artificial Sequence
  Description of Artificial Sequence: Synthetic polypeptide
DEEEIRTTNPVATEQYGSVSVYNFSEASIEMVELSQ

SEQ ID NO: 159981 - protein, 37 aa, Artificial Sequence
  Description of Artificial Sequence: Synthetic polypeptide
CEEEIRTTNPVATEQYGSVISTTPDGPNMGNGEQDGD

SEQ ID NO: 159982 - protein, 32 aa, Artificial Sequence
  Description of Artificial Sequence: Synthetic polypeptide
DEVEIRTTNPVSTEPYGTISMEDIQQQQNFNH

SEQ ID NO: 159983 - protein, 36 aa, Artificial Sequence
  Description of Artificial Sequence: Synthetic polypeptide
DENEIRTTNPVATEQYGSVSWMYPELEHTFNTVQQM

SEQ ID NO: 159984 - protein, 34 aa, Artificial Sequence
  Description of Artificial Sequence: Synthetic polypeptide
DEEEIACTNPVATEQYGSCAAPNHQEAENQNEDE

SEQ ID NO: 159985 - protein, 34 aa, Artificial Sequence
  Description of Artificial Sequence: Synthetic polypeptide
DEEEIRTTNPCATESYGSTIALTVNQHENEQVVD

SEQ ID NO: 159986 - protein, 34 aa, Artificial Sequence
  Description of Artificial Sequence: Synthetic polypeptide
DEEEIACTNPVATEQYGSCAAPGNGPPENMGENN

SEQ ID NO: 159987 - protein, 38 aa, Artificial Sequence
  Description of Artificial Sequence: Synthetic polypeptide
DEEEIRTTNPVATEQYGVVSTVVTTNVTEQGNNTEETE

SEQ ID NO: 159988 - protein, 35 aa, Artificial Sequence
  Description of Artificial Sequence: Synthetic polypeptide
DENEIRTTNPVATEQYGSVSVWPHISTQEIWDDIV

SEQ ID NO: 159989 - protein, 38 aa, Artificial Sequence
  Description of Artificial Sequence: Synthetic polypeptide
DEEEIRTTNPCATEQYGVVSVVVVTNQEQLQQSTNVAE

SEQ ID NO: 159990 - protein, 36 aa, Artificial Sequence
  Description of Artificial Sequence: Synthetic polypeptide
DEEEIRTTNPVATEQYGSVSVYNFAEASIEMIEMVQ

SEQ ID NO: 159991 - protein, 38 aa, Artificial Sequence
  Description of Artificial Sequence: Synthetic polypeptide
DEEEIRTTNPCATEQYGVVSVVVVTNNQQLQQATNVAE

SEQ ID NO: 159992 - protein, 36 aa, Artificial Sequence
  Description of Artificial Sequence: Synthetic polypeptide
DEEEIRTTNPVATEQYGSITHTTLEDHNDEVGDEPQ

SEQ ID NO: 159993 - protein, 38 aa, Artificial Sequence
  Description of Artificial Sequence: Synthetic polypeptide
DEEEIRTTNPCATEQYGVVSVVVTNNNNQLQQATNVAE

SEQ ID NO: 159994 - protein, 37 aa, Artificial Sequence
  Description of Artificial Sequence: Synthetic polypeptide
AEEEIRTTNPVATEQYGSVSTTIGNNNNNQNDTEQGS

SEQ ID NO: 159995 - protein, 31 aa, Artificial Sequence
  Description of Artificial Sequence: Synthetic polypeptide
DDSEVASTNPVSTEGYGNVAANTIQSRLGQR

SEQ ID NO: 159996 - protein, 38 aa, Artificial Sequence
  Description of Artificial Sequence: Synthetic polypeptide
DEEEIRTTNPCATEQYGVVSTVVNNQAGTEQYGVNQQD

SEQ ID NO: 159997 - protein, 35 aa, Artificial Sequence
  Description of Artificial Sequence: Synthetic polypeptide
DEEEIACTNPVATEQYGSCAAGPPGAPGAQMGNRD

SEQ ID NO: 159998 - protein, 38 aa, Artificial Sequence
  Description of Artificial Sequence: Synthetic polypeptide
DEEEIRTTNPCATEQYGVVSTVVNAQQGTEQGGNNQDD

SEQ ID NO: 159999 - protein, 38 aa, Artificial Sequence
  Description of Artificial Sequence: Synthetic polypeptide
DEEEIRTTNPCATEQYGVVSTVVNAQAGTEQYGTNQDD

SEQ ID NO: 160000 - protein, 33 aa, Artificial Sequence
  Description of Artificial Sequence: Synthetic polypeptide
DEVEISTTNPVAYEQWGSVCSNWEHGEQDDHRR

SEQ ID NO: 160001 - protein, 36 aa, Artificial Sequence
  Description of Artificial Sequence: Synthetic polypeptide
DENEIRTTNPVATEQYGTVTTVWLPDENENLQIDFI

SEQ ID NO: 160002 - protein, 35 aa, Artificial Sequence
  Description of Artificial Sequence: Synthetic polypeptide
DEGEIRTTNPVATEQYGSVTYVLDILQAEVQDPSQ

SEQ ID NO: 160003 - protein, 36 aa, Artificial Sequence
  Description of Artificial Sequence: Synthetic polypeptide
DEVEIRTTNPVATEQYGWIVNTCIENKEQNQNEDSQ

SEQ ID NO: 160004 - protein, 31 aa, Artificial Sequence
  Description of Artificial Sequence: Synthetic polypeptide
DDSEIASTNPVSTEGYGNVAAEVCQSRVGQR

SEQ ID NO: 160005 - protein, 36 aa, Artificial Sequence
  Description of Artificial Sequence: Synthetic polypeptide
DECEICTTNPVATEQYGVVSTVTDGQNDEQGENNND

SEQ ID NO: 160006 - protein, 31 aa, Artificial Sequence
  Description of Artificial Sequence: Synthetic polypeptide
DDSEVASTNPVSTEGYGNVAANTIQSRHGQR

SEQ ID NO: 160007 - protein, 35 aa, Artificial Sequence
  Description of Artificial Sequence: Synthetic polypeptide
DDEEIRSTNPVATEQYGQCVCSTGEHQENSGSQQA

SEQ ID NO: 160008 - protein, 31 aa, Artificial Sequence
  Description of Artificial Sequence: Synthetic polypeptide
DDSEIASTNPVSTEGYGNVAAETIQSRVGQR

SEQ ID NO: 160009 - protein, 36 aa, Artificial Sequence
  Description of Artificial Sequence: Synthetic polypeptide
DEAEIRTTNPVATEQYGSSCPAVAGDAEREGNQEMQ

SEQ ID NO: 160010 - protein, 31 aa, Artificial Sequence
  Description of Artificial Sequence: Synthetic polypeptide
DDSEVASTNPVSTEGYGNVAANTIQSRIGQR

SEQ ID NO: 160011 - protein, 35 aa, Artificial Sequence
  Description of Artificial Sequence: Synthetic polypeptide
CEEEIRTTNPVATEQYGSVCSNSVLMEVPSFQLQD

SEQ ID NO: 160012 - protein, 34 aa, Artificial Sequence
  Description of Artificial Sequence: Synthetic polypeptide
DEAEIRTTNPVATEQYGSSCPAVAGAEREEQERV

SEQ ID NO: 160013 - protein, 36 aa, Artificial Sequence
  Description of Artificial Sequence: Synthetic polypeptide
DEAEIRTTNPVATEQYGSSCPAVACNAEREPNQEMD

SEQ ID NO: 160014 - protein, 36 aa, Artificial Sequence
  Description of Artificial Sequence: Synthetic polypeptide
DEEEISTTNPVATEQYGVVCSTGEHNQENFGSDTQL

SEQ ID NO: 160015 - protein, 36 aa, Artificial Sequence
  Description of Artificial Sequence: Synthetic polypeptide
DEDEIRTTNPVAYEQWGSVCSTDNGINEGQQGMGLN

SEQ ID NO: 160016 - protein, 35 aa, Artificial Sequence
  Description of Artificial Sequence: Synthetic polypeptide
DEEEIACTNPVATEQYGSCAAPNPEQDAGEGNPDD

SEQ ID NO: 160017 - protein, 36 aa, Artificial Sequence
  Description of Artificial Sequence: Synthetic polypeptide
DEDEIRTTNPVAYEQWGSVCSTDNGINIGQQGHGEN

SEQ ID NO: 160018 - protein, 37 aa, Artificial Sequence
  Description of Artificial Sequence: Synthetic polypeptide
DENEIRTTNPVATEQYGSVTSDTVDALVGEGSMQQFH

SEQ ID NO: 160019 - protein, 36 aa, Artificial Sequence
  Description of Artificial Sequence: Synthetic polypeptide
DEAEIRTTNPVATEQYGSSCPASVAGNAEREGEQEM

SEQ ID NO: 160020 - protein, 32 aa, Artificial Sequence
  Description of Artificial Sequence: Synthetic polypeptide
DESEIRSTNPVSTEPYGTISNEDIQQQQVGNH

SEQ ID NO: 160021 - protein, 37 aa, Artificial Sequence
  Description of Artificial Sequence: Synthetic polypeptide
DENEIRTTNPVATEQYGSVTITSMKFEQTESLQESGI

SEQ ID NO: 160022 - protein, 36 aa, Artificial Sequence
  Description of Artificial Sequence: Synthetic polypeptide
CEEEIATTNPVATEQYGSACSANPPAQTAEGPNENQ

SEQ ID NO: 160023 - protein, 31 aa, Artificial Sequence
  Description of Artificial Sequence: Synthetic polypeptide
DDSEVASTNPVSTEGYGNVAANTIQSRLGMR

SEQ ID NO: 160024 - protein, 39 aa, Artificial Sequence
  Description of Artificial Sequence: Synthetic polypeptide
DEEEIRTTNPVATEQYGSVSVVVTNNNNGEQGTNANTTD

SEQ ID NO: 160025 - protein, 34 aa, Artificial Sequence
  Description of Artificial Sequence: Synthetic polypeptide
DEEEIRTTNPCATESYGSTIALTVNQHPEQVVDN

SEQ ID NO: 160026 - protein, 35 aa, Artificial Sequence
  Description of Artificial Sequence: Synthetic polypeptide
AEDEICATNPVATEQYGVVATVENLLQLNGNGEDD

SEQ ID NO: 160027 - protein, 39 aa, Artificial Sequence
  Description of Artificial Sequence: Synthetic polypeptide
CEEEIRTTNPVATEQYGSVDTSNMDLGANQSTTGGGQNN

SEQ ID NO: 160028 - protein, 35 aa, Artificial Sequence
  Description of Artificial Sequence: Synthetic polypeptide
DEAEIRTTNPVATEQYGSSCPATVNGDAESEGSHM

SEQ ID NO: 160029 - protein, 35 aa, Artificial Sequence
  Description of Artificial Sequence: Synthetic polypeptide
DENEIRTTNPVATEQYGSVSVWPGIDTQEILDDAV

SEQ ID NO: 160030 - protein, 34 aa, Artificial Sequence
  Description of Artificial Sequence: Synthetic polypeptide
DEMEIKTTNPVATEQYGTVCSATSGTPVEFELND

SEQ ID NO: 160031 - protein, 34 aa, Artificial Sequence
  Description of Artificial Sequence: Synthetic polypeptide
DEEEIACTNPVATEQYGSCATGNPDNSEHSTDRV

SEQ ID NO: 160032 - protein, 35 aa, Artificial Sequence
  Description of Artificial Sequence: Synthetic polypeptide
DEDEIRTTNPVAYEQWGSVATTNAGNQNIDMNGQM

SEQ ID NO: 160033 - protein, 35 aa, Artificial Sequence
  Description of Artificial Sequence: Synthetic polypeptide
DEEEIRTTNPCAYAEYGSVAYTGNEHSGRAGGNDG

SEQ ID NO: 160034 - protein, 35 aa, Artificial Sequence
  Description of Artificial Sequence: Synthetic polypeptide
DENEIRTTNPVATEQYGSVYTWNMGNTESSEEHIQ

SEQ ID NO: 160035 - protein, 35 aa, Artificial Sequence
  Description of Artificial Sequence: Synthetic polypeptide
DENEIRTTNPVATEQYGSVYTWNMGMIESSEEHTQ

SEQ ID NO: 160036 - protein, 35 aa, Artificial Sequence
  Description of Artificial Sequence: Synthetic polypeptide
DENEIRTTNPVATEQYGSVYTWIMIQTESSEEHTE

SEQ ID NO: 160037 - protein, 35 aa, Artificial Sequence
  Description of Artificial Sequence: Synthetic polypeptide
DENEIRTTNPVATEQYGSVYTWIMGSTESSEEHTQ

SEQ ID NO: 160038 - protein, 35 aa, Artificial Sequence
  Description of Artificial Sequence: Synthetic polypeptide
DENEIRTTNPVATEQYGSVYTWFMIQTESSEEHFQ

SEQ ID NO: 160039 - protein, 35 aa, Artificial Sequence
  Description of Artificial Sequence: Synthetic polypeptide
DENEIRTTNPVATEQYGSVYTWDIMIQTESSEETA

SEQ ID NO: 160040 - protein, 36 aa, Artificial Sequence
  Description of Artificial Sequence: Synthetic polypeptide
NEEEIRTTNPVATEQYGSVSIPVVYLTQIMHQADED

SEQ ID NO: 160041 - protein, 37 aa, Artificial Sequence
  Description of Artificial Sequence: Synthetic polypeptide
DENEIRTTNPVATEQYGSYISVTMHDLVQTGPEEQYE

SEQ ID NO: 160042 - protein, 34 aa, Artificial Sequence
  Description of Artificial Sequence: Synthetic polypeptide
DDSEVRTTNPVATECWGNVSACITEPQDRVGENG

SEQ ID NO: 160043 - protein, 35 aa, Artificial Sequence
  Description of Artificial Sequence: Synthetic polypeptide
QEEEIRTTNPVATEQYGDVVVDEMNGQQNIEGGEG

SEQ ID NO: 160044 - protein, 35 aa, Artificial Sequence
  Description of Artificial Sequence: Synthetic polypeptide
DEEEIRTTNPVATECWGSTTSANAEDWNMRKGPYI

SEQ ID NO: 160045 - protein, 33 aa, Artificial Sequence
  Description of Artificial Sequence: Synthetic polypeptide
DEEEIRTTNPCAYAEYGSVAYTNEHSGIGGSGC

SEQ ID NO: 160046 - protein, 31 aa, Artificial Sequence
  Description of Artificial Sequence: Synthetic polypeptide
DDSEVRSTNPVSTEGWGNVAANIEQSRVGDR

SEQ ID NO: 160047 - protein, 35 aa, Artificial Sequence
  Description of Artificial Sequence: Synthetic polypeptide
DDEEIRSTNPVATEQYGCVCSTWGEHQENSGSQQA

SEQ ID NO: 160048 - protein, 39 aa, Artificial Sequence
  Description of Artificial Sequence: Synthetic polypeptide
DEEEIRTTNPVATEQYGSVSVTVNNNQQSTTEQGTEQGS

SEQ ID NO: 160049 - protein, 34 aa, Artificial Sequence
  Description of Artificial Sequence: Synthetic polypeptide
DEGEIRTTNPVATEQYGSVWWLASEEPRSDSDQN

SEQ ID NO: 160050 - protein, 33 aa, Artificial Sequence
  Description of Artificial Sequence: Synthetic polypeptide
DEEEIRTTNPCAYAEYGSVVAYINEHSGIGGNG

SEQ ID NO: 160051 - protein, 35 aa, Artificial Sequence
  Description of Artificial Sequence: Synthetic polypeptide
DEDEIRTTNPVAYEQWGSVCQPTENDQNDTQNGGA

SEQ ID NO: 160052 - protein, 36 aa, Artificial Sequence
  Description of Artificial Sequence: Synthetic polypeptide
DEHEIRTTNPVAYEQWGSVSGGENAGPNMQNGMNMA

SEQ ID NO: 160053 - protein, 32 aa, Artificial Sequence
  Description of Artificial Sequence: Synthetic polypeptide
AENEIACTNPVATEQYGEVCSAENPVEFEGGD

SEQ ID NO: 160054 - protein, 31 aa, Artificial Sequence
  Description of Artificial Sequence: Synthetic polypeptide
DDSEIASTNPVSTEGYGIVAACTIQSRVGQR

SEQ ID NO: 160055 - protein, 35 aa, Artificial Sequence
  Description of Artificial Sequence: Synthetic polypeptide
DEGEIRTTNPVATEQYGSVWYCEDADQDEVQDERI

SEQ ID NO: 160056 - protein, 30 aa, Artificial Sequence
  Description of Artificial Sequence: Synthetic polypeptide
QEQEIATTNPVATEQYGEASAEVCEHEEDL

SEQ ID NO: 160057 - protein, 35 aa, Artificial Sequence
  Description of Artificial Sequence: Synthetic polypeptide
DENEIRTTNPVATEQYGSVYTWNMIITESSEEHTM

SEQ ID NO: 160058 - protein, 33 aa, Artificial Sequence
  Description of Artificial Sequence: Synthetic polypeptide
DEEEIRTTNPCAYAAYGSVAYFANEHSGIGGNG

SEQ ID NO: 160059 - protein, 35 aa, Artificial Sequence
  Description of Artificial Sequence: Synthetic polypeptide
CEEEIRTTNPVATEQYGQCVCSWMEHNQSFNSEQS

SEQ ID NO: 160060 - protein, 35 aa, Artificial Sequence
  Description of Artificial Sequence: Synthetic polypeptide
DENEIRTTNPVATEQYGSVYWWNMGQYESSEEHTQ

SEQ ID NO: 160061 - protein, 35 aa, Artificial Sequence
  Description of Artificial Sequence: Synthetic polypeptide
DEQEIATTNPVAYEQYGTVCSYTDGPVESQHGNTD

SEQ ID NO: 160062 - protein, 30 aa, Artificial Sequence
  Description of Artificial Sequence: Synthetic polypeptide
QEQEIATTNPVATEQYGEASAEVCEHEEDK

SEQ ID NO: 160063 - protein, 34 aa, Artificial Sequence
  Description of Artificial Sequence: Synthetic polypeptide
DEEEIRTTNPCAYAEYGETVAYTLNEHSGQGGNG

SEQ ID NO: 160064 - protein, 31 aa, Artificial Sequence
  Description of Artificial Sequence: Synthetic polypeptide
DENEIATTNPVATASWGCVAANNNLNDAGGH

SEQ ID NO: 160065 - protein, 36 aa, Artificial Sequence
  Description of Artificial Sequence: Synthetic polypeptide
DEMEIGTTNPVATEQYGTVCSNTGEPNEEFEGSNQS

SEQ ID NO: 160066 - protein, 31 aa, Artificial Sequence
  Description of Artificial Sequence: Synthetic polypeptide
QEQEIATTNPVATEQYGEAPTVCEDHEGEDL

SEQ ID NO: 160067 - protein, 35 aa, Artificial Sequence
  Description of Artificial Sequence: Synthetic polypeptide
DEMEIGTTNPVATEQYGTVCSNTGEPNAFFGSDQA

SEQ ID NO: 160068 - protein, 35 aa, Artificial Sequence
  Description of Artificial Sequence: Synthetic polypeptide
DEDEIRTTNPVAYEQWGSVAGLPPGNHQNTGDNDH

SEQ ID NO: 160069 - protein, 34 aa, Artificial Sequence
  Description of Artificial Sequence: Synthetic polypeptide
DENEIRTTNPVATEQYGSVYVPDVDEEPNWEETM

SEQ ID NO: 160070 - protein, 35 aa, Artificial Sequence
  Description of Artificial Sequence: Synthetic polypeptide
DENEIRTTNPVATEQYGSVYVAAVSNQESGQESMM

SEQ ID NO: 160071 - protein, 35 aa, Artificial Sequence
  Description of Artificial Sequence: Synthetic polypeptide
DENEIRTTNPVATEQYGSVYTWVMIQTESSMEAQA

SEQ ID NO: 160072 - protein, 37 aa, Artificial Sequence
  Description of Artificial Sequence: Synthetic polypeptide
DENEIRTTNPVATEQYGSWTSMEGNNLSQSISENQQP

SEQ ID NO: 160073 - protein, 36 aa, Artificial Sequence
  Description of Artificial Sequence: Synthetic polypeptide
DEEEIACTNPVATEQYGSVAATPHGLPTGSGEENNA

SEQ ID NO: 160074 - protein, 37 aa, Artificial Sequence
  Description of Artificial Sequence: Synthetic polypeptide
DENEIRTTNPVATEQYGSWTVMEDNNLSQLSISENQQ

SEQ ID NO: 160075 - protein, 31 aa, Artificial Sequence
  Description of Artificial Sequence: Synthetic polypeptide
DDSEVASTNPVSTEGYGNVAANTIQSRAGDR

SEQ ID NO: 160076 - protein, 36 aa, Artificial Sequence
  Description of Artificial Sequence: Synthetic polypeptide
DEAEIRTTNPVATEQYGSSCPAYVAGNAEREGQEMH

SEQ ID NO: 160077 - protein, 31 aa, Artificial Sequence
  Description of Artificial Sequence: Synthetic polypeptide
DDSEVASTNPVSTEGYGNVAANTIQSRAGQR

SEQ ID NO: 160078 - protein, 35 aa, Artificial Sequence
  Description of Artificial Sequence: Synthetic polypeptide
DENEIRTTNPVATEQYGSVYTWNMISTESSEEHGA

SEQ ID NO: 160079 - protein, 34 aa, Artificial Sequence
  Description of Artificial Sequence: Synthetic polypeptide
DEMEIGTTNPVATEQYGCVCTAWDGPVEFEGNEG

SEQ ID NO: 160080 - protein, 36 aa, Artificial Sequence
  Description of Artificial Sequence: Synthetic polypeptide
DEEEIATTNPVATEQYGSVCSVMTHGGAEAPIGDHN

SEQ ID NO: 160081 - protein, 37 aa, Artificial Sequence
  Description of Artificial Sequence: Synthetic polypeptide
DECEICTTNPVATEQYGVVSTVTNQQSATTEEGNNDD

SEQ ID NO: 160082 - protein, 31 aa, Artificial Sequence
  Description of Artificial Sequence: Synthetic polypeptide
DDSEVASTNPVSTEGYGNVAANTIQSRDGQR

SEQ ID NO: 160083 - protein, 37 aa, Artificial Sequence
  Description of Artificial Sequence: Synthetic polypeptide
DEEEIRTTNPVATEQYGSVSPTMFTHSPPVPGMVFEN

SEQ ID NO: 160084 - protein, 36 aa, Artificial Sequence
  Description of Artificial Sequence: Synthetic polypeptide
DEQEIATTNPVAYEQYGTVCSYTDGLVEGQRPNGEM

SEQ ID NO: 160085 - protein, 34 aa, Artificial Sequence
  Description of Artificial Sequence: Synthetic polypeptide
DEDEIRTTNPVAYEQWGCVYNVPDNHQGQQGNGS

SEQ ID NO: 160086 - protein, 36 aa, Artificial Sequence
  Description of Artificial Sequence: Synthetic polypeptide
DENEIRTTNPVATEQYGSVWYVPVDTLDERPNELHN

SEQ ID NO: 160087 - protein, 39 aa, Artificial Sequence
  Description of Artificial Sequence: Synthetic polypeptide
DEEEIRTTNPVATEQYGSVSVTVTNQAGSEQGTNTDETD

SEQ ID NO: 160088 - protein, 37 aa, Artificial Sequence
  Description of Artificial Sequence: Synthetic polypeptide
DEEEIRTTNPVATEQYGSVPSYDNNHWDISEMVEENV

SEQ ID NO: 160089 - protein, 33 aa, Artificial Sequence
  Description of Artificial Sequence: Synthetic polypeptide
DEMEIKTTNPVATEQYGTVCCAPDGPVEFEGND

SEQ ID NO: 160090 - protein, 36 aa, Artificial Sequence
  Description of Artificial Sequence: Synthetic polypeptide
DEAEIRTTNPVATEQYGSSCPVAVAGNAEREGLQEM

SEQ ID NO: 160091 - protein, 37 aa, Artificial Sequence
  Description of Artificial Sequence: Synthetic polypeptide
DEQEIATTNPVAYEQYGTVCSYTDGLNDEQRGQNSES

SEQ ID NO: 160092 - protein, 30 aa, Artificial Sequence
  Description of Artificial Sequence: Synthetic polypeptide
QEQEIATTNPVATEQYGEAPEVCEDHEGEL

SEQ ID NO: 160093 - protein, 39 aa, Artificial Sequence
  Description of Artificial Sequence: Synthetic polypeptide
DEEEIRTTNPVATEQYGSVSVTVTNQQIGTTEQGTTQGS

SEQ ID NO: 160094 - protein, 35 aa, Artificial Sequence
  Description of Artificial Sequence: Synthetic polypeptide
DEEEIATTNPVATEQYGSVCAAALHLPLDSEGIAN

SEQ ID NO: 160095 - protein, 37 aa, Artificial Sequence
  Description of Artificial Sequence: Synthetic polypeptide
NEEEIRTTNPVATEQYGSVSPELNMMMQEENGEEEVN

SEQ ID NO: 160096 - protein, 37 aa, Artificial Sequence
  Description of Artificial Sequence: Synthetic polypeptide
CEEEIRTTNPVATEQYGSCAQPEMDESTVLENGTLND

SEQ ID NO: 160097 - protein, 35 aa, Artificial Sequence
  Description of Artificial Sequence: Synthetic polypeptide
DEQEIATTNPVAYEQYGTVATENGGQQNGGQRGED

SEQ ID NO: 160098 - protein, 31 aa, Artificial Sequence
  Description of Artificial Sequence: Synthetic polypeptide
DDSEIASTNPVSTECYGNVSAECLQSRVEQL

SEQ ID NO: 160099 - protein, 35 aa, Artificial Sequence
  Description of Artificial Sequence: Synthetic polypeptide
DEGEIRTTNPVATEQYGSWWVTEVMEEGMESVIRE

SEQ ID NO: 160100 - protein, 37 aa, Artificial Sequence
  Description of Artificial Sequence: Synthetic polypeptide
DECEICTTNPVATEQYGVVSTVTNQQSATEEGITNDD

SEQ ID NO: 160101 - protein, 31 aa, Artificial Sequence
  Description of Artificial Sequence: Synthetic polypeptide
CENEIATTNPVAYEPYGKVSNHMLSQHETPL

SEQ ID NO: 160102 - protein, 36 aa, Artificial Sequence
  Description of Artificial Sequence: Synthetic polypeptide
DEVEIRTTNPVATEQYGSVVDFDNNEGQDEQNGEIG

SEQ ID NO: 160103 - protein, 30 aa, Artificial Sequence
  Description of Artificial Sequence: Synthetic polypeptide
DENEIATTNPVATECWGATTAACLQEHEPL

SEQ ID NO: 160104 - protein, 39 aa, Artificial Sequence
  Description of Artificial Sequence: Synthetic polypeptide
DEEEIRTTNPVATEQYGVVSTVTNLNNNQQQATTNVATE

SEQ ID NO: 160105 - protein, 33 aa, Artificial Sequence
  Description of Artificial Sequence: Synthetic polypeptide
DDSEIASTNPVATEQYGTVCSANTIVESFVGQR

SEQ ID NO: 160106 - protein, 39 aa, Artificial Sequence
  Description of Artificial Sequence: Synthetic polypeptide
DEEEIRTTNPVATEQYGSVSVTVTTNNATEQGTNTNTTE

SEQ ID NO: 160107 - protein, 37 aa, Artificial Sequence
  Description of Artificial Sequence: Synthetic polypeptide
DEEEIATTNPVATEQYGSVCSVGHQGPLDSMIENDRD

SEQ ID NO: 160108 - protein, 36 aa, Artificial Sequence
  Description of Artificial Sequence: Synthetic polypeptide
DEHEIRTTNPVAYEQWGSVCYTQDNDQHTQGNSNTN

SEQ ID NO: 160109 - protein, 30 aa, Artificial Sequence
  Description of Artificial Sequence: Synthetic polypeptide
QEQEIATTNPVATEQYGEAPEVCQDHEEEL

SEQ ID NO: 160110 - protein, 38 aa, Artificial Sequence
  Description of Artificial Sequence: Synthetic polypeptide
DEEEIRTTNPVATEQYGVVSTVVTTNNNTEAGNTEQGQ

SEQ ID NO: 160111 - protein, 35 aa, Artificial Sequence
  Description of Artificial Sequence: Synthetic polypeptide
DEDEIRTTNPVAYEQWGEVCSTGNGGNAGEGGGRN

SEQ ID NO: 160112 - protein, 35 aa, Artificial Sequence
  Description of Artificial Sequence: Synthetic polypeptide
DEDEIRTTNPVAYEQWGSVCSMENDQQTDTQNGSQ

SEQ ID NO: 160113 - protein, 35 aa, Artificial Sequence
  Description of Artificial Sequence: Synthetic polypeptide
DEDEIRTTNPVAYEQWGSVCSMENHEQNDTQNGGA

SEQ ID NO: 160114 - protein, 35 aa, Artificial Sequence
  Description of Artificial Sequence: Synthetic polypeptide
DENEIRTTNPVATEQYGSYSQVTATGIELEIAQDF

SEQ ID NO: 160115 - protein, 35 aa, Artificial Sequence
  Description of Artificial Sequence: Synthetic polypeptide
DDEEIRSTNPVATEQYGCVCSWEELNQENFGSQQS

SEQ ID NO: 160116 - protein, 35 aa, Artificial Sequence
  Description of Artificial Sequence: Synthetic polypeptide
DESEIRTTNCVATDAYGSVNTMGLQIQLEGGNGDT

SEQ ID NO: 160117 - protein, 36 aa, Artificial Sequence
  Description of Artificial Sequence: Synthetic polypeptide
DEDEIRTTNPVAYEQWGSVCSNDNHDEQPGQGGNEQ

SEQ ID NO: 160118 - protein, 32 aa, Artificial Sequence
  Description of Artificial Sequence: Synthetic polypeptide
DDSEVASTNPVSTEGYGNVAANTIQSREGNER

SEQ ID NO: 160119 - protein, 36 aa, Artificial Sequence
  Description of Artificial Sequence: Synthetic polypeptide
DEDEIRTTNPVAYEQWGSVCSNDNHDQAGQGGNLEH

SEQ ID NO: 160120 - protein, 31 aa, Artificial Sequence
  Description of Artificial Sequence: Synthetic polypeptide
DDSEVASTNPVSTEGYGNVAANTIQSREGQR

SEQ ID NO: 160121 - protein, 36 aa, Artificial Sequence
  Description of Artificial Sequence: Synthetic polypeptide
DEDEIRTTNPVAYEQWGEVCSTENDQMTGDTQNGGA

SEQ ID NO: 160122 - protein, 35 aa, Artificial Sequence
  Description of Artificial Sequence: Synthetic polypeptide
DENEIRTTNPVATEQYGSYSQVTSALGIELEIQDF

SEQ ID NO: 160123 - protein, 37 aa, Artificial Sequence
  Description of Artificial Sequence: Synthetic polypeptide
DEHEIRTTNPVAYEQWGSVSGNEPQGGNMRNDMNDVY

SEQ ID NO: 160124 - protein, 38 aa, Artificial Sequence
  Description of Artificial Sequence: Synthetic polypeptide
DEEEIRTTNPVATEQYGVVSTVVTTNNQQGTTEEEEET

SEQ ID NO: 160125 - protein, 37 aa, Artificial Sequence
  Description of Artificial Sequence: Synthetic polypeptide
DENEIRTTNPVATEQYGSVYATWNIMIGTESSNETTA

SEQ ID NO: 160126 - protein, 35 aa, Artificial Sequence
  Description of Artificial Sequence: Synthetic polypeptide
DENEIRTTNPVATEQYGSVYATWIMIQTESSQEEA

SEQ ID NO: 160127 - protein, 35 aa, Artificial Sequence
  Description of Artificial Sequence: Synthetic polypeptide
DEMEIITTNPVATEQYGTVCSATSGPVEFQLENID

SEQ ID NO: 160128 - protein, 38 aa, Artificial Sequence
  Description of Artificial Sequence: Synthetic polypeptide
DEEEIRTTNPVATEQYGSVSVTVTNNNNNDEQGTDEQD

SEQ ID NO: 160129 - protein, 35 aa, Artificial Sequence
  Description of Artificial Sequence: Synthetic polypeptide
DEEEIRTTNPCAYAHYGESVAYTANEHSGQGGNGY

SEQ ID NO: 160130 - protein, 36 aa, Artificial Sequence
  Description of Artificial Sequence: Synthetic polypeptide
DESEIRTTNCVATDAYGSVGNTNGLQGQLEGGNGDT

SEQ ID NO: 160131 - protein, 39 aa, Artificial Sequence
  Description of Artificial Sequence: Synthetic polypeptide
DEEEIRTTNPVATEQYGSVSVTVTNNNNSEQGTNNNTTD

SEQ ID NO: 160132 - protein, 33 aa, Artificial Sequence
  Description of Artificial Sequence: Synthetic polypeptide
DDSEIASTNPVSTECYGNVSANITEPQDRVGQR

SEQ ID NO: 160133 - protein, 38 aa, Artificial Sequence
  Description of Artificial Sequence: Synthetic polypeptide
DEEEIRTTNPVATEQYGVVSTVVTTQAGNNDTEENNEG

SEQ ID NO: 160134 - protein, 37 aa, Artificial Sequence
  Description of Artificial Sequence: Synthetic polypeptide
AEEEIRTTNPVATEQYGSVVVVNTNNSESGTVNNNTQ

SEQ ID NO: 160135 - protein, 36 aa, Artificial Sequence
  Description of Artificial Sequence: Synthetic polypeptide
DEGEIRTTNPVATEQYGSVTVVLDANEDEGMQNNQI

SEQ ID NO: 160136 - protein, 36 aa, Artificial Sequence
  Description of Artificial Sequence: Synthetic polypeptide
DENEIRTTNPVATEQYGTVVTPWLPDEQENNQIDEI

SEQ ID NO: 160137 - protein, 37 aa, Artificial Sequence
  Description of Artificial Sequence: Synthetic polypeptide
SEEEIRTTNPVATEQYGSVIDDQSNIEGQEGGGNNGG

SEQ ID NO: 160138 - protein, 32 aa, Artificial Sequence
  Description of Artificial Sequence: Synthetic polypeptide
DEQEIATTNPVSSEQYGIVSACDLEDHEGEDL

SEQ ID NO: 160139 - protein, 37 aa, Artificial Sequence
  Description of Artificial Sequence: Synthetic polypeptide
DEEEIRTTNPCATEQYGSYASPTFPQQQVSRTTVENS

SEQ ID NO: 160140 - protein, 36 aa, Artificial Sequence
  Description of Artificial Sequence: Synthetic polypeptide
DEAEIRTTNPVATEQYGSLIWSYTALIDDLEINDQE

SEQ ID NO: 160141 - protein, 36 aa, Artificial Sequence
  Description of Artificial Sequence: Synthetic polypeptide
DEDEIRTTNPVAYEQWGSVCSTENWDQQNDTQNGGA

SEQ ID NO: 160142 - protein, 36 aa, Artificial Sequence
  Description of Artificial Sequence: Synthetic polypeptide
DENEIRTTNPVATEQYGTVVTVMLPDEQENLQEDEI

SEQ ID NO: 160143 - protein, 36 aa, Artificial Sequence
  Description of Artificial Sequence: Synthetic polypeptide
DEAEIRTTNPVATEQYGSLIWSYTAEINDLEIHDQE

SEQ ID NO: 160144 - protein, 37 aa, Artificial Sequence
  Description of Artificial Sequence: Synthetic polypeptide
DECEICTTNPVATEQYGVVSTVNQQQNNNQQGTNTTD

SEQ ID NO: 160145 - protein, 36 aa, Artificial Sequence
  Description of Artificial Sequence: Synthetic polypeptide
DEAEICTTNPVATEFWGVVSTGNGLLDDDRGQNMES

SEQ ID NO: 160146 - protein, 38 aa, Artificial Sequence
  Description of Artificial Sequence: Synthetic polypeptide
SEEEIRTTNPVATEQYGSVIDGNNVDNNDQRGEQEGNG

SEQ ID NO: 160147 - protein, 36 aa, Artificial Sequence
  Description of Artificial Sequence: Synthetic polypeptide
DEEEIRTTNPVATEQWGSVSATDTGPPNQPVSPPLT

SEQ ID NO: 160148 - protein, 39 aa, Artificial Sequence
  Description of Artificial Sequence: Synthetic polypeptide
DEEEIRTTNPVATEQYGVVSTVTNEQQGTQQGTTTNVTE

SEQ ID NO: 160149 - protein, 38 aa, Artificial Sequence
  Description of Artificial Sequence: Synthetic polypeptide
DEEEIRTTNPVATEQYGVVSTVVVNNNNQEQGTTEEED

SEQ ID NO: 160150 - protein, 37 aa, Artificial Sequence
  Description of Artificial Sequence: Synthetic polypeptide
DEEEIRTTNPCATEQYGSVTPEIANLQAIHTGPVGQN

SEQ ID NO: 160151 - protein, 38 aa, Artificial Sequence
  Description of Artificial Sequence: Synthetic polypeptide
DEEEIRTTNPVATEQYGVVSTVVTTNATEQGNNDEEEE

SEQ ID NO: 160152 - protein, 36 aa, Artificial Sequence
  Description of Artificial Sequence: Synthetic polypeptide
DENEIRTTNPVATEQYGTVVTVWLPAEGENLQIDEI

SEQ ID NO: 160153 - protein, 35 aa, Artificial Sequence
  Description of Artificial Sequence: Synthetic polypeptide
AEDEICATNPVATEQYGVVATTNENLQALGNTEDD

SEQ ID NO: 160154 - protein, 36 aa, Artificial Sequence
  Description of Artificial Sequence: Synthetic polypeptide
DEAEIRTTNPVATEQYGSLIWSLTAPINDLEINDQE

SEQ ID NO: 160155 - protein, 36 aa, Artificial Sequence
  Description of Artificial Sequence: Synthetic polypeptide
DEEEIRTTNPVATEQYGSVYVAIMEQIENTEADNDM

SEQ ID NO: 160156 - protein, 35 aa, Artificial Sequence
  Description of Artificial Sequence: Synthetic polypeptide
DEEEIACTNPVATEQYGSACSANPPAEAEMGNMHS

SEQ ID NO: 160157 - protein, 36 aa, Artificial Sequence
  Description of Artificial Sequence: Synthetic polypeptide
DENEIRTTNPVATEQYGTVVTVWLPDETENLQYDEI

SEQ ID NO: 160158 - protein, 38 aa, Artificial Sequence
  Description of Artificial Sequence: Synthetic polypeptide
CEEEIRTTNPVATEQYGSVSSTTPADGPNMGNGNNPET

SEQ ID NO: 160159 - protein, 36 aa, Artificial Sequence
  Description of Artificial Sequence: Synthetic polypeptide
DENEIRTTNPVATEQYGTVVTVWLPFEQENGQEDEI

SEQ ID NO: 160160 - protein, 37 aa, Artificial Sequence
  Description of Artificial Sequence: Synthetic polypeptide
SEEEIRTTNPVATEQYGSVINDDNADGEGQGGQNQEF

SEQ ID NO: 160161 - protein, 34 aa, Artificial Sequence
  Description of Artificial Sequence: Synthetic polypeptide
DEMEICTTNPVATEQYGTVCFATDGPVEFEGNDD

SEQ ID NO: 160162 - protein, 35 aa, Artificial Sequence
  Description of Artificial Sequence: Synthetic polypeptide
DEEEIRTTNPVATEQYGSVPVENDDHADEASDLEH

SEQ ID NO: 160163 - protein, 37 aa, Artificial Sequence
  Description of Artificial Sequence: Synthetic polypeptide
SEEEIRTTNPVATEQYGSVNMDTNGDDQEDEETNEGQ

SEQ ID NO: 160164 - protein, 34 aa, Artificial Sequence
  Description of Artificial Sequence: Synthetic polypeptide
DEDEIRTTNPVAYECWGSVYYTINDGGNQDNGRG

SEQ ID NO: 160165 - protein, 34 aa, Artificial Sequence
  Description of Artificial Sequence: Synthetic polypeptide
DEAEISTTNPVATEQYGCVCSNWEDQENFGSEQA

SEQ ID NO: 160166 - protein, 38 aa, Artificial Sequence
  Description of Artificial Sequence: Synthetic polypeptide
DEEEIRTTNPCATEQYGVVSTTNQLQAGTEQGTTEAGQ

SEQ ID NO: 160167 - protein, 35 aa, Artificial Sequence
  Description of Artificial Sequence: Synthetic polypeptide
DEEEIRTTNPCAYEGYGSCSCTLNELSGTMGDQVL

SEQ ID NO: 160168 - protein, 37 aa, Artificial Sequence
  Description of Artificial Sequence: Synthetic polypeptide
NEEEIRTTNPVATEQYGSVCPTMNAVEFAADQLENDD

SEQ ID NO: 160169 - protein, 39 aa, Artificial Sequence
  Description of Artificial Sequence: Synthetic polypeptide
DEEEIRTTNPVATEQYGVVSTVVTTNLNGNQQQATTNVE

SEQ ID NO: 160170 - protein, 34 aa, Artificial Sequence
  Description of Artificial Sequence: Synthetic polypeptide
DEDEIRTTNPVAYECWGSVYPIDNDHQQGMTGNH

SEQ ID NO: 160171 - protein, 35 aa, Artificial Sequence
  Description of Artificial Sequence: Synthetic polypeptide
DEEEIRTTNPVATEQYGSVPVMLELDFAAHPVLIG

SEQ ID NO: 160172 - protein, 37 aa, Artificial Sequence
  Description of Artificial Sequence: Synthetic polypeptide
DEEEIRTTNPCATEQYGVVAVTVTNGTNLQAGTDEED

SEQ ID NO: 160173 - protein, 37 aa, Artificial Sequence
  Description of Artificial Sequence: Synthetic polypeptide
DEAEIRTTNPVATEQYGSLIWSYTAPINDLEINNIQE

SEQ ID NO: 160174 - protein, 37 aa, Artificial Sequence
  Description of Artificial Sequence: Synthetic polypeptide
DEEEIRTTNPCATEQYGVVSSVNNNQNGTEQGNNQDD

SEQ ID NO: 160175 - protein, 36 aa, Artificial Sequence
  Description of Artificial Sequence: Synthetic polypeptide
DEYEICTTNPVATEQYGSVIDDTNNNGQGEQGGQQQ

SEQ ID NO: 160176 - protein, 37 aa, Artificial Sequence
  Description of Artificial Sequence: Synthetic polypeptide
DEYEICTTNPVATEQYGSVSGNQLNGGEGNEDQDEDQ

SEQ ID NO: 160177 - protein, 38 aa, Artificial Sequence
  Description of Artificial Sequence: Synthetic polypeptide
DECEICTTNPVATEQYGVVSTVTVGTNLEQGEGGNNDG

SEQ ID NO: 160178 - protein, 37 aa, Artificial Sequence
  Description of Artificial Sequence: Synthetic polypeptide
DEEEIRTTNPCATEQYGVVAVTVVNTNNLQAGTDEED

SEQ ID NO: 160179 - protein, 35 aa, Artificial Sequence
  Description of Artificial Sequence: Synthetic polypeptide
AEDEICATNPVATEQYGVVATTNENLQLQGNGEDD

SEQ ID NO: 160180 - protein, 39 aa, Artificial Sequence
  Description of Artificial Sequence: Synthetic polypeptide
DEEEIRTTNPVATEQYGVVSTVVVNLQQLQQGTTQDEED

SEQ ID NO: 160181 - protein, 36 aa, Artificial Sequence
  Description of Artificial Sequence: Synthetic polypeptide
DEEEIACTNPVATEQYGSACSATNQPEGAGEGNNDD

SEQ ID NO: 160182 - protein, 35 aa, Artificial Sequence
  Description of Artificial Sequence: Synthetic polypeptide
DEMEICTTNPVATEQYGTVCSCTDGPSGFEGGNND

SEQ ID NO: 160183 - protein, 36 aa, Artificial Sequence
  Description of Artificial Sequence: Synthetic polypeptide
SEEEIRTTNPVATEQYGSVMYPDNDINEGQMEDNME

SEQ ID NO: 160184 - protein, 37 aa, Artificial Sequence
  Description of Artificial Sequence: Synthetic polypeptide
DEGEIRTTNPVATEQYGSVSVVLDANEDPEGMQNNQL

SEQ ID NO: 160185 - protein, 37 aa, Artificial Sequence
  Description of Artificial Sequence: Synthetic polypeptide
DEEEIRTTNPVATEQYGSVPVAWPGNEEIRHNVGQLD

SEQ ID NO: 160186 - protein, 37 aa, Artificial Sequence
  Description of Artificial Sequence: Synthetic polypeptide
SEEEIRTTNPVATEQYGSVCYPTFDDQNNNGLELNME

SEQ ID NO: 160187 - protein, 36 aa, Artificial Sequence
  Description of Artificial Sequence: Synthetic polypeptide
DEEEIACTNPVATEQYGSACSANPMLQDSPDEAARE

SEQ ID NO: 160188 - protein, 38 aa, Artificial Sequence
  Description of Artificial Sequence: Synthetic polypeptide
DEEEIRTTNPVATEQYGVVSTVTGNNNDQQGTEQGSTD

SEQ ID NO: 160189 - protein, 31 aa, Artificial Sequence
  Description of Artificial Sequence: Synthetic polypeptide
DDSEVASTNPVSTEGYGNVAANTIQSRVGAR

SEQ ID NO: 160190 - protein, 35 aa, Artificial Sequence
  Description of Artificial Sequence: Synthetic polypeptide
CEEEIRTTNPVATEQYGQCVCSWEEPTEGFNSDQS

SEQ ID NO: 160191 - protein, 38 aa, Artificial Sequence
  Description of Artificial Sequence: Synthetic polypeptide
DEEEIRTTNPVATEQYGVVSTVVTQQAGTEAGNNQQQD

SEQ ID NO: 160192 - protein, 35 aa, Artificial Sequence
  Description of Artificial Sequence: Synthetic polypeptide
DEAEIRTTNPVATEQYGSIWTENDNDARVLFTEGD

SEQ ID NO: 160193 - protein, 37 aa, Artificial Sequence
  Description of Artificial Sequence: Synthetic polypeptide
DEAEIRTTNPVATEQYGSIVSVTDSTSQHGHEYLESN

SEQ ID NO: 160194 - protein, 37 aa, Artificial Sequence
  Description of Artificial Sequence: Synthetic polypeptide
DEEEIRTTNPVATEQYGSVYVAIEGEQLSNQEEDNDM

SEQ ID NO: 160195 - protein, 35 aa, Artificial Sequence
  Description of Artificial Sequence: Synthetic polypeptide
AEDEICATNPVATEQYGVVATTNENLDQLGNEEDD

SEQ ID NO: 160196 - protein, 36 aa, Artificial Sequence
  Description of Artificial Sequence: Synthetic polypeptide
DEEEIRTTNPVATEQYGSVYVAIEEQLSSTEQDNDM

SEQ ID NO: 160197 - protein, 38 aa, Artificial Sequence
  Description of Artificial Sequence: Synthetic polypeptide
DEEEIRTTNPVATEQYGVVSTVVVNNNQQGTEEETEDE

SEQ ID NO: 160198 - protein, 37 aa, Artificial Sequence
  Description of Artificial Sequence: Synthetic polypeptide
DEEEIRTTNPVATEQYGSVQATMDSIVFMSEGNSEHE

SEQ ID NO: 160199 - protein, 36 aa, Artificial Sequence
  Description of Artificial Sequence: Synthetic polypeptide
DEEEIRTTNPVATEQYGSVYVAIEEQISNIEEDNDM

SEQ ID NO: 160200 - protein, 39 aa, Artificial Sequence
  Description of Artificial Sequence: Synthetic polypeptide
DEEEIRTTNPVATEQYGVVSTVVVNNNQQLGNQDEETED

SEQ ID NO: 160201 - protein, 34 aa, Artificial Sequence
  Description of Artificial Sequence: Synthetic polypeptide
DENEIRTTNPVATEQYGVVNMDDEMGGGNEGGTT

SEQ ID NO: 160202 - protein, 37 aa, Artificial Sequence
  Description of Artificial Sequence: Synthetic polypeptide
DEAEIRTTNPVATEQYGSIVGGENETDENRSGENIDT

SEQ ID NO: 160203 - protein, 37 aa, Artificial Sequence
  Description of Artificial Sequence: Synthetic polypeptide
DEAEIRTTNPVATEQYGSIVCGENETDENRSGEPINT

SEQ ID NO: 160204 - protein, 37 aa, Artificial Sequence
  Description of Artificial Sequence: Synthetic polypeptide
CEEEIRTTNPVATEQYGTVVVTMTDGDNGQRFNDNGQ

SEQ ID NO: 160205 - protein, 38 aa, Artificial Sequence
  Description of Artificial Sequence: Synthetic polypeptide
AEEEIRTTNPVATEQYGSVVVVTTNNNLQLQQGTDEED

SEQ ID NO: 160206 - protein, 37 aa, Artificial Sequence
  Description of Artificial Sequence: Synthetic polypeptide
DECEICTTNPVATEQYGVVSTVNNQQSATEEGQNNDD

SEQ ID NO: 160207 - protein, 38 aa, Artificial Sequence
  Description of Artificial Sequence: Synthetic polypeptide
AEEEIRTTNPVATEQYGSVVVVTTNNQAGNQQGNNEGD

SEQ ID NO: 160208 - protein, 34 aa, Artificial Sequence
  Description of Artificial Sequence: Synthetic polypeptide
DEEEISTTNPVAYEQWGSTVPDTPELSTTEDNED

SEQ ID NO: 160209 - protein, 35 aa, Artificial Sequence
  Description of Artificial Sequence: Synthetic polypeptide
DEAEIRTTNPVATEQYGSIPWTPPTEENTHQSEPQ

SEQ ID NO: 160210 - protein, 34 aa, Artificial Sequence
  Description of Artificial Sequence: Synthetic polypeptide
DEEEISTTNPVAYEQWGCTVPSHPELSQTEDNED

SEQ ID NO: 160211 - protein, 33 aa, Artificial Sequence
  Description of Artificial Sequence: Synthetic polypeptide
DEMEICTTNPVATEQYGCVCTFTDGTVEFEGFD

SEQ ID NO: 160212 - protein, 31 aa, Artificial Sequence
  Description of Artificial Sequence: Synthetic polypeptide
DDSEIASTNPVATEGYGNVAANTIQSRAEQA

SEQ ID NO: 160213 - protein, 35 aa, Artificial Sequence
  Description of Artificial Sequence: Synthetic polypeptide
DEEEISTTNPVAYEHWGSTVPSTIPELSQTEDNED

SEQ ID NO: 160214 - protein, 37 aa, Artificial Sequence
  Description of Artificial Sequence: Synthetic polypeptide
CEEEIRTTNPVATEQYGSVVDFNDGQGQEDEGNETTE

SEQ ID NO: 160215 - protein, 37 aa, Artificial Sequence
  Description of Artificial Sequence: Synthetic polypeptide
DEEEIRTTNPCATEQYGSVSPTMNANEFAADQLELDD

SEQ ID NO: 160216 - protein, 36 aa, Artificial Sequence
  Description of Artificial Sequence: Synthetic polypeptide
DENEIRTTNPVATEQYGTVVTVWLPSEQFNGQIDEI

SEQ ID NO: 160217 - protein, 35 aa, Artificial Sequence
  Description of Artificial Sequence: Synthetic polypeptide
DEYEIGTTNPVATEQYGSVVAANAGMEEGGENGTY

SEQ ID NO: 160218 - protein, 36 aa, Artificial Sequence
  Description of Artificial Sequence: Synthetic polypeptide
DENEIRTTNPVATEQYGTVVTWWLPDEQENLQIDEV

SEQ ID NO: 160219 - protein, 34 aa, Artificial Sequence
  Description of Artificial Sequence: Synthetic polypeptide
DEMEICTTNPVATEQYGCVCTATDGPVEFEGNDE

SEQ ID NO: 160220 - protein, 36 aa, Artificial Sequence
  Description of Artificial Sequence: Synthetic polypeptide
DEEEIRTTNPVATEQYGSVYVAIGEQIANTEEDNDM

SEQ ID NO: 160221 - protein, 34 aa, Artificial Sequence
  Description of Artificial Sequence: Synthetic polypeptide
DEYEIGTTNPVATEQYGVVAAGNAGMEEGGENEG

SEQ ID NO: 160222 - protein, 37 aa, Artificial Sequence
  Description of Artificial Sequence: Synthetic polypeptide
CEEEIRTTNPVATEQYGSVVDFNDGQGQEEEGNENEE

SEQ ID NO: 160223 - protein, 36 aa, Artificial Sequence
  Description of Artificial Sequence: Synthetic polypeptide
CEEEIRTTNPVATEQYGSVVDLMVGQEQTGEDNGGN

SEQ ID NO: 160224 - protein, 37 aa, Artificial Sequence
  Description of Artificial Sequence: Synthetic polypeptide
AEEEIRTTNPVATEQYGSVVVVTTNNDESGTVNNETT

SEQ ID NO: 160225 - protein, 37 aa, Artificial Sequence
  Description of Artificial Sequence: Synthetic polypeptide
DEEEIRTTNPVATEQYGSVPYTLMQGEEQMIMNAEEL

SEQ ID NO: 160226 - protein, 35 aa, Artificial Sequence
  Description of Artificial Sequence: Synthetic polypeptide
CEEEIRTTNPVATEQYGSVVLGIMTGGITVTGEQG

SEQ ID NO: 160227 - protein, 39 aa, Artificial Sequence
  Description of Artificial Sequence: Synthetic polypeptide
AEEEIRTTNPVATEQYGSVVVTVTTTNLEQGTEGGNTTT

SEQ ID NO: 160228 - protein, 33 aa, Artificial Sequence
  Description of Artificial Sequence: Synthetic polypeptide
DEEEIRTTNPCAYEPYGSCAGTNHDMNPQGEAM

SEQ ID NO: 160229 - protein, 39 aa, Artificial Sequence
  Description of Artificial Sequence: Synthetic polypeptide
DEEEIRTTNPVATEQYGVVSTVTNDQQGNEQGTTTNVAE

SEQ ID NO: 160230 - protein, 37 aa, Artificial Sequence
  Description of Artificial Sequence: Synthetic polypeptide
DEEEIRTTNPVATEQYGSVFGSFEDDEGGNVQEDDIE

SEQ ID NO: 160231 - protein, 35 aa, Artificial Sequence
  Description of Artificial Sequence: Synthetic polypeptide
DEDEIRTTNPVAYECWGSVCSTMNNDHEGDGKSDR

SEQ ID NO: 160232 - protein, 36 aa, Artificial Sequence
  Description of Artificial Sequence: Synthetic polypeptide
DEEEIACTNPVATEQYGSACSANPAEADAQIGNDTA

SEQ ID NO: 160233 - protein, 35 aa, Artificial Sequence
  Description of Artificial Sequence: Synthetic polypeptide
DEEEIRTTNPCATEQYGSVPEPPWNIETSVVVNNQ

SEQ ID NO: 160234 - protein, 37 aa, Artificial Sequence
  Description of Artificial Sequence: Synthetic polypeptide
DEEEIRTTNPVATEQYGSVQAITMGEEQPEPGAVPEI

SEQ ID NO: 160235 - protein, 33 aa, Artificial Sequence
  Description of Artificial Sequence: Synthetic polypeptide
DEDEIRTTNPVAYECWGSVCPGDLQQENGDGTS

SEQ ID NO: 160236 - protein, 36 aa, Artificial Sequence
  Description of Artificial Sequence: Synthetic polypeptide
DEEEIRTTNPCATEQYGSVPWEIANDQATTGPVGQN

SEQ ID NO: 160237 - protein, 34 aa, Artificial Sequence
  Description of Artificial Sequence: Synthetic polypeptide
DEYEIATTNPVAYEEWGSVATGGNTGNAGNDDPR

SEQ ID NO: 160238 - protein, 38 aa, Artificial Sequence
  Description of Artificial Sequence: Synthetic polypeptide
DEEEIRTTNPVATEQYGSWAQPEMMESTVSENHNTLNR

SEQ ID NO: 160239 - protein, 38 aa, Artificial Sequence
  Description of Artificial Sequence: Synthetic polypeptide
DEEEIRTTNPCATEQYGVVSTVNAGQAGNEQGTTEAGQ

SEQ ID NO: 160240 - protein, 38 aa, Artificial Sequence
  Description of Artificial Sequence: Synthetic polypeptide
DEEEIRTTNPCATEQYGVVSTVNNQQAGNEQGTEQGNE

SEQ ID NO: 160241 - protein, 31 aa, Artificial Sequence
  Description of Artificial Sequence: Synthetic polypeptide
DDSEVASTNPVSTEGYGNVAANTIQSRNGQR

SEQ ID NO: 160242 - protein, 38 aa, Artificial Sequence
  Description of Artificial Sequence: Synthetic polypeptide
DEEEIRTTNPVATEQYGVVSTVVTTNNNGTQGNTEQGS

SEQ ID NO: 160243 - protein, 32 aa, Artificial Sequence
  Description of Artificial Sequence: Synthetic polypeptide
DENEIATTNPVATECYGDISEEDIQQQQNENH

SEQ ID NO: 160244 - protein, 38 aa, Artificial Sequence
  Description of Artificial Sequence: Synthetic polypeptide
DEEEIRTTNPCATEQYGVVSTVNNLQQGAEQGTEQGSE

SEQ ID NO: 160245 - protein, 33 aa, Artificial Sequence
  Description of Artificial Sequence: Synthetic polypeptide
DEVSIATTNPVAYDPWGMVPSCTAEHSQRGDNR

SEQ ID NO: 160246 - protein, 33 aa, Artificial Sequence
  Description of Artificial Sequence: Synthetic polypeptide
DESEIRSTNPVSTEGYGNVAANNIPQSRVGEQG

SEQ ID NO: 160247 - protein, 34 aa, Artificial Sequence
  Description of Artificial Sequence: Synthetic polypeptide
SEEEIRTTNPVATEQYGSVQVQDWVYTEESDERE

SEQ ID NO: 160248 - protein, 37 aa, Artificial Sequence
  Description of Artificial Sequence: Synthetic polypeptide
SEEEIRTTNPVATEQYGSVNVSDNIAGGNQEGGEEGQ

SEQ ID NO: 160249 - protein, 31 aa, Artificial Sequence
  Description of Artificial Sequence: Synthetic polypeptide
DDSEVASTNPVSTEGYGNVAANTIQSRNGSR

SEQ ID NO: 160250 - protein, 39 aa, Artificial Sequence
  Description of Artificial Sequence: Synthetic polypeptide
DEEEIRTTNPCATEQYGVVSTVNPLQAGNTEQGTTEAGQ

SEQ ID NO: 160251 - protein, 38 aa, Artificial Sequence
  Description of Artificial Sequence: Synthetic polypeptide
DEEEIRTTNPCATEQYGVVSTVNGLQAGTEAGTTEAGQ

SEQ ID NO: 160252 - protein, 35 aa, Artificial Sequence
  Description of Artificial Sequence: Synthetic polypeptide
CEEEIRTTNPVATEQYGSVNTDTDDNMNEFEADDG

SEQ ID NO: 160253 - protein, 36 aa, Artificial Sequence
  Description of Artificial Sequence: Synthetic polypeptide
DEAEIRTTNPVATEQYGSNVWHVSQLNTVEGDEEQT

SEQ ID NO: 160254 - protein, 35 aa, Artificial Sequence
  Description of Artificial Sequence: Synthetic polypeptide
AEDEICATNPVATEQYGVVATTQNQLQQLGNGNDD

SEQ ID NO: 160255 - protein, 39 aa, Artificial Sequence
  Description of Artificial Sequence: Synthetic polypeptide
DEEEIRTTNPVATEQYGVVSTVVTTTNLQQGTEEEEEED

SEQ ID NO: 160256 - protein, 37 aa, Artificial Sequence
  Description of Artificial Sequence: Synthetic polypeptide
DEEEIRTTNPVATEQYGSVFLGIDDMTIEEPEQEGTP

SEQ ID NO: 160257 - protein, 38 aa, Artificial Sequence
  Description of Artificial Sequence: Synthetic polypeptide
DEEEIRTTNPVATEQYGVVSTVVTTNNDEQGNNTEETE

SEQ ID NO: 160258 - protein, 35 aa, Artificial Sequence
  Description of Artificial Sequence: Synthetic polypeptide
AEDEICATNPVATEQYGVVATTNQNLEQLGNGEDD

SEQ ID NO: 160259 - protein, 30 aa, Artificial Sequence
  Description of Artificial Sequence: Synthetic polypeptide
DENEIATTNPVATECYGDVANADWAHEEYL

SEQ ID NO: 160260 - protein, 36 aa, Artificial Sequence
  Description of Artificial Sequence: Synthetic polypeptide
DEQEIATTNPVGTEQYGSTVCSCTGLSEDHEGGENL

SEQ ID NO: 160261 - protein, 36 aa, Artificial Sequence
  Description of Artificial Sequence: Synthetic polypeptide
DEAEICTTNPVATECYGSVTTGNQGNQGGHGNGGND

SEQ ID NO: 160262 - protein, 38 aa, Artificial Sequence
  Description of Artificial Sequence: Synthetic polypeptide
DEEEIRTTNPVATEQYGVVSTVVTTQQQQQGTNTTNND

SEQ ID NO: 160263 - protein, 35 aa, Artificial Sequence
  Description of Artificial Sequence: Synthetic polypeptide
DEEEIRTTNPVATECYGAVSSNAEDWPAEPKGPPI

SEQ ID NO: 160264 - protein, 38 aa, Artificial Sequence
  Description of Artificial Sequence: Synthetic polypeptide
DEEEIRTTNPCATEQYGVVSTVNQLEQGTEQGTTEAGQ

SEQ ID NO: 160265 - protein, 35 aa, Artificial Sequence
  Description of Artificial Sequence: Synthetic polypeptide
DEAEIRTTNPVATEQYGSNWHVSQANTVEDEEEQN

SEQ ID NO: 160266 - protein, 37 aa, Artificial Sequence
  Description of Artificial Sequence: Synthetic polypeptide
DEAEIRTTNPVATEQYGSQVISSINDENTGNMSPIED

SEQ ID NO: 160267 - protein, 38 aa, Artificial Sequence
  Description of Artificial Sequence: Synthetic polypeptide
DEEEIRTTNPVATEQYGVVSTVVTTQAGTEQGTNQQEE

SEQ ID NO: 160268 - protein, 38 aa, Artificial Sequence
  Description of Artificial Sequence: Synthetic polypeptide
DEEEIRTTNPCATEQYGVVSTVVAEAGNLQQGTTEAGQ

SEQ ID NO: 160269 - protein, 37 aa, Artificial Sequence
  Description of Artificial Sequence: Synthetic polypeptide
CEEEIRTTNPVATEQYGSVNDENDGQGQEDEGNEFEE

SEQ ID NO: 160270 - protein, 33 aa, Artificial Sequence
  Description of Artificial Sequence: Synthetic polypeptide
DEEEIACTNPVATEQYGSCAAGNGDPAENPGED

SEQ ID NO: 160271 - protein, 31 aa, Artificial Sequence
  Description of Artificial Sequence: Synthetic polypeptide
DDSEVASTNPVSTEGYGNVAANTIQSRMGQR

SEQ ID NO: 160272 - protein, 36 aa, Artificial Sequence
  Description of Artificial Sequence: Synthetic polypeptide
DEGEIRTTNPVATEQYGSVTTPDPDLNERFEEMFQE

SEQ ID NO: 160273 - protein, 38 aa, Artificial Sequence
  Description of Artificial Sequence: Synthetic polypeptide
NEEEIRTTNPVATEQYGSVQCKGSAELQPDRLLVFENG

SEQ ID NO: 160274 - protein, 34 aa, Artificial Sequence
  Description of Artificial Sequence: Synthetic polypeptide
DEDEIRTTNPVAYEEWGSVCYTNIDNDHQQDGDN

SEQ ID NO: 160275 - protein, 35 aa, Artificial Sequence
  Description of Artificial Sequence: Synthetic polypeptide
DEVEIVTTNPVATEQYGTVVSATDGDDEEGEGNNI

SEQ ID NO: 160276 - protein, 36 aa, Artificial Sequence
  Description of Artificial Sequence: Synthetic polypeptide
DEAEIRTTNPVATEQYGSNVWWPDLTQPESNQDKDN

SEQ ID NO: 160277 - protein, 37 aa, Artificial Sequence
  Description of Artificial Sequence: Synthetic polypeptide
DEEEIRTTNPVATEQYGSVPSVYNDMEASIEMQELVQ

SEQ ID NO: 160278 - protein, 38 aa, Artificial Sequence
  Description of Artificial Sequence: Synthetic polypeptide
DEEEIRTTNPCATEQYGVVSTVSNTQAGTEQLGTNQDD

SEQ ID NO: 160279 - protein, 30 aa, Artificial Sequence
  Description of Artificial Sequence: Synthetic polypeptide
CENEIATTNPVAYEPYGKVSNHLSGHVTEL

SEQ ID NO: 160280 - protein, 34 aa, Artificial Sequence
  Description of Artificial Sequence: Synthetic polypeptide
DEEEIACTNPVATEQYGSCAAATNPEATDDMNDD

SEQ ID NO: 160281 - protein, 36 aa, Artificial Sequence
  Description of Artificial Sequence: Synthetic polypeptide
DEVEIVTTNPVATEQYGTVVSATDGDDNEGEGGNIT

SEQ ID NO: 160282 - protein, 35 aa, Artificial Sequence
  Description of Artificial Sequence: Synthetic polypeptide
DEVEIVTTNPVATEQYGTVVSATDGDDQEGEGEGT

SEQ ID NO: 160283 - protein, 31 aa, Artificial Sequence
  Description of Artificial Sequence: Synthetic polypeptide
CENEIATTNPVAYEPYGKVSNHELSQHETEK

SEQ ID NO: 160284 - protein, 38 aa, Artificial Sequence
  Description of Artificial Sequence: Synthetic polypeptide
DEEEIRTTNPCATEQYGVVSTVSNNQAGTEQGQTNQDD

SEQ ID NO: 160285 - protein, 35 aa, Artificial Sequence
  Description of Artificial Sequence: Synthetic polypeptide
DEEEIRTTNPCAYEEWGSVAMTLNDHSGGRGENDV

SEQ ID NO: 160286 - protein, 37 aa, Artificial Sequence
  Description of Artificial Sequence: Synthetic polypeptide
DEEEIRTTNPVATEQYGSVSPTGVIGSIVRQTETPVL

SEQ ID NO: 160287 - protein, 35 aa, Artificial Sequence
  Description of Artificial Sequence: Synthetic polypeptide
DEAEIRTTNPVATEQYGSNWWHVSQANTEEDEEQN

SEQ ID NO: 160288 - protein, 31 aa, Artificial Sequence
  Description of Artificial Sequence: Synthetic polypeptide
CENEIATTNPVAYEPYGKVSNHLSQKETEYL

SEQ ID NO: 160289 - protein, 38 aa, Artificial Sequence
  Description of Artificial Sequence: Synthetic polypeptide
DEEEIRTTNPCATEQYGVVSTVNEQQGGNQQGTEQGNE

SEQ ID NO: 160290 - protein, 34 aa, Artificial Sequence
  Description of Artificial Sequence: Synthetic polypeptide
DEDEIRTTNPVAYECWGVVAWTDDGLDQRGGGEQ

SEQ ID NO: 160291 - protein, 33 aa, Artificial Sequence
  Description of Artificial Sequence: Synthetic polypeptide
DENEIATTNPVATAFWGSVSGPNEPQDNAEENG

SEQ ID NO: 160292 - protein, 32 aa, Artificial Sequence
  Description of Artificial Sequence: Synthetic polypeptide
DDSEIASTNPVSTEGYGNVAANETIQSRVGQR

SEQ ID NO: 160293 - protein, 37 aa, Artificial Sequence
  Description of Artificial Sequence: Synthetic polypeptide
CEEEIRTTNPVATEQYGSVSILIATGDDQQEIGGDGT

SEQ ID NO: 160294 - protein, 31 aa, Artificial Sequence
  Description of Artificial Sequence: Synthetic polypeptide
DDSEVASTNPVSTEGYGNVAANTIQSRSGDR

SEQ ID NO: 160295 - protein, 31 aa, Artificial Sequence
  Description of Artificial Sequence: Synthetic polypeptide
DESEIRSTNPVGTEGYGVTWANSTWAEHGDI

SEQ ID NO: 160296 - protein, 37 aa, Artificial Sequence
  Description of Artificial Sequence: Synthetic polypeptide
CEEEIRTTNPVATEQYGSVSILIATGDEDQEIGGDGD

SEQ ID NO: 160297 - protein, 35 aa, Artificial Sequence
  Description of Artificial Sequence: Synthetic polypeptide
AEDEICATNPVATEQYGVVATTNENNLQLGNGTDQ

SEQ ID NO: 160298 - protein, 32 aa, Artificial Sequence
  Description of Artificial Sequence: Synthetic polypeptide
DDSEIASTNPVSTEGYGNVAANITIQSRVGQR

SEQ ID NO: 160299 - protein, 38 aa, Artificial Sequence
  Description of Artificial Sequence: Synthetic polypeptide
DEEEIRTTNPCATEQYGVVSTVNAQAGNSEQGTTEAGD

SEQ ID NO: 160300 - protein, 37 aa, Artificial Sequence
  Description of Artificial Sequence: Synthetic polypeptide
SEEEIRTTNPVATEQYGSVNQDTIGDDQEDEGQNEGQ

SEQ ID NO: 160301 - protein, 39 aa, Artificial Sequence
  Description of Artificial Sequence: Synthetic polypeptide
DEEEIRTTNPVATEQYGVVSTVVTTNLNNQQGTTETGSE

SEQ ID NO: 160302 - protein, 32 aa, Artificial Sequence
  Description of Artificial Sequence: Synthetic polypeptide
DEWEIRTTNPVSTEPYGTISMEDIQQQQNVNH

SEQ ID NO: 160303 - protein, 32 aa, Artificial Sequence
  Description of Artificial Sequence: Synthetic polypeptide
DDSEIASTNPVSTEGYGNVAANNIPQSRVGQR

SEQ ID NO: 160304 - protein, 36 aa, Artificial Sequence
  Description of Artificial Sequence: Synthetic polypeptide
DEYEIATTNPVATEQYGSVIDDVTNNGQGEQGGQQQ

SEQ ID NO: 160305 - protein, 35 aa, Artificial Sequence
  Description of Artificial Sequence: Synthetic polypeptide
DEYEIATTNPVATEQYGSVSAGGDGEDQEGEGDGI

SEQ ID NO: 160306 - protein, 39 aa, Artificial Sequence
  Description of Artificial Sequence: Synthetic polypeptide
DEEEIRTTNPCATEQYGVVSTVNALQAGNQEQGTTETGS

SEQ ID NO: 160307 - protein, 31 aa, Artificial Sequence
  Description of Artificial Sequence: Synthetic polypeptide
DDSEVASTNPVSTEGYGNVAANTIQSRSGQR

SEQ ID NO: 160308 - protein, 35 aa, Artificial Sequence
  Description of Artificial Sequence: Synthetic polypeptide
DEYEIATTNPVATEQYGSVSATGDGEDEEGEGDGE

SEQ ID NO: 160309 - protein, 36 aa, Artificial Sequence
  Description of Artificial Sequence: Synthetic polypeptide
DEEEIACTNPVATEQYGSACSVGNDQNDSGNDEMMN

SEQ ID NO: 160310 - protein, 31 aa, Artificial Sequence
  Description of Artificial Sequence: Synthetic polypeptide
DDSEVASTNPVSTEGYGNVAANTIQSRTGQR

SEQ ID NO: 160311 - protein, 34 aa, Artificial Sequence
  Description of Artificial Sequence: Synthetic polypeptide
DEEEIRTTNPCAYEGYGCCSCTNEPSGRGGDQVC

SEQ ID NO: 160312 - protein, 36 aa, Artificial Sequence
  Description of Artificial Sequence: Synthetic polypeptide
DEAEIRTTNPVATEQYGSLIWSYTDPTNDLEINDQE

SEQ ID NO: 160313 - protein, 37 aa, Artificial Sequence
  Description of Artificial Sequence: Synthetic polypeptide
DEVEIRTTNPVATEQYGSVSTLPDKMHNSRQEVSFED

SEQ ID NO: 160314 - protein, 38 aa, Artificial Sequence
  Description of Artificial Sequence: Synthetic polypeptide
DEEEIRTTNPCATEQYGVVSTVNAQAGNLEQGTTETGQ

SEQ ID NO: 160315 - protein, 33 aa, Artificial Sequence
  Description of Artificial Sequence: Synthetic polypeptide
AENEIACTNPVATEQYGQCSCSSNDQNFGSGQS

SEQ ID NO: 160316 - protein, 31 aa, Artificial Sequence
  Description of Artificial Sequence: Synthetic polypeptide
DDSEVASTNPVSTEGYGNVAANTIQSRQGQR

SEQ ID NO: 160317 - protein, 36 aa, Artificial Sequence
  Description of Artificial Sequence: Synthetic polypeptide
NEEEIRTTNPVATEQYGSVGNNVDTPGQLGPEGQGD

SEQ ID NO: 160318 - protein, 34 aa, Artificial Sequence
  Description of Artificial Sequence: Synthetic polypeptide
DEAEIRTTNPVATEQYGSMYTWLMESMESIEDTM

SEQ ID NO: 160319 - protein, 34 aa, Artificial Sequence
  Description of Artificial Sequence: Synthetic polypeptide
DEAEIRTTNPVATEQYGSMFTTWLMESESIEDQC

SEQ ID NO: 160320 - protein, 38 aa, Artificial Sequence
  Description of Artificial Sequence: Synthetic polypeptide
CEEEIRTTNPVATEQYGSVQCKESAELQNDFGLTFENG

SEQ ID NO: 160321 - protein, 32 aa, Artificial Sequence
  Description of Artificial Sequence: Synthetic polypeptide
DEWEIRTTNPVATEQWGGIDVSEIEMNAAEDA

SEQ ID NO: 160322 - protein, 34 aa, Artificial Sequence
  Description of Artificial Sequence: Synthetic polypeptide
DEDEIRTTNPVAYECWGVCSTGNLPGMNEGGDNQ

SEQ ID NO: 160323 - protein, 34 aa, Artificial Sequence
  Description of Artificial Sequence: Synthetic polypeptide
DENEIATTNPVATAAWGSVSGNNPPQDAGGENVG

SEQ ID NO: 160324 - protein, 39 aa, Artificial Sequence
  Description of Artificial Sequence: Synthetic polypeptide
DEEEIRTTNPVATEQYGVVSTVVTTTNNQQGTEENEEET

SEQ ID NO: 160325 - protein, 33 aa, Artificial Sequence
  Description of Artificial Sequence: Synthetic polypeptide
DESEIRSTNPVGTEGYGVVSSSPTGQRNGMDPV

SEQ ID NO: 160326 - protein, 31 aa, Artificial Sequence
  Description of Artificial Sequence: Synthetic polypeptide
DDSEVASTNPVSTEGYGNVAANTIQSRPGQR

SEQ ID NO: 160327 - protein, 37 aa, Artificial Sequence
  Description of Artificial Sequence: Synthetic polypeptide
DEEEIQTTNPVATEQYGRVYSPTEMAGPNMRNGMNPV

SEQ ID NO: 160328 - protein, 34 aa, Artificial Sequence
  Description of Artificial Sequence: Synthetic polypeptide
DESEIRSTNPVGTEGYGVVSSSPTGPQRNGMDPV

SEQ ID NO: 160329 - protein, 37 aa, Artificial Sequence
  Description of Artificial Sequence: Synthetic polypeptide
DEAEIRTTNPVATEQYGSLVSSSIMLEELFNGNEEIF

SEQ ID NO: 160330 - protein, 35 aa, Artificial Sequence
  Description of Artificial Sequence: Synthetic polypeptide
AEDEICATNPVATEQYGVVATTNENQLQLGNGNDD

SEQ ID NO: 160331 - protein, 37 aa, Artificial Sequence
  Description of Artificial Sequence: Synthetic polypeptide
DECEICTTNPVATEQYGVVSTVTVGNNDEQGEGNNDT

SEQ ID NO: 160332 - protein, 31 aa, Artificial Sequence
  Description of Artificial Sequence: Synthetic polypeptide
DDSEIASTNPVSTEGYGNVAANDIQDRVGQL

SEQ ID NO: 160333 - protein, 36 aa, Artificial Sequence
  Description of Artificial Sequence: Synthetic polypeptide
NEEEIRTTNPVATEQYGSVIGPTNNLAGIPLEIEDT

SEQ ID NO: 160334 - protein, 34 aa, Artificial Sequence
  Description of Artificial Sequence: Synthetic polypeptide
CEEEIATTNPVATEQYGSACAANGIETEAPGGNT

SEQ ID NO: 160335 - protein, 33 aa, Artificial Sequence
  Description of Artificial Sequence: Synthetic polypeptide
DEMEICTTNPVATEQYGTVCTATDGTVEFEGFY

SEQ ID NO: 160336 - protein, 36 aa, Artificial Sequence
  Description of Artificial Sequence: Synthetic polypeptide
CEEEIRTTNPVATEQYGSVSDGGLGDGEDGDEGEDT

SEQ ID NO: 160337 - protein, 32 aa, Artificial Sequence
  Description of Artificial Sequence: Synthetic polypeptide
DDSEIASTNPVSTEGYGNVAANDTIQSRVGQR

SEQ ID NO: 160338 - protein, 33 aa, Artificial Sequence
  Description of Artificial Sequence: Synthetic polypeptide
QEQEIATTNPVATEMYGSVSATDPFEDHEGEDL

SEQ ID NO: 160339 - protein, 36 aa, Artificial Sequence
  Description of Artificial Sequence: Synthetic polypeptide
CEEEIRTTNPVATEQYGSVSDGGLGGGEDGEEGEDN

SEQ ID NO: 160340 - protein, 36 aa, Artificial Sequence
  Description of Artificial Sequence: Synthetic polypeptide
DEAEIRTTNPVATEQYGSLVNSGWVSLEFGEFEQQV

SEQ ID NO: 160341 - protein, 34 aa, Artificial Sequence
  Description of Artificial Sequence: Synthetic polypeptide
DEDEIRTTNPVAYECWGSVCFTNEDGDDRGGDQI

SEQ ID NO: 160342 - protein, 35 aa, Artificial Sequence
  Description of Artificial Sequence: Synthetic polypeptide
DEEEIATTNPVATEQYGSVCAAMGEEAGDEMGNNH

SEQ ID NO: 160343 - protein, 36 aa, Artificial Sequence
  Description of Artificial Sequence: Synthetic polypeptide
QEEEIRTTNPVATEQYGMVGSIMTGQEDNGGDNDDD

SEQ ID NO: 160344 - protein, 30 aa, Artificial Sequence
  Description of Artificial Sequence: Synthetic polypeptide
DDSEIASTNPVSTEGYGVVAANTIQSSGQQ

SEQ ID NO: 160345 - protein, 32 aa, Artificial Sequence
  Description of Artificial Sequence: Synthetic polypeptide
DENEIATTNPVATEQWGSVSAEDEMDHAEEDA

SEQ ID NO: 160346 - protein, 36 aa, Artificial Sequence
  Description of Artificial Sequence: Synthetic polypeptide
DEEEIRTTNPVATEQYGSVQLAVDEQIENTEEAGIM

SEQ ID NO: 160347 - protein, 35 aa, Artificial Sequence
  Description of Artificial Sequence: Synthetic polypeptide
DEEEIRTTNPVATEQYGDVVVGEGQGQGDGDGEEI

SEQ ID NO: 160348 - protein, 35 aa, Artificial Sequence
  Description of Artificial Sequence: Synthetic polypeptide
NEEEIRTTNPVAYEQWGCVYNVLNDLDQMGHRPRE

SEQ ID NO: 160349 - protein, 36 aa, Artificial Sequence
  Description of Artificial Sequence: Synthetic polypeptide
DEEEIRTTNPVATEQYGSVTFNTMVSEECQSVVEES

SEQ ID NO: 160350 - protein, 36 aa, Artificial Sequence
  Description of Artificial Sequence: Synthetic polypeptide
DEEEIRTTNPVATEQYGDVVVQTDNMNGTGGEQEGD

SEQ ID NO: 160351 - protein, 36 aa, Artificial Sequence
  Description of Artificial Sequence: Synthetic polypeptide
DEEEIRTTNPVATEQYGDVVVQTDNMNGTGGMEEQD

SEQ ID NO: 160352 - protein, 37 aa, Artificial Sequence
  Description of Artificial Sequence: Synthetic polypeptide
DECEICTTNPVATEQYGTVSTVTNGTNLEAGENNEDQ

SEQ ID NO: 160353 - protein, 34 aa, Artificial Sequence
  Description of Artificial Sequence: Synthetic polypeptide
DEEEIRTTNPVAYEPYGQSVSIAEGSTSPPGISE

SEQ ID NO: 160354 - protein, 37 aa, Artificial Sequence
  Description of Artificial Sequence: Synthetic polypeptide
DEEEIRTTNPVATEQYGSVQLLTPVQQQIRTIPMEDD

SEQ ID NO: 160355 - protein, 39 aa, Artificial Sequence
  Description of Artificial Sequence: Synthetic polypeptide
DEEEIRTTNPVATEQYGVVSTVVTNQQGNQQGTNNDEED

SEQ ID NO: 160356 - protein, 36 aa, Artificial Sequence
  Description of Artificial Sequence: Synthetic polypeptide
DEEEIRTTNPVATEQYGDVYSIQMIVGMEGNGNEDG

SEQ ID NO: 160357 - protein, 35 aa, Artificial Sequence
  Description of Artificial Sequence: Synthetic polypeptide
DENEIRTTNPVAYEQWGGVYTIEIDENNQAEGDAR

SEQ ID NO: 160358 - protein, 31 aa, Artificial Sequence
  Description of Artificial Sequence: Synthetic polypeptide
QEGEIAPTNPCSYEQWGIVSCNLEQSGGDTR

SEQ ID NO: 160359 - protein, 35 aa, Artificial Sequence
  Description of Artificial Sequence: Synthetic polypeptide
DEEEIRTTNPVATEQYGDYSWMEAVQNQEQMSVQI

SEQ ID NO: 160360 - protein, 37 aa, Artificial Sequence
  Description of Artificial Sequence: Synthetic polypeptide
DEEEIRTTNPVATEQYGDYTISPSFVTEKNPRDGEHQ

SEQ ID NO: 160361 - protein, 31 aa, Artificial Sequence
  Description of Artificial Sequence: Synthetic polypeptide
DDSEIACTNPVSTEGYGNVAAETIQSRVGQR

SEQ ID NO: 160362 - protein, 34 aa, Artificial Sequence
  Description of Artificial Sequence: Synthetic polypeptide
NEEEIRTTNPVAYEQWGEAWSQRNDDVQRDDIRR

SEQ ID NO: 160363 - protein, 31 aa, Artificial Sequence
  Description of Artificial Sequence: Synthetic polypeptide
QEEEIRTTNPVATEQWGAAWAADWQEHKEPK

SEQ ID NO: 160364 - protein, 32 aa, Artificial Sequence
  Description of Artificial Sequence: Synthetic polypeptide
DDSEVATTNPVSTEQYGNVAATDLQSHVGQDL

SEQ ID NO: 160365 - protein, 33 aa, Artificial Sequence
  Description of Artificial Sequence: Synthetic polypeptide
DEEAEIATTNPCAYEQWGSVCYNIEEKRDGQDS

SEQ ID NO: 160366 - protein, 37 aa, Artificial Sequence
  Description of Artificial Sequence: Synthetic polypeptide
DEEEIRTTNPVATEQYGSVQLTELTAVEPNMALVEVA

SEQ ID NO: 160367 - protein, 34 aa, Artificial Sequence
  Description of Artificial Sequence: Synthetic polypeptide
DEEEIRTTNPVAYEPYGQCVFIHEGSTSPPGAPR

SEQ ID NO: 160368 - protein, 35 aa, Artificial Sequence
  Description of Artificial Sequence: Synthetic polypeptide
DENEIRTTNPVATEQYGMATIMTNGGQEGGEQEGE

SEQ ID NO: 160369 - protein, 32 aa, Artificial Sequence
  Description of Artificial Sequence: Synthetic polypeptide
DEVEIRTTNPCATEQWGDVSSEIEVMNAAEDA

SEQ ID NO: 160370 - protein, 37 aa, Artificial Sequence
  Description of Artificial Sequence: Synthetic polypeptide
AEEEIRTTNPVATEQYGSVYTNNNNQNGTEAGTTTEA

SEQ ID NO: 160371 - protein, 36 aa, Artificial Sequence
  Description of Artificial Sequence: Synthetic polypeptide
DENEIATTNPVATEQWGSVAITNHEEATGDQDGGNP

SEQ ID NO: 160372 - protein, 34 aa, Artificial Sequence
  Description of Artificial Sequence: Synthetic polypeptide
DEEEISTVNPVATEQYGCVCSWEEDNQNFNSQQA

SEQ ID NO: 160373 - protein, 37 aa, Artificial Sequence
  Description of Artificial Sequence: Synthetic polypeptide
DEEEIRTTNPVATEQYGSVQITQLDTPEMNSDPNMDL

SEQ ID NO: 160374 - protein, 33 aa, Artificial Sequence
  Description of Artificial Sequence: Synthetic polypeptide
DEDTICTTNPVATEGYGSVDSIGGQGDGQGETT

SEQ ID NO: 160375 - protein, 36 aa, Artificial Sequence
  Description of Artificial Sequence: Synthetic polypeptide
DENEIATTNPVATEQWGSVAITNPDEEATGNQDGNP

SEQ ID NO: 160376 - protein, 30 aa, Artificial Sequence
  Description of Artificial Sequence: Synthetic polypeptide
QEGEIAPTNPCSYEQWGIVSCNIQSMGDTR

SEQ ID NO: 160377 - protein, 37 aa, Artificial Sequence
  Description of Artificial Sequence: Synthetic polypeptide
DEEEIRTTNPVATEQYGSVQITQLITPEENSLPSMDL

SEQ ID NO: 160378 - protein, 34 aa, Artificial Sequence
  Description of Artificial Sequence: Synthetic polypeptide
DEEEIRTTNPEATRQYGQVPRSDSTQPSVGEEFA

SEQ ID NO: 160379 - protein, 37 aa, Artificial Sequence
  Description of Artificial Sequence: Synthetic polypeptide
DEEEIRTTNPVATEQYGSVQITWLDTPEENSSLNMDI

SEQ ID NO: 160380 - protein, 31 aa, Artificial Sequence
  Description of Artificial Sequence: Synthetic polypeptide
DDSEIRSTNPVATEQWGNVSAEIEMNAAGDA

SEQ ID NO: 160381 - protein, 37 aa, Artificial Sequence
  Description of Artificial Sequence: Synthetic polypeptide
DENEIRTTNPVATEQYGMVGSIMNQLIEEGGGEDENG

SEQ ID NO: 160382 - protein, 35 aa, Artificial Sequence
  Description of Artificial Sequence: Synthetic polypeptide
DESEIRETNPVATECWGAGVPSCINEHQDREGENG

SEQ ID NO: 160383 - protein, 34 aa, Artificial Sequence
  Description of Artificial Sequence: Synthetic polypeptide
DEDTIRTTNPVATEQYGDVADDVEGQGTGGNGNE

SEQ ID NO: 160384 - protein, 36 aa, Artificial Sequence
  Description of Artificial Sequence: Synthetic polypeptide
DENEIRTTNPVATEQYGNSCSSTSALDEQMNQEEEV

SEQ ID NO: 160385 - protein, 34 aa, Artificial Sequence
  Description of Artificial Sequence: Synthetic polypeptide
DENEIRTTNPVATEQYGNCCSADSVLLTENEDHI

SEQ ID NO: 160386 - protein, 35 aa, Artificial Sequence
  Description of Artificial Sequence: Synthetic polypeptide
AEDEICATNPVATEQYGVVATSENNLLQLGNGNDD

SEQ ID NO: 160387 - protein, 31 aa, Artificial Sequence
  Description of Artificial Sequence: Synthetic polypeptide
QEEEIRTTNPVATEQWGAAWAAVWQEHKEPK

SEQ ID NO: 160388 - protein, 37 aa, Artificial Sequence
  Description of Artificial Sequence: Synthetic polypeptide
DEEEIRTTNPVATEQYGSVTEWVNLDPVQPEVHEQEN

SEQ ID NO: 160389 - protein, 35 aa, Artificial Sequence
  Description of Artificial Sequence: Synthetic polypeptide
CEECIACTNPVATEQYGSVSWNEGEQERQRHNTEK

SEQ ID NO: 160390 - protein, 37 aa, Artificial Sequence
  Description of Artificial Sequence: Synthetic polypeptide
AEEEIRTTNPVATEQYGSVYTNNNNQNGTEAGTTDSQ

SEQ ID NO: 160391 - protein, 37 aa, Artificial Sequence
  Description of Artificial Sequence: Synthetic polypeptide
DECEICTTNPVATEQYGTVSTVTNGTNLEQGETTNED

SEQ ID NO: 160392 - protein, 36 aa, Artificial Sequence
  Description of Artificial Sequence: Synthetic polypeptide
DEEEIRTTNPVATEQYGDVVVDGFGQENDQDEDGTQ

SEQ ID NO: 160393 - protein, 34 aa, Artificial Sequence
  Description of Artificial Sequence: Synthetic polypeptide
DEDTIRTTNPVATEQYGDVADDLEGQGTGGGGGE

SEQ ID NO: 160394 - protein, 37 aa, Artificial Sequence
  Description of Artificial Sequence: Synthetic polypeptide
DEEEIRTTNPVATEQYGSVQITQLDTPEENTQPNMDL

SEQ ID NO: 160395 - protein, 36 aa, Artificial Sequence
  Description of Artificial Sequence: Synthetic polypeptide
DENEIRTTNPVATEQYGLCASVTDHDLQTGEVEQQY

SEQ ID NO: 160396 - protein, 36 aa, Artificial Sequence
  Description of Artificial Sequence: Synthetic polypeptide
DEEEIRTTNPVATEQYGSVTGDSMGEEVPEGEVPEI

SEQ ID NO: 160397 - protein, 36 aa, Artificial Sequence
  Description of Artificial Sequence: Synthetic polypeptide
DEVEIRSTNPVATEQYGSVITDNNAGNDEGEQGGQG

SEQ ID NO: 160398 - protein, 37 aa, Artificial Sequence
  Description of Artificial Sequence: Synthetic polypeptide
DEEAEICTTNPVATECWGVVSTGNGLLDDDRGQNDGA

SEQ ID NO: 160399 - protein, 35 aa, Artificial Sequence
  Description of Artificial Sequence: Synthetic polypeptide
DEEAEICTTNPVAYEQWGEVATGGNQQDHQAGNTM

SEQ ID NO: 160400 - protein, 35 aa, Artificial Sequence
  Description of Artificial Sequence: Synthetic polypeptide
DEEAEICTTNPVAYEQWGEVATGGNQQDMQGGNIM

SEQ ID NO: 160401 - protein, 36 aa, Artificial Sequence
  Description of Artificial Sequence: Synthetic polypeptide
DEVEIRSTNPVATEQYGSVITDNNAGNDEGEGGNQT

SEQ ID NO: 160402 - protein, 36 aa, Artificial Sequence
  Description of Artificial Sequence: Synthetic polypeptide
DEVEIRSTNPVATEQYGSVITDNNAGNDEGEGGNDP

SEQ ID NO: 160403 - protein, 33 aa, Artificial Sequence
  Description of Artificial Sequence: Synthetic polypeptide
DDSEIRSTNPVSTEGWGSVSCINEPQSREGEQG

SEQ ID NO: 160404 - protein, 35 aa, Artificial Sequence
  Description of Artificial Sequence: Synthetic polypeptide
NEEEIATTNPVATEQYGSCPATDHEEQPDDQGSRM

SEQ ID NO: 160405 - protein, 34 aa, Artificial Sequence
  Description of Artificial Sequence: Synthetic polypeptide
NEEEIRTTNPVAYEQWGEYWSVLNDDEQRQDISR

SEQ ID NO: 160406 - protein, 34 aa, Artificial Sequence
  Description of Artificial Sequence: Synthetic polypeptide
NEEEIATTNPVATEQYGSCPALHLEAPDDQMGRH

SEQ ID NO: 160407 - protein, 35 aa, Artificial Sequence
  Description of Artificial Sequence: Synthetic polypeptide
NEEEIATTNPVATEQYGSCPATDHLEAPDNQMGEH

SEQ ID NO: 160408 - protein, 33 aa, Artificial Sequence
  Description of Artificial Sequence: Synthetic polypeptide
CEEEIATTNPVATEQYGCVAPGEHGLDSEGEKH

SEQ ID NO: 160409 - protein, 34 aa, Artificial Sequence
  Description of Artificial Sequence: Synthetic polypeptide
DESEIRTTNPIATECWGATVAAINEQEREGENYG

SEQ ID NO: 160410 - protein, 35 aa, Artificial Sequence
  Description of Artificial Sequence: Synthetic polypeptide
DEGEIRTTNPVATEQYGSVNVQLVGEFGIPQEDHD

SEQ ID NO: 160411 - protein, 36 aa, Artificial Sequence
  Description of Artificial Sequence: Synthetic polypeptide
DEEEIRTTNPVATEQYGSVTHTGEDHNDENIEETQE

SEQ ID NO: 160412 - protein, 38 aa, Artificial Sequence
  Description of Artificial Sequence: Synthetic polypeptide
DEEEIRTTNPVATEQYGVVSTVVVTNNQQGQEEEEEES

SEQ ID NO: 160413 - protein, 38 aa, Artificial Sequence
  Description of Artificial Sequence: Synthetic polypeptide
DEEEIRTTNPVATEQYGVVSTVVVTNNQQGTEEEEEGT

SEQ ID NO: 160414 - protein, 36 aa, Artificial Sequence
  Description of Artificial Sequence: Synthetic polypeptide
DDEEIRTTNPVATDQYGSVSGDGQGGEGNDGEEDDT

SEQ ID NO: 160415 - protein, 38 aa, Artificial Sequence
  Description of Artificial Sequence: Synthetic polypeptide
DEEEIRTTNPVATEQYGVVSTVVVTNNQQGTEEEETTD

SEQ ID NO: 160416 - protein, 29 aa, Artificial Sequence
  Description of Artificial Sequence: Synthetic peptide
QESEIASTNPCGTEGYGVIASTLQVIGDI

SEQ ID NO: 160417 - protein, 36 aa, Artificial Sequence
  Description of Artificial Sequence: Synthetic polypeptide
DEEEIRTTNPVATEQYGSVTHTTEDHNDPESYEEDG

SEQ ID NO: 160418 - protein, 39 aa, Artificial Sequence
  Description of Artificial Sequence: Synthetic polypeptide
DEEEIRTTNPVATEQYGVVSTVVTNQQGNQQGTNAQEND

SEQ ID NO: 160419 - protein, 39 aa, Artificial Sequence
  Description of Artificial Sequence: Synthetic polypeptide
DEEEIRTTNPVATEQYGVVSTVNQQLQQGTSEQGSTQDE

SEQ ID NO: 160420 - protein, 31 aa, Artificial Sequence
  Description of Artificial Sequence: Synthetic polypeptide
DDSEVASTNPVSTEGYGNVAANTIQQRVGNH

SEQ ID NO: 160421 - protein, 36 aa, Artificial Sequence
  Description of Artificial Sequence: Synthetic polypeptide
DECEICTTNPVATEQYGTVSTVTNGNVESGENTNED

SEQ ID NO: 160422 - protein, 31 aa, Artificial Sequence
  Description of Artificial Sequence: Synthetic polypeptide
DENEIRTTNPVAYEQWGKDVSEIEMNAAEDA

SEQ ID NO: 160423 - protein, 31 aa, Artificial Sequence
  Description of Artificial Sequence: Synthetic polypeptide
QEGEIAPTNPCSYEQWGIVSCNLKQDQGDTR

SEQ ID NO: 160424 - protein, 37 aa, Artificial Sequence
  Description of Artificial Sequence: Synthetic polypeptide
DEEEIRTTNPVAYEPYGIVTVSYQGNELSMVRGPVRN

SEQ ID NO: 160425 - protein, 37 aa, Artificial Sequence
  Description of Artificial Sequence: Synthetic polypeptide
AEEEIRTTNPVATEQYGSVYTNQNNQNGTEAGTTESG

SEQ ID NO: 160426 - protein, 37 aa, Artificial Sequence
  Description of Artificial Sequence: Synthetic polypeptide
DEEEIRTTNPVAYEPYGITTVSYEGNELSMVRGPMRF

SEQ ID NO: 160427 - protein, 34 aa, Artificial Sequence
  Description of Artificial Sequence: Synthetic polypeptide
DENEIATTNPVATEQWGSVSGEGPGIANAGHGHH

SEQ ID NO: 160428 - protein, 33 aa, Artificial Sequence
  Description of Artificial Sequence: Synthetic polypeptide
DEEAEIATTNPVAYEQWGSVAWNENDNHNGGTV

SEQ ID NO: 160429 - protein, 38 aa, Artificial Sequence
  Description of Artificial Sequence: Synthetic polypeptide
DEEEIRTTNPVATEQYGSVQLTESTAQEPNMLLVEVAM

SEQ ID NO: 160430 - protein, 36 aa, Artificial Sequence
  Description of Artificial Sequence: Synthetic polypeptide
DEEEIRTTNPVATECYGTTTATILTVNEQPLTVNRN

SEQ ID NO: 160431 - protein, 37 aa, Artificial Sequence
  Description of Artificial Sequence: Synthetic polypeptide
DEEEIRTTNPVATEQYGSVQLTEYTANEDNVLLVEVA

SEQ ID NO: 160432 - protein, 35 aa, Artificial Sequence
  Description of Artificial Sequence: Synthetic polypeptide
DEEAEIATTNPVAYEQWGSVSGGNGNTAGEGNDTQ

SEQ ID NO: 160433 - protein, 33 aa, Artificial Sequence
  Description of Artificial Sequence: Synthetic polypeptide
DENEIATTNPVATEQWGTVSEPGEGMNAAEDNA

SEQ ID NO: 160434 - protein, 34 aa, Artificial Sequence
  Description of Artificial Sequence: Synthetic polypeptide
DEEEIRTTNPVCTEGYGCVCSWPEHNQNFGSDQM

SEQ ID NO: 160435 - protein, 31 aa, Artificial Sequence
  Description of Artificial Sequence: Synthetic polypeptide
QEGEIAPTNPCSYEQWGIVSCNLQLSQGDTR

SEQ ID NO: 160436 - protein, 34 aa, Artificial Sequence
  Description of Artificial Sequence: Synthetic polypeptide
DEEAEIATTNPVAYEQWGSVTGNGNGNSGEGNTS

SEQ ID NO: 160437 - protein, 35 aa, Artificial Sequence
  Description of Artificial Sequence: Synthetic polypeptide
DEEAEIATTNPVAYEQWGSVTGPMNQGGEPGENER

SEQ ID NO: 160438 - protein, 31 aa, Artificial Sequence
  Description of Artificial Sequence: Synthetic polypeptide
DENEIATTNPVATEQWGTHVSEGEMNAAEDH

SEQ ID NO: 160439 - protein, 37 aa, Artificial Sequence
  Description of Artificial Sequence: Synthetic polypeptide
DEEEIRTTNPVATEQYGECATPEMMESTVLENGTLND

SEQ ID NO: 160440 - protein, 35 aa, Artificial Sequence
  Description of Artificial Sequence: Synthetic polypeptide
DQEEIRTTNPVATHQYGCVCSSGEGDQNFGSDNQS

SEQ ID NO: 160441 - protein, 35 aa, Artificial Sequence
  Description of Artificial Sequence: Synthetic polypeptide
DQEEIRTTNPVATHQYGCVCSTEGDQENFNSDNQS

SEQ ID NO: 160442 - protein, 33 aa, Artificial Sequence
  Description of Artificial Sequence: Synthetic polypeptide
DENEIATTNPVATEQWGTVCAATNGPEETEIND

SEQ ID NO: 160443 - protein, 38 aa, Artificial Sequence
  Description of Artificial Sequence: Synthetic polypeptide
DEEEIRTTNPVATEQYGVVSTVNQQNGTEQGTTEQGSQ

SEQ ID NO: 160444 - protein, 36 aa, Artificial Sequence
  Description of Artificial Sequence: Synthetic polypeptide
DQEEIRTTNPVATHQYGCVCSTWEGHQENFGSDNQS

SEQ ID NO: 160445 - protein, 36 aa, Artificial Sequence
  Description of Artificial Sequence: Synthetic polypeptide
DENEIATTNPVATEQWGSVSMTGNPEPGGNQMENTV

SEQ ID NO: 160446 - protein, 35 aa, Artificial Sequence
  Description of Artificial Sequence: Synthetic polypeptide
DEEEIRTTNPVATEAYGVVVGMGQGNEQNDEAGED

SEQ ID NO: 160447 - protein, 31 aa, Artificial Sequence
  Description of Artificial Sequence: Synthetic polypeptide
DDSEIRSTNPVATEQWGDVSAEIEMNAAGDA

SEQ ID NO: 160448 - protein, 36 aa, Artificial Sequence
  Description of Artificial Sequence: Synthetic polypeptide
DEEEIRTTNPVATEQYGSVQITLDTPEENSVPNEDL

SEQ ID NO: 160449 - protein, 36 aa, Artificial Sequence
  Description of Artificial Sequence: Synthetic polypeptide
DEEEIRTTNPVATEQYGDVVNGFGMNQDQEGGDEQT

SEQ ID NO: 160450 - protein, 33 aa, Artificial Sequence
  Description of Artificial Sequence: Synthetic polypeptide
DESEIRGTNPVATDAYGVISITGGQGDTGNGDG

SEQ ID NO: 160451 - protein, 35 aa, Artificial Sequence
  Description of Artificial Sequence: Synthetic polypeptide
NEEEIATTNPVATEQYGSVCAMNNGNLEPADLPNA

SEQ ID NO: 160452 - protein, 37 aa, Artificial Sequence
  Description of Artificial Sequence: Synthetic polypeptide
NEEEIATTNPVATEQYGSVCAATMHLEAPDNQMENRH

SEQ ID NO: 160453 - protein, 36 aa, Artificial Sequence
  Description of Artificial Sequence: Synthetic polypeptide
NEEEIRTTNPVAYEQWGCSYNVLRNDLDQMGTRPRD

SEQ ID NO: 160454 - protein, 38 aa, Artificial Sequence
  Description of Artificial Sequence: Synthetic polypeptide
DEEEIRTTNPVATEQYGSVGDAEMSNLTQPEPGQVETT

SEQ ID NO: 160455 - protein, 36 aa, Artificial Sequence
  Description of Artificial Sequence: Synthetic polypeptide
DEEEIRTTNPVATEQYGDVVNGFGTQDQIEGGDEQF

SEQ ID NO: 160456 - protein, 35 aa, Artificial Sequence
  Description of Artificial Sequence: Synthetic polypeptide
DEDEISTTNPVAYEQYGTVATENGGQQNGMQRGEA

SEQ ID NO: 160457 - protein, 34 aa, Artificial Sequence
  Description of Artificial Sequence: Synthetic polypeptide
DEDEISTTNPVAYEQYGTVCSATDGPSEFTGGND

SEQ ID NO: 160458 - protein, 29 aa, Artificial Sequence
  Description of Artificial Sequence: Synthetic peptide
QEGEIAPTNPCSYEQWGIVACNWQSGDTR

SEQ ID NO: 160459 - protein, 37 aa, Artificial Sequence
  Description of Artificial Sequence: Synthetic polypeptide
DEEEIRTTNPVATEQYGDVVNGFGMDNLDQEGGDEQT

SEQ ID NO: 160460 - protein, 36 aa, Artificial Sequence
  Description of Artificial Sequence: Synthetic polypeptide
DEEEIRTTNPVATEQYGDVVNGFGTQDQQEGEDEQT

SEQ ID NO: 160461 - protein, 35 aa, Artificial Sequence
  Description of Artificial Sequence: Synthetic polypeptide
DEEEIRTTNPVGTEFYGSVNIMDNMNMGEGGNDGD

SEQ ID NO: 160462 - protein, 37 aa, Artificial Sequence
  Description of Artificial Sequence: Synthetic polypeptide
DECEICTTNPVATEQYGTVSTVTNQQQGNQQGNNQED

SEQ ID NO: 160463 - protein, 38 aa, Artificial Sequence
  Description of Artificial Sequence: Synthetic polypeptide
DEEEIRTTNPVATEQYGSVQIPNTNFLLDHQNVVDPQV

SEQ ID NO: 160464 - protein, 30 aa, Artificial Sequence
  Description of Artificial Sequence: Synthetic polypeptide
DENEIRTTNPVAYEPWGDVSEIEMNAAEDA

SEQ ID NO: 160465 - protein, 30 aa, Artificial Sequence
  Description of Artificial Sequence: Synthetic polypeptide
QEGEIAPTNPCSYEQWGIVPCNLQSDGDTR

SEQ ID NO: 160466 - protein, 35 aa, Artificial Sequence
  Description of Artificial Sequence: Synthetic polypeptide
DEDEIVTTNPVATEQYGAVVSATDGEEEGEGENDD

SEQ ID NO: 160467 - protein, 35 aa, Artificial Sequence
  Description of Artificial Sequence: Synthetic polypeptide
DENEIRTTNPVATEQYGSAQPVMYSLEVSSDVNTH

SEQ ID NO: 160468 - protein, 29 aa, Artificial Sequence
  Description of Artificial Sequence: Synthetic peptide
QEQEIASTNPVGTEGYGVMAASTLEHGDI

SEQ ID NO: 160469 - protein, 31 aa, Artificial Sequence
  Description of Artificial Sequence: Synthetic polypeptide
QEQEIASTNPVGTEGYGSVSASDLEDHEGEI

SEQ ID NO: 160470 - protein, 36 aa, Artificial Sequence
  Description of Artificial Sequence: Synthetic polypeptide
DENEIRTTNPVATEQYGSACFSWWLNENQQQSGEFQ

SEQ ID NO: 160471 - protein, 33 aa, Artificial Sequence
  Description of Artificial Sequence: Synthetic polypeptide
DESEIRGTNPVATDAYGVISINGNQEGTGNGDG

SEQ ID NO: 160472 - protein, 31 aa, Artificial Sequence
  Description of Artificial Sequence: Synthetic polypeptide
DENEIRTTNPVAYEQWGCVSKEIEMNTAEDA

SEQ ID NO: 160473 - protein, 35 aa, Artificial Sequence
  Description of Artificial Sequence: Synthetic polypeptide
DEHEIRTTNPVAYEQWGSVCSGDNNGDDRQDGSEM

SEQ ID NO: 160474 - protein, 36 aa, Artificial Sequence
  Description of Artificial Sequence: Synthetic polypeptide
DEEEIRTTNPVATEQYGDVVNGFGDNDQEGGDGQTG

SEQ ID NO: 160475 - protein, 37 aa, Artificial Sequence
  Description of Artificial Sequence: Synthetic polypeptide
DEEEIRTTNPVATEQWGICQVCSNTNDHNARFGSGFS

SEQ ID NO: 160476 - protein, 37 aa, Artificial Sequence
  Description of Artificial Sequence: Synthetic polypeptide
DEDEIRTTNPVATEQYGVVSTVVVNNQNEQGTEDETD

SEQ ID NO: 160477 - protein, 36 aa, Artificial Sequence
  Description of Artificial Sequence: Synthetic polypeptide
DEEEIRTTNPVATEQYGDVVGGFGDLNDQEGGDEQT

SEQ ID NO: 160478 - protein, 37 aa, Artificial Sequence
  Description of Artificial Sequence: Synthetic polypeptide
DEMEIATTNPVAYEQYGTVCSYTDGLVEGQQRMKGNS

SEQ ID NO: 160479 - protein, 36 aa, Artificial Sequence
  Description of Artificial Sequence: Synthetic polypeptide
CEEEIRTTNPVATEQYGDVVTGIQNDGQEEDGQQEF

SEQ ID NO: 160480 - protein, 38 aa, Artificial Sequence
  Description of Artificial Sequence: Synthetic polypeptide
AEEEIRTTNPVATEQYGSVVVVVTTNNNNQAGDENEED

SEQ ID NO: 160481 - protein, 37 aa, Artificial Sequence
  Description of Artificial Sequence: Synthetic polypeptide
CEEEIRTTNPVATEQYGDVVSIMGMTGDQEGGGGNGI

SEQ ID NO: 160482 - protein, 37 aa, Artificial Sequence
  Description of Artificial Sequence: Synthetic polypeptide
AEEEIRTTNPVATEQYGSVVVVVTTNNNQEQGETEDD

SEQ ID NO: 160483 - protein, 36 aa, Artificial Sequence
  Description of Artificial Sequence: Synthetic polypeptide
DEEEIRTTNPVATEQYGDVVGSGMGNLIEISDDDDT

SEQ ID NO: 160484 - protein, 38 aa, Artificial Sequence
  Description of Artificial Sequence: Synthetic polypeptide
DEEEIRTTNPVATEQYGSVYTGTMNAGGQDENNEDGQP

SEQ ID NO: 160485 - protein, 35 aa, Artificial Sequence
  Description of Artificial Sequence: Synthetic polypeptide
DEEEIRTTNPVATEQYGDVVNGFGDQDQDGGDEAT

SEQ ID NO: 160486 - protein, 38 aa, Artificial Sequence
  Description of Artificial Sequence: Synthetic polypeptide
DEEEIRTTNPVATEQYGDVVGSGMGNLQQTIEDDNLFI

SEQ ID NO: 160487 - protein, 37 aa, Artificial Sequence
  Description of Artificial Sequence: Synthetic polypeptide
DEEEIRTTNPVATEQYGDVVGSGMGNLQSDSDEDDDE

SEQ ID NO: 160488 - protein, 37 aa, Artificial Sequence
  Description of Artificial Sequence: Synthetic polypeptide
DEEEIRTTNPVATEQYGDVVGSGMGNLQSTVTDDDGT

SEQ ID NO: 160489 - protein, 36 aa, Artificial Sequence
  Description of Artificial Sequence: Synthetic polypeptide
DEMEIATTNPVAYEQYGTVCSYTDGLVEGERGGGNS

SEQ ID NO: 160490 - protein, 35 aa, Artificial Sequence
  Description of Artificial Sequence: Synthetic polypeptide
DEEEIRTTNPVATEQYGDVVIGNNMDNGEGDEDTG

SEQ ID NO: 160491 - protein, 35 aa, Artificial Sequence
  Description of Artificial Sequence: Synthetic polypeptide
NEEEIRTTNPVAYEQWGCSYNVHRNDDDQMGHRPR

SEQ ID NO: 160492 - protein, 34 aa, Artificial Sequence
  Description of Artificial Sequence: Synthetic polypeptide
DEEEIACTNPVATEQYGSACAGTGLAPGEQMEGE

SEQ ID NO: 160493 - protein, 37 aa, Artificial Sequence
  Description of Artificial Sequence: Synthetic polypeptide
DEEEIRTTNPVATEQYGDVVNDDQNSGIQEGQGNEDN

SEQ ID NO: 160494 - protein, 31 aa, Artificial Sequence
  Description of Artificial Sequence: Synthetic polypeptide
DDSEIATTNPVSTEGYGTVCSANTPEFVGQD

SEQ ID NO: 160495 - protein, 38 aa, Artificial Sequence
  Description of Artificial Sequence: Synthetic polypeptide
AEEEIRTTNPVATEQYGSVVVVVTTNNQQGTTDENDET

SEQ ID NO: 160496 - protein, 34 aa, Artificial Sequence
  Description of Artificial Sequence: Synthetic polypeptide
NEEEIRTTNPVAYEQWGCSYNVINDRDQMGHRGR

SEQ ID NO: 160497 - protein, 38 aa, Artificial Sequence
  Description of Artificial Sequence: Synthetic polypeptide
AEEEIRTTNPVATEQYGSVVVVVTTNNQQGATDENNED

SEQ ID NO: 160498 - protein, 31 aa, Artificial Sequence
  Description of Artificial Sequence: Synthetic polypeptide
DDSEVASTNPVSTEGYGNVAANTIQQRVGQR

SEQ ID NO: 160499 - protein, 32 aa, Artificial Sequence
  Description of Artificial Sequence: Synthetic polypeptide
DDSEIRSTNPIATEGYGNVANATIQERVGQYR

SEQ ID NO: 160500 - protein, 31 aa, Artificial Sequence
  Description of Artificial Sequence: Synthetic polypeptide
DENEIRTTNPVAYEQWGDVSEICEMNAAEDA

SEQ ID NO: 160501 - protein, 37 aa, Artificial Sequence
  Description of Artificial Sequence: Synthetic polypeptide
DEEEIRTTNPVATEQYGDVVSDGMTVGQGEGETDGEG

SEQ ID NO: 160502 - protein, 32 aa, Artificial Sequence
  Description of Artificial Sequence: Synthetic polypeptide
DENEIRTTNPVAYEQWGGVYSIEIEMNGAEDA

SEQ ID NO: 160503 - protein, 36 aa, Artificial Sequence
  Description of Artificial Sequence: Synthetic polypeptide
DEEEIRTTNPVATEQYGDVVSDGQIEQLIGGGGGTQ

SEQ ID NO: 160504 - protein, 32 aa, Artificial Sequence
  Description of Artificial Sequence: Synthetic polypeptide
DDSEVATTNPVSTEQYGNVAATTLQSHVGQDL

SEQ ID NO: 160505 - protein, 36 aa, Artificial Sequence
  Description of Artificial Sequence: Synthetic polypeptide
DEEEIRTTNPVATEQYGSVQIQLDTPEENSSNNMDL

SEQ ID NO: 160506 - protein, 34 aa, Artificial Sequence
  Description of Artificial Sequence: Synthetic polypeptide
DENEIATTNPVATEQWGSVAGPNEPGQEHNNQQE

SEQ ID NO: 160507 - protein, 36 aa, Artificial Sequence
  Description of Artificial Sequence: Synthetic polypeptide
DEDESIRTTNPVAYEPWGCVVSTCANEQSQGNDGNR

SEQ ID NO: 160508 - protein, 33 aa, Artificial Sequence
  Description of Artificial Sequence: Synthetic polypeptide
DENEIRTTNPVAYEQWGGVYSIEIEMNQREDAN

SEQ ID NO: 160509 - protein, 35 aa, Artificial Sequence
  Description of Artificial Sequence: Synthetic polypeptide
DEEEISTTNPVGTEQYGCVCSTMEDPNANFGSDQA

SEQ ID NO: 160510 - protein, 35 aa, Artificial Sequence
  Description of Artificial Sequence: Synthetic polypeptide
DEEEISTTNPVGTEQYGCVCSWEDDNANFGSQNQS

SEQ ID NO: 160511 - protein, 36 aa, Artificial Sequence
  Description of Artificial Sequence: Synthetic polypeptide
DEEEIRTTNPVATEQYGDVVQTDTNMNGTGGEEEGA

SEQ ID NO: 160512 - protein, 36 aa, Artificial Sequence
  Description of Artificial Sequence: Synthetic polypeptide
DQEEIRTTNPVATCQYGCVCSTEGDNQENFGSNNQS

SEQ ID NO: 160513 - protein, 35 aa, Artificial Sequence
  Description of Artificial Sequence: Synthetic polypeptide
NEEEIRTTNPVAYEQWGCSYNVTRDDGDQRGHRPR

SEQ ID NO: 160514 - protein, 35 aa, Artificial Sequence
  Description of Artificial Sequence: Synthetic polypeptide
DEEEISTTNPVSTEQYGCVCQSGELNQEGFGSQQS

SEQ ID NO: 160515 - protein, 38 aa, Artificial Sequence
  Description of Artificial Sequence: Synthetic polypeptide
DEDEIRTTNPVATEQYGVVSTVVNTNLEAGNNTEDEDD

SEQ ID NO: 160516 - protein, 36 aa, Artificial Sequence
  Description of Artificial Sequence: Synthetic polypeptide
DQEEIRTTNPVATCQYGCVCSTGEGVNQNFGSQNQS

SEQ ID NO: 160517 - protein, 36 aa, Artificial Sequence
  Description of Artificial Sequence: Synthetic polypeptide
DEEEIATTNPVATEQYGSVCAAENNEEAPDNQGENH

SEQ ID NO: 160518 - protein, 35 aa, Artificial Sequence
  Description of Artificial Sequence: Synthetic polypeptide
DEDNIATTNPVAYECWGSVSTGNGLNMNDQGGGSR

SEQ ID NO: 160519 - protein, 39 aa, Artificial Sequence
  Description of Artificial Sequence: Synthetic polypeptide
AEEEIRTTNPVATEQYGSVVVVVVTTNLQQGSEQGNNVE

SEQ ID NO: 160520 - protein, 34 aa, Artificial Sequence
  Description of Artificial Sequence: Synthetic polypeptide
DEEEISTVNPVATEQYGCVCSNWEDNQHFNSQQS

SEQ ID NO: 160521 - protein, 38 aa, Artificial Sequence
  Description of Artificial Sequence: Synthetic polypeptide
DEDEIRTTNPVATEQYGVVSTVVNTNLEAGNNNSTEDE

SEQ ID NO: 160522 - protein, 33 aa, Artificial Sequence
  Description of Artificial Sequence: Synthetic polypeptide
DENEIATTNPCAYGAHYGSVSTNLQNHDEMAME

SEQ ID NO: 160523 - protein, 34 aa, Artificial Sequence
  Description of Artificial Sequence: Synthetic polypeptide
DEEEISTTNPVSTEQYGCVCGWGELNQGFGSQQA

SEQ ID NO: 160524 - protein, 35 aa, Artificial Sequence
  Description of Artificial Sequence: Synthetic polypeptide
NEEEIRTTNPVAYEQWGCSYNVPRDDHDQRGHRPD

SEQ ID NO: 160525 - protein, 36 aa, Artificial Sequence
  Description of Artificial Sequence: Synthetic polypeptide
DEEEIRTTNPVATEQYGDVVQTDQNMNGTGGDEEGD

SEQ ID NO: 160526 - protein, 36 aa, Artificial Sequence
  Description of Artificial Sequence: Synthetic polypeptide
DEEEIRTTNPVATEQYGDVVQTDNGNEDEMGEGEGI

SEQ ID NO: 160527 - protein, 36 aa, Artificial Sequence
  Description of Artificial Sequence: Synthetic polypeptide
DENEIRTTNPVATEQYGRVTTVWLPEEGENLQIDEI

SEQ ID NO: 160528 - protein, 35 aa, Artificial Sequence
  Description of Artificial Sequence: Synthetic polypeptide
DEEEISTTNPVAYEQYGQCVCSWNDHNQNFGSEQA

SEQ ID NO: 160529 - protein, 36 aa, Artificial Sequence
  Description of Artificial Sequence: Synthetic polypeptide
DENEIRTTNPVATEQYGQVTTVWLPDEEENLQIDEI

SEQ ID NO: 160530 - protein, 38 aa, Artificial Sequence
  Description of Artificial Sequence: Synthetic polypeptide
DECEICTTNPVATEQYGTVSTVTNLQRATNEEGATTDT

SEQ ID NO: 160531 - protein, 35 aa, Artificial Sequence
  Description of Artificial Sequence: Synthetic polypeptide
AEDEICATNPVATEQYGVVATVVNLQALNGNGEDD

SEQ ID NO: 160532 - protein, 35 aa, Artificial Sequence
  Description of Artificial Sequence: Synthetic polypeptide
SEEEIRTTNPAATEQYGSVVQGDDNQEGQGGEGET

SEQ ID NO: 160533 - protein, 37 aa, Artificial Sequence
  Description of Artificial Sequence: Synthetic polypeptide
DQEEIATTNPVAYEQYGQVVVSDTNGLSQYRGGEYHD

SEQ ID NO: 160534 - protein, 35 aa, Artificial Sequence
  Description of Artificial Sequence: Synthetic polypeptide
DEDEIVTTNPVATEQYGTVVSATDGEDEGGEGNDD

SEQ ID NO: 160535 - protein, 32 aa, Artificial Sequence
  Description of Artificial Sequence: Synthetic polypeptide
DDSEVATTNPVSTEQYGNVSATDLESHVGQDL

SEQ ID NO: 160536 - protein, 35 aa, Artificial Sequence
  Description of Artificial Sequence: Synthetic polypeptide
SEEEIRTTNPAATEQYGSVAGDDNTTGQGENEGET

SEQ ID NO: 160537 - protein, 36 aa, Artificial Sequence
  Description of Artificial Sequence: Synthetic polypeptide
DEEEIRTTNPVATEQYGDVVQTDPNMNGTGGEEEMQ

SEQ ID NO: 160538 - protein, 38 aa, Artificial Sequence
  Description of Artificial Sequence: Synthetic polypeptide
AEEEIRTTNPVATEQYGSVVVVVTTNQGNLQQGTDEED

SEQ ID NO: 160539 - protein, 30 aa, Artificial Sequence
  Description of Artificial Sequence: Synthetic polypeptide
QEEEIRTTNPVATEQWGEAPNEVWAEHEEK

SEQ ID NO: 160540 - protein, 36 aa, Artificial Sequence
  Description of Artificial Sequence: Synthetic polypeptide
NEEEIRTTNPVAYEQWGCSYNVPREDNDQRPGGRPV

SEQ ID NO: 160541 - protein, 39 aa, Artificial Sequence
  Description of Artificial Sequence: Synthetic polypeptide
DEEEIRTTNPVATEQYGVVSTVVVTNLQQLNNQDEEGED

SEQ ID NO: 160542 - protein, 30 aa, Artificial Sequence
  Description of Artificial Sequence: Synthetic polypeptide
DENEIRTTNPVAYEQWGDVWEIEMNAAEDA

SEQ ID NO: 160543 - protein, 37 aa, Artificial Sequence
  Description of Artificial Sequence: Synthetic polypeptide
SEEEIRTTNCVATEQYGSVCGSVTGDNGQGGEQEQIE

SEQ ID NO: 160544 - protein, 32 aa, Artificial Sequence
  Description of Artificial Sequence: Synthetic polypeptide
DENEIATTNPVATEQWGNVSEGWEPMNAAEDA

SEQ ID NO: 160545 - protein, 35 aa, Artificial Sequence
  Description of Artificial Sequence: Synthetic polypeptide
DEEEIACTNPVATEQYGSACAGIGLAPGEQMEGNH

SEQ ID NO: 160546 - protein, 36 aa, Artificial Sequence
  Description of Artificial Sequence: Synthetic polypeptide
DEEEIRTTNPVATEQYGDVVQNTDNMNGTGGEEEGT

SEQ ID NO: 160547 - protein, 32 aa, Artificial Sequence
  Description of Artificial Sequence: Synthetic polypeptide
DEDELATTNPVAYEQWGMTSTNWNQGDLGDSS

SEQ ID NO: 160548 - protein, 36 aa, Artificial Sequence
  Description of Artificial Sequence: Synthetic polypeptide
DEEEIRTTNPVATECYGSVVGFGNNLTIDGMEGGQG

SEQ ID NO: 160549 - protein, 35 aa, Artificial Sequence
  Description of Artificial Sequence: Synthetic polypeptide
DQEEIGTTNPVATEQYGCVSTTWSAMTNEGNEDFA

SEQ ID NO: 160550 - protein, 35 aa, Artificial Sequence
  Description of Artificial Sequence: Synthetic polypeptide
DEEEIATTNPVATEQYGSVCAAMAHGSNAMPNDNP

SEQ ID NO: 160551 - protein, 36 aa, Artificial Sequence
  Description of Artificial Sequence: Synthetic polypeptide
DECEICTTNPVATEQYGTVSTVTNGNVEEGEEENED

SEQ ID NO: 160552 - protein, 34 aa, Artificial Sequence
  Description of Artificial Sequence: Synthetic polypeptide
AEDEICATNPVATEQYGVVATSENLQQLLGGTDE

SEQ ID NO: 160553 - protein, 33 aa, Artificial Sequence
  Description of Artificial Sequence: Synthetic polypeptide
DEEAIRTTNPVAHYQYGAVTWTDNLPTVFDSAF

SEQ ID NO: 160554 - protein, 38 aa, Artificial Sequence
  Description of Artificial Sequence: Synthetic polypeptide
DEEEIRTTNPVATEQYGSVPSPNLNNLGVETQEMMFDL

SEQ ID NO: 160555 - protein, 34 aa, Artificial Sequence
  Description of Artificial Sequence: Synthetic polypeptide
DEEAIRTTNPVAHYQYGSVWTDNNLPTVFDLSAF

SEQ ID NO: 160556 - protein, 34 aa, Artificial Sequence
  Description of Artificial Sequence: Synthetic polypeptide
DEEAIRTTNPVAHYQYGSVWWTDNLPTVFDSAFD

SEQ ID NO: 160557 - protein, 35 aa, Artificial Sequence
  Description of Artificial Sequence: Synthetic polypeptide
DEMEIATTNPVAYEQYGTVCSYTDGLNEEHNGNDE

SEQ ID NO: 160558 - protein, 36 aa, Artificial Sequence
  Description of Artificial Sequence: Synthetic polypeptide
CEEEIATTNPVATEQWGSVSMSGDTPTNNDDLGNFM

SEQ ID NO: 160559 - protein, 37 aa, Artificial Sequence
  Description of Artificial Sequence: Synthetic polypeptide
DEEEIRTTNPVATEQWGEVSSTGPAAGPNMRNGMNPV

SEQ ID NO: 160560 - protein, 35 aa, Artificial Sequence
  Description of Artificial Sequence: Synthetic polypeptide
DEAEIRTTNPVATEQYGCYNAVENHLVQDSGEEFN

SEQ ID NO: 160561 - protein, 37 aa, Artificial Sequence
  Description of Artificial Sequence: Synthetic polypeptide
DEMEIATTNPVAYEQYGTVCSYTDGLNEDHQRGMNES

SEQ ID NO: 160562 - protein, 34 aa, Artificial Sequence
  Description of Artificial Sequence: Synthetic polypeptide
DEEEIRTTNPCATEPYGNCAATNLATAPGGEEWN

SEQ ID NO: 160563 - protein, 35 aa, Artificial Sequence
  Description of Artificial Sequence: Synthetic polypeptide
DEEAIRTTNPTAVEQYGSVSTVKHSSETPMNSDRN

SEQ ID NO: 160564 - protein, 34 aa, Artificial Sequence
  Description of Artificial Sequence: Synthetic polypeptide
DEEEIRTTNPCATEPYGNCAATNLATAPGAEMWP

SEQ ID NO: 160565 - protein, 36 aa, Artificial Sequence
  Description of Artificial Sequence: Synthetic polypeptide
DEEEIRTTNPCATEPYGNCAASGNLGQATPGDNQAH

SEQ ID NO: 160566 - protein, 31 aa, Artificial Sequence
  Description of Artificial Sequence: Synthetic polypeptide
QEGEIAPTNPCSYEQWGIVSKNLEQTDGDTR

SEQ ID NO: 160567 - protein, 34 aa, Artificial Sequence
  Description of Artificial Sequence: Synthetic polypeptide
DEEEIRTTNPCATEPYGNCAAGTNLATAPGDEMA

SEQ ID NO: 160568 - protein, 34 aa, Artificial Sequence
  Description of Artificial Sequence: Synthetic polypeptide
DEMEIATTNPVAYEQYGTVCSLTDGPDEFEGNDQ

SEQ ID NO: 160569 - protein, 33 aa, Artificial Sequence
  Description of Artificial Sequence: Synthetic polypeptide
DESEIRATNPVAYEQWGSTCPTDNIGDQRQSQN

SEQ ID NO: 160570 - protein, 37 aa, Artificial Sequence
  Description of Artificial Sequence: Synthetic polypeptide
AEEEIRTTNPVATEQYGTVVVSVTNNNNAEQGETNTD

SEQ ID NO: 160571 - protein, 33 aa, Artificial Sequence
  Description of Artificial Sequence: Synthetic polypeptide
DEVEIGTTNPVATEQYGVVVVANAGMEGFGDQG

SEQ ID NO: 160572 - protein, 34 aa, Artificial Sequence
  Description of Artificial Sequence: Synthetic polypeptide
DEMEIATTNPVAYEQYGTVCSATDRPDEHEGNDN

SEQ ID NO: 160573 - protein, 38 aa, Artificial Sequence
  Description of Artificial Sequence: Synthetic polypeptide
AEEEIRTTNPVATEQYGTVVVSVTNNNNNQEQGENEDT

SEQ ID NO: 160574 - protein, 37 aa, Artificial Sequence
  Description of Artificial Sequence: Synthetic polypeptide
DEDEIRTTNPVATEQYGVVSTVVNNNQNENEEEEEQD

SEQ ID NO: 160575 - protein, 38 aa, Artificial Sequence
  Description of Artificial Sequence: Synthetic polypeptide
DEDEIRTTNPVATEQYGVVSTVVNNQNGNNQAGTTESG

SEQ ID NO: 160576 - protein, 33 aa, Artificial Sequence
  Description of Artificial Sequence: Synthetic polypeptide
DDQEIATTNPVATEQYGSVTAMDLEDHEGQEDL

SEQ ID NO: 160577 - protein, 35 aa, Artificial Sequence
  Description of Artificial Sequence: Synthetic polypeptide
DEEAIRTTNPMAYPQYGSVNAPTDNILPQWTENIE

SEQ ID NO: 160578 - protein, 35 aa, Artificial Sequence
  Description of Artificial Sequence: Synthetic polypeptide
DEVEIHTTNPVATEQYGTVVSATDGDDEEGEGGNA

SEQ ID NO: 160579 - protein, 28 aa, Artificial Sequence
  Description of Artificial Sequence: Synthetic peptide
QESEIASTNPIGTEGYGVMADTLQHGDI

SEQ ID NO: 160580 - protein, 35 aa, Artificial Sequence
  Description of Artificial Sequence: Synthetic polypeptide
DQMEISTTNPVATEQYGTVCSATDAQVEFQGPNDQ

SEQ ID NO: 160581 - protein, 28 aa, Artificial Sequence
  Description of Artificial Sequence: Synthetic peptide
QESEIASTNPIGTEGYGVMASTLQHADI

SEQ ID NO: 160582 - protein, 33 aa, Artificial Sequence
  Description of Artificial Sequence: Synthetic polypeptide
DQQEIATTNPVATEQYGCVAATPDLEDHIGEDL

SEQ ID NO: 160583 - protein, 37 aa, Artificial Sequence
  Description of Artificial Sequence: Synthetic polypeptide
DEMEIATTNPVAYEQYGTVCSYTDGLNEEQRGGNNEI

SEQ ID NO: 160584 - protein, 34 aa, Artificial Sequence
  Description of Artificial Sequence: Synthetic polypeptide
DQQEIATTNPVATEQYGSVPATPDLEDHIGEDLT

SEQ ID NO: 160585 - protein, 29 aa, Artificial Sequence
  Description of Artificial Sequence: Synthetic peptide
QESEIASTNPIGTEGYGVMASTLQHGMDN

SEQ ID NO: 160586 - protein, 37 aa, Artificial Sequence
  Description of Artificial Sequence: Synthetic polypeptide
DEEEIRTTNPVAYEQWGHTNVSYWNELQHQRPGGDAH

SEQ ID NO: 160587 - protein, 34 aa, Artificial Sequence
  Description of Artificial Sequence: Synthetic polypeptide
DEEAIRTTNPCAYEQWGSVYCHDNDQHRAGHGHA

SEQ ID NO: 160588 - protein, 35 aa, Artificial Sequence
  Description of Artificial Sequence: Synthetic polypeptide
CEEEIATTNPVATEQWGTSQSLATALGQHDDMTRN

SEQ ID NO: 160589 - protein, 34 aa, Artificial Sequence
  Description of Artificial Sequence: Synthetic polypeptide
DEEAIRTTNPMAYPCYGSVIAPTDNLPQWTENIN

SEQ ID NO: 160590 - protein, 35 aa, Artificial Sequence
  Description of Artificial Sequence: Synthetic polypeptide
DQQEIATTNPVATEQYGSVSATPDLEDHIGIEDLF

SEQ ID NO: 160591 - protein, 36 aa, Artificial Sequence
  Description of Artificial Sequence: Synthetic polypeptide
DEVEIHTTNPVATEQYGTVVSATDGDDEEGQGGNGI

SEQ ID NO: 160592 - protein, 34 aa, Artificial Sequence
  Description of Artificial Sequence: Synthetic polypeptide
DQQEIATTNPVATEQYGSVSATPDLEDHIWEDPT

SEQ ID NO: 160593 - protein, 37 aa, Artificial Sequence
  Description of Artificial Sequence: Synthetic polypeptide
DENEIRTTNPVATEQYGDVIMSSTNGDEQDEGGEGGT

SEQ ID NO: 160594 - protein, 35 aa, Artificial Sequence
  Description of Artificial Sequence: Synthetic polypeptide
DDQEIATTNPVATEQYGSVTATLDLEDHIGIEDLR

SEQ ID NO: 160595 - protein, 36 aa, Artificial Sequence
  Description of Artificial Sequence: Synthetic polypeptide
DQQEIATTNPVAYEQYGSVCSTTEGLDGARGGENMI

SEQ ID NO: 160596 - protein, 35 aa, Artificial Sequence
  Description of Artificial Sequence: Synthetic polypeptide
NEEEIATTNPVATEQWGCVAGTGPLAPDNQMGKNV

SEQ ID NO: 160597 - protein, 35 aa, Artificial Sequence
  Description of Artificial Sequence: Synthetic polypeptide
DENEIATTNPVATEQYGCVAANNGLEATDSGNNHH

SEQ ID NO: 160598 - protein, 31 aa, Artificial Sequence
  Description of Artificial Sequence: Synthetic polypeptide
QEQEIATTNPVATEQYGEASAEVCEDHGEDL

SEQ ID NO: 160599 - protein, 36 aa, Artificial Sequence
  Description of Artificial Sequence: Synthetic polypeptide
DEMEIATTNPVAYEQYGTVCSYTDGLNEEHRGQNDH

SEQ ID NO: 160600 - protein, 37 aa, Artificial Sequence
  Description of Artificial Sequence: Synthetic polypeptide
DEGEIRTTNPVATEQYGSVMPTTNWPHVIEGSNEDVE

SEQ ID NO: 160601 - protein, 33 aa, Artificial Sequence
  Description of Artificial Sequence: Synthetic polypeptide
DEGEIRTTNPVAYEQWGYCQEDLQIRPMDTQRM

SEQ ID NO: 160602 - protein, 36 aa, Artificial Sequence
  Description of Artificial Sequence: Synthetic polypeptide
DEEEIRTTNPVATEQYGSVTPPPLDVAPIEANIEHG

SEQ ID NO: 160603 - protein, 31 aa, Artificial Sequence
  Description of Artificial Sequence: Synthetic polypeptide
DQSEVASTNPVSTEGYGEVAANTDQSRVGQR

SEQ ID NO: 160604 - protein, 31 aa, Artificial Sequence
  Description of Artificial Sequence: Synthetic polypeptide
DQSEVASTNPVSTEGYGNVAANTIQSRAGQR

SEQ ID NO: 160605 - protein, 36 aa, Artificial Sequence
  Description of Artificial Sequence: Synthetic polypeptide
DEGEIRTTNPVATEQYGSVLWVVTASETQFEGVEDQ

SEQ ID NO: 160606 - protein, 33 aa, Artificial Sequence
  Description of Artificial Sequence: Synthetic polypeptide
SEEEIRCTNPTAYEQWGSTVYGENDMHRGDNEK

SEQ ID NO: 160607 - protein, 34 aa, Artificial Sequence
  Description of Artificial Sequence: Synthetic polypeptide
DEMEIATTNPVAYEQYGTVCSATDGPVEDHEGNM

SEQ ID NO: 160608 - protein, 33 aa, Artificial Sequence
  Description of Artificial Sequence: Synthetic polypeptide
SEEEIRCTNPTAYEQWGSTVYGENDMHRGDHGR

SEQ ID NO: 160609 - protein, 34 aa, Artificial Sequence
  Description of Artificial Sequence: Synthetic polypeptide
SEEEIRCTNPTAYEQWGSTVYGENDDMHRGDNRR

SEQ ID NO: 160610 - protein, 37 aa, Artificial Sequence
  Description of Artificial Sequence: Synthetic polypeptide
DEGEIRTTNPVATEQYGSVLSVLDANEDSEGMQNNQI

SEQ ID NO: 160611 - protein, 34 aa, Artificial Sequence
  Description of Artificial Sequence: Synthetic polypeptide
DEEAIRTTNPVATEQWGCVCGWGELQEHFGSDQA

SEQ ID NO: 160612 - protein, 36 aa, Artificial Sequence
  Description of Artificial Sequence: Synthetic polypeptide
DEEEIRTTNPVAYEHYGSVTACTAAISQAKGGSPRV

SEQ ID NO: 160613 - protein, 34 aa, Artificial Sequence
  Description of Artificial Sequence: Synthetic polypeptide
SEEEIRCTNPTAYEQWGSCVYGENQDMHRGDNGR

SEQ ID NO: 160614 - protein, 37 aa, Artificial Sequence
  Description of Artificial Sequence: Synthetic polypeptide
AEEEIRTTNPVATEQYGTVVVVVTNNNNQEQGEGNTD

SEQ ID NO: 160615 - protein, 34 aa, Artificial Sequence
  Description of Artificial Sequence: Synthetic polypeptide
SEEEIRCTNPTAYEQWGSTVYGENDMHRGGGNSR

SEQ ID NO: 160616 - protein, 38 aa, Artificial Sequence
  Description of Artificial Sequence: Synthetic polypeptide
DEEEIRTTNPVATEQYGSVPSITPNMDSSWPALVIIES

SEQ ID NO: 160617 - protein, 34 aa, Artificial Sequence
  Description of Artificial Sequence: Synthetic polypeptide
DDQEIATTNPVATEQYGCVSATPDLEDHIGEDLN

SEQ ID NO: 160618 - protein, 35 aa, Artificial Sequence
  Description of Artificial Sequence: Synthetic polypeptide
CEEEISTTNPVATEQYGCVCSNSEDQENFGSDNQS

SEQ ID NO: 160619 - protein, 37 aa, Artificial Sequence
  Description of Artificial Sequence: Synthetic polypeptide
AEEEIRTTNPVATEQYGTVVVVVTNNNNQEQGENNQD

SEQ ID NO: 160620 - protein, 31 aa, Artificial Sequence
  Description of Artificial Sequence: Synthetic polypeptide
DENEIRTTNPVAYEQWGTVSKEIEMNKAEDI

SEQ ID NO: 160621 - protein, 32 aa, Artificial Sequence
  Description of Artificial Sequence: Synthetic polypeptide
SEEEIRCTNPTAYEQWGCVWGENDMNRTGNSP

SEQ ID NO: 160622 - protein, 36 aa, Artificial Sequence
  Description of Artificial Sequence: Synthetic polypeptide
DEEEIRTTNPVATEQYGSIGEPIVFTQDAQAPIQVL

SEQ ID NO: 160623 - protein, 31 aa, Artificial Sequence
  Description of Artificial Sequence: Synthetic polypeptide
SEEEIRCTNPTAYEQWGCVWGENDMHRTGHS

SEQ ID NO: 160624 - protein, 32 aa, Artificial Sequence
  Description of Artificial Sequence: Synthetic polypeptide
SEEEIRCTNPTAYEQWGCVWGENDMHRDKNTR

SEQ ID NO: 160625 - protein, 35 aa, Artificial Sequence
  Description of Artificial Sequence: Synthetic polypeptide
DSAEIRTTNPVATEQYGSVCSLLQLEEIGQMEDHE

SEQ ID NO: 160626 - protein, 31 aa, Artificial Sequence
  Description of Artificial Sequence: Synthetic polypeptide
QEGEIAPTNPCSYEQWGIVSKPLEQSRGDTR

SEQ ID NO: 160627 - protein, 34 aa, Artificial Sequence
  Description of Artificial Sequence: Synthetic polypeptide
DESEIRATNPVATEFYGSVIDDNDGEGQGGEEGG

SEQ ID NO: 160628 - protein, 31 aa, Artificial Sequence
  Description of Artificial Sequence: Synthetic polypeptide
DQSEVASTNPVSTEGYGNVAANNIQSRVGQR

SEQ ID NO: 160629 - protein, 35 aa, Artificial Sequence
  Description of Artificial Sequence: Synthetic polypeptide
DEEEIATTNPVATEQYGSVCAAMEHGPADSGENHA

SEQ ID NO: 160630 - protein, 32 aa, Artificial Sequence
  Description of Artificial Sequence: Synthetic polypeptide
DEGEIRTTNPVAYEQWGYCQEDNKRGMDERGK

SEQ ID NO: 160631 - protein, 31 aa, Artificial Sequence
  Description of Artificial Sequence: Synthetic polypeptide
DQSEVASTNPVSTEGYGNVAANTIQSRVGQR

SEQ ID NO: 160632 - protein, 31 aa, Artificial Sequence
  Description of Artificial Sequence: Synthetic polypeptide
DQSEVASTNPVSTEGYGNVAANTIQTRVGQR

SEQ ID NO: 160633 - protein, 32 aa, Artificial Sequence
  Description of Artificial Sequence: Synthetic polypeptide
DDSEVRTTNPVSTECWGNVSACTEQSRVGENG

SEQ ID NO: 160634 - protein, 38 aa, Artificial Sequence
  Description of Artificial Sequence: Synthetic polypeptide
AEEEIRTTNPVATEQYGTVVVSVTTNNNNQEQGENNTD

SEQ ID NO: 160635 - protein, 31 aa, Artificial Sequence
  Description of Artificial Sequence: Synthetic polypeptide
DQSEVASTNPVSTEGYGNVAVNTIQSRVGQR

SEQ ID NO: 160636 - protein, 36 aa, Artificial Sequence
  Description of Artificial Sequence: Synthetic polypeptide
DEEEIRTTNPVATEQYGSVQNAIFEQIENTEEDNDM

SEQ ID NO: 160637 - protein, 34 aa, Artificial Sequence
  Description of Artificial Sequence: Synthetic polypeptide
DEMEIATTNPVAYEQYGTVCSATDRPDEFEGNAD

SEQ ID NO: 160638 - protein, 34 aa, Artificial Sequence
  Description of Artificial Sequence: Synthetic polypeptide
DENEIRTTNPVATEQYGCVWCPQNVEDSESQQRE

SEQ ID NO: 160639 - protein, 34 aa, Artificial Sequence
  Description of Artificial Sequence: Synthetic polypeptide
DEMEIATTNPVAYEQYGTVCSATDGPVETEGNDA

SEQ ID NO: 160640 - protein, 36 aa, Artificial Sequence
  Description of Artificial Sequence: Synthetic polypeptide
DEEEIRTTNPVATEQYGSVQNAVEEVIENTEEANDM

SEQ ID NO: 160641 - protein, 33 aa, Artificial Sequence
  Description of Artificial Sequence: Synthetic polypeptide
SEEEIRCTNPTAYEQWGSTVYGENDMNRHGDNM

SEQ ID NO: 160642 - protein, 37 aa, Artificial Sequence
  Description of Artificial Sequence: Synthetic polypeptide
AEEEIRTTNPVATEQYGTVVVSVTTNQNGTEQGTNTD

SEQ ID NO: 160643 - protein, 36 aa, Artificial Sequence
  Description of Artificial Sequence: Synthetic polypeptide
DEEEIRTTNPVAYEHYGSVYACTNEISQNKGMSPEV

SEQ ID NO: 160644 - protein, 35 aa, Artificial Sequence
  Description of Artificial Sequence: Synthetic polypeptide
DEVEIETTNPVATEQYGTVVSVTDGDDEEGEGGNI

SEQ ID NO: 160645 - protein, 33 aa, Artificial Sequence
  Description of Artificial Sequence: Synthetic polypeptide
DSACIGSTNPVAYEQWGSISCTGNHQRTGGNNN

SEQ ID NO: 160646 - protein, 35 aa, Artificial Sequence
  Description of Artificial Sequence: Synthetic polypeptide
DENEIATTNPVATEQYGCVAATGLLEAPDSQHNRN

SEQ ID NO: 160647 - protein, 37 aa, Artificial Sequence
  Description of Artificial Sequence: Synthetic polypeptide
DEEEIRTTNPVAYEHYGSVYACTNAISQNKNGMSPRA

SEQ ID NO: 160648 - protein, 33 aa, Artificial Sequence
  Description of Artificial Sequence: Synthetic polypeptide
DDQEIATTNPVATEQYGSVSASPDEEDHIGEDL

SEQ ID NO: 160649 - protein, 37 aa, Artificial Sequence
  Description of Artificial Sequence: Synthetic polypeptide
AEEEIRTTNPVATEQYGTVVVTVTTNNNQEQGEENED

SEQ ID NO: 160650 - protein, 34 aa, Artificial Sequence
  Description of Artificial Sequence: Synthetic polypeptide
DEMEIATTNPVAYEQYGTVCSATDGPVENEGNTD

SEQ ID NO: 160651 - protein, 34 aa, Artificial Sequence
  Description of Artificial Sequence: Synthetic polypeptide
SEEEIRCTNPTAYEQWGSTVYGENDRHRDGDNGR

SEQ ID NO: 160652 - protein, 28 aa, Artificial Sequence
  Description of Artificial Sequence: Synthetic peptide
QESEIASTNPLGTEGYGVMASTQQHGDI

SEQ ID NO: 160653 - protein, 38 aa, Artificial Sequence
  Description of Artificial Sequence: Synthetic polypeptide
AEEEIRTTNPVATEQYGTVVVTVTNLQLGNQQGNNEGD

SEQ ID NO: 160654 - protein, 35 aa, Artificial Sequence
  Description of Artificial Sequence: Synthetic polypeptide
DQGEIVTTNPVAYECYGKVSTGNELSFQAVGGNTQ

SEQ ID NO: 160655 - protein, 36 aa, Artificial Sequence
  Description of Artificial Sequence: Synthetic polypeptide
DQGEIRTTNPVAYEQYGQVVVATNGLSQYRGGEYEG

SEQ ID NO: 160656 - protein, 38 aa, Artificial Sequence
  Description of Artificial Sequence: Synthetic polypeptide
DEEEIRTTNPVATEQYGETYSTPNFNVEIQVEGNVELS

SEQ ID NO: 160657 - protein, 30 aa, Artificial Sequence
  Description of Artificial Sequence: Synthetic polypeptide
QEGEIAPTNPCSYEQWGIVSCNLQSPGDTN

SEQ ID NO: 160658 - protein, 37 aa, Artificial Sequence
  Description of Artificial Sequence: Synthetic polypeptide
DECEICTTNPVATEQYGTVSTVTNGNLLAGETGNEDE

SEQ ID NO: 160659 - protein, 35 aa, Artificial Sequence
  Description of Artificial Sequence: Synthetic polypeptide
DENEIATTNPVATEQYGCNVAANNGLEATDSGNEH

SEQ ID NO: 160660 - protein, 31 aa, Artificial Sequence
  Description of Artificial Sequence: Synthetic polypeptide
DDSEIRSTNPVSTEGYGNVANEDIQSQVGQR

SEQ ID NO: 160661 - protein, 36 aa, Artificial Sequence
  Description of Artificial Sequence: Synthetic polypeptide
DEEEIACTNPVATEQYGSACAATNGLAPGEQMEGEV

SEQ ID NO: 160662 - protein, 38 aa, Artificial Sequence
  Description of Artificial Sequence: Synthetic polypeptide
DEEEIRTTNPVAYEPYGISTVVSYEGNELSHVRGPVRF

SEQ ID NO: 160663 - protein, 38 aa, Artificial Sequence
  Description of Artificial Sequence: Synthetic polypeptide
DEEEIRTTNPVAYEPYGISTVSYTGNELSMVRVTPVRF

SEQ ID NO: 160664 - protein, 36 aa, Artificial Sequence
  Description of Artificial Sequence: Synthetic polypeptide
DEEEIRTTNPVATEQYGSIGPTMEMPELNMQPQFGL

SEQ ID NO: 160665 - protein, 31 aa, Artificial Sequence
  Description of Artificial Sequence: Synthetic polypeptide
DEGEIRTTNPVAYEQWGTVSKEIEMNAADDA

SEQ ID NO: 160666 - protein, 33 aa, Artificial Sequence
  Description of Artificial Sequence: Synthetic polypeptide
DEEEIVTTNPVATEQYGEVCPATDGCVEFEEEK

SEQ ID NO: 160667 - protein, 36 aa, Artificial Sequence
  Description of Artificial Sequence: Synthetic polypeptide
DECEICTTNPVATEQYGTVSTVTNGNNENGEGNQDT

SEQ ID NO: 160668 - protein, 35 aa, Artificial Sequence
  Description of Artificial Sequence: Synthetic polypeptide
DEVEIKTTNPVATEQYGTVVSATDGDDEEGEGNQT

SEQ ID NO: 160669 - protein, 37 aa, Artificial Sequence
  Description of Artificial Sequence: Synthetic polypeptide
DEEEIRTTNPVAYEPYGISTVSYTGNEISMVRGPVAF

SEQ ID NO: 160670 - protein, 37 aa, Artificial Sequence
  Description of Artificial Sequence: Synthetic polypeptide
DEEEIRTTNPVAYEPYGISTVSYEGNELSMIRGPVTF

SEQ ID NO: 160671 - protein, 37 aa, Artificial Sequence
  Description of Artificial Sequence: Synthetic polypeptide
DECEICTTNPVATEQYGTVSTVTNGNLEQGEETNEDG

SEQ ID NO: 160672 - protein, 38 aa, Artificial Sequence
  Description of Artificial Sequence: Synthetic polypeptide
DEEEIRTTNPVAYEPYGISTVSYEGNELSMERGPPQRF

SEQ ID NO: 160673 - protein, 36 aa, Artificial Sequence
  Description of Artificial Sequence: Synthetic polypeptide
DEEAICTVNPVATEAYGSVSTVNNLQENNNANNNQD

SEQ ID NO: 160674 - protein, 38 aa, Artificial Sequence
  Description of Artificial Sequence: Synthetic polypeptide
DEEEIRTTNPVATEQYGSVTLAHQTNDQEQMIAFEQRE

SEQ ID NO: 160675 - protein, 29 aa, Artificial Sequence
  Description of Artificial Sequence: Synthetic peptide
QEGEIAPTNPCSYEQWGIVSCWDQSGDTR

SEQ ID NO: 160676 - protein, 37 aa, Artificial Sequence
  Description of Artificial Sequence: Synthetic polypeptide
DEEEIRTTNPVAYEPYGISTVSYEGAELSMTRGTVRF

SEQ ID NO: 160677 - protein, 37 aa, Artificial Sequence
  Description of Artificial Sequence: Synthetic polypeptide
DEEEIRTTNPVATEQYGSIVNYTENYDDVNNQMEAKA

SEQ ID NO: 160678 - protein, 36 aa, Artificial Sequence
  Description of Artificial Sequence: Synthetic polypeptide
DEEEIRTTNPVATEQYGSVTMSSVEWSDDPNVLEFE

SEQ ID NO: 160679 - protein, 38 aa, Artificial Sequence
  Description of Artificial Sequence: Synthetic polypeptide
DEEEIRTTNPVATEQYGSVPSSPWYNGTNTTQQEVLDQ

SEQ ID NO: 160680 - protein, 32 aa, Artificial Sequence
  Description of Artificial Sequence: Synthetic polypeptide
DDQEVATTNPVATEGYGSVAATDLEDHEGEDL

SEQ ID NO: 160681 - protein, 37 aa, Artificial Sequence
  Description of Artificial Sequence: Synthetic polypeptide
DEEEIRTTNPVAYEPYGISVSNTVNSLHEDRIKDDTL

SEQ ID NO: 160682 - protein, 36 aa, Artificial Sequence
  Description of Artificial Sequence: Synthetic polypeptide
DECEICTTNPVATEQYGTVSTVTNGNNESGEGTNDD

SEQ ID NO: 160683 - protein, 36 aa, Artificial Sequence
  Description of Artificial Sequence: Synthetic polypeptide
DEVEIRATNPVATEFYGSVVDNTVNMQGQIGNDSGD

SEQ ID NO: 160684 - protein, 36 aa, Artificial Sequence
  Description of Artificial Sequence: Synthetic polypeptide
NEEEIRTTNPVAYEQWGHTNVSYWNELQHRPGGQGN

SEQ ID NO: 160685 - protein, 35 aa, Artificial Sequence
  Description of Artificial Sequence: Synthetic polypeptide
DEEEIACTNPVATEQYGSACAATNNLAGTQGAEDA

SEQ ID NO: 160686 - protein, 31 aa, Artificial Sequence
  Description of Artificial Sequence: Synthetic polypeptide
DDSEVASTNPVSTEGYGNVAANTIQPRVGQR

SEQ ID NO: 160687 - protein, 35 aa, Artificial Sequence
  Description of Artificial Sequence: Synthetic polypeptide
DEEEIACTNPVATEQYGSACAATNNLAGAPGGEDG

SEQ ID NO: 160688 - protein, 38 aa, Artificial Sequence
  Description of Artificial Sequence: Synthetic polypeptide
DEEEIRTTNPVATEQYGSVTIAHATNDQQHMIVFEQRE

SEQ ID NO: 160689 - protein, 28 aa, Artificial Sequence
  Description of Artificial Sequence: Synthetic peptide
QESEIASTNPCGTEGYGVMASTLQHKDI

SEQ ID NO: 160690 - protein, 34 aa, Artificial Sequence
  Description of Artificial Sequence: Synthetic polypeptide
DEEAIATTNPVAYEEWGQCCTTDLGDHQRGSNER

SEQ ID NO: 160691 - protein, 34 aa, Artificial Sequence
  Description of Artificial Sequence: Synthetic polypeptide
DEEAIATTNPVAYEEWGQVCTTDGGDHQRGMNMR

SEQ ID NO: 160692 - protein, 35 aa, Artificial Sequence
  Description of Artificial Sequence: Synthetic polypeptide
DEGEIRTTNPVATEQYGSVNNVPDHQDEYPNEDPL

SEQ ID NO: 160693 - protein, 31 aa, Artificial Sequence
  Description of Artificial Sequence: Synthetic polypeptide
DDSEIRSTNPVSTEGYGNVANEDIQSQNGQR

SEQ ID NO: 160694 - protein, 33 aa, Artificial Sequence
  Description of Artificial Sequence: Synthetic polypeptide
DEEAIATTNPVAYEPWGQCTTDGGDHQRGSNMR

SEQ ID NO: 160695 - protein, 38 aa, Artificial Sequence
  Description of Artificial Sequence: Synthetic polypeptide
DEEEIRTTNPVATEQYGSVQLTNSTAVEDNMLLVEVAT

SEQ ID NO: 160696 - protein, 30 aa, Artificial Sequence
  Description of Artificial Sequence: Synthetic polypeptide
QESEIASTNPCSSEGYGIVAANTLQSVGQR

SEQ ID NO: 160697 - protein, 36 aa, Artificial Sequence
  Description of Artificial Sequence: Synthetic polypeptide
DECEICTTNPVATEQYGTVSTVTNGNNNEEGEGNED

SEQ ID NO: 160698 - protein, 35 aa, Artificial Sequence
  Description of Artificial Sequence: Synthetic polypeptide
DEEAICTTNPVATEAYGSVATTVNTDQGTEENEME

SEQ ID NO: 160699 - protein, 36 aa, Artificial Sequence
  Description of Artificial Sequence: Synthetic polypeptide
DENEIRTTNPVATEQYGDVSSTEPAGPMMANGMNPV

SEQ ID NO: 160700 - protein, 32 aa, Artificial Sequence
  Description of Artificial Sequence: Synthetic polypeptide
YEEEIATTNPVATEQYGATWADENWAPKGPYI

SEQ ID NO: 160701 - protein, 36 aa, Artificial Sequence
  Description of Artificial Sequence: Synthetic polypeptide
DENEIRTTNPVATEQYGDVSSTEPAEPMMANGMNPV

SEQ ID NO: 160702 - protein, 36 aa, Artificial Sequence
  Description of Artificial Sequence: Synthetic polypeptide
DEEAICTTNPVATEAYGSVATVNTDTQIGTEENEME

SEQ ID NO: 160703 - protein, 36 aa, Artificial Sequence
  Description of Artificial Sequence: Synthetic polypeptide
NEEEIATTNPVATEQYGCVAGNNGLPQTAPGGEFRR

SEQ ID NO: 160704 - protein, 37 aa, Artificial Sequence
  Description of Artificial Sequence: Synthetic polypeptide
DEEEIRTTNPVATEQYGSVTIEINDTGPLMQSVIPQP

SEQ ID NO: 160705 - protein, 33 aa, Artificial Sequence
  Description of Artificial Sequence: Synthetic polypeptide
DEEAIATTNPVAYEQYSEEVTTTGDNHQGGGKS

SEQ ID NO: 160706 - protein, 36 aa, Artificial Sequence
  Description of Artificial Sequence: Synthetic polypeptide
DEVEIKTTNPVATEQYGSVVGPGGTNEGQTGGQDVI

SEQ ID NO: 160707 - protein, 37 aa, Artificial Sequence
  Description of Artificial Sequence: Synthetic polypeptide
DECEICTTNPVATEQYGTVSTVTNGNLEAGTTDNETS

SEQ ID NO: 160708 - protein, 33 aa, Artificial Sequence
  Description of Artificial Sequence: Synthetic polypeptide
DENEIRTTNPVAYEQWGQVSCEIESMNAAEGDA

SEQ ID NO: 160709 - protein, 37 aa, Artificial Sequence
  Description of Artificial Sequence: Synthetic polypeptide
DEVEIKTTNPVATEAYGSVSTDNNINGLGQEGEDGDA

SEQ ID NO: 160710 - protein, 36 aa, Artificial Sequence
  Description of Artificial Sequence: Synthetic polypeptide
DEEEIVTTNPVATEQYGSVPLENSVTTEEMQAESIL

SEQ ID NO: 160711 - protein, 38 aa, Artificial Sequence
  Description of Artificial Sequence: Synthetic polypeptide
DEEEIRTTNPVATEQYGVVSTVVVTNNQQGTEETEEEQ

SEQ ID NO: 160712 - protein, 33 aa, Artificial Sequence
  Description of Artificial Sequence: Synthetic polypeptide
NEEEIATTNPVATEQWGSVSGTIEPGDDMPTDA

SEQ ID NO: 160713 - protein, 34 aa, Artificial Sequence
  Description of Artificial Sequence: Synthetic polypeptide
DDQEIATTNPVATEQYGSVTATPDLADHIGEDLY

SEQ ID NO: 160714 - protein, 35 aa, Artificial Sequence
  Description of Artificial Sequence: Synthetic polypeptide
NEEEIATTNPVATEQWGSVSGTGNPPPDANSNDSW

SEQ ID NO: 160715 - protein, 35 aa, Artificial Sequence
  Description of Artificial Sequence: Synthetic polypeptide
DEEEIRTTNPVATEQYGSVTPIPDKESFSIEEFEE

SEQ ID NO: 160716 - protein, 32 aa, Artificial Sequence
  Description of Artificial Sequence: Synthetic polypeptide
QEGEIAPTNPCSYEQWGIVSKNLEQRSGDTGR

SEQ ID NO: 160717 - protein, 33 aa, Artificial Sequence
  Description of Artificial Sequence: Synthetic polypeptide
CEECICTTNPVAYERYGCSVNINMGSLRPGGNA

SEQ ID NO: 160718 - protein, 37 aa, Artificial Sequence
  Description of Artificial Sequence: Synthetic polypeptide
DEEEIRTTNPVATEQYGETYPSVALSEDPIQQVDENI

SEQ ID NO: 160719 - protein, 37 aa, Artificial Sequence
  Description of Artificial Sequence: Synthetic polypeptide
NEEEIATTNPVATEQWGSVSMSGDTPTNPDDQMGNQM

SEQ ID NO: 160720 - protein, 37 aa, Artificial Sequence
  Description of Artificial Sequence: Synthetic polypeptide
DEEEIRTTNPVATEAYGVVTVVVTTNNEQAGNQNNNE

SEQ ID NO: 160721 - protein, 34 aa, Artificial Sequence
  Description of Artificial Sequence: Synthetic polypeptide
DENEIATTNPVATEQYGCVAANGGLEATMNPEVH

SEQ ID NO: 160722 - protein, 32 aa, Artificial Sequence
  Description of Artificial Sequence: Synthetic polypeptide
DDSEVRTTNPVSTECWGNVSACTEQDRVGENG

SEQ ID NO: 160723 - protein, 38 aa, Artificial Sequence
  Description of Artificial Sequence: Synthetic polypeptide
DEEEIRTTNPVATEQYGETYSTENEWVEMQVEGNVELS

SEQ ID NO: 160724 - protein, 37 aa, Artificial Sequence
  Description of Artificial Sequence: Synthetic polypeptide
DQESIRTTNPVAYEQYGQVVVSVTNGLSQYRGGEYEG

SEQ ID NO: 160725 - protein, 39 aa, Artificial Sequence
  Description of Artificial Sequence: Synthetic polypeptide
DEEEIRTTNPVATEQYGETYSTPNELVEMQAYEGNVELS

SEQ ID NO: 160726 - protein, 38 aa, Artificial Sequence
  Description of Artificial Sequence: Synthetic polypeptide
DEDEIRTTNPVATEQYGVVSTVVNNQNGNQNAGTTEEG

SEQ ID NO: 160727 - protein, 36 aa, Artificial Sequence
  Description of Artificial Sequence: Synthetic polypeptide
DEMEIATTNPVAYEQYGTVCSYTDGLPDEHRGQNDS

SEQ ID NO: 160728 - protein, 36 aa, Artificial Sequence
  Description of Artificial Sequence: Synthetic polypeptide
DEEEIRTTNPVATEQYGSVQMEGLLTLGEFEQMVEE

SEQ ID NO: 160729 - protein, 38 aa, Artificial Sequence
  Description of Artificial Sequence: Synthetic polypeptide
DEEEIRTTNPVATEQYGETYSTPNEMVEMQVEGNVEDS

SEQ ID NO: 160730 - protein, 39 aa, Artificial Sequence
  Description of Artificial Sequence: Synthetic polypeptide
DEEEIRTTNPVATEQYGETYSTPNENVEFQAREGNVELL

SEQ ID NO: 160731 - protein, 31 aa, Artificial Sequence
  Description of Artificial Sequence: Synthetic polypeptide
DENEIRTTNPVAYEQWGTVSKEIEKNKDEDA

SEQ ID NO: 160732 - protein, 36 aa, Artificial Sequence
  Description of Artificial Sequence: Synthetic polypeptide
DEEEIRTTNPVATEQYGSVQLTPWTPVPVQHVMDPQ

SEQ ID NO: 160733 - protein, 37 aa, Artificial Sequence
  Description of Artificial Sequence: Synthetic polypeptide
DEEEIVTTNPVATEQYGSVHPPVNLEQQVLVGMQGGM

SEQ ID NO: 160734 - protein, 33 aa, Artificial Sequence
  Description of Artificial Sequence: Synthetic polypeptide
DDQEIRTTNPVATEQYGCVSMVQNENIEETEEI

SEQ ID NO: 160735 - protein, 36 aa, Artificial Sequence
  Description of Artificial Sequence: Synthetic polypeptide
DEEAICTVNPVATEAYGSVSTVNNLQENNNNNNNQE

SEQ ID NO: 160736 - protein, 32 aa, Artificial Sequence
  Description of Artificial Sequence: Synthetic polypeptide
DDQEVASTNPVATEQYGSVAATTIQDHVGQDL

SEQ ID NO: 160737 - protein, 38 aa, Artificial Sequence
  Description of Artificial Sequence: Synthetic polypeptide
DEEEIRTTNPVAYEPYGISTVQSYTGNELSMVTGPVRF

SEQ ID NO: 160738 - protein, 36 aa, Artificial Sequence
  Description of Artificial Sequence: Synthetic polypeptide
DEEEIATTNPVATEQYGSVCAAMAHLSQAMPNNDNH

SEQ ID NO: 160739 - protein, 37 aa, Artificial Sequence
  Description of Artificial Sequence: Synthetic polypeptide
DECEICTTNPVATEQYGTVSTVTNGNLEAGSTDNEDD

SEQ ID NO: 160740 - protein, 37 aa, Artificial Sequence
  Description of Artificial Sequence: Synthetic polypeptide
DECEICTTNPVATEQYGTVSTVTNGNLEAGNNGNEDQ

SEQ ID NO: 160741 - protein, 37 aa, Artificial Sequence
  Description of Artificial Sequence: Synthetic polypeptide
DQEEIRTTNPVAYEQWGQVVVSDTNGLSQYFGGEYRD

SEQ ID NO: 160742 - protein, 37 aa, Artificial Sequence
  Description of Artificial Sequence: Synthetic polypeptide
DECEICTTNPVATEQYGTVSTVTNGNLEAGETTNEDQ

SEQ ID NO: 160743 - protein, 36 aa, Artificial Sequence
  Description of Artificial Sequence: Synthetic polypeptide
DEEAICTVNPVATEAYGSVSTVNNQLQENNNNNNVE

SEQ ID NO: 160744 - protein, 35 aa, Artificial Sequence
  Description of Artificial Sequence: Synthetic polypeptide
DDQEIRTTNPVATEQYGSVSWANWNEEARNSDLLQ

SEQ ID NO: 160745 - protein, 32 aa, Artificial Sequence
  Description of Artificial Sequence: Synthetic polypeptide
DDSEVASTNPVSTEGYGNVAANTIQSRVGQNR

SEQ ID NO: 160746 - protein, 36 aa, Artificial Sequence
  Description of Artificial Sequence: Synthetic polypeptide
DQEEIRTTNPVAYEQYGQVVVSTNGSSEYRGGEYEG

SEQ ID NO: 160747 - protein, 37 aa, Artificial Sequence
  Description of Artificial Sequence: Synthetic polypeptide
DEEAICTVNPVATEAYGSVSTVNQQLQEGNNNNNNQE

SEQ ID NO: 160748 - protein, 37 aa, Artificial Sequence
  Description of Artificial Sequence: Synthetic polypeptide
DEEAICTVNPVATEAYGSVSTVTNLQQGNNQGNNVTE

SEQ ID NO: 160749 - protein, 32 aa, Artificial Sequence
  Description of Artificial Sequence: Synthetic polypeptide
DEGEIRTTNPVAYEQWGYCQEDLKKGMDNKGA

SEQ ID NO: 160750 - protein, 33 aa, Artificial Sequence
  Description of Artificial Sequence: Synthetic polypeptide
DENEIRTTNPVAYEQWGTTVSKEIEMRAAEGDA

SEQ ID NO: 160751 - protein, 38 aa, Artificial Sequence
  Description of Artificial Sequence: Synthetic polypeptide
DEEEIRTTNPVATEQYGVVSTVVVTNNQQGTEEGTEED

SEQ ID NO: 160752 - protein, 31 aa, Artificial Sequence
  Description of Artificial Sequence: Synthetic polypeptide
DDSEVASTNPVSTEGYGNVAANTIQNRVGQR

SEQ ID NO: 160753 - protein, 36 aa, Artificial Sequence
  Description of Artificial Sequence: Synthetic polypeptide
DEEAICTVNPVATEAYGSVSTVVNLQENNNNNNNDD

SEQ ID NO: 160754 - protein, 36 aa, Artificial Sequence
  Description of Artificial Sequence: Synthetic polypeptide
DEEAICTVNPVATEAYGSVSTVVNNQENNNGNNNQE

SEQ ID NO: 160755 - protein, 35 aa, Artificial Sequence
  Description of Artificial Sequence: Synthetic polypeptide
DEVEIKTTNPVATEQYGAVNDDNNEQIGGQNGQEP

SEQ ID NO: 160756 - protein, 37 aa, Artificial Sequence
  Description of Artificial Sequence: Synthetic polypeptide
DEEEIRTTNPVATEAYGVVTVVVTTNNNQAGNQNGQD

SEQ ID NO: 160757 - protein, 33 aa, Artificial Sequence
  Description of Artificial Sequence: Synthetic polypeptide
DENEIATTNPVATEQYGCVAANGDAMPGGDPVE

SEQ ID NO: 160758 - protein, 34 aa, Artificial Sequence
  Description of Artificial Sequence: Synthetic polypeptide
NEEEIRTTNPVAYEQWGCSYNPLNDPDQMGHRPR

SEQ ID NO: 160759 - protein, 32 aa, Artificial Sequence
  Description of Artificial Sequence: Synthetic polypeptide
DMNEIRTTNPVSTEPYGTISMWDIQQQQNGNH

SEQ ID NO: 160760 - protein, 35 aa, Artificial Sequence
  Description of Artificial Sequence: Synthetic polypeptide
NEEEIRTTNPVAYEQWGCSYNLPRDDSDQRGKRPR

SEQ ID NO: 160761 - protein, 36 aa, Artificial Sequence
  Description of Artificial Sequence: Synthetic polypeptide
DEEEIRTTNPVATEQYGSVQHPWNYMNQELLMEVEI

SEQ ID NO: 160762 - protein, 36 aa, Artificial Sequence
  Description of Artificial Sequence: Synthetic polypeptide
DENEIRTTNPVATEQYGSVCNNAPPLDEVTIGVSEQ

SEQ ID NO: 160763 - protein, 30 aa, Artificial Sequence
  Description of Artificial Sequence: Synthetic polypeptide
DDSEIASTNPVSTEQYGNVANTEMSRVEQA

SEQ ID NO: 160764 - protein, 36 aa, Artificial Sequence
  Description of Artificial Sequence: Synthetic polypeptide
DENEIRTTNPVATEQYGSVAVTPWDSNQESTQNFMN

SEQ ID NO: 160765 - protein, 36 aa, Artificial Sequence
  Description of Artificial Sequence: Synthetic polypeptide
DENEIRTTNPVATEQYGSVAVTPWDDNQAETTQNMQ

SEQ ID NO: 160766 - protein, 30 aa, Artificial Sequence
  Description of Artificial Sequence: Synthetic polypeptide
DDSEIASTNPVSTEQYGNVANTIMSRVEQA

SEQ ID NO: 160767 - protein, 38 aa, Artificial Sequence
  Description of Artificial Sequence: Synthetic polypeptide
AEEEIRTTNPVATEQYGSVVVVVTTDQNNQQIGTNNLQ

SEQ ID NO: 160768 - protein, 29 aa, Artificial Sequence
  Description of Artificial Sequence: Synthetic peptide
QESEIACTNPVGTEGYGVMASLLQHGDIA

SEQ ID NO: 160769 - protein, 34 aa, Artificial Sequence
  Description of Artificial Sequence: Synthetic polypeptide
DDSEIASTNPVSTEQYGNVSSTNTGPNSRVGNPV

SEQ ID NO: 160770 - protein, 33 aa, Artificial Sequence
  Description of Artificial Sequence: Synthetic polypeptide
DEEEISTTNPVAYEQYGCVCSWGEDQNFFSEQS

SEQ ID NO: 160771 - protein, 31 aa, Artificial Sequence
  Description of Artificial Sequence: Synthetic polypeptide
DDSEIASTNPVSTIGYGNVAANTIQSRVGQR

SEQ ID NO: 160772 - protein, 36 aa, Artificial Sequence
  Description of Artificial Sequence: Synthetic polypeptide
NEEEIRGTNPVATEQYGSVPTTPLQNEDLNVLTVKG

SEQ ID NO: 160773 - protein, 37 aa, Artificial Sequence
  Description of Artificial Sequence: Synthetic polypeptide
AEEEIRTTNPVATEQYGSVVVVVTTDQNQEIGTNQND

SEQ ID NO: 160774 - protein, 37 aa, Artificial Sequence
  Description of Artificial Sequence: Synthetic polypeptide
AEEEIRTTNPVATEQYGSVVVVVTTDQQGQTIGTNLD

SEQ ID NO: 160775 - protein, 34 aa, Artificial Sequence
  Description of Artificial Sequence: Synthetic polypeptide
DEEEIRTTNPCAYMQYGSVSSGNIGFHPGDIQDH

SEQ ID NO: 160776 - protein, 36 aa, Artificial Sequence
  Description of Artificial Sequence: Synthetic polypeptide
DENEIRTTNPVATEQYGSVANNWPPLDEVIIGVSEQ

SEQ ID NO: 160777 - protein, 33 aa, Artificial Sequence
  Description of Artificial Sequence: Synthetic polypeptide
DENEIATTNPVATEQWGCVAETGEGMNAAEDNA

SEQ ID NO: 160778 - protein, 33 aa, Artificial Sequence
  Description of Artificial Sequence: Synthetic polypeptide
DENEIATTNPVATEQWGCVAGEGEANAAEGNAD

SEQ ID NO: 160779 - protein, 38 aa, Artificial Sequence
  Description of Artificial Sequence: Synthetic polypeptide
AEEEIRTTNPVATEQYGSVVVVVTTNAQAGTTDENSET

SEQ ID NO: 160780 - protein, 34 aa, Artificial Sequence
  Description of Artificial Sequence: Synthetic polypeptide
DEDEIRTTNPVAYEQWGVVYGGNGLPQDHPNNGQ

SEQ ID NO: 160781 - protein, 35 aa, Artificial Sequence
  Description of Artificial Sequence: Synthetic polypeptide
DENEIRTTNPVATEQYGSTSSAQNDVVDSSQFETG

SEQ ID NO: 160782 - protein, 34 aa, Artificial Sequence
  Description of Artificial Sequence: Synthetic polypeptide
DEDEIRTTNPVAYEQWGVVYGGNLPDDGHQNMGS

SEQ ID NO: 160783 - protein, 32 aa, Artificial Sequence
  Description of Artificial Sequence: Synthetic polypeptide
DDSEVASTNPVSTEGYGNVAANTIQSRVGNVR

SEQ ID NO: 160784 - protein, 31 aa, Artificial Sequence
  Description of Artificial Sequence: Synthetic polypeptide
DENEIATTNPVATEQWGCVAEGEMNAAEEDM

SEQ ID NO: 160785 - protein, 38 aa, Artificial Sequence
  Description of Artificial Sequence: Synthetic polypeptide
AEEEIRTTNPVATEQYGSVVVVVTTNAQQGTNDENDEE

SEQ ID NO: 160786 - protein, 34 aa, Artificial Sequence
  Description of Artificial Sequence: Synthetic polypeptide
DEEEIRTTNPCAYMQYGSVSSGDIGFHGGDNSDI

SEQ ID NO: 160787 - protein, 38 aa, Artificial Sequence
  Description of Artificial Sequence: Synthetic polypeptide
SEEEIRTTNPVATEQYGAIMWSTINFIQDRGEEGNGNI

SEQ ID NO: 160788 - protein, 35 aa, Artificial Sequence
  Description of Artificial Sequence: Synthetic polypeptide
SEEEIRTTNPVATEQYGCMNVTSVLETTRPENKMA

SEQ ID NO: 160789 - protein, 35 aa, Artificial Sequence
  Description of Artificial Sequence: Synthetic polypeptide
DEDEIRTTNPVAYEQWGVVVPTDNGDDKAGGGQNR

SEQ ID NO: 160790 - protein, 35 aa, Artificial Sequence
  Description of Artificial Sequence: Synthetic polypeptide
DEDEIRTTNPVAYEQWGVVVPTDNGDDQAGNMAGN

SEQ ID NO: 160791 - protein, 34 aa, Artificial Sequence
  Description of Artificial Sequence: Synthetic polypeptide
DEEEISTTNPVAYEQYGCVCSWEEHNQNFNSDQS

SEQ ID NO: 160792 - protein, 34 aa, Artificial Sequence
  Description of Artificial Sequence: Synthetic polypeptide
DECEICTTNPVATEQYGVVNVVTDGGVEGEGTND

SEQ ID NO: 160793 - protein, 33 aa, Artificial Sequence
  Description of Artificial Sequence: Synthetic polypeptide
DAEEIATVNPVATEQWGCVAGNGLQSNNNSQAE

SEQ ID NO: 160794 - protein, 36 aa, Artificial Sequence
  Description of Artificial Sequence: Synthetic polypeptide
DAEEIATTNPVATEQYGSVCAMNGGDIDQKAPGQVR

SEQ ID NO: 160795 - protein, 36 aa, Artificial Sequence
  Description of Artificial Sequence: Synthetic polypeptide
DEEEIRTTNPVATEQYGSVQFIHMGEEQPEMGEVEI

SEQ ID NO: 160796 - protein, 34 aa, Artificial Sequence
  Description of Artificial Sequence: Synthetic polypeptide
SEEEIRTTNPVATEQYGCMNCSVLETTRPENKEI

SEQ ID NO: 160797 - protein, 31 aa, Artificial Sequence
  Description of Artificial Sequence: Synthetic polypeptide
DENEIRTTNPVATYQWGDVSEISEMNAAEDA

SEQ ID NO: 160798 - protein, 37 aa, Artificial Sequence
  Description of Artificial Sequence: Synthetic polypeptide
AEEEIRTTNPVATEQYGSVVVVVTTDQGTQEIGTNLD

SEQ ID NO: 160799 - protein, 36 aa, Artificial Sequence
  Description of Artificial Sequence: Synthetic polypeptide
DEDEIRTTNPVAYEQWGVVVPTDNGDDQAGNNSARS

SEQ ID NO: 160800 - protein, 32 aa, Artificial Sequence
  Description of Artificial Sequence: Synthetic polypeptide
QEGEIAPTNPCSTEQYGIVSACNLQDSEGTDL

SEQ ID NO: 160801 - protein, 35 aa, Artificial Sequence
  Description of Artificial Sequence: Synthetic polypeptide
DEDEIRTTNPVAYEQWGVVVPTDNGDDQSGNGMNH

SEQ ID NO: 160802 - protein, 33 aa, Artificial Sequence
  Description of Artificial Sequence: Synthetic polypeptide
DEQEICTTNPVAYESWGSVATTGGNTGADGMTR

SEQ ID NO: 160803 - protein, 34 aa, Artificial Sequence
  Description of Artificial Sequence: Synthetic polypeptide
DENEIATTNPVATEQWGCVAATTGLEAPDNQERH

SEQ ID NO: 160804 - protein, 30 aa, Artificial Sequence
  Description of Artificial Sequence: Synthetic polypeptide
QESEIACTNPVGTEGYGVMANSTLQHGDKI

SEQ ID NO: 160805 - protein, 34 aa, Artificial Sequence
  Description of Artificial Sequence: Synthetic polypeptide
DEAEISTTNPVATEQYGCVCSWGNDNANFNSNQS

SEQ ID NO: 160806 - protein, 31 aa, Artificial Sequence
  Description of Artificial Sequence: Synthetic polypeptide
DDSEIASTNPVSTEQYGNVAANTIMSRAEDR

SEQ ID NO: 160807 - protein, 35 aa, Artificial Sequence
  Description of Artificial Sequence: Synthetic polypeptide
NEEEIRSTNPVATESYGSVCIWVNDQDQRGMDKHN

SEQ ID NO: 160808 - protein, 37 aa, Artificial Sequence
  Description of Artificial Sequence: Synthetic polypeptide
DEEEIRTTNPVATEQYGSVQFILMGEEQPEPGEVPAI

SEQ ID NO: 160809 - protein, 38 aa, Artificial Sequence
  Description of Artificial Sequence: Synthetic polypeptide
AEEEIRTTNPVATEQYGSVVVVVTTDNNQQEIGTNNLE

SEQ ID NO: 160810 - protein, 34 aa, Artificial Sequence
  Description of Artificial Sequence: Synthetic polypeptide
DEVEIRTTNPVATEQYGDVVGVGNMTDGMGGQGI

SEQ ID NO: 160811 - protein, 37 aa, Artificial Sequence
  Description of Artificial Sequence: Synthetic polypeptide
DEEEIRTTNPVATEQYGSVQFICMGNEQPEPGEVPEI

SEQ ID NO: 160812 - protein, 33 aa, Artificial Sequence
  Description of Artificial Sequence: Synthetic polypeptide
DDSEIATTNPVATEGWGSVACINEPQDRVGEQG

SEQ ID NO: 160813 - protein, 31 aa, Artificial Sequence
  Description of Artificial Sequence: Synthetic polypeptide
DEEEIRTTNPCCTAQWGCTAGNGLADGDGEQ

SEQ ID NO: 160814 - protein, 36 aa, Artificial Sequence
  Description of Artificial Sequence: Synthetic polypeptide
DENEIRTTNPVATEQYGSSCSVTWPHNEDHFVHENG

SEQ ID NO: 160815 - protein, 34 aa, Artificial Sequence
  Description of Artificial Sequence: Synthetic polypeptide
DEEEIRTTNPVATECWGMHCWTMNEQQQRQQDHD

SEQ ID NO: 160816 - protein, 35 aa, Artificial Sequence
  Description of Artificial Sequence: Synthetic polypeptide
AEDEICATNPVATEQYGVVATSGNNQLQLGNGNDD

SEQ ID NO: 160817 - protein, 36 aa, Artificial Sequence
  Description of Artificial Sequence: Synthetic polypeptide
DENEIRTTNPVATEQYGSSCSSTSALDEQMNSLEEV

SEQ ID NO: 160818 - protein, 37 aa, Artificial Sequence
  Description of Artificial Sequence: Synthetic polypeptide
DENEIRTTNPVATEQYGSSCSSTSALDEQMINNNEEV

SEQ ID NO: 160819 - protein, 37 aa, Artificial Sequence
  Description of Artificial Sequence: Synthetic polypeptide
DEEEIRTTNPVATEQYGSIPPCSENSLTEGEIMGIDS

SEQ ID NO: 160820 - protein, 37 aa, Artificial Sequence
  Description of Artificial Sequence: Synthetic polypeptide
DNGEIRTTNPVATEQYGCSWSFTINPLSERFENNQNE

SEQ ID NO: 160821 - protein, 36 aa, Artificial Sequence
  Description of Artificial Sequence: Synthetic polypeptide
DENEIRTTNPVATEQYGSSCSSPCANDEQINQNEEM

SEQ ID NO: 160822 - protein, 32 aa, Artificial Sequence
  Description of Artificial Sequence: Synthetic polypeptide
DENEIATTNPVATEQWGCVAGEGEMNDAMDNA

SEQ ID NO: 160823 - protein, 38 aa, Artificial Sequence
  Description of Artificial Sequence: Synthetic polypeptide
AEEEIRTTNPVATEQYGSVVVTVTNQLGGTEQGSNDNE

SEQ ID NO: 160824 - protein, 36 aa, Artificial Sequence
  Description of Artificial Sequence: Synthetic polypeptide
QEEEIRTTNPVATEQYGNVNTDNMFETGGGNQGEQG

SEQ ID NO: 160825 - protein, 35 aa, Artificial Sequence
  Description of Artificial Sequence: Synthetic polypeptide
DEEEIRTTNPVATEQYGSIPLMAPTNSDNEPEMTV

SEQ ID NO: 160826 - protein, 34 aa, Artificial Sequence
  Description of Artificial Sequence: Synthetic polypeptide
DNMEIVTTNPVATEQYGTVCSATDGPVEFEGYND

SEQ ID NO: 160827 - protein, 36 aa, Artificial Sequence
  Description of Artificial Sequence: Synthetic polypeptide
DEVEIRTTNPVATEQYGAVVNSVGNGEFTNQGGQGM

SEQ ID NO: 160828 - protein, 35 aa, Artificial Sequence
  Description of Artificial Sequence: Synthetic polypeptide
DEVEIRTTNPVATEQYGAVVNNVVGNGEFTNTGQG

SEQ ID NO: 160829 - protein, 37 aa, Artificial Sequence
  Description of Artificial Sequence: Synthetic polypeptide
DEEEIRTTNPVATEQYGSVQFINMGEEQPEPGSVAEI

SEQ ID NO: 160830 - protein, 32 aa, Artificial Sequence
  Description of Artificial Sequence: Synthetic polypeptide
DNNEIRTTNPVATEQWGDVSEQIEMNAAENYA

SEQ ID NO: 160831 - protein, 39 aa, Artificial Sequence
  Description of Artificial Sequence: Synthetic polypeptide
DEEEIRTTNPVATEQYGVVSTVVVTNLQLQGTEEEEEED

SEQ ID NO: 160832 - protein, 36 aa, Artificial Sequence
  Description of Artificial Sequence: Synthetic polypeptide
DEEEIRTTNPVATEQYGSVQFISMGEEDPEGEEPEI

SEQ ID NO: 160833 - protein, 37 aa, Artificial Sequence
  Description of Artificial Sequence: Synthetic polypeptide
DEEEIRTTNPVATEQYGSIPCVTSMMQGEQMGPQTID

SEQ ID NO: 160834 - protein, 35 aa, Artificial Sequence
  Description of Artificial Sequence: Synthetic polypeptide
DNNEIRTTNPVATEQYGSVSPYWALNQPQLEDDSF

SEQ ID NO: 160835 - protein, 32 aa, Artificial Sequence
  Description of Artificial Sequence: Synthetic polypeptide
DDSEIATTNPVATEGYGTVCSANDGPEFVGQD

SEQ ID NO: 160836 - protein, 34 aa, Artificial Sequence
  Description of Artificial Sequence: Synthetic polypeptide
DEEEIRTTNPEATCQYGCVCPSGEHNQNFGSDFS

SEQ ID NO: 160837 - protein, 33 aa, Artificial Sequence
  Description of Artificial Sequence: Synthetic polypeptide
DDSEIATTNPVATEGWGSVACINEPQSRVGEQG

SEQ ID NO: 160838 - protein, 33 aa, Artificial Sequence
  Description of Artificial Sequence: Synthetic polypeptide
DEEEISTTNPVAYEQYGCVCWTGEDQNFDSDQS

SEQ ID NO: 160839 - protein, 32 aa, Artificial Sequence
  Description of Artificial Sequence: Synthetic polypeptide
DDSEIATTNPVATEGYGTVCSANDGPEFEGQD

SEQ ID NO: 160840 - protein, 38 aa, Artificial Sequence
  Description of Artificial Sequence: Synthetic polypeptide
AEEEIRTTNPVATEQYGSVVVVVTTNAQQGTTTENAET

SEQ ID NO: 160841 - protein, 38 aa, Artificial Sequence
  Description of Artificial Sequence: Synthetic polypeptide
AEEEIRTTNPVATEQYGSVVVVVTTNDQQGATDENEEM

SEQ ID NO: 160842 - protein, 34 aa, Artificial Sequence
  Description of Artificial Sequence: Synthetic polypeptide
DEEEISTTNPVAYEQYGCVCSWGEHNQNFNSDQA

SEQ ID NO: 160843 - protein, 37 aa, Artificial Sequence
  Description of Artificial Sequence: Synthetic polypeptide
DEEEIRTTNPVATEQYGSVSYVSPGIGQNEQSMVPII

SEQ ID NO: 160844 - protein, 31 aa, Artificial Sequence
  Description of Artificial Sequence: Synthetic polypeptide
DEEEIRTTNPCCTAQWGCTAGNGLADNGDEL

SEQ ID NO: 160845 - protein, 36 aa, Artificial Sequence
  Description of Artificial Sequence: Synthetic polypeptide
CEEEIRTTNPVATEQYGQCVCSNWENHQENFGSDQA

SEQ ID NO: 160846 - protein, 36 aa, Artificial Sequence
  Description of Artificial Sequence: Synthetic polypeptide
CEEEIRTTNPVATEQYGQCVCSNWEHNQSFGSENQS

SEQ ID NO: 160847 - protein, 34 aa, Artificial Sequence
  Description of Artificial Sequence: Synthetic polypeptide
DEEEISTTNPVAYEQYGCVCSWGEHQENFNSDQS

SEQ ID NO: 160848 - protein, 36 aa, Artificial Sequence
  Description of Artificial Sequence: Synthetic polypeptide
DEAEIRTTNPVATEQYGQCVCSMTEHNQENFGSDQA

SEQ ID NO: 160849 - protein, 34 aa, Artificial Sequence
  Description of Artificial Sequence: Synthetic polypeptide
DEEEISTTNPVAYEQYGCVCSWGEHQNFGSDTQG

SEQ ID NO: 160850 - protein, 37 aa, Artificial Sequence
  Description of Artificial Sequence: Synthetic polypeptide
DEEEIRTTNPDATEQYGYVSSTTPAGPNMRNGMNPVD

SEQ ID NO: 160851 - protein, 37 aa, Artificial Sequence
  Description of Artificial Sequence: Synthetic polypeptide
DEEEIRTTNPVATEQYGDVNSDGQNLGMGEGGEQQTQ

SEQ ID NO: 160852 - protein, 32 aa, Artificial Sequence
  Description of Artificial Sequence: Synthetic polypeptide
DEEEIRTTNPCCTAQWGCVAGTGLTADGDQEQ

SEQ ID NO: 160853 - protein, 30 aa, Artificial Sequence
  Description of Artificial Sequence: Synthetic polypeptide
DENEIATTNPCSTEQWGDVSEIEQNAAETA

SEQ ID NO: 160854 - protein, 35 aa, Artificial Sequence
  Description of Artificial Sequence: Synthetic polypeptide
DEEEIRTTNPVAYEQWGCSYNNINDLDPRGHMPTK

SEQ ID NO: 160855 - protein, 36 aa, Artificial Sequence
  Description of Artificial Sequence: Synthetic polypeptide
DEDEIRTTNPVAYEQYGSVAACPNPLATGTNGDSEG

SEQ ID NO: 160856 - protein, 31 aa, Artificial Sequence
  Description of Artificial Sequence: Synthetic polypeptide
DDSEVASTNPVSTEGYGNVAANTIQSRVGPR

SEQ ID NO: 160857 - protein, 36 aa, Artificial Sequence
  Description of Artificial Sequence: Synthetic polypeptide
CEEEIRTTNPVATEQYGQCVCSNTEHNQSFGSETQA

SEQ ID NO: 160858 - protein, 35 aa, Artificial Sequence
  Description of Artificial Sequence: Synthetic polypeptide
DEDEIRTTNPVAYEQYGSVCSAANNLDATTPPDEE

SEQ ID NO: 160859 - protein, 33 aa, Artificial Sequence
  Description of Artificial Sequence: Synthetic polypeptide
DESEIRTTNPIATECWGATACINEPQDREGENG

SEQ ID NO: 160860 - protein, 34 aa, Artificial Sequence
  Description of Artificial Sequence: Synthetic polypeptide
DEECIQTTNPVAYERYGCSVQINMGSDRPGGNTA

SEQ ID NO: 160861 - protein, 34 aa, Artificial Sequence
  Description of Artificial Sequence: Synthetic polypeptide
DEEEIACTNPVATEQYGSVANTGHGEYGAETGHN

SEQ ID NO: 160862 - protein, 35 aa, Artificial Sequence
  Description of Artificial Sequence: Synthetic polypeptide
AEDEICATNPVATEQYGVVATSNDNLQLNGNGNDD

SEQ ID NO: 160863 - protein, 35 aa, Artificial Sequence
  Description of Artificial Sequence: Synthetic polypeptide
AEDEICATNPVATEQYGVVATSGNNNLQQLGGNDD

SEQ ID NO: 160864 - protein, 35 aa, Artificial Sequence
  Description of Artificial Sequence: Synthetic polypeptide
SEEEIRTTNPVATEQYGCSCSNWGEHNQYFQSDQA

SEQ ID NO: 160865 - protein, 36 aa, Artificial Sequence
  Description of Artificial Sequence: Synthetic polypeptide
DEEEIRTTNPVATEQYGSVQFDTMGEEQPEEEVVEI

SEQ ID NO: 160866 - protein, 31 aa, Artificial Sequence
  Description of Artificial Sequence: Synthetic polypeptide
DDSEVASTNPVSTEGYGNVAANTIQSRVGMR

SEQ ID NO: 160867 - protein, 35 aa, Artificial Sequence
  Description of Artificial Sequence: Synthetic polypeptide
DEAEIRTTNPVATEQYGQCVCSWELNANFNSNNQA

SEQ ID NO: 160868 - protein, 35 aa, Artificial Sequence
  Description of Artificial Sequence: Synthetic polypeptide
DEVEIRTTNPVATEQYGQVVATDGGGNDDQNEQQE

SEQ ID NO: 160869 - protein, 33 aa, Artificial Sequence
  Description of Artificial Sequence: Synthetic polypeptide
DEQEICTTNPVAYECWGCATTNLQGNAGENDTS

SEQ ID NO: 160870 - protein, 36 aa, Artificial Sequence
  Description of Artificial Sequence: Synthetic polypeptide
DENEIRTTNPVATEQYGSVCTPPCSGETGYMEDMNF

SEQ ID NO: 160871 - protein, 36 aa, Artificial Sequence
  Description of Artificial Sequence: Synthetic polypeptide
DEEEIRTTNPVATEQWGSTSSTTPAGPNMRNGMPYV

SEQ ID NO: 160872 - protein, 35 aa, Artificial Sequence
  Description of Artificial Sequence: Synthetic polypeptide
AEDEICATNPVATEQYGVVATSNENLQQLGNGEDD

SEQ ID NO: 160873 - protein, 36 aa, Artificial Sequence
  Description of Artificial Sequence: Synthetic polypeptide
DEQEICTTNPVAYECWGSVATGNGPLQDDRGQNGTT

SEQ ID NO: 160874 - protein, 36 aa, Artificial Sequence
  Description of Artificial Sequence: Synthetic polypeptide
QEEEIRTTNPVATEQYGMVNIMNGFNEGGGGQEGNS

SEQ ID NO: 160875 - protein, 36 aa, Artificial Sequence
  Description of Artificial Sequence: Synthetic polypeptide
DENEIRTTNPVATEQYGSVCTPPCAAETGYMEDMND

SEQ ID NO: 160876 - protein, 37 aa, Artificial Sequence
  Description of Artificial Sequence: Synthetic polypeptide
DNAEIRTTNPVATEQYGSVCSVPNGVLQTISPNEYHQ

SEQ ID NO: 160877 - protein, 35 aa, Artificial Sequence
  Description of Artificial Sequence: Synthetic polypeptide
DEDEIRTTNPVAYEQWGVVPPGDNNGDQRNGNNGA

SEQ ID NO: 160878 - protein, 37 aa, Artificial Sequence
  Description of Artificial Sequence: Synthetic polypeptide
DENEIRTTNPVATEQYGSVCSVTWVINEDRDFVHEGG

SEQ ID NO: 160879 - protein, 32 aa, Artificial Sequence
  Description of Artificial Sequence: Synthetic polypeptide
CEECIACTNPVATEQWGCVAGTNPATMPGERW

SEQ ID NO: 160880 - protein, 35 aa, Artificial Sequence
  Description of Artificial Sequence: Synthetic polypeptide
DEDEIRTTNPVAYEQWGVVSGGNGLPQQDHPNNGS

SEQ ID NO: 160881 - protein, 31 aa, Artificial Sequence
  Description of Artificial Sequence: Synthetic polypeptide
DDSEVASTNPVSTEGYGNVAANTIQSRVGNH

SEQ ID NO: 160882 - protein, 31 aa, Artificial Sequence
  Description of Artificial Sequence: Synthetic polypeptide
QEQEIASTNPVGTEQYGSVASDLEDHEGDDI

SEQ ID NO: 160883 - protein, 34 aa, Artificial Sequence
  Description of Artificial Sequence: Synthetic polypeptide
DEDEIRTTNPVAYEQWGVVSGGNLGPNDHPNMGS

SEQ ID NO: 160884 - protein, 35 aa, Artificial Sequence
  Description of Artificial Sequence: Synthetic polypeptide
DEEEISTTNPVAYEQYGCVCSSGEHNANFGSENQS

SEQ ID NO: 160885 - protein, 38 aa, Artificial Sequence
  Description of Artificial Sequence: Synthetic polypeptide
AEEEIRTTNPVATEQYGSVVVVVTNNTQQGTEGTNNGG

SEQ ID NO: 160886 - protein, 37 aa, Artificial Sequence
  Description of Artificial Sequence: Synthetic polypeptide
DEGEIRTTNPVATEQYGSVSPVPPNLTEEEIWQESRF

SEQ ID NO: 160887 - protein, 37 aa, Artificial Sequence
  Description of Artificial Sequence: Synthetic polypeptide
DENEIRTTNPVATEQYGSVCSVTWPINIEDRFSHEYG

SEQ ID NO: 160888 - protein, 34 aa, Artificial Sequence
  Description of Artificial Sequence: Synthetic polypeptide
DENEIRTTNPVATWHYGSVSTMNQEVVETEEEDF

SEQ ID NO: 160889 - protein, 37 aa, Artificial Sequence
  Description of Artificial Sequence: Synthetic polypeptide
DECEICTTNPVATEQYGVVSTTNNQQGNNQQGTNSTD

SEQ ID NO: 160890 - protein, 36 aa, Artificial Sequence
  Description of Artificial Sequence: Synthetic polypeptide
DEAEIRTTNPVATEQYGQCVCSWELNQENFPSDNQS

SEQ ID NO: 160891 - protein, 36 aa, Artificial Sequence
  Description of Artificial Sequence: Synthetic polypeptide
QEEEIRTTNPVATEQYGMVGTIMNGFEGGGGQEGTT

SEQ ID NO: 160892 - protein, 35 aa, Artificial Sequence
  Description of Artificial Sequence: Synthetic polypeptide
AEDEICATNPVATEQYGVVATSNNNNLQLGNGNDD

SEQ ID NO: 160893 - protein, 38 aa, Artificial Sequence
  Description of Artificial Sequence: Synthetic polypeptide
DEEEIRTTNPVATEQYGSVQEPVITTLQITESNANNTA

SEQ ID NO: 160894 - protein, 35 aa, Artificial Sequence
  Description of Artificial Sequence: Synthetic polypeptide
AEDEICATNPVATEQYGVVATSNNLLQLNGNGNDD

SEQ ID NO: 160895 - protein, 35 aa, Artificial Sequence
  Description of Artificial Sequence: Synthetic polypeptide
AEDEICATNPVATEQYGVVATSNLNQLQLGNGEDD

SEQ ID NO: 160896 - protein, 36 aa, Artificial Sequence
  Description of Artificial Sequence: Synthetic polypeptide
DEEEIRTTNPVATEQYGSVGCPIPAMLESQIMVYEV

SEQ ID NO: 160897 - protein, 31 aa, Artificial Sequence
  Description of Artificial Sequence: Synthetic polypeptide
DENEIRTTNPVATSQWGDVSSEIEMNAAEDA

SEQ ID NO: 160898 - protein, 35 aa, Artificial Sequence
  Description of Artificial Sequence: Synthetic polypeptide
QEEEIRTTNPVATEQYGAVIVGGDGGQGGEGNDEV

SEQ ID NO: 160899 - protein, 35 aa, Artificial Sequence
  Description of Artificial Sequence: Synthetic polypeptide
AEDEICATNPVATEQYGVVATSNENNNLQLGNGTD

SEQ ID NO: 160900 - protein, 35 aa, Artificial Sequence
  Description of Artificial Sequence: Synthetic polypeptide
CEEEIRTTNPVATEQYGQCVCSSGEHNQNFNSDQD

SEQ ID NO: 160901 - protein, 37 aa, Artificial Sequence
  Description of Artificial Sequence: Synthetic polypeptide
DECEICTTNPVATEQYGVVSTTNQQQGNNQQGNNVTD

SEQ ID NO: 160902 - protein, 36 aa, Artificial Sequence
  Description of Artificial Sequence: Synthetic polypeptide
DEHEIRTTNPVAYEQWGSVCVTDNGDDQHQHGTDRA

SEQ ID NO: 160903 - protein, 36 aa, Artificial Sequence
  Description of Artificial Sequence: Synthetic polypeptide
SEEEIRTTNPVATEQYGCVCSNWGNHDQNFGSQTQA

SEQ ID NO: 160904 - protein, 38 aa, Artificial Sequence
  Description of Artificial Sequence: Synthetic polypeptide
DEEEIRTTNPVATEQYGVVSTVVTNQQNQQGTTTDEEE

SEQ ID NO: 160905 - protein, 35 aa, Artificial Sequence
  Description of Artificial Sequence: Synthetic polypeptide
CEEEIRTTNPVATEQYGQCVCSSGEHNQNFGSDQE

SEQ ID NO: 160906 - protein, 36 aa, Artificial Sequence
  Description of Artificial Sequence: Synthetic polypeptide
DENEIRTTNPVATEQYGSVCYVTWPDLNEDIMMNEM

SEQ ID NO: 160907 - protein, 36 aa, Artificial Sequence
  Description of Artificial Sequence: Synthetic polypeptide
NEEEIRTTNPVATEQYGAIWSLTINHGQQGEGEEEQ

SEQ ID NO: 160908 - protein, 37 aa, Artificial Sequence
  Description of Artificial Sequence: Synthetic polypeptide
DMSEIRTTNPVATEQYGSVSDFYTNLLEIDTNNQEEN

SEQ ID NO: 160909 - protein, 37 aa, Artificial Sequence
  Description of Artificial Sequence: Synthetic polypeptide
DENEIRTTNPVATEQYGSVCYVTWPDLNEDIIGNEMV

SEQ ID NO: 160910 - protein, 36 aa, Artificial Sequence
  Description of Artificial Sequence: Synthetic polypeptide
DENEIRTTNPVATEQYGSVCYVTWPDLNEDIGGMEM

SEQ ID NO: 160911 - protein, 31 aa, Artificial Sequence
  Description of Artificial Sequence: Synthetic polypeptide
DMSEVASTNPVSTEGYGNVAANTIQQRVGQR

SEQ ID NO: 160912 - protein, 38 aa, Artificial Sequence
  Description of Artificial Sequence: Synthetic polypeptide
AEEEIRTTNPVATEQYGSVVVVVTNNNNNNQAGTNNDG

SEQ ID NO: 160913 - protein, 31 aa, Artificial Sequence
  Description of Artificial Sequence: Synthetic polypeptide
DMSEVASTNPVSTEGYGNVAANTIQSRVGQR

SEQ ID NO: 160914 - protein, 35 aa, Artificial Sequence
  Description of Artificial Sequence: Synthetic polypeptide
DEDEIRTTNPVAYEQWGVVCPGDNNGDQDRNGNGA

SEQ ID NO: 160915 - protein, 32 aa, Artificial Sequence
  Description of Artificial Sequence: Synthetic polypeptide
DDSEIASTNPVSTEPYGTVSMEDIQQQQNGNR

SEQ ID NO: 160916 - protein, 37 aa, Artificial Sequence
  Description of Artificial Sequence: Synthetic polypeptide
DENEIRTTNPVATEQYGSVCSVTWPINEDRMFVHEYH

SEQ ID NO: 160917 - protein, 32 aa, Artificial Sequence
  Description of Artificial Sequence: Synthetic polypeptide
DDSEVASTNPVSTEGYGNVAANTIQSRVGNQR

SEQ ID NO: 160918 - protein, 34 aa, Artificial Sequence
  Description of Artificial Sequence: Synthetic polypeptide
DNEEIRTTNPVATEQYGSCWSAPATTDMPEVDQE

SEQ ID NO: 160919 - protein, 37 aa, Artificial Sequence
  Description of Artificial Sequence: Synthetic polypeptide
DEEEIRTTNPVATEQYGSVQEVMTTLLITELNANNDH

SEQ ID NO: 160920 - protein, 29 aa, Artificial Sequence
  Description of Artificial Sequence: Synthetic peptide
QESEIACTNPVGTEGWGVSASTLQHIDEI

SEQ ID NO: 160921 - protein, 35 aa, Artificial Sequence
  Description of Artificial Sequence: Synthetic polypeptide
DEEEISTTNPVAYEQYGCVCSTGEHNQNFNSQTQA

SEQ ID NO: 160922 - protein, 35 aa, Artificial Sequence
  Description of Artificial Sequence: Synthetic polypeptide
DNEEIRTTNPVATEQYGSIVNSAMDESSAEGDDEE

SEQ ID NO: 160923 - protein, 36 aa, Artificial Sequence
  Description of Artificial Sequence: Synthetic polypeptide
DNEEIRTTNPVATEQYGSIVNSATDESSAEGDDEYS

SEQ ID NO: 160924 - protein, 36 aa, Artificial Sequence
  Description of Artificial Sequence: Synthetic polypeptide
DNEEIRTTNPVATEQYGSIVNSATDHESSAEGEDEM

SEQ ID NO: 160925 - protein, 37 aa, Artificial Sequence
  Description of Artificial Sequence: Synthetic polypeptide
DNEEIRTTNPVATEQYGSIVNSATDPESSAEGNENEM

SEQ ID NO: 160926 - protein, 36 aa, Artificial Sequence
  Description of Artificial Sequence: Synthetic polypeptide
DNEEIRTTNPVATEQYGSIVNSATEDESSAEGVDTL

SEQ ID NO: 160927 - protein, 36 aa, Artificial Sequence
  Description of Artificial Sequence: Synthetic polypeptide
DNEEIRTTNPVATEQYGSIVNSCTEDEGSAEGDDEL

SEQ ID NO: 160928 - protein, 34 aa, Artificial Sequence
  Description of Artificial Sequence: Synthetic polypeptide
DEDEIRTTNPVAYEQWGVVTGGNTGNQGETNDDR

SEQ ID NO: 160929 - protein, 35 aa, Artificial Sequence
  Description of Artificial Sequence: Synthetic polypeptide
DNEEIRTTNPVATEQYGSIVNTATDESSAEGDDEH

SEQ ID NO: 160930 - protein, 35 aa, Artificial Sequence
  Description of Artificial Sequence: Synthetic polypeptide
SEEEIRTTNPVATEQYGCVCGNTGAHNINFGSDQA

SEQ ID NO: 160931 - protein, 35 aa, Artificial Sequence
  Description of Artificial Sequence: Synthetic polypeptide
CEEEIRTTNPVATEQYGQCVCSSEHNAENFNSDQD

SEQ ID NO: 160932 - protein, 35 aa, Artificial Sequence
  Description of Artificial Sequence: Synthetic polypeptide
DEQEICTTNPVAYEQWGSVTGENGNGQGNRMGNQQ

SEQ ID NO: 160933 - protein, 35 aa, Artificial Sequence
  Description of Artificial Sequence: Synthetic polypeptide
QEEEIRTTNPVATEQWGTCCAATAEVQNHQDGNDA

SEQ ID NO: 160934 - protein, 34 aa, Artificial Sequence
  Description of Artificial Sequence: Synthetic polypeptide
DEQEICTTNPVAYEQWGSVTGENGNSQGNQGNDL

SEQ ID NO: 160935 - protein, 35 aa, Artificial Sequence
  Description of Artificial Sequence: Synthetic polypeptide
DEVEIRTTNPVATEQYGDVVVDDFNFGQGEGDEEQ

SEQ ID NO: 160936 - protein, 31 aa, Artificial Sequence
  Description of Artificial Sequence: Synthetic polypeptide
DDSEIASTNPVSTEPYGTVSMDIQQQQVGNH

SEQ ID NO: 160937 - protein, 37 aa, Artificial Sequence
  Description of Artificial Sequence: Synthetic polypeptide
DEEEIRTTNPVATEQYGSIQEATSAYLIQIRDEVEFN

SEQ ID NO: 160938 - protein, 38 aa, Artificial Sequence
  Description of Artificial Sequence: Synthetic polypeptide
DECEICTTNPVATEQYGVVSSTTNLQQGNNQQGTNVTD

SEQ ID NO: 160939 - protein, 36 aa, Artificial Sequence
  Description of Artificial Sequence: Synthetic polypeptide
DEGEIRTTNPVATEQYGSVSDWVWVNENERTMPVQE

SEQ ID NO: 160940 - protein, 37 aa, Artificial Sequence
  Description of Artificial Sequence: Synthetic polypeptide
DEEEIRTTNPVATEQYGSIQLTESTAEETNMLLVEVA

SEQ ID NO: 160941 - protein, 35 aa, Artificial Sequence
  Description of Artificial Sequence: Synthetic polypeptide
DEEEIRTTNPCAYEQYGSCAASNLDQATPGDIEAM

SEQ ID NO: 160942 - protein, 35 aa, Artificial Sequence
  Description of Artificial Sequence: Synthetic polypeptide
DEEEIACTNPVATEQYGSVANPHGLITGSGEENND

SEQ ID NO: 160943 - protein, 35 aa, Artificial Sequence
  Description of Artificial Sequence: Synthetic polypeptide
CEEEIRTTNPVTTECWGSVYCMDNDQDQRQGMNEP

SEQ ID NO: 160944 - protein, 35 aa, Artificial Sequence
  Description of Artificial Sequence: Synthetic polypeptide
DEEEIRTTNPCAYEQYGSCAASNLGQATPQDNTAM

SEQ ID NO: 160945 - protein, 36 aa, Artificial Sequence
  Description of Artificial Sequence: Synthetic polypeptide
DENEIRTTNPVATEQYGSVCSVTWPINEDEFSHEGG

SEQ ID NO: 160946 - protein, 33 aa, Artificial Sequence
  Description of Artificial Sequence: Synthetic polypeptide
DDSEIASTNPVSTEPYGNVSAMETIQQSRVGQR

SEQ ID NO: 160947 - protein, 36 aa, Artificial Sequence
  Description of Artificial Sequence: Synthetic polypeptide
DEEEIRTTNPCAYEQYGSCAATGNLDQATPGDEMAM

SEQ ID NO: 160948 - protein, 34 aa, Artificial Sequence
  Description of Artificial Sequence: Synthetic polypeptide
QEEEIRTTNPVATEQYGMVSIMDGEMVEGGGEQG

SEQ ID NO: 160949 - protein, 35 aa, Artificial Sequence
  Description of Artificial Sequence: Synthetic polypeptide
CEEEIRTTNPVATEQYGQCVCSSGEHEQYFNSDQA

SEQ ID NO: 160950 - protein, 32 aa, Artificial Sequence
  Description of Artificial Sequence: Synthetic polypeptide
DDSEIASTNPVSTEPYGNVSAMETIQSRVGQR

SEQ ID NO: 160951 - protein, 37 aa, Artificial Sequence
  Description of Artificial Sequence: Synthetic polypeptide
DECEICTTNPVATEQYGVVSTTNDQQGNNEQGTNTTD

SEQ ID NO: 160952 - protein, 31 aa, Artificial Sequence
  Description of Artificial Sequence: Synthetic polypeptide
DDSEIASTNPVSTEPYGNVSMDIQQQQVGNH

SEQ ID NO: 160953 - protein, 36 aa, Artificial Sequence
  Description of Artificial Sequence: Synthetic polypeptide
DENEIRTTNPVATEQYGSVCSVTWPILEDEFVVEGG

SEQ ID NO: 160954 - protein, 35 aa, Artificial Sequence
  Description of Artificial Sequence: Synthetic polypeptide
DEEEIRTTNPVATEQYGDVMGGIGGQNAGGGEEFG

SEQ ID NO: 160955 - protein, 33 aa, Artificial Sequence
  Description of Artificial Sequence: Synthetic polypeptide
DENEIATTNPVATEQWGCNVSEGEMNAAEDNAK

SEQ ID NO: 160956 - protein, 35 aa, Artificial Sequence
  Description of Artificial Sequence: Synthetic polypeptide
DNEEIRTTNPVATEQYGCVSTWVNDIEYDDTSISM

SEQ ID NO: 160957 - protein, 35 aa, Artificial Sequence
  Description of Artificial Sequence: Synthetic polypeptide
DNEEIRTTNPVATEQYGCVSTWVNTIENDDTSIST

SEQ ID NO: 160958 - protein, 32 aa, Artificial Sequence
  Description of Artificial Sequence: Synthetic polypeptide
DESEIRTTNPGSTEPYGTISMEDIQQQQNGNH

SEQ ID NO: 160959 - protein, 35 aa, Artificial Sequence
  Description of Artificial Sequence: Synthetic polypeptide
DEMEIRCTNPVATEQYGSVSTYAPEMADAGSEQFS

SEQ ID NO: 160960 - protein, 37 aa, Artificial Sequence
  Description of Artificial Sequence: Synthetic polypeptide
DENEIRTTNPVATEQYGSVCSVTWPGLEDRTFVHEGG

SEQ ID NO: 160961 - protein, 37 aa, Artificial Sequence
  Description of Artificial Sequence: Synthetic polypeptide
DEEEIRTTNPVATEQYGSIQQPSLHWDVTEVEQKGEQ

SEQ ID NO: 160962 - protein, 36 aa, Artificial Sequence
  Description of Artificial Sequence: Synthetic polypeptide
SEEEIRTTNPVATEQYGCVCGTTAHNQENFGSDNQA

SEQ ID NO: 160963 - protein, 35 aa, Artificial Sequence
  Description of Artificial Sequence: Synthetic polypeptide
DEEEISTTNPVAYEQYGCVCSTEHEQENFGSDTQQ

SEQ ID NO: 160964 - protein, 37 aa, Artificial Sequence
  Description of Artificial Sequence: Synthetic polypeptide
DEGEIRTTNPVATEQYGSVSNDWNVDCEFPQENGQIK

SEQ ID NO: 160965 - protein, 29 aa, Artificial Sequence
  Description of Artificial Sequence: Synthetic peptide
QESEIACTNPVGTAGWGVSASTLQHGDDI

SEQ ID NO: 160966 - protein, 35 aa, Artificial Sequence
  Description of Artificial Sequence: Synthetic polypeptide
DNEEIRTTNPVATEQYGCVSTWVNDIEFDITSIST

SEQ ID NO: 160967 - protein, 32 aa, Artificial Sequence
  Description of Artificial Sequence: Synthetic polypeptide
DNNEIRTTNPVSTEPYGTISMEDIQQQQNGNH

SEQ ID NO: 160968 - protein, 37 aa, Artificial Sequence
  Description of Artificial Sequence: Synthetic polypeptide
DECEICTTNPVATEQYGVVATVNLQQSATEEGTNQDD

SEQ ID NO: 160969 - protein, 37 aa, Artificial Sequence
  Description of Artificial Sequence: Synthetic polypeptide
DEGEIRTTNPVATEQYGSVSCVLDANEDPQGMMNNQI

SEQ ID NO: 160970 - protein, 29 aa, Artificial Sequence
  Description of Artificial Sequence: Synthetic peptide
NEEEIATTNPVAYEQWGEAYYVDDQHEQG

SEQ ID NO: 160971 - protein, 34 aa, Artificial Sequence
  Description of Artificial Sequence: Synthetic polypeptide
DEGEIRTTNPVAYEQWGSTYHTLNDDFQQIGSAH

SEQ ID NO: 160972 - protein, 35 aa, Artificial Sequence
  Description of Artificial Sequence: Synthetic polypeptide
DEEEIRTTNPCATEQYGCVCQNTEHNQNFGSDTAS

SEQ ID NO: 160973 - protein, 37 aa, Artificial Sequence
  Description of Artificial Sequence: Synthetic polypeptide
DEEEIRTTNPVATEQYGSVSNWEPEDEAMRMIVNEYS

SEQ ID NO: 160974 - protein, 29 aa, Artificial Sequence
  Description of Artificial Sequence: Synthetic peptide
NEEEIATTNPVAYEQWGEAYYKEQQEEEG

SEQ ID NO: 160975 - protein, 37 aa, Artificial Sequence
  Description of Artificial Sequence: Synthetic polypeptide
DEDEIRTTNPVATEQYGVVSTVVVTTNGTQAGSTEDN

SEQ ID NO: 160976 - protein, 32 aa, Artificial Sequence
  Description of Artificial Sequence: Synthetic polypeptide
NEEEIRTTNPVAYEKWGSVCWIELQGDHDHKN

SEQ ID NO: 160977 - protein, 34 aa, Artificial Sequence
  Description of Artificial Sequence: Synthetic polypeptide
DEEEIRTTNPCATEQYGCVCGWEEHQNFGSDTAS

SEQ ID NO: 160978 - protein, 34 aa, Artificial Sequence
  Description of Artificial Sequence: Synthetic polypeptide
DEGEIRTTNPVAYEQWGSTYHTLNDDNQQMGDAH

SEQ ID NO: 160979 - protein, 32 aa, Artificial Sequence
  Description of Artificial Sequence: Synthetic polypeptide
NEEEIATTNPVAYEQWGCLSCFEHDQRQQGEN

SEQ ID NO: 160980 - protein, 29 aa, Artificial Sequence
  Description of Artificial Sequence: Synthetic peptide
QEGEIAPTNPCSTEQWGAVSADWQESGTI

SEQ ID NO: 160981 - protein, 34 aa, Artificial Sequence
  Description of Artificial Sequence: Synthetic polypeptide
SEEEIRTTNPVATDSYGSCHSNTTHHPRGSDQDD

SEQ ID NO: 160982 - protein, 31 aa, Artificial Sequence
  Description of Artificial Sequence: Synthetic polypeptide
NEEEIRTTNPVAYEKWGSVCWIEQGQPDHHN

SEQ ID NO: 160983 - protein, 35 aa, Artificial Sequence
  Description of Artificial Sequence: Synthetic polypeptide
SEEEIRTTNPVATDHYGSSCFNTHNLDHRGEDQDD

SEQ ID NO: 160984 - protein, 35 aa, Artificial Sequence
  Description of Artificial Sequence: Synthetic polypeptide
DEDEIRTTNPVAYESWGSVCSTIDGLHQNGQAGDH

SEQ ID NO: 160985 - protein, 33 aa, Artificial Sequence
  Description of Artificial Sequence: Synthetic polypeptide
DEDEIRTTNPVAYESWGSVCYNTDENDQDNQHS

SEQ ID NO: 160986 - protein, 37 aa, Artificial Sequence
  Description of Artificial Sequence: Synthetic polypeptide
DEEEIRTTNPVATECYGSVVDMEDNVDQGGGGNDEEG

SEQ ID NO: 160987 - protein, 34 aa, Artificial Sequence
  Description of Artificial Sequence: Synthetic polypeptide
DEEEIRTTNPVCTEHYGCVCSWPEDDQNFGSDQA

SEQ ID NO: 160988 - protein, 33 aa, Artificial Sequence
  Description of Artificial Sequence: Synthetic polypeptide
SEEEIRTTNPVATASWGCVAGNGLADAPGDDQR

SEQ ID NO: 160989 - protein, 35 aa, Artificial Sequence
  Description of Artificial Sequence: Synthetic polypeptide
DEEEIRTTNPCATEQYGCVCGTGAHNQNFGSDTAS

SEQ ID NO: 160990 - protein, 38 aa, Artificial Sequence
  Description of Artificial Sequence: Synthetic polypeptide
AEEEIRTTNPVATEQYGSVVVVVTTNNAQQGTTDENET

SEQ ID NO: 160991 - protein, 38 aa, Artificial Sequence
  Description of Artificial Sequence: Synthetic polypeptide
DEEEIRTTNPVATEQYGSVYTGTMNQNGQDEQNEDGQT

SEQ ID NO: 160992 - protein, 36 aa, Artificial Sequence
  Description of Artificial Sequence: Synthetic polypeptide
SEEEIRTTNPVATDQYGVVNDNSIGQNGQGGNNTTP

SEQ ID NO: 160993 - protein, 38 aa, Artificial Sequence
  Description of Artificial Sequence: Synthetic polypeptide
DEDEIRTTNPVATEQYGVVSTVVVTNQQAGNNNNQEDD

SEQ ID NO: 160994 - protein, 31 aa, Artificial Sequence
  Description of Artificial Sequence: Synthetic polypeptide
DENEIATTNPVATEQWGDVSAEDEMDHAEEA

SEQ ID NO: 160995 - protein, 35 aa, Artificial Sequence
  Description of Artificial Sequence: Synthetic polypeptide
DEDEIRTTNPVAYESWGCVCSNDNDDQPGQRGNEH

SEQ ID NO: 160996 - protein, 32 aa, Artificial Sequence
  Description of Artificial Sequence: Synthetic polypeptide
DDSEIATTNPVSTEGYGNVAATDIQDHEGQDR

SEQ ID NO: 160997 - protein, 37 aa, Artificial Sequence
  Description of Artificial Sequence: Synthetic polypeptide
SEEEIRTTNPVATEFYGSVIDGNVDDGDQRGEQEGNG

SEQ ID NO: 160998 - protein, 31 aa, Artificial Sequence
  Description of Artificial Sequence: Synthetic polypeptide
NEEEIRTTNPVAYEKWGSVCWIEDNQPDHKP

SEQ ID NO: 160999 - protein, 30 aa, Artificial Sequence
  Description of Artificial Sequence: Synthetic polypeptide
DENEIATTNPVATEQWGDASEIEMNAAEDA

SEQ ID NO: 161000 - protein, 31 aa, Artificial Sequence
  Description of Artificial Sequence: Synthetic polypeptide
NEEEIRTTNPVAYEKWGSVCWIEEGQPDHKD

SEQ ID NO: 161001 - protein, 35 aa, Artificial Sequence
  Description of Artificial Sequence: Synthetic polypeptide
DEEEIRTTNPVATEQYGSILPAGNQFINTIELEEF

SEQ ID NO: 161002 - protein, 36 aa, Artificial Sequence
  Description of Artificial Sequence: Synthetic polypeptide
DENEIRTTNPVATEQYGSCSYSDNIWWQNESNEDKD

SEQ ID NO: 161003 - protein, 35 aa, Artificial Sequence
  Description of Artificial Sequence: Synthetic polypeptide
DEMEIATTNPVAYEQYGTVCSYTDGPVEQHGNGDP

SEQ ID NO: 161004 - protein, 37 aa, Artificial Sequence
  Description of Artificial Sequence: Synthetic polypeptide
DEEEIRTTNPVATEQYGSVQGPTNNKLGMPVLEIEDT

SEQ ID NO: 161005 - protein, 32 aa, Artificial Sequence
  Description of Artificial Sequence: Synthetic polypeptide
DDSEIATTNPVSTEGYGNVAATTIQDHEGQDR

SEQ ID NO: 161006 - protein, 30 aa, Artificial Sequence
  Description of Artificial Sequence: Synthetic polypeptide
DENEIATTNPVATEQWGDVNEIEMNAAEDA

SEQ ID NO: 161007 - protein, 37 aa, Artificial Sequence
  Description of Artificial Sequence: Synthetic polypeptide
DEDEIRTTNPVATEQYGVVSTVVVTTNNLEAGSTDDN

SEQ ID NO: 161008 - protein, 35 aa, Artificial Sequence
  Description of Artificial Sequence: Synthetic polypeptide
DENEIRTTNPVATEQYGSCSVANMVEQLEPVEDTV

SEQ ID NO: 161009 - protein, 36 aa, Artificial Sequence
  Description of Artificial Sequence: Synthetic polypeptide
DEEEIRTTNPVATEQYGSILGNNLGLDTVGVFVGEV

SEQ ID NO: 161010 - protein, 36 aa, Artificial Sequence
  Description of Artificial Sequence: Synthetic polypeptide
SEEEIRTTNPVATECYGSVSIMGDLGQLQENQGEGT

SEQ ID NO: 161011 - protein, 32 aa, Artificial Sequence
  Description of Artificial Sequence: Synthetic polypeptide
NEEEIRTTNPVAYEKWGSVCWIEGGQPDHSNY

SEQ ID NO: 161012 - protein, 33 aa, Artificial Sequence
  Description of Artificial Sequence: Synthetic polypeptide
DEDEIRTTNPVAYERWGVCATENLPGDHGNNNP

SEQ ID NO: 161013 - protein, 37 aa, Artificial Sequence
  Description of Artificial Sequence: Synthetic polypeptide
DEEEIRTTNPVATEQYGSILEYSTAVEPNMLLVEVPT

SEQ ID NO: 161014 - protein, 33 aa, Artificial Sequence
  Description of Artificial Sequence: Synthetic polypeptide
DEDEIRTTNPVAYERWGVVCPGDDLQRENGDDQ

SEQ ID NO: 161015 - protein, 36 aa, Artificial Sequence
  Description of Artificial Sequence: Synthetic polypeptide
DEEEIRTTNPVATEQYGSVSPAAWIMETSAMFEHHS

SEQ ID NO: 161016 - protein, 36 aa, Artificial Sequence
  Description of Artificial Sequence: Synthetic polypeptide
DEEEIRTTNPVATEQYGSVSPAAAMVENSAIPEHSS

SEQ ID NO: 161017 - protein, 34 aa, Artificial Sequence
  Description of Artificial Sequence: Synthetic polypeptide
DEEEIRTTNPCATEQYGCVCQWGEHQNFNSDTAS

SEQ ID NO: 161018 - protein, 35 aa, Artificial Sequence
  Description of Artificial Sequence: Synthetic polypeptide
DENEIRTTNPVATEQYGSCSVAVNMVEQLEPQEDT

SEQ ID NO: 161019 - protein, 35 aa, Artificial Sequence
  Description of Artificial Sequence: Synthetic polypeptide
SEEEIRTTNPVATEGWGSVFVNENDHHENRGDQRE

SEQ ID NO: 161020 - protein, 35 aa, Artificial Sequence
  Description of Artificial Sequence: Synthetic polypeptide
DEEEIRTTNPVCTEHYGCVCSWEELNQENFGSQQS

SEQ ID NO: 161021 - protein, 34 aa, Artificial Sequence
  Description of Artificial Sequence: Synthetic polypeptide
DEMEIATTNPVAYEQYGTVCSYTDGPHEHEGNDT

SEQ ID NO: 161022 - protein, 36 aa, Artificial Sequence
  Description of Artificial Sequence: Synthetic polypeptide
DQAEIRTTNPVATEQYGSVWWATWNEEARFGDLQLV

SEQ ID NO: 161023 - protein, 36 aa, Artificial Sequence
  Description of Artificial Sequence: Synthetic polypeptide
DENEIRTTNPVATEQYGSCCSPTNWPENSSPSNQVE

SEQ ID NO: 161024 - protein, 37 aa, Artificial Sequence
  Description of Artificial Sequence: Synthetic polypeptide
DENEIRTTNPVATEQYGSCCSPTNMWPENHSGSNQVE

SEQ ID NO: 161025 - protein, 36 aa, Artificial Sequence
  Description of Artificial Sequence: Synthetic polypeptide
DEMEIATTNPVAYEQYGTVCSYTDGNNDEQMEGNND

SEQ ID NO: 161026 - protein, 35 aa, Artificial Sequence
  Description of Artificial Sequence: Synthetic polypeptide
DEEEIRTTNPVATEQYGDVVDGFNGEDFEDGEDQL

SEQ ID NO: 161027 - protein, 35 aa, Artificial Sequence
  Description of Artificial Sequence: Synthetic polypeptide
DEEEIRTTNPVATEQYGDVVDGFNGEDFEEDGEQG

SEQ ID NO: 161028 - protein, 35 aa, Artificial Sequence
  Description of Artificial Sequence: Synthetic polypeptide
AEDEICATNPVATEQYGVVATSGENLLQLGNGEDD

SEQ ID NO: 161029 - protein, 34 aa, Artificial Sequence
  Description of Artificial Sequence: Synthetic polypeptide
DEEEIRTTNPVATEQYGDVVDGFNGEDNEDDEQL

SEQ ID NO: 161030 - protein, 33 aa, Artificial Sequence
  Description of Artificial Sequence: Synthetic polypeptide
DEDEIRTTNPVSTEPYGTISMEDEISQQQNGNH

SEQ ID NO: 161031 - protein, 36 aa, Artificial Sequence
  Description of Artificial Sequence: Synthetic polypeptide
DEEEIRTTNPVAYEQWGEVSGGTPAGPNMRDGMNPV

SEQ ID NO: 161032 - protein, 34 aa, Artificial Sequence
  Description of Artificial Sequence: Synthetic polypeptide
DQAEIRTTNPVATEQYGSVWVQVEMDEGIGNEKE

SEQ ID NO: 161033 - protein, 35 aa, Artificial Sequence
  Description of Artificial Sequence: Synthetic polypeptide
DEEEIRTTNPVATEQYGDVVDGFQNDEFTGGGEQV

SEQ ID NO: 161034 - protein, 37 aa, Artificial Sequence
  Description of Artificial Sequence: Synthetic polypeptide
DEEEIRTTNPVATEQYGDVVDGMTNQRNDEDIIGEGV

SEQ ID NO: 161035 - protein, 38 aa, Artificial Sequence
  Description of Artificial Sequence: Synthetic polypeptide
DEDEIRTTNPVATEQYGVVSTVVVNTQQQLQQGTEEDT

SEQ ID NO: 161036 - protein, 35 aa, Artificial Sequence
  Description of Artificial Sequence: Synthetic polypeptide
DEEEIRTTNPVATEQYGDVVDIMTLTGGEDGGEET

SEQ ID NO: 161037 - protein, 36 aa, Artificial Sequence
  Description of Artificial Sequence: Synthetic polypeptide
DEEEIRTTNPVATEQYGDVVDNFNEMDDGEGQGNFG

SEQ ID NO: 161038 - protein, 36 aa, Artificial Sequence
  Description of Artificial Sequence: Synthetic polypeptide
DESEIRGTNPVATDQYGDVSTSVGDLGQRGLGEEGV

SEQ ID NO: 161039 - protein, 34 aa, Artificial Sequence
  Description of Artificial Sequence: Synthetic polypeptide
DQAEIRTTNPVAYEQYGCTCSCQVEVFQHGTNNR

SEQ ID NO: 161040 - protein, 36 aa, Artificial Sequence
  Description of Artificial Sequence: Synthetic polypeptide
DEMEIATTNPVAYEQYGTVCSYTDGNNDEKQEGNDS

SEQ ID NO: 161041 - protein, 33 aa, Artificial Sequence
  Description of Artificial Sequence: Synthetic polypeptide
DEDEIRTTNPVSTEPYGTISMIDIQVQQNGPNH

SEQ ID NO: 161042 - protein, 34 aa, Artificial Sequence
  Description of Artificial Sequence: Synthetic polypeptide
DEHEIRTTNPVAYEQWGVVCSGGNGNQGETNDDH

SEQ ID NO: 161043 - protein, 36 aa, Artificial Sequence
  Description of Artificial Sequence: Synthetic polypeptide
DENEIRTTNPVATEQYGSCANVTHDLQTGFEVEQQY

SEQ ID NO: 161044 - protein, 38 aa, Artificial Sequence
  Description of Artificial Sequence: Synthetic polypeptide
DEEEIRTTNPVATEQYGDVVDGMTGEGNQERGGNTEES

SEQ ID NO: 161045 - protein, 34 aa, Artificial Sequence
  Description of Artificial Sequence: Synthetic polypeptide
DEEEIRTTNPVCTEHYGCVCSWEEDNQNFGSDQA

SEQ ID NO: 161046 - protein, 34 aa, Artificial Sequence
  Description of Artificial Sequence: Synthetic polypeptide
DEEEIRTTNPVCTEHYGCVCSNWPEHQNFGSDQA

SEQ ID NO: 161047 - protein, 36 aa, Artificial Sequence
  Description of Artificial Sequence: Synthetic polypeptide
DQAEIRTTNPVATEQYGSVSWATWQEEARFGDQPLQ

SEQ ID NO: 161048 - protein, 37 aa, Artificial Sequence
  Description of Artificial Sequence: Synthetic polypeptide
DEEEIRTTNPVATEQWGICQVCSYTNDLNANFGSEFG

SEQ ID NO: 161049 - protein, 36 aa, Artificial Sequence
  Description of Artificial Sequence: Synthetic polypeptide
DENEIRTTNPVATEQYGSCISVTVHDMQTGMEEQQY

SEQ ID NO: 161050 - protein, 36 aa, Artificial Sequence
  Description of Artificial Sequence: Synthetic polypeptide
DENEIRTTNPVATEQYGSCISVTMHDLETGMEEQQY

SEQ ID NO: 161051 - protein, 35 aa, Artificial Sequence
  Description of Artificial Sequence: Synthetic polypeptide
DEMEIATTNPVAYEQYGTVCSYTDGPGEQDGNTDH

SEQ ID NO: 161052 - protein, 37 aa, Artificial Sequence
  Description of Artificial Sequence: Synthetic polypeptide
DEDEIRTTNPVATEQYGVVSTVVVTNNDNQAGSTDDD

SEQ ID NO: 161053 - protein, 37 aa, Artificial Sequence
  Description of Artificial Sequence: Synthetic polypeptide
DEEEIRTTNPVATEQWGICQVCSYTEDLNARFGSDFP

SEQ ID NO: 161054 - protein, 37 aa, Artificial Sequence
  Description of Artificial Sequence: Synthetic polypeptide
DENEIRTTNPVATEQYGSCISVTHDLEQTGMEGEQQY

SEQ ID NO: 161055 - protein, 35 aa, Artificial Sequence
  Description of Artificial Sequence: Synthetic polypeptide
DEQEIKTTNPVATEFYGSVSATGDGEDQEGGELDD

SEQ ID NO: 161056 - protein, 33 aa, Artificial Sequence
  Description of Artificial Sequence: Synthetic polypeptide
DEEEIRTTNPEATEQYGCVCPWGEDANFNSDQS

SEQ ID NO: 161057 - protein, 37 aa, Artificial Sequence
  Description of Artificial Sequence: Synthetic polypeptide
DEEEIRTTNPVATEQYGDVVDDNTIGQQNIGGENTVA

SEQ ID NO: 161058 - protein, 36 aa, Artificial Sequence
  Description of Artificial Sequence: Synthetic polypeptide
DQAEIRTTNPVATEQYGSVTWASWNEEARNGDLDLQ

SEQ ID NO: 161059 - protein, 34 aa, Artificial Sequence
  Description of Artificial Sequence: Synthetic polypeptide
DEEEIRTTNPEATEQYGCVCPWGEHNANFGSDQS

SEQ ID NO: 161060 - protein, 36 aa, Artificial Sequence
  Description of Artificial Sequence: Synthetic polypeptide
DENEIRTTNPVATEQYGSCISVTAHDLKTGSEEQQY

SEQ ID NO: 161061 - protein, 34 aa, Artificial Sequence
  Description of Artificial Sequence: Synthetic polypeptide
DEEEIRTTNPVATEQYGDVVDGFNGEDFEDDEGG

SEQ ID NO: 161062 - protein, 38 aa, Artificial Sequence
  Description of Artificial Sequence: Synthetic polypeptide
DEEEIRTTNPVATEQYGVVSTVVTNQQGNTEQGTTEGS

SEQ ID NO: 161063 - protein, 36 aa, Artificial Sequence
  Description of Artificial Sequence: Synthetic polypeptide
DENEIRTTNPVATEQYGSCISVTAHDGQTGLEEQQY

SEQ ID NO: 161064 - protein, 36 aa, Artificial Sequence
  Description of Artificial Sequence: Synthetic polypeptide
CEEEIRTTNPVATEQYGDVVVTVGDTGQGIIGNEDN

SEQ ID NO: 161065 - protein, 34 aa, Artificial Sequence
  Description of Artificial Sequence: Synthetic polypeptide
DQAEIRTTNPVATEQYGSVSVDYWPENGFPISQE

SEQ ID NO: 161066 - protein, 35 aa, Artificial Sequence
  Description of Artificial Sequence: Synthetic polypeptide
DQAEIRTTNPVATEQYGSVSWANWNEEAPNGDLLQ

SEQ ID NO: 161067 - protein, 36 aa, Artificial Sequence
  Description of Artificial Sequence: Synthetic polypeptide
DQAEIRTTNPVATEQYGSVSWASWNEEARFGDLPVN

SEQ ID NO: 161068 - protein, 36 aa, Artificial Sequence
  Description of Artificial Sequence: Synthetic polypeptide
DQAEIRTTNPVATEQYGSVSWASWNEEARNGDLPDQ

SEQ ID NO: 161069 - protein, 36 aa, Artificial Sequence
  Description of Artificial Sequence: Synthetic polypeptide
DENEIRTTNPVATEQYGSCIMVTFHDLQTGMEEQQY

SEQ ID NO: 161070 - protein, 36 aa, Artificial Sequence
  Description of Artificial Sequence: Synthetic polypeptide
DQAEIRTTNPVATEQYGSVISWASWNEEARNGDLLQ

SEQ ID NO: 161071 - protein, 36 aa, Artificial Sequence
  Description of Artificial Sequence: Synthetic polypeptide
SEEEIRTTNPVATEGYGAVVVSIMGDLGQRNQGEGD

SEQ ID NO: 161072 - protein, 37 aa, Artificial Sequence
  Description of Artificial Sequence: Synthetic polypeptide
DEEEIRTTNPVATEQYGSVSPAMSSQITLVTTQNSDG

SEQ ID NO: 161073 - protein, 37 aa, Artificial Sequence
  Description of Artificial Sequence: Synthetic polypeptide
DEEEIRTTNPVATEQYGSVSPAMSTQVTIVTTQNDDG

SEQ ID NO: 161074 - protein, 35 aa, Artificial Sequence
  Description of Artificial Sequence: Synthetic polypeptide
DEEEIRTTNPVATEQYGSINNWCEETYDEGEQGIM

SEQ ID NO: 161075 - protein, 32 aa, Artificial Sequence
  Description of Artificial Sequence: Synthetic polypeptide
DESEIRTTNPIATECWGATSAINEAEREGPYI

SEQ ID NO: 161076 - protein, 35 aa, Artificial Sequence
  Description of Artificial Sequence: Synthetic polypeptide
DEGEIRTTNPVATEQYGSVQTVEGSHQEIIESEQD

SEQ ID NO: 161077 - protein, 33 aa, Artificial Sequence
  Description of Artificial Sequence: Synthetic polypeptide
DENEIATTNPVATEQWGCVSAENGEMNAAEDNA

SEQ ID NO: 161078 - protein, 36 aa, Artificial Sequence
  Description of Artificial Sequence: Synthetic polypeptide
DEEEIRTTNPVATEQYGSVSPCMEENTDVAMIELAV

SEQ ID NO: 161079 - protein, 33 aa, Artificial Sequence
  Description of Artificial Sequence: Synthetic polypeptide
SEEEIRTTNPVATEGYGCVCSNWPHANFGSDTQ

SEQ ID NO: 161080 - protein, 36 aa, Artificial Sequence
  Description of Artificial Sequence: Synthetic polypeptide
DEEEIRTTNPVATEQYGSVSPAWDIMETSAMFEHHS

SEQ ID NO: 161081 - protein, 37 aa, Artificial Sequence
  Description of Artificial Sequence: Synthetic polypeptide
DEEEIRTTNPVATEQYGSVSPAVNTLMETSAMPEHES

SEQ ID NO: 161082 - protein, 31 aa, Artificial Sequence
  Description of Artificial Sequence: Synthetic polypeptide
QEGEIAPTNPCSYEAYGVTVSCNLSQSGGTR

SEQ ID NO: 161083 - protein, 36 aa, Artificial Sequence
  Description of Artificial Sequence: Synthetic polypeptide
DEEEIRTTNPVATEQYGSVSPAVNIMETSAMPEHMS

SEQ ID NO: 161084 - protein, 37 aa, Artificial Sequence
  Description of Artificial Sequence: Synthetic polypeptide
DEAEIRTTNPVATEQYGSTIPWTPPLENNQHQSENRQ

SEQ ID NO: 161085 - protein, 36 aa, Artificial Sequence
  Description of Artificial Sequence: Synthetic polypeptide
DEEEIRTTNPVATEQYGSVTAPPLIEEVPMGPLEQG

SEQ ID NO: 161086 - protein, 34 aa, Artificial Sequence
  Description of Artificial Sequence: Synthetic polypeptide
NEEEIRTTNPVAYEHWGCFSWINDLQDRQGQQQK

SEQ ID NO: 161087 - protein, 33 aa, Artificial Sequence
  Description of Artificial Sequence: Synthetic polypeptide
DPSEIRTTNPVSTECWGSVGCINEPEAREGENG

SEQ ID NO: 161088 - protein, 34 aa, Artificial Sequence
  Description of Artificial Sequence: Synthetic polypeptide
SEEEIRTTNPVATEGYGCVCSNWELANFGSDFQA

SEQ ID NO: 161089 - protein, 37 aa, Artificial Sequence
  Description of Artificial Sequence: Synthetic polypeptide
DEEEIRTTNPVATEQYGSVQFITMGEEQPYPGEYPEI

SEQ ID NO: 161090 - protein, 38 aa, Artificial Sequence
  Description of Artificial Sequence: Synthetic polypeptide
DEEEIRTTNPVATEQWGQCQVCSYTNALNAYFGSDNQA

SEQ ID NO: 161091 - protein, 35 aa, Artificial Sequence
  Description of Artificial Sequence: Synthetic polypeptide
SEEEIRTTNPVATEGYGCVCSNTNHNAHFNSDTQS

SEQ ID NO: 161092 - protein, 36 aa, Artificial Sequence
  Description of Artificial Sequence: Synthetic polypeptide
DENEIRTTNPVATEQYGSIMSVDALENTGGSQEPNP

SEQ ID NO: 161093 - protein, 36 aa, Artificial Sequence
  Description of Artificial Sequence: Synthetic polypeptide
DEEEIRTTNPEATEQYGCVCPNSGEDNANFGSDNQS

SEQ ID NO: 161094 - protein, 31 aa, Artificial Sequence
  Description of Artificial Sequence: Synthetic polypeptide
DAEEIATTNPVGTAQWGACVAGNNLAMNPDR

SEQ ID NO: 161095 - protein, 37 aa, Artificial Sequence
  Description of Artificial Sequence: Synthetic polypeptide
DEEEIRTTNPVATEQYGSVQFITMGEEQSETGEVPEI

SEQ ID NO: 161096 - protein, 36 aa, Artificial Sequence
  Description of Artificial Sequence: Synthetic polypeptide
DEEEIRTTNPVATEQYGSVQFITMGEEQPEQSEVEI

SEQ ID NO: 161097 - protein, 35 aa, Artificial Sequence
  Description of Artificial Sequence: Synthetic polypeptide
SEEEIRTTNPVATEGYGCVCSNTGNPANFGSDTQS

SEQ ID NO: 161098 - protein, 37 aa, Artificial Sequence
  Description of Artificial Sequence: Synthetic polypeptide
DPEEIGTTNPVATEQYGSVSWPVHQILEEQQGNNPLP

SEQ ID NO: 161099 - protein, 34 aa, Artificial Sequence
  Description of Artificial Sequence: Synthetic polypeptide
DEGEIRTTNPVATEQYGSVQTVESHDEIIEEIYD

SEQ ID NO: 161100 - protein, 37 aa, Artificial Sequence
  Description of Artificial Sequence: Synthetic polypeptide
DEGEIRTTNPVATEQYGSVSCVLDAFEDPEGMQVNQI

SEQ ID NO: 161101 - protein, 36 aa, Artificial Sequence
  Description of Artificial Sequence: Synthetic polypeptide
SEEEIRTTNPVATEGYGSVVSIMGDAEGQRNQGEGD

SEQ ID NO: 161102 - protein, 36 aa, Artificial Sequence
  Description of Artificial Sequence: Synthetic polypeptide
DEEEIRTTNPCATEQYGSCAAATGYLQATPGDEMAM

SEQ ID NO: 161103 - protein, 37 aa, Artificial Sequence
  Description of Artificial Sequence: Synthetic polypeptide
DEEEIRTTNPVATEQYGSVQFISMGEEQPETGHVPEI

SEQ ID NO: 161104 - protein, 39 aa, Artificial Sequence
  Description of Artificial Sequence: Synthetic polypeptide
DENEIRTTNPVATEQYGSNIVTWSVNDEEQNGEPEINRV

SEQ ID NO: 161105 - protein, 35 aa, Artificial Sequence
  Description of Artificial Sequence: Synthetic polypeptide
AEDEICATNPVATEQYGVVATSGNNNLQLNNGNDD

SEQ ID NO: 161106 - protein, 31 aa, Artificial Sequence
  Description of Artificial Sequence: Synthetic polypeptide
DDSEVASTNPVSTEGYGNVAANTIQRVGQQR

SEQ ID NO: 161107 - protein, 36 aa, Artificial Sequence
  Description of Artificial Sequence: Synthetic polypeptide
DEEEIRTTNPVATEQYGSINSSYESQTNDISEESQI

SEQ ID NO: 161108 - protein, 36 aa, Artificial Sequence
  Description of Artificial Sequence: Synthetic polypeptide
DEGEIRTTNPVATEQYGSVSAVLDDNEDEYAQNNQI

SEQ ID NO: 161109 - protein, 34 aa, Artificial Sequence
  Description of Artificial Sequence: Synthetic polypeptide
NEEEIATTNPVAYEQYGSVATNPLSENAHIEIAN

SEQ ID NO: 161110 - protein, 34 aa, Artificial Sequence
  Description of Artificial Sequence: Synthetic polypeptide
CEEEIRTTNPVATEQYGQCVCPWEHQENFGSDQE

SEQ ID NO: 161111 - protein, 34 aa, Artificial Sequence
  Description of Artificial Sequence: Synthetic polypeptide
DDSEIATTNPVSTECYGNVSANITEPQDREGEQR

SEQ ID NO: 161112 - protein, 34 aa, Artificial Sequence
  Description of Artificial Sequence: Synthetic polypeptide
DEGEIRTTNPVAYEQWGHTSHTLNDDQQQMGFAE

SEQ ID NO: 161113 - protein, 31 aa, Artificial Sequence
  Description of Artificial Sequence: Synthetic polypeptide
DNSEVASTNPVSTEGYGNVAANTIQSRVGQR

SEQ ID NO: 161114 - protein, 35 aa, Artificial Sequence
  Description of Artificial Sequence: Synthetic polypeptide
DEEEIRTTNPVATEQYGSVQFITMGEEMPEMEVEI

SEQ ID NO: 161115 - protein, 34 aa, Artificial Sequence
  Description of Artificial Sequence: Synthetic polypeptide
DNSYIRTTNPVATECWGSVSCINEPQDVEGENGD

SEQ ID NO: 161116 - protein, 33 aa, Artificial Sequence
  Description of Artificial Sequence: Synthetic polypeptide
DEEEIRTTNPEATCQYGCVCPWGEDNQNFGSDQ

SEQ ID NO: 161117 - protein, 32 aa, Artificial Sequence
  Description of Artificial Sequence: Synthetic polypeptide
DESEIRTTNPIATECWGATSAINEADREGPYG

SEQ ID NO: 161118 - protein, 35 aa, Artificial Sequence
  Description of Artificial Sequence: Synthetic polypeptide
DEHEIRTTNPVAYEQWGSVYGGPPGNHQNAGDNDH

SEQ ID NO: 161119 - protein, 37 aa, Artificial Sequence
  Description of Artificial Sequence: Synthetic polypeptide
DEEEIRTTNPVATEQYGSVQFITMGEEQPADGEVPEI

SEQ ID NO: 161120 - protein, 36 aa, Artificial Sequence
  Description of Artificial Sequence: Synthetic polypeptide
DEVEIRTTNPVATEQYGAVNNTDGDEENQEGEGNQQ

SEQ ID NO: 161121 - protein, 39 aa, Artificial Sequence
  Description of Artificial Sequence: Synthetic polypeptide
DEEEIRTTNPVATEQYGVVSTVVVTNLQQGTEQGTEESE

SEQ ID NO: 161122 - protein, 37 aa, Artificial Sequence
  Description of Artificial Sequence: Synthetic polypeptide
DEEEIRTTNPVATEQYGSVQFITFGYEEQPEGEVPEI

SEQ ID NO: 161123 - protein, 35 aa, Artificial Sequence
  Description of Artificial Sequence: Synthetic polypeptide
SEEEIRTTNPVATEGYGCVCSNTGNDAYFNSDTQS

SEQ ID NO: 161124 - protein, 32 aa, Artificial Sequence
  Description of Artificial Sequence: Synthetic polypeptide
DENEIRTTNPVAWEQWGDVSEEIEMNAAEDVA

SEQ ID NO: 161125 - protein, 32 aa, Artificial Sequence
  Description of Artificial Sequence: Synthetic polypeptide
QEGEIAPTNPCSYEHYGKVSFNELSQSGGTNR

SEQ ID NO: 161126 - protein, 32 aa, Artificial Sequence
  Description of Artificial Sequence: Synthetic polypeptide
DENEIATTNPVATEQWGCVSGEGEMNAAEDAH

SEQ ID NO: 161127 - protein, 35 aa, Artificial Sequence
  Description of Artificial Sequence: Synthetic polypeptide
DENEIRTTNPVATEQYGSFWWAPDLTQPESNQFDN

SEQ ID NO: 161128 - protein, 35 aa, Artificial Sequence
  Description of Artificial Sequence: Synthetic polypeptide
DEDEIRTTNPVAYERWGSVCSNDNHDQRGQGGGEH

SEQ ID NO: 161129 - protein, 34 aa, Artificial Sequence
  Description of Artificial Sequence: Synthetic polypeptide
DEDEIRTTNPVAYERWGSVCTIEGMQDHQGGNHA

SEQ ID NO: 161130 - protein, 38 aa, Artificial Sequence
  Description of Artificial Sequence: Synthetic polypeptide
DEEEIRTTNPVATEQWGQCNVCSYTNDLNARFGSDTFS

SEQ ID NO: 161131 - protein, 35 aa, Artificial Sequence
  Description of Artificial Sequence: Synthetic polypeptide
DENEIRTTNPVATEQYGSCYYNTDNMPEGGGSIEM

SEQ ID NO: 161132 - protein, 36 aa, Artificial Sequence
  Description of Artificial Sequence: Synthetic polypeptide
DEDEIRTTNPVATEQYGVVSTVVVVTNDEAGSTDDD

SEQ ID NO: 161133 - protein, 33 aa, Artificial Sequence
  Description of Artificial Sequence: Synthetic polypeptide
DENEIATTNPVATEQWGCVSGEGEMNAAEDNGN

SEQ ID NO: 161134 - protein, 34 aa, Artificial Sequence
  Description of Artificial Sequence: Synthetic polypeptide
DECEICTTNPVATEQYGTVVVVVTDGGVEEEGND

SEQ ID NO: 161135 - protein, 38 aa, Artificial Sequence
  Description of Artificial Sequence: Synthetic polypeptide
DEDEIRTTNPVATEQYGVVSTVVVTTNQLNQQGTDTSE

SEQ ID NO: 161136 - protein, 33 aa, Artificial Sequence
  Description of Artificial Sequence: Synthetic polypeptide
DENEIATTNPVATEQWGCVSGEGEIANAAEDNA

SEQ ID NO: 161137 - protein, 33 aa, Artificial Sequence
  Description of Artificial Sequence: Synthetic polypeptide
DENEIATTNPVATEQWGCVSGEGEMNDAEVDNA

SEQ ID NO: 161138 - protein, 34 aa, Artificial Sequence
  Description of Artificial Sequence: Synthetic polypeptide
DEDEIRTTNPVAYERWGSVCVNDGAGNRDGGDAR

SEQ ID NO: 161139 - protein, 35 aa, Artificial Sequence
  Description of Artificial Sequence: Synthetic polypeptide
DQAEIRTTNPVATEQYGCCCSTEEHNQHFGSNTQA

SEQ ID NO: 161140 - protein, 34 aa, Artificial Sequence
  Description of Artificial Sequence: Synthetic polypeptide
DEDEIRTTNPVAYERWGSVCVNDHAGDRAGDLNQ

SEQ ID NO: 161141 - protein, 31 aa, Artificial Sequence
  Description of Artificial Sequence: Synthetic polypeptide
DENEIRTTNPVAWEQWGDVTSEIEMNAAEDA

SEQ ID NO: 161142 - protein, 33 aa, Artificial Sequence
  Description of Artificial Sequence: Synthetic polypeptide
DEDEIRTTNPVAYERWGSVCVNDHAGDRAGDSQ

SEQ ID NO: 161143 - protein, 35 aa, Artificial Sequence
  Description of Artificial Sequence: Synthetic polypeptide
DEHEIRTTNPVAYEQWGSVCSTGDRQEDTGGKGDP

SEQ ID NO: 161144 - protein, 35 aa, Artificial Sequence
  Description of Artificial Sequence: Synthetic polypeptide
DEHEIRTTNPVAYEQWGSVCSTFDDGERQQNGDDN

SEQ ID NO: 161145 - protein, 34 aa, Artificial Sequence
  Description of Artificial Sequence: Synthetic polypeptide
DQAEIRTTNPVATEQYGCCCSWEEPQHFGSDNQS

SEQ ID NO: 161146 - protein, 32 aa, Artificial Sequence
  Description of Artificial Sequence: Synthetic polypeptide
DDSEIATTNPVSTEGYGNVAANTLQSHVGQDL

SEQ ID NO: 161147 - protein, 33 aa, Artificial Sequence
  Description of Artificial Sequence: Synthetic polypeptide
DENEIATTNPVATEQWGCVSGKGEMNAAEDNAS

SEQ ID NO: 161148 - protein, 35 aa, Artificial Sequence
  Description of Artificial Sequence: Synthetic polypeptide
DEEEIRTTNPVATEQYGSVQFPTMGEETPESEVSI

SEQ ID NO: 161149 - protein, 37 aa, Artificial Sequence
  Description of Artificial Sequence: Synthetic polypeptide
DEEEIRTTNPVATEQWGQCNVCSYTNPLNANFGSDFA

SEQ ID NO: 161150 - protein, 35 aa, Artificial Sequence
  Description of Artificial Sequence: Synthetic polypeptide
DEEEIRTTNPEATEQYGCVCPNTELNAENFGSDQS

SEQ ID NO: 161151 - protein, 36 aa, Artificial Sequence
  Description of Artificial Sequence: Synthetic polypeptide
SEEEIRTTNPVATEQYGSVSTVYDGTDPEFVQNQFD

SEQ ID NO: 161152 - protein, 37 aa, Artificial Sequence
  Description of Artificial Sequence: Synthetic polypeptide
DEEEIRTTNPVATEQYGSVQFITMGELQPEPPSVPEI

SEQ ID NO: 161153 - protein, 34 aa, Artificial Sequence
  Description of Artificial Sequence: Synthetic polypeptide
SEEEIRTTNPVATEGYGCVCSNTETANFGSDQQA

SEQ ID NO: 161154 - protein, 33 aa, Artificial Sequence
  Description of Artificial Sequence: Synthetic polypeptide
DENEIATTNPVATEQWGCVSEGVEGMNAAQDNA

SEQ ID NO: 161155 - protein, 36 aa, Artificial Sequence
  Description of Artificial Sequence: Synthetic polypeptide
DENEIRTTNPVATEQYGSGVTTPHGHNSRQEVSFED

SEQ ID NO: 161156 - protein, 37 aa, Artificial Sequence
  Description of Artificial Sequence: Synthetic polypeptide
DEEEIRTTNPVATEQYGSVQFITMGGEEQPEVGEVEI

SEQ ID NO: 161157 - protein, 31 aa, Artificial Sequence
  Description of Artificial Sequence: Synthetic polypeptide
DENEIATTNPVATEQWGCVSEGVEMNAAEDM

SEQ ID NO: 161158 - protein, 37 aa, Artificial Sequence
  Description of Artificial Sequence: Synthetic polypeptide
DEEEIRTTNPVATEQYGSVQFITMGGEQPEPGSVHEI

SEQ ID NO: 161159 - protein, 35 aa, Artificial Sequence
  Description of Artificial Sequence: Synthetic polypeptide
SEEEIRTTNPVATEGYGCVCSNTELNIHFGSDTQA

SEQ ID NO: 161160 - protein, 32 aa, Artificial Sequence
  Description of Artificial Sequence: Synthetic polypeptide
NEEEIRTTNPVAYEHWGCFSWINDQQRQTQKT

SEQ ID NO: 161161 - protein, 37 aa, Artificial Sequence
  Description of Artificial Sequence: Synthetic polypeptide
DEEEIRTTNPVATEQYGSVQFITMGIEEQPEGMVPEI

SEQ ID NO: 161162 - protein, 36 aa, Artificial Sequence
  Description of Artificial Sequence: Synthetic polypeptide
DEEEIRTTNPVATEQYGSVQFITMGIEIPEGEVPEI

SEQ ID NO: 161163 - protein, 37 aa, Artificial Sequence
  Description of Artificial Sequence: Synthetic polypeptide
DEEEIRTTNPVATEQYGSVQFITMGNEEPPEGEVPEI

SEQ ID NO: 161164 - protein, 33 aa, Artificial Sequence
  Description of Artificial Sequence: Synthetic polypeptide
DQAEIKTTNPVAYEQYGCTASCIVELGHGTNNR

SEQ ID NO: 161165 - protein, 32 aa, Artificial Sequence
  Description of Artificial Sequence: Synthetic polypeptide
DENEIATTNPVATEQWGCVSEGVEQMNAALDD

SEQ ID NO: 161166 - protein, 39 aa, Artificial Sequence
  Description of Artificial Sequence: Synthetic polypeptide
DEDEIRTTNPVATEQYGVVSVTVVTNLQQGNEQGTNQDE

SEQ ID NO: 161167 - protein, 34 aa, Artificial Sequence
  Description of Artificial Sequence: Synthetic polypeptide
SEEEIRTTNPVATEGYGCTSIMNIIGQGGGGGET

SEQ ID NO: 161168 - protein, 34 aa, Artificial Sequence
  Description of Artificial Sequence: Synthetic polypeptide
DEEEISTTNPVAYEQYGQCVCSNWEHQNFGSQQA

SEQ ID NO: 161169 - protein, 34 aa, Artificial Sequence
  Description of Artificial Sequence: Synthetic polypeptide
DEEEIRTTNPEATEQYGCVCPNTEDNANFNSDQA

SEQ ID NO: 161170 - protein, 35 aa, Artificial Sequence
  Description of Artificial Sequence: Synthetic polypeptide
DEEEIRTTNPVGTEFYGAVNIMDNEMQDEGGENND

SEQ ID NO: 161171 - protein, 33 aa, Artificial Sequence
  Description of Artificial Sequence: Synthetic polypeptide
DENEIATTNPVATEQWGCVSGEGEANDAEDNAW

SEQ ID NO: 161172 - protein, 32 aa, Artificial Sequence
  Description of Artificial Sequence: Synthetic polypeptide
DDSEIATTNPVSTEGWGSVACINEQSRVGEQG

SEQ ID NO: 161173 - protein, 35 aa, Artificial Sequence
  Description of Artificial Sequence: Synthetic polypeptide
SEEEIRTTNPVATEGYGCTGSIMNDIGQSGNGGEN

SEQ ID NO: 161174 - protein, 37 aa, Artificial Sequence
  Description of Artificial Sequence: Synthetic polypeptide
DEEEIRTTNPVATEQYGSVQFITMMEEQPEPGQVPEI

SEQ ID NO: 161175 - protein, 36 aa, Artificial Sequence
  Description of Artificial Sequence: Synthetic polypeptide
DEEEIRTTNPVATEQYGSVQIIEMGEEQPEGEVPEI

SEQ ID NO: 161176 - protein, 34 aa, Artificial Sequence
  Description of Artificial Sequence: Synthetic polypeptide
DEECIQTTNPVAYERYGCSVQNINMVSDRPGGNY

SEQ ID NO: 161177 - protein, 36 aa, Artificial Sequence
  Description of Artificial Sequence: Synthetic polypeptide
DESEIRTTNPVATEQYGSVFVWINGEQERDKKSDDS

SEQ ID NO: 161178 - protein, 33 aa, Artificial Sequence
  Description of Artificial Sequence: Synthetic polypeptide
DEECIQTTNPVAYERYGQSVHIPMVSDRPGGNA

SEQ ID NO: 161179 - protein, 34 aa, Artificial Sequence
  Description of Artificial Sequence: Synthetic polypeptide
FEEEIRTTNPVATEQYGAVVNIDGQEQGGQGEGQ

SEQ ID NO: 161180 - protein, 39 aa, Artificial Sequence
  Description of Artificial Sequence: Synthetic polypeptide
DEEEIRTTNPVATESYGTVTTGQSGTIGTNLQMQETGNP

SEQ ID NO: 161181 - protein, 34 aa, Artificial Sequence
  Description of Artificial Sequence: Synthetic polypeptide
DEAEIRTTNPVATECWGGVSCIEVPNDRIGENGE

SEQ ID NO: 161182 - protein, 33 aa, Artificial Sequence
  Description of Artificial Sequence: Synthetic polypeptide
DEECNATTNPIAYEQWGEVCSTDNQDQHDGKSR

SEQ ID NO: 161183 - protein, 35 aa, Artificial Sequence
  Description of Artificial Sequence: Synthetic polypeptide
MEEEIRTTNPVATEAYGSVDSNGDGEGQGEDGEEQ

SEQ ID NO: 161184 - protein, 36 aa, Artificial Sequence
  Description of Artificial Sequence: Synthetic polypeptide
DEEEIRTTNPVATEQYGSVDNPCIVLNLNNFVAEDQ

SEQ ID NO: 161185 - protein, 34 aa, Artificial Sequence
  Description of Artificial Sequence: Synthetic polypeptide
DEQEIVTTNPVATEQYGTVSATDDPVEDHEGEDL

SEQ ID NO: 161186 - protein, 34 aa, Artificial Sequence
  Description of Artificial Sequence: Synthetic polypeptide
DDEEIRTTNPVATEQWGCVTSWGEHNQNFGSDQS

SEQ ID NO: 161187 - protein, 35 aa, Artificial Sequence
  Description of Artificial Sequence: Synthetic polypeptide
FEEEIRTTNPVATEQYGCVCSSGEHNANFGSDTQS

SEQ ID NO: 161188 - protein, 36 aa, Artificial Sequence
  Description of Artificial Sequence: Synthetic polypeptide
DEEVIRTTNPVATEQYGCVCSTGNHNAENFGSDTQA

SEQ ID NO: 161189 - protein, 35 aa, Artificial Sequence
  Description of Artificial Sequence: Synthetic polypeptide
DEEEIRTTNPVATEQYGSVDNPCIVLNNNFVFEDD

SEQ ID NO: 161190 - protein, 35 aa, Artificial Sequence
  Description of Artificial Sequence: Synthetic polypeptide
MEEEIRTTNPVATDQYGVVNDNSIGQNGQGDQVND

SEQ ID NO: 161191 - protein, 30 aa, Artificial Sequence
  Description of Artificial Sequence: Synthetic polypeptide
QESEIASTNPVGTEGYGVMASWTLQHGDIE

SEQ ID NO: 161192 - protein, 36 aa, Artificial Sequence
  Description of Artificial Sequence: Synthetic polypeptide
FEEEIRTTNPVATEQYGCVCSTGEHNIENFGSDTQS

SEQ ID NO: 161193 - protein, 38 aa, Artificial Sequence
  Description of Artificial Sequence: Synthetic polypeptide
AEEEIRTTNPVATEQYGVVSTVTTNQQGGTEQGNNTNQ

SEQ ID NO: 161194 - protein, 28 aa, Artificial Sequence
  Description of Artificial Sequence: Synthetic peptide
QESEIASTNPVGTEGYGVMASYSQHGDI

SEQ ID NO: 161195 - protein, 32 aa, Artificial Sequence
  Description of Artificial Sequence: Synthetic polypeptide
DENEIITTNPVSTEPYGTISMEDIQQAQNGNH

SEQ ID NO: 161196 - protein, 39 aa, Artificial Sequence
  Description of Artificial Sequence: Synthetic polypeptide
DEEEIRTTNPVATESYGTVTTGQQVTISTNTQTGEVGNR

SEQ ID NO: 161197 - protein, 31 aa, Artificial Sequence
  Description of Artificial Sequence: Synthetic polypeptide
DDSEVASTNPVSTEMYGNVAANTIQSRVGQR

SEQ ID NO: 161198 - protein, 32 aa, Artificial Sequence
  Description of Artificial Sequence: Synthetic polypeptide
DENEIITTNPVSTEPYGTISMEDIQQMQNGNH

SEQ ID NO: 161199 - protein, 33 aa, Artificial Sequence
  Description of Artificial Sequence: Synthetic polypeptide
DEECNATTNPIAYEQWGEVCSTDNGDQHDGSNQ

SEQ ID NO: 161200 - protein, 36 aa, Artificial Sequence
  Description of Artificial Sequence: Synthetic polypeptide
DEEVIRTTNPVATEQYGCVCSWGELNIENFGSDNQS

SEQ ID NO: 161201 - protein, 32 aa, Artificial Sequence
  Description of Artificial Sequence: Synthetic polypeptide
DENEIITTNPVSTEPYGTISMEDIQQQKNGNH

SEQ ID NO: 161202 - protein, 32 aa, Artificial Sequence
  Description of Artificial Sequence: Synthetic polypeptide
SAEEIATTNPVATASWGCVAGTGLAQGGNDFA

SEQ ID NO: 161203 - protein, 32 aa, Artificial Sequence
  Description of Artificial Sequence: Synthetic polypeptide
DENEIITTNPVSTEPYGTISMEDIQQQQNGNH

SEQ ID NO: 161204 - protein, 35 aa, Artificial Sequence
  Description of Artificial Sequence: Synthetic polypeptide
MEEEIRTTNPAATEQYGVVSTQTGEGQENGEGGEE

SEQ ID NO: 161205 - protein, 37 aa, Artificial Sequence
  Description of Artificial Sequence: Synthetic polypeptide
DEEEIRCTNPVATEQYGCVCSMTEEDFQEGFGSDNQA

SEQ ID NO: 161206 - protein, 31 aa, Artificial Sequence
  Description of Artificial Sequence: Synthetic polypeptide
SAEEIATTNPVATASWGCVAGTGDAQAGDQR

SEQ ID NO: 161207 - protein, 37 aa, Artificial Sequence
  Description of Artificial Sequence: Synthetic polypeptide
AEEEIRTTNPVATEQYGVVSTVTTNQNNTEEGNNEED

SEQ ID NO: 161208 - protein, 34 aa, Artificial Sequence
  Description of Artificial Sequence: Synthetic polypeptide
DEAEIRTTNPVATECWGMHCWTMNEQDRRTNDKK

SEQ ID NO: 161209 - protein, 34 aa, Artificial Sequence
  Description of Artificial Sequence: Synthetic polypeptide
DECEIATTNPCATEPYGSVCYNNDDQDHGDNDHS

SEQ ID NO: 161210 - protein, 31 aa, Artificial Sequence
  Description of Artificial Sequence: Synthetic polypeptide
DENEIITTNPVATEQWGDVSGEIEMNAAEDA

SEQ ID NO: 161211 - protein, 35 aa, Artificial Sequence
  Description of Artificial Sequence: Synthetic polypeptide
SAEEIATTNPVATEQWGSVSGNNGPPDGALTEGNQ

SEQ ID NO: 161212 - protein, 34 aa, Artificial Sequence
  Description of Artificial Sequence: Synthetic polypeptide
DEQEIVTTNPVATEQYGTVCSATYGPVEVEADND

SEQ ID NO: 161213 - protein, 36 aa, Artificial Sequence
  Description of Artificial Sequence: Synthetic polypeptide
MEEEIRTTNPVATEFYGSVDQSINTMGQIGGGQDGE

SEQ ID NO: 161214 - protein, 29 aa, Artificial Sequence
  Description of Artificial Sequence: Synthetic peptide
QESEIASTNPVGTEGYGVMASVLQKHGDI

SEQ ID NO: 161215 - protein, 29 aa, Artificial Sequence
  Description of Artificial Sequence: Synthetic peptide
QESEIASTNPVGTEGYGVMASVLVQHGDI

SEQ ID NO: 161216 - protein, 36 aa, Artificial Sequence
  Description of Artificial Sequence: Synthetic polypeptide
DEEEIRTTNPVATEQYGSVDNPAIVLNENNFVAESI

SEQ ID NO: 161217 - protein, 34 aa, Artificial Sequence
  Description of Artificial Sequence: Synthetic polypeptide
MEEEIRTTNPVATEFYGCVSNTDGGEEENGQEED

SEQ ID NO: 161218 - protein, 34 aa, Artificial Sequence
  Description of Artificial Sequence: Synthetic polypeptide
MEEEIRTTNPVATEFYGCVSNTDGGEEEEGGQES

SEQ ID NO: 161219 - protein, 35 aa, Artificial Sequence
  Description of Artificial Sequence: Synthetic polypeptide
FEEEIRTTNPVATEQYGAVIVGGDTGQGGEGNEFG

SEQ ID NO: 161220 - protein, 35 aa, Artificial Sequence
  Description of Artificial Sequence: Synthetic polypeptide
FEEEIRTTNPVATEQYGAVIVGGQTGQGGEGNDNM

SEQ ID NO: 161221 - protein, 34 aa, Artificial Sequence
  Description of Artificial Sequence: Synthetic polypeptide
DEAEIRTTNPVATECWGGVSIINETQHEGSEYMP

SEQ ID NO: 161222 - protein, 36 aa, Artificial Sequence
  Description of Artificial Sequence: Synthetic polypeptide
DEEEIRTTNPVATEQYGSVDNPAIVLNPHNFVAEDE

SEQ ID NO: 161223 - protein, 38 aa, Artificial Sequence
  Description of Artificial Sequence: Synthetic polypeptide
AEEEIRTTNPVATEQYGVVSTVTTNNNNQAGNGENEQD

SEQ ID NO: 161224 - protein, 36 aa, Artificial Sequence
  Description of Artificial Sequence: Synthetic polypeptide
MEEEIRTTNPVATECYGSVVGFGGNNQTRGMEGGQG

SEQ ID NO: 161225 - protein, 36 aa, Artificial Sequence
  Description of Artificial Sequence: Synthetic polypeptide
MEEEIRTTNPVATECYGSVVGFGENNLTRGMEGGQG

SEQ ID NO: 161226 - protein, 38 aa, Artificial Sequence
  Description of Artificial Sequence: Synthetic polypeptide
AEEEIRTTNPVATEQYGVVSTVTTNNNNQAGNGTNNQE

SEQ ID NO: 161227 - protein, 34 aa, Artificial Sequence
  Description of Artificial Sequence: Synthetic polypeptide
SAEEIATTNPVATEQWGGCCAGTNLQDEMGPNQK

SEQ ID NO: 161228 - protein, 34 aa, Artificial Sequence
  Description of Artificial Sequence: Synthetic polypeptide
SAEEIATTNPVATEQWGGCCAGTNLQAEMQNSRN

SEQ ID NO: 161229 - protein, 33 aa, Artificial Sequence
  Description of Artificial Sequence: Synthetic polypeptide
SAEEIATTNPVATEQWGGCCAGTGLQDSGGSRV

SEQ ID NO: 161230 - protein, 38 aa, Artificial Sequence
  Description of Artificial Sequence: Synthetic polypeptide
AEEEIRTTNPVATEQYGVVSTVTTNNNNQQGNGNNNQD

SEQ ID NO: 161231 - protein, 38 aa, Artificial Sequence
  Description of Artificial Sequence: Synthetic polypeptide
AEEEIRTTNPVATEQYGVVSTVTTNNSNQQGNNNNNSE

SEQ ID NO: 161232 - protein, 31 aa, Artificial Sequence
  Description of Artificial Sequence: Synthetic polypeptide
DDSEVASTNPVSTEKYGNVAANTIQSRVGQR

SEQ ID NO: 161233 - protein, 32 aa, Artificial Sequence
  Description of Artificial Sequence: Synthetic polypeptide
DENEIITTNPVSTEPYGEISMEDIQQKLNGNG

SEQ ID NO: 161234 - protein, 35 aa, Artificial Sequence
  Description of Artificial Sequence: Synthetic polypeptide
DEAEIRTTNPVATECWGMHCWTMNEQQRGQDNGKP

SEQ ID NO: 161235 - protein, 34 aa, Artificial Sequence
  Description of Artificial Sequence: Synthetic polypeptide
MEEEIRTTNPVATEFYGCVSNTDGGEEDEGGEET

SEQ ID NO: 161236 - protein, 35 aa, Artificial Sequence
  Description of Artificial Sequence: Synthetic polypeptide
DEEVIRTTNPVATEQYGCVCSNSEHNDENFGSDQS

SEQ ID NO: 161237 - protein, 31 aa, Artificial Sequence
  Description of Artificial Sequence: Synthetic polypeptide
QEGEIAPTNPCSSEQWGIVSCNLPQSEGETR

SEQ ID NO: 161238 - protein, 29 aa, Artificial Sequence
  Description of Artificial Sequence: Synthetic peptide
QESEIASTNPVGTEGYGVMATSTLQHCDI

SEQ ID NO: 161239 - protein, 34 aa, Artificial Sequence
  Description of Artificial Sequence: Synthetic polypeptide
SAEEIATTNPVATAQWGSVSGTGNPDNADGNNNN

SEQ ID NO: 161240 - protein, 29 aa, Artificial Sequence
  Description of Artificial Sequence: Synthetic peptide
QESEIASTNPVGTEGYGVMAYRTLQHGDI

SEQ ID NO: 161241 - protein, 31 aa, Artificial Sequence
  Description of Artificial Sequence: Synthetic polypeptide
DESEIASTNPVATEGYGNVAAETIMSRAEQA

SEQ ID NO: 161242 - protein, 36 aa, Artificial Sequence
  Description of Artificial Sequence: Synthetic polypeptide
DEEEIRTTNPVATEQYGSCHHEMNLDQLEVFQVEQV

SEQ ID NO: 161243 - protein, 36 aa, Artificial Sequence
  Description of Artificial Sequence: Synthetic polypeptide
FEEEIRTTNPVATEQYGMIVGSNMNLIEGGGEDEEQ

SEQ ID NO: 161244 - protein, 36 aa, Artificial Sequence
  Description of Artificial Sequence: Synthetic polypeptide
MEEEIRGTNPVATEQYGSVYDNDIGNEQGQGEENGA

SEQ ID NO: 161245 - protein, 35 aa, Artificial Sequence
  Description of Artificial Sequence: Synthetic polypeptide
FEEEIRTTNPVATEQYGMVGIMNGFEGGVGQEGGT

SEQ ID NO: 161246 - protein, 30 aa, Artificial Sequence
  Description of Artificial Sequence: Synthetic polypeptide
QESEIASTNPVGTEGYGVMAYSTLQQHGDI

SEQ ID NO: 161247 - protein, 35 aa, Artificial Sequence
  Description of Artificial Sequence: Synthetic polypeptide
FEEEIRTTNPVATEQYGMVNIMNGFEGGGGQEGTQ

SEQ ID NO: 161248 - protein, 28 aa, Artificial Sequence
  Description of Artificial Sequence: Synthetic peptide
QESEIASTNPVGTEGYGVMAYTLQHADI

SEQ ID NO: 161249 - protein, 38 aa, Artificial Sequence
  Description of Artificial Sequence: Synthetic polypeptide
DEEEIRTTNPVATEQYGVVSTVNNNQISTTEQGTEQGS

SEQ ID NO: 161250 - protein, 36 aa, Artificial Sequence
  Description of Artificial Sequence: Synthetic polypeptide
MEEEIRGTNPVATEQYGSVVQNNDINQNNQDGEGNG

SEQ ID NO: 161251 - protein, 37 aa, Artificial Sequence
  Description of Artificial Sequence: Synthetic polypeptide
DEEEIRTTNPVATEQYGSVVTDTGMTFSEMEQGGDTP

SEQ ID NO: 161252 - protein, 37 aa, Artificial Sequence
  Description of Artificial Sequence: Synthetic polypeptide
MEEEIRGTNPVATEQYGSVVMTNNDINQNQQDQEGNG

SEQ ID NO: 161253 - protein, 37 aa, Artificial Sequence
  Description of Artificial Sequence: Synthetic polypeptide
MEEEIRGTNPVATEQYGSVVMTGMDINQNNQNFEGNG

SEQ ID NO: 161254 - protein, 39 aa, Artificial Sequence
  Description of Artificial Sequence: Synthetic polypeptide
DEEEIRTTNPVATESYGTVTNLQSGVISTNTQNQETGNM

SEQ ID NO: 161255 - protein, 39 aa, Artificial Sequence
  Description of Artificial Sequence: Synthetic polypeptide
DEEEIRTTNPVATESYGTVTNLQSGVISTNTQNGEVGNV

SEQ ID NO: 161256 - protein, 33 aa, Artificial Sequence
  Description of Artificial Sequence: Synthetic polypeptide
SAEEIATTNPVATAQWGCVAGTNGLAGAGGNDH

SEQ ID NO: 161257 - protein, 36 aa, Artificial Sequence
  Description of Artificial Sequence: Synthetic polypeptide
MEEEIRGTNPVATEQYGSVVMNNDINQNNQEQGGNG

SEQ ID NO: 161258 - protein, 36 aa, Artificial Sequence
  Description of Artificial Sequence: Synthetic polypeptide
MEEEIRGTNPVATEQYGSVVMNNDFNQNIQDQEGNG

SEQ ID NO: 161259 - protein, 36 aa, Artificial Sequence
  Description of Artificial Sequence: Synthetic polypeptide
FEEEIRTTNPVATEQYGNVMSDGVNDQDEGGQEEGQ

SEQ ID NO: 161260 - protein, 39 aa, Artificial Sequence
  Description of Artificial Sequence: Synthetic polypeptide
DEEEIRTTNPVATESYGTVTNLQSGVISTNTNNQEGGNV

SEQ ID NO: 161261 - protein, 36 aa, Artificial Sequence
  Description of Artificial Sequence: Synthetic polypeptide
MEEEIRGTNPVATEQYGSVVDNNDQNQNNQDQEGNG

SEQ ID NO: 161262 - protein, 36 aa, Artificial Sequence
  Description of Artificial Sequence: Synthetic polypeptide
MEEEIRGTNPVATEQYGSVSNGVNGQSGQEGGQQDT

SEQ ID NO: 161263 - protein, 32 aa, Artificial Sequence
  Description of Artificial Sequence: Synthetic polypeptide
DENEIRTTNPVATECWGETTANEDWAEPKGPR

SEQ ID NO: 161264 - protein, 38 aa, Artificial Sequence
  Description of Artificial Sequence: Synthetic polypeptide
DEEEIRTTNPVATEQYGVVTVVVTNLQLQNQTGTTEES

SEQ ID NO: 161265 - protein, 34 aa, Artificial Sequence
  Description of Artificial Sequence: Synthetic polypeptide
DEEEIRTTNPVATEQYGSCIEPLNGIPTDVEETV

SEQ ID NO: 161266 - protein, 37 aa, Artificial Sequence
  Description of Artificial Sequence: Synthetic polypeptide
AEEEIRTTNPVATEQYGVVSTVTVNQQGSEEGTTEDD

SEQ ID NO: 161267 - protein, 29 aa, Artificial Sequence
  Description of Artificial Sequence: Synthetic peptide
QESEIASTNPVGTEGYGVMAWTLQHGPDI

SEQ ID NO: 161268 - protein, 34 aa, Artificial Sequence
  Description of Artificial Sequence: Synthetic polypeptide
DEAVISTTNPVATEQYGSVYSLKWEFPNGSQNTS

SEQ ID NO: 161269 - protein, 35 aa, Artificial Sequence
  Description of Artificial Sequence: Synthetic polypeptide
FEEEIRTTNPVATEQYGDVSAYNGNEEMQAEDTDG

SEQ ID NO: 161270 - protein, 35 aa, Artificial Sequence
  Description of Artificial Sequence: Synthetic polypeptide
MEEEIRTTNCVATEQYGMVSVDGNNEGQGEGQDGN

SEQ ID NO: 161271 - protein, 35 aa, Artificial Sequence
  Description of Artificial Sequence: Synthetic polypeptide
DECEAEIRTTNPVAYEHWGSVATTGRGEDQQGNQH

SEQ ID NO: 161272 - protein, 36 aa, Artificial Sequence
  Description of Artificial Sequence: Synthetic polypeptide
DEEEIRTTNPVATEQYGVVTMGQVNMQDIGGEGGQD

SEQ ID NO: 161273 - protein, 35 aa, Artificial Sequence
  Description of Artificial Sequence: Synthetic polypeptide
DEEEIRCTNPVATEQYGCVCSMSEDFQGFGSETQA

SEQ ID NO: 161274 - protein, 39 aa, Artificial Sequence
  Description of Artificial Sequence: Synthetic polypeptide
DEEEIRTTNPVATEQYGVVTNLQSGTISTNTNNQEEGNV

SEQ ID NO: 161275 - protein, 34 aa, Artificial Sequence
  Description of Artificial Sequence: Synthetic polypeptide
DDEEIRTTNPVATEQWGQCVTSSEHNQNFGSDAS

SEQ ID NO: 161276 - protein, 33 aa, Artificial Sequence
  Description of Artificial Sequence: Synthetic polypeptide
DEAEIRTTNPVATEAWGKVPSEIESMNAAEGDA

SEQ ID NO: 161277 - protein, 31 aa, Artificial Sequence
  Description of Artificial Sequence: Synthetic polypeptide
DDSEVASTNPVSTEMYGNVAANTIQSRVGSR

SEQ ID NO: 161278 - protein, 38 aa, Artificial Sequence
  Description of Artificial Sequence: Synthetic polypeptide
DEEEIRTTNPVATEQYGSCGDSEISNLTQPELGQVEDP

SEQ ID NO: 161279 - protein, 36 aa, Artificial Sequence
  Description of Artificial Sequence: Synthetic polypeptide
MEEEIRSTNPVATESYGSVSNGVNGQSDQEGGQNDT

SEQ ID NO: 161280 - protein, 35 aa, Artificial Sequence
  Description of Artificial Sequence: Synthetic polypeptide
DEEEIRTTNPVATEGYGMVSVEGMGGGQGQDGEGT

SEQ ID NO: 161281 - protein, 36 aa, Artificial Sequence
  Description of Artificial Sequence: Synthetic polypeptide
DEAEIRTTNPVATDQYGSVSVTACNQDTGYSEEVES

SEQ ID NO: 161282 - protein, 37 aa, Artificial Sequence
  Description of Artificial Sequence: Synthetic polypeptide
DEEEIRTTNPVATEQYGSCGEPTNAMEMTELPEELQR

SEQ ID NO: 161283 - protein, 36 aa, Artificial Sequence
  Description of Artificial Sequence: Synthetic polypeptide
DEEEIRTTNPVATEQYGSCGPINPNMLQPMMFEPTL

SEQ ID NO: 161284 - protein, 35 aa, Artificial Sequence
  Description of Artificial Sequence: Synthetic polypeptide
DEEEIRTTNPVATEQYGSCGPLNPNDQMMMFEPDQ

SEQ ID NO: 161285 - protein, 36 aa, Artificial Sequence
  Description of Artificial Sequence: Synthetic polypeptide
DEEEIRTTNPVATEQYGSCGPLNPNLGQMNMFEPTQ

SEQ ID NO: 161286 - protein, 36 aa, Artificial Sequence
  Description of Artificial Sequence: Synthetic polypeptide
FEEEIRTTNPVATEQYGDVVDGGTNDQNQENGEGGE

SEQ ID NO: 161287 - protein, 31 aa, Artificial Sequence
  Description of Artificial Sequence: Synthetic polypeptide
DESEIASTNPVATEGYGNVSAETIMSAAEQA

SEQ ID NO: 161288 - protein, 29 aa, Artificial Sequence
  Description of Artificial Sequence: Synthetic peptide
QESEIASTNPVGTEGYGVMAVTLQHGDWI

SEQ ID NO: 161289 - protein, 35 aa, Artificial Sequence
  Description of Artificial Sequence: Synthetic polypeptide
FEEEIRTTNPVATEQYGDVVMGVNDDIGQGNFAEI

SEQ ID NO: 161290 - protein, 35 aa, Artificial Sequence
  Description of Artificial Sequence: Synthetic polypeptide
DESEIASTNPVATEGYGNVSAATPAIPQMRNGNPV

SEQ ID NO: 161291 - protein, 35 aa, Artificial Sequence
  Description of Artificial Sequence: Synthetic polypeptide
DEAEIRTTNPVATEAWGCVSGGNADDSRNGGNGNS

SEQ ID NO: 161292 - protein, 28 aa, Artificial Sequence
  Description of Artificial Sequence: Synthetic peptide
QESEIASTNPVGTEGYGVMAWTLQHDDI

SEQ ID NO: 161293 - protein, 35 aa, Artificial Sequence
  Description of Artificial Sequence: Synthetic polypeptide
FEEEIRTTNPVATEQYGDVVQGVNDNIGQGEFNEI

SEQ ID NO: 161294 - protein, 36 aa, Artificial Sequence
  Description of Artificial Sequence: Synthetic polypeptide
FEEEIRTTNPVATEQYGDVVQSGMNGEPEEGGNEGS

SEQ ID NO: 161295 - protein, 37 aa, Artificial Sequence
  Description of Artificial Sequence: Synthetic polypeptide
MEEEIRSTNPVATEQYGSVGQTQNLDGEGQGGQGEDG

SEQ ID NO: 161296 - protein, 34 aa, Artificial Sequence
  Description of Artificial Sequence: Synthetic polypeptide
SAEEIATTNPVATEQWGSVSGTGNPPDNNMSEDA

SEQ ID NO: 161297 - protein, 34 aa, Artificial Sequence
  Description of Artificial Sequence: Synthetic polypeptide
SAEEIATTNPVATEQWGSVSGTGNPPDNNSADAP

SEQ ID NO: 161298 - protein, 36 aa, Artificial Sequence
  Description of Artificial Sequence: Synthetic polypeptide
FEEEIRTTNPVATEGYGSVVVGTVNGLEAENGGGEG

SEQ ID NO: 161299 - protein, 35 aa, Artificial Sequence
  Description of Artificial Sequence: Synthetic polypeptide
DEMCIRTTNPVATEQYGCVCETGEPNQYFGSQNQS

SEQ ID NO: 161300 - protein, 37 aa, Artificial Sequence
  Description of Artificial Sequence: Synthetic polypeptide
DEEEIRTTNPVATEQYGSCAMPEMMESTVLENGTLTD

SEQ ID NO: 161301 - protein, 38 aa, Artificial Sequence
  Description of Artificial Sequence: Synthetic polypeptide
DEEEIRTTNPVATEQYGVVSVVVVTNTDEQGNNTEDTE

SEQ ID NO: 161302 - protein, 33 aa, Artificial Sequence
  Description of Artificial Sequence: Synthetic polypeptide
DEAPIACTNPVAYEQYGSVCATNGLQPFDQQDE

SEQ ID NO: 161303 - protein, 35 aa, Artificial Sequence
  Description of Artificial Sequence: Synthetic polypeptide
FEEEIRTTNPVATDQYGSVVNNMNVGINGIEEGNG

SEQ ID NO: 161304 - protein, 36 aa, Artificial Sequence
  Description of Artificial Sequence: Synthetic polypeptide
FEEEIRTTNPVATDQYGSVVQDNTDNDQGQEFEGEN

SEQ ID NO: 161305 - protein, 35 aa, Artificial Sequence
  Description of Artificial Sequence: Synthetic polypeptide
FEEEIRTTNPVATDQYGTVVNNMNVGINGGQEGNA

SEQ ID NO: 161306 - protein, 35 aa, Artificial Sequence
  Description of Artificial Sequence: Synthetic polypeptide
FEEEIRTTNPVATDQYGVVNDNSIGQNGQEDNNDI

SEQ ID NO: 161307 - protein, 36 aa, Artificial Sequence
  Description of Artificial Sequence: Synthetic polypeptide
FEEEIRTTNPVATDQYGVVNDNSIGQNGQGGNANDT

SEQ ID NO: 161308 - protein, 36 aa, Artificial Sequence
  Description of Artificial Sequence: Synthetic polypeptide
DEEEIRTTNPVATEQYGSCAPEQTDLDQIQQMMVAD

SEQ ID NO: 161309 - protein, 33 aa, Artificial Sequence
  Description of Artificial Sequence: Synthetic polypeptide
DEECISTTNPVATEGYGCVCNWEGLQNFGSDQS

SEQ ID NO: 161310 - protein, 37 aa, Artificial Sequence
  Description of Artificial Sequence: Synthetic polypeptide
DDEEIRTTNPVATEQYGSVSTMDITQNGEGGGEEEGI

SEQ ID NO: 161311 - protein, 34 aa, Artificial Sequence
  Description of Artificial Sequence: Synthetic polypeptide
DEQEIVTTNPVATEQYGCTVCSATDGPVEEEGLD

SEQ ID NO: 161312 - protein, 36 aa, Artificial Sequence
  Description of Artificial Sequence: Synthetic polypeptide
MEEEIRTTNPVATEGYGSVVVDNIIQGGQGENDEQN

SEQ ID NO: 161313 - protein, 30 aa, Artificial Sequence
  Description of Artificial Sequence: Synthetic polypeptide
DENEIRTTNPVATEFWGDVIEIEMNAAEDA

SEQ ID NO: 161314 - protein, 37 aa, Artificial Sequence
  Description of Artificial Sequence: Synthetic polypeptide
FEEEIRTTNPVATEAYGSVVDTMNLVNQGEQDENEQD

SEQ ID NO: 161315 - protein, 35 aa, Artificial Sequence
  Description of Artificial Sequence: Synthetic polypeptide
FEEEIRTTNPVATEAYGTVVNFDDNNDQTGGGNED

SEQ ID NO: 161316 - protein, 36 aa, Artificial Sequence
  Description of Artificial Sequence: Synthetic polypeptide
FEEEIRTTNPVATECYGSVSDDGPGGEGDQEEGGNV

SEQ ID NO: 161317 - protein, 36 aa, Artificial Sequence
  Description of Artificial Sequence: Synthetic polypeptide
DEEEIRTTNPVATEQYGSCAPEQTGLDEHMQTMVAD

SEQ ID NO: 161318 - protein, 35 aa, Artificial Sequence
  Description of Artificial Sequence: Synthetic polypeptide
FEEEIRTTNPVATEFYGMVTIMNGFEGGGGQEGNA

SEQ ID NO: 161319 - protein, 31 aa, Artificial Sequence
  Description of Artificial Sequence: Synthetic polypeptide
DENEIHTTNPVATEQWGDVSEVIEMNAAEDA

SEQ ID NO: 161320 - protein, 34 aa, Artificial Sequence
  Description of Artificial Sequence: Synthetic polypeptide
FEEEIRTTNPVATEFYGSVDNGQNVNVNGGEGQE

SEQ ID NO: 161321 - protein, 31 aa, Artificial Sequence
  Description of Artificial Sequence: Synthetic polypeptide
DENEIHTTNPVATEQWGDVSLEIEMNAAEDA

SEQ ID NO: 161322 - protein, 31 aa, Artificial Sequence
  Description of Artificial Sequence: Synthetic polypeptide
DENEIRTTNPVATEEWGDVSESIEMNAAEDA

SEQ ID NO: 161323 - protein, 35 aa, Artificial Sequence
  Description of Artificial Sequence: Synthetic polypeptide
FEEEIRTTNPVATEFYGSVIVDNFNGQTQDQNEGE

SEQ ID NO: 161324 - protein, 30 aa, Artificial Sequence
  Description of Artificial Sequence: Synthetic polypeptide
YENEIASTNPVSTEPYGTISMEDIQQQGNH

SEQ ID NO: 161325 - protein, 31 aa, Artificial Sequence
  Description of Artificial Sequence: Synthetic polypeptide
DDSEVASTNPVSTEGYGYVAANTIQSRVGQR

SEQ ID NO: 161326 - protein, 36 aa, Artificial Sequence
  Description of Artificial Sequence: Synthetic polypeptide
DEEEIRTTNPVATEQYGSCAPEQTLDQIMQGDMVGD

SEQ ID NO: 161327 - protein, 35 aa, Artificial Sequence
  Description of Artificial Sequence: Synthetic polypeptide
DEECISTTNPVATEGYGCVCNTTGNALQNFGSDQA

SEQ ID NO: 161328 - protein, 37 aa, Artificial Sequence
  Description of Artificial Sequence: Synthetic polypeptide
DDEEIRTTNPVATEQYGSVSTMDQMQNGEGGGEEEGG

SEQ ID NO: 161329 - protein, 36 aa, Artificial Sequence
  Description of Artificial Sequence: Synthetic polypeptide
MEEEIRTTNPVATEQYGAVDIDTNMNLEEGGQQDTA

SEQ ID NO: 161330 - protein, 35 aa, Artificial Sequence
  Description of Artificial Sequence: Synthetic polypeptide
DEQEITTTNPVATEQYGTVVSATDGDDEEGEGNND

SEQ ID NO: 161331 - protein, 34 aa, Artificial Sequence
  Description of Artificial Sequence: Synthetic polypeptide
DEEVIRCTNPVATEQYGASQSWRNSFTEPGGKEG

SEQ ID NO: 161332 - protein, 32 aa, Artificial Sequence
  Description of Artificial Sequence: Synthetic polypeptide
YEMEIATTNPVCTEQYGVVCSADDGPVESGNQ

SEQ ID NO: 161333 - protein, 29 aa, Artificial Sequence
  Description of Artificial Sequence: Synthetic peptide
QESEIASTNPVGTEGYGVMASTQQLHGDI

SEQ ID NO: 161334 - protein, 34 aa, Artificial Sequence
  Description of Artificial Sequence: Synthetic polypeptide
FEEEIRSTNPVATDQYGTVVSVDTNMDDGIGEDT

SEQ ID NO: 161335 - protein, 29 aa, Artificial Sequence
  Description of Artificial Sequence: Synthetic peptide
QESEIASTNPVGTEGYGVMASTQQPHGRI

SEQ ID NO: 161336 - protein, 35 aa, Artificial Sequence
  Description of Artificial Sequence: Synthetic polypeptide
FEEEIRSTNPVATEQYGAVVSGNGQIGQGGEEQTG

SEQ ID NO: 161337 - protein, 34 aa, Artificial Sequence
  Description of Artificial Sequence: Synthetic polypeptide
FEEEIRSTNPVATEQYGSVDNGQNVNVEGGEGQE

SEQ ID NO: 161338 - protein, 34 aa, Artificial Sequence
  Description of Artificial Sequence: Synthetic polypeptide
DEGEIATTNPVATEQYGSVCAAMHGPDSDGNDSH

SEQ ID NO: 161339 - protein, 36 aa, Artificial Sequence
  Description of Artificial Sequence: Synthetic polypeptide
DENEIRTTNPVATEFYGSVMNDQNDLDQTGGQEGQT

SEQ ID NO: 161340 - protein, 35 aa, Artificial Sequence
  Description of Artificial Sequence: Synthetic polypeptide
DEGEIATTNPVATEQYGSVCAAMGHGQDSDGNDIH

SEQ ID NO: 161341 - protein, 35 aa, Artificial Sequence
  Description of Artificial Sequence: Synthetic polypeptide
DEEEIRTTNPVATEQYGSCAGTGTPGQNHMEMEAN

SEQ ID NO: 161342 - protein, 34 aa, Artificial Sequence
  Description of Artificial Sequence: Synthetic polypeptide
YENCIRTTNPVATEEYGNSTSTPAYQRGIYTFVV

SEQ ID NO: 161343 - protein, 36 aa, Artificial Sequence
  Description of Artificial Sequence: Synthetic polypeptide
FEEEIRSTNPVATEQYGTVVDGTMNAGQNGEGGNNE

SEQ ID NO: 161344 - protein, 38 aa, Artificial Sequence
  Description of Artificial Sequence: Synthetic polypeptide
AEEEIRTTNPVATEQYGVVSTVTQNQNNQQGNGNNNQG

SEQ ID NO: 161345 - protein, 31 aa, Artificial Sequence
  Description of Artificial Sequence: Synthetic polypeptide
DENEIHTTNPVATEQWGDVSEIHEMNAAEDA

SEQ ID NO: 161346 - protein, 34 aa, Artificial Sequence
  Description of Artificial Sequence: Synthetic polypeptide
DEGEIATTNPVATEQYGSVCAALNGEEADNQENH

SEQ ID NO: 161347 - protein, 35 aa, Artificial Sequence
  Description of Artificial Sequence: Synthetic polypeptide
FEEEIRSTNPVATEQYGVVVSGNGQIGQGGEQEEQ

SEQ ID NO: 161348 - protein, 36 aa, Artificial Sequence
  Description of Artificial Sequence: Synthetic polypeptide
MEEEIRTTNPVATEGYGVVVSGMNVGQQEGGNGNTV

SEQ ID NO: 161349 - protein, 35 aa, Artificial Sequence
  Description of Artificial Sequence: Synthetic polypeptide
DEGEIATTNPVATEQYGSVCAAHNNEEAQDNQENH

SEQ ID NO: 161350 - protein, 36 aa, Artificial Sequence
  Description of Artificial Sequence: Synthetic polypeptide
DEGEIATTNPVATEQYGSVCAAHNGEEAIDNQEGNH

SEQ ID NO: 161351 - protein, 35 aa, Artificial Sequence
  Description of Artificial Sequence: Synthetic polypeptide
DEGEIATTNPVATEQYGSVCAAGVLPPDSQMGSDD

SEQ ID NO: 161352 - protein, 35 aa, Artificial Sequence
  Description of Artificial Sequence: Synthetic polypeptide
MEEEIRTTNPVATEGYGSVYDDSIDGGQEDTGEAE

SEQ ID NO: 161353 - protein, 34 aa, Artificial Sequence
  Description of Artificial Sequence: Synthetic polypeptide
DEECISTTNPVATEGYGCVCNTTEAHQYFGSNQS

SEQ ID NO: 161354 - protein, 35 aa, Artificial Sequence
  Description of Artificial Sequence: Synthetic polypeptide
DEGEIATTNPVATEQYGSVCAAGNLGTPDGMPTEM

SEQ ID NO: 161355 - protein, 34 aa, Artificial Sequence
  Description of Artificial Sequence: Synthetic polypeptide
YENCIRTTNPVATEWYGESASTPADQRGIYTFVG

SEQ ID NO: 161356 - protein, 35 aa, Artificial Sequence
  Description of Artificial Sequence: Synthetic polypeptide
FEEEIRTTNPVATEFYGSVNMDEFNDQGNGEEGEG

SEQ ID NO: 161357 - protein, 35 aa, Artificial Sequence
  Description of Artificial Sequence: Synthetic polypeptide
DENEIHTTNPVATEQYGSVGVATGDGEDQEGEGDG

SEQ ID NO: 161358 - protein, 36 aa, Artificial Sequence
  Description of Artificial Sequence: Synthetic polypeptide
DEEEIRTTNPVATEQYGSCAPEQTMLDDIGQTMVAD

SEQ ID NO: 161359 - protein, 37 aa, Artificial Sequence
  Description of Artificial Sequence: Synthetic polypeptide
MEEEIRTTNPVATEFYGVVVDGSGNATNDDDQGGNQG

SEQ ID NO: 161360 - protein, 34 aa, Artificial Sequence
  Description of Artificial Sequence: Synthetic polypeptide
DEAEIRTTNPVATECWGSVSCIEEEPQWSEGEIE

SEQ ID NO: 161361 - protein, 37 aa, Artificial Sequence
  Description of Artificial Sequence: Synthetic polypeptide
DEEEIRCTNPVATEQYGCVCSMTGEDDNQGFGSNTQS

SEQ ID NO: 161362 - protein, 29 aa, Artificial Sequence
  Description of Artificial Sequence: Synthetic peptide
QESEIASTNPVGTEGYGVMASTWQCHGDI

SEQ ID NO: 161363 - protein, 36 aa, Artificial Sequence
  Description of Artificial Sequence: Synthetic polypeptide
DEEEIRTTNPVATEQYGSCCECFWATEIEMTEEGNL

SEQ ID NO: 161364 - protein, 34 aa, Artificial Sequence
  Description of Artificial Sequence: Synthetic polypeptide
MEEEIRTTNPVATEFYGVVVDDNMTMEFNGENAA

SEQ ID NO: 161365 - protein, 36 aa, Artificial Sequence
  Description of Artificial Sequence: Synthetic polypeptide
FEEEIRTTNPVATEGYGSVVDGTINGLEEENGGGQG

SEQ ID NO: 161366 - protein, 36 aa, Artificial Sequence
  Description of Artificial Sequence: Synthetic polypeptide
FEEEIRTTNPVATEGYGSVVDGTVNGLEAEDGEGQG

SEQ ID NO: 161367 - protein, 35 aa, Artificial Sequence
  Description of Artificial Sequence: Synthetic polypeptide
DEQEIVTTNPVATEQYGTVCSATDDLVEDHEGEDD

SEQ ID NO: 161368 - protein, 33 aa, Artificial Sequence
  Description of Artificial Sequence: Synthetic polypeptide
SAEEIATTNPVATEQWGSVSPTGAPPNAAAERN

SEQ ID NO: 161369 - protein, 35 aa, Artificial Sequence
  Description of Artificial Sequence: Synthetic polypeptide
DDEEIRTTNPVATEQWGCVTSTGEDNQHFNSDTQQ

SEQ ID NO: 161370 - protein, 36 aa, Artificial Sequence
  Description of Artificial Sequence: Synthetic polypeptide
FEEEIRTTNPVATEGYGSVVNFDDMNDQDGGAGNEG

SEQ ID NO: 161371 - protein, 31 aa, Artificial Sequence
  Description of Artificial Sequence: Synthetic polypeptide
DESEIASTNPVATEQWGDVAAEIIQNAAEQR

SEQ ID NO: 161372 - protein, 36 aa, Artificial Sequence
  Description of Artificial Sequence: Synthetic polypeptide
FEEEIRTTNPVATEGYGSVVNFDDMNDQGGGGPNED

SEQ ID NO: 161373 - protein, 28 aa, Artificial Sequence
  Description of Artificial Sequence: Synthetic peptide
QESEIASTNPVGTEGYGVMASTYQHHDI

SEQ ID NO: 161374 - protein, 35 aa, Artificial Sequence
  Description of Artificial Sequence: Synthetic polypeptide
FEEEIRTTNPVATEGYGSVVNFDDMNDQTGGGQEG

SEQ ID NO: 161375 - protein, 36 aa, Artificial Sequence
  Description of Artificial Sequence: Synthetic polypeptide
FEEEIRTTNPVATEGYGSVVNFDDMNDQTGGNGNID

SEQ ID NO: 161376 - protein, 29 aa, Artificial Sequence
  Description of Artificial Sequence: Synthetic peptide
QESEIASTNPVGTEGYGVMASTYQHSGDI

SEQ ID NO: 161377 - protein, 28 aa, Artificial Sequence
  Description of Artificial Sequence: Synthetic peptide
QESEIASTNPVGTEGYGVMASVCQHGEI

SEQ ID NO: 161378 - protein, 37 aa, Artificial Sequence
  Description of Artificial Sequence: Synthetic polypeptide
FEEEIRTTNPVATEGYGSVVQGTVNGLEPEGNGGGQG

SEQ ID NO: 161379 - protein, 37 aa, Artificial Sequence
  Description of Artificial Sequence: Synthetic polypeptide
FEEEIRTTNPVATEGYGSVVQNTVNGLEAGENGGGQG

SEQ ID NO: 161380 - protein, 31 aa, Artificial Sequence
  Description of Artificial Sequence: Synthetic polypeptide
DDSEVASTNPVSTEIYGNVAANTIQSRVGQR

SEQ ID NO: 161381 - protein, 35 aa, Artificial Sequence
  Description of Artificial Sequence: Synthetic polypeptide
FEEEIRTTNPVATEGYGSVVQTIGDENQGEGQGQV

SEQ ID NO: 161382 - protein, 32 aa, Artificial Sequence
  Description of Artificial Sequence: Synthetic polypeptide
DENEIHTTNPVSTEPYGTISMEDIQQQQNGNH

SEQ ID NO: 161383 - protein, 37 aa, Artificial Sequence
  Description of Artificial Sequence: Synthetic polypeptide
MEEEIRTTNPVATEFYGSVYDQSNLNIIQEGGGNQGN

SEQ ID NO: 161384 - protein, 35 aa, Artificial Sequence
  Description of Artificial Sequence: Synthetic polypeptide
MEEEIRTTNPVATEFYGSVYDDLIDGGQEDTGEIE

SEQ ID NO: 161385 - protein, 36 aa, Artificial Sequence
  Description of Artificial Sequence: Synthetic polypeptide
FEEEIRTTNPVATEGYGSVVNFDDMNDQTEGEGNED

SEQ ID NO: 161386 - protein, 39 aa, Artificial Sequence
  Description of Artificial Sequence: Synthetic polypeptide
DEEEIRTTNPVATESYGTVTTGQSGTISTNLEEQEVGNP

SEQ ID NO: 161387 - protein, 39 aa, Artificial Sequence
  Description of Artificial Sequence: Synthetic polypeptide
DEEEIRTTNPVATESYGTVTTGQSGTISTNLQGEEQGNP

SEQ ID NO: 161388 - protein, 36 aa, Artificial Sequence
  Description of Artificial Sequence: Synthetic polypeptide
DEEEIRTTNPVATEQYGSCATGTPPFDNPEGENGVE

SEQ ID NO: 161389 - protein, 36 aa, Artificial Sequence
  Description of Artificial Sequence: Synthetic polypeptide
FEEEIRTTNPVATEFYGSVNMTGQSTQGQQEGQGEG

SEQ ID NO: 161390 - protein, 37 aa, Artificial Sequence
  Description of Artificial Sequence: Synthetic polypeptide
FEEEIRTTNPVATEFYGSVNSTTGVNEGQNVEGQDGD

SEQ ID NO: 161391 - protein, 36 aa, Artificial Sequence
  Description of Artificial Sequence: Synthetic polypeptide
SAEEIATTNPVATEQYGSVCSTNHGPLDSGEGEDGK

SEQ ID NO: 161392 - protein, 36 aa, Artificial Sequence
  Description of Artificial Sequence: Synthetic polypeptide
DEEEIRTTNPVATEQYGSCAPMQTGLDQNMQTMVAD

SEQ ID NO: 161393 - protein, 30 aa, Artificial Sequence
  Description of Artificial Sequence: Synthetic polypeptide
DENEIHTTNPVAYEQWGDVSEIEMNAAEDA

SEQ ID NO: 161394 - protein, 35 aa, Artificial Sequence
  Description of Artificial Sequence: Synthetic polypeptide
SAEEIATTNPVATEQYGSVCAANNALEEADGNENQ

SEQ ID NO: 161395 - protein, 29 aa, Artificial Sequence
  Description of Artificial Sequence: Synthetic peptide
QESEIASTNPVGTEGYGVMASTTQHGMDI

SEQ ID NO: 161396 - protein, 37 aa, Artificial Sequence
  Description of Artificial Sequence: Synthetic polypeptide
DEEEIRTTNPVATEQYGSCAQPEMEESTVLENETLND

SEQ ID NO: 161397 - protein, 35 aa, Artificial Sequence
  Description of Artificial Sequence: Synthetic polypeptide
MEEEIRTTNPVATEGYGMVNNQDTNMENNGGNGQE

SEQ ID NO: 161398 - protein, 29 aa, Artificial Sequence
  Description of Artificial Sequence: Synthetic peptide
QESEIASTNPVGTEGYGVMASTTQHSGDG

SEQ ID NO: 161399 - protein, 34 aa, Artificial Sequence
  Description of Artificial Sequence: Synthetic polypeptide
FEEEIRTTNPVATEFYGVVVTTDGEFGQGQNETA

SEQ ID NO: 161400 - protein, 37 aa, Artificial Sequence
  Description of Artificial Sequence: Synthetic polypeptide
DEEEIRTTNPVATEQYGSCAQPEMMAGTVLENGTLND

SEQ ID NO: 161401 - protein, 38 aa, Artificial Sequence
  Description of Artificial Sequence: Synthetic polypeptide
DEEEIRTTNPVATEQYGSCAQPEMMESTVLENGMTDND

SEQ ID NO: 161402 - protein, 35 aa, Artificial Sequence
  Description of Artificial Sequence: Synthetic polypeptide
SAEEIATTNPVATEQYGSVCAADNHNLTANAEGNH

SEQ ID NO: 161403 - protein, 37 aa, Artificial Sequence
  Description of Artificial Sequence: Synthetic polypeptide
DEEEIRTTNPVATEQYGSCAQPEMMESTVLENTTAND

SEQ ID NO: 161404 - protein, 34 aa, Artificial Sequence
  Description of Artificial Sequence: Synthetic polypeptide
FEEEIRTTNPVATEGYGMVNGQGTNQGEGGGDQG

SEQ ID NO: 161405 - protein, 39 aa, Artificial Sequence
  Description of Artificial Sequence: Synthetic polypeptide
DEEEIRTTNPVATEQYGVVSVVVVTNTQAGNSEQYGVAE

SEQ ID NO: 161406 - protein, 29 aa, Artificial Sequence
  Description of Artificial Sequence: Synthetic peptide
QESEIASTNPVGTEGYGVMASTVQHGDIT

SEQ ID NO: 161407 - protein, 36 aa, Artificial Sequence
  Description of Artificial Sequence: Synthetic polypeptide
FEEEIRTTNPVATEGYGSVDQGTVNGLEAENEGGQG

SEQ ID NO: 161408 - protein, 36 aa, Artificial Sequence
  Description of Artificial Sequence: Synthetic polypeptide
FEEEIRTTNPVATEGYGSVITDPGDGGQEDGGNQTG

SEQ ID NO: 161409 - protein, 35 aa, Artificial Sequence
  Description of Artificial Sequence: Synthetic polypeptide
FEEEIRTTNPVATEGYGSVITMGFGDQNNGGQGEG

SEQ ID NO: 161410 - protein, 31 aa, Artificial Sequence
  Description of Artificial Sequence: Synthetic polypeptide
DDSEVASTNPVSTEHYGNVAANTIQSRVGQR

SEQ ID NO: 161411 - protein, 39 aa, Artificial Sequence
  Description of Artificial Sequence: Synthetic polypeptide
DEEEIRTTNPVATESYGTVTTGQSGTISTNNQLQEIGNT

SEQ ID NO: 161412 - protein, 34 aa, Artificial Sequence
  Description of Artificial Sequence: Synthetic polypeptide
DEQEIVTTNPVATEQYGTVCSAQDGPVEYEGNDY

SEQ ID NO: 161413 - protein, 36 aa, Artificial Sequence
  Description of Artificial Sequence: Synthetic polypeptide
DENEIRTTNPVATECYGSVSSTTPAGPQMRNEMEPV

SEQ ID NO: 161414 - protein, 35 aa, Artificial Sequence
  Description of Artificial Sequence: Synthetic polypeptide
DEQEIVTTNPVATEQYGTVCSATDDLVEDFEGEDD

SEQ ID NO: 161415 - protein, 39 aa, Artificial Sequence
  Description of Artificial Sequence: Synthetic polypeptide
DEEEIRTTNPVATESYGTVTTGQSGTISTNLQMEEVGNV

SEQ ID NO: 161416 - protein, 31 aa, Artificial Sequence
  Description of Artificial Sequence: Synthetic polypeptide
DDSEVASTNPVSTEPYGNVAANDIQQRVGNH

SEQ ID NO: 161417 - protein, 37 aa, Artificial Sequence
  Description of Artificial Sequence: Synthetic polypeptide
MEEEIRGTNPVATEQYGSVNMTPGEADQERGGENGDT

SEQ ID NO: 161418 - protein, 30 aa, Artificial Sequence
  Description of Artificial Sequence: Synthetic polypeptide
QESEIASTNPVGTEGYGVMCAASTLQHGDI

SEQ ID NO: 161419 - protein, 31 aa, Artificial Sequence
  Description of Artificial Sequence: Synthetic polypeptide
SAEEIATTNPVATAQWGCVAGTGGAAGGNNH

SEQ ID NO: 161420 - protein, 32 aa, Artificial Sequence
  Description of Artificial Sequence: Synthetic polypeptide
DENEIQTTNPVSTEPYGTISMEDIQQQQNGNH

SEQ ID NO: 161421 - protein, 38 aa, Artificial Sequence
  Description of Artificial Sequence: Synthetic polypeptide
AEEEIRTTNPVATEQYGSVSTVTTNNMEQGTNNVTNED

SEQ ID NO: 161422 - protein, 36 aa, Artificial Sequence
  Description of Artificial Sequence: Synthetic polypeptide
FEEEIRTTNPVATEQYGSVMGDTDPEQTGGGDTGEG

SEQ ID NO: 161423 - protein, 36 aa, Artificial Sequence
  Description of Artificial Sequence: Synthetic polypeptide
FEEEIRTTNPVATEQYGSVMGEDPGGQTNDGEGETQ

SEQ ID NO: 161424 - protein, 35 aa, Artificial Sequence
  Description of Artificial Sequence: Synthetic polypeptide
DEAVIRTTNPVATEQYGQCVCETEPNQEYFGSNQA

SEQ ID NO: 161425 - protein, 31 aa, Artificial Sequence
  Description of Artificial Sequence: Synthetic polypeptide
DENEIRATNPVATEQWGDVSESGEMNAAEDA

SEQ ID NO: 161426 - protein, 36 aa, Artificial Sequence
  Description of Artificial Sequence: Synthetic polypeptide
DEEEIRTTNPVATEQYGSVDNPRIVLELNNFVAEDT

SEQ ID NO: 161427 - protein, 35 aa, Artificial Sequence
  Description of Artificial Sequence: Synthetic polypeptide
DEGEIATTNPVATEQYGSACPGNNDIPQDNPDGNN

SEQ ID NO: 161428 - protein, 31 aa, Artificial Sequence
  Description of Artificial Sequence: Synthetic polypeptide
DENEIRTTNPVATECWGAVSEEIEANAAEPI

SEQ ID NO: 161429 - protein, 36 aa, Artificial Sequence
  Description of Artificial Sequence: Synthetic polypeptide
FEEEIRTTNPVATEQYGSVMGMVNQEQGGGGQDEQV

SEQ ID NO: 161430 - protein, 31 aa, Artificial Sequence
  Description of Artificial Sequence: Synthetic polypeptide
DENEIRTTNPVATECWGAVSEEIEANAAEPA

SEQ ID NO: 161431 - protein, 33 aa, Artificial Sequence
  Description of Artificial Sequence: Synthetic polypeptide
DEECLRTTNPEAYEQYGCVCSTEDQNFGSDTQA

SEQ ID NO: 161432 - protein, 34 aa, Artificial Sequence
  Description of Artificial Sequence: Synthetic polypeptide
MEEEIHTTNPVSTEQMGCSIFAMNPQARFNCPRP

SEQ ID NO: 161433 - protein, 36 aa, Artificial Sequence
  Description of Artificial Sequence: Synthetic polypeptide
DEGEIATTNPVATEQYGSACAATNPLADDPGDGNDP

SEQ ID NO: 161434 - protein, 34 aa, Artificial Sequence
  Description of Artificial Sequence: Synthetic polypeptide
DEAVIRTTNPVATEQYGGVYISLLEFPNGSQTTR

SEQ ID NO: 161435 - protein, 30 aa, Artificial Sequence
  Description of Artificial Sequence: Synthetic polypeptide
QESEIASTNPVGTEGYGVMSATDLEHEGEL

SEQ ID NO: 161436 - protein, 31 aa, Artificial Sequence
  Description of Artificial Sequence: Synthetic polypeptide
DENEIRTTNPVATECWGAVAEIWMNPAGPYA

SEQ ID NO: 161437 - protein, 31 aa, Artificial Sequence
  Description of Artificial Sequence: Synthetic polypeptide
DENEIRTTNPVATECWGAVAEIEMNPAGPYA

SEQ ID NO: 161438 - protein, 36 aa, Artificial Sequence
  Description of Artificial Sequence: Synthetic polypeptide
DEEEIRTTNPVATEQYGSCNCCVSELIEMEEQELLE

SEQ ID NO: 161439 - protein, 36 aa, Artificial Sequence
  Description of Artificial Sequence: Synthetic polypeptide
DDEEIRTTNPVATEQYGSVMGQMVNNDQDEGGEPDQ

SEQ ID NO: 161440 - protein, 37 aa, Artificial Sequence
  Description of Artificial Sequence: Synthetic polypeptide
FEEEIRTTNPVATEQYGSVMSDFNIVVTGEGFENGEQ

SEQ ID NO: 161441 - protein, 36 aa, Artificial Sequence
  Description of Artificial Sequence: Synthetic polypeptide
FEEEIRTTNPVATEQYGSVMSDMDNFPEIGIDGEGE

SEQ ID NO: 161442 - protein, 36 aa, Artificial Sequence
  Description of Artificial Sequence: Synthetic polypeptide
FEEEIRTTNPVATEQYGSVMSGMEMGDVNEGNQVGD

SEQ ID NO: 161443 - protein, 35 aa, Artificial Sequence
  Description of Artificial Sequence: Synthetic polypeptide
DEGEIATTNPVATEQYGNTIATNPLENGMPMGERH

SEQ ID NO: 161444 - protein, 36 aa, Artificial Sequence
  Description of Artificial Sequence: Synthetic polypeptide
DEEEIRTTNPVATEQYGSGSLGFVEGEHNIVNEPEN

SEQ ID NO: 161445 - protein, 36 aa, Artificial Sequence
  Description of Artificial Sequence: Synthetic polypeptide
FEEEIRTTNPVATEQYGSVMSTGVDGEEEEGEGGEG

SEQ ID NO: 161446 - protein, 36 aa, Artificial Sequence
  Description of Artificial Sequence: Synthetic polypeptide
DEEEIRTTNPVATEQYGSVDNPRIVLHNNNFVAEDD

SEQ ID NO: 161447 - protein, 37 aa, Artificial Sequence
  Description of Artificial Sequence: Synthetic polypeptide
DEEEIRTTNPVATEQYGVVTVVVTNNNNQNQNQQGTV

SEQ ID NO: 161448 - protein, 35 aa, Artificial Sequence
  Description of Artificial Sequence: Synthetic polypeptide
FEEEIRTTNPVATEQYGSVIYGVGEGGGDGEENET

SEQ ID NO: 161449 - protein, 36 aa, Artificial Sequence
  Description of Artificial Sequence: Synthetic polypeptide
FEEEIRTTNPVATEQYGSVIVPTGPMAEIESQNPRQ

SEQ ID NO: 161450 - protein, 32 aa, Artificial Sequence
  Description of Artificial Sequence: Synthetic polypeptide
DENEIMTTNPVSTEPYGTISMEDIQQQQNGNL

SEQ ID NO: 161451 - protein, 31 aa, Artificial Sequence
  Description of Artificial Sequence: Synthetic polypeptide
DENEIRTTNPVATECWGDVLSEIEMNAAEDA

SEQ ID NO: 161452 - protein, 31 aa, Artificial Sequence
  Description of Artificial Sequence: Synthetic polypeptide
DENEIRTTNPVATECWGDVGCELEMNAAEDA

SEQ ID NO: 161453 - protein, 31 aa, Artificial Sequence
  Description of Artificial Sequence: Synthetic polypeptide
DENEINTTNPVATEQWGDVSEEIEMNAAEDA

SEQ ID NO: 161454 - protein, 37 aa, Artificial Sequence
  Description of Artificial Sequence: Synthetic polypeptide
FEEEIRTTNPVATEQYGSVISPPQNMEQGEIPQFNTE

SEQ ID NO: 161455 - protein, 31 aa, Artificial Sequence
  Description of Artificial Sequence: Synthetic polypeptide
DENEINTTNPVATEQWGDVSEIAEMNAAEDA

SEQ ID NO: 161456 - protein, 31 aa, Artificial Sequence
  Description of Artificial Sequence: Synthetic polypeptide
DENEIRTTNPVATECWGDVAEIEMNPAGPYA

SEQ ID NO: 161457 - protein, 29 aa, Artificial Sequence
  Description of Artificial Sequence: Synthetic peptide
QESEIASTNPVGTEGYGVMPASTRQHGDI

SEQ ID NO: 161458 - protein, 31 aa, Artificial Sequence
  Description of Artificial Sequence: Synthetic polypeptide
DENEIRTTNPVATECWGDVAEIEMNPAEPYA

SEQ ID NO: 161459 - protein, 32 aa, Artificial Sequence
  Description of Artificial Sequence: Synthetic polypeptide
DENEINTTNPVSTEPYGHISMEDIQQQQNGNH

SEQ ID NO: 161460 - protein, 30 aa, Artificial Sequence
  Description of Artificial Sequence: Synthetic polypeptide
QESEIASTNPVGTEGYGVMPSTLHRHGDIS

SEQ ID NO: 161461 - protein, 34 aa, Artificial Sequence
  Description of Artificial Sequence: Synthetic polypeptide
DEECLRTTNPIAYEQYGQCVCSTELQNFGSDTQA

SEQ ID NO: 161462 - protein, 36 aa, Artificial Sequence
  Description of Artificial Sequence: Synthetic polypeptide
FEEEIRTTNPVATEQYGSVIVTLGMGQEGGGEGETM

SEQ ID NO: 161463 - protein, 34 aa, Artificial Sequence
  Description of Artificial Sequence: Synthetic polypeptide
DEECLRTTNPIAYEQYGQCVCSTEHNQNFGSNQA

SEQ ID NO: 161464 - protein, 32 aa, Artificial Sequence
  Description of Artificial Sequence: Synthetic polypeptide
DENEINTTNPVSTEPYGTISMEDIQQQQNGNH

SEQ ID NO: 161465 - protein, 32 aa, Artificial Sequence
  Description of Artificial Sequence: Synthetic polypeptide
DENEINTTNPVSTEPYGTLSMEDIQQQQNGNH

SEQ ID NO: 161466 - protein, 34 aa, Artificial Sequence
  Description of Artificial Sequence: Synthetic polypeptide
DEMAIVTTNPVATEQYGTVCSATDGPVEFEGNDP

SEQ ID NO: 161467 - protein, 36 aa, Artificial Sequence
  Description of Artificial Sequence: Synthetic polypeptide
DEEEIRTTNPVATEQYGSCNCCPTELIEMEEQELEI

SEQ ID NO: 161468 - protein, 32 aa, Artificial Sequence
  Description of Artificial Sequence: Synthetic polypeptide
DENEIQTTNPVSTEPYGTISMEDIQQQDNGNH

SEQ ID NO: 161469 - protein, 32 aa, Artificial Sequence
  Description of Artificial Sequence: Synthetic polypeptide
DENEIRTTNPVATECWGAVWSAEIWMNPKGPI

SEQ ID NO: 161470 - protein, 36 aa, Artificial Sequence
  Description of Artificial Sequence: Synthetic polypeptide
DDEEIRTTNPVATEQYGSVMGTNNNNMDEGGQEFDI

SEQ ID NO: 161471 - protein, 31 aa, Artificial Sequence
  Description of Artificial Sequence: Synthetic polypeptide
YENEIATVNPVCTEPYGVISMDLQQQQNGNQ

SEQ ID NO: 161472 - protein, 32 aa, Artificial Sequence
  Description of Artificial Sequence: Synthetic polypeptide
DENEIRTTNPVATECWGAVWSAEIWMNAKGPI

SEQ ID NO: 161473 - protein, 38 aa, Artificial Sequence
  Description of Artificial Sequence: Synthetic polypeptide
AEEEIRTTNPVATEQYGSVSTVTTNNAEQGTNNDTDED

SEQ ID NO: 161474 - protein, 34 aa, Artificial Sequence
  Description of Artificial Sequence: Synthetic polypeptide
DEGEIATTNPVATEQYGSACSANPPANDNPGGQP

SEQ ID NO: 161475 - protein, 35 aa, Artificial Sequence
  Description of Artificial Sequence: Synthetic polypeptide
MEEEIKTTNPVATEQYGAVVDDNNEQIGGQNGGGG

SEQ ID NO: 161476 - protein, 32 aa, Artificial Sequence
  Description of Artificial Sequence: Synthetic polypeptide
DENEINTTNPVSTEPYGTISMEDIQQQQEGNH

SEQ ID NO: 161477 - protein, 31 aa, Artificial Sequence
  Description of Artificial Sequence: Synthetic polypeptide
YENEIATVNPVSTEPYGVISMDLQQQQNGNQ

SEQ ID NO: 161478 - protein, 30 aa, Artificial Sequence
  Description of Artificial Sequence: Synthetic polypeptide
QTEEIATTNPVATEQYGEAPEVCQHEHEKC

SEQ ID NO: 161479 - protein, 36 aa, Artificial Sequence
  Description of Artificial Sequence: Synthetic polypeptide
DEGEIATTNPVATEQYGCWSFSATDTLEPHEGEDTR

SEQ ID NO: 161480 - protein, 31 aa, Artificial Sequence
  Description of Artificial Sequence: Synthetic polypeptide
YENEIRSTNPVSTEPYGTISMEDIQQQNGNH

SEQ ID NO: 161481 - protein, 33 aa, Artificial Sequence
  Description of Artificial Sequence: Synthetic polypeptide
DENEIRATNPVATWHYGSVSTMNQEVVHTEEDP

SEQ ID NO: 161482 - protein, 38 aa, Artificial Sequence
  Description of Artificial Sequence: Synthetic polypeptide
AEEEIRTTNPVATEQYGSVSTVTTNNNNNEDEGTNNVE

SEQ ID NO: 161483 - protein, 36 aa, Artificial Sequence
  Description of Artificial Sequence: Synthetic polypeptide
DDEEIRTTNPVATEQYGSVMGENEDNMDEGGQEGEI

SEQ ID NO: 161484 - protein, 38 aa, Artificial Sequence
  Description of Artificial Sequence: Synthetic polypeptide
DEEEIRTTNPVATEQYGVVTVVVTSNNQQLGIGTNNTE

SEQ ID NO: 161485 - protein, 37 aa, Artificial Sequence
  Description of Artificial Sequence: Synthetic polypeptide
DDEEIRTTNPVATEQYGSVISTMDITQNGGGGEEEGM

SEQ ID NO: 161486 - protein, 39 aa, Artificial Sequence
  Description of Artificial Sequence: Synthetic polypeptide
DEEEIRTTNPVATESYGTVTNLQSGTISTNNQNQGVGNR

SEQ ID NO: 161487 - protein, 39 aa, Artificial Sequence
  Description of Artificial Sequence: Synthetic polypeptide
DEEEIRTTNPVATESYGTVTNLQSGTISTNLQNNEVGNM

SEQ ID NO: 161488 - protein, 39 aa, Artificial Sequence
  Description of Artificial Sequence: Synthetic polypeptide
DEEEIRTTNPVATESYGTVTNLQSGTISTNLQGTEQGNV

SEQ ID NO: 161489 - protein, 32 aa, Artificial Sequence
  Description of Artificial Sequence: Synthetic polypeptide
DENEIRATNPVSTEPYGTISMEDIQQQQNGNE

SEQ ID NO: 161490 - protein, 36 aa, Artificial Sequence
  Description of Artificial Sequence: Synthetic polypeptide
DEEEIRTTNPVATEQYGSVDNPRIVLNPNNNVAEIE

SEQ ID NO: 161491 - protein, 35 aa, Artificial Sequence
  Description of Artificial Sequence: Synthetic polypeptide
MEEEIATTNPVATEQYGCVCSNWGELQEGFGSDQS

SEQ ID NO: 161492 - protein, 38 aa, Artificial Sequence
  Description of Artificial Sequence: Synthetic polypeptide
AEEEIRTTNPVATEQYGVVSVVSVNNQQQGTNNNNEQG

SEQ ID NO: 161493 - protein, 34 aa, Artificial Sequence
  Description of Artificial Sequence: Synthetic polypeptide
MEEEIATTNPVATEQYGCVCSNWEHNQGFGSDQA

SEQ ID NO: 161494 - protein, 32 aa, Artificial Sequence
  Description of Artificial Sequence: Synthetic polypeptide
DENEIRATNPVSTEPYGTISMEDIQQQQNGNH

SEQ ID NO: 161495 - protein, 35 aa, Artificial Sequence
  Description of Artificial Sequence: Synthetic polypeptide
AEEEISTTNPVATEQYGCVCSWGEHNQNFGSENQA

SEQ ID NO: 161496 - protein, 36 aa, Artificial Sequence
  Description of Artificial Sequence: Synthetic polypeptide
FEEEIRTTNPVATEQYGSVNVNGFNGQTGETVDDGQ

SEQ ID NO: 161497 - protein, 36 aa, Artificial Sequence
  Description of Artificial Sequence: Synthetic polypeptide
FEEEIRTTNPVATEQYGSVNVNNFNGNQTGETDDGQ

SEQ ID NO: 161498 - protein, 34 aa, Artificial Sequence
  Description of Artificial Sequence: Synthetic polypeptide
DENEIRTTNPVATEAYGCVCSWGEHNQNFGSDQA

SEQ ID NO: 161499 - protein, 37 aa, Artificial Sequence
  Description of Artificial Sequence: Synthetic polypeptide
FEEEIRTTNPVATEQYGSVPIPAITQQAELQPHNNNE

SEQ ID NO: 161500 - protein, 32 aa, Artificial Sequence
  Description of Artificial Sequence: Synthetic polypeptide
YENEIRSTNPVSTEPYGVISDEDLQQQSNGNH

SEQ ID NO: 161501 - protein, 37 aa, Artificial Sequence
  Description of Artificial Sequence: Synthetic polypeptide
FEEEIRTTNPVATEQYGSVPIPTITQMELQPHNVNEY

SEQ ID NO: 161502 - protein, 35 aa, Artificial Sequence
  Description of Artificial Sequence: Synthetic polypeptide
FEEEIRTTNPVATEQYGSVPNPPLLEETMGLLEQV

SEQ ID NO: 161503 - protein, 35 aa, Artificial Sequence
  Description of Artificial Sequence: Synthetic polypeptide
AEEEISTTNPVATEQYGCVCSWGEHNQNFGSDNQA

SEQ ID NO: 161504 - protein, 31 aa, Artificial Sequence
  Description of Artificial Sequence: Synthetic polypeptide
DDSEVASTNPVSTEQYGDVAANTIQSRVEQR

SEQ ID NO: 161505 - protein, 37 aa, Artificial Sequence
  Description of Artificial Sequence: Synthetic polypeptide
DEATEIATTNPVAYEQWGSVCSGNLNDGQQERQGNEH

SEQ ID NO: 161506 - protein, 35 aa, Artificial Sequence
  Description of Artificial Sequence: Synthetic polypeptide
DDEEIRTTNPVATEQYGSVIQGNNNNMDEGGQGDI

SEQ ID NO: 161507 - protein, 34 aa, Artificial Sequence
  Description of Artificial Sequence: Synthetic polypeptide
YENEIRCTNPVATEQTGYSVNPSTWEICRFGGLL

SEQ ID NO: 161508 - protein, 38 aa, Artificial Sequence
  Description of Artificial Sequence: Synthetic polypeptide
AEEEIRTTNPVATEQYGVVSVVSVNNQQQGTNGEETED

SEQ ID NO: 161509 - protein, 39 aa, Artificial Sequence
  Description of Artificial Sequence: Synthetic polypeptide
AEEEIRTTNPVATEQYGVVSVVSTTTNLQAGTTEAGVVE

SEQ ID NO: 161510 - protein, 37 aa, Artificial Sequence
  Description of Artificial Sequence: Synthetic polypeptide
FEEEIRTTNPVATEQYGSVNEVAMEEHQNRTGEQERY

SEQ ID NO: 161511 - protein, 36 aa, Artificial Sequence
  Description of Artificial Sequence: Synthetic polypeptide
DEEEIRTTNPVATEQYGSVSECMPDDEAARMIVLEP

SEQ ID NO: 161512 - protein, 35 aa, Artificial Sequence
  Description of Artificial Sequence: Synthetic polypeptide
DDEEIRTTNPVATEQYGSVMGNNNNMDEGGDGGIG

SEQ ID NO: 161513 - protein, 31 aa, Artificial Sequence
  Description of Artificial Sequence: Synthetic polypeptide
DDSEVASTNPVSTEPYGNVYANTIQSRIGQR

SEQ ID NO: 161514 - protein, 36 aa, Artificial Sequence
  Description of Artificial Sequence: Synthetic polypeptide
DDEEIRTTNPVATEQYGSVMGNNNNFNMDEGGQGNI

SEQ ID NO: 161515 - protein, 36 aa, Artificial Sequence
  Description of Artificial Sequence: Synthetic polypeptide
DENEIRATNPVATEQYGSVVTTDGMNNQTGEDEQGE

SEQ ID NO: 161516 - protein, 36 aa, Artificial Sequence
  Description of Artificial Sequence: Synthetic polypeptide
DENEIRATNPVATEQYGSVYTDGGDEDQGGGEVNQT

SEQ ID NO: 161517 - protein, 37 aa, Artificial Sequence
  Description of Artificial Sequence: Synthetic polypeptide
FEEEIRTTNPVATEQYGSVNINTMNLDLEGGGQEDTT

SEQ ID NO: 161518 - protein, 35 aa, Artificial Sequence
  Description of Artificial Sequence: Synthetic polypeptide
DDEEIRTTNPVATEQYGSVMGNNDNNMDEGGESGI

SEQ ID NO: 161519 - protein, 36 aa, Artificial Sequence
  Description of Artificial Sequence: Synthetic polypeptide
FEEEIRTTNPVATEQYGSVNITNNFDDNTNGGEGQT

SEQ ID NO: 161520 - protein, 36 aa, Artificial Sequence
  Description of Artificial Sequence: Synthetic polypeptide
DDEEIRTTNPVATEQYGSVMGNMVNNDQDEGQEPGI

SEQ ID NO: 161521 - protein, 37 aa, Artificial Sequence
  Description of Artificial Sequence: Synthetic polypeptide
FEEEIRTTNPVATEQYGSVNMATDGQDQEDEGQNEGF

SEQ ID NO: 161522 - protein, 35 aa, Artificial Sequence
  Description of Artificial Sequence: Synthetic polypeptide
DEEEIRTTNPVATEQYGSVDNPRIVLNNNFVLEDI

SEQ ID NO: 161523 - protein, 37 aa, Artificial Sequence
  Description of Artificial Sequence: Synthetic polypeptide
FEEEIRTTNPVATEQYGSVNMDTDGQDQEDEGQNNGS

SEQ ID NO: 161524 - protein, 37 aa, Artificial Sequence
  Description of Artificial Sequence: Synthetic polypeptide
FEEEIRTTNPVATEQYGSVNMDTDGQDQEQEGQNELQ

SEQ ID NO: 161525 - protein, 37 aa, Artificial Sequence
  Description of Artificial Sequence: Synthetic polypeptide
FEEEIRTTNPVATEQYGSVNMGTLNGPEENQEGGEIQ

SEQ ID NO: 161526 - protein, 36 aa, Artificial Sequence
  Description of Artificial Sequence: Synthetic polypeptide
DDEEIRTTNPVATEQYGSVMGNMVNNDQDEGGETEI

SEQ ID NO: 161527 - protein, 35 aa, Artificial Sequence
  Description of Artificial Sequence: Synthetic polypeptide
FEEEIRTTNPVATEQYGSVNMGVNDNNGQGEFTEI

SEQ ID NO: 161528 - protein, 34 aa, Artificial Sequence
  Description of Artificial Sequence: Synthetic polypeptide
DEECLRTTNPCAYEQYGCVCSWGNLNQNFNSDQS

SEQ ID NO: 161529 - protein, 34 aa, Artificial Sequence
  Description of Artificial Sequence: Synthetic polypeptide
YENEIRCTDPVATEQTGYSVNPSTWEPIQRGGLL

SEQ ID NO: 161530 - protein, 36 aa, Artificial Sequence
  Description of Artificial Sequence: Synthetic polypeptide
DEEEIRTTNPVATEQYGSCNCNNSELIEMEEQEDLI

SEQ ID NO: 161531 - protein, 37 aa, Artificial Sequence
  Description of Artificial Sequence: Synthetic polypeptide
FEEEIRTTNPVATEQYGSVNMQNNQDQGQEEDDENGD

SEQ ID NO: 161532 - protein, 36 aa, Artificial Sequence
  Description of Artificial Sequence: Synthetic polypeptide
FEEEIRTTNPVATEQYGSVNMQNNQDQQDEDDTNGD

SEQ ID NO: 161533 - protein, 36 aa, Artificial Sequence
  Description of Artificial Sequence: Synthetic polypeptide
DEGEIATTNPVATEQYGCVTAATANGLQPADMPNND

SEQ ID NO: 161534 - protein, 36 aa, Artificial Sequence
  Description of Artificial Sequence: Synthetic polypeptide
FEEEIRTTNPVATEQYGSVNMQNNQDQQEEQDENGQ

SEQ ID NO: 161535 - protein, 37 aa, Artificial Sequence
  Description of Artificial Sequence: Synthetic polypeptide
FEEEIRTTNPVATEQYGSVNMQNTEQDQQEEGDENGD

SEQ ID NO: 161536 - protein, 36 aa, Artificial Sequence
  Description of Artificial Sequence: Synthetic polypeptide
DDEEIRTTNPVATEQYGSVMGENVNQNMDEGGQGDN

SEQ ID NO: 161537 - protein, 32 aa, Artificial Sequence
  Description of Artificial Sequence: Synthetic polypeptide
DENEIRTTNPVATECWGDVSCIEPQDAAEEDG

SEQ ID NO: 161538 - protein, 33 aa, Artificial Sequence
  Description of Artificial Sequence: Synthetic polypeptide
DEEVIRCTNPVATEQYGASMQWRNSFEPGGKEI

SEQ ID NO: 161539 - protein, 36 aa, Artificial Sequence
  Description of Artificial Sequence: Synthetic polypeptide
DEEEIRTTNPVATEQYGSVDNPRIQLTLNNFVAEDE

SEQ ID NO: 161540 - protein, 32 aa, Artificial Sequence
  Description of Artificial Sequence: Synthetic polypeptide
DENEIMTTNPVSTEPYGEISMEDIIQQQNGNH

SEQ ID NO: 161541 - protein, 37 aa, Artificial Sequence
  Description of Artificial Sequence: Synthetic polypeptide
MEEEIRCTNPVATEQYGSVSNGVNGQSGQEGDQNDTS

SEQ ID NO: 161542 - protein, 36 aa, Artificial Sequence
  Description of Artificial Sequence: Synthetic polypeptide
MEEEIRCTNPVATEQYGSVSNGVNGQSGQEEGQGDT

SEQ ID NO: 161543 - protein, 30 aa, Artificial Sequence
  Description of Artificial Sequence: Synthetic polypeptide
QESEIASTNPVGTEGYGVMIASRTLQHGDI

SEQ ID NO: 161544 - protein, 38 aa, Artificial Sequence
  Description of Artificial Sequence: Synthetic polypeptide
AEEEIRTTNPVATEQYGSVSTVTQNGNEQATTNVATEQ

SEQ ID NO: 161545 - protein, 38 aa, Artificial Sequence
  Description of Artificial Sequence: Synthetic polypeptide
AEEEIRTTNPVATEQYGSVSTVTQNGNEQGTTNATTED

SEQ ID NO: 161546 - protein, 38 aa, Artificial Sequence
  Description of Artificial Sequence: Synthetic polypeptide
DEEEIRTTNPVATEQYGVVSTVNNNQAGTEQGTEETTE

SEQ ID NO: 161547 - protein, 30 aa, Artificial Sequence
  Description of Artificial Sequence: Synthetic polypeptide
DESEIASTNPIGTEGYGVTMANSTLQHGDI

SEQ ID NO: 161548 - protein, 38 aa, Artificial Sequence
  Description of Artificial Sequence: Synthetic polypeptide
AEEEIRTTNPVATEQYGVVSTVVNNQQNQQGNGTNNQD

SEQ ID NO: 161549 - protein, 39 aa, Artificial Sequence
  Description of Artificial Sequence: Synthetic polypeptide
DEEEIRTTNPVATESYGTVTNLQSGTISTNTQNGNNGNR

SEQ ID NO: 161550 - protein, 37 aa, Artificial Sequence
  Description of Artificial Sequence: Synthetic polypeptide
AEEEIRTTNPVATEQYGVVSTVVNNQQQGTDEDEDDE

SEQ ID NO: 161551 - protein, 35 aa, Artificial Sequence
  Description of Artificial Sequence: Synthetic polypeptide
DEECISTTNPVATEQWGCVCQTNEHNQGFGSDNQS

SEQ ID NO: 161552 - protein, 30 aa, Artificial Sequence
  Description of Artificial Sequence: Synthetic polypeptide
DESEIASTNPIGTEGYGATMANSTLQHGDI

SEQ ID NO: 161553 - protein, 32 aa, Artificial Sequence
  Description of Artificial Sequence: Synthetic polypeptide
RENEIRTTNPVSTEPYGTISMEDIQQQQNGNH

SEQ ID NO: 161554 - protein, 34 aa, Artificial Sequence
  Description of Artificial Sequence: Synthetic polypeptide
DENEIKTTNPVATEQYGEMTVTGNGGQGDGDDGN

SEQ ID NO: 161555 - protein, 37 aa, Artificial Sequence
  Description of Artificial Sequence: Synthetic polypeptide
FEEEIRTTNPVATEQYGSVCSMPNPTLVHSEEQDFDI

SEQ ID NO: 161556 - protein, 29 aa, Artificial Sequence
  Description of Artificial Sequence: Synthetic peptide
QESEIASTNPVGTEGYGVMMASQLQHGDI

SEQ ID NO: 161557 - protein, 39 aa, Artificial Sequence
  Description of Artificial Sequence: Synthetic polypeptide
DEEEIRTTNPVATESYGTVTNLQSGTISTNTQLQEVGND

SEQ ID NO: 161558 - protein, 32 aa, Artificial Sequence
  Description of Artificial Sequence: Synthetic polypeptide
DENEIKTTNPVSTEPYGTISMEDIDQQQNGNH

SEQ ID NO: 161559 - protein, 36 aa, Artificial Sequence
  Description of Artificial Sequence: Synthetic polypeptide
DEEEIRTTNPVATEQYGSVDNPLIVLNLNNFVQEDE

SEQ ID NO: 161560 - protein, 39 aa, Artificial Sequence
  Description of Artificial Sequence: Synthetic polypeptide
DEEEIRTTNPVATEQYGVVSTVNNNNTEQGSEAGGNTED

SEQ ID NO: 161561 - protein, 35 aa, Artificial Sequence
  Description of Artificial Sequence: Synthetic polypeptide
DEEEIRTTNPVATEQYGSVDNPPIVVNNNFVAEDI

SEQ ID NO: 161562 - protein, 38 aa, Artificial Sequence
  Description of Artificial Sequence: Synthetic polypeptide
DEEEIRTTNPVATEQYGVVSTVNNNNQQQGTEEETEDS

SEQ ID NO: 161563 - protein, 34 aa, Artificial Sequence
  Description of Artificial Sequence: Synthetic polypeptide
DEAEIRTTNPVAIEWYGSVSSQINDEFSINMISD

SEQ ID NO: 161564 - protein, 32 aa, Artificial Sequence
  Description of Artificial Sequence: Synthetic polypeptide
DENEIKTTNPVSTEPYGTISMEDIQQQQNGNH

SEQ ID NO: 161565 - protein, 36 aa, Artificial Sequence
  Description of Artificial Sequence: Synthetic polypeptide
DEEEIRTTNPVATEQYGSVDNPRAVQNLNNFVAEDE

SEQ ID NO: 161566 - protein, 36 aa, Artificial Sequence
  Description of Artificial Sequence: Synthetic polypeptide
DEGEIATTNPVATEQYGSLVFSATDTLEPHEGPEDT

SEQ ID NO: 161567 - protein, 38 aa, Artificial Sequence
  Description of Artificial Sequence: Synthetic polypeptide
FEEEIRTTNPVATEQYGSVCSHNMDEHEEVQMGEPRIN

SEQ ID NO: 161568 - protein, 35 aa, Artificial Sequence
  Description of Artificial Sequence: Synthetic polypeptide
DEAEIRTTNPVAIEQYGSCSSQINLEFEPINMISK

SEQ ID NO: 161569 - protein, 37 aa, Artificial Sequence
  Description of Artificial Sequence: Synthetic polypeptide
FEEEIRTTNPVATEQYGSVASEAPLMPRDRLAVEENG

SEQ ID NO: 161570 - protein, 36 aa, Artificial Sequence
  Description of Artificial Sequence: Synthetic polypeptide
MEEEIRCTNPVATESYGSVSNGVTGQSGQEGGGNDT

SEQ ID NO: 161571 - protein, 31 aa, Artificial Sequence
  Description of Artificial Sequence: Synthetic polypeptide
DENEIRTTNPVATECWGDVWSEIEMNPAEPI

SEQ ID NO: 161572 - protein, 32 aa, Artificial Sequence
  Description of Artificial Sequence: Synthetic polypeptide
SAEEIATTNPVATAQWGCVAATAGLAAGGNDF

SEQ ID NO: 161573 - protein, 32 aa, Artificial Sequence
  Description of Artificial Sequence: Synthetic polypeptide
SAEEIATTNPVATAQWGCVAANGLPTAGGDNF

SEQ ID NO: 161574 - protein, 37 aa, Artificial Sequence
  Description of Artificial Sequence: Synthetic polypeptide
FEEEIRTTNPVATEQYGQVSTMTNGGDTGDEGNDGGD

SEQ ID NO: 161575 - protein, 31 aa, Artificial Sequence
  Description of Artificial Sequence: Synthetic polypeptide
DENEIRTTNPVATECWGDVWSEIEMNPAEDI

SEQ ID NO: 161576 - protein, 29 aa, Artificial Sequence
  Description of Artificial Sequence: Synthetic peptide
DESEIASTNPVATEGWGVMAETLMNAGDI

SEQ ID NO: 161577 - protein, 36 aa, Artificial Sequence
  Description of Artificial Sequence: Synthetic polypeptide
FEEEIRTTNPVATEQYGQVVTMDNGGDTGQGNDDGD

SEQ ID NO: 161578 - protein, 29 aa, Artificial Sequence
  Description of Artificial Sequence: Synthetic peptide
QESEIASTNPVGTEGYGVMCQSTHQHGDQ

SEQ ID NO: 161579 - protein, 31 aa, Artificial Sequence
  Description of Artificial Sequence: Synthetic polypeptide
DENEIRTTNPVATECWGDVWSEIEMNAAEDI

SEQ ID NO: 161580 - protein, 37 aa, Artificial Sequence
  Description of Artificial Sequence: Synthetic polypeptide
FEEEIRTTNPVATEQYGSAANSPTNPAGAQVQENIVP

SEQ ID NO: 161581 - protein, 35 aa, Artificial Sequence
  Description of Artificial Sequence: Synthetic polypeptide
DEGEIATTNPVATEQYGSSTSAADTLEPQEGEDTG

SEQ ID NO: 161582 - protein, 34 aa, Artificial Sequence
  Description of Artificial Sequence: Synthetic polypeptide
MEEEIRGTNPVATEQWGDSVTGGQLTIGGGNDGQ

SEQ ID NO: 161583 - protein, 34 aa, Artificial Sequence
  Description of Artificial Sequence: Synthetic polypeptide
DEAEIRTTNPVATAQYGSCYSENFQDFHSLEDDN

SEQ ID NO: 161584 - protein, 34 aa, Artificial Sequence
  Description of Artificial Sequence: Synthetic polypeptide
MEEEIRGTNPVATEFYGCVSNTDGGEEEEGGNED

SEQ ID NO: 161585 - protein, 35 aa, Artificial Sequence
  Description of Artificial Sequence: Synthetic polypeptide
DEGEIATTNPVATEQYGSSGSATDTLSEPHEGEDT

SEQ ID NO: 161586 - protein, 35 aa, Artificial Sequence
  Description of Artificial Sequence: Synthetic polypeptide
FEEEIRTTNPVATEQYGSCSPTNAENEVIIEPQDN

SEQ ID NO: 161587 - protein, 36 aa, Artificial Sequence
  Description of Artificial Sequence: Synthetic polypeptide
DEGEIATTNPVATEQYGSSFSATDYLEPHEGTEDTR

SEQ ID NO: 161588 - protein, 32 aa, Artificial Sequence
  Description of Artificial Sequence: Synthetic polypeptide
DESEIASTNPVATECYGVMSCITEQDHEGENG

SEQ ID NO: 161589 - protein, 34 aa, Artificial Sequence
  Description of Artificial Sequence: Synthetic polypeptide
DEGEIATTNPVATEQYGSSFSATDTLEPHEIEDS

SEQ ID NO: 161590 - protein, 35 aa, Artificial Sequence
  Description of Artificial Sequence: Synthetic polypeptide
REQEIATTNPVATEQYGSVSATDLNEDHQGLEDEF

SEQ ID NO: 161591 - protein, 32 aa, Artificial Sequence
  Description of Artificial Sequence: Synthetic polypeptide
QEETIATTNPVATECYGSVIEPVIGTQIGALN

SEQ ID NO: 161592 - protein, 39 aa, Artificial Sequence
  Description of Artificial Sequence: Synthetic polypeptide
DEEEIRTTNPVATEQYGVVSTVNNNQELQQQATTNVATE

SEQ ID NO: 161593 - protein, 32 aa, Artificial Sequence
  Description of Artificial Sequence: Synthetic polypeptide
RENEIRTTNPVSTEPYGTISMEDIYQQQNGNH

SEQ ID NO: 161594 - protein, 35 aa, Artificial Sequence
  Description of Artificial Sequence: Synthetic polypeptide
FEEEIRTTNPVATEQYGSTPQPPINWEPLNEEELR

SEQ ID NO: 161595 - protein, 30 aa, Artificial Sequence
  Description of Artificial Sequence: Synthetic polypeptide
QESEIASTNPVGTEGYGVMHASTLQHTGDI

SEQ ID NO: 161596 - protein, 34 aa, Artificial Sequence
  Description of Artificial Sequence: Synthetic polypeptide
DEAEIRTTNPVATAQYGSCYSENFQLDFASLEDN

SEQ ID NO: 161597 - protein, 36 aa, Artificial Sequence
  Description of Artificial Sequence: Synthetic polypeptide
FEEEIRTTNPVATEQYGSCSLCANEEIMQLGPESVQ

SEQ ID NO: 161598 - protein, 38 aa, Artificial Sequence
  Description of Artificial Sequence: Synthetic polypeptide
AEEEIRTTNPVATEQYGSVSTVTQNNMEQGTNNATNEN

SEQ ID NO: 161599 - protein, 31 aa, Artificial Sequence
  Description of Artificial Sequence: Synthetic polypeptide
DDSEVASTNPVSTEPYGNVAANTIQQRVGNH

SEQ ID NO: 161600 - protein, 33 aa, Artificial Sequence
  Description of Artificial Sequence: Synthetic polypeptide
QEEVIACTNPVATEQWGSVAMNNNQTAGGPNSK

SEQ ID NO: 161601 - protein, 36 aa, Artificial Sequence
  Description of Artificial Sequence: Synthetic polypeptide
MEEEIRATNPAATEQYGSVSITTGLGDQGGGGGQET

SEQ ID NO: 161602 - protein, 32 aa, Artificial Sequence
  Description of Artificial Sequence: Synthetic polypeptide
DENEILTTNPVSTEPYGTISMEDIQQQQNGNH

SEQ ID NO: 161603 - protein, 31 aa, Artificial Sequence
  Description of Artificial Sequence: Synthetic polypeptide
DENEIMTTNPVATEQWGDVSEGIEMNAAEDA

SEQ ID NO: 161604 - protein, 31 aa, Artificial Sequence
  Description of Artificial Sequence: Synthetic polypeptide
DENEIRTTNPVATECWGDVSEEIEANAAEPA

SEQ ID NO: 161605 - protein, 31 aa, Artificial Sequence
  Description of Artificial Sequence: Synthetic polypeptide
DENEIMTTNPVATEQWGDVSEHIEMNAAEDA

SEQ ID NO: 161606 - protein, 39 aa, Artificial Sequence
  Description of Artificial Sequence: Synthetic polypeptide
DEEEIRTTNPVATEQYGSVVTNSLNQNMGELEQAVVPTA

SEQ ID NO: 161607 - protein, 30 aa, Artificial Sequence
  Description of Artificial Sequence: Synthetic polypeptide
QESEIASTNPVGTEGYGVMPASTLQHGDIW

SEQ ID NO: 161608 - protein, 37 aa, Artificial Sequence
  Description of Artificial Sequence: Synthetic polypeptide
DDEEIRTTNPVATEQYGSVNSTMDIQTGEIGGEEEGG

SEQ ID NO: 161609 - protein, 38 aa, Artificial Sequence
  Description of Artificial Sequence: Synthetic polypeptide
AEEEIRTTNPVATEQYGVVSTVVTDGGNNQLGGNNDDE

SEQ ID NO: 161610 - protein, 37 aa, Artificial Sequence
  Description of Artificial Sequence: Synthetic polypeptide
AEEEIRTTNPVATEQYGVVSTVVTDGGNTNLGGNNDD

SEQ ID NO: 161611 - protein, 37 aa, Artificial Sequence
  Description of Artificial Sequence: Synthetic polypeptide
AEEEIRTTNPVATEQYGVVSTVVTDGGTNLGGNNDDG

SEQ ID NO: 161612 - protein, 31 aa, Artificial Sequence
  Description of Artificial Sequence: Synthetic polypeptide
DDSEVASTNPVSTEPYGNVAANTIQSRVGQR

SEQ ID NO: 161613 - protein, 32 aa, Artificial Sequence
  Description of Artificial Sequence: Synthetic polypeptide
DENEILTTNPVSTEPYGTISMADIQQQQNGNH

SEQ ID NO: 161614 - protein, 36 aa, Artificial Sequence
  Description of Artificial Sequence: Synthetic polypeptide
FEEEIRTTNPVATEQYGSVIGPTNNLLNMPLEIEDN

SEQ ID NO: 161615 - protein, 36 aa, Artificial Sequence
  Description of Artificial Sequence: Synthetic polypeptide
FEEEIRTTNPVATEQYGSVIMTGIGLGENEEEQEGG

SEQ ID NO: 161616 - protein, 36 aa, Artificial Sequence
  Description of Artificial Sequence: Synthetic polypeptide
FEEEIRTTNPVATEQYGSVIMTGIGLGENENGQEGF

SEQ ID NO: 161617 - protein, 37 aa, Artificial Sequence
  Description of Artificial Sequence: Synthetic polypeptide
AEEEIRTTNPVATEQYGSVSTVTSNNSEQGTTTDEED

SEQ ID NO: 161618 - protein, 36 aa, Artificial Sequence
  Description of Artificial Sequence: Synthetic polypeptide
FEEEIRTTNPVATEQYGSVINIMNNTGQQGEDGEGQ

SEQ ID NO: 161619 - protein, 35 aa, Artificial Sequence
  Description of Artificial Sequence: Synthetic polypeptide
FEEEIRTTNPVATEQYGSVINIMNVGPGGEDEFGG

SEQ ID NO: 161620 - protein, 36 aa, Artificial Sequence
  Description of Artificial Sequence: Synthetic polypeptide
DEECISTTNPVATEQYGCVCSNTEHNEENFGSDNQP

SEQ ID NO: 161621 - protein, 34 aa, Artificial Sequence
  Description of Artificial Sequence: Synthetic polypeptide
QEEVIACTNPVATEQYGSVSMNNSEQLAEGPGEN

SEQ ID NO: 161622 - protein, 36 aa, Artificial Sequence
  Description of Artificial Sequence: Synthetic polypeptide
FEEEIRTTNPVATEQYGSVIQQPPLVIQPEQNLDNL

SEQ ID NO: 161623 - protein, 38 aa, Artificial Sequence
  Description of Artificial Sequence: Synthetic polypeptide
FEEEIRTTNPVATEQYGSVIQSTSNVQQQQNVLSMVGE

SEQ ID NO: 161624 - protein, 36 aa, Artificial Sequence
  Description of Artificial Sequence: Synthetic polypeptide
FEEEIRTTNPVATEQYGSVIRPPNMEQQEIPQVNTE

SEQ ID NO: 161625 - protein, 38 aa, Artificial Sequence
  Description of Artificial Sequence: Synthetic polypeptide
AEEEIRTTNPVATEQYGVVSTVVTTNNNQQLGGNNQQE

SEQ ID NO: 161626 - protein, 37 aa, Artificial Sequence
  Description of Artificial Sequence: Synthetic polypeptide
FEEEIRTTNPVATEQYGSVISEAPLMPHDRLVVEENG

SEQ ID NO: 161627 - protein, 37 aa, Artificial Sequence
  Description of Artificial Sequence: Synthetic polypeptide
AEEEIRTTNPVATEQYGVVSTVVTEGGNNLGGNNDDM

SEQ ID NO: 161628 - protein, 35 aa, Artificial Sequence
  Description of Artificial Sequence: Synthetic polypeptide
DEEEIRTTNPVATEQYGSVDNPRHVLNNNIVAEDI

SEQ ID NO: 161629 - protein, 38 aa, Artificial Sequence
  Description of Artificial Sequence: Synthetic polypeptide
DDEEIRTTNPVATEQYGSVNSTTSGNMDQNDNGGGIQG

SEQ ID NO: 161630 - protein, 37 aa, Artificial Sequence
  Description of Artificial Sequence: Synthetic polypeptide
AEEEIRTTNPVATEQYGSVSTVTQQLNDNEEIGTTDD

SEQ ID NO: 161631 - protein, 32 aa, Artificial Sequence
  Description of Artificial Sequence: Synthetic polypeptide
DENEIKTTNPVSTEPYGTISMEDIQQQQNGNK

SEQ ID NO: 161632 - protein, 38 aa, Artificial Sequence
  Description of Artificial Sequence: Synthetic polypeptide
FEEEIRTTNPVATEQYGSVFSPPTNMEQQEIPQFNTEN

SEQ ID NO: 161633 - protein, 34 aa, Artificial Sequence
  Description of Artificial Sequence: Synthetic polypeptide
DEMCIATTNPVATEQYGTVCSATDGDPVEFEGND

SEQ ID NO: 161634 - protein, 36 aa, Artificial Sequence
  Description of Artificial Sequence: Synthetic polypeptide
FEEEIRTTNPVATEQYGSVGDFGNDGQENDDQNDGT

SEQ ID NO: 161635 - protein, 35 aa, Artificial Sequence
  Description of Artificial Sequence: Synthetic polypeptide
DEEEIRTTNPVATEGYGQCAVCSSGEHQNFNSNQS

SEQ ID NO: 161636 - protein, 36 aa, Artificial Sequence
  Description of Artificial Sequence: Synthetic polypeptide
FEEEIRTTNPVATEQYGSVGEPTQLDSSFENEQLTM

SEQ ID NO: 161637 - protein, 35 aa, Artificial Sequence
  Description of Artificial Sequence: Synthetic polypeptide
DEEEIRTTNPVATEGYGQCAVCSTGEHANFNSDQS

SEQ ID NO: 161638 - protein, 37 aa, Artificial Sequence
  Description of Artificial Sequence: Synthetic polypeptide
AEEEIRTTNPVATEQYGVVSTVVNQGNNNDEGGNVSD

SEQ ID NO: 161639 - protein, 37 aa, Artificial Sequence
  Description of Artificial Sequence: Synthetic polypeptide
FEEEIRTTNPVATEQYGSVGLEPSQLQNSRTNETENV

SEQ ID NO: 161640 - protein, 31 aa, Artificial Sequence
  Description of Artificial Sequence: Synthetic polypeptide
DENEIRTTNPVATECWGDVSEEIEMNAAEDA

SEQ ID NO: 161641 - protein, 38 aa, Artificial Sequence
  Description of Artificial Sequence: Synthetic polypeptide
AEEEIRTTNPVATEQYGSVSTVTQNNMEQGTTNVATET

SEQ ID NO: 161642 - protein, 30 aa, Artificial Sequence
  Description of Artificial Sequence: Synthetic polypeptide
QESEIASTNPVGTEGYGVMNASTLMQHGDI

SEQ ID NO: 161643 - protein, 38 aa, Artificial Sequence
  Description of Artificial Sequence: Synthetic polypeptide
AEEEIRTTNPVATEQYGSVSTVTQNNQQNGTEAGVEDD

SEQ ID NO: 161644 - protein, 38 aa, Artificial Sequence
  Description of Artificial Sequence: Synthetic polypeptide
AEEEIRTTNPVATEQYGSVSTVTQNNSEQGTNNTTTEM

SEQ ID NO: 161645 - protein, 35 aa, Artificial Sequence
  Description of Artificial Sequence: Synthetic polypeptide
DEASIATTNPVAYECWGSVSTGNGLNMNDQGGNEV

SEQ ID NO: 161646 - protein, 37 aa, Artificial Sequence
  Description of Artificial Sequence: Synthetic polypeptide
DDEEIRTTNPVATEQYGSVQSTMDITNGEGGGEEEGY

SEQ ID NO: 161647 - protein, 37 aa, Artificial Sequence
  Description of Artificial Sequence: Synthetic polypeptide
DDEEIRTTNPVATEQYGSVQSTMDIQNGEGGGEEEQG

SEQ ID NO: 161648 - protein, 38 aa, Artificial Sequence
  Description of Artificial Sequence: Synthetic polypeptide
AEEEIRTTNPVATEQYGSVSTVTQNNSEQGTTNVTEES

SEQ ID NO: 161649 - protein, 38 aa, Artificial Sequence
  Description of Artificial Sequence: Synthetic polypeptide
AEEEIRTTNPVATEQYGSVSTVTQNNTEQGTNNVATEA

SEQ ID NO: 161650 - protein, 38 aa, Artificial Sequence
  Description of Artificial Sequence: Synthetic polypeptide
AEEEIRTTNPVATEQYGSVSTVTQNNTEQGTNNVTEED

SEQ ID NO: 161651 - protein, 38 aa, Artificial Sequence
  Description of Artificial Sequence: Synthetic polypeptide
AEEEIRTTNPVATEQYGSVSTVTQNNVEQGTVNVTEEN

SEQ ID NO: 161652 - protein, 34 aa, Artificial Sequence
  Description of Artificial Sequence: Synthetic polypeptide
MEEEIRATNPVATEQYGMSSNMNIADDGGGNEEI

SEQ ID NO: 161653 - protein, 35 aa, Artificial Sequence
  Description of Artificial Sequence: Synthetic polypeptide
MEEEIRATNPVATEQYGAVSDNDNMDNGGGGQNLS

SEQ ID NO: 161654 - protein, 30 aa, Artificial Sequence
  Description of Artificial Sequence: Synthetic polypeptide
QESEIASTNPVGTEGYGVMPASTLQHFGDI

SEQ ID NO: 161655 - protein, 38 aa, Artificial Sequence
  Description of Artificial Sequence: Synthetic polypeptide
AEEEIRTTNPVATEQYGSVSTVTQNTNEQGTVNVATED

SEQ ID NO: 161656 - protein, 38 aa, Artificial Sequence
  Description of Artificial Sequence: Synthetic polypeptide
AEEEIRTTNPVATEQYGSVSTVTQPGNEQGTTNVATED

SEQ ID NO: 161657 - protein, 34 aa, Artificial Sequence
  Description of Artificial Sequence: Synthetic polypeptide
QEEVIACTNPVATEQYGSVAMNNSEQTAGNPNSN

SEQ ID NO: 161658 - protein, 32 aa, Artificial Sequence
  Description of Artificial Sequence: Synthetic polypeptide
DENEIMTTNPVSTEPYGTISMEDIQQQQNGNH

SEQ ID NO: 161659 - protein, 35 aa, Artificial Sequence
  Description of Artificial Sequence: Synthetic polypeptide
DEATEIATTNPVAYEQWGSVSGPNAGNQGGGNGDH

SEQ ID NO: 161660 - protein, 36 aa, Artificial Sequence
  Description of Artificial Sequence: Synthetic polypeptide
MEEEIRTTNPVATEQYGAVDIDTNMNLEGGGDQDIT

SEQ ID NO: 161661 - protein, 32 aa, Artificial Sequence
  Description of Artificial Sequence: Synthetic polypeptide
SDECIATTNPVATEQWGGVCSTWEDHQQQVNA

SEQ ID NO: 161662 - protein, 30 aa, Artificial Sequence
  Description of Artificial Sequence: Synthetic polypeptide
QESEIASTNPVGTEGYGVMASTLQPHTGDI

SEQ ID NO: 161663 - protein, 34 aa, Artificial Sequence
  Description of Artificial Sequence: Synthetic polypeptide
DEEEIATTNPVATEQYGSVCAMTGVEEVMDMSEG

SEQ ID NO: 161664 - protein, 38 aa, Artificial Sequence
  Description of Artificial Sequence: Synthetic polypeptide
DEEEIRTTNPVATEQYGSAVGMPWTNLENTTQQEELFQ

SEQ ID NO: 161665 - protein, 36 aa, Artificial Sequence
  Description of Artificial Sequence: Synthetic polypeptide
DEECVRTTNPIAYEQYGCTVVSCLNLSPQTGGNYRD

SEQ ID NO: 161666 - protein, 31 aa, Artificial Sequence
  Description of Artificial Sequence: Synthetic polypeptide
DDSEVASTNPVSTEGYGVVAANTIQSRVGQR

SEQ ID NO: 161667 - protein, 36 aa, Artificial Sequence
  Description of Artificial Sequence: Synthetic polypeptide
DDEEIRTTNPVATEQYGSVVQTGPEAVEQGGGGGET

SEQ ID NO: 161668 - protein, 36 aa, Artificial Sequence
  Description of Artificial Sequence: Synthetic polypeptide
DDEEIRTTNPVATEQYGSVVQTDPEMEVQDQGGTET

SEQ ID NO: 161669 - protein, 31 aa, Artificial Sequence
  Description of Artificial Sequence: Synthetic polypeptide
CEGEIAPTNPCSYEQYGKVSANLSGSGGTNP

SEQ ID NO: 161670 - protein, 37 aa, Artificial Sequence
  Description of Artificial Sequence: Synthetic polypeptide
MEEEIRTTNPVATEQYGSVSLLMTSADESLEMQSDTT

SEQ ID NO: 161671 - protein, 32 aa, Artificial Sequence
  Description of Artificial Sequence: Synthetic polypeptide
CEGEIAPTNPCSYEQYGKVCCGNLSQSGGTNR

SEQ ID NO: 161672 - protein, 31 aa, Artificial Sequence
  Description of Artificial Sequence: Synthetic polypeptide
DESEIASTNPVGTEGYGVMSASALPQHGMDI

SEQ ID NO: 161673 - protein, 36 aa, Artificial Sequence
  Description of Artificial Sequence: Synthetic polypeptide
DDEEIRTTNPVATEQYGSVVPTDPEMDEQGGGGGEG

SEQ ID NO: 161674 - protein, 30 aa, Artificial Sequence
  Description of Artificial Sequence: Synthetic polypeptide
QESEIASTNPVGTEGYGVMASTLQPHGDIE

SEQ ID NO: 161675 - protein, 36 aa, Artificial Sequence
  Description of Artificial Sequence: Synthetic polypeptide
DEAEIATTNPVATEIYGSVCSNWNDGQDRQGQGGED

SEQ ID NO: 161676 - protein, 34 aa, Artificial Sequence
  Description of Artificial Sequence: Synthetic polypeptide
DEQEIRTTNPVAYESYGSVCCSGGQSDTEGGERL

SEQ ID NO: 161677 - protein, 38 aa, Artificial Sequence
  Description of Artificial Sequence: Synthetic polypeptide
DEETIRTTNPVATEQYGVVSVVVSTNNNNDQQGDEEDE

SEQ ID NO: 161678 - protein, 37 aa, Artificial Sequence
  Description of Artificial Sequence: Synthetic polypeptide
DEIEIRTTNPVATEQYGSYCVPSIAEVEPNDLQLFRQ

SEQ ID NO: 161679 - protein, 32 aa, Artificial Sequence
  Description of Artificial Sequence: Synthetic polypeptide
CEGEIAPTNPCSYEQWGKVSCDNLSQSGGTNR

SEQ ID NO: 161680 - protein, 37 aa, Artificial Sequence
  Description of Artificial Sequence: Synthetic polypeptide
SEAEIRTTNPVATEQYGSVSTMEDCLMQPGYSQEPID

SEQ ID NO: 161681 - protein, 38 aa, Artificial Sequence
  Description of Artificial Sequence: Synthetic polypeptide
DEEEIRTTNPVATEQYGSAVMPVMLQLDDIRPQVNEDL

SEQ ID NO: 161682 - protein, 34 aa, Artificial Sequence
  Description of Artificial Sequence: Synthetic polypeptide
SEAEIRTTNPVATEQYGSVNNIETLWEGGSEESG

SEQ ID NO: 161683 - protein, 30 aa, Artificial Sequence
  Description of Artificial Sequence: Synthetic polypeptide
QESEIASTNPVGTEGYGVMASTLQQHGMDI

SEQ ID NO: 161684 - protein, 36 aa, Artificial Sequence
  Description of Artificial Sequence: Synthetic polypeptide
DEEEIRTTNPVATEQYGSVDEMVWELVPITQGEEEV

SEQ ID NO: 161685 - protein, 36 aa, Artificial Sequence
  Description of Artificial Sequence: Synthetic polypeptide
DDEEIRTTNPVATEQYGSVVNTDPEMVEQGGGGGGT

SEQ ID NO: 161686 - protein, 35 aa, Artificial Sequence
  Description of Artificial Sequence: Synthetic polypeptide
SEAEIRTTNPVATEQYGSVCTPPCSETGYMEDMND

SEQ ID NO: 161687 - protein, 30 aa, Artificial Sequence
  Description of Artificial Sequence: Synthetic polypeptide
QESEIASTNPVGTEGYGVMASTLQQHNGDI

SEQ ID NO: 161688 - protein, 30 aa, Artificial Sequence
  Description of Artificial Sequence: Synthetic polypeptide
DESEIASTNPVGTEGYGVMSASALNHGMDV

SEQ ID NO: 161689 - protein, 31 aa, Artificial Sequence
  Description of Artificial Sequence: Synthetic polypeptide
DENEIATVNPVSTEPYGTISMDIQQQQNGNQ

SEQ ID NO: 161690 - protein, 38 aa, Artificial Sequence
  Description of Artificial Sequence: Synthetic polypeptide
AEEEIRTTNPVATEQYGVVSTVTNNNLGGTEQGTNQGQ

SEQ ID NO: 161691 - protein, 39 aa, Artificial Sequence
  Description of Artificial Sequence: Synthetic polypeptide
DEEEIRTTNPVATEQYGSAVDSPWTNQNEEFLEQHVTEE

SEQ ID NO: 161692 - protein, 39 aa, Artificial Sequence
  Description of Artificial Sequence: Synthetic polypeptide
DEETIRTTNPVATEQYGVVSTVVSTNNNLNQNEGDEEDE

SEQ ID NO: 161693 - protein, 30 aa, Artificial Sequence
  Description of Artificial Sequence: Synthetic polypeptide
DENEIATTNPVSTEQWGDVSEIEMNAAEDA

SEQ ID NO: 161694 - protein, 29 aa, Artificial Sequence
  Description of Artificial Sequence: Synthetic peptide
EEVEIATTNPVAYECWGCVYECLQHQEAD

SEQ ID NO: 161695 - protein, 30 aa, Artificial Sequence
  Description of Artificial Sequence: Synthetic polypeptide
DESEIASTNPVGTEGYGVTWASTWAEHGDI

SEQ ID NO: 161696 - protein, 36 aa, Artificial Sequence
  Description of Artificial Sequence: Synthetic polypeptide
DEEEIRTTNPVATEGYGMVNNIGMGNLDENNGGNQQ

SEQ ID NO: 161697 - protein, 31 aa, Artificial Sequence
  Description of Artificial Sequence: Synthetic polypeptide
DESEIASTNPVGTEGYGVMWASETLQEHGDI

SEQ ID NO: 161698 - protein, 30 aa, Artificial Sequence
  Description of Artificial Sequence: Synthetic polypeptide
DESEIASTNPVGTEGYGVMSSSALNHGMDV

SEQ ID NO: 161699 - protein, 30 aa, Artificial Sequence
  Description of Artificial Sequence: Synthetic polypeptide
DESEIASTNPVGTEGYGVMSSSAGNHGMNV

SEQ ID NO: 161700 - protein, 30 aa, Artificial Sequence
  Description of Artificial Sequence: Synthetic polypeptide
SECEICATNPCTTEIYGVVSTSTLLNGTDI

SEQ ID NO: 161701 - protein, 38 aa, Artificial Sequence
  Description of Artificial Sequence: Synthetic polypeptide
DEETIRTTNPVATEQYGVVSTVVSTNNNNQEQGEEEDE

SEQ ID NO: 161702 - protein, 30 aa, Artificial Sequence
  Description of Artificial Sequence: Synthetic polypeptide
QESEIASTNPVGTEGYGVMASTLQNHAGDI

SEQ ID NO: 161703 - protein, 38 aa, Artificial Sequence
  Description of Artificial Sequence: Synthetic polypeptide
DEETIRTTNPVATEQYGVVSTVVSTNNNNQQQGDEEDE

SEQ ID NO: 161704 - protein, 38 aa, Artificial Sequence
  Description of Artificial Sequence: Synthetic polypeptide
AEEEIRTTNPVATEQYGVVSTVTNNNANQQGNNNQQQD

SEQ ID NO: 161705 - protein, 38 aa, Artificial Sequence
  Description of Artificial Sequence: Synthetic polypeptide
DEETIRTTNPVATEQYGVVSTVVSTNNNNQQQGTEEDE

SEQ ID NO: 161706 - protein, 30 aa, Artificial Sequence
  Description of Artificial Sequence: Synthetic polypeptide
SECEICATNPCTTEIYGVVATTSTLQNGDG

SEQ ID NO: 161707 - protein, 38 aa, Artificial Sequence
  Description of Artificial Sequence: Synthetic polypeptide
DEEEIRTTNPVATEQYGVVSTVNNNQQNNQQIGTTEDE

SEQ ID NO: 161708 - protein, 31 aa, Artificial Sequence
  Description of Artificial Sequence: Synthetic polypeptide
DDSEVASTNPVSTEGYGVVAANTIQSRIGQR

SEQ ID NO: 161709 - protein, 31 aa, Artificial Sequence
  Description of Artificial Sequence: Synthetic polypeptide
SECEICATNPCTTEIYGVVATSTLQNGNDTI

SEQ ID NO: 161710 - protein, 32 aa, Artificial Sequence
  Description of Artificial Sequence: Synthetic polypeptide
DDSEVASTNPVSTEGYGVVAANTIQSRVGQNR

SEQ ID NO: 161711 - protein, 30 aa, Artificial Sequence
  Description of Artificial Sequence: Synthetic polypeptide
SECEICATNPCTTEIYGVVATSTLQNGEDT

SEQ ID NO: 161712 - protein, 30 aa, Artificial Sequence
  Description of Artificial Sequence: Synthetic polypeptide
SECEICATNPCTTEIYGVVATSTLQNGDET

SEQ ID NO: 161713 - protein, 33 aa, Artificial Sequence
  Description of Artificial Sequence: Synthetic polypeptide
SECEIATTNPVAYEGWGSVVCNDLQGDTGGNEG

SEQ ID NO: 161714 - protein, 31 aa, Artificial Sequence
  Description of Artificial Sequence: Synthetic polypeptide
DESEIASTNPVGTEGYGVMSCITLQDHGEDI

SEQ ID NO: 161715 - protein, 34 aa, Artificial Sequence
  Description of Artificial Sequence: Synthetic polypeptide
DAEEIATTNPVAYEQWGSTTAGTNLTTAEGGNDE

SEQ ID NO: 161716 - protein, 38 aa, Artificial Sequence
  Description of Artificial Sequence: Synthetic polypeptide
DEEEIRTTNPVATEQYGSAVDSPWNQEEENLEQHVHEE

SEQ ID NO: 161717 - protein, 34 aa, Artificial Sequence
  Description of Artificial Sequence: Synthetic polypeptide
DAEEIATTNPVAYEQWGHSVSVTGDIGQHMIAER

SEQ ID NO: 161718 - protein, 38 aa, Artificial Sequence
  Description of Artificial Sequence: Synthetic polypeptide
DEETIRTTNPVATEQYGVVSTVVSTNNNQQQIGTEEDE

SEQ ID NO: 161719 - protein, 29 aa, Artificial Sequence
  Description of Artificial Sequence: Synthetic peptide
EEVEIATTNPVAYECWGCVYECLQHEEDA

SEQ ID NO: 161720 - protein, 34 aa, Artificial Sequence
  Description of Artificial Sequence: Synthetic polypeptide
SEAEIRTTNPVATEQYGSITTMQDDNTTEGEDTD

SEQ ID NO: 161721 - protein, 31 aa, Artificial Sequence
  Description of Artificial Sequence: Synthetic polypeptide
DENEIATVNPVSTEPYGVISMDIQQQQNGNQ

SEQ ID NO: 161722 - protein, 37 aa, Artificial Sequence
  Description of Artificial Sequence: Synthetic polypeptide
DEEEIRTTNPVATEQYGSAVQPWMQEEEFLEQHVGEE

SEQ ID NO: 161723 - protein, 36 aa, Artificial Sequence
  Description of Artificial Sequence: Synthetic polypeptide
DDEEIRTTNPVATEQYGSVVDIMQNGEGTTNNEGDG

SEQ ID NO: 161724 - protein, 32 aa, Artificial Sequence
  Description of Artificial Sequence: Synthetic polypeptide
EIEEIRTTNPVAYEQWGSVAWNENDNHNGGEM

SEQ ID NO: 161725 - protein, 34 aa, Artificial Sequence
  Description of Artificial Sequence: Synthetic polypeptide
DECEIATTNPVATEHWGSVCYNNDDQDHGGQDRD

SEQ ID NO: 161726 - protein, 37 aa, Artificial Sequence
  Description of Artificial Sequence: Synthetic polypeptide
DEEEIRTTNPVATEQYGSAVQPWNQEEEFLEQEISEE

SEQ ID NO: 161727 - protein, 34 aa, Artificial Sequence
  Description of Artificial Sequence: Synthetic polypeptide
DEAEIATTNPVATEPWGISVCSYSPVSQMGGANG

SEQ ID NO: 161728 - protein, 36 aa, Artificial Sequence
  Description of Artificial Sequence: Synthetic polypeptide
EITEIATTNPVATEQYGSVVITNDQDDDRTGGDGSR

SEQ ID NO: 161729 - protein, 38 aa, Artificial Sequence
  Description of Artificial Sequence: Synthetic polypeptide
MEEEIRTTNPVATEQYGSVNDDTNNMQENEMGVNEEFN

SEQ ID NO: 161730 - protein, 36 aa, Artificial Sequence
  Description of Artificial Sequence: Synthetic polypeptide
DEAEIRTTNPVATECYGSVSTATNGEEPNNVQEDHN

SEQ ID NO: 161731 - protein, 37 aa, Artificial Sequence
  Description of Artificial Sequence: Synthetic polypeptide
DEEEIRTTNPVATEQYGSAVQPWNQEIEILEQHVQEV

SEQ ID NO: 161732 - protein, 36 aa, Artificial Sequence
  Description of Artificial Sequence: Synthetic polypeptide
ENAEIATTNPVATEQYGSVSWTDNHQQNDRQGGDSP

SEQ ID NO: 161733 - protein, 37 aa, Artificial Sequence
  Description of Artificial Sequence: Synthetic polypeptide
DEEEIRTTNPVATEQYGSVSALNVDNDGDIFQEEMLI

SEQ ID NO: 161734 - protein, 37 aa, Artificial Sequence
  Description of Artificial Sequence: Synthetic polypeptide
DDEEIRTTNPVATEQYGSVVDIMQNGQGGATNNTGDG

SEQ ID NO: 161735 - protein, 37 aa, Artificial Sequence
  Description of Artificial Sequence: Synthetic polypeptide
AEEEIRTTNPVATEQYGSVSTVTNNSEQGSTEEEDDD

SEQ ID NO: 161736 - protein, 37 aa, Artificial Sequence
  Description of Artificial Sequence: Synthetic polypeptide
DDEEIRTTNPVATEQYGSVVDGTINMVDEGEEGNTTD

SEQ ID NO: 161737 - protein, 30 aa, Artificial Sequence
  Description of Artificial Sequence: Synthetic polypeptide
DENEICTTNPVATEQWGDVQEIEMNAAEDA

SEQ ID NO: 161738 - protein, 33 aa, Artificial Sequence
  Description of Artificial Sequence: Synthetic polypeptide
DECEIATTNPVATEHWGSVCYNNDDQDHGDTDT

SEQ ID NO: 161739 - protein, 37 aa, Artificial Sequence
  Description of Artificial Sequence: Synthetic polypeptide
MEEEIRTTNPVATEQYGSVMSDNGNQGQTNDNGQGDT

SEQ ID NO: 161740 - protein, 36 aa, Artificial Sequence
  Description of Artificial Sequence: Synthetic polypeptide
SEAEICTTNPVATECYGVVSTGNGLLDDDRGQNMES

SEQ ID NO: 161741 - protein, 36 aa, Artificial Sequence
  Description of Artificial Sequence: Synthetic polypeptide
SEAEICTTNPVATECYGTVSTGNGLLDDDRGQNDET

SEQ ID NO: 161742 - protein, 34 aa, Artificial Sequence
  Description of Artificial Sequence: Synthetic polypeptide
ENEAEIATTNPVAYEQWGCVSTTNHNNDAGDNDR

SEQ ID NO: 161743 - protein, 35 aa, Artificial Sequence
  Description of Artificial Sequence: Synthetic polypeptide
SEAEICTTNPVATECYGEVSTGVGGGQNRGGGNEV

SEQ ID NO: 161744 - protein, 36 aa, Artificial Sequence
  Description of Artificial Sequence: Synthetic polypeptide
MEEEIRTTNPVATEQYGSVMGVVNGQQDQEGEDEIV

SEQ ID NO: 161745 - protein, 35 aa, Artificial Sequence
  Description of Artificial Sequence: Synthetic polypeptide
DEEVEIATTNPVAYEPWGSVYCTDNHQQQQGGNND

SEQ ID NO: 161746 - protein, 36 aa, Artificial Sequence
  Description of Artificial Sequence: Synthetic polypeptide
DEEEIRTTNPVATEQYGSAVSAPSGIQQLSVEELCF

SEQ ID NO: 161747 - protein, 33 aa, Artificial Sequence
  Description of Artificial Sequence: Synthetic polypeptide
ENEEIATTNPVATTQWGNVAKTWNPNEQGQNDR

SEQ ID NO: 161748 - protein, 36 aa, Artificial Sequence
  Description of Artificial Sequence: Synthetic polypeptide
MEEEIRTTNPVATEQYGSVMSNNVEFFGEGEEDGDV

SEQ ID NO: 161749 - protein, 33 aa, Artificial Sequence
  Description of Artificial Sequence: Synthetic polypeptide
SEAEIRTTNPVATEQYGSITTMQDDETTEGDED

SEQ ID NO: 161750 - protein, 34 aa, Artificial Sequence
  Description of Artificial Sequence: Synthetic polypeptide
DECEIATTNPVATEHWGSVCYNNDDQDHNGRNDA

SEQ ID NO: 161751 - protein, 36 aa, Artificial Sequence
  Description of Artificial Sequence: Synthetic polypeptide
DDEEIRTTNPVATEQYGSVVDLMDDTDQLEDQTEGP

SEQ ID NO: 161752 - protein, 38 aa, Artificial Sequence
  Description of Artificial Sequence: Synthetic polypeptide
AEEEIRTTNPVATEQYGVVSTVTNNNQNQQGNGNNNSE

SEQ ID NO: 161753 - protein, 38 aa, Artificial Sequence
  Description of Artificial Sequence: Synthetic polypeptide
AEEEIRTTNPVATEQYGVVSTVTNNNQQNQEQGTNVVD

SEQ ID NO: 161754 - protein, 36 aa, Artificial Sequence
  Description of Artificial Sequence: Synthetic polypeptide
MEEEIRTTNPVATEQYGSVQVITMGEEQPEGEVPEI

SEQ ID NO: 161755 - protein, 30 aa, Artificial Sequence
  Description of Artificial Sequence: Synthetic polypeptide
DDSEVASTNPVSTEGYGVVAANTIQSSGQR

SEQ ID NO: 161756 - protein, 34 aa, Artificial Sequence
  Description of Artificial Sequence: Synthetic polypeptide
SEAEIRTTNPVATEQYGCVCSTGEHNQNFPSDQA

SEQ ID NO: 161757 - protein, 34 aa, Artificial Sequence
  Description of Artificial Sequence: Synthetic polypeptide
SEAEIRTTNPVATEQYGCMNTSVLETTQPENKEA

SEQ ID NO: 161758 - protein, 37 aa, Artificial Sequence
  Description of Artificial Sequence: Synthetic polypeptide
MEEEIRTTNPVATEQYGSVPSLLMTADEHLVMQSDTT

SEQ ID NO: 161759 - protein, 36 aa, Artificial Sequence
  Description of Artificial Sequence: Synthetic polypeptide
DEEEIRTTNPVATEQYGSVDEPIKGLQPEMMEAEEN

SEQ ID NO: 161760 - protein, 34 aa, Artificial Sequence
  Description of Artificial Sequence: Synthetic polypeptide
EGEEIATTNPVAYEQWGSVYWNEQGDPRSGGKTR

SEQ ID NO: 161761 - protein, 38 aa, Artificial Sequence
  Description of Artificial Sequence: Synthetic polypeptide
AEEEIRTTNPVATEQYGVVSTVTNNQAGNQQSTNNEGD

SEQ ID NO: 161762 - protein, 38 aa, Artificial Sequence
  Description of Artificial Sequence: Synthetic polypeptide
AEEEIRTTNPVATEQYGVVSTVTNNQANQQGNNNNQDD

SEQ ID NO: 161763 - protein, 38 aa, Artificial Sequence
  Description of Artificial Sequence: Synthetic polypeptide
AEEEIRTTNPVATEQYGVVSTVTNNQGNQQGNGNNNQD

SEQ ID NO: 161764 - protein, 38 aa, Artificial Sequence
  Description of Artificial Sequence: Synthetic polypeptide
AEEEIRTTNPVATEQYGVVSTVTNNQNNQAGNGNNEQD

SEQ ID NO: 161765 - protein, 36 aa, Artificial Sequence
  Description of Artificial Sequence: Synthetic polypeptide
DEAEIATTNPVATEMWGVVSKTNNPLDDRQNGGGNA

SEQ ID NO: 161766 - protein, 36 aa, Artificial Sequence
  Description of Artificial Sequence: Synthetic polypeptide
DDEEIRTTNPVATEQYGSVVIDPEQTEIQGGQGTEE

SEQ ID NO: 161767 - protein, 34 aa, Artificial Sequence
  Description of Artificial Sequence: Synthetic polypeptide
SEAEIRCTNPVATEQYGCVCEWNHNQHFGSDNQS

SEQ ID NO: 161768 - protein, 38 aa, Artificial Sequence
  Description of Artificial Sequence: Synthetic polypeptide
DEEEIRTTNPVATEQYGVVSVVVVTNNDEQGNNTEEEE

SEQ ID NO: 161769 - protein, 32 aa, Artificial Sequence
  Description of Artificial Sequence: Synthetic polypeptide
EIEEIATTNPCAYEEWGSVYFVDEQQRGQGNR

SEQ ID NO: 161770 - protein, 34 aa, Artificial Sequence
  Description of Artificial Sequence: Synthetic polypeptide
SEAEIRCTNPVATEQYGCVCETELNQHFGSDTQS

SEQ ID NO: 161771 - protein, 36 aa, Artificial Sequence
  Description of Artificial Sequence: Synthetic polypeptide
CEEEIACTNPVATEQYGSCATGNHLPQDSDEGNDND

SEQ ID NO: 161772 - protein, 38 aa, Artificial Sequence
  Description of Artificial Sequence: Synthetic polypeptide
DEEEIRTTNPVATEQYGSAVQPHAVELDVQMIEPGNIS

SEQ ID NO: 161773 - protein, 33 aa, Artificial Sequence
  Description of Artificial Sequence: Synthetic polypeptide
DEQEIRTTNPVSTEPYGSISAMEDIQDQNGEDL

SEQ ID NO: 161774 - protein, 37 aa, Artificial Sequence
  Description of Artificial Sequence: Synthetic polypeptide
DEEEIRTTNPVATEGYGMVNNSGMGNLGENNGGNTQT

SEQ ID NO: 161775 - protein, 36 aa, Artificial Sequence
  Description of Artificial Sequence: Synthetic polypeptide
DDEEIRTTNPVATEQYGSVVDQMVNGEGQTNVTGDG

SEQ ID NO: 161776 - protein, 36 aa, Artificial Sequence
  Description of Artificial Sequence: Synthetic polypeptide
DDEEIRTTNPVATEQYGSVVDQMQPGEGQTNNTGDG

SEQ ID NO: 161777 - protein, 36 aa, Artificial Sequence
  Description of Artificial Sequence: Synthetic polypeptide
DEEEIRTTNPVATEQYGSVSALMEGLDDEDLESEGE

SEQ ID NO: 161778 - protein, 38 aa, Artificial Sequence
  Description of Artificial Sequence: Synthetic polypeptide
AEEEIRTTNPVATEQYGVVSTVTNNQGNQQGNNNNQQN

SEQ ID NO: 161779 - protein, 30 aa, Artificial Sequence
  Description of Artificial Sequence: Synthetic polypeptide
EEVEIATTNPVAYECWGCVSECLQHMEEAG

SEQ ID NO: 161780 - protein, 39 aa, Artificial Sequence
  Description of Artificial Sequence: Synthetic polypeptide
DEETIRTTNPVATEQYGVVSTVVSTNNNLNNQQGDEEDE

SEQ ID NO: 161781 - protein, 38 aa, Artificial Sequence
  Description of Artificial Sequence: Synthetic polypeptide
AEEEIRTTNPVATEQYGVVSTVTNNGNNQNDNGNNNVE

SEQ ID NO: 161782 - protein, 36 aa, Artificial Sequence
  Description of Artificial Sequence: Synthetic polypeptide
DEEEIRTTNPVATEVYGSVDGQTNMEDEGGEEGVGI

SEQ ID NO: 161783 - protein, 35 aa, Artificial Sequence
  Description of Artificial Sequence: Synthetic polypeptide
DEAEIRTTNPVATEGWGCVCSWGNENQEYEGSDNQ

SEQ ID NO: 161784 - protein, 32 aa, Artificial Sequence
  Description of Artificial Sequence: Synthetic polypeptide
DENEIATTNPVSTEPYGTISMETLQQQQNGDH

SEQ ID NO: 161785 - protein, 31 aa, Artificial Sequence
  Description of Artificial Sequence: Synthetic polypeptide
DESEIASTNPVSTEGYGNAAANTCQSRVEER

SEQ ID NO: 161786 - protein, 37 aa, Artificial Sequence
  Description of Artificial Sequence: Synthetic polypeptide
DEEEIRCTNPVATEQYGDVVEGTNGQQDNEGGQNTTD

SEQ ID NO: 161787 - protein, 37 aa, Artificial Sequence
  Description of Artificial Sequence: Synthetic polypeptide
DDEEIRTTNPVATEQYGSVVSAGVDQEDGEGLEGNEG

SEQ ID NO: 161788 - protein, 33 aa, Artificial Sequence
  Description of Artificial Sequence: Synthetic polypeptide
DAEEIATTNPVAYEQYGSACAANNNNQTAGEGE

SEQ ID NO: 161789 - protein, 37 aa, Artificial Sequence
  Description of Artificial Sequence: Synthetic polypeptide
DEEEIRTTNPVATEVYGRVVSPTTMAGPNMRNGMNPV

SEQ ID NO: 161790 - protein, 29 aa, Artificial Sequence
  Description of Artificial Sequence: Synthetic peptide
DESEIASTNPVSTEGYGEAAEVIQHVGQK

SEQ ID NO: 161791 - protein, 36 aa, Artificial Sequence
  Description of Artificial Sequence: Synthetic polypeptide
DECEIATTNPVATEPYGEVVHTDNKNDQRQGMGNHS

SEQ ID NO: 161792 - protein, 37 aa, Artificial Sequence
  Description of Artificial Sequence: Synthetic polypeptide
MEEEIRTTNPVATEQYGSVSVLMTGADEHLEMQSQTT

SEQ ID NO: 161793 - protein, 36 aa, Artificial Sequence
  Description of Artificial Sequence: Synthetic polypeptide
MEEEIRTTNPVATEQYGSVSVLMLAPEHLEMQSDTT

SEQ ID NO: 161794 - protein, 29 aa, Artificial Sequence
  Description of Artificial Sequence: Synthetic peptide
DESEIASTNPVSTEGYGNAAEVIQHVGQK

SEQ ID NO: 161795 - protein, 36 aa, Artificial Sequence
  Description of Artificial Sequence: Synthetic polypeptide
DECEIATTNPVATEPYGEVSWTDNHQQQDRQGGDGD

SEQ ID NO: 161796 - protein, 32 aa, Artificial Sequence
  Description of Artificial Sequence: Synthetic polypeptide
DENEIATTNPVSTEPYGTISMEWGQQQNNGNH

SEQ ID NO: 161797 - protein, 32 aa, Artificial Sequence
  Description of Artificial Sequence: Synthetic polypeptide
DENEIATTNPVSTEPYGTISMQAIQQQQNGNH

SEQ ID NO: 161798 - protein, 35 aa, Artificial Sequence
  Description of Artificial Sequence: Synthetic polypeptide
DEAEIATTNPVATECWGAVCSTDNMGDERDGDIRY

SEQ ID NO: 161799 - protein, 35 aa, Artificial Sequence
  Description of Artificial Sequence: Synthetic polypeptide
SEDEIRCTNPVATEQYGSVYCTWNDQHHQGGGGQG

SEQ ID NO: 161800 - protein, 34 aa, Artificial Sequence
  Description of Artificial Sequence: Synthetic polypeptide
DEAEIATTNPVATECWGEVAWTDNEQQQGGGGGR

SEQ ID NO: 161801 - protein, 32 aa, Artificial Sequence
  Description of Artificial Sequence: Synthetic polypeptide
DENEIATTNPVSTEPYGTISSEDIQQQHNGNH

SEQ ID NO: 161802 - protein, 33 aa, Artificial Sequence
  Description of Artificial Sequence: Synthetic polypeptide
EESCIRTTNPVAYEQYGTTVACTQNVSQSSGEN

SEQ ID NO: 161803 - protein, 35 aa, Artificial Sequence
  Description of Artificial Sequence: Synthetic polypeptide
EESEEIATTNPVAYEQWGSVSTGGNAGEHQGTDER

SEQ ID NO: 161804 - protein, 33 aa, Artificial Sequence
  Description of Artificial Sequence: Synthetic polypeptide
DAEEIATTNPVAYEQWGSVCSNWEDGEQDMHNP

SEQ ID NO: 161805 - protein, 29 aa, Artificial Sequence
  Description of Artificial Sequence: Synthetic peptide
EESEIAATNPVGTEGYGVMASLLQHGGDI

SEQ ID NO: 161806 - protein, 33 aa, Artificial Sequence
  Description of Artificial Sequence: Synthetic polypeptide
DECEIATTNPVATEPWGSVCYNNDHKDTGGDDR

SEQ ID NO: 161807 - protein, 35 aa, Artificial Sequence
  Description of Artificial Sequence: Synthetic polypeptide
DEIEIRTTNPVATEQYGSCNYAVTYNDESLFELQV

SEQ ID NO: 161808 - protein, 35 aa, Artificial Sequence
  Description of Artificial Sequence: Synthetic polypeptide
SEDEIRSTNPVATEQYGSVYCNWNDQHHQGHNGQG

SEQ ID NO: 161809 - protein, 32 aa, Artificial Sequence
  Description of Artificial Sequence: Synthetic polypeptide
DENEIATTNPVSTEPYGTMSMETLQQQQNGDI

SEQ ID NO: 161810 - protein, 35 aa, Artificial Sequence
  Description of Artificial Sequence: Synthetic polypeptide
DEAEIATTNPVATCQYGQCVCSTADNQENFGSNQS

SEQ ID NO: 161811 - protein, 32 aa, Artificial Sequence
  Description of Artificial Sequence: Synthetic polypeptide
DENEIATTNPVSTEPYGTISMEDIQQQSNGNH

SEQ ID NO: 161812 - protein, 38 aa, Artificial Sequence
  Description of Artificial Sequence: Synthetic polypeptide
DEEEIRTTNPVATEQYGVVSTVNNNQQQGTEQGSTVTE

SEQ ID NO: 161813 - protein, 36 aa, Artificial Sequence
  Description of Artificial Sequence: Synthetic polypeptide
MEEEIRTTNPVATEQYGSVVMGQIENSDQDEGGGGE

SEQ ID NO: 161814 - protein, 34 aa, Artificial Sequence
  Description of Artificial Sequence: Synthetic polypeptide
SEDEIRTTNPVAYEQWGVVVPTDNGDQAGGNMTQ

SEQ ID NO: 161815 - protein, 35 aa, Artificial Sequence
  Description of Artificial Sequence: Synthetic polypeptide
DEGEIATTNPVATEQYGSVCAMTPLEAPDNQDNEM

SEQ ID NO: 161816 - protein, 36 aa, Artificial Sequence
  Description of Artificial Sequence: Synthetic polypeptide
MEEEIRTTNPVATEQYGSVVLGMEGESGEEDGGNNG

SEQ ID NO: 161817 - protein, 37 aa, Artificial Sequence
  Description of Artificial Sequence: Synthetic polypeptide
DEEEIRTTNPVATEVYGSVSDGMGENLGNNDGMEAGQ

SEQ ID NO: 161818 - protein, 36 aa, Artificial Sequence
  Description of Artificial Sequence: Synthetic polypeptide
DDEEIRTTNPVATEQYGSVVSGGQNDEEGEGGEGQG

SEQ ID NO: 161819 - protein, 36 aa, Artificial Sequence
  Description of Artificial Sequence: Synthetic polypeptide
DEEEIRTTNPVATEVYGSVMGVNDEDETGGEENEGE

SEQ ID NO: 161820 - protein, 30 aa, Artificial Sequence
  Description of Artificial Sequence: Synthetic polypeptide
DESEIASTNPVSTEGYGNVAAETIQHVGQK

SEQ ID NO: 161821 - protein, 31 aa, Artificial Sequence
  Description of Artificial Sequence: Synthetic polypeptide
DENEIATTNPVSTEPYGTISMEDIQQQNGGH

SEQ ID NO: 161822 - protein, 36 aa, Artificial Sequence
  Description of Artificial Sequence: Synthetic polypeptide
MEEEIRTTNPVATEQYGSVVFDDDDEGQGDGEDQNN

SEQ ID NO: 161823 - protein, 37 aa, Artificial Sequence
  Description of Artificial Sequence: Synthetic polypeptide
DDEEIRTTNPVATEQYGSVVSDIMQNGDGQTNNTGDG

SEQ ID NO: 161824 - protein, 32 aa, Artificial Sequence
  Description of Artificial Sequence: Synthetic polypeptide
DENEIATTNPVSTEPYGTISMEDIQQQWNGNH

SEQ ID NO: 161825 - protein, 31 aa, Artificial Sequence
  Description of Artificial Sequence: Synthetic polypeptide
EENEIRTTNPVATEQWGDVSEIIEMNAAEDA

SEQ ID NO: 161826 - protein, 32 aa, Artificial Sequence
  Description of Artificial Sequence: Synthetic polypeptide
DENEIATTNPVSTEPYGTISMEDIQQQQNGNH

SEQ ID NO: 161827 - protein, 35 aa, Artificial Sequence
  Description of Artificial Sequence: Synthetic polypeptide
DEEEIRTTNPVATEVYGSVMGQNMEDNGGEEVEGE

SEQ ID NO: 161828 - protein, 32 aa, Artificial Sequence
  Description of Artificial Sequence: Synthetic polypeptide
DENEIATTNPVSTEPYGTISMEDIQQQQNGNQ

SEQ ID NO: 161829 - protein, 33 aa, Artificial Sequence
  Description of Artificial Sequence: Synthetic polypeptide
SEDEIRTTNPVAYEQWGCVCDNNDQMDEGGNAP

SEQ ID NO: 161830 - protein, 32 aa, Artificial Sequence
  Description of Artificial Sequence: Synthetic polypeptide
EENEIRTTNPVSTEPYGTISMEDIKQQFKGNH

SEQ ID NO: 161831 - protein, 32 aa, Artificial Sequence
  Description of Artificial Sequence: Synthetic polypeptide
EENEIRTTNPVSTEPYGTISMEDIQQQQNGNH

SEQ ID NO: 161832 - protein, 37 aa, Artificial Sequence
  Description of Artificial Sequence: Synthetic polypeptide
MEEEIRTTNPVATEQYGSVTEWTTYNEADGQMNTDGG

SEQ ID NO: 161833 - protein, 35 aa, Artificial Sequence
  Description of Artificial Sequence: Synthetic polypeptide
DEAEIRTTNPVATEGWGCVCSWINENQDYFGSNQS

SEQ ID NO: 161834 - protein, 32 aa, Artificial Sequence
  Description of Artificial Sequence: Synthetic polypeptide
EENEIRTTNPVSTEPYGTISMEWIQQQQNGNH

SEQ ID NO: 161835 - protein, 32 aa, Artificial Sequence
  Description of Artificial Sequence: Synthetic polypeptide
DENEIATTNPVSTEPYGTISMEDIQQQRNGQH

SEQ ID NO: 161836 - protein, 35 aa, Artificial Sequence
  Description of Artificial Sequence: Synthetic polypeptide
DEEEIRTTNPVATEVYGSVMGQNMEDEGGEIGGGV

SEQ ID NO: 161837 - protein, 37 aa, Artificial Sequence
  Description of Artificial Sequence: Synthetic polypeptide
DEEEIAATNPVATEQYGSVCSPTNHGPLDSGEGTEED

SEQ ID NO: 161838 - protein, 37 aa, Artificial Sequence
  Description of Artificial Sequence: Synthetic polypeptide
MEEEIRTTNPVATEQYGSVVDIDTNMNLEEGGGQDIT

SEQ ID NO: 161839 - protein, 35 aa, Artificial Sequence
  Description of Artificial Sequence: Synthetic polypeptide
DEAEIATTNPVATECWGSVCFTNEQDQNDGDQRRD

SEQ ID NO: 161840 - protein, 36 aa, Artificial Sequence
  Description of Artificial Sequence: Synthetic polypeptide
CEEEISTTNPVATEQYGQCVCSNTEDQENFGSDNQS

SEQ ID NO: 161841 - protein, 31 aa, Artificial Sequence
  Description of Artificial Sequence: Synthetic polypeptide
EESEIASTNPVGTEGYGVMASYTMPQHRGDI

SEQ ID NO: 161842 - protein, 37 aa, Artificial Sequence
  Description of Artificial Sequence: Synthetic polypeptide
EESVIRTTNPVATEAYGSVPSITPNEQSFYPGGNNRI

SEQ ID NO: 161843 - protein, 37 aa, Artificial Sequence
  Description of Artificial Sequence: Synthetic polypeptide
EESVIRTTNPVATEQYGCCVPSYMNEQSHRPGGNNRL

SEQ ID NO: 161844 - protein, 38 aa, Artificial Sequence
  Description of Artificial Sequence: Synthetic polypeptide
EESVIRTTNPVATEQYGCSVPSCMGNEQSFRPGGNNRI

SEQ ID NO: 161845 - protein, 29 aa, Artificial Sequence
  Description of Artificial Sequence: Synthetic peptide
QESEIASTNPVGTEGYGVMASTLQKHTDI

SEQ ID NO: 161846 - protein, 34 aa, Artificial Sequence
  Description of Artificial Sequence: Synthetic polypeptide
DEQEIRTTNPVAYECYGSVCCLGNHSHERGGTLL

SEQ ID NO: 161847 - protein, 35 aa, Artificial Sequence
  Description of Artificial Sequence: Synthetic polypeptide
EETEIATTNPVATEHYGCVATGNGLNDTERGGDHR

SEQ ID NO: 161848 - protein, 37 aa, Artificial Sequence
  Description of Artificial Sequence: Synthetic polypeptide
DEIEIRTTNPVATEQYGSVCTPPHCLEETGYMEDMNA

SEQ ID NO: 161849 - protein, 34 aa, Artificial Sequence
  Description of Artificial Sequence: Synthetic polypeptide
DEGEIATTNPVATEQYGSVCAGTGPPTDDQGQDQ

SEQ ID NO: 161850 - protein, 37 aa, Artificial Sequence
  Description of Artificial Sequence: Synthetic polypeptide
DEIEIRTTNPVATEQYGSVCVPSIAEVEPNDLALGTQ

SEQ ID NO: 161851 - protein, 36 aa, Artificial Sequence
  Description of Artificial Sequence: Synthetic polypeptide
DEEEIRTTNPVATEQYGSVSAEMEGLDDEALESEDE

SEQ ID NO: 161852 - protein, 35 aa, Artificial Sequence
  Description of Artificial Sequence: Synthetic polypeptide
EETEIATTNPVATENYGCVSTSNGPNDTERGGGER

SEQ ID NO: 161853 - protein, 34 aa, Artificial Sequence
  Description of Artificial Sequence: Synthetic polypeptide
SECEIRTTNPVATEQYGVVSTMHATEEGTQASPG

SEQ ID NO: 161854 - protein, 36 aa, Artificial Sequence
  Description of Artificial Sequence: Synthetic polypeptide
EESVIRTTNPVATEAYGCSVPSMNEQSFEPGGNNRI

SEQ ID NO: 161855 - protein, 32 aa, Artificial Sequence
  Description of Artificial Sequence: Synthetic polypeptide
DEAELATTNPVAYEQWGSASKTLEDRQNMQES

SEQ ID NO: 161856 - protein, 35 aa, Artificial Sequence
  Description of Artificial Sequence: Synthetic polypeptide
EETEIRTTNPVATEAYGKTVWCQGNSDQVREGNTS

SEQ ID NO: 161857 - protein, 32 aa, Artificial Sequence
  Description of Artificial Sequence: Synthetic polypeptide
DEAELATTNPVAYEQWGSISKTLEDRQNMQGN

SEQ ID NO: 161858 - protein, 34 aa, Artificial Sequence
  Description of Artificial Sequence: Synthetic polypeptide
DEAEIATTNPVATEHWGSVCYNNDDQDHGDQDHR

SEQ ID NO: 161859 - protein, 36 aa, Artificial Sequence
  Description of Artificial Sequence: Synthetic polypeptide
DEEEIRTTNPVATEQYGSVSESPAALDAVVEEEAET

SEQ ID NO: 161860 - protein, 34 aa, Artificial Sequence
  Description of Artificial Sequence: Synthetic polypeptide
DEGEIATTNPVATEQYGSVCAGMTHGGAEAPGDH

SEQ ID NO: 161861 - protein, 36 aa, Artificial Sequence
  Description of Artificial Sequence: Synthetic polypeptide
DEEEIRTTNPVATEGYGMVNNGQGTFGQEGGGQNGG

SEQ ID NO: 161862 - protein, 35 aa, Artificial Sequence
  Description of Artificial Sequence: Synthetic polypeptide
DEQEIRTTNPVAYEQWGVVTGGNAGNQQGEGNADR

SEQ ID NO: 161863 - protein, 33 aa, Artificial Sequence
  Description of Artificial Sequence: Synthetic polypeptide
EEVEIATTNPVATTQWGMVVRTWDTQHQQGNER

SEQ ID NO: 161864 - protein, 38 aa, Artificial Sequence
  Description of Artificial Sequence: Synthetic polypeptide
AEEEIRTTNPVATEQYGSVSTVTNNQNNQNENNNNTED

SEQ ID NO: 161865 - protein, 28 aa, Artificial Sequence
  Description of Artificial Sequence: Synthetic peptide
EEVEIATTNPVAYECWGCAYEPLQHEEA

SEQ ID NO: 161866 - protein, 35 aa, Artificial Sequence
  Description of Artificial Sequence: Synthetic polypeptide
DEGEIATTNPVATEQYGSVCAENGEEAPDNQMENH

SEQ ID NO: 161867 - protein, 37 aa, Artificial Sequence
  Description of Artificial Sequence: Synthetic polypeptide
AEEEIRTTNPVATEQYGVVSTVTNNDEQGSTEENQDT

SEQ ID NO: 161868 - protein, 30 aa, Artificial Sequence
  Description of Artificial Sequence: Synthetic polypeptide
EETEIATTNPVAYERWGCVYECLQHNMGEA

SEQ ID NO: 161869 - protein, 34 aa, Artificial Sequence
  Description of Artificial Sequence: Synthetic polypeptide
EESNEIATTNPVAYECWGSVYCTELEQGNDGNDR

SEQ ID NO: 161870 - protein, 36 aa, Artificial Sequence
  Description of Artificial Sequence: Synthetic polypeptide
DEEEIRTTNPVATEQYGSVSESPVVAPEVVEENEVI

SEQ ID NO: 161871 - protein, 30 aa, Artificial Sequence
  Description of Artificial Sequence: Synthetic polypeptide
QESEIASTNPVGTEGYGVMASTLQKHGSYI

SEQ ID NO: 161872 - protein, 37 aa, Artificial Sequence
  Description of Artificial Sequence: Synthetic polypeptide
CEEEISTTNPVATEQYGQCVCSNTELNQENFGSDNQS

SEQ ID NO: 161873 - protein, 32 aa, Artificial Sequence
  Description of Artificial Sequence: Synthetic polypeptide
DENEIATTNPVSTEPYGTTSGEDGQQQGNGNH

SEQ ID NO: 161874 - protein, 31 aa, Artificial Sequence
  Description of Artificial Sequence: Synthetic polypeptide
DDSEVASTNPVSTEGYGVVAANTIQERMGQR

SEQ ID NO: 161875 - protein, 33 aa, Artificial Sequence
  Description of Artificial Sequence: Synthetic polypeptide
DENEIATTNPVSTEPYGTTSMEDWNQQNQNGNH

SEQ ID NO: 161876 - protein, 33 aa, Artificial Sequence
  Description of Artificial Sequence: Synthetic polypeptide
DENEIATTNPVSTEPYGTVCSMWDQQQQQHGNH

SEQ ID NO: 161877 - protein, 36 aa, Artificial Sequence
  Description of Artificial Sequence: Synthetic polypeptide
CEEEISTTNPVATEQYGQCVCSNTGELQNFGSDTQS

SEQ ID NO: 161878 - protein, 31 aa, Artificial Sequence
  Description of Artificial Sequence: Synthetic polypeptide
DDSEVASTNPVSTEGYGVVAANTIQKREGQR

SEQ ID NO: 161879 - protein, 35 aa, Artificial Sequence
  Description of Artificial Sequence: Synthetic polypeptide
DEEEIRCTNPVATEQYGCVCSWGNDNAYFNSDTQA

SEQ ID NO: 161880 - protein, 35 aa, Artificial Sequence
  Description of Artificial Sequence: Synthetic polypeptide
DEEEIRCTNPVATEQYGCVCSWGNDHDHFGSDTQM

SEQ ID NO: 161881 - protein, 35 aa, Artificial Sequence
  Description of Artificial Sequence: Synthetic polypeptide
EESEIRTTNPVATEQYGAASDVPQDVNNQDGQEYI

SEQ ID NO: 161882 - protein, 35 aa, Artificial Sequence
  Description of Artificial Sequence: Synthetic polypeptide
DEEEIATTNPVATEQYGSVCAMTGVEPEDEENNFM

SEQ ID NO: 161883 - protein, 36 aa, Artificial Sequence
  Description of Artificial Sequence: Synthetic polypeptide
DEIEIRTTNPVATEQYGSVCIPPCPLETGNMEDMYD

SEQ ID NO: 161884 - protein, 34 aa, Artificial Sequence
  Description of Artificial Sequence: Synthetic polypeptide
DEEEIRCTNPVATEQYGCVCSWGEDDYFGSDTAS

SEQ ID NO: 161885 - protein, 32 aa, Artificial Sequence
  Description of Artificial Sequence: Synthetic polypeptide
DENEIATTNPVSTEPYGTVSMEDIQQQHNEEH

SEQ ID NO: 161886 - protein, 37 aa, Artificial Sequence
  Description of Artificial Sequence: Synthetic polypeptide
DEEEIRTTNPVATEQYGSVSAEFPGTQQEREFPQHDT

SEQ ID NO: 161887 - protein, 31 aa, Artificial Sequence
  Description of Artificial Sequence: Synthetic polypeptide
DESEIASTNPVGTEQYGVMAATDGLVEFGDD

SEQ ID NO: 161888 - protein, 35 aa, Artificial Sequence
  Description of Artificial Sequence: Synthetic polypeptide
SEDEIATTNPVATEQYGSVSATDLNEDHQGLEDTN

SEQ ID NO: 161889 - protein, 33 aa, Artificial Sequence
  Description of Artificial Sequence: Synthetic polypeptide
EESEIRTTNPVAYECWGTVYRINENQDRRGENE

SEQ ID NO: 161890 - protein, 38 aa, Artificial Sequence
  Description of Artificial Sequence: Synthetic polypeptide
DEEEIRTTNPVATEQYGSAVAQPTMMEETVLENITLNR

SEQ ID NO: 161891 - protein, 38 aa, Artificial Sequence
  Description of Artificial Sequence: Synthetic polypeptide
AEEEIRTTNPVATEQYGVVSTVNTNNQAGNQQGNNEGD

SEQ ID NO: 161892 - protein, 34 aa, Artificial Sequence
  Description of Artificial Sequence: Synthetic polypeptide
EESEIRTTNPVAYEQWGVYTISPQEGDQDRGNAR

SEQ ID NO: 161893 - protein, 33 aa, Artificial Sequence
  Description of Artificial Sequence: Synthetic polypeptide
DEEEIRCTNPVATEQYGCVCSWEHDHSISDTQA

SEQ ID NO: 161894 - protein, 35 aa, Artificial Sequence
  Description of Artificial Sequence: Synthetic polypeptide
DEEEIRCTNPVATEQYGCVCSWEEHNDHFGSDTQG

SEQ ID NO: 161895 - protein, 33 aa, Artificial Sequence
  Description of Artificial Sequence: Synthetic polypeptide
SEDEIACTNPVATEQYGCVATNLADAGIGEMQD

SEQ ID NO: 161896 - protein, 37 aa, Artificial Sequence
  Description of Artificial Sequence: Synthetic polypeptide
DEEEIATTNPVATEQYGSVCAATNPQENPDDQMGGTA

SEQ ID NO: 161897 - protein, 34 aa, Artificial Sequence
  Description of Artificial Sequence: Synthetic polypeptide
DEGEIATTNPVATEQYGSVCAMANPAEDNMALEH

SEQ ID NO: 161898 - protein, 38 aa, Artificial Sequence
  Description of Artificial Sequence: Synthetic polypeptide
AEEEIRTTNPVATEQYGVVSTVTGNNQQQGNNDEEDED

SEQ ID NO: 161899 - protein, 31 aa, Artificial Sequence
  Description of Artificial Sequence: Synthetic polypeptide
DENEICTTNPVATEQWGDVSEIEYMNAASDA

SEQ ID NO: 161900 - protein, 34 aa, Artificial Sequence
  Description of Artificial Sequence: Synthetic polypeptide
ENEEIATTNPVATTQWGNVSKTWNPNEQQANNDR

SEQ ID NO: 161901 - protein, 35 aa, Artificial Sequence
  Description of Artificial Sequence: Synthetic polypeptide
SEAEIATTNPVAYEQYGSVCSTNSITPAPGMENGM

SEQ ID NO: 161902 - protein, 34 aa, Artificial Sequence
  Description of Artificial Sequence: Synthetic polypeptide
ENEEIATTNPVATTQWGNVSKTWNPNEQQQGEGR

SEQ ID NO: 161903 - protein, 39 aa, Artificial Sequence
  Description of Artificial Sequence: Synthetic polypeptide
DEEEIRTTNPVATESYGTVTTNQQVTISTNTQGQEVGNR

SEQ ID NO: 161904 - protein, 31 aa, Artificial Sequence
  Description of Artificial Sequence: Synthetic polypeptide
DEEVIATVNPVAYEPYGSPTAGNLEMNMNNS

SEQ ID NO: 161905 - protein, 35 aa, Artificial Sequence
  Description of Artificial Sequence: Synthetic polypeptide
MEEEIRTTNPVATEQYGDVVQTDNMNGGGGGEEGD

SEQ ID NO: 161906 - protein, 36 aa, Artificial Sequence
  Description of Artificial Sequence: Synthetic polypeptide
MEEEIRTTNPVATEQYGDVVNGFGTNDTQEGGDEQT

SEQ ID NO: 161907 - protein, 36 aa, Artificial Sequence
  Description of Artificial Sequence: Synthetic polypeptide
MEEEIRTTNPVATEQYGDVVDNFNMDQNGEGQGNQA

SEQ ID NO: 161908 - protein, 35 aa, Artificial Sequence
  Description of Artificial Sequence: Synthetic polypeptide
DENEIRTTNPVATEGYGSVMGQFVGIQENGNGGQE

SEQ ID NO: 161909 - protein, 38 aa, Artificial Sequence
  Description of Artificial Sequence: Synthetic polypeptide
DEEEIRTTNPVATEQYGVVSVVVVTNQQAIGTTTEESD

SEQ ID NO: 161910 - protein, 33 aa, Artificial Sequence
  Description of Artificial Sequence: Synthetic polypeptide
DEANEIATTNPVAYEQWGSVSGGGNHGGAQNGM

SEQ ID NO: 161911 - protein, 34 aa, Artificial Sequence
  Description of Artificial Sequence: Synthetic polypeptide
SDEEIRTTNPVATEQYGVVCSWEHNQENFGSDQS

SEQ ID NO: 161912 - protein, 28 aa, Artificial Sequence
  Description of Artificial Sequence: Synthetic peptide
QESEIASTNPVGTEGYGVMASTMRHGDI

SEQ ID NO: 161913 - protein, 36 aa, Artificial Sequence
  Description of Artificial Sequence: Synthetic polypeptide
FEDEIRTTNPVATEQYGSVMGEVNQEQGIGNQDEQA

SEQ ID NO: 161914 - protein, 34 aa, Artificial Sequence
  Description of Artificial Sequence: Synthetic polypeptide
MEEEIRTTNPVATEQYGDVNDQLINEMGEEGGEG

SEQ ID NO: 161915 - protein, 38 aa, Artificial Sequence
  Description of Artificial Sequence: Synthetic polypeptide
DEEEIRTTNPVATEQYGSAYSPTTNTENTESVGEENQF

SEQ ID NO: 161916 - protein, 32 aa, Artificial Sequence
  Description of Artificial Sequence: Synthetic polypeptide
DENEIFTTNPVSTEPYGTISMEDIQQDQNGNH

SEQ ID NO: 161917 - protein, 35 aa, Artificial Sequence
  Description of Artificial Sequence: Synthetic polypeptide
FEDEIRTTNPVATEQYGSVNSDGSGQENEQGEAGV

SEQ ID NO: 161918 - protein, 35 aa, Artificial Sequence
  Description of Artificial Sequence: Synthetic polypeptide
DEECTCTTNPVAVEQYGVVSTVNNNNQDEQGTNVD

SEQ ID NO: 161919 - protein, 34 aa, Artificial Sequence
  Description of Artificial Sequence: Synthetic polypeptide
DEEVICTTNPVAYEAYGHVSCSNSLSQVSGGEFP

SEQ ID NO: 161920 - protein, 33 aa, Artificial Sequence
  Description of Artificial Sequence: Synthetic polypeptide
SDEEIRTTNPVATEQWGCVCSWEHNQNFGSDQA

SEQ ID NO: 161921 - protein, 34 aa, Artificial Sequence
  Description of Artificial Sequence: Synthetic polypeptide
SDEEIRTTNPVATEQWGCVCSTGEDNQHFGSDQA

SEQ ID NO: 161922 - protein, 38 aa, Artificial Sequence
  Description of Artificial Sequence: Synthetic polypeptide
DEEEIRTTNPVATEGYGMVNNSGMGNNLQNNNGGFNES

SEQ ID NO: 161923 - protein, 35 aa, Artificial Sequence
  Description of Artificial Sequence: Synthetic polypeptide
DEECTCTTNPVAVEQYGVVSTVNNNNQDENGNNDD

SEQ ID NO: 161924 - protein, 38 aa, Artificial Sequence
  Description of Artificial Sequence: Synthetic polypeptide
AEEEIRTTNPVATEQYGVVSTVTQNGNNQQGNGTNNQD

SEQ ID NO: 161925 - protein, 38 aa, Artificial Sequence
  Description of Artificial Sequence: Synthetic polypeptide
AEEEIRTTNPVATEQYGVVSTVTQNGNNQQGNNNNQQD

SEQ ID NO: 161926 - protein, 35 aa, Artificial Sequence
  Description of Artificial Sequence: Synthetic polypeptide
MEEEIRTTNPVATEQYGCVNVENDHQHRTSQEDPN

SEQ ID NO: 161927 - protein, 35 aa, Artificial Sequence
  Description of Artificial Sequence: Synthetic polypeptide
DEECTCTTNPVAVEQYGVVSTVNNNNQDEGNNNND

SEQ ID NO: 161928 - protein, 36 aa, Artificial Sequence
  Description of Artificial Sequence: Synthetic polypeptide
DEQEISTTNPVATEQYGSVSATGDEGEDLEGEGDGD

SEQ ID NO: 161929 - protein, 32 aa, Artificial Sequence
  Description of Artificial Sequence: Synthetic polypeptide
DENEIFTTNPVSTEPYGTISMEDIQQQQNGNH

SEQ ID NO: 161930 - protein, 35 aa, Artificial Sequence
  Description of Artificial Sequence: Synthetic polypeptide
DEQEISTTNPVATEQYGSVSATGDGEDENGEGDGD

SEQ ID NO: 161931 - protein, 32 aa, Artificial Sequence
  Description of Artificial Sequence: Synthetic polypeptide
DENEIETTNPVSTEPYGTISMEDIQQQQNGNH

SEQ ID NO: 161932 - protein, 37 aa, Artificial Sequence
  Description of Artificial Sequence: Synthetic polypeptide
DEEEIRTTNPVATEQYGSAYSPTTNENTTSVIEENQF

SEQ ID NO: 161933 - protein, 35 aa, Artificial Sequence
  Description of Artificial Sequence: Synthetic polypeptide
MEEEIRTTNPVATEQYGMVGIMNGDEGGNGQEGFT

SEQ ID NO: 161934 - protein, 35 aa, Artificial Sequence
  Description of Artificial Sequence: Synthetic polypeptide
ETEEIATTNPVATTQWGSVAWTENGDQDQRGPNNH

SEQ ID NO: 161935 - protein, 32 aa, Artificial Sequence
  Description of Artificial Sequence: Synthetic polypeptide
DENEIDTTNPVSTEPYGTISMEDIQQQQNGNH

SEQ ID NO: 161936 - protein, 32 aa, Artificial Sequence
  Description of Artificial Sequence: Synthetic polypeptide
ETEEIATTNPVAYEQWGSVMWTEGDMRGTTEP

SEQ ID NO: 161937 - protein, 30 aa, Artificial Sequence
  Description of Artificial Sequence: Synthetic polypeptide
QESEIASTNPVGTEGYGVMASTLWQHGDPI

SEQ ID NO: 161938 - protein, 37 aa, Artificial Sequence
  Description of Artificial Sequence: Synthetic polypeptide
DEEEIRTTNPVATEQYGSAYLTVNQTLAIETQVQDET

SEQ ID NO: 161939 - protein, 36 aa, Artificial Sequence
  Description of Artificial Sequence: Synthetic polypeptide
DENEIRTTNPVATEGYGSVNIMQEGQTNEQGIGGET

SEQ ID NO: 161940 - protein, 31 aa, Artificial Sequence
  Description of Artificial Sequence: Synthetic polypeptide
DDSEVASTNPVSTEGYGVVAVSTIQSRFGQR

SEQ ID NO: 161941 - protein, 33 aa, Artificial Sequence
  Description of Artificial Sequence: Synthetic polypeptide
ETGEEIATTNPVAYEQWGSVTWTEGDQRGTTEP

SEQ ID NO: 161942 - protein, 32 aa, Artificial Sequence
  Description of Artificial Sequence: Synthetic polypeptide
ETNEIATTNPCAYEEWGSVYFVDLTQRQEGNR

SEQ ID NO: 161943 - protein, 32 aa, Artificial Sequence
  Description of Artificial Sequence: Synthetic polypeptide
DENEIDTTNPVSTEPYGTISMEDIQQQQNGNS

SEQ ID NO: 161944 - protein, 33 aa, Artificial Sequence
  Description of Artificial Sequence: Synthetic polypeptide
ETNEIATTNPVAYEQWGSVAWTNIDQGGGNQSD

SEQ ID NO: 161945 - protein, 39 aa, Artificial Sequence
  Description of Artificial Sequence: Synthetic polypeptide
DEEEIRTTNPVATESYGTVTTNQSVTISTNTQESEVGNT

SEQ ID NO: 161946 - protein, 35 aa, Artificial Sequence
  Description of Artificial Sequence: Synthetic polypeptide
DEGEIATTNPVATEQYGSVCAANMGEEATDQGGEE

SEQ ID NO: 161947 - protein, 35 aa, Artificial Sequence
  Description of Artificial Sequence: Synthetic polypeptide
SEAEAEIRTTNPVAYEQWGSVAWTDQLNQDDSGDM

SEQ ID NO: 161948 - protein, 34 aa, Artificial Sequence
  Description of Artificial Sequence: Synthetic polypeptide
DENEIRTTNPVATEGYGSVMNEDGIGGQDDGEDI

SEQ ID NO: 161949 - protein, 35 aa, Artificial Sequence
  Description of Artificial Sequence: Synthetic polypeptide
ETTEIATTNPVATEAYGSVSWNEGDQQDGRQGNDS

SEQ ID NO: 161950 - protein, 34 aa, Artificial Sequence
  Description of Artificial Sequence: Synthetic polypeptide
SEAAEIRTTNPVAYEQWGSVCSTTDQGDEQNGSA

SEQ ID NO: 161951 - protein, 32 aa, Artificial Sequence
  Description of Artificial Sequence: Synthetic polypeptide
ETTEIATTNPVAYEQWGSVAWTEIDQDGGDNV

SEQ ID NO: 161952 - protein, 39 aa, Artificial Sequence
  Description of Artificial Sequence: Synthetic polypeptide
DEEEIRTTNPVATESYGTVTTTQSGTISTNLQGQEIGNT

SEQ ID NO: 161953 - protein, 37 aa, Artificial Sequence
  Description of Artificial Sequence: Synthetic polypeptide
DEEEIRTTNPVATEQYGSAYNPTTNNENTSVGEENQF

SEQ ID NO: 161954 - protein, 36 aa, Artificial Sequence
  Description of Artificial Sequence: Synthetic polypeptide
MEEEIRTTNPVATEQYGDVVTGQTGLQSGEGGQGGT

SEQ ID NO: 161955 - protein, 32 aa, Artificial Sequence
  Description of Artificial Sequence: Synthetic polypeptide
DENEIDTTNPVSTEPYGTISMEDWQQQQNGNH

SEQ ID NO: 161956 - protein, 39 aa, Artificial Sequence
  Description of Artificial Sequence: Synthetic polypeptide
DEEEIRTTNPVATESYGTVTTQQQVTISTNTQMEEVGNR

SEQ ID NO: 161957 - protein, 35 aa, Artificial Sequence
  Description of Artificial Sequence: Synthetic polypeptide
DEEVIATTNPVAYETYGSVPTDISLFTLRSGNEEF

SEQ ID NO: 161958 - protein, 36 aa, Artificial Sequence
  Description of Artificial Sequence: Synthetic polypeptide
MEEEIRTTNPVATEQYGDVVTGDTGLQEDEGGDGGT

SEQ ID NO: 161959 - protein, 30 aa, Artificial Sequence
  Description of Artificial Sequence: Synthetic polypeptide
QESEIASTNPVGTEGYGVMASTLYQWHGDI

SEQ ID NO: 161960 - protein, 35 aa, Artificial Sequence
  Description of Artificial Sequence: Synthetic polypeptide
FEDEIRTTNPVATEQYGSVVDDNNMTMEGQGDNDD

SEQ ID NO: 161961 - protein, 34 aa, Artificial Sequence
  Description of Artificial Sequence: Synthetic polypeptide
DEGEIATTNPVATEQYGSVCAANAGEEAADEMNN

SEQ ID NO: 161962 - protein, 35 aa, Artificial Sequence
  Description of Artificial Sequence: Synthetic polypeptide
FEDEIRTTNPVATEQYGSVVDLQENIQQNIGGGGI

SEQ ID NO: 161963 - protein, 36 aa, Artificial Sequence
  Description of Artificial Sequence: Synthetic polypeptide
FEEEIKTTNPVATEQYGSVVIGNNFQDGNQEFENDT

SEQ ID NO: 161964 - protein, 36 aa, Artificial Sequence
  Description of Artificial Sequence: Synthetic polypeptide
MEEEIRTTNPVATEQYGCVCSNTGEHQENFGSDTQS

SEQ ID NO: 161965 - protein, 32 aa, Artificial Sequence
  Description of Artificial Sequence: Synthetic polypeptide
SDECISTTNPVAYEQWGHVCSTWNDHQQVNDL

SEQ ID NO: 161966 - protein, 34 aa, Artificial Sequence
  Description of Artificial Sequence: Synthetic polypeptide
FEEEIRATNPVATEQYGDVSVDDTGQGNNGGQDG

SEQ ID NO: 161967 - protein, 34 aa, Artificial Sequence
  Description of Artificial Sequence: Synthetic polypeptide
FEEEIRATNPVATEQYGDVSVGDTGQGNDGGQDD

SEQ ID NO: 161968 - protein, 35 aa, Artificial Sequence
  Description of Artificial Sequence: Synthetic polypeptide
FEEEIRATNPVATEQYGDVSVGDTGQQNIGDGQDD

SEQ ID NO: 161969 - protein, 29 aa, Artificial Sequence
  Description of Artificial Sequence: Synthetic peptide
QESEIASTNPVGTEGYGVMASTPQHEGDI

SEQ ID NO: 161970 - protein, 39 aa, Artificial Sequence
  Description of Artificial Sequence: Synthetic polypeptide
DEEEIRTTNPVATESYGTVTTGQSNTISTNLQMQEVGND

SEQ ID NO: 161971 - protein, 35 aa, Artificial Sequence
  Description of Artificial Sequence: Synthetic polypeptide
DEQEISTTNPVATEQYGVVSATGDGEDQEGEGQGD

SEQ ID NO: 161972 - protein, 34 aa, Artificial Sequence
  Description of Artificial Sequence: Synthetic polypeptide
FEEEIRATNPVATEQYGSVNMDPDGNNEEGQGEN

SEQ ID NO: 161973 - protein, 31 aa, Artificial Sequence
  Description of Artificial Sequence: Synthetic polypeptide
DDSEVASTNPVSTEGYGWVAANTIQSREGQR

SEQ ID NO: 161974 - protein, 35 aa, Artificial Sequence
  Description of Artificial Sequence: Synthetic polypeptide
MEEEIRTTNPVATEQYGAVVQTDNMNGTGGEEEGD

SEQ ID NO: 161975 - protein, 35 aa, Artificial Sequence
  Description of Artificial Sequence: Synthetic polypeptide
DEGEIATTNPVATEQYGSVCAAMHGTDSMDGNDAH

SEQ ID NO: 161976 - protein, 34 aa, Artificial Sequence
  Description of Artificial Sequence: Synthetic polypeptide
DEGEIATTNPVATEQYGSVCAAMHGQDSDGSDDH

SEQ ID NO: 161977 - protein, 32 aa, Artificial Sequence
  Description of Artificial Sequence: Synthetic polypeptide
DENEIGTTNPVSTEPYGTISMEDIQQQQNGNH

SEQ ID NO: 161978 - protein, 36 aa, Artificial Sequence
  Description of Artificial Sequence: Synthetic polypeptide
DENEIRTTNPVATEFYGSVVINANGLDQQTGQTGQG

SEQ ID NO: 161979 - protein, 36 aa, Artificial Sequence
  Description of Artificial Sequence: Synthetic polypeptide
DEEEIRTTNPVATEQYGSVDMPRIVLNINNFVAEDE

SEQ ID NO: 161980 - protein, 37 aa, Artificial Sequence
  Description of Artificial Sequence: Synthetic polypeptide
DEEEIRTTNPVATEGYGMVNNSGMGNNLQNNNGGIQM

SEQ ID NO: 161981 - protein, 33 aa, Artificial Sequence
  Description of Artificial Sequence: Synthetic polypeptide
SDECIATTNPVATEQWGKVSHTNDHQGQVDNPL

SEQ ID NO: 161982 - protein, 33 aa, Artificial Sequence
  Description of Artificial Sequence: Synthetic polypeptide
SDECIATTNPVATEQWGKVSHTNDHQGQQVNGL

SEQ ID NO: 161983 - protein, 38 aa, Artificial Sequence
  Description of Artificial Sequence: Synthetic polypeptide
DEEEIRTTNPVATEGYGMVNNSGMGNNLQNNNGQNGQV

SEQ ID NO: 161984 - protein, 33 aa, Artificial Sequence
  Description of Artificial Sequence: Synthetic polypeptide
DENEIGTTNPVSTEPYGTISMEDNIQQQQNGNH

SEQ ID NO: 161985 - protein, 31 aa, Artificial Sequence
  Description of Artificial Sequence: Synthetic polypeptide
DDSEVASTNPVSTEGYGWVAANTIQSRVGQR

SEQ ID NO: 161986 - protein, 32 aa, Artificial Sequence
  Description of Artificial Sequence: Synthetic polypeptide
SDECIATTNPVATEQWGKVCSTWEDHQQQQNS

SEQ ID NO: 161987 - protein, 35 aa, Artificial Sequence
  Description of Artificial Sequence: Synthetic polypeptide
DEITIATTNPVATEQYGSVSATDLNEDHQGLEDEL

SEQ ID NO: 161988 - protein, 36 aa, Artificial Sequence
  Description of Artificial Sequence: Synthetic polypeptide
MEEEIRTTNPVATEQYGAVDIDTNMNLETGGGQDTV

SEQ ID NO: 161989 - protein, 32 aa, Artificial Sequence
  Description of Artificial Sequence: Synthetic polypeptide
DENEIGTTNPVSTEPYGTISMEDIEQQQNGNH

SEQ ID NO: 161990 - protein, 38 aa, Artificial Sequence
  Description of Artificial Sequence: Synthetic polypeptide
DEEEIRTTNPVATEQYGSAYYSPSTYENTTSVGEENTF

SEQ ID NO: 161991 - protein, 30 aa, Artificial Sequence
  Description of Artificial Sequence: Synthetic polypeptide
DENEIRTTNPVATEGWGDVAEIEMNAAEDA

SEQ ID NO: 161992 - protein, 30 aa, Artificial Sequence
  Description of Artificial Sequence: Synthetic polypeptide
DENEIRTTNPVATEGWGDVAEIIMNAAEDA

SEQ ID NO: 161993 - protein, 36 aa, Artificial Sequence
  Description of Artificial Sequence: Synthetic polypeptide
DEGEIATTNPVATEQYGSVCAAMQNEEAPDNQEGNH

SEQ ID NO: 161994 - protein, 38 aa, Artificial Sequence
  Description of Artificial Sequence: Synthetic polypeptide
DEEEIRTTNPVATEQYGSAYSYTVNEDDSMSTQDGDDQ

SEQ ID NO: 161995 - protein, 36 aa, Artificial Sequence
  Description of Artificial Sequence: Synthetic polypeptide
DEEEIRTTNPVATEQYGSAYVAIEEKIENTEEDNDM

SEQ ID NO: 161996 - protein, 35 aa, Artificial Sequence
  Description of Artificial Sequence: Synthetic polypeptide
DEGEIATTNPVATEQYGSVCAAMNPLNDMDGGGEN

SEQ ID NO: 161997 - protein, 29 aa, Artificial Sequence
  Description of Artificial Sequence: Synthetic peptide
QESEIASTNPVGTEGYGVMASTPEFEGDD

SEQ ID NO: 161998 - protein, 29 aa, Artificial Sequence
  Description of Artificial Sequence: Synthetic peptide
QESEIASTNPVGTEGYGVMASTPEHEGDD

SEQ ID NO: 161999 - protein, 29 aa, Artificial Sequence
  Description of Artificial Sequence: Synthetic peptide
QESEIASTNPVGTEGYGVMASTPEHEGDI

SEQ ID NO: 162000 - protein, 36 aa, Artificial Sequence
  Description of Artificial Sequence: Synthetic polypeptide
DEEEIRTTNPVATEQYGSAYVAIEEQQENTEEDTDL

SEQ ID NO: 162001 - protein, 33 aa, Artificial Sequence
  Description of Artificial Sequence: Synthetic polypeptide
DEECNATTNPIAYEQWGEVCYTNEQDHDGDNGR

SEQ ID NO: 162002 - protein, 32 aa, Artificial Sequence
  Description of Artificial Sequence: Synthetic polypeptide
DEECNATTNPIAYEQWGEVCYTNDGDHDGDNR

SEQ ID NO: 162003 - protein, 32 aa, Artificial Sequence
  Description of Artificial Sequence: Synthetic polypeptide
DENEIRTTNPVATEGWGDVSNEAIEMNDAEDA

SEQ ID NO: 162004 - protein, 32 aa, Artificial Sequence
  Description of Artificial Sequence: Synthetic polypeptide
DENEIRTTNPVATEGWGDVSNEAIEMNANEDG

SEQ ID NO: 162005 - protein, 34 aa, Artificial Sequence
  Description of Artificial Sequence: Synthetic polypeptide
DECEIATTNPVATECWGSVCYNNDDQDHGDQDRG

SEQ ID NO: 162006 - protein, 34 aa, Artificial Sequence
  Description of Artificial Sequence: Synthetic polypeptide
DEECISTTNPVATEGYGCVCNTEAHQYFGSDNQS

SEQ ID NO: 162007 - protein, 36 aa, Artificial Sequence
  Description of Artificial Sequence: Synthetic polypeptide
DEQEISTTNPVATEQYGSVSATGDMGEDQEGEGDGE

SEQ ID NO: 162008 - protein, 39 aa, Artificial Sequence
  Description of Artificial Sequence: Synthetic polypeptide
DEEEIRTTNPVATESYGTVTTGQSNTISTNTQMGTVGNR

SEQ ID NO: 162009 - protein, 37 aa, Artificial Sequence
  Description of Artificial Sequence: Synthetic polypeptide
DEEEIRTTNPVATEQYGSAYWPTTNPENTSVGEENQT

SEQ ID NO: 162010 - protein, 33 aa, Artificial Sequence
  Description of Artificial Sequence: Synthetic polypeptide
FEEEIGSVNPVSTEQYGVVSSVNTQGQQGPNQT

SEQ ID NO: 162011 - protein, 35 aa, Artificial Sequence
  Description of Artificial Sequence: Synthetic polypeptide
DEGEIATTNPVATEQYGSVCAAMHPLNMGGENGTL

SEQ ID NO: 162012 - protein, 33 aa, Artificial Sequence
  Description of Artificial Sequence: Synthetic polypeptide
DEECISTTNPVATEGYGCVCNTEGHNQYFGSDQ

SEQ ID NO: 162013 - protein, 31 aa, Artificial Sequence
  Description of Artificial Sequence: Synthetic polypeptide
DENEIRTTNPVATEGWGDVSEAIEMNAAEDA

SEQ ID NO: 162014 - protein, 30 aa, Artificial Sequence
  Description of Artificial Sequence: Synthetic polypeptide
DENEIRTTNPVATEGWGDVANIIMNAAEDA

SEQ ID NO: 162015 - protein, 32 aa, Artificial Sequence
  Description of Artificial Sequence: Synthetic polypeptide
FEEEIGSVNPVSTEQYGVVSVNTQGQQGPHVL

SEQ ID NO: 162016 - protein, 32 aa, Artificial Sequence
  Description of Artificial Sequence: Synthetic polypeptide
FEEEIGSVNPVSTEQYGVVSVNTQGQQGPMVQ

SEQ ID NO: 162017 - protein, 33 aa, Artificial Sequence
  Description of Artificial Sequence: Synthetic polypeptide
FEEEIGSVNPVSTEQYGVVSVNTQGQQTGPNNQ

SEQ ID NO: 162018 - protein, 33 aa, Artificial Sequence
  Description of Artificial Sequence: Synthetic polypeptide
FEEEIGSVNPVSTEQYGVVSVNTQGQQVGPNQW

SEQ ID NO: 162019 - protein, 33 aa, Artificial Sequence
  Description of Artificial Sequence: Synthetic polypeptide
DEECNATTNPIAYEQWGEVCSTWDDQDHDGNNR

SEQ ID NO: 162020 - protein, 32 aa, Artificial Sequence
  Description of Artificial Sequence: Synthetic polypeptide
DENEIDTTNPVSTEPYGTISMEDIQQNQNGNH

SEQ ID NO: 162021 - protein, 37 aa, Artificial Sequence
  Description of Artificial Sequence: Synthetic polypeptide
MEEEIRTTNPVATEQYGAVDIDTNMNLESEGGGQENT

SEQ ID NO: 162022 - protein, 31 aa, Artificial Sequence
  Description of Artificial Sequence: Synthetic polypeptide
SEAEIACTNPVATAQWGCVAGTMLQHDDNPE

SEQ ID NO: 162023 - protein, 35 aa, Artificial Sequence
  Description of Artificial Sequence: Synthetic polypeptide
DEEVIATTNPVAYEQWGTVCSTNDNHDQNGGDNTS

SEQ ID NO: 162024 - protein, 33 aa, Artificial Sequence
  Description of Artificial Sequence: Synthetic polypeptide
DEEVIATTNPDATEGYGSCFSTPPLAGYGEYDG

SEQ ID NO: 162025 - protein, 30 aa, Artificial Sequence
  Description of Artificial Sequence: Synthetic polypeptide
DESEIASTNPVGTEGYGVIAMDLQQQNGDH

SEQ ID NO: 162026 - protein, 32 aa, Artificial Sequence
  Description of Artificial Sequence: Synthetic polypeptide
ENEEIATTNPVAYERWGVVYTTNQGDHGPNDR

SEQ ID NO: 162027 - protein, 33 aa, Artificial Sequence
  Description of Artificial Sequence: Synthetic polypeptide
DEQEIRTTNPVSTEPYGTISMEDIQQQQNGMNH

SEQ ID NO: 162028 - protein, 35 aa, Artificial Sequence
  Description of Artificial Sequence: Synthetic polypeptide
DEGEIATTNPVATEQYGSVCAATANDADMPPNAND

SEQ ID NO: 162029 - protein, 35 aa, Artificial Sequence
  Description of Artificial Sequence: Synthetic polypeptide
SEAEIATTNPVATEQYGSVATNNLEADTPPDNAQM

SEQ ID NO: 162030 - protein, 36 aa, Artificial Sequence
  Description of Artificial Sequence: Synthetic polypeptide
DEEEIRTTNPVATEQYGSVSEPPEYEIEHALMNIET

SEQ ID NO: 162031 - protein, 36 aa, Artificial Sequence
  Description of Artificial Sequence: Synthetic polypeptide
DEAEIRTTNPVATECWGSVSRCINEEPQVRDDENLG

SEQ ID NO: 162032 - protein, 33 aa, Artificial Sequence
  Description of Artificial Sequence: Synthetic polypeptide
DEQEIRTTNPVSTEPYGTISMEDIQQQQNGNHW

SEQ ID NO: 162033 - protein, 33 aa, Artificial Sequence
  Description of Artificial Sequence: Synthetic polypeptide
DEEVIATTNPDATEGYGSCSTPLGAGYMEEYDG

SEQ ID NO: 162034 - protein, 36 aa, Artificial Sequence
  Description of Artificial Sequence: Synthetic polypeptide
DEEEIRCTNPVATEQYGCVCSNTGEHQENFGSEFQA

SEQ ID NO: 162035 - protein, 36 aa, Artificial Sequence
  Description of Artificial Sequence: Synthetic polypeptide
DENEICTTNPVATEQYGSVFTGWYNPETQHQDNQIM

SEQ ID NO: 162036 - protein, 33 aa, Artificial Sequence
  Description of Artificial Sequence: Synthetic polypeptide
ENEEIATTNPVAYERWGVVYTNLQGDHGPTNSE

SEQ ID NO: 162037 - protein, 36 aa, Artificial Sequence
  Description of Artificial Sequence: Synthetic polypeptide
DEEEIRCTNPVATEQYGCVCSNTEHNQENFNSETQT

SEQ ID NO: 162038 - protein, 36 aa, Artificial Sequence
  Description of Artificial Sequence: Synthetic polypeptide
MEEEIRTTNPVATEQYGSVDNFNMNNVGEIGGNGEE

SEQ ID NO: 162039 - protein, 35 aa, Artificial Sequence
  Description of Artificial Sequence: Synthetic polypeptide
DENEICTTNPVATEQYGSVFTWTYGPQTQEDNQIM

SEQ ID NO: 162040 - protein, 35 aa, Artificial Sequence
  Description of Artificial Sequence: Synthetic polypeptide
DEEEIRCTNPVATEQYGCVCSNSGEHNQNFNSDQA

SEQ ID NO: 162041 - protein, 33 aa, Artificial Sequence
  Description of Artificial Sequence: Synthetic polypeptide
DECEIATTNPVATEHWGCVCYQNDDQDHGDQDR

SEQ ID NO: 162042 - protein, 30 aa, Artificial Sequence
  Description of Artificial Sequence: Synthetic polypeptide
QESEIASTNPVGTEGYGVMASTLQYHGDDI

SEQ ID NO: 162043 - protein, 32 aa, Artificial Sequence
  Description of Artificial Sequence: Synthetic polypeptide
SEAEIATTNPVATEQYGCTAATENLTADIMPD

SEQ ID NO: 162044 - protein, 33 aa, Artificial Sequence
  Description of Artificial Sequence: Synthetic polypeptide
DEEVIATTNPDATEGYGSCSTPLGAMYMQEDDG

SEQ ID NO: 162045 - protein, 39 aa, Artificial Sequence
  Description of Artificial Sequence: Synthetic polypeptide
DEEEIRTTNPVATEQYGVVSTVNNNQQGNQQGTTNQQQD

SEQ ID NO: 162046 - protein, 36 aa, Artificial Sequence
  Description of Artificial Sequence: Synthetic polypeptide
DENEICTTNPVATEQYGSVFTWTYNPQTMPQDNQIM

SEQ ID NO: 162047 - protein, 37 aa, Artificial Sequence
  Description of Artificial Sequence: Synthetic polypeptide
DEEEIRTTNPVATEQYGSAVSWVMNDEGAQLPMFDVE

SEQ ID NO: 162048 - protein, 33 aa, Artificial Sequence
  Description of Artificial Sequence: Synthetic polypeptide
DEEVIATTNPDATEGYGSCSTPLGARYEEEYDC

SEQ ID NO: 162049 - protein, 34 aa, Artificial Sequence
  Description of Artificial Sequence: Synthetic polypeptide
ENNEIATTNPVATTQWGNVSKTWNPNEQQDGNDR

SEQ ID NO: 162050 - protein, 35 aa, Artificial Sequence
  Description of Artificial Sequence: Synthetic polypeptide
DENEIRTTNPVATEIYGCVCSNWNHNQENFGSDQA

SEQ ID NO: 162051 - protein, 36 aa, Artificial Sequence
  Description of Artificial Sequence: Synthetic polypeptide
DENEICTTNPVATEQYGSVFTWTYNPQTQFNDNQIV

SEQ ID NO: 162052 - protein, 38 aa, Artificial Sequence
  Description of Artificial Sequence: Synthetic polypeptide
AEEEIRTTNPVATEQYGVVSTVTNNQQGNQQAGNNEGD

SEQ ID NO: 162053 - protein, 34 aa, Artificial Sequence
  Description of Artificial Sequence: Synthetic polypeptide
SEAEIATTNPVATEQYGSVCAMTGPLEATDDTGN

SEQ ID NO: 162054 - protein, 34 aa, Artificial Sequence
  Description of Artificial Sequence: Synthetic polypeptide
ENEEIATTNPVATTQWGNVSKTWNPNEQQQNDRE

SEQ ID NO: 162055 - protein, 35 aa, Artificial Sequence
  Description of Artificial Sequence: Synthetic polypeptide
ENEEIATTNPVATTQWGSVSKTWNPEMERNGQNSE

SEQ ID NO: 162056 - protein, 28 aa, Artificial Sequence
  Description of Artificial Sequence: Synthetic peptide
DESEIASTNPVGTEGYGVMASIEQAEDA

SEQ ID NO: 162057 - protein, 33 aa, Artificial Sequence
  Description of Artificial Sequence: Synthetic polypeptide
ENEEIATTNPVAYEQWGCVSTTNHPNDAGNNDQ

SEQ ID NO: 162058 - protein, 36 aa, Artificial Sequence
  Description of Artificial Sequence: Synthetic polypeptide
DEEEIRTTNPVATEQYGSAVSPIFNNVVMPIMPEDP

SEQ ID NO: 162059 - protein, 36 aa, Artificial Sequence
  Description of Artificial Sequence: Synthetic polypeptide
MEEEIRTTNPVATEQYGSVMGIDDEGGNDDDDEGNN

SEQ ID NO: 162060 - protein, 35 aa, Artificial Sequence
  Description of Artificial Sequence: Synthetic polypeptide
DEAGEIATTNPVAYEQWGSVCYTENDLDDLGDMRD

SEQ ID NO: 162061 - protein, 36 aa, Artificial Sequence
  Description of Artificial Sequence: Synthetic polypeptide
DEGEIATTNPVATEQYGSVCAATMHGEATADGDNRM

SEQ ID NO: 162062 - protein, 35 aa, Artificial Sequence
  Description of Artificial Sequence: Synthetic polypeptide
MEEEIRTTNPVATEQYGSVMGDMANNAEDGGGDGN

SEQ ID NO: 162063 - protein, 34 aa, Artificial Sequence
  Description of Artificial Sequence: Synthetic polypeptide
DEGEIATTNPVATEQYGSVCAATMGEEANDNMNN

SEQ ID NO: 162064 - protein, 39 aa, Artificial Sequence
  Description of Artificial Sequence: Synthetic polypeptide
DEEEIRTTNPVATEQYGVVSVVVVTNNNNLQQIGTDEEQ

SEQ ID NO: 162065 - protein, 38 aa, Artificial Sequence
  Description of Artificial Sequence: Synthetic polypeptide
AEEEIRTTNPVATEQYGVVSTVTNNQNNQGENGNNSED

SEQ ID NO: 162066 - protein, 34 aa, Artificial Sequence
  Description of Artificial Sequence: Synthetic polypeptide
DEAEIRTTNPVATECWGSVSRCINEPAVSDDENE

SEQ ID NO: 162067 - protein, 38 aa, Artificial Sequence
  Description of Artificial Sequence: Synthetic polypeptide
AEEEIRTTNPVATEQYGVVSTVTNNQNNQQGNGGNNQQ

SEQ ID NO: 162068 - protein, 35 aa, Artificial Sequence
  Description of Artificial Sequence: Synthetic polypeptide
DEAEIRTTNPVATECWGSVWRCINEPQVRDDENLQ

SEQ ID NO: 162069 - protein, 34 aa, Artificial Sequence
  Description of Artificial Sequence: Synthetic polypeptide
ENEEIATTNPVAYEQWGVVCSTELQGDHGQNTMP

SEQ ID NO: 162070 - protein, 36 aa, Artificial Sequence
  Description of Artificial Sequence: Synthetic polypeptide
DEGEIATTNPVATEQYGSVCAATHLEATANAENNRQ

SEQ ID NO: 162071 - protein, 31 aa, Artificial Sequence
  Description of Artificial Sequence: Synthetic polypeptide
DDSEVASTNPVSTEGYGVVAINDIQSREGQR

SEQ ID NO: 162072 - protein, 33 aa, Artificial Sequence
  Description of Artificial Sequence: Synthetic polypeptide
DEQEIRTTNPVSTEPYGTIHSMEDIQQQQNGNH

SEQ ID NO: 162073 - protein, 37 aa, Artificial Sequence
  Description of Artificial Sequence: Synthetic polypeptide
MEEEIRTTNPVATEQYGSVGSLLMTADEHLEMQSDTE

SEQ ID NO: 162074 - protein, 33 aa, Artificial Sequence
  Description of Artificial Sequence: Synthetic polypeptide
DEQEIRTTNPVSTEPYGTISAMEDIQQDQNGNH

SEQ ID NO: 162075 - protein, 33 aa, Artificial Sequence
  Description of Artificial Sequence: Synthetic polypeptide
DEQEIRTTNPVSTEPYGTISAMEDLQQQHNGEH

SEQ ID NO: 162076 - protein, 37 aa, Artificial Sequence
  Description of Artificial Sequence: Synthetic polypeptide
DEEEIRTTNPVATEQYGSVSEPVNFNDPVSMPNVEQH

SEQ ID NO: 162077 - protein, 35 aa, Artificial Sequence
  Description of Artificial Sequence: Synthetic polypeptide
DEEEIRCTNPVATEQYGCVCSNWGEHQNFNSENQL

SEQ ID NO: 162078 - protein, 32 aa, Artificial Sequence
  Description of Artificial Sequence: Synthetic polypeptide
DEQEIRTTNPVSTEPYGTISMEDIQQQHNGEH

SEQ ID NO: 162079 - protein, 31 aa, Artificial Sequence
  Description of Artificial Sequence: Synthetic polypeptide
DESEIASTNPVGTEGYGVISMEDLQQQNGDH

SEQ ID NO: 162080 - protein, 34 aa, Artificial Sequence
  Description of Artificial Sequence: Synthetic polypeptide
ENEEIATTNPVAYEQWGVVCSTELPQGDHGQNTE

SEQ ID NO: 162081 - protein, 38 aa, Artificial Sequence
  Description of Artificial Sequence: Synthetic polypeptide
AEEEIRTTNPVATEQYGVVSTVTNNTNNQQGNNNEQQD

SEQ ID NO: 162082 - protein, 36 aa, Artificial Sequence
  Description of Artificial Sequence: Synthetic polypeptide
DENEICTTNPVATEQYGSVFTWTYNPQTQLQDSQIN

SEQ ID NO: 162083 - protein, 29 aa, Artificial Sequence
  Description of Artificial Sequence: Synthetic peptide
ENNEIATTNPVAYECWGCVYECLQHEGAH

SEQ ID NO: 162084 - protein, 34 aa, Artificial Sequence
  Description of Artificial Sequence: Synthetic polypeptide
DEECISTTNPVATEGYGCVCGTEAHNQYFGSNQS

SEQ ID NO: 162085 - protein, 32 aa, Artificial Sequence
  Description of Artificial Sequence: Synthetic polypeptide
DENEICTTNPVAYEQWGTVSKEIENRQAEDDA

SEQ ID NO: 162086 - protein, 38 aa, Artificial Sequence
  Description of Artificial Sequence: Synthetic polypeptide
MEEEIRTTNPVATEQYGSCGSVTTGDNGLGGEQEGIIQ

SEQ ID NO: 162087 - protein, 36 aa, Artificial Sequence
  Description of Artificial Sequence: Synthetic polypeptide
ESSVIATTNPVATEQYGSVPSITNEQSFYPGGNNRI

SEQ ID NO: 162088 - protein, 37 aa, Artificial Sequence
  Description of Artificial Sequence: Synthetic polypeptide
MEEEIRTTNPVATEQYGSCGSVTTGDNGLGGEQEDGI

SEQ ID NO: 162089 - protein, 29 aa, Artificial Sequence
  Description of Artificial Sequence: Synthetic peptide
QESEIASTNPVGTEGYGVMASTLTAHGDI

SEQ ID NO: 162090 - protein, 32 aa, Artificial Sequence
  Description of Artificial Sequence: Synthetic polypeptide
DENEICTTNPVSTEPYGTISMEDIQQQQNGNC

SEQ ID NO: 162091 - protein, 37 aa, Artificial Sequence
  Description of Artificial Sequence: Synthetic polypeptide
AEEEIRTTNPVATEQYGVVSTVTNQQQQQNNTNVATE

SEQ ID NO: 162092 - protein, 35 aa, Artificial Sequence
  Description of Artificial Sequence: Synthetic polypeptide
ETAEIATTNPVATEQYGSVSWNEGDQQDRQQGDHN

SEQ ID NO: 162093 - protein, 32 aa, Artificial Sequence
  Description of Artificial Sequence: Synthetic polypeptide
DENEICTTNPVSTEPYGTISMEDIQQQQNGNH

SEQ ID NO: 162094 - protein, 39 aa, Artificial Sequence
  Description of Artificial Sequence: Synthetic polypeptide
DEEEIRTTNPVATESYGVVTNLQSGTIGTNTQNQEDGNR

SEQ ID NO: 162095 - protein, 38 aa, Artificial Sequence
  Description of Artificial Sequence: Synthetic polypeptide
DEEEIRTTNPVATEQYGVVSVVVVTNQNQAGTTTEEDD

SEQ ID NO: 162096 - protein, 35 aa, Artificial Sequence
  Description of Artificial Sequence: Synthetic polypeptide
SEAEIACTNPVATEQYGSVASANIIIDQLAMGPER

SEQ ID NO: 162097 - protein, 35 aa, Artificial Sequence
  Description of Artificial Sequence: Synthetic polypeptide
ETAEIRTTNPVAYEQWGSVCQTDNHDGQRTGQDDR

SEQ ID NO: 162098 - protein, 29 aa, Artificial Sequence
  Description of Artificial Sequence: Synthetic peptide
QESEIASTNPVGTEGYGVMASTLVMHGDI

SEQ ID NO: 162099 - protein, 34 aa, Artificial Sequence
  Description of Artificial Sequence: Synthetic polypeptide
DEAEIATTNPVATEPYGSVCIIEQDQGLDHNGQA

SEQ ID NO: 162100 - protein, 32 aa, Artificial Sequence
  Description of Artificial Sequence: Synthetic polypeptide
SEAEIACTNPVATEQWGCVAGTAMLQHQDDNP

SEQ ID NO: 162101 - protein, 30 aa, Artificial Sequence
  Description of Artificial Sequence: Synthetic polypeptide
DDSEVASTNPVSTEGYGVVANTIQSRVGQR

SEQ ID NO: 162102 - protein, 39 aa, Artificial Sequence
  Description of Artificial Sequence: Synthetic polypeptide
DEEEIRTTNPVATESYGTVTTVQSVTISTNTQMQEGGNT

SEQ ID NO: 162103 - protein, 38 aa, Artificial Sequence
  Description of Artificial Sequence: Synthetic polypeptide
DEEEIRTTNPVATEGYGMVNNSGMGNNLQNNNGEQNQV

SEQ ID NO: 162104 - protein, 31 aa, Artificial Sequence
  Description of Artificial Sequence: Synthetic polypeptide
ETEEIATTNPCAYEEWGSVYFVDMQRQEGNS

SEQ ID NO: 162105 - protein, 31 aa, Artificial Sequence
  Description of Artificial Sequence: Synthetic polypeptide
ETEEIATTNPCAYEEWGSVYYVDDQRQQGNW

SEQ ID NO: 162106 - protein, 29 aa, Artificial Sequence
  Description of Artificial Sequence: Synthetic peptide
QESEIASTNPVGTEGYGVMASTLWHGDSI

SEQ ID NO: 162107 - protein, 39 aa, Artificial Sequence
  Description of Artificial Sequence: Synthetic polypeptide
DEEEIRTTNPVATESYGTVTTTQSVTISTNTEMQEVGNT

SEQ ID NO: 162108 - protein, 31 aa, Artificial Sequence
  Description of Artificial Sequence: Synthetic polypeptide
ETEEIATTNPCAYEEWGSVYYVDNQRGQGNP

SEQ ID NO: 162109 - protein, 35 aa, Artificial Sequence
  Description of Artificial Sequence: Synthetic polypeptide
DEGEIATTNPVATEQYGSVCAANMGEEQTDDGGQE

SEQ ID NO: 162110 - protein, 29 aa, Artificial Sequence
  Description of Artificial Sequence: Synthetic peptide
QESEIASTNPVGTEGYGVMASTLVHGQDI

SEQ ID NO: 162111 - protein, 36 aa, Artificial Sequence
  Description of Artificial Sequence: Synthetic polypeptide
DEGEIATTNPVATEQYGSVCAANNNPEAPDNQEGNH

SEQ ID NO: 162112 - protein, 29 aa, Artificial Sequence
  Description of Artificial Sequence: Synthetic peptide
QESEIASTNPVGTEGYGVMASTLSHGDII

SEQ ID NO: 162113 - protein, 31 aa, Artificial Sequence
  Description of Artificial Sequence: Synthetic polypeptide
DENEICTTNPVAYEQWGTVSKEIEMNTQEDA

SEQ ID NO: 162114 - protein, 29 aa, Artificial Sequence
  Description of Artificial Sequence: Synthetic peptide
ENNEIATTNPVAYEPWGDVSECLQHMEEI

SEQ ID NO: 162115 - protein, 33 aa, Artificial Sequence
  Description of Artificial Sequence: Synthetic polypeptide
DEEVIATTNPDATEGYGSCSTPPLAHGKGEYDG

SEQ ID NO: 162116 - protein, 28 aa, Artificial Sequence
  Description of Artificial Sequence: Synthetic peptide
ENNEIATTNPVAYERWGCVYECLQHEMA

SEQ ID NO: 162117 - protein, 36 aa, Artificial Sequence
  Description of Artificial Sequence: Synthetic polypeptide
DENEICTTNPVATEQYGSVFTWTYNPQTQPEDNQIN

SEQ ID NO: 162118 - protein, 38 aa, Artificial Sequence
  Description of Artificial Sequence: Synthetic polypeptide
DEEEIRTTNPVATEQYGSAVSWVMTDEGAQVQMINEVE

SEQ ID NO: 162119 - protein, 38 aa, Artificial Sequence
  Description of Artificial Sequence: Synthetic polypeptide
AEEEIRTTNPVATEQYGVVSTVTNQGGNQQGNGNNQQD

SEQ ID NO: 162120 - protein, 35 aa, Artificial Sequence
  Description of Artificial Sequence: Synthetic polypeptide
DENEICTTNPVATEQYGSVFTWTYNPQTQQDTQIE

SEQ ID NO: 162121 - protein, 36 aa, Artificial Sequence
  Description of Artificial Sequence: Synthetic polypeptide
DEAEIATTNPVATEPYGSVAITLIDHQERQGQGNHP

SEQ ID NO: 162122 - protein, 34 aa, Artificial Sequence
  Description of Artificial Sequence: Synthetic polypeptide
DEEVIATTNPVATEPWGISVCSYSPVSQHMGNNG

SEQ ID NO: 162123 - protein, 39 aa, Artificial Sequence
  Description of Artificial Sequence: Synthetic polypeptide
DEEEIRTTNPVATESYGVVTTGQSGTISTNLQMQEIGNT

SEQ ID NO: 162124 - protein, 33 aa, Artificial Sequence
  Description of Artificial Sequence: Synthetic polypeptide
SEAEIACTNPVATEQYGSVCATNNLHDSLDDAE

SEQ ID NO: 162125 - protein, 36 aa, Artificial Sequence
  Description of Artificial Sequence: Synthetic polypeptide
DENEICTTNPVATEQYGSVFTWTYNPVTQGQDNQIM

SEQ ID NO: 162126 - protein, 31 aa, Artificial Sequence
  Description of Artificial Sequence: Synthetic polypeptide
DDSEVASTNPVSTEGYGVVAMNTIQSRIGQR

SEQ ID NO: 162127 - protein, 30 aa, Artificial Sequence
  Description of Artificial Sequence: Synthetic polypeptide
QESEIASTNPVGTEGYGVMASTLQYHGRDI

SEQ ID NO: 162128 - protein, 31 aa, Artificial Sequence
  Description of Artificial Sequence: Synthetic polypeptide
DENEIRTTNPVATEHWGDVSSEIEMNAAEDA

SEQ ID NO: 162129 - protein, 39 aa, Artificial Sequence
  Description of Artificial Sequence: Synthetic polypeptide
DEEEIRTTNPVATEQYGVVSVVVVTNNQAGNTEQYGQTE

SEQ ID NO: 162130 - protein, 33 aa, Artificial Sequence
  Description of Artificial Sequence: Synthetic polypeptide
EQEEIATTNPVAYEQWGSTYISNDQHEHGGNDR

SEQ ID NO: 162131 - protein, 35 aa, Artificial Sequence
  Description of Artificial Sequence: Synthetic polypeptide
DEGEIATTNPVATEQYGSVCAAPENTENDDLGAQG

SEQ ID NO: 162132 - protein, 31 aa, Artificial Sequence
  Description of Artificial Sequence: Synthetic polypeptide
DENEIRTTNPVATEHWGDVSQEIEMNAAEDA

SEQ ID NO: 162133 - protein, 31 aa, Artificial Sequence
  Description of Artificial Sequence: Synthetic polypeptide
YEMEIASTNPVCTEQYGVVSADDGPVESGNQ

SEQ ID NO: 162134 - protein, 32 aa, Artificial Sequence
  Description of Artificial Sequence: Synthetic polypeptide
DESEIASTNPVGTEGYGSMACITLQDREGEDG

SEQ ID NO: 162135 - protein, 38 aa, Artificial Sequence
  Description of Artificial Sequence: Synthetic polypeptide
DEEEIRTTNPVATEQYGVVSVVVVTNNTEQGNNTEEED

SEQ ID NO: 162136 - protein, 29 aa, Artificial Sequence
  Description of Artificial Sequence: Synthetic peptide
QESEIASTNPVGTEGYGVMASTLSHGDDI

SEQ ID NO: 162137 - protein, 35 aa, Artificial Sequence
  Description of Artificial Sequence: Synthetic polypeptide
MEEEIRTTNPVATEQYGSIHNTTLEDTNGESDEQC

SEQ ID NO: 162138 - protein, 35 aa, Artificial Sequence
  Description of Artificial Sequence: Synthetic polypeptide
DEEEIRCTNPVATEQYGCVCSMWGEDFQGFNSNQG

SEQ ID NO: 162139 - protein, 39 aa, Artificial Sequence
  Description of Artificial Sequence: Synthetic polypeptide
DEEEIRTTNPVATESYGVVTNLQSGTISTNLQNQEAGNV

SEQ ID NO: 162140 - protein, 38 aa, Artificial Sequence
  Description of Artificial Sequence: Synthetic polypeptide
DEEEIRTTNPVATEQYGVVSVVVVTNPDEQGNNEEEED

SEQ ID NO: 162141 - protein, 30 aa, Artificial Sequence
  Description of Artificial Sequence: Synthetic polypeptide
QESEIASTNPVGTEGYGVMASTLWQHGDIG

SEQ ID NO: 162142 - protein, 37 aa, Artificial Sequence
  Description of Artificial Sequence: Synthetic polypeptide
FEEEIRTTNPVATEQYGSVQISTPTVEQQNVGSFVGE

SEQ ID NO: 162143 - protein, 37 aa, Artificial Sequence
  Description of Artificial Sequence: Synthetic polypeptide
FEEEIRTTNPVATEQYGSVQMSMNNTEQEGMEPPELI

SEQ ID NO: 162144 - protein, 35 aa, Artificial Sequence
  Description of Artificial Sequence: Synthetic polypeptide
DEATEIATTNPVAYEQWGSVSGPNGNAGNGGNGDR

SEQ ID NO: 162145 - protein, 36 aa, Artificial Sequence
  Description of Artificial Sequence: Synthetic polypeptide
FEQEIRTTNPVATEQYGSVIVDDNDLQIIGGGQGQQ

SEQ ID NO: 162146 - protein, 34 aa, Artificial Sequence
  Description of Artificial Sequence: Synthetic polypeptide
IESEIRTTNPVATEQYGAASDVQDLNNQDAQEQI

SEQ ID NO: 162147 - protein, 35 aa, Artificial Sequence
  Description of Artificial Sequence: Synthetic polypeptide
FEQEISTTNPVATEQYGSVSATGDMEDQEGEGQGD

SEQ ID NO: 162148 - protein, 32 aa, Artificial Sequence
  Description of Artificial Sequence: Synthetic polypeptide
DENEIRTTNPFSTEPYGTISMEDKQQQQNGNH

SEQ ID NO: 162149 - protein, 33 aa, Artificial Sequence
  Description of Artificial Sequence: Synthetic polypeptide
FESEIRATNPVATDIYGVVSTRGLGAFQEEGGQ

SEQ ID NO: 162150 - protein, 37 aa, Artificial Sequence
  Description of Artificial Sequence: Synthetic polypeptide
DEEEIRATNPVATEQYGSVCSPVDNNHNIDAMGMTNW

SEQ ID NO: 162151 - protein, 32 aa, Artificial Sequence
  Description of Artificial Sequence: Synthetic polypeptide
DENEIRTTNPFSTEPYGTISMEDIQQQQNGNH

SEQ ID NO: 162152 - protein, 32 aa, Artificial Sequence
  Description of Artificial Sequence: Synthetic polypeptide
DENEIRTTNPFSTEPYGTISMEDIQQDQNGNH

SEQ ID NO: 162153 - protein, 35 aa, Artificial Sequence
  Description of Artificial Sequence: Synthetic polypeptide
DEAEIATTNPVATEQYGCVCSTTDLNEEHIGSEDL

SEQ ID NO: 162154 - protein, 35 aa, Artificial Sequence
  Description of Artificial Sequence: Synthetic polypeptide
DAEEIATTNPVATEYWGTVISEGNALSATTGGNTR

SEQ ID NO: 162155 - protein, 32 aa, Artificial Sequence
  Description of Artificial Sequence: Synthetic polypeptide
DENEIRTTNPESTEPYGTISMEDIQQQQNGNH

SEQ ID NO: 162156 - protein, 34 aa, Artificial Sequence
  Description of Artificial Sequence: Synthetic polypeptide
IESEIRTTNPVATEQYGAASDVLDFNNQDSQEHN

SEQ ID NO: 162157 - protein, 36 aa, Artificial Sequence
  Description of Artificial Sequence: Synthetic polypeptide
DEEEIRATNPVATEQYGSVCTDTPLPDDSGDGMGMN

SEQ ID NO: 162158 - protein, 35 aa, Artificial Sequence
  Description of Artificial Sequence: Synthetic polypeptide
FETEIRTTNPVATEQYGSVTDQVNEGQDGGEEGGA

SEQ ID NO: 162159 - protein, 28 aa, Artificial Sequence
  Description of Artificial Sequence: Synthetic peptide
QESEIASTNPVGTNGYGVMASTTQHGDI

SEQ ID NO: 162160 - protein, 28 aa, Artificial Sequence
  Description of Artificial Sequence: Synthetic peptide
QESEIASTNPVGTSGYGVMASTLTHGDI

SEQ ID NO: 162161 - protein, 29 aa, Artificial Sequence
  Description of Artificial Sequence: Synthetic peptide
QESEIASTNPVGTYGYGVMASTLQHGSDI

SEQ ID NO: 162162 - protein, 29 aa, Artificial Sequence
  Description of Artificial Sequence: Synthetic peptide
QESEIASTNPVGWEGYGVMAESTLQHGDI

SEQ ID NO: 162163 - protein, 28 aa, Artificial Sequence
  Description of Artificial Sequence: Synthetic peptide
QESEIASTNPVGWEGYGVMAKTLQHGDI

SEQ ID NO: 162164 - protein, 36 aa, Artificial Sequence
  Description of Artificial Sequence: Synthetic polypeptide
DEEEIRTTNPVATEQYGSVVYDGMFGQEGDQEEDDD

SEQ ID NO: 162165 - protein, 32 aa, Artificial Sequence
  Description of Artificial Sequence: Synthetic polypeptide
AEEEIRTTNPVAYEAWGCFCIDDDQQRMGGNH

SEQ ID NO: 162166 - protein, 33 aa, Artificial Sequence
  Description of Artificial Sequence: Synthetic polypeptide
DEGEIACTNPVATAQWGCVAGTALTQADGNTDM

SEQ ID NO: 162167 - protein, 37 aa, Artificial Sequence
  Description of Artificial Sequence: Synthetic polypeptide
DEEEIRTTNPVATEQYGSCTAPEQTGLDQIEQGMVAD

SEQ ID NO: 162168 - protein, 36 aa, Artificial Sequence
  Description of Artificial Sequence: Synthetic polypeptide
FQVERFIHRETNFVATIEARYMGSVSTNLKQGYGNR

SEQ ID NO: 162169 - protein, 33 aa, Artificial Sequence
  Description of Artificial Sequence: Synthetic polypeptide
CEEVIACTNPVATEQYGCVAGTNLATMNPNSNV

SEQ ID NO: 162170 - protein, 35 aa, Artificial Sequence
  Description of Artificial Sequence: Synthetic polypeptide
IEQEIRTTNPVATEQYGAASDVQDDVNNQDGQEYI

SEQ ID NO: 162171 - protein, 28 aa, Artificial Sequence
  Description of Artificial Sequence: Synthetic peptide
QESEIASTNPVGTNGYGVMACTLQHGDI

SEQ ID NO: 162172 - protein, 33 aa, Artificial Sequence
  Description of Artificial Sequence: Synthetic polypeptide
QESEIATTNPVGTEGYGVMSATSPTLQHNGNPV

SEQ ID NO: 162173 - protein, 35 aa, Artificial Sequence
  Description of Artificial Sequence: Synthetic polypeptide
IESEIRTTNPVATEQYGAASDVQDLNNQDFGQEMI

SEQ ID NO: 162174 - protein, 36 aa, Artificial Sequence
  Description of Artificial Sequence: Synthetic polypeptide
DEEEIRATNPVATEQYGSVINMGNNTGQEDGQTGGQ

SEQ ID NO: 162175 - protein, 34 aa, Artificial Sequence
  Description of Artificial Sequence: Synthetic polypeptide
DEGCIRCTNPVAYEQYGSVVSVNEFSTRGGPELM

SEQ ID NO: 162176 - protein, 32 aa, Artificial Sequence
  Description of Artificial Sequence: Synthetic polypeptide
DEGEIATTNPVATAQWGSVAATGAGGQPQDAF

SEQ ID NO: 162177 - protein, 34 aa, Artificial Sequence
  Description of Artificial Sequence: Synthetic polypeptide
DEGEIATTNPVATAQWGSVAAGNLFTPNPMGPRN

SEQ ID NO: 162178 - protein, 38 aa, Artificial Sequence
  Description of Artificial Sequence: Synthetic polypeptide
AEEEIRTTNPVATEQYGVVVVTTTNQLGGTEQGTNGND

SEQ ID NO: 162179 - protein, 37 aa, Artificial Sequence
  Description of Artificial Sequence: Synthetic polypeptide
DEEEIRTTNPVATEGYGSVINMNLVGDDQDQEDDDGN

SEQ ID NO: 162180 - protein, 34 aa, Artificial Sequence
  Description of Artificial Sequence: Synthetic polypeptide
DEEEIRTTNPVATEGYGSVIVLVGMGEGDETTDD

SEQ ID NO: 162181 - protein, 30 aa, Artificial Sequence
  Description of Artificial Sequence: Synthetic polypeptide
QESEIASTNPVGTEYGYGVMASTLQHEGDI

SEQ ID NO: 162182 - protein, 28 aa, Artificial Sequence
  Description of Artificial Sequence: Synthetic peptide
QESEIASTNPVGTHGYGVMASTFQHGDI

SEQ ID NO: 162183 - protein, 29 aa, Artificial Sequence
  Description of Artificial Sequence: Synthetic peptide
QESEIASTNPVGTHGYGVMASTLQHGDVI

SEQ ID NO: 162184 - protein, 35 aa, Artificial Sequence
  Description of Artificial Sequence: Synthetic polypeptide
FENEIKTTNPVATETYGSVSAFNSLIQEVGDTTPA

SEQ ID NO: 162185 - protein, 28 aa, Artificial Sequence
  Description of Artificial Sequence: Synthetic peptide
QESEIASTNPVGTHGYGVMASTLQHYDI

SEQ ID NO: 162186 - protein, 31 aa, Artificial Sequence
  Description of Artificial Sequence: Synthetic polypeptide
QESEIATTNPVSTEPYGTMSSETIQQHNGDH

SEQ ID NO: 162187 - protein, 36 aa, Artificial Sequence
  Description of Artificial Sequence: Synthetic polypeptide
FEQEIRTTNPVATEQYGSVGVDTNAEGQGNQEENGD

SEQ ID NO: 162188 - protein, 35 aa, Artificial Sequence
  Description of Artificial Sequence: Synthetic polypeptide
FENEIRTTNPVATEQYGSVSWDDVAEIPFHQEDNT

SEQ ID NO: 162189 - protein, 32 aa, Artificial Sequence
  Description of Artificial Sequence: Synthetic polypeptide
FENEIRTTNPVSTEPYGTISMEDIQQQQIGNH

SEQ ID NO: 162190 - protein, 32 aa, Artificial Sequence
  Description of Artificial Sequence: Synthetic polypeptide
FENEIRTTNPVSTEPYGTISMEDIQQQQNGNH

SEQ ID NO: 162191 - protein, 32 aa, Artificial Sequence
  Description of Artificial Sequence: Synthetic polypeptide
FENEIRTTNPVSTEPYGTISMEDIQQQQNGNP

SEQ ID NO: 162192 - protein, 32 aa, Artificial Sequence
  Description of Artificial Sequence: Synthetic polypeptide
FENEIRTTNPVSTEPYGTISMEDIQQQQPGNH

SEQ ID NO: 162193 - protein, 35 aa, Artificial Sequence
  Description of Artificial Sequence: Synthetic polypeptide
FEPEIRTTNPVATEQYGCVSSYLGLDIEGNDLIES

SEQ ID NO: 162194 - protein, 35 aa, Artificial Sequence
  Description of Artificial Sequence: Synthetic polypeptide
IESEIRTTNPVATEQYGAASDVSQDLNNQDNQEMI

SEQ ID NO: 162195 - protein, 34 aa, Artificial Sequence
  Description of Artificial Sequence: Synthetic polypeptide
IESEIRTTNPVATEQYGAASDVQDQNNQDTQEMI

SEQ ID NO: 162196 - protein, 36 aa, Artificial Sequence
  Description of Artificial Sequence: Synthetic polypeptide
FEPEIRTTNPVATEQYGSVSVNLTDNEDPESINTDN

SEQ ID NO: 162197 - protein, 34 aa, Artificial Sequence
  Description of Artificial Sequence: Synthetic polypeptide
FEPEIRTTNPVATEQYGSVWPEDYGNQEQTDVGL

SEQ ID NO: 162198 - protein, 32 aa, Artificial Sequence
  Description of Artificial Sequence: Synthetic polypeptide
DEGCISTTNPVAYEQWGCFSWDNGDNDNGNAR

SEQ ID NO: 162199 - protein, 35 aa, Artificial Sequence
  Description of Artificial Sequence: Synthetic polypeptide
DEEEIRTTNPVATEGYGSVMDDMGDGGGQTTNNGE

SEQ ID NO: 162200 - protein, 34 aa, Artificial Sequence
  Description of Artificial Sequence: Synthetic polypeptide
IESEIRTTNPVATEQYGAASDVQDLNNQGSQEHN

SEQ ID NO: 162201 - protein, 32 aa, Artificial Sequence
  Description of Artificial Sequence: Synthetic polypeptide
DEGCISTTNPVAYEQWGCFSWDNGDFNKGNRM

SEQ ID NO: 162202 - protein, 34 aa, Artificial Sequence
  Description of Artificial Sequence: Synthetic polypeptide
DEGEIATTNPVATAQWGSVSATGAGGQPQDGAFN

SEQ ID NO: 162203 - protein, 32 aa, Artificial Sequence
  Description of Artificial Sequence: Synthetic polypeptide
DENEIRTTNPCSTEQYGTISMEDIQQQQNGTH

SEQ ID NO: 162204 - protein, 36 aa, Artificial Sequence
  Description of Artificial Sequence: Synthetic polypeptide
DEREISTTNPVATEQYGCVCSNTGEHNQENFGSNQS

SEQ ID NO: 162205 - protein, 37 aa, Artificial Sequence
  Description of Artificial Sequence: Synthetic polypeptide
AEEEIRTTNPVATESYGSVSTVVSTNNATEQGNNQQQ

SEQ ID NO: 162206 - protein, 36 aa, Artificial Sequence
  Description of Artificial Sequence: Synthetic polypeptide
DEEEIRTTNPVATEGYGSVMGMGNLDNMNGEEMGTY

SEQ ID NO: 162207 - protein, 32 aa, Artificial Sequence
  Description of Artificial Sequence: Synthetic polypeptide
DENEIRTTNPASTEPYGTVAMEDIQQQQNGNH

SEQ ID NO: 162208 - protein, 36 aa, Artificial Sequence
  Description of Artificial Sequence: Synthetic polypeptide
DEEEIRTTNPVATEGYGSVMGMGNLDNMNGEEVGLT

SEQ ID NO: 162209 - protein, 37 aa, Artificial Sequence
  Description of Artificial Sequence: Synthetic polypeptide
AEEEIRTTNPVATESYGSVSTVVSNNNVEEIGTNETN

SEQ ID NO: 162210 - protein, 32 aa, Artificial Sequence
  Description of Artificial Sequence: Synthetic polypeptide
IENEIRTTNPVSTEPYGTISMEDIQQQQNGNH

SEQ ID NO: 162211 - protein, 32 aa, Artificial Sequence
  Description of Artificial Sequence: Synthetic polypeptide
DEGEIACTNPVATEQWGCVAGTGLADAMNGMV

SEQ ID NO: 162212 - protein, 36 aa, Artificial Sequence
  Description of Artificial Sequence: Synthetic polypeptide
AEEEIRTTNPVATESYGSVSTVVSNNNVEEGTTEQL

SEQ ID NO: 162213 - protein, 33 aa, Artificial Sequence
  Description of Artificial Sequence: Synthetic polypeptide
IENEIRTTNPVSTEPYGCISMEDMLQPQSGNEH

SEQ ID NO: 162214 - protein, 29 aa, Artificial Sequence
  Description of Artificial Sequence: Synthetic peptide
QESEIASTNPVGYEGYGVIASTLQHGGDE

SEQ ID NO: 162215 - protein, 36 aa, Artificial Sequence
  Description of Artificial Sequence: Synthetic polypeptide
AEEEIRTTNPVATESYGSVSTVVSNNNVEEGTTDQN

SEQ ID NO: 162216 - protein, 33 aa, Artificial Sequence
  Description of Artificial Sequence: Synthetic polypeptide
CEEVIACTNPVATEQYGCIASNNDQTAGGPNSN

SEQ ID NO: 162217 - protein, 37 aa, Artificial Sequence
  Description of Artificial Sequence: Synthetic polypeptide
AEEEIRTTNPVATESYGSVSTVVSTQQGTEQGNNQQQ

SEQ ID NO: 162218 - protein, 36 aa, Artificial Sequence
  Description of Artificial Sequence: Synthetic polypeptide
IENEIRTTNPVATEQYGSVSYTYEEEPIEGMNQDHS

SEQ ID NO: 162219 - protein, 29 aa, Artificial Sequence
  Description of Artificial Sequence: Synthetic peptide
QESEIATTNPVGTEGYGVMASDLAEPGDI

SEQ ID NO: 162220 - protein, 34 aa, Artificial Sequence
  Description of Artificial Sequence: Synthetic polypeptide
IENEIRTTNPVATEQYGSVSPWNGNEFSFVEPGS

SEQ ID NO: 162221 - protein, 29 aa, Artificial Sequence
  Description of Artificial Sequence: Synthetic peptide
QESEIASTNPVGYEGYGVMACSTLQHGDE

SEQ ID NO: 162222 - protein, 29 aa, Artificial Sequence
  Description of Artificial Sequence: Synthetic peptide
QESEIASTNPVGYEGYGVMAKSTLQHGDI

SEQ ID NO: 162223 - protein, 28 aa, Artificial Sequence
  Description of Artificial Sequence: Synthetic peptide
QESEIASTNPVGYEGYGVMASELQHGDI

SEQ ID NO: 162224 - protein, 29 aa, Artificial Sequence
  Description of Artificial Sequence: Synthetic peptide
QESEIASTNPVGYEGYGVMASPTLQHGDI

SEQ ID NO: 162225 - protein, 37 aa, Artificial Sequence
  Description of Artificial Sequence: Synthetic polypeptide
AEEEIRTTNPVATESYGSVSTVVSNNNVAEEGTNQTD

SEQ ID NO: 162226 - protein, 37 aa, Artificial Sequence
  Description of Artificial Sequence: Synthetic polypeptide
DEEEIRTTNPVATEGYGSVMGNMQEGGQGGDQNVTPQ

SEQ ID NO: 162227 - protein, 30 aa, Artificial Sequence
  Description of Artificial Sequence: Synthetic polypeptide
QEGEIACTNPCSYEQWGIVSCNLQSGGDTM

SEQ ID NO: 162228 - protein, 37 aa, Artificial Sequence
  Description of Artificial Sequence: Synthetic polypeptide
AEEEIRTTNPVATESYGSVSTVVSNNNNTEEGNNNQD

SEQ ID NO: 162229 - protein, 32 aa, Artificial Sequence
  Description of Artificial Sequence: Synthetic polypeptide
DENEIRTCNPVSTEPYGTISMEDIQQQQNGNH

SEQ ID NO: 162230 - protein, 37 aa, Artificial Sequence
  Description of Artificial Sequence: Synthetic polypeptide
AEEEIRTTNPVATESYGSVSTVVSNNNDEEIGTNEQL

SEQ ID NO: 162231 - protein, 30 aa, Artificial Sequence
  Description of Artificial Sequence: Synthetic polypeptide
QESEIASTNPVGYEGYGVIASTLSQHGDNQ

SEQ ID NO: 162232 - protein, 32 aa, Artificial Sequence
  Description of Artificial Sequence: Synthetic polypeptide
QESEIATTNPVGTEGYGVMATSPTLQHNGNPV

SEQ ID NO: 162233 - protein, 37 aa, Artificial Sequence
  Description of Artificial Sequence: Synthetic polypeptide
AEEEIRTTNPVATESYGSVSTVVTNNNVAEEGNNNQD

SEQ ID NO: 162234 - protein, 33 aa, Artificial Sequence
  Description of Artificial Sequence: Synthetic polypeptide
DEREIRTTNPVCYEHYGSVSMPDADTQTLINLK

SEQ ID NO: 162235 - protein, 31 aa, Artificial Sequence
  Description of Artificial Sequence: Synthetic polypeptide
QESEIATTNPVGTEGYGVMATSPTLQHNGDV

SEQ ID NO: 162236 - protein, 36 aa, Artificial Sequence
  Description of Artificial Sequence: Synthetic polypeptide
AEEEIRTTNPVATESYGVVSTVVSNNNVTEEGTNQD

SEQ ID NO: 162237 - protein, 28 aa, Artificial Sequence
  Description of Artificial Sequence: Synthetic peptide
QESEIASTNPVGYEGWGVAASTLQHGDH

SEQ ID NO: 162238 - protein, 32 aa, Artificial Sequence
  Description of Artificial Sequence: Synthetic polypeptide
DENEIRTTNPCSTEPYGTISMEDIQQQQNGNH

SEQ ID NO: 162239 - protein, 32 aa, Artificial Sequence
  Description of Artificial Sequence: Synthetic polypeptide
DENEIRTTNPCSTEPYGTISMEDIQFQQNGNH

SEQ ID NO: 162240 - protein, 36 aa, Artificial Sequence
  Description of Artificial Sequence: Synthetic polypeptide
DEEEIRTTNPVATEQYGSVVVDGFGQENDQEEDTGE

SEQ ID NO: 162241 - protein, 33 aa, Artificial Sequence
  Description of Artificial Sequence: Synthetic polypeptide
DEREIRTTNPVSTEPYGTISMEDHQQQDNGNHK

SEQ ID NO: 162242 - protein, 32 aa, Artificial Sequence
  Description of Artificial Sequence: Synthetic polypeptide
DENEIRTTNPCSSEQYGTISMEDIQQQQNGNH

SEQ ID NO: 162243 - protein, 33 aa, Artificial Sequence
  Description of Artificial Sequence: Synthetic polypeptide
DEGEIATTNPVATAQWGGCVAINNAPTQDGNDQ

SEQ ID NO: 162244 - protein, 34 aa, Artificial Sequence
  Description of Artificial Sequence: Synthetic polypeptide
DEGEIACTNPVATEPYGSVCAGNNLADAGGDNEQ

SEQ ID NO: 162245 - protein, 37 aa, Artificial Sequence
  Description of Artificial Sequence: Synthetic polypeptide
DEEEIRTTNPVATEQYGSVDSPMIPQQQNQAQNMMEL

SEQ ID NO: 162246 - protein, 36 aa, Artificial Sequence
  Description of Artificial Sequence: Synthetic polypeptide
AEEEIRTTNPVATESYGVVSTVVSNNNVEEGTNEQQ

SEQ ID NO: 162247 - protein, 31 aa, Artificial Sequence
  Description of Artificial Sequence: Synthetic polypeptide
DENEIRTTNPCATEQWGDVSEIYEMNAAEDA

SEQ ID NO: 162248 - protein, 36 aa, Artificial Sequence
  Description of Artificial Sequence: Synthetic polypeptide
AEEEIRTTNPVATESYGVVSTVVSNGNVEEGNNNQD

SEQ ID NO: 162249 - protein, 36 aa, Artificial Sequence
  Description of Artificial Sequence: Synthetic polypeptide
AEEEIRTTNPVATESYGVVSTVTSNNNVEEGTNNQT

SEQ ID NO: 162250 - protein, 37 aa, Artificial Sequence
  Description of Artificial Sequence: Synthetic polypeptide
AEEEIRTTNPVATESYGVVSTVTNNQLGNEQGSEGGA

SEQ ID NO: 162251 - protein, 37 aa, Artificial Sequence
  Description of Artificial Sequence: Synthetic polypeptide
DEEEIRTTNPVATEGYGSVMGIGNDLDNMNGGEVGNT

SEQ ID NO: 162252 - protein, 37 aa, Artificial Sequence
  Description of Artificial Sequence: Synthetic polypeptide
AEEEIRTTNPVATESYGVVSTVTNNLLGNNQQGEDGG

SEQ ID NO: 162253 - protein, 36 aa, Artificial Sequence
  Description of Artificial Sequence: Synthetic polypeptide
DEEEIRTTNPVATEGYGSVMGIGNLDNMNGAEGGVT

SEQ ID NO: 162254 - protein, 37 aa, Artificial Sequence
  Description of Artificial Sequence: Synthetic polypeptide
DEEEIRTTNPVATEQYGSVVVDGFGQQNDQDEDGTTA

SEQ ID NO: 162255 - protein, 37 aa, Artificial Sequence
  Description of Artificial Sequence: Synthetic polypeptide
DEEEIRTTNPVATEQYGSVVVDGLFGQENDQEEDTNG

SEQ ID NO: 162256 - protein, 36 aa, Artificial Sequence
  Description of Artificial Sequence: Synthetic polypeptide
DEEEIRTTNPVATEQYGSVVVDGMGQENDQGEDDGT

SEQ ID NO: 162257 - protein, 37 aa, Artificial Sequence
  Description of Artificial Sequence: Synthetic polypeptide
DEEEIRTTNPVATEQYGSVVVDGNFGDENDQEEDNTG

SEQ ID NO: 162258 - protein, 29 aa, Artificial Sequence
  Description of Artificial Sequence: Synthetic peptide
QESEIASTNPVGYEGYGKMASTLSQHGDI

SEQ ID NO: 162259 - protein, 36 aa, Artificial Sequence
  Description of Artificial Sequence: Synthetic polypeptide
DEEEIRTTNPVATEGYGSVMGIGNLDNMNGEEDGTT

SEQ ID NO: 162260 - protein, 30 aa, Artificial Sequence
  Description of Artificial Sequence: Synthetic polypeptide
QESEIASTNPVGYEGYGVIACSTMLQHGDI

SEQ ID NO: 162261 - protein, 36 aa, Artificial Sequence
  Description of Artificial Sequence: Synthetic polypeptide
DEEEIRTTNPVATEGYGSVMGDPMNLDGSGEFEGEG

SEQ ID NO: 162262 - protein, 36 aa, Artificial Sequence
  Description of Artificial Sequence: Synthetic polypeptide
FEGEICTTNPVATEQYGSVSATGDGNEDQEGEGDGM

SEQ ID NO: 162263 - protein, 35 aa, Artificial Sequence
  Description of Artificial Sequence: Synthetic polypeptide
DEAEIATTNPVATEQYGCVCSTTDDNEEHEGSETL

SEQ ID NO: 162264 - protein, 37 aa, Artificial Sequence
  Description of Artificial Sequence: Synthetic polypeptide
DEEEIATTNPVATEQYGSVCAMNNGQLEPPDDQANGN

SEQ ID NO: 162265 - protein, 37 aa, Artificial Sequence
  Description of Artificial Sequence: Synthetic polypeptide
AEEEIRTTNPVATEQYGVVVVSVTTNNQEQNEETTDT

SEQ ID NO: 162266 - protein, 36 aa, Artificial Sequence
  Description of Artificial Sequence: Synthetic polypeptide
DDEEIRTTNPVATEQYGCVCSTGEHNQENFGSDTQA

SEQ ID NO: 162267 - protein, 36 aa, Artificial Sequence
  Description of Artificial Sequence: Synthetic polypeptide
FEEEIRTTNPVATEQYGVVMGDTNNVEGQGGGETGI

SEQ ID NO: 162268 - protein, 40 aa, Artificial Sequence
  Description of Artificial Sequence: Synthetic polypeptide
DEEEIRTTNPVATEQYGVVSTVNLQSGNTTEQGTNQNTTE

SEQ ID NO: 162269 - protein, 37 aa, Artificial Sequence
  Description of Artificial Sequence: Synthetic polypeptide
AEEEIRTTNPVATEQYGVVVVSVTTNQNLEQGEETED

SEQ ID NO: 162270 - protein, 38 aa, Artificial Sequence
  Description of Artificial Sequence: Synthetic polypeptide
AEEEIRTTNPVATEQYGVVVVSVTTNQNNQEQGENNDT

SEQ ID NO: 162271 - protein, 33 aa, Artificial Sequence
  Description of Artificial Sequence: Synthetic polypeptide
DEGEIATTNPVATEQWGCNTSANNELAGMPPNN

SEQ ID NO: 162272 - protein, 36 aa, Artificial Sequence
  Description of Artificial Sequence: Synthetic polypeptide
DEEEIRTTNPVATEGYGSVYDNIIQGGQGQEEVEEL

SEQ ID NO: 162273 - protein, 36 aa, Artificial Sequence
  Description of Artificial Sequence: Synthetic polypeptide
DEEEIRTTNPVATEGYGSVYDNIIQGGQGDEEVEGA

SEQ ID NO: 162274 - protein, 34 aa, Artificial Sequence
  Description of Artificial Sequence: Synthetic polypeptide
DEAVIRATNPVATEQYGSVYSALLEFPNYSQSTL

SEQ ID NO: 162275 - protein, 38 aa, Artificial Sequence
  Description of Artificial Sequence: Synthetic polypeptide
AEEEIRTTNPVATEQYGVVVVSVTTNQNQEQGEQNEDT

SEQ ID NO: 162276 - protein, 37 aa, Artificial Sequence
  Description of Artificial Sequence: Synthetic polypeptide
AEEEIRTTNPVATEQYGVVVVSVTTNQNQEQGETEDQ

SEQ ID NO: 162277 - protein, 36 aa, Artificial Sequence
  Description of Artificial Sequence: Synthetic polypeptide
DDEEIRTTNPVATEQYGCVCSTGEHNQENFGSDTQS

SEQ ID NO: 162278 - protein, 32 aa, Artificial Sequence
  Description of Artificial Sequence: Synthetic polypeptide
DENEIRCTNPVSTEPYGTISMEDIQQQQNGNH

SEQ ID NO: 162279 - protein, 36 aa, Artificial Sequence
  Description of Artificial Sequence: Synthetic polypeptide
DEEEIRTTNPVATEQYGSVVVDGFGQENDQDEDQTL

SEQ ID NO: 162280 - protein, 36 aa, Artificial Sequence
  Description of Artificial Sequence: Synthetic polypeptide
DEGAEISTTNPVAYEQWGTVCSTDNDGNQGQRGNAD

SEQ ID NO: 162281 - protein, 33 aa, Artificial Sequence
  Description of Artificial Sequence: Synthetic polypeptide
DEAEIATTNPVATEQYGCVAANNGDTMNNSKVW

SEQ ID NO: 162282 - protein, 33 aa, Artificial Sequence
  Description of Artificial Sequence: Synthetic polypeptide
DEGEIATTNPVATEQWGCNATTIEPLQAPMENN

SEQ ID NO: 162283 - protein, 35 aa, Artificial Sequence
  Description of Artificial Sequence: Synthetic polypeptide
DEGAIATTNPVATEQYGSVFSATDTLEPHEGLEDT

SEQ ID NO: 162284 - protein, 30 aa, Artificial Sequence
  Description of Artificial Sequence: Synthetic polypeptide
QESEIRSTNPVGTEGYGVVAETEQNHAGDA

SEQ ID NO: 162285 - protein, 36 aa, Artificial Sequence
  Description of Artificial Sequence: Synthetic polypeptide
DEEEIRTTNPVATEGYGSVYDDNNMGQEIGGGQEQE

SEQ ID NO: 162286 - protein, 28 aa, Artificial Sequence
  Description of Artificial Sequence: Synthetic peptide
QESEIASTNPVGTEQYGVAASVCQHEEI

SEQ ID NO: 162287 - protein, 34 aa, Artificial Sequence
  Description of Artificial Sequence: Synthetic polypeptide
DEEEIRATNPVATEQYGTVVDDGQGEGQGDEAGT

SEQ ID NO: 162288 - protein, 36 aa, Artificial Sequence
  Description of Artificial Sequence: Synthetic polypeptide
DEECISTTNPVATEQYGSVFVWINGEQDRKKEMGDY

SEQ ID NO: 162289 - protein, 29 aa, Artificial Sequence
  Description of Artificial Sequence: Synthetic peptide
QESEIRSTNPVGTEGWGVMASTLAHKGDI

SEQ ID NO: 162290 - protein, 34 aa, Artificial Sequence
  Description of Artificial Sequence: Synthetic polypeptide
DEAEIATTNPVATEQYGCVAANPHGDTDSGENNH

SEQ ID NO: 162291 - protein, 32 aa, Artificial Sequence
  Description of Artificial Sequence: Synthetic polypeptide
DENEIRCTNPVSTEPYGTISMEDQQQQQNGNH

SEQ ID NO: 162292 - protein, 36 aa, Artificial Sequence
  Description of Artificial Sequence: Synthetic polypeptide
DEEEIRTTNPVATEQYGSVVVDGFGQENDQEEDAGG

SEQ ID NO: 162293 - protein, 35 aa, Artificial Sequence
  Description of Artificial Sequence: Synthetic polypeptide
FEEEIRTTNPVATEQYGVVDVNQDGQEQGGQGEGT

SEQ ID NO: 162294 - protein, 35 aa, Artificial Sequence
  Description of Artificial Sequence: Synthetic polypeptide
FEEEIRTTNPVATEQYGVVDPDGQGQEDIGNEGFE

SEQ ID NO: 162295 - protein, 38 aa, Artificial Sequence
  Description of Artificial Sequence: Synthetic polypeptide
DEEEIRTTNPVATEQYGSVSDPELMWQQAITPVEQSRV

SEQ ID NO: 162296 - protein, 32 aa, Artificial Sequence
  Description of Artificial Sequence: Synthetic polypeptide
QESEIRTTNPVATECWGDVSCNEPQDHEEEEL

SEQ ID NO: 162297 - protein, 36 aa, Artificial Sequence
  Description of Artificial Sequence: Synthetic polypeptide
DDEEIRTTNPVATEQYGCVCSTTEEHNQFFGSETQG

SEQ ID NO: 162298 - protein, 36 aa, Artificial Sequence
  Description of Artificial Sequence: Synthetic polypeptide
DEAEIATTNPVATEQYGSVAITLNIDNDERNGQGTA

SEQ ID NO: 162299 - protein, 30 aa, Artificial Sequence
  Description of Artificial Sequence: Synthetic polypeptide
KENEIRTTNPVATEQWGDVFEIEMNAAEDA

SEQ ID NO: 162300 - protein, 33 aa, Artificial Sequence
  Description of Artificial Sequence: Synthetic polypeptide
QESEIRTTNPVATECWGDVSCINEPQDHEEENL

SEQ ID NO: 162301 - protein, 37 aa, Artificial Sequence
  Description of Artificial Sequence: Synthetic polypeptide
FEEEIRTTNPVATEQYGSYSSPITAEPNSRVGHPRVA

SEQ ID NO: 162302 - protein, 35 aa, Artificial Sequence
  Description of Artificial Sequence: Synthetic polypeptide
DEAEIATTNPVATEQYGCVAANGALEATANGNDYN

SEQ ID NO: 162303 - protein, 30 aa, Artificial Sequence
  Description of Artificial Sequence: Synthetic polypeptide
KENEINTTNPVATEQWGDVSEIEMNAAEDA

SEQ ID NO: 162304 - protein, 37 aa, Artificial Sequence
  Description of Artificial Sequence: Synthetic polypeptide
FEEEIRTTNPVATEQYGSYVEPANTQPQDLQIGPGDI

SEQ ID NO: 162305 - protein, 37 aa, Artificial Sequence
  Description of Artificial Sequence: Synthetic polypeptide
DEEEIRTTNPVATEQYGSVVVDGFGQENDQDEDGGQT

SEQ ID NO: 162306 - protein, 35 aa, Artificial Sequence
  Description of Artificial Sequence: Synthetic polypeptide
DEEEIRTTNPVATEQYGSVDQPWPESNQVPIMQLE

SEQ ID NO: 162307 - protein, 32 aa, Artificial Sequence
  Description of Artificial Sequence: Synthetic polypeptide
DENEIRTTNPIATEPYGAIAMEDIQEQKGNYH

SEQ ID NO: 162308 - protein, 31 aa, Artificial Sequence
  Description of Artificial Sequence: Synthetic polypeptide
QESEIRTTNPIATECYGATASEDWQHKGPYI

SEQ ID NO: 162309 - protein, 36 aa, Artificial Sequence
  Description of Artificial Sequence: Synthetic polypeptide
FEEEIRTTNPVATEQYGTVVDTMNDAGQGEDDENGN

SEQ ID NO: 162310 - protein, 37 aa, Artificial Sequence
  Description of Artificial Sequence: Synthetic polypeptide
DEEEIRTTNPVATEQYGSVVVDGFGQENDQDEDNGQV

SEQ ID NO: 162311 - protein, 38 aa, Artificial Sequence
  Description of Artificial Sequence: Synthetic polypeptide
AEEEIRTTNPVATEQYGSVSTVTVNNMEQGTNNVTDEQ

SEQ ID NO: 162312 - protein, 34 aa, Artificial Sequence
  Description of Artificial Sequence: Synthetic polypeptide
DEAEIATTNPVATEQYGCVAANMNGLATMNPENH

SEQ ID NO: 162313 - protein, 37 aa, Artificial Sequence
  Description of Artificial Sequence: Synthetic polypeptide
AEEEIRTTNPVATEQYGVVVVSVTTNNNQEQNEGTTD

SEQ ID NO: 162314 - protein, 33 aa, Artificial Sequence
  Description of Artificial Sequence: Synthetic polypeptide
DEAEIATTNPVATEQYGCVAANNDATMPPGEHP

SEQ ID NO: 162315 - protein, 34 aa, Artificial Sequence
  Description of Artificial Sequence: Synthetic polypeptide
DEAEIATTNPVATEQYGCVAANNDATMPPGNQPN

SEQ ID NO: 162316 - protein, 34 aa, Artificial Sequence
  Description of Artificial Sequence: Synthetic polypeptide
KEMEIVTTNPVATEQYGTVCSATDGIVENFEGND

SEQ ID NO: 162317 - protein, 36 aa, Artificial Sequence
  Description of Artificial Sequence: Synthetic polypeptide
DEEEIATTNPVATEQYGSVCAMNNGVLPETDMENNQ

SEQ ID NO: 162318 - protein, 34 aa, Artificial Sequence
  Description of Artificial Sequence: Synthetic polypeptide
KEMEIQTTNPVATEQYGTVCSATDGPVEFEGNKD

SEQ ID NO: 162319 - protein, 37 aa, Artificial Sequence
  Description of Artificial Sequence: Synthetic polypeptide
DEEEIATTNPVATEQYGSVCAMNNGVLPEEDGGNADQ

SEQ ID NO: 162320 - protein, 34 aa, Artificial Sequence
  Description of Artificial Sequence: Synthetic polypeptide
FEEEIRTTNPVATEQYGVVDNQDGQEQGGQGEGQ

SEQ ID NO: 162321 - protein, 32 aa, Artificial Sequence
  Description of Artificial Sequence: Synthetic polypeptide
DENEIRCTNPVSTEPYGTISEEDIQQQQNGNH

SEQ ID NO: 162322 - protein, 28 aa, Artificial Sequence
  Description of Artificial Sequence: Synthetic peptide
QESEIASTNPVGTEQYGVAPEVCQHEEI

SEQ ID NO: 162323 - protein, 36 aa, Artificial Sequence
  Description of Artificial Sequence: Synthetic polypeptide
DEEEIRTTNPVATEGYGSVVYDNVIQGGQGEEDEGD

SEQ ID NO: 162324 - protein, 34 aa, Artificial Sequence
  Description of Artificial Sequence: Synthetic polypeptide
DEAEIATTNPVATEQYGCVAATGGEQANPGVDQM

SEQ ID NO: 162325 - protein, 34 aa, Artificial Sequence
  Description of Artificial Sequence: Synthetic polypeptide
AEEEIRTTNPVAYEHWGCFSWLNDEQRRNGTKNE

SEQ ID NO: 162326 - protein, 34 aa, Artificial Sequence
  Description of Artificial Sequence: Synthetic polypeptide
AEEEIRTTNPVAYEHWGCFSWINDEQRRSGNGNE

SEQ ID NO: 162327 - protein, 35 aa, Artificial Sequence
  Description of Artificial Sequence: Synthetic polypeptide
DDEEIRTTNPVATEQYGCVCSNWGEHNQNFNSDQM

SEQ ID NO: 162328 - protein, 35 aa, Artificial Sequence
  Description of Artificial Sequence: Synthetic polypeptide
DDEEIRTTNPVATEQYGCVCSNWGEHNQNFGSEQA

SEQ ID NO: 162329 - protein, 35 aa, Artificial Sequence
  Description of Artificial Sequence: Synthetic polypeptide
DENEIRGTNPVATEAYGSVMSNQNNIGQEEMNGGD

SEQ ID NO: 162330 - protein, 34 aa, Artificial Sequence
  Description of Artificial Sequence: Synthetic polypeptide
DEGEIATTNPVATEPYGVVCAGNNLTDTGGGIER

SEQ ID NO: 162331 - protein, 36 aa, Artificial Sequence
  Description of Artificial Sequence: Synthetic polypeptide
DEEEIRTTNPVATEGYGSVVMGQSVGGQENNGGGQE

SEQ ID NO: 162332 - protein, 35 aa, Artificial Sequence
  Description of Artificial Sequence: Synthetic polypeptide
DEEEIRTTNPVATEQYGSFVIELDSQEVAEELTAF

SEQ ID NO: 162333 - protein, 36 aa, Artificial Sequence
  Description of Artificial Sequence: Synthetic polypeptide
DEEEIRTTNPVATEGYGSVVMDNIDQGGQGEEDEQN

SEQ ID NO: 162334 - protein, 36 aa, Artificial Sequence
  Description of Artificial Sequence: Synthetic polypeptide
DEEEIRTTNPVATEGYGSVVGMGQTGIEQDTENGED

SEQ ID NO: 162335 - protein, 31 aa, Artificial Sequence
  Description of Artificial Sequence: Synthetic polypeptide
QESEIASTNPVGTEQYGVMASTLQDHEGDDI

SEQ ID NO: 162336 - protein, 35 aa, Artificial Sequence
  Description of Artificial Sequence: Synthetic polypeptide
DEEEIRTTNPVATEGYGSVVGMGQGGEQDTEFGED

SEQ ID NO: 162337 - protein, 35 aa, Artificial Sequence
  Description of Artificial Sequence: Synthetic polypeptide
DENEIRGTNPVATEAYGSVMSNGQNIEQEEMNEAG

SEQ ID NO: 162338 - protein, 31 aa, Artificial Sequence
  Description of Artificial Sequence: Synthetic polypeptide
QESEIASTNPVGTEQYGVMATTLQDHEGDDI

SEQ ID NO: 162339 - protein, 32 aa, Artificial Sequence
  Description of Artificial Sequence: Synthetic polypeptide
DENEIRTTNPIATECWGATVSNADLAPKGPYI

SEQ ID NO: 162340 - protein, 32 aa, Artificial Sequence
  Description of Artificial Sequence: Synthetic polypeptide
DENEIRTTNPIATECWGATVSNADLAPKGEYI

SEQ ID NO: 162341 - protein, 31 aa, Artificial Sequence
  Description of Artificial Sequence: Synthetic polypeptide
QESEIASTNPVGTEQYGVMCSASGLVEHGND

SEQ ID NO: 162342 - protein, 31 aa, Artificial Sequence
  Description of Artificial Sequence: Synthetic polypeptide
QESEIASTNPVGTEQYGVMCSASGLVEHGNI

SEQ ID NO: 162343 - protein, 32 aa, Artificial Sequence
  Description of Artificial Sequence: Synthetic polypeptide
FEETIKTTNPVATEQWGAVEVGNHEVIAVNRE

SEQ ID NO: 162344 - protein, 35 aa, Artificial Sequence
  Description of Artificial Sequence: Synthetic polypeptide
DEAEIATTNPVATEQYGCVCSNTEPNEDHEGSEDL

SEQ ID NO: 162345 - protein, 32 aa, Artificial Sequence
  Description of Artificial Sequence: Synthetic polypeptide
DENEIRTTNPIATECWGATVSNACLAPKGEYI

SEQ ID NO: 162346 - protein, 34 aa, Artificial Sequence
  Description of Artificial Sequence: Synthetic polypeptide
ITEEIRTTNPVATDAYGSVSTYGMGQTIGQGGFQ

SEQ ID NO: 162347 - protein, 37 aa, Artificial Sequence
  Description of Artificial Sequence: Synthetic polypeptide
DEEEIRTTNPVATEQYGSFTQSVMNDMLIDVEQADLF

SEQ ID NO: 162348 - protein, 35 aa, Artificial Sequence
  Description of Artificial Sequence: Synthetic polypeptide
DDEEIRTTNPVATEQYGCVCSNWEEHNQFFNSDQG

SEQ ID NO: 162349 - protein, 35 aa, Artificial Sequence
  Description of Artificial Sequence: Synthetic polypeptide
DEEEIRTTNPVATEQYGSVSDDPVGWIETMVPQTK

SEQ ID NO: 162350 - protein, 37 aa, Artificial Sequence
  Description of Artificial Sequence: Synthetic polypeptide
DEEEIATTNPVATEQYGSVCAMNNGVDNQTAGPMENP

SEQ ID NO: 162351 - protein, 31 aa, Artificial Sequence
  Description of Artificial Sequence: Synthetic polypeptide
QESEIASTNPVGTEQYGVMATTLQDHEGDDL

SEQ ID NO: 162352 - protein, 37 aa, Artificial Sequence
  Description of Artificial Sequence: Synthetic polypeptide
DEEEIATTNPVATEQYGSVCAMNNGVLPEDDGGNDNQ

SEQ ID NO: 162353 - protein, 36 aa, Artificial Sequence
  Description of Artificial Sequence: Synthetic polypeptide
DEEEIRTTNPVATEGYGSVVQDNIIQEGQGEEDEGN

SEQ ID NO: 162354 - protein, 35 aa, Artificial Sequence
  Description of Artificial Sequence: Synthetic polypeptide
DDEEIRTTNPVATEQYGCVCSSGEHNQFFNSDFQS

SEQ ID NO: 162355 - protein, 35 aa, Artificial Sequence
  Description of Artificial Sequence: Synthetic polypeptide
FEEEIRTTNPVATEQYGVVVDGGQIGQGGGNNNQT

SEQ ID NO: 162356 - protein, 28 aa, Artificial Sequence
  Description of Artificial Sequence: Synthetic peptide
QESEIASTNPVGTEQYGVAPSVCQHEEI

SEQ ID NO: 162357 - protein, 35 aa, Artificial Sequence
  Description of Artificial Sequence: Synthetic polypeptide
FEEEIRTTNPVATEQYGVVVNGGQIGEGGGNNLSD

SEQ ID NO: 162358 - protein, 34 aa, Artificial Sequence
  Description of Artificial Sequence: Synthetic polypeptide
FEEEIRTTNPVATEQYGVVVNQDDQEQGGQGEVQ

SEQ ID NO: 162359 - protein, 36 aa, Artificial Sequence
  Description of Artificial Sequence: Synthetic polypeptide
DEEEIRTTNPVATEQYGSVVVDGFGQENDQEEDAGT

SEQ ID NO: 162360 - protein, 35 aa, Artificial Sequence
  Description of Artificial Sequence: Synthetic polypeptide
FEEEIRTTNPVATEQYGVVVSIVNGMEGGDEEEGD

SEQ ID NO: 162361 - protein, 34 aa, Artificial Sequence
  Description of Artificial Sequence: Synthetic polypeptide
DEAEIATTNPVATEQYGCVAATGVDDTGDGGNPN

SEQ ID NO: 162362 - protein, 33 aa, Artificial Sequence
  Description of Artificial Sequence: Synthetic polypeptide
QESEIRSTNPVGTECYGSVACITEPQDREGEDG

SEQ ID NO: 162363 - protein, 33 aa, Artificial Sequence
  Description of Artificial Sequence: Synthetic polypeptide
QESEIRSTNPVGTECWGSVACITEPQDREGENG

SEQ ID NO: 162364 - protein, 37 aa, Artificial Sequence
  Description of Artificial Sequence: Synthetic polypeptide
DEEEIRTTNPVATEQYGSVVVDGFGQENDQEEDGFTS

SEQ ID NO: 162365 - protein, 33 aa, Artificial Sequence
  Description of Artificial Sequence: Synthetic polypeptide
QESEIRSTNPVGTECWGSVACINEPQDREGENG

SEQ ID NO: 162366 - protein, 40 aa, Artificial Sequence
  Description of Artificial Sequence: Synthetic polypeptide
DEEEIRTTNPVATEQYGVVSTVNLQQNATTEQGTNNQTEE

SEQ ID NO: 162367 - protein, 40 aa, Artificial Sequence
  Description of Artificial Sequence: Synthetic polypeptide
DEEEIRTTNPVATEQYGVVSTVNLQQNATTEQGTNNNTTE

SEQ ID NO: 162368 - protein, 33 aa, Artificial Sequence
  Description of Artificial Sequence: Synthetic polypeptide
DEECISTVNPVATEGYGCVCSNWNLENFGSQQS

SEQ ID NO: 162369 - protein, 35 aa, Artificial Sequence
  Description of Artificial Sequence: Synthetic polypeptide
AEEEIRTTNPVAYEQWGSYWSTINPNGEQEENQND

SEQ ID NO: 162370 - protein, 37 aa, Artificial Sequence
  Description of Artificial Sequence: Synthetic polypeptide
DEEEIRTTNPVATEGYGSVVTTGMNDETGETGEGNET

SEQ ID NO: 162371 - protein, 30 aa, Artificial Sequence
  Description of Artificial Sequence: Synthetic polypeptide
QESEIASTNPVGTEQYGVMAASTLVEHGDI

SEQ ID NO: 162372 - protein, 32 aa, Artificial Sequence
  Description of Artificial Sequence: Synthetic polypeptide
DDSEVATTNPVATECYGNVSACITIQDRVGQG

SEQ ID NO: 162373 - protein, 36 aa, Artificial Sequence
  Description of Artificial Sequence: Synthetic polypeptide
FEEEIRTTNPVATESYGSVVQDNNQVEEGQGGNGDT

SEQ ID NO: 162374 - protein, 36 aa, Artificial Sequence
  Description of Artificial Sequence: Synthetic polypeptide
DEEEIRTTNPVATEGYGSVVQTDVGQGQEQGGGETA

SEQ ID NO: 162375 - protein, 31 aa, Artificial Sequence
  Description of Artificial Sequence: Synthetic polypeptide
QESEIASTNPVGTEQYGVMAATDGLVQFGDD

SEQ ID NO: 162376 - protein, 36 aa, Artificial Sequence
  Description of Artificial Sequence: Synthetic polypeptide
DDEEIRTTNPVATEQYGCVCSTEEDHQESFGSDTQQ

SEQ ID NO: 162377 - protein, 36 aa, Artificial Sequence
  Description of Artificial Sequence: Synthetic polypeptide
FEEEIRTTNPVATEVYGSVVNDVNGQQEIDGNGNQG

SEQ ID NO: 162378 - protein, 36 aa, Artificial Sequence
  Description of Artificial Sequence: Synthetic polypeptide
FEEEIRTTNPVATEVYGSVVNNFDDMNDQTGGGNED

SEQ ID NO: 162379 - protein, 40 aa, Artificial Sequence
  Description of Artificial Sequence: Synthetic polypeptide
DEEEIRTTNPVATEQYGVVSTVNLQQNATNEQGTNNQTSE

SEQ ID NO: 162380 - protein, 37 aa, Artificial Sequence
  Description of Artificial Sequence: Synthetic polypeptide
AEEEIRTTNPVAYEPYGISTVSYEGNELSAVRGPVRF

SEQ ID NO: 162381 - protein, 31 aa, Artificial Sequence
  Description of Artificial Sequence: Synthetic polypeptide
DENEIRTTNPIATECWGDVANAEDLAPGEYI

SEQ ID NO: 162382 - protein, 30 aa, Artificial Sequence
  Description of Artificial Sequence: Synthetic polypeptide
DENEIRTCNPVATEAWGDVSEIEMNAAEDA

SEQ ID NO: 162383 - protein, 30 aa, Artificial Sequence
  Description of Artificial Sequence: Synthetic polypeptide
QESEIATTNPVGTEGYGTMASDLQQHNGDI

SEQ ID NO: 162384 - protein, 37 aa, Artificial Sequence
  Description of Artificial Sequence: Synthetic polypeptide
DEEEIATTNPVATEQYGSVCAMNGNLEPGADIANDAP

SEQ ID NO: 162385 - protein, 31 aa, Artificial Sequence
  Description of Artificial Sequence: Synthetic polypeptide
YESEVASTNPVSTEGYGNVAANTLQSRVGQQ

SEQ ID NO: 162386 - protein, 33 aa, Artificial Sequence
  Description of Artificial Sequence: Synthetic polypeptide
HEEPIRTTNPVATEQYGCVTTEMDCQFSEQSCI

SEQ ID NO: 162387 - protein, 35 aa, Artificial Sequence
  Description of Artificial Sequence: Synthetic polypeptide
DEEEIRATNPVATEQYGSVCAANMGEEGGMMGEVG

SEQ ID NO: 162388 - protein, 38 aa, Artificial Sequence
  Description of Artificial Sequence: Synthetic polypeptide
DEEEIRTTNPVATEGYGSVMSDGTGGDTQEDGNTNEGN

SEQ ID NO: 162389 - protein, 30 aa, Artificial Sequence
  Description of Artificial Sequence: Synthetic polypeptide
DEGEIAPTNPIASECWGAVSCDLASKGPYR

SEQ ID NO: 162390 - protein, 28 aa, Artificial Sequence
  Description of Artificial Sequence: Synthetic peptide
QESEIASTNPVSTEQYGNAAETIQHEQK

SEQ ID NO: 162391 - protein, 38 aa, Artificial Sequence
  Description of Artificial Sequence: Synthetic polypeptide
AEEEIRTTNPVATEQYGVVVVVSTNTNLQQGTEEGSVE

SEQ ID NO: 162392 - protein, 33 aa, Artificial Sequence
  Description of Artificial Sequence: Synthetic polypeptide
HEGEIRCTNPVATEQYGETSWTLEDAQFNQNDM

SEQ ID NO: 162393 - protein, 35 aa, Artificial Sequence
  Description of Artificial Sequence: Synthetic polypeptide
DEEEIRATNPVATEQYGSVCAANMGEEAGMMDMEG

SEQ ID NO: 162394 - protein, 36 aa, Artificial Sequence
  Description of Artificial Sequence: Synthetic polypeptide
DEEEIRATNPVATEQYGSVCAANGEEAPDNQMENTM

SEQ ID NO: 162395 - protein, 36 aa, Artificial Sequence
  Description of Artificial Sequence: Synthetic polypeptide
DEEEIRATNPVATEQYGSVCAANGEEANMNQGENTM

SEQ ID NO: 162396 - protein, 36 aa, Artificial Sequence
  Description of Artificial Sequence: Synthetic polypeptide
DEREIRTTNPVATEQYGCVCSTGEHNQENFNSNNQS

SEQ ID NO: 162397 - protein, 30 aa, Artificial Sequence
  Description of Artificial Sequence: Synthetic polypeptide
QESEIATTNPVATECYGSAPCIVCQDHEEG

SEQ ID NO: 162398 - protein, 36 aa, Artificial Sequence
  Description of Artificial Sequence: Synthetic polypeptide
AEEEIRTTNPVATEQYGVVVVVNTNDESGTVNNTTM

SEQ ID NO: 162399 - protein, 36 aa, Artificial Sequence
  Description of Artificial Sequence: Synthetic polypeptide
DEEEIRTTNPVATEQYGSVVYDGFGQEGDQEEGDTG

SEQ ID NO: 162400 - protein, 30 aa, Artificial Sequence
  Description of Artificial Sequence: Synthetic polypeptide
QEGEIACTNPVGTEPWGGVSASDLQHGDDI

SEQ ID NO: 162401 - protein, 34 aa, Artificial Sequence
  Description of Artificial Sequence: Synthetic polypeptide
HEGEIRTTNPVATEQYGSVFTVEKNHDESIEPEQ

SEQ ID NO: 162402 - protein, 37 aa, Artificial Sequence
  Description of Artificial Sequence: Synthetic polypeptide
DEREIRTTNPVATEQYGCVCSNTGEHNQENFGSDNQS

SEQ ID NO: 162403 - protein, 35 aa, Artificial Sequence
  Description of Artificial Sequence: Synthetic polypeptide
HEGEIRTTNPVATEQYGSVSCADNQDENDFSNMIM

SEQ ID NO: 162404 - protein, 35 aa, Artificial Sequence
  Description of Artificial Sequence: Synthetic polypeptide
HEGEIRTTNPVATEQYGSVSCATNQDEFDFSDMII

SEQ ID NO: 162405 - protein, 34 aa, Artificial Sequence
  Description of Artificial Sequence: Synthetic polypeptide
CEEEIACTNPVATEQYGSASLANMGQSAEDPGEN

SEQ ID NO: 162406 - protein, 37 aa, Artificial Sequence
  Description of Artificial Sequence: Synthetic polypeptide
IEEEIRTTNPVATEQYGSVSLTPWLIQVSQPPEEQLP

SEQ ID NO: 162407 - protein, 34 aa, Artificial Sequence
  Description of Artificial Sequence: Synthetic polypeptide
DEAVIGTTNPVATEQWGCVCSNTDDHQYFGSNQS

SEQ ID NO: 162408 - protein, 35 aa, Artificial Sequence
  Description of Artificial Sequence: Synthetic polypeptide
DEEEIRTTNPVATEQYGYTIFPSFVTEVRDGEFEL

SEQ ID NO: 162409 - protein, 34 aa, Artificial Sequence
  Description of Artificial Sequence: Synthetic polypeptide
DEEEIRATNPVATEQYGSVCAAIGEEAMMDENTM

SEQ ID NO: 162410 - protein, 36 aa, Artificial Sequence
  Description of Artificial Sequence: Synthetic polypeptide
DEEEIRTTNPVATEQYGSVVYDGFGQEGDQEEDEIN

SEQ ID NO: 162411 - protein, 32 aa, Artificial Sequence
  Description of Artificial Sequence: Synthetic polypeptide
QESEIATTNPVATECYGEVSEIVEPQHEGEEK

SEQ ID NO: 162412 - protein, 37 aa, Artificial Sequence
  Description of Artificial Sequence: Synthetic polypeptide
DAEEIATTNPVATEQYGSVCSPDGTPGNEAGIGNDLD

SEQ ID NO: 162413 - protein, 31 aa, Artificial Sequence
  Description of Artificial Sequence: Synthetic polypeptide
QESEIATTNPVATECYGEVSEIVEPQHEEEK

SEQ ID NO: 162414 - protein, 36 aa, Artificial Sequence
  Description of Artificial Sequence: Synthetic polypeptide
DEEEIRATNPVATEQYGSVCAASNGEEATMMGEGPW

SEQ ID NO: 162415 - protein, 35 aa, Artificial Sequence
  Description of Artificial Sequence: Synthetic polypeptide
DEEEIRTTNPVATEQYGYTISPSFVFEKNRDMEHQ

SEQ ID NO: 162416 - protein, 32 aa, Artificial Sequence
  Description of Artificial Sequence: Synthetic polypeptide
YETEIRTTNPVATECYGVVANDDWQEPKGPYI

SEQ ID NO: 162417 - protein, 32 aa, Artificial Sequence
  Description of Artificial Sequence: Synthetic polypeptide
YETEIRTTNPVATECYGVVANDDWQESKGPYI

SEQ ID NO: 162418 - protein, 32 aa, Artificial Sequence
  Description of Artificial Sequence: Synthetic polypeptide
DENEIRQTNPVSTEPYGTISMEDIQQQQNGNH

SEQ ID NO: 162419 - protein, 32 aa, Artificial Sequence
  Description of Artificial Sequence: Synthetic polypeptide
DENEIRQTNPVSTEPYGTCSMEDIQQQQNGNS

SEQ ID NO: 162420 - protein, 30 aa, Artificial Sequence
  Description of Artificial Sequence: Synthetic polypeptide
QEGEIACTNPVGTEGWGVSASGLQHGDDNI

SEQ ID NO: 162421 - protein, 35 aa, Artificial Sequence
  Description of Artificial Sequence: Synthetic polypeptide
DEAEIATTNPVATEQYGSVAAAVNNQENADGPTPQ

SEQ ID NO: 162422 - protein, 37 aa, Artificial Sequence
  Description of Artificial Sequence: Synthetic polypeptide
DEEEIRTTNPVATEQYGSFSDTLTNHHGNTPEQEEES

SEQ ID NO: 162423 - protein, 29 aa, Artificial Sequence
  Description of Artificial Sequence: Synthetic peptide
QEGEIACTNPVGTEGWGVSASGLQHGDQD

SEQ ID NO: 162424 - protein, 36 aa, Artificial Sequence
  Description of Artificial Sequence: Synthetic polypeptide
DEEEIRTTNPVATEQYGYVGNNVDTPGELGPGGQGG

SEQ ID NO: 162425 - protein, 34 aa, Artificial Sequence
  Description of Artificial Sequence: Synthetic polypeptide
DEGEIATTNPEATDQYGQVCCCDQDQKREGDNRK

SEQ ID NO: 162426 - protein, 37 aa, Artificial Sequence
  Description of Artificial Sequence: Synthetic polypeptide
DEEEIRTTNPVATEQYGYVDDNDDGQEQGGNGNNIQG

SEQ ID NO: 162427 - protein, 36 aa, Artificial Sequence
  Description of Artificial Sequence: Synthetic polypeptide
HEEEIRTTNPVATEQYGSVVVDGFGQENDQDEDGQG

SEQ ID NO: 162428 - protein, 36 aa, Artificial Sequence
  Description of Artificial Sequence: Synthetic polypeptide
DEEEIRTTNPVATEQYGYTIRPSFVLEKNDRDGEHQ

SEQ ID NO: 162429 - protein, 35 aa, Artificial Sequence
  Description of Artificial Sequence: Synthetic polypeptide
DEECISTTNPVAYEQWGVVCFTIENDGQRQQNGNV

SEQ ID NO: 162430 - protein, 33 aa, Artificial Sequence
  Description of Artificial Sequence: Synthetic polypeptide
DEGEIATTNPEATDAYGQVCCCDQDQKREGNHR

SEQ ID NO: 162431 - protein, 35 aa, Artificial Sequence
  Description of Artificial Sequence: Synthetic polypeptide
DEREIRTTNPVATEQYGCVCSWGEHNQENFNSEQA

SEQ ID NO: 162432 - protein, 35 aa, Artificial Sequence
  Description of Artificial Sequence: Synthetic polypeptide
DEEEIRATNPVATEQYGSVCAATGEEAGMSMGGHG

SEQ ID NO: 162433 - protein, 32 aa, Artificial Sequence
  Description of Artificial Sequence: Synthetic polypeptide
QESEIATTNPVATECYGVVSSITEQDHEGEDG

SEQ ID NO: 162434 - protein, 37 aa, Artificial Sequence
  Description of Artificial Sequence: Synthetic polypeptide
DEAEIATTNPVATEQYGSVAASANNTHDQEAGGNAED

SEQ ID NO: 162435 - protein, 35 aa, Artificial Sequence
  Description of Artificial Sequence: Synthetic polypeptide
DEEEIRATNPVATEQYGSVCAATGEEAGMMDGTHG

SEQ ID NO: 162436 - protein, 37 aa, Artificial Sequence
  Description of Artificial Sequence: Synthetic polypeptide
DEEEIRTTNPVATEQYGSVDSPVALELQMQMPEFVHD

SEQ ID NO: 162437 - protein, 35 aa, Artificial Sequence
  Description of Artificial Sequence: Synthetic polypeptide
DEEEIRATNPVATEQYGSVCAATGEEAGMDMEGEG

SEQ ID NO: 162438 - protein, 34 aa, Artificial Sequence
  Description of Artificial Sequence: Synthetic polypeptide
DERDEIATTNPVAYECWGSVATNLQGNAGEDDGM

SEQ ID NO: 162439 - protein, 37 aa, Artificial Sequence
  Description of Artificial Sequence: Synthetic polypeptide
DEEEIRATNPVATEQYGSVCAATEPGLEATMPGGENH

SEQ ID NO: 162440 - protein, 36 aa, Artificial Sequence
  Description of Artificial Sequence: Synthetic polypeptide
DEEEIRTTNPVATEQYGYTISPSGVLEKNRDQPEHQ

SEQ ID NO: 162441 - protein, 36 aa, Artificial Sequence
  Description of Artificial Sequence: Synthetic polypeptide
DEEEIRTTNPVATEQYGYTISPSFVTEVRDGLEFEQ

SEQ ID NO: 162442 - protein, 35 aa, Artificial Sequence
  Description of Artificial Sequence: Synthetic polypeptide
YEVEIRSTNPVATEQYGSVITDNNGNDEGEGGNGV

SEQ ID NO: 162443 - protein, 36 aa, Artificial Sequence
  Description of Artificial Sequence: Synthetic polypeptide
DEEEIRTTNPVATEGYGSVMSPMGDGEGQGEDGEEQ

SEQ ID NO: 162444 - protein, 36 aa, Artificial Sequence
  Description of Artificial Sequence: Synthetic polypeptide
DEEEIRTTNPVATEQYGSVVYDDMFGQEGDVEEDDG

SEQ ID NO: 162445 - protein, 33 aa, Artificial Sequence
  Description of Artificial Sequence: Synthetic polypeptide
QESEIATTNPVATECYGEVPCINEPQDHEGENK

SEQ ID NO: 162446 - protein, 32 aa, Artificial Sequence
  Description of Artificial Sequence: Synthetic polypeptide
HENEIRTTNPVSTEPYGTISMEDIQQQQNGNH

SEQ ID NO: 162447 - protein, 32 aa, Artificial Sequence
  Description of Artificial Sequence: Synthetic polypeptide
HENEIRTTNPVSTEPYGTISMEDIQQQQNGNV

SEQ ID NO: 162448 - protein, 34 aa, Artificial Sequence
  Description of Artificial Sequence: Synthetic polypeptide
HEQEIATTNPVATEQYGSVSAFDLNEDHQGLEDE

SEQ ID NO: 162449 - protein, 37 aa, Artificial Sequence
  Description of Artificial Sequence: Synthetic polypeptide
DENEIRGTNPVATEQYGSVYGQVNGLEQGDGGNQDDE

SEQ ID NO: 162450 - protein, 36 aa, Artificial Sequence
  Description of Artificial Sequence: Synthetic polypeptide
DEEEIATTNPVATEQYGSVCAMNNGLEPTDSGGEAE

SEQ ID NO: 162451 - protein, 32 aa, Artificial Sequence
  Description of Artificial Sequence: Synthetic polypeptide
DENEIRGTNPVSTEPYGTISMEDIQQQQNGNH

SEQ ID NO: 162452 - protein, 32 aa, Artificial Sequence
  Description of Artificial Sequence: Synthetic polypeptide
DEGEIAPTNPVSTEPYGTVSMEDIQQQQNGNH

SEQ ID NO: 162453 - protein, 37 aa, Artificial Sequence
  Description of Artificial Sequence: Synthetic polypeptide
DEEEIRTTNPVATEQYGSFGSQTVSEEQEDATVANQP

SEQ ID NO: 162454 - protein, 33 aa, Artificial Sequence
  Description of Artificial Sequence: Synthetic polypeptide
DEGEIATTNPCAYMQYGSVSSGNIGFHGDNSSH

SEQ ID NO: 162455 - protein, 37 aa, Artificial Sequence
  Description of Artificial Sequence: Synthetic polypeptide
DENEIRGTNPVATEQYGSVYTQVNGLEQGEGTGQDDE

SEQ ID NO: 162456 - protein, 35 aa, Artificial Sequence
  Description of Artificial Sequence: Synthetic polypeptide
DENEIRGTNPVATEQYGVVMGDDENDNNQDIGGNI

SEQ ID NO: 162457 - protein, 32 aa, Artificial Sequence
  Description of Artificial Sequence: Synthetic polypeptide
QESEIATTNPCSSEQWGSVSCINEPQSEGETR

SEQ ID NO: 162458 - protein, 32 aa, Artificial Sequence
  Description of Artificial Sequence: Synthetic polypeptide
HENEIRTTNPVSTEPYGTCSMVAIQHVPNGNH

SEQ ID NO: 162459 - protein, 36 aa, Artificial Sequence
  Description of Artificial Sequence: Synthetic polypeptide
DEEEIATTNPVATEQYGSVCAMNNGGTEAGDVNEAD

SEQ ID NO: 162460 - protein, 35 aa, Artificial Sequence
  Description of Artificial Sequence: Synthetic polypeptide
DEEEIRATNPVATEQYGSVAVADGGPLGNTEEGTT

SEQ ID NO: 162461 - protein, 29 aa, Artificial Sequence
  Description of Artificial Sequence: Synthetic peptide
QESEIATTNPIATECWGAMWASDLQPGDI

SEQ ID NO: 162462 - protein, 30 aa, Artificial Sequence
  Description of Artificial Sequence: Synthetic polypeptide
QESEIATTNPIATECWGAMWASEDLQPGPI

SEQ ID NO: 162463 - protein, 37 aa, Artificial Sequence
  Description of Artificial Sequence: Synthetic polypeptide
DEEEIRTTNPVATEQYGSFFIDTGTNTHGLTQEQEEE

SEQ ID NO: 162464 - protein, 36 aa, Artificial Sequence
  Description of Artificial Sequence: Synthetic polypeptide
DEEEIRTTNPVATEQYGSFFPEAVVDAAQMMNGQFQ

SEQ ID NO: 162465 - protein, 36 aa, Artificial Sequence
  Description of Artificial Sequence: Synthetic polypeptide
DEEEIRTTNPVATEQYGSFGDMNADEFGSGGNNQTS

SEQ ID NO: 162466 - protein, 35 aa, Artificial Sequence
  Description of Artificial Sequence: Synthetic polypeptide
DDEEIRTTNPVATEQYGCVCSMWEHNQENFNSDQS

SEQ ID NO: 162467 - protein, 32 aa, Artificial Sequence
  Description of Artificial Sequence: Synthetic polypeptide
DEGEIASTNPIATECWGSCSKNEDDQGGGNQM

SEQ ID NO: 162468 - protein, 37 aa, Artificial Sequence
  Description of Artificial Sequence: Synthetic polypeptide
DEEEIATTNPVATEQYGSVCAMNNGGLEAPGDVNNAE

SEQ ID NO: 162469 - protein, 37 aa, Artificial Sequence
  Description of Artificial Sequence: Synthetic polypeptide
DEEEIRTTNPVATEQYGSFGISPWLYGQQADNETIEE

SEQ ID NO: 162470 - protein, 32 aa, Artificial Sequence
  Description of Artificial Sequence: Synthetic polypeptide
QESEIATTNPVATECWGSVSCICEPQDREEEG

SEQ ID NO: 162471 - protein, 35 aa, Artificial Sequence
  Description of Artificial Sequence: Synthetic polypeptide
CEEEIACTNPVATEQYGSACSTNPQTEHQDGMEMK

SEQ ID NO: 162472 - protein, 29 aa, Artificial Sequence
  Description of Artificial Sequence: Synthetic peptide
QESEIATTNPIATECWGAMWASDLQHGDI

SEQ ID NO: 162473 - protein, 34 aa, Artificial Sequence
  Description of Artificial Sequence: Synthetic polypeptide
HENEIRTTNPVATETYGSVSNVESLQEVHDTVPG

SEQ ID NO: 162474 - protein, 36 aa, Artificial Sequence
  Description of Artificial Sequence: Synthetic polypeptide
HENEIRTTNPVATETYGSVSNTNSLAFQEVHETVPG

SEQ ID NO: 162475 - protein, 32 aa, Artificial Sequence
  Description of Artificial Sequence: Synthetic polypeptide
DENEIRMTNPVSTEPYGTISMEDIQQQQNGNH

SEQ ID NO: 162476 - protein, 28 aa, Artificial Sequence
  Description of Artificial Sequence: Synthetic peptide
QESEIASTNVVGYEGYGVMASTLQHGDI

SEQ ID NO: 162477 - protein, 33 aa, Artificial Sequence
  Description of Artificial Sequence: Synthetic polypeptide
HEMEICTTNPVATEPYGSVCHGQMLLTFGGQNE

SEQ ID NO: 162478 - protein, 33 aa, Artificial Sequence
  Description of Artificial Sequence: Synthetic polypeptide
HEMEICTVNPVATEPYGSVCHKQMLLTRGSQNE

SEQ ID NO: 162479 - protein, 35 aa, Artificial Sequence
  Description of Artificial Sequence: Synthetic polypeptide
HEMEIRTTNPVATEPYGSVCEGQMLLTRGGQNDEP

SEQ ID NO: 162480 - protein, 38 aa, Artificial Sequence
  Description of Artificial Sequence: Synthetic polypeptide
IEEEIRTTNPVATEQYGSVCSPILAMLEQEVVGSLNEM

SEQ ID NO: 162481 - protein, 33 aa, Artificial Sequence
  Description of Artificial Sequence: Synthetic polypeptide
HEMEIVTTNPVATEQYGTVCLATDGPVEFEGND

SEQ ID NO: 162482 - protein, 36 aa, Artificial Sequence
  Description of Artificial Sequence: Synthetic polypeptide
DEEEIRTTNPVATEGYGSVNMNESGQDQEQEDEDGN

SEQ ID NO: 162483 - protein, 33 aa, Artificial Sequence
  Description of Artificial Sequence: Synthetic polypeptide
HEMEIVTTNPVATEQYGTVCSATDGPVEFEDND

SEQ ID NO: 162484 - protein, 36 aa, Artificial Sequence
  Description of Artificial Sequence: Synthetic polypeptide
DEEEIRTTNPVATEQYGSFQVAVDEQIENTEEANIM

SEQ ID NO: 162485 - protein, 33 aa, Artificial Sequence
  Description of Artificial Sequence: Synthetic polypeptide
HEMEIVTTNPVATEQYGTVCSATDGPVEFESND

SEQ ID NO: 162486 - protein, 32 aa, Artificial Sequence
  Description of Artificial Sequence: Synthetic polypeptide
DENEIRPTNPVSTEPYGTISMEDIQQQQNGNH

SEQ ID NO: 162487 - protein, 32 aa, Artificial Sequence
  Description of Artificial Sequence: Synthetic polypeptide
DENEIRPTNPVSTEPYGTISCEDLQQQQNGTH

SEQ ID NO: 162488 - protein, 36 aa, Artificial Sequence
  Description of Artificial Sequence: Synthetic polypeptide
DEEEIRTTNPVATEGYGSVNMNESGQTQDQEDEDGQ

SEQ ID NO: 162489 - protein, 36 aa, Artificial Sequence
  Description of Artificial Sequence: Synthetic polypeptide
DEREIRTTNPVATEPYGSYRCFTLNSQHNRGGVVCP

SEQ ID NO: 162490 - protein, 38 aa, Artificial Sequence
  Description of Artificial Sequence: Synthetic polypeptide
AEEEIRTTNPVATEQYGVVVVVSTTTNLQQGTEEGTVD

SEQ ID NO: 162491 - protein, 36 aa, Artificial Sequence
  Description of Artificial Sequence: Synthetic polypeptide
IEEEIRTTNPVATEHYGSVSSTTPAGPNMRNEMNPV

SEQ ID NO: 162492 - protein, 35 aa, Artificial Sequence
  Description of Artificial Sequence: Synthetic polypeptide
DENEIRGTNPVATEQYGSVVMSNPNIFQENMTEGG

SEQ ID NO: 162493 - protein, 36 aa, Artificial Sequence
  Description of Artificial Sequence: Synthetic polypeptide
DEEEIRTTNPVATEQYGSFNNPDLVNLPFQPMLEEV

SEQ ID NO: 162494 - protein, 34 aa, Artificial Sequence
  Description of Artificial Sequence: Synthetic polypeptide
HENEIRTTNPVATEFYGSVSNNSLFEEVIETVPG

SEQ ID NO: 162495 - protein, 31 aa, Artificial Sequence
  Description of Artificial Sequence: Synthetic polypeptide
HENEIRTTNPVATEQWGDVSEIIEMSPAEDA

SEQ ID NO: 162496 - protein, 32 aa, Artificial Sequence
  Description of Artificial Sequence: Synthetic polypeptide
HENEIRTTNPVATEQWGDVSEIREMQAAEDSA

SEQ ID NO: 162497 - protein, 33 aa, Artificial Sequence
  Description of Artificial Sequence: Synthetic polypeptide
DEAVIGTTNPVATEQWGCVCSTEDLTYFGSDQA

SEQ ID NO: 162498 - protein, 36 aa, Artificial Sequence
  Description of Artificial Sequence: Synthetic polypeptide
DEEEIRTTNPVATEQYGSFMVHPFVGQEEVAGAVVS

SEQ ID NO: 162499 - protein, 36 aa, Artificial Sequence
  Description of Artificial Sequence: Synthetic polypeptide
DEEEIATTNPVATEQYGSVCAMNNGELSNDSDENGH

SEQ ID NO: 162500 - protein, 36 aa, Artificial Sequence
  Description of Artificial Sequence: Synthetic polypeptide
DEEEIRTTNPVAYEQYGQVVHFQMQDLLQPGFGQIR

SEQ ID NO: 162501 - protein, 37 aa, Artificial Sequence
  Description of Artificial Sequence: Synthetic polypeptide
DEEEIATTNPVATEQYGSVCAMNNGELSQDSPDENGM

SEQ ID NO: 162502 - protein, 36 aa, Artificial Sequence
  Description of Artificial Sequence: Synthetic polypeptide
DEEEIRTTNPVATEQYGSEYVAIEEQIENTAEDNDM

SEQ ID NO: 162503 - protein, 36 aa, Artificial Sequence
  Description of Artificial Sequence: Synthetic polypeptide
DEEEIRTTNPVATEQYGSCVVPPHDVYLENGFEQEI

SEQ ID NO: 162504 - protein, 32 aa, Artificial Sequence
  Description of Artificial Sequence: Synthetic polypeptide
KENEIRTTNPVSTEPYGTISKEDIQQQQNGNH

SEQ ID NO: 162505 - protein, 30 aa, Artificial Sequence
  Description of Artificial Sequence: Synthetic polypeptide
QESEIATTNPVATEGYGVMCAASGLEHGDI

SEQ ID NO: 162506 - protein, 34 aa, Artificial Sequence
  Description of Artificial Sequence: Synthetic polypeptide
CEEEIACTNPVATEQYGSACSAPNLPEAEAGTDF

SEQ ID NO: 162507 - protein, 33 aa, Artificial Sequence
  Description of Artificial Sequence: Synthetic polypeptide
IENEIATTNPVATECYGHVNNSVLEQHGENEDL

SEQ ID NO: 162508 - protein, 32 aa, Artificial Sequence
  Description of Artificial Sequence: Synthetic polypeptide
IENEIATTNPVATECYGHVNEVLEWHGENEDL

SEQ ID NO: 162509 - protein, 33 aa, Artificial Sequence
  Description of Artificial Sequence: Synthetic polypeptide
IENEIATTNPVATECYGHVNEVLEQIHGKNEDL

SEQ ID NO: 162510 - protein, 37 aa, Artificial Sequence
  Description of Artificial Sequence: Synthetic polypeptide
DEEEIRTTNPVATEQYGSVSCTMEGLFDDEALEFEDE

SEQ ID NO: 162511 - protein, 33 aa, Artificial Sequence
  Description of Artificial Sequence: Synthetic polypeptide
QESEIATTNPVAYEQWGSVCSGENDQHLTNDHA

SEQ ID NO: 162512 - protein, 32 aa, Artificial Sequence
  Description of Artificial Sequence: Synthetic polypeptide
QESEIATTNPVAYECYGIQVSCECLSQHEGEL

SEQ ID NO: 162513 - protein, 37 aa, Artificial Sequence
  Description of Artificial Sequence: Synthetic polypeptide
DEEEIATTNPVATEQYGSVCAMNGNLEPGADQPNDAV

SEQ ID NO: 162514 - protein, 34 aa, Artificial Sequence
  Description of Artificial Sequence: Synthetic polypeptide
DEGEIACTNPVATEQYGSVANTGNGEYGAEGTGD

SEQ ID NO: 162515 - protein, 33 aa, Artificial Sequence
  Description of Artificial Sequence: Synthetic polypeptide
QESEIATTNPVAYDHYGSVSYTAELSQQVLNMN

SEQ ID NO: 162516 - protein, 37 aa, Artificial Sequence
  Description of Artificial Sequence: Synthetic polypeptide
DEEEIATTNPVATEQYGSVCAMNGNLEPGAGIPNDAD

SEQ ID NO: 162517 - protein, 38 aa, Artificial Sequence
  Description of Artificial Sequence: Synthetic polypeptide
AEEEIRTTNPVATEQYGVVVVTVNTNQLGNQQGNNAGD

SEQ ID NO: 162518 - protein, 35 aa, Artificial Sequence
  Description of Artificial Sequence: Synthetic polypeptide
DEEEIRTTNPVATEQYGSVVVQGFGQENDPDEDGT

SEQ ID NO: 162519 - protein, 37 aa, Artificial Sequence
  Description of Artificial Sequence: Synthetic polypeptide
DEEEIRTTNPVATEQYGSCVAPEQTPLDPIAQTMVAD

SEQ ID NO: 162520 - protein, 38 aa, Artificial Sequence
  Description of Artificial Sequence: Synthetic polypeptide
DEEEIRTTNPVATEQYGSCVEPTNWPAELHPVMVSNEN

SEQ ID NO: 162521 - protein, 31 aa, Artificial Sequence
  Description of Artificial Sequence: Synthetic polypeptide
DENEIRSTNPVSTEPYGTIASEDIQQHNGDI

SEQ ID NO: 162522 - protein, 31 aa, Artificial Sequence
  Description of Artificial Sequence: Synthetic polypeptide
IENCIATTNPVATECYGMVSKEELQHDEELQ

SEQ ID NO: 162523 - protein, 31 aa, Artificial Sequence
  Description of Artificial Sequence: Synthetic polypeptide
IENCIATTNPVATECYGMVSKEEALQHEEEL

SEQ ID NO: 162524 - protein, 30 aa, Artificial Sequence
  Description of Artificial Sequence: Synthetic polypeptide
QESEIASTNPVGYTEGGYGVMASTLQHGDI

SEQ ID NO: 162525 - protein, 37 aa, Artificial Sequence
  Description of Artificial Sequence: Synthetic polypeptide
DEEEIRTTNPVATEQYGSCVLGIAVMTIEEPEQEGTP

SEQ ID NO: 162526 - protein, 38 aa, Artificial Sequence
  Description of Artificial Sequence: Synthetic polypeptide
DEEEIRTTNPVATEQYGSCVQSVRTLEEEAEQLQTNTP

SEQ ID NO: 162527 - protein, 29 aa, Artificial Sequence
  Description of Artificial Sequence: Synthetic peptide
QESEIASTNPVGYTEGYGVMAKTLQHGDI

SEQ ID NO: 162528 - protein, 33 aa, Artificial Sequence
  Description of Artificial Sequence: Synthetic polypeptide
DEGEIATTNPVATAQWGGCCAPNGLEPRDGNPH

SEQ ID NO: 162529 - protein, 34 aa, Artificial Sequence
  Description of Artificial Sequence: Synthetic polypeptide
IEGEIRTTNPVATEQYGSVSCAPELTEIVEDVDE

SEQ ID NO: 162530 - protein, 35 aa, Artificial Sequence
  Description of Artificial Sequence: Synthetic polypeptide
IEGEIRTTNPVATEQYGSCISVLNGQDQDTYDGRI

SEQ ID NO: 162531 - protein, 36 aa, Artificial Sequence
  Description of Artificial Sequence: Synthetic polypeptide
DEEEIRTTNPVATEGYGSVMGQFPNNGEQNNGGGQG

SEQ ID NO: 162532 - protein, 32 aa, Artificial Sequence
  Description of Artificial Sequence: Synthetic polypeptide
DENEIRSTNPVSTEPYGNIAANTIQQSQVGQR

SEQ ID NO: 162533 - protein, 36 aa, Artificial Sequence
  Description of Artificial Sequence: Synthetic polypeptide
DEEEIATTNPVATEQYGSVCAMNGNLEPPADIANDN

SEQ ID NO: 162534 - protein, 36 aa, Artificial Sequence
  Description of Artificial Sequence: Synthetic polypeptide
DEAEIATTNPVATEQYGSACATNPELQEHQDDNMAG

SEQ ID NO: 162535 - protein, 35 aa, Artificial Sequence
  Description of Artificial Sequence: Synthetic polypeptide
DENEIRGTNPVATEQYGSVMSDTIMGGQEDIDDIG

SEQ ID NO: 162536 - protein, 35 aa, Artificial Sequence
  Description of Artificial Sequence: Synthetic polypeptide
DENEIRGTNPVATEQYGSVMSDTIMGGNEDDDDFG

SEQ ID NO: 162537 - protein, 34 aa, Artificial Sequence
  Description of Artificial Sequence: Synthetic polypeptide
IENEIRTTNPVATEQYGSVCYVTWPLNEDIEQEM

SEQ ID NO: 162538 - protein, 36 aa, Artificial Sequence
  Description of Artificial Sequence: Synthetic polypeptide
DEEEIRTTNPVAYEQYGSSVCSEVGLLEVINYGQFQ

SEQ ID NO: 162539 - protein, 30 aa, Artificial Sequence
  Description of Artificial Sequence: Synthetic polypeptide
QESEIATTNPVGTEGYGTMAMDIQQHNGNI

SEQ ID NO: 162540 - protein, 28 aa, Artificial Sequence
  Description of Artificial Sequence: Synthetic peptide
QESEIASTNPVGYEGYGVMASTLLHGDI

SEQ ID NO: 162541 - protein, 35 aa, Artificial Sequence
  Description of Artificial Sequence: Synthetic polypeptide
DEAEIATTNPVATEQYGCVSTTDLNEDHEGSETLG

SEQ ID NO: 162542 - protein, 30 aa, Artificial Sequence
  Description of Artificial Sequence: Synthetic polypeptide
YESEVASVNPVSTEQYGNVANTLQSRVGQQ

SEQ ID NO: 162543 - protein, 32 aa, Artificial Sequence
  Description of Artificial Sequence: Synthetic polypeptide
YETEIASTNPIATEQYGAVADENLQESKGPYQ

SEQ ID NO: 162544 - protein, 31 aa, Artificial Sequence
  Description of Artificial Sequence: Synthetic polypeptide
DENEIRSTNPVSTEPYGTMASEDIQQHNGDI

SEQ ID NO: 162545 - protein, 35 aa, Artificial Sequence
  Description of Artificial Sequence: Synthetic polypeptide
CEEEIACTNPVATEQYGSACSAANPQDDADGNDNE

SEQ ID NO: 162546 - protein, 32 aa, Artificial Sequence
  Description of Artificial Sequence: Synthetic polypeptide
DENEIRSTNPVSTEPYGTISMEFIQQQQNGNH

SEQ ID NO: 162547 - protein, 29 aa, Artificial Sequence
  Description of Artificial Sequence: Synthetic peptide
QESEIASTNPVGYEGYGVMASTLQHGDKI

SEQ ID NO: 162548 - protein, 36 aa, Artificial Sequence
  Description of Artificial Sequence: Synthetic polypeptide
DEEEIATTNPVATEQYGSVCAMNGNLEPGADIDEDA

SEQ ID NO: 162549 - protein, 36 aa, Artificial Sequence
  Description of Artificial Sequence: Synthetic polypeptide
DEEEIRTTNPVATEQYGSCTYPHTPLTALVPQVILD

SEQ ID NO: 162550 - protein, 36 aa, Artificial Sequence
  Description of Artificial Sequence: Synthetic polypeptide
GHEEETRFTTNPTAQERYGSVQSTNESSERIGTSNR

SEQ ID NO: 162551 - protein, 29 aa, Artificial Sequence
  Description of Artificial Sequence: Synthetic peptide
QESEIASTNPVGYEGYGVMASTLQHGDLI

SEQ ID NO: 162552 - protein, 32 aa, Artificial Sequence
  Description of Artificial Sequence: Synthetic polypeptide
DENEIRSTNPVSTEPYGTISMEDIQQQQNGNH

SEQ ID NO: 162553 - protein, 29 aa, Artificial Sequence
  Description of Artificial Sequence: Synthetic peptide
QESEIASTNPVGYEGYGVMASTLQHMGDI

SEQ ID NO: 162554 - protein, 37 aa, Artificial Sequence
  Description of Artificial Sequence: Synthetic polypeptide
AEEEIRTTNPVATESYGSVSTVVSNNNATEEGTNEQD

SEQ ID NO: 162555 - protein, 37 aa, Artificial Sequence
  Description of Artificial Sequence: Synthetic polypeptide
AEEEIRTTNPVATESYGSVSTVVSNNNAEEIGTNTQS

SEQ ID NO: 162556 - protein, 35 aa, Artificial Sequence
  Description of Artificial Sequence: Synthetic polypeptide
IENEICTTNPVATEQYGSVATTVNLNEANFDLPQE

SEQ ID NO: 162557 - protein, 36 aa, Artificial Sequence
  Description of Artificial Sequence: Synthetic polypeptide
DEEEIRTTNPVATEQYGSCTWDWYELQPQSTQNGQI

SEQ ID NO: 162558 - protein, 30 aa, Artificial Sequence
  Description of Artificial Sequence: Synthetic polypeptide
QESEIATTNPVGTEGYGATTWAATLQHGDI

SEQ ID NO: 162559 - protein, 37 aa, Artificial Sequence
  Description of Artificial Sequence: Synthetic polypeptide
AEEEIRTTNPVATESYGSVSTVVSNGNVNEQGTNQQA

SEQ ID NO: 162560 - protein, 32 aa, Artificial Sequence
  Description of Artificial Sequence: Synthetic polypeptide
DENEIRSTNPVSTEPYGTISMEDIQQQQHGNH

SEQ ID NO: 162561 - protein, 36 aa, Artificial Sequence
  Description of Artificial Sequence: Synthetic polypeptide
DEEEIATTNPVATEQYGSVCAMNGNLEPGADIPGTA

SEQ ID NO: 162562 - protein, 32 aa, Artificial Sequence
  Description of Artificial Sequence: Synthetic polypeptide
IENEIATTNPVATECYGHVSVECLETHGEEDL

SEQ ID NO: 162563 - protein, 36 aa, Artificial Sequence
  Description of Artificial Sequence: Synthetic polypeptide
DEAEIATTNPVATEQYGCVTAATANGLQPADPPNNN

SEQ ID NO: 162564 - protein, 28 aa, Artificial Sequence
  Description of Artificial Sequence: Synthetic peptide
QESEIASTNPVGYYGYGVMASTLQHGDI

SEQ ID NO: 162565 - protein, 34 aa, Artificial Sequence
  Description of Artificial Sequence: Synthetic polypeptide
DEGEIACTNPVATEQYGSVCAAGNLGPDGMPTQM

SEQ ID NO: 162566 - protein, 35 aa, Artificial Sequence
  Description of Artificial Sequence: Synthetic polypeptide
DEEEIRTTNPVATEGYGSVMGQFVGGQENNGGGFE

SEQ ID NO: 162567 - protein, 36 aa, Artificial Sequence
  Description of Artificial Sequence: Synthetic polypeptide
DENEIRSTNPVATEQYGSVITDNNAGNDEGEGGNEG

SEQ ID NO: 162568 - protein, 29 aa, Artificial Sequence
  Description of Artificial Sequence: Synthetic peptide
QESEIATTNPVATEQWGDMSEIEMNHEDI

SEQ ID NO: 162569 - protein, 36 aa, Artificial Sequence
  Description of Artificial Sequence: Synthetic polypeptide
DEEEIRATNPVATEQYGSVCAATMGEEAGMNMDEEG

SEQ ID NO: 162570 - protein, 35 aa, Artificial Sequence
  Description of Artificial Sequence: Synthetic polypeptide
CEEEIACTNPVATEQYGSACSANPLQNHADEGGHH

SEQ ID NO: 162571 - protein, 36 aa, Artificial Sequence
  Description of Artificial Sequence: Synthetic polypeptide
IEEEIRTTNPVATEQYGSYSSPITAEPNANVGHPQV

SEQ ID NO: 162572 - protein, 35 aa, Artificial Sequence
  Description of Artificial Sequence: Synthetic polypeptide
DEEEIRTTNPVATEGYGSVMGQPVVGGENNGGGQE

SEQ ID NO: 162573 - protein, 36 aa, Artificial Sequence
  Description of Artificial Sequence: Synthetic polypeptide
DEEEIRATNPVATEQYGSVCAATMGEEAGMMDENPG

SEQ ID NO: 162574 - protein, 34 aa, Artificial Sequence
  Description of Artificial Sequence: Synthetic polypeptide
DELEITTTNPVATEQYGTVCSATSGPVEFEHEND

SEQ ID NO: 162575 - protein, 30 aa, Artificial Sequence
  Description of Artificial Sequence: Synthetic polypeptide
DEGEIAPTNPCATECWGAVWACDLQPGPYI

SEQ ID NO: 162576 - protein, 38 aa, Artificial Sequence
  Description of Artificial Sequence: Synthetic polypeptide
DEEEIRTTNPVAYEQYGQVAVSFQMNDLLQPIGQISRF

SEQ ID NO: 162577 - protein, 34 aa, Artificial Sequence
  Description of Artificial Sequence: Synthetic polypeptide
DELEIVTTNPVATEQYGTVCSATSGPVEFEHNPD

SEQ ID NO: 162578 - protein, 30 aa, Artificial Sequence
  Description of Artificial Sequence: Synthetic polypeptide
DENEIRSTNPVATEGWGDVSEIEMNAAEDA

SEQ ID NO: 162579 - protein, 37 aa, Artificial Sequence
  Description of Artificial Sequence: Synthetic polypeptide
AEEEIRTTNPVATESYGSVSTVTNNANNNQQGTDGGN

SEQ ID NO: 162580 - protein, 29 aa, Artificial Sequence
  Description of Artificial Sequence: Synthetic peptide
QEGEIAPTNPCASEQYGIVSCNEMNSEDA

SEQ ID NO: 162581 - protein, 30 aa, Artificial Sequence
  Description of Artificial Sequence: Synthetic polypeptide
DENEIRSTNPVATEGWGDVANIIMNAAGDA

SEQ ID NO: 162582 - protein, 34 aa, Artificial Sequence
  Description of Artificial Sequence: Synthetic polypeptide
DEAVIGTTNPVATEQWGCVCSTMEDLQYFGSDQS

SEQ ID NO: 162583 - protein, 36 aa, Artificial Sequence
  Description of Artificial Sequence: Synthetic polypeptide
DEECISTTNPVAYEHYGQSTVAVTNELAQRVGPTYF

SEQ ID NO: 162584 - protein, 29 aa, Artificial Sequence
  Description of Artificial Sequence: Synthetic peptide
QEGEIACTNPVGTEGWGVSASALQHGDDA

SEQ ID NO: 162585 - protein, 29 aa, Artificial Sequence
  Description of Artificial Sequence: Synthetic peptide
DENEIRSTNPVATEGWGDVAEIEMAAEDA

SEQ ID NO: 162586 - protein, 29 aa, Artificial Sequence
  Description of Artificial Sequence: Synthetic peptide
QEGEIACTNPVGTEGWGVSASGLQDGDMQ

SEQ ID NO: 162587 - protein, 33 aa, Artificial Sequence
  Description of Artificial Sequence: Synthetic polypeptide
QESEIATTNPVATEGYGVVCAASDTLVEFEGND

SEQ ID NO: 162588 - protein, 30 aa, Artificial Sequence
  Description of Artificial Sequence: Synthetic polypeptide
QESEIASTNPVSTEGYGVMASTLQQHNGDH

SEQ ID NO: 162589 - protein, 29 aa, Artificial Sequence
  Description of Artificial Sequence: Synthetic peptide
QEGEIACTNPVGTEGWGVSASGLQGGDDM

SEQ ID NO: 162590 - protein, 31 aa, Artificial Sequence
  Description of Artificial Sequence: Synthetic polypeptide
QESEIATTNPVATEGYGVMCASDTLVEHGDD

SEQ ID NO: 162591 - protein, 30 aa, Artificial Sequence
  Description of Artificial Sequence: Synthetic polypeptide
QESEIASTNPVSTEGYGVMSSTLQQHNGDH

SEQ ID NO: 162592 - protein, 32 aa, Artificial Sequence
  Description of Artificial Sequence: Synthetic polypeptide
DENEIRQTNPVSTEPYGTISMEDIQQSQNGNH

SEQ ID NO: 162593 - protein, 35 aa, Artificial Sequence
  Description of Artificial Sequence: Synthetic polypeptide
DEECISTTNPVAYEHYGQSTVAVGNELAQIGGERK

SEQ ID NO: 162594 - protein, 36 aa, Artificial Sequence
  Description of Artificial Sequence: Synthetic polypeptide
HEEEIRTTNPVATEQYGSVSLPVWRTEEHRLAAPYP

SEQ ID NO: 162595 - protein, 36 aa, Artificial Sequence
  Description of Artificial Sequence: Synthetic polypeptide
DEEEIATTNPVATEQYGSVCAMNNGNLEPADIPNEA

SEQ ID NO: 162596 - protein, 35 aa, Artificial Sequence
  Description of Artificial Sequence: Synthetic polypeptide
DEEEIRATNPVATEQYGSVCAATMGEEAGTMGEQG

SEQ ID NO: 162597 - protein, 31 aa, Artificial Sequence
  Description of Artificial Sequence: Synthetic polypeptide
QESEIASTNPVSTECYGNVSANCIQSRVEQL

SEQ ID NO: 162598 - protein, 36 aa, Artificial Sequence
  Description of Artificial Sequence: Synthetic polypeptide
DEEEIRTTNPVATEQYGSFSNASMGEETQIAFVNDP

SEQ ID NO: 162599 - protein, 29 aa, Artificial Sequence
  Description of Artificial Sequence: Synthetic peptide
QESEIASTNPVSTEGYGVIAMTLQQHGDI

SEQ ID NO: 162600 - protein, 38 aa, Artificial Sequence
  Description of Artificial Sequence: Synthetic polypeptide
AEEEIRTTNPVATESYGSVSTVTNNQLGNNQQGEDGGT

SEQ ID NO: 162601 - protein, 38 aa, Artificial Sequence
  Description of Artificial Sequence: Synthetic polypeptide
AEEEIRTTNPVATESYGSVSTVTNNQLGNEQGTTDGGP

SEQ ID NO: 162602 - protein, 31 aa, Artificial Sequence
  Description of Artificial Sequence: Synthetic polypeptide
QESEIATTNPVATEQYGEAPTEFVCDQHEMK

SEQ ID NO: 162603 - protein, 32 aa, Artificial Sequence
  Description of Artificial Sequence: Synthetic polypeptide
DENEIRSTNPVSTEGYGTISMEDIQQQQNGNH

SEQ ID NO: 162604 - protein, 30 aa, Artificial Sequence
  Description of Artificial Sequence: Synthetic polypeptide
DENEIRSTNPVGTEQWGDMASIEMNAAGDI

SEQ ID NO: 162605 - protein, 31 aa, Artificial Sequence
  Description of Artificial Sequence: Synthetic polypeptide
DEGEIATTNPISTECYGAVWANCNLAPKGTI

SEQ ID NO: 162606 - protein, 29 aa, Artificial Sequence
  Description of Artificial Sequence: Synthetic peptide
DENEIRSTNPVGTEGWGDVASIEQAAEDA

SEQ ID NO: 162607 - protein, 30 aa, Artificial Sequence
  Description of Artificial Sequence: Synthetic polypeptide
YETEIATTNPICTECYGVVSNDDWQESGPQ

SEQ ID NO: 162608 - protein, 38 aa, Artificial Sequence
  Description of Artificial Sequence: Synthetic polypeptide
AEEEIRTTNPVATESYGSVSTVTNNNLGNNQQGTDQGE

SEQ ID NO: 162609 - protein, 38 aa, Artificial Sequence
  Description of Artificial Sequence: Synthetic polypeptide
AEEEIRTTNPVATESYGSVSTVTNNNLGNNQQGTDGQS

SEQ ID NO: 162610 - protein, 34 aa, Artificial Sequence
  Description of Artificial Sequence: Synthetic polypeptide
DEGEIATTNPIATEQWGSIVPTNWDQHEHGQDGL

SEQ ID NO: 162611 - protein, 36 aa, Artificial Sequence
  Description of Artificial Sequence: Synthetic polypeptide
DEEEIRTTNPVATEQYGSVVYDGMFGQDNDQEEDDG

SEQ ID NO: 162612 - protein, 36 aa, Artificial Sequence
  Description of Artificial Sequence: Synthetic polypeptide
DEEEIATTNPVATEQYGSVCAMNHIENIDDQDEGRH

SEQ ID NO: 162613 - protein, 38 aa, Artificial Sequence
  Description of Artificial Sequence: Synthetic polypeptide
AEEEIRTTNPVATESYGSVSTVTNNNLGNNQIGTDGGT

SEQ ID NO: 162614 - protein, 36 aa, Artificial Sequence
  Description of Artificial Sequence: Synthetic polypeptide
HEEEIRTTNPVATEQYGSVGSLCVNTEEHILAGPVS

SEQ ID NO: 162615 - protein, 35 aa, Artificial Sequence
  Description of Artificial Sequence: Synthetic polypeptide
HEEEIRTTNPVATEQYGSVILPVNTEEHRLAAPPT

SEQ ID NO: 162616 - protein, 37 aa, Artificial Sequence
  Description of Artificial Sequence: Synthetic polypeptide
AEEEIRTTNPVATESYGSVSTVTNNNANNQQGTDGGE

SEQ ID NO: 162617 - protein, 37 aa, Artificial Sequence
  Description of Artificial Sequence: Synthetic polypeptide
AEEEIRTTNPVATESYGSVSTVTNNNANNNQQGEDGG

SEQ ID NO: 162618 - protein, 38 aa, Artificial Sequence
  Description of Artificial Sequence: Synthetic polypeptide
AEEEIRTTNPVATEQYGVVVVTVTTNNGNLQQGTNQID

SEQ ID NO: 162619 - protein, 35 aa, Artificial Sequence
  Description of Artificial Sequence: Synthetic polypeptide
DEGEIATTNPIATEQWGSIVPTNWDQHEGGQNDTE

SEQ ID NO: 162620 - protein, 35 aa, Artificial Sequence
  Description of Artificial Sequence: Synthetic polypeptide
DEAEIATTNPVATEQYGSCAAAMGNGLANTRDGDD

SEQ ID NO: 162621 - protein, 29 aa, Artificial Sequence
  Description of Artificial Sequence: Synthetic peptide
QESEIATTNPVATEQWGVMASIEMNHEDI

SEQ ID NO: 162622 - protein, 37 aa, Artificial Sequence
  Description of Artificial Sequence: Synthetic polypeptide
IEEEIRTTNPVATEQYGSYSSPPTAEPNMRVGHTNVC

SEQ ID NO: 162623 - protein, 37 aa, Artificial Sequence
  Description of Artificial Sequence: Synthetic polypeptide
AEEEIRTTNPVATESYGSVSTVTNNEQGNQQGTDGGD

SEQ ID NO: 162624 - protein, 35 aa, Artificial Sequence
  Description of Artificial Sequence: Synthetic polypeptide
DEECISTTNPVAYEHYGQTTVAVTNELAQRGGEIY

SEQ ID NO: 162625 - protein, 36 aa, Artificial Sequence
  Description of Artificial Sequence: Synthetic polypeptide
DDEEIRTTNPVATEQYGCVCSTTGEDHNENFGSDQS

SEQ ID NO: 162626 - protein, 32 aa, Artificial Sequence
  Description of Artificial Sequence: Synthetic polypeptide
KENEIRTTNPVSTEPYGTISLEDIQQQQNGNH

SEQ ID NO: 162627 - protein, 32 aa, Artificial Sequence
  Description of Artificial Sequence: Synthetic polypeptide
KENEIRTTNPVSTEPYGTISMEDIQQQQNGNH

SEQ ID NO: 162628 - protein, 34 aa, Artificial Sequence
  Description of Artificial Sequence: Synthetic polypeptide
DEGEIATTNPVATEQYGCNYATIEPLQAPMENNN

SEQ ID NO: 162629 - protein, 36 aa, Artificial Sequence
  Description of Artificial Sequence: Synthetic polypeptide
DEEEIRTTNPVATEQYGSVVVDGFGDENDQEEDEIG

SEQ ID NO: 162630 - protein, 38 aa, Artificial Sequence
  Description of Artificial Sequence: Synthetic polypeptide
AEEEIRTTNPVATEQYGSVSTVTTNQNNNNEQGNNAED

SEQ ID NO: 162631 - protein, 34 aa, Artificial Sequence
  Description of Artificial Sequence: Synthetic polypeptide
YENEITRTTNSVAHESYGEVFSCWMNLNNRGGER

SEQ ID NO: 162632 - protein, 37 aa, Artificial Sequence
  Description of Artificial Sequence: Synthetic polypeptide
DEEEIRTTNPVATEQYGSVVVDGFGDENDQEEDPNNG

SEQ ID NO: 162633 - protein, 30 aa, Artificial Sequence
  Description of Artificial Sequence: Synthetic polypeptide
QETEIRTTNPVATEQWGETPNEVWAEHGEK

SEQ ID NO: 162634 - protein, 30 aa, Artificial Sequence
  Description of Artificial Sequence: Synthetic polypeptide
QETEIRTTNPVATEQWGEAPNEVWAEHGEK

SEQ ID NO: 162635 - protein, 30 aa, Artificial Sequence
  Description of Artificial Sequence: Synthetic polypeptide
QESEIASTNPVGTEGYGVVSASTLEHEGDI

SEQ ID NO: 162636 - protein, 30 aa, Artificial Sequence
  Description of Artificial Sequence: Synthetic polypeptide
QETEIRTTNPIATEGWGATTWAADLQPGDI

SEQ ID NO: 162637 - protein, 32 aa, Artificial Sequence
  Description of Artificial Sequence: Synthetic polypeptide
QESEIASTNPVGTEGYGVVSATTTLPQHGMDV

SEQ ID NO: 162638 - protein, 36 aa, Artificial Sequence
  Description of Artificial Sequence: Synthetic polypeptide
DEKVIRTTNPVATEQYGSVSSTTPAHPNMRNQMNPV

SEQ ID NO: 162639 - protein, 39 aa, Artificial Sequence
  Description of Artificial Sequence: Synthetic polypeptide
DEEEIRTTNPVATEQYGSFVTLSTFQNMVELEQAVVPTQ

SEQ ID NO: 162640 - protein, 34 aa, Artificial Sequence
  Description of Artificial Sequence: Synthetic polypeptide
QETEIRTTNPVATESYGSVSDGLGGGEGQEEQQG

SEQ ID NO: 162641 - protein, 31 aa, Artificial Sequence
  Description of Artificial Sequence: Synthetic polypeptide
QETEIRTTNPIATECWGAVWSNADWQPGPYI

SEQ ID NO: 162642 - protein, 33 aa, Artificial Sequence
  Description of Artificial Sequence: Synthetic polypeptide
DEGEIATTNPVATEQWGTVCAATDGGVEPEGND

SEQ ID NO: 162643 - protein, 32 aa, Artificial Sequence
  Description of Artificial Sequence: Synthetic polypeptide
QETEIRTTNPIATECWGATVWANAEDWQPGPR

SEQ ID NO: 162644 - protein, 31 aa, Artificial Sequence
  Description of Artificial Sequence: Synthetic polypeptide
QETEIRTTNPIATECWGATTWANADLQPGPI

SEQ ID NO: 162645 - protein, 37 aa, Artificial Sequence
  Description of Artificial Sequence: Synthetic polypeptide
DEEEIRTTNPVATEQYGSCQLVMNNDEQGVIAIVNEV

SEQ ID NO: 162646 - protein, 37 aa, Artificial Sequence
  Description of Artificial Sequence: Synthetic polypeptide
DEEEIRTTNPVATEQYGSCQLVMNNDTQQPIAPVNEV

SEQ ID NO: 162647 - protein, 32 aa, Artificial Sequence
  Description of Artificial Sequence: Synthetic polypeptide
QESEIASTNPVGTEGYGVVSSTTTLPQHGMDV

SEQ ID NO: 162648 - protein, 35 aa, Artificial Sequence
  Description of Artificial Sequence: Synthetic polypeptide
DEAEIATTNPVATEQWGSVAITNPEEAPDNQNGRD

SEQ ID NO: 162649 - protein, 34 aa, Artificial Sequence
  Description of Artificial Sequence: Synthetic polypeptide
DEQSEIATTNPVAYEQWGSTSTNNPGDTQKGGDQ

SEQ ID NO: 162650 - protein, 36 aa, Artificial Sequence
  Description of Artificial Sequence: Synthetic polypeptide
DEEEIRTTNPVATEQYGSCQVAVEEQIENTEEANIF

SEQ ID NO: 162651 - protein, 33 aa, Artificial Sequence
  Description of Artificial Sequence: Synthetic polypeptide
DENEIRCTNPVATEQWGATSNEEDLQEPKGGYI

SEQ ID NO: 162652 - protein, 34 aa, Artificial Sequence
  Description of Artificial Sequence: Synthetic polypeptide
DESCIRTTNPVAYEQWGESYYNVDQHGQRGDNPW

SEQ ID NO: 162653 - protein, 36 aa, Artificial Sequence
  Description of Artificial Sequence: Synthetic polypeptide
DEEEIRTTNPVATEQYGSCQVIIEEQIENTEEANDM

SEQ ID NO: 162654 - protein, 35 aa, Artificial Sequence
  Description of Artificial Sequence: Synthetic polypeptide
DEAEIATTNPVATEQWGSVAITNAPEQTGDGDSQD

SEQ ID NO: 162655 - protein, 35 aa, Artificial Sequence
  Description of Artificial Sequence: Synthetic polypeptide
DEAEIATTNPVATEQWGSVAPGNALEQSGEGTGDP

SEQ ID NO: 162656 - protein, 34 aa, Artificial Sequence
  Description of Artificial Sequence: Synthetic polypeptide
DEFEIATTNPVAYEQWGSVCQTFETDDGRGGGTR

SEQ ID NO: 162657 - protein, 34 aa, Artificial Sequence
  Description of Artificial Sequence: Synthetic polypeptide
DEFEIATTNPVAYEQWGSVCQTFEDRTTQDGDSR

SEQ ID NO: 162658 - protein, 37 aa, Artificial Sequence
  Description of Artificial Sequence: Synthetic polypeptide
DDEEIRTTNPVATEQYGSVDSGVQEGEGQGGNQGNGD

SEQ ID NO: 162659 - protein, 37 aa, Artificial Sequence
  Description of Artificial Sequence: Synthetic polypeptide
DDEEIRTTNPVATEQYGSVDSGVQEGEDLGGGQGNGD

SEQ ID NO: 162660 - protein, 39 aa, Artificial Sequence
  Description of Artificial Sequence: Synthetic polypeptide
DEEEIRTTNPVATESYGSVTNLQSGTISTNTQNNEQGNM

SEQ ID NO: 162661 - protein, 35 aa, Artificial Sequence
  Description of Artificial Sequence: Synthetic polypeptide
QEVEIRTTNPVATEQYGSVDDGTNDEGEGQGEQQT

SEQ ID NO: 162662 - protein, 36 aa, Artificial Sequence
  Description of Artificial Sequence: Synthetic polypeptide
QEVEIRTTNPVATEQYGSVCTGDGNDQGEGEEGIGP

SEQ ID NO: 162663 - protein, 33 aa, Artificial Sequence
  Description of Artificial Sequence: Synthetic polypeptide
DEGEIATTNPVATEQYGCVAANPDATMPPGEPH

SEQ ID NO: 162664 - protein, 35 aa, Artificial Sequence
  Description of Artificial Sequence: Synthetic polypeptide
MDMEIRTTNPVATEQYGCVTSTLLATQFNGLQDQE

SEQ ID NO: 162665 - protein, 34 aa, Artificial Sequence
  Description of Artificial Sequence: Synthetic polypeptide
DEGEIATTNPVATEQYGCVAANNGGVTTDDGNEN

SEQ ID NO: 162666 - protein, 34 aa, Artificial Sequence
  Description of Artificial Sequence: Synthetic polypeptide
QEVEIRTTNPVATDQYGVVVGFGNLEDGENENIS

SEQ ID NO: 162667 - protein, 34 aa, Artificial Sequence
  Description of Artificial Sequence: Synthetic polypeptide
QEVEIGTTNPVATEQYGVVVVAANAGMEQGGNEG

SEQ ID NO: 162668 - protein, 36 aa, Artificial Sequence
  Description of Artificial Sequence: Synthetic polypeptide
DEEEIRTTNPVATEQYGSVWGAVPDPMTQMGSQEET

SEQ ID NO: 162669 - protein, 35 aa, Artificial Sequence
  Description of Artificial Sequence: Synthetic polypeptide
DEGEIATTNPVATEQYGCVAANHSGDANMDPQGGN

SEQ ID NO: 162670 - protein, 34 aa, Artificial Sequence
  Description of Artificial Sequence: Synthetic polypeptide
DEGEIATTNPVATEQYGCVAANGDTTTHQGNETP

SEQ ID NO: 162671 - protein, 39 aa, Artificial Sequence
  Description of Artificial Sequence: Synthetic polypeptide
DEEEIRTTNPVATEQYGSFVTNSTNQNQDELEQAVVPTA

SEQ ID NO: 162672 - protein, 31 aa, Artificial Sequence
  Description of Artificial Sequence: Synthetic polypeptide
DENEIRTTNPVATAQWGDVCSEIEMNAAEDA

SEQ ID NO: 162673 - protein, 36 aa, Artificial Sequence
  Description of Artificial Sequence: Synthetic polypeptide
DEEEIRTTNPVATEQYGSVWGAVPDPMQQMGSLEEE

SEQ ID NO: 162674 - protein, 39 aa, Artificial Sequence
  Description of Artificial Sequence: Synthetic polypeptide
DEEEIRTTNPVATESYGSVTNLQSGTISTNQQNQEVGNV

SEQ ID NO: 162675 - protein, 39 aa, Artificial Sequence
  Description of Artificial Sequence: Synthetic polypeptide
DEEEIRTTNPVATESYGSVTNLQSGTIGTNTQNQEQGNE

SEQ ID NO: 162676 - protein, 36 aa, Artificial Sequence
  Description of Artificial Sequence: Synthetic polypeptide
DEEEIRTTNPVATEQYGSVWGAVPDPMQQMFNLEET

SEQ ID NO: 162677 - protein, 36 aa, Artificial Sequence
  Description of Artificial Sequence: Synthetic polypeptide
DEEEIATTNPVATEQYGSVCAGNNGLADDPGDEGAM

SEQ ID NO: 162678 - protein, 30 aa, Artificial Sequence
  Description of Artificial Sequence: Synthetic polypeptide
QEVEIATTNPVATEQYGCAPEHGQDSEEKN

SEQ ID NO: 162679 - protein, 38 aa, Artificial Sequence
  Description of Artificial Sequence: Synthetic polypeptide
DEEEIRTTNPVATEQYGSFVTNSCNQNMELEQAVQTTA

SEQ ID NO: 162680 - protein, 36 aa, Artificial Sequence
  Description of Artificial Sequence: Synthetic polypeptide
DEEEIRTTNPVATEQYGSCPENNSNLSQFQEVELEV

SEQ ID NO: 162681 - protein, 36 aa, Artificial Sequence
  Description of Artificial Sequence: Synthetic polypeptide
DEEEIATTNPVATEQYGSVCAGNNGLADRPIDEDAM

SEQ ID NO: 162682 - protein, 36 aa, Artificial Sequence
  Description of Artificial Sequence: Synthetic polypeptide
DEGEIATTNPVATEQYGCVAANHALTQGDPGEENHW

SEQ ID NO: 162683 - protein, 31 aa, Artificial Sequence
  Description of Artificial Sequence: Synthetic polypeptide
QESEIASTNPVGTEGYGVVATTTLPQHGMDV

SEQ ID NO: 162684 - protein, 36 aa, Artificial Sequence
  Description of Artificial Sequence: Synthetic polypeptide
DESDEIATTNPVAYECWGSVASNDNLGEERNGENSR

SEQ ID NO: 162685 - protein, 29 aa, Artificial Sequence
  Description of Artificial Sequence: Synthetic peptide
QESEIASTNPVGTEGYGVYMAQTLQHGDI

SEQ ID NO: 162686 - protein, 36 aa, Artificial Sequence
  Description of Artificial Sequence: Synthetic polypeptide
DEAEIATTNPVATEQWGSVSANSGENAEDQTAGMIR

SEQ ID NO: 162687 - protein, 32 aa, Artificial Sequence
  Description of Artificial Sequence: Synthetic polypeptide
QEFEIATTNPVAYECYGKVSECALSQTEVGEL

SEQ ID NO: 162688 - protein, 30 aa, Artificial Sequence
  Description of Artificial Sequence: Synthetic polypeptide
QETEIATTNPIATECWGATSNADLQEHGPL

SEQ ID NO: 162689 - protein, 32 aa, Artificial Sequence
  Description of Artificial Sequence: Synthetic polypeptide
QETEIATTNPCSTEQYGATVWANCENLQSGPI

SEQ ID NO: 162690 - protein, 32 aa, Artificial Sequence
  Description of Artificial Sequence: Synthetic polypeptide
QETEIATTNPCSTEQYGATVWANCENLQPGPI

SEQ ID NO: 162691 - protein, 35 aa, Artificial Sequence
  Description of Artificial Sequence: Synthetic polypeptide
DEEEIRTTNPVATESYGSVSDGFGGEEGQGEEQGE

SEQ ID NO: 162692 - protein, 35 aa, Artificial Sequence
  Description of Artificial Sequence: Synthetic polypeptide
LEPEIRTTNPVATEQYGSSHVGETSQQHEGSEEQN

SEQ ID NO: 162693 - protein, 32 aa, Artificial Sequence
  Description of Artificial Sequence: Synthetic polypeptide
LENEIRTTNPVSTEPYGTISMQDIQQQQNGNH

SEQ ID NO: 162694 - protein, 36 aa, Artificial Sequence
  Description of Artificial Sequence: Synthetic polypeptide
DEEEIRTTNPVATEQYGSCSGAGPDHDDGAAIGNNH

SEQ ID NO: 162695 - protein, 33 aa, Artificial Sequence
  Description of Artificial Sequence: Synthetic polypeptide
AEEEISTTNPVATEQYGCVCGWEHNQNFNSEQP

SEQ ID NO: 162696 - protein, 36 aa, Artificial Sequence
  Description of Artificial Sequence: Synthetic polypeptide
DEEEIATTNPVATEQYGSVCAMNNNEPTGGDLENGG

SEQ ID NO: 162697 - protein, 32 aa, Artificial Sequence
  Description of Artificial Sequence: Synthetic polypeptide
LENEIRTTNPVSTEPYGTISMEDIQWQQNGNH

SEQ ID NO: 162698 - protein, 32 aa, Artificial Sequence
  Description of Artificial Sequence: Synthetic polypeptide
LENEIRTTNPVSTEPYGTISMEDIQQQQNGNH

SEQ ID NO: 162699 - protein, 33 aa, Artificial Sequence
  Description of Artificial Sequence: Synthetic polypeptide
QETEIATTNPCATEQYGATVWANCENLQEPGPI

SEQ ID NO: 162700 - protein, 30 aa, Artificial Sequence
  Description of Artificial Sequence: Synthetic polypeptide
QETEIATTNPIATECWGIVWAAEDWQPGPR

SEQ ID NO: 162701 - protein, 33 aa, Artificial Sequence
  Description of Artificial Sequence: Synthetic polypeptide
QETEIATTNPCATEQYGATVWANCEDLQEPGPI

SEQ ID NO: 162702 - protein, 33 aa, Artificial Sequence
  Description of Artificial Sequence: Synthetic polypeptide
QETEIATTNPCATEQYGATVWANAEDLQEPGPI

SEQ ID NO: 162703 - protein, 31 aa, Artificial Sequence
  Description of Artificial Sequence: Synthetic polypeptide
QETEIATTNPCATECYGITTWSNADLQSGTI

SEQ ID NO: 162704 - protein, 35 aa, Artificial Sequence
  Description of Artificial Sequence: Synthetic polypeptide
DESCIRTTNPVATEQYGSVWMTNDITQPEEPQDDD

SEQ ID NO: 162705 - protein, 36 aa, Artificial Sequence
  Description of Artificial Sequence: Synthetic polypeptide
DEEEIRTTNPVATESYGSVQQTDNNGEEEEVEGGGT

SEQ ID NO: 162706 - protein, 34 aa, Artificial Sequence
  Description of Artificial Sequence: Synthetic polypeptide
LENEIRTTNPVATEQYGSVSVDVSDETDGGLEDN

SEQ ID NO: 162707 - protein, 34 aa, Artificial Sequence
  Description of Artificial Sequence: Synthetic polypeptide
DEAEIATTNPVATEQWGSVSGQGPPQEADGSFHE

SEQ ID NO: 162708 - protein, 36 aa, Artificial Sequence
  Description of Artificial Sequence: Synthetic polypeptide
DEEEIRTTNPVATEQYGSCSGAGPDLDGTAGGSEHN

SEQ ID NO: 162709 - protein, 38 aa, Artificial Sequence
  Description of Artificial Sequence: Synthetic polypeptide
DEEEIRTTNPVATESYGSVMTNGIGGQTEDVTTGDINI

SEQ ID NO: 162710 - protein, 36 aa, Artificial Sequence
  Description of Artificial Sequence: Synthetic polypeptide
DESCIRTTNPVATEQYGSVWATNNITQPEEGQDDSV

SEQ ID NO: 162711 - protein, 36 aa, Artificial Sequence
  Description of Artificial Sequence: Synthetic polypeptide
DEEEIRTTNPVATEQYGSCSGAGPDPQDGTAGGSVH

SEQ ID NO: 162712 - protein, 37 aa, Artificial Sequence
  Description of Artificial Sequence: Synthetic polypeptide
DEEEIRTTNPVATEQYGSVDNSGSADLGTIGGEQDGE

SEQ ID NO: 162713 - protein, 35 aa, Artificial Sequence
  Description of Artificial Sequence: Synthetic polypeptide
LENEIRTTNPVATEQYGSVCSVTWPSEDQTFVHEM

SEQ ID NO: 162714 - protein, 35 aa, Artificial Sequence
  Description of Artificial Sequence: Synthetic polypeptide
DEEEIRTTNPVATEQYGVYVHPSPVNMPNAVDMAE

SEQ ID NO: 162715 - protein, 31 aa, Artificial Sequence
  Description of Artificial Sequence: Synthetic polypeptide
QETEIATTNPIATECYGITTWSNADLQSGTI

SEQ ID NO: 162716 - protein, 29 aa, Artificial Sequence
  Description of Artificial Sequence: Synthetic peptide
QETEIATTNPIATEQYGEAPNEVCQHEEK

SEQ ID NO: 162717 - protein, 35 aa, Artificial Sequence
  Description of Artificial Sequence: Synthetic polypeptide
DESCIRTTNPVATEQYGVTVPNTNETSQTTTGSTP

SEQ ID NO: 162718 - protein, 36 aa, Artificial Sequence
  Description of Artificial Sequence: Synthetic polypeptide
DEEEIRTTNPVATEQYGSVVVDGFGQENDDDEDGTA

SEQ ID NO: 162719 - protein, 34 aa, Artificial Sequence
  Description of Artificial Sequence: Synthetic polypeptide
DESCIRTTNPVAYEQWGESYNVDLRHGQRGDNIA

SEQ ID NO: 162720 - protein, 30 aa, Artificial Sequence
  Description of Artificial Sequence: Synthetic polypeptide
QETEIATTNPVATEQYGATPNEDWQHKEPK

SEQ ID NO: 162721 - protein, 35 aa, Artificial Sequence
  Description of Artificial Sequence: Synthetic polypeptide
DENEIRTTNPVAFEQYGSVIDGNNNGQERNQVEGD

SEQ ID NO: 162722 - protein, 35 aa, Artificial Sequence
  Description of Artificial Sequence: Synthetic polypeptide
DESCIRTTNPVAYEQWGESYNVDLQHGQRGENPRD

SEQ ID NO: 162723 - protein, 32 aa, Artificial Sequence
  Description of Artificial Sequence: Synthetic polypeptide
QEFEICTTNPVATECYGHVRDEVLEQHGEEDL

SEQ ID NO: 162724 - protein, 29 aa, Artificial Sequence
  Description of Artificial Sequence: Synthetic peptide
QETEIATTNPVATEQWGEAPEVCQEHEEK

SEQ ID NO: 162725 - protein, 34 aa, Artificial Sequence
  Description of Artificial Sequence: Synthetic polypeptide
DESCIRTTNPVAYEQWGESYNLVDLHGQRGDNPI

SEQ ID NO: 162726 - protein, 33 aa, Artificial Sequence
  Description of Artificial Sequence: Synthetic polypeptide
DESCIRTTNPVAYEQWGEAYNIDGHGQRGDNGR

SEQ ID NO: 162727 - protein, 36 aa, Artificial Sequence
  Description of Artificial Sequence: Synthetic polypeptide
DEEEIRTTNPVATEQYGSCSAGNALGIEHPDDAQAN

SEQ ID NO: 162728 - protein, 35 aa, Artificial Sequence
  Description of Artificial Sequence: Synthetic polypeptide
DEAEIRTTNPCAYEQWGSVYCTENLDGDDPGNGDQ

SEQ ID NO: 162729 - protein, 36 aa, Artificial Sequence
  Description of Artificial Sequence: Synthetic polypeptide
DENEIRTTNPVAFEQYGSVIADGNNNGQERNQNEGQ

SEQ ID NO: 162730 - protein, 30 aa, Artificial Sequence
  Description of Artificial Sequence: Synthetic polypeptide
DENEIRTTNPVAFEQWGDVTEIEMNAAEDA

SEQ ID NO: 162731 - protein, 34 aa, Artificial Sequence
  Description of Artificial Sequence: Synthetic polypeptide
DEECIVTTNPVAYERYGCSVHINMVSDRPGGNTA

SEQ ID NO: 162732 - protein, 37 aa, Artificial Sequence
  Description of Artificial Sequence: Synthetic polypeptide
DDEEIRTTNPVATEQYGQVVSAGNDQNDGEGEEGNEG

SEQ ID NO: 162733 - protein, 33 aa, Artificial Sequence
  Description of Artificial Sequence: Synthetic polypeptide
DEMAISTTNPVATEQYGCFCSTEHNIYFGSDQS

SEQ ID NO: 162734 - protein, 31 aa, Artificial Sequence
  Description of Artificial Sequence: Synthetic polypeptide
DDSEVASTNPVSTEQYGTVCAANTPQRVGQD

SEQ ID NO: 162735 - protein, 35 aa, Artificial Sequence
  Description of Artificial Sequence: Synthetic polypeptide
DEEEIRTTNPVATEQYGSVWDYNIAPTSIDVLVMS

SEQ ID NO: 162736 - protein, 35 aa, Artificial Sequence
  Description of Artificial Sequence: Synthetic polypeptide
DEEEIRTTNPVATEQYGSVDNPRVPLNNNFVMEDI

SEQ ID NO: 162737 - protein, 36 aa, Artificial Sequence
  Description of Artificial Sequence: Synthetic polypeptide
DESCIRTTNPVATERYGCTVSQTNEQSDYRGGQYGF

SEQ ID NO: 162738 - protein, 36 aa, Artificial Sequence
  Description of Artificial Sequence: Synthetic polypeptide
DDEEIRTTNPVATEQYGQCVCSWGEHNQEGFNSDQA

SEQ ID NO: 162739 - protein, 35 aa, Artificial Sequence
  Description of Artificial Sequence: Synthetic polypeptide
DEEEIRTTNPVATEQYGSVWDYNIADWSIDVLVKS

SEQ ID NO: 162740 - protein, 31 aa, Artificial Sequence
  Description of Artificial Sequence: Synthetic polypeptide
DENEIRTTNPVAFEQWGDVSEIEIMNAAEDA

SEQ ID NO: 162741 - protein, 35 aa, Artificial Sequence
  Description of Artificial Sequence: Synthetic polypeptide
DEEEIRATNPVATEQYGMVSIMDGEMQEGIGEQGS

SEQ ID NO: 162742 - protein, 37 aa, Artificial Sequence
  Description of Artificial Sequence: Synthetic polypeptide
DESCIRTTNPVATEQYGVTVPSYTNNETSQQTGSTRP

SEQ ID NO: 162743 - protein, 36 aa, Artificial Sequence
  Description of Artificial Sequence: Synthetic polypeptide
DESCIRTTNPVATEQYGVTVPSTYETSQQTGTSTRP

SEQ ID NO: 162744 - protein, 35 aa, Artificial Sequence
  Description of Artificial Sequence: Synthetic polypeptide
AEEEISTTNPVATEQYGCVCSNTEDQENFGSDTQS

SEQ ID NO: 162745 - protein, 36 aa, Artificial Sequence
  Description of Artificial Sequence: Synthetic polypeptide
DEEEIRTTNPVATEQYGSVDNPRLVLNPNNFVAEDQ

SEQ ID NO: 162746 - protein, 36 aa, Artificial Sequence
  Description of Artificial Sequence: Synthetic polypeptide
LENEIRTTNPVATEQYGSVCSVTWPLEDRMFVHEMD

SEQ ID NO: 162747 - protein, 32 aa, Artificial Sequence
  Description of Artificial Sequence: Synthetic polypeptide
YENEIRTVNPVSTEPYGTVSDEDIQQQSNGNH

SEQ ID NO: 162748 - protein, 35 aa, Artificial Sequence
  Description of Artificial Sequence: Synthetic polypeptide
AEEEISTTNPVATEQYGCVCSNWGEHQNFGSNTQS

SEQ ID NO: 162749 - protein, 35 aa, Artificial Sequence
  Description of Artificial Sequence: Synthetic polypeptide
DEECISTTNPVATEQYGCVCSTGEDNDENFGSDQS

SEQ ID NO: 162750 - protein, 36 aa, Artificial Sequence
  Description of Artificial Sequence: Synthetic polypeptide
DEGEIATTNPVATEQYGCVAATTGHNQTPSGDNNRQ

SEQ ID NO: 162751 - protein, 33 aa, Artificial Sequence
  Description of Artificial Sequence: Synthetic polypeptide
DEECLRTTNPCAYEQYGCVCSTEDQEYFGSDQS

SEQ ID NO: 162752 - protein, 32 aa, Artificial Sequence
  Description of Artificial Sequence: Synthetic polypeptide
DENEIRCTNPISTEQYGTISMEDIQQQQNGNH

SEQ ID NO: 162753 - protein, 37 aa, Artificial Sequence
  Description of Artificial Sequence: Synthetic polypeptide
FEEEIRTTNPVATEQYGSVSESTVGNMISRDTPVSEI

SEQ ID NO: 162754 - protein, 37 aa, Artificial Sequence
  Description of Artificial Sequence: Synthetic polypeptide
AEEEIRTTNPVATEQYGVVTVVVTNLQQQNEGEEEED

SEQ ID NO: 162755 - protein, 34 aa, Artificial Sequence
  Description of Artificial Sequence: Synthetic polypeptide
MEDEITTTNPVATEQYGNVSVTGGGQGDGGDGEF

SEQ ID NO: 162756 - protein, 38 aa, Artificial Sequence
  Description of Artificial Sequence: Synthetic polypeptide
DEEEIRTTNPVATEQYGSVVTVVVTQAGNNDEEEEEGT

SEQ ID NO: 162757 - protein, 38 aa, Artificial Sequence
  Description of Artificial Sequence: Synthetic polypeptide
DEEEIRTTNPVATEQYGSVVTVVVTQAGNNDTEENTGT

SEQ ID NO: 162758 - protein, 35 aa, Artificial Sequence
  Description of Artificial Sequence: Synthetic polypeptide
DEECISTTNPVATEQYGCVCSTGEHNQYFNSDNQS

SEQ ID NO: 162759 - protein, 38 aa, Artificial Sequence
  Description of Artificial Sequence: Synthetic polypeptide
DEEEIRTTNPVATEQYGSVVTVVVTQAGNNDTTEETNG

SEQ ID NO: 162760 - protein, 34 aa, Artificial Sequence
  Description of Artificial Sequence: Synthetic polypeptide
QEYEIGTTNPVATEQYGSVSVANAGMENGGQDEG

SEQ ID NO: 162761 - protein, 35 aa, Artificial Sequence
  Description of Artificial Sequence: Synthetic polypeptide
DEGEIATTNPVATEQYGCVAATTNLPATDPGGEAA

SEQ ID NO: 162762 - protein, 34 aa, Artificial Sequence
  Description of Artificial Sequence: Synthetic polypeptide
DEATIATTNPVAYEQWGTVCSTNDLHDINGQNHS

SEQ ID NO: 162763 - protein, 33 aa, Artificial Sequence
  Description of Artificial Sequence: Synthetic polypeptide
DEEVISTTNPDATEGYGSCSTPLGARYPQEYDG

SEQ ID NO: 162764 - protein, 34 aa, Artificial Sequence
  Description of Artificial Sequence: Synthetic polypeptide
MEDEIRTTNPVGTEQYGSVTDQNGQLGEGGQSGG

SEQ ID NO: 162765 - protein, 38 aa, Artificial Sequence
  Description of Artificial Sequence: Synthetic polypeptide
DEEEIRTTNPVATEQYGSVVTVVVTQAGNNGTTEENGT

SEQ ID NO: 162766 - protein, 33 aa, Artificial Sequence
  Description of Artificial Sequence: Synthetic polypeptide
DEQLIATTNPVATEQYGSMSATPDLEWHEAEDL

SEQ ID NO: 162767 - protein, 31 aa, Artificial Sequence
  Description of Artificial Sequence: Synthetic polypeptide
DDSEVASTNPVSTEQYGNVAANTIQSHVGQR

SEQ ID NO: 162768 - protein, 33 aa, Artificial Sequence
  Description of Artificial Sequence: Synthetic polypeptide
DEKEIRTTNPVSTEPYGTISMEDIQQQQNGNHS

SEQ ID NO: 162769 - protein, 36 aa, Artificial Sequence
  Description of Artificial Sequence: Synthetic polypeptide
DEEEIRTTNPVATEQYGSVDNPRIVLNQNNQVAEDE

SEQ ID NO: 162770 - protein, 35 aa, Artificial Sequence
  Description of Artificial Sequence: Synthetic polypeptide
DEEEIRTTNPVATEQYGSCNWPEEPLDADEKDIRG

SEQ ID NO: 162771 - protein, 38 aa, Artificial Sequence
  Description of Artificial Sequence: Synthetic polypeptide
DEEEIRTTNPVATEQYGSGCTIESNIPIGVNVIEAVRE

SEQ ID NO: 162772 - protein, 39 aa, Artificial Sequence
  Description of Artificial Sequence: Synthetic polypeptide
DEEEIRTTNPVATESYGTVNNLQSGTISTNTQNQEVGNR

SEQ ID NO: 162773 - protein, 34 aa, Artificial Sequence
  Description of Artificial Sequence: Synthetic polypeptide
DEECISTTNPVATEQYGCVCSWGEENTNFGSDQS

SEQ ID NO: 162774 - protein, 34 aa, Artificial Sequence
  Description of Artificial Sequence: Synthetic polypeptide
MEDEIRTTNPVATEFYGSVVDGLNGGNDTNGDEA

SEQ ID NO: 162775 - protein, 35 aa, Artificial Sequence
  Description of Artificial Sequence: Synthetic polypeptide
MEDEIRTTNPVSTEGYGSVGTGNNGQLGEGGQNGG

SEQ ID NO: 162776 - protein, 39 aa, Artificial Sequence
  Description of Artificial Sequence: Synthetic polypeptide
DEEEIRTTNPVATESYGTVATVQSVTISTNTQGQEVGNP

SEQ ID NO: 162777 - protein, 31 aa, Artificial Sequence
  Description of Artificial Sequence: Synthetic polypeptide
DDSEVASTNPVSTEQYGNVAANTEQSRVEQR

SEQ ID NO: 162778 - protein, 36 aa, Artificial Sequence
  Description of Artificial Sequence: Synthetic polypeptide
DEGEIATTNPVATEQYGCVAATTNSNATPDGDENRH

SEQ ID NO: 162779 - protein, 37 aa, Artificial Sequence
  Description of Artificial Sequence: Synthetic polypeptide
FEEEIRTTNPVATEQYGSVQQSTTSVPAQNVLSFVGE

SEQ ID NO: 162780 - protein, 35 aa, Artificial Sequence
  Description of Artificial Sequence: Synthetic polypeptide
DEAVIRTTNPVATEQYGCVINKTNPQYTFIIDNAP

SEQ ID NO: 162781 - protein, 32 aa, Artificial Sequence
  Description of Artificial Sequence: Synthetic polypeptide
DENEIRATNPVSTERYGTISMEDIQQQQNGNH

SEQ ID NO: 162782 - protein, 34 aa, Artificial Sequence
  Description of Artificial Sequence: Synthetic polypeptide
DEAEIRTTNPCAYEEWGSVAMTLNDHAGGRGNAK

SEQ ID NO: 162783 - protein, 37 aa, Artificial Sequence
  Description of Artificial Sequence: Synthetic polypeptide
FEEEIRTTNPVATEQYGSVQSEAPLVPHDNLAVEENG

SEQ ID NO: 162784 - protein, 37 aa, Artificial Sequence
  Description of Artificial Sequence: Synthetic polypeptide
FEEEIRTTNPVATEQYGSVQTAGVNDNNGQGEFNEVD

SEQ ID NO: 162785 - protein, 36 aa, Artificial Sequence
  Description of Artificial Sequence: Synthetic polypeptide
DEEEIRTTNPVATEQYGSGGYLMNGEEQMIMNAEEL

SEQ ID NO: 162786 - protein, 29 aa, Artificial Sequence
  Description of Artificial Sequence: Synthetic peptide
QESEIASTNPVGTEGYGVMWASDLQHGDI

SEQ ID NO: 162787 - protein, 35 aa, Artificial Sequence
  Description of Artificial Sequence: Synthetic polypeptide
FEEEIRTTNPVATEQYGSVQYLPHLEVAENIIQDI

SEQ ID NO: 162788 - protein, 30 aa, Artificial Sequence
  Description of Artificial Sequence: Synthetic polypeptide
QESEIASTNPVGTEGYGVMWASETLQHGDI

SEQ ID NO: 162789 - protein, 30 aa, Artificial Sequence
  Description of Artificial Sequence: Synthetic polypeptide
QESEIASTNPVGTEGYGVMWASTLGQHGDI

SEQ ID NO: 162790 - protein, 33 aa, Artificial Sequence
  Description of Artificial Sequence: Synthetic polypeptide
DENEIRTTNPVATEAWGKVPSEGESMNAAEGDI

SEQ ID NO: 162791 - protein, 32 aa, Artificial Sequence
  Description of Artificial Sequence: Synthetic polypeptide
DDSEVASTNPVSTEQYGNVAANDTIQSRVGQR

SEQ ID NO: 162792 - protein, 34 aa, Artificial Sequence
  Description of Artificial Sequence: Synthetic polypeptide
DEGEIATTNPVATEQYGCVAMGGTQPDNGMDTRM

SEQ ID NO: 162793 - protein, 34 aa, Artificial Sequence
  Description of Artificial Sequence: Synthetic polypeptide
DENEIRCTNPIATEQYGATWSNEEDWQERKGPYR

SEQ ID NO: 162794 - protein, 31 aa, Artificial Sequence
  Description of Artificial Sequence: Synthetic polypeptide
DENEIRTTNPVATEAWGDVSIEIEMNAAEDA

SEQ ID NO: 162795 - protein, 38 aa, Artificial Sequence
  Description of Artificial Sequence: Synthetic polypeptide
AEEEIRTTNPVATEQYGVVTTVVTTNLQQGNNNEENEL

SEQ ID NO: 162796 - protein, 37 aa, Artificial Sequence
  Description of Artificial Sequence: Synthetic polypeptide
DDEEIRTTNPVATEQYGSVGSTMDIQNGEGGGEGEGY

SEQ ID NO: 162797 - protein, 36 aa, Artificial Sequence
  Description of Artificial Sequence: Synthetic polypeptide
DEEEIRTTNPVATEQYGVVVNITGMGEGNDDENSED

SEQ ID NO: 162798 - protein, 36 aa, Artificial Sequence
  Description of Artificial Sequence: Synthetic polypeptide
DEEEIRTTNPVATEQYGVVVPDDDENEQNFGGGIGG

SEQ ID NO: 162799 - protein, 35 aa, Artificial Sequence
  Description of Artificial Sequence: Synthetic polypeptide
DENEIRTTNPVATDQYGVVMSDNNMSIREGMGGDT

SEQ ID NO: 162800 - protein, 29 aa, Artificial Sequence
  Description of Artificial Sequence: Synthetic peptide
QESEIASTNPVGTEGYGVQMASTLPHGDI

SEQ ID NO: 162801 - protein, 32 aa, Artificial Sequence
  Description of Artificial Sequence: Synthetic polypeptide
CEEVIACTNPVATEQWGCNVATNLATMNPEGV

SEQ ID NO: 162802 - protein, 34 aa, Artificial Sequence
  Description of Artificial Sequence: Synthetic polypeptide
DENEIRTTNPVATDQYGSVWPMPVWDENRSEQQE

SEQ ID NO: 162803 - protein, 33 aa, Artificial Sequence
  Description of Artificial Sequence: Synthetic polypeptide
CEEVIACTNPVATEQWGCNVATNLATMNPGEDR

SEQ ID NO: 162804 - protein, 39 aa, Artificial Sequence
  Description of Artificial Sequence: Synthetic polypeptide
DEEEIRTTNPVATESYGTVTNLQSGTIGTNLQNTEEGNE

SEQ ID NO: 162805 - protein, 37 aa, Artificial Sequence
  Description of Artificial Sequence: Synthetic polypeptide
AEEEIRTTNPVATEQYGVVSVVVVNNQQQGNNGNNQD

SEQ ID NO: 162806 - protein, 38 aa, Artificial Sequence
  Description of Artificial Sequence: Synthetic polypeptide
DEEEIRTTNPVATEQYGVVVTVVNTQAGNNDTEEEQGT

SEQ ID NO: 162807 - protein, 38 aa, Artificial Sequence
  Description of Artificial Sequence: Synthetic polypeptide
DEEEIRTTNPVATEQYGVVVVVTTNNNEQGGNNNENGN

SEQ ID NO: 162808 - protein, 34 aa, Artificial Sequence
  Description of Artificial Sequence: Synthetic polypeptide
DEATVIQTTNPVAYEQWGCVAACTNPSTRGGNER

SEQ ID NO: 162809 - protein, 36 aa, Artificial Sequence
  Description of Artificial Sequence: Synthetic polypeptide
QEVEIRTTNPVATEQYGSVTVTGDNDQTGEGEEGII

SEQ ID NO: 162810 - protein, 36 aa, Artificial Sequence
  Description of Artificial Sequence: Synthetic polypeptide
QEVEIRTTNPVATEQYGSVTTTGDNNQGEGEEGIIP

SEQ ID NO: 162811 - protein, 36 aa, Artificial Sequence
  Description of Artificial Sequence: Synthetic polypeptide
QEVEIRTTNPVATEQYGSVTTGVEDDQGEGEEGNIF

SEQ ID NO: 162812 - protein, 36 aa, Artificial Sequence
  Description of Artificial Sequence: Synthetic polypeptide
QEVEIRTTNPVATEQYGSVTTGDNDQDGEGEEGIIS

SEQ ID NO: 162813 - protein, 32 aa, Artificial Sequence
  Description of Artificial Sequence: Synthetic polypeptide
YENEIRTTNPVSTEPYGTISMEDIQQQQNGNH

SEQ ID NO: 162814 - protein, 37 aa, Artificial Sequence
  Description of Artificial Sequence: Synthetic polypeptide
DEEEIRTTNPVATEQYGSVVVDGFFGQENDQEEDGGS

SEQ ID NO: 162815 - protein, 34 aa, Artificial Sequence
  Description of Artificial Sequence: Synthetic polypeptide
MDTEIRTTNPVATEQYGSVFTTMYVESELGNEQI

SEQ ID NO: 162816 - protein, 34 aa, Artificial Sequence
  Description of Artificial Sequence: Synthetic polypeptide
MDPEIRTTNPVATEQYGSVTTYVDSIELGNEQSI

SEQ ID NO: 162817 - protein, 36 aa, Artificial Sequence
  Description of Artificial Sequence: Synthetic polypeptide
QEVEIRTTNPVATEQYGSVTTGDENDQGGGEEGIGP

SEQ ID NO: 162818 - protein, 35 aa, Artificial Sequence
  Description of Artificial Sequence: Synthetic polypeptide
AEEEISTTNPVATEQYGCVCSTELNAEYFNSDFQA

SEQ ID NO: 162819 - protein, 31 aa, Artificial Sequence
  Description of Artificial Sequence: Synthetic polypeptide
DENEIRTTNPVATDQWGDVTSEIEMNAAEDA

SEQ ID NO: 162820 - protein, 31 aa, Artificial Sequence
  Description of Artificial Sequence: Synthetic polypeptide
DENEIRTTNPVATDQWGDVSYEIEMNAAEDA

SEQ ID NO: 162821 - protein, 36 aa, Artificial Sequence
  Description of Artificial Sequence: Synthetic polypeptide
DESDIRTTNPVATQECWGSTVHSCINEPQDRKGENG

SEQ ID NO: 162822 - protein, 35 aa, Artificial Sequence
  Description of Artificial Sequence: Synthetic polypeptide
QEVEIRTTNPVATEQYGSVTTGDDDQNGEGEEGEI

SEQ ID NO: 162823 - protein, 36 aa, Artificial Sequence
  Description of Artificial Sequence: Synthetic polypeptide
DEEEIRTTNPVATEQYGSVDNPRIVQNPNNFVDEDE

SEQ ID NO: 162824 - protein, 31 aa, Artificial Sequence
  Description of Artificial Sequence: Synthetic polypeptide
DENEIRTTNPVATDQWGDVSKEIEMNAAEDA

SEQ ID NO: 162825 - protein, 37 aa, Artificial Sequence
  Description of Artificial Sequence: Synthetic polypeptide
FEEEIRTTNPVATEQYGSVSPADFMEQTQRDTGTEVV

SEQ ID NO: 162826 - protein, 37 aa, Artificial Sequence
  Description of Artificial Sequence: Synthetic polypeptide
FEEEIRTTNPVATEQYGSVSPAMSTQDTPVQTQNSDG

SEQ ID NO: 162827 - protein, 36 aa, Artificial Sequence
  Description of Artificial Sequence: Synthetic polypeptide
DDEEIRTTNPVATEQYGSVDTMDIQNGEGGDEEEGS

SEQ ID NO: 162828 - protein, 36 aa, Artificial Sequence
  Description of Artificial Sequence: Synthetic polypeptide
DEEEIRTTNPVATEQYGSCNYMTQPLDEPGMEHEIV

SEQ ID NO: 162829 - protein, 35 aa, Artificial Sequence
  Description of Artificial Sequence: Synthetic polypeptide
DEFCIATVNPVAYEAYGSVPSCDNEQSERGGNNRR

SEQ ID NO: 162830 - protein, 37 aa, Artificial Sequence
  Description of Artificial Sequence: Synthetic polypeptide
DEEEIRTTNPVATESYGSVVQDNPGDDQENEGQNEGT

SEQ ID NO: 162831 - protein, 32 aa, Artificial Sequence
  Description of Artificial Sequence: Synthetic polypeptide
DEKEISTTNPVSTEPYGTISMEDIQQQQNGNH

SEQ ID NO: 162832 - protein, 31 aa, Artificial Sequence
  Description of Artificial Sequence: Synthetic polypeptide
QESEIASTNPVGTEGYGVVASTEPQDHEGDI

SEQ ID NO: 162833 - protein, 37 aa, Artificial Sequence
  Description of Artificial Sequence: Synthetic polypeptide
FEEEIRTTNPVATEQYGSVSPPINLEVIEDNDVANLN

SEQ ID NO: 162834 - protein, 31 aa, Artificial Sequence
  Description of Artificial Sequence: Synthetic polypeptide
DDSEVASTNPVSTEQYGNVSAETEMSRVGQA

SEQ ID NO: 162835 - protein, 32 aa, Artificial Sequence
  Description of Artificial Sequence: Synthetic polypeptide
DDSEVASTNPVSTEQYGNVCSANTIQSRVGQD

SEQ ID NO: 162836 - protein, 32 aa, Artificial Sequence
  Description of Artificial Sequence: Synthetic polypeptide
YENEIRTTNPVSTEPYGTISMEDIQQENNGNH

SEQ ID NO: 162837 - protein, 36 aa, Artificial Sequence
  Description of Artificial Sequence: Synthetic polypeptide
QEVEIRTTNPVATEQYGSVVDDGTNDEGEGQGENQE

SEQ ID NO: 162838 - protein, 36 aa, Artificial Sequence
  Description of Artificial Sequence: Synthetic polypeptide
QEVEIRTTNPVATEQYGSVVGVDNQNGQEGNGGNEE

SEQ ID NO: 162839 - protein, 37 aa, Artificial Sequence
  Description of Artificial Sequence: Synthetic polypeptide
DEEEIRTTNPVATEQYGSVVVAVTPLIHIAEGASQQE

SEQ ID NO: 162840 - protein, 29 aa, Artificial Sequence
  Description of Artificial Sequence: Synthetic peptide
QESEIASTNPVGTEGYGVTASTWAEHGDI

SEQ ID NO: 162841 - protein, 30 aa, Artificial Sequence
  Description of Artificial Sequence: Synthetic polypeptide
QESEIASTNPVGTEGYGVTIASTLQHGGDD

SEQ ID NO: 162842 - protein, 32 aa, Artificial Sequence
  Description of Artificial Sequence: Synthetic polypeptide
DEKEIRTTNPVSTEPYGTISMEDIQQQQNGPH

SEQ ID NO: 162843 - protein, 34 aa, Artificial Sequence
  Description of Artificial Sequence: Synthetic polypeptide
DEQNEIATTNPVAYEQWGSVCSGENDQHDTNDHH

SEQ ID NO: 162844 - protein, 34 aa, Artificial Sequence
  Description of Artificial Sequence: Synthetic polypeptide
DEECISTTNPVATEQYGCVCSWGPHQENFGSDQS

SEQ ID NO: 162845 - protein, 36 aa, Artificial Sequence
  Description of Artificial Sequence: Synthetic polypeptide
MECYIRTTNPVATEQQYGSMVISTPVQQNRQVMNCQ

SEQ ID NO: 162846 - protein, 37 aa, Artificial Sequence
  Description of Artificial Sequence: Synthetic polypeptide
DEEEIRTTNPVATEQYGSVVVDGAFGQENDQEEDGTG

SEQ ID NO: 162847 - protein, 38 aa, Artificial Sequence
  Description of Artificial Sequence: Synthetic polypeptide
AEEEIRTTNPVATEQYGVVTVVVTTNLQQGNATEETEE

SEQ ID NO: 162848 - protein, 34 aa, Artificial Sequence
  Description of Artificial Sequence: Synthetic polypeptide
DENEIRTTNPVATDQYGSVNATQAEHPRQAVQDS

SEQ ID NO: 162849 - protein, 35 aa, Artificial Sequence
  Description of Artificial Sequence: Synthetic polypeptide
DENEIRTTNPVATDQYGSVNATMQAEEPRQAVNDA

SEQ ID NO: 162850 - protein, 35 aa, Artificial Sequence
  Description of Artificial Sequence: Synthetic polypeptide
DEEEIRTTNPVATEQYGSCNWPEIPLDSEEKDIRE

SEQ ID NO: 162851 - protein, 30 aa, Artificial Sequence
  Description of Artificial Sequence: Synthetic polypeptide
QESEIASTNPVGTEGYGVTMAQSTLQHGDI

SEQ ID NO: 162852 - protein, 29 aa, Artificial Sequence
  Description of Artificial Sequence: Synthetic peptide
QESEIASTNPVGTEGYGVTMASDLQPGDI

SEQ ID NO: 162853 - protein, 34 aa, Artificial Sequence
  Description of Artificial Sequence: Synthetic polypeptide
DENEIRTTNPVATDQYGSVNAMEAEHPQQAVNDA

SEQ ID NO: 162854 - protein, 32 aa, Artificial Sequence
  Description of Artificial Sequence: Synthetic polypeptide
DDSEVASTNPVSTEQYGNVAANTIQSRVGQAR

SEQ ID NO: 162855 - protein, 29 aa, Artificial Sequence
  Description of Artificial Sequence: Synthetic peptide
QESEIASTNPVGTEGYGVTMASTLAHGDI

SEQ ID NO: 162856 - protein, 30 aa, Artificial Sequence
  Description of Artificial Sequence: Synthetic polypeptide
QESEIASTNPVGTEGYGVTMASTLIQHGDI

SEQ ID NO: 162857 - protein, 34 aa, Artificial Sequence
  Description of Artificial Sequence: Synthetic polypeptide
DENEIRTTNPVATDQYGSVNAAQAEHPRQAVNDA

SEQ ID NO: 162858 - protein, 35 aa, Artificial Sequence
  Description of Artificial Sequence: Synthetic polypeptide
MEAEIRTTNPVATETWGSVSRCDNEPQVRDDENLG

SEQ ID NO: 162859 - protein, 35 aa, Artificial Sequence
  Description of Artificial Sequence: Synthetic polypeptide
AEEEISTTNPVATEQYGCVCSTGEHNQESFGSEQP

SEQ ID NO: 162860 - protein, 34 aa, Artificial Sequence
  Description of Artificial Sequence: Synthetic polypeptide
DEGEIATTNPVATEQYGCVAATNDATPSPMENAN

SEQ ID NO: 162861 - protein, 34 aa, Artificial Sequence
  Description of Artificial Sequence: Synthetic polypeptide
DENEIRTTNPVATDQYGSVCWTMDPQTTELDQQE

SEQ ID NO: 162862 - protein, 29 aa, Artificial Sequence
  Description of Artificial Sequence: Synthetic peptide
QESEIASTNPVGTEGYGVTMASTPQHGDI

SEQ ID NO: 162863 - protein, 32 aa, Artificial Sequence
  Description of Artificial Sequence: Synthetic polypeptide
YENEIRTTNPVSTEPYGTISHEDIQQQQNGNH

SEQ ID NO: 162864 - protein, 29 aa, Artificial Sequence
  Description of Artificial Sequence: Synthetic peptide
QESEIASTNPVGTEGYGVTTASTLAHGDI

SEQ ID NO: 162865 - protein, 34 aa, Artificial Sequence
  Description of Artificial Sequence: Synthetic polypeptide
QEVEIRTTNPVATEQYGVVVDGNGNNLDEGEDGQ

SEQ ID NO: 162866 - protein, 32 aa, Artificial Sequence
  Description of Artificial Sequence: Synthetic polypeptide
YENEIRTVNPVSTEPYGTISMEDLQQQSNGNH

SEQ ID NO: 162867 - protein, 32 aa, Artificial Sequence
  Description of Artificial Sequence: Synthetic polypeptide
SEDEIRTTNPVAYESWGSVCPEDGRGNGNNDP

SEQ ID NO: 162868 - protein, 36 aa, Artificial Sequence
  Description of Artificial Sequence: Synthetic polypeptide
LENEIRTTNPVATEQYGSCISVTWHDLQTGMEEQQI

SEQ ID NO: 162869 - protein, 29 aa, Artificial Sequence
  Description of Artificial Sequence: Synthetic peptide
QESVIASTNPVGTEGYGVMASTLQHGDFI

SEQ ID NO: 162870 - protein, 35 aa, Artificial Sequence
  Description of Artificial Sequence: Synthetic polypeptide
FEEEIRTTNPVATEQYGSVVAGVNDNIGQGEFTEI

SEQ ID NO: 162871 - protein, 36 aa, Artificial Sequence
  Description of Artificial Sequence: Synthetic polypeptide
DENEIRCTNPVATEQYGSVSCNDVDEEIFMLQDHPI

SEQ ID NO: 162872 - protein, 35 aa, Artificial Sequence
  Description of Artificial Sequence: Synthetic polypeptide
YEQEISTTNPVATEQYGSVNATGDGEDQEGEGDND

SEQ ID NO: 162873 - protein, 34 aa, Artificial Sequence
  Description of Artificial Sequence: Synthetic polypeptide
LEEEIATTNPVATEPWGISVCSYFPVSQMGGDNG

SEQ ID NO: 162874 - protein, 37 aa, Artificial Sequence
  Description of Artificial Sequence: Synthetic polypeptide
DEEEIRATNPVATEQYGVVSTVVNQQSATEEGSTEGQ

SEQ ID NO: 162875 - protein, 37 aa, Artificial Sequence
  Description of Artificial Sequence: Synthetic polypeptide
DEEEIRTTNPVATEQYGSVSDPSPAGPPMQNGMQDVV

SEQ ID NO: 162876 - protein, 36 aa, Artificial Sequence
  Description of Artificial Sequence: Synthetic polypeptide
FEEEIRTTNPVATEQYGSVVDGTVNGEEVETGGGQG

SEQ ID NO: 162877 - protein, 37 aa, Artificial Sequence
  Description of Artificial Sequence: Synthetic polypeptide
DEEEIRATNPVATEQYGVVSTVVNQQGSTEQGSTTDQ

SEQ ID NO: 162878 - protein, 36 aa, Artificial Sequence
  Description of Artificial Sequence: Synthetic polypeptide
FEEEIRTTNPVATEQYGSVVDGVNQNGQTGEFGDEG

SEQ ID NO: 162879 - protein, 36 aa, Artificial Sequence
  Description of Artificial Sequence: Synthetic polypeptide
FEEEIRTTNPVATEQYGSVVDLFENIQQNIGQTGGI

SEQ ID NO: 162880 - protein, 37 aa, Artificial Sequence
  Description of Artificial Sequence: Synthetic polypeptide
FEEEIRTTNPVATEQYGSVVDLFNNIQQNIGGNGQGI

SEQ ID NO: 162881 - protein, 31 aa, Artificial Sequence
  Description of Artificial Sequence: Synthetic polypeptide
DDSEVASTNPVSTEYYGNVAANTIQSRVGQR

SEQ ID NO: 162882 - protein, 34 aa, Artificial Sequence
  Description of Artificial Sequence: Synthetic polypeptide
DENEIRCTNPVATEQYGSVCSEPYAEITRVQDDV

SEQ ID NO: 162883 - protein, 37 aa, Artificial Sequence
  Description of Artificial Sequence: Synthetic polypeptide
DEEEIRATNPVATEQYGVVSTVVNQQGATEQGSTDTE

SEQ ID NO: 162884 - protein, 35 aa, Artificial Sequence
  Description of Artificial Sequence: Synthetic polypeptide
FEEEIRTTNPVATEQYGSVVEPAGQAAPSQDPGDE

SEQ ID NO: 162885 - protein, 37 aa, Artificial Sequence
  Description of Artificial Sequence: Synthetic polypeptide
FEEEIRTTNPVATEQYGSVVEPANTQQQDLQIGEGDG

SEQ ID NO: 162886 - protein, 37 aa, Artificial Sequence
  Description of Artificial Sequence: Synthetic polypeptide
FEEEIRTTNPVATEQYGSVVEPANVQAQQLQIGPGDI

SEQ ID NO: 162887 - protein, 37 aa, Artificial Sequence
  Description of Artificial Sequence: Synthetic polypeptide
DEEEIRATNPVATEQYGVVSTVVNQQEATEQGSTDQQ

SEQ ID NO: 162888 - protein, 37 aa, Artificial Sequence
  Description of Artificial Sequence: Synthetic polypeptide
FEEEIRTTNPVATEQYGSVVFGQVNGLEQEDNEGGQG

SEQ ID NO: 162889 - protein, 37 aa, Artificial Sequence
  Description of Artificial Sequence: Synthetic polypeptide
DEEEIATTNPVATEQYGSVCALAGNLEPTRDGMEDKV

SEQ ID NO: 162890 - protein, 33 aa, Artificial Sequence
  Description of Artificial Sequence: Synthetic polypeptide
DEGEIATTNPVATEQWGCVAGTGLVIMEMDMRP

SEQ ID NO: 162891 - protein, 31 aa, Artificial Sequence
  Description of Artificial Sequence: Synthetic polypeptide
DDSEVASTNPVSTEYYGNVCENTIQSRVGER

SEQ ID NO: 162892 - protein, 36 aa, Artificial Sequence
  Description of Artificial Sequence: Synthetic polypeptide
DDEEIRTTNPVATEQYGCVCSYTDNGTDEETFENQV

SEQ ID NO: 162893 - protein, 37 aa, Artificial Sequence
  Description of Artificial Sequence: Synthetic polypeptide
DEEEIATTNPVATEQYGSVCALANGLEPTRDGMESGV

SEQ ID NO: 162894 - protein, 35 aa, Artificial Sequence
  Description of Artificial Sequence: Synthetic polypeptide
DEAEIATTNPVATEQWGVVAPTDNQDDQRQTGGTE

SEQ ID NO: 162895 - protein, 35 aa, Artificial Sequence
  Description of Artificial Sequence: Synthetic polypeptide
DEAEIATTNPVATEQWGVVAPTDNQDMQRQGGGSE

SEQ ID NO: 162896 - protein, 36 aa, Artificial Sequence
  Description of Artificial Sequence: Synthetic polypeptide
FEEEIRTTNPVATEQYGSVVDTQQAEGQGNDEENGD

SEQ ID NO: 162897 - protein, 37 aa, Artificial Sequence
  Description of Artificial Sequence: Synthetic polypeptide
DEEEIRTTNPVATEQYGSVVVDGFGQENDQDEDDGTP

SEQ ID NO: 162898 - protein, 35 aa, Artificial Sequence
  Description of Artificial Sequence: Synthetic polypeptide
FEEEIRTTNPVATEQYGSVVAGVNDGNGQGEDTEI

SEQ ID NO: 162899 - protein, 36 aa, Artificial Sequence
  Description of Artificial Sequence: Synthetic polypeptide
FEEEIRTTNPVATEQYGSVVAGVNDENGQGEFNEIL

SEQ ID NO: 162900 - protein, 34 aa, Artificial Sequence
  Description of Artificial Sequence: Synthetic polypeptide
LEEEIRTTNPVATEQYGSVAPAEDGQDESQEDQG

SEQ ID NO: 162901 - protein, 31 aa, Artificial Sequence
  Description of Artificial Sequence: Synthetic polypeptide
DDSEVASTNPVSTEYYGNVAANTAQSRVGQR

SEQ ID NO: 162902 - protein, 36 aa, Artificial Sequence
  Description of Artificial Sequence: Synthetic polypeptide
AEEEIRTTNPVAYEQYGQCVCSWENDLNQHFGSQQS

SEQ ID NO: 162903 - protein, 34 aa, Artificial Sequence
  Description of Artificial Sequence: Synthetic polypeptide
AEEEIRTTNPVAYEQYGQCVCSSGEHQNFNSDQA

SEQ ID NO: 162904 - protein, 33 aa, Artificial Sequence
  Description of Artificial Sequence: Synthetic polypeptide
DEAVIRTTNPVATEQYGCFINTNHPETFINNAP

SEQ ID NO: 162905 - protein, 33 aa, Artificial Sequence
  Description of Artificial Sequence: Synthetic polypeptide
DEMAIRTTNPVATEQYGCFCSTGEHINFGSDQA

SEQ ID NO: 162906 - protein, 35 aa, Artificial Sequence
  Description of Artificial Sequence: Synthetic polypeptide
DEFELCTVNPVATEQYGSVSWTENDQHNQKGGGDS

SEQ ID NO: 162907 - protein, 35 aa, Artificial Sequence
  Description of Artificial Sequence: Synthetic polypeptide
FEEEIRTTNPVATEQYGSVTCPLISVEVSGEEQAQ

SEQ ID NO: 162908 - protein, 32 aa, Artificial Sequence
  Description of Artificial Sequence: Synthetic polypeptide
DENEIRTTNPISTEPYGTISMEDIQQQQNGNH

SEQ ID NO: 162909 - protein, 33 aa, Artificial Sequence
  Description of Artificial Sequence: Synthetic polypeptide
DEEEIRATNPVAYEQWGMVTGENDHQAGQGGDL

SEQ ID NO: 162910 - protein, 38 aa, Artificial Sequence
  Description of Artificial Sequence: Synthetic polypeptide
FEEEIRTTNPVATEQYGSVTDLNSGGLEQQGEQGDNED

SEQ ID NO: 162911 - protein, 36 aa, Artificial Sequence
  Description of Artificial Sequence: Synthetic polypeptide
DEEEIRTTNPVATEQYGSVVVDGFGQENDGEEDQAG

SEQ ID NO: 162912 - protein, 35 aa, Artificial Sequence
  Description of Artificial Sequence: Synthetic polypeptide
FEEEIRTTNPVATEQYGSVVAGVNDENGQGEFTEN

SEQ ID NO: 162913 - protein, 37 aa, Artificial Sequence
  Description of Artificial Sequence: Synthetic polypeptide
DEEEIRTTNPVATEQYGSVVVDGFGQENDQDEDDGTM

SEQ ID NO: 162914 - protein, 32 aa, Artificial Sequence
  Description of Artificial Sequence: Synthetic polypeptide
DENEIRTTNPISTEPYGATISAEDWQQQNGNI

SEQ ID NO: 162915 - protein, 35 aa, Artificial Sequence
  Description of Artificial Sequence: Synthetic polypeptide
DEFELCTVNPVATEQYGTVSWTENDQHTQKGGNDH

SEQ ID NO: 162916 - protein, 32 aa, Artificial Sequence
  Description of Artificial Sequence: Synthetic polypeptide
DEGEIATTNPVATEQWGCVSEGVEMNAAEDGA

SEQ ID NO: 162917 - protein, 36 aa, Artificial Sequence
  Description of Artificial Sequence: Synthetic polypeptide
DEEEIRTTNPVATEQYGSVVYDGVGQEGDQEEDEGM

SEQ ID NO: 162918 - protein, 33 aa, Artificial Sequence
  Description of Artificial Sequence: Synthetic polypeptide
DEECISTVNPVATEGYGCVCSWNHENFGSQNQS

SEQ ID NO: 162919 - protein, 36 aa, Artificial Sequence
  Description of Artificial Sequence: Synthetic polypeptide
DEEEIRATNPVAYEEWGCSVSCTNTGFSQSGNGNSA

SEQ ID NO: 162920 - protein, 33 aa, Artificial Sequence
  Description of Artificial Sequence: Synthetic polypeptide
DEECISTVNPVATEGYGCVCSWNHEENFGSNQS

SEQ ID NO: 162921 - protein, 32 aa, Artificial Sequence
  Description of Artificial Sequence: Synthetic polypeptide
DESAIRTTNPVAYEQWGYVRHIEDNQRTGGQI

SEQ ID NO: 162922 - protein, 36 aa, Artificial Sequence
  Description of Artificial Sequence: Synthetic polypeptide
FEEEIRTTNPVATEQYGSVTSPPNMEQQEIPQFEQE

SEQ ID NO: 162923 - protein, 32 aa, Artificial Sequence
  Description of Artificial Sequence: Synthetic polypeptide
DEFETCTVNPVATEQYGTVSWNEDDFEGGDGH

SEQ ID NO: 162924 - protein, 33 aa, Artificial Sequence
  Description of Artificial Sequence: Synthetic polypeptide
DEECISTVNPVATEGYGCVCSWGNTENFGSNQS

SEQ ID NO: 162925 - protein, 35 aa, Artificial Sequence
  Description of Artificial Sequence: Synthetic polypeptide
DESAIRTTNPVAYEQWGCYSIETNMDQRDQGGSRN

SEQ ID NO: 162926 - protein, 32 aa, Artificial Sequence
  Description of Artificial Sequence: Synthetic polypeptide
DEECISTVNPVATEGYGCVCSWNHESFGSDQS

SEQ ID NO: 162927 - protein, 32 aa, Artificial Sequence
  Description of Artificial Sequence: Synthetic polypeptide
DENEIRTTNPIATEQWGDVWSEEDWMNAAGDA

SEQ ID NO: 162928 - protein, 34 aa, Artificial Sequence
  Description of Artificial Sequence: Synthetic polypeptide
DEMAIRTTNPVATEQYGCFCSNTNHNINFGSQQA

SEQ ID NO: 162929 - protein, 37 aa, Artificial Sequence
  Description of Artificial Sequence: Synthetic polypeptide
FEEEIRTTNPVATEQYGSVVGTPGVNEGQQVEGQSGD

SEQ ID NO: 162930 - protein, 37 aa, Artificial Sequence
  Description of Artificial Sequence: Synthetic polypeptide
FEEEIRTTNPVATEQYGSVVSDVNGFGQENDQGEGGG

SEQ ID NO: 162931 - protein, 32 aa, Artificial Sequence
  Description of Artificial Sequence: Synthetic polypeptide
QESEIASTNPVGTEQYGSMAATTLQDHEGDDL

SEQ ID NO: 162932 - protein, 36 aa, Artificial Sequence
  Description of Artificial Sequence: Synthetic polypeptide
FEEEIRTTNPVATEQYGSVVSPLVPLEDGQLPVISN

SEQ ID NO: 162933 - protein, 32 aa, Artificial Sequence
  Description of Artificial Sequence: Synthetic polypeptide
QESEIASTNPVGTEQYGSMAATTLQDHEGEDL

SEQ ID NO: 162934 - protein, 37 aa, Artificial Sequence
  Description of Artificial Sequence: Synthetic polypeptide
FEEEIRTTNPVATEQYGSVVSTAVDGFGQENQGEGQG

SEQ ID NO: 162935 - protein, 38 aa, Artificial Sequence
  Description of Artificial Sequence: Synthetic polypeptide
FEEEIRTTNPVATEQYGSVVSTMGVNEGQNVEGQSGDQ

SEQ ID NO: 162936 - protein, 36 aa, Artificial Sequence
  Description of Artificial Sequence: Synthetic polypeptide
DEEEIRTTNPVATEQYGSVDQPIIGLQPVMMEAEEN

SEQ ID NO: 162937 - protein, 36 aa, Artificial Sequence
  Description of Artificial Sequence: Synthetic polypeptide
DEEEIRTTNPVATEQYGSVDQPIKGLEPQMMEQEEN

SEQ ID NO: 162938 - protein, 34 aa, Artificial Sequence
  Description of Artificial Sequence: Synthetic polypeptide
DESAEIATTNPVAYEQWGSVCSGENDQHDTNDHP

SEQ ID NO: 162939 - protein, 37 aa, Artificial Sequence
  Description of Artificial Sequence: Synthetic polypeptide
FEEEIRTTNPVATEQYGSVVTFGVNDNNGQGEFNEII

SEQ ID NO: 162940 - protein, 37 aa, Artificial Sequence
  Description of Artificial Sequence: Synthetic polypeptide
FEEEIRTTNPVATEQYGSVVTGTVNGLEEEANGGGQG

SEQ ID NO: 162941 - protein, 37 aa, Artificial Sequence
  Description of Artificial Sequence: Synthetic polypeptide
FEEEIRTTNPVATEQYGSVVTSAVNGFGQENIGEGQG

SEQ ID NO: 162942 - protein, 32 aa, Artificial Sequence
  Description of Artificial Sequence: Synthetic polypeptide
QESEIASTNPVGTEQYGSMAATDLQDHEGEDL

SEQ ID NO: 162943 - protein, 39 aa, Artificial Sequence
  Description of Artificial Sequence: Synthetic polypeptide
DEEEIRTTNPVATESYGAVTNLQSGTISTNTQNQEAGNR

SEQ ID NO: 162944 - protein, 36 aa, Artificial Sequence
  Description of Artificial Sequence: Synthetic polypeptide
FEEEIRTTNPVATEQYGSVVVGVNDNNGQGEFNEIP

SEQ ID NO: 162945 - protein, 36 aa, Artificial Sequence
  Description of Artificial Sequence: Synthetic polypeptide
FEEEIRTTNPVATEQYGSVVVGVNQNTGNQGEFGEG

SEQ ID NO: 162946 - protein, 34 aa, Artificial Sequence
  Description of Artificial Sequence: Synthetic polypeptide
QESEIRTTNPVATECWGSVLSCINEPQDREFEGG

SEQ ID NO: 162947 - protein, 34 aa, Artificial Sequence
  Description of Artificial Sequence: Synthetic polypeptide
KEQEIATTNPVATEQYGSVTATPDLEDHFGEDLN

SEQ ID NO: 162948 - protein, 36 aa, Artificial Sequence
  Description of Artificial Sequence: Synthetic polypeptide
DDEEIRTTNPVATEQYGCVCSWEEDHQEHFGSENQA

SEQ ID NO: 162949 - protein, 35 aa, Artificial Sequence
  Description of Artificial Sequence: Synthetic polypeptide
DDEEIRTTNPVATEQYGCVCSWEEDHNQHFNSEQA

SEQ ID NO: 162950 - protein, 32 aa, Artificial Sequence
  Description of Artificial Sequence: Synthetic polypeptide
DENEIRCTNPVSTEPYGTISEEDIQMQQNGNH

SEQ ID NO: 162951 - protein, 34 aa, Artificial Sequence
  Description of Artificial Sequence: Synthetic polypeptide
KEQCIATTNPVAYECYGSVAATENELSQSNGGNM

SEQ ID NO: 162952 - protein, 34 aa, Artificial Sequence
  Description of Artificial Sequence: Synthetic polypeptide
DEFVIQTTNPVAYEQWGCTVAACTNPSQRGGVER

SEQ ID NO: 162953 - protein, 36 aa, Artificial Sequence
  Description of Artificial Sequence: Synthetic polypeptide
FEEEIRTTNPVATEQYGSVYGVMNVGQFEEGEDEQD

SEQ ID NO: 162954 - protein, 36 aa, Artificial Sequence
  Description of Artificial Sequence: Synthetic polypeptide
FEEEIRTTNPVATEQYGSVYLPHELEEVRENIIQDI

SEQ ID NO: 162955 - protein, 36 aa, Artificial Sequence
  Description of Artificial Sequence: Synthetic polypeptide
DEEEIRTTNPVATEQYGSVDQPINYLMPEMMEAEEN

SEQ ID NO: 162956 - protein, 38 aa, Artificial Sequence
  Description of Artificial Sequence: Synthetic polypeptide
FEEEIRTTNPVATEQYGSVVVAGVNDNLNGQGEFNEIR

SEQ ID NO: 162957 - protein, 30 aa, Artificial Sequence
  Description of Artificial Sequence: Synthetic polypeptide
QEGEIACTNPCSSEQYGKVSCNLQSPQTKH

SEQ ID NO: 162958 - protein, 37 aa, Artificial Sequence
  Description of Artificial Sequence: Synthetic polypeptide
FEEEIRTTNPVATEQYGSVVQITNNFDDNNEEGNGDT

SEQ ID NO: 162959 - protein, 32 aa, Artificial Sequence
  Description of Artificial Sequence: Synthetic polypeptide
DENEIRTTNPIATEQWGDTVSNEDEANAAGDA

SEQ ID NO: 162960 - protein, 32 aa, Artificial Sequence
  Description of Artificial Sequence: Synthetic polypeptide
DENEIRTTNPIATEQWGDVWSEEDWMEAAGDA

SEQ ID NO: 162961 - protein, 36 aa, Artificial Sequence
  Description of Artificial Sequence: Synthetic polypeptide
FEEEIRTTNPVATEQYGSVVITLGMGGNGDTNNFDD

SEQ ID NO: 162962 - protein, 34 aa, Artificial Sequence
  Description of Artificial Sequence: Synthetic polypeptide
DENEIRCTNPVATEQYGSVTWTEVMEERIDDTIE

SEQ ID NO: 162963 - protein, 35 aa, Artificial Sequence
  Description of Artificial Sequence: Synthetic polypeptide
FEEEIRTTNPVATEQYGSVVLDGFGQENDQENDGG

SEQ ID NO: 162964 - protein, 36 aa, Artificial Sequence
  Description of Artificial Sequence: Synthetic polypeptide
FEEEIRTTNPVATEQYGSVVLGIMTGGGQTVTGEGG

SEQ ID NO: 162965 - protein, 36 aa, Artificial Sequence
  Description of Artificial Sequence: Synthetic polypeptide
FEEEIRTTNPVATEQYGSVVLNGSDQEFGEGGEGGQ

SEQ ID NO: 162966 - protein, 37 aa, Artificial Sequence
  Description of Artificial Sequence: Synthetic polypeptide
DEEEIRATNPVATEQYGVVSTVNDQQGTTEQGSTQDD

SEQ ID NO: 162967 - protein, 36 aa, Artificial Sequence
  Description of Artificial Sequence: Synthetic polypeptide
FEEEIRTTNPVATEQYGSVVMNDQDGQEQGGQGEGQ

SEQ ID NO: 162968 - protein, 35 aa, Artificial Sequence
  Description of Artificial Sequence: Synthetic polypeptide
FEEEIRTTNPVATEQYGSVVMNGFNGGGFDDLTIV

SEQ ID NO: 162969 - protein, 28 aa, Artificial Sequence
  Description of Artificial Sequence: Synthetic peptide
QESEIASTNPVGTEQWGVMASILQHEDI

SEQ ID NO: 162970 - protein, 29 aa, Artificial Sequence
  Description of Artificial Sequence: Synthetic peptide
QESEIASTNPVGTEQWGVMASTLMNAGDI

SEQ ID NO: 162971 - protein, 35 aa, Artificial Sequence
  Description of Artificial Sequence: Synthetic polypeptide
FEEEIRTTNPVATEQYGSVVMNGFNGGGFDQDTVP

SEQ ID NO: 162972 - protein, 37 aa, Artificial Sequence
  Description of Artificial Sequence: Synthetic polypeptide
DEEEIRTTNPVATEQYGSVVVDGFGQENDQDEDGDTG

SEQ ID NO: 162973 - protein, 35 aa, Artificial Sequence
  Description of Artificial Sequence: Synthetic polypeptide
DDEEIRTTNPVATEQYGCVCSWGEHNENFGSETQS

SEQ ID NO: 162974 - protein, 36 aa, Artificial Sequence
  Description of Artificial Sequence: Synthetic polypeptide
DDEEIRTTNPVATEQYGCVCSWGEHNEENFGSDNQS

SEQ ID NO: 162975 - protein, 36 aa, Artificial Sequence
  Description of Artificial Sequence: Synthetic polypeptide
FEEEIRTTNPVATEQYGSVVNFDDNIDQQGGGGETA

SEQ ID NO: 162976 - protein, 36 aa, Artificial Sequence
  Description of Artificial Sequence: Synthetic polypeptide
DEEEIATTNPVATEQYGSVCAMNNGVLTEDDLEDNQ

SEQ ID NO: 162977 - protein, 36 aa, Artificial Sequence
  Description of Artificial Sequence: Synthetic polypeptide
DEEEIRTTNPVATEGYGVVDNFTANNGQEEGQGQET

SEQ ID NO: 162978 - protein, 36 aa, Artificial Sequence
  Description of Artificial Sequence: Synthetic polypeptide
FEEEIRTTNPVATEQYGSVVNGVNQNGQTGDEFGEG

SEQ ID NO: 162979 - protein, 32 aa, Artificial Sequence
  Description of Artificial Sequence: Synthetic polypeptide
DEGEIATTNPVATEQWGCVAGEGEMNNHSDNA

SEQ ID NO: 162980 - protein, 37 aa, Artificial Sequence
  Description of Artificial Sequence: Synthetic polypeptide
FEEEIRTTNPVATEQYGSVVNMQNTQDQNEEGDENGD

SEQ ID NO: 162981 - protein, 35 aa, Artificial Sequence
  Description of Artificial Sequence: Synthetic polypeptide
DEEEIRTTNPVATEGYGVVDIGGNGGETGGENGGG

SEQ ID NO: 162982 - protein, 34 aa, Artificial Sequence
  Description of Artificial Sequence: Synthetic polypeptide
DEAVIRTTNPVATEQYGCAINTWNPQETFINNAP

SEQ ID NO: 162983 - protein, 33 aa, Artificial Sequence
  Description of Artificial Sequence: Synthetic polypeptide
DEECISTVNPVATEGYGCVCSWELEEHFGSNQS

SEQ ID NO: 162984 - protein, 36 aa, Artificial Sequence
  Description of Artificial Sequence: Synthetic polypeptide
FEEEIRTTNPVATEQYGSVVPTEDTASPEVSQVGMQ

SEQ ID NO: 162985 - protein, 36 aa, Artificial Sequence
  Description of Artificial Sequence: Synthetic polypeptide
DDEEIRTTNPVATEQYGCVCSWGEHDQENFGSENQP

SEQ ID NO: 162986 - protein, 36 aa, Artificial Sequence
  Description of Artificial Sequence: Synthetic polypeptide
DEEEIRTTNPVATESYGDVMTGMGNGGEGQTEFGEF

SEQ ID NO: 162987 - protein, 34 aa, Artificial Sequence
  Description of Artificial Sequence: Synthetic polypeptide
DEEEIRATNPVAYEQWGMVTGWNDHQGGQGNSGL

SEQ ID NO: 162988 - protein, 28 aa, Artificial Sequence
  Description of Artificial Sequence: Synthetic peptide
QESVIASTNPVGTEGYGVMASTWQHGDI

SEQ ID NO: 162989 - protein, 34 aa, Artificial Sequence
  Description of Artificial Sequence: Synthetic polypeptide
DEAVIRTTNPVATEQYGCVCENTGEPQYFGSDQA

SEQ ID NO: 162990 - protein, 31 aa, Artificial Sequence
  Description of Artificial Sequence: Synthetic polypeptide
DDSEVASTNPVSTEWYGVVAANTIQSRVGQR

SEQ ID NO: 162991 - protein, 30 aa, Artificial Sequence
  Description of Artificial Sequence: Synthetic polypeptide
QESEVASTNPVGTEGYGNVAANTIQHVGQR

SEQ ID NO: 162992 - protein, 30 aa, Artificial Sequence
  Description of Artificial Sequence: Synthetic polypeptide
QESEIVTTNPVATEGYGVMCAASGLEHGDI

SEQ ID NO: 162993 - protein, 36 aa, Artificial Sequence
  Description of Artificial Sequence: Synthetic polypeptide
DEEEIRTTNPVATEQYGSCSLVANQDQVVDISQVSG

SEQ ID NO: 162994 - protein, 34 aa, Artificial Sequence
  Description of Artificial Sequence: Synthetic polypeptide
DEFEIRTTNPVAFEQWGSCVSEIQETMNGMEEMA

SEQ ID NO: 162995 - protein, 31 aa, Artificial Sequence
  Description of Artificial Sequence: Synthetic polypeptide
DEEEIRCTNPIATECWGATVWAENWAEPGPI

SEQ ID NO: 162996 - protein, 34 aa, Artificial Sequence
  Description of Artificial Sequence: Synthetic polypeptide
DEFEIRTTNPVAFEQWGSDVSEIEETMNGMEEAI

SEQ ID NO: 162997 - protein, 31 aa, Artificial Sequence
  Description of Artificial Sequence: Synthetic polypeptide
DDSEVASTNPVSTERYGNVAANTIQPRVGQR

SEQ ID NO: 162998 - protein, 35 aa, Artificial Sequence
  Description of Artificial Sequence: Synthetic polypeptide
DEFEIRTTNPVAFEQWGSDVSEIQETFNGMEEGAN

SEQ ID NO: 162999 - protein, 34 aa, Artificial Sequence
  Description of Artificial Sequence: Synthetic polypeptide
AEEEISTTNPVATEEYGCSCSSGELNQNFGSDQS

SEQ ID NO: 163000 - protein, 34 aa, Artificial Sequence
  Description of Artificial Sequence: Synthetic polypeptide
DEFEIRTTNPVAFEQWGSDVSEIQETMNGMIEAT

SEQ ID NO: 163001 - protein, 34 aa, Artificial Sequence
  Description of Artificial Sequence: Synthetic polypeptide
LEGEIATTNPVATEQYGSVFSATDTVEPHEGEDT

SEQ ID NO: 163002 - protein, 34 aa, Artificial Sequence
  Description of Artificial Sequence: Synthetic polypeptide
DEGEIATTNPVATEQWGSVSAGPPGANGAGMGED

SEQ ID NO: 163003 - protein, 36 aa, Artificial Sequence
  Description of Artificial Sequence: Synthetic polypeptide
AEEEIRTTNPVATEQYGVVVTVNTNDESGTVNNNTN

SEQ ID NO: 163004 - protein, 35 aa, Artificial Sequence
  Description of Artificial Sequence: Synthetic polypeptide
DEEEIRTTNPVATEGYGQCVCSSGEHNQNFGSEQS

SEQ ID NO: 163005 - protein, 31 aa, Artificial Sequence
  Description of Artificial Sequence: Synthetic polypeptide
DDSEVASTNPVSTERYGNVAANTIQSRVGQR

SEQ ID NO: 163006 - protein, 37 aa, Artificial Sequence
  Description of Artificial Sequence: Synthetic polypeptide
DDEEIRTTNPVATEQYGNVIMGNLNTGGNGQTGNNGN

SEQ ID NO: 163007 - protein, 31 aa, Artificial Sequence
  Description of Artificial Sequence: Synthetic polypeptide
DDSEVASTNPVSTESYGNVAANTILSRVGQR

SEQ ID NO: 163008 - protein, 34 aa, Artificial Sequence
  Description of Artificial Sequence: Synthetic polypeptide
DEFEIRTTNPVATEQWGSDVIEYIQETMNGMEEA

SEQ ID NO: 163009 - protein, 34 aa, Artificial Sequence
  Description of Artificial Sequence: Synthetic polypeptide
DEFEIRTTNPVATEQWGSDVQSWIQEMNGMEEVA

SEQ ID NO: 163010 - protein, 31 aa, Artificial Sequence
  Description of Artificial Sequence: Synthetic polypeptide
DDSEVASTNPVSTESYGNVAANTIQSRVGIR

SEQ ID NO: 163011 - protein, 31 aa, Artificial Sequence
  Description of Artificial Sequence: Synthetic polypeptide
DDSEVASTNPVSTESYGNVAANTIQSRVGQR

SEQ ID NO: 163012 - protein, 34 aa, Artificial Sequence
  Description of Artificial Sequence: Synthetic polypeptide
DEFEIRTTNPVATEQWGSDVSEIQEMNGMEEAAG

SEQ ID NO: 163013 - protein, 39 aa, Artificial Sequence
  Description of Artificial Sequence: Synthetic polypeptide
DEEEIRTTNPVATEQYGVVSTVNNDQSGNNNLQGNVEDT

SEQ ID NO: 163014 - protein, 35 aa, Artificial Sequence
  Description of Artificial Sequence: Synthetic polypeptide
DEAVIRTTNPVATEQYGCVCETENPNQEYFGSEQA

SEQ ID NO: 163015 - protein, 37 aa, Artificial Sequence
  Description of Artificial Sequence: Synthetic polypeptide
AEEEIRTTNPVATEQYGVVVTVNTTNLQSGTVDTGTD

SEQ ID NO: 163016 - protein, 31 aa, Artificial Sequence
  Description of Artificial Sequence: Synthetic polypeptide
DDSEVASTNPVSTEVYGNVAANTFQSRVGQR

SEQ ID NO: 163017 - protein, 34 aa, Artificial Sequence
  Description of Artificial Sequence: Synthetic polypeptide
DEFEIRTTNPVAFEQWGSNVYESINETMNGMEEA

SEQ ID NO: 163018 - protein, 36 aa, Artificial Sequence
  Description of Artificial Sequence: Synthetic polypeptide
DDEEIRTTNPVATEQYGNVIMGNLNGGNGQTNNGGN

SEQ ID NO: 163019 - protein, 30 aa, Artificial Sequence
  Description of Artificial Sequence: Synthetic polypeptide
QESEVASTNPVGTEGYGVVASTIQSHVGDR

SEQ ID NO: 163020 - protein, 37 aa, Artificial Sequence
  Description of Artificial Sequence: Synthetic polypeptide
DEEEIRTTNPVATESYGSVMGQNVGNLDIFEGTNGDT

SEQ ID NO: 163021 - protein, 29 aa, Artificial Sequence
  Description of Artificial Sequence: Synthetic peptide
QESVIASTNPVGTEGYGVMASSTLQHGDI

SEQ ID NO: 163022 - protein, 36 aa, Artificial Sequence
  Description of Artificial Sequence: Synthetic polypeptide
DEEEIATTNPVATEQYGSVCAMNNNDLPADGSGDFP

SEQ ID NO: 163023 - protein, 28 aa, Artificial Sequence
  Description of Artificial Sequence: Synthetic peptide
QESPIASTNPVGTEGWGVMASTLQHGDI

SEQ ID NO: 163024 - protein, 30 aa, Artificial Sequence
  Description of Artificial Sequence: Synthetic polypeptide
QESNIASTNPVGTEGYGCVMASTLQHGDIP

SEQ ID NO: 163025 - protein, 28 aa, Artificial Sequence
  Description of Artificial Sequence: Synthetic peptide
QESGIASTNPVGTEGYGVMAVTLQHGDI

SEQ ID NO: 163026 - protein, 35 aa, Artificial Sequence
  Description of Artificial Sequence: Synthetic polypeptide
DEGEIATTNPVATEQWGSVSGTGNPDNSEHGTDHA

SEQ ID NO: 163027 - protein, 30 aa, Artificial Sequence
  Description of Artificial Sequence: Synthetic polypeptide
QESEVATTNPVATEQYGNAAAEVCQSHEER

SEQ ID NO: 163028 - protein, 30 aa, Artificial Sequence
  Description of Artificial Sequence: Synthetic polypeptide
QESEVATTNPVATEQYGEAAAEVCQSHEER

SEQ ID NO: 163029 - protein, 37 aa, Artificial Sequence
  Description of Artificial Sequence: Synthetic polypeptide
DEEEIRTTNPVATESYGSVMTNGIGGQGDVTTDNIND

SEQ ID NO: 163030 - protein, 33 aa, Artificial Sequence
  Description of Artificial Sequence: Synthetic polypeptide
DENEIRCTNPVATEQYGCSSAWAYLTDIQENEQ

SEQ ID NO: 163031 - protein, 29 aa, Artificial Sequence
  Description of Artificial Sequence: Synthetic peptide
QESEVASTNPVSTEQYGNVPNVIQSREQK

SEQ ID NO: 163032 - protein, 30 aa, Artificial Sequence
  Description of Artificial Sequence: Synthetic polypeptide
QESEVASTNPVSTEQYGNVANTCQSRVGQK

SEQ ID NO: 163033 - protein, 30 aa, Artificial Sequence
  Description of Artificial Sequence: Synthetic polypeptide
QESEVASTNPVSTEGYGNVAANTIQSRGQI

SEQ ID NO: 163034 - protein, 30 aa, Artificial Sequence
  Description of Artificial Sequence: Synthetic polypeptide
QESEIASTNPVGTEHYGVMASTLSQHGGDI

SEQ ID NO: 163035 - protein, 29 aa, Artificial Sequence
  Description of Artificial Sequence: Synthetic peptide
QESEVASTNPVSTEQYGNAAETIQHVGQR

SEQ ID NO: 163036 - protein, 30 aa, Artificial Sequence
  Description of Artificial Sequence: Synthetic polypeptide
QESEVASTNPVSTEGYGVVASTIQSHVGQR

SEQ ID NO: 163037 - protein, 30 aa, Artificial Sequence
  Description of Artificial Sequence: Synthetic polypeptide
QESEVASTNPVSTEGYGVVASTIQSHVGDR

SEQ ID NO: 163038 - protein, 29 aa, Artificial Sequence
  Description of Artificial Sequence: Synthetic peptide
QESEVASTNPVSTEGYGVMAASTLQHGDI

SEQ ID NO: 163039 - protein, 30 aa, Artificial Sequence
  Description of Artificial Sequence: Synthetic polypeptide
QESEVASTNPVSTEGYGNVASTIQSRVGQI

SEQ ID NO: 163040 - protein, 30 aa, Artificial Sequence
  Description of Artificial Sequence: Synthetic polypeptide
QESEVASTNPVSTEGYGNVASTIQSHVGQR

SEQ ID NO: 163041 - protein, 28 aa, Artificial Sequence
  Description of Artificial Sequence: Synthetic peptide
QESEIASTNPVGTEIYGVMASTEMHGDI

SEQ ID NO: 163042 - protein, 29 aa, Artificial Sequence
  Description of Artificial Sequence: Synthetic peptide
QESEVASTNPVSTEGYGNVANTLQSREQL

SEQ ID NO: 163043 - protein, 35 aa, Artificial Sequence
  Description of Artificial Sequence: Synthetic polypeptide
DESCIRTTNPVATEQYGSVFVWIQGEQDRKKSGDH

SEQ ID NO: 163044 - protein, 29 aa, Artificial Sequence
  Description of Artificial Sequence: Synthetic peptide
QESEVASTNPVSTEGYGNVAASTIQHGQI

SEQ ID NO: 163045 - protein, 34 aa, Artificial Sequence
  Description of Artificial Sequence: Synthetic polypeptide
DEFEICTVNPVAYEKYGKVSCTNELSTAFVGNNL

SEQ ID NO: 163046 - protein, 36 aa, Artificial Sequence
  Description of Artificial Sequence: Synthetic polypeptide
DESCIRTTNPVATEQYGSVFVWINGEQDRKKNMGDH

SEQ ID NO: 163047 - protein, 35 aa, Artificial Sequence
  Description of Artificial Sequence: Synthetic polypeptide
DEGEIATTNPVATEQWGSVSGEGMNPGQAKGPPDE

SEQ ID NO: 163048 - protein, 36 aa, Artificial Sequence
  Description of Artificial Sequence: Synthetic polypeptide
DDEEIRTTNPVATEQYGNVIMGNLNGGNGQTGDDGG

SEQ ID NO: 163049 - protein, 38 aa, Artificial Sequence
  Description of Artificial Sequence: Synthetic polypeptide
AEEEIRTTNPVATEQYGVVVTVTNNLQQGTEQGTNTNQ

SEQ ID NO: 163050 - protein, 30 aa, Artificial Sequence
  Description of Artificial Sequence: Synthetic polypeptide
QESEIRTTNPVGTEGWGVVSETLMNAAEDI

SEQ ID NO: 163051 - protein, 34 aa, Artificial Sequence
  Description of Artificial Sequence: Synthetic polypeptide
DEAVEIATTNPVAYEQWGSVPTPPMLGEDHNGER

SEQ ID NO: 163052 - protein, 36 aa, Artificial Sequence
  Description of Artificial Sequence: Synthetic polypeptide
DEEEIRTTNPVATEQYGSVWAVPDPMAQTGTSLEED

SEQ ID NO: 163053 - protein, 35 aa, Artificial Sequence
  Description of Artificial Sequence: Synthetic polypeptide
DEFEIVTTNPVATEQYGTVCSATDGMPVEFEGNDN

SEQ ID NO: 163054 - protein, 38 aa, Artificial Sequence
  Description of Artificial Sequence: Synthetic polypeptide
DEEEIRTTNPVATEQYGVVSTVNNANQQGTEAGTEEED

SEQ ID NO: 163055 - protein, 32 aa, Artificial Sequence
  Description of Artificial Sequence: Synthetic polypeptide
DEFEIWTTNPVSTEPYGTISMEDIQQQQQGNH

SEQ ID NO: 163056 - protein, 36 aa, Artificial Sequence
  Description of Artificial Sequence: Synthetic polypeptide
DEEEIRTTNPVATEGYGVVVSAGFGNGQTDDDNIDT

SEQ ID NO: 163057 - protein, 36 aa, Artificial Sequence
  Description of Artificial Sequence: Synthetic polypeptide
DEFELATVNPVATEQYGSVSWNENDQRDTQKGMDHR

SEQ ID NO: 163058 - protein, 32 aa, Artificial Sequence
  Description of Artificial Sequence: Synthetic polypeptide
DENEIRTTNPSSTEPYGTISMEDIQQQQNGNH

SEQ ID NO: 163059 - protein, 35 aa, Artificial Sequence
  Description of Artificial Sequence: Synthetic polypeptide
CEEEIACTNPVATEQYGSACAATNGLAPGEQMEGR

SEQ ID NO: 163060 - protein, 33 aa, Artificial Sequence
  Description of Artificial Sequence: Synthetic polypeptide
DENEIRTTNPMSTEPYGTISMSDIQVQQNGENH

SEQ ID NO: 163061 - protein, 32 aa, Artificial Sequence
  Description of Artificial Sequence: Synthetic polypeptide
DENEIRTTNPMSTEPYGTISMEDIQQTQNGNH

SEQ ID NO: 163062 - protein, 32 aa, Artificial Sequence
  Description of Artificial Sequence: Synthetic polypeptide
DENEIRTTNPMSTEPYGTISMEDIQQQQNGNH

SEQ ID NO: 163063 - protein, 38 aa, Artificial Sequence
  Description of Artificial Sequence: Synthetic polypeptide
AEEEIRTTNPVATEQYGVVVTVVTNNLQSNEQGSTNND

SEQ ID NO: 163064 - protein, 32 aa, Artificial Sequence
  Description of Artificial Sequence: Synthetic polypeptide
DENEIRTTNPMSTEPYGTISMEDIQQQQNGNF

SEQ ID NO: 163065 - protein, 32 aa, Artificial Sequence
  Description of Artificial Sequence: Synthetic polypeptide
DENEIRTTNPMSTEPYGTISMEAIQQQQNGNH

SEQ ID NO: 163066 - protein, 36 aa, Artificial Sequence
  Description of Artificial Sequence: Synthetic polypeptide
DEFELCTVNPVATEQYGSVSWNENDQRDTQKGGDGR

SEQ ID NO: 163067 - protein, 37 aa, Artificial Sequence
  Description of Artificial Sequence: Synthetic polypeptide
DEEEIRTTNPVATEGYGVVVGVGTGNVGNQEGEGNVT

SEQ ID NO: 163068 - protein, 33 aa, Artificial Sequence
  Description of Artificial Sequence: Synthetic polypeptide
DENEIRTTNPLSTEPYGTISMEDNIQQQQNGNH

SEQ ID NO: 163069 - protein, 34 aa, Artificial Sequence
  Description of Artificial Sequence: Synthetic polypeptide
DEEEIRATNPVAYEQYGSVCAANGEEADNQNNTM

SEQ ID NO: 163070 - protein, 32 aa, Artificial Sequence
  Description of Artificial Sequence: Synthetic polypeptide
DENEIRTTNPLSTEPYGTISMEDIQQQQNGNH

SEQ ID NO: 163071 - protein, 37 aa, Artificial Sequence
  Description of Artificial Sequence: Synthetic polypeptide
DEEEIRTTNPVATEGYGVVVGVGTGNDGQQEGEGNTV

SEQ ID NO: 163072 - protein, 33 aa, Artificial Sequence
  Description of Artificial Sequence: Synthetic polypeptide
QESEIRTTNPVATEFYGVVNDINGQGNDDEGGN

SEQ ID NO: 163073 - protein, 37 aa, Artificial Sequence
  Description of Artificial Sequence: Synthetic polypeptide
DEEEIRTTNPVATEGYGVVVDGGTNQGQQEGGNGNTV

SEQ ID NO: 163074 - protein, 33 aa, Artificial Sequence
  Description of Artificial Sequence: Synthetic polypeptide
QEGEIAATNPCSYEQYGITVSCNALSQSGGTNR

SEQ ID NO: 163075 - protein, 35 aa, Artificial Sequence
  Description of Artificial Sequence: Synthetic polypeptide
DEFELCTVNPVATEQYGSVSWTENDQDTQKGEGDK

SEQ ID NO: 163076 - protein, 31 aa, Artificial Sequence
  Description of Artificial Sequence: Synthetic polypeptide
DDSEVASTNPVSTEWYGNVAANTIQSRVGQR

SEQ ID NO: 163077 - protein, 31 aa, Artificial Sequence
  Description of Artificial Sequence: Synthetic polypeptide
DDSEVASTNPVSTEVYGNVAINTIQSRVGQR

SEQ ID NO: 163078 - protein, 31 aa, Artificial Sequence
  Description of Artificial Sequence: Synthetic polypeptide
DDSEVASTNPVSTEVYGNVAANTIQSRVGQR

SEQ ID NO: 163079 - protein, 33 aa, Artificial Sequence
  Description of Artificial Sequence: Synthetic polypeptide
DEFEIRTTNPVSTEPYGTISMEDIQQQQNGNHF

SEQ ID NO: 163080 - protein, 31 aa, Artificial Sequence
  Description of Artificial Sequence: Synthetic polypeptide
DDSEVASTNPVSTEVYGNVAANTIQGRVGQR

SEQ ID NO: 163081 - protein, 37 aa, Artificial Sequence
  Description of Artificial Sequence: Synthetic polypeptide
DDEEIRTTNPVATEQYGNVIMGNLDEGGNGQTGNGGN

SEQ ID NO: 163082 - protein, 29 aa, Artificial Sequence
  Description of Artificial Sequence: Synthetic peptide
QESEIASTNPVGTEPWGEMAYSTLQHGDI

SEQ ID NO: 163083 - protein, 32 aa, Artificial Sequence
  Description of Artificial Sequence: Synthetic polypeptide
DENEIRTTNPTSTEPYGTISMEDIQQQQNGNH

SEQ ID NO: 163084 - protein, 32 aa, Artificial Sequence
  Description of Artificial Sequence: Synthetic polypeptide
DENEIRTTNPTSTEPYGTISMEDIQPQQNGNH

SEQ ID NO: 163085 - protein, 35 aa, Artificial Sequence
  Description of Artificial Sequence: Synthetic polypeptide
DEFEIRTTNPVATEQYGSVNTPLWEVSMEYDEIDN

SEQ ID NO: 163086 - protein, 37 aa, Artificial Sequence
  Description of Artificial Sequence: Synthetic polypeptide
AEEEIRTTNPVATEQYGVVVTVTNNNLGGTEQGSNNQ

SEQ ID NO: 163087 - protein, 32 aa, Artificial Sequence
  Description of Artificial Sequence: Synthetic polypeptide
QESEIRTTNPVGTEGWGVMSSINEPQDRGEDI

SEQ ID NO: 163088 - protein, 34 aa, Artificial Sequence
  Description of Artificial Sequence: Synthetic polypeptide
DEMAIRTTNPVATEQYGCFCSWGEHNIGFGSNQA

SEQ ID NO: 163089 - protein, 38 aa, Artificial Sequence
  Description of Artificial Sequence: Synthetic polypeptide
DEEEIRTTNPVATEQYGVVSTVNNDQQGTTEQGTEQGS

SEQ ID NO: 163090 - protein, 29 aa, Artificial Sequence
  Description of Artificial Sequence: Synthetic peptide
QESEIASTNPVGTEPWGVAASTLQHGDIG

SEQ ID NO: 163091 - protein, 33 aa, Artificial Sequence
  Description of Artificial Sequence: Synthetic polypeptide
DEAVEIATTNPVAYECWGSVYMENDHQNGGNEH

SEQ ID NO: 163092 - protein, 36 aa, Artificial Sequence
  Description of Artificial Sequence: Synthetic polypeptide
DEEEIRTTNPVATEQYGSVWAVPDPMFQTGGSLEET

SEQ ID NO: 163093 - protein, 32 aa, Artificial Sequence
  Description of Artificial Sequence: Synthetic polypeptide
DEGEIATTNPVATEQWGGCSAATANGMDMPGT

SEQ ID NO: 163094 - protein, 34 aa, Artificial Sequence
  Description of Artificial Sequence: Synthetic polypeptide
DEQTIGTTNPVATEQYGSVDQINGDQGGFGQGEG

SEQ ID NO: 163095 - protein, 37 aa, Artificial Sequence
  Description of Artificial Sequence: Synthetic polypeptide
DDEEIRTTNPVATEQYGDVVTTGGQIINGQGGDNDIN

SEQ ID NO: 163096 - protein, 28 aa, Artificial Sequence
  Description of Artificial Sequence: Synthetic peptide
QESEIASTNPVGTEPWGVMYSDLQHGDI

SEQ ID NO: 163097 - protein, 34 aa, Artificial Sequence
  Description of Artificial Sequence: Synthetic polypeptide
DESCIRTTNPVATEQFWGSVTATNNLELYDVYGE

SEQ ID NO: 163098 - protein, 37 aa, Artificial Sequence
  Description of Artificial Sequence: Synthetic polypeptide
DEEEIRTTNPVATESYGSVMETNDQNDQETNGQGGGN

SEQ ID NO: 163099 - protein, 35 aa, Artificial Sequence
  Description of Artificial Sequence: Synthetic polypeptide
DESCIRTTNPVATEQFWGSVCATNNSLELYDVNGE

SEQ ID NO: 163100 - protein, 36 aa, Artificial Sequence
  Description of Artificial Sequence: Synthetic polypeptide
AEEEIRTTNPVATEQYGVVVTVVTDGNGNLGGNDDE

SEQ ID NO: 163101 - protein, 36 aa, Artificial Sequence
  Description of Artificial Sequence: Synthetic polypeptide
DEEEIRTTNPVATESYGSVDGQGNMTDTGILGGGIT

SEQ ID NO: 163102 - protein, 34 aa, Artificial Sequence
  Description of Artificial Sequence: Synthetic polypeptide
DEMAIRTTNPVATEQYGCFCSWEHNINFGSNNQA

SEQ ID NO: 163103 - protein, 36 aa, Artificial Sequence
  Description of Artificial Sequence: Synthetic polypeptide
AEEEIRTTNPVATEQYGVVVTVVTDGNNNLGGNNDD

SEQ ID NO: 163104 - protein, 35 aa, Artificial Sequence
  Description of Artificial Sequence: Synthetic polypeptide
QESEIRTTNPVATEQYGSVVTDNMIETGGGQEQGQ

SEQ ID NO: 163105 - protein, 33 aa, Artificial Sequence
  Description of Artificial Sequence: Synthetic polypeptide
DEFEIRTTNPVSTEPYGTISCMEDIQQQQNGNH

SEQ ID NO: 163106 - protein, 31 aa, Artificial Sequence
  Description of Artificial Sequence: Synthetic polypeptide
DENEIRTTNPTATEQWGDVSEEIEMNAAEDA

SEQ ID NO: 163107 - protein, 34 aa, Artificial Sequence
  Description of Artificial Sequence: Synthetic polypeptide
DEAVIRTTNPVATEQYGCVCESGEPNQYFNSQQS

SEQ ID NO: 163108 - protein, 33 aa, Artificial Sequence
  Description of Artificial Sequence: Synthetic polypeptide
DEEEIRATNPVAYEQWGMVTGWNNDTQGQGGDL

SEQ ID NO: 163109 - protein, 34 aa, Artificial Sequence
  Description of Artificial Sequence: Synthetic polypeptide
DEECIQTTNPVAYERYGISLVNINMGSDRPGGNA

SEQ ID NO: 163110 - protein, 35 aa, Artificial Sequence
  Description of Artificial Sequence: Synthetic polypeptide
DEGEIATTNPVATEQYGSVCAPMNLENDDLMGAQA

SEQ ID NO: 163111 - protein, 33 aa, Artificial Sequence
  Description of Artificial Sequence: Synthetic polypeptide
EENEIRTTNPVATDQYGSVNIEQQEVHQQANVD

SEQ ID NO: 163112 - protein, 28 aa, Artificial Sequence
  Description of Artificial Sequence: Synthetic peptide
QESEIASTNPVGTEGYGVMASHLQHIDI

SEQ ID NO: 163113 - protein, 30 aa, Artificial Sequence
  Description of Artificial Sequence: Synthetic polypeptide
QESEIASTNPVGTEGYGVMASHTLQHGDIF

SEQ ID NO: 163114 - protein, 34 aa, Artificial Sequence
  Description of Artificial Sequence: Synthetic polypeptide
DDEEISTTNPVATEQYGCVCSSEEHNQNFGSDQD

SEQ ID NO: 163115 - protein, 30 aa, Artificial Sequence
  Description of Artificial Sequence: Synthetic polypeptide
QESEIASTNPVGTEGYGVMASHTLQHGGDI

SEQ ID NO: 163116 - protein, 36 aa, Artificial Sequence
  Description of Artificial Sequence: Synthetic polypeptide
QEEEIRTTNPVATEQYGVVSSTTPAGPNMRNGMDPV

SEQ ID NO: 163117 - protein, 37 aa, Artificial Sequence
  Description of Artificial Sequence: Synthetic polypeptide
DTEEIRTTNPVATEQYGVVVVTVVNNQQGNQEEEDEE

SEQ ID NO: 163118 - protein, 37 aa, Artificial Sequence
  Description of Artificial Sequence: Synthetic polypeptide
AEEEIRTTNPVATEQYGVVSTTQQLLTNSEEGTNTNE

SEQ ID NO: 163119 - protein, 36 aa, Artificial Sequence
  Description of Artificial Sequence: Synthetic polypeptide
DEAEIACTNPVATEQYGSACATNPQLNPDAQTGGRM

SEQ ID NO: 163120 - protein, 28 aa, Artificial Sequence
  Description of Artificial Sequence: Synthetic peptide
QESEIASTNPVGTEGYGVMASIEQHGDI

SEQ ID NO: 163121 - protein, 35 aa, Artificial Sequence
  Description of Artificial Sequence: Synthetic polypeptide
DEAEIACTNPVATEQYGSACSANDLQNHADENGHH

SEQ ID NO: 163122 - protein, 32 aa, Artificial Sequence
  Description of Artificial Sequence: Synthetic polypeptide
MENEIACTNPVATEQYGEAIHEVLQRGDGQQD

SEQ ID NO: 163123 - protein, 32 aa, Artificial Sequence
  Description of Artificial Sequence: Synthetic polypeptide
MENEIACTNPVATEQYGEADSAEVLTRGDGQQ

SEQ ID NO: 163124 - protein, 37 aa, Artificial Sequence
  Description of Artificial Sequence: Synthetic polypeptide
DEEEIRTTNPVATEQYGQCVCSTEEHNQEYFNSDTQS

SEQ ID NO: 163125 - protein, 28 aa, Artificial Sequence
  Description of Artificial Sequence: Synthetic peptide
QESEIASTNPVGTEGYGVMASILQHEDI

SEQ ID NO: 163126 - protein, 31 aa, Artificial Sequence
  Description of Artificial Sequence: Synthetic polypeptide
DENEIRTTNPVATEQWGDVQREIEMNAAEDA

SEQ ID NO: 163127 - protein, 31 aa, Artificial Sequence
  Description of Artificial Sequence: Synthetic polypeptide
DENEIRTTNPVATEQWGDVQNIMEMEAAEDI

SEQ ID NO: 163128 - protein, 31 aa, Artificial Sequence
  Description of Artificial Sequence: Synthetic polypeptide
DDSEVASTNPVSTEGYGNVCAANTIQRVGQR

SEQ ID NO: 163129 - protein, 32 aa, Artificial Sequence
  Description of Artificial Sequence: Synthetic polypeptide
DDSEVASTNPVSTEGYGNVCAANTIQSRVGNR

SEQ ID NO: 163130 - protein, 37 aa, Artificial Sequence
  Description of Artificial Sequence: Synthetic polypeptide
DEEEIRGTNPVATEQYGVVNMSDTNGQGEFGDQDDDN

SEQ ID NO: 163131 - protein, 32 aa, Artificial Sequence
  Description of Artificial Sequence: Synthetic polypeptide
CEEEIACTNPVATEQYGCAPAMHGQDSDGENN

SEQ ID NO: 163132 - protein, 33 aa, Artificial Sequence
  Description of Artificial Sequence: Synthetic polypeptide
DEHEIRTTNPVSTEPYGTNSMEDIQQQQNGNLH

SEQ ID NO: 163133 - protein, 35 aa, Artificial Sequence
  Description of Artificial Sequence: Synthetic polypeptide
DEECIRTTNPVATEQWGSVVCNCINMGSDSIPGND

SEQ ID NO: 163134 - protein, 35 aa, Artificial Sequence
  Description of Artificial Sequence: Synthetic polypeptide
QEEEIRTTNPVATEQYGVVVNGNPDQTGEEGGQGG

SEQ ID NO: 163135 - protein, 36 aa, Artificial Sequence
  Description of Artificial Sequence: Synthetic polypeptide
DEECIRTTNPVATEQWGSVVQNCINMGSDSRPGNDT

SEQ ID NO: 163136 - protein, 36 aa, Artificial Sequence
  Description of Artificial Sequence: Synthetic polypeptide
DEECIRTTNPVATEQWGSVVVHCINMGSDSRPGNDV

SEQ ID NO: 163137 - protein, 35 aa, Artificial Sequence
  Description of Artificial Sequence: Synthetic polypeptide
QEEEIRTTNPVATEQYGVVVNTDNMFETGGGQEQG

SEQ ID NO: 163138 - protein, 31 aa, Artificial Sequence
  Description of Artificial Sequence: Synthetic polypeptide
MENEIACTNPVATEFYGEAVEVLQRGDGQQY

SEQ ID NO: 163139 - protein, 30 aa, Artificial Sequence
  Description of Artificial Sequence: Synthetic polypeptide
QESEIASTNPVGTEGYGVMASITEQDHGNI

SEQ ID NO: 163140 - protein, 36 aa, Artificial Sequence
  Description of Artificial Sequence: Synthetic polypeptide
DTEEIRTTNPVATEQYGVVSVTVVTTNQQNEEEDED

SEQ ID NO: 163141 - protein, 31 aa, Artificial Sequence
  Description of Artificial Sequence: Synthetic polypeptide
DDSEVASTNPVSTEGYGNVAYNTIQSRVGQR

SEQ ID NO: 163142 - protein, 38 aa, Artificial Sequence
  Description of Artificial Sequence: Synthetic polypeptide
DTEEIRTTNPVATEQYGVVSTVVNQQQGNTEQGTTDEQ

SEQ ID NO: 163143 - protein, 37 aa, Artificial Sequence
  Description of Artificial Sequence: Synthetic polypeptide
DTEEIRTTNPVATEQYGVVSTVVNQQQNTEQGTEEDE

SEQ ID NO: 163144 - protein, 37 aa, Artificial Sequence
  Description of Artificial Sequence: Synthetic polypeptide
DTEEIRTTNPVATEQYGVVSTVVNQQQQNNVNNTTED

SEQ ID NO: 163145 - protein, 38 aa, Artificial Sequence
  Description of Artificial Sequence: Synthetic polypeptide
DTEEIRTTNPVATEQYGVVSTVVNTNLQQGTTTDEDED

SEQ ID NO: 163146 - protein, 37 aa, Artificial Sequence
  Description of Artificial Sequence: Synthetic polypeptide
DEEEIRTTNPVATEQYGSVVLGIMDNTIEEPEQEGTP

SEQ ID NO: 163147 - protein, 31 aa, Artificial Sequence
  Description of Artificial Sequence: Synthetic polypeptide
DDSEVASTNPVSTEGYGNVATWTIQSRLGQR

SEQ ID NO: 163148 - protein, 31 aa, Artificial Sequence
  Description of Artificial Sequence: Synthetic polypeptide
DDSEVASTNPVSTEGYGNVAVNTIQSRVGQR

SEQ ID NO: 163149 - protein, 30 aa, Artificial Sequence
  Description of Artificial Sequence: Synthetic polypeptide
QESEIASTNPVGTEGYGVMASGTLQHGHIN

SEQ ID NO: 163150 - protein, 37 aa, Artificial Sequence
  Description of Artificial Sequence: Synthetic polypeptide
DEEEIRTTNPVATEQYGSVVLGINDMTIEEPEQDGTT

SEQ ID NO: 163151 - protein, 37 aa, Artificial Sequence
  Description of Artificial Sequence: Synthetic polypeptide
DEEEIRTTNPVATEQYGSVVLGINDVTTEVPEQEGTP

SEQ ID NO: 163152 - protein, 37 aa, Artificial Sequence
  Description of Artificial Sequence: Synthetic polypeptide
DEEEIRTTNPVATEQYGSVVLGIYDMTMEEIEQEGTD

SEQ ID NO: 163153 - protein, 35 aa, Artificial Sequence
  Description of Artificial Sequence: Synthetic polypeptide
QEEEIRTTNPVATEQYGVMSSTTPAGPNMRNGMDV

SEQ ID NO: 163154 - protein, 31 aa, Artificial Sequence
  Description of Artificial Sequence: Synthetic polypeptide
DENEIRTTNPVATEQWGDVRCEIEMNAAEDA

SEQ ID NO: 163155 - protein, 35 aa, Artificial Sequence
  Description of Artificial Sequence: Synthetic polypeptide
QEEEIRTTNPVATEQYGVVDGTANMDTGDGGGEEQ

SEQ ID NO: 163156 - protein, 28 aa, Artificial Sequence
  Description of Artificial Sequence: Synthetic peptide
QESEIASTNPVGTEGYGVMASHDQHGDI

SEQ ID NO: 163157 - protein, 36 aa, Artificial Sequence
  Description of Artificial Sequence: Synthetic polypeptide
DTEEIRTTNPVATEQYGVVSTVVTTNTDEEGTEDED

SEQ ID NO: 163158 - protein, 38 aa, Artificial Sequence
  Description of Artificial Sequence: Synthetic polypeptide
DEEEIRTTNPVATEQYGSVQTRMMVMEGVINMQNNVNQ

SEQ ID NO: 163159 - protein, 38 aa, Artificial Sequence
  Description of Artificial Sequence: Synthetic polypeptide
DTEEIRTTNPVATEQYGVVSVTTNQQQGNTEQGTNDEQ

SEQ ID NO: 163160 - protein, 37 aa, Artificial Sequence
  Description of Artificial Sequence: Synthetic polypeptide
DEEEIRTTNPVATEQYGQCVCSTEEHNQENFGSDTQS

SEQ ID NO: 163161 - protein, 29 aa, Artificial Sequence
  Description of Artificial Sequence: Synthetic peptide
QESEIASTNPVGTEGYGVMASHLMQHGDI

SEQ ID NO: 163162 - protein, 36 aa, Artificial Sequence
  Description of Artificial Sequence: Synthetic polypeptide
QEEEIRTTNPVATEQYGVVMGNDENNEQTQEGNGGT

SEQ ID NO: 163163 - protein, 31 aa, Artificial Sequence
  Description of Artificial Sequence: Synthetic polypeptide
DDSEVASTNPVSTEGYGNVAWNTIQSRVGQR

SEQ ID NO: 163164 - protein, 32 aa, Artificial Sequence
  Description of Artificial Sequence: Synthetic polypeptide
DEHEIRTTNPVSTEPYGTISMEDIQQQQNLNH

SEQ ID NO: 163165 - protein, 37 aa, Artificial Sequence
  Description of Artificial Sequence: Synthetic polypeptide
DTEEIRTTNPVATEQYGVVSVTVTNQQNQEQGTEEED

SEQ ID NO: 163166 - protein, 35 aa, Artificial Sequence
  Description of Artificial Sequence: Synthetic polypeptide
QEEEIRTTNPVATEQYGVVNFTIGLGQNDEQETED

SEQ ID NO: 163167 - protein, 35 aa, Artificial Sequence
  Description of Artificial Sequence: Synthetic polypeptide
DEEEIRTTNPVATEFYGYVVNQVNIQGQEGEEGDE

SEQ ID NO: 163168 - protein, 32 aa, Artificial Sequence
  Description of Artificial Sequence: Synthetic polypeptide
DEHEIRTTNPVSTEPYGTISMEDIQQQQNGDH

SEQ ID NO: 163169 - protein, 37 aa, Artificial Sequence
  Description of Artificial Sequence: Synthetic polypeptide
DEEEIRTTNPVATEQYGSVVLGIAQQTIEEPEQEGTP

SEQ ID NO: 163170 - protein, 36 aa, Artificial Sequence
  Description of Artificial Sequence: Synthetic polypeptide
DEEEIRGTNPVATEQYGVVMGQDIENDNNQDEGENG

SEQ ID NO: 163171 - protein, 35 aa, Artificial Sequence
  Description of Artificial Sequence: Synthetic polypeptide
DEGEIATTNPVAYEQYGSVVANPHLQASGGDEQDD

SEQ ID NO: 163172 - protein, 37 aa, Artificial Sequence
  Description of Artificial Sequence: Synthetic polypeptide
DEEEIRTTNPVATEQYGQCVCSTGEHNQEFFGSDTQE

SEQ ID NO: 163173 - protein, 37 aa, Artificial Sequence
  Description of Artificial Sequence: Synthetic polypeptide
DEEEIRTTNPVATEQYGQCVCSTGEHNQESFGSEFQF

SEQ ID NO: 163174 - protein, 36 aa, Artificial Sequence
  Description of Artificial Sequence: Synthetic polypeptide
DEAEIACTNPVATEQYGSACSTNPLEAEAPMGNGNE

SEQ ID NO: 163175 - protein, 34 aa, Artificial Sequence
  Description of Artificial Sequence: Synthetic polypeptide
DEGEIATTNPVAYEQYGSVSWPGDEATPGDNTYH

SEQ ID NO: 163176 - protein, 32 aa, Artificial Sequence
  Description of Artificial Sequence: Synthetic polypeptide
DECEIATTNPVAYEQYGVCSIIDQHTQPNMDN

SEQ ID NO: 163177 - protein, 34 aa, Artificial Sequence
  Description of Artificial Sequence: Synthetic polypeptide
DEESIATTNPVATEPWGISVCSYSPESQMMGNNG

SEQ ID NO: 163178 - protein, 33 aa, Artificial Sequence
  Description of Artificial Sequence: Synthetic polypeptide
DEAEIACTNPVATEQYGSCAATNHPSGEDGEPA

SEQ ID NO: 163179 - protein, 33 aa, Artificial Sequence
  Description of Artificial Sequence: Synthetic polypeptide
DEHEIRTTNPVSYEQWGSCYTMDNHQNGGKQTN

SEQ ID NO: 163180 - protein, 35 aa, Artificial Sequence
  Description of Artificial Sequence: Synthetic polypeptide
DEHEIRTTNPVTTEHWGSVYCMPNQDDQRQGQNNF

SEQ ID NO: 163181 - protein, 32 aa, Artificial Sequence
  Description of Artificial Sequence: Synthetic polypeptide
DENEIATTNPVAYEQWGCVYSIEIEMNQREDQ

SEQ ID NO: 163182 - protein, 31 aa, Artificial Sequence
  Description of Artificial Sequence: Synthetic polypeptide
DENEIATTNPVAYEQWGEVSWIEMRALEDAD

SEQ ID NO: 163183 - protein, 30 aa, Artificial Sequence
  Description of Artificial Sequence: Synthetic polypeptide
QESEIASTNPVGTEGYGVMASLTLQHGMDI

SEQ ID NO: 163184 - protein, 36 aa, Artificial Sequence
  Description of Artificial Sequence: Synthetic polypeptide
DEEEIRTTNPVATEQYGQCVCSTGEHNANFNSDTQA

SEQ ID NO: 163185 - protein, 31 aa, Artificial Sequence
  Description of Artificial Sequence: Synthetic polypeptide
CEEEIACTNPVATEQYGCAPMHGNDSEGEDH

SEQ ID NO: 163186 - protein, 32 aa, Artificial Sequence
  Description of Artificial Sequence: Synthetic polypeptide
DENEIRTTNPVATEQWGDVLAECIEMNAAEDA

SEQ ID NO: 163187 - protein, 32 aa, Artificial Sequence
  Description of Artificial Sequence: Synthetic polypeptide
CEEEIACTNPVATEQYGCAPMHGQDSEGENDD

SEQ ID NO: 163188 - protein, 35 aa, Artificial Sequence
  Description of Artificial Sequence: Synthetic polypeptide
DEGEIATTNPVAYEQYGSVSVAPHLQEAPGGAAEN

SEQ ID NO: 163189 - protein, 36 aa, Artificial Sequence
  Description of Artificial Sequence: Synthetic polypeptide
QEEEIRTTNPVATESYGSVNVMGDNQDQQRIIGGDD

SEQ ID NO: 163190 - protein, 32 aa, Artificial Sequence
  Description of Artificial Sequence: Synthetic polypeptide
DEESIATTNPVAYECWGCVYNWDNDHQREQNM

SEQ ID NO: 163191 - protein, 31 aa, Artificial Sequence
  Description of Artificial Sequence: Synthetic polypeptide
AEMEIACTNPVATEQYGEVCSEDGPVEFGGD

SEQ ID NO: 163192 - protein, 36 aa, Artificial Sequence
  Description of Artificial Sequence: Synthetic polypeptide
QEEEIRTTNPVATESYGSVSDGLGGGEGQNGEQQGF

SEQ ID NO: 163193 - protein, 36 aa, Artificial Sequence
  Description of Artificial Sequence: Synthetic polypeptide
YEEEIRTTNPVATEQYGSVSNGFDEENDEIGGADGT

SEQ ID NO: 163194 - protein, 33 aa, Artificial Sequence
  Description of Artificial Sequence: Synthetic polypeptide
DESEIATTNPVATEQYGEVPEIVEPQDHEGEEG

SEQ ID NO: 163195 - protein, 32 aa, Artificial Sequence
  Description of Artificial Sequence: Synthetic polypeptide
AEMEIACTNPVATEQYGEVCSATDGPVEFGGD

SEQ ID NO: 163196 - protein, 33 aa, Artificial Sequence
  Description of Artificial Sequence: Synthetic polypeptide
AEMEIACTNPVATEQYGEVCSATDGPVEFEGND

SEQ ID NO: 163197 - protein, 32 aa, Artificial Sequence
  Description of Artificial Sequence: Synthetic polypeptide
AEMEIACTNPVATEQYGEVCSAENPVEFEGGD

SEQ ID NO: 163198 - protein, 29 aa, Artificial Sequence
  Description of Artificial Sequence: Synthetic peptide
QESEIASTNPVGTEGYGVMASLTLQHPDI

SEQ ID NO: 163199 - protein, 31 aa, Artificial Sequence
  Description of Artificial Sequence: Synthetic polypeptide
DDSEVASTNPVSTEGYGNVCANTDQSRVGQR

SEQ ID NO: 163200 - protein, 37 aa, Artificial Sequence
  Description of Artificial Sequence: Synthetic polypeptide
DEEEIRTTNPVATEQYGQCVCSTGEHNAENFNSDPQS

SEQ ID NO: 163201 - protein, 37 aa, Artificial Sequence
  Description of Artificial Sequence: Synthetic polypeptide
DEEEIRTTNPVATEQYGQCVCSTGEHDQENFGSDTQA

SEQ ID NO: 163202 - protein, 32 aa, Artificial Sequence
  Description of Artificial Sequence: Synthetic polypeptide
DEESIATTNPVATASWGCVATGELQPDDSNGM

SEQ ID NO: 163203 - protein, 31 aa, Artificial Sequence
  Description of Artificial Sequence: Synthetic polypeptide
DDSEVASTNPVSTEGYGNVCANTIQSRVGQR

SEQ ID NO: 163204 - protein, 33 aa, Artificial Sequence
  Description of Artificial Sequence: Synthetic polypeptide
AEANEIATTNPVAYEQWGSVAWTEDQGGPNGHD

SEQ ID NO: 163205 - protein, 30 aa, Artificial Sequence
  Description of Artificial Sequence: Synthetic polypeptide
QESEIASTNPVGTEGYGVMASITLQHGDIT

SEQ ID NO: 163206 - protein, 35 aa, Artificial Sequence
  Description of Artificial Sequence: Synthetic polypeptide
QEEEIRTTNPVATEQYGVVVSINMGMEGGDEGAGD

SEQ ID NO: 163207 - protein, 35 aa, Artificial Sequence
  Description of Artificial Sequence: Synthetic polypeptide
DEEEIRTTNPVATEGYGCSCSNWGEEQYFNSDNQA

SEQ ID NO: 163208 - protein, 37 aa, Artificial Sequence
  Description of Artificial Sequence: Synthetic polypeptide
DEEEIRTTNPVATEQYGQCVCSTGEDEQENFNSEFQA

SEQ ID NO: 163209 - protein, 32 aa, Artificial Sequence
  Description of Artificial Sequence: Synthetic polypeptide
SEEEIRATNPTAYECWGSVYGENDDMHRGDQR

SEQ ID NO: 163210 - protein, 35 aa, Artificial Sequence
  Description of Artificial Sequence: Synthetic polypeptide
QEEEIRTTNPVATEQYGVVVSINVGMEGGDEEEGI

SEQ ID NO: 163211 - protein, 30 aa, Artificial Sequence
  Description of Artificial Sequence: Synthetic polypeptide
QESEIASTNPVGTEGYGVMASITLQHGDIW

SEQ ID NO: 163212 - protein, 36 aa, Artificial Sequence
  Description of Artificial Sequence: Synthetic polypeptide
DEEEIRTTNPVATEQYGQCVCSTGEDHQNFISDPQS

SEQ ID NO: 163213 - protein, 32 aa, Artificial Sequence
  Description of Artificial Sequence: Synthetic polypeptide
DENEIRTTNPVATEQWGDVNEGIVEMNPGEDA

SEQ ID NO: 163214 - protein, 36 aa, Artificial Sequence
  Description of Artificial Sequence: Synthetic polypeptide
DEEEIRTTNPVATEQYGQCVCSTGEHETYFGSETQE

SEQ ID NO: 163215 - protein, 37 aa, Artificial Sequence
  Description of Artificial Sequence: Synthetic polypeptide
MEMEIATTNPVATEQYGSVSPTSAVGDQFRIGENYQK

SEQ ID NO: 163216 - protein, 37 aa, Artificial Sequence
  Description of Artificial Sequence: Synthetic polypeptide
DEEEIRTTNPVATEQYGQCVCSTGEDNQEFFNSDNQS

SEQ ID NO: 163217 - protein, 29 aa, Artificial Sequence
  Description of Artificial Sequence: Synthetic peptide
QESEIASTNPVGTEGYGVMASLLQHGDFI

SEQ ID NO: 163218 - protein, 34 aa, Artificial Sequence
  Description of Artificial Sequence: Synthetic polypeptide
DEGEIATTNPVAYEQYGSVTSAANQSDTNNPPVT

SEQ ID NO: 163219 - protein, 37 aa, Artificial Sequence
  Description of Artificial Sequence: Synthetic polypeptide
DEEEIRTTNPVATEQYGSVQTTDTVEEGARDGQMLLP

SEQ ID NO: 163220 - protein, 37 aa, Artificial Sequence
  Description of Artificial Sequence: Synthetic polypeptide
DEEEIRTTNPVATEQYGSVQTTESTAVEPMMLLVEVA

SEQ ID NO: 163221 - protein, 35 aa, Artificial Sequence
  Description of Artificial Sequence: Synthetic polypeptide
QEEEIRTTNPVATEQYGVVVSIQNGMEGGDTEEGQ

SEQ ID NO: 163222 - protein, 33 aa, Artificial Sequence
  Description of Artificial Sequence: Synthetic polypeptide
DEHEIRTTNPVSYEQWGSCYTIDNHQNGGKEPT

SEQ ID NO: 163223 - protein, 33 aa, Artificial Sequence
  Description of Artificial Sequence: Synthetic polypeptide
DEHEIRTTNPVSYEQWGSCYTIDNQHQNGGKGT

SEQ ID NO: 163224 - protein, 35 aa, Artificial Sequence
  Description of Artificial Sequence: Synthetic polypeptide
DTEEIRTTNPVAWEQWGQVTVPTGVLSQNTGTNQE

SEQ ID NO: 163225 - protein, 33 aa, Artificial Sequence
  Description of Artificial Sequence: Synthetic polypeptide
DENEIATTNPVAYEQWGCVAGNGLQAAADGSSN

SEQ ID NO: 163226 - protein, 31 aa, Artificial Sequence
  Description of Artificial Sequence: Synthetic polypeptide
DENEIRTTNPVATEQWGDVMEEIEENAAEDA

SEQ ID NO: 163227 - protein, 36 aa, Artificial Sequence
  Description of Artificial Sequence: Synthetic polypeptide
DEEEIRTTNPVATEQYGQCVCSTGEHAENFISDTQA

SEQ ID NO: 163228 - protein, 35 aa, Artificial Sequence
  Description of Artificial Sequence: Synthetic polypeptide
DEEEIRTTNPVATEGYGCSCSSEHNQEYFNSDTQA

SEQ ID NO: 163229 - protein, 34 aa, Artificial Sequence
  Description of Artificial Sequence: Synthetic polypeptide
DECEIATTNPVAYERWGEVCSTNDIGQHQGNNEE

SEQ ID NO: 163230 - protein, 35 aa, Artificial Sequence
  Description of Artificial Sequence: Synthetic polypeptide
DESEIATTNPVATEQYGSVCAADAHLEQTMADINL

SEQ ID NO: 163231 - protein, 36 aa, Artificial Sequence
  Description of Artificial Sequence: Synthetic polypeptide
DEEEIATTNPVATEQYGSVCAATANPEEMMGMPTEG

SEQ ID NO: 163232 - protein, 36 aa, Artificial Sequence
  Description of Artificial Sequence: Synthetic polypeptide
QEEEIRTTNPVATEQYGSVVNTDNMIETGGGQETGG

SEQ ID NO: 163233 - protein, 29 aa, Artificial Sequence
  Description of Artificial Sequence: Synthetic peptide
DDSEVASTNPVSTEGYGNVANTIQSHGDR

SEQ ID NO: 163234 - protein, 35 aa, Artificial Sequence
  Description of Artificial Sequence: Synthetic polypeptide
DEMEIATTNPVATEQYGCVCSNTGEPVEFEGSNDS

SEQ ID NO: 163235 - protein, 36 aa, Artificial Sequence
  Description of Artificial Sequence: Synthetic polypeptide
DEEEIRTTNPVATEFYGVVQDGGGNATNDDEAGNQG

SEQ ID NO: 163236 - protein, 35 aa, Artificial Sequence
  Description of Artificial Sequence: Synthetic polypeptide
DEEEIRTTNPVATEFYGVVSVLQNDMEGQGEEQFG

SEQ ID NO: 163237 - protein, 30 aa, Artificial Sequence
  Description of Artificial Sequence: Synthetic polypeptide
QESEIASTNPVGTEGYGVMASCTLQHMGDI

SEQ ID NO: 163238 - protein, 37 aa, Artificial Sequence
  Description of Artificial Sequence: Synthetic polypeptide
DTEEIRTTNPVATEQYGVVSTVNNNQQQNNNNNQTTD

SEQ ID NO: 163239 - protein, 36 aa, Artificial Sequence
  Description of Artificial Sequence: Synthetic polypeptide
QEEEIRTTNPVATEQYGSVVSNTDTGEIVEGQGEFN

SEQ ID NO: 163240 - protein, 35 aa, Artificial Sequence
  Description of Artificial Sequence: Synthetic polypeptide
DEEEIRTTNPVATEFYGVVVDDNMTMEEDGDENGP

SEQ ID NO: 163241 - protein, 30 aa, Artificial Sequence
  Description of Artificial Sequence: Synthetic polypeptide
QESEIASTNPVGTEGYGVMASDGLVQFGDD

SEQ ID NO: 163242 - protein, 30 aa, Artificial Sequence
  Description of Artificial Sequence: Synthetic polypeptide
DDSEVASTNPVSTEGYGNVANTIQSRVGQR

SEQ ID NO: 163243 - protein, 29 aa, Artificial Sequence
  Description of Artificial Sequence: Synthetic peptide
QESEIASTNPVGTEGYGVMASDLQHGDDI

SEQ ID NO: 163244 - protein, 34 aa, Artificial Sequence
  Description of Artificial Sequence: Synthetic polypeptide
DEEEIRTTNPVATEFYGVVNDDNMTMEFNDENGA

SEQ ID NO: 163245 - protein, 34 aa, Artificial Sequence
  Description of Artificial Sequence: Synthetic polypeptide
DEEEIRTTNPVATEFYGVVVDDNMTMEFDDENGP

SEQ ID NO: 163246 - protein, 38 aa, Artificial Sequence
  Description of Artificial Sequence: Synthetic polypeptide
DTEEIRTTNPVATEQYGVVSTVNQNGNNQQGNNDENQD

SEQ ID NO: 163247 - protein, 34 aa, Artificial Sequence
  Description of Artificial Sequence: Synthetic polypeptide
DEEEIRTTNPVATEFYGVVVDDNMTMEFDNENVS

SEQ ID NO: 163248 - protein, 38 aa, Artificial Sequence
  Description of Artificial Sequence: Synthetic polypeptide
DTEEIRTTNPVATEQYGVVSTVNQQAGNNNQEGTNQEN

SEQ ID NO: 163249 - protein, 38 aa, Artificial Sequence
  Description of Artificial Sequence: Synthetic polypeptide
DTEEIRTTNPVATEQYGVVSTVNQQGNNQQGNNNQQQD

SEQ ID NO: 163250 - protein, 38 aa, Artificial Sequence
  Description of Artificial Sequence: Synthetic polypeptide
DTEEIRTTNPVATEQYGVVSTVNQQGNQTGEQGTTNAD

SEQ ID NO: 163251 - protein, 38 aa, Artificial Sequence
  Description of Artificial Sequence: Synthetic polypeptide
DTEEIRTTNPVATEQYGVVSTVNQQGNTEQGSTNQAQD

SEQ ID NO: 163252 - protein, 36 aa, Artificial Sequence
  Description of Artificial Sequence: Synthetic polypeptide
QEEEIRTTNPVATEQYGSVVVDGFGDENDQEEDNMG

SEQ ID NO: 163253 - protein, 36 aa, Artificial Sequence
  Description of Artificial Sequence: Synthetic polypeptide
QEEEIRTTNPVATEQYGSVVVDGFGQENDQDEDGET

SEQ ID NO: 163254 - protein, 38 aa, Artificial Sequence
  Description of Artificial Sequence: Synthetic polypeptide
DTEEIRTTNPVATEQYGVVSTVNQQQGNTEQGNNQQEQ

SEQ ID NO: 163255 - protein, 38 aa, Artificial Sequence
  Description of Artificial Sequence: Synthetic polypeptide
DTEEIRTTNPVATEQYGVVSTVNQQQGNTTEQGSTNAE

SEQ ID NO: 163256 - protein, 34 aa, Artificial Sequence
  Description of Artificial Sequence: Synthetic polypeptide
DESEIATTNPVATEQYGSVSACIDEPEDHEGEDG

SEQ ID NO: 163257 - protein, 38 aa, Artificial Sequence
  Description of Artificial Sequence: Synthetic polypeptide
DTEEIRTTNPVATEQYGVVSTVNQQQGTTGEQGSTNVD

SEQ ID NO: 163258 - protein, 35 aa, Artificial Sequence
  Description of Artificial Sequence: Synthetic polypeptide
DEEEIRTTNPVATEFYGVVVDDNMTMEFDGNENGS

SEQ ID NO: 163259 - protein, 30 aa, Artificial Sequence
  Description of Artificial Sequence: Synthetic polypeptide
DDSEVASTNPVSTEGYGNVANTIQSRVGTR

SEQ ID NO: 163260 - protein, 37 aa, Artificial Sequence
  Description of Artificial Sequence: Synthetic polypeptide
DTEEIRTTNPVATEQYGVVSTTVTNQNNNQQGTEEED

SEQ ID NO: 163261 - protein, 38 aa, Artificial Sequence
  Description of Artificial Sequence: Synthetic polypeptide
DTEEIRTTNPVATEQYGVVSTTVTNLQQSATEEGSTTE

SEQ ID NO: 163262 - protein, 37 aa, Artificial Sequence
  Description of Artificial Sequence: Synthetic polypeptide
DEEEIRTTNPVATEQYGSVVFVHNTNDDNMIANEQTE

SEQ ID NO: 163263 - protein, 37 aa, Artificial Sequence
  Description of Artificial Sequence: Synthetic polypeptide
DTEEIRTTNPVATEQYGVVSTTNQQQQQNIATTNVTE

SEQ ID NO: 163264 - protein, 37 aa, Artificial Sequence
  Description of Artificial Sequence: Synthetic polypeptide
DTEEIRTTNPVATEQYGVVSTTNQQQQQNTTTTNVAE

SEQ ID NO: 163265 - protein, 31 aa, Artificial Sequence
  Description of Artificial Sequence: Synthetic polypeptide
DDSEVASTNPVSTEGYGNVANNTIQNRSGQR

SEQ ID NO: 163266 - protein, 28 aa, Artificial Sequence
  Description of Artificial Sequence: Synthetic peptide
QESEIASTNPVGTEGYGVMASALQHDDI

SEQ ID NO: 163267 - protein, 31 aa, Artificial Sequence
  Description of Artificial Sequence: Synthetic polypeptide
DDSEVASTNPVSTEGYGNVANNTIQSRVGQR

SEQ ID NO: 163268 - protein, 38 aa, Artificial Sequence
  Description of Artificial Sequence: Synthetic polypeptide
DEEEIRTTNPVATEQYGSVVGDMNGNPLDEGQEGGGQG

SEQ ID NO: 163269 - protein, 35 aa, Artificial Sequence
  Description of Artificial Sequence: Synthetic polypeptide
DDEEIRTTNPVATEGYGCVCSMWEEHQNFGSDNQS

SEQ ID NO: 163270 - protein, 35 aa, Artificial Sequence
  Description of Artificial Sequence: Synthetic polypeptide
DECEICTTNPMATEQWGSVAPTDNQQEQHRGTGED

SEQ ID NO: 163271 - protein, 34 aa, Artificial Sequence
  Description of Artificial Sequence: Synthetic polypeptide
DEECIRTTNPVATEQWGCVCGWNEHNQGFNSNQS

SEQ ID NO: 163272 - protein, 38 aa, Artificial Sequence
  Description of Artificial Sequence: Synthetic polypeptide
DTEEIRTTNPVATEQYGVVSTTTNLQAGTEQGATEQGQ

SEQ ID NO: 163273 - protein, 30 aa, Artificial Sequence
  Description of Artificial Sequence: Synthetic polypeptide
DDSEVASTNPVSTEGYGNVANTIMSRVGDR

SEQ ID NO: 163274 - protein, 38 aa, Artificial Sequence
  Description of Artificial Sequence: Synthetic polypeptide
DEEEIRTTNPVATEQYGSVVGSGQDDEEQDGEGGNNGM

SEQ ID NO: 163275 - protein, 29 aa, Artificial Sequence
  Description of Artificial Sequence: Synthetic peptide
DDSEVASTNPVSTEGYGNVANTIQHVGQR

SEQ ID NO: 163276 - protein, 31 aa, Artificial Sequence
  Description of Artificial Sequence: Synthetic polypeptide
DDSEVASTNPVSTEGYGNVANTIQQSRVGQR

SEQ ID NO: 163277 - protein, 30 aa, Artificial Sequence
  Description of Artificial Sequence: Synthetic polypeptide
QESEIASTNPVGTEGYGVMASATLQHVGDI

SEQ ID NO: 163278 - protein, 38 aa, Artificial Sequence
  Description of Artificial Sequence: Synthetic polypeptide
DTEEIRTTNPVATEQYGVVSTTTNLQQGTTEQGTEDEQ

SEQ ID NO: 163279 - protein, 34 aa, Artificial Sequence
  Description of Artificial Sequence: Synthetic polypeptide
DEEEIRTTNPVATEFYGVVDIMGNNGFEDNGEGN

SEQ ID NO: 163280 - protein, 33 aa, Artificial Sequence
  Description of Artificial Sequence: Synthetic polypeptide
DENEIATTNPVAYEPYGSVAGSDPANPNPGAQP

SEQ ID NO: 163281 - protein, 37 aa, Artificial Sequence
  Description of Artificial Sequence: Synthetic polypeptide
DTEEIRTTNPVATEQYGVVSTTTNQAGTQQGTEQGSE

SEQ ID NO: 163282 - protein, 36 aa, Artificial Sequence
  Description of Artificial Sequence: Synthetic polypeptide
DEEEIRTTNPVATEFYGVVDLGDEVNGQDDEENGNG

SEQ ID NO: 163283 - protein, 39 aa, Artificial Sequence
  Description of Artificial Sequence: Synthetic polypeptide
DEEEIRTTNPVATEQYGVVSVTVVTNLQQGTEQGTEEEE

SEQ ID NO: 163284 - protein, 30 aa, Artificial Sequence
  Description of Artificial Sequence: Synthetic polypeptide
QESEIASTNPVGTEGYGVMASCTLDQHGDI

SEQ ID NO: 163285 - protein, 33 aa, Artificial Sequence
  Description of Artificial Sequence: Synthetic polypeptide
MENEIRTTNPVATEQWGCVTSEVEMNILEDEAM

SEQ ID NO: 163286 - protein, 36 aa, Artificial Sequence
  Description of Artificial Sequence: Synthetic polypeptide
DEEEIRTTNPVATEFYGVVDNDDENQGQDDNPNGNA

SEQ ID NO: 163287 - protein, 36 aa, Artificial Sequence
  Description of Artificial Sequence: Synthetic polypeptide
DEEEIRTTNPVATEFYGVVDNDGENLGQDQEENGEG

SEQ ID NO: 163288 - protein, 29 aa, Artificial Sequence
  Description of Artificial Sequence: Synthetic peptide
QESEIASTNPVGTEGYGVMASATLQHSDI

SEQ ID NO: 163289 - protein, 38 aa, Artificial Sequence
  Description of Artificial Sequence: Synthetic polypeptide
DTEEIRTTNPVATEQYGVVSTVNQQQNATNEQGTTNME

SEQ ID NO: 163290 - protein, 38 aa, Artificial Sequence
  Description of Artificial Sequence: Synthetic polypeptide
DTEEIRTTNPVATEQYGVVSTVNQQQNATTEQGSTNEQ

SEQ ID NO: 163291 - protein, 38 aa, Artificial Sequence
  Description of Artificial Sequence: Synthetic polypeptide
DTEEIRTTNPVATEQYGVVSTVNQQQNATTEQGTTNDD

SEQ ID NO: 163292 - protein, 32 aa, Artificial Sequence
  Description of Artificial Sequence: Synthetic polypeptide
CEEEIASVNPVCYEQYGVVSCINELSQSGGDQ

SEQ ID NO: 163293 - protein, 28 aa, Artificial Sequence
  Description of Artificial Sequence: Synthetic peptide
QESEIASTNPVGTEGYGVMASELQHKDI

SEQ ID NO: 163294 - protein, 29 aa, Artificial Sequence
  Description of Artificial Sequence: Synthetic peptide
QESEIASTNPVGTEGYGVMASELQIHGDI

SEQ ID NO: 163295 - protein, 36 aa, Artificial Sequence
  Description of Artificial Sequence: Synthetic polypeptide
QEEEIRTTNPVATEQYGTVMTGDNNDQEGEGGGGDT

SEQ ID NO: 163296 - protein, 35 aa, Artificial Sequence
  Description of Artificial Sequence: Synthetic polypeptide
DEESIACTNPVATEQYGSVCATNNSEEDDGAGDNT

SEQ ID NO: 163297 - protein, 35 aa, Artificial Sequence
  Description of Artificial Sequence: Synthetic polypeptide
DEEEIRTTNPVATEQYGSVVHPVMMAGEFGQLSIG

SEQ ID NO: 163298 - protein, 37 aa, Artificial Sequence
  Description of Artificial Sequence: Synthetic polypeptide
DTEEIRTTNPVATEQYGVVSTVTNNQQQQNNNNEDED

SEQ ID NO: 163299 - protein, 30 aa, Artificial Sequence
  Description of Artificial Sequence: Synthetic polypeptide
MENEIRSTNPVATEQWGDVSEIEMNAAEDA

SEQ ID NO: 163300 - protein, 37 aa, Artificial Sequence
  Description of Artificial Sequence: Synthetic polypeptide
DEEEIRTTNPVATEQYGSVVHWTPNVAQPTQMVQEPD

SEQ ID NO: 163301 - protein, 37 aa, Artificial Sequence
  Description of Artificial Sequence: Synthetic polypeptide
DTEEIRTTNPVATEQYGVVSTVTNQQQGTEQGTEEEE

SEQ ID NO: 163302 - protein, 37 aa, Artificial Sequence
  Description of Artificial Sequence: Synthetic polypeptide
DTEEIRTTNPVATEQYGVVSTVTNSNQQEATNVATEE

SEQ ID NO: 163303 - protein, 29 aa, Artificial Sequence
  Description of Artificial Sequence: Synthetic peptide
QESEIASTNPVGTEGYGVMASFLQHFGDI

SEQ ID NO: 163304 - protein, 35 aa, Artificial Sequence
  Description of Artificial Sequence: Synthetic polypeptide
DESEIATTNPVATEQYGSVCAADNHLEAAMMDINM

SEQ ID NO: 163305 - protein, 36 aa, Artificial Sequence
  Description of Artificial Sequence: Synthetic polypeptide
DESEIATTNPVATEQYGSVCAADNGLEAQADAMIRH

SEQ ID NO: 163306 - protein, 39 aa, Artificial Sequence
  Description of Artificial Sequence: Synthetic polypeptide
DEEEIRTTNPVATEQYGVVSVVTNNQQNQQQGTTNNNVE

SEQ ID NO: 163307 - protein, 36 aa, Artificial Sequence
  Description of Artificial Sequence: Synthetic polypeptide
MENEICTTNPVATEQYGSVTVTGGQLQEEMGENGEE

SEQ ID NO: 163308 - protein, 29 aa, Artificial Sequence
  Description of Artificial Sequence: Synthetic peptide
QESEIASTNPVGTEGYGVMASFTLPHGDI

SEQ ID NO: 163309 - protein, 30 aa, Artificial Sequence
  Description of Artificial Sequence: Synthetic polypeptide
QESEIASTNPVGTEGYGVMASFTLPQHGDI

SEQ ID NO: 163310 - protein, 35 aa, Artificial Sequence
  Description of Artificial Sequence: Synthetic polypeptide
DESEIATTNPVATEQYGSVCAADNGLEANAAMIRM

SEQ ID NO: 163311 - protein, 35 aa, Artificial Sequence
  Description of Artificial Sequence: Synthetic polypeptide
DESEIATTNPVATEQYGSVCAADNGLEAGTAMIKH

SEQ ID NO: 163312 - protein, 38 aa, Artificial Sequence
  Description of Artificial Sequence: Synthetic polypeptide
DTEEIRTTNPVATEQYGVVSTVVNNNNQNQQQGNNNED

SEQ ID NO: 163313 - protein, 35 aa, Artificial Sequence
  Description of Artificial Sequence: Synthetic polypeptide
DESEIATTNPVATEQYGSVCAADNGLEADRAMIHH

SEQ ID NO: 163314 - protein, 35 aa, Artificial Sequence
  Description of Artificial Sequence: Synthetic polypeptide
DESEIATTNPVATEQYGSVCAADNGLEADNAMIHH

SEQ ID NO: 163315 - protein, 36 aa, Artificial Sequence
  Description of Artificial Sequence: Synthetic polypeptide
DEMEIATTNPVATEQYGCVCSNTDHNEDHFGSENLF

SEQ ID NO: 163316 - protein, 34 aa, Artificial Sequence
  Description of Artificial Sequence: Synthetic polypeptide
DESEIATTNPVATEQYGSVCAADNGLEAAAMEKH

SEQ ID NO: 163317 - protein, 39 aa, Artificial Sequence
  Description of Artificial Sequence: Synthetic polypeptide
DEEEIRTTNPVATEQYGVVSTVNQNGTEQGSEDGGNTTD

SEQ ID NO: 163318 - protein, 35 aa, Artificial Sequence
  Description of Artificial Sequence: Synthetic polypeptide
DEMEIATTNPVATEQYGCVCSNTDHNEDHSGSEDQ

SEQ ID NO: 163319 - protein, 37 aa, Artificial Sequence
  Description of Artificial Sequence: Synthetic polypeptide
DEAEIRTTNPVATEQWGQVCTPSVDLPQERQNGSENM

SEQ ID NO: 163320 - protein, 35 aa, Artificial Sequence
  Description of Artificial Sequence: Synthetic polypeptide
DEECIRTTNPVATEQWGCVCQTGEHNQEGFNSDQS

SEQ ID NO: 163321 - protein, 36 aa, Artificial Sequence
  Description of Artificial Sequence: Synthetic polypeptide
DESEIATTNPVATEQYGSVCAADNSLEARNAMIGRH

SEQ ID NO: 163322 - protein, 38 aa, Artificial Sequence
  Description of Artificial Sequence: Synthetic polypeptide
DTEEIRTTNPVATEQYGVVSTVNQQQNENAEQGTTNAD

SEQ ID NO: 163323 - protein, 38 aa, Artificial Sequence
  Description of Artificial Sequence: Synthetic polypeptide
DTEEIRTTNPVATEQYGVVSTVNQQQNNNTEQGSTNVD

SEQ ID NO: 163324 - protein, 38 aa, Artificial Sequence
  Description of Artificial Sequence: Synthetic polypeptide
DTEEIRTTNPVATEQYGVVSTVNQQQNNTGEQGSTNQD

SEQ ID NO: 163325 - protein, 34 aa, Artificial Sequence
  Description of Artificial Sequence: Synthetic polypeptide
DEEEIRTTNPVATEFYGVVVDGNMTMEFDGEEGS

SEQ ID NO: 163326 - protein, 36 aa, Artificial Sequence
  Description of Artificial Sequence: Synthetic polypeptide
QEEEIRTTNPVATEQYGSVVVIMNGFGQTEEEFGEI

SEQ ID NO: 163327 - protein, 38 aa, Artificial Sequence
  Description of Artificial Sequence: Synthetic polypeptide
DTEEIRTTNPVATEQYGVVSTVNQQQNTTNEQGSTNVA

SEQ ID NO: 163328 - protein, 38 aa, Artificial Sequence
  Description of Artificial Sequence: Synthetic polypeptide
DTEEIRTTNPVATEQYGVVSTVNQQQNTTTEQGSTNPE

SEQ ID NO: 163329 - protein, 37 aa, Artificial Sequence
  Description of Artificial Sequence: Synthetic polypeptide
DTEEIRTTNPVATEQYGVVSTVNQQQQANNATTNVAE

SEQ ID NO: 163330 - protein, 38 aa, Artificial Sequence
  Description of Artificial Sequence: Synthetic polypeptide
DTEEIRTTNPVATEQYGVVSTVNQQQQGTNEQGSTNVD

SEQ ID NO: 163331 - protein, 37 aa, Artificial Sequence
  Description of Artificial Sequence: Synthetic polypeptide
DTEEIRTTNPVATEQYGVVSTVNQQQQQINTTTNVAE

SEQ ID NO: 163332 - protein, 38 aa, Artificial Sequence
  Description of Artificial Sequence: Synthetic polypeptide
DTEEIRTTNPVATEQYGVVSTVNQQQSTTTEQGTTNAD

SEQ ID NO: 163333 - protein, 38 aa, Artificial Sequence
  Description of Artificial Sequence: Synthetic polypeptide
DEEEIRTTNPVATEPYGSVCVFWNYELATQRAGQVGVV

SEQ ID NO: 163334 - protein, 34 aa, Artificial Sequence
  Description of Artificial Sequence: Synthetic polypeptide
DECEIATTNPVAYERWGSVSGGNGNAGENDGQRP

SEQ ID NO: 163335 - protein, 35 aa, Artificial Sequence
  Description of Artificial Sequence: Synthetic polypeptide
DEMEIATTNPVATEQYGCVCSNTEHNEEHFNSEDL

SEQ ID NO: 163336 - protein, 31 aa, Artificial Sequence
  Description of Artificial Sequence: Synthetic polypeptide
DDSEVASTNPVSTEGYGNVAQNTIQSRVGQR

SEQ ID NO: 163337 - protein, 29 aa, Artificial Sequence
  Description of Artificial Sequence: Synthetic peptide
QESEIASTNPVGTEGYGVMASDTEQHGDI

SEQ ID NO: 163338 - protein, 37 aa, Artificial Sequence
  Description of Artificial Sequence: Synthetic polypeptide
DTEEIRTTNPVATEQYGVVSTVTNDQNGTEQGTEEDE

SEQ ID NO: 163339 - protein, 35 aa, Artificial Sequence
  Description of Artificial Sequence: Synthetic polypeptide
DEEEIRTTNPVATEFYGVVVGDGGQIEDGGGNNGP

SEQ ID NO: 163340 - protein, 34 aa, Artificial Sequence
  Description of Artificial Sequence: Synthetic polypeptide
DAEEIATTNPVAYEQYGSVATPHGQAVPGDSVDN

SEQ ID NO: 163341 - protein, 31 aa, Artificial Sequence
  Description of Artificial Sequence: Synthetic polypeptide
DDSEVASTNPVSTEGYGNVASNPIQSRVGQR

SEQ ID NO: 163342 - protein, 37 aa, Artificial Sequence
  Description of Artificial Sequence: Synthetic polypeptide
DEEEIRTTNPVATEQYGVVSVVNVATEQYGSTEQQDE

SEQ ID NO: 163343 - protein, 31 aa, Artificial Sequence
  Description of Artificial Sequence: Synthetic polypeptide
DDSEVASTNPVSTEGYGNVASNTIQSRVGQR

SEQ ID NO: 163344 - protein, 35 aa, Artificial Sequence
  Description of Artificial Sequence: Synthetic polypeptide
DESEIATTNPVATEQYGSVCAATMGEEAGDNMNGN

SEQ ID NO: 163345 - protein, 33 aa, Artificial Sequence
  Description of Artificial Sequence: Synthetic polypeptide
MENEIRTTNPVATEFYGSVVDGFNGGNDTDGDP

SEQ ID NO: 163346 - protein, 31 aa, Artificial Sequence
  Description of Artificial Sequence: Synthetic polypeptide
DDSEVASTNPVSTEGYGNVATMTIQSRVGQR

SEQ ID NO: 163347 - protein, 34 aa, Artificial Sequence
  Description of Artificial Sequence: Synthetic polypeptide
DEECIRTTNPVATEQWGCVCQTGEHNIGFGSDQS

SEQ ID NO: 163348 - protein, 32 aa, Artificial Sequence
  Description of Artificial Sequence: Synthetic polypeptide
DDSEVASTNPVSTEGYGNVATNPTIQSRVGQR

SEQ ID NO: 163349 - protein, 35 aa, Artificial Sequence
  Description of Artificial Sequence: Synthetic polypeptide
MEHEIATVNPAATEQYGSVIITNGLGGGQEGGENQ

SEQ ID NO: 163350 - protein, 40 aa, Artificial Sequence
  Description of Artificial Sequence: Synthetic polypeptide
DEEEIRTTNPVATEQYGVVSTVNLQAGNNDEQGTNNNTTE

SEQ ID NO: 163351 - protein, 35 aa, Artificial Sequence
  Description of Artificial Sequence: Synthetic polypeptide
MEHEIATVNPAATEQYGSVIITNGLGGGQEGGENG

SEQ ID NO: 163352 - protein, 35 aa, Artificial Sequence
  Description of Artificial Sequence: Synthetic polypeptide
DEEEIRTTNPVATEPYGSVCFNNAWSTDTGGTPTN

SEQ ID NO: 163353 - protein, 31 aa, Artificial Sequence
  Description of Artificial Sequence: Synthetic polypeptide
DENEIATTNPVAYEQWGTVSKEIEDNGKEDH

SEQ ID NO: 163354 - protein, 31 aa, Artificial Sequence
  Description of Artificial Sequence: Synthetic polypeptide
DENEIATTNPVAYEQWGTVSKEINMNGAEDA

SEQ ID NO: 163355 - protein, 33 aa, Artificial Sequence
  Description of Artificial Sequence: Synthetic polypeptide
DENEIATTNPVAYEQWGVSWSLDNMEDRHDSNE

SEQ ID NO: 163356 - protein, 32 aa, Artificial Sequence
  Description of Artificial Sequence: Synthetic polypeptide
DENEIRTTNPVATEQWGDTTSAIEMNAKEDYI

SEQ ID NO: 163357 - protein, 29 aa, Artificial Sequence
  Description of Artificial Sequence: Synthetic peptide
QESEIASTNPVGTEGYGVMASTEQHGDHI

SEQ ID NO: 163358 - protein, 36 aa, Artificial Sequence
  Description of Artificial Sequence: Synthetic polypeptide
DEECIRTTNPVATEQYGCVCSTWGEHNDENFGSQQS

SEQ ID NO: 163359 - protein, 33 aa, Artificial Sequence
  Description of Artificial Sequence: Synthetic polypeptide
DENEIRTTNPVATEQWGDSVMSEIMEMNAAEDA

SEQ ID NO: 163360 - protein, 33 aa, Artificial Sequence
  Description of Artificial Sequence: Synthetic polypeptide
DVSEIRTTNPVATLCWGSVACINEPQDKLGENG

SEQ ID NO: 163361 - protein, 31 aa, Artificial Sequence
  Description of Artificial Sequence: Synthetic polypeptide
DENEIRTTNPVATEQWGDSSCEIEMNAAEDA

SEQ ID NO: 163362 - protein, 32 aa, Artificial Sequence
  Description of Artificial Sequence: Synthetic polypeptide
DENEIATTNPVAYEQWGYCQEDKKRGDDNRGK

SEQ ID NO: 163363 - protein, 36 aa, Artificial Sequence
  Description of Artificial Sequence: Synthetic polypeptide
DEEEIRTTNPVATEQYGQCVCSWEEHNQNFNSENQQ

SEQ ID NO: 163364 - protein, 35 aa, Artificial Sequence
  Description of Artificial Sequence: Synthetic polypeptide
DEECIRTTNPVATEQYGCVCSWEDHQENFGSDTQA

SEQ ID NO: 163365 - protein, 35 aa, Artificial Sequence
  Description of Artificial Sequence: Synthetic polypeptide
MEGEIRTTNPVATEQYGSVSVPCLLTDEESGEMVQ

SEQ ID NO: 163366 - protein, 32 aa, Artificial Sequence
  Description of Artificial Sequence: Synthetic polypeptide
DENEIRTTNPVATEQWGDRVSEIMEMNAAEDA

SEQ ID NO: 163367 - protein, 34 aa, Artificial Sequence
  Description of Artificial Sequence: Synthetic polypeptide
DENEIATTNPVAYEQYGCVAGTGLDNRGGEMLMW

SEQ ID NO: 163368 - protein, 36 aa, Artificial Sequence
  Description of Artificial Sequence: Synthetic polypeptide
DECEIATTNPVAYEQWGSVSIPNAGDDQDRQGDSGR

SEQ ID NO: 163369 - protein, 36 aa, Artificial Sequence
  Description of Artificial Sequence: Synthetic polypeptide
DDEEISTTNPVATEQYGCVCSMTMEHNQNFGSDNQS

SEQ ID NO: 163370 - protein, 31 aa, Artificial Sequence
  Description of Artificial Sequence: Synthetic polypeptide
DDSEVASTNPVSTEGYGNVSAETIQSRVGGR

SEQ ID NO: 163371 - protein, 34 aa, Artificial Sequence
  Description of Artificial Sequence: Synthetic polypeptide
DEECIRTTNPVATEQYGCVCSWEDQEFFISDTQS

SEQ ID NO: 163372 - protein, 33 aa, Artificial Sequence
  Description of Artificial Sequence: Synthetic polypeptide
DECEIATTNPVAYEQWGSVSGPNGNAGEGDATT

SEQ ID NO: 163373 - protein, 31 aa, Artificial Sequence
  Description of Artificial Sequence: Synthetic polypeptide
DENEIRTTNPVATEQWGDRSEGIEMNAAEDA

SEQ ID NO: 163374 - protein, 32 aa, Artificial Sequence
  Description of Artificial Sequence: Synthetic polypeptide
DENEIRTTNPVATEQWGDQVSGEIEMNAAEDA

SEQ ID NO: 163375 - protein, 36 aa, Artificial Sequence
  Description of Artificial Sequence: Synthetic polypeptide
QEEEIRTTNPVCYEPYGSVSCDLNFSQNRNGGNNDM

SEQ ID NO: 163376 - protein, 33 aa, Artificial Sequence
  Description of Artificial Sequence: Synthetic polypeptide
DEMEIATTNPVATCQYGCVCSWAHNQNFNSDQS

SEQ ID NO: 163377 - protein, 37 aa, Artificial Sequence
  Description of Artificial Sequence: Synthetic polypeptide
DEESICTVNPVATEAYGSVSTVVNLQQGNNQGNEDTE

SEQ ID NO: 163378 - protein, 33 aa, Artificial Sequence
  Description of Artificial Sequence: Synthetic polypeptide
EAEAEIATTNPVAYEQWGSVSGGDLGGTNGNTE

SEQ ID NO: 163379 - protein, 37 aa, Artificial Sequence
  Description of Artificial Sequence: Synthetic polypeptide
DEEEIRTTNPVATEQYGQCVCSWEEHNTENFGSDNQS

SEQ ID NO: 163380 - protein, 30 aa, Artificial Sequence
  Description of Artificial Sequence: Synthetic polypeptide
DENEIRTTNPVATEQWGDMWEIEMNAAEDA

SEQ ID NO: 163381 - protein, 36 aa, Artificial Sequence
  Description of Artificial Sequence: Synthetic polypeptide
MEGEIRTTNPVATEQYGSVSVPDTGVIDSTEGVQNN

SEQ ID NO: 163382 - protein, 37 aa, Artificial Sequence
  Description of Artificial Sequence: Synthetic polypeptide
DEEEIRTTNPVATEQYGQCVCSWEEHNQENFGSNNQS

SEQ ID NO: 163383 - protein, 36 aa, Artificial Sequence
  Description of Artificial Sequence: Synthetic polypeptide
DEECIRTTNPVATEQYGCVCSTTGEENAENFGSDQS

SEQ ID NO: 163384 - protein, 33 aa, Artificial Sequence
  Description of Artificial Sequence: Synthetic polypeptide
DENEIRTTNPVATEQWGDTVSNEEIEMNPAEPI

SEQ ID NO: 163385 - protein, 35 aa, Artificial Sequence
  Description of Artificial Sequence: Synthetic polypeptide
QEEEIRTTNPVAYEQYGTTISCTVNSTSQTSTENP

SEQ ID NO: 163386 - protein, 38 aa, Artificial Sequence
  Description of Artificial Sequence: Synthetic polypeptide
DEEEIRTTNPVATEQYGVVSTVNQEQGVNNQQGTEEQE

SEQ ID NO: 163387 - protein, 36 aa, Artificial Sequence
  Description of Artificial Sequence: Synthetic polypeptide
DTTEIRTTNPVATEQYGVVSTTNNQGNQLQGEEEAE

SEQ ID NO: 163388 - protein, 35 aa, Artificial Sequence
  Description of Artificial Sequence: Synthetic polypeptide
DESEIATTNPVATEQWGSVSACINEPQDHEGEEDG

SEQ ID NO: 163389 - protein, 34 aa, Artificial Sequence
  Description of Artificial Sequence: Synthetic polypeptide
DESEIATTNPVATEQWGSVSACDEPEDHEGENDL

SEQ ID NO: 163390 - protein, 37 aa, Artificial Sequence
  Description of Artificial Sequence: Synthetic polypeptide
DTTEIRTTNPVATEQYGVVSTTVNQQQLLLQGTEENE

SEQ ID NO: 163391 - protein, 37 aa, Artificial Sequence
  Description of Artificial Sequence: Synthetic polypeptide
DTTEIRTTNPVATEQYGVVSTTVNTNNQQLGGNQQAE

SEQ ID NO: 163392 - protein, 37 aa, Artificial Sequence
  Description of Artificial Sequence: Synthetic polypeptide
DTTEIRTTNPVATEQYGVVSTTVNTNNQQLNGNDEAS

SEQ ID NO: 163393 - protein, 32 aa, Artificial Sequence
  Description of Artificial Sequence: Synthetic polypeptide
DENEIRTTNPVATEQWGDTVSEEIEMNPAEPI

SEQ ID NO: 163394 - protein, 35 aa, Artificial Sequence
  Description of Artificial Sequence: Synthetic polypeptide
DENEIRTTNPVATEQWGDTVSCEIESDNAAEGDNA

SEQ ID NO: 163395 - protein, 36 aa, Artificial Sequence
  Description of Artificial Sequence: Synthetic polypeptide
DEECIRTTNPVATEQYGCVCSTTPAHNNEYSGSDPV

SEQ ID NO: 163396 - protein, 35 aa, Artificial Sequence
  Description of Artificial Sequence: Synthetic polypeptide
QEEEIRTTNPVCYEPYGKVSCDLNFSLNPQGGNND

SEQ ID NO: 163397 - protein, 37 aa, Artificial Sequence
  Description of Artificial Sequence: Synthetic polypeptide
DTTEIRTTNPVATEQYGVVSVVVTVNNDQLAGNQEQS

SEQ ID NO: 163398 - protein, 38 aa, Artificial Sequence
  Description of Artificial Sequence: Synthetic polypeptide
DEEEIRTTNPVATEQYGVVSVVVNTQQQQQGTNVATNE

SEQ ID NO: 163399 - protein, 37 aa, Artificial Sequence
  Description of Artificial Sequence: Synthetic polypeptide
DEECIRTTNPVATEQYGCVCSTTPAHNAERSGSDPVS

SEQ ID NO: 163400 - protein, 35 aa, Artificial Sequence
  Description of Artificial Sequence: Synthetic polypeptide
DEEEIATTNPVATEQYGSVCAQDGLENDDDLGAQA

SEQ ID NO: 163401 - protein, 36 aa, Artificial Sequence
  Description of Artificial Sequence: Synthetic polypeptide
DEEEIRTTNPVATEQYGQCVCSWEEDHNQFFGSDQS

SEQ ID NO: 163402 - protein, 30 aa, Artificial Sequence
  Description of Artificial Sequence: Synthetic polypeptide
QESEIASTNPVGTEGYGVMASTEPQDHGDI

SEQ ID NO: 163403 - protein, 35 aa, Artificial Sequence
  Description of Artificial Sequence: Synthetic polypeptide
MEGEIRTTNPVATEQYGSVSVSFDLQPMEVQADII

SEQ ID NO: 163404 - protein, 29 aa, Artificial Sequence
  Description of Artificial Sequence: Synthetic peptide
QESEIASTNPVGTEGYGVMASTEQHAGDI

SEQ ID NO: 163405 - protein, 34 aa, Artificial Sequence
  Description of Artificial Sequence: Synthetic polypeptide
DVEEIRTTNPVATEQYGSASASGEEHVENENNQD

SEQ ID NO: 163406 - protein, 33 aa, Artificial Sequence
  Description of Artificial Sequence: Synthetic polypeptide
DENEIATTNPVAYEQWGSVCAAANGLQSEQDDS

SEQ ID NO: 163407 - protein, 36 aa, Artificial Sequence
  Description of Artificial Sequence: Synthetic polypeptide
DEEEIRTTNPVATEQYGQCVCSWEEHNQEHFNSDQA

SEQ ID NO: 163408 - protein, 35 aa, Artificial Sequence
  Description of Artificial Sequence: Synthetic polypeptide
MEGEIRTTNPVATEQYGSVSVPNNIADSSEMSANE

SEQ ID NO: 163409 - protein, 34 aa, Artificial Sequence
  Description of Artificial Sequence: Synthetic polypeptide
CEEEIACTNPVATEQYGCVAGTNSHQEADMLIND

SEQ ID NO: 163410 - protein, 29 aa, Artificial Sequence
  Description of Artificial Sequence: Synthetic peptide
QESEIASTNPVGTEGYGVMASTEQHGEDI

SEQ ID NO: 163411 - protein, 31 aa, Artificial Sequence
  Description of Artificial Sequence: Synthetic polypeptide
DENEIRTTNPVATEQWGDMVWEIEMNAAEDA

SEQ ID NO: 163412 - protein, 38 aa, Artificial Sequence
  Description of Artificial Sequence: Synthetic polypeptide
DEEEIRTTNPVATEQYGVVSVVVSNLGQQGSEYGSVQE

SEQ ID NO: 163413 - protein, 35 aa, Artificial Sequence
  Description of Artificial Sequence: Synthetic polypeptide
DDEEISTTNPVATEQYGCVCSMTEDQENFGSDTQA

SEQ ID NO: 163414 - protein, 38 aa, Artificial Sequence
  Description of Artificial Sequence: Synthetic polypeptide
DEEEIRTTNPVATQQYGSVSSTTPAYGPNMRNGMNPVP

SEQ ID NO: 163415 - protein, 35 aa, Artificial Sequence
  Description of Artificial Sequence: Synthetic polypeptide
DEECIRTTNPVATEQYGCVCSWGEENAENFNSNQS

SEQ ID NO: 163416 - protein, 37 aa, Artificial Sequence
  Description of Artificial Sequence: Synthetic polypeptide
MEGEIRTTNPVATEQYGSVSSPTPEGPNMDFGENPVT

SEQ ID NO: 163417 - protein, 31 aa, Artificial Sequence
  Description of Artificial Sequence: Synthetic polypeptide
DENEIRTTNPVATEQWGDISMEIEMNAAEDA

SEQ ID NO: 163418 - protein, 36 aa, Artificial Sequence
  Description of Artificial Sequence: Synthetic polypeptide
MEGEIRTTNPVATEQYGSVSSPTPAGPNVNFFENNT

SEQ ID NO: 163419 - protein, 37 aa, Artificial Sequence
  Description of Artificial Sequence: Synthetic polypeptide
DEEEIRTTNPVATEQYGSVVMGINIMTIEEPEQEGTP

SEQ ID NO: 163420 - protein, 36 aa, Artificial Sequence
  Description of Artificial Sequence: Synthetic polypeptide
MEGEIRTTNPVATEQYGSVSSPTPAGPNMRFEDGPV

SEQ ID NO: 163421 - protein, 35 aa, Artificial Sequence
  Description of Artificial Sequence: Synthetic polypeptide
AEAEIRTTNPVATEQYGCVCSTEHNAENFNSQFQA

SEQ ID NO: 163422 - protein, 31 aa, Artificial Sequence
  Description of Artificial Sequence: Synthetic polypeptide
DENEIRTTNPVATEQWGDISEEIEMNAAEDA

SEQ ID NO: 163423 - protein, 32 aa, Artificial Sequence
  Description of Artificial Sequence: Synthetic polypeptide
DENEIRTTNPVATEQWGDHVQSEIEMNAAEDA

SEQ ID NO: 163424 - protein, 37 aa, Artificial Sequence
  Description of Artificial Sequence: Synthetic polypeptide
EDEEICTTNPVATEQYGVVSTTNNNQLQQLGGGNNDD

SEQ ID NO: 163425 - protein, 35 aa, Artificial Sequence
  Description of Artificial Sequence: Synthetic polypeptide
EDEEICTTNPVATEQWGTVSTVNLQQNEQGTEEEN

SEQ ID NO: 163426 - protein, 37 aa, Artificial Sequence
  Description of Artificial Sequence: Synthetic polypeptide
EDEEICTTNPVATEQYGVVSTTNNQQLQQGTGNNNDD

SEQ ID NO: 163427 - protein, 35 aa, Artificial Sequence
  Description of Artificial Sequence: Synthetic polypeptide
DEECIRTTNPVATEQYGCVCSWGEHNQENFNSEQS

SEQ ID NO: 163428 - protein, 35 aa, Artificial Sequence
  Description of Artificial Sequence: Synthetic polypeptide
DAEEIATTNPVATEQYGSVCSANPGADNDVGPAEM

SEQ ID NO: 163429 - protein, 33 aa, Artificial Sequence
  Description of Artificial Sequence: Synthetic polypeptide
DESEIATTNPVATEGYGTVCSANDGPVEFEGQD

SEQ ID NO: 163430 - protein, 33 aa, Artificial Sequence
  Description of Artificial Sequence: Synthetic polypeptide
DECEIATTNPVAYEQWGSVCDGDDLRNNQGGHA

SEQ ID NO: 163431 - protein, 37 aa, Artificial Sequence
  Description of Artificial Sequence: Synthetic polypeptide
MEGEIRTTNPVATEQYGSVSSPTPAGPNMEFGENNAI

SEQ ID NO: 163432 - protein, 36 aa, Artificial Sequence
  Description of Artificial Sequence: Synthetic polypeptide
MEGEIRTTNPVATEQYGSVSSPTPAGPNERFNENPV

SEQ ID NO: 163433 - protein, 36 aa, Artificial Sequence
  Description of Artificial Sequence: Synthetic polypeptide
DEEEIRTTNPVATEGYGCVCSNTGEDHNQNFGSEQS

SEQ ID NO: 163434 - protein, 35 aa, Artificial Sequence
  Description of Artificial Sequence: Synthetic polypeptide
EDEEICTTNPVATTQYGSVSTNQQGNGQQGTTEQG

SEQ ID NO: 163435 - protein, 38 aa, Artificial Sequence
  Description of Artificial Sequence: Synthetic polypeptide
DEEEIRTTNPVATEQYGVVSVVVSNLNQAGSEEGSVSE

SEQ ID NO: 163436 - protein, 36 aa, Artificial Sequence
  Description of Artificial Sequence: Synthetic polypeptide
DEEEIRTTNPVATEQYGQCVCSWGEDDQENFGSEQS

SEQ ID NO: 163437 - protein, 36 aa, Artificial Sequence
  Description of Artificial Sequence: Synthetic polypeptide
DEEEIRTTNPVATNQYGSVVCCVDLNQPNNSQIDSQ

SEQ ID NO: 163438 - protein, 38 aa, Artificial Sequence
  Description of Artificial Sequence: Synthetic polypeptide
DEEEIRTTNPVATEQYGVVSVVVSNLQAGISEAGSTVQ

SEQ ID NO: 163439 - protein, 32 aa, Artificial Sequence
  Description of Artificial Sequence: Synthetic polypeptide
DDSEVASTNPVSTEGYGNVSANTEPQSRVGQR

SEQ ID NO: 163440 - protein, 32 aa, Artificial Sequence
  Description of Artificial Sequence: Synthetic polypeptide
DENEIRTTNPVATEQWGDISMEIIQMNAAEDA

SEQ ID NO: 163441 - protein, 35 aa, Artificial Sequence
  Description of Artificial Sequence: Synthetic polypeptide
EDEEICTTNPVATEQWGTVSTTTNLNLEQGTNAEQ

SEQ ID NO: 163442 - protein, 33 aa, Artificial Sequence
  Description of Artificial Sequence: Synthetic polypeptide
DECEIATTNPVAYEQWGSVCWGENDQHLTNDHP

SEQ ID NO: 163443 - protein, 31 aa, Artificial Sequence
  Description of Artificial Sequence: Synthetic polypeptide
DDSEVASTNPVSTEGYGNVSANDIQSHEGER

SEQ ID NO: 163444 - protein, 33 aa, Artificial Sequence
  Description of Artificial Sequence: Synthetic polypeptide
EASEIATTNPVAYEQWGSVCTENKLDDLGGMDR

SEQ ID NO: 163445 - protein, 36 aa, Artificial Sequence
  Description of Artificial Sequence: Synthetic polypeptide
DDEEISTTNPVATEQYGCVCSMTGEHNANFGSDNQA

SEQ ID NO: 163446 - protein, 37 aa, Artificial Sequence
  Description of Artificial Sequence: Synthetic polypeptide
MEGEIRTTNPVATEQYGSVSSTWPAGPNERFEGNDSA

SEQ ID NO: 163447 - protein, 35 aa, Artificial Sequence
  Description of Artificial Sequence: Synthetic polypeptide
DENEIATTNPVAYEQYGSACSANDQQEHQDGTARK

SEQ ID NO: 163448 - protein, 35 aa, Artificial Sequence
  Description of Artificial Sequence: Synthetic polypeptide
DDEEISTTNPVATEQYGCVCSMTEEHQNFGSDTQS

SEQ ID NO: 163449 - protein, 36 aa, Artificial Sequence
  Description of Artificial Sequence: Synthetic polypeptide
DEEEIRTTNPVATEQYGQCVCSWEHNEEHFNSENQA

SEQ ID NO: 163450 - protein, 36 aa, Artificial Sequence
  Description of Artificial Sequence: Synthetic polypeptide
DEEEIRTTNPVATEQYGQCVCSWEHNQENFNSNNQM

SEQ ID NO: 163451 - protein, 36 aa, Artificial Sequence
  Description of Artificial Sequence: Synthetic polypeptide
MEGEIRTTNPVATEQYGSVSSTTAAGPNEHFEMNDV

SEQ ID NO: 163452 - protein, 32 aa, Artificial Sequence
  Description of Artificial Sequence: Synthetic polypeptide
DDSEVASTNPVSTEGYGNVSANDLQSHVGEDR

SEQ ID NO: 163453 - protein, 36 aa, Artificial Sequence
  Description of Artificial Sequence: Synthetic polypeptide
DEECIRTTNPVATEQYGCVCSWEEHDQENFGSENQP

SEQ ID NO: 163454 - protein, 37 aa, Artificial Sequence
  Description of Artificial Sequence: Synthetic polypeptide
MEGEIRTTNPVATEQYGSVSSTNPVGPNERFEMNDVA

SEQ ID NO: 163455 - protein, 35 aa, Artificial Sequence
  Description of Artificial Sequence: Synthetic polypeptide
DEECIRTTNPVATEQYGCVCSWEEHNQENFNSDQS

SEQ ID NO: 163456 - protein, 37 aa, Artificial Sequence
  Description of Artificial Sequence: Synthetic polypeptide
MEGEIRTTNPVATEQYGSVSSTNMAGPNERFEMNYVK

SEQ ID NO: 163457 - protein, 35 aa, Artificial Sequence
  Description of Artificial Sequence: Synthetic polypeptide
DEECIRTTNPVATEQYGCVCSWEHNAENFGSDTQS

SEQ ID NO: 163458 - protein, 38 aa, Artificial Sequence
  Description of Artificial Sequence: Synthetic polypeptide
DEEEIRTTNPVATSQYGCSTVSSTTPAGPNMRNGMNPV

SEQ ID NO: 163459 - protein, 32 aa, Artificial Sequence
  Description of Artificial Sequence: Synthetic polypeptide
CEEEIACTNPVATEQYGCVAPIHGLDSEGEDE

SEQ ID NO: 163460 - protein, 34 aa, Artificial Sequence
  Description of Artificial Sequence: Synthetic polypeptide
EDEEICTTNPVATEQWGTVSTNSNNDEQGTNAEE

SEQ ID NO: 163461 - protein, 33 aa, Artificial Sequence
  Description of Artificial Sequence: Synthetic polypeptide
CEEEIACTNPVATEQYGCVATNLADAPAEATAP

SEQ ID NO: 163462 - protein, 35 aa, Artificial Sequence
  Description of Artificial Sequence: Synthetic polypeptide
DEEEIRTTNPVATEGYGCVCSNSGEHNQNFGSEQS

SEQ ID NO: 163463 - protein, 35 aa, Artificial Sequence
  Description of Artificial Sequence: Synthetic polypeptide
CEEEIACTNPVAYEQYGSVCSTNPAQQEHQDGTMK

SEQ ID NO: 163464 - protein, 35 aa, Artificial Sequence
  Description of Artificial Sequence: Synthetic polypeptide
QEEEIRTTNPVCYEPYGTVSCDLAFSQNRNGGNND

SEQ ID NO: 163465 - protein, 32 aa, Artificial Sequence
  Description of Artificial Sequence: Synthetic polypeptide
DDSEVASTNPVSTEGYGNVSANITIQDRVGQR

SEQ ID NO: 163466 - protein, 32 aa, Artificial Sequence
  Description of Artificial Sequence: Synthetic polypeptide
DENEIRTTNPVATEQWGDKVSEIEDMNAAEDA

SEQ ID NO: 163467 - protein, 31 aa, Artificial Sequence
  Description of Artificial Sequence: Synthetic polypeptide
DENEIRTTNPVATEQWGDKFSEIEMNAAEDA

SEQ ID NO: 163468 - protein, 37 aa, Artificial Sequence
  Description of Artificial Sequence: Synthetic polypeptide
MEGEIRTTNPVATEQYGSVSSTNMAGPNERFEMNDTA

SEQ ID NO: 163469 - protein, 31 aa, Artificial Sequence
  Description of Artificial Sequence: Synthetic polypeptide
DENEIRTTNPVATEQWGDKFSEIDMNAAEDA

SEQ ID NO: 163470 - protein, 34 aa, Artificial Sequence
  Description of Artificial Sequence: Synthetic polypeptide
MEGEIRTTNPVATEQYGSVTFEAMQQETDNEVEN

SEQ ID NO: 163471 - protein, 38 aa, Artificial Sequence
  Description of Artificial Sequence: Synthetic polypeptide
DTEEIRTTNPVATEQYGVVSTTNQQQGNTEAGNNNQED

SEQ ID NO: 163472 - protein, 35 aa, Artificial Sequence
  Description of Artificial Sequence: Synthetic polypeptide
MEGEIRTTNPVATEQYGSVTMEAMGQEETGNEEEN

SEQ ID NO: 163473 - protein, 32 aa, Artificial Sequence
  Description of Artificial Sequence: Synthetic polypeptide
DENEIRTTNPVATEQWGDTVWSEIEMNAAEPA

SEQ ID NO: 163474 - protein, 33 aa, Artificial Sequence
  Description of Artificial Sequence: Synthetic polypeptide
DTMEIVTTNPVACEQYGTVCSATDGPVEFEGND

SEQ ID NO: 163475 - protein, 33 aa, Artificial Sequence
  Description of Artificial Sequence: Synthetic polypeptide
DTMEIVTTNPVATEQYGTVCHATDGPVEFEGND

SEQ ID NO: 163476 - protein, 36 aa, Artificial Sequence
  Description of Artificial Sequence: Synthetic polypeptide
DECEIATTNPVAYEQYGTVCSYTDGLREEHRGDNDS

SEQ ID NO: 163477 - protein, 35 aa, Artificial Sequence
  Description of Artificial Sequence: Synthetic polypeptide
DEEEIRTTNPVATEGYGCVCFTEDHNTENFGSDQS

SEQ ID NO: 163478 - protein, 29 aa, Artificial Sequence
  Description of Artificial Sequence: Synthetic peptide
QESEIASTNPVGTEGYGVMASSLQHEGDI

SEQ ID NO: 163479 - protein, 29 aa, Artificial Sequence
  Description of Artificial Sequence: Synthetic peptide
QESEIASTNPVGTEGYGVMASSLQHGDIT

SEQ ID NO: 163480 - protein, 36 aa, Artificial Sequence
  Description of Artificial Sequence: Synthetic polypeptide
DEEEIRGTNPVATEQYGSVTPVPNEMFGNVGQVQVD

SEQ ID NO: 163481 - protein, 29 aa, Artificial Sequence
  Description of Artificial Sequence: Synthetic peptide
QESEIASTNPVGTEGYGVMASSLQHIGDI

SEQ ID NO: 163482 - protein, 28 aa, Artificial Sequence
  Description of Artificial Sequence: Synthetic peptide
QESEIASTNPVGTEGYGVMASSLRHGDI

SEQ ID NO: 163483 - protein, 33 aa, Artificial Sequence
  Description of Artificial Sequence: Synthetic polypeptide
DEGEIATTNPVAYEQYGSVCSPPGGAEAPNENQ

SEQ ID NO: 163484 - protein, 30 aa, Artificial Sequence
  Description of Artificial Sequence: Synthetic polypeptide
DTNEIRTTNPIATEQWGDVSEIEMNAAEDA

SEQ ID NO: 163485 - protein, 31 aa, Artificial Sequence
  Description of Artificial Sequence: Synthetic polypeptide
DTNEIRTTNPVATEQWGDVLSEIEMNAAEDA

SEQ ID NO: 163486 - protein, 38 aa, Artificial Sequence
  Description of Artificial Sequence: Synthetic polypeptide
DEEEIRTTNPVATEQYGVVSTVNQNGNNNNEQGTDEGD

SEQ ID NO: 163487 - protein, 31 aa, Artificial Sequence
  Description of Artificial Sequence: Synthetic polypeptide
DTNEIRTTNPVATEQWGDVSEIIEMNAAEDA

SEQ ID NO: 163488 - protein, 36 aa, Artificial Sequence
  Description of Artificial Sequence: Synthetic polypeptide
DEEEIRTTNPVATEQYGQCVCSTTEDHQENFISDQA

SEQ ID NO: 163489 - protein, 30 aa, Artificial Sequence
  Description of Artificial Sequence: Synthetic polypeptide
QESEIASTNPVGTEGYGVMASSTLQHGDII

SEQ ID NO: 163490 - protein, 36 aa, Artificial Sequence
  Description of Artificial Sequence: Synthetic polypeptide
DTNEIRTTNPVATEQYGTVTTWWLPDEGENLQIDER

SEQ ID NO: 163491 - protein, 31 aa, Artificial Sequence
  Description of Artificial Sequence: Synthetic polypeptide
DDSEVASTNPVSTEGYGNVGANTIQSRVGQR

SEQ ID NO: 163492 - protein, 37 aa, Artificial Sequence
  Description of Artificial Sequence: Synthetic polypeptide
DEEEIRTTNPVATEQYGQCVCSTTGEHDQENFGSDQS

SEQ ID NO: 163493 - protein, 34 aa, Artificial Sequence
  Description of Artificial Sequence: Synthetic polypeptide
MEGEIRTTNPVATEQYGSWSCVDMDENNEEIGPD

SEQ ID NO: 163494 - protein, 32 aa, Artificial Sequence
  Description of Artificial Sequence: Synthetic polypeptide
DTNEIRTTNPVSTEPYGTISMEDIQQQQNGNH

SEQ ID NO: 163495 - protein, 36 aa, Artificial Sequence
  Description of Artificial Sequence: Synthetic polypeptide
DEEEIRTTNPVATEQYGSVEPANTHPPIMAQEVLEL

SEQ ID NO: 163496 - protein, 35 aa, Artificial Sequence
  Description of Artificial Sequence: Synthetic polypeptide
DEEEIRTTNPVATEGYGCVCFTGEDNTEYFNSDQA

SEQ ID NO: 163497 - protein, 34 aa, Artificial Sequence
  Description of Artificial Sequence: Synthetic polypeptide
DEEEIRTTNPVATEGYGCVCFTGEDNTNFNSDQS

SEQ ID NO: 163498 - protein, 36 aa, Artificial Sequence
  Description of Artificial Sequence: Synthetic polypeptide
DECEIATTNPVAYEQYGTVCSYTDGLNEESRGQNDS

SEQ ID NO: 163499 - protein, 33 aa, Artificial Sequence
  Description of Artificial Sequence: Synthetic polypeptide
DESEIATTNPVATEQWGTVCSCTDGVSEFEGSD

SEQ ID NO: 163500 - protein, 35 aa, Artificial Sequence
  Description of Artificial Sequence: Synthetic polypeptide
DEAEIACTNPVATEQYGSVAATENLEAGEQGEEAM

SEQ ID NO: 163501 - protein, 35 aa, Artificial Sequence
  Description of Artificial Sequence: Synthetic polypeptide
QEEEIRTTNPVAYEAYGTICSCTVNELSQTSTENP

SEQ ID NO: 163502 - protein, 29 aa, Artificial Sequence
  Description of Artificial Sequence: Synthetic peptide
QESEIASTNPVGTEGYGVMASQLQFHGDI

SEQ ID NO: 163503 - protein, 35 aa, Artificial Sequence
  Description of Artificial Sequence: Synthetic polypeptide
DEGEIATTNPVAYEQYGSVCTANGGQESPGDQLAK

SEQ ID NO: 163504 - protein, 34 aa, Artificial Sequence
  Description of Artificial Sequence: Synthetic polypeptide
DEGEIATTNPVAYEQYGSVSNAGNLEMTMIQDSQ

SEQ ID NO: 163505 - protein, 37 aa, Artificial Sequence
  Description of Artificial Sequence: Synthetic polypeptide
DEEEIRTTNPVATEQYGQCVCSTMEDHQESFNSDTQS

SEQ ID NO: 163506 - protein, 32 aa, Artificial Sequence
  Description of Artificial Sequence: Synthetic polypeptide
DEESIATTNPVAYECWGSVYNWPNDHEREGHM

SEQ ID NO: 163507 - protein, 37 aa, Artificial Sequence
  Description of Artificial Sequence: Synthetic polypeptide
DEEEIRTTNPVATEPYGSVCFMQNAISTQDTQGNPEN

SEQ ID NO: 163508 - protein, 33 aa, Artificial Sequence
  Description of Artificial Sequence: Synthetic polypeptide
DEESIATTNPVAYECWGSVYNWTNDVQEDEGHM

SEQ ID NO: 163509 - protein, 33 aa, Artificial Sequence
  Description of Artificial Sequence: Synthetic polypeptide
DEESIATTNPVAYECWGSVYNWTNDVQQEGHHM

SEQ ID NO: 163510 - protein, 33 aa, Artificial Sequence
  Description of Artificial Sequence: Synthetic polypeptide
DEESIATTNPVAYECWGVVYNMTNDHQREQNMQ

SEQ ID NO: 163511 - protein, 30 aa, Artificial Sequence
  Description of Artificial Sequence: Synthetic polypeptide
AEMEIACTNPCSYEQYGCVSWNTNQSGSEQ

SEQ ID NO: 163512 - protein, 36 aa, Artificial Sequence
  Description of Artificial Sequence: Synthetic polypeptide
DEEEIRTTNPVATEPYGSVCFIHNAWSTDTGGNPEN

SEQ ID NO: 163513 - protein, 32 aa, Artificial Sequence
  Description of Artificial Sequence: Synthetic polypeptide
DENEIRTTNPVATEQWGDVKDEIEMNAAEIGA

SEQ ID NO: 163514 - protein, 35 aa, Artificial Sequence
  Description of Artificial Sequence: Synthetic polypeptide
DEECIRTTNPVATEQYGCVCSNWGEHQENFGSDQS

SEQ ID NO: 163515 - protein, 36 aa, Artificial Sequence
  Description of Artificial Sequence: Synthetic polypeptide
MEGTIRTTNPVATEQYGSVMGSMDNLDIGIGGQNGG

SEQ ID NO: 163516 - protein, 36 aa, Artificial Sequence
  Description of Artificial Sequence: Synthetic polypeptide
DEGEIATTNPVAYEQYGSVCSVPDGAQATEGDNTRM

SEQ ID NO: 163517 - protein, 34 aa, Artificial Sequence
  Description of Artificial Sequence: Synthetic polypeptide
QEEEIRTTNPVATESYGSVVDGEVEGEEDGGNNG

SEQ ID NO: 163518 - protein, 36 aa, Artificial Sequence
  Description of Artificial Sequence: Synthetic polypeptide
MEGTIRTTNPVATEQYGSVMGSMDNALDGEGGENGG

SEQ ID NO: 163519 - protein, 34 aa, Artificial Sequence
  Description of Artificial Sequence: Synthetic polypeptide
DEGEIATTNPVAYEQYGSVSANPAGAPVEDNLAD

SEQ ID NO: 163520 - protein, 40 aa, Artificial Sequence
  Description of Artificial Sequence: Synthetic polypeptide
DEEEIRTTNPVATEQYGVVSTVNLQAGNNTEQGTNNDTDE

SEQ ID NO: 163521 - protein, 31 aa, Artificial Sequence
  Description of Artificial Sequence: Synthetic polypeptide
AEMEIACTNPCSYEQYGCVCSWNLQSGSEAA

SEQ ID NO: 163522 - protein, 38 aa, Artificial Sequence
  Description of Artificial Sequence: Synthetic polypeptide
DEEEIRTTNPVATEQYGVVSTVNQNGNNNNQQGTEESD

SEQ ID NO: 163523 - protein, 35 aa, Artificial Sequence
  Description of Artificial Sequence: Synthetic polypeptide
DEECIRTTNPVATEQYGCVCSSEENAENFNSDTQS

SEQ ID NO: 163524 - protein, 33 aa, Artificial Sequence
  Description of Artificial Sequence: Synthetic polypeptide
MEGEIRTTNPVATGHYGSVPDVLENLTEGTQDM

SEQ ID NO: 163525 - protein, 36 aa, Artificial Sequence
  Description of Artificial Sequence: Synthetic polypeptide
DTETICTTNPVATEQYGAVSTTQNNGEQYGTVNNLQ

SEQ ID NO: 163526 - protein, 29 aa, Artificial Sequence
  Description of Artificial Sequence: Synthetic peptide
QESEIASTNPVGTEGYGVMASNTLFHGDI

SEQ ID NO: 163527 - protein, 38 aa, Artificial Sequence
  Description of Artificial Sequence: Synthetic polypeptide
DEEEIRTTNPVATEQYGVVSTVNQNGNNNNQQGTDEQA

SEQ ID NO: 163528 - protein, 30 aa, Artificial Sequence
  Description of Artificial Sequence: Synthetic polypeptide
QESEIASTNPVGTEGYGVMASNTLIQHGDI

SEQ ID NO: 163529 - protein, 33 aa, Artificial Sequence
  Description of Artificial Sequence: Synthetic polypeptide
DEGEIATTNPVAYEQYGSVCTANPAWIPADMEE

SEQ ID NO: 163530 - protein, 37 aa, Artificial Sequence
  Description of Artificial Sequence: Synthetic polypeptide
MEGTIRTTNPVATEQYGSVMGSMDNALQIGIGGENGG

SEQ ID NO: 163531 - protein, 30 aa, Artificial Sequence
  Description of Artificial Sequence: Synthetic polypeptide
QESEIASTNPVGTEGYGVMASSTLQQHGFI

SEQ ID NO: 163532 - protein, 35 aa, Artificial Sequence
  Description of Artificial Sequence: Synthetic polypeptide
DDEEISTTNPVATEQYGCVCSNTEHNQNFGSQTQS

SEQ ID NO: 163533 - protein, 36 aa, Artificial Sequence
  Description of Artificial Sequence: Synthetic polypeptide
DEGEIATTNPVAYEQYGSVCSAPALGQDHQGGNEHN

SEQ ID NO: 163534 - protein, 32 aa, Artificial Sequence
  Description of Artificial Sequence: Synthetic polypeptide
DENEIRTTNPVATEQWGDVCSEDIEMNAEEDD

SEQ ID NO: 163535 - protein, 32 aa, Artificial Sequence
  Description of Artificial Sequence: Synthetic polypeptide
DENEIRTTNPVATEQWGDVCSEDGEMNAEEDD

SEQ ID NO: 163536 - protein, 34 aa, Artificial Sequence
  Description of Artificial Sequence: Synthetic polypeptide
DEEEIRTTNPVATEGYGCVCFWEDLNTNFGSDQS

SEQ ID NO: 163537 - protein, 33 aa, Artificial Sequence
  Description of Artificial Sequence: Synthetic polypeptide
DENEIRTTNPVATEQWGDVCSATIPVMNFEEDA

SEQ ID NO: 163538 - protein, 33 aa, Artificial Sequence
  Description of Artificial Sequence: Synthetic polypeptide
DENEIRTTNPVATEQWGDVCSATIEVMNFEEDA

SEQ ID NO: 163539 - protein, 37 aa, Artificial Sequence
  Description of Artificial Sequence: Synthetic polypeptide
DEEEIATTNPVATEQYGSVCARANPAEEAGDSGENRD

SEQ ID NO: 163540 - protein, 33 aa, Artificial Sequence
  Description of Artificial Sequence: Synthetic polypeptide
DENEIRTTNPVATEQWGDVASNDIAEMNAAEDA

SEQ ID NO: 163541 - protein, 38 aa, Artificial Sequence
  Description of Artificial Sequence: Synthetic polypeptide
DEEEIRTTNPVATEQYGQCVCSTWGEHNQENGNSENQL

SEQ ID NO: 163542 - protein, 32 aa, Artificial Sequence
  Description of Artificial Sequence: Synthetic polypeptide
DDSEVASTNPVSTEGYGNVSAANTIQSRVGQR

SEQ ID NO: 163543 - protein, 34 aa, Artificial Sequence
  Description of Artificial Sequence: Synthetic polypeptide
DEEEIRTTNPVATEGYGCVCFWEEHNTYFGSDQS

SEQ ID NO: 163544 - protein, 37 aa, Artificial Sequence
  Description of Artificial Sequence: Synthetic polypeptide
DEEEIRTTNPVATEQYGQCVCSTWGEHNQNFNSDTQS

SEQ ID NO: 163545 - protein, 35 aa, Artificial Sequence
  Description of Artificial Sequence: Synthetic polypeptide
DEEEIRTTNPVATEGYGCVCFWEHNTENFNSDNQS

SEQ ID NO: 163546 - protein, 35 aa, Artificial Sequence
  Description of Artificial Sequence: Synthetic polypeptide
DEEEIRTTNPVATEGYGCVCFTWMEHNTNFGSDQS

SEQ ID NO: 163547 - protein, 35 aa, Artificial Sequence
  Description of Artificial Sequence: Synthetic polypeptide
QEEEIRTTNPVAYEQYGTIACTVNSISQNGTENYP

SEQ ID NO: 163548 - protein, 32 aa, Artificial Sequence
  Description of Artificial Sequence: Synthetic polypeptide
DDSEVATTNPVSTEGYGNVAANPAIQSRVGQR

SEQ ID NO: 163549 - protein, 38 aa, Artificial Sequence
  Description of Artificial Sequence: Synthetic polypeptide
AEEEIRTTNPVATEQYGSVSTVNQNGSEQGTTNVATED

SEQ ID NO: 163550 - protein, 32 aa, Artificial Sequence
  Description of Artificial Sequence: Synthetic polypeptide
DENEIATTNPVAYEQWGGVYSVEIEMMQREDH

SEQ ID NO: 163551 - protein, 34 aa, Artificial Sequence
  Description of Artificial Sequence: Synthetic polypeptide
AEAEISTTNPVATEQYGCVCSTGEHEQNFGSDQS

SEQ ID NO: 163552 - protein, 38 aa, Artificial Sequence
  Description of Artificial Sequence: Synthetic polypeptide
DEEEIRTTNPVATEQYGVVSTVNQGGNNNNQQGTQETD

SEQ ID NO: 163553 - protein, 35 aa, Artificial Sequence
  Description of Artificial Sequence: Synthetic polypeptide
MEGEIRTTNPVATEQYGSVTWPTGADDQPMGEEKN

SEQ ID NO: 163554 - protein, 29 aa, Artificial Sequence
  Description of Artificial Sequence: Synthetic peptide
QESEIASTNPVGTEGYGVMASTDQHGDDI

SEQ ID NO: 163555 - protein, 36 aa, Artificial Sequence
  Description of Artificial Sequence: Synthetic polypeptide
QEEEIRTTNPVAYEQYGTICSCTVNSLSQTSTETNP

SEQ ID NO: 163556 - protein, 31 aa, Artificial Sequence
  Description of Artificial Sequence: Synthetic polypeptide
DENEIRTTNPVATEQWGDVAEIIEMNAAEDA

SEQ ID NO: 163557 - protein, 31 aa, Artificial Sequence
  Description of Artificial Sequence: Synthetic polypeptide
DENEIRTTNPVATEQWGDTWSEDEANAAEDA

SEQ ID NO: 163558 - protein, 32 aa, Artificial Sequence
  Description of Artificial Sequence: Synthetic polypeptide
DENEIRTTNPVATEQWGDTVWSEIEMNAAEPI

SEQ ID NO: 163559 - protein, 35 aa, Artificial Sequence
  Description of Artificial Sequence: Synthetic polypeptide
MEGEIRTTNPVATEQYGSVTPEPMDQKEMGNEEKN

SEQ ID NO: 163560 - protein, 37 aa, Artificial Sequence
  Description of Artificial Sequence: Synthetic polypeptide
DEEEIRTTNPVATEQYGQCVCSVSGEHNQENFNSQQS

SEQ ID NO: 163561 - protein, 37 aa, Artificial Sequence
  Description of Artificial Sequence: Synthetic polypeptide
DEEEIRTTNPVATEQYGQCVCSTWGEHNQENFGSDQS

SEQ ID NO: 163562 - protein, 35 aa, Artificial Sequence
  Description of Artificial Sequence: Synthetic polypeptide
DEHEISTTNPVAYEQWGVVCSTDNLDQHQHGDSDM

SEQ ID NO: 163563 - protein, 37 aa, Artificial Sequence
  Description of Artificial Sequence: Synthetic polypeptide
DEEEIRTTNPVATEQYGQCVCSTWGEHNQENFGSDQA

SEQ ID NO: 163564 - protein, 32 aa, Artificial Sequence
  Description of Artificial Sequence: Synthetic polypeptide
DTQEIRTTNPVSTEPYGTISMKDIQQQQNGNH

SEQ ID NO: 163565 - protein, 31 aa, Artificial Sequence
  Description of Artificial Sequence: Synthetic polypeptide
DDSEVASTNPVSTEGYGNVNCNTIQSRVGQR

SEQ ID NO: 163566 - protein, 37 aa, Artificial Sequence
  Description of Artificial Sequence: Synthetic polypeptide
DEEEIRTTNPVATEQYGQCVCSTTGETNQENFNSDQN

SEQ ID NO: 163567 - protein, 40 aa, Artificial Sequence
  Description of Artificial Sequence: Synthetic polypeptide
DEEEIRTTNPVATEQYGVVSTVNLQAGNNTEQGTNQNTEE

SEQ ID NO: 163568 - protein, 33 aa, Artificial Sequence
  Description of Artificial Sequence: Synthetic polypeptide
DENEIATTNPVAYEQWGGVYSIEIEMVQREGDA

SEQ ID NO: 163569 - protein, 34 aa, Artificial Sequence
  Description of Artificial Sequence: Synthetic polypeptide
DEGEIATTNPVAYEQYGSVCATPEEAGDQENGAE

SEQ ID NO: 163570 - protein, 37 aa, Artificial Sequence
  Description of Artificial Sequence: Synthetic polypeptide
DEEEIRTTNPVATEQYGQCVCSTTPAHNNENSGSDPV

SEQ ID NO: 163571 - protein, 37 aa, Artificial Sequence
  Description of Artificial Sequence: Synthetic polypeptide
DEEEIRTTNPVATEQYGQCVCSTWEDHQESFNSDTQS

SEQ ID NO: 163572 - protein, 34 aa, Artificial Sequence
  Description of Artificial Sequence: Synthetic polypeptide
DDEEIRTTNPVATEGYGCVCSWEEHQEFFNSDQN

SEQ ID NO: 163573 - protein, 31 aa, Artificial Sequence
  Description of Artificial Sequence: Synthetic polypeptide
DTSEVASTNPVSTEGYGNVAANTIQSRVGQR

SEQ ID NO: 163574 - protein, 35 aa, Artificial Sequence
  Description of Artificial Sequence: Synthetic polypeptide
MEGEIRTTNPVATEQYGSVWNVTPLDIEPNEDEVG

SEQ ID NO: 163575 - protein, 37 aa, Artificial Sequence
  Description of Artificial Sequence: Synthetic polypeptide
DEEEIRTTNPVATEQYGQCVCSTWEEHNQENFGSDQA

SEQ ID NO: 163576 - protein, 30 aa, Artificial Sequence
  Description of Artificial Sequence: Synthetic polypeptide
DDSEVASTNPVSTEGYGNVPANTCQHVGQR

SEQ ID NO: 163577 - protein, 34 aa, Artificial Sequence
  Description of Artificial Sequence: Synthetic polypeptide
DAEEIATTNPVATEQYGSVCDTPGPDDSGDGMDN

SEQ ID NO: 163578 - protein, 32 aa, Artificial Sequence
  Description of Artificial Sequence: Synthetic polypeptide
DEMEIATTNPVATECYGDVCSAEDGPQFEEED

SEQ ID NO: 163579 - protein, 28 aa, Artificial Sequence
  Description of Artificial Sequence: Synthetic peptide
QESEIASTNPVGTEGYGVMASTCQHEDI

SEQ ID NO: 163580 - protein, 36 aa, Artificial Sequence
  Description of Artificial Sequence: Synthetic polypeptide
DEGEIATTNPVAYEQYGSVCAPTNAGPQEAEIGNEN

SEQ ID NO: 163581 - protein, 33 aa, Artificial Sequence
  Description of Artificial Sequence: Synthetic polypeptide
DEGEIATTNPVAYEQYGSVCANNNEEADNQENH

SEQ ID NO: 163582 - protein, 37 aa, Artificial Sequence
  Description of Artificial Sequence: Synthetic polypeptide
DEEEIRTTNPVATEQYGQCVCSTWGEHNAENFNSDQP

SEQ ID NO: 163583 - protein, 36 aa, Artificial Sequence
  Description of Artificial Sequence: Synthetic polypeptide
DEECIRTTNPVATEQYGCVCSTEEPNQEFFGSDTQS

SEQ ID NO: 163584 - protein, 32 aa, Artificial Sequence
  Description of Artificial Sequence: Synthetic polypeptide
DENEIRTTNPVATEQWGDVFEIDEMNAAEDAL

SEQ ID NO: 163585 - protein, 35 aa, Artificial Sequence
  Description of Artificial Sequence: Synthetic polypeptide
DEEEIATTNPVATEQYGSVCAATGEEAIDEMANNM

SEQ ID NO: 163586 - protein, 37 aa, Artificial Sequence
  Description of Artificial Sequence: Synthetic polypeptide
DEEEIRTTNPVATEQYGQCVCSTWGEHNINFNSDNQS

SEQ ID NO: 163587 - protein, 34 aa, Artificial Sequence
  Description of Artificial Sequence: Synthetic polypeptide
DEAEISTTNPVAYEQYGCVCSTEHNAEYFGSDQA

SEQ ID NO: 163588 - protein, 35 aa, Artificial Sequence
  Description of Artificial Sequence: Synthetic polypeptide
DECEIATTNPVAYEQYGTVATENGGMQNGGQRGQA

SEQ ID NO: 163589 - protein, 31 aa, Artificial Sequence
  Description of Artificial Sequence: Synthetic polypeptide
DDSEVASTNPVSTEGYGNVPANTIQSRVGQR

SEQ ID NO: 163590 - protein, 38 aa, Artificial Sequence
  Description of Artificial Sequence: Synthetic polypeptide
DEEEIRTTNPVATEQYGQCVCSTWGEHNQENFGSDNQA

SEQ ID NO: 163591 - protein, 32 aa, Artificial Sequence
  Description of Artificial Sequence: Synthetic polypeptide
DENEIRTTNPVATEQWGDTVWSEIEMNAAEDA

SEQ ID NO: 163592 - protein, 29 aa, Artificial Sequence
  Description of Artificial Sequence: Synthetic peptide
QESEIASTNPVGTEGYGVMASTFQHGDIE

SEQ ID NO: 163593 - protein, 38 aa, Artificial Sequence
  Description of Artificial Sequence: Synthetic polypeptide
DTEEIRTTNPVATEQYGVVSTTNQQLQAGTEQGTTQEE

SEQ ID NO: 163594 - protein, 39 aa, Artificial Sequence
  Description of Artificial Sequence: Synthetic polypeptide
DEEEIRTTNPVATEQYGVVSVTVVTNLQQGTEQGSTVVD

SEQ ID NO: 163595 - protein, 36 aa, Artificial Sequence
  Description of Artificial Sequence: Synthetic polypeptide
DDEEIRTTNPVATEFYGSVSIVNMDGQGEFDDNQQP

SEQ ID NO: 163596 - protein, 36 aa, Artificial Sequence
  Description of Artificial Sequence: Synthetic polypeptide
DDEEIRTTNPVATEFYGSVSIVNMDGQNEFDDNEQT

SEQ ID NO: 163597 - protein, 34 aa, Artificial Sequence
  Description of Artificial Sequence: Synthetic polypeptide
DESEIATTNPVAYEQWGSVCSGENDQMDTNDHIK

SEQ ID NO: 163598 - protein, 30 aa, Artificial Sequence
  Description of Artificial Sequence: Synthetic polypeptide
QESEIASTNPVGTEGYGTMSSTLVQHEGDD

SEQ ID NO: 163599 - protein, 35 aa, Artificial Sequence
  Description of Artificial Sequence: Synthetic polypeptide
DEMEIATTNPVATEQYGCVSNTDHNEDHFGSEDQA

SEQ ID NO: 163600 - protein, 34 aa, Artificial Sequence
  Description of Artificial Sequence: Synthetic polypeptide
SEEEIRCTNPIATEQWGSTVWSNAENWMEPKGPR

SEQ ID NO: 163601 - protein, 34 aa, Artificial Sequence
  Description of Artificial Sequence: Synthetic polypeptide
DESEIATTNPVAYEQWGSVCSGENDQHHDTNDIK

SEQ ID NO: 163602 - protein, 30 aa, Artificial Sequence
  Description of Artificial Sequence: Synthetic polypeptide
QESEIASTNPVGTEGYGTMSSTLVQHEGDI

SEQ ID NO: 163603 - protein, 39 aa, Artificial Sequence
  Description of Artificial Sequence: Synthetic polypeptide
DEEEIRTTNPVATEQYGVVSVTVTNNQNQLQGNNNNNDE

SEQ ID NO: 163604 - protein, 39 aa, Artificial Sequence
  Description of Artificial Sequence: Synthetic polypeptide
DEEEIRTTNPVATEQYGVVSVTVTNNQQNQQGTNNNNDE

SEQ ID NO: 163605 - protein, 34 aa, Artificial Sequence
  Description of Artificial Sequence: Synthetic polypeptide
DEEEIACTNPVATEQWGCVAGTGQLDNPMGGNLW

SEQ ID NO: 163606 - protein, 37 aa, Artificial Sequence
  Description of Artificial Sequence: Synthetic polypeptide
DDEEIRTTNPVATEFYGSVSIVNMDGQQGEFDDNIGF

SEQ ID NO: 163607 - protein, 36 aa, Artificial Sequence
  Description of Artificial Sequence: Synthetic polypeptide
DDEEIRTTNPVATEFYGSVSIVNMDGQGEFDDNEII

SEQ ID NO: 163608 - protein, 36 aa, Artificial Sequence
  Description of Artificial Sequence: Synthetic polypeptide
DEEEIRATNPVATEQYGAVDIDTNMNLETGGGQTIS

SEQ ID NO: 163609 - protein, 34 aa, Artificial Sequence
  Description of Artificial Sequence: Synthetic polypeptide
DESEIATTNPVAYEQWGSVCSGENDQHDTNDHKE

SEQ ID NO: 163610 - protein, 31 aa, Artificial Sequence
  Description of Artificial Sequence: Synthetic polypeptide
DEGEIRTTNPISTECWGAVWSNCDLAPKGTI

SEQ ID NO: 163611 - protein, 34 aa, Artificial Sequence
  Description of Artificial Sequence: Synthetic polypeptide
DESEIATTNPVAYEQWGSVCSGENDQHDTNDHGF

SEQ ID NO: 163612 - protein, 35 aa, Artificial Sequence
  Description of Artificial Sequence: Synthetic polypeptide
DDEEISTTNPVATEQYGCVCSTGEDNQNFNSDTQS

SEQ ID NO: 163613 - protein, 31 aa, Artificial Sequence
  Description of Artificial Sequence: Synthetic polypeptide
DEGEIRTTNPISTECWGAVWANCDLAPKGTI

SEQ ID NO: 163614 - protein, 35 aa, Artificial Sequence
  Description of Artificial Sequence: Synthetic polypeptide
DEEEIRTTNPVATEQYGSVYIMEMIEPVIMNTVMQ

SEQ ID NO: 163615 - protein, 38 aa, Artificial Sequence
  Description of Artificial Sequence: Synthetic polypeptide
MESEIATTNPVATEQYGYVVSPTSNVLDQFRIGENYQK

SEQ ID NO: 163616 - protein, 37 aa, Artificial Sequence
  Description of Artificial Sequence: Synthetic polypeptide
MESEIATTNPVATEQYGSVSPTSNVLDQFNIMENYQK

SEQ ID NO: 163617 - protein, 37 aa, Artificial Sequence
  Description of Artificial Sequence: Synthetic polypeptide
MESEIATTNPVATEQYGSVSPTSNVLDFFRIGEEYQK

SEQ ID NO: 163618 - protein, 29 aa, Artificial Sequence
  Description of Artificial Sequence: Synthetic peptide
MESEIASTNPVGTEGYGVMASYLQHGDII

SEQ ID NO: 163619 - protein, 33 aa, Artificial Sequence
  Description of Artificial Sequence: Synthetic polypeptide
DESEIATTNPVAYEQWGSVCSGENDQHDTDDHH

SEQ ID NO: 163620 - protein, 30 aa, Artificial Sequence
  Description of Artificial Sequence: Synthetic polypeptide
QESEIASTNPVGTEGYGVAAFSTLLIHGDI

SEQ ID NO: 163621 - protein, 31 aa, Artificial Sequence
  Description of Artificial Sequence: Synthetic polypeptide
DEESIACTNPVATASWGCVATNELQDSPKMH

SEQ ID NO: 163622 - protein, 34 aa, Artificial Sequence
  Description of Artificial Sequence: Synthetic polypeptide
DESEIATTNPVAYEQWGSVCSGENDQDHDTNDHM

SEQ ID NO: 163623 - protein, 32 aa, Artificial Sequence
  Description of Artificial Sequence: Synthetic polypeptide
DDSEVASTNPVSTEGYGNVACNTIQSRAGQNR

SEQ ID NO: 163624 - protein, 31 aa, Artificial Sequence
  Description of Artificial Sequence: Synthetic polypeptide
AEDEIACTNPVAYEQWGEAFIENDQNRGGER

SEQ ID NO: 163625 - protein, 34 aa, Artificial Sequence
  Description of Artificial Sequence: Synthetic polypeptide
CEEEIATTNPVATAQWGSVSAGPPPDEAGGNMRN

SEQ ID NO: 163626 - protein, 32 aa, Artificial Sequence
  Description of Artificial Sequence: Synthetic polypeptide
DTEEIRATNPVAYEQWGCSYQNDNHQQIDTSR

SEQ ID NO: 163627 - protein, 32 aa, Artificial Sequence
  Description of Artificial Sequence: Synthetic polypeptide
QESEIASTNPVGTEGYGSVSASPTLQHNGDPV

SEQ ID NO: 163628 - protein, 36 aa, Artificial Sequence
  Description of Artificial Sequence: Synthetic polypeptide
DEEEIRTTNPVATEQYGQCVCSNWEHNQSFNSENQI

SEQ ID NO: 163629 - protein, 37 aa, Artificial Sequence
  Description of Artificial Sequence: Synthetic polypeptide
DDEEIRTTNPVATEFYGSVSAVNTDGQQGEFDDNEQF

SEQ ID NO: 163630 - protein, 29 aa, Artificial Sequence
  Description of Artificial Sequence: Synthetic peptide
QESEIASTNPVGTEGYGTMASETIQHGDI

SEQ ID NO: 163631 - protein, 30 aa, Artificial Sequence
  Description of Artificial Sequence: Synthetic polypeptide
QESEIASTNPVGTEGYGTMASETIQQHGDI

SEQ ID NO: 163632 - protein, 37 aa, Artificial Sequence
  Description of Artificial Sequence: Synthetic polypeptide
DEAEIRTTNPVATEQYGCVCSMTGEHNQENFGSENQS

SEQ ID NO: 163633 - protein, 30 aa, Artificial Sequence
  Description of Artificial Sequence: Synthetic polypeptide
QESEIASTNPVGTEGYGTMASETIQQQGDH

SEQ ID NO: 163634 - protein, 35 aa, Artificial Sequence
  Description of Artificial Sequence: Synthetic polypeptide
DEEEIRTTNPVATEQYGQCVCSNWEHQENFFSQQG

SEQ ID NO: 163635 - protein, 35 aa, Artificial Sequence
  Description of Artificial Sequence: Synthetic polypeptide
DEAEIRTTNPVATEQYGCVCSMTGEHAENFGSDQA

SEQ ID NO: 163636 - protein, 37 aa, Artificial Sequence
  Description of Artificial Sequence: Synthetic polypeptide
DEEEIRTTNPVATEQYGSVSLEIFNNPQINMPPEPVS

SEQ ID NO: 163637 - protein, 35 aa, Artificial Sequence
  Description of Artificial Sequence: Synthetic polypeptide
DEMEIATTNPVATEQYGCVSNTDLNEEHFGSETLA

SEQ ID NO: 163638 - protein, 35 aa, Artificial Sequence
  Description of Artificial Sequence: Synthetic polypeptide
DEMEIATTNPVATEQYGCVSTTELNEDHEGSEDLA

SEQ ID NO: 163639 - protein, 31 aa, Artificial Sequence
  Description of Artificial Sequence: Synthetic polypeptide
DDSEVASTNPVSTEGYGNVACNPIQSREGQR

SEQ ID NO: 163640 - protein, 31 aa, Artificial Sequence
  Description of Artificial Sequence: Synthetic polypeptide
AEDEIACTNPVAYEQWGEAISIENDQHGGER

SEQ ID NO: 163641 - protein, 36 aa, Artificial Sequence
  Description of Artificial Sequence: Synthetic polypeptide
DEAEIRTTNPVATEQYGCVCSMTEEHNQNFGSETQS

SEQ ID NO: 163642 - protein, 36 aa, Artificial Sequence
  Description of Artificial Sequence: Synthetic polypeptide
DEEEIRTTNPVATEQYGQCVCSNWEHQENFGSETQS

SEQ ID NO: 163643 - protein, 30 aa, Artificial Sequence
  Description of Artificial Sequence: Synthetic polypeptide
QESEIASTNPVGTEGYGTMASETIQQQGDI

SEQ ID NO: 163644 - protein, 29 aa, Artificial Sequence
  Description of Artificial Sequence: Synthetic peptide
QESEIASTNPVGTEGYGTMASSLYQHGDI

SEQ ID NO: 163645 - protein, 35 aa, Artificial Sequence
  Description of Artificial Sequence: Synthetic polypeptide
AENEEIATTNPVAYEQWGSVSTGGNAGEHQGGTDE

SEQ ID NO: 163646 - protein, 38 aa, Artificial Sequence
  Description of Artificial Sequence: Synthetic polypeptide
DDEEIRTTNPVATEFYGSVSIVNLDPGQQGEFDDNEQF

SEQ ID NO: 163647 - protein, 37 aa, Artificial Sequence
  Description of Artificial Sequence: Synthetic polypeptide
DDEEIRTTNPVATEFYGSVSIVNMDDQQGEFDDNEQA

SEQ ID NO: 163648 - protein, 37 aa, Artificial Sequence
  Description of Artificial Sequence: Synthetic polypeptide
DEEEIRTTNPVATEQYGSVEPTWPIMPPEPGLNVPLQ

SEQ ID NO: 163649 - protein, 34 aa, Artificial Sequence
  Description of Artificial Sequence: Synthetic polypeptide
DEEEIACTNPVATEQWGCVAGTGQLDNRMGGTLG

SEQ ID NO: 163650 - protein, 36 aa, Artificial Sequence
  Description of Artificial Sequence: Synthetic polypeptide
DEEEIRTTNPVATEQYGQCVCSNWEPNQENFGSEQS

SEQ ID NO: 163651 - protein, 35 aa, Artificial Sequence
  Description of Artificial Sequence: Synthetic polypeptide
DEMEIATTNPVATEQYGCVSTTDLNEEHFGSEDLS

SEQ ID NO: 163652 - protein, 36 aa, Artificial Sequence
  Description of Artificial Sequence: Synthetic polypeptide
DAEEIATTNPVATEQYGSVCATNPQDNPDDQMGGPF

SEQ ID NO: 163653 - protein, 34 aa, Artificial Sequence
  Description of Artificial Sequence: Synthetic polypeptide
DEECIRCTNPVAYEQYGSVVSQVNEFSTDGGPLM

SEQ ID NO: 163654 - protein, 33 aa, Artificial Sequence
  Description of Artificial Sequence: Synthetic polypeptide
DEECIRSTNPVAYEQYGCVFTIPVETRIGDGQQ

SEQ ID NO: 163655 - protein, 36 aa, Artificial Sequence
  Description of Artificial Sequence: Synthetic polypeptide
DEQEIRTTNPVATEQYGSVNIPVTSENEPEDVTEER

SEQ ID NO: 163656 - protein, 36 aa, Artificial Sequence
  Description of Artificial Sequence: Synthetic polypeptide
DEEEIATTNPVATEQYGSVCPWPPPQNGAGGENQDQ

SEQ ID NO: 163657 - protein, 36 aa, Artificial Sequence
  Description of Artificial Sequence: Synthetic polypeptide
DESEIATTNPVAYEQWGCVSIPNAGNDDQRQGDNER

SEQ ID NO: 163658 - protein, 36 aa, Artificial Sequence
  Description of Artificial Sequence: Synthetic polypeptide
DEEEIRTTNPVATEQYGSVEPTPIMPMEPMLNVPLQ

SEQ ID NO: 163659 - protein, 32 aa, Artificial Sequence
  Description of Artificial Sequence: Synthetic polypeptide
SEEEIRCTNPIATEEYGCVCSWELANFGSDQS

SEQ ID NO: 163660 - protein, 32 aa, Artificial Sequence
  Description of Artificial Sequence: Synthetic polypeptide
AEDEIACTNPVAYEQWGAYYIIENLDQRGGER

SEQ ID NO: 163661 - protein, 32 aa, Artificial Sequence
  Description of Artificial Sequence: Synthetic polypeptide
DEECIRTTNPEAWEQYGQCCATITVMGGGNNV

SEQ ID NO: 163662 - protein, 36 aa, Artificial Sequence
  Description of Artificial Sequence: Synthetic polypeptide
DEQEIRTTNPVATEQYGSVNIPVTSLNEQEDSTEEN

SEQ ID NO: 163663 - protein, 33 aa, Artificial Sequence
  Description of Artificial Sequence: Synthetic polypeptide
DESEIATTNPVAYEPYGEVAAMANWDQVSNDTR

SEQ ID NO: 163664 - protein, 37 aa, Artificial Sequence
  Description of Artificial Sequence: Synthetic polypeptide
DTEEIRTTNPCATEAYGSVSTVTTNLGQQGTEEEEDE

SEQ ID NO: 163665 - protein, 36 aa, Artificial Sequence
  Description of Artificial Sequence: Synthetic polypeptide
DEQEIRTTNPVATEQYGSVNIPVTSLNEQEDVTEPQ

SEQ ID NO: 163666 - protein, 34 aa, Artificial Sequence
  Description of Artificial Sequence: Synthetic polypeptide
MEQEIRTTNPVATEQYGSVNSEAESMMEGIEDQN

SEQ ID NO: 163667 - protein, 34 aa, Artificial Sequence
  Description of Artificial Sequence: Synthetic polypeptide
DEECIRTTNPCAYEQWGSVSTTNPGDNHNNGGEQ

SEQ ID NO: 163668 - protein, 39 aa, Artificial Sequence
  Description of Artificial Sequence: Synthetic polypeptide
DEEEIRTTNPVATEQYGVVSVTVTNQQQLEQGNNNNNVE

SEQ ID NO: 163669 - protein, 36 aa, Artificial Sequence
  Description of Artificial Sequence: Synthetic polypeptide
DEEEIRTTNPVATEQYGSVEPTPIMPAEPHLNEPLM

SEQ ID NO: 163670 - protein, 36 aa, Artificial Sequence
  Description of Artificial Sequence: Synthetic polypeptide
DEMEIATTNPVATEQYGCVCSTWEHNIEHFGSENQA

SEQ ID NO: 163671 - protein, 34 aa, Artificial Sequence
  Description of Artificial Sequence: Synthetic polypeptide
DESEIATTNPVAYEGWGSVVHEDLQRDQDGNNGQ

SEQ ID NO: 163672 - protein, 36 aa, Artificial Sequence
  Description of Artificial Sequence: Synthetic polypeptide
DEEEIRTTNPVATEQYGSVEPTPIMPAEDGLSVPLM

SEQ ID NO: 163673 - protein, 39 aa, Artificial Sequence
  Description of Artificial Sequence: Synthetic polypeptide
DEEEIRTTNPVATEQYGVVSVTVTTNQNQQQGNNNNNNE

SEQ ID NO: 163674 - protein, 34 aa, Artificial Sequence
  Description of Artificial Sequence: Synthetic polypeptide
DEHEIRTTNPVAYESWGSVCYNNDNQDQGNQHES

SEQ ID NO: 163675 - protein, 34 aa, Artificial Sequence
  Description of Artificial Sequence: Synthetic polypeptide
DEHEIRTTNPVAYESWGSVCYNNDQQDQDNSHER

SEQ ID NO: 163676 - protein, 30 aa, Artificial Sequence
  Description of Artificial Sequence: Synthetic polypeptide
QESEIASTNPVGTEGYGVCMANSTLQHGDI

SEQ ID NO: 163677 - protein, 33 aa, Artificial Sequence
  Description of Artificial Sequence: Synthetic polypeptide
AEMEIVTTNPVATYQYGTVCSATDGPVEFEGND

SEQ ID NO: 163678 - protein, 29 aa, Artificial Sequence
  Description of Artificial Sequence: Synthetic peptide
QESEIASTNPVGTEGYGVCMASGLQHGDI

SEQ ID NO: 163679 - protein, 33 aa, Artificial Sequence
  Description of Artificial Sequence: Synthetic polypeptide
DESEIATTNPVAYECWGSVSCASSSDDREGGNV

SEQ ID NO: 163680 - protein, 30 aa, Artificial Sequence
  Description of Artificial Sequence: Synthetic polypeptide
QESEIASTNPVGTEGYGVCMASKTLQHGDI

SEQ ID NO: 163681 - protein, 34 aa, Artificial Sequence
  Description of Artificial Sequence: Synthetic polypeptide
DEAEIRTTNPVATEQYGCTCSWGAHNQNFGSDQS

SEQ ID NO: 163682 - protein, 37 aa, Artificial Sequence
  Description of Artificial Sequence: Synthetic polypeptide
DEEEIRTTNPVATEQYGSVSIWDYDPMDLQSMEDFYI

SEQ ID NO: 163683 - protein, 31 aa, Artificial Sequence
  Description of Artificial Sequence: Synthetic polypeptide
AEDEIACTNPVAYEQWGCAYIINDQDRGGER

SEQ ID NO: 163684 - protein, 31 aa, Artificial Sequence
  Description of Artificial Sequence: Synthetic polypeptide
DDSEVASTNPVSTEGYGNVACNTIQSRVGQR

SEQ ID NO: 163685 - protein, 33 aa, Artificial Sequence
  Description of Artificial Sequence: Synthetic polypeptide
AEDEIACTNPVAYEQWGEACSIENLQDRDGGER

SEQ ID NO: 163686 - protein, 35 aa, Artificial Sequence
  Description of Artificial Sequence: Synthetic polypeptide
DEECIRTTNPCATECYGVVCYKTNDEGQRQQDNDV

SEQ ID NO: 163687 - protein, 29 aa, Artificial Sequence
  Description of Artificial Sequence: Synthetic peptide
MESEIASTNPVGTEGYGVMASTLKPTGDI

SEQ ID NO: 163688 - protein, 35 aa, Artificial Sequence
  Description of Artificial Sequence: Synthetic polypeptide
DEECIRTTNPCATECYGVVCYKTNDEHQRQGGEEH

SEQ ID NO: 163689 - protein, 31 aa, Artificial Sequence
  Description of Artificial Sequence: Synthetic polypeptide
QESEIASTNPVGTEGYGVAASTLSQHGGDNI

SEQ ID NO: 163690 - protein, 28 aa, Artificial Sequence
  Description of Artificial Sequence: Synthetic peptide
QESEIASTNPVGTEGYGVAASVLQHEDI

SEQ ID NO: 163691 - protein, 29 aa, Artificial Sequence
  Description of Artificial Sequence: Synthetic peptide
QESEIASTNPVGTEGYGVAMASMLQHGDI

SEQ ID NO: 163692 - protein, 36 aa, Artificial Sequence
  Description of Artificial Sequence: Synthetic polypeptide
DEECIRTTNPCATECYGVVCYKTNDENQRIGGGDQR

SEQ ID NO: 163693 - protein, 29 aa, Artificial Sequence
  Description of Artificial Sequence: Synthetic peptide
QESEIASTNPVGTEGYGVAMASTIQHGDI

SEQ ID NO: 163694 - protein, 30 aa, Artificial Sequence
  Description of Artificial Sequence: Synthetic polypeptide
QESEIASTNPVGTEGYGVAMASTLHQHGDI

SEQ ID NO: 163695 - protein, 35 aa, Artificial Sequence
  Description of Artificial Sequence: Synthetic polypeptide
DEEEIACTNPVATEQWGCVAGMTGLNPRDGMGDNH

SEQ ID NO: 163696 - protein, 36 aa, Artificial Sequence
  Description of Artificial Sequence: Synthetic polypeptide
DEECIRTTNPCATECYGVVCYKTNDETQRQGGGGQR

SEQ ID NO: 163697 - protein, 36 aa, Artificial Sequence
  Description of Artificial Sequence: Synthetic polypeptide
DEEEIATTNPVATEQYGSVCPWPTPGPDDSGDGMNF

SEQ ID NO: 163698 - protein, 34 aa, Artificial Sequence
  Description of Artificial Sequence: Synthetic polypeptide
DEAEIRTTNPVATEQYGCVCQTTGAHINFMSDQA

SEQ ID NO: 163699 - protein, 35 aa, Artificial Sequence
  Description of Artificial Sequence: Synthetic polypeptide
DDEEISTTNPVATEQYGCVCSTEHEQESFGSDPQS

SEQ ID NO: 163700 - protein, 32 aa, Artificial Sequence
  Description of Artificial Sequence: Synthetic polypeptide
DDSEVATTNPVSTEGYGNVAANTIPQSRVGQR

SEQ ID NO: 163701 - protein, 39 aa, Artificial Sequence
  Description of Artificial Sequence: Synthetic polypeptide
DEEEIRTTNPVATEQYGVVSVTVTNQQAGTEAGTNQQQD

SEQ ID NO: 163702 - protein, 35 aa, Artificial Sequence
  Description of Artificial Sequence: Synthetic polypeptide
MEQEISTTNPVATEQYGSVSATGDGEDQEGEGQGN

SEQ ID NO: 163703 - protein, 34 aa, Artificial Sequence
  Description of Artificial Sequence: Synthetic polypeptide
DENEIATTNPVATEQYGTVCAANDGPAEDDGNDI

SEQ ID NO: 163704 - protein, 32 aa, Artificial Sequence
  Description of Artificial Sequence: Synthetic polypeptide
AENAIMCTNPVSTEQYGEAASEGLQQRIGGAR

SEQ ID NO: 163705 - protein, 38 aa, Artificial Sequence
  Description of Artificial Sequence: Synthetic polypeptide
DEEEIRTTNPVATEQYGVVSVTVTNQQGNNQQGTEQGQ

SEQ ID NO: 163706 - protein, 34 aa, Artificial Sequence
  Description of Artificial Sequence: Synthetic polypeptide
DEAEIRTTNPVATEQYGCVCQTAHDINFMSDTQA

SEQ ID NO: 163707 - protein, 34 aa, Artificial Sequence
  Description of Artificial Sequence: Synthetic polypeptide
DEECIRTTNPCAYEQWGEVAPTWENDQRKYGHEQ

SEQ ID NO: 163708 - protein, 35 aa, Artificial Sequence
  Description of Artificial Sequence: Synthetic polypeptide
DEQEIRTTNPVATEQYGSVNGPVTSLNEPEDTEED

SEQ ID NO: 163709 - protein, 37 aa, Artificial Sequence
  Description of Artificial Sequence: Synthetic polypeptide
DTEEIRTTNPCATEAYGSVSTVNNNNGQQGTEENEDE

SEQ ID NO: 163710 - protein, 36 aa, Artificial Sequence
  Description of Artificial Sequence: Synthetic polypeptide
DEEEIACTNPVATEQWGCVAATGNHLNEAPGNQDRF

SEQ ID NO: 163711 - protein, 35 aa, Artificial Sequence
  Description of Artificial Sequence: Synthetic polypeptide
DEQEIRTTNPVATEQYGSVIIPVTVLNEPEDTEEN

SEQ ID NO: 163712 - protein, 37 aa, Artificial Sequence
  Description of Artificial Sequence: Synthetic polypeptide
DDEEIRTTNPVATEFYGSVNVNMGLQEEQDGGGENTT

SEQ ID NO: 163713 - protein, 36 aa, Artificial Sequence
  Description of Artificial Sequence: Synthetic polypeptide
DEEEIRTTNPVATEQYGQCVCSNWEHNQNFNSQFQG

SEQ ID NO: 163714 - protein, 33 aa, Artificial Sequence
  Description of Artificial Sequence: Synthetic polypeptide
DESEIATTNPVAYEQWGSVSGGNGNESGEGDKS

SEQ ID NO: 163715 - protein, 36 aa, Artificial Sequence
  Description of Artificial Sequence: Synthetic polypeptide
DEEEIRTTNPVATEQYGSVSLPVMNDMAIDAIQELM

SEQ ID NO: 163716 - protein, 36 aa, Artificial Sequence
  Description of Artificial Sequence: Synthetic polypeptide
DEEEIRTTNPVATEQYGQCVCSNWEEHNQNFGSEQQ

SEQ ID NO: 163717 - protein, 35 aa, Artificial Sequence
  Description of Artificial Sequence: Synthetic polypeptide
DENEIRTTNPVATEQWGDVSSTTPIEPNNRNGMDV

SEQ ID NO: 163718 - protein, 38 aa, Artificial Sequence
  Description of Artificial Sequence: Synthetic polypeptide
DTEEIRATNPVATEQYGSVSTVNTNNNNGQEQGTNNNE

SEQ ID NO: 163719 - protein, 38 aa, Artificial Sequence
  Description of Artificial Sequence: Synthetic polypeptide
DTEEIRATNPVATEQYGSVSTVSTNNNNQEQIGTNNNE

SEQ ID NO: 163720 - protein, 36 aa, Artificial Sequence
  Description of Artificial Sequence: Synthetic polypeptide
DEEEIATTNPVATEQYGSVCAANNGEEAGDEMGDNH

SEQ ID NO: 163721 - protein, 32 aa, Artificial Sequence
  Description of Artificial Sequence: Synthetic polypeptide
CEEEIATTNPVATASWGCIATTNAEQTRADNN

SEQ ID NO: 163722 - protein, 34 aa, Artificial Sequence
  Description of Artificial Sequence: Synthetic polypeptide
DEAEISTTNPVATEQYGTVCACTDGPSEFEGGND

SEQ ID NO: 163723 - protein, 37 aa, Artificial Sequence
  Description of Artificial Sequence: Synthetic polypeptide
DEAEIRTTNPVATEQYGCVCSNTGEHNQENFGSDNQS

SEQ ID NO: 163724 - protein, 36 aa, Artificial Sequence
  Description of Artificial Sequence: Synthetic polypeptide
DEAEIRTTNPVATEQYGCVCSNTGEDQENFNSDTQS

SEQ ID NO: 163725 - protein, 30 aa, Artificial Sequence
  Description of Artificial Sequence: Synthetic polypeptide
CEEEIATTNPVATASWGCIATTAEQTDNEN

SEQ ID NO: 163726 - protein, 30 aa, Artificial Sequence
  Description of Artificial Sequence: Synthetic polypeptide
AENEIACTNPIATEQWGAAWAEDLQPKGPR

SEQ ID NO: 163727 - protein, 36 aa, Artificial Sequence
  Description of Artificial Sequence: Synthetic polypeptide
DEEEIATTNPVATEQYGSVCAANNGEEAGDEMENAV

SEQ ID NO: 163728 - protein, 31 aa, Artificial Sequence
  Description of Artificial Sequence: Synthetic polypeptide
AENEIACTNPIATECYGATTANENWQRKGGR

SEQ ID NO: 163729 - protein, 36 aa, Artificial Sequence
  Description of Artificial Sequence: Synthetic polypeptide
MESEIRTTNPVATEQYGCVPSTTVPTQSRGGDQSMN

SEQ ID NO: 163730 - protein, 37 aa, Artificial Sequence
  Description of Artificial Sequence: Synthetic polypeptide
DEEEIRTTNPVATEQYGQCVCSNWEEHNQNFGSQNQS

SEQ ID NO: 163731 - protein, 34 aa, Artificial Sequence
  Description of Artificial Sequence: Synthetic polypeptide
MESEIRTTNPVATEQYGCVAWTEVPNDSLGGQMD

SEQ ID NO: 163732 - protein, 33 aa, Artificial Sequence
  Description of Artificial Sequence: Synthetic polypeptide
DENEIRTTNPVATEQWGDVSSEIGPMNAAEMDA

SEQ ID NO: 163733 - protein, 35 aa, Artificial Sequence
  Description of Artificial Sequence: Synthetic polypeptide
DEECIRCTNPVATEQYGCVCSWGEDDNQNFGSNQS

SEQ ID NO: 163734 - protein, 31 aa, Artificial Sequence
  Description of Artificial Sequence: Synthetic polypeptide
DDSEVASTNPVSTEGYGNVAASTIQSRTGQR

SEQ ID NO: 163735 - protein, 31 aa, Artificial Sequence
  Description of Artificial Sequence: Synthetic polypeptide
DDSEVASTNPVSTEGYGNVAASTIQSRVGDR

SEQ ID NO: 163736 - protein, 35 aa, Artificial Sequence
  Description of Artificial Sequence: Synthetic polypeptide
DAEEIATTNPVAYEQYGSVCAGNDGLQNDDLGAQA

SEQ ID NO: 163737 - protein, 36 aa, Artificial Sequence
  Description of Artificial Sequence: Synthetic polypeptide
DEEEIATTNPVATEQYGSVCAANNGEEAGMEMNGNH

SEQ ID NO: 163738 - protein, 34 aa, Artificial Sequence
  Description of Artificial Sequence: Synthetic polypeptide
DEECIRCTNPVATEQYGCVCSWMEHNQNFGSVQS

SEQ ID NO: 163739 - protein, 31 aa, Artificial Sequence
  Description of Artificial Sequence: Synthetic polypeptide
CEEEIATTNPVATASWGCIATTAAEQRDNNQ

SEQ ID NO: 163740 - protein, 31 aa, Artificial Sequence
  Description of Artificial Sequence: Synthetic polypeptide
DDSEVASTNPVSTEGYGNVAASTIQSRVGQR

SEQ ID NO: 163741 - protein, 33 aa, Artificial Sequence
  Description of Artificial Sequence: Synthetic polypeptide
MESEIRTTNPVATEQYGCVPTVPDDSDGGQSMN

SEQ ID NO: 163742 - protein, 35 aa, Artificial Sequence
  Description of Artificial Sequence: Synthetic polypeptide
DEECIRCTNPVATEQYGCVCSWNHNQENFNSDTQS

SEQ ID NO: 163743 - protein, 35 aa, Artificial Sequence
  Description of Artificial Sequence: Synthetic polypeptide
DEAEIRTTNCVAYDQYGSTVPSCQEQSQRTGGDNE

SEQ ID NO: 163744 - protein, 31 aa, Artificial Sequence
  Description of Artificial Sequence: Synthetic polypeptide
DDSEVATTNPVSTEGYGNVAANTIQSQVGQR

SEQ ID NO: 163745 - protein, 38 aa, Artificial Sequence
  Description of Artificial Sequence: Synthetic polypeptide
DTEEIRATNPVATEQYGSVSTNTNNNNNQQQIGTNNNE

SEQ ID NO: 163746 - protein, 33 aa, Artificial Sequence
  Description of Artificial Sequence: Synthetic polypeptide
DEECIRATNPVAYEQWGMVTGENDHQKGQGNAD

SEQ ID NO: 163747 - protein, 31 aa, Artificial Sequence
  Description of Artificial Sequence: Synthetic polypeptide
AENEIACTNPIATEQYGETWSNEDLQPGGYI

SEQ ID NO: 163748 - protein, 31 aa, Artificial Sequence
  Description of Artificial Sequence: Synthetic polypeptide
DDSEVATTNPVSTEGYGNVAANTIQSRVGQL

SEQ ID NO: 163749 - protein, 32 aa, Artificial Sequence
  Description of Artificial Sequence: Synthetic polypeptide
DDSEVATTNPVSTEGYGNVAANTIQSRVGQDR

SEQ ID NO: 163750 - protein, 35 aa, Artificial Sequence
  Description of Artificial Sequence: Synthetic polypeptide
DESEIATTNPVAYEQYGSVSATGDLSEDHEGGEDL

SEQ ID NO: 163751 - protein, 32 aa, Artificial Sequence
  Description of Artificial Sequence: Synthetic polypeptide
DDSEVATTNPVSTEGYGNVAANTIQSREGQDR

SEQ ID NO: 163752 - protein, 31 aa, Artificial Sequence
  Description of Artificial Sequence: Synthetic polypeptide
AEDEIACTNPVAYEQWGEAYENLQRGDGDTQ

SEQ ID NO: 163753 - protein, 34 aa, Artificial Sequence
  Description of Artificial Sequence: Synthetic polypeptide
DEAEIRTTNPVATEQYGCVCSSEHNQEYFPSDQA

SEQ ID NO: 163754 - protein, 35 aa, Artificial Sequence
  Description of Artificial Sequence: Synthetic polypeptide
MESEIRTTNPVATEQYGSVNWPYGINQFDNNQERG

SEQ ID NO: 163755 - protein, 35 aa, Artificial Sequence
  Description of Artificial Sequence: Synthetic polypeptide
DEAEIRTTNPVATEQYGCVCSNWGYHQNFNSDNQS

SEQ ID NO: 163756 - protein, 34 aa, Artificial Sequence
  Description of Artificial Sequence: Synthetic polypeptide
DEECIRCTNPVATEQYGCVCSNWEDNQNFGSQQS

SEQ ID NO: 163757 - protein, 34 aa, Artificial Sequence
  Description of Artificial Sequence: Synthetic polypeptide
DEGEIRTTNPVATEQWGKVPQEHEESMNAAEGDD

SEQ ID NO: 163758 - protein, 37 aa, Artificial Sequence
  Description of Artificial Sequence: Synthetic polypeptide
MESEIRTTNPVATEQYGSVNWPTGGLDNQFDNNQERM

SEQ ID NO: 163759 - protein, 36 aa, Artificial Sequence
  Description of Artificial Sequence: Synthetic polypeptide
DEEEIRTTNPVATEQYGQCVCSNWEEHNQGFNSDQF

SEQ ID NO: 163760 - protein, 35 aa, Artificial Sequence
  Description of Artificial Sequence: Synthetic polypeptide
DEAEIRTTNPVATEQYGCVCSNWGEHQESFGSDQS

SEQ ID NO: 163761 - protein, 35 aa, Artificial Sequence
  Description of Artificial Sequence: Synthetic polypeptide
MESEIRTTNPVATEQYGSVNWPGGLNQFDNNQEKN

SEQ ID NO: 163762 - protein, 35 aa, Artificial Sequence
  Description of Artificial Sequence: Synthetic polypeptide
DEEEIRTTNPVATEQYGSVSLSMVEMMIVPVETLN

SEQ ID NO: 163763 - protein, 36 aa, Artificial Sequence
  Description of Artificial Sequence: Synthetic polypeptide
DEECIRCTNPVATEQYGCVCSTWEDNQENFGSDNQS

SEQ ID NO: 163764 - protein, 39 aa, Artificial Sequence
  Description of Artificial Sequence: Synthetic polypeptide
DEEEIRTTNPVATEQYGVVSVTTSNQQAGNTEQGVVSTQ

SEQ ID NO: 163765 - protein, 34 aa, Artificial Sequence
  Description of Artificial Sequence: Synthetic polypeptide
DEECIRCTNPVATEQYGCVCSWAHNQENFGSDQS

SEQ ID NO: 163766 - protein, 36 aa, Artificial Sequence
  Description of Artificial Sequence: Synthetic polypeptide
DEEEIRTTNPVATEQYGQCVCSNWEEHNQNFGSDQS

SEQ ID NO: 163767 - protein, 29 aa, Artificial Sequence
  Description of Artificial Sequence: Synthetic peptide
QESEIASTNPVGTEGYGQYMASTVQHGDI

SEQ ID NO: 163768 - protein, 34 aa, Artificial Sequence
  Description of Artificial Sequence: Synthetic polypeptide
DEGEIRTTNPVATEQWGKVSESEESMNAAEGDDA

SEQ ID NO: 163769 - protein, 32 aa, Artificial Sequence
  Description of Artificial Sequence: Synthetic polypeptide
AEDEIACTNPVAYEQWGEAWSIENDQRSGGER

SEQ ID NO: 163770 - protein, 36 aa, Artificial Sequence
  Description of Artificial Sequence: Synthetic polypeptide
DEEEIATTNPVATEQYGSVCAANNGEEAGDDMENNN

SEQ ID NO: 163771 - protein, 38 aa, Artificial Sequence
  Description of Artificial Sequence: Synthetic polypeptide
AEEEIRTTNPVATEQYGSVSTVDQNNMEQGTNNVATEQ

SEQ ID NO: 163772 - protein, 33 aa, Artificial Sequence
  Description of Artificial Sequence: Synthetic polypeptide
DENEIRTTNPVATEQWGDVSSEAGPMNAAEMDA

SEQ ID NO: 163773 - protein, 36 aa, Artificial Sequence
  Description of Artificial Sequence: Synthetic polypeptide
DEEEIATTNPVATEQYGSVCAANNGEEAGMPMENNH

SEQ ID NO: 163774 - protein, 35 aa, Artificial Sequence
  Description of Artificial Sequence: Synthetic polypeptide
DEEEIRTTNPVATEQYGQCVCSNWEHAEFFNSNQP

SEQ ID NO: 163775 - protein, 36 aa, Artificial Sequence
  Description of Artificial Sequence: Synthetic polypeptide
DEEEIRTTNPVATEQYGSVTTLMNMVMPPVSEEPDV

SEQ ID NO: 163776 - protein, 37 aa, Artificial Sequence
  Description of Artificial Sequence: Synthetic polypeptide
DTEEIRATNPVATEQYGVVSTVNQNNNQAGNGNQQQD

SEQ ID NO: 163777 - protein, 34 aa, Artificial Sequence
  Description of Artificial Sequence: Synthetic polypeptide
MESEIRTTNPVATEQWGSSSTDSMVQSFQEDNQS

SEQ ID NO: 163778 - protein, 32 aa, Artificial Sequence
  Description of Artificial Sequence: Synthetic polypeptide
DESEIATTNPVAYEQWGTVCYTENDEHDGGEQ

SEQ ID NO: 163779 - protein, 37 aa, Artificial Sequence
  Description of Artificial Sequence: Synthetic polypeptide
DEEEIRTTNPVATEQYGSVTTLNANEEHQLTTVEMHQ

SEQ ID NO: 163780 - protein, 37 aa, Artificial Sequence
  Description of Artificial Sequence: Synthetic polypeptide
DTEEIRATNPVATEQYGVVSTVVNNNQQLQQGTTDDT

SEQ ID NO: 163781 - protein, 37 aa, Artificial Sequence
  Description of Artificial Sequence: Synthetic polypeptide
DTEEIRATNPVATEQYGVVSTVVNQQQLLQQGTTDDT

SEQ ID NO: 163782 - protein, 34 aa, Artificial Sequence
  Description of Artificial Sequence: Synthetic polypeptide
DEHEIRTTNPVAYESWGCVSGGNGEERNNMDGNM

SEQ ID NO: 163783 - protein, 36 aa, Artificial Sequence
  Description of Artificial Sequence: Synthetic polypeptide
DEEEIRTTNPVATEQYGSVESQPQQGEQAQPELAQG

SEQ ID NO: 163784 - protein, 34 aa, Artificial Sequence
  Description of Artificial Sequence: Synthetic polypeptide
CEEEIATTNPVATAQWGSVSLAGNGDEANNNMRN

SEQ ID NO: 163785 - protein, 37 aa, Artificial Sequence
  Description of Artificial Sequence: Synthetic polypeptide
DTEEIRATNPVATEQYGVVSTVVTNNGQAGSTNQQQD

SEQ ID NO: 163786 - protein, 37 aa, Artificial Sequence
  Description of Artificial Sequence: Synthetic polypeptide
DTEEIRATNPVATEQYGVVSTVVTNTTQAGNNQQGTD

SEQ ID NO: 163787 - protein, 36 aa, Artificial Sequence
  Description of Artificial Sequence: Synthetic polypeptide
DEEEIRTTNPVATEQYGSGYIDNTLEVVLMNEEMLN

SEQ ID NO: 163788 - protein, 36 aa, Artificial Sequence
  Description of Artificial Sequence: Synthetic polypeptide
DEEEIRTTNPVATEQYGSGWDAVPDPMQQLGSLEEP

SEQ ID NO: 163789 - protein, 32 aa, Artificial Sequence
  Description of Artificial Sequence: Synthetic polypeptide
QESEIASTNPVGTEGYGSVACINEQDHEGENI

SEQ ID NO: 163790 - protein, 37 aa, Artificial Sequence
  Description of Artificial Sequence: Synthetic polypeptide
DEEEIRTTNPVATEQYGQCVCSNWEHNQENFGSNNQA

SEQ ID NO: 163791 - protein, 37 aa, Artificial Sequence
  Description of Artificial Sequence: Synthetic polypeptide
DEEEIRTTNPVATEQYGSVESQPCLQGAVAQPELFEG

SEQ ID NO: 163792 - protein, 39 aa, Artificial Sequence
  Description of Artificial Sequence: Synthetic polypeptide
DEEEIRTTNPVATEQYGVVSTVNGNQLQQGTEQGTVVTE

SEQ ID NO: 163793 - protein, 34 aa, Artificial Sequence
  Description of Artificial Sequence: Synthetic polypeptide
DESEIATTNPVAYEQWGSVSGGNGNESRGEGDTL

SEQ ID NO: 163794 - protein, 34 aa, Artificial Sequence
  Description of Artificial Sequence: Synthetic polypeptide
DEGEIRTTNPVATECWGSFGCINEPEAREGENLG

SEQ ID NO: 163795 - protein, 34 aa, Artificial Sequence
  Description of Artificial Sequence: Synthetic polypeptide
DTEEIRATNPVAYEQWGCSYNEIDNLLQDNGGTR

SEQ ID NO: 163796 - protein, 34 aa, Artificial Sequence
  Description of Artificial Sequence: Synthetic polypeptide
DTEEIRATNPVAYEQWGCSYNEIDNLQDNGNTHD

SEQ ID NO: 163797 - protein, 33 aa, Artificial Sequence
  Description of Artificial Sequence: Synthetic polypeptide
DTEEIRATNPVAYEQWGCSYNEIDNLRQDNGTS

SEQ ID NO: 163798 - protein, 32 aa, Artificial Sequence
  Description of Artificial Sequence: Synthetic polypeptide
DTEEIRATNPVAYEQWGCSYNMDNHQQNDTSR

SEQ ID NO: 163799 - protein, 37 aa, Artificial Sequence
  Description of Artificial Sequence: Synthetic polypeptide
DEEEIRTTNPVATEQYGSVESCAVFGEQGQLEMENAF

SEQ ID NO: 163800 - protein, 36 aa, Artificial Sequence
  Description of Artificial Sequence: Synthetic polypeptide
DEEEIRTTNPVATEQYGQCVCSNWEHNQEYFNSEQA

SEQ ID NO: 163801 - protein, 39 aa, Artificial Sequence
  Description of Artificial Sequence: Synthetic polypeptide
DEEEIRTTNPVATEQYGVVSVTVTNNNNLEQGTNTNTTD

SEQ ID NO: 163802 - protein, 34 aa, Artificial Sequence
  Description of Artificial Sequence: Synthetic polypeptide
DEHEIRTTNPVAYESWGCVSGGNGEDERNTNGNA

SEQ ID NO: 163803 - protein, 37 aa, Artificial Sequence
  Description of Artificial Sequence: Synthetic polypeptide
DEEEIATTNPVATEQYGSVCAANNGVLPEDDGGNNDQ

SEQ ID NO: 163804 - protein, 32 aa, Artificial Sequence
  Description of Artificial Sequence: Synthetic polypeptide
DENEIRTTNPVATEQWGDVSMECIEMEAAEDA

SEQ ID NO: 163805 - protein, 37 aa, Artificial Sequence
  Description of Artificial Sequence: Synthetic polypeptide
DEEEIRTTNPVATEQYGQCVCSNWEHDQENFGSENQD

SEQ ID NO: 163806 - protein, 36 aa, Artificial Sequence
  Description of Artificial Sequence: Synthetic polypeptide
DEEEIRTTNPVATEQYGQCVCSNWEHDQGFNSDTQG

SEQ ID NO: 163807 - protein, 31 aa, Artificial Sequence
  Description of Artificial Sequence: Synthetic polypeptide
AEDEIACTNPVAYEQWGEASIENDHRGAGER

SEQ ID NO: 163808 - protein, 31 aa, Artificial Sequence
  Description of Artificial Sequence: Synthetic polypeptide
QESEIASTNPVGTEGYGSMASTLPQHEGEDG

SEQ ID NO: 163809 - protein, 31 aa, Artificial Sequence
  Description of Artificial Sequence: Synthetic polypeptide
QESEIASTNPVGTEGYGSMASTLPQHEGEDI

SEQ ID NO: 163810 - protein, 35 aa, Artificial Sequence
  Description of Artificial Sequence: Synthetic polypeptide
DEEEIATTNPVATEQYGSVCAANNGEEAIDENNNH

SEQ ID NO: 163811 - protein, 35 aa, Artificial Sequence
  Description of Artificial Sequence: Synthetic polypeptide
DAEEIATTNPVAYEQYGSVCAANNPLNGDPMGNNN

SEQ ID NO: 163812 - protein, 36 aa, Artificial Sequence
  Description of Artificial Sequence: Synthetic polypeptide
DEEEIATTNPVATEQYGSVCAANNGEEAPDDQGNSL

SEQ ID NO: 163813 - protein, 36 aa, Artificial Sequence
  Description of Artificial Sequence: Synthetic polypeptide
DEEEIRTTNPVATEQYGQCVCSNWEHNEGFNSDTQS

SEQ ID NO: 163814 - protein, 33 aa, Artificial Sequence
  Description of Artificial Sequence: Synthetic polypeptide
AEDEIACTNPVAYEQWGEASIELNHDQRGNGER

SEQ ID NO: 163815 - protein, 37 aa, Artificial Sequence
  Description of Artificial Sequence: Synthetic polypeptide
DEEEIRTTNPVATEQYGQCVCSNWEHNQEGFNSDTQA

SEQ ID NO: 163816 - protein, 35 aa, Artificial Sequence
  Description of Artificial Sequence: Synthetic polypeptide
DEAEIRTTNPVATEQYGCVCSMWGEHQENFNSDQA

SEQ ID NO: 163817 - protein, 33 aa, Artificial Sequence
  Description of Artificial Sequence: Synthetic polypeptide
DENEIRTTNPVATEQWGDVSNEEDWANAAEDYA

SEQ ID NO: 163818 - protein, 35 aa, Artificial Sequence
  Description of Artificial Sequence: Synthetic polypeptide
CEEEIATTNPVATAQWGSVSVSGNGENTRGVNEQD

SEQ ID NO: 163819 - protein, 31 aa, Artificial Sequence
  Description of Artificial Sequence: Synthetic polypeptide
DDSEVASTNPVSTEGYGNVAATTIQDRVGQR

SEQ ID NO: 163820 - protein, 38 aa, Artificial Sequence
  Description of Artificial Sequence: Synthetic polypeptide
DEEEIRTTNPVATEQYGVVSTVNQNQNNNNQQGTEQGS

SEQ ID NO: 163821 - protein, 36 aa, Artificial Sequence
  Description of Artificial Sequence: Synthetic polypeptide
CEGEIATTNPVATEQYGSVCSAPALGQDHQDGSDNH

SEQ ID NO: 163822 - protein, 31 aa, Artificial Sequence
  Description of Artificial Sequence: Synthetic polypeptide
DDSEVASTNPVSTEGYGNVAATTIQSRVGQR

SEQ ID NO: 163823 - protein, 38 aa, Artificial Sequence
  Description of Artificial Sequence: Synthetic polypeptide
DTEEIRATNPVATEQYGSVVVTVTNNLQQGNNGGTDDE

SEQ ID NO: 163824 - protein, 38 aa, Artificial Sequence
  Description of Artificial Sequence: Synthetic polypeptide
DTEEIRATNPVATEQYGSVVVTVTNNLQQGNNGNTEDT

SEQ ID NO: 163825 - protein, 36 aa, Artificial Sequence
  Description of Artificial Sequence: Synthetic polypeptide
DEEEIATTNPVATEQYGSVCAANNGEEQPDDQMNSL

SEQ ID NO: 163826 - protein, 38 aa, Artificial Sequence
  Description of Artificial Sequence: Synthetic polypeptide
DTEEIRATNPVATEQYGSVVVTVTNNLQQGNNNNTEDT

SEQ ID NO: 163827 - protein, 34 aa, Artificial Sequence
  Description of Artificial Sequence: Synthetic polypeptide
DEEEIACTNPVATEQWGCVAGTGSLQNAMGGTLI

SEQ ID NO: 163828 - protein, 32 aa, Artificial Sequence
  Description of Artificial Sequence: Synthetic polypeptide
AEDEIACTNPVAYEQWGEASIEGNDIQRGGER

SEQ ID NO: 163829 - protein, 36 aa, Artificial Sequence
  Description of Artificial Sequence: Synthetic polypeptide
DESEIATTNPVAYEQWGVVYSGLNDTEQRGGGGGNR

SEQ ID NO: 163830 - protein, 38 aa, Artificial Sequence
  Description of Artificial Sequence: Synthetic polypeptide
DTEEIRATNPVATEQYGSVVVTVTTNNLQQGNNTTTDT

SEQ ID NO: 163831 - protein, 37 aa, Artificial Sequence
  Description of Artificial Sequence: Synthetic polypeptide
DTEEIRATNPVATEQYGVVSTNQNQNQNNEQGTNPNE

SEQ ID NO: 163832 - protein, 30 aa, Artificial Sequence
  Description of Artificial Sequence: Synthetic polypeptide
QESEIASTNPVGTEGYGVCMASSTLQHGDI

SEQ ID NO: 163833 - protein, 37 aa, Artificial Sequence
  Description of Artificial Sequence: Synthetic polypeptide
DEEEIRTTNPVATEFYGSVSVNTGMGFETGDGNNEGF

SEQ ID NO: 163834 - protein, 35 aa, Artificial Sequence
  Description of Artificial Sequence: Synthetic polypeptide
DEAEIRTTNPVATEQYGCTCSTEDHNQHFGSDTQS

SEQ ID NO: 163835 - protein, 31 aa, Artificial Sequence
  Description of Artificial Sequence: Synthetic polypeptide
DDSEVASTNPVSTEGYGNVADNTIQSRVGQR

SEQ ID NO: 163836 - protein, 34 aa, Artificial Sequence
  Description of Artificial Sequence: Synthetic polypeptide
SEEEIRCTNPCATEQYGQCVCSWELNANFGSNQS

SEQ ID NO: 163837 - protein, 29 aa, Artificial Sequence
  Description of Artificial Sequence: Synthetic peptide
QESEIASTNPVGTEGYGVMAGSNMQHGDI

SEQ ID NO: 163838 - protein, 36 aa, Artificial Sequence
  Description of Artificial Sequence: Synthetic polypeptide
DTEEIRTTNPVATEQYGSQSWSTTNDENIMNMDAID

SEQ ID NO: 163839 - protein, 36 aa, Artificial Sequence
  Description of Artificial Sequence: Synthetic polypeptide
DEEEIRTTNPVATEQYGQCVCSSGEHNQFFNSDTQA

SEQ ID NO: 163840 - protein, 36 aa, Artificial Sequence
  Description of Artificial Sequence: Synthetic polypeptide
DEEEIRTTNPVATEQYGQCVCSSGEPQENFGSETQS

SEQ ID NO: 163841 - protein, 30 aa, Artificial Sequence
  Description of Artificial Sequence: Synthetic polypeptide
QESEIASTNPVGTEGYGVMAGSTLQHGDFI

SEQ ID NO: 163842 - protein, 35 aa, Artificial Sequence
  Description of Artificial Sequence: Synthetic polypeptide
DESEIATTNPVATEQYGTVCSATGGSPSTFEGGND

SEQ ID NO: 163843 - protein, 36 aa, Artificial Sequence
  Description of Artificial Sequence: Synthetic polypeptide
DESEIATTNPVATEQYGTVCSATGGEVSENGEGGND

SEQ ID NO: 163844 - protein, 33 aa, Artificial Sequence
  Description of Artificial Sequence: Synthetic polypeptide
DEGEICTTNPVAYEQWGSTYHTLNDDFQQMGAP

SEQ ID NO: 163845 - protein, 30 aa, Artificial Sequence
  Description of Artificial Sequence: Synthetic polypeptide
QESEIASTNPVGTEGYGVMAGSTLQHGDIF

SEQ ID NO: 163846 - protein, 29 aa, Artificial Sequence
  Description of Artificial Sequence: Synthetic peptide
QESEIASTNPVGTEGYGVMAGSTLSHGDI

SEQ ID NO: 163847 - protein, 36 aa, Artificial Sequence
  Description of Artificial Sequence: Synthetic polypeptide
DEEEIRTTNPVATEQYGQCVCSTEDHNQENFISEQS

SEQ ID NO: 163848 - protein, 35 aa, Artificial Sequence
  Description of Artificial Sequence: Synthetic polypeptide
DTEEIRTTNPVATEQYGSGCWPETDVLQEILQEDE

SEQ ID NO: 163849 - protein, 30 aa, Artificial Sequence
  Description of Artificial Sequence: Synthetic polypeptide
QESEIASTNPVGTEGYGVMAHSTLQHGEDI

SEQ ID NO: 163850 - protein, 36 aa, Artificial Sequence
  Description of Artificial Sequence: Synthetic polypeptide
DESEIATTNPVATEQYGTVCSATGGEPSHNFSGGND

SEQ ID NO: 163851 - protein, 38 aa, Artificial Sequence
  Description of Artificial Sequence: Synthetic polypeptide
AECEICTTNPVATEQYGSVYTVSTEEIGTNLQIGNEEM

SEQ ID NO: 163852 - protein, 34 aa, Artificial Sequence
  Description of Artificial Sequence: Synthetic polypeptide
DEESIACTNPVATEQYGSVCAAPQQGTHNDEDAH

SEQ ID NO: 163853 - protein, 36 aa, Artificial Sequence
  Description of Artificial Sequence: Synthetic polypeptide
QEEEIRTTNPVATEQYGSVVFDDDFEGQNDGGTNTI

SEQ ID NO: 163854 - protein, 35 aa, Artificial Sequence
  Description of Artificial Sequence: Synthetic polypeptide
DEGEICTTNPVAYEQWGSCVYSDEWNDGQHRDNGM

SEQ ID NO: 163855 - protein, 33 aa, Artificial Sequence
  Description of Artificial Sequence: Synthetic polypeptide
SEEEIRCTNPCATEQYGCVCSWNHNAYFNSNQA

SEQ ID NO: 163856 - protein, 29 aa, Artificial Sequence
  Description of Artificial Sequence: Synthetic peptide
QESEIASTNPVGTEGYGVMAITLQHCGDI

SEQ ID NO: 163857 - protein, 29 aa, Artificial Sequence
  Description of Artificial Sequence: Synthetic peptide
QESEIASTNPVGTEGYGVMAITLQHGGDQ

SEQ ID NO: 163858 - protein, 34 aa, Artificial Sequence
  Description of Artificial Sequence: Synthetic polypeptide
DESEIATTNPVATEQYGTVCSATGGEPSEFEVND

SEQ ID NO: 163859 - protein, 35 aa, Artificial Sequence
  Description of Artificial Sequence: Synthetic polypeptide
DEGEICTTNPVAYEQWGSCVYSDELNDGQHRDSGR

SEQ ID NO: 163860 - protein, 36 aa, Artificial Sequence
  Description of Artificial Sequence: Synthetic polypeptide
DEGEICTTNPVAYEQWGSCVYSDEINDGQHRNQGNQ

SEQ ID NO: 163861 - protein, 30 aa, Artificial Sequence
  Description of Artificial Sequence: Synthetic polypeptide
QESEIASTNPVGTEGYGVMALSTLQHGDIL

SEQ ID NO: 163862 - protein, 29 aa, Artificial Sequence
  Description of Artificial Sequence: Synthetic peptide
QESEIASTNPVGTEGYGVMAHSYLQHGDI

SEQ ID NO: 163863 - protein, 33 aa, Artificial Sequence
  Description of Artificial Sequence: Synthetic polypeptide
SEEEIRCTNPCATEQYGCVCSWGNHNANFGSDQ

SEQ ID NO: 163864 - protein, 35 aa, Artificial Sequence
  Description of Artificial Sequence: Synthetic polypeptide
MENEIRTTNPVATEQYGSISLTFEEQEIREMMLEG

SEQ ID NO: 163865 - protein, 36 aa, Artificial Sequence
  Description of Artificial Sequence: Synthetic polypeptide
DEEEIRTTNPVATEQYGQCVCSSGEHNQEYFNSEQA

SEQ ID NO: 163866 - protein, 36 aa, Artificial Sequence
  Description of Artificial Sequence: Synthetic polypeptide
DEEEIRTTNPVATEQYGQCVCSSGEHDQENFGSDQT

SEQ ID NO: 163867 - protein, 35 aa, Artificial Sequence
  Description of Artificial Sequence: Synthetic polypeptide
DESEIATTNPVATEQYGTVVSATDGDDEEGEGFND

SEQ ID NO: 163868 - protein, 37 aa, Artificial Sequence
  Description of Artificial Sequence: Synthetic polypeptide
QEEEIRTTNPVATEQYGSVVDFNDNQGQEDEGNEFEE

SEQ ID NO: 163869 - protein, 36 aa, Artificial Sequence
  Description of Artificial Sequence: Synthetic polypeptide
QEEEIRTTNPVATEQYGSVVDGIDNEQENEGEGGGQ

SEQ ID NO: 163870 - protein, 37 aa, Artificial Sequence
  Description of Artificial Sequence: Synthetic polypeptide
DEEEIATTNPVATEQYGSVCAWNNLLENLDDSEENRM

SEQ ID NO: 163871 - protein, 34 aa, Artificial Sequence
  Description of Artificial Sequence: Synthetic polypeptide
DEECIRTTNPVATEIYGCVCGTEDHNQNFGSQQA

SEQ ID NO: 163872 - protein, 36 aa, Artificial Sequence
  Description of Artificial Sequence: Synthetic polypeptide
DEEEIRTTNPVATEQYGQCVCSSGEHNAEFFNSDQP

SEQ ID NO: 163873 - protein, 36 aa, Artificial Sequence
  Description of Artificial Sequence: Synthetic polypeptide
DESEIATTNPVATEQYGTVLSVTGGEPSENFEGGND

SEQ ID NO: 163874 - protein, 34 aa, Artificial Sequence
  Description of Artificial Sequence: Synthetic polypeptide
DEECIRTTNPVATEIYGCVCGTEHNAENFGSQQA

SEQ ID NO: 163875 - protein, 35 aa, Artificial Sequence
  Description of Artificial Sequence: Synthetic polypeptide
DESEIATTNPVATEQYGTVISATGGEISEFEGGND

SEQ ID NO: 163876 - protein, 35 aa, Artificial Sequence
  Description of Artificial Sequence: Synthetic polypeptide
DESEIATTNPVATEQYGTVGSATGGEPSEFEGGNS

SEQ ID NO: 163877 - protein, 35 aa, Artificial Sequence
  Description of Artificial Sequence: Synthetic polypeptide
DESEIATTNPVATEQYGTVCSVTGGEPSEFEGNDD

SEQ ID NO: 163878 - protein, 30 aa, Artificial Sequence
  Description of Artificial Sequence: Synthetic polypeptide
QESEIASTNPVGTEGYGVMAFSTLQHGDYI

SEQ ID NO: 163879 - protein, 35 aa, Artificial Sequence
  Description of Artificial Sequence: Synthetic polypeptide
DEECIRTTNPVATEIYGCVCGTGEDNQNFGSNNQS

SEQ ID NO: 163880 - protein, 35 aa, Artificial Sequence
  Description of Artificial Sequence: Synthetic polypeptide
DESEIATTNPVATEQYGTVCSTTGMEPSEFEGGND

SEQ ID NO: 163881 - protein, 36 aa, Artificial Sequence
  Description of Artificial Sequence: Synthetic polypeptide
DTEEIRTTNPVATEQYGCVSTTWSAMTLEEFNEDFD

SEQ ID NO: 163882 - protein, 36 aa, Artificial Sequence
  Description of Artificial Sequence: Synthetic polypeptide
DTEEIRTTNPVATEQYGCVVPSTTHAMTLEGNEDFD

SEQ ID NO: 163883 - protein, 35 aa, Artificial Sequence
  Description of Artificial Sequence: Synthetic polypeptide
DESEIATTNPVATEQYGTVCSSTGGEVSEFEGGNQ

SEQ ID NO: 163884 - protein, 36 aa, Artificial Sequence
  Description of Artificial Sequence: Synthetic polypeptide
MENEIRTTNPVATEQYGSVCSTHLVEYNEIPNNNET

SEQ ID NO: 163885 - protein, 35 aa, Artificial Sequence
  Description of Artificial Sequence: Synthetic polypeptide
DESEIATTNPVATEQYGTVCSLTGTEVSEFEGGND

SEQ ID NO: 163886 - protein, 34 aa, Artificial Sequence
  Description of Artificial Sequence: Synthetic polypeptide
MENEIRTTNPVATEQYGSTYSPLNDDIIDLNNQY

SEQ ID NO: 163887 - protein, 37 aa, Artificial Sequence
  Description of Artificial Sequence: Synthetic polypeptide
DEEEIRTTNPVATEQYGQCVCSSGEHNQEGFGSDNQS

SEQ ID NO: 163888 - protein, 36 aa, Artificial Sequence
  Description of Artificial Sequence: Synthetic polypeptide
DEEEIRTTNPVATEQYGQCVCSSGEHNQENFGSEQA

SEQ ID NO: 163889 - protein, 29 aa, Artificial Sequence
  Description of Artificial Sequence: Synthetic peptide
QESEIASTNPVGTEGYGVMAETLQHGDIK

SEQ ID NO: 163890 - protein, 30 aa, Artificial Sequence
  Description of Artificial Sequence: Synthetic polypeptide
QESEIASTNPVGTEGYGVMAFSETLQHGDI

SEQ ID NO: 163891 - protein, 30 aa, Artificial Sequence
  Description of Artificial Sequence: Synthetic polypeptide
QESEIASTNPVGTEGYGVMAFSTLQHGDIM

SEQ ID NO: 163892 - protein, 38 aa, Artificial Sequence
  Description of Artificial Sequence: Synthetic polypeptide
DEEEIRTTNPVATEQYGSVTVVNVTNISTEQYGVSTTT

SEQ ID NO: 163893 - protein, 29 aa, Artificial Sequence
  Description of Artificial Sequence: Synthetic peptide
QESEIASTNPVGTEGYGVMALTLQHGDIN

SEQ ID NO: 163894 - protein, 38 aa, Artificial Sequence
  Description of Artificial Sequence: Synthetic polypeptide
DTEEIRTTNPVATEQYGSVSTTNNNQNGTVEQGTTDEQ

SEQ ID NO: 163895 - protein, 31 aa, Artificial Sequence
  Description of Artificial Sequence: Synthetic polypeptide
DDSEVASTNPVSTEGYGNVAINTIQSRVGQR

SEQ ID NO: 163896 - protein, 37 aa, Artificial Sequence
  Description of Artificial Sequence: Synthetic polypeptide
DTEEIRTTNPVATEQYGSVSTVTNQNGTEAGTEQGSQ

SEQ ID NO: 163897 - protein, 36 aa, Artificial Sequence
  Description of Artificial Sequence: Synthetic polypeptide
MENEIRTTNPVATEQYGEVMRICSAELEQQRPQNDG

SEQ ID NO: 163898 - protein, 33 aa, Artificial Sequence
  Description of Artificial Sequence: Synthetic polypeptide
DEHEIRTTNPVAYMQWGSVPTWEHDQHQGQMDP

SEQ ID NO: 163899 - protein, 36 aa, Artificial Sequence
  Description of Artificial Sequence: Synthetic polypeptide
DEEEIRTTNPVATEQYGSVVDDDNEGDEQEEFEQMT

SEQ ID NO: 163900 - protein, 33 aa, Artificial Sequence
  Description of Artificial Sequence: Synthetic polypeptide
DENEIATTNPVAYEPWGQSVSVTGDIGQHMIAR

SEQ ID NO: 163901 - protein, 31 aa, Artificial Sequence
  Description of Artificial Sequence: Synthetic polypeptide
DDSEVASTNPVSTEGYGNVALNTIQSRVGQR

SEQ ID NO: 163902 - protein, 34 aa, Artificial Sequence
  Description of Artificial Sequence: Synthetic polypeptide
DEEEIRTTNPVATEFYGTVVDDNMTMEFNGEQGA

SEQ ID NO: 163903 - protein, 34 aa, Artificial Sequence
  Description of Artificial Sequence: Synthetic polypeptide
CEEEIACTNPVATEQWGCVAGTGQLQNRMGGSFE

SEQ ID NO: 163904 - protein, 34 aa, Artificial Sequence
  Description of Artificial Sequence: Synthetic polypeptide
CEEEIACTNPVATEQWGCVAGTGSLQNRMGGTLD

SEQ ID NO: 163905 - protein, 37 aa, Artificial Sequence
  Description of Artificial Sequence: Synthetic polypeptide
DTEEIRTTNPVATEQYGSVSVTTTQAGTEAGTEQGSE

SEQ ID NO: 163906 - protein, 34 aa, Artificial Sequence
  Description of Artificial Sequence: Synthetic polypeptide
DEGEIATVNPVATEQYGCVAGTGLQSNANAQVEN

SEQ ID NO: 163907 - protein, 30 aa, Artificial Sequence
  Description of Artificial Sequence: Synthetic polypeptide
QESEIASTNPVGTEGYGVMAPSITLQHGDI

SEQ ID NO: 163908 - protein, 35 aa, Artificial Sequence
  Description of Artificial Sequence: Synthetic polypeptide
MENEIRTTNPVATEQYGEVMVMSSAELEHRYQNDG

SEQ ID NO: 163909 - protein, 37 aa, Artificial Sequence
  Description of Artificial Sequence: Synthetic polypeptide
QEEEIRTTNPVATEQYGSVVNMTNFGQTQEQGEGEDE

SEQ ID NO: 163910 - protein, 34 aa, Artificial Sequence
  Description of Artificial Sequence: Synthetic polypeptide
DEGEIATVNPVATEQYGCVAGNGLQTAANPQMEN

SEQ ID NO: 163911 - protein, 29 aa, Artificial Sequence
  Description of Artificial Sequence: Synthetic peptide
QESEIASTNPVGTEGYGVMAPSTLQHYDI

SEQ ID NO: 163912 - protein, 37 aa, Artificial Sequence
  Description of Artificial Sequence: Synthetic polypeptide
DEEEIRTTNPVATEQYGSVVDPTIGVHSAQIGVAEQN

SEQ ID NO: 163913 - protein, 36 aa, Artificial Sequence
  Description of Artificial Sequence: Synthetic polypeptide
DTEEIRTTNPVATEQYGVVSTQAGNNTNEQGTTEED

SEQ ID NO: 163914 - protein, 31 aa, Artificial Sequence
  Description of Artificial Sequence: Synthetic polypeptide
DDSEVASTNPVSTEGYGNVAMNDHQSRQGQR

SEQ ID NO: 163915 - protein, 34 aa, Artificial Sequence
  Description of Artificial Sequence: Synthetic polypeptide
DEGEIATVNPVATEQYGCVAGNGLQSNNNSQAEE

SEQ ID NO: 163916 - protein, 36 aa, Artificial Sequence
  Description of Artificial Sequence: Synthetic polypeptide
DEEEIRTTNPVATEQYGSVVEPVEMMLQEVASLTAM

SEQ ID NO: 163917 - protein, 32 aa, Artificial Sequence
  Description of Artificial Sequence: Synthetic polypeptide
SEEEIRCTNPCATEQYGCVCSWAHAYFGSDQA

SEQ ID NO: 163918 - protein, 31 aa, Artificial Sequence
  Description of Artificial Sequence: Synthetic polypeptide
DDSEVASTNPVSTEGYGNVAMNTIQSRVGQR

SEQ ID NO: 163919 - protein, 30 aa, Artificial Sequence
  Description of Artificial Sequence: Synthetic polypeptide
QESEIASTNPVGTEGYGVMARSTLQDHGDI

SEQ ID NO: 163920 - protein, 39 aa, Artificial Sequence
  Description of Artificial Sequence: Synthetic polypeptide
DEEEIRTTNPVATEQYGVVSVTVVTNLQQGTEQGSTEDE

SEQ ID NO: 163921 - protein, 30 aa, Artificial Sequence
  Description of Artificial Sequence: Synthetic polypeptide
QESEIASTNPVGTEGYGVMARSTLQHGDIG

SEQ ID NO: 163922 - protein, 34 aa, Artificial Sequence
  Description of Artificial Sequence: Synthetic polypeptide
DEGEIATVNPVATEQYGCVAGTGLQSANNDQMEN

SEQ ID NO: 163923 - protein, 35 aa, Artificial Sequence
  Description of Artificial Sequence: Synthetic polypeptide
MENEIRTTNPVATEQYGEVQMSSAEDEQRPQNDDG

SEQ ID NO: 163924 - protein, 34 aa, Artificial Sequence
  Description of Artificial Sequence: Synthetic polypeptide
DEECIRTTNPVATEIYGCVCTTEHNQENFGSEQA

SEQ ID NO: 163925 - protein, 38 aa, Artificial Sequence
  Description of Artificial Sequence: Synthetic polypeptide
DTEEIRTTNPVATEQYGSVSTVTNLNEGTEAGTEQGSD

SEQ ID NO: 163926 - protein, 35 aa, Artificial Sequence
  Description of Artificial Sequence: Synthetic polypeptide
DEGEICTTNPVATEQYGTVPSATDGEPSEFEGGNE

SEQ ID NO: 163927 - protein, 28 aa, Artificial Sequence
  Description of Artificial Sequence: Synthetic peptide
QESEIASTNPVGTEGYGVMAMTHQHGDI

SEQ ID NO: 163928 - protein, 38 aa, Artificial Sequence
  Description of Artificial Sequence: Synthetic polypeptide
DTEEIRTTNPVATEQYGSVSTTNQQQSGTEAGTEQGSD

SEQ ID NO: 163929 - protein, 38 aa, Artificial Sequence
  Description of Artificial Sequence: Synthetic polypeptide
DTEEIRTTNPVATEQYGSVSTTNTQAGTEQGTEQQGDD

SEQ ID NO: 163930 - protein, 38 aa, Artificial Sequence
  Description of Artificial Sequence: Synthetic polypeptide
DTEEIRTTNPVATEQYGSVSTTTGQAGTEAGTEEQGND

SEQ ID NO: 163931 - protein, 37 aa, Artificial Sequence
  Description of Artificial Sequence: Synthetic polypeptide
DEQEIRTTNPVATEQYGSVPEAALMLEQGRIIVNTNQ

SEQ ID NO: 163932 - protein, 38 aa, Artificial Sequence
  Description of Artificial Sequence: Synthetic polypeptide
QEEEIRTTNPVATEQYGSVVIPTNLEGPEMGQGENEEG

SEQ ID NO: 163933 - protein, 34 aa, Artificial Sequence
  Description of Artificial Sequence: Synthetic polypeptide
DESEIATTNPVATEQYGTVCSAADGPVEAEGNND

SEQ ID NO: 163934 - protein, 38 aa, Artificial Sequence
  Description of Artificial Sequence: Synthetic polypeptide
DTEEIRTTNPVATEQYGSVSTTTNQEGGTQAGTEQGSE

SEQ ID NO: 163935 - protein, 37 aa, Artificial Sequence
  Description of Artificial Sequence: Synthetic polypeptide
DTEEIRTTNPVATEQYGSVSTTTQQAGTEQGTEQGSD

SEQ ID NO: 163936 - protein, 35 aa, Artificial Sequence
  Description of Artificial Sequence: Synthetic polypeptide
DESEIATTNPVATEQYGTTVCSATDGEPSESEGND

SEQ ID NO: 163937 - protein, 34 aa, Artificial Sequence
  Description of Artificial Sequence: Synthetic polypeptide
DEGEICTTNPVATEQYGSSFGATDTLEPHEGEDT

SEQ ID NO: 163938 - protein, 34 aa, Artificial Sequence
  Description of Artificial Sequence: Synthetic polypeptide
SEEEIRCTNPCATEQYGCVCSWGELNAHFGSNQA

SEQ ID NO: 163939 - protein, 37 aa, Artificial Sequence
  Description of Artificial Sequence: Synthetic polypeptide
DEEEIRTTNPVATEQYGSVVAGINDWTIEQPEQEGEP

SEQ ID NO: 163940 - protein, 37 aa, Artificial Sequence
  Description of Artificial Sequence: Synthetic polypeptide
DTEEIRTTNPVATEQYGSVSTVNNNNQNNDEEEEQDE

SEQ ID NO: 163941 - protein, 29 aa, Artificial Sequence
  Description of Artificial Sequence: Synthetic peptide
QESEIASTNPVGTEGYGVMANSTLAHGDI

SEQ ID NO: 163942 - protein, 34 aa, Artificial Sequence
  Description of Artificial Sequence: Synthetic polypeptide
DEMEIATTNPVATEQYGCVCSNWDLNEDHFGETL

SEQ ID NO: 163943 - protein, 38 aa, Artificial Sequence
  Description of Artificial Sequence: Synthetic polypeptide
DTEEIRTTNPVATEQYGSVSTVNQGGNTEQGSTNQAQE

SEQ ID NO: 163944 - protein, 38 aa, Artificial Sequence
  Description of Artificial Sequence: Synthetic polypeptide
DTEEIRTTNPVATEQYGSVSTVNQNGNTEQGTTTNNQD

SEQ ID NO: 163945 - protein, 33 aa, Artificial Sequence
  Description of Artificial Sequence: Synthetic polypeptide
DEAEIRTTNPVATEQYGACNGPFINDMIYNDQQ

SEQ ID NO: 163946 - protein, 30 aa, Artificial Sequence
  Description of Artificial Sequence: Synthetic polypeptide
QESEIASTNPVGTEGYGVMANSTLQHGDIH

SEQ ID NO: 163947 - protein, 37 aa, Artificial Sequence
  Description of Artificial Sequence: Synthetic polypeptide
DEEEIRTTNPVATEQYGSVQTPIMVMEGQINIHEVNQ

SEQ ID NO: 163948 - protein, 35 aa, Artificial Sequence
  Description of Artificial Sequence: Synthetic polypeptide
MENEIRTTNPVATEQYGEVVMSSAELEQYPQNADG

SEQ ID NO: 163949 - protein, 30 aa, Artificial Sequence
  Description of Artificial Sequence: Synthetic polypeptide
QESEIASTNPVGTEGYGVMANSTLQHKGDI

SEQ ID NO: 163950 - protein, 35 aa, Artificial Sequence
  Description of Artificial Sequence: Synthetic polypeptide
MENEIRTTNPVATEQYGEVVMSSAELEQENPQNDG

SEQ ID NO: 163951 - protein, 35 aa, Artificial Sequence
  Description of Artificial Sequence: Synthetic polypeptide
MENEIRTTNPVATEQYGEVVMSSAELEDERTQNDG

SEQ ID NO: 163952 - protein, 38 aa, Artificial Sequence
  Description of Artificial Sequence: Synthetic polypeptide
DEEEIRTTNPVATEQYGSVVCEPTNNMESPFVQLENQV

SEQ ID NO: 163953 - protein, 29 aa, Artificial Sequence
  Description of Artificial Sequence: Synthetic peptide
QESEIASTNPVGTEGYGVMAETLAQHGDI

SEQ ID NO: 163954 - protein, 35 aa, Artificial Sequence
  Description of Artificial Sequence: Synthetic polypeptide
SEEEIRCTNPCATEQYGCVCSTWEHNANFGSDNQS

SEQ ID NO: 163955 - protein, 30 aa, Artificial Sequence
  Description of Artificial Sequence: Synthetic polypeptide
QESEIASTNPVGTEGYGVMAESTLQHGMDI

SEQ ID NO: 163956 - protein, 30 aa, Artificial Sequence
  Description of Artificial Sequence: Synthetic polypeptide
QESEIASTNPVGTEGYGVMAESTLQDHGDI

SEQ ID NO: 163957 - protein, 34 aa, Artificial Sequence
  Description of Artificial Sequence: Synthetic polypeptide
DEECIRTTNPVATEGYGCVCGWGNHQEYFGSDQS

SEQ ID NO: 163958 - protein, 32 aa, Artificial Sequence
  Description of Artificial Sequence: Synthetic polypeptide
DDSEVASTNPVSTEGYGNVAFNTIQSRVGNQR

SEQ ID NO: 163959 - protein, 31 aa, Artificial Sequence
  Description of Artificial Sequence: Synthetic polypeptide
DDSEVASTNPVSTEGYGNVAFNTIQSRVGQR

SEQ ID NO: 163960 - protein, 34 aa, Artificial Sequence
  Description of Artificial Sequence: Synthetic polypeptide
DEHEIRTTNPVAYESWGSVSGGGNQGGMQGDNGK

SEQ ID NO: 163961 - protein, 37 aa, Artificial Sequence
  Description of Artificial Sequence: Synthetic polypeptide
MEPEICTTNPVATEQYGSVSTVTGGQNFQEEMGNGEE

SEQ ID NO: 163962 - protein, 32 aa, Artificial Sequence
  Description of Artificial Sequence: Synthetic polypeptide
AEMEIVCTNPVATEQYGEACSATDGPEFEGND

SEQ ID NO: 163963 - protein, 37 aa, Artificial Sequence
  Description of Artificial Sequence: Synthetic polypeptide
DEEEIRTTNPVATEQYGQCVCSNWGEHNANFGSDNQS

SEQ ID NO: 163964 - protein, 34 aa, Artificial Sequence
  Description of Artificial Sequence: Synthetic polypeptide
CEEEIACTNPVATEQWGCVAGTGLVQAENAGMNQ

SEQ ID NO: 163965 - protein, 37 aa, Artificial Sequence
  Description of Artificial Sequence: Synthetic polypeptide
DEEEIRTTNPVATEQYGSVEPTLPIMPAEPGLNVPPM

SEQ ID NO: 163966 - protein, 31 aa, Artificial Sequence
  Description of Artificial Sequence: Synthetic polypeptide
SEEEIRCTNPIATECWGATVWAENWAERGPI

SEQ ID NO: 163967 - protein, 31 aa, Artificial Sequence
  Description of Artificial Sequence: Synthetic polypeptide
MENPIACTNPVATEQYGEASEVLTLRGDGQQ

SEQ ID NO: 163968 - protein, 34 aa, Artificial Sequence
  Description of Artificial Sequence: Synthetic polypeptide
DENEIATTNPVATESYGSVAMNNDTNPDNQTEGI

SEQ ID NO: 163969 - protein, 33 aa, Artificial Sequence
  Description of Artificial Sequence: Synthetic polypeptide
AEMEIVCTNPVATEQYGTVCSATDGPVEFEGND

SEQ ID NO: 163970 - protein, 39 aa, Artificial Sequence
  Description of Artificial Sequence: Synthetic polypeptide
DEEEIRTTNPVATEQYGVVSVTVVNTNLEQGNNEEDEDE

SEQ ID NO: 163971 - protein, 31 aa, Artificial Sequence
  Description of Artificial Sequence: Synthetic polypeptide
DDSEVASTNPVSTEGYGNVAGNDIQSRVGQR

SEQ ID NO: 163972 - protein, 32 aa, Artificial Sequence
  Description of Artificial Sequence: Synthetic polypeptide
MENEIRTTNPVSTEPYGTISMEDRQQQQQGNH

SEQ ID NO: 163973 - protein, 32 aa, Artificial Sequence
  Description of Artificial Sequence: Synthetic polypeptide
MENEIRTTNPVSTEPYGTISMEDKQQQQNGNH

SEQ ID NO: 163974 - protein, 31 aa, Artificial Sequence
  Description of Artificial Sequence: Synthetic polypeptide
DDSEVASTNPVSTEGYGNVAGNTIQSRLGQR

SEQ ID NO: 163975 - protein, 32 aa, Artificial Sequence
  Description of Artificial Sequence: Synthetic polypeptide
MENEIRTTNPVSTEPYGTISMEDIQQQQNGNH

SEQ ID NO: 163976 - protein, 30 aa, Artificial Sequence
  Description of Artificial Sequence: Synthetic polypeptide
QESEIASTNPVGTEGYGVICASTLQHGDIS

SEQ ID NO: 163977 - protein, 30 aa, Artificial Sequence
  Description of Artificial Sequence: Synthetic polypeptide
QESEIASTNPVGTEGYGVIMASATLQHGDI

SEQ ID NO: 163978 - protein, 37 aa, Artificial Sequence
  Description of Artificial Sequence: Synthetic polypeptide
DEEEIRTTNPVATEQYGQCVCSNWGEHNQENFGSNQL

SEQ ID NO: 163979 - protein, 30 aa, Artificial Sequence
  Description of Artificial Sequence: Synthetic polypeptide
MENEIRTTNPVAYEQWGDVSEIEMNAAEDA

SEQ ID NO: 163980 - protein, 30 aa, Artificial Sequence
  Description of Artificial Sequence: Synthetic polypeptide
QESEIASTNPVGTEGYGVIMASTLQHGDTI

SEQ ID NO: 163981 - protein, 30 aa, Artificial Sequence
  Description of Artificial Sequence: Synthetic polypeptide
QESEIASTNPVGTEGYGVIMASTLQHGLDI

SEQ ID NO: 163982 - protein, 34 aa, Artificial Sequence
  Description of Artificial Sequence: Synthetic polypeptide
CEEEIACTNPVATEQWGCVAGTGLVQTAENDGNN

SEQ ID NO: 163983 - protein, 35 aa, Artificial Sequence
  Description of Artificial Sequence: Synthetic polypeptide
MENEITTTNPVATEQYGDVSVTGEGGQGGQGNDEE

SEQ ID NO: 163984 - protein, 35 aa, Artificial Sequence
  Description of Artificial Sequence: Synthetic polypeptide
DEECIRTTNPVATEGYGCVCSTGEDQEFFGSDTQA

SEQ ID NO: 163985 - protein, 33 aa, Artificial Sequence
  Description of Artificial Sequence: Synthetic polypeptide
AEMEIVTTNPVATEMYGTVCSATDGPVEFEGND

SEQ ID NO: 163986 - protein, 36 aa, Artificial Sequence
  Description of Artificial Sequence: Synthetic polypeptide
DDEEIRTTNPVATEFYGSVSTMDDQIGEGGGEEEGG

SEQ ID NO: 163987 - protein, 35 aa, Artificial Sequence
  Description of Artificial Sequence: Synthetic polypeptide
DEEEIRTTNPVATEFYGSVVDDGFNGGNEDTNNDP

SEQ ID NO: 163988 - protein, 35 aa, Artificial Sequence
  Description of Artificial Sequence: Synthetic polypeptide
YEEEIRTTNPAATEQYGSVNQEEDGQEEGNGGNNI

SEQ ID NO: 163989 - protein, 39 aa, Artificial Sequence
  Description of Artificial Sequence: Synthetic polypeptide
DEEEIRTTNPVATEQYGVVSVTVVNNLQQGTEQGTTTTE

SEQ ID NO: 163990 - protein, 37 aa, Artificial Sequence
  Description of Artificial Sequence: Synthetic polypeptide
DTEEIRTTNPCATEAYGVVSTVVTNLGQQGTEENEDE

SEQ ID NO: 163991 - protein, 36 aa, Artificial Sequence
  Description of Artificial Sequence: Synthetic polypeptide
DTEEIRTTNPCATEAYGVVSTVVTNLQAGTEEGEDD

SEQ ID NO: 163992 - protein, 33 aa, Artificial Sequence
  Description of Artificial Sequence: Synthetic polypeptide
AEMEIVTTNPVATGQYGTVCSATDGPVEFEGND

SEQ ID NO: 163993 - protein, 33 aa, Artificial Sequence
  Description of Artificial Sequence: Synthetic polypeptide
AEMEIVTTNPVATESYGTVCSATDGPVEFEGND

SEQ ID NO: 163994 - protein, 36 aa, Artificial Sequence
  Description of Artificial Sequence: Synthetic polypeptide
DEEEIATTNPVATEQYGSVCAANSNLEATDSGGSDM

SEQ ID NO: 163995 - protein, 36 aa, Artificial Sequence
  Description of Artificial Sequence: Synthetic polypeptide
DEQEIRTTNPVATEQYGSVNIPVVSLNPQEDVTEEN

SEQ ID NO: 163996 - protein, 36 aa, Artificial Sequence
  Description of Artificial Sequence: Synthetic polypeptide
DEMEIATTNPVATEQYGCVCSTTEHNEDHFGSENLA

SEQ ID NO: 163997 - protein, 35 aa, Artificial Sequence
  Description of Artificial Sequence: Synthetic polypeptide
DEMEIATTNPVATEQYGCVCSTTEDNEDHFGSETL

SEQ ID NO: 163998 - protein, 29 aa, Artificial Sequence
  Description of Artificial Sequence: Synthetic peptide
QESEIASTNPVGTEGYGVGMASPLQHGDI

SEQ ID NO: 163999 - protein, 37 aa, Artificial Sequence
  Description of Artificial Sequence: Synthetic polypeptide
DEEEIRTTNPVATEQYGVVSVTVVNQQGTTTEEDEDE

SEQ ID NO: 164000 - protein, 35 aa, Artificial Sequence
  Description of Artificial Sequence: Synthetic polypeptide
DEAEIRTTNPVATEQYGCTCSNSGEHNQYFGSDQA

SEQ ID NO: 164001 - protein, 36 aa, Artificial Sequence
  Description of Artificial Sequence: Synthetic polypeptide
DEEEIRTTNPVATEQYGSVTVAIEEQIENTEEDEDM

SEQ ID NO: 164002 - protein, 36 aa, Artificial Sequence
  Description of Artificial Sequence: Synthetic polypeptide
DEMEIATTNPVATEQYGCVCSTTDLNEDHFGSENLM

SEQ ID NO: 164003 - protein, 39 aa, Artificial Sequence
  Description of Artificial Sequence: Synthetic polypeptide
DEEEIRTTNPVATEQYGVVSVTVVNNQQQLQGTNNNNNE

SEQ ID NO: 164004 - protein, 34 aa, Artificial Sequence
  Description of Artificial Sequence: Synthetic polypeptide
DEECIRTTNPVATECWGMHCWTMNEQQRRENDSQ

SEQ ID NO: 164005 - protein, 35 aa, Artificial Sequence
  Description of Artificial Sequence: Synthetic polypeptide
DEECIRTTNPVATECWGSVVVNCINMGSESRPGND

SEQ ID NO: 164006 - protein, 35 aa, Artificial Sequence
  Description of Artificial Sequence: Synthetic polypeptide
DEQEIRTTNPVATEQYGSVNIWVTSENEPEDTEET

SEQ ID NO: 164007 - protein, 35 aa, Artificial Sequence
  Description of Artificial Sequence: Synthetic polypeptide
DEEEIATTNPVATEQYGSVCAATAGEEMMGMPPEG

SEQ ID NO: 164008 - protein, 32 aa, Artificial Sequence
  Description of Artificial Sequence: Synthetic polypeptide
DENEIATTNPVATESYGCIAANNNLNDAGAGH

SEQ ID NO: 164009 - protein, 31 aa, Artificial Sequence
  Description of Artificial Sequence: Synthetic polypeptide
DDSEVASTNPVSTEGYGNVAENTIQSRVGQR

SEQ ID NO: 164010 - protein, 34 aa, Artificial Sequence
  Description of Artificial Sequence: Synthetic polypeptide
DEEEIATTNPVATEQYGSVCAATAGEEMMMPTED

SEQ ID NO: 164011 - protein, 33 aa, Artificial Sequence
  Description of Artificial Sequence: Synthetic polypeptide
AEMEIVTTNPVATEQYGEVCSATDGPVEFEGGD

SEQ ID NO: 164012 - protein, 32 aa, Artificial Sequence
  Description of Artificial Sequence: Synthetic polypeptide
DDSEVATTNPVSTEGYGNVAANPTIQSRVGQR

SEQ ID NO: 164013 - protein, 34 aa, Artificial Sequence
  Description of Artificial Sequence: Synthetic polypeptide
AEMEIVTTNPVATEQYGTVCSATDGPVEFEGGND

SEQ ID NO: 164014 - protein, 31 aa, Artificial Sequence
  Description of Artificial Sequence: Synthetic polypeptide
DDSEVASTNPVSTEGYGNVAGNTIQSRVGQR

SEQ ID NO: 164015 - protein, 30 aa, Artificial Sequence
  Description of Artificial Sequence: Synthetic polypeptide
QESEIASTNPVGTEGYGVLMASTNQHGDID

SEQ ID NO: 164016 - protein, 29 aa, Artificial Sequence
  Description of Artificial Sequence: Synthetic peptide
QESEIASTNPVGTEGYGVMAAETLQPGDI

SEQ ID NO: 164017 - protein, 38 aa, Artificial Sequence
  Description of Artificial Sequence: Synthetic polypeptide
AEEEIRTTNPVATEQYGVVSTTNTNNLEQGSNQNQNDD

SEQ ID NO: 164018 - protein, 29 aa, Artificial Sequence
  Description of Artificial Sequence: Synthetic peptide
QESEIASTNPVGTEGYGVMADSTRQHGDI

SEQ ID NO: 164019 - protein, 28 aa, Artificial Sequence
  Description of Artificial Sequence: Synthetic peptide
QESEIASTNPVGTEGYGVMADTKQHGDI

SEQ ID NO: 164020 - protein, 29 aa, Artificial Sequence
  Description of Artificial Sequence: Synthetic peptide
QESEIASTNPVGTEGYGVMADTLQFHGDI

SEQ ID NO: 164021 - protein, 37 aa, Artificial Sequence
  Description of Artificial Sequence: Synthetic polypeptide
DEEEIRTTNPVATEQYGQCVCSNWGETNQENFNSDQT

SEQ ID NO: 164022 - protein, 37 aa, Artificial Sequence
  Description of Artificial Sequence: Synthetic polypeptide
DDEEIRTTNPVATEFYGSVVNTTMNGQIEEGGGNNGQ

SEQ ID NO: 164023 - protein, 36 aa, Artificial Sequence
  Description of Artificial Sequence: Synthetic polypeptide
DEEEIRTTNPVATEQYGQCVCSNWGETQEHFNSDQN

SEQ ID NO: 164024 - protein, 37 aa, Artificial Sequence
  Description of Artificial Sequence: Synthetic polypeptide
AEEEIRTTNPVATEQYGVVSTTNTNNTEQGSNQNNDD

SEQ ID NO: 164025 - protein, 35 aa, Artificial Sequence
  Description of Artificial Sequence: Synthetic polypeptide
DEESIACTNPVATEQWGSVAITNPEQGGHQDNSDA

SEQ ID NO: 164026 - protein, 28 aa, Artificial Sequence
  Description of Artificial Sequence: Synthetic peptide
QESEIASTNPVGTEGYGVMADTLQHSDI

SEQ ID NO: 164027 - protein, 34 aa, Artificial Sequence
  Description of Artificial Sequence: Synthetic polypeptide
AEMEISTTNPVATEQYGCVCSTGEHQENFGSDQS

SEQ ID NO: 164028 - protein, 36 aa, Artificial Sequence
  Description of Artificial Sequence: Synthetic polypeptide
DEEEIRTTNPVATEQYGQCVCSNWGPHNQNFGSEQS

SEQ ID NO: 164029 - protein, 30 aa, Artificial Sequence
  Description of Artificial Sequence: Synthetic polypeptide
QESEIASTNPVGTEGYGVMADSTLQFHGDI

SEQ ID NO: 164030 - protein, 35 aa, Artificial Sequence
  Description of Artificial Sequence: Synthetic polypeptide
DEEEIRTTNPVATEQYGQCVCSNWGYHANFNSDQY

SEQ ID NO: 164031 - protein, 36 aa, Artificial Sequence
  Description of Artificial Sequence: Synthetic polypeptide
DEEEIRTTNPVATEQYGQCVCSNWMEHNQNFNSDQA

SEQ ID NO: 164032 - protein, 37 aa, Artificial Sequence
  Description of Artificial Sequence: Synthetic polypeptide
DEEEIRTTNPVATEQYGQCVCSNWNEHEQGFNSNTQS

SEQ ID NO: 164033 - protein, 37 aa, Artificial Sequence
  Description of Artificial Sequence: Synthetic polypeptide
DEEEIRTTNPVATEQYGQCVCSNWVEHQENFGSDNQG

SEQ ID NO: 164034 - protein, 36 aa, Artificial Sequence
  Description of Artificial Sequence: Synthetic polypeptide
DEEEIRTTNPVATEQYGQCVCSNWYHQENFGSDTQT

SEQ ID NO: 164035 - protein, 36 aa, Artificial Sequence
  Description of Artificial Sequence: Synthetic polypeptide
MENEIRTTNPVATEQYGSVSAVNPDEMKMSGGNVEQ

SEQ ID NO: 164036 - protein, 36 aa, Artificial Sequence
  Description of Artificial Sequence: Synthetic polypeptide
DEEEIRTTNPVATEQYGQCVCSSEEHNQNFGSDTQS

SEQ ID NO: 164037 - protein, 36 aa, Artificial Sequence
  Description of Artificial Sequence: Synthetic polypeptide
DEEEIRTTNPVATEQYGQCVCSSEEHQESFGSDTQS

SEQ ID NO: 164038 - protein, 35 aa, Artificial Sequence
  Description of Artificial Sequence: Synthetic polypeptide
DEESIACTNPVATEQWGSVSATAHGPLANPGGNHQ

SEQ ID NO: 164039 - protein, 35 aa, Artificial Sequence
  Description of Artificial Sequence: Synthetic polypeptide
DDEEISTTNPVATEQYGCVCSTEEHNQNFGSQTQA

SEQ ID NO: 164040 - protein, 35 aa, Artificial Sequence
  Description of Artificial Sequence: Synthetic polypeptide
DEESIACTNPVATEQYGSACAANNLQDSPDENARE

SEQ ID NO: 164041 - protein, 29 aa, Artificial Sequence
  Description of Artificial Sequence: Synthetic peptide
QESEIASTNPVGTEGYGVMAESALQHGDI

SEQ ID NO: 164042 - protein, 36 aa, Artificial Sequence
  Description of Artificial Sequence: Synthetic polypeptide
MENEIRTTNPVATEQYGSVISVMMHDLQTGPEEQYE

SEQ ID NO: 164043 - protein, 35 aa, Artificial Sequence
  Description of Artificial Sequence: Synthetic polypeptide
DEGETYRTWTNPDAPEQYDSPVSTCYYQYRWGKSR

SEQ ID NO: 164044 - protein, 39 aa, Artificial Sequence
  Description of Artificial Sequence: Synthetic polypeptide
DTEEIRTTNPVATEAYGSVSVTVTNLQQGTEQGSNNQTD

SEQ ID NO: 164045 - protein, 38 aa, Artificial Sequence
  Description of Artificial Sequence: Synthetic polypeptide
DTEEIRTTNPVATEAYGSVSTVNNQQGNTEQGSTNQQD

SEQ ID NO: 164046 - protein, 29 aa, Artificial Sequence
  Description of Artificial Sequence: Synthetic peptide
QESEIASTNPVGTEGYGVMADFTLQHGDI

SEQ ID NO: 164047 - protein, 37 aa, Artificial Sequence
  Description of Artificial Sequence: Synthetic polypeptide
MENEIRTTNPVATEQYGSVYDQSNLNIIQEGGGNQGV

SEQ ID NO: 164048 - protein, 36 aa, Artificial Sequence
  Description of Artificial Sequence: Synthetic polypeptide
DEEEIRTTNPVATEQYGQCVCSNWGEHNQGFGSDQA

SEQ ID NO: 164049 - protein, 36 aa, Artificial Sequence
  Description of Artificial Sequence: Synthetic polypeptide
DEEEIRTTNPVATEQYGQCVCSNWGEHNQNFGSDQD

SEQ ID NO: 164050 - protein, 29 aa, Artificial Sequence
  Description of Artificial Sequence: Synthetic peptide
QESEIASTNPVGTEGYGVMAASSLQHGDI

SEQ ID NO: 164051 - protein, 37 aa, Artificial Sequence
  Description of Artificial Sequence: Synthetic polypeptide
DEEEIRTTNPVATEQYGQCVCSNWGEHNQNFGSENQF

SEQ ID NO: 164052 - protein, 29 aa, Artificial Sequence
  Description of Artificial Sequence: Synthetic peptide
QESEIASTNPVGTEGYGVMAASTLGHGDI

SEQ ID NO: 164053 - protein, 36 aa, Artificial Sequence
  Description of Artificial Sequence: Synthetic polypeptide
MENEIRTTNPVATEQYGSVSWTPGVLEIEDGQEIEY

SEQ ID NO: 164054 - protein, 35 aa, Artificial Sequence
  Description of Artificial Sequence: Synthetic polypeptide
MENEIRTTNPVATEQYGSVSWTGVAEIPFMQETED

SEQ ID NO: 164055 - protein, 36 aa, Artificial Sequence
  Description of Artificial Sequence: Synthetic polypeptide
DEEEIATTNPVATEQYGSVCDDTPLPDDSGDGMAYN

SEQ ID NO: 164056 - protein, 30 aa, Artificial Sequence
  Description of Artificial Sequence: Synthetic polypeptide
QESEIASTNPVGTEGYGVMAASTLQHGDID

SEQ ID NO: 164057 - protein, 30 aa, Artificial Sequence
  Description of Artificial Sequence: Synthetic polypeptide
QESEIASTNPVGTEGYGVMAASTLQHGRDI

SEQ ID NO: 164058 - protein, 36 aa, Artificial Sequence
  Description of Artificial Sequence: Synthetic polypeptide
DEEEIRTTNPVATEQYGQCVCSNWGEHNQYFGSDFS

SEQ ID NO: 164059 - protein, 29 aa, Artificial Sequence
  Description of Artificial Sequence: Synthetic peptide
QESEIASTNPVGTEGYGVMAATLQHGQDI

SEQ ID NO: 164060 - protein, 33 aa, Artificial Sequence
  Description of Artificial Sequence: Synthetic polypeptide
SEEEIRCTNPEATEQYGCVCSWGELANFGSDQA

SEQ ID NO: 164061 - protein, 33 aa, Artificial Sequence
  Description of Artificial Sequence: Synthetic polypeptide
SEEEIRCTNPEATEQYGCVCSWELNAHFGSDQA

SEQ ID NO: 164062 - protein, 29 aa, Artificial Sequence
  Description of Artificial Sequence: Synthetic peptide
QESEIASTNPVGTEGYGVMAATLQPGDYI

SEQ ID NO: 164063 - protein, 36 aa, Artificial Sequence
  Description of Artificial Sequence: Synthetic polypeptide
DECEICTTNPVATEAYGVVSTVNDQQGNTEENEDED

SEQ ID NO: 164064 - protein, 31 aa, Artificial Sequence
  Description of Artificial Sequence: Synthetic polypeptide
DDSEVASTNPVSTEGYGNVAHNTIQSRVGQR

SEQ ID NO: 164065 - protein, 34 aa, Artificial Sequence
  Description of Artificial Sequence: Synthetic polypeptide
DEESIACTNPVATEQWGGCVAGNNNLQEAGHNDN

SEQ ID NO: 164066 - protein, 35 aa, Artificial Sequence
  Description of Artificial Sequence: Synthetic polypeptide
MENEIRTTNPVATEQYGSVSWCGVAEIPFHQEGED

SEQ ID NO: 164067 - protein, 30 aa, Artificial Sequence
  Description of Artificial Sequence: Synthetic polypeptide
QESEIASTNPVGTEGYGVMACSTLQHGDID

SEQ ID NO: 164068 - protein, 36 aa, Artificial Sequence
  Description of Artificial Sequence: Synthetic polypeptide
DEEEIRTTNPVATEQYGQCVCSNWGEHQFFGSDTQS

SEQ ID NO: 164069 - protein, 36 aa, Artificial Sequence
  Description of Artificial Sequence: Synthetic polypeptide
DEEEIRTTNPVATEQYGQCVCSNWGEHQNFGSQTQA

SEQ ID NO: 164070 - protein, 36 aa, Artificial Sequence
  Description of Artificial Sequence: Synthetic polypeptide
DEEEIRTTNPVATEQYGQCVCSNWGEHQNSNSDNQS

SEQ ID NO: 164071 - protein, 34 aa, Artificial Sequence
  Description of Artificial Sequence: Synthetic polypeptide
DEESIACTNPVATEQWGGCVAGNNNLQEAGHNHQ

SEQ ID NO: 164072 - protein, 37 aa, Artificial Sequence
  Description of Artificial Sequence: Synthetic polypeptide
DEEEIRTTNPVATEQYGSVEPTLIIMQEMAEIEITRM

SEQ ID NO: 164073 - protein, 39 aa, Artificial Sequence
  Description of Artificial Sequence: Synthetic polypeptide
DTEEIRTTNPVATEAYGSVSTTVTNLQQNTEQGSNNQQD

SEQ ID NO: 164074 - protein, 35 aa, Artificial Sequence
  Description of Artificial Sequence: Synthetic polypeptide
DEEEIRTTNPVATEFYGTVDNDTMNVGEGEIEGEI

SEQ ID NO: 164075 - protein, 33 aa, Artificial Sequence
  Description of Artificial Sequence: Synthetic polypeptide
DECEIATTNPVAYEQWGSVCDGDDLNNNQGGPH

SEQ ID NO: 164076 - protein, 29 aa, Artificial Sequence
  Description of Artificial Sequence: Synthetic peptide
QESEIASTNPVGTEGYGVMASTFQHGTDI

SEQ ID NO: 164077 - protein, 33 aa, Artificial Sequence
  Description of Artificial Sequence: Synthetic polypeptide
DECEIATTNPVAYEQWGSVCDGDDLNNNQGGAN

SEQ ID NO: 164078 - protein, 36 aa, Artificial Sequence
  Description of Artificial Sequence: Synthetic polypeptide
EEEEIRTTNPVATEQYGSVSVTPLMHHVPIPFEVHE

SEQ ID NO: 164079 - protein, 36 aa, Artificial Sequence
  Description of Artificial Sequence: Synthetic polypeptide
DEETIRTTNPVATEQWGVVVTVNNNNQQLAGNNTDD

SEQ ID NO: 164080 - protein, 38 aa, Artificial Sequence
  Description of Artificial Sequence: Synthetic polypeptide
DEEEIATTNPVATEQYGSVCAATMHPLEAPDDQMENRH

SEQ ID NO: 164081 - protein, 37 aa, Artificial Sequence
  Description of Artificial Sequence: Synthetic polypeptide
EEEEIRTTNPVATEQYGSVSWIMSNDDMLFQLPELPE

SEQ ID NO: 164082 - protein, 36 aa, Artificial Sequence
  Description of Artificial Sequence: Synthetic polypeptide
DENEIATTNPVAYEQYGSVSVADDLDNDRGDGNNHA

SEQ ID NO: 164083 - protein, 36 aa, Artificial Sequence
  Description of Artificial Sequence: Synthetic polypeptide
DENEIRTTNPVATEPYGSISSTTEDIPNMRNGMNPH

SEQ ID NO: 164084 - protein, 36 aa, Artificial Sequence
  Description of Artificial Sequence: Synthetic polypeptide
DEEEIRTTNPVATEQYGQVVVDLDGNENGENDGGQG

SEQ ID NO: 164085 - protein, 36 aa, Artificial Sequence
  Description of Artificial Sequence: Synthetic polypeptide
DENEIRTTNPVATEPYGSISSTTEAIPNMRNGMNPH

SEQ ID NO: 164086 - protein, 38 aa, Artificial Sequence
  Description of Artificial Sequence: Synthetic polypeptide
AEEEIRTTNPVATEQYGVVSTTTTSNLQAGTEAGSEEG

SEQ ID NO: 164087 - protein, 31 aa, Artificial Sequence
  Description of Artificial Sequence: Synthetic polypeptide
DDSEVASTNPVSTEGYGSVAATTIEDRVGQR

SEQ ID NO: 164088 - protein, 36 aa, Artificial Sequence
  Description of Artificial Sequence: Synthetic polypeptide
DEETIRTTNPVATEQWGVVVTVVNNNQQLAGNNQDT

SEQ ID NO: 164089 - protein, 36 aa, Artificial Sequence
  Description of Artificial Sequence: Synthetic polypeptide
DEEEIRTTNPVATEQYGSVQVAVDEQIENTNEAVIM

SEQ ID NO: 164090 - protein, 30 aa, Artificial Sequence
  Description of Artificial Sequence: Synthetic polypeptide
DESEIATTNPIGTEGYGVMAATLQPKGDYI

SEQ ID NO: 164091 - protein, 36 aa, Artificial Sequence
  Description of Artificial Sequence: Synthetic polypeptide
DEEEIRTTNPVATEQYGSVQVAVDNQIENTEEQNIM

SEQ ID NO: 164092 - protein, 36 aa, Artificial Sequence
  Description of Artificial Sequence: Synthetic polypeptide
DEEEIRTTNPVATEQYGSVVSDGMFGQEDEQEEDDG

SEQ ID NO: 164093 - protein, 36 aa, Artificial Sequence
  Description of Artificial Sequence: Synthetic polypeptide
DENEIATTNPVAYEQYGSVSVAPHLNQEAPGGEGRN

SEQ ID NO: 164094 - protein, 35 aa, Artificial Sequence
  Description of Artificial Sequence: Synthetic polypeptide
DENEIATTNPVAYEQYGSVSVAPHLQEAPIGEAEN

SEQ ID NO: 164095 - protein, 35 aa, Artificial Sequence
  Description of Artificial Sequence: Synthetic polypeptide
DEAEIATTNPCATECYGCVVCTDNHLQDDTQGNTH

SEQ ID NO: 164096 - protein, 37 aa, Artificial Sequence
  Description of Artificial Sequence: Synthetic polypeptide
DEEEIRTTNPVATEQYGSVVSDLMPEEGQGEGQTTEE

SEQ ID NO: 164097 - protein, 36 aa, Artificial Sequence
  Description of Artificial Sequence: Synthetic polypeptide
DEAEIRTTNPVATEPWGSVCPTDNHNMDQGGQNGSS

SEQ ID NO: 164098 - protein, 37 aa, Artificial Sequence
  Description of Artificial Sequence: Synthetic polypeptide
DEEEIRTTNPVATEQYGSVCWSTDPDSEMSVMSLLRQ

SEQ ID NO: 164099 - protein, 36 aa, Artificial Sequence
  Description of Artificial Sequence: Synthetic polypeptide
DEAEIATTNPCATEQYGSVAITENDQDDQRQGGDHQ

SEQ ID NO: 164100 - protein, 37 aa, Artificial Sequence
  Description of Artificial Sequence: Synthetic polypeptide
DEEEIRTTNPVATEQYGRVYCPTTMAEPNMRNGMNPV

SEQ ID NO: 164101 - protein, 37 aa, Artificial Sequence
  Description of Artificial Sequence: Synthetic polypeptide
DEEEIRTTNPVATEQYGRVYSPFVMAGPNMRNGMNPV

SEQ ID NO: 164102 - protein, 37 aa, Artificial Sequence
  Description of Artificial Sequence: Synthetic polypeptide
DEEEIRTTNPVATEQYGRVYSPTTMAGPIMMNGMNPV

SEQ ID NO: 164103 - protein, 34 aa, Artificial Sequence
  Description of Artificial Sequence: Synthetic polypeptide
DDEEIRTTNPVGTEQWGCVCSSGELNQYFGSVQS

SEQ ID NO: 164104 - protein, 37 aa, Artificial Sequence
  Description of Artificial Sequence: Synthetic polypeptide
DEEEIRTTNPVATEQYGSVQVAVDSEQIENTEEANQM

SEQ ID NO: 164105 - protein, 38 aa, Artificial Sequence
  Description of Artificial Sequence: Synthetic polypeptide
DEEEIRTTNPVATEQYGRVYSPTVMAGPNMRLGMNPVQ

SEQ ID NO: 164106 - protein, 36 aa, Artificial Sequence
  Description of Artificial Sequence: Synthetic polypeptide
DEEEIRCTNPVATEQYGSVSVDQNVMDDNGEGGGGT

SEQ ID NO: 164107 - protein, 34 aa, Artificial Sequence
  Description of Artificial Sequence: Synthetic polypeptide
SEEEIACTNPVATEQYGSACAATGLAPGEQMEGN

SEQ ID NO: 164108 - protein, 36 aa, Artificial Sequence
  Description of Artificial Sequence: Synthetic polypeptide
DEEEIRCTNPVAYEQWGEKTVVYTNALSHRPGGNDV

SEQ ID NO: 164109 - protein, 36 aa, Artificial Sequence
  Description of Artificial Sequence: Synthetic polypeptide
DEEEIRTTNPVATEQYGSVQVAVAEQIFNTEEANDM

SEQ ID NO: 164110 - protein, 37 aa, Artificial Sequence
  Description of Artificial Sequence: Synthetic polypeptide
DEEEIATTNPVATEQYGSVCAATMHLEAPADQMENNH

SEQ ID NO: 164111 - protein, 36 aa, Artificial Sequence
  Description of Artificial Sequence: Synthetic polypeptide
DEEEIATTNPVATEQYGSVCAATMHLEATIDVEMRH

SEQ ID NO: 164112 - protein, 36 aa, Artificial Sequence
  Description of Artificial Sequence: Synthetic polypeptide
DEEEIRTTNPVATEGYGICVCSTVELNQENFISDQF

SEQ ID NO: 164113 - protein, 37 aa, Artificial Sequence
  Description of Artificial Sequence: Synthetic polypeptide
DEEEIRCTNPVATEQYGVVSVGVGNTLNNGGGNDEGT

SEQ ID NO: 164114 - protein, 37 aa, Artificial Sequence
  Description of Artificial Sequence: Synthetic polypeptide
DEETIRTTNPVATEQWGTVVVVTVNNQQLQQGTNDDE

SEQ ID NO: 164115 - protein, 36 aa, Artificial Sequence
  Description of Artificial Sequence: Synthetic polypeptide
DEEEIRTTNPVATEQYGSVQVAVDEQIANTEEAEIM

SEQ ID NO: 164116 - protein, 35 aa, Artificial Sequence
  Description of Artificial Sequence: Synthetic polypeptide
DENEIATTNPVAYEQYGSVSAGNASGSPHGEGTRP

SEQ ID NO: 164117 - protein, 35 aa, Artificial Sequence
  Description of Artificial Sequence: Synthetic polypeptide
DENEIATTNPVAYEQYGSVSAISLVQPDDQDITNM

SEQ ID NO: 164118 - protein, 36 aa, Artificial Sequence
  Description of Artificial Sequence: Synthetic polypeptide
DEETIRTTNPVATEQWGVVATVVNNNQQLGNNNNDE

SEQ ID NO: 164119 - protein, 36 aa, Artificial Sequence
  Description of Artificial Sequence: Synthetic polypeptide
DEETIRTTNPVATEQWGVVTVTVNNNNQQLGNNQDT

SEQ ID NO: 164120 - protein, 36 aa, Artificial Sequence
  Description of Artificial Sequence: Synthetic polypeptide
DENEIRTTNPVATEPYGSISSTTPAGPNMRNGMNPV

SEQ ID NO: 164121 - protein, 36 aa, Artificial Sequence
  Description of Artificial Sequence: Synthetic polypeptide
DEETIRTTNPVATEQWGVVVTTNNNNQQLNGNDEDE

SEQ ID NO: 164122 - protein, 36 aa, Artificial Sequence
  Description of Artificial Sequence: Synthetic polypeptide
DEETIRTTNPVATEQWGVVVTVNNNNQLLQGNNQDT

SEQ ID NO: 164123 - protein, 38 aa, Artificial Sequence
  Description of Artificial Sequence: Synthetic polypeptide
AEEEIRTTNPVATEQYGVVSTTTQNLQQAGTEAGSEEG

SEQ ID NO: 164124 - protein, 31 aa, Artificial Sequence
  Description of Artificial Sequence: Synthetic polypeptide
DESEIATTNPIGTEGYGVMWASEDLQEHGPI

SEQ ID NO: 164125 - protein, 39 aa, Artificial Sequence
  Description of Artificial Sequence: Synthetic polypeptide
EEEEIRTTNPVATEQYGSVSTVVNNQQGNNQEGTNVATE

SEQ ID NO: 164126 - protein, 30 aa, Artificial Sequence
  Description of Artificial Sequence: Synthetic polypeptide
QESEIASTNPVGTEGYGVMASTLQHGPDLI

SEQ ID NO: 164127 - protein, 35 aa, Artificial Sequence
  Description of Artificial Sequence: Synthetic polypeptide
DENEIATTNPVAYEQYGSVSNANDPAGDPMGNDAE

SEQ ID NO: 164128 - protein, 30 aa, Artificial Sequence
  Description of Artificial Sequence: Synthetic polypeptide
QESEIASTNPVGTEGYGVMASTLQHGPDTI

SEQ ID NO: 164129 - protein, 36 aa, Artificial Sequence
  Description of Artificial Sequence: Synthetic polypeptide
EEEEIRTTNPVATEQYGSVSVPFNAIEMMEVVGILN

SEQ ID NO: 164130 - protein, 36 aa, Artificial Sequence
  Description of Artificial Sequence: Synthetic polypeptide
EEEEIRTTNPVATEQYGSVSVPGNAIEMPIVVGEEN

SEQ ID NO: 164131 - protein, 35 aa, Artificial Sequence
  Description of Artificial Sequence: Synthetic polypeptide
EEEEIRTTNPVATEQYGSVSVPNAIEMMMVVVEEN

SEQ ID NO: 164132 - protein, 36 aa, Artificial Sequence
  Description of Artificial Sequence: Synthetic polypeptide
EEEEIRTTNPVATEQYGSVSVRTGEEEARQTQTVTP

SEQ ID NO: 164133 - protein, 37 aa, Artificial Sequence
  Description of Artificial Sequence: Synthetic polypeptide
AEEEIRTTNPVATEQYGVVSTTTQQLTNSEEGTNTNQ

SEQ ID NO: 164134 - protein, 36 aa, Artificial Sequence
  Description of Artificial Sequence: Synthetic polypeptide
DEEEIRTTNPVATEQYGSVQVAVDEQIENTEEASIG

SEQ ID NO: 164135 - protein, 35 aa, Artificial Sequence
  Description of Artificial Sequence: Synthetic polypeptide
DEECIRTTNPVAYEQWGVVCFTIEEDGQRQMNGNN

SEQ ID NO: 164136 - protein, 36 aa, Artificial Sequence
  Description of Artificial Sequence: Synthetic polypeptide
DEAEIRTTNPVATEPWGSVCPTDNDNNDQGGDRTET

SEQ ID NO: 164137 - protein, 37 aa, Artificial Sequence
  Description of Artificial Sequence: Synthetic polypeptide
DEEEIRTTNPVATEQYGSAADPTTNENTTSVGEENAM

SEQ ID NO: 164138 - protein, 36 aa, Artificial Sequence
  Description of Artificial Sequence: Synthetic polypeptide
DEEEIRTTNPVATEQYGSVQVAVGEQHENTEEANNM

SEQ ID NO: 164139 - protein, 34 aa, Artificial Sequence
  Description of Artificial Sequence: Synthetic polypeptide
MEEEITTTNPVATEQYGDVSVDGQGQGGQGGDEE

SEQ ID NO: 164140 - protein, 31 aa, Artificial Sequence
  Description of Artificial Sequence: Synthetic polypeptide
DENEIRTTNPVATEPWGTVSEIESMNAAEDA

SEQ ID NO: 164141 - protein, 37 aa, Artificial Sequence
  Description of Artificial Sequence: Synthetic polypeptide
DEEEIRTTNPVATEQYGSACNSPWLYLQQIINEEGEQ

SEQ ID NO: 164142 - protein, 36 aa, Artificial Sequence
  Description of Artificial Sequence: Synthetic polypeptide
MEEEITTTNPVATEQYGAVSVTGEGEQGGNQGEDGV

SEQ ID NO: 164143 - protein, 34 aa, Artificial Sequence
  Description of Artificial Sequence: Synthetic polypeptide
DDEEIRTTNPVAYEQYGCVCSWGEHQNFGSETQA

SEQ ID NO: 164144 - protein, 38 aa, Artificial Sequence
  Description of Artificial Sequence: Synthetic polypeptide
DEEEIRTTNPVATEQYGSACSHTTNMLPEFTQTVQMDA

SEQ ID NO: 164145 - protein, 36 aa, Artificial Sequence
  Description of Artificial Sequence: Synthetic polypeptide
DEEEIRTTNPVATEQYGSVQVAVHEQIENEEEASDM

SEQ ID NO: 164146 - protein, 37 aa, Artificial Sequence
  Description of Artificial Sequence: Synthetic polypeptide
EEEEIRTTNPVATEQYGSVYSEADNEEIQVNGQGQPD

SEQ ID NO: 164147 - protein, 37 aa, Artificial Sequence
  Description of Artificial Sequence: Synthetic polypeptide
EEEEIRTTNPVATEQYGSVYSEAPNLEIAVNSQGQTD

SEQ ID NO: 164148 - protein, 31 aa, Artificial Sequence
  Description of Artificial Sequence: Synthetic polypeptide
DDSEVASTNPVSTEGYGSVSNTIQSRVGEQG

SEQ ID NO: 164149 - protein, 37 aa, Artificial Sequence
  Description of Artificial Sequence: Synthetic polypeptide
EEEEIRTTNPVATEQYGSVYSEAPNQEIQVNTQGQPD

SEQ ID NO: 164150 - protein, 34 aa, Artificial Sequence
  Description of Artificial Sequence: Synthetic polypeptide
SEEEIACTNPVATEQWGCVAMTHLNPRDGMGDNH

SEQ ID NO: 164151 - protein, 37 aa, Artificial Sequence
  Description of Artificial Sequence: Synthetic polypeptide
EEEEIRTTNPVATEQYGSVYSSAPNLEIFVNGQGQPD

SEQ ID NO: 164152 - protein, 38 aa, Artificial Sequence
  Description of Artificial Sequence: Synthetic polypeptide
DEEEIRTTNPVATEQYGVVSTVNNQNNQAGTEQGVVQD

SEQ ID NO: 164153 - protein, 36 aa, Artificial Sequence
  Description of Artificial Sequence: Synthetic polypeptide
DEGEIATTNPVATEQYGSVSATTEAGTNMRNGMEPV

SEQ ID NO: 164154 - protein, 36 aa, Artificial Sequence
  Description of Artificial Sequence: Synthetic polypeptide
DEEEIRTTNPVATEQYGSACTYPHNPNILGPLVILD

SEQ ID NO: 164155 - protein, 37 aa, Artificial Sequence
  Description of Artificial Sequence: Synthetic polypeptide
DEEEIRTTNPVATEQYGSADVPTMDTHIPPRPGMVES

SEQ ID NO: 164156 - protein, 36 aa, Artificial Sequence
  Description of Artificial Sequence: Synthetic polypeptide
DDEEIRTTNPVAYEQYGCVCSNTNEHQEGFGSETQA

SEQ ID NO: 164157 - protein, 38 aa, Artificial Sequence
  Description of Artificial Sequence: Synthetic polypeptide
DEEEIRTTNPVATEQYGVVSTVNNQNNQAGSEEGSTVQ

SEQ ID NO: 164158 - protein, 34 aa, Artificial Sequence
  Description of Artificial Sequence: Synthetic polypeptide
DAEEIATTNPVAYEQYGSTTAGTNPTEAEGGNDD

SEQ ID NO: 164159 - protein, 39 aa, Artificial Sequence
  Description of Artificial Sequence: Synthetic polypeptide
EEEEIRTTNPVATEQYGTVVVVSTNLQAGTEAGSTNTDD

SEQ ID NO: 164160 - protein, 36 aa, Artificial Sequence
  Description of Artificial Sequence: Synthetic polypeptide
DEEEIRTTNPVATEQYGSVQVDGEEQNENTEEANIQ

SEQ ID NO: 164161 - protein, 37 aa, Artificial Sequence
  Description of Artificial Sequence: Synthetic polypeptide
DEEEIRTTNPVATEQYGSVQVDGESEQIENTEEANIM

SEQ ID NO: 164162 - protein, 37 aa, Artificial Sequence
  Description of Artificial Sequence: Synthetic polypeptide
EEEEIRTTNPVATEQYGVVATQQQQLQQGTNATEQGS

SEQ ID NO: 164163 - protein, 32 aa, Artificial Sequence
  Description of Artificial Sequence: Synthetic polypeptide
DENEIRTTNPVATEPWGTTISAEDIQQPNGPI

SEQ ID NO: 164164 - protein, 37 aa, Artificial Sequence
  Description of Artificial Sequence: Synthetic polypeptide
DEGEIATTNPVATEQYGSVSATTPAVIPNMRMGENPV

SEQ ID NO: 164165 - protein, 37 aa, Artificial Sequence
  Description of Artificial Sequence: Synthetic polypeptide
DEEEIRTTNPVATEQYGSVQVAVDTEGIENTEEANIM

SEQ ID NO: 164166 - protein, 37 aa, Artificial Sequence
  Description of Artificial Sequence: Synthetic polypeptide
DEEEIRTTNPVATEQYGVVSVVVVNQQGNTTEDEEDE

SEQ ID NO: 164167 - protein, 37 aa, Artificial Sequence
  Description of Artificial Sequence: Synthetic polypeptide
EEEEIRTTNPVATEQYGSVYHEAPNLEIHVNQEGQPD

SEQ ID NO: 164168 - protein, 37 aa, Artificial Sequence
  Description of Artificial Sequence: Synthetic polypeptide
DEEEIRTTNPVATEQYGSVQVAVECEQIENTEEGNDM

SEQ ID NO: 164169 - protein, 37 aa, Artificial Sequence
  Description of Artificial Sequence: Synthetic polypeptide
DEEEIRTTNPVATEQYGSAAENLCNQHITNQDEEAEQ

SEQ ID NO: 164170 - protein, 36 aa, Artificial Sequence
  Description of Artificial Sequence: Synthetic polypeptide
DEEEIRTTNPVATEQYGSVQVAVEEQIENTEEDNDS

SEQ ID NO: 164171 - protein, 35 aa, Artificial Sequence
  Description of Artificial Sequence: Synthetic polypeptide
DEECIRTTNPVAYEQYGCVCSNWGEHQYFGSDNQA

SEQ ID NO: 164172 - protein, 36 aa, Artificial Sequence
  Description of Artificial Sequence: Synthetic polypeptide
DEEEIRTTNPVATEQYGSAAENTCNQEITNDEENEA

SEQ ID NO: 164173 - protein, 35 aa, Artificial Sequence
  Description of Artificial Sequence: Synthetic polypeptide
DEEEIRTTNPVATEGYGICVCSTVPDQENFISDQA

SEQ ID NO: 164174 - protein, 36 aa, Artificial Sequence
  Description of Artificial Sequence: Synthetic polypeptide
DEEEIRTTNPVATEQYGSAAEPTGGAGAQVQENIVP

SEQ ID NO: 164175 - protein, 35 aa, Artificial Sequence
  Description of Artificial Sequence: Synthetic polypeptide
DEECIRTTNPVAYEQYGCVCSTGEDNQEYFNSDQA

SEQ ID NO: 164176 - protein, 37 aa, Artificial Sequence
  Description of Artificial Sequence: Synthetic polypeptide
EEEEIRTTNPVATEQYGSVVHGIADMTMNEPEQEGTP

SEQ ID NO: 164177 - protein, 39 aa, Artificial Sequence
  Description of Artificial Sequence: Synthetic polypeptide
AEEEIRTTNPVATEQYGVVSTTVANLQNATNEQGTNTVE

SEQ ID NO: 164178 - protein, 36 aa, Artificial Sequence
  Description of Artificial Sequence: Synthetic polypeptide
DEEEIRTTNPVATEQYGSVQVAVEEQIENTMEAQIM

SEQ ID NO: 164179 - protein, 37 aa, Artificial Sequence
  Description of Artificial Sequence: Synthetic polypeptide
EEEEIRTTNPVATEQYGSVVLGIADMTMLIPEQEGTP

SEQ ID NO: 164180 - protein, 37 aa, Artificial Sequence
  Description of Artificial Sequence: Synthetic polypeptide
EEEEIRTTNPVATEQYGSVYMEAENLEIQVNSQGQPD

SEQ ID NO: 164181 - protein, 37 aa, Artificial Sequence
  Description of Artificial Sequence: Synthetic polypeptide
DEEEIRTTNPVATEQYGSAASPTTNENTTSVGEELAS

SEQ ID NO: 164182 - protein, 37 aa, Artificial Sequence
  Description of Artificial Sequence: Synthetic polypeptide
DEEEIRTTNPVATEQYGVVSVVVVNQQGNLQEEEEDE

SEQ ID NO: 164183 - protein, 37 aa, Artificial Sequence
  Description of Artificial Sequence: Synthetic polypeptide
DEEEIRTTNPVATEQYGSACAANPELGQEHQDDNEAG

SEQ ID NO: 164184 - protein, 34 aa, Artificial Sequence
  Description of Artificial Sequence: Synthetic polypeptide
DEECIRTTNPVAYEQYGCVCSTGEDNQYFISEQS

SEQ ID NO: 164185 - protein, 37 aa, Artificial Sequence
  Description of Artificial Sequence: Synthetic polypeptide
DEEEIRTTNPVATEQYGSVQVAVESEQIENEEELNDM

SEQ ID NO: 164186 - protein, 38 aa, Artificial Sequence
  Description of Artificial Sequence: Synthetic polypeptide
DEEEIRTTNPVATEQYGSACAQPEMMESTVLENGTLSR

SEQ ID NO: 164187 - protein, 37 aa, Artificial Sequence
  Description of Artificial Sequence: Synthetic polypeptide
DEEEIRTTNPVATEQYGSACATNPELGQEHQDDQMAK

SEQ ID NO: 164188 - protein, 32 aa, Artificial Sequence
  Description of Artificial Sequence: Synthetic polypeptide
SEEEIACTNPVATEQYGCVAPIHGQDSEGEKM

SEQ ID NO: 164189 - protein, 38 aa, Artificial Sequence
  Description of Artificial Sequence: Synthetic polypeptide
DEEEIRTTNPVATEQYGSVDYPSLNMVEQPRDVPSQDE

SEQ ID NO: 164190 - protein, 34 aa, Artificial Sequence
  Description of Artificial Sequence: Synthetic polypeptide
DEECIRTTNPVAYEQYGCVCSWGEDHQYFGSDTQ

SEQ ID NO: 164191 - protein, 32 aa, Artificial Sequence
  Description of Artificial Sequence: Synthetic polypeptide
SEEEIACTNPVATEQYGCAPEHGLDSEGENKM

SEQ ID NO: 164192 - protein, 35 aa, Artificial Sequence
  Description of Artificial Sequence: Synthetic polypeptide
EEEEIRTTNPVATEQYGSVWPEPWTEQLVGLEEEL

SEQ ID NO: 164193 - protein, 35 aa, Artificial Sequence
  Description of Artificial Sequence: Synthetic polypeptide
SEEEIACTNPVATEQWGSVSGTGNPPPQAEMSNDS

SEQ ID NO: 164194 - protein, 36 aa, Artificial Sequence
  Description of Artificial Sequence: Synthetic polypeptide
DEEEIRTTNPVATEQYGSVQVAVEEQIESTEEENDM

SEQ ID NO: 164195 - protein, 34 aa, Artificial Sequence
  Description of Artificial Sequence: Synthetic polypeptide
DENEIATTNPVAYEQYGSVPAAANNLPLDSEGTN

SEQ ID NO: 164196 - protein, 35 aa, Artificial Sequence
  Description of Artificial Sequence: Synthetic polypeptide
DEECIRTTNPVAYEQWGVVCFTIEDGQDQQLNGNR

SEQ ID NO: 164197 - protein, 33 aa, Artificial Sequence
  Description of Artificial Sequence: Synthetic polypeptide
DEECIRTTNPVAYEQWGTYVYTQDSDLRNGEEP

SEQ ID NO: 164198 - protein, 36 aa, Artificial Sequence
  Description of Artificial Sequence: Synthetic polypeptide
DEEEIRGTNPVATEQWGIVVSNGGQTLIRGGGNDDN

SEQ ID NO: 164199 - protein, 35 aa, Artificial Sequence
  Description of Artificial Sequence: Synthetic polypeptide
DENEIRTTNPVATEPYGTISSMPDIQNMQNGMNPV

SEQ ID NO: 164200 - protein, 37 aa, Artificial Sequence
  Description of Artificial Sequence: Synthetic polypeptide
AEENIRTTNPVATEQYGVVSTTNNNDQQGTNTTTTTD

SEQ ID NO: 164201 - protein, 35 aa, Artificial Sequence
  Description of Artificial Sequence: Synthetic polypeptide
CEEEIACTNPVATEQYGCVATNNLENGMPGENDNH

SEQ ID NO: 164202 - protein, 36 aa, Artificial Sequence
  Description of Artificial Sequence: Synthetic polypeptide
DEEEIRGTNPVATEQWGIVVSNGGETNIRGGGNDGQ

SEQ ID NO: 164203 - protein, 36 aa, Artificial Sequence
  Description of Artificial Sequence: Synthetic polypeptide
DEEEIRGTNPVATEQWGIVVANGGQTLGRGGGNDGQ

SEQ ID NO: 164204 - protein, 38 aa, Artificial Sequence
  Description of Artificial Sequence: Synthetic polypeptide
AEEEIRTTNPVATEQYGSVSTVTLNNMEQGTNNTTDEE

SEQ ID NO: 164205 - protein, 31 aa, Artificial Sequence
  Description of Artificial Sequence: Synthetic polypeptide
DDSEVASTNPVSTEGYGQVAANTIQSRVGQR

SEQ ID NO: 164206 - protein, 31 aa, Artificial Sequence
  Description of Artificial Sequence: Synthetic polypeptide
DDSEVATTNPVSTEGWGNVANTIPQSRVGQR

SEQ ID NO: 164207 - protein, 31 aa, Artificial Sequence
  Description of Artificial Sequence: Synthetic polypeptide
DDSEVATTNPVSTEGWGNVAANTIQSRVGQR

SEQ ID NO: 164208 - protein, 35 aa, Artificial Sequence
  Description of Artificial Sequence: Synthetic polypeptide
DEEEIRTTNPVATEQYGSVEGWNQMDIPMEFVSQA

SEQ ID NO: 164209 - protein, 37 aa, Artificial Sequence
  Description of Artificial Sequence: Synthetic polypeptide
DEEEIRTTNPVATEGYGICVCSNTVNLNQENFISEQA

SEQ ID NO: 164210 - protein, 32 aa, Artificial Sequence
  Description of Artificial Sequence: Synthetic polypeptide
DEGEIATTNPVAYEQWGCTAGNGLQNNMDNED

SEQ ID NO: 164211 - protein, 38 aa, Artificial Sequence
  Description of Artificial Sequence: Synthetic polypeptide
AEEEIRTTNPVATEQYGSVSTVTLNNNEQGTNNVTDED

SEQ ID NO: 164212 - protein, 38 aa, Artificial Sequence
  Description of Artificial Sequence: Synthetic polypeptide
DEEEIRTTNPVATEQYGVVSVVVTTNNTEQGNNTEEGE

SEQ ID NO: 164213 - protein, 34 aa, Artificial Sequence
  Description of Artificial Sequence: Synthetic polypeptide
DESEIATTNPVATASWGSVSVANNEPTDRGEENG

SEQ ID NO: 164214 - protein, 38 aa, Artificial Sequence
  Description of Artificial Sequence: Synthetic polypeptide
DEEEIRTTNPVATEQYGVVSVVVTTNQDEQGTNTEETE

SEQ ID NO: 164215 - protein, 35 aa, Artificial Sequence
  Description of Artificial Sequence: Synthetic polypeptide
DEEEIRTTNPVATEGYGICVCSSVEHNQENFISNQ

SEQ ID NO: 164216 - protein, 33 aa, Artificial Sequence
  Description of Artificial Sequence: Synthetic polypeptide
DESEIATTNPVATASWGSVSANNEPTDNGGENE

SEQ ID NO: 164217 - protein, 37 aa, Artificial Sequence
  Description of Artificial Sequence: Synthetic polypeptide
DEEEIRGTNPVATEQWGDVVQTNGGQTLTRGGGNDGQ

SEQ ID NO: 164218 - protein, 35 aa, Artificial Sequence
  Description of Artificial Sequence: Synthetic polypeptide
DEEEIRGTNPVATEQWGAVVAGGQQLIRGGGNDGQ

SEQ ID NO: 164219 - protein, 35 aa, Artificial Sequence
  Description of Artificial Sequence: Synthetic polypeptide
DENEIATTNPVAYEQYGSVCSPMHNLNTADGGSLH

SEQ ID NO: 164220 - protein, 34 aa, Artificial Sequence
  Description of Artificial Sequence: Synthetic polypeptide
DESEIATTNPVATASWGSVSANNEPQDQGDENGN

SEQ ID NO: 164221 - protein, 36 aa, Artificial Sequence
  Description of Artificial Sequence: Synthetic polypeptide
DEEEIRTTNPVATEGYGICVCSTGNHNQENFISQQS

SEQ ID NO: 164222 - protein, 35 aa, Artificial Sequence
  Description of Artificial Sequence: Synthetic polypeptide
DESEIATTNPVATASWGSVSAANNEPQDRGGENGN

SEQ ID NO: 164223 - protein, 35 aa, Artificial Sequence
  Description of Artificial Sequence: Synthetic polypeptide
DEAEIRTTNPVATEQFGTVCVSTLYAEELRGQDDS

SEQ ID NO: 164224 - protein, 35 aa, Artificial Sequence
  Description of Artificial Sequence: Synthetic polypeptide
DESEIATTNPVATASWGSVSVANNGPLDRGGENGD

SEQ ID NO: 164225 - protein, 34 aa, Artificial Sequence
  Description of Artificial Sequence: Synthetic polypeptide
DEAEIRTTNPVATEQFGTVCVGTLYGELRGQDDS

SEQ ID NO: 164226 - protein, 34 aa, Artificial Sequence
  Description of Artificial Sequence: Synthetic polypeptide
DECEIATTNPVATEPYGSVCYNNDNQDDDNQDSN

SEQ ID NO: 164227 - protein, 37 aa, Artificial Sequence
  Description of Artificial Sequence: Synthetic polypeptide
AEENIRTTNPVATEQYGVVSTVTNQQQQIGTTEEGNQ

SEQ ID NO: 164228 - protein, 36 aa, Artificial Sequence
  Description of Artificial Sequence: Synthetic polypeptide
DEEEIRTTNPVATEQYGSVCVAVDEFIENTEEANIM

SEQ ID NO: 164229 - protein, 34 aa, Artificial Sequence
  Description of Artificial Sequence: Synthetic polypeptide
MEGEIRTTNPVATEQYGCCSPDNMSHENGNEDQP

SEQ ID NO: 164230 - protein, 37 aa, Artificial Sequence
  Description of Artificial Sequence: Synthetic polypeptide
DEEEIRGTNPVATEQWGSVVNSNGGQTLIRGGGNDGQ

SEQ ID NO: 164231 - protein, 33 aa, Artificial Sequence
  Description of Artificial Sequence: Synthetic polypeptide
DENEIRTTNPVATEQWGACYSIEIEMNQQEKDA

SEQ ID NO: 164232 - protein, 36 aa, Artificial Sequence
  Description of Artificial Sequence: Synthetic polypeptide
DEEEIRTTNPVATEGYGCVCSTWPAHNAENSGSDPV

SEQ ID NO: 164233 - protein, 37 aa, Artificial Sequence
  Description of Artificial Sequence: Synthetic polypeptide
DEEEIRTTNPVATEQYGSVEHPTGVKEAIRPMMEVGN

SEQ ID NO: 164234 - protein, 34 aa, Artificial Sequence
  Description of Artificial Sequence: Synthetic polypeptide
DESEIATTNPVATEAYGTVCSPTGGEPSEFEGND

SEQ ID NO: 164235 - protein, 36 aa, Artificial Sequence
  Description of Artificial Sequence: Synthetic polypeptide
MEGEIRTTNPVATEQYGCCSLEVLNQNNIGNNGDRD

SEQ ID NO: 164236 - protein, 33 aa, Artificial Sequence
  Description of Artificial Sequence: Synthetic polypeptide
DDEEISTTNPVATCQYGCVCSSGEPINFGSNQA

SEQ ID NO: 164237 - protein, 38 aa, Artificial Sequence
  Description of Artificial Sequence: Synthetic polypeptide
DEEEIRTTNPVATEQYGVVSVVVTTNNDEQGNNTEEQE

SEQ ID NO: 164238 - protein, 31 aa, Artificial Sequence
  Description of Artificial Sequence: Synthetic polypeptide
DDSEVASTNPVSTEGYGNVYANTIQSRVGQR

SEQ ID NO: 164239 - protein, 35 aa, Artificial Sequence
  Description of Artificial Sequence: Synthetic polypeptide
DEEEIRTTNPVATEGYGCVCSWEEHNQNFNSDNQS

SEQ ID NO: 164240 - protein, 38 aa, Artificial Sequence
  Description of Artificial Sequence: Synthetic polypeptide
AEEEIRTTNPVATEQYGSVSTVTGNQQGSTEEGTTEDD

SEQ ID NO: 164241 - protein, 35 aa, Artificial Sequence
  Description of Artificial Sequence: Synthetic polypeptide
CEEEIACTNPVATEQYGSVATVNDVQTAMDPNENT

SEQ ID NO: 164242 - protein, 36 aa, Artificial Sequence
  Description of Artificial Sequence: Synthetic polypeptide
DEEEIRTTNPVATEQYGSVVPGEGLPETDVMENDEI

SEQ ID NO: 164243 - protein, 36 aa, Artificial Sequence
  Description of Artificial Sequence: Synthetic polypeptide
DEEEIRTTNPVATEQYGSVEHPHYYLQPQEVESQDN

SEQ ID NO: 164244 - protein, 37 aa, Artificial Sequence
  Description of Artificial Sequence: Synthetic polypeptide
DESEIATTNPVATEAYGSTVPSCTANMLSEYKGTNHN

SEQ ID NO: 164245 - protein, 37 aa, Artificial Sequence
  Description of Artificial Sequence: Synthetic polypeptide
DEEEIRTTNPVATEQYGSVCVMNLSEPTQNEVSELKN

SEQ ID NO: 164246 - protein, 39 aa, Artificial Sequence
  Description of Artificial Sequence: Synthetic polypeptide
DEEEIRTTNPVATEQYGQSVHSILPNYLSQEYNGSKIPT

SEQ ID NO: 164247 - protein, 33 aa, Artificial Sequence
  Description of Artificial Sequence: Synthetic polypeptide
DEAEIRTTNPVATEQWGCVAGENGVEMNAAEDA

SEQ ID NO: 164248 - protein, 34 aa, Artificial Sequence
  Description of Artificial Sequence: Synthetic polypeptide
DEIAEIATTNPVAYEQWGSVAWINDDQGQGDHGR

SEQ ID NO: 164249 - protein, 34 aa, Artificial Sequence
  Description of Artificial Sequence: Synthetic polypeptide
DENEIRTTNPVATEPYGTIWANMEDIQQQPNGNH

SEQ ID NO: 164250 - protein, 33 aa, Artificial Sequence
  Description of Artificial Sequence: Synthetic polypeptide
DEECIRTTNPVAYEQWGSVCVNWEHGEQDEHQF

SEQ ID NO: 164251 - protein, 39 aa, Artificial Sequence
  Description of Artificial Sequence: Synthetic polypeptide
DEEEIRTTNPVATEQYGVVSVVVTTNNQAGNTEQGGTTE

SEQ ID NO: 164252 - protein, 33 aa, Artificial Sequence
  Description of Artificial Sequence: Synthetic polypeptide
DEIAEIATTNPVAYEQWGSVAWNDDGGQGDDGR

SEQ ID NO: 164253 - protein, 37 aa, Artificial Sequence
  Description of Artificial Sequence: Synthetic polypeptide
DESEIATTNPVATEAWGSVCSTWENDQRDANGRGDTR

SEQ ID NO: 164254 - protein, 31 aa, Artificial Sequence
  Description of Artificial Sequence: Synthetic polypeptide
DDSEVASTNPVSTEGYGQVAANDIQSRVGQR

SEQ ID NO: 164255 - protein, 35 aa, Artificial Sequence
  Description of Artificial Sequence: Synthetic polypeptide
DESEIATTNPVATAQWGSVSATGAGGQAPMGNGFP

SEQ ID NO: 164256 - protein, 30 aa, Artificial Sequence
  Description of Artificial Sequence: Synthetic polypeptide
QESEIASTNPVGTEGYGVMASTLQHGFDIN

SEQ ID NO: 164257 - protein, 35 aa, Artificial Sequence
  Description of Artificial Sequence: Synthetic polypeptide
AEEEVRTTNPVATEQYGCVCSMTGEHDQYIGSDQS

SEQ ID NO: 164258 - protein, 33 aa, Artificial Sequence
  Description of Artificial Sequence: Synthetic polypeptide
DESEIATTNPVATAFWGSVSGNNEPQDHPDENG

SEQ ID NO: 164259 - protein, 37 aa, Artificial Sequence
  Description of Artificial Sequence: Synthetic polypeptide
AEEEIRTTNPVATEQYGVVSTTTNNNQQQLQSATEMG

SEQ ID NO: 164260 - protein, 38 aa, Artificial Sequence
  Description of Artificial Sequence: Synthetic polypeptide
DEEEIRTTNPVATEQYGQVSNLSNMNLEMEDEGQEGGQ

SEQ ID NO: 164261 - protein, 36 aa, Artificial Sequence
  Description of Artificial Sequence: Synthetic polypeptide
EEEEIRTTNPVATEQYGSVSTTMNMPMPPVSEEPDM

SEQ ID NO: 164262 - protein, 37 aa, Artificial Sequence
  Description of Artificial Sequence: Synthetic polypeptide
DEQEIRTTNPVATEQYGSVSWPENWNEEIPNSHQLRN

SEQ ID NO: 164263 - protein, 34 aa, Artificial Sequence
  Description of Artificial Sequence: Synthetic polypeptide
DESEIATTNPVATAAWGSVSGNNPPQDAGGENGN

SEQ ID NO: 164264 - protein, 31 aa, Artificial Sequence
  Description of Artificial Sequence: Synthetic polypeptide
DDSEVATTNPVSTECWGSVSCTEQDREGEQG

SEQ ID NO: 164265 - protein, 38 aa, Artificial Sequence
  Description of Artificial Sequence: Synthetic polypeptide
AEEEIRTTNPVATEQYGVVSTTTNNNSNQQGNNNNQQD

SEQ ID NO: 164266 - protein, 35 aa, Artificial Sequence
  Description of Artificial Sequence: Synthetic polypeptide
DDSEVATTNPVATEQYGNVSATNPTGPNSRNGMNV

SEQ ID NO: 164267 - protein, 35 aa, Artificial Sequence
  Description of Artificial Sequence: Synthetic polypeptide
DDSEVATTNPVATEQYGNVSATNPAGPNSRNGMNV

SEQ ID NO: 164268 - protein, 35 aa, Artificial Sequence
  Description of Artificial Sequence: Synthetic polypeptide
DEEEIRTTNPVATEQYGSVEGWNGMDIPMETASPS

SEQ ID NO: 164269 - protein, 35 aa, Artificial Sequence
  Description of Artificial Sequence: Synthetic polypeptide
DEEEIRCTNPVAYEQWGSVCYTTDLNDHQHGFTDH

SEQ ID NO: 164270 - protein, 37 aa, Artificial Sequence
  Description of Artificial Sequence: Synthetic polypeptide
DENEIATTNPVAYEQYGSVCSVDNHLPQDSPDGNEMW

SEQ ID NO: 164271 - protein, 33 aa, Artificial Sequence
  Description of Artificial Sequence: Synthetic polypeptide
DEECIRTTNPVAYEQWGTYVYNQLNDDDRGEDD

SEQ ID NO: 164272 - protein, 36 aa, Artificial Sequence
  Description of Artificial Sequence: Synthetic polypeptide
DENEIATTNPVAYEQYGSVCSVDNLPQDSMNGMEAW

SEQ ID NO: 164273 - protein, 33 aa, Artificial Sequence
  Description of Artificial Sequence: Synthetic polypeptide
DEECIRTTNPVAYEQWGTYVYTQDEGEDRGEEP

SEQ ID NO: 164274 - protein, 37 aa, Artificial Sequence
  Description of Artificial Sequence: Synthetic polypeptide
DEEEIRTTNPVATEQYGSVSFVMTGDSSDPPLSNIEL

SEQ ID NO: 164275 - protein, 34 aa, Artificial Sequence
  Description of Artificial Sequence: Synthetic polypeptide
DEECIRTTNPVAYEQWGTYVYTQDGVDDRGENGA

SEQ ID NO: 164276 - protein, 36 aa, Artificial Sequence
  Description of Artificial Sequence: Synthetic polypeptide
DEEEIRTTNPVATEQYGSVVQNGFNTTEGGEGEGGF

SEQ ID NO: 164277 - protein, 36 aa, Artificial Sequence
  Description of Artificial Sequence: Synthetic polypeptide
DEEEIRTTNPVATEQYGSVVQNGFNTTGGGEEEGGE

SEQ ID NO: 164278 - protein, 36 aa, Artificial Sequence
  Description of Artificial Sequence: Synthetic polypeptide
DEEEIRTTNPVATEQYGSVVQNGFNTTGTGEGEEQT

SEQ ID NO: 164279 - protein, 36 aa, Artificial Sequence
  Description of Artificial Sequence: Synthetic polypeptide
DEEEIRTTNPVATEQYGSVVQNGFNTTGTGEGEGIE

SEQ ID NO: 164280 - protein, 36 aa, Artificial Sequence
  Description of Artificial Sequence: Synthetic polypeptide
DEEEIRTTNPVATEQYGSVVQPERGLQPEMDEAEEN

SEQ ID NO: 164281 - protein, 34 aa, Artificial Sequence
  Description of Artificial Sequence: Synthetic polypeptide
DEECIRTTNPVAYEQWGTYVYTQDPDLEDRGEEP

SEQ ID NO: 164282 - protein, 36 aa, Artificial Sequence
  Description of Artificial Sequence: Synthetic polypeptide
DEEEIRTTNPVATEQYGSVVQPTKGDQPEMDETEEN

SEQ ID NO: 164283 - protein, 36 aa, Artificial Sequence
  Description of Artificial Sequence: Synthetic polypeptide
DEEEIRTTNPVATEQYGSVCVTPGYHVVREDHVPIN

SEQ ID NO: 164284 - protein, 36 aa, Artificial Sequence
  Description of Artificial Sequence: Synthetic polypeptide
DAEEIATTNPVAYEQYGSVAAIANNLQGQGGGNAQN

SEQ ID NO: 164285 - protein, 34 aa, Artificial Sequence
  Description of Artificial Sequence: Synthetic polypeptide
DEECIRTTNPVAYEQWGTYVYNQDSDNDHRGEKD

SEQ ID NO: 164286 - protein, 35 aa, Artificial Sequence
  Description of Artificial Sequence: Synthetic polypeptide
DESEIATTNPVATAFWGSVSGNNPPQDRAGENDGN

SEQ ID NO: 164287 - protein, 35 aa, Artificial Sequence
  Description of Artificial Sequence: Synthetic polypeptide
CEEEISTTNPVATEQYGCVCSNTGEPNQGFGSDQS

SEQ ID NO: 164288 - protein, 37 aa, Artificial Sequence
  Description of Artificial Sequence: Synthetic polypeptide
DEEEIRTTNPVATEQYGSVEGWNLGMDNIPMEFESQA

SEQ ID NO: 164289 - protein, 36 aa, Artificial Sequence
  Description of Artificial Sequence: Synthetic polypeptide
DEEEIRTTNPVATEYYGSVVVDGFGQENDQEEDGST

SEQ ID NO: 164290 - protein, 35 aa, Artificial Sequence
  Description of Artificial Sequence: Synthetic polypeptide
SEEEIACTNPVATEQYGSVCAMTEPGGAVAGIDNR

SEQ ID NO: 164291 - protein, 38 aa, Artificial Sequence
  Description of Artificial Sequence: Synthetic polypeptide
DEEEIRTTNPVATEQYGVVSVVVTTNVNEQGNNTEEED

SEQ ID NO: 164292 - protein, 36 aa, Artificial Sequence
  Description of Artificial Sequence: Synthetic polypeptide
DEEEIRTTNPVATEQYGSVQVAIEEQIENEEEAWDM

SEQ ID NO: 164293 - protein, 36 aa, Artificial Sequence
  Description of Artificial Sequence: Synthetic polypeptide
MEGEICTTNPVATEQYGSVCSTVILLSEEGGDGANE

SEQ ID NO: 164294 - protein, 34 aa, Artificial Sequence
  Description of Artificial Sequence: Synthetic polypeptide
DESEIATTNPVATAPAWGSVSGNNEPLDHGGENG

SEQ ID NO: 164295 - protein, 36 aa, Artificial Sequence
  Description of Artificial Sequence: Synthetic polypeptide
MEGEICTTNPVATEQYGSVCSTTCLLSEEGEDGANE

SEQ ID NO: 164296 - protein, 35 aa, Artificial Sequence
  Description of Artificial Sequence: Synthetic polypeptide
DEEEIRTTNPVATEQYGSVEGWNGMDIPMMFESQM

SEQ ID NO: 164297 - protein, 35 aa, Artificial Sequence
  Description of Artificial Sequence: Synthetic polypeptide
DEEEIRGTNPVATEFYGTVNNMTTNIFNGGGNDQE

SEQ ID NO: 164298 - protein, 34 aa, Artificial Sequence
  Description of Artificial Sequence: Synthetic polypeptide
DEEEIRGTNPVATEFYGTVNNMTNIFNGGGGQDQ

SEQ ID NO: 164299 - protein, 37 aa, Artificial Sequence
  Description of Artificial Sequence: Synthetic polypeptide
DEEEIRGTNPVATEFYGTVMTDENDGLTNQGGEQTNG

SEQ ID NO: 164300 - protein, 30 aa, Artificial Sequence
  Description of Artificial Sequence: Synthetic polypeptide
ADNEIACTNPVSTEGYGNAAAENIQRVGGR

SEQ ID NO: 164301 - protein, 34 aa, Artificial Sequence
  Description of Artificial Sequence: Synthetic polypeptide
DEGEIATTNPVATEQYGTVCAANDGPVEDEGGND

SEQ ID NO: 164302 - protein, 34 aa, Artificial Sequence
  Description of Artificial Sequence: Synthetic polypeptide
DEGEIATTNPVATEQYGTVCAANDGPVEDDGNDS

SEQ ID NO: 164303 - protein, 36 aa, Artificial Sequence
  Description of Artificial Sequence: Synthetic polypeptide
DENEIATTNPVAYEQYGSVCSPTNNPLGQTHADITD

SEQ ID NO: 164304 - protein, 35 aa, Artificial Sequence
  Description of Artificial Sequence: Synthetic polypeptide
DEEEIRGTNPVATEAYGSVVVNTDTGLNDENEFGQ

SEQ ID NO: 164305 - protein, 35 aa, Artificial Sequence
  Description of Artificial Sequence: Synthetic polypeptide
DEAEIRTTNPVATEQFGTVCHSTLYSELRGQDDSG

SEQ ID NO: 164306 - protein, 36 aa, Artificial Sequence
  Description of Artificial Sequence: Synthetic polypeptide
DEEEIRTTNPVATEQYGSVQVAIEEQIENTEEDNYM

SEQ ID NO: 164307 - protein, 36 aa, Artificial Sequence
  Description of Artificial Sequence: Synthetic polypeptide
DEEEIRTTNPVATEQYGSVQVAIEEQIENVEEANDE

SEQ ID NO: 164308 - protein, 36 aa, Artificial Sequence
  Description of Artificial Sequence: Synthetic polypeptide
DEEEIRGTNPVATEAYGSVSITMDTGEDTEGQGGGG

SEQ ID NO: 164309 - protein, 36 aa, Artificial Sequence
  Description of Artificial Sequence: Synthetic polypeptide
DEEEIRTTNPVATEQYGSVQVAIFEQIENTEEANDY

SEQ ID NO: 164310 - protein, 36 aa, Artificial Sequence
  Description of Artificial Sequence: Synthetic polypeptide
DEEEIRTTNPVATEQYGSVQVAREEQIENTEQANDM

SEQ ID NO: 164311 - protein, 35 aa, Artificial Sequence
  Description of Artificial Sequence: Synthetic polypeptide
DENEIATTNPVAYEQYGSVCSVDHLPQDSDGAEIW

SEQ ID NO: 164312 - protein, 33 aa, Artificial Sequence
  Description of Artificial Sequence: Synthetic polypeptide
DESEIATTNPVATAFWGSVSGPNEPGDNAGENG

SEQ ID NO: 164313 - protein, 36 aa, Artificial Sequence
  Description of Artificial Sequence: Synthetic polypeptide
DEEEIRTTNPVATEQYGSVQVAVAEQIENTEPAHII

SEQ ID NO: 164314 - protein, 36 aa, Artificial Sequence
  Description of Artificial Sequence: Synthetic polypeptide
DEEEIRGTNPVAFEQYGAVVVNGQNDLGQEGQRFSP

SEQ ID NO: 164315 - protein, 36 aa, Artificial Sequence
  Description of Artificial Sequence: Synthetic polypeptide
DEEEIRTTNPVATEQYGSVQVDPEEQIENTEEANAM

SEQ ID NO: 164316 - protein, 37 aa, Artificial Sequence
  Description of Artificial Sequence: Synthetic polypeptide
EEEEIRTTNPVATEQYGVVATTQQNQQQGTNNNEQGS

SEQ ID NO: 164317 - protein, 37 aa, Artificial Sequence
  Description of Artificial Sequence: Synthetic polypeptide
EEEEIRTTNPVATEQYGVVATTQQQLQAGNNNNEQGS

SEQ ID NO: 164318 - protein, 37 aa, Artificial Sequence
  Description of Artificial Sequence: Synthetic polypeptide
DEEEIRTTNPVATEQYGSVQVFTDMWEEEERQENVNY

SEQ ID NO: 164319 - protein, 34 aa, Artificial Sequence
  Description of Artificial Sequence: Synthetic polypeptide
CEEEISTTNPVATEQYGCVCSSGEDNQNFNSDQD

SEQ ID NO: 164320 - protein, 34 aa, Artificial Sequence
  Description of Artificial Sequence: Synthetic polypeptide
CEEEISTTNPVATEQYGCVCSSGELAENFNSDQA

SEQ ID NO: 164321 - protein, 31 aa, Artificial Sequence
  Description of Artificial Sequence: Synthetic polypeptide
DDSEVASTNPVSTEGYGVMAANTLQSRVGDR

SEQ ID NO: 164322 - protein, 36 aa, Artificial Sequence
  Description of Artificial Sequence: Synthetic polypeptide
DEEEIATTNPVATEQYGSVCAMTGVEPEGDLEENNP

SEQ ID NO: 164323 - protein, 36 aa, Artificial Sequence
  Description of Artificial Sequence: Synthetic polypeptide
DEEEIRTTNPVATEQYGSASPCEVAHIQITIENAEQ

SEQ ID NO: 164324 - protein, 35 aa, Artificial Sequence
  Description of Artificial Sequence: Synthetic polypeptide
CEEEISTTNPVATEQYGCVCSTEHNQENFFSDNQA

SEQ ID NO: 164325 - protein, 35 aa, Artificial Sequence
  Description of Artificial Sequence: Synthetic polypeptide
DEEEIRTTNPVATEGYGMVNGQGTFGQDGGGDITG

SEQ ID NO: 164326 - protein, 36 aa, Artificial Sequence
  Description of Artificial Sequence: Synthetic polypeptide
MEEEIRTTNPVATESYGSVYEETDGQNGQGGQGEEG

SEQ ID NO: 164327 - protein, 34 aa, Artificial Sequence
  Description of Artificial Sequence: Synthetic polypeptide
CEEEISTTNPVATEQYGCVCSTGEDAEHFGSEQT

SEQ ID NO: 164328 - protein, 32 aa, Artificial Sequence
  Description of Artificial Sequence: Synthetic polypeptide
DENEIATTNPVSTEPYGTASMEDIQQQHNGNH

SEQ ID NO: 164329 - protein, 35 aa, Artificial Sequence
  Description of Artificial Sequence: Synthetic polypeptide
DEAEIATTNPVATCQYGCVCSTGADLNQNFGSDQS

SEQ ID NO: 164330 - protein, 37 aa, Artificial Sequence
  Description of Artificial Sequence: Synthetic polypeptide
EEETICTTNPVATEQYGSVSTVLNNGNNQLQGTNQED

SEQ ID NO: 164331 - protein, 29 aa, Artificial Sequence
  Description of Artificial Sequence: Synthetic peptide
QESEIASTNPVGTEGYGVMASTLQHQDIY

SEQ ID NO: 164332 - protein, 31 aa, Artificial Sequence
  Description of Artificial Sequence: Synthetic polypeptide
DENEIATTNPVSTEPYGTASMEDIQQQNGEH

SEQ ID NO: 164333 - protein, 34 aa, Artificial Sequence
  Description of Artificial Sequence: Synthetic polypeptide
CEEEISTTNPVATEQYGCVCSTGEHAEHFNSDQA

SEQ ID NO: 164334 - protein, 35 aa, Artificial Sequence
  Description of Artificial Sequence: Synthetic polypeptide
CEEEISTTNPVATEQYGCVCSTGEHAENFGSNNQS

SEQ ID NO: 164335 - protein, 34 aa, Artificial Sequence
  Description of Artificial Sequence: Synthetic polypeptide
CEEEISTTNPVATEQYGCVCSTGEHNQNFFSDQA

SEQ ID NO: 164336 - protein, 37 aa, Artificial Sequence
  Description of Artificial Sequence: Synthetic polypeptide
DEQEIRTTNPVATEQYGVVMSNNDNLTGGGQTGQSGD

SEQ ID NO: 164337 - protein, 32 aa, Artificial Sequence
  Description of Artificial Sequence: Synthetic polypeptide
DESEIASTNPVSTEGYGNVSATDLEDHEGEDL

SEQ ID NO: 164338 - protein, 32 aa, Artificial Sequence
  Description of Artificial Sequence: Synthetic polypeptide
DENEIATTNPVSTEPYGTASMEDIQQQQNGNH

SEQ ID NO: 164339 - protein, 34 aa, Artificial Sequence
  Description of Artificial Sequence: Synthetic polypeptide
MEEEIRTTNPVATESYGSVSDGFGGGEGQGEQGG

SEQ ID NO: 164340 - protein, 34 aa, Artificial Sequence
  Description of Artificial Sequence: Synthetic polypeptide
DEECIRTTNPVAYERYGSVPSCDGHLTAVVTINA

SEQ ID NO: 164341 - protein, 35 aa, Artificial Sequence
  Description of Artificial Sequence: Synthetic polypeptide
CEEEISTTNPVATEQYGCVCSTPEPNQENFGSEQS

SEQ ID NO: 164342 - protein, 37 aa, Artificial Sequence
  Description of Artificial Sequence: Synthetic polypeptide
EEETICTTNPVATEQYGTVSTVNNNQNQLQQGTNQED

SEQ ID NO: 164343 - protein, 37 aa, Artificial Sequence
  Description of Artificial Sequence: Synthetic polypeptide
EEETICTTNPVATEQYGVVSTVNNQQNQLQQGTNQDD

SEQ ID NO: 164344 - protein, 37 aa, Artificial Sequence
  Description of Artificial Sequence: Synthetic polypeptide
EEETICTTNPVATEQYGVVSTVQNLGNNLQQGTNQND

SEQ ID NO: 164345 - protein, 34 aa, Artificial Sequence
  Description of Artificial Sequence: Synthetic polypeptide
DDSEVATTNPVATEGYGNVSATNPTGQSRNGMQV

SEQ ID NO: 164346 - protein, 37 aa, Artificial Sequence
  Description of Artificial Sequence: Synthetic polypeptide
EEETICTTNPVATEQYGVVSTVVNDQQLLQQGTNQSD

SEQ ID NO: 164347 - protein, 35 aa, Artificial Sequence
  Description of Artificial Sequence: Synthetic polypeptide
DEAEIATTNPVATCQYGCVCSNTGADNQNFGSNQS

SEQ ID NO: 164348 - protein, 34 aa, Artificial Sequence
  Description of Artificial Sequence: Synthetic polypeptide
CEEEISTTNPVATEQYGCVCSNWGEPQHFGSDQS

SEQ ID NO: 164349 - protein, 35 aa, Artificial Sequence
  Description of Artificial Sequence: Synthetic polypeptide
DAEEIATTNPVAYEQYGSCAAAVGNGLQNEMGGRQ

SEQ ID NO: 164350 - protein, 36 aa, Artificial Sequence
  Description of Artificial Sequence: Synthetic polypeptide
DEEEIRTTNPVATEQYGSANTEAFPDDEDSGNEEIG

SEQ ID NO: 164351 - protein, 32 aa, Artificial Sequence
  Description of Artificial Sequence: Synthetic polypeptide
DENEIATTNPVSTEPYGETSGEGGQNQGNGNH

SEQ ID NO: 164352 - protein, 36 aa, Artificial Sequence
  Description of Artificial Sequence: Synthetic polypeptide
DEEEIRTTNPVATEQYGSVQVVGEEQIENTEEAEIM

SEQ ID NO: 164353 - protein, 36 aa, Artificial Sequence
  Description of Artificial Sequence: Synthetic polypeptide
DEEEIRTTNPVATEQYGSVQVVIIEQIENTEEDNDM

SEQ ID NO: 164354 - protein, 37 aa, Artificial Sequence
  Description of Artificial Sequence: Synthetic polypeptide
DDEEIRTTNPVATEQYGTVDSTMDIQNGEGGGEENGG

SEQ ID NO: 164355 - protein, 35 aa, Artificial Sequence
  Description of Artificial Sequence: Synthetic polypeptide
CEEEISTTNPVATEQYGCVCSNWGELQNFGSETQS

SEQ ID NO: 164356 - protein, 37 aa, Artificial Sequence
  Description of Artificial Sequence: Synthetic polypeptide
DEGEIATTNPVATEQYGSVCSATLALPQNHQDGAEAN

SEQ ID NO: 164357 - protein, 36 aa, Artificial Sequence
  Description of Artificial Sequence: Synthetic polypeptide
DEEEIRTTNPVATEQYGSVQVYIEEQIENTELDNDM

SEQ ID NO: 164358 - protein, 32 aa, Artificial Sequence
  Description of Artificial Sequence: Synthetic polypeptide
DENEIATTNPVSTEPYGIISMEDIQQQSNGNH

SEQ ID NO: 164359 - protein, 36 aa, Artificial Sequence
  Description of Artificial Sequence: Synthetic polypeptide
DEEEIRTTNPVATEVYGSVVVDMDQDEGQTDDDNDN

SEQ ID NO: 164360 - protein, 37 aa, Artificial Sequence
  Description of Artificial Sequence: Synthetic polypeptide
DEEEIRTTNPVATEVYGSVVSDGMGENLGNDTGEAGM

SEQ ID NO: 164361 - protein, 35 aa, Artificial Sequence
  Description of Artificial Sequence: Synthetic polypeptide
DEECIRTTNPVAYEQYGSVPSCDGTLITANVTINA

SEQ ID NO: 164362 - protein, 37 aa, Artificial Sequence
  Description of Artificial Sequence: Synthetic polypeptide
DEEEIRTTNPVATEVYGSVVSDGMGENLGNDGTEAGQ

SEQ ID NO: 164363 - protein, 35 aa, Artificial Sequence
  Description of Artificial Sequence: Synthetic polypeptide
DEAEISTVNPVATEQYGCVCSTMELNANFGSNNQA

SEQ ID NO: 164364 - protein, 36 aa, Artificial Sequence
  Description of Artificial Sequence: Synthetic polypeptide
DEGEIATTNPVATEQYGSVCSAPALGQDHQDGMDHN

SEQ ID NO: 164365 - protein, 35 aa, Artificial Sequence
  Description of Artificial Sequence: Synthetic polypeptide
DEAEISTVNPVATEQYGCVCSTNDHNANFGSDNQA

SEQ ID NO: 164366 - protein, 37 aa, Artificial Sequence
  Description of Artificial Sequence: Synthetic polypeptide
DDEEIRTTNPVATEQYGSVYGQGTIGDLEVGNGGEEV

SEQ ID NO: 164367 - protein, 39 aa, Artificial Sequence
  Description of Artificial Sequence: Synthetic polypeptide
AEEEIRTTNPVATEQYGSVSTVTNNNQAGNQQLGNNEDD

SEQ ID NO: 164368 - protein, 35 aa, Artificial Sequence
  Description of Artificial Sequence: Synthetic polypeptide
DEAEISTVNPVATEQYGCVCSTSEHNANFGSDNQA

SEQ ID NO: 164369 - protein, 37 aa, Artificial Sequence
  Description of Artificial Sequence: Synthetic polypeptide
DEEEIRCTNPVATEQYGSVNQNGSVGQSGQEGGQNDE

SEQ ID NO: 164370 - protein, 36 aa, Artificial Sequence
  Description of Artificial Sequence: Synthetic polypeptide
DEEEIRCTNPVATEQYGSVIVDQNVMGDAGQGGGGN

SEQ ID NO: 164371 - protein, 36 aa, Artificial Sequence
  Description of Artificial Sequence: Synthetic polypeptide
DEEEIRTTNPVATEQYGSASLGFGEIQVNVIEMNTM

SEQ ID NO: 164372 - protein, 36 aa, Artificial Sequence
  Description of Artificial Sequence: Synthetic polypeptide
DEEEIRTTNPVATEGYGMVDINQDTNMENNGGGNGQ

SEQ ID NO: 164373 - protein, 33 aa, Artificial Sequence
  Description of Artificial Sequence: Synthetic polypeptide
DEAEISTVNPVATEQYGCVCSWEDAYFGSNNQS

SEQ ID NO: 164374 - protein, 37 aa, Artificial Sequence
  Description of Artificial Sequence: Synthetic polypeptide
DEEEIRTTNPVATEQYGSASLMTGGELEHFINFENNV

SEQ ID NO: 164375 - protein, 30 aa, Artificial Sequence
  Description of Artificial Sequence: Synthetic polypeptide
QESEIASTNPVGTEGYGVMASTLQHPGSDI

SEQ ID NO: 164376 - protein, 36 aa, Artificial Sequence
  Description of Artificial Sequence: Synthetic polypeptide
DEGEIATTNPVATEQYGSVCSAPAEGQDHQDGQDNH

SEQ ID NO: 164377 - protein, 37 aa, Artificial Sequence
  Description of Artificial Sequence: Synthetic polypeptide
EEETICTTNPVATEQYGVVSTVVTNQQQLQQGTNNSD

SEQ ID NO: 164378 - protein, 32 aa, Artificial Sequence
  Description of Artificial Sequence: Synthetic polypeptide
DESEIASTNPVSTEGYGNVSANDIQSHVGQDL

SEQ ID NO: 164379 - protein, 38 aa, Artificial Sequence
  Description of Artificial Sequence: Synthetic polypeptide
AEEEIRTTNPVATEQYGVVSTVNNNQANQAGNGNNQQD

SEQ ID NO: 164380 - protein, 34 aa, Artificial Sequence
  Description of Artificial Sequence: Synthetic polypeptide
EENEIATTNPVATEQYGSVPCWDNHGQQGQGGDA

SEQ ID NO: 164381 - protein, 34 aa, Artificial Sequence
  Description of Artificial Sequence: Synthetic polypeptide
CEEEISTTNPVATEQYGCVCSWGEDTENFGSDQS

SEQ ID NO: 164382 - protein, 39 aa, Artificial Sequence
  Description of Artificial Sequence: Synthetic polypeptide
DDEEIRTTNPVATEQYGSVVVSTTSGNMDQNDNGGGNQG

SEQ ID NO: 164383 - protein, 34 aa, Artificial Sequence
  Description of Artificial Sequence: Synthetic polypeptide
DEEEIRTTNPVATEGYGMVNGQGTIQEGGGDTTG

SEQ ID NO: 164384 - protein, 38 aa, Artificial Sequence
  Description of Artificial Sequence: Synthetic polypeptide
DEEEIRTTNPVATEQYGVVSTVNNQNATEQGTTEQGSD

SEQ ID NO: 164385 - protein, 36 aa, Artificial Sequence
  Description of Artificial Sequence: Synthetic polypeptide
DDEEIRTTNPVATEQYGSVVVDGFGQENDQEEDNGV

SEQ ID NO: 164386 - protein, 30 aa, Artificial Sequence
  Description of Artificial Sequence: Synthetic polypeptide
EENEIATTNPVAYECWGCVSECLQHEHEAS

SEQ ID NO: 164387 - protein, 33 aa, Artificial Sequence
  Description of Artificial Sequence: Synthetic polypeptide
SEECAEIATTNPVAYERWGSTVTNLQLGDTGDS

SEQ ID NO: 164388 - protein, 32 aa, Artificial Sequence
  Description of Artificial Sequence: Synthetic polypeptide
DENEIATTNPVSTEPYGTISMEDIAQQQNGNH

SEQ ID NO: 164389 - protein, 30 aa, Artificial Sequence
  Description of Artificial Sequence: Synthetic polypeptide
EENEIATTNPVAYECWGNVSECLQHMEETE

SEQ ID NO: 164390 - protein, 37 aa, Artificial Sequence
  Description of Artificial Sequence: Synthetic polypeptide
MEEEIRTTNPVATEQYGSVYDQSNLNNIQEGGGEQGD

SEQ ID NO: 164391 - protein, 31 aa, Artificial Sequence
  Description of Artificial Sequence: Synthetic polypeptide
DDSEVASTNPVSTEGYGVVAANDIQSRVGQR

SEQ ID NO: 164392 - protein, 32 aa, Artificial Sequence
  Description of Artificial Sequence: Synthetic polypeptide
DENEIATTNPVSTEPYGTISMEDIQQDQNGNH

SEQ ID NO: 164393 - protein, 32 aa, Artificial Sequence
  Description of Artificial Sequence: Synthetic polypeptide
DESEIASTNPVSTEGYGNVAANTIQSRVGQDL

SEQ ID NO: 164394 - protein, 34 aa, Artificial Sequence
  Description of Artificial Sequence: Synthetic polypeptide
CEEEIACTNPVATEQYGSVASGEHGTEGEMNDLQ

SEQ ID NO: 164395 - protein, 31 aa, Artificial Sequence
  Description of Artificial Sequence: Synthetic polypeptide
DDSEVASTNPVSTEGYGVVAANNIQSRVGQR

SEQ ID NO: 164396 - protein, 33 aa, Artificial Sequence
  Description of Artificial Sequence: Synthetic polypeptide
CEEEISTTNPVATEQYGCVCSWGEPANFGSEQS

SEQ ID NO: 164397 - protein, 30 aa, Artificial Sequence
  Description of Artificial Sequence: Synthetic polypeptide
EENEIATTNPVAYEPWGTVSECLQHMEHEL

SEQ ID NO: 164398 - protein, 29 aa, Artificial Sequence
  Description of Artificial Sequence: Synthetic peptide
EENEIATTNPVAYEPWGVVAECLQHEHEL

SEQ ID NO: 164399 - protein, 34 aa, Artificial Sequence
  Description of Artificial Sequence: Synthetic polypeptide
SEEAEIRTTNPVAYEQWGSVCYNNDNDHGGDNQG

SEQ ID NO: 164400 - protein, 32 aa, Artificial Sequence
  Description of Artificial Sequence: Synthetic polypeptide
DENEIATTNPVSTEPYGTISMEDIQQQHNGNH

SEQ ID NO: 164401 - protein, 32 aa, Artificial Sequence
  Description of Artificial Sequence: Synthetic polypeptide
DEEEIAATNPVAYEQWGMVTGWNDHQGQPGDL

SEQ ID NO: 164402 - protein, 37 aa, Artificial Sequence
  Description of Artificial Sequence: Synthetic polypeptide
MEEEIRTTNPVATEQYGSVVSTGPTGPEAGQGENEQN

SEQ ID NO: 164403 - protein, 36 aa, Artificial Sequence
  Description of Artificial Sequence: Synthetic polypeptide
MEEEIRTTNPVATEQYGSVVSDLMEFNNENENDDED

SEQ ID NO: 164404 - protein, 33 aa, Artificial Sequence
  Description of Artificial Sequence: Synthetic polypeptide
EENEIRTTNPVATDQYGSVNEMGQEVHQQANSD

SEQ ID NO: 164405 - protein, 35 aa, Artificial Sequence
  Description of Artificial Sequence: Synthetic polypeptide
CEEEIACTNPVATEQYGSVATGNGDNTAPGGNMEN

SEQ ID NO: 164406 - protein, 32 aa, Artificial Sequence
  Description of Artificial Sequence: Synthetic polypeptide
DENEIATTNPVSTEPYGTISEEDIQQQQNGNH

SEQ ID NO: 164407 - protein, 38 aa, Artificial Sequence
  Description of Artificial Sequence: Synthetic polypeptide
DEETIRTTNPVATEQYGTVTVVSVTNNQNQQIGTNEEE

SEQ ID NO: 164408 - protein, 31 aa, Artificial Sequence
  Description of Artificial Sequence: Synthetic polypeptide
DENEIATTNPVSTEPYGTISEEDCQQQNENH

SEQ ID NO: 164409 - protein, 36 aa, Artificial Sequence
  Description of Artificial Sequence: Synthetic polypeptide
DEGEIATTNPVATEQYGSVCATNNLLDQAHQDDTEN

SEQ ID NO: 164410 - protein, 37 aa, Artificial Sequence
  Description of Artificial Sequence: Synthetic polypeptide
DEECIRTTNPVSTERYGKTVPSQTNEQSDYRGGQYRF

SEQ ID NO: 164411 - protein, 35 aa, Artificial Sequence
  Description of Artificial Sequence: Synthetic polypeptide
DEAEIATTNPVATCQYGCVCSTGAPNQNFGSDNQS

SEQ ID NO: 164412 - protein, 32 aa, Artificial Sequence
  Description of Artificial Sequence: Synthetic polypeptide
DESEIASTNPVSTEGYGNVSANDIQSHVGEDL

SEQ ID NO: 164413 - protein, 35 aa, Artificial Sequence
  Description of Artificial Sequence: Synthetic polypeptide
DEECIRTTNPVTTEHWGSVYCWMPNDQDDQRQGNL

SEQ ID NO: 164414 - protein, 36 aa, Artificial Sequence
  Description of Artificial Sequence: Synthetic polypeptide
DEEEIRTTNPVATEGYGMVNGQGTFGQEEGGGENTG

SEQ ID NO: 164415 - protein, 32 aa, Artificial Sequence
  Description of Artificial Sequence: Synthetic polypeptide
DESEIASTNPVSTEGYGNVSANDIQSHEGEDL

SEQ ID NO: 164416 - protein, 35 aa, Artificial Sequence
  Description of Artificial Sequence: Synthetic polypeptide
MEEEIRTTNPVATESYGSVMGFTVNNGEFTGGEGQ

SEQ ID NO: 164417 - protein, 35 aa, Artificial Sequence
  Description of Artificial Sequence: Synthetic polypeptide
DEEEIRTTNPVATEGYGMVNGQGTFGQEGGGQGTG

SEQ ID NO: 164418 - protein, 32 aa, Artificial Sequence
  Description of Artificial Sequence: Synthetic polypeptide
DENEIATTNPVSTEPYGTCSMEDIQQQQNGNS

SEQ ID NO: 164419 - protein, 33 aa, Artificial Sequence
  Description of Artificial Sequence: Synthetic polypeptide
SEECIQTTNPVAYERYGCSVWINMVSDRPGGNA

SEQ ID NO: 164420 - protein, 33 aa, Artificial Sequence
  Description of Artificial Sequence: Synthetic polypeptide
CEEEISTTNPVATEQYGCVCSWEHANFNSDTQD

SEQ ID NO: 164421 - protein, 35 aa, Artificial Sequence
  Description of Artificial Sequence: Synthetic polypeptide
CEEEISTTNPVATEQYGCVCSWEHNQEGFGSDNQA

SEQ ID NO: 164422 - protein, 37 aa, Artificial Sequence
  Description of Artificial Sequence: Synthetic polypeptide
MEEEIRTTNPVATEQYGVVYDQSNLNIIQEGGGNQED

SEQ ID NO: 164423 - protein, 35 aa, Artificial Sequence
  Description of Artificial Sequence: Synthetic polypeptide
DEEEIRCTNPVATEQYGQCVCSWEHNDHFGSDTQM

SEQ ID NO: 164424 - protein, 34 aa, Artificial Sequence
  Description of Artificial Sequence: Synthetic polypeptide
CEEEISTTNPVATEQYGCVCSWEHNQNFNSQPQS

SEQ ID NO: 164425 - protein, 33 aa, Artificial Sequence
  Description of Artificial Sequence: Synthetic polypeptide
EEMEIVTTNPVATEQYGTMCSATDGPVEFEGND

SEQ ID NO: 164426 - protein, 36 aa, Artificial Sequence
  Description of Artificial Sequence: Synthetic polypeptide
MEEEIRTTNPVATEQYGVVMGNDNNVEQTQGGNGGN

SEQ ID NO: 164427 - protein, 34 aa, Artificial Sequence
  Description of Artificial Sequence: Synthetic polypeptide
MEEEIRTTNPVATEQYGVVMGINDNEGGDDEIEA

SEQ ID NO: 164428 - protein, 36 aa, Artificial Sequence
  Description of Artificial Sequence: Synthetic polypeptide
DEEEIRCTNPVATEQYGQCVCSMTEDFQEGFGSDQS

SEQ ID NO: 164429 - protein, 36 aa, Artificial Sequence
  Description of Artificial Sequence: Synthetic polypeptide
DEEEIRTTNPVATEQYGSASPVTTSIEEGRSEVEGD

SEQ ID NO: 164430 - protein, 30 aa, Artificial Sequence
  Description of Artificial Sequence: Synthetic polypeptide
QESEIASTNPVGTEGYGVMASTLQHTGDMI

SEQ ID NO: 164431 - protein, 36 aa, Artificial Sequence
  Description of Artificial Sequence: Synthetic polypeptide
MEEEIRTTNPVATEQYGVVDIDTNMNLNEGGGQDAT

SEQ ID NO: 164432 - protein, 35 aa, Artificial Sequence
  Description of Artificial Sequence: Synthetic polypeptide
DEGEIATTNPVATEQYGSVCAPNNLEMTDDLGAQA

SEQ ID NO: 164433 - protein, 29 aa, Artificial Sequence
  Description of Artificial Sequence: Synthetic peptide
QESEIASTNPVGTEGYGVMASTLQHVDIY

SEQ ID NO: 164434 - protein, 36 aa, Artificial Sequence
  Description of Artificial Sequence: Synthetic polypeptide
DEEEIRTTNPVATEQYGSVWSYAMEVEAQSTQLEED

SEQ ID NO: 164435 - protein, 33 aa, Artificial Sequence
  Description of Artificial Sequence: Synthetic polypeptide
DEIEIRTTNPVATECWGSFGCINEPEAREFEND

SEQ ID NO: 164436 - protein, 36 aa, Artificial Sequence
  Description of Artificial Sequence: Synthetic polypeptide
DEGEIATTNPVATEQYGSVCSMNNQNNEAMIGDGAN

SEQ ID NO: 164437 - protein, 31 aa, Artificial Sequence
  Description of Artificial Sequence: Synthetic polypeptide
DENEIRTTNPVATEQWGATSEIIEMNAAEDA

SEQ ID NO: 164438 - protein, 37 aa, Artificial Sequence
  Description of Artificial Sequence: Synthetic polypeptide
DDEEIRTTNPVATEQYGTVVSGGTDQNDGEGEGNGEG

SEQ ID NO: 164439 - protein, 37 aa, Artificial Sequence
  Description of Artificial Sequence: Synthetic polypeptide
DEEEIRTTNPVATEQYGSANSEPNPDDLGGSPQEEIG

SEQ ID NO: 164440 - protein, 32 aa, Artificial Sequence
  Description of Artificial Sequence: Synthetic polypeptide
DDSEVASTNPVSTEGYGTVANETIQQSRVGNR

SEQ ID NO: 164441 - protein, 38 aa, Artificial Sequence
  Description of Artificial Sequence: Synthetic polypeptide
EEEEIRTTNPVATEQYGVVSTTTNQQLQAGTEAGSTEE

SEQ ID NO: 164442 - protein, 36 aa, Artificial Sequence
  Description of Artificial Sequence: Synthetic polypeptide
DEEEIRTTNPVATEQYGSVQVHIEEQIENTEEAGDM

SEQ ID NO: 164443 - protein, 35 aa, Artificial Sequence
  Description of Artificial Sequence: Synthetic polypeptide
DEEEIRTTNPVATEGYGMVDGMENVQGDIGETGGG

SEQ ID NO: 164444 - protein, 38 aa, Artificial Sequence
  Description of Artificial Sequence: Synthetic polypeptide
DEEEIRTTNPVATEQYGSVDVPGEPYLQEHRVEENVEL

SEQ ID NO: 164445 - protein, 36 aa, Artificial Sequence
  Description of Artificial Sequence: Synthetic polypeptide
DEEEIRTTNPVATEGYGMVDGMENVVGQDGNGTGQG

SEQ ID NO: 164446 - protein, 37 aa, Artificial Sequence
  Description of Artificial Sequence: Synthetic polypeptide
EEEEIRTTNPVATEQYGVVSTVNNQQNEQQNGTEESE

SEQ ID NO: 164447 - protein, 33 aa, Artificial Sequence
  Description of Artificial Sequence: Synthetic polypeptide
DEAEIATTNPEATDQYGQVCCCDQDQKREGNSQ

SEQ ID NO: 164448 - protein, 37 aa, Artificial Sequence
  Description of Artificial Sequence: Synthetic polypeptide
EEEEIRTTNPVATEQYGVVSTVNQQAGTEAGGTTTDD

SEQ ID NO: 164449 - protein, 37 aa, Artificial Sequence
  Description of Artificial Sequence: Synthetic polypeptide
EEEEIRTTNPVATEQYGVVSTVNQQGNQQQNGTEESE

SEQ ID NO: 164450 - protein, 36 aa, Artificial Sequence
  Description of Artificial Sequence: Synthetic polypeptide
DEEEIRTTNPVATEGYGMVDGVGNLNVNVGGNGEQN

SEQ ID NO: 164451 - protein, 38 aa, Artificial Sequence
  Description of Artificial Sequence: Synthetic polypeptide
DEEEIRTTNPVATEQYGSVDVPGENYLQEVRVEEQDEL

SEQ ID NO: 164452 - protein, 33 aa, Artificial Sequence
  Description of Artificial Sequence: Synthetic polypeptide
DEECIRTTNPVAYEQYGCVCSWGEHQYFISDQA

SEQ ID NO: 164453 - protein, 36 aa, Artificial Sequence
  Description of Artificial Sequence: Synthetic polypeptide
DEEEIRTTNPVATEQYGSVQVHVEEQIETTEEANNM

SEQ ID NO: 164454 - protein, 38 aa, Artificial Sequence
  Description of Artificial Sequence: Synthetic polypeptide
DEEEIRTTNPVATEQYGVVSVVVVTNDTEQGNNTEEDE

SEQ ID NO: 164455 - protein, 37 aa, Artificial Sequence
  Description of Artificial Sequence: Synthetic polypeptide
DEEEIRTTNPVATEQYGSVDTVMVDNGGDEDEEDGDE

SEQ ID NO: 164456 - protein, 37 aa, Artificial Sequence
  Description of Artificial Sequence: Synthetic polypeptide
DEEEIRTTNPVATEQYGSAISPCEVAHIQDTIGNAVQ

SEQ ID NO: 164457 - protein, 36 aa, Artificial Sequence
  Description of Artificial Sequence: Synthetic polypeptide
DEEEIRTTNPVATEQYGSVQVIGDEQIENTEEANIM

SEQ ID NO: 164458 - protein, 39 aa, Artificial Sequence
  Description of Artificial Sequence: Synthetic polypeptide
DEEEIRTTNPVATEQYGVVSVVVVTNGTNLQQNTTNSEE

SEQ ID NO: 164459 - protein, 37 aa, Artificial Sequence
  Description of Artificial Sequence: Synthetic polypeptide
EEEEIRTTNPVATEQYGVVSTVVNNQNQQLQNATEEG

SEQ ID NO: 164460 - protein, 36 aa, Artificial Sequence
  Description of Artificial Sequence: Synthetic polypeptide
DEEEIRTTNPVATEQYGSVQVIGEEQIENTELANIG

SEQ ID NO: 164461 - protein, 37 aa, Artificial Sequence
  Description of Artificial Sequence: Synthetic polypeptide
EEEEIRTTNPVATEQYGVVSTVVNNQQLELQEATEEA

SEQ ID NO: 164462 - protein, 37 aa, Artificial Sequence
  Description of Artificial Sequence: Synthetic polypeptide
EEEEIRTTNPVATEQYGVVSTVVNNQQLGLQSATEEG

SEQ ID NO: 164463 - protein, 33 aa, Artificial Sequence
  Description of Artificial Sequence: Synthetic polypeptide
YEFIIRTTNTVAIEIYGDSVNWTMAQADFGNRL

SEQ ID NO: 164464 - protein, 37 aa, Artificial Sequence
  Description of Artificial Sequence: Synthetic polypeptide
EEEEIRTTNPVATEQYGVVSTVVNNQQQNNQNATEEG

SEQ ID NO: 164465 - protein, 34 aa, Artificial Sequence
  Description of Artificial Sequence: Synthetic polypeptide
DEEEIACTNPVATAQWGSVSVSGNLENTAGVGEF

SEQ ID NO: 164466 - protein, 37 aa, Artificial Sequence
  Description of Artificial Sequence: Synthetic polypeptide
DEEEIRCTNPVATEQYGSVSNGSNGQIGQEGGQEDTT

SEQ ID NO: 164467 - protein, 36 aa, Artificial Sequence
  Description of Artificial Sequence: Synthetic polypeptide
DEGEIATTNPVATEQYGSVSASTPAITNIGNGMESV

SEQ ID NO: 164468 - protein, 32 aa, Artificial Sequence
  Description of Artificial Sequence: Synthetic polypeptide
DDSEVASTNPVSTEGYGTVANETIQQSRNGNR

SEQ ID NO: 164469 - protein, 32 aa, Artificial Sequence
  Description of Artificial Sequence: Synthetic polypeptide
DDSEVASTNPVSTEGYGTVANETIQQQRNGNR

SEQ ID NO: 164470 - protein, 37 aa, Artificial Sequence
  Description of Artificial Sequence: Synthetic polypeptide
EEEEIRTTNPVATEQYGVVATTTQQLQQGNNNTEQGS

SEQ ID NO: 164471 - protein, 31 aa, Artificial Sequence
  Description of Artificial Sequence: Synthetic polypeptide
DENEIATTNPVGTEPYGTISMEDIQQQHGDH

SEQ ID NO: 164472 - protein, 37 aa, Artificial Sequence
  Description of Artificial Sequence: Synthetic polypeptide
EEEEIRTTNPVATEQYGVVAVTNLQAGTEAGSTQTDD

SEQ ID NO: 164473 - protein, 37 aa, Artificial Sequence
  Description of Artificial Sequence: Synthetic polypeptide
EEEEIRTTNPVATEQYGVVAVTVNLQQGTEQGTVQDD

SEQ ID NO: 164474 - protein, 37 aa, Artificial Sequence
  Description of Artificial Sequence: Synthetic polypeptide
EEEEIRTTNPVATEQYGVVSSTELQAGTEEGSTQEDD

SEQ ID NO: 164475 - protein, 36 aa, Artificial Sequence
  Description of Artificial Sequence: Synthetic polypeptide
QEEGIRTTNPAATEQYGSVSVTNGGEEGEGQGNQGN

SEQ ID NO: 164476 - protein, 37 aa, Artificial Sequence
  Description of Artificial Sequence: Synthetic polypeptide
EEEEIRTTNPVATEQYGVVSSTQLQAGTEAGSTDTDD

SEQ ID NO: 164477 - protein, 37 aa, Artificial Sequence
  Description of Artificial Sequence: Synthetic polypeptide
EEEEIRTTNPVATEQYGVVSSTQNQQQGTEQGTTTDD

SEQ ID NO: 164478 - protein, 32 aa, Artificial Sequence
  Description of Artificial Sequence: Synthetic polypeptide
DENEIATTNPVGTEPYGTISMEDIQQQHNGNH

SEQ ID NO: 164479 - protein, 38 aa, Artificial Sequence
  Description of Artificial Sequence: Synthetic polypeptide
DEEEIATTNPVATEQYGSVCAMTNGEETNIDDGMENRM

SEQ ID NO: 164480 - protein, 37 aa, Artificial Sequence
  Description of Artificial Sequence: Synthetic polypeptide
EEEEIRTTNPVATEQYGVVSTELQQAGTEQGSTQTDD

SEQ ID NO: 164481 - protein, 36 aa, Artificial Sequence
  Description of Artificial Sequence: Synthetic polypeptide
QEEGIRTTNPVATEAYGSVSVTENGGEEGGQGNQGN

SEQ ID NO: 164482 - protein, 38 aa, Artificial Sequence
  Description of Artificial Sequence: Synthetic polypeptide
DEEEIRTTNPVATEQYGVVSVVVVTNADEQGNNNEEDE

SEQ ID NO: 164483 - protein, 35 aa, Artificial Sequence
  Description of Artificial Sequence: Synthetic polypeptide
DEAEIATTNPCAYEQWGSVYCTDNGLDIDRNGNAG

SEQ ID NO: 164484 - protein, 37 aa, Artificial Sequence
  Description of Artificial Sequence: Synthetic polypeptide
AEEEIRTTNPVATEQYGSVSTVTNNDEQGSTDEDEDD

SEQ ID NO: 164485 - protein, 35 aa, Artificial Sequence
  Description of Artificial Sequence: Synthetic polypeptide
DEAEIRTTNPVATEHYGCVVCIENDQRGEEGQQGS

SEQ ID NO: 164486 - protein, 39 aa, Artificial Sequence
  Description of Artificial Sequence: Synthetic polypeptide
EEEEIRTTNPVATEQYGVVSTTNLQSGTEQGSTNLQEED

SEQ ID NO: 164487 - protein, 37 aa, Artificial Sequence
  Description of Artificial Sequence: Synthetic polypeptide
EEEEIRTTNPVATEQYGVVSTTNNNQQQLNQNATETG

SEQ ID NO: 164488 - protein, 30 aa, Artificial Sequence
  Description of Artificial Sequence: Synthetic polypeptide
QESEIASTNPVGTEGYGVMASTLQHGSDIQ

SEQ ID NO: 164489 - protein, 31 aa, Artificial Sequence
  Description of Artificial Sequence: Synthetic polypeptide
DENEIRTTNPVATEPWGDVSEISEMNAAEDA

SEQ ID NO: 164490 - protein, 37 aa, Artificial Sequence
  Description of Artificial Sequence: Synthetic polypeptide
EEEEIRTTNPVATEQYGVVSTTNNQQNNQQQGTEESE

SEQ ID NO: 164491 - protein, 31 aa, Artificial Sequence
  Description of Artificial Sequence: Synthetic polypeptide
DDSEVASTNPVSTEGYGTVAANTIQSRVGQR

SEQ ID NO: 164492 - protein, 37 aa, Artificial Sequence
  Description of Artificial Sequence: Synthetic polypeptide
AEEEIRTTNPVATEQYGSVSTVTNNDEQGSTEEQETD

SEQ ID NO: 164493 - protein, 38 aa, Artificial Sequence
  Description of Artificial Sequence: Synthetic polypeptide
EEEEIRTTNPVATEQYGVVSTTNQQLQLAGTEQGTEEE

SEQ ID NO: 164494 - protein, 35 aa, Artificial Sequence
  Description of Artificial Sequence: Synthetic polypeptide
DEEEIRTTNPVATEGYGMVDGMENDTNIIGQTNEG

SEQ ID NO: 164495 - protein, 37 aa, Artificial Sequence
  Description of Artificial Sequence: Synthetic polypeptide
QEEGIRTTNPVATEQYGSVSATDNGGEEGGNQGNAGI

SEQ ID NO: 164496 - protein, 37 aa, Artificial Sequence
  Description of Artificial Sequence: Synthetic polypeptide
DEEEIRTTNPVATEQYGSAGVNGNVEQSGDSLQDSIV

SEQ ID NO: 164497 - protein, 36 aa, Artificial Sequence
  Description of Artificial Sequence: Synthetic polypeptide
DEGEIATTNPVATEQYGSVSASNPAITNIGNGMEQA

SEQ ID NO: 164498 - protein, 37 aa, Artificial Sequence
  Description of Artificial Sequence: Synthetic polypeptide
EEEEIRTTNPVATEQYGVVSTVVTNQQLQLQQATEEA

SEQ ID NO: 164499 - protein, 37 aa, Artificial Sequence
  Description of Artificial Sequence: Synthetic polypeptide
EEEEIRTTNPVATEQYGVVSTVVTNQQQLLQSATEEG

SEQ ID NO: 164500 - protein, 29 aa, Artificial Sequence
  Description of Artificial Sequence: Synthetic peptide
QESEIASTNPVGTEGYGVMASTLQHIQDI

SEQ ID NO: 164501 - protein, 34 aa, Artificial Sequence
  Description of Artificial Sequence: Synthetic polypeptide
DEAEIRTTNGVAYCQYGQCVCSTELNQGFGSDQA

SEQ ID NO: 164502 - protein, 36 aa, Artificial Sequence
  Description of Artificial Sequence: Synthetic polypeptide
DEEEIRTTNPVATEQYGSANNVIILEDDDRSNEKDN

SEQ ID NO: 164503 - protein, 36 aa, Artificial Sequence
  Description of Artificial Sequence: Synthetic polypeptide
DDEEIRTTNPVATEQYGVVSINGDQNDGGGEEGVEG

SEQ ID NO: 164504 - protein, 35 aa, Artificial Sequence
  Description of Artificial Sequence: Synthetic polypeptide
DEEEIRTTNPVATEQYGSANNVIVQDDDPNSNEDN

SEQ ID NO: 164505 - protein, 37 aa, Artificial Sequence
  Description of Artificial Sequence: Synthetic polypeptide
DDEEIRTTNPVATEQYGVVSANDDQNDGEGEEGNGEG

SEQ ID NO: 164506 - protein, 32 aa, Artificial Sequence
  Description of Artificial Sequence: Synthetic polypeptide
DENEIATTNPVSTEGYGTISMEDIQQQQNGNH

SEQ ID NO: 164507 - protein, 35 aa, Artificial Sequence
  Description of Artificial Sequence: Synthetic polypeptide
DEAEISTVNPVATEQYGCVCSTAHNAENFGSDNQA

SEQ ID NO: 164508 - protein, 39 aa, Artificial Sequence
  Description of Artificial Sequence: Synthetic polypeptide
DEEEIRTTNPVATEQYGVVSVVVVTNLGLEQGNNTEEED

SEQ ID NO: 164509 - protein, 36 aa, Artificial Sequence
  Description of Artificial Sequence: Synthetic polypeptide
DEEEIRTTNPVATEQYGSANSEANPDDEGSGSEEAG

SEQ ID NO: 164510 - protein, 36 aa, Artificial Sequence
  Description of Artificial Sequence: Synthetic polypeptide
DEGEIATTNPVATEQYGSVCSPVGDDLNPDAQMGDN

SEQ ID NO: 164511 - protein, 35 aa, Artificial Sequence
  Description of Artificial Sequence: Synthetic polypeptide
DEGEIATTNPVATEQYGSVCSPVDNNHNIDAMGED

SEQ ID NO: 164512 - protein, 36 aa, Artificial Sequence
  Description of Artificial Sequence: Synthetic polypeptide
DEEEIRTTNPVATEQYGSVSEVEWHDVVVNIAASPY

SEQ ID NO: 164513 - protein, 37 aa, Artificial Sequence
  Description of Artificial Sequence: Synthetic polypeptide
DEEEIRTTNPVATEQYGSANSEANPDDLEGSGQESIG

SEQ ID NO: 164514 - protein, 31 aa, Artificial Sequence
  Description of Artificial Sequence: Synthetic polypeptide
DESEIASTNPVSTEQYGNAAAETCQSRVEER

SEQ ID NO: 164515 - protein, 34 aa, Artificial Sequence
  Description of Artificial Sequence: Synthetic polypeptide
DEAEISTVNPVATEQYGCVCSTEDNANFNSDNQA

SEQ ID NO: 164516 - protein, 35 aa, Artificial Sequence
  Description of Artificial Sequence: Synthetic polypeptide
DEAEISTVNPVATEQYGCVCSTEEHNANFGSDNQA

SEQ ID NO: 164517 - protein, 31 aa, Artificial Sequence
  Description of Artificial Sequence: Synthetic polypeptide
DENEIATTNPVSTEPYGDISMECIQQQHENL

SEQ ID NO: 164518 - protein, 35 aa, Artificial Sequence
  Description of Artificial Sequence: Synthetic polypeptide
EEEEIRTTNPVAYEQWGVYATISPDEGDQDRGNAR

SEQ ID NO: 164519 - protein, 36 aa, Artificial Sequence
  Description of Artificial Sequence: Synthetic polypeptide
DDEEIRTTNPVATEQYGVVIVGDTDQNDGEGEGNEG

SEQ ID NO: 164520 - protein, 34 aa, Artificial Sequence
  Description of Artificial Sequence: Synthetic polypeptide
DEAEISTVNPVATEQYGCVCSTEHNANFISNNQA

SEQ ID NO: 164521 - protein, 36 aa, Artificial Sequence
  Description of Artificial Sequence: Synthetic polypeptide
DEECIRTTNPVAYEQYGQCVCSNTGEDNQYFGSNQS

SEQ ID NO: 164522 - protein, 30 aa, Artificial Sequence
  Description of Artificial Sequence: Synthetic polypeptide
DESEIASTNPVSTEQWGNVSEIIQSAVEQA

SEQ ID NO: 164523 - protein, 35 aa, Artificial Sequence
  Description of Artificial Sequence: Synthetic polypeptide
DDEEIRTTNPVATEQYGVVDGTDTGQGGGETTFGG

SEQ ID NO: 164524 - protein, 38 aa, Artificial Sequence
  Description of Artificial Sequence: Synthetic polypeptide
AEEEIRTTNPVATEQYGSVSTVTNNNEAGTEQGSNQNQ

SEQ ID NO: 164525 - protein, 36 aa, Artificial Sequence
  Description of Artificial Sequence: Synthetic polypeptide
DDEEIRTTNPVATEQYGVISVGGDQNDGEGNEGNEG

SEQ ID NO: 164526 - protein, 36 aa, Artificial Sequence
  Description of Artificial Sequence: Synthetic polypeptide
DAEEIATTNPVAYEQYGSCASAVGNGLNHEDGDNRQ

SEQ ID NO: 164527 - protein, 35 aa, Artificial Sequence
  Description of Artificial Sequence: Synthetic polypeptide
DENEIRTTNPVATEIYGSVVNDGLDQQTGGQQGQG

SEQ ID NO: 164528 - protein, 36 aa, Artificial Sequence
  Description of Artificial Sequence: Synthetic polypeptide
DDEEIRTTNPVATEQYGVVSVGGDQNDGNGEEGNEG

SEQ ID NO: 164529 - protein, 36 aa, Artificial Sequence
  Description of Artificial Sequence: Synthetic polypeptide
MEEEISTTNPVATEQYGCVCSVSGELNQEGFGSDQM

SEQ ID NO: 164530 - protein, 30 aa, Artificial Sequence
  Description of Artificial Sequence: Synthetic polypeptide
DENEIRTTNPVATEKWGDVFEIEMNAAEDA

SEQ ID NO: 164531 - protein, 31 aa, Artificial Sequence
  Description of Artificial Sequence: Synthetic polypeptide
DENEIRTTNPVATEKWGDKVSEIEMNAAEDA

SEQ ID NO: 164532 - protein, 33 aa, Artificial Sequence
  Description of Artificial Sequence: Synthetic polypeptide
DEAEIRTTNGVAYCQYGCVCSWGELQGFGSDQS

SEQ ID NO: 164533 - protein, 30 aa, Artificial Sequence
  Description of Artificial Sequence: Synthetic polypeptide
QESEIASTNPVGTEGYGVMASTLQHGWDIM

SEQ ID NO: 164534 - protein, 32 aa, Artificial Sequence
  Description of Artificial Sequence: Synthetic polypeptide
DENEIATTNPVSTECYGTCSMEDIQQQPNGNH

SEQ ID NO: 164535 - protein, 30 aa, Artificial Sequence
  Description of Artificial Sequence: Synthetic polypeptide
QESEIASTNPVGTEGYGVMASTLQHGWDTI

SEQ ID NO: 164536 - protein, 36 aa, Artificial Sequence
  Description of Artificial Sequence: Synthetic polypeptide
DEEEIRTTNPVATEQYGSALPAYNGQFINTIELSEL

SEQ ID NO: 164537 - protein, 35 aa, Artificial Sequence
  Description of Artificial Sequence: Synthetic polypeptide
DDEEIRTTNPVATESYGSVVPTDPEMDQGGGGQEG

SEQ ID NO: 164538 - protein, 30 aa, Artificial Sequence
  Description of Artificial Sequence: Synthetic polypeptide
QESEIASTNPVGTEGYGVMASTLQHGYDIN

SEQ ID NO: 164539 - protein, 30 aa, Artificial Sequence
  Description of Artificial Sequence: Synthetic polypeptide
QESEIASTNPVGTEGYGVMASTLQHGYDYI

SEQ ID NO: 164540 - protein, 38 aa, Artificial Sequence
  Description of Artificial Sequence: Synthetic polypeptide
EEEEIRTTNPVATEQYGVVTVTVTNLNLQNGNQQGTEQ

SEQ ID NO: 164541 - protein, 32 aa, Artificial Sequence
  Description of Artificial Sequence: Synthetic polypeptide
DEEEIACTNPVATAQWGSVSATGAGGTPQDAM

SEQ ID NO: 164542 - protein, 38 aa, Artificial Sequence
  Description of Artificial Sequence: Synthetic polypeptide
EEEEIRTTNPVATEQYGVVTVTVTNLQLQNGNQNGTED

SEQ ID NO: 164543 - protein, 32 aa, Artificial Sequence
  Description of Artificial Sequence: Synthetic polypeptide
DENEIATTNPVSTEEYGTISMEDIQQQQNGNH

SEQ ID NO: 164544 - protein, 33 aa, Artificial Sequence
  Description of Artificial Sequence: Synthetic polypeptide
YEFVIRTTSTVAIEQYGDSVNWTMAQADFGMNR

SEQ ID NO: 164545 - protein, 38 aa, Artificial Sequence
  Description of Artificial Sequence: Synthetic polypeptide
EEEEIRTTNPVATEQYGVVVVSTNLQAGTEAGSTQTDD

SEQ ID NO: 164546 - protein, 36 aa, Artificial Sequence
  Description of Artificial Sequence: Synthetic polypeptide
DEGEIATTNPVATEQYGSVSAATPAGTNMRNLMEPV

SEQ ID NO: 164547 - protein, 35 aa, Artificial Sequence
  Description of Artificial Sequence: Synthetic polypeptide
DEAEISTVNPVATEQYGCVCSNTEDNANFGSNNQA

SEQ ID NO: 164548 - protein, 36 aa, Artificial Sequence
  Description of Artificial Sequence: Synthetic polypeptide
DDEEIRTTNPVATEQYGVVVGGTDQNDGEGGEGNEG

SEQ ID NO: 164549 - protein, 29 aa, Artificial Sequence
  Description of Artificial Sequence: Synthetic peptide
QESEIASTNPVGTEGYGVMASTLQHIDDI

SEQ ID NO: 164550 - protein, 36 aa, Artificial Sequence
  Description of Artificial Sequence: Synthetic polypeptide
EEEEIRTTNPVATESYGSVSLTVAEEIHARVGQTQD

SEQ ID NO: 164551 - protein, 37 aa, Artificial Sequence
  Description of Artificial Sequence: Synthetic polypeptide
EEEEIRTTNPVATESYGSVSLTVLEEIDVRVGQVQMP

SEQ ID NO: 164552 - protein, 36 aa, Artificial Sequence
  Description of Artificial Sequence: Synthetic polypeptide
DDEEIRTTNPVATEQWGCVTSTEDHNQENFGSDNAS

SEQ ID NO: 164553 - protein, 37 aa, Artificial Sequence
  Description of Artificial Sequence: Synthetic polypeptide
EEEEIRTTNPVATESYGSVSLTVLEEIHQEVGQFQGV

SEQ ID NO: 164554 - protein, 36 aa, Artificial Sequence
  Description of Artificial Sequence: Synthetic polypeptide
DEGEIATTNPVATEQYGSVFSATPDTLEPHEGEDTC

SEQ ID NO: 164555 - protein, 35 aa, Artificial Sequence
  Description of Artificial Sequence: Synthetic polypeptide
DEAEIRTTNPVATEGYGCVCSWGEHNQNFGSDNQA

SEQ ID NO: 164556 - protein, 36 aa, Artificial Sequence
  Description of Artificial Sequence: Synthetic polypeptide
DEEEIRTTNPVATEQYGSANCCSSELIEMEEQEDLI

SEQ ID NO: 164557 - protein, 36 aa, Artificial Sequence
  Description of Artificial Sequence: Synthetic polypeptide
DEAEIATTNPIATEQWGSIVPTLNWDQHEGGQNDRV

SEQ ID NO: 164558 - protein, 32 aa, Artificial Sequence
  Description of Artificial Sequence: Synthetic polypeptide
DESEIATTNPVATECWGDVSCICEPQREEEEL

SEQ ID NO: 164559 - protein, 34 aa, Artificial Sequence
  Description of Artificial Sequence: Synthetic polypeptide
DDEEISTTNPVATCQYGCVCSTGEPANFGSNFQA

SEQ ID NO: 164560 - protein, 33 aa, Artificial Sequence
  Description of Artificial Sequence: Synthetic polypeptide
DENEIRTTNPVATEQWGATTAEENWAERKGPYI

SEQ ID NO: 164561 - protein, 35 aa, Artificial Sequence
  Description of Artificial Sequence: Synthetic polypeptide
DEEEIRTTNPVATEQYGQCVCSWGEHQENFFSDQS

SEQ ID NO: 164562 - protein, 29 aa, Artificial Sequence
  Description of Artificial Sequence: Synthetic peptide
QESEIASTNPVGTEGYGVMASTLGPHGDI

SEQ ID NO: 164563 - protein, 36 aa, Artificial Sequence
  Description of Artificial Sequence: Synthetic polypeptide
DEEEIRTTNPVATEQYGSVQVAGEEQPENTEEANII

SEQ ID NO: 164564 - protein, 35 aa, Artificial Sequence
  Description of Artificial Sequence: Synthetic polypeptide
DEEEIATTNPVATEQYGSVCAATMGEEAIDNMMNN

SEQ ID NO: 164565 - protein, 31 aa, Artificial Sequence
  Description of Artificial Sequence: Synthetic polypeptide
AEAEIACTNPVAYEQWGEASIENDQHQGGER

SEQ ID NO: 164566 - protein, 32 aa, Artificial Sequence
  Description of Artificial Sequence: Synthetic polypeptide
QEEEISTTNPVATEQYGDVAGPEGDGQGEEQA

SEQ ID NO: 164567 - protein, 33 aa, Artificial Sequence
  Description of Artificial Sequence: Synthetic polypeptide
DENEIRTTNPVATEQWGCVTSSEEANNFNSDAA

SEQ ID NO: 164568 - protein, 34 aa, Artificial Sequence
  Description of Artificial Sequence: Synthetic polypeptide
DEGEIATTNPVAYEQYGSVATNGVTTAENPNSKT

SEQ ID NO: 164569 - protein, 34 aa, Artificial Sequence
  Description of Artificial Sequence: Synthetic polypeptide
DECEIATTNPVAYEHWGSVATGGNTGNAGLDNQR

SEQ ID NO: 164570 - protein, 36 aa, Artificial Sequence
  Description of Artificial Sequence: Synthetic polypeptide
DEEEIRTTNPVATEQYGQCVCSWGEHQEYFNSDTQA

SEQ ID NO: 164571 - protein, 34 aa, Artificial Sequence
  Description of Artificial Sequence: Synthetic polypeptide
DEGEIATTNPVAYEQYGSVATGHGQAAPGDSVDG

SEQ ID NO: 164572 - protein, 36 aa, Artificial Sequence
  Description of Artificial Sequence: Synthetic polypeptide
DEESVRTTNPIAYEQYGEVVSCTNMLSQTPGGNYMD

SEQ ID NO: 164573 - protein, 36 aa, Artificial Sequence
  Description of Artificial Sequence: Synthetic polypeptide
DEEEIRTTNPVATEQYGQCVCSWGEHQEHFGSDFQS

SEQ ID NO: 164574 - protein, 37 aa, Artificial Sequence
  Description of Artificial Sequence: Synthetic polypeptide
DEEEIRTTNPVATEQYGQCVCSWGELNQENFNSENQS

SEQ ID NO: 164575 - protein, 29 aa, Artificial Sequence
  Description of Artificial Sequence: Synthetic peptide
QESEIASTNPVGTEGYGVMASTLIHGDIV

SEQ ID NO: 164576 - protein, 29 aa, Artificial Sequence
  Description of Artificial Sequence: Synthetic peptide
QESEIASTNPVGTEGYGVMASTLIHGPDI

SEQ ID NO: 164577 - protein, 37 aa, Artificial Sequence
  Description of Artificial Sequence: Synthetic polypeptide
DEEEIRTTNPVATEQYGQCVCSWGETNQENFGSEFQT

SEQ ID NO: 164578 - protein, 34 aa, Artificial Sequence
  Description of Artificial Sequence: Synthetic polypeptide
DEETEIATTNPVAYEQWGSVSGGNGNESGEGDSS

SEQ ID NO: 164579 - protein, 31 aa, Artificial Sequence
  Description of Artificial Sequence: Synthetic polypeptide
DDSEVATTNPVSTEGYGNVAAMTIQSQVGQR

SEQ ID NO: 164580 - protein, 32 aa, Artificial Sequence
  Description of Artificial Sequence: Synthetic polypeptide
DESEIATTNPVATECYGSAPCINCPQDHEEEG

SEQ ID NO: 164581 - protein, 29 aa, Artificial Sequence
  Description of Artificial Sequence: Synthetic peptide
QESEIASTNPVGTEGYGVMASTLITHGDI

SEQ ID NO: 164582 - protein, 36 aa, Artificial Sequence
  Description of Artificial Sequence: Synthetic polypeptide
SEEEIATTNPVATEQYGSVANANNLPQEAPMENDNS

SEQ ID NO: 164583 - protein, 36 aa, Artificial Sequence
  Description of Artificial Sequence: Synthetic polypeptide
DEEEIRTTNPVATEQYGQCVCSWMEHDQENFGSEQP

SEQ ID NO: 164584 - protein, 33 aa, Artificial Sequence
  Description of Artificial Sequence: Synthetic polypeptide
DEGEIATTNPVAYEQYGSVATAGTPTANNIENP

SEQ ID NO: 164585 - protein, 35 aa, Artificial Sequence
  Description of Artificial Sequence: Synthetic polypeptide
DEEEIATTNPVATEQYGSVCAATMGGEAIDGMEAH

SEQ ID NO: 164586 - protein, 36 aa, Artificial Sequence
  Description of Artificial Sequence: Synthetic polypeptide
EEEEIATTNPVATEQWGCVAGTNGLPQTAPGEDFRQ

SEQ ID NO: 164587 - protein, 36 aa, Artificial Sequence
  Description of Artificial Sequence: Synthetic polypeptide
DEESVRTTNPIAYEQYGEVVSCVNMLSQTTGGNYRD

SEQ ID NO: 164588 - protein, 33 aa, Artificial Sequence
  Description of Artificial Sequence: Synthetic polypeptide
DENEIRTTNPVATEQWGCVTSNEVEMNILEDSA

SEQ ID NO: 164589 - protein, 35 aa, Artificial Sequence
  Description of Artificial Sequence: Synthetic polypeptide
DESEIATTNPVATECYGSVSACIDEPQDREGEEDG

SEQ ID NO: 164590 - protein, 33 aa, Artificial Sequence
  Description of Artificial Sequence: Synthetic polypeptide
DEMEIASTNPVGTEQYGTVCSATDGPVEFEGND

SEQ ID NO: 164591 - protein, 31 aa, Artificial Sequence
  Description of Artificial Sequence: Synthetic polypeptide
DENEIRTTNPVATEQWGDASEKIEMNAFEDA

SEQ ID NO: 164592 - protein, 33 aa, Artificial Sequence
  Description of Artificial Sequence: Synthetic polypeptide
AEAEIACTNPVAYEQYGEASCENLSQDPVGGRK

SEQ ID NO: 164593 - protein, 31 aa, Artificial Sequence
  Description of Artificial Sequence: Synthetic polypeptide
DECEIATTNPVAYEKWGVVSGGGNHGADNGM

SEQ ID NO: 164594 - protein, 36 aa, Artificial Sequence
  Description of Artificial Sequence: Synthetic polypeptide
DEEEIRTTNPVATEQYGSVQVAFEEQIECTEEDNLM

SEQ ID NO: 164595 - protein, 31 aa, Artificial Sequence
  Description of Artificial Sequence: Synthetic polypeptide
DDSEVASTNPVSTEGYGNVSANTIQSSVGQR

SEQ ID NO: 164596 - protein, 32 aa, Artificial Sequence
  Description of Artificial Sequence: Synthetic polypeptide
DEMEIASTNPVGTEQYGVMCSATGPVQHEGDI

SEQ ID NO: 164597 - protein, 32 aa, Artificial Sequence
  Description of Artificial Sequence: Synthetic polypeptide
DDSEVASTNPVSTEGYGNVSANTIVQSRVGQR

SEQ ID NO: 164598 - protein, 36 aa, Artificial Sequence
  Description of Artificial Sequence: Synthetic polypeptide
EEAEIRTTNPVAYEQWGSYTISPNEGDLQQRAGNEV

SEQ ID NO: 164599 - protein, 35 aa, Artificial Sequence
  Description of Artificial Sequence: Synthetic polypeptide
EEAEIRTTNPVAYEQWGSYTISPNEGDQQQAGNVR

SEQ ID NO: 164600 - protein, 36 aa, Artificial Sequence
  Description of Artificial Sequence: Synthetic polypeptide
EEAEIRTTNPVAYEQWGSYTISPNEGDQQRAGNRNQ

SEQ ID NO: 164601 - protein, 31 aa, Artificial Sequence
  Description of Artificial Sequence: Synthetic polypeptide
DDSEVASTNPVSTEGYGNVSANTLESHVGQR

SEQ ID NO: 164602 - protein, 32 aa, Artificial Sequence
  Description of Artificial Sequence: Synthetic polypeptide
EEAEIRTTNPVAYEQWGVVYGDNGNQTNGDVN

SEQ ID NO: 164603 - protein, 31 aa, Artificial Sequence
  Description of Artificial Sequence: Synthetic polypeptide
AEAEIACTNPVAYEQWGEYYTIINDTQGGER

SEQ ID NO: 164604 - protein, 35 aa, Artificial Sequence
  Description of Artificial Sequence: Synthetic polypeptide
SEEEIATTNPVATEQYGSVCAAGPLGEATMGDNEG

SEQ ID NO: 164605 - protein, 36 aa, Artificial Sequence
  Description of Artificial Sequence: Synthetic polypeptide
DEEEIRTTNPVATEQYGQCVCSWGEHNQHFNSETQL

SEQ ID NO: 164606 - protein, 33 aa, Artificial Sequence
  Description of Artificial Sequence: Synthetic polypeptide
DENEIRTTNPVATEQWGCVVSEVEQMNIAEDEA

SEQ ID NO: 164607 - protein, 34 aa, Artificial Sequence
  Description of Artificial Sequence: Synthetic polypeptide
EEAEISTTNPVAYEQWGSYTISPNEGDQDRKGPR

SEQ ID NO: 164608 - protein, 35 aa, Artificial Sequence
  Description of Artificial Sequence: Synthetic polypeptide
MEGEIRTTNPVATEQYGSVAVMAMSQETFEQEVIE

SEQ ID NO: 164609 - protein, 36 aa, Artificial Sequence
  Description of Artificial Sequence: Synthetic polypeptide
DEEEIRTTNPVATEQYGQCVCSWGEHNQNFGSDTQS

SEQ ID NO: 164610 - protein, 32 aa, Artificial Sequence
  Description of Artificial Sequence: Synthetic polypeptide
DENEIRTTNPVATEQWGCVVDEVEMNILEDES

SEQ ID NO: 164611 - protein, 35 aa, Artificial Sequence
  Description of Artificial Sequence: Synthetic polypeptide
DEEEIRTTNPVATEQYGQCVCSWGEHNQNFISEQF

SEQ ID NO: 164612 - protein, 32 aa, Artificial Sequence
  Description of Artificial Sequence: Synthetic polypeptide
DEMEIASTNPVGTEQYGVMCSASGLVEHEGND

SEQ ID NO: 164613 - protein, 36 aa, Artificial Sequence
  Description of Artificial Sequence: Synthetic polypeptide
DEEEIRTTNPVATEQYGQCVCSWGEHNQNFNSDTQN

SEQ ID NO: 164614 - protein, 32 aa, Artificial Sequence
  Description of Artificial Sequence: Synthetic polypeptide
DENEIRTTNPVATEQWGCVTWEVEMNIFEDEA

SEQ ID NO: 164615 - protein, 36 aa, Artificial Sequence
  Description of Artificial Sequence: Synthetic polypeptide
DEEEIRTTNPVATEQYGQCVCSWGEHNQNFNSDTQS

SEQ ID NO: 164616 - protein, 38 aa, Artificial Sequence
  Description of Artificial Sequence: Synthetic polypeptide
AEEEIRTTNPVATEQYGSVSTVQGNNMEQGTNNVTDED

SEQ ID NO: 164617 - protein, 30 aa, Artificial Sequence
  Description of Artificial Sequence: Synthetic polypeptide
DENEIRTTNPVATEQWGDAPEIEMNAAEDK

SEQ ID NO: 164618 - protein, 35 aa, Artificial Sequence
  Description of Artificial Sequence: Synthetic polypeptide
MEGEIRTTNPVATEQYGSLWSPVNEGHEYGNEDQG

SEQ ID NO: 164619 - protein, 31 aa, Artificial Sequence
  Description of Artificial Sequence: Synthetic polypeptide
DEMEIAPTNPCASEQYGTVCSCDGPVQFGTD

SEQ ID NO: 164620 - protein, 35 aa, Artificial Sequence
  Description of Artificial Sequence: Synthetic polypeptide
DEETICTTNPVATEAYGSVATVNTDEQGTEENEEA

SEQ ID NO: 164621 - protein, 32 aa, Artificial Sequence
  Description of Artificial Sequence: Synthetic polypeptide
DENEIRTTNPVATEQWGCVTMEVEMNILEDEV

SEQ ID NO: 164622 - protein, 35 aa, Artificial Sequence
  Description of Artificial Sequence: Synthetic polypeptide
CEEEIACTNPVATEQYGSVCSVNPQQEHQDGTGMK

SEQ ID NO: 164623 - protein, 36 aa, Artificial Sequence
  Description of Artificial Sequence: Synthetic polypeptide
MEGEIRTTNPVATEQYGSLCSCTDHIWQRENSEEHN

SEQ ID NO: 164624 - protein, 37 aa, Artificial Sequence
  Description of Artificial Sequence: Synthetic polypeptide
DEEEIRGTNPVATEQYGSVQTPTPNEHQGNVTQVQVD

SEQ ID NO: 164625 - protein, 30 aa, Artificial Sequence
  Description of Artificial Sequence: Synthetic polypeptide
QESEIASTNPVGTEGYGVMASTLKQHGDIT

SEQ ID NO: 164626 - protein, 34 aa, Artificial Sequence
  Description of Artificial Sequence: Synthetic polypeptide
DEGEIATTNPVAYEQYGSVANMNGDEATGNQGEH

SEQ ID NO: 164627 - protein, 38 aa, Artificial Sequence
  Description of Artificial Sequence: Synthetic polypeptide
DEEEIRGTNPVATEQYGSVQQETQDNGGEEERGNGGNG

SEQ ID NO: 164628 - protein, 33 aa, Artificial Sequence
  Description of Artificial Sequence: Synthetic polypeptide
DEGEIATTNPVAYEQYGSVANMHDTATGNGGEH

SEQ ID NO: 164629 - protein, 36 aa, Artificial Sequence
  Description of Artificial Sequence: Synthetic polypeptide
CEEEIACTNPVATEQYGSVCSTNPAQQEHQDGMQMK

SEQ ID NO: 164630 - protein, 36 aa, Artificial Sequence
  Description of Artificial Sequence: Synthetic polypeptide
DEECIRTTNPVATEQYGQCVCSWGEENANFGSDNQS

SEQ ID NO: 164631 - protein, 33 aa, Artificial Sequence
  Description of Artificial Sequence: Synthetic polypeptide
DEHELATTNPVAYEQWGSVTGPNGNQGAGNGMD

SEQ ID NO: 164632 - protein, 34 aa, Artificial Sequence
  Description of Artificial Sequence: Synthetic polypeptide
DEGEIATTNPVAYEQYGSVAMNNDTATGNGDEHP

SEQ ID NO: 164633 - protein, 32 aa, Artificial Sequence
  Description of Artificial Sequence: Synthetic polypeptide
DENEIRTTNPVATEQWGCVTPEVEMNIAEDEG

SEQ ID NO: 164634 - protein, 35 aa, Artificial Sequence
  Description of Artificial Sequence: Synthetic polypeptide
DEEEIRGTNPVATEQYGSVQGPIMFLEEITGDLGL

SEQ ID NO: 164635 - protein, 34 aa, Artificial Sequence
  Description of Artificial Sequence: Synthetic polypeptide
EEEEIGSVNPVCTEQYGVVSTVNNNNQQGTNVQE

SEQ ID NO: 164636 - protein, 29 aa, Artificial Sequence
  Description of Artificial Sequence: Synthetic peptide
QESEIASTNPVGTEGYGVMASTLMHTGDI

SEQ ID NO: 164637 - protein, 38 aa, Artificial Sequence
  Description of Artificial Sequence: Synthetic polypeptide
DEEEIRTTNPVATEQYGVVSVVVSTQQAGNQAGTEQGS

SEQ ID NO: 164638 - protein, 29 aa, Artificial Sequence
  Description of Artificial Sequence: Synthetic peptide
QESEIASTNPVGTEGYGVMASTLNHGDIT

SEQ ID NO: 164639 - protein, 33 aa, Artificial Sequence
  Description of Artificial Sequence: Synthetic polypeptide
SEEEIATTNPVATEQYGCSCPTSEDQEHFESEQ

SEQ ID NO: 164640 - protein, 36 aa, Artificial Sequence
  Description of Artificial Sequence: Synthetic polypeptide
CEEEIACTNPVATEQYGSVCSPTNPAQTEHQDGTMK

SEQ ID NO: 164641 - protein, 34 aa, Artificial Sequence
  Description of Artificial Sequence: Synthetic polypeptide
DEETICTTNPVATEFYGSVNVDNTGEEDEDGGNI

SEQ ID NO: 164642 - protein, 31 aa, Artificial Sequence
  Description of Artificial Sequence: Synthetic polypeptide
SEEEIATTNPVATEQYGCACPWVDQHNSEQF

SEQ ID NO: 164643 - protein, 36 aa, Artificial Sequence
  Description of Artificial Sequence: Synthetic polypeptide
DEGEIATTNPVAYEQYGSVAITNNEEAGDNMSHNRH

SEQ ID NO: 164644 - protein, 34 aa, Artificial Sequence
  Description of Artificial Sequence: Synthetic polypeptide
EEEEIRCTNPTAYEQWGSTVYGENHDQRGGDNPM

SEQ ID NO: 164645 - protein, 35 aa, Artificial Sequence
  Description of Artificial Sequence: Synthetic polypeptide
DEETICTTNPVATEFYGSVVDDNTGEQDEDGGNDT

SEQ ID NO: 164646 - protein, 31 aa, Artificial Sequence
  Description of Artificial Sequence: Synthetic polypeptide
AEAEIACTNPCSYEQYGCVCSWNLNQSGEQA

SEQ ID NO: 164647 - protein, 34 aa, Artificial Sequence
  Description of Artificial Sequence: Synthetic polypeptide
SEEEIATTNPVATEQYGCVAATNDATPSPMENGD

SEQ ID NO: 164648 - protein, 33 aa, Artificial Sequence
  Description of Artificial Sequence: Synthetic polypeptide
DENEIRTTNPVATEQWGCVTSEEVEMNILEDES

SEQ ID NO: 164649 - protein, 37 aa, Artificial Sequence
  Description of Artificial Sequence: Synthetic polypeptide
DEECIRTTNPVATEQYGQCVCSTEEHNEENFGSDNQP

SEQ ID NO: 164650 - protein, 31 aa, Artificial Sequence
  Description of Artificial Sequence: Synthetic polypeptide
DESEIATTNPVATECYGATANADLAEPKGPI

SEQ ID NO: 164651 - protein, 35 aa, Artificial Sequence
  Description of Artificial Sequence: Synthetic polypeptide
DENEIATTNPVAYEQYGSVANANDLPLDSDDGNPN

SEQ ID NO: 164652 - protein, 36 aa, Artificial Sequence
  Description of Artificial Sequence: Synthetic polypeptide
DEETICTTNPVATEAYGSVATVVNNQQNGNEEQEED

SEQ ID NO: 164653 - protein, 36 aa, Artificial Sequence
  Description of Artificial Sequence: Synthetic polypeptide
DEAEIACTNPVATEQYGSVCAANPLPQEHQDGNAHQ

SEQ ID NO: 164654 - protein, 36 aa, Artificial Sequence
  Description of Artificial Sequence: Synthetic polypeptide
DEETICTTNPVATEAYGSVVVTVNNDQQGTEENEED

SEQ ID NO: 164655 - protein, 35 aa, Artificial Sequence
  Description of Artificial Sequence: Synthetic polypeptide
DEETICTTNPVATEAYGVVATVNNNQQGTEENEED

SEQ ID NO: 164656 - protein, 35 aa, Artificial Sequence
  Description of Artificial Sequence: Synthetic polypeptide
MEGEIRTTNPVATEQYGSLSPWNPENHENGNEDQN

SEQ ID NO: 164657 - protein, 35 aa, Artificial Sequence
  Description of Artificial Sequence: Synthetic polypeptide
MEGEIRTTNPVATEQYGSLSPVNPEDHEHGNEDQN

SEQ ID NO: 164658 - protein, 35 aa, Artificial Sequence
  Description of Artificial Sequence: Synthetic polypeptide
MEGEIRTTNPVATEQYGSLSPENIEGHENGNEDQN

SEQ ID NO: 164659 - protein, 36 aa, Artificial Sequence
  Description of Artificial Sequence: Synthetic polypeptide
DEEEIATTNPVATEQYGSVCAPMNLEANDDLMGAQA

SEQ ID NO: 164660 - protein, 34 aa, Artificial Sequence
  Description of Artificial Sequence: Synthetic polypeptide
MEGEIRTTNPVATEQYGSLSPDNEGHENQNEDQV

SEQ ID NO: 164661 - protein, 35 aa, Artificial Sequence
  Description of Artificial Sequence: Synthetic polypeptide
SEEEIATTNPVATEQYGSACSANPPAEAEMGNGHS

SEQ ID NO: 164662 - protein, 34 aa, Artificial Sequence
  Description of Artificial Sequence: Synthetic polypeptide
SEEEIATTNPVATEQYGSACAGNNGLDTEMGDDI

SEQ ID NO: 164663 - protein, 33 aa, Artificial Sequence
  Description of Artificial Sequence: Synthetic polypeptide
SEEEIATTNPVATEQYGQCYTPWEDNQHFNSEQ

SEQ ID NO: 164664 - protein, 35 aa, Artificial Sequence
  Description of Artificial Sequence: Synthetic polypeptide
MEGEIRTTNPVATEQYGSLSDVNPETHENGNEDQN

SEQ ID NO: 164665 - protein, 31 aa, Artificial Sequence
  Description of Artificial Sequence: Synthetic polypeptide
SEEEIATTNPVATEQYGEYTPWEDQHFESEQ

SEQ ID NO: 164666 - protein, 34 aa, Artificial Sequence
  Description of Artificial Sequence: Synthetic polypeptide
EEEEIATTNPVAYEQWGCVAGNGLQAAPDGSVRN

SEQ ID NO: 164667 - protein, 33 aa, Artificial Sequence
  Description of Artificial Sequence: Synthetic polypeptide
EEEEIATTNPVAYEQWGCVATTNHNNDAGNNDD

SEQ ID NO: 164668 - protein, 33 aa, Artificial Sequence
  Description of Artificial Sequence: Synthetic polypeptide
DENEIRTTNPVATEQWGCVTSEVGEENILEDES

SEQ ID NO: 164669 - protein, 33 aa, Artificial Sequence
  Description of Artificial Sequence: Synthetic polypeptide
EEEEIATTNPVAYEQWGCVTGGAGQDQGDGENR

SEQ ID NO: 164670 - protein, 33 aa, Artificial Sequence
  Description of Artificial Sequence: Synthetic polypeptide
EEEEIATTNPVAYEQWGCVTGGGMQDQGDGNRQ

SEQ ID NO: 164671 - protein, 32 aa, Artificial Sequence
  Description of Artificial Sequence: Synthetic polypeptide
EEEEIATTNPVAYEQWGCVTGGGQDQGDGNQI

SEQ ID NO: 164672 - protein, 29 aa, Artificial Sequence
  Description of Artificial Sequence: Synthetic peptide
EEEEIATTNPVAYEQWGEAYYVEQEIQEG

SEQ ID NO: 164673 - protein, 31 aa, Artificial Sequence
  Description of Artificial Sequence: Synthetic polypeptide
SEEEIATTNPVATEQYGEYCPWVDQHESEQF

SEQ ID NO: 164674 - protein, 31 aa, Artificial Sequence
  Description of Artificial Sequence: Synthetic polypeptide
SEEEIATTNPVATEQYGEYCPWVDNQHNSEQ

SEQ ID NO: 164675 - protein, 31 aa, Artificial Sequence
  Description of Artificial Sequence: Synthetic polypeptide
SEEEIATTNPVATEQYGEFCPWEDNQHSSEQ

SEQ ID NO: 164676 - protein, 32 aa, Artificial Sequence
  Description of Artificial Sequence: Synthetic polypeptide
DESEIATTNPVATECYGDVSCICEPQHEEEEL

SEQ ID NO: 164677 - protein, 36 aa, Artificial Sequence
  Description of Artificial Sequence: Synthetic polypeptide
DEEEIRGTNPVATEQYGSVSPAMSTQITVTEQNSDG

SEQ ID NO: 164678 - protein, 35 aa, Artificial Sequence
  Description of Artificial Sequence: Synthetic polypeptide
DEEEIRTTNPVATEQYGSVVMGVGEEGGGGGETSE

SEQ ID NO: 164679 - protein, 29 aa, Artificial Sequence
  Description of Artificial Sequence: Synthetic peptide
QESEIASTNPVGTEGYGVMASTLPHGSDI

SEQ ID NO: 164680 - protein, 35 aa, Artificial Sequence
  Description of Artificial Sequence: Synthetic polypeptide
EEAEIRTTNPVAYEQWGSVCVNENDGQQDGQDNVR

SEQ ID NO: 164681 - protein, 37 aa, Artificial Sequence
  Description of Artificial Sequence: Synthetic polypeptide
DEEEIRTTNPVATEQYGSVVMGLPIEMDTNDDGGQST

SEQ ID NO: 164682 - protein, 39 aa, Artificial Sequence
  Description of Artificial Sequence: Synthetic polypeptide
AEEEIRTTNPVATEQYGSVSTVNTNQQQGNQQLGNNEGD

SEQ ID NO: 164683 - protein, 36 aa, Artificial Sequence
  Description of Artificial Sequence: Synthetic polypeptide
MEGEIRTTNPVATEQYGSVSITPDVLDEIRDEVIIT

SEQ ID NO: 164684 - protein, 36 aa, Artificial Sequence
  Description of Artificial Sequence: Synthetic polypeptide
DEEEIRTTNPVATEQYGQCVCSWGEHNEENFNSEQG

SEQ ID NO: 164685 - protein, 35 aa, Artificial Sequence
  Description of Artificial Sequence: Synthetic polypeptide
DEEEIRTTNPVATEQYGQCVCSWGEHNENFISDQS

SEQ ID NO: 164686 - protein, 33 aa, Artificial Sequence
  Description of Artificial Sequence: Synthetic polypeptide
CEEEIACTNPVAYEQYGCVATNLADTGGEDQMG

SEQ ID NO: 164687 - protein, 35 aa, Artificial Sequence
  Description of Artificial Sequence: Synthetic polypeptide
DEEEIRTTNPVATEQYGQCVCSWGEHNINFNSDQS

SEQ ID NO: 164688 - protein, 36 aa, Artificial Sequence
  Description of Artificial Sequence: Synthetic polypeptide
DEEEIRTTNPVATEQYGQCVCSWGEHNQEFFGSEQA

SEQ ID NO: 164689 - protein, 28 aa, Artificial Sequence
  Description of Artificial Sequence: Synthetic peptide
QESEIASTNPVGTEGYGVMASTKTHGDI

SEQ ID NO: 164690 - protein, 37 aa, Artificial Sequence
  Description of Artificial Sequence: Synthetic polypeptide
DEEEIRTTNPVATEQYGQCVCSWGEHNQENFGSDNQT

SEQ ID NO: 164691 - protein, 36 aa, Artificial Sequence
  Description of Artificial Sequence: Synthetic polypeptide
DEEEIRTTNPVATEQYGQCVCSWGEHNQENFGSDQY

SEQ ID NO: 164692 - protein, 32 aa, Artificial Sequence
  Description of Artificial Sequence: Synthetic polypeptide
DENEIRTTNPVATEQWGDEVASEIEMNAAEDA

SEQ ID NO: 164693 - protein, 30 aa, Artificial Sequence
  Description of Artificial Sequence: Synthetic polypeptide
DENEIRTTNPVATEQWGDCYEPEMNIAEDA

SEQ ID NO: 164694 - protein, 36 aa, Artificial Sequence
  Description of Artificial Sequence: Synthetic polypeptide
DEEEIRTTNPVATEQYGQCVCSWGEHIENGNSNNQL

SEQ ID NO: 164695 - protein, 34 aa, Artificial Sequence
  Description of Artificial Sequence: Synthetic polypeptide
DECEIATTNPVAYEQWGSAYYTPNPLMMEDGNTK

SEQ ID NO: 164696 - protein, 40 aa, Artificial Sequence
  Description of Artificial Sequence: Synthetic polypeptide
DEEEIRTTNPVATEQYGVVSTVNLQQGNNDEQGTNNTTDD

SEQ ID NO: 164697 - protein, 31 aa, Artificial Sequence
  Description of Artificial Sequence: Synthetic polypeptide
DENEIRTTNPVATEQWGDCVDEIEMNAAEDA

SEQ ID NO: 164698 - protein, 34 aa, Artificial Sequence
  Description of Artificial Sequence: Synthetic polypeptide
EDETICTTNPVATTQYGSVSTTQQGTQQGTNQQG

SEQ ID NO: 164699 - protein, 34 aa, Artificial Sequence
  Description of Artificial Sequence: Synthetic polypeptide
DECEIATTNPVAYEQWGSAYYTINPLMMEDGNLQ

SEQ ID NO: 164700 - protein, 34 aa, Artificial Sequence
  Description of Artificial Sequence: Synthetic polypeptide
AEAEIATTNPVAYEQWGCVSTTLDLGEDERNGSR

SEQ ID NO: 164701 - protein, 37 aa, Artificial Sequence
  Description of Artificial Sequence: Synthetic polypeptide
MEGEIRTTNPVATEQYGSVSEDTPTGPNERFEGNDVA

SEQ ID NO: 164702 - protein, 36 aa, Artificial Sequence
  Description of Artificial Sequence: Synthetic polypeptide
DEEEIRTTNPVATNQYGSVCSCVVDLNQPNSQIDEQ

SEQ ID NO: 164703 - protein, 33 aa, Artificial Sequence
  Description of Artificial Sequence: Synthetic polypeptide
DEMEIASTNPVSTEQYGTVCAATTIVESFVGNR

SEQ ID NO: 164704 - protein, 37 aa, Artificial Sequence
  Description of Artificial Sequence: Synthetic polypeptide
SEEEIATTNPVATEQYGSVCAMTNGELTQDSPDENGM

SEQ ID NO: 164705 - protein, 37 aa, Artificial Sequence
  Description of Artificial Sequence: Synthetic polypeptide
SEEEIATTNPVATEQYGSVCAMTNGELTNDDGMEHRM

SEQ ID NO: 164706 - protein, 36 aa, Artificial Sequence
  Description of Artificial Sequence: Synthetic polypeptide
DEEEIRTTNPVATEQYGQCVCSWGEHNQESFNSEQM

SEQ ID NO: 164707 - protein, 30 aa, Artificial Sequence
  Description of Artificial Sequence: Synthetic polypeptide
QESEIASTNPVGTEGYGVMASTLAQHGVDI

SEQ ID NO: 164708 - protein, 35 aa, Artificial Sequence
  Description of Artificial Sequence: Synthetic polypeptide
EDETICTTNPVATTQYGSVSTTQLLGNQQGTNQQA

SEQ ID NO: 164709 - protein, 35 aa, Artificial Sequence
  Description of Artificial Sequence: Synthetic polypeptide
EEAEIATTNPVATESYGCVATGNGLNDTERGGDER

SEQ ID NO: 164710 - protein, 36 aa, Artificial Sequence
  Description of Artificial Sequence: Synthetic polypeptide
DEEEIRTTNPVATEQYGQCVCSWGEHEQYFNSDTQS

SEQ ID NO: 164711 - protein, 36 aa, Artificial Sequence
  Description of Artificial Sequence: Synthetic polypeptide
DEEEIRTTNPVATEQYGQCVCSWGEHDQENFGSQQS

SEQ ID NO: 164712 - protein, 36 aa, Artificial Sequence
  Description of Artificial Sequence: Synthetic polypeptide
DEECIRTTNPVATEQYGCVTSTWPAHNAEHFGSDPQ

SEQ ID NO: 164713 - protein, 36 aa, Artificial Sequence
  Description of Artificial Sequence: Synthetic polypeptide
DEEEIRTTNPVATEGYGCVCSNTGEDHQEHFGSDQS

SEQ ID NO: 164714 - protein, 34 aa, Artificial Sequence
  Description of Artificial Sequence: Synthetic polypeptide
EDETICTTNPVATEQWGTVSTTNLNLLEQGTNQE

SEQ ID NO: 164715 - protein, 30 aa, Artificial Sequence
  Description of Artificial Sequence: Synthetic polypeptide
QESEIASTNPVGTEGYGVMASTGPQMHGDI

SEQ ID NO: 164716 - protein, 35 aa, Artificial Sequence
  Description of Artificial Sequence: Synthetic polypeptide
DEGEIATTNPVAYEQYGSVCAADHNLTANPGGNHP

SEQ ID NO: 164717 - protein, 29 aa, Artificial Sequence
  Description of Artificial Sequence: Synthetic peptide
QESEIASTNPVGTEGYGVMASTGQHGDIE

SEQ ID NO: 164718 - protein, 29 aa, Artificial Sequence
  Description of Artificial Sequence: Synthetic peptide
QESEIASTNPVGTEGYGVMASTGQHGDII

SEQ ID NO: 164719 - protein, 38 aa, Artificial Sequence
  Description of Artificial Sequence: Synthetic polypeptide
DEEEIRTTNPVATEQYGVVSVVVSNLQAGISEYGSVSE

SEQ ID NO: 164720 - protein, 34 aa, Artificial Sequence
  Description of Artificial Sequence: Synthetic polypeptide
DDEEISTTNPVATEQWGCVTSTEDNQENFNSQQS

SEQ ID NO: 164721 - protein, 40 aa, Artificial Sequence
  Description of Artificial Sequence: Synthetic polypeptide
DEEEIRTTNPVATEQYGVVSTVNLQAGNTTEQGTTNDTTE

SEQ ID NO: 164722 - protein, 34 aa, Artificial Sequence
  Description of Artificial Sequence: Synthetic polypeptide
EDETICTTNPVATEQWGTVSTVNLQQLEQGTEGS

SEQ ID NO: 164723 - protein, 29 aa, Artificial Sequence
  Description of Artificial Sequence: Synthetic peptide
QESEIASTNPVGTEGYGVMASTHQHGSDI

SEQ ID NO: 164724 - protein, 34 aa, Artificial Sequence
  Description of Artificial Sequence: Synthetic polypeptide
DDEEIRTTNPVATEGYGCVCSWGEHQENFGSEQA

SEQ ID NO: 164725 - protein, 36 aa, Artificial Sequence
  Description of Artificial Sequence: Synthetic polypeptide
DEGEIATTNPVAYEQYGSVATTANLPQTAMGPQEEN

SEQ ID NO: 164726 - protein, 35 aa, Artificial Sequence
  Description of Artificial Sequence: Synthetic polypeptide
MEGEIRTTNPVATEQYGSVSPVVALDEGIPGDQLT

SEQ ID NO: 164727 - protein, 34 aa, Artificial Sequence
  Description of Artificial Sequence: Synthetic polypeptide
DENEIATTNPVAYEQYGSACSANDQQEHQDGTVA

SEQ ID NO: 164728 - protein, 37 aa, Artificial Sequence
  Description of Artificial Sequence: Synthetic polypeptide
DEEEIRTTNPVATEQYGQCVCSWGEDHNQFFGSDNQT

SEQ ID NO: 164729 - protein, 40 aa, Artificial Sequence
  Description of Artificial Sequence: Synthetic polypeptide
DEEEIRTTNPVATEQYGVVSTVNLQAGNVTEQGTNQDTTE

SEQ ID NO: 164730 - protein, 35 aa, Artificial Sequence
  Description of Artificial Sequence: Synthetic polypeptide
MEGEIRTTNPVATEQYGSVSPVDGLENMNSADHTG

SEQ ID NO: 164731 - protein, 36 aa, Artificial Sequence
  Description of Artificial Sequence: Synthetic polypeptide
DEEEIRTTNPVATEQYGQCVCSWGEDIQENFGSDQA

SEQ ID NO: 164732 - protein, 40 aa, Artificial Sequence
  Description of Artificial Sequence: Synthetic polypeptide
DEEEIRTTNPVATEQYGVVSTVNLQAGTNDEQGTNNNTDD

SEQ ID NO: 164733 - protein, 40 aa, Artificial Sequence
  Description of Artificial Sequence: Synthetic polypeptide
DEEEIRTTNPVATEQYGVVSTVNLQAGTTTEQGTNQNTTE

SEQ ID NO: 164734 - protein, 36 aa, Artificial Sequence
  Description of Artificial Sequence: Synthetic polypeptide
DEEEIATTNPVATEQYGSVCAPNPLENDDDLDGAQA

SEQ ID NO: 164735 - protein, 36 aa, Artificial Sequence
  Description of Artificial Sequence: Synthetic polypeptide
DEEEIRTTNPVATEQYGQCVCSWGEDNQNFNSENQS

SEQ ID NO: 164736 - protein, 28 aa, Artificial Sequence
  Description of Artificial Sequence: Synthetic peptide
QESEIASTNPVGTEGYGVMASTIQHIDI

SEQ ID NO: 164737 - protein, 35 aa, Artificial Sequence
  Description of Artificial Sequence: Synthetic polypeptide
MEGEIRTTNPVATEQYGSVSNPDNIDEDEYNDEDI

SEQ ID NO: 164738 - protein, 36 aa, Artificial Sequence
  Description of Artificial Sequence: Synthetic polypeptide
MEGEIRTTNPVATEQYGSVSPWDYELEQERNSDHAG

SEQ ID NO: 164739 - protein, 32 aa, Artificial Sequence
  Description of Artificial Sequence: Synthetic polypeptide
DECEIATTNPVAYEQWGCVYSMDMQMNGGGDD

SEQ ID NO: 164740 - protein, 34 aa, Artificial Sequence
  Description of Artificial Sequence: Synthetic polypeptide
SEEEIATTNPVATEQYGSVCAMTGPGEATDTGQF

SEQ ID NO: 164741 - protein, 36 aa, Artificial Sequence
  Description of Artificial Sequence: Synthetic polypeptide
SEEEIATTNPVATEQYGSVCAMTEPGEAVAQIDNRV

SEQ ID NO: 164742 - protein, 34 aa, Artificial Sequence
  Description of Artificial Sequence: Synthetic polypeptide
DENEIATTNPVAYEQYGSVAITHDEQTGELGEYF

SEQ ID NO: 164743 - protein, 30 aa, Artificial Sequence
  Description of Artificial Sequence: Synthetic polypeptide
QESEIASTNPVGTEGYGVMASTLDQHGTDI

SEQ ID NO: 164744 - protein, 37 aa, Artificial Sequence
  Description of Artificial Sequence: Synthetic polypeptide
MEGEIRTTNPVATEQYGSVLMWVNELNQESGDDNYEG

SEQ ID NO: 164745 - protein, 36 aa, Artificial Sequence
  Description of Artificial Sequence: Synthetic polypeptide
DEEEIRTTNPVATEQYGSVQVAFCEQIENTEEDNDM

SEQ ID NO: 164746 - protein, 36 aa, Artificial Sequence
  Description of Artificial Sequence: Synthetic polypeptide
EEAEIRTTNPVATEQYGSTSNVYDNAETQEGVNEES

SEQ ID NO: 164747 - protein, 34 aa, Artificial Sequence
  Description of Artificial Sequence: Synthetic polypeptide
MEGEIRTTNPVATEQYGSVHVEAMQMEMSNEEEN

SEQ ID NO: 164748 - protein, 31 aa, Artificial Sequence
  Description of Artificial Sequence: Synthetic polypeptide
DDSEVASTNPVSTEGYGNVSANTIQSRVEQR

SEQ ID NO: 164749 - protein, 33 aa, Artificial Sequence
  Description of Artificial Sequence: Synthetic polypeptide
EEAEIRTTNPVAYEAWGSVSGGGNHQNPGGQDS

SEQ ID NO: 164750 - protein, 34 aa, Artificial Sequence
  Description of Artificial Sequence: Synthetic polypeptide
MEGEIRTTNPVATEQYGSVFEDTTYNSGEADDEL

SEQ ID NO: 164751 - protein, 32 aa, Artificial Sequence
  Description of Artificial Sequence: Synthetic polypeptide
DEMEIASTNPVSTEGYGTVCAATTIESFVGNR

SEQ ID NO: 164752 - protein, 33 aa, Artificial Sequence
  Description of Artificial Sequence: Synthetic polypeptide
AEAEIACTNPVAYEQYGEISCENPLSQIVGGRK

SEQ ID NO: 164753 - protein, 32 aa, Artificial Sequence
  Description of Artificial Sequence: Synthetic polypeptide
DECEIATTNPVAYEQWGCTATNHMMNEDGNTQ

SEQ ID NO: 164754 - protein, 35 aa, Artificial Sequence
  Description of Artificial Sequence: Synthetic polypeptide
EEAEIRTTNPVATEAYGCTVWCQGNSDQVRPGNTS

SEQ ID NO: 164755 - protein, 34 aa, Artificial Sequence
  Description of Artificial Sequence: Synthetic polypeptide
EEAEIRTTNPVAYEQWGAYTISPNEGDQQRQQNR

SEQ ID NO: 164756 - protein, 31 aa, Artificial Sequence
  Description of Artificial Sequence: Synthetic polypeptide
DDSEVASTNPVSTEGYGNVSANTIQSRVGQG

SEQ ID NO: 164757 - protein, 34 aa, Artificial Sequence
  Description of Artificial Sequence: Synthetic polypeptide
EEAEIRTTNPVAYEQWGHYTISPNDGDQQRQGNY

SEQ ID NO: 164758 - protein, 30 aa, Artificial Sequence
  Description of Artificial Sequence: Synthetic polypeptide
QESEIASTNPVGTEGYGVMASTLEQHHGDI

SEQ ID NO: 164759 - protein, 32 aa, Artificial Sequence
  Description of Artificial Sequence: Synthetic polypeptide
AEAEIACTNPVAYEQYGEASCENLSQSVGGPK

SEQ ID NO: 164760 - protein, 31 aa, Artificial Sequence
  Description of Artificial Sequence: Synthetic polypeptide
DDSEVATTNPVSTEGYGNVAANGIQSFEGQR

SEQ ID NO: 164761 - protein, 34 aa, Artificial Sequence
  Description of Artificial Sequence: Synthetic polypeptide
DECEIATTNPVAYEPWGSVATGGNTGNAGNDNNR

SEQ ID NO: 164762 - protein, 32 aa, Artificial Sequence
  Description of Artificial Sequence: Synthetic polypeptide
DENEIRTTNPVATEQWGDAVMSEIEMNAAEDA

SEQ ID NO: 164763 - protein, 34 aa, Artificial Sequence
  Description of Artificial Sequence: Synthetic polypeptide
EEAEIRTTNPVAYEQWGSVCSTMDRDNGPGDRQE

SEQ ID NO: 164764 - protein, 34 aa, Artificial Sequence
  Description of Artificial Sequence: Synthetic polypeptide
DENEIATTNPVAYEQYGSVAITNQDENPGQMEDD

SEQ ID NO: 164765 - protein, 34 aa, Artificial Sequence
  Description of Artificial Sequence: Synthetic polypeptide
EEAEIRTTNPVAYEQWGSVCSTMDRDNGPGEGDE

SEQ ID NO: 164766 - protein, 35 aa, Artificial Sequence
  Description of Artificial Sequence: Synthetic polypeptide
EEAEIRTTNPVAYEQWGSVCSTMDRDNNGGGDRGE

SEQ ID NO: 164767 - protein, 29 aa, Artificial Sequence
  Description of Artificial Sequence: Synthetic peptide
QESEIASTNPVGTEGYGVMASTLFHSGDI

SEQ ID NO: 164768 - protein, 34 aa, Artificial Sequence
  Description of Artificial Sequence: Synthetic polypeptide
DEAEIRTTNGVAYCQYGCVCSTEDHQERFGSDQS

SEQ ID NO: 164769 - protein, 36 aa, Artificial Sequence
  Description of Artificial Sequence: Synthetic polypeptide
MEGEIRTTNPVATEQYGSVMWVDELEQESGDDNGEG

SEQ ID NO: 164770 - protein, 36 aa, Artificial Sequence
  Description of Artificial Sequence: Synthetic polypeptide
MEGEIRTTNPVATEQYGSVMWVNELEHESGDQNYEG

SEQ ID NO: 164771 - protein, 36 aa, Artificial Sequence
  Description of Artificial Sequence: Synthetic polypeptide
MEGEIRTTNPVATEQYGSVMWVNELEQEHGDDIDEG

SEQ ID NO: 164772 - protein, 36 aa, Artificial Sequence
  Description of Artificial Sequence: Synthetic polypeptide
DEEEIRTTNPVATNQYGQVSSTTPAGENMRNHMNPV

SEQ ID NO: 164773 - protein, 35 aa, Artificial Sequence
  Description of Artificial Sequence: Synthetic polypeptide
SEEEIATTNPVATEQYGSVCAMNGNLEPADIPNDA

SEQ ID NO: 164774 - protein, 35 aa, Artificial Sequence
  Description of Artificial Sequence: Synthetic polypeptide
SEEEIATTNPVATEQYGSVCAMIHLDETAGTGGPR

SEQ ID NO: 164775 - protein, 34 aa, Artificial Sequence
  Description of Artificial Sequence: Synthetic polypeptide
SEEEIATTNPVATEQYGSVCAMIHGDETAGEGVR

SEQ ID NO: 164776 - protein, 35 aa, Artificial Sequence
  Description of Artificial Sequence: Synthetic polypeptide
SEEEIATTNPVATEQYGSVCAMIHDDETAGTHGMR

SEQ ID NO: 164777 - protein, 33 aa, Artificial Sequence
  Description of Artificial Sequence: Synthetic polypeptide
DEMEIASTNPVSTEQYGTVCAATDTIVEFVGNR

SEQ ID NO: 164778 - protein, 33 aa, Artificial Sequence
  Description of Artificial Sequence: Synthetic polypeptide
EEAEIATTNPVAYEQWGSVSGGDVGGHQKGDER

SEQ ID NO: 164779 - protein, 33 aa, Artificial Sequence
  Description of Artificial Sequence: Synthetic polypeptide
EEAEIATTNPVAYEQWGSVTGGNQGDLRDGEER

SEQ ID NO: 164780 - protein, 34 aa, Artificial Sequence
  Description of Artificial Sequence: Synthetic polypeptide
EEAEIATTNPVAYEQWGSVYGGWNDDQPNGNRGQ

SEQ ID NO: 164781 - protein, 35 aa, Artificial Sequence
  Description of Artificial Sequence: Synthetic polypeptide
EEAEIATTNPVAYEQWGSYTISPNEGDQQQRAGNR

SEQ ID NO: 164782 - protein, 32 aa, Artificial Sequence
  Description of Artificial Sequence: Synthetic polypeptide
AEAEIAPTNPVAYEQYGEASCEGNDSQRVGGS

SEQ ID NO: 164783 - protein, 35 aa, Artificial Sequence
  Description of Artificial Sequence: Synthetic polypeptide
DEEEIACTNPVATAQWGSVSVSGNPLENTAGVNES

SEQ ID NO: 164784 - protein, 35 aa, Artificial Sequence
  Description of Artificial Sequence: Synthetic polypeptide
SEEEIATTNPVATEQYGSVCAGTGGPDEANSNNRN

SEQ ID NO: 164785 - protein, 36 aa, Artificial Sequence
  Description of Artificial Sequence: Synthetic polypeptide
DEEEIATTNPVATEQYGSVCAPNNGLEATDSGGSDD

SEQ ID NO: 164786 - protein, 32 aa, Artificial Sequence
  Description of Artificial Sequence: Synthetic polypeptide
AEAEIAPTNPVAYEQYGEAACENLSQRVGGSP

SEQ ID NO: 164787 - protein, 33 aa, Artificial Sequence
  Description of Artificial Sequence: Synthetic polypeptide
EEAEICTTNPVAYEQWGTVATNDGNQGQAGNAD

SEQ ID NO: 164788 - protein, 31 aa, Artificial Sequence
  Description of Artificial Sequence: Synthetic polypeptide
DDSEVASTNPVSTEGYGNVSANTINSRVGQR

SEQ ID NO: 164789 - protein, 37 aa, Artificial Sequence
  Description of Artificial Sequence: Synthetic polypeptide
MEGEIRTTNPVATEQYGSVPSPTPAGPNERFGDNPVM

SEQ ID NO: 164790 - protein, 29 aa, Artificial Sequence
  Description of Artificial Sequence: Synthetic peptide
QESEIASTNPVGTEGYGVMASTLCHGCDI

SEQ ID NO: 164791 - protein, 36 aa, Artificial Sequence
  Description of Artificial Sequence: Synthetic polypeptide
MEGEIRTTNPVATEQYGSVNWVENTIFNQRDGSIEQ

SEQ ID NO: 164792 - protein, 35 aa, Artificial Sequence
  Description of Artificial Sequence: Synthetic polypeptide
MEGEIRTTNPVATEQYGSVNVQWTVESGGESNQTS

SEQ ID NO: 164793 - protein, 35 aa, Artificial Sequence
  Description of Artificial Sequence: Synthetic polypeptide
MEGEIRTTNPVATEQYGSVNVQWDVESDGPESNQR

SEQ ID NO: 164794 - protein, 32 aa, Artificial Sequence
  Description of Artificial Sequence: Synthetic polypeptide
AEAEIACTNPVAYERYGEASCENLSQAVGGRK

SEQ ID NO: 164795 - protein, 34 aa, Artificial Sequence
  Description of Artificial Sequence: Synthetic polypeptide
DENEIATTNPVAYEQYGSVAGANDPAGDPMGNNE

SEQ ID NO: 164796 - protein, 33 aa, Artificial Sequence
  Description of Artificial Sequence: Synthetic polypeptide
AEAEIACTNPVAYEQYGQEASCENLSGRVGGRK

SEQ ID NO: 164797 - protein, 29 aa, Artificial Sequence
  Description of Artificial Sequence: Synthetic peptide
QESEIASTNPVGTEGYGVMASTLDHHGDI

SEQ ID NO: 164798 - protein, 36 aa, Artificial Sequence
  Description of Artificial Sequence: Synthetic polypeptide
MEGEIRTTNPVATEQYGSVMWVNEMEQESGDGNTEG

SEQ ID NO: 164799 - protein, 37 aa, Artificial Sequence
  Description of Artificial Sequence: Synthetic polypeptide
DEEEIRTTNPVATEQYGSVVMGTPEMDVNDDEEGQEV

SEQ ID NO: 164800 - protein, 38 aa, Artificial Sequence
  Description of Artificial Sequence: Synthetic polypeptide
DEEEIRTTNPVATEQYGVVSTVNNNQQQNNQQGTTEEN

SEQ ID NO: 164801 - protein, 37 aa, Artificial Sequence
  Description of Artificial Sequence: Synthetic polypeptide
MEGEIRTTNPVATEQYGSCVSLPDNEEQHENGNEDQG

SEQ ID NO: 164802 - protein, 30 aa, Artificial Sequence
  Description of Artificial Sequence: Synthetic polypeptide
QESEIASTNPVGTEGYGVMASTLPQHGDPI

SEQ ID NO: 164803 - protein, 33 aa, Artificial Sequence
  Description of Artificial Sequence: Synthetic polypeptide
DECEIATTNPVATETWGAVCTIEGQQGQDGNTI

SEQ ID NO: 164804 - protein, 37 aa, Artificial Sequence
  Description of Artificial Sequence: Synthetic polypeptide
DEEEIATTNPVATEQYGSVCAATMHGEAPIDGMENRN

SEQ ID NO: 164805 - protein, 33 aa, Artificial Sequence
  Description of Artificial Sequence: Synthetic polypeptide
SEEEIASVNPVCTEQYGVVCSWNHQSFGSNNQG

SEQ ID NO: 164806 - protein, 34 aa, Artificial Sequence
  Description of Artificial Sequence: Synthetic polypeptide
MEGEIRTTNPVATEQYGCVSYSYLNIPEMEENFL

SEQ ID NO: 164807 - protein, 36 aa, Artificial Sequence
  Description of Artificial Sequence: Synthetic polypeptide
DEEEIRTTNPVATEQYGSVQVAIDEQIENNEEDNDM

SEQ ID NO: 164808 - protein, 35 aa, Artificial Sequence
  Description of Artificial Sequence: Synthetic polypeptide
EEEEIRTTNPVATEQYGSVQCTTTPELEIMETVAS

SEQ ID NO: 164809 - protein, 33 aa, Artificial Sequence
  Description of Artificial Sequence: Synthetic polypeptide
SEEEIASVNPVCTEQYGVVCSWNDHQSFGSNQI

SEQ ID NO: 164810 - protein, 36 aa, Artificial Sequence
  Description of Artificial Sequence: Synthetic polypeptide
DEECIRTTNPVAYEHWGSVACTNNGLQDDHQSNERH

SEQ ID NO: 164811 - protein, 32 aa, Artificial Sequence
  Description of Artificial Sequence: Synthetic polypeptide
SEEEIASVNPVCTEQYGVVCSWMNHQSFGSEQ

SEQ ID NO: 164812 - protein, 37 aa, Artificial Sequence
  Description of Artificial Sequence: Synthetic polypeptide
EEEEIRTTNPVATEQYGSVQQGGASVTAQNVLSFVGE

SEQ ID NO: 164813 - protein, 32 aa, Artificial Sequence
  Description of Artificial Sequence: Synthetic polypeptide
SEEEIASVNPVCTEQYGVVCSWETQSFGSNQS

SEQ ID NO: 164814 - protein, 37 aa, Artificial Sequence
  Description of Artificial Sequence: Synthetic polypeptide
DEETIRATNPVATEQYGVVSTVTNNQQNQQNGNNADD

SEQ ID NO: 164815 - protein, 35 aa, Artificial Sequence
  Description of Artificial Sequence: Synthetic polypeptide
EEEEIRTTNPVATEQYGSVPPWNYMNQLMMEVQEI

SEQ ID NO: 164816 - protein, 33 aa, Artificial Sequence
  Description of Artificial Sequence: Synthetic polypeptide
DENEIRTTNPVATEQWGCVCSSEEAEAINSDAS

SEQ ID NO: 164817 - protein, 33 aa, Artificial Sequence
  Description of Artificial Sequence: Synthetic polypeptide
DENEIRTTNPVATEQWGCVCSSAEAEYFNSDAS

SEQ ID NO: 164818 - protein, 32 aa, Artificial Sequence
  Description of Artificial Sequence: Synthetic polypeptide
DENEIRTTNPVATEQWGCVCSREHEMNIAEDA

SEQ ID NO: 164819 - protein, 36 aa, Artificial Sequence
  Description of Artificial Sequence: Synthetic polypeptide
DENEIATTNPVAYEQYGSVCSAANDLPLDSDDGNHN

SEQ ID NO: 164820 - protein, 32 aa, Artificial Sequence
  Description of Artificial Sequence: Synthetic polypeptide
SEEEIASVNPVCTEQYGVVCSWELQSSGSEQS

SEQ ID NO: 164821 - protein, 37 aa, Artificial Sequence
  Description of Artificial Sequence: Synthetic polypeptide
DEETIRATNPVATEQYGVVSTVTNNQQQNQNGNNQDE

SEQ ID NO: 164822 - protein, 37 aa, Artificial Sequence
  Description of Artificial Sequence: Synthetic polypeptide
DEETIRATNPVATEQYGVVSTVVNNQQQGENGNEQGD

SEQ ID NO: 164823 - protein, 33 aa, Artificial Sequence
  Description of Artificial Sequence: Synthetic polypeptide
SEEEIASVNPVCTEQYGVVCSWELNQSGSENQA

SEQ ID NO: 164824 - protein, 36 aa, Artificial Sequence
  Description of Artificial Sequence: Synthetic polypeptide
EEEEIRTTNPVATEQYGSVSEEPETQEAAVAQALAG

SEQ ID NO: 164825 - protein, 31 aa, Artificial Sequence
  Description of Artificial Sequence: Synthetic polypeptide
SEEEIASVNPVCTEQYGVVCSWEHASFGSNQ

SEQ ID NO: 164826 - protein, 36 aa, Artificial Sequence
  Description of Artificial Sequence: Synthetic polypeptide
DEEEIRGTNPVATEQYGDVVMGQDQQNDNNQDEGNG

SEQ ID NO: 164827 - protein, 32 aa, Artificial Sequence
  Description of Artificial Sequence: Synthetic polypeptide
SEEEIASVNPVCTEQYGVVCSNWNHQSFGSDQ

SEQ ID NO: 164828 - protein, 36 aa, Artificial Sequence
  Description of Artificial Sequence: Synthetic polypeptide
MEGEIRTTNPVATEQYGCVSLEVVNQNNIGNNDFRD

SEQ ID NO: 164829 - protein, 33 aa, Artificial Sequence
  Description of Artificial Sequence: Synthetic polypeptide
SEEEIASVNPVCTEQYGVVCSWENHQSFGSNQF

SEQ ID NO: 164830 - protein, 37 aa, Artificial Sequence
  Description of Artificial Sequence: Synthetic polypeptide
DEETIRATNPVATEQYGVVSTVVNNQQQNQNGNQQGD

SEQ ID NO: 164831 - protein, 37 aa, Artificial Sequence
  Description of Artificial Sequence: Synthetic polypeptide
EEEEIRTTNPVATEQYGSVPGPTLTNPEDVLTDENIV

SEQ ID NO: 164832 - protein, 38 aa, Artificial Sequence
  Description of Artificial Sequence: Synthetic polypeptide
DEEEIATTNPVATEQYGSVCAMTNPELTQDSPDENGMQ

SEQ ID NO: 164833 - protein, 36 aa, Artificial Sequence
  Description of Artificial Sequence: Synthetic polypeptide
DEECIRTTNPVAYECWGSVACTNNGLQDDHQDNERQ

SEQ ID NO: 164834 - protein, 35 aa, Artificial Sequence
  Description of Artificial Sequence: Synthetic polypeptide
EEEEIRTTNPVATEQYGSVILTSNMWVVAILVEEA

SEQ ID NO: 164835 - protein, 35 aa, Artificial Sequence
  Description of Artificial Sequence: Synthetic polypeptide
DEEEIRTTNPVATEGYGCVCSNWGEHNQNFNSDQS

SEQ ID NO: 164836 - protein, 34 aa, Artificial Sequence
  Description of Artificial Sequence: Synthetic polypeptide
DEECIRTTNPVAYECWGVVCTIEDDGQAQGNGNR

SEQ ID NO: 164837 - protein, 34 aa, Artificial Sequence
  Description of Artificial Sequence: Synthetic polypeptide
DEAEIACTNPVATEQYGSVCSPAALFNQASEEGD

SEQ ID NO: 164838 - protein, 35 aa, Artificial Sequence
  Description of Artificial Sequence: Synthetic polypeptide
MEGEIRTTNPVATEQYGQVCTPDPDDLNREENNQH

SEQ ID NO: 164839 - protein, 32 aa, Artificial Sequence
  Description of Artificial Sequence: Synthetic polypeptide
DDSEVATTNPVSTEGYGNVAACTEPQSRVGQR

SEQ ID NO: 164840 - protein, 34 aa, Artificial Sequence
  Description of Artificial Sequence: Synthetic polypeptide
DEGEIATTNPVAYEQYGSACAAMNLQNSMNGEGN

SEQ ID NO: 164841 - protein, 36 aa, Artificial Sequence
  Description of Artificial Sequence: Synthetic polypeptide
EEEEIRTTNPVATEQYGSVISPTTYAQQHEQIVPEN

SEQ ID NO: 164842 - protein, 39 aa, Artificial Sequence
  Description of Artificial Sequence: Synthetic polypeptide
DEEEIRTTNPVATEQYGVVSVVVTNQQAGTEQGTNTQEQ

SEQ ID NO: 164843 - protein, 37 aa, Artificial Sequence
  Description of Artificial Sequence: Synthetic polypeptide
DEEEIATTNPVATEQYGSVCAMTNPEPTGGDLENGVM

SEQ ID NO: 164844 - protein, 36 aa, Artificial Sequence
  Description of Artificial Sequence: Synthetic polypeptide
DEECIRTTNPVAYEEWGCSVSCTNTGFSQQGEGNSA

SEQ ID NO: 164845 - protein, 35 aa, Artificial Sequence
  Description of Artificial Sequence: Synthetic polypeptide
MEGEIRTTNPVATEQYGCVTSTLDVQNNIENTIVQ

SEQ ID NO: 164846 - protein, 34 aa, Artificial Sequence
  Description of Artificial Sequence: Synthetic polypeptide
DEECIRTTNPVAYEEWGICTTTDGGDHQRGSNKR

SEQ ID NO: 164847 - protein, 34 aa, Artificial Sequence
  Description of Artificial Sequence: Synthetic polypeptide
DEGEIATTNPVAYEQYGCVFAANGLTGAPGNPEE

SEQ ID NO: 164848 - protein, 34 aa, Artificial Sequence
  Description of Artificial Sequence: Synthetic polypeptide
DESEIATTNPVATECWGSVRCIDWEMQDRVGDNG

SEQ ID NO: 164849 - protein, 36 aa, Artificial Sequence
  Description of Artificial Sequence: Synthetic polypeptide
DENEIATTNPVAYEQYGSVCGVDNLPQDSMDGMERW

SEQ ID NO: 164850 - protein, 34 aa, Artificial Sequence
  Description of Artificial Sequence: Synthetic polypeptide
MEGEIRTTNPVATEQYGCVYTLEMETQMNGFDEQ

SEQ ID NO: 164851 - protein, 36 aa, Artificial Sequence
  Description of Artificial Sequence: Synthetic polypeptide
EEEEIRTTNPVATEQYGSVIVPTNAIEMMIVVGEEN

SEQ ID NO: 164852 - protein, 34 aa, Artificial Sequence
  Description of Artificial Sequence: Synthetic polypeptide
DESEIATTNPVATECWGSVRCIDWEMQDRAGENP

SEQ ID NO: 164853 - protein, 33 aa, Artificial Sequence
  Description of Artificial Sequence: Synthetic polypeptide
DENEIRTTNPVATEQWGCVCSSEENANHSISDA

SEQ ID NO: 164854 - protein, 34 aa, Artificial Sequence
  Description of Artificial Sequence: Synthetic polypeptide
DESEIATTNPVATECWGSVRCIDWDMQDREGENQ

SEQ ID NO: 164855 - protein, 36 aa, Artificial Sequence
  Description of Artificial Sequence: Synthetic polypeptide
DEECIRTTNPVAYEEWGSVACTNNGLQDDQQINENR

SEQ ID NO: 164856 - protein, 38 aa, Artificial Sequence
  Description of Artificial Sequence: Synthetic polypeptide
AEEEIRTTNPVATEQYGSVSTVTANNTEQGTTNVTDED

SEQ ID NO: 164857 - protein, 36 aa, Artificial Sequence
  Description of Artificial Sequence: Synthetic polypeptide
DEECIRTTNPVAYEEWGSVACTNNGLQDDQRDNEDG

SEQ ID NO: 164858 - protein, 34 aa, Artificial Sequence
  Description of Artificial Sequence: Synthetic polypeptide
DEGEIATTNPVAYEQYGCVAATAGLTGAPGNPEN

SEQ ID NO: 164859 - protein, 33 aa, Artificial Sequence
  Description of Artificial Sequence: Synthetic polypeptide
DENEIRTTNPVATEQWGCVCSSEPEANAFMSDA

SEQ ID NO: 164860 - protein, 36 aa, Artificial Sequence
  Description of Artificial Sequence: Synthetic polypeptide
MEGEIRTTNPVATEQYGCVSLEVVEQNNIGNNFFRN

SEQ ID NO: 164861 - protein, 35 aa, Artificial Sequence
  Description of Artificial Sequence: Synthetic polypeptide
CEEEIACTNPVATEQYGSVCAATGLAPGEQMEGRH

SEQ ID NO: 164862 - protein, 35 aa, Artificial Sequence
  Description of Artificial Sequence: Synthetic polypeptide
MEGEIRTTNPVATEQYGCVSLEVLNQNNIFNNFHD

SEQ ID NO: 164863 - protein, 33 aa, Artificial Sequence
  Description of Artificial Sequence: Synthetic polypeptide
DENEIRTTNPVATEQWGAVYSIEIDEMNQQEDA

SEQ ID NO: 164864 - protein, 33 aa, Artificial Sequence
  Description of Artificial Sequence: Synthetic polypeptide
MEGEIRTTNPVATEQYGCVHNNDVQEFIETQVQ

SEQ ID NO: 164865 - protein, 33 aa, Artificial Sequence
  Description of Artificial Sequence: Synthetic polypeptide
SEEEIASVNPVCTEQYGCVCSWELQSFGSNTQS

SEQ ID NO: 164866 - protein, 37 aa, Artificial Sequence
  Description of Artificial Sequence: Synthetic polypeptide
AEEQIRTTNPVATEQYGSVSTVTNQGQNQLNNQGTTE

SEQ ID NO: 164867 - protein, 37 aa, Artificial Sequence
  Description of Artificial Sequence: Synthetic polypeptide
DEEEIATTNPVATEQYGSVCAMTNNEPTGGDLEEGGY

SEQ ID NO: 164868 - protein, 37 aa, Artificial Sequence
  Description of Artificial Sequence: Synthetic polypeptide
DEEEIATTNPVATEQYGSVCAMTNNDLHPADGSGGDP

SEQ ID NO: 164869 - protein, 33 aa, Artificial Sequence
  Description of Artificial Sequence: Synthetic polypeptide
DEGEIATTNPVAYEQYGCVAANGHDTGAPGNPE

SEQ ID NO: 164870 - protein, 32 aa, Artificial Sequence
  Description of Artificial Sequence: Synthetic polypeptide
SEEEIASVNPVCTEQYGCVCSWAHQSFGSNQA

SEQ ID NO: 164871 - protein, 32 aa, Artificial Sequence
  Description of Artificial Sequence: Synthetic polypeptide
SEEEIASVNPVCTEQYGCVCSSNDQSFGSQQS

SEQ ID NO: 164872 - protein, 37 aa, Artificial Sequence
  Description of Artificial Sequence: Synthetic polypeptide
AEEQIRTTNPVATEQYGSVSTVTNQGDNQNNQQGTTT

SEQ ID NO: 164873 - protein, 33 aa, Artificial Sequence
  Description of Artificial Sequence: Synthetic polypeptide
DDEEISTTNPVATCQYGCVCSTGNPINFISDQA

SEQ ID NO: 164874 - protein, 35 aa, Artificial Sequence
  Description of Artificial Sequence: Synthetic polypeptide
DDEEISTTNPVATCQYGCVCSTGEPNINFGSNTQA

SEQ ID NO: 164875 - protein, 33 aa, Artificial Sequence
  Description of Artificial Sequence: Synthetic polypeptide
DENEIRTTNPVATEQWGAVYSIEIEMNQKEDQA

SEQ ID NO: 164876 - protein, 32 aa, Artificial Sequence
  Description of Artificial Sequence: Synthetic polypeptide
DEGEIATTNPVAYEQYGCVAANGGTGAPGSDE

SEQ ID NO: 164877 - protein, 38 aa, Artificial Sequence
  Description of Artificial Sequence: Synthetic polypeptide
AEEEIRTTNPVATEQYGSVSTVTATNMEQGTNNVTDED

SEQ ID NO: 164878 - protein, 36 aa, Artificial Sequence
  Description of Artificial Sequence: Synthetic polypeptide
DEEEIATTNPVATEQYGSVCAMTNHGEATLDGESDI

SEQ ID NO: 164879 - protein, 34 aa, Artificial Sequence
  Description of Artificial Sequence: Synthetic polypeptide
DDEEISTTNPVATCQYGCVCSTGEPAYFGSDNQS

SEQ ID NO: 164880 - protein, 38 aa, Artificial Sequence
  Description of Artificial Sequence: Synthetic polypeptide
AEEEIRTTNPVATEQYGSVSTVTDNQNNATEQGNNVED

SEQ ID NO: 164881 - protein, 33 aa, Artificial Sequence
  Description of Artificial Sequence: Synthetic polypeptide
DDEEISTTNPVATCQYGCVCSTGEPANFSSDQA

SEQ ID NO: 164882 - protein, 33 aa, Artificial Sequence
  Description of Artificial Sequence: Synthetic polypeptide
DEGEIATTNPVAYEQYGCVAANGDITGAGGNPE

SEQ ID NO: 164883 - protein, 37 aa, Artificial Sequence
  Description of Artificial Sequence: Synthetic polypeptide
EEEEIRTTNPVATEQYGSVSPVSYSLQTIRPVEQQDL

SEQ ID NO: 164884 - protein, 34 aa, Artificial Sequence
  Description of Artificial Sequence: Synthetic polypeptide
DEGEIATTNPVAYEQYGCVAANAGLTGAPGQNPE

SEQ ID NO: 164885 - protein, 34 aa, Artificial Sequence
  Description of Artificial Sequence: Synthetic polypeptide
DEGEIATTNPVAYEQYGCNVAANGLTGAPGNPEN

SEQ ID NO: 164886 - protein, 32 aa, Artificial Sequence
  Description of Artificial Sequence: Synthetic polypeptide
DENEIRTTNPVATEQWGATTSNEIWANAKGPI

SEQ ID NO: 164887 - protein, 32 aa, Artificial Sequence
  Description of Artificial Sequence: Synthetic polypeptide
DENEIRTTNPVATEQWGATTSNAIWANAKGPI

SEQ ID NO: 164888 - protein, 32 aa, Artificial Sequence
  Description of Artificial Sequence: Synthetic polypeptide
DENEIRTTNPVATEQWGATTANAIWANAKGPI

SEQ ID NO: 164889 - protein, 37 aa, Artificial Sequence
  Description of Artificial Sequence: Synthetic polypeptide
DEEEIRTTNPVATEPYGDVCGFCNYLLSTQRVGQEEV

SEQ ID NO: 164890 - protein, 35 aa, Artificial Sequence
  Description of Artificial Sequence: Synthetic polypeptide
EEEEIRTTNPVATEQYGSVSPMPSVEQPVVLIPGD

SEQ ID NO: 164891 - protein, 34 aa, Artificial Sequence
  Description of Artificial Sequence: Synthetic polypeptide
DENEIRTTNPVATEQWGAVYSIEIEMNQKENDAE

SEQ ID NO: 164892 - protein, 35 aa, Artificial Sequence
  Description of Artificial Sequence: Synthetic polypeptide
DESEIATTNPVATECWGMHCWTMNEQQRGQDNNSR

SEQ ID NO: 164893 - protein, 32 aa, Artificial Sequence
  Description of Artificial Sequence: Synthetic polypeptide
DDSEVASTNPVSTEGYGNVSDANTIQVRVGQR

SEQ ID NO: 164894 - protein, 36 aa, Artificial Sequence
  Description of Artificial Sequence: Synthetic polypeptide
MEGEIRTTNPVATEQYGCVSLEVLEQNNIGNNSFFD

SEQ ID NO: 164895 - protein, 37 aa, Artificial Sequence
  Description of Artificial Sequence: Synthetic polypeptide
DEETIRATNPVATEQYGVVSTVVVNQQQEQNGNNQGD

SEQ ID NO: 164896 - protein, 33 aa, Artificial Sequence
  Description of Artificial Sequence: Synthetic polypeptide
DEECIRTTNPVAYEQWGAYYSLDNDLRKAKVDR

SEQ ID NO: 164897 - protein, 37 aa, Artificial Sequence
  Description of Artificial Sequence: Synthetic polypeptide
MEGEIRTTNPVATEQYGCVSLDVLNQNNIGTNNFFRD

SEQ ID NO: 164898 - protein, 37 aa, Artificial Sequence
  Description of Artificial Sequence: Synthetic polypeptide
AEEQIRTTNPVATEQYGVVSTVTQQLGNQLNQQGTTE

SEQ ID NO: 164899 - protein, 33 aa, Artificial Sequence
  Description of Artificial Sequence: Synthetic polypeptide
SEEEIASVNPVCTEQYGCVCSWNHNQSFGSNNQ

SEQ ID NO: 164900 - protein, 36 aa, Artificial Sequence
  Description of Artificial Sequence: Synthetic polypeptide
DEEEIRTTNPVATEQYGSVQVAIEEMIENNEEANDM

SEQ ID NO: 164901 - protein, 36 aa, Artificial Sequence
  Description of Artificial Sequence: Synthetic polypeptide
DEEEIRTTNPVATEGYGCVCSTEEHNQENFGSETQS

SEQ ID NO: 164902 - protein, 37 aa, Artificial Sequence
  Description of Artificial Sequence: Synthetic polypeptide
AEEQIRTTNPVATEQYGVVSTVTNQQGNQLLQQGTTE

SEQ ID NO: 164903 - protein, 37 aa, Artificial Sequence
  Description of Artificial Sequence: Synthetic polypeptide
AEEQIRTTNPVATEQYGVVSTVTNQLGNQGEQQGTTE

SEQ ID NO: 164904 - protein, 30 aa, Artificial Sequence
  Description of Artificial Sequence: Synthetic polypeptide
QESEIASTNPVGTEGYGVMASTLQHGDFIG

SEQ ID NO: 164905 - protein, 33 aa, Artificial Sequence
  Description of Artificial Sequence: Synthetic polypeptide
DENEIRTTNPVATEQWGCTVTSEVEMNIAEDEA

SEQ ID NO: 164906 - protein, 33 aa, Artificial Sequence
  Description of Artificial Sequence: Synthetic polypeptide
DENEIRTTNPVATEQWGCTATSEVEMNILEDES

SEQ ID NO: 164907 - protein, 36 aa, Artificial Sequence
  Description of Artificial Sequence: Synthetic polypeptide
EEEEIRTTNPVATEQYGSVSMMASVEQVGVLIPLGD

SEQ ID NO: 164908 - protein, 33 aa, Artificial Sequence
  Description of Artificial Sequence: Synthetic polypeptide
DENEIRTTNPVATEQWGCLTSEVEMNIAEDEAN

SEQ ID NO: 164909 - protein, 36 aa, Artificial Sequence
  Description of Artificial Sequence: Synthetic polypeptide
EEEEIRTTNPVATEQYGSVSMSPAALDMEVENEAEM

SEQ ID NO: 164910 - protein, 31 aa, Artificial Sequence
  Description of Artificial Sequence: Synthetic polypeptide
DENEIRTTNPVATEQWGCKSEWEFENTIEDA

SEQ ID NO: 164911 - protein, 37 aa, Artificial Sequence
  Description of Artificial Sequence: Synthetic polypeptide
DEEEIATTNPVATEQYGSVCAMTNPEINPDDQMEGRM

SEQ ID NO: 164912 - protein, 35 aa, Artificial Sequence
  Description of Artificial Sequence: Synthetic polypeptide
CEEEIACTNPVATEQYGSVCAATENLDAGTGAEDA

SEQ ID NO: 164913 - protein, 36 aa, Artificial Sequence
  Description of Artificial Sequence: Synthetic polypeptide
EEEEIRTTNPVATEQYGSVSNPFDAIEMMQVVGIVN

SEQ ID NO: 164914 - protein, 37 aa, Artificial Sequence
  Description of Artificial Sequence: Synthetic polypeptide
EEEEIRTTNPVATEQYGSVSPAISNQTQQMANSQGVY

SEQ ID NO: 164915 - protein, 32 aa, Artificial Sequence
  Description of Artificial Sequence: Synthetic polypeptide
DDSEVASTNPVSTEGYGNVSTNPTIQMRVGQV

SEQ ID NO: 164916 - protein, 36 aa, Artificial Sequence
  Description of Artificial Sequence: Synthetic polypeptide
DEEEIATTNPVATEQYGSVCAMTNNPEEMGMGMPEG

SEQ ID NO: 164917 - protein, 36 aa, Artificial Sequence
  Description of Artificial Sequence: Synthetic polypeptide
EEEEIRTTNPVATEQYGSVSPIMPQTEQIENGTPFC

SEQ ID NO: 164918 - protein, 33 aa, Artificial Sequence
  Description of Artificial Sequence: Synthetic polypeptide
DENEIRTTNPVATEQWGCCVSEVEMNIAESDEA

SEQ ID NO: 164919 - protein, 37 aa, Artificial Sequence
  Description of Artificial Sequence: Synthetic polypeptide
DEEEIATTNPVATEQYGSVCAMTNNEPTGGDSLENGQ

SEQ ID NO: 164920 - protein, 37 aa, Artificial Sequence
  Description of Artificial Sequence: Synthetic polypeptide
EEEEIRTTNPVATEQYGSVGYTPNTQGFVHENVELGA

SEQ ID NO: 164921 - protein, 36 aa, Artificial Sequence
  Description of Artificial Sequence: Synthetic polypeptide
CEEEIACTNPVATEQYGSVCATNPQLNPDDQMGGLA

SEQ ID NO: 164922 - protein, 36 aa, Artificial Sequence
  Description of Artificial Sequence: Synthetic polypeptide
DEEEIRTTNPVATEQYGSVEIAAPEMVPVRGEQADE

SEQ ID NO: 164923 - protein, 35 aa, Artificial Sequence
  Description of Artificial Sequence: Synthetic polypeptide
DEEEIRGTNPVATEQYGSVCPTIGGVVIRQELELD

SEQ ID NO: 164924 - protein, 37 aa, Artificial Sequence
  Description of Artificial Sequence: Synthetic polypeptide
EEEEIRTTNPVATEAYGVVSTVNTQQYGNQNGNDEDE

SEQ ID NO: 164925 - protein, 37 aa, Artificial Sequence
  Description of Artificial Sequence: Synthetic polypeptide
EEEEIRTTNPVATEAYGVVSTVSTQQGGNQNGNDQDE

SEQ ID NO: 164926 - protein, 35 aa, Artificial Sequence
  Description of Artificial Sequence: Synthetic polypeptide
SEEEIATTNPVATEQWGSVSGTGNPDNSEHNTGIV

SEQ ID NO: 164927 - protein, 37 aa, Artificial Sequence
  Description of Artificial Sequence: Synthetic polypeptide
DEEEIRTTNPVATEQYGSVVMTQAEFGDQDDEGGGGN

SEQ ID NO: 164928 - protein, 35 aa, Artificial Sequence
  Description of Artificial Sequence: Synthetic polypeptide
SEEEIATTNPVATEQWGSVSGTGNPDNSEHGTDHD

SEQ ID NO: 164929 - protein, 34 aa, Artificial Sequence
  Description of Artificial Sequence: Synthetic polypeptide
DENEIRTTNPVATEQWGCVSEGVEGMNAAEDNAQ

SEQ ID NO: 164930 - protein, 35 aa, Artificial Sequence
  Description of Artificial Sequence: Synthetic polypeptide
DEEEIRTTNPVATEQYGSVELPINIPVTVVEQFDV

SEQ ID NO: 164931 - protein, 34 aa, Artificial Sequence
  Description of Artificial Sequence: Synthetic polypeptide
DEGEIATTNPVAYEQYGSVAITHDTTAEGGNMDD

SEQ ID NO: 164932 - protein, 35 aa, Artificial Sequence
  Description of Artificial Sequence: Synthetic polypeptide
SEEEIATTNPVATEQWGSVSGNNPLPNGAGDGTMN

SEQ ID NO: 164933 - protein, 33 aa, Artificial Sequence
  Description of Artificial Sequence: Synthetic polypeptide
QEEEITTTNPVATEQYGAVAGLEVGQGNEEGQE

SEQ ID NO: 164934 - protein, 37 aa, Artificial Sequence
  Description of Artificial Sequence: Synthetic polypeptide
DEECIRTTNPVATEQYGSVVVNCIDNMGSDSRPGNND

SEQ ID NO: 164935 - protein, 31 aa, Artificial Sequence
  Description of Artificial Sequence: Synthetic polypeptide
AEACIAPTNPVAYEQYGEASCENLSQAVGGS

SEQ ID NO: 164936 - protein, 34 aa, Artificial Sequence
  Description of Artificial Sequence: Synthetic polypeptide
DECEIATTNPVAYEEWGSVATPGNTGNAGNDNGR

SEQ ID NO: 164937 - protein, 35 aa, Artificial Sequence
  Description of Artificial Sequence: Synthetic polypeptide
MEGEIRTTNPVATEQYGSCTSPASTMINEHFSSND

SEQ ID NO: 164938 - protein, 34 aa, Artificial Sequence
  Description of Artificial Sequence: Synthetic polypeptide
MEGEIRTTNPVATEQYGSCTPWNMQHENGEEDQG

SEQ ID NO: 164939 - protein, 35 aa, Artificial Sequence
  Description of Artificial Sequence: Synthetic polypeptide
MEGEIRTTNPVATEQYGSCSWDNDMQHENGEEDQG

SEQ ID NO: 164940 - protein, 37 aa, Artificial Sequence
  Description of Artificial Sequence: Synthetic polypeptide
EEEEIRTTNPVATEQYGSASLMSNISQEVRMMIEDER

SEQ ID NO: 164941 - protein, 35 aa, Artificial Sequence
  Description of Artificial Sequence: Synthetic polypeptide
DECEIATTNPVAYECWGSVCFTNEQDQNDGGHNGR

SEQ ID NO: 164942 - protein, 35 aa, Artificial Sequence
  Description of Artificial Sequence: Synthetic polypeptide
SEEEIATTNPVATEQWGCVAMTNLTNPDDGMGDRA

SEQ ID NO: 164943 - protein, 35 aa, Artificial Sequence
  Description of Artificial Sequence: Synthetic polypeptide
DEGEIATTNPVAYEQYGSVAANNGLAEAPGEGMNN

SEQ ID NO: 164944 - protein, 38 aa, Artificial Sequence
  Description of Artificial Sequence: Synthetic polypeptide
DEEEIRTTNPVATEQYGQCVTSTWGADNAEHFGSDNQS

SEQ ID NO: 164945 - protein, 36 aa, Artificial Sequence
  Description of Artificial Sequence: Synthetic polypeptide
EEEEIRTTNPVATEQYGSNGSWTPNVIPTQMVQTAD

SEQ ID NO: 164946 - protein, 35 aa, Artificial Sequence
  Description of Artificial Sequence: Synthetic polypeptide
MEGEIRTTNPVATEQYGSCSSPDNMSHENGNEDQV

SEQ ID NO: 164947 - protein, 32 aa, Artificial Sequence
  Description of Artificial Sequence: Synthetic polypeptide
QEEEIVTTNPVATEQYGEAPATDGCVEHEENK

SEQ ID NO: 164948 - protein, 35 aa, Artificial Sequence
  Description of Artificial Sequence: Synthetic polypeptide
DEGEIATTNPVAYEQYGSTACAGANGLQDSDGSRM

SEQ ID NO: 164949 - protein, 36 aa, Artificial Sequence
  Description of Artificial Sequence: Synthetic polypeptide
DEGEIATTNPVAYEQYGSTACAGANGLQDSDGNARY

SEQ ID NO: 164950 - protein, 34 aa, Artificial Sequence
  Description of Artificial Sequence: Synthetic polypeptide
EEEEIRTTNPVATEQYGDVADGMGGQNGGGEDEM

SEQ ID NO: 164951 - protein, 35 aa, Artificial Sequence
  Description of Artificial Sequence: Synthetic polypeptide
DEECIRTTNPVATEQYSACVCSTEHNQEYFNSDQS

SEQ ID NO: 164952 - protein, 37 aa, Artificial Sequence
  Description of Artificial Sequence: Synthetic polypeptide
EEEEIRTTNPVATEAYGVVSTVNNQQGGNQNGNQQDE

SEQ ID NO: 164953 - protein, 37 aa, Artificial Sequence
  Description of Artificial Sequence: Synthetic polypeptide
EEEEIRTTNPVATEAYGVVSTVNNDQQGNQNGNDTDE

SEQ ID NO: 164954 - protein, 35 aa, Artificial Sequence
  Description of Artificial Sequence: Synthetic polypeptide
DENEIATTNPVAYEQYGSVATNGHGPLDSMENNFD

SEQ ID NO: 164955 - protein, 36 aa, Artificial Sequence
  Description of Artificial Sequence: Synthetic polypeptide
SEEEIATTNPVATEQWGSVSMTGNPEPGGNQMENNH

SEQ ID NO: 164956 - protein, 35 aa, Artificial Sequence
  Description of Artificial Sequence: Synthetic polypeptide
DEEEIATTNPVATEQYGSVCAPDVLENDDLMGAQA

SEQ ID NO: 164957 - protein, 36 aa, Artificial Sequence
  Description of Artificial Sequence: Synthetic polypeptide
SEEEIATTNPVATEQWGSVSMSGDTPTNNDDGGNDM

SEQ ID NO: 164958 - protein, 33 aa, Artificial Sequence
  Description of Artificial Sequence: Synthetic polypeptide
DECEIATTNPVAYEGWGSVATNGEQGNDMGGDK

SEQ ID NO: 164959 - protein, 36 aa, Artificial Sequence
  Description of Artificial Sequence: Synthetic polypeptide
CEEEIACTNPVATEQYGSVCATNPEEAGAGGENTRD

SEQ ID NO: 164960 - protein, 33 aa, Artificial Sequence
  Description of Artificial Sequence: Synthetic polypeptide
DENEIRTTNPVATEQWGCVSSEEEANAINSDAS

SEQ ID NO: 164961 - protein, 36 aa, Artificial Sequence
  Description of Artificial Sequence: Synthetic polypeptide
DEECIRTTNPVATEQYGSVNNLEVELLENLDNDGQD

SEQ ID NO: 164962 - protein, 35 aa, Artificial Sequence
  Description of Artificial Sequence: Synthetic polypeptide
DEEEIATTNPVATEQYGSVCAPDNPENADDLGAQA

SEQ ID NO: 164963 - protein, 33 aa, Artificial Sequence
  Description of Artificial Sequence: Synthetic polypeptide
DECEIATTNPVAYEEWGSVTGGNGNAGNGGDRP

SEQ ID NO: 164964 - protein, 35 aa, Artificial Sequence
  Description of Artificial Sequence: Synthetic polypeptide
SEEEIATTNPVATEQWGSVSGTGNPPQAEASSDSL

SEQ ID NO: 164965 - protein, 37 aa, Artificial Sequence
  Description of Artificial Sequence: Synthetic polypeptide
EEEEIRTTNPVATEAYGVVSTTNNQQAGNNNNNDQDE

SEQ ID NO: 164966 - protein, 37 aa, Artificial Sequence
  Description of Artificial Sequence: Synthetic polypeptide
DEEEIATTNPVATEQYGSVCANMNPAEEAGDSGAENR

SEQ ID NO: 164967 - protein, 37 aa, Artificial Sequence
  Description of Artificial Sequence: Synthetic polypeptide
EEEEIRTTNPVATEAYGVVSTTNNQQQGNNNGNQQDE

SEQ ID NO: 164968 - protein, 33 aa, Artificial Sequence
  Description of Artificial Sequence: Synthetic polypeptide
DECEIATTNPVAYEEWGSVTGGNGNAGNDNQRN

SEQ ID NO: 164969 - protein, 36 aa, Artificial Sequence
  Description of Artificial Sequence: Synthetic polypeptide
DEHIIRTTNPVATEQYGKTISYTNEFSGLKEGGSNQ

SEQ ID NO: 164970 - protein, 33 aa, Artificial Sequence
  Description of Artificial Sequence: Synthetic polypeptide
DENEIRTTNPVATEQWGCVSLEVEMNIAEFDEA

SEQ ID NO: 164971 - protein, 33 aa, Artificial Sequence
  Description of Artificial Sequence: Synthetic polypeptide
DEAEIRTTNPVATEQWGDFVSIEIREMNAAEDA

SEQ ID NO: 164972 - protein, 33 aa, Artificial Sequence
  Description of Artificial Sequence: Synthetic polypeptide
DECEIATTNPVAYEEWGSVSGGNGNAGNNDNQS

SEQ ID NO: 164973 - protein, 37 aa, Artificial Sequence
  Description of Artificial Sequence: Synthetic polypeptide
EEEEIRTTNPVATEAYGVVSTTNTQQAGNQAGNQQNE

SEQ ID NO: 164974 - protein, 33 aa, Artificial Sequence
  Description of Artificial Sequence: Synthetic polypeptide
DENEIRTTNPVATEQWGCVSGEGVEQMNAAEDA

SEQ ID NO: 164975 - protein, 33 aa, Artificial Sequence
  Description of Artificial Sequence: Synthetic polypeptide
DENEIRTTNPVATEQWGCVSEVGVEMNAAEDTA

SEQ ID NO: 164976 - protein, 36 aa, Artificial Sequence
  Description of Artificial Sequence: Synthetic polypeptide
DEEEIATTNPVATEQYGSVCANMNPAEEAGDSQENF

SEQ ID NO: 164977 - protein, 33 aa, Artificial Sequence
  Description of Artificial Sequence: Synthetic polypeptide
DECEIATTNPVAYEEWGSVCPTDNQDQNHDGDS

SEQ ID NO: 164978 - protein, 30 aa, Artificial Sequence
  Description of Artificial Sequence: Synthetic polypeptide
QESEIASTNPVGTEGYGVMASTLPQMHGDI

SEQ ID NO: 164979 - protein, 37 aa, Artificial Sequence
  Description of Artificial Sequence: Synthetic polypeptide
EEEEIRTTNPVATEAYGVVSTTVNQQNGNQNGNQQGE

SEQ ID NO: 164980 - protein, 32 aa, Artificial Sequence
  Description of Artificial Sequence: Synthetic polypeptide
DENEIRTTNPVATEQWGCVSSAEAEAFESDAF

SEQ ID NO: 164981 - protein, 37 aa, Artificial Sequence
  Description of Artificial Sequence: Synthetic polypeptide
AEGEICTTNPVATEAYGSVSTVVTEQLGNLQTGNETM

SEQ ID NO: 164982 - protein, 35 aa, Artificial Sequence
  Description of Artificial Sequence: Synthetic polypeptide
EEEEIRTTNPVATEQYGSVADGMGGENNTGGEDEE

SEQ ID NO: 164983 - protein, 35 aa, Artificial Sequence
  Description of Artificial Sequence: Synthetic polypeptide
DENEIRTTNPVATEQWGCVCSTSPENANAFNSDAN

SEQ ID NO: 164984 - protein, 32 aa, Artificial Sequence
  Description of Artificial Sequence: Synthetic polypeptide
SEEEIATTNPVATASWGCVAGTGLARDPDQRH

SEQ ID NO: 164985 - protein, 32 aa, Artificial Sequence
  Description of Artificial Sequence: Synthetic polypeptide
DDSEVASTNPVSTEGYGNVSATDLQSHEGEDR

SEQ ID NO: 164986 - protein, 32 aa, Artificial Sequence
  Description of Artificial Sequence: Synthetic polypeptide
DDSEVASTNPVSTEGYGNVSATDLQSHVGEDR

SEQ ID NO: 164987 - protein, 35 aa, Artificial Sequence
  Description of Artificial Sequence: Synthetic polypeptide
DEEEIATTNPVATEQYGSVCAATMHGEAFIDGEAH

SEQ ID NO: 164988 - protein, 29 aa, Artificial Sequence
  Description of Artificial Sequence: Synthetic peptide
QESEIASTNPVGTEGYGVMASTLQHDQDI

SEQ ID NO: 164989 - protein, 36 aa, Artificial Sequence
  Description of Artificial Sequence: Synthetic polypeptide
EEEEIRTTNPVATEQYGSVATTQQQQQANNNAEQGS

SEQ ID NO: 164990 - protein, 37 aa, Artificial Sequence
  Description of Artificial Sequence: Synthetic polypeptide
EEEEIRTTNPVATEQYGSVATTQQQQQQGNNNAEQGQ

SEQ ID NO: 164991 - protein, 35 aa, Artificial Sequence
  Description of Artificial Sequence: Synthetic polypeptide
MEGEIRTTNPVATEQYGSCSDPDNMDHENGNEDQG

SEQ ID NO: 164992 - protein, 35 aa, Artificial Sequence
  Description of Artificial Sequence: Synthetic polypeptide
MEGEIRTTNPVATEQYGSCSCTDHIWQPENNEEHN

SEQ ID NO: 164993 - protein, 34 aa, Artificial Sequence
  Description of Artificial Sequence: Synthetic polypeptide
MEGEIRTTNPVATEQYGSCSCDNEGHENLNEDQA

SEQ ID NO: 164994 - protein, 35 aa, Artificial Sequence
  Description of Artificial Sequence: Synthetic polypeptide
MEGEIRTTNPVATEQYGSCPSPDNMQHENFEEDQG

SEQ ID NO: 164995 - protein, 36 aa, Artificial Sequence
  Description of Artificial Sequence: Synthetic polypeptide
DEECIRTTNPVATERYGSVVGYTLEPSQGTGGNQGW

SEQ ID NO: 164996 - protein, 31 aa, Artificial Sequence
  Description of Artificial Sequence: Synthetic polypeptide
SEEEIATTNPVATASWGCVAGTGLARDSDQN

SEQ ID NO: 164997 - protein, 34 aa, Artificial Sequence
  Description of Artificial Sequence: Synthetic polypeptide
DENEIRTTNPVATEQWGCVCSSMAETNAFISDAA

SEQ ID NO: 164998 - protein, 30 aa, Artificial Sequence
  Description of Artificial Sequence: Synthetic polypeptide
QESEIASTNPVGTEGYGVMASTLQHEGDMI

SEQ ID NO: 164999 - protein, 34 aa, Artificial Sequence
  Description of Artificial Sequence: Synthetic polypeptide
DENEIRTTNPVATEQWGCVCSSGPETNAFNSDAA

SEQ ID NO: 165000 - protein, 33 aa, Artificial Sequence
  Description of Artificial Sequence: Synthetic polypeptide
MEGEIRTTNPVATEQYGSCPPDDTQENGEEDQG

SEQ ID NO: 165001 - protein, 37 aa, Artificial Sequence
  Description of Artificial Sequence: Synthetic polypeptide
DEEEIRGTNPVATEQYGSVGQTDNMQTNENEEEGGGE

SEQ ID NO: 165002 - protein, 35 aa, Artificial Sequence
  Description of Artificial Sequence: Synthetic polypeptide
MEGEIRTTNPVATEQYGSCGSVLNGEDQSTYDGDI

SEQ ID NO: 165003 - protein, 36 aa, Artificial Sequence
  Description of Artificial Sequence: Synthetic polypeptide
DEEEIRGTNPVATEQYGSVGDVVNNSGMEGNENGDD

SEQ ID NO: 165004 - protein, 33 aa, Artificial Sequence
  Description of Artificial Sequence: Synthetic polypeptide
DENEIRTTNPVATEQWGCVCSSGPEMEAFNSDA

SEQ ID NO: 165005 - protein, 33 aa, Artificial Sequence
  Description of Artificial Sequence: Synthetic polypeptide
DENEIRTTNPVATEQWGCVCSSGPEANYFNSDA

SEQ ID NO: 165006 - protein, 34 aa, Artificial Sequence
  Description of Artificial Sequence: Synthetic polypeptide
MEGEIRTTNPVATEQYGSCGPDNEGHENGNEDQI

SEQ ID NO: 165007 - protein, 36 aa, Artificial Sequence
  Description of Artificial Sequence: Synthetic polypeptide
DEEEIRTTNPVATEQYGSVEICAVFGEVQPEVENAQ

SEQ ID NO: 165008 - protein, 36 aa, Artificial Sequence
  Description of Artificial Sequence: Synthetic polypeptide
DEEEIRGTNPVATEQYGSVGDDVNNSGMEGNEGGDQ

SEQ ID NO: 165009 - protein, 35 aa, Artificial Sequence
  Description of Artificial Sequence: Synthetic polypeptide
DENEIATTNPVAYEQYGSVCASNDLPIEHGGDNEA

SEQ ID NO: 165010 - protein, 38 aa, Artificial Sequence
  Description of Artificial Sequence: Synthetic polypeptide
DEEEIRTTNPVATEQYGQSTVPPVLQSGEQSINEQLTM

SEQ ID NO: 165011 - protein, 35 aa, Artificial Sequence
  Description of Artificial Sequence: Synthetic polypeptide
DEECIRTTNPVATEQYYACVCSWGEDLQNFGSDQA

SEQ ID NO: 165012 - protein, 35 aa, Artificial Sequence
  Description of Artificial Sequence: Synthetic polypeptide
MEGEIRTTNPVATEQYGSCSPDLPMSHENGNEDQG

SEQ ID NO: 165013 - protein, 32 aa, Artificial Sequence
  Description of Artificial Sequence: Synthetic polypeptide
CEGEIAPTNPCSYEQYGKVSINLSQSGGTNTY

SEQ ID NO: 165014 - protein, 34 aa, Artificial Sequence
  Description of Artificial Sequence: Synthetic polypeptide
DECEIATTNPVAYECWGSVATGNMLGDTQGMNKG

SEQ ID NO: 165015 - protein, 37 aa, Artificial Sequence
  Description of Artificial Sequence: Synthetic polypeptide
AEGEICTTNPVATEAYGSVSTNSTEQIGNLQTGNEVM

SEQ ID NO: 165016 - protein, 37 aa, Artificial Sequence
  Description of Artificial Sequence: Synthetic polypeptide
AEGEICTTNPVATEAYGSVSTNSTEEIGNLQIGNEAM

SEQ ID NO: 165017 - protein, 36 aa, Artificial Sequence
  Description of Artificial Sequence: Synthetic polypeptide
DEEEIRGTNPVATEQYGSVNVDDQNGENIEEAEGQG

SEQ ID NO: 165018 - protein, 35 aa, Artificial Sequence
  Description of Artificial Sequence: Synthetic polypeptide
ADSEIRTTNPVATEQYGSVIVTYADLEDRFQENQF

SEQ ID NO: 165019 - protein, 39 aa, Artificial Sequence
  Description of Artificial Sequence: Synthetic polypeptide
DEEEIRTTNPVATEQYGVVSVVVTNNQNGNQQATTEQGS

SEQ ID NO: 165020 - protein, 33 aa, Artificial Sequence
  Description of Artificial Sequence: Synthetic polypeptide
DENEIRTTNPVATEQWGCVCSSPETEAFESDAA

SEQ ID NO: 165021 - protein, 34 aa, Artificial Sequence
  Description of Artificial Sequence: Synthetic polypeptide
DENEIRTTNPVATEQWGCVCSSPENINAFNSDQA

SEQ ID NO: 165022 - protein, 34 aa, Artificial Sequence
  Description of Artificial Sequence: Synthetic polypeptide
DEMCIVTTNPVATEQYGTVCSATDGPVEVFEGND

SEQ ID NO: 165023 - protein, 36 aa, Artificial Sequence
  Description of Artificial Sequence: Synthetic polypeptide
DEECIRTTNPVATEQYSACVCSTNHNQENFGSDTQS

SEQ ID NO: 165024 - protein, 36 aa, Artificial Sequence
  Description of Artificial Sequence: Synthetic polypeptide
DEEEIRTTNPVATEQYGSVQVAHDEQIENTEEAHEM

SEQ ID NO: 165025 - protein, 33 aa, Artificial Sequence
  Description of Artificial Sequence: Synthetic polypeptide
DENEIRTTNPVATEQWGCVCSSPEMNAFMSDAS

SEQ ID NO: 165026 - protein, 34 aa, Artificial Sequence
  Description of Artificial Sequence: Synthetic polypeptide
MEGEIRTTNPVATEQYGSCSPGDEGHENGNEDQG

SEQ ID NO: 165027 - protein, 33 aa, Artificial Sequence
  Description of Artificial Sequence: Synthetic polypeptide
DENEIRTTNPVATEQWGCVCSSPEANNFSSDAA

SEQ ID NO: 165028 - protein, 35 aa, Artificial Sequence
  Description of Artificial Sequence: Synthetic polypeptide
DEECIRTTNPVATEQYSACVCSWELNQENFNSDQA

SEQ ID NO: 165029 - protein, 35 aa, Artificial Sequence
  Description of Artificial Sequence: Synthetic polypeptide
MEGEIRTTNPVATEQYGSCSPDNMYQHENGDEDQG

SEQ ID NO: 165030 - protein, 36 aa, Artificial Sequence
  Description of Artificial Sequence: Synthetic polypeptide
DEEEIRTTNPVATEQYGSVYEAIEEQIENTEIDNDM

SEQ ID NO: 165031 - protein, 35 aa, Artificial Sequence
  Description of Artificial Sequence: Synthetic polypeptide
MEGEIRTTNPVATEQYGSCSPDNMQQHENGEEDQA

SEQ ID NO: 165032 - protein, 34 aa, Artificial Sequence
  Description of Artificial Sequence: Synthetic polypeptide
DENEIRTTNPVATEQWGCVCSSPEANAFSSDNAG

SEQ ID NO: 165033 - protein, 35 aa, Artificial Sequence
  Description of Artificial Sequence: Synthetic polypeptide
MEGEIRTTNPVATEQYGSCSPDNMETHENGNEDQG

SEQ ID NO: 165034 - protein, 35 aa, Artificial Sequence
  Description of Artificial Sequence: Synthetic polypeptide
DEECIRTTNPVATEQYSAQCVCSWELNQNFGSDQS

SEQ ID NO: 165035 - protein, 32 aa, Artificial Sequence
  Description of Artificial Sequence: Synthetic polypeptide
SEEEIATTNPVATASWGCVAGTNLAVRNPDQT

SEQ ID NO: 165036 - protein, 34 aa, Artificial Sequence
  Description of Artificial Sequence: Synthetic polypeptide
MEGEIRTTNPVATEQYGSCSPDNEGHENGFEDQV

SEQ ID NO: 165037 - protein, 32 aa, Artificial Sequence
  Description of Artificial Sequence: Synthetic polypeptide
SEEEIATTNPVATASWGCVAGTGLEARDIDQR

SEQ ID NO: 165038 - protein, 34 aa, Artificial Sequence
  Description of Artificial Sequence: Synthetic polypeptide
MEGEIRTTNPVATEQYGSCSPDNEGGENGQEDQA

SEQ ID NO: 165039 - protein, 35 aa, Artificial Sequence
  Description of Artificial Sequence: Synthetic polypeptide
DEECIRTTNPVATEQYYACVCSTGEHNQNFGSDQS

SEQ ID NO: 165040 - protein, 33 aa, Artificial Sequence
  Description of Artificial Sequence: Synthetic polypeptide
DENEIRTTNPVATEQWGCVCSSPDMNAFESDAA

SEQ ID NO: 165041 - protein, 34 aa, Artificial Sequence
  Description of Artificial Sequence: Synthetic polypeptide
MEGEIRTTNPVATEQYGSCCSPDDLIENGEEDQG

SEQ ID NO: 165042 - protein, 36 aa, Artificial Sequence
  Description of Artificial Sequence: Synthetic polypeptide
DEEEIRTTNPVATEQYGQCVCSNWGYHQENFGSDQS

SEQ ID NO: 165043 - protein, 37 aa, Artificial Sequence
  Description of Artificial Sequence: Synthetic polypeptide
DEEEIRTTNPVGTEQWGSVSGNANELGGERGSDIEAM

SEQ ID NO: 165044 - protein, 33 aa, Artificial Sequence
  Description of Artificial Sequence: Synthetic polypeptide
DENEIRTTNPVSTEPWGTCSYNEDIQQQQVGNH

SEQ ID NO: 165045 - protein, 38 aa, Artificial Sequence
  Description of Artificial Sequence: Synthetic polypeptide
DEEEIRTTNPVAYEQYGESVCISVNDELASRVGEPLVD

SEQ ID NO: 165046 - protein, 33 aa, Artificial Sequence
  Description of Artificial Sequence: Synthetic polypeptide
QEEEIATTNPVAYEPYGEVAAMANDQVSNDTPR

SEQ ID NO: 165047 - protein, 37 aa, Artificial Sequence
  Description of Artificial Sequence: Synthetic polypeptide
DEDEIATTNPVATEQYGSVCAMTNNQDNDSNPGNQLH

SEQ ID NO: 165048 - protein, 36 aa, Artificial Sequence
  Description of Artificial Sequence: Synthetic polypeptide
DEEEISTTNPVATEQYGCVCSNTEHNAENSNSDNQL

SEQ ID NO: 165049 - protein, 35 aa, Artificial Sequence
  Description of Artificial Sequence: Synthetic polypeptide
DEAEIRTTNPVATEQYGVVCSNTEHNQNFPSDTQA

SEQ ID NO: 165050 - protein, 32 aa, Artificial Sequence
  Description of Artificial Sequence: Synthetic polypeptide
DENEIRTTNPVSTRPYGTISMEDIQQQQNGNH

SEQ ID NO: 165051 - protein, 35 aa, Artificial Sequence
  Description of Artificial Sequence: Synthetic polypeptide
DEMEIVTTNPVATEQYGTQVCSATDGPIEEFEGND

SEQ ID NO: 165052 - protein, 36 aa, Artificial Sequence
  Description of Artificial Sequence: Synthetic polypeptide
DEDEIATTNPVATEQYGSVCAMTNNEPTGGDLENDG

SEQ ID NO: 165053 - protein, 36 aa, Artificial Sequence
  Description of Artificial Sequence: Synthetic polypeptide
DETEIATTNPVATEQYGSVCAAANNGPLDSGEGENE

SEQ ID NO: 165054 - protein, 31 aa, Artificial Sequence
  Description of Artificial Sequence: Synthetic polypeptide
QEEEIATTNPVAYEPYGEVAPEVQSQHEGEF

SEQ ID NO: 165055 - protein, 35 aa, Artificial Sequence
  Description of Artificial Sequence: Synthetic polypeptide
DETEIATTNPVATEQYGSVCAADNGDEAGDDIDRD

SEQ ID NO: 165056 - protein, 35 aa, Artificial Sequence
  Description of Artificial Sequence: Synthetic polypeptide
DEMEIVTTNPVATEQYGTQVCSATDGPVEFEGNND

SEQ ID NO: 165057 - protein, 34 aa, Artificial Sequence
  Description of Artificial Sequence: Synthetic polypeptide
QEEEIATTNPCSTEQYGIVSSCPALQMSNGMTPR

SEQ ID NO: 165058 - protein, 35 aa, Artificial Sequence
  Description of Artificial Sequence: Synthetic polypeptide
DEEEIRTTNPVATEQYGSVHNGNAVEVAMALVEEE

SEQ ID NO: 165059 - protein, 35 aa, Artificial Sequence
  Description of Artificial Sequence: Synthetic polypeptide
DEEEIATTNPVATEQYGSACAANPLNNHAGEGDHH

SEQ ID NO: 165060 - protein, 35 aa, Artificial Sequence
  Description of Artificial Sequence: Synthetic polypeptide
DETEIATTNPVATEQYGSVCAADNGDEAGMDIDNV

SEQ ID NO: 165061 - protein, 34 aa, Artificial Sequence
  Description of Artificial Sequence: Synthetic polypeptide
DETEIATTNPVATEQYGSVCAADNGDEAGMDIEA

SEQ ID NO: 165062 - protein, 35 aa, Artificial Sequence
  Description of Artificial Sequence: Synthetic polypeptide
DETEIATTNPVATEQYGSVCAADNGDEAGMDMSER

SEQ ID NO: 165063 - protein, 32 aa, Artificial Sequence
  Description of Artificial Sequence: Synthetic polypeptide
DENEIRTTNPVSTQPYGTISMEDIQQQQNGNH

SEQ ID NO: 165064 - protein, 34 aa, Artificial Sequence
  Description of Artificial Sequence: Synthetic polypeptide
DETEIATTNPVATEQYGSVCAADNGDEAMDINAH

SEQ ID NO: 165065 - protein, 29 aa, Artificial Sequence
  Description of Artificial Sequence: Synthetic peptide
DDSEVASTNPVSTEGYGNAAAETIQRGER

SEQ ID NO: 165066 - protein, 35 aa, Artificial Sequence
  Description of Artificial Sequence: Synthetic polypeptide
DETEIATTNPVATEQYGSVCAADNGDEDGMDIERH

SEQ ID NO: 165067 - protein, 35 aa, Artificial Sequence
  Description of Artificial Sequence: Synthetic polypeptide
DETEIATTNPVATEQYGSVCAADNGDEDGMDIGAR

SEQ ID NO: 165068 - protein, 36 aa, Artificial Sequence
  Description of Artificial Sequence: Synthetic polypeptide
DETEIATTNPVATEQYGSVCAADNGDEDGMDIGNRS

SEQ ID NO: 165069 - protein, 34 aa, Artificial Sequence
  Description of Artificial Sequence: Synthetic polypeptide
DEMEIVTTNPVATEQYGTTACSATDGPVEFEGND

SEQ ID NO: 165070 - protein, 32 aa, Artificial Sequence
  Description of Artificial Sequence: Synthetic polypeptide
DENEIRTTNPVSTRPYGTISMEGIQQQQNGNH

SEQ ID NO: 165071 - protein, 38 aa, Artificial Sequence
  Description of Artificial Sequence: Synthetic polypeptide
AEEEIRTTNPVATEQYGSVVTVTNNNLGGTEQGTNQNQ

SEQ ID NO: 165072 - protein, 35 aa, Artificial Sequence
  Description of Artificial Sequence: Synthetic polypeptide
DEDEIATTNPVATEQYGSVCAMTTGGADSKIGNEN

SEQ ID NO: 165073 - protein, 32 aa, Artificial Sequence
  Description of Artificial Sequence: Synthetic polypeptide
DENEIRTTNPVSTSPYGTISMEDIQQQQNGNH

SEQ ID NO: 165074 - protein, 31 aa, Artificial Sequence
  Description of Artificial Sequence: Synthetic polypeptide
DDSEVASTNPVSTEGYGNAAAENLQSRVGQR

SEQ ID NO: 165075 - protein, 35 aa, Artificial Sequence
  Description of Artificial Sequence: Synthetic polypeptide
DETEIATTNPVATEQYGSTCAADNGDEQGMDINRD

SEQ ID NO: 165076 - protein, 34 aa, Artificial Sequence
  Description of Artificial Sequence: Synthetic polypeptide
AEECISTTNPVATEQYGCVCSNWEHNQRFGSDQS

SEQ ID NO: 165077 - protein, 39 aa, Artificial Sequence
  Description of Artificial Sequence: Synthetic polypeptide
DEEEIRTTNPVATEAYGTVSTNGNLQVIGTTSISTTGNT

SEQ ID NO: 165078 - protein, 35 aa, Artificial Sequence
  Description of Artificial Sequence: Synthetic polypeptide
DEEEIRTTNPVATEQYGSVHPEEGDQQESQAPDTW

SEQ ID NO: 165079 - protein, 34 aa, Artificial Sequence
  Description of Artificial Sequence: Synthetic polypeptide
QEEEIATTNPVAYEGWGSVCSGTDNQDRDGDQEL

SEQ ID NO: 165080 - protein, 37 aa, Artificial Sequence
  Description of Artificial Sequence: Synthetic polypeptide
DEDEIATTNPVATEQYGSVCAPNPMLPQEHQDGNQHQ

SEQ ID NO: 165081 - protein, 32 aa, Artificial Sequence
  Description of Artificial Sequence: Synthetic polypeptide
DENEIRTTNPVSWEPYGTISMEKIQQQQNGNH

SEQ ID NO: 165082 - protein, 33 aa, Artificial Sequence
  Description of Artificial Sequence: Synthetic polypeptide
DETEIATTNPVATEQYGSTVAAADWADHKGEYL

SEQ ID NO: 165083 - protein, 37 aa, Artificial Sequence
  Description of Artificial Sequence: Synthetic polypeptide
DEEEIRTTNPVATEQYGVVSTVVNTNDEAGTTTEQQD

SEQ ID NO: 165084 - protein, 33 aa, Artificial Sequence
  Description of Artificial Sequence: Synthetic polypeptide
DEEEICATNPVAYEQWGEVTGWNDHQGMRGDMP

SEQ ID NO: 165085 - protein, 32 aa, Artificial Sequence
  Description of Artificial Sequence: Synthetic polypeptide
DENEIRTTNPVSWEPYGTISMEDIQQQQNGNH

SEQ ID NO: 165086 - protein, 36 aa, Artificial Sequence
  Description of Artificial Sequence: Synthetic polypeptide
DETEIATTNPVATEQYGSVCAADNGDEDGMDINEPR

SEQ ID NO: 165087 - protein, 33 aa, Artificial Sequence
  Description of Artificial Sequence: Synthetic polypeptide
DENEIRTTNPVSVEPYGTISTMEDIQQQQNGNH

SEQ ID NO: 165088 - protein, 32 aa, Artificial Sequence
  Description of Artificial Sequence: Synthetic polypeptide
DENEIRTTNPVSVEPYGTISMEDIQQQQNGNH

SEQ ID NO: 165089 - protein, 32 aa, Artificial Sequence
  Description of Artificial Sequence: Synthetic polypeptide
DENEIRTTNPVSVEPYGEISMEDIQQQQNGNH

SEQ ID NO: 165090 - protein, 37 aa, Artificial Sequence
  Description of Artificial Sequence: Synthetic polypeptide
DEEEISTTNPVATEQYGCVCSNTEEHNQENSGSDNQL

SEQ ID NO: 165091 - protein, 39 aa, Artificial Sequence
  Description of Artificial Sequence: Synthetic polypeptide
AEEEIRTTNPVATEQYGSVSTVVTNNQQGNQQSGNNEGD

SEQ ID NO: 165092 - protein, 32 aa, Artificial Sequence
  Description of Artificial Sequence: Synthetic polypeptide
DENEIRTTNPVSTYPYGTISMEDIQQQQNGNH

SEQ ID NO: 165093 - protein, 32 aa, Artificial Sequence
  Description of Artificial Sequence: Synthetic polypeptide
DENEIRTTNPVSTWPYGTISMEDIQQQQNGNH

SEQ ID NO: 165094 - protein, 32 aa, Artificial Sequence
  Description of Artificial Sequence: Synthetic polypeptide
DENEIRTTNPVSTVPYGTISMEDIQQQQNGNH

SEQ ID NO: 165095 - protein, 34 aa, Artificial Sequence
  Description of Artificial Sequence: Synthetic polypeptide
DETEIATTNPVATEQYGSVAGPPEPGQEHNNQNN

SEQ ID NO: 165096 - protein, 35 aa, Artificial Sequence
  Description of Artificial Sequence: Synthetic polypeptide
DEMEIVTTNPVATEQYGTMVCSATDGPVEFEGNND

SEQ ID NO: 165097 - protein, 32 aa, Artificial Sequence
  Description of Artificial Sequence: Synthetic polypeptide
DENEIRTTNPVSTTPYGTISMEDIQQQQNGNH

SEQ ID NO: 165098 - protein, 32 aa, Artificial Sequence
  Description of Artificial Sequence: Synthetic polypeptide
DENEIRTTNPVSTSPYGTISMEDMQQQQNGNH

SEQ ID NO: 165099 - protein, 33 aa, Artificial Sequence
  Description of Artificial Sequence: Synthetic polypeptide
DENEIRTTNPVSTSPYGTISMEDIQQQQNGNRH

SEQ ID NO: 165100 - protein, 32 aa, Artificial Sequence
  Description of Artificial Sequence: Synthetic polypeptide
DENEIRTTNPVSVEPYGTISMEHIQQQQNGNH

SEQ ID NO: 165101 - protein, 36 aa, Artificial Sequence
  Description of Artificial Sequence: Synthetic polypeptide
DETEIATTNPVATEQYGSVCAADNGDEDGMDINHRM

SEQ ID NO: 165102 - protein, 35 aa, Artificial Sequence
  Description of Artificial Sequence: Synthetic polypeptide
DETEIATTNPVATEQYGSVCAADNGDEDGMDINNA

SEQ ID NO: 165103 - protein, 36 aa, Artificial Sequence
  Description of Artificial Sequence: Synthetic polypeptide
DEEEISTTNPVATEQYGCVCSNTEHNQEFFGSDTQD

SEQ ID NO: 165104 - protein, 33 aa, Artificial Sequence
  Description of Artificial Sequence: Synthetic polypeptide
DENEIRTTNPVSTEYYGTISWEDDQQEQFGNQS

SEQ ID NO: 165105 - protein, 34 aa, Artificial Sequence
  Description of Artificial Sequence: Synthetic polypeptide
DENEIRTTNPVSTEYYGTISWEAINQEQFGSNQS

SEQ ID NO: 165106 - protein, 35 aa, Artificial Sequence
  Description of Artificial Sequence: Synthetic polypeptide
DETEIATTNPVATEQYGSVCAAMHLQAMAPMNDNH

SEQ ID NO: 165107 - protein, 37 aa, Artificial Sequence
  Description of Artificial Sequence: Synthetic polypeptide
DEEEIRTTNPVATEQYGVVSTVVATNNNDEQGTEEQD

SEQ ID NO: 165108 - protein, 36 aa, Artificial Sequence
  Description of Artificial Sequence: Synthetic polypeptide
DETEIATTNPVATEQYGSVCAAMNHLQAMAPAADRP

SEQ ID NO: 165109 - protein, 36 aa, Artificial Sequence
  Description of Artificial Sequence: Synthetic polypeptide
DETEIATTNPVATEQYGSVCAAMNHLQAMAPDDDNP

SEQ ID NO: 165110 - protein, 36 aa, Artificial Sequence
  Description of Artificial Sequence: Synthetic polypeptide
DETEIATTNPVATEQYGSVCAAMNHLTAMAPDNDRG

SEQ ID NO: 165111 - protein, 35 aa, Artificial Sequence
  Description of Artificial Sequence: Synthetic polypeptide
DEEEIRTTNPVATEQYGCVCSNWGEDEENFGSDQG

SEQ ID NO: 165112 - protein, 32 aa, Artificial Sequence
  Description of Artificial Sequence: Synthetic polypeptide
DENEIRTTNPVSTEYYGTISMEDIQQQQNGIH

SEQ ID NO: 165113 - protein, 35 aa, Artificial Sequence
  Description of Artificial Sequence: Synthetic polypeptide
DETEIATTNPVATEQYGSVCAAMNPLNDMDGTGAN

SEQ ID NO: 165114 - protein, 35 aa, Artificial Sequence
  Description of Artificial Sequence: Synthetic polypeptide
DEEEIRTTNPVATEQYGCVCSNWGEDEEYFNSEQA

SEQ ID NO: 165115 - protein, 35 aa, Artificial Sequence
  Description of Artificial Sequence: Synthetic polypeptide
DETEIATTNPVATEQYGSVCAAMNPLNDMDPNEND

SEQ ID NO: 165116 - protein, 34 aa, Artificial Sequence
  Description of Artificial Sequence: Synthetic polypeptide
DEEEICTTNPMATETYGSVPPPDPQHASGENFYG

SEQ ID NO: 165117 - protein, 33 aa, Artificial Sequence
  Description of Artificial Sequence: Synthetic polypeptide
DENEIRTTNPVSTEWYGTISMIDMIQVQQNGNH

SEQ ID NO: 165118 - protein, 35 aa, Artificial Sequence
  Description of Artificial Sequence: Synthetic polypeptide
DEEEIRTTNPVATEQYGCVCSNWGEDEGFGSETQS

SEQ ID NO: 165119 - protein, 36 aa, Artificial Sequence
  Description of Artificial Sequence: Synthetic polypeptide
DEEEISTTNPVATEQYGCVCSNTEHNQENFGSDTQS

SEQ ID NO: 165120 - protein, 35 aa, Artificial Sequence
  Description of Artificial Sequence: Synthetic polypeptide
DEEEICTTNPMATETYGSVPTPDPFQHASGESFRG

SEQ ID NO: 165121 - protein, 35 aa, Artificial Sequence
  Description of Artificial Sequence: Synthetic polypeptide
DETEIATTNPVATEQYGSVCAANMGEEQPDDQANF

SEQ ID NO: 165122 - protein, 34 aa, Artificial Sequence
  Description of Artificial Sequence: Synthetic polypeptide
DEMEIVTTNPVATEQYGTTVCSATDGPVEFEGID

SEQ ID NO: 165123 - protein, 36 aa, Artificial Sequence
  Description of Artificial Sequence: Synthetic polypeptide
DETEIATTNPVATEQYGSVCAANMHPLEATIDGERH

SEQ ID NO: 165124 - protein, 35 aa, Artificial Sequence
  Description of Artificial Sequence: Synthetic polypeptide
DETEIATTNPVATEQYGSVCAANNGDEDGMDINHN

SEQ ID NO: 165125 - protein, 35 aa, Artificial Sequence
  Description of Artificial Sequence: Synthetic polypeptide
DETEIATTNPVATEQYGSVCAANNGDEDGMDINSN

SEQ ID NO: 165126 - protein, 37 aa, Artificial Sequence
  Description of Artificial Sequence: Synthetic polypeptide
DEAEIRTTNPVATEQYGVVVSDGIMLEELRNGNEEVF

SEQ ID NO: 165127 - protein, 37 aa, Artificial Sequence
  Description of Artificial Sequence: Synthetic polypeptide
DEEEIRTTNPVATEQYGCVCSNWGEDHDQNFGSDNQS

SEQ ID NO: 165128 - protein, 34 aa, Artificial Sequence
  Description of Artificial Sequence: Synthetic polypeptide
DAEEIATTNPVATAQWGCVSGTGNPDNADGNGNN

SEQ ID NO: 165129 - protein, 34 aa, Artificial Sequence
  Description of Artificial Sequence: Synthetic polypeptide
DEMEIVTTNPVATEQYGTTVCSATSGPVEFEVND

SEQ ID NO: 165130 - protein, 34 aa, Artificial Sequence
  Description of Artificial Sequence: Synthetic polypeptide
DETEIATTNPVATEQYGSVCAAMNPRNDMDGGHN

SEQ ID NO: 165131 - protein, 36 aa, Artificial Sequence
  Description of Artificial Sequence: Synthetic polypeptide
DETEIATTNPVATEQYGSCSGAGPDLDGRAGGNVHN

SEQ ID NO: 165132 - protein, 32 aa, Artificial Sequence
  Description of Artificial Sequence: Synthetic polypeptide
DENEIRTTNPVSTFPYGTISMEDIQQQQNGNH

SEQ ID NO: 165133 - protein, 32 aa, Artificial Sequence
  Description of Artificial Sequence: Synthetic polypeptide
DENEIRTTNPVSTGPYGTISMEDIQQQQNGNH

SEQ ID NO: 165134 - protein, 35 aa, Artificial Sequence
  Description of Artificial Sequence: Synthetic polypeptide
DETEIATTNPVATEQYGSVCAADNGDEDGMDISNN

SEQ ID NO: 165135 - protein, 34 aa, Artificial Sequence
  Description of Artificial Sequence: Synthetic polypeptide
DETEIATTNPVATEQYGSVCAADNGDEDGMDPGN

SEQ ID NO: 165136 - protein, 32 aa, Artificial Sequence
  Description of Artificial Sequence: Synthetic polypeptide
DENEIRTTNPVSTNPYGTISMGDIQQQQNGNH

SEQ ID NO: 165137 - protein, 33 aa, Artificial Sequence
  Description of Artificial Sequence: Synthetic polypeptide
DETEIATTNPVATEQYGSVCAADNGDEMMDIDH

SEQ ID NO: 165138 - protein, 35 aa, Artificial Sequence
  Description of Artificial Sequence: Synthetic polypeptide
DETEIATTNPVATEQYGSVCAADNGDENGMDIEHR

SEQ ID NO: 165139 - protein, 32 aa, Artificial Sequence
  Description of Artificial Sequence: Synthetic polypeptide
DENEIRTTNPVSTNPYGTISMEDIQQQQNGNH

SEQ ID NO: 165140 - protein, 32 aa, Artificial Sequence
  Description of Artificial Sequence: Synthetic polypeptide
DENEIRTTNPVSTNPYGTISMEDIQQQENGNH

SEQ ID NO: 165141 - protein, 32 aa, Artificial Sequence
  Description of Artificial Sequence: Synthetic polypeptide
DENEIRTTNPVSTNPYGTISMEDIQEQQNGNH

SEQ ID NO: 165142 - protein, 36 aa, Artificial Sequence
  Description of Artificial Sequence: Synthetic polypeptide
DETEIATTNPVATEQYGSVCAADNGDEQGMDIDNRN

SEQ ID NO: 165143 - protein, 35 aa, Artificial Sequence
  Description of Artificial Sequence: Synthetic polypeptide
DETEIATTNPVATEQYGSVCAADNGDEQGMDIIER

SEQ ID NO: 165144 - protein, 36 aa, Artificial Sequence
  Description of Artificial Sequence: Synthetic polypeptide
DETEIATTNPVATEQYGSVCAADNGDEQGMDINARA

SEQ ID NO: 165145 - protein, 32 aa, Artificial Sequence
  Description of Artificial Sequence: Synthetic polypeptide
DENEIRTTNPVSTMPYGTISMEDIQQQQNGNH

SEQ ID NO: 165146 - protein, 35 aa, Artificial Sequence
  Description of Artificial Sequence: Synthetic polypeptide
DEAEIRTTNPVATEQYGVVCSWGEDHNQNFPSNQS

SEQ ID NO: 165147 - protein, 35 aa, Artificial Sequence
  Description of Artificial Sequence: Synthetic polypeptide
DETEIATTNPVATEQYGSVCAADNGDEQGMDISRF

SEQ ID NO: 165148 - protein, 38 aa, Artificial Sequence
  Description of Artificial Sequence: Synthetic polypeptide
DEEEIRTTNPVATEAYGVVSTTVTNNQQQGNNNTEDEE

SEQ ID NO: 165149 - protein, 35 aa, Artificial Sequence
  Description of Artificial Sequence: Synthetic polypeptide
DETEIATTNPVATEQYGSVCAADNGDETGMDIDPR

SEQ ID NO: 165150 - protein, 36 aa, Artificial Sequence
  Description of Artificial Sequence: Synthetic polypeptide
DETEIATTNPVATEQYGSVCAADNGDETGMDINNDR

SEQ ID NO: 165151 - protein, 32 aa, Artificial Sequence
  Description of Artificial Sequence: Synthetic polypeptide
DENEIRTTNPVSTLPYGTISMEDIQQQQNGNH

SEQ ID NO: 165152 - protein, 34 aa, Artificial Sequence
  Description of Artificial Sequence: Synthetic polypeptide
DETEIATTNPVATEQYGSVCAADNGDETMDINHV

SEQ ID NO: 165153 - protein, 32 aa, Artificial Sequence
  Description of Artificial Sequence: Synthetic polypeptide
DENEIRTTNPVSTLPYGTISMEAIQQQQNGNH

SEQ ID NO: 165154 - protein, 34 aa, Artificial Sequence
  Description of Artificial Sequence: Synthetic polypeptide
DEMEIVTTNPVATEQYGTTCSATDGPVEFEGNYD

SEQ ID NO: 165155 - protein, 35 aa, Artificial Sequence
  Description of Artificial Sequence: Synthetic polypeptide
DETEIATTNPVATEQYGSVCAADNGVDEDGMDIAR

SEQ ID NO: 165156 - protein, 34 aa, Artificial Sequence
  Description of Artificial Sequence: Synthetic polypeptide
DEMEIVTTNPVATEQYGTTCSATDGPVEFEGNYI

SEQ ID NO: 165157 - protein, 32 aa, Artificial Sequence
  Description of Artificial Sequence: Synthetic polypeptide
DENEIRTTNPVSTHPYGTISMEDIQQQQNGNH

SEQ ID NO: 165158 - protein, 32 aa, Artificial Sequence
  Description of Artificial Sequence: Synthetic polypeptide
DENEIRTTNPVSTHPYGTISMEDIQAQQNGNH

SEQ ID NO: 165159 - protein, 32 aa, Artificial Sequence
  Description of Artificial Sequence: Synthetic polypeptide
DENEIRTTNPVSTHPYGTISMEDDQQQQNGNH

SEQ ID NO: 165160 - protein, 35 aa, Artificial Sequence
  Description of Artificial Sequence: Synthetic polypeptide
DETEIATTNPVATEQYGSVCAADNGDEQMDINHHM

SEQ ID NO: 165161 - protein, 36 aa, Artificial Sequence
  Description of Artificial Sequence: Synthetic polypeptide
DEDEIATTNPVATEQYGSVCATNNPMNQGNQTEGAD

SEQ ID NO: 165162 - protein, 35 aa, Artificial Sequence
  Description of Artificial Sequence: Synthetic polypeptide
DEEEIATTNPVAYEQWGSVAKTNDEQEQDLGQMDI

SEQ ID NO: 165163 - protein, 30 aa, Artificial Sequence
  Description of Artificial Sequence: Synthetic polypeptide
QEEEIATTNPIATEQWGETWAADWQHKGEK

SEQ ID NO: 165164 - protein, 32 aa, Artificial Sequence
  Description of Artificial Sequence: Synthetic polypeptide
DENEIRTTNPVSYEPYGTISMWDIQQQQNGNH

SEQ ID NO: 165165 - protein, 33 aa, Artificial Sequence
  Description of Artificial Sequence: Synthetic polypeptide
DEAEIATTNPVAYEQWGTVCSTENDEGDGQHEQ

SEQ ID NO: 165166 - protein, 33 aa, Artificial Sequence
  Description of Artificial Sequence: Synthetic polypeptide
DENEIRTTNPVSYEPYGTISMEDISQNQNGTNH

SEQ ID NO: 165167 - protein, 35 aa, Artificial Sequence
  Description of Artificial Sequence: Synthetic polypeptide
DETEIATTNPVATEQWGSVSANNGALEATDNGTDN

SEQ ID NO: 165168 - protein, 35 aa, Artificial Sequence
  Description of Artificial Sequence: Synthetic polypeptide
DEEEIRTTNPVATEQYGCVCSNWEEHQSFISDTQS

SEQ ID NO: 165169 - protein, 32 aa, Artificial Sequence
  Description of Artificial Sequence: Synthetic polypeptide
DENEIRTTNPVSYEPYGTISMEDIQQQQNGNH

SEQ ID NO: 165170 - protein, 32 aa, Artificial Sequence
  Description of Artificial Sequence: Synthetic polypeptide
DENEIRTTNPVSYEPYGTISMEDIQQNQNGNH

SEQ ID NO: 165171 - protein, 32 aa, Artificial Sequence
  Description of Artificial Sequence: Synthetic polypeptide
DENEIRTTNPVSYEPYGTISMEDHSQQQTGNH

SEQ ID NO: 165172 - protein, 36 aa, Artificial Sequence
  Description of Artificial Sequence: Synthetic polypeptide
DEEEIRTTNPVATEQYGCVCSNWEEHTEFFGSDNQS

SEQ ID NO: 165173 - protein, 34 aa, Artificial Sequence
  Description of Artificial Sequence: Synthetic polypeptide
DEMEIVTTNPVATEQYGTAVCSATDIPVEFEGPD

SEQ ID NO: 165174 - protein, 38 aa, Artificial Sequence
  Description of Artificial Sequence: Synthetic polypeptide
DEAEIRTTNPVATEQYGSYVSCSNLLCEELMNGNEEVF

SEQ ID NO: 165175 - protein, 34 aa, Artificial Sequence
  Description of Artificial Sequence: Synthetic polypeptide
DEMEIVTTNPVATEQYGTCVCSAIDGPVEFEGND

SEQ ID NO: 165176 - protein, 36 aa, Artificial Sequence
  Description of Artificial Sequence: Synthetic polypeptide
DEHEIRTTNPVATEQYGSVYPLDELQWAEGGEEEDG

SEQ ID NO: 165177 - protein, 36 aa, Artificial Sequence
  Description of Artificial Sequence: Synthetic polypeptide
DEHEIRTTNPVATEQYGSYCYTTPDLWNLEGGGEES

SEQ ID NO: 165178 - protein, 32 aa, Artificial Sequence
  Description of Artificial Sequence: Synthetic polypeptide
AEECISTTNPVATEQYGCVCSWEHQYFISDQS

SEQ ID NO: 165179 - protein, 34 aa, Artificial Sequence
  Description of Artificial Sequence: Synthetic polypeptide
DETEIATTNPVATEQWGSVSAVGDLEADTPGEDH

SEQ ID NO: 165180 - protein, 38 aa, Artificial Sequence
  Description of Artificial Sequence: Synthetic polypeptide
DEAEIRTTNPVATEQYGSYVSNSGIMLEELRNGNEEVF

SEQ ID NO: 165181 - protein, 34 aa, Artificial Sequence
  Description of Artificial Sequence: Synthetic polypeptide
DEMEIVTTNPVATEQYGTFCSATDGAPVEFEGND

SEQ ID NO: 165182 - protein, 34 aa, Artificial Sequence
  Description of Artificial Sequence: Synthetic polypeptide
DETEIATTNPVATEQWGSVSGEGMNPGSAGPPDE

SEQ ID NO: 165183 - protein, 34 aa, Artificial Sequence
  Description of Artificial Sequence: Synthetic polypeptide
DETEIATTNPVATEQWGSVSGEGNEPTGDTGPPV

SEQ ID NO: 165184 - protein, 36 aa, Artificial Sequence
  Description of Artificial Sequence: Synthetic polypeptide
DETEIATTNPVATEQWGSVSGEGNLPDTQGNGEPVS

SEQ ID NO: 165185 - protein, 33 aa, Artificial Sequence
  Description of Artificial Sequence: Synthetic polypeptide
DEMEIVTTNPVATEQYGTFCSATDGPVEFEMND

SEQ ID NO: 165186 - protein, 34 aa, Artificial Sequence
  Description of Artificial Sequence: Synthetic polypeptide
DETEIATTNPVATEQWGSVSGEGPPDNTDGNPMN

SEQ ID NO: 165187 - protein, 34 aa, Artificial Sequence
  Description of Artificial Sequence: Synthetic polypeptide
DETEIATTNPVATEQWGSVSGEGPPNQNTDDNPV

SEQ ID NO: 165188 - protein, 36 aa, Artificial Sequence
  Description of Artificial Sequence: Synthetic polypeptide
DEEEIRTTNPVATEQYGCVCSNWEHDQENFNSENQP

SEQ ID NO: 165189 - protein, 36 aa, Artificial Sequence
  Description of Artificial Sequence: Synthetic polypeptide
DEEEIRTTNPVATEQYGCVCSNWEHDQENFNSETQD

SEQ ID NO: 165190 - protein, 37 aa, Artificial Sequence
  Description of Artificial Sequence: Synthetic polypeptide
DEEEIRTTNPVATEQYGCVCSNWEELNQENFNSDFQS

SEQ ID NO: 165191 - protein, 35 aa, Artificial Sequence
  Description of Artificial Sequence: Synthetic polypeptide
DEMEIVTTNPVATEQYGTFVCSATDGAPVEFEGND

SEQ ID NO: 165192 - protein, 33 aa, Artificial Sequence
  Description of Artificial Sequence: Synthetic polypeptide
DETEIATTNPVATEQWGSVANAGGGEYGAEGGR

SEQ ID NO: 165193 - protein, 35 aa, Artificial Sequence
  Description of Artificial Sequence: Synthetic polypeptide
DEEEIRTTNPVATEQYGCVCSNWEEHQFFQSEFQS

SEQ ID NO: 165194 - protein, 36 aa, Artificial Sequence
  Description of Artificial Sequence: Synthetic polypeptide
DEEEIRTTNPVATEQYGCVCSNWEEHNQENFNSDQS

SEQ ID NO: 165195 - protein, 33 aa, Artificial Sequence
  Description of Artificial Sequence: Synthetic polypeptide
DEDEIATTNPVATEQYGTVCAANDGPAEDDGGD

SEQ ID NO: 165196 - protein, 35 aa, Artificial Sequence
  Description of Artificial Sequence: Synthetic polypeptide
DEAEIRTTNPVATEQYGSVHYTIDPYDVEGEEDGD

SEQ ID NO: 165197 - protein, 34 aa, Artificial Sequence
  Description of Artificial Sequence: Synthetic polypeptide
DETEIATTNPVATEQWGCVAMTHLNPDDGMGDRH

SEQ ID NO: 165198 - protein, 34 aa, Artificial Sequence
  Description of Artificial Sequence: Synthetic polypeptide
AEECISTTNPVATEQYGCVCSWENHNQHFGSDQS

SEQ ID NO: 165199 - protein, 33 aa, Artificial Sequence
  Description of Artificial Sequence: Synthetic polypeptide
DETEIATTNPVATEQWGCVSGEGVEMNAAEDNS

SEQ ID NO: 165200 - protein, 29 aa, Artificial Sequence
  Description of Artificial Sequence: Synthetic peptide
DETEIATTNPVATEQWGEAPEVWAEHEPK

SEQ ID NO: 165201 - protein, 36 aa, Artificial Sequence
  Description of Artificial Sequence: Synthetic polypeptide
DEHEIRTTNPVATEAWGISVRTWNDDQQDDRQSEGN

SEQ ID NO: 165202 - protein, 30 aa, Artificial Sequence
  Description of Artificial Sequence: Synthetic polypeptide
DENEIRTVNPVATEQWGDVPEIEMNAAEDA

SEQ ID NO: 165203 - protein, 31 aa, Artificial Sequence
  Description of Artificial Sequence: Synthetic polypeptide
AESEIASTNPVGTEGYGVMCGSTLQHGSDNI

SEQ ID NO: 165204 - protein, 36 aa, Artificial Sequence
  Description of Artificial Sequence: Synthetic polypeptide
DEEEIRTTNPVATEQYGCVCSNWEEHNQFFGSDTQS

SEQ ID NO: 165205 - protein, 34 aa, Artificial Sequence
  Description of Artificial Sequence: Synthetic polypeptide
DEMEIVTTNPVATEQYGTACSATDGYPVEFEGND

SEQ ID NO: 165206 - protein, 36 aa, Artificial Sequence
  Description of Artificial Sequence: Synthetic polypeptide
DEEEISTTNPVATEQYGCVCSNSGEDHQAFGSENQD

SEQ ID NO: 165207 - protein, 34 aa, Artificial Sequence
  Description of Artificial Sequence: Synthetic polypeptide
DEEEIATVNPVATEQWGCVAGNGLQSNNNQQAEM

SEQ ID NO: 165208 - protein, 35 aa, Artificial Sequence
  Description of Artificial Sequence: Synthetic polypeptide
DEEEIRTTNPVATEQYGCVCSNWEEHNQNFISEQF

SEQ ID NO: 165209 - protein, 33 aa, Artificial Sequence
  Description of Artificial Sequence: Synthetic polypeptide
DETEIATTNPVATEQWGSTWSNADLADPKGEYI

SEQ ID NO: 165210 - protein, 34 aa, Artificial Sequence
  Description of Artificial Sequence: Synthetic polypeptide
DEDEIATTNPVATEQYGTCASATDGHPVEAEGND

SEQ ID NO: 165211 - protein, 36 aa, Artificial Sequence
  Description of Artificial Sequence: Synthetic polypeptide
DEDEIATTNPVATEQYGSVSSTTDAGPNMRNGMEPV

SEQ ID NO: 165212 - protein, 35 aa, Artificial Sequence
  Description of Artificial Sequence: Synthetic polypeptide
DEEEIRTTNPVATEQYGCVCSNWEEHNQNFLSEQS

SEQ ID NO: 165213 - protein, 34 aa, Artificial Sequence
  Description of Artificial Sequence: Synthetic polypeptide
DETEIATTNPVATEQWGSVAGPNEPGQEHNNDLE

SEQ ID NO: 165214 - protein, 34 aa, Artificial Sequence
  Description of Artificial Sequence: Synthetic polypeptide
DETEIATTNPVATEQWGSVAGTNPTAEAIGTEDA

SEQ ID NO: 165215 - protein, 30 aa, Artificial Sequence
  Description of Artificial Sequence: Synthetic polypeptide
AESEIASTNPVGTEGYGVMCASGTLQHGDI

SEQ ID NO: 165216 - protein, 37 aa, Artificial Sequence
  Description of Artificial Sequence: Synthetic polypeptide
DEDEIATTNPVATEQYGSVSATWPALGTNQGNGMEPV

SEQ ID NO: 165217 - protein, 33 aa, Artificial Sequence
  Description of Artificial Sequence: Synthetic polypeptide
QEEEIATTNPVATAQWGCVAGTNGLEATANGEF

SEQ ID NO: 165218 - protein, 36 aa, Artificial Sequence
  Description of Artificial Sequence: Synthetic polypeptide
DEEEIRTTNPVATEQYGCVCSNWEEHQENFNSDTQS

SEQ ID NO: 165219 - protein, 36 aa, Artificial Sequence
  Description of Artificial Sequence: Synthetic polypeptide
DEDEIATTNPVATEQYGSVSATTPAGTNQGNLMEPV

SEQ ID NO: 165220 - protein, 33 aa, Artificial Sequence
  Description of Artificial Sequence: Synthetic polypeptide
DEMEIVTTNPVATEQYGTACSATDVPVEFEGED

SEQ ID NO: 165221 - protein, 29 aa, Artificial Sequence
  Description of Artificial Sequence: Synthetic peptide
QEEEIATTNPVAYEQWGEAPCVEQHDSEK

SEQ ID NO: 165222 - protein, 36 aa, Artificial Sequence
  Description of Artificial Sequence: Synthetic polypeptide
DEQEIATTNPVATEQYGSVSATDGDGEDQEGEEDGD

SEQ ID NO: 165223 - protein, 35 aa, Artificial Sequence
  Description of Artificial Sequence: Synthetic polypeptide
TEEEIRTTNPVATEQYGSVSPDVSVAHMHGVHPPG

SEQ ID NO: 165224 - protein, 36 aa, Artificial Sequence
  Description of Artificial Sequence: Synthetic polypeptide
TEEEIRTTNPVATEQYGSVSIDQDGGEGQGGEGAGV

SEQ ID NO: 165225 - protein, 36 aa, Artificial Sequence
  Description of Artificial Sequence: Synthetic polypeptide
DEDEIATTNPVATEQYGSVCATNPPMQPDNQTEGAM

SEQ ID NO: 165226 - protein, 35 aa, Artificial Sequence
  Description of Artificial Sequence: Synthetic polypeptide
DETEIATTNPVATEQYGCVAATSGNPQAEAEPNHQ

SEQ ID NO: 165227 - protein, 36 aa, Artificial Sequence
  Description of Artificial Sequence: Synthetic polypeptide
DEEEISTTNPVATEQYGCVCSNSGEHNQSFGSDNQQ

SEQ ID NO: 165228 - protein, 29 aa, Artificial Sequence
  Description of Artificial Sequence: Synthetic peptide
AESEIASTNPVGTEGYGVMAATLQSHGDI

SEQ ID NO: 165229 - protein, 38 aa, Artificial Sequence
  Description of Artificial Sequence: Synthetic polypeptide
DEAEIRTTNPVATEQYGSYVSYSLIMPEELRNGNEEVF

SEQ ID NO: 165230 - protein, 33 aa, Artificial Sequence
  Description of Artificial Sequence: Synthetic polypeptide
DEMEIVTTNPVATEQYGTMCSATDGPVEFEGDD

SEQ ID NO: 165231 - protein, 39 aa, Artificial Sequence
  Description of Artificial Sequence: Synthetic polypeptide
DEEEIRTTNPVATEQYGSVSTTNNNNQQGTEQYGTEESE

SEQ ID NO: 165232 - protein, 34 aa, Artificial Sequence
  Description of Artificial Sequence: Synthetic polypeptide
DEMEIVTTNPVATEQYGTMCSATDGPVEFEGNLD

SEQ ID NO: 165233 - protein, 37 aa, Artificial Sequence
  Description of Artificial Sequence: Synthetic polypeptide
DEEEIRTTNPVAYEQYGESVSPSVNDELEVFVGEPVD

SEQ ID NO: 165234 - protein, 35 aa, Artificial Sequence
  Description of Artificial Sequence: Synthetic polypeptide
DETEIATTNPVATEQYGNTIATNPLENGMPMGEMR

SEQ ID NO: 165235 - protein, 36 aa, Artificial Sequence
  Description of Artificial Sequence: Synthetic polypeptide
CEEEIATTNPVAYEQYGSVCSTNPGPQEHQDGTEMK

SEQ ID NO: 165236 - protein, 37 aa, Artificial Sequence
  Description of Artificial Sequence: Synthetic polypeptide
TEEEIRTTNPVATEQYGSVSIDQDIGTQGQGGEGATV

SEQ ID NO: 165237 - protein, 38 aa, Artificial Sequence
  Description of Artificial Sequence: Synthetic polypeptide
DEEEIRTTNPVATEQYGSVSTTNNNNAEQGTTTEDEEE

SEQ ID NO: 165238 - protein, 33 aa, Artificial Sequence
  Description of Artificial Sequence: Synthetic polypeptide
DEMEIVTTNPVATEQYGTMCSATDGPVEFEHND

SEQ ID NO: 165239 - protein, 33 aa, Artificial Sequence
  Description of Artificial Sequence: Synthetic polypeptide
DETEIATTNPVATEQYGSACAAPAEGQNHQDMM

SEQ ID NO: 165240 - protein, 33 aa, Artificial Sequence
  Description of Artificial Sequence: Synthetic polypeptide
DEMEIVTTNPVATEQYGTMCSATDGPVEFESND

SEQ ID NO: 165241 - protein, 34 aa, Artificial Sequence
  Description of Artificial Sequence: Synthetic polypeptide
DETEIATTNPVATEQYGSACAATNPEEAEAEMGN

SEQ ID NO: 165242 - protein, 38 aa, Artificial Sequence
  Description of Artificial Sequence: Synthetic polypeptide
DEEEIRTTNPVAYEQYGESVGPSVNDELVVRVNEPLVD

SEQ ID NO: 165243 - protein, 36 aa, Artificial Sequence
  Description of Artificial Sequence: Synthetic polypeptide
DETEIATTNPVATEQYGSACAATNPQEADSQMGERH

SEQ ID NO: 165244 - protein, 36 aa, Artificial Sequence
  Description of Artificial Sequence: Synthetic polypeptide
DEEEISTTNPVATEQYGCVCSNTEDNQENFNSQNQS

SEQ ID NO: 165245 - protein, 38 aa, Artificial Sequence
  Description of Artificial Sequence: Synthetic polypeptide
DEEEIRTTNPVATEQYGVVSTVVATQAGNNDTEEDENE

SEQ ID NO: 165246 - protein, 36 aa, Artificial Sequence
  Description of Artificial Sequence: Synthetic polypeptide
DEEEISTTNPVATEQYGCVCSNTEDPNQENFGSEQA

SEQ ID NO: 165247 - protein, 39 aa, Artificial Sequence
  Description of Artificial Sequence: Synthetic polypeptide
DEEEIRTTNPVATEQYGSVSTTNNANQQGTEAGVTEEGQ

SEQ ID NO: 165248 - protein, 31 aa, Artificial Sequence
  Description of Artificial Sequence: Synthetic polypeptide
QEEEIATTNPIATEQWGETWANEEVWQHGEK

SEQ ID NO: 165249 - protein, 36 aa, Artificial Sequence
  Description of Artificial Sequence: Synthetic polypeptide
DETEIATTNPVATEQYGSACSANPGLAEAEIGNGNF

SEQ ID NO: 165250 - protein, 38 aa, Artificial Sequence
  Description of Artificial Sequence: Synthetic polypeptide
DEAEIRTTNPVATEQYGSYVSYVGIMLEEIRNGNEEVF

SEQ ID NO: 165251 - protein, 35 aa, Artificial Sequence
  Description of Artificial Sequence: Synthetic polypeptide
TEEEIRTTNPVATEQYGSVSPDVSVAQMVVVHPPI

SEQ ID NO: 165252 - protein, 36 aa, Artificial Sequence
  Description of Artificial Sequence: Synthetic polypeptide
DEEEIRTTNPVATEQYGCVCSNWEHNQENFNSNNQG

SEQ ID NO: 165253 - protein, 30 aa, Artificial Sequence
  Description of Artificial Sequence: Synthetic polypeptide
QEEEIATTNPIATEQYGEAPNAEVCQHEEK

SEQ ID NO: 165254 - protein, 35 aa, Artificial Sequence
  Description of Artificial Sequence: Synthetic polypeptide
DEMEIVTTNPVATEQYGTGVCSATDGGPVEFEGND

SEQ ID NO: 165255 - protein, 37 aa, Artificial Sequence
  Description of Artificial Sequence: Synthetic polypeptide
DEDEIATTNPVATEQYGSVCSPVGNGLPLDSGEENHH

SEQ ID NO: 165256 - protein, 34 aa, Artificial Sequence
  Description of Artificial Sequence: Synthetic polypeptide
DEMEIVTTNPVATEQYGTHCSATDGPVEFEGMND

SEQ ID NO: 165257 - protein, 34 aa, Artificial Sequence
  Description of Artificial Sequence: Synthetic polypeptide
DEMEIVTTNPVATEQYGTHCSATDGPVEFEGNPD

SEQ ID NO: 165258 - protein, 35 aa, Artificial Sequence
  Description of Artificial Sequence: Synthetic polypeptide
TEEEIRTTNPVATEQYGSVSPDVSKAQQVVEHPPI

SEQ ID NO: 165259 - protein, 35 aa, Artificial Sequence
  Description of Artificial Sequence: Synthetic polypeptide
TEEEIRTTNPVATEQYGSVSPDVSKAQMHMELPPI

SEQ ID NO: 165260 - protein, 37 aa, Artificial Sequence
  Description of Artificial Sequence: Synthetic polypeptide
DEDEIATTNPVATEQYGSVCSPVGDDLNPDAQMGQRN

SEQ ID NO: 165261 - protein, 33 aa, Artificial Sequence
  Description of Artificial Sequence: Synthetic polypeptide
DETEIATTNPVATEQWGTVCAANDGPVPDQGND

SEQ ID NO: 165262 - protein, 35 aa, Artificial Sequence
  Description of Artificial Sequence: Synthetic polypeptide
DEMEIVTTNPVATEQYGTHVCSATDGPVEFEGNDH

SEQ ID NO: 165263 - protein, 36 aa, Artificial Sequence
  Description of Artificial Sequence: Synthetic polypeptide
DEEEIRTTNPVATEQYGCVCSNWEHNEENFISDNQA

SEQ ID NO: 165264 - protein, 33 aa, Artificial Sequence
  Description of Artificial Sequence: Synthetic polypeptide
DETEIATTNPVATEQYGATSNAEDLEDHEGEYL

SEQ ID NO: 165265 - protein, 33 aa, Artificial Sequence
  Description of Artificial Sequence: Synthetic polypeptide
AEECISTTNPVATEQYGCVCSWEHAYFGSDNQS

SEQ ID NO: 165266 - protein, 35 aa, Artificial Sequence
  Description of Artificial Sequence: Synthetic polypeptide
DETEIATTNPVATEQYGCVAATAGLTATMNGNDFH

SEQ ID NO: 165267 - protein, 33 aa, Artificial Sequence
  Description of Artificial Sequence: Synthetic polypeptide
DCEEIRATNPVAYEQWGSSYYAEHMHQQRGQNE

SEQ ID NO: 165268 - protein, 34 aa, Artificial Sequence
  Description of Artificial Sequence: Synthetic polypeptide
AEECISTTNPVATEQYGCVCSTWMEHQYFGSDQS

SEQ ID NO: 165269 - protein, 30 aa, Artificial Sequence
  Description of Artificial Sequence: Synthetic polypeptide
QEEEIATTNPIATEQYGETWAAVWQHKEEK

SEQ ID NO: 165270 - protein, 37 aa, Artificial Sequence
  Description of Artificial Sequence: Synthetic polypeptide
DEAEIRTTNPVATEQYGSYVSSGIMLEELANGNEDVF

SEQ ID NO: 165271 - protein, 34 aa, Artificial Sequence
  Description of Artificial Sequence: Synthetic polypeptide
DETEIATTNPVATEQYGCSAANTLSQDDTEGEAM

SEQ ID NO: 165272 - protein, 36 aa, Artificial Sequence
  Description of Artificial Sequence: Synthetic polypeptide
DEEEIRTTNPVATEQYGCVCSNWEHNQENFISDNQS

SEQ ID NO: 165273 - protein, 36 aa, Artificial Sequence
  Description of Artificial Sequence: Synthetic polypeptide
DEEEIRTTNPVATEQYGCVCSNWEHNQENFNSDNQS

SEQ ID NO: 165274 - protein, 35 aa, Artificial Sequence
  Description of Artificial Sequence: Synthetic polypeptide
DEMEIVTTNPVATEQYGTLVCSATDGPVHFEGNDN

SEQ ID NO: 165275 - protein, 32 aa, Artificial Sequence
  Description of Artificial Sequence: Synthetic polypeptide
DEMEIVTTNPVATEQYGTMCAATDGPEFEGDD

SEQ ID NO: 165276 - protein, 37 aa, Artificial Sequence
  Description of Artificial Sequence: Synthetic polypeptide
DEEEIRTTNPVATEQYGVVSTVVATQQGTTEEEEEED

SEQ ID NO: 165277 - protein, 35 aa, Artificial Sequence
  Description of Artificial Sequence: Synthetic polypeptide
DEDEIATTNPVATEQYGSVCATPPMQPDNQTEGDN

SEQ ID NO: 165278 - protein, 36 aa, Artificial Sequence
  Description of Artificial Sequence: Synthetic polypeptide
DEEEIRTTNPVATEQYGCVCSNWEHNQENFNSDTQN

SEQ ID NO: 165279 - protein, 33 aa, Artificial Sequence
  Description of Artificial Sequence: Synthetic polypeptide
DETEIATTNPVATEQYGCVAANNGDTMDNNNNN

SEQ ID NO: 165280 - protein, 34 aa, Artificial Sequence
  Description of Artificial Sequence: Synthetic polypeptide
DEMEIVTTNPVATEQYGTIKCSATDGPVEFEGND

SEQ ID NO: 165281 - protein, 29 aa, Artificial Sequence
  Description of Artificial Sequence: Synthetic peptide
QEEEIATTNPVAYEQWGEAYIVEDQHEEG

SEQ ID NO: 165282 - protein, 31 aa, Artificial Sequence
  Description of Artificial Sequence: Synthetic polypeptide
QEGEIATTNPVATEQYGEAPTEVCQPTESKP

SEQ ID NO: 165283 - protein, 29 aa, Artificial Sequence
  Description of Artificial Sequence: Synthetic peptide
QEEEIATTNPVAYEQWGEAYMVEQHDEEG

SEQ ID NO: 165284 - protein, 32 aa, Artificial Sequence
  Description of Artificial Sequence: Synthetic polypeptide
DENEIRTTNPVSTEPYMTISMEDIQQQQNGNH

SEQ ID NO: 165285 - protein, 34 aa, Artificial Sequence
  Description of Artificial Sequence: Synthetic polypeptide
DEDEIATTNPVATEQYGSVCAADNGDETGMDIDN

SEQ ID NO: 165286 - protein, 36 aa, Artificial Sequence
  Description of Artificial Sequence: Synthetic polypeptide
DEEEISTTNPVATEQYGCVCSNTGEDHNQFFGSQQA

SEQ ID NO: 165287 - protein, 36 aa, Artificial Sequence
  Description of Artificial Sequence: Synthetic polypeptide
DEEEISTTNPVATEQYGCVCSNTGEDHNQHFGSDQA

SEQ ID NO: 165288 - protein, 37 aa, Artificial Sequence
  Description of Artificial Sequence: Synthetic polypeptide
DEEEISTTNPVATEQYGCVCSNTGEDLNQEHFGSEQS

SEQ ID NO: 165289 - protein, 36 aa, Artificial Sequence
  Description of Artificial Sequence: Synthetic polypeptide
DEDEIATTNPVATEQYGSVCAADNGDEQGMDINNRD

SEQ ID NO: 165290 - protein, 36 aa, Artificial Sequence
  Description of Artificial Sequence: Synthetic polypeptide
DEEEISTTNPVATEQYGCVCSNTGEDNQEHFNSDQS

SEQ ID NO: 165291 - protein, 33 aa, Artificial Sequence
  Description of Artificial Sequence: Synthetic polypeptide
DEMEIVTTNPVATEQYGTVCMAWDGPVEFEGND

SEQ ID NO: 165292 - protein, 35 aa, Artificial Sequence
  Description of Artificial Sequence: Synthetic polypeptide
DEDEIATTNPVATEQYGSVCAADNGDEQGMDININ

SEQ ID NO: 165293 - protein, 34 aa, Artificial Sequence
  Description of Artificial Sequence: Synthetic polypeptide
DEMEIVTTNPVATEQYGTVCNATDGPVEFEGNDK

SEQ ID NO: 165294 - protein, 33 aa, Artificial Sequence
  Description of Artificial Sequence: Synthetic polypeptide
DENEIRTTNPVSTEPYGYTISMEDIQQQQNGNH

SEQ ID NO: 165295 - protein, 32 aa, Artificial Sequence
  Description of Artificial Sequence: Synthetic polypeptide
DEMEIVTTNPVATEQYGTVCPAEDGPVEFENK

SEQ ID NO: 165296 - protein, 33 aa, Artificial Sequence
  Description of Artificial Sequence: Synthetic polypeptide
DEMEIVTTNPVATEQYGTVCMATDGPVEFEGPD

SEQ ID NO: 165297 - protein, 36 aa, Artificial Sequence
  Description of Artificial Sequence: Synthetic polypeptide
DEEEISTTNPVATEQYGCVCSNTGEDNQHFNSDNQA

SEQ ID NO: 165298 - protein, 35 aa, Artificial Sequence
  Description of Artificial Sequence: Synthetic polypeptide
DETEIATTNPVAYECWGSVASNDNRGEERNGDNDR

SEQ ID NO: 165299 - protein, 34 aa, Artificial Sequence
  Description of Artificial Sequence: Synthetic polypeptide
DETEIATTNPVAYECWGSVATGNMLGDAQGMNHA

SEQ ID NO: 165300 - protein, 33 aa, Artificial Sequence
  Description of Artificial Sequence: Synthetic polypeptide
DENEIRTTNPVSTEPYGWTISMEDIQQQQNRNH

SEQ ID NO: 165301 - protein, 33 aa, Artificial Sequence
  Description of Artificial Sequence: Synthetic polypeptide
DETEIATTNPVAYECWGSVAWTDDQDDRPGGDS

SEQ ID NO: 165302 - protein, 33 aa, Artificial Sequence
  Description of Artificial Sequence: Synthetic polypeptide
DENEIRTTNPVSTEPYGWTISMEDIQQQQNGNH

SEQ ID NO: 165303 - protein, 33 aa, Artificial Sequence
  Description of Artificial Sequence: Synthetic polypeptide
DENEIRTTNPVSTEPYGWTISMEDIQQQQAGNH

SEQ ID NO: 165304 - protein, 33 aa, Artificial Sequence
  Description of Artificial Sequence: Synthetic polypeptide
DENEIRTTNPVSTEPYGWTISMEDIQQQLNGNH

SEQ ID NO: 165305 - protein, 38 aa, Artificial Sequence
  Description of Artificial Sequence: Synthetic polypeptide
TEEEIRTTNPVATEQYGSVNSTGLTEGPEMGQGENDEN

SEQ ID NO: 165306 - protein, 33 aa, Artificial Sequence
  Description of Artificial Sequence: Synthetic polypeptide
DENEIRTTNPVSTEPYGWTISMEDIQQKQNGNH

SEQ ID NO: 165307 - protein, 35 aa, Artificial Sequence
  Description of Artificial Sequence: Synthetic polypeptide
DEAEIRTTNPVAWETWGSVSRCINEPQVRDDENLG

SEQ ID NO: 165308 - protein, 34 aa, Artificial Sequence
  Description of Artificial Sequence: Synthetic polypeptide
DETEIATTNPVAYEEWGSVSGGNTGNAGNDNQRN

SEQ ID NO: 165309 - protein, 33 aa, Artificial Sequence
  Description of Artificial Sequence: Synthetic polypeptide
DENEIRTTNPVSTEPYGWISMEDSQQPQSGEHN

SEQ ID NO: 165310 - protein, 33 aa, Artificial Sequence
  Description of Artificial Sequence: Synthetic polypeptide
DENEIRTTNPVSTEPYGYISMEDIQQQQNGNHD

SEQ ID NO: 165311 - protein, 36 aa, Artificial Sequence
  Description of Artificial Sequence: Synthetic polypeptide
CEEEIATTNPVAYEQYGSVCSTNPDQNEHQDGTEMK

SEQ ID NO: 165312 - protein, 37 aa, Artificial Sequence
  Description of Artificial Sequence: Synthetic polypeptide
AEEEIRATNPCATEQYGSVSTVTNQAGNQQIGTNTTD

SEQ ID NO: 165313 - protein, 30 aa, Artificial Sequence
  Description of Artificial Sequence: Synthetic polypeptide
QEEEIATTNPVAYEQYGEAPEHEHSQHEEK

SEQ ID NO: 165314 - protein, 35 aa, Artificial Sequence
  Description of Artificial Sequence: Synthetic polypeptide
DEAEIRTTNPVATEQYGSVFDTYQVTVGDGEESED

SEQ ID NO: 165315 - protein, 35 aa, Artificial Sequence
  Description of Artificial Sequence: Synthetic polypeptide
DEAEIRTTNPVATEQYGSVFDMYDVTVQDREESED

SEQ ID NO: 165316 - protein, 31 aa, Artificial Sequence
  Description of Artificial Sequence: Synthetic polypeptide
QEEEIATTNPVAYEQYGEAPCEVVSQHVGEK

SEQ ID NO: 165317 - protein, 35 aa, Artificial Sequence
  Description of Artificial Sequence: Synthetic polypeptide
TEEEIRTTNPVATEQYGSVPIMPSQGIAEPQLQEP

SEQ ID NO: 165318 - protein, 34 aa, Artificial Sequence
  Description of Artificial Sequence: Synthetic polypeptide
DETEIATTNPVATEQYGSVWANAEDWEDHEGEDI

SEQ ID NO: 165319 - protein, 34 aa, Artificial Sequence
  Description of Artificial Sequence: Synthetic polypeptide
DEAEIRTTNPVATGCWGSVSCINETQHHGSEYMP

SEQ ID NO: 165320 - protein, 33 aa, Artificial Sequence
  Description of Artificial Sequence: Synthetic polypeptide
DETEIATTNPVATEQYGTVCAANDGPVEDEGMD

SEQ ID NO: 165321 - protein, 33 aa, Artificial Sequence
  Description of Artificial Sequence: Synthetic polypeptide
DETEIATTNPVATEQYGTVCAANDGPVPDENND

SEQ ID NO: 165322 - protein, 35 aa, Artificial Sequence
  Description of Artificial Sequence: Synthetic polypeptide
DETEIATTNPVATEQYGTVCSATDGHPVEAEGGND

SEQ ID NO: 165323 - protein, 36 aa, Artificial Sequence
  Description of Artificial Sequence: Synthetic polypeptide
DETEIATTNPVATEQYGTVCSATGGEPSANFNGGND

SEQ ID NO: 165324 - protein, 35 aa, Artificial Sequence
  Description of Artificial Sequence: Synthetic polypeptide
DEMEIRTTNPVATEQYGCVVSTVHLGETSAPDKSN

SEQ ID NO: 165325 - protein, 33 aa, Artificial Sequence
  Description of Artificial Sequence: Synthetic polypeptide
CEDEIATTNPVAYEPYGSVTSAANQLDSNNPPP

SEQ ID NO: 165326 - protein, 35 aa, Artificial Sequence
  Description of Artificial Sequence: Synthetic polypeptide
DEAEIRTTNPVATVQYGSVYCSENWQDFESLEDGV

SEQ ID NO: 165327 - protein, 36 aa, Artificial Sequence
  Description of Artificial Sequence: Synthetic polypeptide
DEEEIRTTNPVAYEQYGCVYACTNAISQNKGMSPDV

SEQ ID NO: 165328 - protein, 33 aa, Artificial Sequence
  Description of Artificial Sequence: Synthetic polypeptide
DETEIATTNPVATEQYGVVCAANDGGVEDESND

SEQ ID NO: 165329 - protein, 34 aa, Artificial Sequence
  Description of Artificial Sequence: Synthetic polypeptide
DETEIATTNPVATEQYGVVCAANDGPVEDEGNND

SEQ ID NO: 165330 - protein, 37 aa, Artificial Sequence
  Description of Artificial Sequence: Synthetic polypeptide
AEEEIRATNPCATEQYGSVSTVNNQNQNQQQGTNTAD

SEQ ID NO: 165331 - protein, 37 aa, Artificial Sequence
  Description of Artificial Sequence: Synthetic polypeptide
AEEEIRATNPCATEQYGSVSTVNNQQQNQQQGTNVVD

SEQ ID NO: 165332 - protein, 39 aa, Artificial Sequence
  Description of Artificial Sequence: Synthetic polypeptide
DEEEIRTTNPVATEQYGVVSTTLQLQAGNNTEQGSTTNQ

SEQ ID NO: 165333 - protein, 33 aa, Artificial Sequence
  Description of Artificial Sequence: Synthetic polypeptide
DEDEIATTNPVATEQYGSVCAANAGEEMMMPEG

SEQ ID NO: 165334 - protein, 35 aa, Artificial Sequence
  Description of Artificial Sequence: Synthetic polypeptide
DEAEIRTTNPVATNCWGSVSRCINEPQVRDDENPE

SEQ ID NO: 165335 - protein, 36 aa, Artificial Sequence
  Description of Artificial Sequence: Synthetic polypeptide
DEDEIATTNPVATEQYGSVCAAMNHLQAMAPANDNP

SEQ ID NO: 165336 - protein, 36 aa, Artificial Sequence
  Description of Artificial Sequence: Synthetic polypeptide
DEEEISTTNPVATEQYGCVCSNTEPNQENFGSETQA

SEQ ID NO: 165337 - protein, 38 aa, Artificial Sequence
  Description of Artificial Sequence: Synthetic polypeptide
VEEEIRTTNPVATEQYGSVVYDDTDNEQENEMGERGGN

SEQ ID NO: 165338 - protein, 33 aa, Artificial Sequence
  Description of Artificial Sequence: Synthetic polypeptide
DENEIRTTNPVSTEPYWGTISMEDIQQQQNGNH

SEQ ID NO: 165339 - protein, 32 aa, Artificial Sequence
  Description of Artificial Sequence: Synthetic polypeptide
DENEIRTTNPVSTEPYTTISYEDIQQQQNGNH

SEQ ID NO: 165340 - protein, 35 aa, Artificial Sequence
  Description of Artificial Sequence: Synthetic polypeptide
DEEEISTTNPVATEQYGCVCSNTEPIENFGSEFQG

SEQ ID NO: 165341 - protein, 34 aa, Artificial Sequence
  Description of Artificial Sequence: Synthetic polypeptide
DEAEIRTTNPVATEQYGSVFHEDQPNTVEDEEQN

SEQ ID NO: 165342 - protein, 34 aa, Artificial Sequence
  Description of Artificial Sequence: Synthetic polypeptide
DEAEIRTTNPVAYEAWGEVACTNLQLNDHDNSGA

SEQ ID NO: 165343 - protein, 37 aa, Artificial Sequence
  Description of Artificial Sequence: Synthetic polypeptide
DEEEIRTTNPVATEQYGCVCSNWGEDHNIGFGSENQS

SEQ ID NO: 165344 - protein, 35 aa, Artificial Sequence
  Description of Artificial Sequence: Synthetic polypeptide
DEAEIRTTNPVAYECWGSVCYTDNQQQDLGQNGEN

SEQ ID NO: 165345 - protein, 36 aa, Artificial Sequence
  Description of Artificial Sequence: Synthetic polypeptide
DEAEIRTTNPVATEQYGSVEPDVEQENSIQGSSQRG

SEQ ID NO: 165346 - protein, 38 aa, Artificial Sequence
  Description of Artificial Sequence: Synthetic polypeptide
TEEEIRTTNPVATEQYGSVNEASANQQEYVGTLNPVDF

SEQ ID NO: 165347 - protein, 36 aa, Artificial Sequence
  Description of Artificial Sequence: Synthetic polypeptide
DEEEIRTTNPVATEQYGSVMSDQIIEGGQEDDDIFG

SEQ ID NO: 165348 - protein, 33 aa, Artificial Sequence
  Description of Artificial Sequence: Synthetic polypeptide
DAEEIATTNPVATAQWGSVSGTGVPDNANPQGH

SEQ ID NO: 165349 - protein, 34 aa, Artificial Sequence
  Description of Artificial Sequence: Synthetic polypeptide
DEMEIVTTNPVATEQYGTVCRATDGPVEFEGQND

SEQ ID NO: 165350 - protein, 37 aa, Artificial Sequence
  Description of Artificial Sequence: Synthetic polypeptide
DEDEIATTNPVATEQYGSTVCAANPELQEHQDGNQHQ

SEQ ID NO: 165351 - protein, 34 aa, Artificial Sequence
  Description of Artificial Sequence: Synthetic polypeptide
DEDEIATTNPVATEQYGSCSAGENPQENTADIEN

SEQ ID NO: 165352 - protein, 33 aa, Artificial Sequence
  Description of Artificial Sequence: Synthetic polypeptide
DETEIATTNPVAYEQWGGVYSIEIEMNQREDRA

SEQ ID NO: 165353 - protein, 34 aa, Artificial Sequence
  Description of Artificial Sequence: Synthetic polypeptide
DEMEIVTTNPVATEQYGTVCSAADGPVEDFEGND

SEQ ID NO: 165354 - protein, 37 aa, Artificial Sequence
  Description of Artificial Sequence: Synthetic polypeptide
TEEEIRTTNPVATEQYGSVLEGSTAVEPNMLLVEVAT

SEQ ID NO: 165355 - protein, 33 aa, Artificial Sequence
  Description of Artificial Sequence: Synthetic polypeptide
DETEIATTNPVAYEQWGMISHMDNHQERRGDSD

SEQ ID NO: 165356 - protein, 36 aa, Artificial Sequence
  Description of Artificial Sequence: Synthetic polypeptide
DEAEIRTTNPVAYECWGSVCYTDNQDQDLRGQNGTN

SEQ ID NO: 165357 - protein, 33 aa, Artificial Sequence
  Description of Artificial Sequence: Synthetic polypeptide
DEDEIATTNPVATEQYGSCAAGNNPQENMDIEN

SEQ ID NO: 165358 - protein, 36 aa, Artificial Sequence
  Description of Artificial Sequence: Synthetic polypeptide
VEEEIRTTNPVATEQYGSYGSVTDGDTGQGGEQEGI

SEQ ID NO: 165359 - protein, 35 aa, Artificial Sequence
  Description of Artificial Sequence: Synthetic polypeptide
DEEEISTTNPVATEQYGCVCSNTGEHAEHFGSQQL

SEQ ID NO: 165360 - protein, 32 aa, Artificial Sequence
  Description of Artificial Sequence: Synthetic polypeptide
DENEIRTTNPVSTEPYGVIAMEDIQQQQNGNH

SEQ ID NO: 165361 - protein, 33 aa, Artificial Sequence
  Description of Artificial Sequence: Synthetic polypeptide
DENEIRTTNPVSTEPYGVCSGEDHQQQQNGNHH

SEQ ID NO: 165362 - protein, 33 aa, Artificial Sequence
  Description of Artificial Sequence: Synthetic polypeptide
DENEIRTTNPVSTEPYGTYYSMEDIQQYQNGNH

SEQ ID NO: 165363 - protein, 32 aa, Artificial Sequence
  Description of Artificial Sequence: Synthetic polypeptide
DETEIATTNPVAYEQWGSTVTNGNGNSGGDMT

SEQ ID NO: 165364 - protein, 35 aa, Artificial Sequence
  Description of Artificial Sequence: Synthetic polypeptide
DETEIATTNPVAYEQWGSVAIANNLEQESPGDNEE

SEQ ID NO: 165365 - protein, 37 aa, Artificial Sequence
  Description of Artificial Sequence: Synthetic polypeptide
TEEEIRTTNPVATEQYGSVISPMMENIVTGTVAPNNT

SEQ ID NO: 165366 - protein, 36 aa, Artificial Sequence
  Description of Artificial Sequence: Synthetic polypeptide
DETEIATTNPVAYEQWGSVAKTNDLQEQRDGQQIDI

SEQ ID NO: 165367 - protein, 32 aa, Artificial Sequence
  Description of Artificial Sequence: Synthetic polypeptide
QEEEIATTNPVAYEQYGEASPSEVTCQHLEKI

SEQ ID NO: 165368 - protein, 33 aa, Artificial Sequence
  Description of Artificial Sequence: Synthetic polypeptide
DENEIRTTNPVSTEPYGTYSMEDIQQQQNGNAH

SEQ ID NO: 165369 - protein, 32 aa, Artificial Sequence
  Description of Artificial Sequence: Synthetic polypeptide
QEGEIATTNPVATEQYGCAPMHGQDSNGENKM

SEQ ID NO: 165370 - protein, 29 aa, Artificial Sequence
  Description of Artificial Sequence: Synthetic peptide
QEEEIASTNPVSTEGYGEAAAEVIQREEK

SEQ ID NO: 165371 - protein, 33 aa, Artificial Sequence
  Description of Artificial Sequence: Synthetic polypeptide
DETEIATTNPVAYEEWGSVTGGNPGNAGNDGQR

SEQ ID NO: 165372 - protein, 33 aa, Artificial Sequence
  Description of Artificial Sequence: Synthetic polypeptide
DEMEIVTTNPVATEQYGTVCRATDGPVEFEGDC

SEQ ID NO: 165373 - protein, 36 aa, Artificial Sequence
  Description of Artificial Sequence: Synthetic polypeptide
DEAEIRTTNPVAYECWGSVCVNELNDQQQDGQDNVR

SEQ ID NO: 165374 - protein, 34 aa, Artificial Sequence
  Description of Artificial Sequence: Synthetic polypeptide
DETEIATTNPVAYEGWGSVCSGTDMQDRNGGQEQ

SEQ ID NO: 165375 - protein, 34 aa, Artificial Sequence
  Description of Artificial Sequence: Synthetic polypeptide
DETEIATTNPVAYEGWGSVCSGTDQQDRDGEQEL

SEQ ID NO: 165376 - protein, 35 aa, Artificial Sequence
  Description of Artificial Sequence: Synthetic polypeptide
DEDEIRTTNPVATEMWGCVCVNDHQADGDRGDLGR

SEQ ID NO: 165377 - protein, 40 aa, Artificial Sequence
  Description of Artificial Sequence: Synthetic polypeptide
DEEEIRTTNPVATEQYGVVSTTNLQAGNNENLGNNNNQNE

SEQ ID NO: 165378 - protein, 33 aa, Artificial Sequence
  Description of Artificial Sequence: Synthetic polypeptide
DETEIATTNPVAYEHWGSVCPTDNQDQNNDNPG

SEQ ID NO: 165379 - protein, 32 aa, Artificial Sequence
  Description of Artificial Sequence: Synthetic polypeptide
AESEIACTNPVAYERYGEASCENLSQREVGGS

SEQ ID NO: 165380 - protein, 33 aa, Artificial Sequence
  Description of Artificial Sequence: Synthetic polypeptide
DENEIRTTNPVSTEPYGVTISMEDIQQQQNGNQ

SEQ ID NO: 165381 - protein, 33 aa, Artificial Sequence
  Description of Artificial Sequence: Synthetic polypeptide
DENEIRTTNPVSTEPYGVTISMEDIQQQQNGNH

SEQ ID NO: 165382 - protein, 37 aa, Artificial Sequence
  Description of Artificial Sequence: Synthetic polypeptide
DEEEIRTTNPVATEQYGSVMQEVMLQLDDIVNVDEDT

SEQ ID NO: 165383 - protein, 33 aa, Artificial Sequence
  Description of Artificial Sequence: Synthetic polypeptide
DENEIRTTNPVSTEPYGVTCSNEDIQQQQNGNH

SEQ ID NO: 165384 - protein, 35 aa, Artificial Sequence
  Description of Artificial Sequence: Synthetic polypeptide
DEDEIATTNPVATEQYGSVAIVNHPEAPDNQEGRD

SEQ ID NO: 165385 - protein, 36 aa, Artificial Sequence
  Description of Artificial Sequence: Synthetic polypeptide
DEEEISTTNPVATEQYGCVCSNTGEDNQNFGSDTQS

SEQ ID NO: 165386 - protein, 36 aa, Artificial Sequence
  Description of Artificial Sequence: Synthetic polypeptide
DEEEISTTNPVATEQYGCVCSNTGEDQEYFNSEFQG

SEQ ID NO: 165387 - protein, 34 aa, Artificial Sequence
  Description of Artificial Sequence: Synthetic polypeptide
DETEIATTNPVAYEPVWGQSVAMNDGLQTDGITR

SEQ ID NO: 165388 - protein, 33 aa, Artificial Sequence
  Description of Artificial Sequence: Synthetic polypeptide
DEMEIVTTNPVATEQYGTVCPATDGPVEFEENK

SEQ ID NO: 165389 - protein, 34 aa, Artificial Sequence
  Description of Artificial Sequence: Synthetic polypeptide
DEAEIRTTNPVAYEAWGVVSGGNADDSRNGGGNS

SEQ ID NO: 165390 - protein, 33 aa, Artificial Sequence
  Description of Artificial Sequence: Synthetic polypeptide
DETEIATTNPVAYEPWGSVSQGNPQQDTPGGSE

SEQ ID NO: 165391 - protein, 35 aa, Artificial Sequence
  Description of Artificial Sequence: Synthetic polypeptide
DEEEISTTNPVATEQYGCVCSNTGEDNQNFISEQA

SEQ ID NO: 165392 - protein, 33 aa, Artificial Sequence
  Description of Artificial Sequence: Synthetic polypeptide
DEAEIRTTNPVAYEAWGVVTGGNANEDGPGNSR

SEQ ID NO: 165393 - protein, 33 aa, Artificial Sequence
  Description of Artificial Sequence: Synthetic polypeptide
DEAEIRTTNPVAYEAWGVVTGGNGNQGEMNDNR

SEQ ID NO: 165394 - protein, 34 aa, Artificial Sequence
  Description of Artificial Sequence: Synthetic polypeptide
DEMEIVTTNPVATEQYGTVCQATDGPVEFEGNDK

SEQ ID NO: 165395 - protein, 35 aa, Artificial Sequence
  Description of Artificial Sequence: Synthetic polypeptide
DEDEIATTNPVATEQYGSVAGAGNPSEEAGGNDEN

SEQ ID NO: 165396 - protein, 31 aa, Artificial Sequence
  Description of Artificial Sequence: Synthetic polypeptide
QEEEIATTNPVAYEQYGEAPEVEISQHEGSK

SEQ ID NO: 165397 - protein, 37 aa, Artificial Sequence
  Description of Artificial Sequence: Synthetic polypeptide
DEAEIRTTNPVAYEAYGISTVSYEANELSDVRGPERF

SEQ ID NO: 165398 - protein, 30 aa, Artificial Sequence
  Description of Artificial Sequence: Synthetic polypeptide
QEEEIATTNPVAYEQYGEAPEVEQSQHEEE

SEQ ID NO: 165399 - protein, 35 aa, Artificial Sequence
  Description of Artificial Sequence: Synthetic polypeptide
VEEEIRTTNPVATEQYGSVYSIPPLDEYAEADLIE

SEQ ID NO: 165400 - protein, 36 aa, Artificial Sequence
  Description of Artificial Sequence: Synthetic polypeptide
DEEEIRTTNPVATEQYGSVMQMMGIEEGENGQPMDQ

SEQ ID NO: 165401 - protein, 34 aa, Artificial Sequence
  Description of Artificial Sequence: Synthetic polypeptide
DEDEIATTNPVATEQYGTVCAANDGPAEDDGNDA

SEQ ID NO: 165402 - protein, 34 aa, Artificial Sequence
  Description of Artificial Sequence: Synthetic polypeptide
DEMEIVTTNPVATEQYGTVCIATDGTPVEFEGND

SEQ ID NO: 165403 - protein, 31 aa, Artificial Sequence
  Description of Artificial Sequence: Synthetic polypeptide
QEGEIATTNPVATEQYGEAPERVECQPTNEK

SEQ ID NO: 165404 - protein, 34 aa, Artificial Sequence
  Description of Artificial Sequence: Synthetic polypeptide
DEMEIVTTNPVATEQYGTVCAATDGPVESFEGND

SEQ ID NO: 165405 - protein, 35 aa, Artificial Sequence
  Description of Artificial Sequence: Synthetic polypeptide
DETEIATTNPVATEQYGSVCAANNGEAPDNGMENT

SEQ ID NO: 165406 - protein, 35 aa, Artificial Sequence
  Description of Artificial Sequence: Synthetic polypeptide
DETEIATTNPVATEQYGSVCAANNGEEAGDEMNNH

SEQ ID NO: 165407 - protein, 35 aa, Artificial Sequence
  Description of Artificial Sequence: Synthetic polypeptide
DETEIATTNPVATEQYGSVCAANNGEQPDDQDNNS

SEQ ID NO: 165408 - protein, 36 aa, Artificial Sequence
  Description of Artificial Sequence: Synthetic polypeptide
VEEEIRTTNPVATEQYGSVSYMPNLVEMTELWEPDE

SEQ ID NO: 165409 - protein, 37 aa, Artificial Sequence
  Description of Artificial Sequence: Synthetic polypeptide
DEEEIRTTNPVATEQYGSVMGTVNQNMDEGGEGVEDT

SEQ ID NO: 165410 - protein, 36 aa, Artificial Sequence
  Description of Artificial Sequence: Synthetic polypeptide
DETEIATTNPVATEQYGSVCAANNGVLPEADGGNDD

SEQ ID NO: 165411 - protein, 30 aa, Artificial Sequence
  Description of Artificial Sequence: Synthetic polypeptide
DDSEVASTNPVSTEGYGNAAANTIQSRGQR

SEQ ID NO: 165412 - protein, 34 aa, Artificial Sequence
  Description of Artificial Sequence: Synthetic polypeptide
DETEIATTNPVATEQYGSVCAAQNGDEDGMDIDN

SEQ ID NO: 165413 - protein, 34 aa, Artificial Sequence
  Description of Artificial Sequence: Synthetic polypeptide
DEMEIVTTNPVATEQYGTVCCATDGPVEFEGNDQ

SEQ ID NO: 165414 - protein, 36 aa, Artificial Sequence
  Description of Artificial Sequence: Synthetic polypeptide
DETEIATTNPVATEQYGSVCAAQNGDEQDRSINEDM

SEQ ID NO: 165415 - protein, 34 aa, Artificial Sequence
  Description of Artificial Sequence: Synthetic polypeptide
DEMEIVTTNPVATEQYGTVCCATDGPVEFEGNDW

SEQ ID NO: 165416 - protein, 34 aa, Artificial Sequence
  Description of Artificial Sequence: Synthetic polypeptide
DETEIATTNPVATEQYGSVCAANNGDETGMDIDH

SEQ ID NO: 165417 - protein, 35 aa, Artificial Sequence
  Description of Artificial Sequence: Synthetic polypeptide
DETEIATTNPVATEQYGSVCAATAHHDQAMPMDNN

SEQ ID NO: 165418 - protein, 36 aa, Artificial Sequence
  Description of Artificial Sequence: Synthetic polypeptide
DEEEISTTNPVATEQYGCVCSNTEHNQENSGSDTQS

SEQ ID NO: 165419 - protein, 35 aa, Artificial Sequence
  Description of Artificial Sequence: Synthetic polypeptide
DETEIATTNPVATEQYGSVCAATMHGEATIDGERH

SEQ ID NO: 165420 - protein, 35 aa, Artificial Sequence
  Description of Artificial Sequence: Synthetic polypeptide
DETEIATTNPVATEQYGSVCAATMHGLDSMGGDHQ

SEQ ID NO: 165421 - protein, 35 aa, Artificial Sequence
  Description of Artificial Sequence: Synthetic polypeptide
DETEIATTNPVATEQYGSVCAATMHLEADIPPERH

SEQ ID NO: 165422 - protein, 34 aa, Artificial Sequence
  Description of Artificial Sequence: Synthetic polypeptide
DEMEIVTTNPVATEQYGTVCCATDGPVENFEGND

SEQ ID NO: 165423 - protein, 34 aa, Artificial Sequence
  Description of Artificial Sequence: Synthetic polypeptide
DEMEIVTTNPVATEQYGTVCDATDGPVEFEGNCD

SEQ ID NO: 165424 - protein, 35 aa, Artificial Sequence
  Description of Artificial Sequence: Synthetic polypeptide
DEEEISTTNPVATEQYGCVCSNTEHNQENSISDQE

SEQ ID NO: 165425 - protein, 38 aa, Artificial Sequence
  Description of Artificial Sequence: Synthetic polypeptide
DEEEIRTTNPVATEQYGSVMGVMSNGGEQEDNGGNEQQ

SEQ ID NO: 165426 - protein, 29 aa, Artificial Sequence
  Description of Artificial Sequence: Synthetic peptide
QEEEIATTNPVAYEQWGEAYYVEQGHEQG

SEQ ID NO: 165427 - protein, 36 aa, Artificial Sequence
  Description of Artificial Sequence: Synthetic polypeptide
DETEIATTNPVATEQYGSVCALANGLEPTRDGMEGN

SEQ ID NO: 165428 - protein, 35 aa, Artificial Sequence
  Description of Artificial Sequence: Synthetic polypeptide
DETEIATTNPVATEQYGSVCAMANPEEAGDGENAE

SEQ ID NO: 165429 - protein, 36 aa, Artificial Sequence
  Description of Artificial Sequence: Synthetic polypeptide
DEEEISTTNPVATEQYGCVCSNTEHNQESFPSDNQP

SEQ ID NO: 165430 - protein, 34 aa, Artificial Sequence
  Description of Artificial Sequence: Synthetic polypeptide
DEMEIVTTNPVATEQYGTVCCATDGPVEFEGNYD

SEQ ID NO: 165431 - protein, 36 aa, Artificial Sequence
  Description of Artificial Sequence: Synthetic polypeptide
DETEIATTNPVATEQYGSVCAMNNGGLEAGDVNNMA

SEQ ID NO: 165432 - protein, 35 aa, Artificial Sequence
  Description of Artificial Sequence: Synthetic polypeptide
DEEEISTTNPVATEQYGCVCSNTEHNQENFLSQQS

SEQ ID NO: 165433 - protein, 36 aa, Artificial Sequence
  Description of Artificial Sequence: Synthetic polypeptide
DETEIATTNPVATEQYGSVCAANNGDEQGMDISNTR

SEQ ID NO: 165434 - protein, 33 aa, Artificial Sequence
  Description of Artificial Sequence: Synthetic polypeptide
DEMEIVTTNPVATEQYGTVCAAADGPEFEGNYD

SEQ ID NO: 165435 - protein, 38 aa, Artificial Sequence
  Description of Artificial Sequence: Synthetic polypeptide
AEEEIRTTNPVATEQYGSVVTVTNNQAGNTEQGTNNET

SEQ ID NO: 165436 - protein, 30 aa, Artificial Sequence
  Description of Artificial Sequence: Synthetic polypeptide
QEEEIATTNPVAYEQWGEAYMVEQHERDGK

SEQ ID NO: 165437 - protein, 39 aa, Artificial Sequence
  Description of Artificial Sequence: Synthetic polypeptide
DEEEIRTTNPVATEAYGVVSTTVVNQQLNNQQGTNVATE

SEQ ID NO: 165438 - protein, 29 aa, Artificial Sequence
  Description of Artificial Sequence: Synthetic peptide
QEEEIATTNPVAYEQWGEAYMVEQHHEGL

SEQ ID NO: 165439 - protein, 37 aa, Artificial Sequence
  Description of Artificial Sequence: Synthetic polypeptide
DEEEIRTTNPVATEAYGVVSTTVVTNNAEQGNDEETD

SEQ ID NO: 165440 - protein, 34 aa, Artificial Sequence
  Description of Artificial Sequence: Synthetic polypeptide
DEMEIVTTNPVATEQYGTVCAATDGPVEEFEGND

SEQ ID NO: 165441 - protein, 30 aa, Artificial Sequence
  Description of Artificial Sequence: Synthetic polypeptide
QEEEIATTNPVAYEQWGEAYMVEQQKEGEG

SEQ ID NO: 165442 - protein, 34 aa, Artificial Sequence
  Description of Artificial Sequence: Synthetic polypeptide
DEMEIVTTNPVATEQYGTVCAATDGPVEEFKGND

SEQ ID NO: 165443 - protein, 35 aa, Artificial Sequence
  Description of Artificial Sequence: Synthetic polypeptide
DETEIATTNPVATEQYGSVCAANNGDENGMDINTN

SEQ ID NO: 165444 - protein, 34 aa, Artificial Sequence
  Description of Artificial Sequence: Synthetic polypeptide
DEMEIVTTNPVATEQYGTVCAATDGPVEFEGGND

SEQ ID NO: 165445 - protein, 33 aa, Artificial Sequence
  Description of Artificial Sequence: Synthetic polypeptide
DCEEIATTNPVAYEQWGSVCSNWEHGEQDMMNG

SEQ ID NO: 165446 - protein, 34 aa, Artificial Sequence
  Description of Artificial Sequence: Synthetic polypeptide
DETEIATTNPVATEQYGSVCAANNGDEQMDIDHL

SEQ ID NO: 165447 - protein, 34 aa, Artificial Sequence
  Description of Artificial Sequence: Synthetic polypeptide
DEMEIVTTNPVATEQYGTVCAATDGPVEFEGNQD

SEQ ID NO: 165448 - protein, 35 aa, Artificial Sequence
  Description of Artificial Sequence: Synthetic polypeptide
DETEIATTNPVATEQYGSVCAANNGDENGMDMGER

SEQ ID NO: 165449 - protein, 30 aa, Artificial Sequence
  Description of Artificial Sequence: Synthetic polypeptide
DDSEVASTNPVSTEGYGNAAANTIQSRGER

SEQ ID NO: 165450 - protein, 35 aa, Artificial Sequence
  Description of Artificial Sequence: Synthetic polypeptide
DETEIATTNPVATEQYGSVCAANNGDEQDMSINEH

SEQ ID NO: 165451 - protein, 35 aa, Artificial Sequence
  Description of Artificial Sequence: Synthetic polypeptide
DETEIATTNPVATEQYGSVCAANNGDEQDMSINEQ

SEQ ID NO: 165452 - protein, 36 aa, Artificial Sequence
  Description of Artificial Sequence: Synthetic polypeptide
DEDEIATTNPVATEQYGSVCAMNNGEDQDQGGNMTQ

SEQ ID NO: 165453 - protein, 35 aa, Artificial Sequence
  Description of Artificial Sequence: Synthetic polypeptide
DETEIATTNPVATEQYGSVCAANNGDEQDRSIEED

SEQ ID NO: 165454 - protein, 36 aa, Artificial Sequence
  Description of Artificial Sequence: Synthetic polypeptide
DETEIATTNPVATEQYGSVCAANNGDEQDRSINDEN

SEQ ID NO: 165455 - protein, 29 aa, Artificial Sequence
  Description of Artificial Sequence: Synthetic peptide
QEEEIATTNPVAYEQWGEAYYVEQEIESD

SEQ ID NO: 165456 - protein, 34 aa, Artificial Sequence
  Description of Artificial Sequence: Synthetic polypeptide
DEDEIATTNPVATEQYGSVCAMANPAEDNMLNHL

SEQ ID NO: 165457 - protein, 34 aa, Artificial Sequence
  Description of Artificial Sequence: Synthetic polypeptide
DETEIATTNPVATEQYGSVCAANNGDEQGMDIEE

SEQ ID NO: 165458 - protein, 35 aa, Artificial Sequence
  Description of Artificial Sequence: Synthetic polypeptide
DETEIATTNPVATEQYGSVCAANNGDEQGMDINNH

SEQ ID NO: 165459 - protein, 33 aa, Artificial Sequence
  Description of Artificial Sequence: Synthetic polypeptide
DEMEIVTTNPVATEQYGTVCAATDGPVEHEGDD

SEQ ID NO: 165460 - protein, 34 aa, Artificial Sequence
  Description of Artificial Sequence: Synthetic polypeptide
DEMEIVTTNPVATEQYGTVCAATDGPVEFEGTND

SEQ ID NO: 165461 - protein, 34 aa, Artificial Sequence
  Description of Artificial Sequence: Synthetic polypeptide
DEMEIVTTNPVATEQYGTVCIATDGPVEFEGNGD

SEQ ID NO: 165462 - protein, 29 aa, Artificial Sequence
  Description of Artificial Sequence: Synthetic peptide
QEEEIATTNPVAYEQWGEAYYVEQHEHEI

SEQ ID NO: 165463 - protein, 35 aa, Artificial Sequence
  Description of Artificial Sequence: Synthetic polypeptide
DETEIATTNPVATEQYGSVCAMNNHLEADSGGEAG

SEQ ID NO: 165464 - protein, 36 aa, Artificial Sequence
  Description of Artificial Sequence: Synthetic polypeptide
DEEEIRTTNPVAYEQYGESNAPSVHDELFRVGEPVD

SEQ ID NO: 165465 - protein, 35 aa, Artificial Sequence
  Description of Artificial Sequence: Synthetic polypeptide
DEEEISTTNPVATEQYGCVCSNTEHNQNFPSDTQG

SEQ ID NO: 165466 - protein, 30 aa, Artificial Sequence
  Description of Artificial Sequence: Synthetic polypeptide
AESEIASTNPVGTEGWGVCAPTDLQHGDNE

SEQ ID NO: 165467 - protein, 35 aa, Artificial Sequence
  Description of Artificial Sequence: Synthetic polypeptide
DEMEIRTTNPVATEQYGCYSVVIHEREHGFSENPQ

SEQ ID NO: 165468 - protein, 31 aa, Artificial Sequence
  Description of Artificial Sequence: Synthetic polypeptide
QEGEIATTNPVATEQYGEAPEVWCQHGEYEK

SEQ ID NO: 165469 - protein, 37 aa, Artificial Sequence
  Description of Artificial Sequence: Synthetic polypeptide
DETEIATTNPVATEQYGSVSATMSGLPPAEAEPGHNH

SEQ ID NO: 165470 - protein, 39 aa, Artificial Sequence
  Description of Artificial Sequence: Synthetic polypeptide
DEEEIRTTNPVATEQYGVVSTVVANLAGNDEQGNNEQGQ

SEQ ID NO: 165471 - protein, 36 aa, Artificial Sequence
  Description of Artificial Sequence: Synthetic polypeptide
DEEEIRTTNPVATEQYGSVMGVVNMEDEGGEDGDTV

SEQ ID NO: 165472 - protein, 36 aa, Artificial Sequence
  Description of Artificial Sequence: Synthetic polypeptide
DETEIATTNPVATEQYGSVSSTTPAGTNMRNGMEPV

SEQ ID NO: 165473 - protein, 35 aa, Artificial Sequence
  Description of Artificial Sequence: Synthetic polypeptide
DEAEIRTTNPVATETWGSVSRCINEPQVHSDENLG

SEQ ID NO: 165474 - protein, 31 aa, Artificial Sequence
  Description of Artificial Sequence: Synthetic polypeptide
QEEEIATTNPVAYEQYGEAPCAVQSQHEGEM

SEQ ID NO: 165475 - protein, 37 aa, Artificial Sequence
  Description of Artificial Sequence: Synthetic polypeptide
DEEEIRTTNPVATEQYGSVMHDVMLQLDMIRAVDEDL

SEQ ID NO: 165476 - protein, 36 aa, Artificial Sequence
  Description of Artificial Sequence: Synthetic polypeptide
DEAEIRTTNPVATEQYGSVHDYQELIQTGIIQSEGF

SEQ ID NO: 165477 - protein, 29 aa, Artificial Sequence
  Description of Artificial Sequence: Synthetic peptide
AESEIASTNPVGTEGWGVAASTLQHGDAH

SEQ ID NO: 165478 - protein, 30 aa, Artificial Sequence
  Description of Artificial Sequence: Synthetic polypeptide
QEEEIATTNPVAYEQYGEAPCCVHSQHEEK

SEQ ID NO: 165479 - protein, 29 aa, Artificial Sequence
  Description of Artificial Sequence: Synthetic peptide
AESEIASTNPVGTEGWGVAASTLQDHGDI

SEQ ID NO: 165480 - protein, 36 aa, Artificial Sequence
  Description of Artificial Sequence: Synthetic polypeptide
DEEEIRTTNPVATEQYGSVMLDTIEGGQEDDDDIGT

SEQ ID NO: 165481 - protein, 38 aa, Artificial Sequence
  Description of Artificial Sequence: Synthetic polypeptide
AEEEIRTTNPVATEQYGSVVTVTNNQQGNTEQGTNDEA

SEQ ID NO: 165482 - protein, 38 aa, Artificial Sequence
  Description of Artificial Sequence: Synthetic polypeptide
DEEEIRTTNPVAYEQYGESMVCPSVTLEQKERVGDPVD

SEQ ID NO: 165483 - protein, 36 aa, Artificial Sequence
  Description of Artificial Sequence: Synthetic polypeptide
DEAEIRTTNPVATEQYGSVGEVNMEDFTGFNENDED

SEQ ID NO: 165484 - protein, 31 aa, Artificial Sequence
  Description of Artificial Sequence: Synthetic polypeptide
QEEEIATTNPVAYEQYGEAPCEGGSQHEGEK

SEQ ID NO: 165485 - protein, 36 aa, Artificial Sequence
  Description of Artificial Sequence: Synthetic polypeptide
DEAEIRTTNPVATEWWGSVSRCINEPQVRDDENLGE

SEQ ID NO: 165486 - protein, 38 aa, Artificial Sequence
  Description of Artificial Sequence: Synthetic polypeptide
AEEEIRTTNPVATEQYGSVVTVTNNQSGNTEQGNNEES

SEQ ID NO: 165487 - protein, 31 aa, Artificial Sequence
  Description of Artificial Sequence: Synthetic polypeptide
QEEEIATTNPVAYEQYGEAPCEVCSQHEGEQ

SEQ ID NO: 165488 - protein, 30 aa, Artificial Sequence
  Description of Artificial Sequence: Synthetic polypeptide
QEEEIATTNPVAYEQYGEAPCEVDSQHEEE

SEQ ID NO: 165489 - protein, 30 aa, Artificial Sequence
  Description of Artificial Sequence: Synthetic polypeptide
QEGEIATTNPVATEQYGEAPETVCEPHQEK

SEQ ID NO: 165490 - protein, 29 aa, Artificial Sequence
  Description of Artificial Sequence: Synthetic peptide
AESEIASTNPVGTEGWGVAASTLQHGADA

SEQ ID NO: 165491 - protein, 29 aa, Artificial Sequence
  Description of Artificial Sequence: Synthetic peptide
DDSEVASTNPVSTEGYGNAANTIQRVGQR

SEQ ID NO: 165492 - protein, 36 aa, Artificial Sequence
  Description of Artificial Sequence: Synthetic polypeptide
VEEEIRTTNPVATEQYGSVVGDINNDQQLEEGFGEF

SEQ ID NO: 165493 - protein, 36 aa, Artificial Sequence
  Description of Artificial Sequence: Synthetic polypeptide
DETEIATTNPVATEQYGSVCSVADTLQEDAGEPKME

SEQ ID NO: 165494 - protein, 29 aa, Artificial Sequence
  Description of Artificial Sequence: Synthetic peptide
QEEEIATTNPVAYEQWGEAYYVEQHMEGQ

SEQ ID NO: 165495 - protein, 30 aa, Artificial Sequence
  Description of Artificial Sequence: Synthetic polypeptide
QEEEIATTNPVAYEQWGEAYYVETQQGEEG

SEQ ID NO: 165496 - protein, 36 aa, Artificial Sequence
  Description of Artificial Sequence: Synthetic polypeptide
DEDEIATTNPVATEQYGSVCAGTDGLQNGDPMDQDD

SEQ ID NO: 165497 - protein, 37 aa, Artificial Sequence
  Description of Artificial Sequence: Synthetic polypeptide
DETEIATTNPVATEQYGSVCAMTNGELTNDDGMENHM

SEQ ID NO: 165498 - protein, 37 aa, Artificial Sequence
  Description of Artificial Sequence: Synthetic polypeptide
DETEIATTNPVATEQYGSVCAMTNGVLTQDSPDENGN

SEQ ID NO: 165499 - protein, 32 aa, Artificial Sequence
  Description of Artificial Sequence: Synthetic polypeptide
DENEIRTTNPVSTETYGTISMEDIQQQQNENH

SEQ ID NO: 165500 - protein, 36 aa, Artificial Sequence
  Description of Artificial Sequence: Synthetic polypeptide
DETEIATTNPVATEQYGSVCAMTNHGEQTMDGEQDI

SEQ ID NO: 165501 - protein, 37 aa, Artificial Sequence
  Description of Artificial Sequence: Synthetic polypeptide
VEEEIRTTNPVATEQYGSVVDEENMNLDQLDEQEGGQ

SEQ ID NO: 165502 - protein, 33 aa, Artificial Sequence
  Description of Artificial Sequence: Synthetic polypeptide
DENEIRTTNPVSTETYGTISGMEDIQQQQNGNH

SEQ ID NO: 165503 - protein, 32 aa, Artificial Sequence
  Description of Artificial Sequence: Synthetic polypeptide
DENEIRTTNPVSTETYGTIIMEDIQQQQNGNH

SEQ ID NO: 165504 - protein, 34 aa, Artificial Sequence
  Description of Artificial Sequence: Synthetic polypeptide
VEEEIRTTNPVATEQYGSVVDGFNGEDFEDDEEL

SEQ ID NO: 165505 - protein, 34 aa, Artificial Sequence
  Description of Artificial Sequence: Synthetic polypeptide
DEMEIVTTNPVATEQYGTVCFATDGCPVEFEGND

SEQ ID NO: 165506 - protein, 35 aa, Artificial Sequence
  Description of Artificial Sequence: Synthetic polypeptide
QEEEIATTNPVAYEQWGTVSATNNEPMTRGGNSMT

SEQ ID NO: 165507 - protein, 31 aa, Artificial Sequence
  Description of Artificial Sequence: Synthetic polypeptide
DDSEVASTNPVSTEGYGNCAANTIQSRVGNR

SEQ ID NO: 165508 - protein, 33 aa, Artificial Sequence
  Description of Artificial Sequence: Synthetic polypeptide
DENEIRTTNPVSTESYGTISMEDIQQQQNGQNH

SEQ ID NO: 165509 - protein, 33 aa, Artificial Sequence
  Description of Artificial Sequence: Synthetic polypeptide
DENEIRTTNPVSTESYGTISMEDIQQQQNGNHI

SEQ ID NO: 165510 - protein, 37 aa, Artificial Sequence
  Description of Artificial Sequence: Synthetic polypeptide
VEEEIRTTNPVATEQYGSVVDQQNNVDGQSEGEGGNE

SEQ ID NO: 165511 - protein, 31 aa, Artificial Sequence
  Description of Artificial Sequence: Synthetic polypeptide
QEEEIATTNPVAYEQWGESYMVEEQHGEEGH

SEQ ID NO: 165512 - protein, 34 aa, Artificial Sequence
  Description of Artificial Sequence: Synthetic polypeptide
DEMEIVTTNPVATEQYGTVCFATDGPVEQFEGQD

SEQ ID NO: 165513 - protein, 35 aa, Artificial Sequence
  Description of Artificial Sequence: Synthetic polypeptide
DEDEIATTNPVATEQYGSVCAATPGVQDAQMGDAM

SEQ ID NO: 165514 - protein, 34 aa, Artificial Sequence
  Description of Artificial Sequence: Synthetic polypeptide
QEEEIATTNPVAYEQWGSVCGNPPLMDDMGGGNY

SEQ ID NO: 165515 - protein, 36 aa, Artificial Sequence
  Description of Artificial Sequence: Synthetic polypeptide
DETEIATTNPVATEQYGSVCSPAGNNGQEADNNEHT

SEQ ID NO: 165516 - protein, 32 aa, Artificial Sequence
  Description of Artificial Sequence: Synthetic polypeptide
DENEIRTTNPVSTERYGTISMEDIQQQQNYNH

SEQ ID NO: 165517 - protein, 34 aa, Artificial Sequence
  Description of Artificial Sequence: Synthetic polypeptide
DEAEIRTTNPVATEQYGSVHLIDWLNTVEDEEQN

SEQ ID NO: 165518 - protein, 35 aa, Artificial Sequence
  Description of Artificial Sequence: Synthetic polypeptide
DEDEIATTNPVATEQYGSVCAATMHGEQDSGGSDQ

SEQ ID NO: 165519 - protein, 36 aa, Artificial Sequence
  Description of Artificial Sequence: Synthetic polypeptide
DEDEIATTNPVATEQYGSVCAATMHGEQDSDGSDRM

SEQ ID NO: 165520 - protein, 35 aa, Artificial Sequence
  Description of Artificial Sequence: Synthetic polypeptide
DETEIATTNPVATEQYGSVCAPGNLENDDLDGAQA

SEQ ID NO: 165521 - protein, 33 aa, Artificial Sequence
  Description of Artificial Sequence: Synthetic polypeptide
DENEIRTTNPVSTEPYGTYISMEDIQQQQNGNH

SEQ ID NO: 165522 - protein, 37 aa, Artificial Sequence
  Description of Artificial Sequence: Synthetic polypeptide
DEEEIRTTNPVATEQYGCVCSNWEEHNQENFGSQNQS

SEQ ID NO: 165523 - protein, 34 aa, Artificial Sequence
  Description of Artificial Sequence: Synthetic polypeptide
DEDEIATTNPVATEQYGTVCAANDGPAEDDGNHD

SEQ ID NO: 165524 - protein, 33 aa, Artificial Sequence
  Description of Artificial Sequence: Synthetic polypeptide
DENEISTTNPVATEIYGCVCSWEDNQNFGSDQS

SEQ ID NO: 165525 - protein, 37 aa, Artificial Sequence
  Description of Artificial Sequence: Synthetic polypeptide
DEEEIRTTNPVATEQYGCVCSNTGEHNTENFGSEFQF

SEQ ID NO: 165526 - protein, 37 aa, Artificial Sequence
  Description of Artificial Sequence: Synthetic polypeptide
DEEEIRTTNPVATEQYGCVCSNTGEHNTENFGSEFQY

SEQ ID NO: 165527 - protein, 34 aa, Artificial Sequence
  Description of Artificial Sequence: Synthetic polypeptide
DEMEIVTTNPVATEQWGTVCSCDGPVQDFEGENG

SEQ ID NO: 165528 - protein, 37 aa, Artificial Sequence
  Description of Artificial Sequence: Synthetic polypeptide
DEEEIRTTNPVATEQYGCVCSNTGEHNTEYFNSETQA

SEQ ID NO: 165529 - protein, 34 aa, Artificial Sequence
  Description of Artificial Sequence: Synthetic polypeptide
DEMEIVTTNPVATEQWGTVCSCIGPVQDFEGENG

SEQ ID NO: 165530 - protein, 35 aa, Artificial Sequence
  Description of Artificial Sequence: Synthetic polypeptide
DEDEIATTNPVAYEKWGSVASNDNLGEERNGDNSQ

SEQ ID NO: 165531 - protein, 31 aa, Artificial Sequence
  Description of Artificial Sequence: Synthetic polypeptide
DETEIAPTNPCASEQYGAVWACENWQEPGPI

SEQ ID NO: 165532 - protein, 38 aa, Artificial Sequence
  Description of Artificial Sequence: Synthetic polypeptide
DEEEIRTTNPVATEQYGSVSTTTQQQQNATEQGTTEEE

SEQ ID NO: 165533 - protein, 35 aa, Artificial Sequence
  Description of Artificial Sequence: Synthetic polypeptide
DEQEIATTNPVATEQYGSVCSMNNGNEAMPTDGAN

SEQ ID NO: 165534 - protein, 30 aa, Artificial Sequence
  Description of Artificial Sequence: Synthetic polypeptide
DETEIAPTNPIASECWGAVSCDLASKGPYR

SEQ ID NO: 165535 - protein, 40 aa, Artificial Sequence
  Description of Artificial Sequence: Synthetic polypeptide
DEEEIRTTNPVATEQYGTVSTTNLQYGNNTENGNNNNQNQ

SEQ ID NO: 165536 - protein, 37 aa, Artificial Sequence
  Description of Artificial Sequence: Synthetic polypeptide
AEEEIRTTNPVATEQYGSVVTVNTNNDESGTVNNNTQ

SEQ ID NO: 165537 - protein, 36 aa, Artificial Sequence
  Description of Artificial Sequence: Synthetic polypeptide
DEEEIRTTNPVATEQYGCVCSNTGEHQEYFPSDTQS

SEQ ID NO: 165538 - protein, 30 aa, Artificial Sequence
  Description of Artificial Sequence: Synthetic polypeptide
DETEIAPTNPIATECWGITVSCNWASKGTI

SEQ ID NO: 165539 - protein, 35 aa, Artificial Sequence
  Description of Artificial Sequence: Synthetic polypeptide
DEQEIATTNPVATEQYGSVCSNWGDLEEHFGSEDL

SEQ ID NO: 165540 - protein, 37 aa, Artificial Sequence
  Description of Artificial Sequence: Synthetic polypeptide
AEEEIRTTNPVATEQYGSVVTVNTNNDETGTVNNTTD

SEQ ID NO: 165541 - protein, 34 aa, Artificial Sequence
  Description of Artificial Sequence: Synthetic polypeptide
DEMEIVTTNPVATEQYGATGCSATDGPVEFEGND

SEQ ID NO: 165542 - protein, 35 aa, Artificial Sequence
  Description of Artificial Sequence: Synthetic polypeptide
TEEEIRTTNPVAYEQWGQVSSCTNMESADPGSYRA

SEQ ID NO: 165543 - protein, 36 aa, Artificial Sequence
  Description of Artificial Sequence: Synthetic polypeptide
DEEEIRTTNPVAYEQYGQCVCSTWADHNQNFGSEQA

SEQ ID NO: 165544 - protein, 35 aa, Artificial Sequence
  Description of Artificial Sequence: Synthetic polypeptide
DEEEISTTNPVATEQYGCVCGSGEHNAENFGSEQA

SEQ ID NO: 165545 - protein, 33 aa, Artificial Sequence
  Description of Artificial Sequence: Synthetic polypeptide
AEEEICTTNPVATEQYGVVATEVGEQNEEEEDD

SEQ ID NO: 165546 - protein, 36 aa, Artificial Sequence
  Description of Artificial Sequence: Synthetic polypeptide
TEEEIRTTNPVAYEQWGHSTVCYTNAPSHRPGGNFC

SEQ ID NO: 165547 - protein, 34 aa, Artificial Sequence
  Description of Artificial Sequence: Synthetic polypeptide
TEEEIRTTNPVAYEQWGEYWSPRNDDEQRQDIVR

SEQ ID NO: 165548 - protein, 35 aa, Artificial Sequence
  Description of Artificial Sequence: Synthetic polypeptide
DEEEISTTNPVATEQYGCVCGTGEHNAFFNSENQA

SEQ ID NO: 165549 - protein, 33 aa, Artificial Sequence
  Description of Artificial Sequence: Synthetic polypeptide
AEEEICTTNPVATEQYGVVATEQVAEQGEEEED

SEQ ID NO: 165550 - protein, 31 aa, Artificial Sequence
  Description of Artificial Sequence: Synthetic polypeptide
QEEEIATTNPVATEQYGATAPNEDCAHKEEK

SEQ ID NO: 165551 - protein, 34 aa, Artificial Sequence
  Description of Artificial Sequence: Synthetic polypeptide
DEDEIATTNPVAYEKWGSVSGEGNGNHGNGQNHR

SEQ ID NO: 165552 - protein, 33 aa, Artificial Sequence
  Description of Artificial Sequence: Synthetic polypeptide
DEMEIVTTNPVATEQWGTVCSCDGPVEFEGENG

SEQ ID NO: 165553 - protein, 32 aa, Artificial Sequence
  Description of Artificial Sequence: Synthetic polypeptide
QEEEIATTNPVATEQYGCAPEHGTDSVEGEKK

SEQ ID NO: 165554 - protein, 34 aa, Artificial Sequence
  Description of Artificial Sequence: Synthetic polypeptide
DEMEIVTTNPVATEQWGTTVCSATEGPVEPEGND

SEQ ID NO: 165555 - protein, 37 aa, Artificial Sequence
  Description of Artificial Sequence: Synthetic polypeptide
DEEEIRTTNPVATEQYGCVCSNTGEHNAENFNSDNQL

SEQ ID NO: 165556 - protein, 33 aa, Artificial Sequence
  Description of Artificial Sequence: Synthetic polypeptide
DEMEIVTTNPVATEQWGTVCAATDGPVAFEGND

SEQ ID NO: 165557 - protein, 37 aa, Artificial Sequence
  Description of Artificial Sequence: Synthetic polypeptide
DEEEIRTTNPVATEQYGCVCSNTGEHNIENFNSDPQS

SEQ ID NO: 165558 - protein, 37 aa, Artificial Sequence
  Description of Artificial Sequence: Synthetic polypeptide
DEEEIRTTNPVATEQYGCVCSNTGEHNIENFNSDTQI

SEQ ID NO: 165559 - protein, 36 aa, Artificial Sequence
  Description of Artificial Sequence: Synthetic polypeptide
DEEEIRTTNPVATEQYGCVCSNTGEHNIENFPSEQP

SEQ ID NO: 165560 - protein, 37 aa, Artificial Sequence
  Description of Artificial Sequence: Synthetic polypeptide
DEEEIRTTNPVATEQYGCVCSNTGEHNQEFFISDNQE

SEQ ID NO: 165561 - protein, 34 aa, Artificial Sequence
  Description of Artificial Sequence: Synthetic polypeptide
DEMEIVTTNPVATEQWGTVCSATDGPVEFEGNDA

SEQ ID NO: 165562 - protein, 37 aa, Artificial Sequence
  Description of Artificial Sequence: Synthetic polypeptide
DEEEIRTTNPVATEQYGCVCSNTGEHNQENFGSETQL

SEQ ID NO: 165563 - protein, 34 aa, Artificial Sequence
  Description of Artificial Sequence: Synthetic polypeptide
DEMEIVTTNPVATEQWGTVCSATDGPVENFEGND

SEQ ID NO: 165564 - protein, 37 aa, Artificial Sequence
  Description of Artificial Sequence: Synthetic polypeptide
DEEEIRTTNPVATEQYGCVCSNTGEHNQENFISNNQP

SEQ ID NO: 165565 - protein, 37 aa, Artificial Sequence
  Description of Artificial Sequence: Synthetic polypeptide
AEEEIRTTNPVATEQYGSVVTVNTNNNDEAGTVNNTD

SEQ ID NO: 165566 - protein, 32 aa, Artificial Sequence
  Description of Artificial Sequence: Synthetic polypeptide
QEEEIATTNPVATEQYGCAPAMHGQDSEGEKH

SEQ ID NO: 165567 - protein, 31 aa, Artificial Sequence
  Description of Artificial Sequence: Synthetic polypeptide
QEEEIATTNPVATEQYGCAPAEHGQDSEEKS

SEQ ID NO: 165568 - protein, 33 aa, Artificial Sequence
  Description of Artificial Sequence: Synthetic polypeptide
QEEEIATTNPVATEQYGCANPAMHGQDSEGENN

SEQ ID NO: 165569 - protein, 35 aa, Artificial Sequence
  Description of Artificial Sequence: Synthetic polypeptide
DEEEISTTNPVATEQYGCTCSWNEHNQNFNSDTQS

SEQ ID NO: 165570 - protein, 36 aa, Artificial Sequence
  Description of Artificial Sequence: Synthetic polypeptide
DEEEIRTTNPVATEQYGCVCSNTGEHNQESFISDQG

SEQ ID NO: 165571 - protein, 37 aa, Artificial Sequence
  Description of Artificial Sequence: Synthetic polypeptide
DEEEIRTTNPVATEQYGCVCSNTGEHNQEYFNSDTQA

SEQ ID NO: 165572 - protein, 37 aa, Artificial Sequence
  Description of Artificial Sequence: Synthetic polypeptide
DEEEIRTTNPVATEQYGCVCSNTGEHNQEYFNSDTQE

SEQ ID NO: 165573 - protein, 34 aa, Artificial Sequence
  Description of Artificial Sequence: Synthetic polypeptide
DEEEISTTNPVATEQYGCVCETGEHANFNSDTQP

SEQ ID NO: 165574 - protein, 38 aa, Artificial Sequence
  Description of Artificial Sequence: Synthetic polypeptide
DEEEIRTTNPVATEAYGVVSTTNQQQGNNQQSNTEQGS

SEQ ID NO: 165575 - protein, 35 aa, Artificial Sequence
  Description of Artificial Sequence: Synthetic polypeptide
DEEEISTTNPVATEQYGCVCGNSGNHAEHFGSDQS

SEQ ID NO: 165576 - protein, 32 aa, Artificial Sequence
  Description of Artificial Sequence: Synthetic polypeptide
QEEEIATTNPVATEQYGAVAGPEGGQGEEQDI

SEQ ID NO: 165577 - protein, 35 aa, Artificial Sequence
  Description of Artificial Sequence: Synthetic polypeptide
DEEEISTTNPVATEQYGCVCGNWEHEQENFGSDQN

SEQ ID NO: 165578 - protein, 34 aa, Artificial Sequence
  Description of Artificial Sequence: Synthetic polypeptide
TEEEIRTTNPVAYEQYGIQVSTTGCEWSAQVTEF

SEQ ID NO: 165579 - protein, 37 aa, Artificial Sequence
  Description of Artificial Sequence: Synthetic polypeptide
DEEEIRTTNPVATEQYGCVCSNTGEHNQENFNSDTQS

SEQ ID NO: 165580 - protein, 35 aa, Artificial Sequence
  Description of Artificial Sequence: Synthetic polypeptide
TEEEIRTTNPVAYEPYGTVVSLTANHDQDPGSSEK

SEQ ID NO: 165581 - protein, 34 aa, Artificial Sequence
  Description of Artificial Sequence: Synthetic polypeptide
DEMEIVTTNPVATEQYGATVCSAYDGGHEFEGND

SEQ ID NO: 165582 - protein, 37 aa, Artificial Sequence
  Description of Artificial Sequence: Synthetic polypeptide
QEEEIATTNPVATEQWGSVSATPNPQVADAGGDNNDD

SEQ ID NO: 165583 - protein, 34 aa, Artificial Sequence
  Description of Artificial Sequence: Synthetic polypeptide
AEEEICTTNPVATEQYGVVATVEQVTEQGEEETE

SEQ ID NO: 165584 - protein, 33 aa, Artificial Sequence
  Description of Artificial Sequence: Synthetic polypeptide
AEEEICTTNPVATEQYGVVATVEVAEQGEEEED

SEQ ID NO: 165585 - protein, 34 aa, Artificial Sequence
  Description of Artificial Sequence: Synthetic polypeptide
DEMEIVTTNPVATEQYGCTVCNATDGPVEFEGND

SEQ ID NO: 165586 - protein, 40 aa, Artificial Sequence
  Description of Artificial Sequence: Synthetic polypeptide
DEEEIRTTNPVATEQYGSVSTTTNNNNQNNQAGTEQGNTD

SEQ ID NO: 165587 - protein, 33 aa, Artificial Sequence
  Description of Artificial Sequence: Synthetic polypeptide
DEDEIATTNPVAYECWGSVCSTWNGIDGGGTDG

SEQ ID NO: 165588 - protein, 33 aa, Artificial Sequence
  Description of Artificial Sequence: Synthetic polypeptide
AEEEICTTNPVATEQYGVVATVEVGEQGEEEDE

SEQ ID NO: 165589 - protein, 30 aa, Artificial Sequence
  Description of Artificial Sequence: Synthetic polypeptide
QEEEIATTNPVATEQWGEAPEVCPQDHEEK

SEQ ID NO: 165590 - protein, 32 aa, Artificial Sequence
  Description of Artificial Sequence: Synthetic polypeptide
DETEIATTNPIATECWGATTANDEDLQPGNYI

SEQ ID NO: 165591 - protein, 29 aa, Artificial Sequence
  Description of Artificial Sequence: Synthetic peptide
QEEEIATTNPVATEQWGEAPEVCAHKEEK

SEQ ID NO: 165592 - protein, 36 aa, Artificial Sequence
  Description of Artificial Sequence: Synthetic polypeptide
DEDEIATTNPVAYECWGSVASNDNNLGNERNGDNDR

SEQ ID NO: 165593 - protein, 29 aa, Artificial Sequence
  Description of Artificial Sequence: Synthetic peptide
QEEEIATTNPVATEQWGEAPEICMNHEEA

SEQ ID NO: 165594 - protein, 36 aa, Artificial Sequence
  Description of Artificial Sequence: Synthetic polypeptide
DEEEIRTTNPVATEQYGSVSTTTEMFMEPVSEEPDN

SEQ ID NO: 165595 - protein, 31 aa, Artificial Sequence
  Description of Artificial Sequence: Synthetic polypeptide
DDSEVASTNPVSTEGYGHVAANGIQSRVGQR

SEQ ID NO: 165596 - protein, 29 aa, Artificial Sequence
  Description of Artificial Sequence: Synthetic peptide
QEEEIATTNPVATEQWGEAPAVCAHKEEK

SEQ ID NO: 165597 - protein, 32 aa, Artificial Sequence
  Description of Artificial Sequence: Synthetic polypeptide
DETEIATTNPIATECWGATTSNDEDLQSGNYI

SEQ ID NO: 165598 - protein, 34 aa, Artificial Sequence
  Description of Artificial Sequence: Synthetic polypeptide
AEEEICTTNPVATEQYGVVATVEVGEQQGEDEEE

SEQ ID NO: 165599 - protein, 36 aa, Artificial Sequence
  Description of Artificial Sequence: Synthetic polypeptide
DESEIRTTNPVATECWGSVVSCLGHEESQDREGENG

SEQ ID NO: 165600 - protein, 33 aa, Artificial Sequence
  Description of Artificial Sequence: Synthetic polypeptide
AEEEICTTNPVATEQYGVVATVEVTEQNEEDED

SEQ ID NO: 165601 - protein, 34 aa, Artificial Sequence
  Description of Artificial Sequence: Synthetic polypeptide
AEEEICTTNPVATEQYGVVATVGNVGEQGTEDEE

SEQ ID NO: 165602 - protein, 35 aa, Artificial Sequence
  Description of Artificial Sequence: Synthetic polypeptide
AEEEICTTNPVATEQYGVVATVLEQGAEQGETEDE

SEQ ID NO: 165603 - protein, 31 aa, Artificial Sequence
  Description of Artificial Sequence: Synthetic polypeptide
DDSEVASTNPVSTEGYGHVAANTIQSRVGQR

SEQ ID NO: 165604 - protein, 35 aa, Artificial Sequence
  Description of Artificial Sequence: Synthetic polypeptide
AEEEICTTNPVATEQYGVVATVLEQVAEQGETEED

SEQ ID NO: 165605 - protein, 35 aa, Artificial Sequence
  Description of Artificial Sequence: Synthetic polypeptide
AEEEICTTNPVATEQYGVVATVLEQVAEQGTEEEE

SEQ ID NO: 165606 - protein, 35 aa, Artificial Sequence
  Description of Artificial Sequence: Synthetic polypeptide
AEEEICTTNPVATEQYGVVATVLEQVAEQGTTEDE

SEQ ID NO: 165607 - protein, 36 aa, Artificial Sequence
  Description of Artificial Sequence: Synthetic polypeptide
DEMEIVTTNPVATEQYGCVCSMTGEPNEFFGSDNQA

SEQ ID NO: 165608 - protein, 36 aa, Artificial Sequence
  Description of Artificial Sequence: Synthetic polypeptide
DEAEIRTTNPVATEQYGSVWWCTDLTQPESLQDKMN

SEQ ID NO: 165609 - protein, 32 aa, Artificial Sequence
  Description of Artificial Sequence: Synthetic polypeptide
DETEIATTNPIATECWGATTSNDEDLQPGNYI

SEQ ID NO: 165610 - protein, 30 aa, Artificial Sequence
  Description of Artificial Sequence: Synthetic polypeptide
QEEEIATTNPVATEQYGCAPEHGTDSWEEK

SEQ ID NO: 165611 - protein, 31 aa, Artificial Sequence
  Description of Artificial Sequence: Synthetic polypeptide
DETEIATTNPIASECWGAVSCEDLASKGPYR

SEQ ID NO: 165612 - protein, 34 aa, Artificial Sequence
  Description of Artificial Sequence: Synthetic polypeptide
AEEEICTTNPVATEQYGVVATVEQVGEQGTEDEE

SEQ ID NO: 165613 - protein, 37 aa, Artificial Sequence
  Description of Artificial Sequence: Synthetic polypeptide
AEEEIRTTNPVATEQYGSVVTVNTNNSESGSVNNVTT

SEQ ID NO: 165614 - protein, 34 aa, Artificial Sequence
  Description of Artificial Sequence: Synthetic polypeptide
DEEEISTTNPVATEQYGCVCGTTGEHAFFGSEQS

SEQ ID NO: 165615 - protein, 37 aa, Artificial Sequence
  Description of Artificial Sequence: Synthetic polypeptide
AEEEIRTTNPVATEQYGSVVTVNTNNVESGSVNNVTT

SEQ ID NO: 165616 - protein, 35 aa, Artificial Sequence
  Description of Artificial Sequence: Synthetic polypeptide
DEMEIVTTNPVATEQYGAVCSATDGDPVEFEGNEY

SEQ ID NO: 165617 - protein, 35 aa, Artificial Sequence
  Description of Artificial Sequence: Synthetic polypeptide
AEEEICTTNPVATEQYGVVATTLEQVAEQGTEEGE

SEQ ID NO: 165618 - protein, 35 aa, Artificial Sequence
  Description of Artificial Sequence: Synthetic polypeptide
DEMEIVTTNPVATEQYGAVCSATDGPVEFEGENYN

SEQ ID NO: 165619 - protein, 34 aa, Artificial Sequence
  Description of Artificial Sequence: Synthetic polypeptide
DESEIRTTNPVATECWGSVYSCINEPQDTEFEGG

SEQ ID NO: 165620 - protein, 34 aa, Artificial Sequence
  Description of Artificial Sequence: Synthetic polypeptide
DEMEIVTTNPVATEQYGAVCSATDGPVEFEGPYD

SEQ ID NO: 165621 - protein, 34 aa, Artificial Sequence
  Description of Artificial Sequence: Synthetic polypeptide
QEEEIATTNPVATEQWGHCNVAATNGLFHDSGGF

SEQ ID NO: 165622 - protein, 31 aa, Artificial Sequence
  Description of Artificial Sequence: Synthetic polypeptide
DDSEVASTNPVSTEGYGFVAANTIQSRVGQR

SEQ ID NO: 165623 - protein, 34 aa, Artificial Sequence
  Description of Artificial Sequence: Synthetic polypeptide
AEEEICTTNPVATEQYGVVATVEGVEQGEDEGED

SEQ ID NO: 165624 - protein, 33 aa, Artificial Sequence
  Description of Artificial Sequence: Synthetic polypeptide
AEEEICTTNPVATEQYGVVATVEGVEQGEEEED

SEQ ID NO: 165625 - protein, 31 aa, Artificial Sequence
  Description of Artificial Sequence: Synthetic polypeptide
DETEIATTNPCSTEQYGIVANANWAESKGTI

SEQ ID NO: 165626 - protein, 40 aa, Artificial Sequence
  Description of Artificial Sequence: Synthetic polypeptide
DEEEIRTTNPVATEQYGTVSTTNLQYGNNNNLGNNNNQNQ

SEQ ID NO: 165627 - protein, 33 aa, Artificial Sequence
  Description of Artificial Sequence: Synthetic polypeptide
AEEEICTTNPVATEQYGVVATVEGVTEQGEDEE

SEQ ID NO: 165628 - protein, 30 aa, Artificial Sequence
  Description of Artificial Sequence: Synthetic polypeptide
QEEEIATTNPVATEQWGEVPEVCMNAAEEA

SEQ ID NO: 165629 - protein, 34 aa, Artificial Sequence
  Description of Artificial Sequence: Synthetic polypeptide
DEEEISTTNPVATEQYGCVCGWGEHNQNFGSEQD

SEQ ID NO: 165630 - protein, 34 aa, Artificial Sequence
  Description of Artificial Sequence: Synthetic polypeptide
DEEEISTTNPVATEQYGCVCGWGEHNQNFNSDQA

SEQ ID NO: 165631 - protein, 34 aa, Artificial Sequence
  Description of Artificial Sequence: Synthetic polypeptide
AEEEICTTNPVATEQYGVVATVEQVAEQGEEEED

SEQ ID NO: 165632 - protein, 35 aa, Artificial Sequence
  Description of Artificial Sequence: Synthetic polypeptide
DEEEISTTNPVATEQYGCVCNNWGEHNQNFNSDQS

SEQ ID NO: 165633 - protein, 34 aa, Artificial Sequence
  Description of Artificial Sequence: Synthetic polypeptide
DETEIATTNPCAYEHWGSVCSTWNGDERQGQNDH

SEQ ID NO: 165634 - protein, 34 aa, Artificial Sequence
  Description of Artificial Sequence: Synthetic polypeptide
AEEEICTTNPVATEQYGVVATVEQVAEQGEETET

SEQ ID NO: 165635 - protein, 34 aa, Artificial Sequence
  Description of Artificial Sequence: Synthetic polypeptide
DEEEISTTNPVATEQYGCVCPWEHEQENFGSDQS

SEQ ID NO: 165636 - protein, 35 aa, Artificial Sequence
  Description of Artificial Sequence: Synthetic polypeptide
DEQEIATTNPVATEQYGSVIATLDLNEDHQGLEDE

SEQ ID NO: 165637 - protein, 33 aa, Artificial Sequence
  Description of Artificial Sequence: Synthetic polypeptide
DETEIATTNPCAYEQWGSVSGGGNHQDQQNGEE

SEQ ID NO: 165638 - protein, 34 aa, Artificial Sequence
  Description of Artificial Sequence: Synthetic polypeptide
AEEEICTTNPVATEQYGVVATVEQVGEEQGEEEE

SEQ ID NO: 165639 - protein, 34 aa, Artificial Sequence
  Description of Artificial Sequence: Synthetic polypeptide
AEEEICTTNPVATEQYGVVATVEGVEQQGEDEEE

SEQ ID NO: 165640 - protein, 33 aa, Artificial Sequence
  Description of Artificial Sequence: Synthetic polypeptide
DEMEIVTTNPVATEQWGTTCSATDGPVEFEGND

SEQ ID NO: 165641 - protein, 37 aa, Artificial Sequence
  Description of Artificial Sequence: Synthetic polypeptide
DETEIACTNPVATEQYGSVCSTPNPQPNEAGIGNADD

SEQ ID NO: 165642 - protein, 34 aa, Artificial Sequence
  Description of Artificial Sequence: Synthetic polypeptide
AEEEIATTNPVAYEQWGTVCAATAGQDPDSGPNR

SEQ ID NO: 165643 - protein, 32 aa, Artificial Sequence
  Description of Artificial Sequence: Synthetic polypeptide
QEEEIATTNPVATEQYGCVAPGEHGQDSEEKT

SEQ ID NO: 165644 - protein, 37 aa, Artificial Sequence
  Description of Artificial Sequence: Synthetic polypeptide
VEEEIRTTNPVATEQYGSVSLTPWLIPVSQPPEEQLV

SEQ ID NO: 165645 - protein, 34 aa, Artificial Sequence
  Description of Artificial Sequence: Synthetic polypeptide
DEMEIVTTNPVATEGYGTVCSATDGPVEFEGNND

SEQ ID NO: 165646 - protein, 37 aa, Artificial Sequence
  Description of Artificial Sequence: Synthetic polypeptide
DEEEIRTTNPVATEQYGSVMGGLNTDTQENGGEGQTQ

SEQ ID NO: 165647 - protein, 40 aa, Artificial Sequence
  Description of Artificial Sequence: Synthetic polypeptide
DEEEIRTTNPVATEQYGTVSTVNLQLNNTTEQGTNNVATE

SEQ ID NO: 165648 - protein, 34 aa, Artificial Sequence
  Description of Artificial Sequence: Synthetic polypeptide
DESEIRTTNPVATECWGVVLVPINEPQDREGEVG

SEQ ID NO: 165649 - protein, 36 aa, Artificial Sequence
  Description of Artificial Sequence: Synthetic polypeptide
DETEIACTNPVATEQYGSACSVGNDQNDSGNDEMRM

SEQ ID NO: 165650 - protein, 35 aa, Artificial Sequence
  Description of Artificial Sequence: Synthetic polypeptide
TEEEISTTNPVATEQYGCVCNTGELNQYFGSDTQA

SEQ ID NO: 165651 - protein, 35 aa, Artificial Sequence
  Description of Artificial Sequence: Synthetic polypeptide
TEEEISTTNPVATEQYGCVCNTGEHNQYFGSNTQS

SEQ ID NO: 165652 - protein, 33 aa, Artificial Sequence
  Description of Artificial Sequence: Synthetic polypeptide
DEMEIVTTNPVATEIYGTVCSARDGPVEFEGND

SEQ ID NO: 165653 - protein, 39 aa, Artificial Sequence
  Description of Artificial Sequence: Synthetic polypeptide
DEEEIRTTNPVATEAYGTVTNLQSGTIGTNLQNQEQGNA

SEQ ID NO: 165654 - protein, 37 aa, Artificial Sequence
  Description of Artificial Sequence: Synthetic polypeptide
VEEEIRTTNPVATEQYGSVSLTPWLNVVSQPTEEQLF

SEQ ID NO: 165655 - protein, 36 aa, Artificial Sequence
  Description of Artificial Sequence: Synthetic polypeptide
DEEEIRTTNPVAYEQYGQCVCSTGEHNQNFNSDNQA

SEQ ID NO: 165656 - protein, 31 aa, Artificial Sequence
  Description of Artificial Sequence: Synthetic polypeptide
DDSEVASTNPVSTEGYGEVAANNIQSRVGQR

SEQ ID NO: 165657 - protein, 35 aa, Artificial Sequence
  Description of Artificial Sequence: Synthetic polypeptide
DEEEIATTNPVATEQYGSACAANNIETEAEGGNTD

SEQ ID NO: 165658 - protein, 31 aa, Artificial Sequence
  Description of Artificial Sequence: Synthetic polypeptide
DDSEVASTNPVSTEGYGEVAANTIQSRVGQR

SEQ ID NO: 165659 - protein, 33 aa, Artificial Sequence
  Description of Artificial Sequence: Synthetic polypeptide
DEMEIVTTNPVATELYGTVCSACDGPVEFEGND

SEQ ID NO: 165660 - protein, 38 aa, Artificial Sequence
  Description of Artificial Sequence: Synthetic polypeptide
DEEEIRTTNPVATEAYGTVSTVVNSQIGTTSISTTGNT

SEQ ID NO: 165661 - protein, 37 aa, Artificial Sequence
  Description of Artificial Sequence: Synthetic polypeptide
DEMEIRTTNPVATEQYGSHSSTTPAMPNMENGMNPVN

SEQ ID NO: 165662 - protein, 39 aa, Artificial Sequence
  Description of Artificial Sequence: Synthetic polypeptide
DEEEIRTTNPVATEQYGVVSTVVNDNLQLNQNATEQGSE

SEQ ID NO: 165663 - protein, 34 aa, Artificial Sequence
  Description of Artificial Sequence: Synthetic polypeptide
DEMEIVTTNPVATEMYGTIVCSATDGPVEFEGND

SEQ ID NO: 165664 - protein, 35 aa, Artificial Sequence
  Description of Artificial Sequence: Synthetic polypeptide
QEEEIATTNPVATEQYGCVAATNHLTWGTPIGEEE

SEQ ID NO: 165665 - protein, 37 aa, Artificial Sequence
  Description of Artificial Sequence: Synthetic polypeptide
DEEEIRTTNPVAYEQYGQCVCSTGNHNQENFNSENQG

SEQ ID NO: 165666 - protein, 34 aa, Artificial Sequence
  Description of Artificial Sequence: Synthetic polypeptide
DEMEIVTTNPVATENYGTVCSATDGTPVEFEGND

SEQ ID NO: 165667 - protein, 35 aa, Artificial Sequence
  Description of Artificial Sequence: Synthetic polypeptide
QEEEIATTNPVATEQYGCVAANGNPLNADGGGDNH

SEQ ID NO: 165668 - protein, 38 aa, Artificial Sequence
  Description of Artificial Sequence: Synthetic polypeptide
DEEEIRTTNPVATEAYGVVSTTNQQQGNNQQGGTEEGS

SEQ ID NO: 165669 - protein, 31 aa, Artificial Sequence
  Description of Artificial Sequence: Synthetic polypeptide
DDSEVASTNPVSTEGYGEVAANTIQDRVGQR

SEQ ID NO: 165670 - protein, 32 aa, Artificial Sequence
  Description of Artificial Sequence: Synthetic polypeptide
QEEEIATTNPVATEQYGCSCPWYDNQHISEQG

SEQ ID NO: 165671 - protein, 36 aa, Artificial Sequence
  Description of Artificial Sequence: Synthetic polypeptide
AEEEIATTNPVATEQYGSVSSTTPAGPNMRNGMGPV

SEQ ID NO: 165672 - protein, 40 aa, Artificial Sequence
  Description of Artificial Sequence: Synthetic polypeptide
DEEEIRTTNPVATEQYGTVSTVNLQLNQVTEQGTNNTTTE

SEQ ID NO: 165673 - protein, 34 aa, Artificial Sequence
  Description of Artificial Sequence: Synthetic polypeptide
DDECIRTTNPVATEQYGCVCSWMEHNQNFNSDLA

SEQ ID NO: 165674 - protein, 36 aa, Artificial Sequence
  Description of Artificial Sequence: Synthetic polypeptide
DEEEIRTTNPVATEQYGCVCSNTEEDAEFFNSDNQS

SEQ ID NO: 165675 - protein, 32 aa, Artificial Sequence
  Description of Artificial Sequence: Synthetic polypeptide
AEEEIATTNPVATEQYGCYTPWEDQEHFNSEQ

SEQ ID NO: 165676 - protein, 38 aa, Artificial Sequence
  Description of Artificial Sequence: Synthetic polypeptide
DEEEIRTTNPVATEQYGCVCSNTEEDHNQEAFGSENQS

SEQ ID NO: 165677 - protein, 37 aa, Artificial Sequence
  Description of Artificial Sequence: Synthetic polypeptide
DEEEIRTTNPVATEQYGCVCSNTEEDHNQEGFGSDQT

SEQ ID NO: 165678 - protein, 37 aa, Artificial Sequence
  Description of Artificial Sequence: Synthetic polypeptide
DEEEIRTTNPVATEQYGCVCSNTEEDHNQENFGSDQA

SEQ ID NO: 165679 - protein, 37 aa, Artificial Sequence
  Description of Artificial Sequence: Synthetic polypeptide
DEEEIRTTNPVATEQYGCVCSNTEEDHNQENFGSDQG

SEQ ID NO: 165680 - protein, 31 aa, Artificial Sequence
  Description of Artificial Sequence: Synthetic polypeptide
QEEEIATTNPVATEQYGCYCPWEDNQHNEQA

SEQ ID NO: 165681 - protein, 37 aa, Artificial Sequence
  Description of Artificial Sequence: Synthetic polypeptide
DEEEIRTTNPVATEQYGCVCSNTEEDNQEFFNSDTQE

SEQ ID NO: 165682 - protein, 30 aa, Artificial Sequence
  Description of Artificial Sequence: Synthetic polypeptide
DDSEVASTNPVSTEGYGDVANCIQSRVGQR

SEQ ID NO: 165683 - protein, 37 aa, Artificial Sequence
  Description of Artificial Sequence: Synthetic polypeptide
DEEEIRTTNPVATEQYGCVCSNTEEHNAEFFNSDTQG

SEQ ID NO: 165684 - protein, 37 aa, Artificial Sequence
  Description of Artificial Sequence: Synthetic polypeptide
DEEEIRTTNPVATEQYGCVCSNTEEHNQEGFGSDTQV

SEQ ID NO: 165685 - protein, 34 aa, Artificial Sequence
  Description of Artificial Sequence: Synthetic polypeptide
DEMEIVTTNPVATEGYGTVCSATDGFPVEFEGND

SEQ ID NO: 165686 - protein, 37 aa, Artificial Sequence
  Description of Artificial Sequence: Synthetic polypeptide
DEEEIRTTNPVATEQYGCVCSNTEEHNQENFGSDTQT

SEQ ID NO: 165687 - protein, 32 aa, Artificial Sequence
  Description of Artificial Sequence: Synthetic polypeptide
QEEEIATTNPVATEQYGCYCGWEDQHFNSEQF

SEQ ID NO: 165688 - protein, 32 aa, Artificial Sequence
  Description of Artificial Sequence: Synthetic polypeptide
AEEEIATTNPVATEQYGEYCPWEDNQHNSENQ

SEQ ID NO: 165689 - protein, 40 aa, Artificial Sequence
  Description of Artificial Sequence: Synthetic polypeptide
DEEEIRTTNPVATEQYGTVSTVNLQQLANTEQGTNNQTTE

SEQ ID NO: 165690 - protein, 36 aa, Artificial Sequence
  Description of Artificial Sequence: Synthetic polypeptide
AEEEIATTNPVATEQYGSACATNPELGQLHQDDQNH

SEQ ID NO: 165691 - protein, 32 aa, Artificial Sequence
  Description of Artificial Sequence: Synthetic polypeptide
TEEGIRTTNPCATEQYGSVPVVPPVPSVVNNQ

SEQ ID NO: 165692 - protein, 40 aa, Artificial Sequence
  Description of Artificial Sequence: Synthetic polypeptide
DEEEIRTTNPVATEQYGTVSTVNLQQGNNTEQGTNQQNTE

SEQ ID NO: 165693 - protein, 40 aa, Artificial Sequence
  Description of Artificial Sequence: Synthetic polypeptide
DEEEIRTTNPVATEQYGTVSTVNLQQGNNTEQGTNNTTTE

SEQ ID NO: 165694 - protein, 40 aa, Artificial Sequence
  Description of Artificial Sequence: Synthetic polypeptide
DEEEIRTTNPVATEQYGTVSTVNLQQGNNTEQGTNNQDTE

SEQ ID NO: 165695 - protein, 40 aa, Artificial Sequence
  Description of Artificial Sequence: Synthetic polypeptide
DEEEIRTTNPVATEQYGTVSTVNLQQGNGTEQGTNNQDTE

SEQ ID NO: 165696 - protein, 34 aa, Artificial Sequence
  Description of Artificial Sequence: Synthetic polypeptide
DETEIACTNPVATEQYGSACSAPNLPEAEAEGHF

SEQ ID NO: 165697 - protein, 35 aa, Artificial Sequence
  Description of Artificial Sequence: Synthetic polypeptide
AEEEIATTNPVATEQYGSVCAAGPLGFAHMGDNEF

SEQ ID NO: 165698 - protein, 35 aa, Artificial Sequence
  Description of Artificial Sequence: Synthetic polypeptide
DEEEISTTNPVATEGYGQCVCSTEEHNQNFGSDQS

SEQ ID NO: 165699 - protein, 37 aa, Artificial Sequence
  Description of Artificial Sequence: Synthetic polypeptide
DEEEIRTTNPVATEQYGCVCSNTEEHNQENFGSETQI

SEQ ID NO: 165700 - protein, 36 aa, Artificial Sequence
  Description of Artificial Sequence: Synthetic polypeptide
AEEEICTTNPVATEQYGVVATVNEQLGEQIGTEDEE

SEQ ID NO: 165701 - protein, 32 aa, Artificial Sequence
  Description of Artificial Sequence: Synthetic polypeptide
QEEEIATTNPVATEQYGCSCPSVDQEHISEQG

SEQ ID NO: 165702 - protein, 36 aa, Artificial Sequence
  Description of Artificial Sequence: Synthetic polypeptide
DETEIACTNPVATEQYGSCSTGDALGQDHQDGDNEW

SEQ ID NO: 165703 - protein, 37 aa, Artificial Sequence
  Description of Artificial Sequence: Synthetic polypeptide
DEEEIRTTNPVATEQYGCVCSNTGEDTNQNFGSETQS

SEQ ID NO: 165704 - protein, 35 aa, Artificial Sequence
  Description of Artificial Sequence: Synthetic polypeptide
DENEISTTNPVATEQYGCVCQTGEHNQNFGSENQA

SEQ ID NO: 165705 - protein, 30 aa, Artificial Sequence
  Description of Artificial Sequence: Synthetic polypeptide
DDSEVASTNPVSTEGYGEVPANTCQHVGQR

SEQ ID NO: 165706 - protein, 36 aa, Artificial Sequence
  Description of Artificial Sequence: Synthetic polypeptide
DEEEISTTNPVATEQYGCQVCSTWEEHQESFNSDQN

SEQ ID NO: 165707 - protein, 37 aa, Artificial Sequence
  Description of Artificial Sequence: Synthetic polypeptide
DEEEIRTTNPVATEQYGCVCSNTGEGHQENFGSDTQQ

SEQ ID NO: 165708 - protein, 32 aa, Artificial Sequence
  Description of Artificial Sequence: Synthetic polypeptide
DEAEIATTNPVAYEQWGSVPGPMLGEDHDGEQ

SEQ ID NO: 165709 - protein, 30 aa, Artificial Sequence
  Description of Artificial Sequence: Synthetic polypeptide
AEEEIATTNPVAYEQWGEAYMVEEQHGEEP

SEQ ID NO: 165710 - protein, 31 aa, Artificial Sequence
  Description of Artificial Sequence: Synthetic polypeptide
DDSEVASTNPVSTEGYGEVSAETIQSRVGQR

SEQ ID NO: 165711 - protein, 33 aa, Artificial Sequence
  Description of Artificial Sequence: Synthetic polypeptide
DEMEIVTTNPVATEQFGTICSATDGPVEFEGND

SEQ ID NO: 165712 - protein, 34 aa, Artificial Sequence
  Description of Artificial Sequence: Synthetic polypeptide
DETEIACTNPVATEQYGSVCAAMNPLNDMDGGEN

SEQ ID NO: 165713 - protein, 34 aa, Artificial Sequence
  Description of Artificial Sequence: Synthetic polypeptide
DEMEIVTTNPVATEQFGTVCSATDGPVEFEGMND

SEQ ID NO: 165714 - protein, 37 aa, Artificial Sequence
  Description of Artificial Sequence: Synthetic polypeptide
DEEEIRTTNPVATEQYGCQVCSNTGEDHNQNFGSEQS

SEQ ID NO: 165715 - protein, 37 aa, Artificial Sequence
  Description of Artificial Sequence: Synthetic polypeptide
DEEEISTTNPVATEQYGCQVCSTGEHNQENFGSDNQY

SEQ ID NO: 165716 - protein, 36 aa, Artificial Sequence
  Description of Artificial Sequence: Synthetic polypeptide
DEAEIRTTNPVATEQYGSVWVTAPNTYTGQGLEVES

SEQ ID NO: 165717 - protein, 36 aa, Artificial Sequence
  Description of Artificial Sequence: Synthetic polypeptide
DETEIACTNPVATEQYGSVCAATGLTAPGEQMEGNH

SEQ ID NO: 165718 - protein, 34 aa, Artificial Sequence
  Description of Artificial Sequence: Synthetic polypeptide
DEMEIVTTNPVATEQWGSVCSACIGPPEDFEGND

SEQ ID NO: 165719 - protein, 36 aa, Artificial Sequence
  Description of Artificial Sequence: Synthetic polypeptide
DEEEISTTNPVATEQYGCSCSWGEPLNQENFNSDQA

SEQ ID NO: 165720 - protein, 33 aa, Artificial Sequence
  Description of Artificial Sequence: Synthetic polypeptide
AEEEIATTNPVAYEQWGSVSGGNGNHSGEGGTS

SEQ ID NO: 165721 - protein, 32 aa, Artificial Sequence
  Description of Artificial Sequence: Synthetic polypeptide
QEEEIATTNPVATEQYGCAPGEHGQDSEGEAN

SEQ ID NO: 165722 - protein, 36 aa, Artificial Sequence
  Description of Artificial Sequence: Synthetic polypeptide
DEEEIRTTNPVATEQYGCVCSNTGEHDQENFISDQD

SEQ ID NO: 165723 - protein, 40 aa, Artificial Sequence
  Description of Artificial Sequence: Synthetic polypeptide
DEEEIRTTNPVATEQYGTVSTVNLQAGNNDEQGTNVTTDD

SEQ ID NO: 165724 - protein, 37 aa, Artificial Sequence
  Description of Artificial Sequence: Synthetic polypeptide
DEEEIRTTNPVATEQYGCQVCSNSGEHNQNFGSENQS

SEQ ID NO: 165725 - protein, 35 aa, Artificial Sequence
  Description of Artificial Sequence: Synthetic polypeptide
DEEEISTTNPVATEQYGCTCSMTEEHNQSIGSDQA

SEQ ID NO: 165726 - protein, 32 aa, Artificial Sequence
  Description of Artificial Sequence: Synthetic polypeptide
AEEEIATTNPVAYEQWGSVTGGNGNSGEGDTT

SEQ ID NO: 165727 - protein, 36 aa, Artificial Sequence
  Description of Artificial Sequence: Synthetic polypeptide
DETEIACTNPVATEQYGSVCATNPQLNPDDQTGGAM

SEQ ID NO: 165728 - protein, 38 aa, Artificial Sequence
  Description of Artificial Sequence: Synthetic polypeptide
DEEEIRTTNPVATEQYGTVSTVNAEQGNNEQGSTEDEE

SEQ ID NO: 165729 - protein, 34 aa, Artificial Sequence
  Description of Artificial Sequence: Synthetic polypeptide
DETEIACTNPVATEQYGSVCAATGLAPGEQMEGA

SEQ ID NO: 165730 - protein, 32 aa, Artificial Sequence
  Description of Artificial Sequence: Synthetic polypeptide
QEEEIATTNPVATEQYGCSCPSADQEHFISEQ

SEQ ID NO: 165731 - protein, 31 aa, Artificial Sequence
  Description of Artificial Sequence: Synthetic polypeptide
QEEEIATTNPVATEQYGCAPMHGTDSEGEDD

SEQ ID NO: 165732 - protein, 37 aa, Artificial Sequence
  Description of Artificial Sequence: Synthetic polypeptide
DEEEIRTTNPVATEQYGCVCSNTGEDNTENFNSDNQS

SEQ ID NO: 165733 - protein, 36 aa, Artificial Sequence
  Description of Artificial Sequence: Synthetic polypeptide
DETEIACTNPVATEQYGSCSTGNALGQDHQDEDNAW

SEQ ID NO: 165734 - protein, 40 aa, Artificial Sequence
  Description of Artificial Sequence: Synthetic polypeptide
DEEEIRTTNPVATEQYGTVSTVNLQLGNNNQNTGTNPATE

SEQ ID NO: 165735 - protein, 36 aa, Artificial Sequence
  Description of Artificial Sequence: Synthetic polypeptide
DEEEIRTTNPVAYEQYGQCVCSTMEHQEHFNSDFQS

SEQ ID NO: 165736 - protein, 37 aa, Artificial Sequence
  Description of Artificial Sequence: Synthetic polypeptide
DEEEIRTTNPVATEQYGCVCSNTGEDDQENFGSDTQS

SEQ ID NO: 165737 - protein, 30 aa, Artificial Sequence
  Description of Artificial Sequence: Synthetic polypeptide
DDSEVASTNPVSTEGYGEVAANVIQHVGQR

SEQ ID NO: 165738 - protein, 32 aa, Artificial Sequence
  Description of Artificial Sequence: Synthetic polypeptide
QEEEIATTNPVATEQYGCNAPGEHGQDSEGEK

SEQ ID NO: 165739 - protein, 38 aa, Artificial Sequence
  Description of Artificial Sequence: Synthetic polypeptide
DEEEIRTTNPVATEQYGCVCSNTGEDHEQENFGSDNQQ

SEQ ID NO: 165740 - protein, 37 aa, Artificial Sequence
  Description of Artificial Sequence: Synthetic polypeptide
DEEEIRTTNPVATEQYGCVCSNTGEDHEQNFGSETFS

SEQ ID NO: 165741 - protein, 33 aa, Artificial Sequence
  Description of Artificial Sequence: Synthetic polypeptide
DEMEIVTTNPVATEPYGTVCGATDGPVEFEGND

SEQ ID NO: 165742 - protein, 38 aa, Artificial Sequence
  Description of Artificial Sequence: Synthetic polypeptide
DEEEIRTTNPVATEQYGCVCSNTGEDHNAESFGSENQA

SEQ ID NO: 165743 - protein, 36 aa, Artificial Sequence
  Description of Artificial Sequence: Synthetic polypeptide
DEAEIRTTNPVATEQYGSVWTSMNNTEETYNQGDDM

SEQ ID NO: 165744 - protein, 37 aa, Artificial Sequence
  Description of Artificial Sequence: Synthetic polypeptide
DEEEIRTTNPVATEQYGCVCSNTGEDHNQEFFNSDQA

SEQ ID NO: 165745 - protein, 32 aa, Artificial Sequence
  Description of Artificial Sequence: Synthetic polypeptide
QEEEIATTNPVATEQYGCAPMHGTDSEGENKV

SEQ ID NO: 165746 - protein, 38 aa, Artificial Sequence
  Description of Artificial Sequence: Synthetic polypeptide
DEEEIRTTNPVATEQYGCVCSNTGEDHNQENFGSDNQA

SEQ ID NO: 165747 - protein, 33 aa, Artificial Sequence
  Description of Artificial Sequence: Synthetic polypeptide
DEMEIVTTNPVATEPYGTVCSATDGPVEFEEND

SEQ ID NO: 165748 - protein, 37 aa, Artificial Sequence
  Description of Artificial Sequence: Synthetic polypeptide
DEEEIRTTNPVATEQYGCVCSNTGEDHNQENFNSQQA

SEQ ID NO: 165749 - protein, 34 aa, Artificial Sequence
  Description of Artificial Sequence: Synthetic polypeptide
DEMEIVTTNPVATEPYGTVCSATDGPVEFEGNDL

SEQ ID NO: 165750 - protein, 37 aa, Artificial Sequence
  Description of Artificial Sequence: Synthetic polypeptide
DEEEIRTTNPVATEQYGCVCSNTGEDHNQENSGSDQA

SEQ ID NO: 165751 - protein, 37 aa, Artificial Sequence
  Description of Artificial Sequence: Synthetic polypeptide
DEEEIRTTNPVATEQYGCVCSNTGEDHNQEYFNSDQA

SEQ ID NO: 165752 - protein, 37 aa, Artificial Sequence
  Description of Artificial Sequence: Synthetic polypeptide
DEEEIRTTNPVATEQYGCVCSNTGEDHNQFFGSDTQA

SEQ ID NO: 165753 - protein, 34 aa, Artificial Sequence
  Description of Artificial Sequence: Synthetic polypeptide
DEMEIVTTNPVATEPYGTVCSATDGPVEFEGNND

SEQ ID NO: 165754 - protein, 33 aa, Artificial Sequence
  Description of Artificial Sequence: Synthetic polypeptide
DEMEIVTTNPVATEPYGTVCSATDGPVEFEGWD

SEQ ID NO: 165755 - protein, 35 aa, Artificial Sequence
  Description of Artificial Sequence: Synthetic polypeptide
DENEISTTNPVATEQYGCVCSTGEHQEYFGSDTQS

SEQ ID NO: 165756 - protein, 34 aa, Artificial Sequence
  Description of Artificial Sequence: Synthetic polypeptide
TEEEIRTTNPVAYEQYGVQVSTVGNEWSVAVTEF

SEQ ID NO: 165757 - protein, 35 aa, Artificial Sequence
  Description of Artificial Sequence: Synthetic polypeptide
DENEISTTNPVATEQYGCVCSTEHNQEHFNSDNQS

SEQ ID NO: 165758 - protein, 37 aa, Artificial Sequence
  Description of Artificial Sequence: Synthetic polypeptide
DEEEIRTTNPVATEQYGCVCSNTGEDNQENFNSDTQS

SEQ ID NO: 165759 - protein, 37 aa, Artificial Sequence
  Description of Artificial Sequence: Synthetic polypeptide
DEEEIRTTNPVATEQYGCVCSNTGEDHNQENFGSQQA

SEQ ID NO: 165760 - protein, 31 aa, Artificial Sequence
  Description of Artificial Sequence: Synthetic polypeptide
DDSEVASTNPVSTEGYGIVAACNIQSRVGQR

SEQ ID NO: 165761 - protein, 35 aa, Artificial Sequence
  Description of Artificial Sequence: Synthetic polypeptide
DEAEIRTTNPVATEQYGSVWWTDITQPESSQDKDN

SEQ ID NO: 165762 - protein, 35 aa, Artificial Sequence
  Description of Artificial Sequence: Synthetic polypeptide
DEEEIATTNPVATEQYGSACAANPAEGQNHQDMQM

SEQ ID NO: 165763 - protein, 36 aa, Artificial Sequence
  Description of Artificial Sequence: Synthetic polypeptide
DEEEISTTNPVATEQYGCVCSNSEEDLQEGFGSDQS

SEQ ID NO: 165764 - protein, 36 aa, Artificial Sequence
  Description of Artificial Sequence: Synthetic polypeptide
DEEEIATTNPVSTEGYGNVSSTNPAGPNMRVGMQPR

SEQ ID NO: 165765 - protein, 36 aa, Artificial Sequence
  Description of Artificial Sequence: Synthetic polypeptide
TEEEIRTTNPVATEQYGSVSVGPGGGNQGGEDGEQQ

SEQ ID NO: 165766 - protein, 34 aa, Artificial Sequence
  Description of Artificial Sequence: Synthetic polypeptide
CEEEIACTNPVATEQYGSACSVANMGQAEDPNEN

SEQ ID NO: 165767 - protein, 35 aa, Artificial Sequence
  Description of Artificial Sequence: Synthetic polypeptide
QEEEIATTNPVATECYGSVSSTTPAGPQHNEMNPV

SEQ ID NO: 165768 - protein, 31 aa, Artificial Sequence
  Description of Artificial Sequence: Synthetic polypeptide
DDSEVASTNPVSTEGYGMVAANTIQSRVGQR

SEQ ID NO: 165769 - protein, 37 aa, Artificial Sequence
  Description of Artificial Sequence: Synthetic polypeptide
DEEEIRTTNPVATEQYGSVMGQPDEGGQNDDDDAGNN

SEQ ID NO: 165770 - protein, 33 aa, Artificial Sequence
  Description of Artificial Sequence: Synthetic polypeptide
DCEEIRATNPVAYEQWGSSYYDEHTHQREGTNV

SEQ ID NO: 165771 - protein, 36 aa, Artificial Sequence
  Description of Artificial Sequence: Synthetic polypeptide
DEEEIRTTNPVATEQYGCVCSNWEDHNAENFNSDQS

SEQ ID NO: 165772 - protein, 36 aa, Artificial Sequence
  Description of Artificial Sequence: Synthetic polypeptide
DEEEIRTTNPVATEQYGCVCSNWEDHNQEFFNSDQS

SEQ ID NO: 165773 - protein, 36 aa, Artificial Sequence
  Description of Artificial Sequence: Synthetic polypeptide
DEEEIATTNPVSTEGYGNVSSTNPTIPNMRVGMQPR

SEQ ID NO: 165774 - protein, 32 aa, Artificial Sequence
  Description of Artificial Sequence: Synthetic polypeptide
DETEIATTNPVATAQWGSVAAGNGFTPNPMGT

SEQ ID NO: 165775 - protein, 35 aa, Artificial Sequence
  Description of Artificial Sequence: Synthetic polypeptide
DEMEIVTTNPVATEQYGQCVCSTWGEPNEFFGSDQ

SEQ ID NO: 165776 - protein, 37 aa, Artificial Sequence
  Description of Artificial Sequence: Synthetic polypeptide
DEEEIRTTNPVATEQYGCVCSNWEDHNQENFGSENQF

SEQ ID NO: 165777 - protein, 33 aa, Artificial Sequence
  Description of Artificial Sequence: Synthetic polypeptide
DETEIATTNPVATAQWGSVAAGNLFTPNPMGPP

SEQ ID NO: 165778 - protein, 36 aa, Artificial Sequence
  Description of Artificial Sequence: Synthetic polypeptide
DEEEIRTTNPVATEQYGCVCSNWEDHNQNFGSETQS

SEQ ID NO: 165779 - protein, 36 aa, Artificial Sequence
  Description of Artificial Sequence: Synthetic polypeptide
DEEEIRTTNPVATEQYGCVCSNWEDHNTENFNSDQT

SEQ ID NO: 165780 - protein, 38 aa, Artificial Sequence
  Description of Artificial Sequence: Synthetic polypeptide
DEEEIRTTNPVATEQYGTVSTQGNSDIGTTSISTTGNT

SEQ ID NO: 165781 - protein, 35 aa, Artificial Sequence
  Description of Artificial Sequence: Synthetic polypeptide
DESEIRTTNPVATECWGSVSSCIAEPNMRNGENPV

SEQ ID NO: 165782 - protein, 35 aa, Artificial Sequence
  Description of Artificial Sequence: Synthetic polypeptide
DESEIRTTNPVATECWGSVSSCIAEPNMRNGENPG

SEQ ID NO: 165783 - protein, 38 aa, Artificial Sequence
  Description of Artificial Sequence: Synthetic polypeptide
DEEEIRTTNPVATEQYGTVSTNVATEQYGTSTTQQGQD

SEQ ID NO: 165784 - protein, 33 aa, Artificial Sequence
  Description of Artificial Sequence: Synthetic polypeptide
AEECISTTNPVATEQYGCVCSWMEHNQNGSDQS

SEQ ID NO: 165785 - protein, 36 aa, Artificial Sequence
  Description of Artificial Sequence: Synthetic polypeptide
DEEEISTTNPVATEQYGCVCSNSEETNQENFGSEQS

SEQ ID NO: 165786 - protein, 36 aa, Artificial Sequence
  Description of Artificial Sequence: Synthetic polypeptide
DEEEISTTNPVATEQYGCVCSNSEHNAEFFGSDNQD

SEQ ID NO: 165787 - protein, 39 aa, Artificial Sequence
  Description of Artificial Sequence: Synthetic polypeptide
DEEEIRTTNPVATEQYGSVSTTNQQQQNGTTEQGVTEDE

SEQ ID NO: 165788 - protein, 35 aa, Artificial Sequence
  Description of Artificial Sequence: Synthetic polypeptide
DEEEISTTNPVATEQYGCVCSNSEHNAEFFNSDQP

SEQ ID NO: 165789 - protein, 35 aa, Artificial Sequence
  Description of Artificial Sequence: Synthetic polypeptide
DEAEIATTNPVAYEQWGSVSHTMNDRGNDVGNNHE

SEQ ID NO: 165790 - protein, 34 aa, Artificial Sequence
  Description of Artificial Sequence: Synthetic polypeptide
DEAEIATTNPVAYEQWGSVSQGPPQQATPDGSNH

SEQ ID NO: 165791 - protein, 34 aa, Artificial Sequence
  Description of Artificial Sequence: Synthetic polypeptide
DETEIATTNPVATAFWGSVSGNNEPQDHAGENGM

SEQ ID NO: 165792 - protein, 36 aa, Artificial Sequence
  Description of Artificial Sequence: Synthetic polypeptide
DEEEIATTNPVSTEGYGNVSATNPTIPNMRVGMQPR

SEQ ID NO: 165793 - protein, 37 aa, Artificial Sequence
  Description of Artificial Sequence: Synthetic polypeptide
DEEEIRTTNPVATEQYGSVMGQAVNFGQEDQEGESTD

SEQ ID NO: 165794 - protein, 34 aa, Artificial Sequence
  Description of Artificial Sequence: Synthetic polypeptide
DEDEIATTNPVATEVWGNVCYTNDHQDQGGQNDV

SEQ ID NO: 165795 - protein, 34 aa, Artificial Sequence
  Description of Artificial Sequence: Synthetic polypeptide
DEMEIVTTNPVATEQYGMTVCSATDGPVEFEAND

SEQ ID NO: 165796 - protein, 35 aa, Artificial Sequence
  Description of Artificial Sequence: Synthetic polypeptide
DEMEIVTTNPVATEQYGMTVCSATDGPVEFEGNCD

SEQ ID NO: 165797 - protein, 35 aa, Artificial Sequence
  Description of Artificial Sequence: Synthetic polypeptide
AEEEICTTNPVATEQYGVVSTVAEQVAEQGEEDED

SEQ ID NO: 165798 - protein, 37 aa, Artificial Sequence
  Description of Artificial Sequence: Synthetic polypeptide
DEEEIRTTNPVATEQYGSVMGQIVNIGQEDQEGESTV

SEQ ID NO: 165799 - protein, 36 aa, Artificial Sequence
  Description of Artificial Sequence: Synthetic polypeptide
TEEEIRTTNPVATEQYGSVVGTFNIGGDEEGGGETA

SEQ ID NO: 165800 - protein, 38 aa, Artificial Sequence
  Description of Artificial Sequence: Synthetic polypeptide
DEEEIRTTNPVATEAYGVVSTTVNNQQGNNEQGTNATE

SEQ ID NO: 165801 - protein, 36 aa, Artificial Sequence
  Description of Artificial Sequence: Synthetic polypeptide
TEEEIRTTNPVATEQYGSVVDNFNNIQTNAGGQGGI

SEQ ID NO: 165802 - protein, 35 aa, Artificial Sequence
  Description of Artificial Sequence: Synthetic polypeptide
AEEEICTTNPVATEQYGVVSTVAEQVAEQGEEETE

SEQ ID NO: 165803 - protein, 35 aa, Artificial Sequence
  Description of Artificial Sequence: Synthetic polypeptide
DESEIRTTNPVATECWGSVSSCPAEPNMRNGENPV

SEQ ID NO: 165804 - protein, 35 aa, Artificial Sequence
  Description of Artificial Sequence: Synthetic polypeptide
DEAEIRTTNPVATEQYGSVYYPIPLKESMGEEEED

SEQ ID NO: 165805 - protein, 38 aa, Artificial Sequence
  Description of Artificial Sequence: Synthetic polypeptide
DEEEIRTTNPVAYEQYGESVSPSVNDELFVRVGELDVD

SEQ ID NO: 165806 - protein, 36 aa, Artificial Sequence
  Description of Artificial Sequence: Synthetic polypeptide
AEEEICTTNPVATEQYGVVSTVLEQVAEQGTEEQED

SEQ ID NO: 165807 - protein, 34 aa, Artificial Sequence
  Description of Artificial Sequence: Synthetic polypeptide
DEMEIVTTNPVATEQYGNTVCSATDGPVEFECND

SEQ ID NO: 165808 - protein, 37 aa, Artificial Sequence
  Description of Artificial Sequence: Synthetic polypeptide
AEEEICTTNPVATEQYGVVSTVNNQQGEQQGTEEENE

SEQ ID NO: 165809 - protein, 32 aa, Artificial Sequence
  Description of Artificial Sequence: Synthetic polypeptide
DETEIATTNPICTECYGAVWANDDLQEPKGPI

SEQ ID NO: 165810 - protein, 32 aa, Artificial Sequence
  Description of Artificial Sequence: Synthetic polypeptide
DETEIATTNPICTECYGAVWANDDLQEPKGPQ

SEQ ID NO: 165811 - protein, 36 aa, Artificial Sequence
  Description of Artificial Sequence: Synthetic polypeptide
DEEEISTTNPVATEQYGCVCSMWGEHQEYFGSENQS

SEQ ID NO: 165812 - protein, 34 aa, Artificial Sequence
  Description of Artificial Sequence: Synthetic polypeptide
DEAEIRTTNPVATEQYGSYFYTWLMESESLEDQM

SEQ ID NO: 165813 - protein, 35 aa, Artificial Sequence
  Description of Artificial Sequence: Synthetic polypeptide
DEEEISTTNPVATEQYGCVCSMWGEHQYFGSDTQS

SEQ ID NO: 165814 - protein, 37 aa, Artificial Sequence
  Description of Artificial Sequence: Synthetic polypeptide
AEEEICTTNPVATEQYGVVSTVNNQQGNQQGTEDETE

SEQ ID NO: 165815 - protein, 35 aa, Artificial Sequence
  Description of Artificial Sequence: Synthetic polypeptide
DEEEIATTNPVCTEQYGCVAGFNNLQTGMGPQSTH

SEQ ID NO: 165816 - protein, 31 aa, Artificial Sequence
  Description of Artificial Sequence: Synthetic polypeptide
DCEEIRATNPVAYEQWGSSYYMEHMHEGGNN

SEQ ID NO: 165817 - protein, 38 aa, Artificial Sequence
  Description of Artificial Sequence: Synthetic polypeptide
DEEEIRTTNPVATEQYGVVSTVVNQQQNNEQSTTNVAE

SEQ ID NO: 165818 - protein, 39 aa, Artificial Sequence
  Description of Artificial Sequence: Synthetic polypeptide
DEEEIRTTNPVATEQYGVVSTVVNQQQNNNQGNTTNVAE

SEQ ID NO: 165819 - protein, 37 aa, Artificial Sequence
  Description of Artificial Sequence: Synthetic polypeptide
AEEEICTTNPVATEQYGVVSTVNLQQGEQQLGTEDEE

SEQ ID NO: 165820 - protein, 34 aa, Artificial Sequence
  Description of Artificial Sequence: Synthetic polypeptide
DEDEIATTNPVATEVWGSVCYTNDHQDQGGDHDQ

SEQ ID NO: 165821 - protein, 34 aa, Artificial Sequence
  Description of Artificial Sequence: Synthetic polypeptide
DETEIATTNPVATASWGCVSAANNEPLDRGMENG

SEQ ID NO: 165822 - protein, 40 aa, Artificial Sequence
  Description of Artificial Sequence: Synthetic polypeptide
DEEEIRTTNPVATEQYGTVSTNLQYGNNNQAIGTNQQGNE

SEQ ID NO: 165823 - protein, 37 aa, Artificial Sequence
  Description of Artificial Sequence: Synthetic polypeptide
DEEEIRTTNPVATEQYGSVMGQVNMEDETGGEDNQTM

SEQ ID NO: 165824 - protein, 32 aa, Artificial Sequence
  Description of Artificial Sequence: Synthetic polypeptide
DENEIRTVNPVSTEPYGTISMEDIQQQQNGNH

SEQ ID NO: 165825 - protein, 37 aa, Artificial Sequence
  Description of Artificial Sequence: Synthetic polypeptide
DEEEIRTTNPVATEQYGSVMGQVVNMEDEGGEDNQTQ

SEQ ID NO: 165826 - protein, 33 aa, Artificial Sequence
  Description of Artificial Sequence: Synthetic polypeptide
DEDEIATTNPVATEQYGTVCAANDGPVEDDSND

SEQ ID NO: 165827 - protein, 29 aa, Artificial Sequence
  Description of Artificial Sequence: Synthetic peptide
AESEIASTNPVGTEHWGVAASTLQHMGDI

SEQ ID NO: 165828 - protein, 35 aa, Artificial Sequence
  Description of Artificial Sequence: Synthetic polypeptide
DETEIATTNPVATEHWGSVCYNNDLGDDKGGNQSR

SEQ ID NO: 165829 - protein, 36 aa, Artificial Sequence
  Description of Artificial Sequence: Synthetic polypeptide
DEEEIRTTNPVATEQYGCVCSNWEEDNQENFNSDQS

SEQ ID NO: 165830 - protein, 34 aa, Artificial Sequence
  Description of Artificial Sequence: Synthetic polypeptide
DETEIATTNPVATEHYGSVCINIENDQHGHQQEE

SEQ ID NO: 165831 - protein, 33 aa, Artificial Sequence
  Description of Artificial Sequence: Synthetic polypeptide
DEMEIVTTNPVATEQYGTACSAEDGPVEFEGGR

SEQ ID NO: 165832 - protein, 32 aa, Artificial Sequence
  Description of Artificial Sequence: Synthetic polypeptide
DENEIRTVNPVSTEPYGTFSMEDIQQQQNGNH

SEQ ID NO: 165833 - protein, 35 aa, Artificial Sequence
  Description of Artificial Sequence: Synthetic polypeptide
CEEEIRTTNPVATEQYGCVCSWMEDHQNFNSDTQD

SEQ ID NO: 165834 - protein, 32 aa, Artificial Sequence
  Description of Artificial Sequence: Synthetic polypeptide
DENEIRTVNPVCTEPYGTISMEDIQQQQNGNH

SEQ ID NO: 165835 - protein, 36 aa, Artificial Sequence
  Description of Artificial Sequence: Synthetic polypeptide
DEHEIRTTNPVATEAWGISVRTWNDDQQDTRQMEER

SEQ ID NO: 165836 - protein, 30 aa, Artificial Sequence
  Description of Artificial Sequence: Synthetic polypeptide
AESEIASTNPVGTEGYGVMCQSTLQHGDIA

SEQ ID NO: 165837 - protein, 32 aa, Artificial Sequence
  Description of Artificial Sequence: Synthetic polypeptide
DEMEIVTTNPVATEQYGTACSAEVPVEFEGED

SEQ ID NO: 165838 - protein, 36 aa, Artificial Sequence
  Description of Artificial Sequence: Synthetic polypeptide
DEEEIRTTNPVATEQYGCVCSNWEEHDQEFFGSDQA

SEQ ID NO: 165839 - protein, 30 aa, Artificial Sequence
  Description of Artificial Sequence: Synthetic polypeptide
QEEEIATTNPVATECYGATAAEDCQEPEPI

SEQ ID NO: 165840 - protein, 36 aa, Artificial Sequence
  Description of Artificial Sequence: Synthetic polypeptide
DEHEIRTTNPVATEAWGISVRTWNDDQQDRRNKSEE

SEQ ID NO: 165841 - protein, 36 aa, Artificial Sequence
  Description of Artificial Sequence: Synthetic polypeptide
DEEEIRTTNPVATEQYGCVCSNWEEHEEYFGSENQA

SEQ ID NO: 165842 - protein, 30 aa, Artificial Sequence
  Description of Artificial Sequence: Synthetic polypeptide
QEEEIATTNPVATECWGEVPEVCPQDHEEK

SEQ ID NO: 165843 - protein, 29 aa, Artificial Sequence
  Description of Artificial Sequence: Synthetic peptide
QEEEIATTNPVATECWGETPAVCQPEEYK

SEQ ID NO: 165844 - protein, 36 aa, Artificial Sequence
  Description of Artificial Sequence: Synthetic polypeptide
DEHEIRTTNPVATEAWGISVRTWNDDQQDRQQKEER

SEQ ID NO: 165845 - protein, 37 aa, Artificial Sequence
  Description of Artificial Sequence: Synthetic polypeptide
DEEEIRTTNPVATEQYGCVCSNWEEHNIENFGSDNQS

SEQ ID NO: 165846 - protein, 36 aa, Artificial Sequence
  Description of Artificial Sequence: Synthetic polypeptide
DEHEIRTTNPVATEAWGISVRTWNDDQQDPRQGEEN

SEQ ID NO: 165847 - protein, 33 aa, Artificial Sequence
  Description of Artificial Sequence: Synthetic polypeptide
DEMEIVTTNPVATEQYGTACSATDGPVEFEGGD

SEQ ID NO: 165848 - protein, 37 aa, Artificial Sequence
  Description of Artificial Sequence: Synthetic polypeptide
DEEEIRTTNPVATEQYGCVCSNWEEHNQEGFISDNQS

SEQ ID NO: 165849 - protein, 37 aa, Artificial Sequence
  Description of Artificial Sequence: Synthetic polypeptide
DEEEIRTTNPVATEQYGCVCSNWEEDPQEGFNSDNQA

SEQ ID NO: 165850 - protein, 31 aa, Artificial Sequence
  Description of Artificial Sequence: Synthetic polypeptide
QEEEIATTNPVATECYGEVPCIVCPQHEEEK

SEQ ID NO: 165851 - protein, 37 aa, Artificial Sequence
  Description of Artificial Sequence: Synthetic polypeptide
DEEEIRTTNPVATEQYGCVCSNWEEDHQEYFGSDNQG

SEQ ID NO: 165852 - protein, 36 aa, Artificial Sequence
  Description of Artificial Sequence: Synthetic polypeptide
DEEEIRTTNPVATEQYGCVCSNWEEDHNQNFGSDQA

SEQ ID NO: 165853 - protein, 36 aa, Artificial Sequence
  Description of Artificial Sequence: Synthetic polypeptide
DEEEIRTTNPVATEQYGSVMGQVNMEDDGGEDGQGV

SEQ ID NO: 165854 - protein, 35 aa, Artificial Sequence
  Description of Artificial Sequence: Synthetic polypeptide
DEEEISTTNPVATEQYGCVCSNSEHNINFGSETQA

SEQ ID NO: 165855 - protein, 32 aa, Artificial Sequence
  Description of Artificial Sequence: Synthetic polypeptide
DETEIATTNPVATECWGATANSEDLQEPGDYI

SEQ ID NO: 165856 - protein, 36 aa, Artificial Sequence
  Description of Artificial Sequence: Synthetic polypeptide
DEEEIRTTNPVATEQYGSVMGQVNMEDEGGEDDQTI

SEQ ID NO: 165857 - protein, 40 aa, Artificial Sequence
  Description of Artificial Sequence: Synthetic polypeptide
DEEEIRTTNPVATEQYGTVSTNLQSGNNNTNQGNNNNQNQ

SEQ ID NO: 165858 - protein, 35 aa, Artificial Sequence
  Description of Artificial Sequence: Synthetic polypeptide
DEEEISTTNPVATEQYGCVCSNSEHQENFSSNTQA

SEQ ID NO: 165859 - protein, 38 aa, Artificial Sequence
  Description of Artificial Sequence: Synthetic polypeptide
AEEEICTTNPVATEQYGVVSVVVTNTNLQQGTENNEDD

SEQ ID NO: 165860 - protein, 31 aa, Artificial Sequence
  Description of Artificial Sequence: Synthetic polypeptide
DETEIATTNPVATECWGATWANEEDWARGPI

SEQ ID NO: 165861 - protein, 36 aa, Artificial Sequence
  Description of Artificial Sequence: Synthetic polypeptide
DEEEIRTTNPVATEQYGSVMGQVNMEDEGGEDIQGT

SEQ ID NO: 165862 - protein, 31 aa, Artificial Sequence
  Description of Artificial Sequence: Synthetic polypeptide
DETEIATTNPVATECWGETTANADWQHGPYK

SEQ ID NO: 165863 - protein, 31 aa, Artificial Sequence
  Description of Artificial Sequence: Synthetic polypeptide
DETEIATTNPVATECWGETWANEEDWARGPI

SEQ ID NO: 165864 - protein, 32 aa, Artificial Sequence
  Description of Artificial Sequence: Synthetic polypeptide
DENEIRYTNPVSTEPYGTISMEWIQQQQNGNH

SEQ ID NO: 165865 - protein, 36 aa, Artificial Sequence
  Description of Artificial Sequence: Synthetic polypeptide
DETEIATTNPVATECYGTVAATMNDGDERNGGNQRR

SEQ ID NO: 165866 - protein, 34 aa, Artificial Sequence
  Description of Artificial Sequence: Synthetic polypeptide
DEAEIATTNPVAYEQWGSVSWGDNLNPADGTGDH

SEQ ID NO: 165867 - protein, 35 aa, Artificial Sequence
  Description of Artificial Sequence: Synthetic polypeptide
AEEEIGTTNPVATEQYGCVCSTGEHDQENFGSEQS

SEQ ID NO: 165868 - protein, 35 aa, Artificial Sequence
  Description of Artificial Sequence: Synthetic polypeptide
DEAEIATTNPVAYEQWGSVTGLNENDQQGNMGSQR

SEQ ID NO: 165869 - protein, 33 aa, Artificial Sequence
  Description of Artificial Sequence: Synthetic polypeptide
DEAEIATTNPVAYEQWGSVTGQNGNQGAMNGGD

SEQ ID NO: 165870 - protein, 33 aa, Artificial Sequence
  Description of Artificial Sequence: Synthetic polypeptide
DENEIRYTNPVSTEPYGTISMEDNIQQQQGGNH

SEQ ID NO: 165871 - protein, 32 aa, Artificial Sequence
  Description of Artificial Sequence: Synthetic polypeptide
DENEIRYTNPVSTEPYGTISMEDIQVQQNGNH

SEQ ID NO: 165872 - protein, 35 aa, Artificial Sequence
  Description of Artificial Sequence: Synthetic polypeptide
DETEIATTNPVATECYGSTVWSNTEDLEEHEGEYI

SEQ ID NO: 165873 - protein, 37 aa, Artificial Sequence
  Description of Artificial Sequence: Synthetic polypeptide
DEEEIRTTNPVATEQYGSVMGQVNMEDEGGGEDNFTA

SEQ ID NO: 165874 - protein, 32 aa, Artificial Sequence
  Description of Artificial Sequence: Synthetic polypeptide
DENEIRYTNPVSTEPYGTISMEDIQQQQNGNH

SEQ ID NO: 165875 - protein, 36 aa, Artificial Sequence
  Description of Artificial Sequence: Synthetic polypeptide
DEQEIATTNPVATEQYGSVSASNPAITNIGNGMEPV

SEQ ID NO: 165876 - protein, 34 aa, Artificial Sequence
  Description of Artificial Sequence: Synthetic polypeptide
DEDEIATTNPVATEQYGTVCAGNDGPAETDDGND

SEQ ID NO: 165877 - protein, 37 aa, Artificial Sequence
  Description of Artificial Sequence: Synthetic polypeptide
DEEEIRTTNPVATEQYGSVMGQVNMEDEGGGEDNQLV

SEQ ID NO: 165878 - protein, 33 aa, Artificial Sequence
  Description of Artificial Sequence: Synthetic polypeptide
DEDEIATTNPVATEQYGTVCAATSGGVEPEIND

SEQ ID NO: 165879 - protein, 33 aa, Artificial Sequence
  Description of Artificial Sequence: Synthetic polypeptide
AEEEICTTNPVAYECWGSVATTGGNTGADGMQR

SEQ ID NO: 165880 - protein, 37 aa, Artificial Sequence
  Description of Artificial Sequence: Synthetic polypeptide
DEEEIRTTNPVATEQYGCVCSNWEEHNQENFGSDNQS

SEQ ID NO: 165881 - protein, 37 aa, Artificial Sequence
  Description of Artificial Sequence: Synthetic polypeptide
DEEEIRTTNPVATEQYGSVMGPQVNMEDEGNEDNQGV

SEQ ID NO: 165882 - protein, 35 aa, Artificial Sequence
  Description of Artificial Sequence: Synthetic polypeptide
DEMEIVTTNPVATEQYGKTVCSATDGGPVEFEGND

SEQ ID NO: 165883 - protein, 37 aa, Artificial Sequence
  Description of Artificial Sequence: Synthetic polypeptide
DEEEIRTTNPVATEAYGVVSTTNQQQIGTTEQGSTVE

SEQ ID NO: 165884 - protein, 31 aa, Artificial Sequence
  Description of Artificial Sequence: Synthetic polypeptide
DDSEVASTNPVSTEGYGIVAANTIQNRVGQR

SEQ ID NO: 165885 - protein, 37 aa, Artificial Sequence
  Description of Artificial Sequence: Synthetic polypeptide
DEEEIRTTNPVAYEQYGFSFVCTINDELVPLGQPAVY

SEQ ID NO: 165886 - protein, 31 aa, Artificial Sequence
  Description of Artificial Sequence: Synthetic polypeptide
DDSEVASTNPVSTEGYGIVAANTIQSRQGQR

SEQ ID NO: 165887 - protein, 37 aa, Artificial Sequence
  Description of Artificial Sequence: Synthetic polypeptide
DEEEIRTTNPVATEAYGVVSTTNSEQGNTEQGTEQGS

SEQ ID NO: 165888 - protein, 34 aa, Artificial Sequence
  Description of Artificial Sequence: Synthetic polypeptide
DEAAIRTTNPVATEQYGCFCSTGEDNIGFGSQQA

SEQ ID NO: 165889 - protein, 35 aa, Artificial Sequence
  Description of Artificial Sequence: Synthetic polypeptide
DEEEISTTNPVATEQYGCVCSMTEPNQENFFSEQS

SEQ ID NO: 165890 - protein, 35 aa, Artificial Sequence
  Description of Artificial Sequence: Synthetic polypeptide
DEMEIVTTNPVATEQYGCVCSNTGEPNEFFGSDAA

SEQ ID NO: 165891 - protein, 36 aa, Artificial Sequence
  Description of Artificial Sequence: Synthetic polypeptide
DEMEIVTTNPVATEQYGCVCSNTGEPNEFFGSNNDA

SEQ ID NO: 165892 - protein, 38 aa, Artificial Sequence
  Description of Artificial Sequence: Synthetic polypeptide
DEEEIRTTNPVATEQYGVVSTNVATEQYGTSTTQQQAD

SEQ ID NO: 165893 - protein, 30 aa, Artificial Sequence
  Description of Artificial Sequence: Synthetic polypeptide
QEEEIATTNPVATEPYGEIPEEVCQQQEEK

SEQ ID NO: 165894 - protein, 37 aa, Artificial Sequence
  Description of Artificial Sequence: Synthetic polypeptide
DEEEIRTTNPVATEAYGVVSTTNTEQGNNQGGTEQGS

SEQ ID NO: 165895 - protein, 39 aa, Artificial Sequence
  Description of Artificial Sequence: Synthetic polypeptide
DEEEIRTTNPVATEQYGVVSTVVNQQQGNQQGVTTNVAE

SEQ ID NO: 165896 - protein, 37 aa, Artificial Sequence
  Description of Artificial Sequence: Synthetic polypeptide
AEEEICTTNPVATEQYGVVATVNLQQGNQQQGTEDEE

SEQ ID NO: 165897 - protein, 34 aa, Artificial Sequence
  Description of Artificial Sequence: Synthetic polypeptide
DEMEIVTTNPVATEQYGCVCSNTGEPVEFFGSDQ

SEQ ID NO: 165898 - protein, 35 aa, Artificial Sequence
  Description of Artificial Sequence: Synthetic polypeptide
DEMEIVTTNPVATEQYGCVCSNTMEPNEFFGSEDS

SEQ ID NO: 165899 - protein, 36 aa, Artificial Sequence
  Description of Artificial Sequence: Synthetic polypeptide
DEEEIATTNPVAYETYGSVPYTDLSMFTVRSGNEEF

SEQ ID NO: 165900 - protein, 36 aa, Artificial Sequence
  Description of Artificial Sequence: Synthetic polypeptide
AEEEICTTNPVATEQYGVVATVNLQVGEQQGTEDEE

SEQ ID NO: 165901 - protein, 34 aa, Artificial Sequence
  Description of Artificial Sequence: Synthetic polypeptide
DEHEIRTTNPVATECWGSVRCIDWEDQDRHGEQM

SEQ ID NO: 165902 - protein, 35 aa, Artificial Sequence
  Description of Artificial Sequence: Synthetic polypeptide
DEMEIRTTNPVATEQYGSCSSVLEALDMGIPEGHE

SEQ ID NO: 165903 - protein, 35 aa, Artificial Sequence
  Description of Artificial Sequence: Synthetic polypeptide
DEEEISTTNPVATEQYGCVCSMTGEHNQNFISDQA

SEQ ID NO: 165904 - protein, 32 aa, Artificial Sequence
  Description of Artificial Sequence: Synthetic polypeptide
DEEEIATTNPVCTECWGATVSNDEDLAESGPI

SEQ ID NO: 165905 - protein, 35 aa, Artificial Sequence
  Description of Artificial Sequence: Synthetic polypeptide
DEMEIVTTNPVATEQYGCVCSTTGEPNEFFGSDDM

SEQ ID NO: 165906 - protein, 40 aa, Artificial Sequence
  Description of Artificial Sequence: Synthetic polypeptide
DEEEIRTTNPVATEQYGTVSTTNLQYGNNLQAGTNQQGNE

SEQ ID NO: 165907 - protein, 40 aa, Artificial Sequence
  Description of Artificial Sequence: Synthetic polypeptide
DEEEIRTTNPVATEQYGTVSTTNLQSGNNQGNGNNNNQND

SEQ ID NO: 165908 - protein, 38 aa, Artificial Sequence
  Description of Artificial Sequence: Synthetic polypeptide
DEEEIRTTNPVATEAYGVVSTTQQQQNNNQQIGTNVAE

SEQ ID NO: 165909 - protein, 35 aa, Artificial Sequence
  Description of Artificial Sequence: Synthetic polypeptide
DEMEIVTTNPVATEQYGCVCSNTGEPVEFEGSNTD

SEQ ID NO: 165910 - protein, 32 aa, Artificial Sequence
  Description of Artificial Sequence: Synthetic polypeptide
DETEIATTNPIATECWGSTSATDLADHKGEDI

SEQ ID NO: 165911 - protein, 35 aa, Artificial Sequence
  Description of Artificial Sequence: Synthetic polypeptide
DEEEIATTNPVAYEQWGSVCSGEGNQATNGNNGMS

SEQ ID NO: 165912 - protein, 31 aa, Artificial Sequence
  Description of Artificial Sequence: Synthetic polypeptide
DDSEVASTNPVSTEGYGIVAANNIQSRVGQR

SEQ ID NO: 165913 - protein, 35 aa, Artificial Sequence
  Description of Artificial Sequence: Synthetic polypeptide
QEEEIATTNPVATEQWGCVAGATGALGQNHGDIRM

SEQ ID NO: 165914 - protein, 36 aa, Artificial Sequence
  Description of Artificial Sequence: Synthetic polypeptide
DEEEISTTNPVATEQYGCVCSDTGEHNQEYSNSEQA

SEQ ID NO: 165915 - protein, 35 aa, Artificial Sequence
  Description of Artificial Sequence: Synthetic polypeptide
DEEEISTTNPVATEQYGCVCSDWEDQENFNSDNQS

SEQ ID NO: 165916 - protein, 35 aa, Artificial Sequence
  Description of Artificial Sequence: Synthetic polypeptide
DEMEIVTTNPVATEQYGCVCSMWGEPNEFFGSNQA

SEQ ID NO: 165917 - protein, 34 aa, Artificial Sequence
  Description of Artificial Sequence: Synthetic polypeptide
DEEEISTTNPVATEQYGCVCSDWEHAENFISDQS

SEQ ID NO: 165918 - protein, 35 aa, Artificial Sequence
  Description of Artificial Sequence: Synthetic polypeptide
DEEEISTTNPVATEQYGCVCSDWEHNQESFNSDQS

SEQ ID NO: 165919 - protein, 35 aa, Artificial Sequence
  Description of Artificial Sequence: Synthetic polypeptide
DEEEISTTNPVATEQYGCVCSDWEHNQHFNSETQS

SEQ ID NO: 165920 - protein, 33 aa, Artificial Sequence
  Description of Artificial Sequence: Synthetic polypeptide
DEEEIATTNPVAYERWGVVYITGNQGEGQHNED

SEQ ID NO: 165921 - protein, 37 aa, Artificial Sequence
  Description of Artificial Sequence: Synthetic polypeptide
AEEEICTTNPVATEQYGVVATVNLQQGEQQGTEDENL

SEQ ID NO: 165922 - protein, 30 aa, Artificial Sequence
  Description of Artificial Sequence: Synthetic polypeptide
QEEEIATTNPVATEQWGAAWAAVCQEHEPK

SEQ ID NO: 165923 - protein, 36 aa, Artificial Sequence
  Description of Artificial Sequence: Synthetic polypeptide
DEEEIATTNPVAYETYGSVCPTDKSLFTVRSGNEEF

SEQ ID NO: 165924 - protein, 35 aa, Artificial Sequence
  Description of Artificial Sequence: Synthetic polypeptide
DEMEIVTTNPVATEQYGCVCSNTDEPVEFFGSNDS

SEQ ID NO: 165925 - protein, 35 aa, Artificial Sequence
  Description of Artificial Sequence: Synthetic polypeptide
DEMEIVTTNPVATEQYGCVCSNTGEPNEFEISNDS

SEQ ID NO: 165926 - protein, 35 aa, Artificial Sequence
  Description of Artificial Sequence: Synthetic polypeptide
DEMEIVTTNPVATEQYGCVCSNTEEPNAFFGSDQA

SEQ ID NO: 165927 - protein, 36 aa, Artificial Sequence
  Description of Artificial Sequence: Synthetic polypeptide
DEMEIVTTNPVATEQYGCVCSNTEEPNEFEGSDNQA

SEQ ID NO: 165928 - protein, 35 aa, Artificial Sequence
  Description of Artificial Sequence: Synthetic polypeptide
DEEEIATTNPVAYETYGSVPGDISEFTVRSGNEEF

SEQ ID NO: 165929 - protein, 35 aa, Artificial Sequence
  Description of Artificial Sequence: Synthetic polypeptide
DEEEIATTNPVAYETYGSVPTDISLFTVRSGMEEF

SEQ ID NO: 165930 - protein, 38 aa, Artificial Sequence
  Description of Artificial Sequence: Synthetic polypeptide
DEEEIRTTNPVATEAYGVVSTTNQQQGTNQNNGTEQGS

SEQ ID NO: 165931 - protein, 34 aa, Artificial Sequence
  Description of Artificial Sequence: Synthetic polypeptide
DEAAIRTTNPVATEQYGCFCSNWEHNINFGSNQS

SEQ ID NO: 165932 - protein, 37 aa, Artificial Sequence
  Description of Artificial Sequence: Synthetic polypeptide
DEEEIRTTNPVATEQYGCVCSNTGPHNEENFNSDNQF

SEQ ID NO: 165933 - protein, 31 aa, Artificial Sequence
  Description of Artificial Sequence: Synthetic polypeptide
DETEIATTNPIATECWGATWSNADLQEHGPI

SEQ ID NO: 165934 - protein, 31 aa, Artificial Sequence
  Description of Artificial Sequence: Synthetic polypeptide
DETEIATTNPIATECWGATWSNADLQEHGPL

SEQ ID NO: 165935 - protein, 36 aa, Artificial Sequence
  Description of Artificial Sequence: Synthetic polypeptide
DEMEIVTTNPVATEQYGCVCSNTGEPNAENFGSNQS

SEQ ID NO: 165936 - protein, 38 aa, Artificial Sequence
  Description of Artificial Sequence: Synthetic polypeptide
DEEEIRTTNPVATEAYGVVSTTNQQQGTNQQNGTEQGS

SEQ ID NO: 165937 - protein, 35 aa, Artificial Sequence
  Description of Artificial Sequence: Synthetic polypeptide
DEEEISTTNPVATEQYGCVCSMSGEHNQNFNSQQS

SEQ ID NO: 165938 - protein, 37 aa, Artificial Sequence
  Description of Artificial Sequence: Synthetic polypeptide
DEEEIRTTNPVATEQYGCVCSNTMEDHNQENFGSDQT

SEQ ID NO: 165939 - protein, 37 aa, Artificial Sequence
  Description of Artificial Sequence: Synthetic polypeptide
AEEEIRTTNPVATEQYGSVVTVNTTNDEAGTVNNATG

SEQ ID NO: 165940 - protein, 31 aa, Artificial Sequence
  Description of Artificial Sequence: Synthetic polypeptide
AEEEICTTNPVATEQYGVVAVEVAEDEEEED

SEQ ID NO: 165941 - protein, 32 aa, Artificial Sequence
  Description of Artificial Sequence: Synthetic polypeptide
DETEIATTNPIATECWGSTSATDLADHKGEDL

SEQ ID NO: 165942 - protein, 36 aa, Artificial Sequence
  Description of Artificial Sequence: Synthetic polypeptide
DEEEISTTNPVATEQYGCVCSMTGETNQNFNSDTQA

SEQ ID NO: 165943 - protein, 33 aa, Artificial Sequence
  Description of Artificial Sequence: Synthetic polypeptide
AEEEICTTNPVATEQYGVVATVTEVGEQQDEEE

SEQ ID NO: 165944 - protein, 36 aa, Artificial Sequence
  Description of Artificial Sequence: Synthetic polypeptide
TEEEIRTTNPVATEQYGVVVGTFNNDGQEEGGGETA

SEQ ID NO: 165945 - protein, 34 aa, Artificial Sequence
  Description of Artificial Sequence: Synthetic polypeptide
DEMEIVTTNPVATEQYGETVCSATDGPVEFERND

SEQ ID NO: 165946 - protein, 40 aa, Artificial Sequence
  Description of Artificial Sequence: Synthetic polypeptide
DEEEIRTTNPVATEQYGTVSTTNLQAGNPTEQGTNNNTTE

SEQ ID NO: 165947 - protein, 36 aa, Artificial Sequence
  Description of Artificial Sequence: Synthetic polypeptide
DEEEIATTNPVATEQYGSACAANPELQEHQDDNDAG

SEQ ID NO: 165948 - protein, 35 aa, Artificial Sequence
  Description of Artificial Sequence: Synthetic polypeptide
DEAEIATTNPVATEQYGSVCAADNGLEADDAMGRH

SEQ ID NO: 165949 - protein, 36 aa, Artificial Sequence
  Description of Artificial Sequence: Synthetic polypeptide
DEEEISTTNPVATEQYGCVCSMWEEHNQNFGSDNQN

SEQ ID NO: 165950 - protein, 34 aa, Artificial Sequence
  Description of Artificial Sequence: Synthetic polypeptide
AEEEICTTNPVATEQYGVVATVVENVNEQGDEEE

SEQ ID NO: 165951 - protein, 38 aa, Artificial Sequence
  Description of Artificial Sequence: Synthetic polypeptide
DEEEIRTTNPVATEAYGTVSTQGNSQIGTTSISTTNNT

SEQ ID NO: 165952 - protein, 33 aa, Artificial Sequence
  Description of Artificial Sequence: Synthetic polypeptide
AEEEICTTNPVATEQYGVVATVVEQVEEQEEEE

SEQ ID NO: 165953 - protein, 38 aa, Artificial Sequence
  Description of Artificial Sequence: Synthetic polypeptide
AEEEIRTTNPVATEQYGSVSTVVTNNMEQGTNNVTDEM

SEQ ID NO: 165954 - protein, 40 aa, Artificial Sequence
  Description of Artificial Sequence: Synthetic polypeptide
DEEEIRTTNPVATEQYGTVSTTNLQAGNNTEQGTNQNTDE

SEQ ID NO: 165955 - protein, 39 aa, Artificial Sequence
  Description of Artificial Sequence: Synthetic polypeptide
DEEEIRTTNPVATEAYGTVSTQYGNSEQGTTSIRTTGNT

SEQ ID NO: 165956 - protein, 33 aa, Artificial Sequence
  Description of Artificial Sequence: Synthetic polypeptide
AEEEICTTNPVATEQYGVVATVVEVEQNDEEEQ

SEQ ID NO: 165957 - protein, 35 aa, Artificial Sequence
  Description of Artificial Sequence: Synthetic polypeptide
DEMEIVTTNPVATEQYGHTVCSATDGFPVEFEGND

SEQ ID NO: 165958 - protein, 35 aa, Artificial Sequence
  Description of Artificial Sequence: Synthetic polypeptide
DEMEIVTTNPVATEQYGHTVCSATDGPVEAFEGND

SEQ ID NO: 165959 - protein, 33 aa, Artificial Sequence
  Description of Artificial Sequence: Synthetic polypeptide
DCEEIRATNPVAYEQWGSSYYNEHMHQREQQNV

SEQ ID NO: 165960 - protein, 35 aa, Artificial Sequence
  Description of Artificial Sequence: Synthetic polypeptide
DEAEIRTTNPVATEQYGSVYQCWTLNNEDFSVQEN

SEQ ID NO: 165961 - protein, 40 aa, Artificial Sequence
  Description of Artificial Sequence: Synthetic polypeptide
DEEEIRTTNPVATEQYGTVSTTNLQAGNNQNIGNNNNQNT

SEQ ID NO: 165962 - protein, 33 aa, Artificial Sequence
  Description of Artificial Sequence: Synthetic polypeptide
DETEIATTNPIATEQWGATWSEENWQEPKGPYR

SEQ ID NO: 165963 - protein, 34 aa, Artificial Sequence
  Description of Artificial Sequence: Synthetic polypeptide
DENEISTTNPVATEGYGCVCSTEPQENFNSENQA

SEQ ID NO: 165964 - protein, 33 aa, Artificial Sequence
  Description of Artificial Sequence: Synthetic polypeptide
AEEEICTTNPVATEQYGVVATVVVAEQGEEEDE

SEQ ID NO: 165965 - protein, 36 aa, Artificial Sequence
  Description of Artificial Sequence: Synthetic polypeptide
TEEEIRTTNPVATEQYGSYVIYPITTQQQMPQVGEC

SEQ ID NO: 165966 - protein, 35 aa, Artificial Sequence
  Description of Artificial Sequence: Synthetic polypeptide
DEDEIATTNPVATEVWGSVCYTNDHQDQGGQNNKA

SEQ ID NO: 165967 - protein, 35 aa, Artificial Sequence
  Description of Artificial Sequence: Synthetic polypeptide
DEEEISTTNPVATEQYGCVCSMWEHNQNFNSDTQV

SEQ ID NO: 165968 - protein, 31 aa, Artificial Sequence
  Description of Artificial Sequence: Synthetic polypeptide
DDSEVASTNPVSTEGYGLVAANTIQSRVGQR

SEQ ID NO: 165969 - protein, 34 aa, Artificial Sequence
  Description of Artificial Sequence: Synthetic polypeptide
DEMEIVTTNPVATEQYGFTVCSARDGPVEFEGND

SEQ ID NO: 165970 - protein, 35 aa, Artificial Sequence
  Description of Artificial Sequence: Synthetic polypeptide
DEMEIRTTNPVATEQYGSCSSVLEALDMGIPEEGQ

SEQ ID NO: 165971 - protein, 34 aa, Artificial Sequence
  Description of Artificial Sequence: Synthetic polypeptide
DEMEIVTTNPVATEQYGETVCSAKDGPVEFEGND

SEQ ID NO: 165972 - protein, 32 aa, Artificial Sequence
  Description of Artificial Sequence: Synthetic polypeptide
DEMEIVTTNPVATEQYGEAPATDGPVEHEENK

SEQ ID NO: 165973 - protein, 38 aa, Artificial Sequence
  Description of Artificial Sequence: Synthetic polypeptide
DEEEIRTTNPVATEAYGTVSTTGNSQIGTTTISTTGNT

SEQ ID NO: 165974 - protein, 37 aa, Artificial Sequence
  Description of Artificial Sequence: Synthetic polypeptide
DEEEISTTNPVATEQYGCVCSMTGNHNQENFGSDTQA

SEQ ID NO: 165975 - protein, 31 aa, Artificial Sequence
  Description of Artificial Sequence: Synthetic polypeptide
DDSEVASTNPVSTEGYGIVAANTIQSRVGQR

SEQ ID NO: 165976 - protein, 38 aa, Artificial Sequence
  Description of Artificial Sequence: Synthetic polypeptide
DEEEIRTTNPVATEQYGCVCSNTNEDHEQENFGSETQN

SEQ ID NO: 165977 - protein, 34 aa, Artificial Sequence
  Description of Artificial Sequence: Synthetic polypeptide
DEMEIVTTNPVATEQYGCVCTATDGPVEFEGEND

SEQ ID NO: 165978 - protein, 31 aa, Artificial Sequence
  Description of Artificial Sequence: Synthetic polypeptide
DDSEVASTNPVSTEGYGKVAANTIQSRVGQR

SEQ ID NO: 165979 - protein, 39 aa, Artificial Sequence
  Description of Artificial Sequence: Synthetic polypeptide
DEEEIRTTNPVATEAYGVVSTTSNLQAGNTEAGGTTTDD

SEQ ID NO: 165980 - protein, 34 aa, Artificial Sequence
  Description of Artificial Sequence: Synthetic polypeptide
DEQEIATTNPVATEQYGSVSACIDEPEDHEGEDG

SEQ ID NO: 165981 - protein, 35 aa, Artificial Sequence
  Description of Artificial Sequence: Synthetic polypeptide
DEMEIRTTNPVATEQYGSCSSTIADNQPEVTEEGT

SEQ ID NO: 165982 - protein, 35 aa, Artificial Sequence
  Description of Artificial Sequence: Synthetic polypeptide
DEEEISTTNPVATEQYGCVCSMTGPDANFNSETQA

SEQ ID NO: 165983 - protein, 35 aa, Artificial Sequence
  Description of Artificial Sequence: Synthetic polypeptide
DEEEISTTNPVATEQYGCVCSMTMEDHINFGSDQA

SEQ ID NO: 165984 - protein, 40 aa, Artificial Sequence
  Description of Artificial Sequence: Synthetic polypeptide
DEEEIRTTNPVATEQYGTVSTTNLQSGNNNNNGNNNNQNQ

SEQ ID NO: 165985 - protein, 40 aa, Artificial Sequence
  Description of Artificial Sequence: Synthetic polypeptide
DEEEIRTTNPVATEQYGTVSTTNLQAGNVTEQGTNQNGTE

SEQ ID NO: 165986 - protein, 31 aa, Artificial Sequence
  Description of Artificial Sequence: Synthetic polypeptide
DDSEVASTNPVSTEGYGKVAANTQQSRVGQR

SEQ ID NO: 165987 - protein, 37 aa, Artificial Sequence
  Description of Artificial Sequence: Synthetic polypeptide
DEEEIRTTNPVATEAYGTVSTSQTNNTEQGTNNNNDE

SEQ ID NO: 165988 - protein, 35 aa, Artificial Sequence
  Description of Artificial Sequence: Synthetic polypeptide
DEEEIRTTNPVATEQYGSVHPVMMDAEFHQLSHIG

SEQ ID NO: 165989 - protein, 38 aa, Artificial Sequence
  Description of Artificial Sequence: Synthetic polypeptide
AEEEIRTTNPVATEQYGSVVTVTNDQLGNTEQGTNDEE

SEQ ID NO: 165990 - protein, 35 aa, Artificial Sequence
  Description of Artificial Sequence: Synthetic polypeptide
DEEEIRTTNPVAYEQYGQCVCSWEDDNQRFISDQF

SEQ ID NO: 165991 - protein, 31 aa, Artificial Sequence
  Description of Artificial Sequence: Synthetic polypeptide
DDSEVACTNPVSTEGYGNVAANTIQSRVGQR

SEQ ID NO: 165992 - protein, 35 aa, Artificial Sequence
  Description of Artificial Sequence: Synthetic polypeptide
DEAEIRTTNPVATEQYGSVYEWFKLDGFSGQEDGD

SEQ ID NO: 165993 - protein, 35 aa, Artificial Sequence
  Description of Artificial Sequence: Synthetic polypeptide
DEAEIRTTNPVATEQYGSVYNCWTLNEEDFSLQEF

SEQ ID NO: 165994 - protein, 37 aa, Artificial Sequence
  Description of Artificial Sequence: Synthetic polypeptide
DEEEIRTTNPVATEAYGTVSTSGTNNNEQGNNNNQGG

SEQ ID NO: 165995 - protein, 34 aa, Artificial Sequence
  Description of Artificial Sequence: Synthetic polypeptide
AEEEICTTNPVATEQYGVVATVTEQVTEQGEEEE

SEQ ID NO: 165996 - protein, 35 aa, Artificial Sequence
  Description of Artificial Sequence: Synthetic polypeptide
DEAEIATTNPVATEQYGSVCAADNGLEAGDAMIHH

SEQ ID NO: 165997 - protein, 32 aa, Artificial Sequence
  Description of Artificial Sequence: Synthetic polypeptide
DEMEIVTTNPVATEQYGEACSAEVPVEHEGEK

SEQ ID NO: 165998 - protein, 35 aa, Artificial Sequence
  Description of Artificial Sequence: Synthetic polypeptide
DEAEIRTTNPVATEQYGSVYQCWFLNEEDMSNQEE

SEQ ID NO: 165999 - protein, 40 aa, Artificial Sequence
  Description of Artificial Sequence: Synthetic polypeptide
DEEEIRTTNPVATEQYGTVSTTNLQQGTNLQNGNNNNQND

SEQ ID NO: 166000 - protein, 32 aa, Artificial Sequence
  Description of Artificial Sequence: Synthetic polypeptide
DENEIRTTNPVSTEPYGTWSMEDIQQQQNGQH

SEQ ID NO: 166001 - protein, 32 aa, Artificial Sequence
  Description of Artificial Sequence: Synthetic polypeptide
QEGEIATTNPVATEQYGCAPMHGQDSEGENDD

SEQ ID NO: 166002 - protein, 35 aa, Artificial Sequence
  Description of Artificial Sequence: Synthetic polypeptide
DEEEISTTNPVATEQYGCVCSNTGEHAENFGSEQA

SEQ ID NO: 166003 - protein, 35 aa, Artificial Sequence
  Description of Artificial Sequence: Synthetic polypeptide
DEMEIRTTNPVATEQYGCVQTVDALQEPIDSQVEI

SEQ ID NO: 166004 - protein, 38 aa, Artificial Sequence
  Description of Artificial Sequence: Synthetic polypeptide
DEEEIRTTNPVATEQYGSVNMNSPEELYDEENGNSDDP

SEQ ID NO: 166005 - protein, 36 aa, Artificial Sequence
  Description of Artificial Sequence: Synthetic polypeptide
TEEEIRTTNPVATEGYGSVNGQTDANGQEEDEGGGN

SEQ ID NO: 166006 - protein, 35 aa, Artificial Sequence
  Description of Artificial Sequence: Synthetic polypeptide
DEEEISTTNPVATEQYGCVCSNWEHNQNFGSDTQS

SEQ ID NO: 166007 - protein, 33 aa, Artificial Sequence
  Description of Artificial Sequence: Synthetic polypeptide
DENEIRTTNPVSTEPYGTISQEDISQQQNGNQH

SEQ ID NO: 166008 - protein, 32 aa, Artificial Sequence
  Description of Artificial Sequence: Synthetic polypeptide
DETEIRTTNPIATECWGATTANDEDLQPGPYI

SEQ ID NO: 166009 - protein, 35 aa, Artificial Sequence
  Description of Artificial Sequence: Synthetic polypeptide
DASEIRTTNPVATECWGSVSCLNEPNDREGENPGW

SEQ ID NO: 166010 - protein, 36 aa, Artificial Sequence
  Description of Artificial Sequence: Synthetic polypeptide
DEEEIRTTNPVATEQYGSVNMPNMNNMEERQTEPFT

SEQ ID NO: 166011 - protein, 34 aa, Artificial Sequence
  Description of Artificial Sequence: Synthetic polypeptide
DEDEIATTNPVATASWGCVSAANNENQDRGGENG

SEQ ID NO: 166012 - protein, 35 aa, Artificial Sequence
  Description of Artificial Sequence: Synthetic polypeptide
DEEEISTTNPVATEQYGCVCSNWEHQEHFGSQPQS

SEQ ID NO: 166013 - protein, 36 aa, Artificial Sequence
  Description of Artificial Sequence: Synthetic polypeptide
AEEEIRTTNPVATEAYGSVSTTTDNGNNVEQGSVED

SEQ ID NO: 166014 - protein, 36 aa, Artificial Sequence
  Description of Artificial Sequence: Synthetic polypeptide
AEEEIRTTNPVATEAYGSVSTTTDNGNVEQGEEEEN

SEQ ID NO: 166015 - protein, 33 aa, Artificial Sequence
  Description of Artificial Sequence: Synthetic polypeptide
DEAEIRTTNPVAYEQWGEVMWTEHDNRGGGAGA

SEQ ID NO: 166016 - protein, 37 aa, Artificial Sequence
  Description of Artificial Sequence: Synthetic polypeptide
AEEEIRTTNPVATEAYGSVSTTTNANNQQEATNVATE

SEQ ID NO: 166017 - protein, 36 aa, Artificial Sequence
  Description of Artificial Sequence: Synthetic polypeptide
AEEEIRTTNPVATEAYGSVSTTTNGNNDEQGTEDED

SEQ ID NO: 166018 - protein, 35 aa, Artificial Sequence
  Description of Artificial Sequence: Synthetic polypeptide
DEEEISTTNPVATEQYGCVCSNWEHQEYFNSETAS

SEQ ID NO: 166019 - protein, 36 aa, Artificial Sequence
  Description of Artificial Sequence: Synthetic polypeptide
DEEEIRTTNPVATEQYGCVCSNWGPDHQENFGSEQM

SEQ ID NO: 166020 - protein, 35 aa, Artificial Sequence
  Description of Artificial Sequence: Synthetic polypeptide
DEAEIRTTNPVAYEQWGEVSGGNNGNQIGETNGDH

SEQ ID NO: 166021 - protein, 34 aa, Artificial Sequence
  Description of Artificial Sequence: Synthetic polypeptide
DEEEISTTNPVATEQYGCVCSNWEHQNFSSETQA

SEQ ID NO: 166022 - protein, 34 aa, Artificial Sequence
  Description of Artificial Sequence: Synthetic polypeptide
QEEEIACTNPVATEQYGCVAGTNLQAAPEEDTHW

SEQ ID NO: 166023 - protein, 36 aa, Artificial Sequence
  Description of Artificial Sequence: Synthetic polypeptide
DEEEIRTTNPVATEQYGSVNMQEGQTDQEEGGIEGQ

SEQ ID NO: 166024 - protein, 32 aa, Artificial Sequence
  Description of Artificial Sequence: Synthetic polypeptide
DEDEIATTNPVATASWGCVANNNLQDAGGGHV

SEQ ID NO: 166025 - protein, 37 aa, Artificial Sequence
  Description of Artificial Sequence: Synthetic polypeptide
AEEEIRTTNPVATEAYGSVSTTTQLQNQQEATNVATE

SEQ ID NO: 166026 - protein, 34 aa, Artificial Sequence
  Description of Artificial Sequence: Synthetic polypeptide
DEAEIATTNPVAYEQYGSTTAGNGLQNDSGGEFH

SEQ ID NO: 166027 - protein, 37 aa, Artificial Sequence
  Description of Artificial Sequence: Synthetic polypeptide
AEEEIRTTNPVATEAYGSVSTTTQNGNGVEQGTEEDD

SEQ ID NO: 166028 - protein, 35 aa, Artificial Sequence
  Description of Artificial Sequence: Synthetic polypeptide
DEEEISTTNPVATEQYGCVCSNWEHNQEYFGSDQA

SEQ ID NO: 166029 - protein, 36 aa, Artificial Sequence
  Description of Artificial Sequence: Synthetic polypeptide
TEEEIRTTNPVATEGYGSVVGQTSNNGQEEMEGGGD

SEQ ID NO: 166030 - protein, 36 aa, Artificial Sequence
  Description of Artificial Sequence: Synthetic polypeptide
TEEEIRTTNPVATEGYGVVSGTMNNDQELEGGGGEQ

SEQ ID NO: 166031 - protein, 37 aa, Artificial Sequence
  Description of Artificial Sequence: Synthetic polypeptide
DEEEIATTNPVATEQYGSACATNPELGQLHQDDINAH

SEQ ID NO: 166032 - protein, 36 aa, Artificial Sequence
  Description of Artificial Sequence: Synthetic polypeptide
DEEEIRTTNPVATEQYGCVCSNWGEPQEFFNSDFQS

SEQ ID NO: 166033 - protein, 34 aa, Artificial Sequence
  Description of Artificial Sequence: Synthetic polypeptide
DEDEIATTNPVATASWGGCVATGALQMQMGNDRN

SEQ ID NO: 166034 - protein, 36 aa, Artificial Sequence
  Description of Artificial Sequence: Synthetic polypeptide
DEEEISTTNPVATEQYGCVCSNWEELNQNFNSDTQS

SEQ ID NO: 166035 - protein, 37 aa, Artificial Sequence
  Description of Artificial Sequence: Synthetic polypeptide
DEEEIRTTNPVATEQYGSVNMGDNFDLGGGEDEITGG

SEQ ID NO: 166036 - protein, 34 aa, Artificial Sequence
  Description of Artificial Sequence: Synthetic polypeptide
DEEEISTTNPVATEQYGCVCSNWEHDQGFISEQS

SEQ ID NO: 166037 - protein, 33 aa, Artificial Sequence
  Description of Artificial Sequence: Synthetic polypeptide
DEDEIATTNPVATASWGCVSANNTPLDNAGENG

SEQ ID NO: 166038 - protein, 35 aa, Artificial Sequence
  Description of Artificial Sequence: Synthetic polypeptide
DEEEISTTNPVATEQYGCVCSNWEHFQESFGSDQS

SEQ ID NO: 166039 - protein, 34 aa, Artificial Sequence
  Description of Artificial Sequence: Synthetic polypeptide
DEMEIVTTNPVATEQYGTVCSATDGPVEFESNVD

SEQ ID NO: 166040 - protein, 34 aa, Artificial Sequence
  Description of Artificial Sequence: Synthetic polypeptide
DEDEIATTNPVATASWGCVSANNEPLDQGGENGD

SEQ ID NO: 166041 - protein, 35 aa, Artificial Sequence
  Description of Artificial Sequence: Synthetic polypeptide
DEEEISTTNPVATEQYGCVCSNWEHNAESFNSDQS

SEQ ID NO: 166042 - protein, 35 aa, Artificial Sequence
  Description of Artificial Sequence: Synthetic polypeptide
DEEEISTTNPVATEQYGCVCSNWEHNANFGSETQE

SEQ ID NO: 166043 - protein, 35 aa, Artificial Sequence
  Description of Artificial Sequence: Synthetic polypeptide
DEEEISTTNPVATEQYGCVCSNWEHNEENFGSDQS

SEQ ID NO: 166044 - protein, 36 aa, Artificial Sequence
  Description of Artificial Sequence: Synthetic polypeptide
DEEEIRTTNPVATEQYGCVCSNWGYHQENFNSDNQS

SEQ ID NO: 166045 - protein, 34 aa, Artificial Sequence
  Description of Artificial Sequence: Synthetic polypeptide
DEEEISTTNPVATEQYGCVCSNWEHNEHFNSDQY

SEQ ID NO: 166046 - protein, 37 aa, Artificial Sequence
  Description of Artificial Sequence: Synthetic polypeptide
AEEEIRTTNPVATEAYGSVSTTQQNQNISEQGTNNVE

SEQ ID NO: 166047 - protein, 35 aa, Artificial Sequence
  Description of Artificial Sequence: Synthetic polypeptide
DEEEISTTNPVATEQYGCVCSNWEHNQEGFGSDQS

SEQ ID NO: 166048 - protein, 35 aa, Artificial Sequence
  Description of Artificial Sequence: Synthetic polypeptide
DEEEISTTNPVATEQYGCVCSNWEHNQENFGSDQP

SEQ ID NO: 166049 - protein, 35 aa, Artificial Sequence
  Description of Artificial Sequence: Synthetic polypeptide
DEEEISTTNPVATEQYGCVCSNWEHNQENFGSDQS

SEQ ID NO: 166050 - protein, 34 aa, Artificial Sequence
  Description of Artificial Sequence: Synthetic polypeptide
DEMEIVTTNPVATEQYGTVCSATDGPVEFETNDI

SEQ ID NO: 166051 - protein, 34 aa, Artificial Sequence
  Description of Artificial Sequence: Synthetic polypeptide
DEDEIATTNPVATASWGCVSANNEDQDRGGENTG

SEQ ID NO: 166052 - protein, 36 aa, Artificial Sequence
  Description of Artificial Sequence: Synthetic polypeptide
DEMEIRTTNPVATEQYGCVSCPKNMQEDSMESQQRE

SEQ ID NO: 166053 - protein, 36 aa, Artificial Sequence
  Description of Artificial Sequence: Synthetic polypeptide
AEEEIRTTNPVATEAYGSVSTTQQQNQNAGTEAGTE

SEQ ID NO: 166054 - protein, 35 aa, Artificial Sequence
  Description of Artificial Sequence: Synthetic polypeptide
DEEEISTTNPVATEQYGCVCSNWEHNQENFISNQP

SEQ ID NO: 166055 - protein, 36 aa, Artificial Sequence
  Description of Artificial Sequence: Synthetic polypeptide
AEEEIRTTNPVATEAYGSVSTTQQQQNATEQGTAVE

SEQ ID NO: 166056 - protein, 37 aa, Artificial Sequence
  Description of Artificial Sequence: Synthetic polypeptide
DEEEIRTTNPVATEQYGCVCSNWGNDHNQENFGSDQS

SEQ ID NO: 166057 - protein, 37 aa, Artificial Sequence
  Description of Artificial Sequence: Synthetic polypeptide
AEEEIRTTNPVATEAYGSVSTTQQQQNGTEQGTNSVE

SEQ ID NO: 166058 - protein, 34 aa, Artificial Sequence
  Description of Artificial Sequence: Synthetic polypeptide
DEEEISTTNPVATEQYGCVCSNWEHNINFNSDQS

SEQ ID NO: 166059 - protein, 33 aa, Artificial Sequence
  Description of Artificial Sequence: Synthetic polypeptide
QEEEIACTNPVATEQYGCVAATTNPAVAPGEHW

SEQ ID NO: 166060 - protein, 37 aa, Artificial Sequence
  Description of Artificial Sequence: Synthetic polypeptide
AEEEIRTTNPVATEAYGSVSTTTQNGNPVEQGTEEEQ

SEQ ID NO: 166061 - protein, 34 aa, Artificial Sequence
  Description of Artificial Sequence: Synthetic polypeptide
DEAEIRTTNPVAYEQWGEVSGGNQAEGGDRNGDH

SEQ ID NO: 166062 - protein, 37 aa, Artificial Sequence
  Description of Artificial Sequence: Synthetic polypeptide
AEEEIRTTNPVATEAYGSVSTVTNNQQLQGAEEEEDE

SEQ ID NO: 166063 - protein, 39 aa, Artificial Sequence
  Description of Artificial Sequence: Synthetic polypeptide
DEEEIRTTNPVATEQYGVVSTVTNQQYGTEQGTTTNVAE

SEQ ID NO: 166064 - protein, 33 aa, Artificial Sequence
  Description of Artificial Sequence: Synthetic polypeptide
DEEEIATTNPVATECWGCVSGGNGIEAGGEGMS

SEQ ID NO: 166065 - protein, 34 aa, Artificial Sequence
  Description of Artificial Sequence: Synthetic polypeptide
DEMEIVTTNPVATEQYGTVCSATDGPVEHFEGDD

SEQ ID NO: 166066 - protein, 36 aa, Artificial Sequence
  Description of Artificial Sequence: Synthetic polypeptide
DEEEIRTTNPVATEQYGCVCSSEEDHNQSFNSDTQS

SEQ ID NO: 166067 - protein, 34 aa, Artificial Sequence
  Description of Artificial Sequence: Synthetic polypeptide
DEMEIVTTNPVATEQYGTVCSATDGPVEHFPEND

SEQ ID NO: 166068 - protein, 34 aa, Artificial Sequence
  Description of Artificial Sequence: Synthetic polypeptide
WEEEIACTNPVATEQWGCVAITNHDENGMQENDR

SEQ ID NO: 166069 - protein, 36 aa, Artificial Sequence
  Description of Artificial Sequence: Synthetic polypeptide
DEEEIRTTNPVATEQYGSVNNEINPDDENSGQEDIP

SEQ ID NO: 166070 - protein, 37 aa, Artificial Sequence
  Description of Artificial Sequence: Synthetic polypeptide
AEEEIRTTNPVATEAYGSVSTVTNNQQLQQNEEEEDT

SEQ ID NO: 166071 - protein, 36 aa, Artificial Sequence
  Description of Artificial Sequence: Synthetic polypeptide
DEEEIRTTNPVATEQYGCVCSSEEHNEENFGSDTQA

SEQ ID NO: 166072 - protein, 34 aa, Artificial Sequence
  Description of Artificial Sequence: Synthetic polypeptide
DEMEIVTTNPVATEQYGTVCSATDGPVEKFEDND

SEQ ID NO: 166073 - protein, 35 aa, Artificial Sequence
  Description of Artificial Sequence: Synthetic polypeptide
WEEEIACTNPVATEQWGSVAITNHTENGMPMENDR

SEQ ID NO: 166074 - protein, 36 aa, Artificial Sequence
  Description of Artificial Sequence: Synthetic polypeptide
DEEEIRTTNPVATEQYGAVVNGFGNGQVTDQTGGFG

SEQ ID NO: 166075 - protein, 31 aa, Artificial Sequence
  Description of Artificial Sequence: Synthetic polypeptide
DEEEIATTNPVATECWGATWAAVCQPKGEYI

SEQ ID NO: 166076 - protein, 34 aa, Artificial Sequence
  Description of Artificial Sequence: Synthetic polypeptide
DEMEIVTTNPVATEQYGTVCSATDGPVEKFEGYD

SEQ ID NO: 166077 - protein, 34 aa, Artificial Sequence
  Description of Artificial Sequence: Synthetic polypeptide
DEMEIVTTNPVATEQYGTVCSATDGPVEMFEDND

SEQ ID NO: 166078 - protein, 35 aa, Artificial Sequence
  Description of Artificial Sequence: Synthetic polypeptide
DEEEIRTTNPVATEQYGCVCSSEEHNQENFISQQS

SEQ ID NO: 166079 - protein, 36 aa, Artificial Sequence
  Description of Artificial Sequence: Synthetic polypeptide
DEEEIRTTNPVATEQYGCVCSSEEHNQENFNSDTQA

SEQ ID NO: 166080 - protein, 36 aa, Artificial Sequence
  Description of Artificial Sequence: Synthetic polypeptide
DEEEIRTTNPVATEQYGCVCSSEEHNQENFNSDTQS

SEQ ID NO: 166081 - protein, 37 aa, Artificial Sequence
  Description of Artificial Sequence: Synthetic polypeptide
AEEEIRTTNPVATEAYGSVSTVTSNNNVNEEGTNTQG

SEQ ID NO: 166082 - protein, 37 aa, Artificial Sequence
  Description of Artificial Sequence: Synthetic polypeptide
AEEEIRTTNPVATEAYGSVSTVVNNNQLQQNEEEEDQ

SEQ ID NO: 166083 - protein, 32 aa, Artificial Sequence
  Description of Artificial Sequence: Synthetic polypeptide
QEEEIATTNPVSTEQYGTIPMEDIQQQHNGNK

SEQ ID NO: 166084 - protein, 37 aa, Artificial Sequence
  Description of Artificial Sequence: Synthetic polypeptide
TEEEIRTTNPVATDHYGSTVPSYAGNNLSDEVGLNNR

SEQ ID NO: 166085 - protein, 36 aa, Artificial Sequence
  Description of Artificial Sequence: Synthetic polypeptide
AEEEIRTTNPVATEAYGSVSTVVSNNNSEEGTTTQQ

SEQ ID NO: 166086 - protein, 35 aa, Artificial Sequence
  Description of Artificial Sequence: Synthetic polypeptide
TEEEIRTTNPSATMEWGSTVSYTNAISQSGGNPSD

SEQ ID NO: 166087 - protein, 35 aa, Artificial Sequence
  Description of Artificial Sequence: Synthetic polypeptide
TEEEIRTTNPSATEEWGSTYSYTNAISASGGNPRD

SEQ ID NO: 166088 - protein, 36 aa, Artificial Sequence
  Description of Artificial Sequence: Synthetic polypeptide
DEEEIRTTNPVATEQYGCVCSSEEHNQEFFNSQTQE

SEQ ID NO: 166089 - protein, 34 aa, Artificial Sequence
  Description of Artificial Sequence: Synthetic polypeptide
DEMEIVTTNPVATEQYGTVCSATDGPVEFEQNDT

SEQ ID NO: 166090 - protein, 36 aa, Artificial Sequence
  Description of Artificial Sequence: Synthetic polypeptide
DEEEIRTTNPVATEQYGCVCSSEDHNQENFNSDNQS

SEQ ID NO: 166091 - protein, 36 aa, Artificial Sequence
  Description of Artificial Sequence: Synthetic polypeptide
DEEEIRTTNPVATEQYGCVCSNWPEHNQENFNSDQA

SEQ ID NO: 166092 - protein, 37 aa, Artificial Sequence
  Description of Artificial Sequence: Synthetic polypeptide
AEEEIRTTNPVATEAYGSVSTTTQQQNATEQGTNENN

SEQ ID NO: 166093 - protein, 37 aa, Artificial Sequence
  Description of Artificial Sequence: Synthetic polypeptide
AEEEIRTTNPVATEAYGSVSTTTQQQNATEQGTNNAE

SEQ ID NO: 166094 - protein, 37 aa, Artificial Sequence
  Description of Artificial Sequence: Synthetic polypeptide
AEEEIRTTNPVATEAYGSVSTTTQQQNATEQGTTSNE

SEQ ID NO: 166095 - protein, 37 aa, Artificial Sequence
  Description of Artificial Sequence: Synthetic polypeptide
AEEEIRTTNPVATEAYGSVSTTTTTNNQNEATNNATE

SEQ ID NO: 166096 - protein, 37 aa, Artificial Sequence
  Description of Artificial Sequence: Synthetic polypeptide
AEEEIRTTNPVATEAYGSVSTTVNQNGQEEATNNATE

SEQ ID NO: 166097 - protein, 37 aa, Artificial Sequence
  Description of Artificial Sequence: Synthetic polypeptide
AEEEIRTTNPVATEAYGSVSTTVTNNQQLQQNEEEQD

SEQ ID NO: 166098 - protein, 31 aa, Artificial Sequence
  Description of Artificial Sequence: Synthetic polypeptide
QEEEIACTNPVATEQYGCAPMHGTDSEGENN

SEQ ID NO: 166099 - protein, 31 aa, Artificial Sequence
  Description of Artificial Sequence: Synthetic polypeptide
QEEEIACTNPVATEQYGCAPMHGQDSEGEMD

SEQ ID NO: 166100 - protein, 32 aa, Artificial Sequence
  Description of Artificial Sequence: Synthetic polypeptide
QEEEIACTNPVATEQYGCAPMHGLDSEGENKD

SEQ ID NO: 166101 - protein, 37 aa, Artificial Sequence
  Description of Artificial Sequence: Synthetic polypeptide
AEEEIRTTNPVATEAYGSVSTVNSNNNATEEGTNDQD

SEQ ID NO: 166102 - protein, 32 aa, Artificial Sequence
  Description of Artificial Sequence: Synthetic polypeptide
DEHEIRTTNPCSYEQWGSCYTIDNHQNGGKAT

SEQ ID NO: 166103 - protein, 33 aa, Artificial Sequence
  Description of Artificial Sequence: Synthetic polypeptide
QEEEIACTNPVATEQYGCAPEHGTDSQEGENKM

SEQ ID NO: 166104 - protein, 36 aa, Artificial Sequence
  Description of Artificial Sequence: Synthetic polypeptide
DEEEIRTTNPVATEQYGCVCSNYGEHQENFFSENQA

SEQ ID NO: 166105 - protein, 37 aa, Artificial Sequence
  Description of Artificial Sequence: Synthetic polypeptide
AEEEIRTTNPVATEAYGSVSTVTDNGNNVEQGTTNED

SEQ ID NO: 166106 - protein, 32 aa, Artificial Sequence
  Description of Artificial Sequence: Synthetic polypeptide
DEHEIRTTNPCSTEPYGTISMEDIQQQQNGNH

SEQ ID NO: 166107 - protein, 33 aa, Artificial Sequence
  Description of Artificial Sequence: Synthetic polypeptide
DEDEIATTNPVATASWGCVAANNTPQDRGGENG

SEQ ID NO: 166108 - protein, 35 aa, Artificial Sequence
  Description of Artificial Sequence: Synthetic polypeptide
DEHEIRTTNPCAYEQWGSVSGGDNPQDRQGQDGQD

SEQ ID NO: 166109 - protein, 29 aa, Artificial Sequence
  Description of Artificial Sequence: Synthetic peptide
DEEEIATTNPVATECWGETAEDCAHEEYI

SEQ ID NO: 166110 - protein, 35 aa, Artificial Sequence
  Description of Artificial Sequence: Synthetic polypeptide
QEEEIACTNPVATEQWGCVAMTNGLNPRDGMGDRH

SEQ ID NO: 166111 - protein, 35 aa, Artificial Sequence
  Description of Artificial Sequence: Synthetic polypeptide
DEEEIATTNPVATEQYGSACAVPAEGQNHQDDEMN

SEQ ID NO: 166112 - protein, 35 aa, Artificial Sequence
  Description of Artificial Sequence: Synthetic polypeptide
DEEEIATTNPVATEQYGSACAVPAEGQNHQDDQMW

SEQ ID NO: 166113 - protein, 36 aa, Artificial Sequence
  Description of Artificial Sequence: Synthetic polypeptide
DEMEIRTTNPVATEQYGCVISTCPHNMEDSESQQRE

SEQ ID NO: 166114 - protein, 38 aa, Artificial Sequence
  Description of Artificial Sequence: Synthetic polypeptide
DEEEIRTTNPVATEQYGVVSTVTNSNNNTEQGTNQTED

SEQ ID NO: 166115 - protein, 37 aa, Artificial Sequence
  Description of Artificial Sequence: Synthetic polypeptide
AEEEIRTTNPVATEAYGSVSTVTNNQNLQQNEEEEDQ

SEQ ID NO: 166116 - protein, 37 aa, Artificial Sequence
  Description of Artificial Sequence: Synthetic polypeptide
DEEEIRTTNPVATEQYGSVARPTFSLQELQMVEVIVE

SEQ ID NO: 166117 - protein, 35 aa, Artificial Sequence
  Description of Artificial Sequence: Synthetic polypeptide
DEMEIVTTNPVATEQYGTVCSATDGPVEGFEGNDL

SEQ ID NO: 166118 - protein, 30 aa, Artificial Sequence
  Description of Artificial Sequence: Synthetic polypeptide
QEEEIACTNPVATEQYGCAPEHGTDSEGED

SEQ ID NO: 166119 - protein, 36 aa, Artificial Sequence
  Description of Artificial Sequence: Synthetic polypeptide
DEEEIRTTNPVATEQYGCVCSNWGEPNQGFNSENQG

SEQ ID NO: 166120 - protein, 33 aa, Artificial Sequence
  Description of Artificial Sequence: Synthetic polypeptide
DETEIRTTNPIATECWGATSNAIDWPQERKGNG

SEQ ID NO: 166121 - protein, 33 aa, Artificial Sequence
  Description of Artificial Sequence: Synthetic polypeptide
DETEIRTTNPIATECWGATSNAIDWPQEREGNG

SEQ ID NO: 166122 - protein, 35 aa, Artificial Sequence
  Description of Artificial Sequence: Synthetic polypeptide
DEMEIRTTNPVATEQYGCVSPVIPEREHGFSEMPQ

SEQ ID NO: 166123 - protein, 34 aa, Artificial Sequence
  Description of Artificial Sequence: Synthetic polypeptide
DEDEIATTNPVATEQWGANTTAATNHLAGMGNNH

SEQ ID NO: 166124 - protein, 33 aa, Artificial Sequence
  Description of Artificial Sequence: Synthetic polypeptide
DEAEIRTTNPVAYEQWGCVCINNDHMDTGNNEP

SEQ ID NO: 166125 - protein, 34 aa, Artificial Sequence
  Description of Artificial Sequence: Synthetic polypeptide
AEEEIRTTNPCAYEQWGEVAPTWENDQRTGGHEQ

SEQ ID NO: 166126 - protein, 38 aa, Artificial Sequence
  Description of Artificial Sequence: Synthetic polypeptide
DEEEIRTTNPVATEQYGSVNGPTFAQHPAPTLGNENMG

SEQ ID NO: 166127 - protein, 36 aa, Artificial Sequence
  Description of Artificial Sequence: Synthetic polypeptide
DEEEIRTTNPVATEQYGCVCSNWGEHNQENFNSDQM

SEQ ID NO: 166128 - protein, 34 aa, Artificial Sequence
  Description of Artificial Sequence: Synthetic polypeptide
DEAEIRTTNPVAYEQWGCVCINNDQEMDTGGNEQ

SEQ ID NO: 166129 - protein, 35 aa, Artificial Sequence
  Description of Artificial Sequence: Synthetic polypeptide
DEDEIATTNPVATEPWGVVCFTNEDQHHRGDTERR

SEQ ID NO: 166130 - protein, 36 aa, Artificial Sequence
  Description of Artificial Sequence: Synthetic polypeptide
DEEEIRTTNPVATEQYGCVCSNWGEHNQENFNSEQS

SEQ ID NO: 166131 - protein, 38 aa, Artificial Sequence
  Description of Artificial Sequence: Synthetic polypeptide
DEEEIRTTNPVATEQYGSVNGQHVNYEEQIIIGPEQNS

SEQ ID NO: 166132 - protein, 38 aa, Artificial Sequence
  Description of Artificial Sequence: Synthetic polypeptide
DEEEIRTTNPVATEQYGSVNGQLFVYEEQIILGPNQNS

SEQ ID NO: 166133 - protein, 37 aa, Artificial Sequence
  Description of Artificial Sequence: Synthetic polypeptide
DEEEIRTTNPVATEQYGCVCSNWGEHNQENFQSENQA

SEQ ID NO: 166134 - protein, 33 aa, Artificial Sequence
  Description of Artificial Sequence: Synthetic polypeptide
DEAEIRTTNPVAYEQWGCVCINNDENDTGDNEG

SEQ ID NO: 166135 - protein, 36 aa, Artificial Sequence
  Description of Artificial Sequence: Synthetic polypeptide
DEEEIRTTNPVATEQYGCVCSNWGEHNQESFGSEQS

SEQ ID NO: 166136 - protein, 35 aa, Artificial Sequence
  Description of Artificial Sequence: Synthetic polypeptide
DEEEIRTTNPVAYEQYGCVCSWGEHNQENFNSDQS

SEQ ID NO: 166137 - protein, 36 aa, Artificial Sequence
  Description of Artificial Sequence: Synthetic polypeptide
DEEEIRTTNPVATEQYGCVCSNWGEHNQGFNSDNQA

SEQ ID NO: 166138 - protein, 35 aa, Artificial Sequence
  Description of Artificial Sequence: Synthetic polypeptide
DEEEIRTTNPVAYEQYGCVCSWGEHNQENFGSEQS

SEQ ID NO: 166139 - protein, 36 aa, Artificial Sequence
  Description of Artificial Sequence: Synthetic polypeptide
DEEEIRTTNPVATEQYGCVCSNWGEHNQHFNSETQG

SEQ ID NO: 166140 - protein, 35 aa, Artificial Sequence
  Description of Artificial Sequence: Synthetic polypeptide
DEEEIRTTNPVATEQYGCVCSNWGEHNQNFISDQP

SEQ ID NO: 166141 - protein, 35 aa, Artificial Sequence
  Description of Artificial Sequence: Synthetic polypeptide
DEEEIRTTNPVAYEQYGCVCSWGEHNAENFNSEQS

SEQ ID NO: 166142 - protein, 38 aa, Artificial Sequence
  Description of Artificial Sequence: Synthetic polypeptide
DEEEIRTTNPVATEQYGVVSTTNNQNANQQGTTEQGSG

SEQ ID NO: 166143 - protein, 36 aa, Artificial Sequence
  Description of Artificial Sequence: Synthetic polypeptide
DEEEIRTTNPVATEQYGCVCSNWGEHNQNFLSENQT

SEQ ID NO: 166144 - protein, 33 aa, Artificial Sequence
  Description of Artificial Sequence: Synthetic polypeptide
DEAEIRTTNPVAYEQWGCVCMNNDNADGGGNAP

SEQ ID NO: 166145 - protein, 36 aa, Artificial Sequence
  Description of Artificial Sequence: Synthetic polypeptide
DEEEIRTTNPVATEQYGCVCSNWGEHNQNFNSDTQA

SEQ ID NO: 166146 - protein, 36 aa, Artificial Sequence
  Description of Artificial Sequence: Synthetic polypeptide
DEEEIRTTNPVATEQYGCVCSNWGEHNQNFNSDTQS

SEQ ID NO: 166147 - protein, 36 aa, Artificial Sequence
  Description of Artificial Sequence: Synthetic polypeptide
DEEEIRTTNPVATEQYGCVCSNWGEHNQNFNSQTQL

SEQ ID NO: 166148 - protein, 35 aa, Artificial Sequence
  Description of Artificial Sequence: Synthetic polypeptide
DEEEIRTTNPVAYEQYGCVCSWGEHNQENFNSEQS

SEQ ID NO: 166149 - protein, 31 aa, Artificial Sequence
  Description of Artificial Sequence: Synthetic polypeptide
DDSEVACTNPVSTEGYGNVAAETIQSRVGNR

SEQ ID NO: 166150 - protein, 37 aa, Artificial Sequence
  Description of Artificial Sequence: Synthetic polypeptide
DEEEIRTTNPVATEQYGCVCSNWGEHNQENFGSQNQS

SEQ ID NO: 166151 - protein, 34 aa, Artificial Sequence
  Description of Artificial Sequence: Synthetic polypeptide
DAEEIATTNPVATEQWGSVSGTGPPPDNHSAEAP

SEQ ID NO: 166152 - protein, 33 aa, Artificial Sequence
  Description of Artificial Sequence: Synthetic polypeptide
DEAEIRTTNPVAYEQWGCVCINNDAMDTGDNHQ

SEQ ID NO: 166153 - protein, 34 aa, Artificial Sequence
  Description of Artificial Sequence: Synthetic polypeptide
DETEIRTTNPCAYEQWGSVCGDNNNDQQHQGGDR

SEQ ID NO: 166154 - protein, 35 aa, Artificial Sequence
  Description of Artificial Sequence: Synthetic polypeptide
DEEEIATTNPVATEQYGSACAATGEEAGDEMGNNP

SEQ ID NO: 166155 - protein, 37 aa, Artificial Sequence
  Description of Artificial Sequence: Synthetic polypeptide
DEEEIRTTNPVATEQYGCVCSNWGEHNQEGFNSDNQS

SEQ ID NO: 166156 - protein, 36 aa, Artificial Sequence
  Description of Artificial Sequence: Synthetic polypeptide
DASEIRTTNPVATERYGQQHVPSLGTQSQRVGNNAM

SEQ ID NO: 166157 - protein, 37 aa, Artificial Sequence
  Description of Artificial Sequence: Synthetic polypeptide
DEEEISTTNPVATEQYGCVCSNTMEHNQENFGSENQF

SEQ ID NO: 166158 - protein, 36 aa, Artificial Sequence
  Description of Artificial Sequence: Synthetic polypeptide
DETEIRTTNPCAYEQWGSVCSTENLGDQDIHDEGGQ

SEQ ID NO: 166159 - protein, 37 aa, Artificial Sequence
  Description of Artificial Sequence: Synthetic polypeptide
VENEIRTTNPVATEQYGSVITVGDNGLGGGGEDNDEQ

SEQ ID NO: 166160 - protein, 36 aa, Artificial Sequence
  Description of Artificial Sequence: Synthetic polypeptide
DEEEIATTNPVATEQYGSACAATMNGQNEMGPEGAN

SEQ ID NO: 166161 - protein, 33 aa, Artificial Sequence
  Description of Artificial Sequence: Synthetic polypeptide
DETEIRTTNPCAYEQWGSVCYNQEQEDQDNQDS

SEQ ID NO: 166162 - protein, 32 aa, Artificial Sequence
  Description of Artificial Sequence: Synthetic polypeptide
VENEIRTTNPVSTEKYGTISMEDIQQQQNGNH

SEQ ID NO: 166163 - protein, 36 aa, Artificial Sequence
  Description of Artificial Sequence: Synthetic polypeptide
DEEEIATTNPVATEQYGSACAATMTGQNEMGPNGDT

SEQ ID NO: 166164 - protein, 38 aa, Artificial Sequence
  Description of Artificial Sequence: Synthetic polypeptide
DEEEIRTTNPVATEQYGVVSTTNNNQQQGTEAGTDEED

SEQ ID NO: 166165 - protein, 32 aa, Artificial Sequence
  Description of Artificial Sequence: Synthetic polypeptide
VENEIRTTNPVSTEPYGTISMEDIQQQQNGNH

SEQ ID NO: 166166 - protein, 32 aa, Artificial Sequence
  Description of Artificial Sequence: Synthetic polypeptide
VENEIRTTNPVSTEPYGTISMIDIQQQQNGNH

SEQ ID NO: 166167 - protein, 35 aa, Artificial Sequence
  Description of Artificial Sequence: Synthetic polypeptide
DEEEIRTTNPVATEQYGAVVNGFGQGQDTDNTIGF

SEQ ID NO: 166168 - protein, 35 aa, Artificial Sequence
  Description of Artificial Sequence: Synthetic polypeptide
TEEEIRTTNPVATEQYGCVCGTGEHNIYFGSDTQA

SEQ ID NO: 166169 - protein, 37 aa, Artificial Sequence
  Description of Artificial Sequence: Synthetic polypeptide
DEEEIRTTNPVATEQYGCVCSNWGEHNQENFGSDNQA

SEQ ID NO: 166170 - protein, 37 aa, Artificial Sequence
  Description of Artificial Sequence: Synthetic polypeptide
DEEEIRTTNPVATEQYGCVCSNWGEHNQENFGSDNQP

SEQ ID NO: 166171 - protein, 37 aa, Artificial Sequence
  Description of Artificial Sequence: Synthetic polypeptide
DEEEIRTTNPVATEQYGCVCSNWGEHNQENFGSDNQS

SEQ ID NO: 166172 - protein, 38 aa, Artificial Sequence
  Description of Artificial Sequence: Synthetic polypeptide
DEEEIRTTNPVATEQYGVVSTTNNNQQNGTEAGTEEQD

SEQ ID NO: 166173 - protein, 36 aa, Artificial Sequence
  Description of Artificial Sequence: Synthetic polypeptide
DEEEIRTTNPVATEQYGAVVNGFGQGQDNDQTTGFV

SEQ ID NO: 166174 - protein, 36 aa, Artificial Sequence
  Description of Artificial Sequence: Synthetic polypeptide
DEEEIRTTNPVATEQYGAVVNGFGQGGQTDSQTGGF

SEQ ID NO: 166175 - protein, 35 aa, Artificial Sequence
  Description of Artificial Sequence: Synthetic polypeptide
TEEEIRTTNPVATEQYGAVMGDGNGNLGSNVEFDE

SEQ ID NO: 166176 - protein, 36 aa, Artificial Sequence
  Description of Artificial Sequence: Synthetic polypeptide
VEQEISTTNPVATEQYGSVSATGDGEEDQEGEGQND

SEQ ID NO: 166177 - protein, 37 aa, Artificial Sequence
  Description of Artificial Sequence: Synthetic polypeptide
DEEEIRTTNPVATEQYGCVCSNWGEHNQENFGSENQF

SEQ ID NO: 166178 - protein, 32 aa, Artificial Sequence
  Description of Artificial Sequence: Synthetic polypeptide
VENEIRTTNPVSTEPYGTISMEDIRQQQNGNH

SEQ ID NO: 166179 - protein, 36 aa, Artificial Sequence
  Description of Artificial Sequence: Synthetic polypeptide
TEEEIRTTNPSATEEWGSTVSYTNAISQSQGGEPRD

SEQ ID NO: 166180 - protein, 37 aa, Artificial Sequence
  Description of Artificial Sequence: Synthetic polypeptide
DEEEIRTTNPVATEQYGCVCSNWGEHNTENFGSDNQD

SEQ ID NO: 166181 - protein, 37 aa, Artificial Sequence
  Description of Artificial Sequence: Synthetic polypeptide
AEEEIRTTNPVATEAYGSVSTNTNQQNQQEATNVATE

SEQ ID NO: 166182 - protein, 35 aa, Artificial Sequence
  Description of Artificial Sequence: Synthetic polypeptide
DEAEIRTTNPVAYEQWGCVCTGGNDMQQDRGGGEY

SEQ ID NO: 166183 - protein, 34 aa, Artificial Sequence
  Description of Artificial Sequence: Synthetic polypeptide
DEAEIRTTNPVAYEQWGCVCTPNNDEGDTGDNEI

SEQ ID NO: 166184 - protein, 36 aa, Artificial Sequence
  Description of Artificial Sequence: Synthetic polypeptide
TEEEIRTTNPVATEPYGSVCFMNAWSTADTGGNPTN

SEQ ID NO: 166185 - protein, 35 aa, Artificial Sequence
  Description of Artificial Sequence: Synthetic polypeptide
DEEEIATTNPVATECWGMHCWTMNEQQRGQDNSKD

SEQ ID NO: 166186 - protein, 35 aa, Artificial Sequence
  Description of Artificial Sequence: Synthetic polypeptide
DEAEIRTTNPVAYEQWGCVTGGNDMQQDRGGGNAN

SEQ ID NO: 166187 - protein, 34 aa, Artificial Sequence
  Description of Artificial Sequence: Synthetic polypeptide
DEMEIVTTNPVATEQYGTVCSATDGPVEFEGWLD

SEQ ID NO: 166188 - protein, 35 aa, Artificial Sequence
  Description of Artificial Sequence: Synthetic polypeptide
DEEEIATTNPVATECWGMHCWTMNEQQRGQDNNMS

SEQ ID NO: 166189 - protein, 35 aa, Artificial Sequence
  Description of Artificial Sequence: Synthetic polypeptide
DEEEISTTNPVATEQYGCVCSNWEEHNANFGSDQA

SEQ ID NO: 166190 - protein, 35 aa, Artificial Sequence
  Description of Artificial Sequence: Synthetic polypeptide
DEEEISTTNPVATEQYGCVCSNWEEHNANFGSDQE

SEQ ID NO: 166191 - protein, 38 aa, Artificial Sequence
  Description of Artificial Sequence: Synthetic polypeptide
DEEEIRTTNPVATEQYGVVSTTNNQNQNGTEQGSTTEE

SEQ ID NO: 166192 - protein, 35 aa, Artificial Sequence
  Description of Artificial Sequence: Synthetic polypeptide
DEMEIRTTNPVATEQYGCVSCPQNQQEDSESQQEE

SEQ ID NO: 166193 - protein, 35 aa, Artificial Sequence
  Description of Artificial Sequence: Synthetic polypeptide
DEDEIATTNPVATASWGSVSVANNTPQDRGIENGN

SEQ ID NO: 166194 - protein, 35 aa, Artificial Sequence
  Description of Artificial Sequence: Synthetic polypeptide
DEEEISTTNPVATEQYGCVCSNWEEDQYFNSDNQD

SEQ ID NO: 166195 - protein, 35 aa, Artificial Sequence
  Description of Artificial Sequence: Synthetic polypeptide
DEDEIATTNPVATASWGSVSVANNTPQDRGGENAN

SEQ ID NO: 166196 - protein, 34 aa, Artificial Sequence
  Description of Artificial Sequence: Synthetic polypeptide
DEMEIVTTNPVATEQYGTVCSATDGPVEFEKNED

SEQ ID NO: 166197 - protein, 32 aa, Artificial Sequence
  Description of Artificial Sequence: Synthetic polypeptide
DDSEVASTNPVSTEGYGNVAAITNIQSRVGQR

SEQ ID NO: 166198 - protein, 35 aa, Artificial Sequence
  Description of Artificial Sequence: Synthetic polypeptide
DEMEIRTTNPVATEQYGCVSCPQNMQEDSESQQFD

SEQ ID NO: 166199 - protein, 34 aa, Artificial Sequence
  Description of Artificial Sequence: Synthetic polypeptide
DEMEIVTTNPVATEQYGTVCSATDGPVEFELVND

SEQ ID NO: 166200 - protein, 35 aa, Artificial Sequence
  Description of Artificial Sequence: Synthetic polypeptide
DEDEIATTNPVATASWGSVSANNAEPQDRGDENDG

SEQ ID NO: 166201 - protein, 36 aa, Artificial Sequence
  Description of Artificial Sequence: Synthetic polypeptide
DEEEIRTTNPVATEQYGSVNIYINPDDEGSGQEEIP

SEQ ID NO: 166202 - protein, 34 aa, Artificial Sequence
  Description of Artificial Sequence: Synthetic polypeptide
DEEEIATTNPVATEQYGSACAGMHGQDSGEEPMN

SEQ ID NO: 166203 - protein, 36 aa, Artificial Sequence
  Description of Artificial Sequence: Synthetic polypeptide
DEEEISTTNPVATEQYGCVCSNWEEHNQHFGSDNQP

SEQ ID NO: 166204 - protein, 34 aa, Artificial Sequence
  Description of Artificial Sequence: Synthetic polypeptide
DEDEIATTNPVATASWGSVSAANNEPQDQGDENG

SEQ ID NO: 166205 - protein, 35 aa, Artificial Sequence
  Description of Artificial Sequence: Synthetic polypeptide
DEMEIRTTNPVATEQYGCVSCPMNMAEDSESQQRE

SEQ ID NO: 166206 - protein, 36 aa, Artificial Sequence
  Description of Artificial Sequence: Synthetic polypeptide
DEEEIRTTNPVATEQYGCVCSNWGEPAENFNSDNQE

SEQ ID NO: 166207 - protein, 36 aa, Artificial Sequence
  Description of Artificial Sequence: Synthetic polypeptide
DEEEIRTTNPVATEQYGCVCSNWGEPHNQYFGSDQA

SEQ ID NO: 166208 - protein, 37 aa, Artificial Sequence
  Description of Artificial Sequence: Synthetic polypeptide
DEEEIRTTNPVATEQYGCVCSNWGELHNQENFNSDQA

SEQ ID NO: 166209 - protein, 36 aa, Artificial Sequence
  Description of Artificial Sequence: Synthetic polypeptide
DEEEIRTTNPVATEQYGCVCSNWGEHNTENFGSDQS

SEQ ID NO: 166210 - protein, 35 aa, Artificial Sequence
  Description of Artificial Sequence: Synthetic polypeptide
DEAEIRTTNPVAYEQWGCVCTGGNDMQGDRGGEAY

SEQ ID NO: 166211 - protein, 36 aa, Artificial Sequence
  Description of Artificial Sequence: Synthetic polypeptide
DEEEISTTNPVATEQYGCVCSNWEEDNQEGFNSDQD

SEQ ID NO: 166212 - protein, 34 aa, Artificial Sequence
  Description of Artificial Sequence: Synthetic polypeptide
DEAEIRTTNPVAYEQWGCVCPNNDDQMDTGGNEP

SEQ ID NO: 166213 - protein, 33 aa, Artificial Sequence
  Description of Artificial Sequence: Synthetic polypeptide
DEAEIRTTNPVAYEQWGCVCPNNDEMDTGDQER

SEQ ID NO: 166214 - protein, 35 aa, Artificial Sequence
  Description of Artificial Sequence: Synthetic polypeptide
DEDEIATTNPVATECYGSVCQTLDQMQREGGDQGE

SEQ ID NO: 166215 - protein, 35 aa, Artificial Sequence
  Description of Artificial Sequence: Synthetic polypeptide
DEDEIATTNPVATECYGSVCQTLDQMQREGGDQGD

SEQ ID NO: 166216 - protein, 33 aa, Artificial Sequence
  Description of Artificial Sequence: Synthetic polypeptide
DEAEIRTTNPVAYEQWGCVCPNNDNMDTGDNEE

SEQ ID NO: 166217 - protein, 36 aa, Artificial Sequence
  Description of Artificial Sequence: Synthetic polypeptide
AEEEIRTTNPVATEAYGSVSTTDNGNGTEQGTEEES

SEQ ID NO: 166218 - protein, 37 aa, Artificial Sequence
  Description of Artificial Sequence: Synthetic polypeptide
DEEEICTTNPVATECYGCVSTGGNQGNQGGHGGGGQR

SEQ ID NO: 166219 - protein, 36 aa, Artificial Sequence
  Description of Artificial Sequence: Synthetic polypeptide
DEEEIRTTNPVATEQYGCVCSNWGEHNTENFNSEQD

SEQ ID NO: 166220 - protein, 36 aa, Artificial Sequence
  Description of Artificial Sequence: Synthetic polypeptide
DEEEIRTTNPVATEQYGCVCSNWGEHQEHFGSDTQT

SEQ ID NO: 166221 - protein, 34 aa, Artificial Sequence
  Description of Artificial Sequence: Synthetic polypeptide
DEEEIATTNPVAYELWGISVCSCAPVSQMMGNNG

SEQ ID NO: 166222 - protein, 36 aa, Artificial Sequence
  Description of Artificial Sequence: Synthetic polypeptide
DEEEISTTNPVATEQYGCVCSNWEDHNQFFGSDNQT

SEQ ID NO: 166223 - protein, 37 aa, Artificial Sequence
  Description of Artificial Sequence: Synthetic polypeptide
AEEEIRTTNPVATEAYGSVSTTNGNDENNNIGTNNMD

SEQ ID NO: 166224 - protein, 33 aa, Artificial Sequence
  Description of Artificial Sequence: Synthetic polypeptide
DEAEIRTTNPVAYEQWGCVCPNNEQMDTGDHEI

SEQ ID NO: 166225 - protein, 34 aa, Artificial Sequence
  Description of Artificial Sequence: Synthetic polypeptide
DEMEIVTTNPVATEQYGTVCSATDGPVEFEGPLD

SEQ ID NO: 166226 - protein, 35 aa, Artificial Sequence
  Description of Artificial Sequence: Synthetic polypeptide
DEEEISTTNPVATEQYGCVCSNWEDNQESFNSEQP

SEQ ID NO: 166227 - protein, 36 aa, Artificial Sequence
  Description of Artificial Sequence: Synthetic polypeptide
DEEEIRTTNPVATEQYGCVCSNWGEHQENFGSQTQV

SEQ ID NO: 166228 - protein, 36 aa, Artificial Sequence
  Description of Artificial Sequence: Synthetic polypeptide
DEEEIRTTNPVATEQYGCVCSNWGEHQENFNSDNQS

SEQ ID NO: 166229 - protein, 35 aa, Artificial Sequence
  Description of Artificial Sequence: Synthetic polypeptide
DEMEIVTTNPVATEQYGTVCSATDGPVEFEGPNDC

SEQ ID NO: 166230 - protein, 34 aa, Artificial Sequence
  Description of Artificial Sequence: Synthetic polypeptide
DEMEIVTTNPVATEQYGTVCSATDGPVEFEGPYD

SEQ ID NO: 166231 - protein, 36 aa, Artificial Sequence
  Description of Artificial Sequence: Synthetic polypeptide
DEEEIRTTNPVATEQYGCVCSNWGEHQEYFGSDTQS

SEQ ID NO: 166232 - protein, 37 aa, Artificial Sequence
  Description of Artificial Sequence: Synthetic polypeptide
AEEEIRTTNPVATEAYGSVSTTNNNQQNNDEGTEDGD

SEQ ID NO: 166233 - protein, 35 aa, Artificial Sequence
  Description of Artificial Sequence: Synthetic polypeptide
DEEEIRTTNPVATEQYGCVCSNWGEHQNFISDTQA

SEQ ID NO: 166234 - protein, 35 aa, Artificial Sequence
  Description of Artificial Sequence: Synthetic polypeptide
DEDEIATTNPVATECWGSVCFTNEDTQDQNRGGTD

SEQ ID NO: 166235 - protein, 35 aa, Artificial Sequence
  Description of Artificial Sequence: Synthetic polypeptide
DEDEIATTNPVATECWGSVCFTNEDTHDGQRGGDD

SEQ ID NO: 166236 - protein, 34 aa, Artificial Sequence
  Description of Artificial Sequence: Synthetic polypeptide
DEEEIATTNPVATECYGCVSGGNGNEAGGEGMTS

SEQ ID NO: 166237 - protein, 37 aa, Artificial Sequence
  Description of Artificial Sequence: Synthetic polypeptide
AEEEIRTTNPVATEAYGSVSTTNNQNNQNEANNNATE

SEQ ID NO: 166238 - protein, 36 aa, Artificial Sequence
  Description of Artificial Sequence: Synthetic polypeptide
DEEEIATTNPVATEQYGSACAATNPHHTEAPGENMN

SEQ ID NO: 166239 - protein, 36 aa, Artificial Sequence
  Description of Artificial Sequence: Synthetic polypeptide
TEEEIRTTNPSATEEWGSTVSYTNAISQNSGGNPYD

SEQ ID NO: 166240 - protein, 36 aa, Artificial Sequence
  Description of Artificial Sequence: Synthetic polypeptide
TEEEIRTTNPSATEEWGSTVSYTGNAISQSGGFPRD

SEQ ID NO: 166241 - protein, 36 aa, Artificial Sequence
  Description of Artificial Sequence: Synthetic polypeptide
TEEEIRTTNPSATEEWGSTVSYNNAISQISGGNPRD

SEQ ID NO: 166242 - protein, 33 aa, Artificial Sequence
  Description of Artificial Sequence: Synthetic polypeptide
DEMEIVTTNPVATEQYGTVCSATDIPVEAEEDD

SEQ ID NO: 166243 - protein, 37 aa, Artificial Sequence
  Description of Artificial Sequence: Synthetic polypeptide
AEEEIRTTNPVATEAYGVVSTTTNLQNQQNATNVATE

SEQ ID NO: 166244 - protein, 37 aa, Artificial Sequence
  Description of Artificial Sequence: Synthetic polypeptide
DEEEIRTTNPVATEQYGSVSTMVTEEYENENTEETDT

SEQ ID NO: 166245 - protein, 35 aa, Artificial Sequence
  Description of Artificial Sequence: Synthetic polypeptide
DEAEIRTTNPVAYEQWGSVCQGDHNLQDDKGGQDS

SEQ ID NO: 166246 - protein, 36 aa, Artificial Sequence
  Description of Artificial Sequence: Synthetic polypeptide
TEEEIATTNPVAYERDGSVSTANELSQDQFGDNNMN

SEQ ID NO: 166247 - protein, 36 aa, Artificial Sequence
  Description of Artificial Sequence: Synthetic polypeptide
AEEEIRTTNPVATEAYGVVSTVTQNGNVEQGTEQEE

SEQ ID NO: 166248 - protein, 37 aa, Artificial Sequence
  Description of Artificial Sequence: Synthetic polypeptide
AEEEIRTTNPVATEAYGVVSTVVNNLQQNEQGTEEEM

SEQ ID NO: 166249 - protein, 35 aa, Artificial Sequence
  Description of Artificial Sequence: Synthetic polypeptide
DEHEIRTTNPCATECYGVVCYKTNDEGQRQGDVDK

SEQ ID NO: 166250 - protein, 32 aa, Artificial Sequence
  Description of Artificial Sequence: Synthetic polypeptide
DEDEIATTNPVATAQWGGCVAGTGGETLDGNN

SEQ ID NO: 166251 - protein, 35 aa, Artificial Sequence
  Description of Artificial Sequence: Synthetic polypeptide
QECEICTTNPVATEAYGVVSTVNQQQLQQGTEEQE

SEQ ID NO: 166252 - protein, 35 aa, Artificial Sequence
  Description of Artificial Sequence: Synthetic polypeptide
DEEEISTTNPVATEQYGCVCSNWGEHNQGFGSDQS

SEQ ID NO: 166253 - protein, 36 aa, Artificial Sequence
  Description of Artificial Sequence: Synthetic polypeptide
QECEICTTNPVATEAYGVVSTVNQQQLQAGNEEQSE

SEQ ID NO: 166254 - protein, 38 aa, Artificial Sequence
  Description of Artificial Sequence: Synthetic polypeptide
DEEEIRTTNPVATEQYGVVSTTNNQSATEQGTTEQGSQ

SEQ ID NO: 166255 - protein, 36 aa, Artificial Sequence
  Description of Artificial Sequence: Synthetic polypeptide
DEEEISTTNPVATEQYGCVCSNWGEHNQGFGSENQG

SEQ ID NO: 166256 - protein, 36 aa, Artificial Sequence
  Description of Artificial Sequence: Synthetic polypeptide
DEEEISTTNPVATEQYGCVCSNWGEHNQNFGSDNQA

SEQ ID NO: 166257 - protein, 35 aa, Artificial Sequence
  Description of Artificial Sequence: Synthetic polypeptide
DEEEISTTNPVATEQYGCVCSNWGEHNQNFGSDQS

SEQ ID NO: 166258 - protein, 36 aa, Artificial Sequence
  Description of Artificial Sequence: Synthetic polypeptide
QECEICTTNPVATEAYGVVSTVNQQLQQGTNEEDED

SEQ ID NO: 166259 - protein, 35 aa, Artificial Sequence
  Description of Artificial Sequence: Synthetic polypeptide
DEEEISTTNPVATEQYGCVCSNWGEHNQNFNSNQA

SEQ ID NO: 166260 - protein, 36 aa, Artificial Sequence
  Description of Artificial Sequence: Synthetic polypeptide
DEEEISTTNPVATEQYGCVCSNWGEHNQYFGSDNQS

SEQ ID NO: 166261 - protein, 30 aa, Artificial Sequence
  Description of Artificial Sequence: Synthetic polypeptide
TEEEIATTNPVAYEQYGEVAPEVHSTHEEK

SEQ ID NO: 166262 - protein, 31 aa, Artificial Sequence
  Description of Artificial Sequence: Synthetic polypeptide
TEEEIATTNPVAYEQYGEAPEVQSQHEGEYK

SEQ ID NO: 166263 - protein, 35 aa, Artificial Sequence
  Description of Artificial Sequence: Synthetic polypeptide
DEEEISTTNPVATEQYGCVCSNWGEHNTNFGSEQV

SEQ ID NO: 166264 - protein, 36 aa, Artificial Sequence
  Description of Artificial Sequence: Synthetic polypeptide
DEEEISTTNPVATEQYGCVCSNWGEHNTYFGSENQS

SEQ ID NO: 166265 - protein, 35 aa, Artificial Sequence
  Description of Artificial Sequence: Synthetic polypeptide
QECEICTTNPVATEAYGVVSTNTQQLQQGTDEDTE

SEQ ID NO: 166266 - protein, 36 aa, Artificial Sequence
  Description of Artificial Sequence: Synthetic polypeptide
QECEICTTNPVATEAYGVVSTNQQQLQQGTNGEQED

SEQ ID NO: 166267 - protein, 35 aa, Artificial Sequence
  Description of Artificial Sequence: Synthetic polypeptide
QECEICTTNPVATEAYGVVSTNQQQLQQGTEGQEF

SEQ ID NO: 166268 - protein, 39 aa, Artificial Sequence
  Description of Artificial Sequence: Synthetic polypeptide
DEEEIRTTNPVATEQYGVVSTVVSNGQAGTQNIGNEEDD

SEQ ID NO: 166269 - protein, 38 aa, Artificial Sequence
  Description of Artificial Sequence: Synthetic polypeptide
DEEEIRTTNPVATEQYGVVSTTNQAIGNNNQQGTTQDT

SEQ ID NO: 166270 - protein, 36 aa, Artificial Sequence
  Description of Artificial Sequence: Synthetic polypeptide
AEEEIRTTNPVATEAYGVVSTTTDNGNVEQGTEGES

SEQ ID NO: 166271 - protein, 34 aa, Artificial Sequence
  Description of Artificial Sequence: Synthetic polypeptide
TEEEIATTNPVVTEHYGVVSWNEGEKQDQRGDTH

SEQ ID NO: 166272 - protein, 31 aa, Artificial Sequence
  Description of Artificial Sequence: Synthetic polypeptide
QEDCIATTNPVATECYGQDWVIEELQHGMES

SEQ ID NO: 166273 - protein, 34 aa, Artificial Sequence
  Description of Artificial Sequence: Synthetic polypeptide
DEMEIVTTNPVATEQYGTVCSATDGSPVEFETND

SEQ ID NO: 166274 - protein, 38 aa, Artificial Sequence
  Description of Artificial Sequence: Synthetic polypeptide
DEEEIRTTNPVATEQYGVVSTTNNQQQSATEEGTTQQQ

SEQ ID NO: 166275 - protein, 37 aa, Artificial Sequence
  Description of Artificial Sequence: Synthetic polypeptide
AEEEIRTTNPVATEAYGVVSTTNNQLTGSEEGTNTNT

SEQ ID NO: 166276 - protein, 37 aa, Artificial Sequence
  Description of Artificial Sequence: Synthetic polypeptide
AEEEIRTTNPVATEAYGVVSTTNNQQQGNQQGTEELD

SEQ ID NO: 166277 - protein, 37 aa, Artificial Sequence
  Description of Artificial Sequence: Synthetic polypeptide
AEEEIRTTNPVATEAYGVVSTTNNQQQGNQQGTNATD

SEQ ID NO: 166278 - protein, 35 aa, Artificial Sequence
  Description of Artificial Sequence: Synthetic polypeptide
DEMEIVTTNPVATEQYGTVCSATDGWPVEFEGCND

SEQ ID NO: 166279 - protein, 37 aa, Artificial Sequence
  Description of Artificial Sequence: Synthetic polypeptide
AEEEIRTTNPVATEAYGVVSTTNNQQQGNQQGTTQED

SEQ ID NO: 166280 - protein, 36 aa, Artificial Sequence
  Description of Artificial Sequence: Synthetic polypeptide
AEEEIRTTNPVATEAYGVVSTTNPNNQQEATNVATE

SEQ ID NO: 166281 - protein, 36 aa, Artificial Sequence
  Description of Artificial Sequence: Synthetic polypeptide
DEEEIRTTNPVATEQYGSVNNNEVSAEVADDKNTQE

SEQ ID NO: 166282 - protein, 37 aa, Artificial Sequence
  Description of Artificial Sequence: Synthetic polypeptide
AEEEIRTTNPVATEAYGVVSTTNQNQQQANNNENGNE

SEQ ID NO: 166283 - protein, 36 aa, Artificial Sequence
  Description of Artificial Sequence: Synthetic polypeptide
AEEEIRTTNPVATEAYGVVSTTNQQLNNNNGQEQDE

SEQ ID NO: 166284 - protein, 39 aa, Artificial Sequence
  Description of Artificial Sequence: Synthetic polypeptide
AEEEIRTTNPVATEQYGSVTVVVTTNNLQQGNNNEEEEE

SEQ ID NO: 166285 - protein, 37 aa, Artificial Sequence
  Description of Artificial Sequence: Synthetic polypeptide
AEEEIRTTNPVATEAYGVVSTTNQQQNQNEQGNNNVE

SEQ ID NO: 166286 - protein, 36 aa, Artificial Sequence
  Description of Artificial Sequence: Synthetic polypeptide
AEEEIRTTNPVATEAYGVVSTTNTQNQQEATNNATE

SEQ ID NO: 166287 - protein, 36 aa, Artificial Sequence
  Description of Artificial Sequence: Synthetic polypeptide
AEEEIRTTNPVATEAYGVVSTTQQQLGNNNNGQEDE

SEQ ID NO: 166288 - protein, 36 aa, Artificial Sequence
  Description of Artificial Sequence: Synthetic polypeptide
DEEEIRTTNPVATEQYGSVNNNIENESDSENDSYLP

SEQ ID NO: 166289 - protein, 36 aa, Artificial Sequence
  Description of Artificial Sequence: Synthetic polypeptide
AEEEIRTTNPVATEAYGVVSTTQQQQNATEQGTNTE

SEQ ID NO: 166290 - protein, 36 aa, Artificial Sequence
  Description of Artificial Sequence: Synthetic polypeptide
AEEEIRTTNPVATEAYGVVSTTQQQQQANNGEQGNE

SEQ ID NO: 166291 - protein, 35 aa, Artificial Sequence
  Description of Artificial Sequence: Synthetic polypeptide
DEDEIATTNPVATAQWGGCVATGAHLQHQMGNDRN

SEQ ID NO: 166292 - protein, 36 aa, Artificial Sequence
  Description of Artificial Sequence: Synthetic polypeptide
AEEEIRTTNPVATEAYGVVSTTQQQQQANNNNNGNE

SEQ ID NO: 166293 - protein, 38 aa, Artificial Sequence
  Description of Artificial Sequence: Synthetic polypeptide
DEEEIRTTNPVATEQYGVVSTTNNQQQSATETGTTDTQ

SEQ ID NO: 166294 - protein, 35 aa, Artificial Sequence
  Description of Artificial Sequence: Synthetic polypeptide
DEMEIVTTNPVATEQYGTVCSATDGYPVEFEGNQD

SEQ ID NO: 166295 - protein, 34 aa, Artificial Sequence
  Description of Artificial Sequence: Synthetic polypeptide
DEAEIRTTNPVAYEQWGSVAWNDDQGGHQGGQDQ

SEQ ID NO: 166296 - protein, 35 aa, Artificial Sequence
  Description of Artificial Sequence: Synthetic polypeptide
AEEEIRTTNPVATEAYGVVSTTTDNGNVEQGEDEN

SEQ ID NO: 166297 - protein, 34 aa, Artificial Sequence
  Description of Artificial Sequence: Synthetic polypeptide
DEMEIVTTNPVATEQYGTVCSATDIEVENAEEDD

SEQ ID NO: 166298 - protein, 35 aa, Artificial Sequence
  Description of Artificial Sequence: Synthetic polypeptide
DEMEIVTTNPVATEQYGTVCSATDGWPVEVFEGND

SEQ ID NO: 166299 - protein, 32 aa, Artificial Sequence
  Description of Artificial Sequence: Synthetic polypeptide
QEDCIATTNPVATECYGQDWVSEELQHGHELN

SEQ ID NO: 166300 - protein, 35 aa, Artificial Sequence
  Description of Artificial Sequence: Synthetic polypeptide
DEEEISTTNPVATEQYGCVCSNWGEHQNFGSDTQA

SEQ ID NO: 166301 - protein, 34 aa, Artificial Sequence
  Description of Artificial Sequence: Synthetic polypeptide
TEEEIATTNPVAYEQWGCYVWQIDDHLQRGQHQR

SEQ ID NO: 166302 - protein, 39 aa, Artificial Sequence
  Description of Artificial Sequence: Synthetic polypeptide
DEEEIRTTNPVATEQYGVVSTTNQEQLGNNTEQGSTDDD

SEQ ID NO: 166303 - protein, 39 aa, Artificial Sequence
  Description of Artificial Sequence: Synthetic polypeptide
DEEEIRTTNPVATEQYGVVSTTNQEQQGTNAEQGSTDDD

SEQ ID NO: 166304 - protein, 36 aa, Artificial Sequence
  Description of Artificial Sequence: Synthetic polypeptide
DEEEIRTTNPVATEQYGTVCSNWEEDHQEGFGSEQS

SEQ ID NO: 166305 - protein, 34 aa, Artificial Sequence
  Description of Artificial Sequence: Synthetic polypeptide
DEDEIATTNPVATAQWGGCCAPTGALQQMGNDRN

SEQ ID NO: 166306 - protein, 39 aa, Artificial Sequence
  Description of Artificial Sequence: Synthetic polypeptide
AEEEIRTTNPVATEAYGVVSVSVVTNNLQQGNNQQNEQD

SEQ ID NO: 166307 - protein, 34 aa, Artificial Sequence
  Description of Artificial Sequence: Synthetic polypeptide
QECEICTTNPVATEAYGVVSTEQQLQQGEEEEQL

SEQ ID NO: 166308 - protein, 38 aa, Artificial Sequence
  Description of Artificial Sequence: Synthetic polypeptide
AEEEIRTTNPVATEAYGVVSVTVVTNQLQQGNNQNLQD

SEQ ID NO: 166309 - protein, 35 aa, Artificial Sequence
  Description of Artificial Sequence: Synthetic polypeptide
DEAEIRTTNPVAYEQWGSVCVNENDHQQDGQDGVR

SEQ ID NO: 166310 - protein, 37 aa, Artificial Sequence
  Description of Artificial Sequence: Synthetic polypeptide
DEEEIRTTNPVATEQYGVVSTVVSNNNNNEQGTEEQQ

SEQ ID NO: 166311 - protein, 35 aa, Artificial Sequence
  Description of Artificial Sequence: Synthetic polypeptide
AEDEIRTTNPVAYEQWGSVCSTENDDRNDTQGRDA

SEQ ID NO: 166312 - protein, 36 aa, Artificial Sequence
  Description of Artificial Sequence: Synthetic polypeptide
AEDEIRTTNPVAYEQWGSVCSTENDDQRNDHQNGDA

SEQ ID NO: 166313 - protein, 35 aa, Artificial Sequence
  Description of Artificial Sequence: Synthetic polypeptide
AEEEIRTTNPVATEAYGVVVTVTNNQQQGEEEEAD

SEQ ID NO: 166314 - protein, 37 aa, Artificial Sequence
  Description of Artificial Sequence: Synthetic polypeptide
DEEEIRTTNPVATEQYGVVSTVVSNNNEQGTDEEEDE

SEQ ID NO: 166315 - protein, 34 aa, Artificial Sequence
  Description of Artificial Sequence: Synthetic polypeptide
QECEICTTNPVATEAYGVVSTEQQLNQQGEDEQL

SEQ ID NO: 166316 - protein, 36 aa, Artificial Sequence
  Description of Artificial Sequence: Synthetic polypeptide
DEAEIRTTNPVAYEQWGSVCVNENDQEQQQGQDNVR

SEQ ID NO: 166317 - protein, 35 aa, Artificial Sequence
  Description of Artificial Sequence: Synthetic polypeptide
DEMEIRTTNPVATEQYGCVCSNWGELAEYFNSDQS

SEQ ID NO: 166318 - protein, 35 aa, Artificial Sequence
  Description of Artificial Sequence: Synthetic polypeptide
DEAEIRTTNPVAYEQWGSVCVNENDQQNDGQDMVR

SEQ ID NO: 166319 - protein, 38 aa, Artificial Sequence
  Description of Artificial Sequence: Synthetic polypeptide
DEEEIRTTNPVATEQYGTVATVNNNNLQQGEGDEEDEE

SEQ ID NO: 166320 - protein, 36 aa, Artificial Sequence
  Description of Artificial Sequence: Synthetic polypeptide
DEEEISTTNPVATEQYGCVCSNWMEHNQNFGSDNQS

SEQ ID NO: 166321 - protein, 35 aa, Artificial Sequence
  Description of Artificial Sequence: Synthetic polypeptide
DEAEIRTTNPVAYEQWGSVCVNENDQQQDGQDNVT

SEQ ID NO: 166322 - protein, 36 aa, Artificial Sequence
  Description of Artificial Sequence: Synthetic polypeptide
DEAEIRTTNPVAYEQWGSVCVNENDQRQQDGHDNVQ

SEQ ID NO: 166323 - protein, 36 aa, Artificial Sequence
  Description of Artificial Sequence: Synthetic polypeptide
DEAEIRTTNPVAYEQWGSVCVNENGQAQQDGQDNVR

SEQ ID NO: 166324 - protein, 35 aa, Artificial Sequence
  Description of Artificial Sequence: Synthetic polypeptide
DEAEIRTTNPVAYEQWGSVCVNENGQQQDGQDNWQ

SEQ ID NO: 166325 - protein, 31 aa, Artificial Sequence
  Description of Artificial Sequence: Synthetic polypeptide
TEEEIATTNPVATEQYGEAPCEVEQSQHEEK

SEQ ID NO: 166326 - protein, 35 aa, Artificial Sequence
  Description of Artificial Sequence: Synthetic polypeptide
QECEICTTNPVATEAYGVVSTENQQLQQGTEEQTQ

SEQ ID NO: 166327 - protein, 35 aa, Artificial Sequence
  Description of Artificial Sequence: Synthetic polypeptide
AEEEIRTTNPVATEEYGCSCSNSGELNQNFGSQQS

SEQ ID NO: 166328 - protein, 36 aa, Artificial Sequence
  Description of Artificial Sequence: Synthetic polypeptide
DEQEIATTNPVATEQYGSVSATGDGIEDQEGEEDGD

SEQ ID NO: 166329 - protein, 35 aa, Artificial Sequence
  Description of Artificial Sequence: Synthetic polypeptide
DEEEISTTNPVATEQYGCVCSNWGEHQNFISENQS

SEQ ID NO: 166330 - protein, 34 aa, Artificial Sequence
  Description of Artificial Sequence: Synthetic polypeptide
QECEICTTNPVATEAYGVVSTEQQQLQQGEEETD

SEQ ID NO: 166331 - protein, 34 aa, Artificial Sequence
  Description of Artificial Sequence: Synthetic polypeptide
QECEICTTNPVATEAYGVVSTEQQQLQQGTEEAN

SEQ ID NO: 166332 - protein, 35 aa, Artificial Sequence
  Description of Artificial Sequence: Synthetic polypeptide
QECEICTTNPVATEAYGVVSTNQQQLQQGTEGEQD

SEQ ID NO: 166333 - protein, 37 aa, Artificial Sequence
  Description of Artificial Sequence: Synthetic polypeptide
DEEEISTTNPVATEQYGCVCSNWGELHNQNFGSENQS

SEQ ID NO: 166334 - protein, 35 aa, Artificial Sequence
  Description of Artificial Sequence: Synthetic polypeptide
QECEICTTNPVATEAYGVVSTNQQQLQQGTEEQTD

SEQ ID NO: 166335 - protein, 35 aa, Artificial Sequence
  Description of Artificial Sequence: Synthetic polypeptide
QECEICTTNPVATEAYGVVSTNQQQLQQGTEEEET

SEQ ID NO: 166336 - protein, 35 aa, Artificial Sequence
  Description of Artificial Sequence: Synthetic polypeptide
TEEEIATTNPVAYEQDGSVSIAMELSQDQGGNYMN

SEQ ID NO: 166337 - protein, 35 aa, Artificial Sequence
  Description of Artificial Sequence: Synthetic polypeptide
AEDEIRTTNPVAYEQWGSVCSTENDNNNDTQNGDA

SEQ ID NO: 166338 - protein, 38 aa, Artificial Sequence
  Description of Artificial Sequence: Synthetic polypeptide
DEEEIRTTNPVATEQYGSVGSWTPNSVSQNTQMVQQAD

SEQ ID NO: 166339 - protein, 35 aa, Artificial Sequence
  Description of Artificial Sequence: Synthetic polypeptide
QECEICTTNPVATEAYGVVSTNQQQLQQGTDEQEQ

SEQ ID NO: 166340 - protein, 36 aa, Artificial Sequence
  Description of Artificial Sequence: Synthetic polypeptide
DEEEISTTNPVATEQYGCVCSNWGELNQNFNSETQS

SEQ ID NO: 166341 - protein, 36 aa, Artificial Sequence
  Description of Artificial Sequence: Synthetic polypeptide
TEEEIATTNPVAYEADGSVSTANELSQDQFGDNYSE

SEQ ID NO: 166342 - protein, 35 aa, Artificial Sequence
  Description of Artificial Sequence: Synthetic polypeptide
DEAEIRTTNPVAYEQWGSVCSTIDGGRQGDQIDQM

SEQ ID NO: 166343 - protein, 35 aa, Artificial Sequence
  Description of Artificial Sequence: Synthetic polypeptide
DEEEISTTNPVATEQYGCVCSNWGEPNQNFNSDQS

SEQ ID NO: 166344 - protein, 34 aa, Artificial Sequence
  Description of Artificial Sequence: Synthetic polypeptide
DEAEIATTNPVAYEQYGSVAITNQDENGGMESDD

SEQ ID NO: 166345 - protein, 37 aa, Artificial Sequence
  Description of Artificial Sequence: Synthetic polypeptide
DEEEISTTNPVATEQYGCVCSNWGETNQENFGSDNQE

SEQ ID NO: 166346 - protein, 37 aa, Artificial Sequence
  Description of Artificial Sequence: Synthetic polypeptide
DEEEISTTNPVATEQYGCVCSNWGETNQENFGSENQF

SEQ ID NO: 166347 - protein, 34 aa, Artificial Sequence
  Description of Artificial Sequence: Synthetic polypeptide
TEEEIATTNPVAWEQYGSVQCTGSASVRTVANNE

SEQ ID NO: 166348 - protein, 35 aa, Artificial Sequence
  Description of Artificial Sequence: Synthetic polypeptide
QECEICTTNPVATEAYGVVSTNNQQLQQGTEEQET

SEQ ID NO: 166349 - protein, 36 aa, Artificial Sequence
  Description of Artificial Sequence: Synthetic polypeptide
DEEEISTTNPVATEQYGCVCSNWGETNQNFISDNQS

SEQ ID NO: 166350 - protein, 35 aa, Artificial Sequence
  Description of Artificial Sequence: Synthetic polypeptide
QECEICTTNPVATEAYGVVSTNLQQLQQGTDEQDE

SEQ ID NO: 166351 - protein, 34 aa, Artificial Sequence
  Description of Artificial Sequence: Synthetic polypeptide
QECEICTTNPVATEAYGVVSTNLQQLQAATEEGQ

SEQ ID NO: 166352 - protein, 36 aa, Artificial Sequence
  Description of Artificial Sequence: Synthetic polypeptide
DEEEISTTNPVATEQYGCVCSNWGNHNTNFGSENQS

SEQ ID NO: 166353 - protein, 35 aa, Artificial Sequence
  Description of Artificial Sequence: Synthetic polypeptide
DEEEISTTNPVATEQYGCVCSNWGNHTENFGSDQS

SEQ ID NO: 166354 - protein, 35 aa, Artificial Sequence
  Description of Artificial Sequence: Synthetic polypeptide
QECEICTTNPVATEAYGVVSTNLQQLNQAGTEQGQ

SEQ ID NO: 166355 - protein, 34 aa, Artificial Sequence
  Description of Artificial Sequence: Synthetic polypeptide
QECEICTTNPVATEAYGVVSTLLQQLQQGTEEQD

SEQ ID NO: 166356 - protein, 33 aa, Artificial Sequence
  Description of Artificial Sequence: Synthetic polypeptide
DEAEIATTNPVAYEQYGSVAITHGEATANGGEQ

SEQ ID NO: 166357 - protein, 35 aa, Artificial Sequence
  Description of Artificial Sequence: Synthetic polypeptide
QECEICTTNPVATEAYGVVSTEQQQLQQGTNEQTE

SEQ ID NO: 166358 - protein, 36 aa, Artificial Sequence
  Description of Artificial Sequence: Synthetic polypeptide
DEEEICTTNPVATECYGSVTTGNQGNQGGHGQGGDD

SEQ ID NO: 166359 - protein, 35 aa, Artificial Sequence
  Description of Artificial Sequence: Synthetic polypeptide
DEEEIATTNPVAYEPQWGQSVAQNDGLQTDDITQR

SEQ ID NO: 166360 - protein, 36 aa, Artificial Sequence
  Description of Artificial Sequence: Synthetic polypeptide
DEEEIRTTNPVATEQYGCVCSSGEHNQENFPSENQS

SEQ ID NO: 166361 - protein, 36 aa, Artificial Sequence
  Description of Artificial Sequence: Synthetic polypeptide
DEEEIRTTNPVATEQYGSVAEPPSPHQLPLIVEYHD

SEQ ID NO: 166362 - protein, 36 aa, Artificial Sequence
  Description of Artificial Sequence: Synthetic polypeptide
DEEEIRTTNPVSTEQYGQCVCGNWGELNQGFGSQQA

SEQ ID NO: 166363 - protein, 35 aa, Artificial Sequence
  Description of Artificial Sequence: Synthetic polypeptide
DEEEISTTNPVATEQYGCVCSNWGEHANFQSDTQE

SEQ ID NO: 166364 - protein, 37 aa, Artificial Sequence
  Description of Artificial Sequence: Synthetic polypeptide
TEEEIRCTNPVATEAYGSVPNATSNELSQNRVTNYEG

SEQ ID NO: 166365 - protein, 34 aa, Artificial Sequence
  Description of Artificial Sequence: Synthetic polypeptide
DEEEISTTNPVATEQYGCVCSNWGEHASFGSDQS

SEQ ID NO: 166366 - protein, 30 aa, Artificial Sequence
  Description of Artificial Sequence: Synthetic polypeptide
QEECIATTNPVATEQYGEAPERVCQPEQEK

SEQ ID NO: 166367 - protein, 29 aa, Artificial Sequence
  Description of Artificial Sequence: Synthetic peptide
QEECIATTNPVATEGYGEAPEVCQHEEEK

SEQ ID NO: 166368 - protein, 36 aa, Artificial Sequence
  Description of Artificial Sequence: Synthetic polypeptide
DEEEISTTNPVATEQYGCVCSNWGEHEQYFGSDNQA

SEQ ID NO: 166369 - protein, 34 aa, Artificial Sequence
  Description of Artificial Sequence: Synthetic polypeptide
DEMEIVTTNPVATEQYGTVCSATDGPVEWFEGDD

SEQ ID NO: 166370 - protein, 35 aa, Artificial Sequence
  Description of Artificial Sequence: Synthetic polypeptide
QEECIACTNPVATEQFGSVSWNEGEQERQRMNGER

SEQ ID NO: 166371 - protein, 35 aa, Artificial Sequence
  Description of Artificial Sequence: Synthetic polypeptide
DEEEIRTTNPVAYEQYGQCVCSWGEHNQNFNSQQS

SEQ ID NO: 166372 - protein, 30 aa, Artificial Sequence
  Description of Artificial Sequence: Synthetic polypeptide
QEEEIATVNPVATEQYGEACEEVCQHEECK

SEQ ID NO: 166373 - protein, 35 aa, Artificial Sequence
  Description of Artificial Sequence: Synthetic polypeptide
AEDEIRTTNPVAYEQWGVVCSTENDQRNDEQNGDA

SEQ ID NO: 166374 - protein, 37 aa, Artificial Sequence
  Description of Artificial Sequence: Synthetic polypeptide
AEEEIRTTNPVATEAYGSVSVTTNGNNQNEATNVATE

SEQ ID NO: 166375 - protein, 34 aa, Artificial Sequence
  Description of Artificial Sequence: Synthetic polypeptide
AEDEIRTTNPVAYEQWGSYWSTINPNGEEGNAKD

SEQ ID NO: 166376 - protein, 35 aa, Artificial Sequence
  Description of Artificial Sequence: Synthetic polypeptide
AEEEIRTTNPVATEAYGSVVTTVTNNQQSAEEEED

SEQ ID NO: 166377 - protein, 34 aa, Artificial Sequence
  Description of Artificial Sequence: Synthetic polypeptide
DEMEIRTTNPVATEQYGCVCSWGEDAHFNSDTQS

SEQ ID NO: 166378 - protein, 36 aa, Artificial Sequence
  Description of Artificial Sequence: Synthetic polypeptide
QEDEIRTTNPVAYEQYGTIVSCTGNSLSQTSTEENP

SEQ ID NO: 166379 - protein, 36 aa, Artificial Sequence
  Description of Artificial Sequence: Synthetic polypeptide
AEEEIRTTNPVATEAYGSVVTVTNNQLQQNEEEEDD

SEQ ID NO: 166380 - protein, 36 aa, Artificial Sequence
  Description of Artificial Sequence: Synthetic polypeptide
AEEEIRTTNPVATEAYGSVVTVTNNQNQQGEEEEDA

SEQ ID NO: 166381 - protein, 36 aa, Artificial Sequence
  Description of Artificial Sequence: Synthetic polypeptide
QEDEIRTTNPVAYEQYGTICSCTSNSLSQTSTEGNP

SEQ ID NO: 166382 - protein, 36 aa, Artificial Sequence
  Description of Artificial Sequence: Synthetic polypeptide
AEEEIRTTNPVATEAYGSVVTVTNNQQQGEEEETDE

SEQ ID NO: 166383 - protein, 36 aa, Artificial Sequence
  Description of Artificial Sequence: Synthetic polypeptide
AEEEIRTTNPVATEAYGSVVTVTNNQQQQGEEEESD

SEQ ID NO: 166384 - protein, 34 aa, Artificial Sequence
  Description of Artificial Sequence: Synthetic polypeptide
DEHEIRTTNPCAYEQWGSVCGDGNNDQRGQTGDQ

SEQ ID NO: 166385 - protein, 35 aa, Artificial Sequence
  Description of Artificial Sequence: Synthetic polypeptide
AEEEIRTTNPVATEAYGSVVTVTTNNQQQAEEEED

SEQ ID NO: 166386 - protein, 36 aa, Artificial Sequence
  Description of Artificial Sequence: Synthetic polypeptide
AEEEIRTTNPVATEAYGSVVTVTVNNQQQNEEEEDT

SEQ ID NO: 166387 - protein, 38 aa, Artificial Sequence
  Description of Artificial Sequence: Synthetic polypeptide
DEEEIRTTNPVATEQYGVVSTVVNTNQNQQGTTEQGSE

SEQ ID NO: 166388 - protein, 35 aa, Artificial Sequence
  Description of Artificial Sequence: Synthetic polypeptide
DEMEIRTTNPVATEQYGCVCSWGEHAENFNSENQL

SEQ ID NO: 166389 - protein, 36 aa, Artificial Sequence
  Description of Artificial Sequence: Synthetic polypeptide
AEEEIRTTNPVATEAYGSVVVTVTNNNQQQNEEEED

SEQ ID NO: 166390 - protein, 35 aa, Artificial Sequence
  Description of Artificial Sequence: Synthetic polypeptide
TEEEIRSTNPSATEEWGSTVSYSNAISQSGGNPRD

SEQ ID NO: 166391 - protein, 37 aa, Artificial Sequence
  Description of Artificial Sequence: Synthetic polypeptide
AEEEIRTTNPVATEAYGSVSVTNNQQNQQEATNVATE

SEQ ID NO: 166392 - protein, 35 aa, Artificial Sequence
  Description of Artificial Sequence: Synthetic polypeptide
TEEEIRTTNPSATEEWGSTVSYKNAISQSGGNPQD

SEQ ID NO: 166393 - protein, 34 aa, Artificial Sequence
  Description of Artificial Sequence: Synthetic polypeptide
DASEIATTNPVATERYGQQVPSKGPQSQRVGSNA

SEQ ID NO: 166394 - protein, 35 aa, Artificial Sequence
  Description of Artificial Sequence: Synthetic polypeptide
WEEEIATTNPVATEQYGCVANANGLPTEAPGENMN

SEQ ID NO: 166395 - protein, 34 aa, Artificial Sequence
  Description of Artificial Sequence: Synthetic polypeptide
DEMEIVTTNPVATEQYGTVCSATDGPVEPFEDND

SEQ ID NO: 166396 - protein, 34 aa, Artificial Sequence
  Description of Artificial Sequence: Synthetic polypeptide
DEMEIVTTNPVATEQYGTVCSATDGPVEPFEIND

SEQ ID NO: 166397 - protein, 35 aa, Artificial Sequence
  Description of Artificial Sequence: Synthetic polypeptide
DEEEIATTNPVATEQYGSACAVPPAEGQNHQDMMH

SEQ ID NO: 166398 - protein, 36 aa, Artificial Sequence
  Description of Artificial Sequence: Synthetic polypeptide
DEEEIATTNPVATEQYGSACCANPHQAEAEIGNENF

SEQ ID NO: 166399 - protein, 36 aa, Artificial Sequence
  Description of Artificial Sequence: Synthetic polypeptide
DEEEISTTNPVATEQYGCVCSNWGEDLQENFGSEQA

SEQ ID NO: 166400 - protein, 36 aa, Artificial Sequence
  Description of Artificial Sequence: Synthetic polypeptide
DEEEIRTTNPVATEQYGAVVNGFGNGQQTTQTVGAT

SEQ ID NO: 166401 - protein, 37 aa, Artificial Sequence
  Description of Artificial Sequence: Synthetic polypeptide
AEEEIRTTNPVATEAYGSVSTVVSNNNVTEEGTNSQD

SEQ ID NO: 166402 - protein, 36 aa, Artificial Sequence
  Description of Artificial Sequence: Synthetic polypeptide
TEEEIRTTNPCATEQYGSVPEEIANLQATTGPVGQN

SEQ ID NO: 166403 - protein, 36 aa, Artificial Sequence
  Description of Artificial Sequence: Synthetic polypeptide
DEEEISTTNPVATEQYGCVCSNWGEDNQEGFNSDQG

SEQ ID NO: 166404 - protein, 35 aa, Artificial Sequence
  Description of Artificial Sequence: Synthetic polypeptide
DEEEIRTTNPVSTEQYGQCVCQSELNQEGFGSQQS

SEQ ID NO: 166405 - protein, 37 aa, Artificial Sequence
  Description of Artificial Sequence: Synthetic polypeptide
AEEEIRTTNPVATEAYGSVSTVVSTNDGTEQGNNQQQ

SEQ ID NO: 166406 - protein, 39 aa, Artificial Sequence
  Description of Artificial Sequence: Synthetic polypeptide
DEEEIRTTNPVATEQYGVVSTVTNQQQGNQQGTTTNNDD

SEQ ID NO: 166407 - protein, 29 aa, Artificial Sequence
  Description of Artificial Sequence: Synthetic peptide
QEECIATVNPVATEQYGEANEVCQHEEFK

SEQ ID NO: 166408 - protein, 36 aa, Artificial Sequence
  Description of Artificial Sequence: Synthetic polypeptide
TEEEIRSTNPVAYEQYGSTVSCTGEMLDHPGENNAQ

SEQ ID NO: 166409 - protein, 36 aa, Artificial Sequence
  Description of Artificial Sequence: Synthetic polypeptide
DEEEIATTNPVATEQYGSACPGNNDIPQDNPGGNNQ

SEQ ID NO: 166410 - protein, 34 aa, Artificial Sequence
  Description of Artificial Sequence: Synthetic polypeptide
TEEEIRSTNPVAYEQWGSTVSCTGEMLDMAENNA

SEQ ID NO: 166411 - protein, 35 aa, Artificial Sequence
  Description of Artificial Sequence: Synthetic polypeptide
DEEEISTTNPVATEQYGCVCSNWGEDQNFNSNTQS

SEQ ID NO: 166412 - protein, 35 aa, Artificial Sequence
  Description of Artificial Sequence: Synthetic polypeptide
TEEEIRSTNPVAYEAYGSTVSCTGEMLDHFGENNA

SEQ ID NO: 166413 - protein, 36 aa, Artificial Sequence
  Description of Artificial Sequence: Synthetic polypeptide
DEEEIRTTNPVATEQYGAVVIDGNMNLNEGGGQDTT

SEQ ID NO: 166414 - protein, 34 aa, Artificial Sequence
  Description of Artificial Sequence: Synthetic polypeptide
TEEEIRSTNPVAYDQYGSTVSCTGEMLDHPENNA

SEQ ID NO: 166415 - protein, 29 aa, Artificial Sequence
  Description of Artificial Sequence: Synthetic peptide
QEECIATTNPVAYEQYGEATEVCQHEEEK

SEQ ID NO: 166416 - protein, 31 aa, Artificial Sequence
  Description of Artificial Sequence: Synthetic polypeptide
QEECIATTNPVAYEQYGEASPSEVCQPHLEK

SEQ ID NO: 166417 - protein, 35 aa, Artificial Sequence
  Description of Artificial Sequence: Synthetic polypeptide
DEEEIATTNPVATEQYGSACPGNNDIPQDNPMENN

SEQ ID NO: 166418 - protein, 33 aa, Artificial Sequence
  Description of Artificial Sequence: Synthetic polypeptide
QEECIQTTNPVAYERYGCSVPINMGSDRPGGNA

SEQ ID NO: 166419 - protein, 34 aa, Artificial Sequence
  Description of Artificial Sequence: Synthetic polypeptide
DEAEIRTTNPVAYEQWGSVAGTGPPGEHQQQGDH

SEQ ID NO: 166420 - protein, 37 aa, Artificial Sequence
  Description of Artificial Sequence: Synthetic polypeptide
AEEEIRTTNPVATEAYGSVVVTVTNNQQLQQGEEEED

SEQ ID NO: 166421 - protein, 35 aa, Artificial Sequence
  Description of Artificial Sequence: Synthetic polypeptide
QEDEIRTTNPVATEQYGSVNTDNMFETIGGGQEMG

SEQ ID NO: 166422 - protein, 31 aa, Artificial Sequence
  Description of Artificial Sequence: Synthetic polypeptide
DEDEIATTNPVATASWGCIATTAEQRDDNEN

SEQ ID NO: 166423 - protein, 37 aa, Artificial Sequence
  Description of Artificial Sequence: Synthetic polypeptide
DEEEIRTTNPVATEQYGSVNNNEEVSLEVPDNENEQW

SEQ ID NO: 166424 - protein, 36 aa, Artificial Sequence
  Description of Artificial Sequence: Synthetic polypeptide
DEEEISTTNPVATEQYGCVCSNWGEHNEGFGSDNQA

SEQ ID NO: 166425 - protein, 39 aa, Artificial Sequence
  Description of Artificial Sequence: Synthetic polypeptide
DEEEIRTTNPVATEQYGVVSTVVNTQAGNNDTTEENNAT

SEQ ID NO: 166426 - protein, 35 aa, Artificial Sequence
  Description of Artificial Sequence: Synthetic polypeptide
DEAEIATTNPVAYEQYGSTVGCTLLSEDHEGGENF

SEQ ID NO: 166427 - protein, 36 aa, Artificial Sequence
  Description of Artificial Sequence: Synthetic polypeptide
DEAEIATTNPVAYEQYGSVAAAINLLQVAGTGTVRN

SEQ ID NO: 166428 - protein, 30 aa, Artificial Sequence
  Description of Artificial Sequence: Synthetic polypeptide
DEDEIATTNPVATASWGCIAANNETRQDNF

SEQ ID NO: 166429 - protein, 34 aa, Artificial Sequence
  Description of Artificial Sequence: Synthetic polypeptide
DEEEIRTTNPVSTEQYGCVCQWGEDQGFNSQNQS

SEQ ID NO: 166430 - protein, 38 aa, Artificial Sequence
  Description of Artificial Sequence: Synthetic polypeptide
DEEEIRTTNPVATEQYGSVAEPTMMEVTVLENMATLNR

SEQ ID NO: 166431 - protein, 38 aa, Artificial Sequence
  Description of Artificial Sequence: Synthetic polypeptide
DEEEIRTTNPVATEQYGSVNNNENVELLEVLGNDETQD

SEQ ID NO: 166432 - protein, 36 aa, Artificial Sequence
  Description of Artificial Sequence: Synthetic polypeptide
DEEEIRTTNPVATEQYGSVNNNEVEDEVPVNTGTVW

SEQ ID NO: 166433 - protein, 36 aa, Artificial Sequence
  Description of Artificial Sequence: Synthetic polypeptide
DEEEIRTTNPVATEQYGCVCSSGEHEQENFISDNQQ

SEQ ID NO: 166434 - protein, 38 aa, Artificial Sequence
  Description of Artificial Sequence: Synthetic polypeptide
DEEEIRTTNPVATEQYGSVAHPEMMEVTVEENGITLNR

SEQ ID NO: 166435 - protein, 38 aa, Artificial Sequence
  Description of Artificial Sequence: Synthetic polypeptide
DEEEIRTTNPVATEQYGVVSTTNNQQQNATEQGSTEEE

SEQ ID NO: 166436 - protein, 35 aa, Artificial Sequence
  Description of Artificial Sequence: Synthetic polypeptide
DEEEIRTTNPVSTEQYGCVCQWGEDLQEGFGSQQS

SEQ ID NO: 166437 - protein, 38 aa, Artificial Sequence
  Description of Artificial Sequence: Synthetic polypeptide
DEEEIRTTNPVATEQYGVVSTVVNTQQGTEDEEDEEEE

SEQ ID NO: 166438 - protein, 35 aa, Artificial Sequence
  Description of Artificial Sequence: Synthetic polypeptide
DEEEIRTTNPVATEQYGCVCSSGEHNIFFNSEFQS

SEQ ID NO: 166439 - protein, 36 aa, Artificial Sequence
  Description of Artificial Sequence: Synthetic polypeptide
DEMEIRTTNPVATEQYGCVCSTGEHNQENFNSENQS

SEQ ID NO: 166440 - protein, 37 aa, Artificial Sequence
  Description of Artificial Sequence: Synthetic polypeptide
DEEEIRTTNPVATEQYGSVNNNEVELWEVLDNFNTQD

SEQ ID NO: 166441 - protein, 36 aa, Artificial Sequence
  Description of Artificial Sequence: Synthetic polypeptide
DEEEIRTTNPVATEQYGCVCSSGEHNQEGFGSETQL

SEQ ID NO: 166442 - protein, 36 aa, Artificial Sequence
  Description of Artificial Sequence: Synthetic polypeptide
DEEEIRTTNPVAYEQYGQCVCSWMEDLNQHFGSQQN

SEQ ID NO: 166443 - protein, 28 aa, Artificial Sequence
  Description of Artificial Sequence: Synthetic peptide
QEDEIACTNPVGTEGWGVFASALQHGDI

SEQ ID NO: 166444 - protein, 37 aa, Artificial Sequence
  Description of Artificial Sequence: Synthetic polypeptide
DEEEIRTTNPVATEQYGSVAEPPSPTHQLRLIVEQHI

SEQ ID NO: 166445 - protein, 39 aa, Artificial Sequence
  Description of Artificial Sequence: Synthetic polypeptide
DEEEIRTTNPVATEQYGVVSTVVNTTNNQQGTENEEEED

SEQ ID NO: 166446 - protein, 36 aa, Artificial Sequence
  Description of Artificial Sequence: Synthetic polypeptide
DEEEIRTTNPVATEQYGCVCSSGEHNQENFISENQA

SEQ ID NO: 166447 - protein, 36 aa, Artificial Sequence
  Description of Artificial Sequence: Synthetic polypeptide
DEEEIRTTNPVATEQYGCVCSSGEHNQENFISENQS

SEQ ID NO: 166448 - protein, 39 aa, Artificial Sequence
  Description of Artificial Sequence: Synthetic polypeptide
DEEEIRTTNPVATEQYGVVSTTNNQQQSATEEGGTNQTQ

SEQ ID NO: 166449 - protein, 30 aa, Artificial Sequence
  Description of Artificial Sequence: Synthetic polypeptide
QEEEIATVNPVATEQYGEAPFEVDQHEECK

SEQ ID NO: 166450 - protein, 36 aa, Artificial Sequence
  Description of Artificial Sequence: Synthetic polypeptide
AEEEIRTTNPVATEAYGTVSTTTQNGNTEQGTEEED

SEQ ID NO: 166451 - protein, 35 aa, Artificial Sequence
  Description of Artificial Sequence: Synthetic polypeptide
TEEEIGTTNPVAWEQYGSTVSCTGQAAVRTVANNE

SEQ ID NO: 166452 - protein, 37 aa, Artificial Sequence
  Description of Artificial Sequence: Synthetic polypeptide
DEEEICTTNPVATECYGSVATTGNQGNQGGHGGGGNW

SEQ ID NO: 166453 - protein, 31 aa, Artificial Sequence
  Description of Artificial Sequence: Synthetic polypeptide
DDSEVASTNPVSTEGYGNVAANAIQSRVGQR

SEQ ID NO: 166454 - protein, 35 aa, Artificial Sequence
  Description of Artificial Sequence: Synthetic polypeptide
DEAEIATTNPVAYEQYGSTVAGANDQTAMGPNENT

SEQ ID NO: 166455 - protein, 36 aa, Artificial Sequence
  Description of Artificial Sequence: Synthetic polypeptide
AEEEIRTTNPVATEAYGSVVVTVTNNQQQAEEEEND

SEQ ID NO: 166456 - protein, 36 aa, Artificial Sequence
  Description of Artificial Sequence: Synthetic polypeptide
AEEEIRTTNPVATEAYGSVVVTVTNNQQQGEEEEGD

SEQ ID NO: 166457 - protein, 35 aa, Artificial Sequence
  Description of Artificial Sequence: Synthetic polypeptide
DEMEIRTTNPVATEQYGCVCSWEELNINFNSDTQA

SEQ ID NO: 166458 - protein, 37 aa, Artificial Sequence
  Description of Artificial Sequence: Synthetic polypeptide
DEEEIRTTNPVATEQYGCVCSSGEDHNAENFGSDNQS

SEQ ID NO: 166459 - protein, 37 aa, Artificial Sequence
  Description of Artificial Sequence: Synthetic polypeptide
DEEEIRTTNPVATEQYGSVAQPPRMIENVENGLTINV

SEQ ID NO: 166460 - protein, 35 aa, Artificial Sequence
  Description of Artificial Sequence: Synthetic polypeptide
QEDEIRTTNPVATEAWGSVSAINGEGQDGEGENNG

SEQ ID NO: 166461 - protein, 37 aa, Artificial Sequence
  Description of Artificial Sequence: Synthetic polypeptide
DEEEIRTTNPVATEQYGSVAQNDGEEQIENTEEANIM

SEQ ID NO: 166462 - protein, 36 aa, Artificial Sequence
  Description of Artificial Sequence: Synthetic polypeptide
DEEEIRTTNPVATEQYGCVCSSGEDHNQENFGSEQV

SEQ ID NO: 166463 - protein, 38 aa, Artificial Sequence
  Description of Artificial Sequence: Synthetic polypeptide
AEEEIRTTNPVATEAYGSVVVVVTTNLQQAGEGNETEE

SEQ ID NO: 166464 - protein, 36 aa, Artificial Sequence
  Description of Artificial Sequence: Synthetic polypeptide
AEEEIRTTNPVATEAYGTVSTTNTNNQNEATNNATE

SEQ ID NO: 166465 - protein, 36 aa, Artificial Sequence
  Description of Artificial Sequence: Synthetic polypeptide
DEEEIATTNPVATEQYGSACSANDPQQEHQDGTAEK

SEQ ID NO: 166466 - protein, 36 aa, Artificial Sequence
  Description of Artificial Sequence: Synthetic polypeptide
DEEEIRTTNPVATEQYGSVGSWWPDVQTTQMVQQAD

SEQ ID NO: 166467 - protein, 36 aa, Artificial Sequence
  Description of Artificial Sequence: Synthetic polypeptide
DEEEIRTTNPVATEQYGSVANPTFSLDELEIVEVVE

SEQ ID NO: 166468 - protein, 38 aa, Artificial Sequence
  Description of Artificial Sequence: Synthetic polypeptide
AEEEIRTTNPVATEAYGSVVVVVTTNNLQQGENNEEEE

SEQ ID NO: 166469 - protein, 37 aa, Artificial Sequence
  Description of Artificial Sequence: Synthetic polypeptide
DEEEIRTTNPVATEQYGSVNNNEEVEGEVLDNKNTQQ

SEQ ID NO: 166470 - protein, 37 aa, Artificial Sequence
  Description of Artificial Sequence: Synthetic polypeptide
DEEEIRTTNPVATEQYGVVSTVVNTNTEAGTTEQGSE

SEQ ID NO: 166471 - protein, 38 aa, Artificial Sequence
  Description of Artificial Sequence: Synthetic polypeptide
AEEEIRTTNPVATEAYGSVVVVVTTNQLQQGENTEEEG

SEQ ID NO: 166472 - protein, 37 aa, Artificial Sequence
  Description of Artificial Sequence: Synthetic polypeptide
AEEEIRTTNPVATEAYGSVVVVVTTTNLQQGEGDEEE

SEQ ID NO: 166473 - protein, 36 aa, Artificial Sequence
  Description of Artificial Sequence: Synthetic polypeptide
DEMEIRTTNPVATEQYGCVCSTTPAHNIEYSGSDPV

SEQ ID NO: 166474 - protein, 34 aa, Artificial Sequence
  Description of Artificial Sequence: Synthetic polypeptide
TEEEIKTTNPVATEPYGKVVPRTTALSHSDEGNP

SEQ ID NO: 166475 - protein, 34 aa, Artificial Sequence
  Description of Artificial Sequence: Synthetic polypeptide
TEEEIKTTNPVATEPYGKVVPRTTALSHPEGNMW

SEQ ID NO: 166476 - protein, 35 aa, Artificial Sequence
  Description of Artificial Sequence: Synthetic polypeptide
DEEEISTTNPVATEQYGCVCSNWGEHNANFGSDQS

SEQ ID NO: 166477 - protein, 37 aa, Artificial Sequence
  Description of Artificial Sequence: Synthetic polypeptide
DEEEIRTTNPVATEQYGSVAIATTDAGNQPPMQEPRI

SEQ ID NO: 166478 - protein, 36 aa, Artificial Sequence
  Description of Artificial Sequence: Synthetic polypeptide
DEEEIRTTNPVATEQYGSVAPAALPHDIMIEPVNIL

SEQ ID NO: 166479 - protein, 37 aa, Artificial Sequence
  Description of Artificial Sequence: Synthetic polypeptide
DEEEIRTTNPVATEQYGCVCSNWGEHNQEFFGSDNQD

SEQ ID NO: 166480 - protein, 35 aa, Artificial Sequence
  Description of Artificial Sequence: Synthetic polypeptide
DAEEIATTNPVATEQWGHSNVAATNGLEAAPGPGN

SEQ ID NO: 166481 - protein, 36 aa, Artificial Sequence
  Description of Artificial Sequence: Synthetic polypeptide
DEEEIRTTNPVATEQYGCVCSNWGEHNIYFGSDTQA

SEQ ID NO: 166482 - protein, 36 aa, Artificial Sequence
  Description of Artificial Sequence: Synthetic polypeptide
TEEEIRTTNPVATEQYGSVCSNTEGMQTEEVLEPIV

SEQ ID NO: 166483 - protein, 36 aa, Artificial Sequence
  Description of Artificial Sequence: Synthetic polypeptide
DEEEIRTTNPVATEQYGCAGPTGPLDEMGTMEQNDN

SEQ ID NO: 166484 - protein, 36 aa, Artificial Sequence
  Description of Artificial Sequence: Synthetic polypeptide
TEEEIRTTNPVATEQYGSVCSNTEGMQTEEVELEGV

SEQ ID NO: 166485 - protein, 40 aa, Artificial Sequence
  Description of Artificial Sequence: Synthetic polypeptide
DEEEIRTTNPVATEQYGVVSTTNLQYGNNNNQGNNNNQND

SEQ ID NO: 166486 - protein, 38 aa, Artificial Sequence
  Description of Artificial Sequence: Synthetic polypeptide
DEEEIRTTNPVATEAYGVVSTVNNNQQQGNQQGTTEES

SEQ ID NO: 166487 - protein, 33 aa, Artificial Sequence
  Description of Artificial Sequence: Synthetic polypeptide
DENEIRTTNPVSTEPYGTNISMIDIQVDQNGNH

SEQ ID NO: 166488 - protein, 35 aa, Artificial Sequence
  Description of Artificial Sequence: Synthetic polypeptide
DETEIATTNPVAYESWGSVYSGDNDHQEGRGGNSP

SEQ ID NO: 166489 - protein, 33 aa, Artificial Sequence
  Description of Artificial Sequence: Synthetic polypeptide
DENEIRTTNPVSTEPYGTMSMEDIQQQQNGHNH

SEQ ID NO: 166490 - protein, 35 aa, Artificial Sequence
  Description of Artificial Sequence: Synthetic polypeptide
TEEEIRTTNPVATEQYGSVCPTLEAQQDEIVLDQI

SEQ ID NO: 166491 - protein, 36 aa, Artificial Sequence
  Description of Artificial Sequence: Synthetic polypeptide
AEEEIRATNPCATEQYGVVSTVNNQGTNQQIGTNVD

SEQ ID NO: 166492 - protein, 36 aa, Artificial Sequence
  Description of Artificial Sequence: Synthetic polypeptide
DEEEIRTTNPVSTEQYGSVPTPWNTEQIQQVMTPHI

SEQ ID NO: 166493 - protein, 32 aa, Artificial Sequence
  Description of Artificial Sequence: Synthetic polypeptide
DETEIATVNPIATEQWGVTVSNAENWQPKGPI

SEQ ID NO: 166494 - protein, 37 aa, Artificial Sequence
  Description of Artificial Sequence: Synthetic polypeptide
DEEEIRTTNPVATEQYGSVSTTMNMFMVPVSSEPDMM

SEQ ID NO: 166495 - protein, 32 aa, Artificial Sequence
  Description of Artificial Sequence: Synthetic polypeptide
DETEIATVNPIATEQWGVTVSNAENWQSKGPI

SEQ ID NO: 166496 - protein, 33 aa, Artificial Sequence
  Description of Artificial Sequence: Synthetic polypeptide
DENEIRTTNPVSTEPYGTMISMEDIQQQQNGNH

SEQ ID NO: 166497 - protein, 37 aa, Artificial Sequence
  Description of Artificial Sequence: Synthetic polypeptide
AEEEIRATNPCATEQYGVVSTVNNQLGNEQIGTNNED

SEQ ID NO: 166498 - protein, 37 aa, Artificial Sequence
  Description of Artificial Sequence: Synthetic polypeptide
AEEEIRATNPCATEQYGVVSTVNNQLGNQEIGTNAVD

SEQ ID NO: 166499 - protein, 33 aa, Artificial Sequence
  Description of Artificial Sequence: Synthetic polypeptide
DENEIRTTNPVSTEPYGTMISMEDIQEQQNGNH

SEQ ID NO: 166500 - protein, 37 aa, Artificial Sequence
  Description of Artificial Sequence: Synthetic polypeptide
AEEEIRATNPCATEQYGVVSTVNNQLGNQNIGTNMED

SEQ ID NO: 166501 - protein, 36 aa, Artificial Sequence
  Description of Artificial Sequence: Synthetic polypeptide
DEEEIRTTNPVSTEQYGSVPTPWNNGYQQQVMQPQI

SEQ ID NO: 166502 - protein, 38 aa, Artificial Sequence
  Description of Artificial Sequence: Synthetic polypeptide
AEEEIRTTNPVATEQYGSVVTVTTNNQAGNQQGNNNQD

SEQ ID NO: 166503 - protein, 36 aa, Artificial Sequence
  Description of Artificial Sequence: Synthetic polypeptide
DEEEIRTTNPVSTEQYGSVPTPETNEQIQAVMQPQI

SEQ ID NO: 166504 - protein, 36 aa, Artificial Sequence
  Description of Artificial Sequence: Synthetic polypeptide
DEEEISTTNPVATEQYGCVCSNTGEHNQNFGSEFQF

SEQ ID NO: 166505 - protein, 36 aa, Artificial Sequence
  Description of Artificial Sequence: Synthetic polypeptide
DEEEISTTNPVATEQYGCVCSNTGEHNQNFGSQTQL

SEQ ID NO: 166506 - protein, 37 aa, Artificial Sequence
  Description of Artificial Sequence: Synthetic polypeptide
DEEEIRTTNPVATEQYGSVHENVSNQLSQFQEVELEV

SEQ ID NO: 166507 - protein, 35 aa, Artificial Sequence
  Description of Artificial Sequence: Synthetic polypeptide
DEMEIVTTNPVATEQYGTVCSATDGAPVEFEGNYD

SEQ ID NO: 166508 - protein, 34 aa, Artificial Sequence
  Description of Artificial Sequence: Synthetic polypeptide
DENEIRTTNPVSTEPYGTMISMEDIQQQQNGNRH

SEQ ID NO: 166509 - protein, 38 aa, Artificial Sequence
  Description of Artificial Sequence: Synthetic polypeptide
DEEEIRTTNPVATEQYGVVSTTNNANQQGTEAGTEEGQ

SEQ ID NO: 166510 - protein, 37 aa, Artificial Sequence
  Description of Artificial Sequence: Synthetic polypeptide
DEEEIRTTNPVATEQYGSVSTTMNMGMPPVSPEPDMF

SEQ ID NO: 166511 - protein, 33 aa, Artificial Sequence
  Description of Artificial Sequence: Synthetic polypeptide
DETEIATTNPVAYERWGSTSTNPNGNGMGQNDP

SEQ ID NO: 166512 - protein, 33 aa, Artificial Sequence
  Description of Artificial Sequence: Synthetic polypeptide
DENEIRTTNPVSTEPYGTSSMEDIQQQQNGNNH

SEQ ID NO: 166513 - protein, 36 aa, Artificial Sequence
  Description of Artificial Sequence: Synthetic polypeptide
DEEEIRTTNPVATEQYGSVSTTMVMMMEPVSEEPDN

SEQ ID NO: 166514 - protein, 34 aa, Artificial Sequence
  Description of Artificial Sequence: Synthetic polypeptide
DEAEIATTNPVAYEQWGTVCSTENQDEDHDGNEQ

SEQ ID NO: 166515 - protein, 36 aa, Artificial Sequence
  Description of Artificial Sequence: Synthetic polypeptide
DEEEIRTTNPVATEQYGSVSTTMTMVMPPTSEEPDM

SEQ ID NO: 166516 - protein, 37 aa, Artificial Sequence
  Description of Artificial Sequence: Synthetic polypeptide
AEEEIRATNPCATEQYGVVSTVNLQAGNQQIGTNNED

SEQ ID NO: 166517 - protein, 37 aa, Artificial Sequence
  Description of Artificial Sequence: Synthetic polypeptide
AEEEIRATNPCATEQYGVVSTVNLQQGNQQQGTNNVD

SEQ ID NO: 166518 - protein, 37 aa, Artificial Sequence
  Description of Artificial Sequence: Synthetic polypeptide
AEEEIRATNPCATEQYGVVSTVNNNLGNQQIGTNYED

SEQ ID NO: 166519 - protein, 36 aa, Artificial Sequence
  Description of Artificial Sequence: Synthetic polypeptide
DETEIATTNPVAYEQYGSVSTTADIGTEHMNNNQRD

SEQ ID NO: 166520 - protein, 35 aa, Artificial Sequence
  Description of Artificial Sequence: Synthetic polypeptide
DETEIATTNPVAYEQYGSVSVAPHLNEAPNGEARN

SEQ ID NO: 166521 - protein, 34 aa, Artificial Sequence
  Description of Artificial Sequence: Synthetic polypeptide
DETEIATTNPVAYEQYGTVCHTENDQFDQGDDGD

SEQ ID NO: 166522 - protein, 34 aa, Artificial Sequence
  Description of Artificial Sequence: Synthetic polypeptide
DETEIATTNPVAYEQYGTVCSATDGPDEHEGNDK

SEQ ID NO: 166523 - protein, 34 aa, Artificial Sequence
  Description of Artificial Sequence: Synthetic polypeptide
DETEIATTNPVAYEQYGTVCSHGDDQQQMGNGDA

SEQ ID NO: 166524 - protein, 33 aa, Artificial Sequence
  Description of Artificial Sequence: Synthetic polypeptide
DENEIRTTNPVSTEPYGTQISMEDIQQQQNGNH

SEQ ID NO: 166525 - protein, 36 aa, Artificial Sequence
  Description of Artificial Sequence: Synthetic polypeptide
DEEEIRTTNPVATEQYGSVSTTMPMFMETVSEEPDN

SEQ ID NO: 166526 - protein, 35 aa, Artificial Sequence
  Description of Artificial Sequence: Synthetic polypeptide
DEMEIVTTNPVATEQYGTVCSAPDVTPVEVFEGND

SEQ ID NO: 166527 - protein, 37 aa, Artificial Sequence
  Description of Artificial Sequence: Synthetic polypeptide
DEEEISTTNPVATEQYGCVCSNTGEHNQEYFGSDNQS

SEQ ID NO: 166528 - protein, 36 aa, Artificial Sequence
  Description of Artificial Sequence: Synthetic polypeptide
DEEEISTTNPVATEQYGCVCSNTGEHNQHFGSDTQG

SEQ ID NO: 166529 - protein, 33 aa, Artificial Sequence
  Description of Artificial Sequence: Synthetic polypeptide
DENEIRTTNPVSTEPYGTSISMEDIQQQQNHNH

SEQ ID NO: 166530 - protein, 31 aa, Artificial Sequence
  Description of Artificial Sequence: Synthetic polypeptide
AESEIACTNPVAYEGYGEASCLNLSQTVGGQ

SEQ ID NO: 166531 - protein, 36 aa, Artificial Sequence
  Description of Artificial Sequence: Synthetic polypeptide
TEEEIRTTNPVATEQYGSVCSNTEGMQTEEVLESVG

SEQ ID NO: 166532 - protein, 31 aa, Artificial Sequence
  Description of Artificial Sequence: Synthetic polypeptide
AESEIACTNPVAYEGYGEASCINLSQGVGGS

SEQ ID NO: 166533 - protein, 37 aa, Artificial Sequence
  Description of Artificial Sequence: Synthetic polypeptide
DEEEIRTTNPVATEQYGSVSTTMNMVMPPVSEEPEAQ

SEQ ID NO: 166534 - protein, 34 aa, Artificial Sequence
  Description of Artificial Sequence: Synthetic polypeptide
DENEIRTTNPVSTEPYGTRIVSMEDIQQQQNGNH

SEQ ID NO: 166535 - protein, 37 aa, Artificial Sequence
  Description of Artificial Sequence: Synthetic polypeptide
DEEEIRTTNPVATEQYGSVSTTMNMVMPPHSEEPEMG

SEQ ID NO: 166536 - protein, 37 aa, Artificial Sequence
  Description of Artificial Sequence: Synthetic polypeptide
DEEEIRTTNPVATEQYGSVSTTMNMMMPPVSEEPEMH

SEQ ID NO: 166537 - protein, 33 aa, Artificial Sequence
  Description of Artificial Sequence: Synthetic polypeptide
DEMEIVTTNPVATEQYGTVCSAQDGPVEFEEND

SEQ ID NO: 166538 - protein, 36 aa, Artificial Sequence
  Description of Artificial Sequence: Synthetic polypeptide
TEEEIRTTNPVATEQYGSVCSNTSGMQTEEVTLELV

SEQ ID NO: 166539 - protein, 36 aa, Artificial Sequence
  Description of Artificial Sequence: Synthetic polypeptide
DEEEIRTTNPVATEQYGSVSTTMWMIMPPVSEEPDM

SEQ ID NO: 166540 - protein, 37 aa, Artificial Sequence
  Description of Artificial Sequence: Synthetic polypeptide
DEEEIRTTNPVATEQYGSVGYYLMTTEEQMIMNEEEL

SEQ ID NO: 166541 - protein, 38 aa, Artificial Sequence
  Description of Artificial Sequence: Synthetic polypeptide
AEEEIRTTNPVATEQYGSVVTVTTNQLGGTEQGVTNNQ

SEQ ID NO: 166542 - protein, 32 aa, Artificial Sequence
  Description of Artificial Sequence: Synthetic polypeptide
DENEIRTTNPVSTEPYGTIWAMEDIQQQNGNH

SEQ ID NO: 166543 - protein, 35 aa, Artificial Sequence
  Description of Artificial Sequence: Synthetic polypeptide
DEEEIATTNPVATEPWGISVCSYWPVSQMTMGNNG

SEQ ID NO: 166544 - protein, 35 aa, Artificial Sequence
  Description of Artificial Sequence: Synthetic polypeptide
DEEEIATTNPVATEPWGISVCSYSPVSQEMGNNGE

SEQ ID NO: 166545 - protein, 37 aa, Artificial Sequence
  Description of Artificial Sequence: Synthetic polypeptide
DEEEIRTTNPVATEQYGSVSTTMNMFMPPVSETPDMF

SEQ ID NO: 166546 - protein, 33 aa, Artificial Sequence
  Description of Artificial Sequence: Synthetic polypeptide
DETEICTTNPVAYEQWGCVCMNNDQMDRGGGLP

SEQ ID NO: 166547 - protein, 34 aa, Artificial Sequence
  Description of Artificial Sequence: Synthetic polypeptide
DETEICTTNPVAYEQWGEVATGGNQGDHQGGNTM

SEQ ID NO: 166548 - protein, 34 aa, Artificial Sequence
  Description of Artificial Sequence: Synthetic polypeptide
DETEICTTNPVAYEQWGEVATNDGNQGQAGENAT

SEQ ID NO: 166549 - protein, 37 aa, Artificial Sequence
  Description of Artificial Sequence: Synthetic polypeptide
DEEEIRTTNPVATEQYGCVCSNWGEDHNQNFGSDNQA

SEQ ID NO: 166550 - protein, 34 aa, Artificial Sequence
  Description of Artificial Sequence: Synthetic polypeptide
DETEICTTNPVAYEQWGMISHTDNQHQQRNGDSD

SEQ ID NO: 166551 - protein, 34 aa, Artificial Sequence
  Description of Artificial Sequence: Synthetic polypeptide
DENEIRTTNPVSTEPYGTIVSMEDSIQQQQNGNH

SEQ ID NO: 166552 - protein, 37 aa, Artificial Sequence
  Description of Artificial Sequence: Synthetic polypeptide
DEEEIRTTNPVATEQYGSVSTTMNMFMPPVSEEPDYM

SEQ ID NO: 166553 - protein, 37 aa, Artificial Sequence
  Description of Artificial Sequence: Synthetic polypeptide
DEEEIRTTNPVATEQYGSVSTTMNMFMPPVPEEPDGF

SEQ ID NO: 166554 - protein, 32 aa, Artificial Sequence
  Description of Artificial Sequence: Synthetic polypeptide
DENEIRTTNPVSTEPYGTIWAMEDIQQQNGNI

SEQ ID NO: 166555 - protein, 33 aa, Artificial Sequence
  Description of Artificial Sequence: Synthetic polypeptide
DENEIRTTNPVSTEPYGTIVRMEDIQQQQSGNH

SEQ ID NO: 166556 - protein, 35 aa, Artificial Sequence
  Description of Artificial Sequence: Synthetic polypeptide
DEEEIATTNPVATEPWGISVCSYSPQSQNMMGNNG

SEQ ID NO: 166557 - protein, 32 aa, Artificial Sequence
  Description of Artificial Sequence: Synthetic polypeptide
DENEIRTTNPVSTEPYGTIVMEDIQQQQNGEH

SEQ ID NO: 166558 - protein, 36 aa, Artificial Sequence
  Description of Artificial Sequence: Synthetic polypeptide
DEEEIRTTNPVATEQYGSVMTDIMDDGDGEEGEGDE

SEQ ID NO: 166559 - protein, 35 aa, Artificial Sequence
  Description of Artificial Sequence: Synthetic polypeptide
DEAEIRTTNPVAYEEWGSVCVNENMQQQDGQDNVR

SEQ ID NO: 166560 - protein, 34 aa, Artificial Sequence
  Description of Artificial Sequence: Synthetic polypeptide
DEAEIRTTNPVAYEEWGSVCYTNEDNDHQQDGDG

SEQ ID NO: 166561 - protein, 33 aa, Artificial Sequence
  Description of Artificial Sequence: Synthetic polypeptide
DENEIRTTNPVSTEPYGTITSMEHIQQQQNGNH

SEQ ID NO: 166562 - protein, 33 aa, Artificial Sequence
  Description of Artificial Sequence: Synthetic polypeptide
DENEIRTTNPVSTEPYGTITSMEDIQQQQNGNH

SEQ ID NO: 166563 - protein, 36 aa, Artificial Sequence
  Description of Artificial Sequence: Synthetic polypeptide
DEEEISTTNPVATEQYGCVCSNTGEHNQNSGSDTQA

SEQ ID NO: 166564 - protein, 32 aa, Artificial Sequence
  Description of Artificial Sequence: Synthetic polypeptide
DENEIRTTNPVSTEPYGTITMEDIQQQQNGNH

SEQ ID NO: 166565 - protein, 32 aa, Artificial Sequence
  Description of Artificial Sequence: Synthetic polypeptide
DENEIRTTNPVSTEPYGTITMEDIQQKQNGNH

SEQ ID NO: 166566 - protein, 37 aa, Artificial Sequence
  Description of Artificial Sequence: Synthetic polypeptide
DEEEIRTTNPVATEQYGSVMTDIMDIDDGEEGNEMDE

SEQ ID NO: 166567 - protein, 33 aa, Artificial Sequence
  Description of Artificial Sequence: Synthetic polypeptide
DENEIRTTNPVSTEPYGTISYMEDISQQQNGNH

SEQ ID NO: 166568 - protein, 37 aa, Artificial Sequence
  Description of Artificial Sequence: Synthetic polypeptide
DEEEIRTTNPVATEQYGSVSTTMNMFMNPVSEEPQMM

SEQ ID NO: 166569 - protein, 35 aa, Artificial Sequence
  Description of Artificial Sequence: Synthetic polypeptide
DEEEIATTNPVATEPWGISVSCSYSPVSQMGGNNG

SEQ ID NO: 166570 - protein, 37 aa, Artificial Sequence
  Description of Artificial Sequence: Synthetic polypeptide
DEEEIRTTNPVATEQYGSVGYYLMNGEEQMIMNEDEI

SEQ ID NO: 166571 - protein, 34 aa, Artificial Sequence
  Description of Artificial Sequence: Synthetic polypeptide
DEMEIVTTNPVATEQYGTVCSATDGEPVEFEGAD

SEQ ID NO: 166572 - protein, 37 aa, Artificial Sequence
  Description of Artificial Sequence: Synthetic polypeptide
AEEEIRATNPCATEQYGVVSTVNNQLGNQQIGTNDEM

SEQ ID NO: 166573 - protein, 31 aa, Artificial Sequence
  Description of Artificial Sequence: Synthetic polypeptide
AESEIACTNPVAYECYGEASCENSSQRVGGS

SEQ ID NO: 166574 - protein, 33 aa, Artificial Sequence
  Description of Artificial Sequence: Synthetic polypeptide
DENEIRTTNPVSTEPYGTLSVEDVIQQQPNGPV

SEQ ID NO: 166575 - protein, 37 aa, Artificial Sequence
  Description of Artificial Sequence: Synthetic polypeptide
DEEEIRTTNPVATEQYGSVGYYLMQGEEQMIMNAEED

SEQ ID NO: 166576 - protein, 33 aa, Artificial Sequence
  Description of Artificial Sequence: Synthetic polypeptide
DENEIRTTNPVSTEPYGTLSMEDIQQQQNGNLH

SEQ ID NO: 166577 - protein, 37 aa, Artificial Sequence
  Description of Artificial Sequence: Synthetic polypeptide
DEEEIRTTNPVATEQYGSVGYYLMNGEEYMIQNAEEL

SEQ ID NO: 166578 - protein, 33 aa, Artificial Sequence
  Description of Artificial Sequence: Synthetic polypeptide
DENEIRTTNPVSTEPYGTLISMEDISQQQNGNH

SEQ ID NO: 166579 - protein, 33 aa, Artificial Sequence
  Description of Artificial Sequence: Synthetic polypeptide
DENEIRTTNPVSTEPYGTLISMEDIQQQQNGNH

SEQ ID NO: 166580 - protein, 33 aa, Artificial Sequence
  Description of Artificial Sequence: Synthetic polypeptide
DENEIRTTNPVSTEPYGTIYSMEDIQQQQNGNH

SEQ ID NO: 166581 - protein, 33 aa, Artificial Sequence
  Description of Artificial Sequence: Synthetic polypeptide
DENEIRTTNPVSTEPYGTIYSMEDIHQQQNGNH

SEQ ID NO: 166582 - protein, 32 aa, Artificial Sequence
  Description of Artificial Sequence: Synthetic polypeptide
DENEIRTTNPVSTEPYGTIYMEDIQQQQNGNH

SEQ ID NO: 166583 - protein, 30 aa, Artificial Sequence
  Description of Artificial Sequence: Synthetic polypeptide
QEEEIASTNPVATEQYGEAAAEVCQSHEEK

SEQ ID NO: 166584 - protein, 36 aa, Artificial Sequence
  Description of Artificial Sequence: Synthetic polypeptide
DEEEIRTTNPVATEQYGCVCSNWGEDHNQHFNSEQS

SEQ ID NO: 166585 - protein, 33 aa, Artificial Sequence
  Description of Artificial Sequence: Synthetic polypeptide
DENEIRTTNPVSTEPYGTIWSMFDIQQQQNGNH

SEQ ID NO: 166586 - protein, 33 aa, Artificial Sequence
  Description of Artificial Sequence: Synthetic polypeptide
DENEIRTTNPVSTEPYGTIWSMEDIQQQQNGNH

SEQ ID NO: 166587 - protein, 33 aa, Artificial Sequence
  Description of Artificial Sequence: Synthetic polypeptide
DENEIRTTNPVSTEPYGTIWSMEDIQQQQKGNH

SEQ ID NO: 166588 - protein, 33 aa, Artificial Sequence
  Description of Artificial Sequence: Synthetic polypeptide
DENEIRTTNPVSTEPYGTIWSMEDIQQQPNGNH

SEQ ID NO: 166589 - protein, 33 aa, Artificial Sequence
  Description of Artificial Sequence: Synthetic polypeptide
DENEIRTTNPVSTEPYGTIWSMEDIIQQQNGNH

SEQ ID NO: 166590 - protein, 38 aa, Artificial Sequence
  Description of Artificial Sequence: Synthetic polypeptide
DEEEIRTTNPVATEAYGVVSTVNNQQQQGNQQGTTDED

SEQ ID NO: 166591 - protein, 33 aa, Artificial Sequence
  Description of Artificial Sequence: Synthetic polypeptide
DENEIRTTNPVSTEPYGTIWSAEDIQQQQKGNH

SEQ ID NO: 166592 - protein, 33 aa, Artificial Sequence
  Description of Artificial Sequence: Synthetic polypeptide
DENEIRTTNPVSTEPYGTIWMEDITQQQNGNKH

SEQ ID NO: 166593 - protein, 32 aa, Artificial Sequence
  Description of Artificial Sequence: Synthetic polypeptide
DENEIRTTNPVSTEPYGTIWMEDIQQQQNGNH

SEQ ID NO: 166594 - protein, 34 aa, Artificial Sequence
  Description of Artificial Sequence: Synthetic polypeptide
DEMEIVTTNPVATEQYGTVCSATDGDPVEFEMND

SEQ ID NO: 166595 - protein, 37 aa, Artificial Sequence
  Description of Artificial Sequence: Synthetic polypeptide
AEEEIRATNPCATEQYGVVSTVNNQLGNQQIGTNTTD

SEQ ID NO: 166596 - protein, 38 aa, Artificial Sequence
  Description of Artificial Sequence: Synthetic polypeptide
DEEEIRTTNPVATEAYGVVSTVNNQQQQQQGTNNVATE

SEQ ID NO: 166597 - protein, 37 aa, Artificial Sequence
  Description of Artificial Sequence: Synthetic polypeptide
DEEEIRTTNPVATEQYGSVGYYLMNGEEYMIMNEEYL

SEQ ID NO: 166598 - protein, 33 aa, Artificial Sequence
  Description of Artificial Sequence: Synthetic polypeptide
DENEIRTTNPVSTEPYGTIWSMEDIQQQQNGNI

SEQ ID NO: 166599 - protein, 33 aa, Artificial Sequence
  Description of Artificial Sequence: Synthetic polypeptide
DENEIRTTNPVSTEPYGTISYMEDIQQQQNGNW

SEQ ID NO: 166600 - protein, 37 aa, Artificial Sequence
  Description of Artificial Sequence: Synthetic polypeptide
DEEEISTTNPVATEQYGCVCSNTGEHNQENSGSDNQE

SEQ ID NO: 166601 - protein, 34 aa, Artificial Sequence
  Description of Artificial Sequence: Synthetic polypeptide
DEAEIATTNPVAYEQWGTVCSTENDEHDGQNDQD

SEQ ID NO: 166602 - protein, 34 aa, Artificial Sequence
  Description of Artificial Sequence: Synthetic polypeptide
DETEIATTNPVAYEQWGSVSQGNPQQDTPGGEHK

SEQ ID NO: 166603 - protein, 34 aa, Artificial Sequence
  Description of Artificial Sequence: Synthetic polypeptide
DETEIATTNPVAYEQWGSVSQGNPQQDTPGGQEN

SEQ ID NO: 166604 - protein, 34 aa, Artificial Sequence
  Description of Artificial Sequence: Synthetic polypeptide
DETEIATTNPVAYEQWGSVSQGPPQDDTPDGSNN

SEQ ID NO: 166605 - protein, 33 aa, Artificial Sequence
  Description of Artificial Sequence: Synthetic polypeptide
DEMEIVTTNPVATEQYGTVCSACDGPVEFEKND

SEQ ID NO: 166606 - protein, 34 aa, Artificial Sequence
  Description of Artificial Sequence: Synthetic polypeptide
DEMEIVTTNPVATEQYGTVCSACDGPVEHFEGND

SEQ ID NO: 166607 - protein, 33 aa, Artificial Sequence
  Description of Artificial Sequence: Synthetic polypeptide
DETEIATTNPVAYEQWGSVSQGPPQQATPDGSV

SEQ ID NO: 166608 - protein, 33 aa, Artificial Sequence
  Description of Artificial Sequence: Synthetic polypeptide
DENEIRTTNPVSTEPYGTVISMEDISQQQTVNH

SEQ ID NO: 166609 - protein, 34 aa, Artificial Sequence
  Description of Artificial Sequence: Synthetic polypeptide
DENEIRTTNPVSTEPYGTVISMEDIQQQQNGNEH

SEQ ID NO: 166610 - protein, 36 aa, Artificial Sequence
  Description of Artificial Sequence: Synthetic polypeptide
CEEEIATTNPVAYEQYGSVCATNPQLNPDDQTGGTD

SEQ ID NO: 166611 - protein, 38 aa, Artificial Sequence
  Description of Artificial Sequence: Synthetic polypeptide
AEEEIRTTNPVATEQYGSVVTVTNTQLGNTEQGNNDED

SEQ ID NO: 166612 - protein, 37 aa, Artificial Sequence
  Description of Artificial Sequence: Synthetic polypeptide
AEEEIRATNPCATEQYGVVSTVNDQLGNNQQGTNNVD

SEQ ID NO: 166613 - protein, 34 aa, Artificial Sequence
  Description of Artificial Sequence: Synthetic polypeptide
DENEIRTTNPVSTEPYGTVISCIEDISQQQNGNH

SEQ ID NO: 166614 - protein, 33 aa, Artificial Sequence
  Description of Artificial Sequence: Synthetic polypeptide
DEMEIVTTNPVATEQYGTVCSACDGPVEFEGTD

SEQ ID NO: 166615 - protein, 31 aa, Artificial Sequence
  Description of Artificial Sequence: Synthetic polypeptide
AESEIACTNPVAYEQWGWACSIENDQKGGER

SEQ ID NO: 166616 - protein, 33 aa, Artificial Sequence
  Description of Artificial Sequence: Synthetic polypeptide
DENEIRTTNPVSTEPYGTVIRMEDSQQPQSGEH

SEQ ID NO: 166617 - protein, 36 aa, Artificial Sequence
  Description of Artificial Sequence: Synthetic polypeptide
DEEEISTTNPVATEQYGCVCSNTGEHNQEFFGSDQS

SEQ ID NO: 166618 - protein, 34 aa, Artificial Sequence
  Description of Artificial Sequence: Synthetic polypeptide
DENEIRTTNPVSTEPYGTVESMVDIQQQTQGNHF

SEQ ID NO: 166619 - protein, 34 aa, Artificial Sequence
  Description of Artificial Sequence: Synthetic polypeptide
DEAEIRTTNPVAYECWGSVSGGGNQGGPQGDNGK

SEQ ID NO: 166620 - protein, 33 aa, Artificial Sequence
  Description of Artificial Sequence: Synthetic polypeptide
QEEEIASTNPVGTEGYGVVSATTPTGQHNGMNI

SEQ ID NO: 166621 - protein, 33 aa, Artificial Sequence
  Description of Artificial Sequence: Synthetic polypeptide
DENEIRTTNPVSTEPYGTTWSMEDIQAEPKGNH

SEQ ID NO: 166622 - protein, 33 aa, Artificial Sequence
  Description of Artificial Sequence: Synthetic polypeptide
DENEIRTTNPVSTEPYGTTSWMEDIQQQQNGNH

SEQ ID NO: 166623 - protein, 36 aa, Artificial Sequence
  Description of Artificial Sequence: Synthetic polypeptide
DEDEIATTNPVATEQYGCVAATTNMNQTMSGDENPW

SEQ ID NO: 166624 - protein, 33 aa, Artificial Sequence
  Description of Artificial Sequence: Synthetic polypeptide
DENEIRTTNPVSTEPYGTTSNMEDIQAQPKGNH

SEQ ID NO: 166625 - protein, 35 aa, Artificial Sequence
  Description of Artificial Sequence: Synthetic polypeptide
DEEEIATTNPVAYEQWGQSVSVTGDIGQHMIAERP

SEQ ID NO: 166626 - protein, 40 aa, Artificial Sequence
  Description of Artificial Sequence: Synthetic polypeptide
DEEEIRTTNPVATEQYGVVSTTNLQYGNNLEQGTNNNTDD

SEQ ID NO: 166627 - protein, 33 aa, Artificial Sequence
  Description of Artificial Sequence: Synthetic polypeptide
DETEIATTNPVAYEQWGSVTGGGNHQAQQNDSE

SEQ ID NO: 166628 - protein, 34 aa, Artificial Sequence
  Description of Artificial Sequence: Synthetic polypeptide
DENEIRTTNPVSTEPYGTVISCEDISQQQNGNNH

SEQ ID NO: 166629 - protein, 37 aa, Artificial Sequence
  Description of Artificial Sequence: Synthetic polypeptide
TEEEIRTTNPVATEQYGSVGDFNNGDGQENDNGNEGT

SEQ ID NO: 166630 - protein, 34 aa, Artificial Sequence
  Description of Artificial Sequence: Synthetic polypeptide
DETEIATTNPVAYEQWGSVSQGNPQDDTPGGSEH

SEQ ID NO: 166631 - protein, 35 aa, Artificial Sequence
  Description of Artificial Sequence: Synthetic polypeptide
DETEIATTNPVAYEQWGSVSNNNDDHGEGRGENSP

SEQ ID NO: 166632 - protein, 36 aa, Artificial Sequence
  Description of Artificial Sequence: Synthetic polypeptide
DETEIATTNPVAYEQWGSVCSTENLLDQDGEGGMQH

SEQ ID NO: 166633 - protein, 36 aa, Artificial Sequence
  Description of Artificial Sequence: Synthetic polypeptide
DEAEIRTTNPVATEQYGSVCYPSVDWQENQHGSEAM

SEQ ID NO: 166634 - protein, 35 aa, Artificial Sequence
  Description of Artificial Sequence: Synthetic polypeptide
VEEEIRTTNPVATEQYGTVNGNVITQTVELQQLTL

SEQ ID NO: 166635 - protein, 36 aa, Artificial Sequence
  Description of Artificial Sequence: Synthetic polypeptide
DEDEIATTNPVATEQYGSACAATNPQEADSSMGDRM

SEQ ID NO: 166636 - protein, 36 aa, Artificial Sequence
  Description of Artificial Sequence: Synthetic polypeptide
DEDEIATTNPVATEQYGSACAATNPQEADSGMDNSM

SEQ ID NO: 166637 - protein, 37 aa, Artificial Sequence
  Description of Artificial Sequence: Synthetic polypeptide
DEEEIRTTNPVATEQYGSVMSDTIEGGQENDDEDEGD

SEQ ID NO: 166638 - protein, 33 aa, Artificial Sequence
  Description of Artificial Sequence: Synthetic polypeptide
DETEIATTNPVAYEQWGSVPMTPGELGDHNGEG

SEQ ID NO: 166639 - protein, 36 aa, Artificial Sequence
  Description of Artificial Sequence: Synthetic polypeptide
DEDEIATTNPVATEQYGSACAATNPQAPDAGMGDRA

SEQ ID NO: 166640 - protein, 34 aa, Artificial Sequence
  Description of Artificial Sequence: Synthetic polypeptide
DETEIATTNPVAYEQWGSVPTGPMLGEDTGNQSQ

SEQ ID NO: 166641 - protein, 34 aa, Artificial Sequence
  Description of Artificial Sequence: Synthetic polypeptide
DEAEIRTTNPVAYECWGSVCYTNIDNDHQQDGDH

SEQ ID NO: 166642 - protein, 39 aa, Artificial Sequence
  Description of Artificial Sequence: Synthetic polypeptide
DEEEIRTTNPVATEQYGVVSTTNLQQQNATTEQGSTQME

SEQ ID NO: 166643 - protein, 40 aa, Artificial Sequence
  Description of Artificial Sequence: Synthetic polypeptide
DEEEIRTTNPVATEQYGVVSTTNLQSGNNQLAGNNNQQND

SEQ ID NO: 166644 - protein, 34 aa, Artificial Sequence
  Description of Artificial Sequence: Synthetic polypeptide
DETEIATTNPVAYEQWGSVSQGNPPEQDTPGGDE

SEQ ID NO: 166645 - protein, 32 aa, Artificial Sequence
  Description of Artificial Sequence: Synthetic polypeptide
DCEEIAATNPVAYEQWGSSYYDEHMHQRRGNW

SEQ ID NO: 166646 - protein, 33 aa, Artificial Sequence
  Description of Artificial Sequence: Synthetic polypeptide
DETEIATTNPVAYEQWGSVSGGNGNEGGEGDIS

SEQ ID NO: 166647 - protein, 35 aa, Artificial Sequence
  Description of Artificial Sequence: Synthetic polypeptide
DEMEIVTTNPVATEQYGTVCSACDGPVEDREGEND

SEQ ID NO: 166648 - protein, 34 aa, Artificial Sequence
  Description of Artificial Sequence: Synthetic polypeptide
DEMEIVTTNPVATEQYGTVCSACDGPVEFEGGND

SEQ ID NO: 166649 - protein, 34 aa, Artificial Sequence
  Description of Artificial Sequence: Synthetic polypeptide
DEMEIVTTNPVATEQYGTVCSACDGPVEFEGKND

SEQ ID NO: 166650 - protein, 37 aa, Artificial Sequence
  Description of Artificial Sequence: Synthetic polypeptide
DEDEIATTNPVATEQYGSACAATNGQEAGDSGMGNRM

SEQ ID NO: 166651 - protein, 35 aa, Artificial Sequence
  Description of Artificial Sequence: Synthetic polypeptide
VEEEIRTTNPVATEQYGVVIDTDNGEMEGGEEDGI

SEQ ID NO: 166652 - protein, 36 aa, Artificial Sequence
  Description of Artificial Sequence: Synthetic polypeptide
DEEEIRTTNPVATEQYGCAVCSSGEHNTENFNSEQF

SEQ ID NO: 166653 - protein, 33 aa, Artificial Sequence
  Description of Artificial Sequence: Synthetic polypeptide
DEEEIATTNPVAYEQWGSACAAANGLQSEMDDS

SEQ ID NO: 166654 - protein, 37 aa, Artificial Sequence
  Description of Artificial Sequence: Synthetic polypeptide
DEEEISTTNPVATEQYGCVCSNTGEHNAENFGSQNQA

SEQ ID NO: 166655 - protein, 36 aa, Artificial Sequence
  Description of Artificial Sequence: Synthetic polypeptide
DEEEISTTNPVATEQYGCVCSNTGEHNAENSGSDQS

SEQ ID NO: 166656 - protein, 36 aa, Artificial Sequence
  Description of Artificial Sequence: Synthetic polypeptide
DEEEISTTNPVATEQYGCVCSNTGEHNANFGSDTQA

SEQ ID NO: 166657 - protein, 34 aa, Artificial Sequence
  Description of Artificial Sequence: Synthetic polypeptide
DEMEIVTTNPVATEQYGTVCSACDGPVEFEGNDW

SEQ ID NO: 166658 - protein, 31 aa, Artificial Sequence
  Description of Artificial Sequence: Synthetic polypeptide
QEGEIATTNPVATEQYGCAPEHGQDSEGEKH

SEQ ID NO: 166659 - protein, 32 aa, Artificial Sequence
  Description of Artificial Sequence: Synthetic polypeptide
DEAEIATTNPVAYEQWGTVCSTENDEHDLSEQ

SEQ ID NO: 166660 - protein, 37 aa, Artificial Sequence
  Description of Artificial Sequence: Synthetic polypeptide
TEEEIRTTNPVATEQYGSVGDFGNEDGQENDDGNEQT

SEQ ID NO: 166661 - protein, 36 aa, Artificial Sequence
  Description of Artificial Sequence: Synthetic polypeptide
TEEEIRTTNPVATEQYGSVGDFGNDGQENNDNDEGT

SEQ ID NO: 166662 - protein, 32 aa, Artificial Sequence
  Description of Artificial Sequence: Synthetic polypeptide
DENEIRTTNPVSTEPYGTTSGEGGQQQDNGPH

SEQ ID NO: 166663 - protein, 35 aa, Artificial Sequence
  Description of Artificial Sequence: Synthetic polypeptide
CEEEIATTNPVAYEQYGSVCAAANGLQEAEHANDS

SEQ ID NO: 166664 - protein, 33 aa, Artificial Sequence
  Description of Artificial Sequence: Synthetic polypeptide
DENEIRTTNPVSTEPYGTTSGEDPGQQQDNGNH

SEQ ID NO: 166665 - protein, 33 aa, Artificial Sequence
  Description of Artificial Sequence: Synthetic polypeptide
DETEIATTNPVAYEQYGSVATAGTPTANNDEAE

SEQ ID NO: 166666 - protein, 32 aa, Artificial Sequence
  Description of Artificial Sequence: Synthetic polypeptide
DENEIRTTNPVSTEPYGTTSGEDGQQQQNDNH

SEQ ID NO: 166667 - protein, 33 aa, Artificial Sequence
  Description of Artificial Sequence: Synthetic polypeptide
DENEIRTTNPVSTEPYGTTSGEDGQNQTNGNEH

SEQ ID NO: 166668 - protein, 34 aa, Artificial Sequence
  Description of Artificial Sequence: Synthetic polypeptide
DENEIRTTNPVSTEPYGTTPSMEDWTQQNQNGNH

SEQ ID NO: 166669 - protein, 34 aa, Artificial Sequence
  Description of Artificial Sequence: Synthetic polypeptide
DEHEIRTTNPVATESWGCVSGGNGEDERNMNGPQ

SEQ ID NO: 166670 - protein, 33 aa, Artificial Sequence
  Description of Artificial Sequence: Synthetic polypeptide
DENEIRTTNPVSTEPYGTTPSGEDGQQNQNGNH

SEQ ID NO: 166671 - protein, 32 aa, Artificial Sequence
  Description of Artificial Sequence: Synthetic polypeptide
QEEEIATTNPVAYEQYGEVAPEGSQSQHEGEK

SEQ ID NO: 166672 - protein, 35 aa, Artificial Sequence
  Description of Artificial Sequence: Synthetic polypeptide
DETEIATTNPVAYEQYGSVCADGLQNPDDQTEGNN

SEQ ID NO: 166673 - protein, 40 aa, Artificial Sequence
  Description of Artificial Sequence: Synthetic polypeptide
DEEEIRTTNPVATEQYGVVSTTNLQYGNNLNNGNNNNQND

SEQ ID NO: 166674 - protein, 33 aa, Artificial Sequence
  Description of Artificial Sequence: Synthetic polypeptide
DENEIRTTNPVSTEPYGTTSGEGGQQQGNGNHE

SEQ ID NO: 166675 - protein, 33 aa, Artificial Sequence
  Description of Artificial Sequence: Synthetic polypeptide
DENEIRTTNPVSTEPYGTTISMEDIQQQQQGNH

SEQ ID NO: 166676 - protein, 36 aa, Artificial Sequence
  Description of Artificial Sequence: Synthetic polypeptide
DETEIATTNPVAYEQYGSVCATNPQLNPDDQMGGLA

SEQ ID NO: 166677 - protein, 34 aa, Artificial Sequence
  Description of Artificial Sequence: Synthetic polypeptide
DETEIATTNPVAYEQYGSVCMPAGQPEGGDNSDD

SEQ ID NO: 166678 - protein, 34 aa, Artificial Sequence
  Description of Artificial Sequence: Synthetic polypeptide
DEMEIVTTNPVATEQYGTVCSAMDGPVEFEGNTD

SEQ ID NO: 166679 - protein, 37 aa, Artificial Sequence
  Description of Artificial Sequence: Synthetic polypeptide
VEEEIRTTNPVATEVYGSVSTDGMGENLGNDTGEAGQ

SEQ ID NO: 166680 - protein, 33 aa, Artificial Sequence
  Description of Artificial Sequence: Synthetic polypeptide
DENEIRTTNPVSTEPYGTTISMEDIQQQQNGNH

SEQ ID NO: 166681 - protein, 33 aa, Artificial Sequence
  Description of Artificial Sequence: Synthetic polypeptide
DEDEIATTNPVATEQYGCVAANGDATMNPGETK

SEQ ID NO: 166682 - protein, 35 aa, Artificial Sequence
  Description of Artificial Sequence: Synthetic polypeptide
DETEIATTNPVAYEQYGSVSAAGPLDEDTPGGNLH

SEQ ID NO: 166683 - protein, 33 aa, Artificial Sequence
  Description of Artificial Sequence: Synthetic polypeptide
DENEIRTTNPVSTEPYGTTISMEDIQDQQNGNH

SEQ ID NO: 166684 - protein, 31 aa, Artificial Sequence
  Description of Artificial Sequence: Synthetic polypeptide
QEEEIATTNPVAYEQYGEVAPPEVHSQHEEK

SEQ ID NO: 166685 - protein, 38 aa, Artificial Sequence
  Description of Artificial Sequence: Synthetic polypeptide
DEEEIRTTNPVATEAYGVVSTVNNNQNQQQGTEQGNNE

SEQ ID NO: 166686 - protein, 32 aa, Artificial Sequence
  Description of Artificial Sequence: Synthetic polypeptide
DENEIRTTNPVSTEPYGTTISAEDIQQPNGPH

SEQ ID NO: 166687 - protein, 36 aa, Artificial Sequence
  Description of Artificial Sequence: Synthetic polypeptide
DEEEIRTTNPVATEQYGCAGPTGPQWDEGEMEINDN

SEQ ID NO: 166688 - protein, 34 aa, Artificial Sequence
  Description of Artificial Sequence: Synthetic polypeptide
DEDEIATTNPVATEQYGCVAANGTGEAPDSGNQD

SEQ ID NO: 166689 - protein, 34 aa, Artificial Sequence
  Description of Artificial Sequence: Synthetic polypeptide
DEAEIRTTNPVAYECWGSVYYGNGMEQQNGGNDM

SEQ ID NO: 166690 - protein, 34 aa, Artificial Sequence
  Description of Artificial Sequence: Synthetic polypeptide
DEAEIRTTNPVAYECWGVVSGGNHQETPGDNGGE

SEQ ID NO: 166691 - protein, 32 aa, Artificial Sequence
  Description of Artificial Sequence: Synthetic polypeptide
QEEEIATTNPVAYEQYGEVAAAEVQSQHEGEK

SEQ ID NO: 166692 - protein, 30 aa, Artificial Sequence
  Description of Artificial Sequence: Synthetic polypeptide
QEEEIATTNPVAYEQYGEIPEVEISQHEEK

SEQ ID NO: 166693 - protein, 40 aa, Artificial Sequence
  Description of Artificial Sequence: Synthetic polypeptide
DEEEIRTTNPVATEQYGVVSTTNLQYGNNLNIGNNNNQNQ

SEQ ID NO: 166694 - protein, 33 aa, Artificial Sequence
  Description of Artificial Sequence: Synthetic polypeptide
DENEIRTTNPVSTEPYGTTSMEDIQQQQNGENH

SEQ ID NO: 166695 - protein, 36 aa, Artificial Sequence
  Description of Artificial Sequence: Synthetic polypeptide
TEEEIRTTNPVATEQYGSVGDFGNDGQENDDQNVGV

SEQ ID NO: 166696 - protein, 33 aa, Artificial Sequence
  Description of Artificial Sequence: Synthetic polypeptide
DETEIATTNPVAYEQWGVCSTGNPDIDGGMGQR

SEQ ID NO: 166697 - protein, 36 aa, Artificial Sequence
  Description of Artificial Sequence: Synthetic polypeptide
TEEEIRTTNPVATEQYGSVGDFGNDGQENDDQNENG

SEQ ID NO: 166698 - protein, 34 aa, Artificial Sequence
  Description of Artificial Sequence: Synthetic polypeptide
DETEIATTNPVAYEQWGVVCSGENDQHLTNDGRK

SEQ ID NO: 166699 - protein, 34 aa, Artificial Sequence
  Description of Artificial Sequence: Synthetic polypeptide
DEEEIATTNPVAYEQWGQSVSVTGDIGQHMIAAQ

SEQ ID NO: 166700 - protein, 33 aa, Artificial Sequence
  Description of Artificial Sequence: Synthetic polypeptide
DETEIATTNPVAYEQWGVVSGDNMQLNDEHGRM

SEQ ID NO: 166701 - protein, 34 aa, Artificial Sequence
  Description of Artificial Sequence: Synthetic polypeptide
DEAEIRTTNPVAYECWGVVCSTDNGMERDGDKDP

SEQ ID NO: 166702 - protein, 33 aa, Artificial Sequence
  Description of Artificial Sequence: Synthetic polypeptide
DETEIATTNPVAYEQWGVVVHTDNHNQQDGSPD

SEQ ID NO: 166703 - protein, 34 aa, Artificial Sequence
  Description of Artificial Sequence: Synthetic polypeptide
DEMEIVTTNPVATEQYGTVCSAGDGPVEFEGNTD

SEQ ID NO: 166704 - protein, 33 aa, Artificial Sequence
  Description of Artificial Sequence: Synthetic polypeptide
DENEIRTTNPVSTEPYGTTSIGEDHQQQQNGNH

SEQ ID NO: 166705 - protein, 34 aa, Artificial Sequence
  Description of Artificial Sequence: Synthetic polypeptide
DEMEIVTTNPVATEQYGTVCSAGDGPVEFFEGND

SEQ ID NO: 166706 - protein, 33 aa, Artificial Sequence
  Description of Artificial Sequence: Synthetic polypeptide
DETEIATTNPVAYEQYGSACAAANGLQSEQDDD

SEQ ID NO: 166707 - protein, 36 aa, Artificial Sequence
  Description of Artificial Sequence: Synthetic polypeptide
DEEEISTTNPVATEQYGCVCSNTGEHNQEGFLSDQS

SEQ ID NO: 166708 - protein, 36 aa, Artificial Sequence
  Description of Artificial Sequence: Synthetic polypeptide
DETEIATTNPVAYEQYGSACSAANPLQAAAGDINDM

SEQ ID NO: 166709 - protein, 34 aa, Artificial Sequence
  Description of Artificial Sequence: Synthetic polypeptide
DETEIATTNPVAYEQYGSACSANPALQHDDLAAM

SEQ ID NO: 166710 - protein, 35 aa, Artificial Sequence
  Description of Artificial Sequence: Synthetic polypeptide
DETEIATTNPVAYEQYGSACSANPLQNHADENGHH

SEQ ID NO: 166711 - protein, 35 aa, Artificial Sequence
  Description of Artificial Sequence: Synthetic polypeptide
DETEIATTNPVAYEQYGSACSPANPLPEAEIGNEN

SEQ ID NO: 166712 - protein, 37 aa, Artificial Sequence
  Description of Artificial Sequence: Synthetic polypeptide
DEEEISTTNPVATEQYGCVCSNTGEHNQEGFNSDPQA

SEQ ID NO: 166713 - protein, 33 aa, Artificial Sequence
  Description of Artificial Sequence: Synthetic polypeptide
DEMEIVTTNPVATEQYGTVCSAHDGPVEFEHND

SEQ ID NO: 166714 - protein, 33 aa, Artificial Sequence
  Description of Artificial Sequence: Synthetic polypeptide
DEMEIVTTNPVATEQYGTVCSAIDGPVEFEGWD

SEQ ID NO: 166715 - protein, 31 aa, Artificial Sequence
  Description of Artificial Sequence: Synthetic polypeptide
QEEEIATTNPVAYEQYGETIPPEVHQHEGEK

SEQ ID NO: 166716 - protein, 34 aa, Artificial Sequence
  Description of Artificial Sequence: Synthetic polypeptide
DEMEIVTTNPVATEQYGTVCSAKDMPVEFEGNAD

SEQ ID NO: 166717 - protein, 33 aa, Artificial Sequence
  Description of Artificial Sequence: Synthetic polypeptide
DENEIRTTNPVSTEPYGTTSMEDFIQQQQNGNH

SEQ ID NO: 166718 - protein, 36 aa, Artificial Sequence
  Description of Artificial Sequence: Synthetic polypeptide
TEEEIRTTNPVATEQYGSVGDFGNDGQENDDQGEST

SEQ ID NO: 166719 - protein, 33 aa, Artificial Sequence
  Description of Artificial Sequence: Synthetic polypeptide
AEEEIATTNPVATEQYGCYTPNWEDQHFNSEQA

SEQ ID NO: 166720 - protein, 35 aa, Artificial Sequence
  Description of Artificial Sequence: Synthetic polypeptide
DETEICTTNPVAYEQWGSVTGENNDSNQGNMGNQR

SEQ ID NO: 166721 - protein, 35 aa, Artificial Sequence
  Description of Artificial Sequence: Synthetic polypeptide
DEDEIATTNPVATEQWGSVSVTADPLAPDAQGPLD

SEQ ID NO: 166722 - protein, 33 aa, Artificial Sequence
  Description of Artificial Sequence: Synthetic polypeptide
DENEIRTTNPVSTEPYGTISRMEDIQQQQNGNH

SEQ ID NO: 166723 - protein, 33 aa, Artificial Sequence
  Description of Artificial Sequence: Synthetic polypeptide
DEDEIATTNPVATEQWGGCCAATNHQAEPPMRD

SEQ ID NO: 166724 - protein, 31 aa, Artificial Sequence
  Description of Artificial Sequence: Synthetic polypeptide
DDSEVASTNPVSTEGYGNVAAENIQSRVGQR

SEQ ID NO: 166725 - protein, 35 aa, Artificial Sequence
  Description of Artificial Sequence: Synthetic polypeptide
DEMEIVTTNPVATEQYGTVCSATDGPVEDFEGNDD

SEQ ID NO: 166726 - protein, 33 aa, Artificial Sequence
  Description of Artificial Sequence: Synthetic polypeptide
DEAEIRTTNPVAYEHWGTVYLIDNHDDQHGNSM

SEQ ID NO: 166727 - protein, 34 aa, Artificial Sequence
  Description of Artificial Sequence: Synthetic polypeptide
DEMEIVTTNPVATEQYGTVCSATDGPVEDFEIND

SEQ ID NO: 166728 - protein, 36 aa, Artificial Sequence
  Description of Artificial Sequence: Synthetic polypeptide
DEEEIRTTNPVATEQYGCVCSNWGEHNAENFNSDQD

SEQ ID NO: 166729 - protein, 34 aa, Artificial Sequence
  Description of Artificial Sequence: Synthetic polypeptide
DEDEIATTNPVATEQWGCVAMTHLTNPDDGMGDR

SEQ ID NO: 166730 - protein, 35 aa, Artificial Sequence
  Description of Artificial Sequence: Synthetic polypeptide
VEEGIRTTNPVATEQYGSVPSVTIPVLVSPVVHEV

SEQ ID NO: 166731 - protein, 35 aa, Artificial Sequence
  Description of Artificial Sequence: Synthetic polypeptide
DEMEIVTTNPVATEQYGTVCSATDGPVEEFEGNYD

SEQ ID NO: 166732 - protein, 34 aa, Artificial Sequence
  Description of Artificial Sequence: Synthetic polypeptide
DEMEIVTTNPVATEQYGTVCSATDGPVEEPEGPD

SEQ ID NO: 166733 - protein, 31 aa, Artificial Sequence
  Description of Artificial Sequence: Synthetic polypeptide
DDSEVACTNPVSTEGYGNVAANTIQSRGGQR

SEQ ID NO: 166734 - protein, 34 aa, Artificial Sequence
  Description of Artificial Sequence: Synthetic polypeptide
DEDEIATTNPVATEQWGGCCAATNNHQEAEGPRE

SEQ ID NO: 166735 - protein, 36 aa, Artificial Sequence
  Description of Artificial Sequence: Synthetic polypeptide
DEEEIRTTNPVATEQYGSVGYLMNMEEQMIMPEEEL

SEQ ID NO: 166736 - protein, 36 aa, Artificial Sequence
  Description of Artificial Sequence: Synthetic polypeptide
DEEEIRTTNPVATEQYGCVCSNWGEHNAFFNSDNQA

SEQ ID NO: 166737 - protein, 37 aa, Artificial Sequence
  Description of Artificial Sequence: Synthetic polypeptide
DEEEIRTTNPVATEQYGSVGYLMNMEEQMIMNEYPEL

SEQ ID NO: 166738 - protein, 36 aa, Artificial Sequence
  Description of Artificial Sequence: Synthetic polypeptide
DEEEIRTTNPVATEQYGSVGYLMNMEENMSMNEEEL

SEQ ID NO: 166739 - protein, 35 aa, Artificial Sequence
  Description of Artificial Sequence: Synthetic polypeptide
AEECIACTNPVATEQYGSVSWNEGEQERQRHGGED

SEQ ID NO: 166740 - protein, 37 aa, Artificial Sequence
  Description of Artificial Sequence: Synthetic polypeptide
DEEEIRTTNPVATEQYGSVASPTFSALELEIVEVDVL

SEQ ID NO: 166741 - protein, 35 aa, Artificial Sequence
  Description of Artificial Sequence: Synthetic polypeptide
DEEEIRTTNPVATEQYGCVCSNWGEHNANFNSDQA

SEQ ID NO: 166742 - protein, 30 aa, Artificial Sequence
  Description of Artificial Sequence: Synthetic polypeptide
DDSEVASTNPVSTEGYGNVAAETIQRVGQR

SEQ ID NO: 166743 - protein, 36 aa, Artificial Sequence
  Description of Artificial Sequence: Synthetic polypeptide
DEEEIATTNPVATEGWGSVCSGTDNNDDRQDGGQEL

SEQ ID NO: 166744 - protein, 38 aa, Artificial Sequence
  Description of Artificial Sequence: Synthetic polypeptide
AEEEIRTTNPVATEQYGSVVTVVTVNQAGNQQGNNNED

SEQ ID NO: 166745 - protein, 33 aa, Artificial Sequence
  Description of Artificial Sequence: Synthetic polypeptide
VEEMIGTTNPVATQAYGSVASIEQIGRHGNNMG

SEQ ID NO: 166746 - protein, 36 aa, Artificial Sequence
  Description of Artificial Sequence: Synthetic polypeptide
DEEEISTTNPVATEQYGCVCSNTGPHQENFNSDTQL

SEQ ID NO: 166747 - protein, 39 aa, Artificial Sequence
  Description of Artificial Sequence: Synthetic polypeptide
DEEEIRTTNPVATEQYGVVSTTNNNNLQQGTEQGTTDTE

SEQ ID NO: 166748 - protein, 37 aa, Artificial Sequence
  Description of Artificial Sequence: Synthetic polypeptide
AEEEIRTTNPVATEQYGSVVTVVTTNDESGTVNNNTQ

SEQ ID NO: 166749 - protein, 37 aa, Artificial Sequence
  Description of Artificial Sequence: Synthetic polypeptide
AEEEIRTTNPCATEQYGVVSTVNNNQQGNNQQGTDEQ

SEQ ID NO: 166750 - protein, 36 aa, Artificial Sequence
  Description of Artificial Sequence: Synthetic polypeptide
VEEGIRTTNPVATEQYGSVPSVTIPLEVSPVQVNQM

SEQ ID NO: 166751 - protein, 33 aa, Artificial Sequence
  Description of Artificial Sequence: Synthetic polypeptide
DENEIRTTNPVSTEPYGTISSEDIQQQQNGFNH

SEQ ID NO: 166752 - protein, 33 aa, Artificial Sequence
  Description of Artificial Sequence: Synthetic polypeptide
QEGEIATTNPCSTEQYGIVSSCALQMSNGMTPR

SEQ ID NO: 166753 - protein, 36 aa, Artificial Sequence
  Description of Artificial Sequence: Synthetic polypeptide
TEEEIRTTNPVATEQYGSIVHTTLEDHNDESDEMQG

SEQ ID NO: 166754 - protein, 33 aa, Artificial Sequence
  Description of Artificial Sequence: Synthetic polypeptide
DEEEIATTNPVAYEQWGCTAGNGLQAAPDGSTN

SEQ ID NO: 166755 - protein, 35 aa, Artificial Sequence
  Description of Artificial Sequence: Synthetic polypeptide
TEEEIRTTNPVATEQYGSITHTPLEDHNDEGSDEQ

SEQ ID NO: 166756 - protein, 35 aa, Artificial Sequence
  Description of Artificial Sequence: Synthetic polypeptide
TEEEIRTTNPVATEQYGSIPNTMLEDHNGESDEQC

SEQ ID NO: 166757 - protein, 35 aa, Artificial Sequence
  Description of Artificial Sequence: Synthetic polypeptide
DEEEIATTNPVAYEQWGCSYNSINDGDQRGHAPTH

SEQ ID NO: 166758 - protein, 33 aa, Artificial Sequence
  Description of Artificial Sequence: Synthetic polypeptide
DEDEIATTNPVATEQWGGCCAGTGHQAEGPNLN

SEQ ID NO: 166759 - protein, 34 aa, Artificial Sequence
  Description of Artificial Sequence: Synthetic polypeptide
TEEEIRTTNPVATEQYGSIHWTTPEDHNDESDEQ

SEQ ID NO: 166760 - protein, 35 aa, Artificial Sequence
  Description of Artificial Sequence: Synthetic polypeptide
TEEEIRTTNPVATEQYGSIHNTTLEDTNPESDEQD

SEQ ID NO: 166761 - protein, 35 aa, Artificial Sequence
  Description of Artificial Sequence: Synthetic polypeptide
TEEEIRTTNPVATEQYGSIHNTTLEDHNNESDEQH

SEQ ID NO: 166762 - protein, 35 aa, Artificial Sequence
  Description of Artificial Sequence: Synthetic polypeptide
TEEEIRTTNPVATEQYGSIHNTTLEDHNGMSDEQE

SEQ ID NO: 166763 - protein, 35 aa, Artificial Sequence
  Description of Artificial Sequence: Synthetic polypeptide
TEEEIRTTNPVATEQYGSIHNTTLEDHNDNESDEQ

SEQ ID NO: 166764 - protein, 37 aa, Artificial Sequence
  Description of Artificial Sequence: Synthetic polypeptide
DEEEIRTTNPVATEQYGSVGYLMNMEEQPIMNEEIEL

SEQ ID NO: 166765 - protein, 37 aa, Artificial Sequence
  Description of Artificial Sequence: Synthetic polypeptide
AEEEIRTTNPVATEQYGSVVTVVTDGNNNNLGGNDDT

SEQ ID NO: 166766 - protein, 36 aa, Artificial Sequence
  Description of Artificial Sequence: Synthetic polypeptide
DEEEISTTNPVATEQYGCVCSNTGETNQENFGSEQG

SEQ ID NO: 166767 - protein, 37 aa, Artificial Sequence
  Description of Artificial Sequence: Synthetic polypeptide
AEEEIRTTNPVATEQYGSVVTVVTNGGNNNLGGNNDD

SEQ ID NO: 166768 - protein, 35 aa, Artificial Sequence
  Description of Artificial Sequence: Synthetic polypeptide
DEEEIATTNPVAYEPWGSVYCTNGLGEDMGNGGGS

SEQ ID NO: 166769 - protein, 34 aa, Artificial Sequence
  Description of Artificial Sequence: Synthetic polypeptide
DEEEIATTNPVAYEPWGSVTGGGNEGNQRGDIPS

SEQ ID NO: 166770 - protein, 33 aa, Artificial Sequence
  Description of Artificial Sequence: Synthetic polypeptide
DENEIRTTNPVSTEPYGTISSMEDIQQQQNGNK

SEQ ID NO: 166771 - protein, 33 aa, Artificial Sequence
  Description of Artificial Sequence: Synthetic polypeptide
DENEIRTTNPVSTEPYGTISSMEDIQQQQNGNH

SEQ ID NO: 166772 - protein, 34 aa, Artificial Sequence
  Description of Artificial Sequence: Synthetic polypeptide
DENEIRTTNPVSTEPYGTISSMEDIQNQQNGNPV

SEQ ID NO: 166773 - protein, 36 aa, Artificial Sequence
  Description of Artificial Sequence: Synthetic polypeptide
DEEEIRTTNPVATEQYGCVCSNWGEHNAEFFNSDQA

SEQ ID NO: 166774 - protein, 35 aa, Artificial Sequence
  Description of Artificial Sequence: Synthetic polypeptide
DEEEIRTTNPVATEQYGAVVVNGFGNEGQTQETGI

SEQ ID NO: 166775 - protein, 35 aa, Artificial Sequence
  Description of Artificial Sequence: Synthetic polypeptide
AEECIACTNPVATEQYGSVSWNEGEQERQRMNGEQ

SEQ ID NO: 166776 - protein, 37 aa, Artificial Sequence
  Description of Artificial Sequence: Synthetic polypeptide
DEEEIRTTNPVATEQYGSVGYNPMNGEEQMIMNAEEL

SEQ ID NO: 166777 - protein, 36 aa, Artificial Sequence
  Description of Artificial Sequence: Synthetic polypeptide
DEEEIRTTNPVATEQYGSVGYLMNMEEVMIMNEELL

SEQ ID NO: 166778 - protein, 38 aa, Artificial Sequence
  Description of Artificial Sequence: Synthetic polypeptide
DEEEIRTTNPVATEQYGVVSTVVNTNNNEQGTNEQGQE

SEQ ID NO: 166779 - protein, 37 aa, Artificial Sequence
  Description of Artificial Sequence: Synthetic polypeptide
DEEEIRTTNPVATEQYGCVCSNWGEHFQEGFNSDTQA

SEQ ID NO: 166780 - protein, 37 aa, Artificial Sequence
  Description of Artificial Sequence: Synthetic polypeptide
AEEEIRTTNPCATEQYGVVSTVNNQQGNTQQGTDEED

SEQ ID NO: 166781 - protein, 35 aa, Artificial Sequence
  Description of Artificial Sequence: Synthetic polypeptide
DEEEIRTTNPVATEQYGSVNCVVDDHNQPNSQIEQ

SEQ ID NO: 166782 - protein, 34 aa, Artificial Sequence
  Description of Artificial Sequence: Synthetic polypeptide
DEMEIVTTNPVATEQYGTVCSATDGPVEFEGIAD

SEQ ID NO: 166783 - protein, 33 aa, Artificial Sequence
  Description of Artificial Sequence: Synthetic polypeptide
DEAEIRTTNPVAYEQWGCVCGNNDQMDTGDTEI

SEQ ID NO: 166784 - protein, 35 aa, Artificial Sequence
  Description of Artificial Sequence: Synthetic polypeptide
DEHEIRTTNPTATECYGCVATTNGNDPREGGNTEM

SEQ ID NO: 166785 - protein, 38 aa, Artificial Sequence
  Description of Artificial Sequence: Synthetic polypeptide
DEEEIRTTNPVATEQYGVVSTTNNNNQQGTEQGTEEED

SEQ ID NO: 166786 - protein, 34 aa, Artificial Sequence
  Description of Artificial Sequence: Synthetic polypeptide
DEAEIRTTNPVAYEQWGCVCGPNNDQMDVGGNEP

SEQ ID NO: 166787 - protein, 33 aa, Artificial Sequence
  Description of Artificial Sequence: Synthetic polypeptide
DEHEIRTTNPIAYEAYGSVCSQIISGPVGGNQC

SEQ ID NO: 166788 - protein, 35 aa, Artificial Sequence
  Description of Artificial Sequence: Synthetic polypeptide
TEEEIRTTNPVATEQYGDVVGTFNDGDEEGGGETI

SEQ ID NO: 166789 - protein, 35 aa, Artificial Sequence
  Description of Artificial Sequence: Synthetic polypeptide
DEDEIATTNPVATEQWGCTAGNEHLEATRDGDNRE

SEQ ID NO: 166790 - protein, 33 aa, Artificial Sequence
  Description of Artificial Sequence: Synthetic polypeptide
DENEIRTTNPVSTEPYGTISQMEDIQQQQNGNH

SEQ ID NO: 166791 - protein, 35 aa, Artificial Sequence
  Description of Artificial Sequence: Synthetic polypeptide
DETEIRTTNPCAYEEWGSVAVTWNDHQGDRLGNEQ

SEQ ID NO: 166792 - protein, 36 aa, Artificial Sequence
  Description of Artificial Sequence: Synthetic polypeptide
DEEEIRTTNPVATEQYGAVVNNFGQGGQDTDQTGGF

SEQ ID NO: 166793 - protein, 35 aa, Artificial Sequence
  Description of Artificial Sequence: Synthetic polypeptide
DETEIRTTNPCAYEEWGSVAVTWNDHQGDRRGNAS

SEQ ID NO: 166794 - protein, 35 aa, Artificial Sequence
  Description of Artificial Sequence: Synthetic polypeptide
DEMEIVTTNPVATEQYGTVCSATDGPVEFEGHNVD

SEQ ID NO: 166795 - protein, 34 aa, Artificial Sequence
  Description of Artificial Sequence: Synthetic polypeptide
DEMEIVTTNPVATEQYGTVCSATDGPVEFEGKDQ

SEQ ID NO: 166796 - protein, 36 aa, Artificial Sequence
  Description of Artificial Sequence: Synthetic polypeptide
DEEEIRTTNPVATEQYGSVGVAVEEQIENTEEANFM

SEQ ID NO: 166797 - protein, 36 aa, Artificial Sequence
  Description of Artificial Sequence: Synthetic polypeptide
DEEEIRTTNPVATEQYGSVGVAVDEQIENTEEEHIT

SEQ ID NO: 166798 - protein, 35 aa, Artificial Sequence
  Description of Artificial Sequence: Synthetic polypeptide
TEEEIRTTNPVATEQYGCVCQWMEHNQNFGSDNQA

SEQ ID NO: 166799 - protein, 34 aa, Artificial Sequence
  Description of Artificial Sequence: Synthetic polypeptide
DETEIRTTNPCAYEQWGSVCGDNNGDQQGQGGND

SEQ ID NO: 166800 - protein, 36 aa, Artificial Sequence
  Description of Artificial Sequence: Synthetic polypeptide
DEEEIRTTNPVATEQYGCVCSNWGEHNIEYFNSDQA

SEQ ID NO: 166801 - protein, 38 aa, Artificial Sequence
  Description of Artificial Sequence: Synthetic polypeptide
DEEEIRTTNPVATEQYGVVSTTNNNQQGTEQGSTDEED

SEQ ID NO: 166802 - protein, 36 aa, Artificial Sequence
  Description of Artificial Sequence: Synthetic polypeptide
DEEEISTTNPVATEQYGCVCSNTMEHNAENFGSDQS

SEQ ID NO: 166803 - protein, 35 aa, Artificial Sequence
  Description of Artificial Sequence: Synthetic polypeptide
DEEEIATTNPVAYEPQWGQSVAQPNDGLQTDGITQ

SEQ ID NO: 166804 - protein, 34 aa, Artificial Sequence
  Description of Artificial Sequence: Synthetic polypeptide
DEMEIVTTNPVATEQYGTVCSATDGPVEFEGMDE

SEQ ID NO: 166805 - protein, 34 aa, Artificial Sequence
  Description of Artificial Sequence: Synthetic polypeptide
DEMEIVTTNPVATEQYGTVCSATDGPVEFEGMED

SEQ ID NO: 166806 - protein, 35 aa, Artificial Sequence
  Description of Artificial Sequence: Synthetic polypeptide
DEEEIRTTNPVATEQYGCVCSNWGEHNINFNSDQS

SEQ ID NO: 166807 - protein, 34 aa, Artificial Sequence
  Description of Artificial Sequence: Synthetic polypeptide
DETEIRTTNPCAYEQWGSVCGDNNNDQNGNGGDD

SEQ ID NO: 166808 - protein, 36 aa, Artificial Sequence
  Description of Artificial Sequence: Synthetic polypeptide
DEEEIRTTNPVATEQYGCVCSNWGEHNIENFGSDQS

SEQ ID NO: 166809 - protein, 37 aa, Artificial Sequence
  Description of Artificial Sequence: Synthetic polypeptide
AEEEIRTTNPCATEQYGVVSTVNQQAGTEQGTNQQDE

SEQ ID NO: 166810 - protein, 33 aa, Artificial Sequence
  Description of Artificial Sequence: Synthetic polypeptide
DEAEIRTTNPVAYEQWGCVCGNNDNMDIGGNLP

SEQ ID NO: 166811 - protein, 34 aa, Artificial Sequence
  Description of Artificial Sequence: Synthetic polypeptide
DEMEIVTTNPVATEQYGTVCSATDGPVEFEGGWD

SEQ ID NO: 166812 - protein, 36 aa, Artificial Sequence
  Description of Artificial Sequence: Synthetic polypeptide
DEEEIRTTNPVATEQYGSVNCWTEAHIVQVQVIDEE

SEQ ID NO: 166813 - protein, 34 aa, Artificial Sequence
  Description of Artificial Sequence: Synthetic polypeptide
DEMEIVTTNPVATEQYGTVCSATDGPVEFECNHD

SEQ ID NO: 166814 - protein, 35 aa, Artificial Sequence
  Description of Artificial Sequence: Synthetic polypeptide
DEEEIATTNPVATEQYGSACAAPAEGQNHQDGMMW

SEQ ID NO: 166815 - protein, 35 aa, Artificial Sequence
  Description of Artificial Sequence: Synthetic polypeptide
DEEEIRTTNPVATEQYGCVCSNWGEHNANFNSEQF

SEQ ID NO: 166816 - protein, 37 aa, Artificial Sequence
  Description of Artificial Sequence: Synthetic polypeptide
DEEEIRTTNPVATEQYGSVGYELMNGEEQVIMNEEEI

SEQ ID NO: 166817 - protein, 33 aa, Artificial Sequence
  Description of Artificial Sequence: Synthetic polypeptide
DEMEIVTTNPVATEQYGTVCSATDGPVEFEEDD

SEQ ID NO: 166818 - protein, 36 aa, Artificial Sequence
  Description of Artificial Sequence: Synthetic polypeptide
DEEEIRTTNPVATEQYGCVCSNWGEHNEEHFGSEQS

SEQ ID NO: 166819 - protein, 38 aa, Artificial Sequence
  Description of Artificial Sequence: Synthetic polypeptide
AEEEIRTTNPCATEQYGVVSTVVNLQQNATEAGTNQTE

SEQ ID NO: 166820 - protein, 34 aa, Artificial Sequence
  Description of Artificial Sequence: Synthetic polypeptide
DEEEIATTNPVAYEPWGISVCSYSPVSQMMGNEG

SEQ ID NO: 166821 - protein, 31 aa, Artificial Sequence
  Description of Artificial Sequence: Synthetic polypeptide
DASEVASTNPVSTEGYGNVAQNTIQSRVGQR

SEQ ID NO: 166822 - protein, 34 aa, Artificial Sequence
  Description of Artificial Sequence: Synthetic polypeptide
DAEEIATTNPVATEQWGGCCTAATHLQTAMGNQT

SEQ ID NO: 166823 - protein, 37 aa, Artificial Sequence
  Description of Artificial Sequence: Synthetic polypeptide
DEEEIRTTNPVATEAYGVVSTVNQQQSATESGTEEEE

SEQ ID NO: 166824 - protein, 34 aa, Artificial Sequence
  Description of Artificial Sequence: Synthetic polypeptide
DEAEIRTTNPVAYEQWGCVCDNNDQMDTGGNSEP

SEQ ID NO: 166825 - protein, 38 aa, Artificial Sequence
  Description of Artificial Sequence: Synthetic polypeptide
DEEEIRTTNPVATEQYGSVGVTPFNGLGEEQAATVLVS

SEQ ID NO: 166826 - protein, 35 aa, Artificial Sequence
  Description of Artificial Sequence: Synthetic polypeptide
DEEEIATTNPVAYEPQWGQSVASNALLNTAGGITR

SEQ ID NO: 166827 - protein, 35 aa, Artificial Sequence
  Description of Artificial Sequence: Synthetic polypeptide
DEMEIVTTNPVATEQYGTVCSATDGPVEFEGENDC

SEQ ID NO: 166828 - protein, 38 aa, Artificial Sequence
  Description of Artificial Sequence: Synthetic polypeptide
DEEEIRTTNPVATEQYGSVNDPVMNSLEQQSMVQNEPS

SEQ ID NO: 166829 - protein, 37 aa, Artificial Sequence
  Description of Artificial Sequence: Synthetic polypeptide
DEEEIRTTNPVATEQYGSVNEPTFGQMESAQGQPELF

SEQ ID NO: 166830 - protein, 31 aa, Artificial Sequence
  Description of Artificial Sequence: Synthetic polypeptide
DDSEVASTNPVSTEGYGNVAAETIQSRVGNR

SEQ ID NO: 166831 - protein, 34 aa, Artificial Sequence
  Description of Artificial Sequence: Synthetic polypeptide
DEMEIVTTNPVATEQYGTVCSATDGPVEFEGGDM

SEQ ID NO: 166832 - protein, 37 aa, Artificial Sequence
  Description of Artificial Sequence: Synthetic polypeptide
DEEEIRTTNPVATEQYGSVNEPTVGQMTAAQGQIELF

SEQ ID NO: 166833 - protein, 35 aa, Artificial Sequence
  Description of Artificial Sequence: Synthetic polypeptide
DEEEIATTNPVAYEPQWGQSVAQVNDLVQTADITR

SEQ ID NO: 166834 - protein, 33 aa, Artificial Sequence
  Description of Artificial Sequence: Synthetic polypeptide
DENEIRTTNPVSTEPYGTISRMEDIQQEQNGNH

SEQ ID NO: 166835 - protein, 37 aa, Artificial Sequence
  Description of Artificial Sequence: Synthetic polypeptide
DEEEIRTTNPVATEQYGSVNEPTYGQMDAAQGQPELN

SEQ ID NO: 166836 - protein, 32 aa, Artificial Sequence
  Description of Artificial Sequence: Synthetic polypeptide
DEDEIATTNPVATEQWGCVAAKANLMGMDPGT

SEQ ID NO: 166837 - protein, 37 aa, Artificial Sequence
  Description of Artificial Sequence: Synthetic polypeptide
DEEEIRTTNPVATEQYGSVNEPTYGQMGAPQEQPELF

SEQ ID NO: 166838 - protein, 31 aa, Artificial Sequence
  Description of Artificial Sequence: Synthetic polypeptide
DASEVASTNPVSTEGYGNVAANTIQSRVGQR

SEQ ID NO: 166839 - protein, 33 aa, Artificial Sequence
  Description of Artificial Sequence: Synthetic polypeptide
DENEIRTTNPVSTEPYGTISYMEDIQQQQNGNH

SEQ ID NO: 166840 - protein, 36 aa, Artificial Sequence
  Description of Artificial Sequence: Synthetic polypeptide
DEEEIRTTNPVATEQYGCVCSNWGEHETENFGSDQA

SEQ ID NO: 166841 - protein, 36 aa, Artificial Sequence
  Description of Artificial Sequence: Synthetic polypeptide
DEEEISTTNPVATEQYGCVCSNTGEPNQNFNSDNQS

SEQ ID NO: 166842 - protein, 35 aa, Artificial Sequence
  Description of Artificial Sequence: Synthetic polypeptide
QEGEIATTNPVASEQYGSVSSTTPALPNRNGMTPV

SEQ ID NO: 166843 - protein, 37 aa, Artificial Sequence
  Description of Artificial Sequence: Synthetic polypeptide
AEEEIRATNPCATEQYGVVSTVNQQLGNQQIGTNPED

SEQ ID NO: 166844 - protein, 37 aa, Artificial Sequence
  Description of Artificial Sequence: Synthetic polypeptide
AEEEIRATNPCATEQYGVVSTVNQQLQNQQQGTNGTD

SEQ ID NO: 166845 - protein, 35 aa, Artificial Sequence
  Description of Artificial Sequence: Synthetic polypeptide
DEMEIVTTNPVATEQYGTVCSATDGHPVEFEGEND

SEQ ID NO: 166846 - protein, 35 aa, Artificial Sequence
  Description of Artificial Sequence: Synthetic polypeptide
DEDEIATTNPVATEQWGSVSAAIDPPLENAEEGDR

SEQ ID NO: 166847 - protein, 34 aa, Artificial Sequence
  Description of Artificial Sequence: Synthetic polypeptide
DENEIRTTNPVSTEPYGTISVMEDIQWQQNGVNH

SEQ ID NO: 166848 - protein, 36 aa, Artificial Sequence
  Description of Artificial Sequence: Synthetic polypeptide
DEDEIATTNPVATEQWGSVSAAGNPTQSNDGMQNPN

SEQ ID NO: 166849 - protein, 36 aa, Artificial Sequence
  Description of Artificial Sequence: Synthetic polypeptide
AEEEIRATNPCATEQYGVVSTVTNQAGNQQIGTNVE

SEQ ID NO: 166850 - protein, 36 aa, Artificial Sequence
  Description of Artificial Sequence: Synthetic polypeptide
DEDEIATTNPVATEQWGSVPAIANNLDDQGTGMARE

SEQ ID NO: 166851 - protein, 34 aa, Artificial Sequence
  Description of Artificial Sequence: Synthetic polypeptide
DEDEIATTNPVATEQWGSVATTNPDNHADEHGDH

SEQ ID NO: 166852 - protein, 34 aa, Artificial Sequence
  Description of Artificial Sequence: Synthetic polypeptide
DEMEIVTTNPVATEQYGTVCSATDGIPVEFELND

SEQ ID NO: 166853 - protein, 37 aa, Artificial Sequence
  Description of Artificial Sequence: Synthetic polypeptide
AEEEIRATNPCATEQYGVVSTVTNQLGNNQIGTNTVE

SEQ ID NO: 166854 - protein, 36 aa, Artificial Sequence
  Description of Artificial Sequence: Synthetic polypeptide
DEEEIRTTNPVATEQYGSVSTTMMMFMPPVWEEPDM

SEQ ID NO: 166855 - protein, 36 aa, Artificial Sequence
  Description of Artificial Sequence: Synthetic polypeptide
DEDEIATTNPVATEQWGSVATNANGLPQGNNHTNNL

SEQ ID NO: 166856 - protein, 33 aa, Artificial Sequence
  Description of Artificial Sequence: Synthetic polypeptide
DENEIRTTNPVSTEPYGTISVLDIQQQQGGFEH

SEQ ID NO: 166857 - protein, 35 aa, Artificial Sequence
  Description of Artificial Sequence: Synthetic polypeptide
DETEIKTTNPVATEQYGSVNTGMGQGNDEGIEEET

SEQ ID NO: 166858 - protein, 33 aa, Artificial Sequence
  Description of Artificial Sequence: Synthetic polypeptide
DENEIRTTNPVSTEPYGTISVEDIQQQQNGDHF

SEQ ID NO: 166859 - protein, 36 aa, Artificial Sequence
  Description of Artificial Sequence: Synthetic polypeptide
DETEIKTTNPVATEQYGSVSSTTDGQFEEEGGEGET

SEQ ID NO: 166860 - protein, 34 aa, Artificial Sequence
  Description of Artificial Sequence: Synthetic polypeptide
DENEIRTTNPVSTEPYGTISVEDIQQPQSGQNHN

SEQ ID NO: 166861 - protein, 38 aa, Artificial Sequence
  Description of Artificial Sequence: Synthetic polypeptide
AEEEIRTTNPVATEQYGSVVTVVNANQAGNQQGNNNGD

SEQ ID NO: 166862 - protein, 36 aa, Artificial Sequence
  Description of Artificial Sequence: Synthetic polypeptide
DETEIKTTNPVATEQYGVVITNDQNIGGEDGGQNEE

SEQ ID NO: 166863 - protein, 37 aa, Artificial Sequence
  Description of Artificial Sequence: Synthetic polypeptide
AEEEIRATNPCATEQYGVVSTVTNQLGNQQIGTNVTE

SEQ ID NO: 166864 - protein, 34 aa, Artificial Sequence
  Description of Artificial Sequence: Synthetic polypeptide
DEAEIATTNPVAYEQWGVVSGGNGLQQDHPNMDS

SEQ ID NO: 166865 - protein, 33 aa, Artificial Sequence
  Description of Artificial Sequence: Synthetic polypeptide
CEDEIATTNPVAYEQYGSCATAALTQNNLDNDN

SEQ ID NO: 166866 - protein, 37 aa, Artificial Sequence
  Description of Artificial Sequence: Synthetic polypeptide
AEEEIRATNPCATEQYGVVSTVTNQLQNQEQGTTNVD

SEQ ID NO: 166867 - protein, 34 aa, Artificial Sequence
  Description of Artificial Sequence: Synthetic polypeptide
DEEEIATTNPVATEPWGIQVCAYSPVSQMGGNNG

SEQ ID NO: 166868 - protein, 36 aa, Artificial Sequence
  Description of Artificial Sequence: Synthetic polypeptide
DETEIKTTNPVATEQYGSVASSTDGEDEGENVEEIA

SEQ ID NO: 166869 - protein, 36 aa, Artificial Sequence
  Description of Artificial Sequence: Synthetic polypeptide
DETEINTTNPVATEQYGETVVSINNELSQESNGGSQ

SEQ ID NO: 166870 - protein, 34 aa, Artificial Sequence
  Description of Artificial Sequence: Synthetic polypeptide
DEEEIATTNPVATEPWGISVCCYAPVSQTMGNNG

SEQ ID NO: 166871 - protein, 36 aa, Artificial Sequence
  Description of Artificial Sequence: Synthetic polypeptide
AEEEIRATNPCATEQYGVVSTVNNQNGNQQQGTNVE

SEQ ID NO: 166872 - protein, 34 aa, Artificial Sequence
  Description of Artificial Sequence: Synthetic polypeptide
DEAEIRTTNPVAYEEWGSVCYTNIDNDGGQDGDN

SEQ ID NO: 166873 - protein, 35 aa, Artificial Sequence
  Description of Artificial Sequence: Synthetic polypeptide
DEAEIRTTNPVAYEEWGSVYYTNNDQDDHGRNEDI

SEQ ID NO: 166874 - protein, 33 aa, Artificial Sequence
  Description of Artificial Sequence: Synthetic polypeptide
DENEIRTTNPVSTEPYGTISWMEQIQQQQNGNH

SEQ ID NO: 166875 - protein, 36 aa, Artificial Sequence
  Description of Artificial Sequence: Synthetic polypeptide
DEEEISTTNPVATEQYGCVCSNTGEHNQYFGSETQS

SEQ ID NO: 166876 - protein, 37 aa, Artificial Sequence
  Description of Artificial Sequence: Synthetic polypeptide
DEEEIRTTNPVATEQYGSVSTTMNIFMPPVSEEQDMM

SEQ ID NO: 166877 - protein, 33 aa, Artificial Sequence
  Description of Artificial Sequence: Synthetic polypeptide
DENEIRTTNPVSTEPYGTISWMEDIQQQQVGNH

SEQ ID NO: 166878 - protein, 35 aa, Artificial Sequence
  Description of Artificial Sequence: Synthetic polypeptide
QEEEIATTNPVAYEQYGSVCAAANVLDQMAEANDS

SEQ ID NO: 166879 - protein, 33 aa, Artificial Sequence
  Description of Artificial Sequence: Synthetic polypeptide
DENEIRTTNPVSTEPYGTISWMEDIQQQQNGNH

SEQ ID NO: 166880 - protein, 36 aa, Artificial Sequence
  Description of Artificial Sequence: Synthetic polypeptide
DEHEIRTTNPVATESYGKTISTNEFSGLSEAGSNQT

SEQ ID NO: 166881 - protein, 34 aa, Artificial Sequence
  Description of Artificial Sequence: Synthetic polypeptide
DEMEIVTTNPVATEQYGTVCSATDGFPVEFESND

SEQ ID NO: 166882 - protein, 33 aa, Artificial Sequence
  Description of Artificial Sequence: Synthetic polypeptide
DENEIRTTNPVSTEPYGTISWEEINQEQFGQQA

SEQ ID NO: 166883 - protein, 37 aa, Artificial Sequence
  Description of Artificial Sequence: Synthetic polypeptide
DEEEIRTTNPVATEQYGSVGYVSIEEQLSNTEEDNDM

SEQ ID NO: 166884 - protein, 38 aa, Artificial Sequence
  Description of Artificial Sequence: Synthetic polypeptide
AEEEIRTTNPVATEQYGSVVTVTTTNLGGTEQGTNVNQ

SEQ ID NO: 166885 - protein, 36 aa, Artificial Sequence
  Description of Artificial Sequence: Synthetic polypeptide
DEEEIATTNPVATEQYGSACAANPVLPMAMGPNEFQ

SEQ ID NO: 166886 - protein, 33 aa, Artificial Sequence
  Description of Artificial Sequence: Synthetic polypeptide
DENEIRTTNPVSTEPYGTISWEDIQQQQNGFNH

SEQ ID NO: 166887 - protein, 32 aa, Artificial Sequence
  Description of Artificial Sequence: Synthetic polypeptide
DENEIRTTNPVSTEPYGTISWEDIQQQQNGAH

SEQ ID NO: 166888 - protein, 32 aa, Artificial Sequence
  Description of Artificial Sequence: Synthetic polypeptide
DENEIRTTNPVSTEPYGTISWEDINQEYFGDQ

SEQ ID NO: 166889 - protein, 33 aa, Artificial Sequence
  Description of Artificial Sequence: Synthetic polypeptide
DENEIRTTNPVSTEPYGTISWEDINQEQFGSEF

SEQ ID NO: 166890 - protein, 36 aa, Artificial Sequence
  Description of Artificial Sequence: Synthetic polypeptide
DEDEIATTNPVATEQWGSVSATTPAGTNQRNGMEPV

SEQ ID NO: 166891 - protein, 37 aa, Artificial Sequence
  Description of Artificial Sequence: Synthetic polypeptide
AEEEIRATNPCATEQYGVVSTVNNQLQNQQIGTNGND

SEQ ID NO: 166892 - protein, 36 aa, Artificial Sequence
  Description of Artificial Sequence: Synthetic polypeptide
AEEEIRATNPCATEQYGVVSTVNNQLQNQQIGTTVD

SEQ ID NO: 166893 - protein, 37 aa, Artificial Sequence
  Description of Artificial Sequence: Synthetic polypeptide
AEEEIRATNPCATEQYGVVSTVNNQLQNQQQGTNNVD

SEQ ID NO: 166894 - protein, 35 aa, Artificial Sequence
  Description of Artificial Sequence: Synthetic polypeptide
DEEEIATTNPVATEPWGISVCSCAPCSQMMGNNGQ

SEQ ID NO: 166895 - protein, 37 aa, Artificial Sequence
  Description of Artificial Sequence: Synthetic polypeptide
AEEEIRATNPCATEQYGVVSTVNNQLQNQQQGTNVEQ

SEQ ID NO: 166896 - protein, 37 aa, Artificial Sequence
  Description of Artificial Sequence: Synthetic polypeptide
AEEEIRATNPCATEQYGVVSTVNNQNGNLQQGTNIVD

SEQ ID NO: 166897 - protein, 38 aa, Artificial Sequence
  Description of Artificial Sequence: Synthetic polypeptide
DEEEIRTTNPVATEQYGSVGYSLMNMEEQMIMNEESIL

SEQ ID NO: 166898 - protein, 37 aa, Artificial Sequence
  Description of Artificial Sequence: Synthetic polypeptide
DEEEIRTTNPVATEQYGSVGYTLMNGEEQVIMFAEEL

SEQ ID NO: 166899 - protein, 36 aa, Artificial Sequence
  Description of Artificial Sequence: Synthetic polypeptide
DEEEIRTTNPVATEQYGCVCSNWGEHEQENFGSDQY

SEQ ID NO: 166900 - protein, 34 aa, Artificial Sequence
  Description of Artificial Sequence: Synthetic polypeptide
DEAEIATTNPVAYEQWGVVTGGNGGNQGEGNDDR

SEQ ID NO: 166901 - protein, 37 aa, Artificial Sequence
  Description of Artificial Sequence: Synthetic polypeptide
AEEEIRTTNPVATEQYGSVVTVVTDGGNNNLGNNDDD

SEQ ID NO: 166902 - protein, 35 aa, Artificial Sequence
  Description of Artificial Sequence: Synthetic polypeptide
QEEEIAPTNPCATEQYGIVSSCPNGPQMSNGMNPR

SEQ ID NO: 166903 - protein, 35 aa, Artificial Sequence
  Description of Artificial Sequence: Synthetic polypeptide
DEEEIRTTNPVATEQYGCVCSNWGEHAENFGSEQD

SEQ ID NO: 166904 - protein, 34 aa, Artificial Sequence
  Description of Artificial Sequence: Synthetic polypeptide
AEEEIRCTNPTAYEQWGSVWGENDDDMRRGQNTR

SEQ ID NO: 166905 - protein, 35 aa, Artificial Sequence
  Description of Artificial Sequence: Synthetic polypeptide
DEEEIRTTNPVATEQYGCVCSNWGEHAENFNSQQP

SEQ ID NO: 166906 - protein, 33 aa, Artificial Sequence
  Description of Artificial Sequence: Synthetic polypeptide
DENEIRTTNPVSTEPYGTISTMEDIQQQQNGIH

SEQ ID NO: 166907 - protein, 34 aa, Artificial Sequence
  Description of Artificial Sequence: Synthetic polypeptide
DENEIRTTNPVSTEPYGTISTMEDIQQPQNGNHH

SEQ ID NO: 166908 - protein, 37 aa, Artificial Sequence
  Description of Artificial Sequence: Synthetic polypeptide
DEEEIRTTNPVATEAYGVVSTVNQQNQNQQSTNVATE

SEQ ID NO: 166909 - protein, 32 aa, Artificial Sequence
  Description of Artificial Sequence: Synthetic polypeptide
QEGEIATTNPCSTEQYGSVSACDLEDHEGTDL

SEQ ID NO: 166910 - protein, 35 aa, Artificial Sequence
  Description of Artificial Sequence: Synthetic polypeptide
DEEEIRTTNPVATEQYGCVCSNWGEHAFFNSNNQP

SEQ ID NO: 166911 - protein, 37 aa, Artificial Sequence
  Description of Artificial Sequence: Synthetic polypeptide
DEEEIRTTNPVATEAYGVVSTVNQQQIGTTEEGTTDE

SEQ ID NO: 166912 - protein, 37 aa, Artificial Sequence
  Description of Artificial Sequence: Synthetic polypeptide
DEEEIRTTNPVATEAYGVVSTVNQQQNQEQGTEQGSE

SEQ ID NO: 166913 - protein, 39 aa, Artificial Sequence
  Description of Artificial Sequence: Synthetic polypeptide
DEDEIRTTNPVATEQYGVVSTSNNGNQLQGIGTTNVTEQ

SEQ ID NO: 166914 - protein, 32 aa, Artificial Sequence
  Description of Artificial Sequence: Synthetic polypeptide
DEDEIATTNPVATEQWGGCVAANANGMMPGTG

SEQ ID NO: 166915 - protein, 32 aa, Artificial Sequence
  Description of Artificial Sequence: Synthetic polypeptide
DEEEIATTNPVAYEQWGCVSYSGGDNHGGHDA

SEQ ID NO: 166916 - protein, 33 aa, Artificial Sequence
  Description of Artificial Sequence: Synthetic polypeptide
DENEIRTTNPVSTEPYGTISSMEDIQQQWNGNH

SEQ ID NO: 166917 - protein, 33 aa, Artificial Sequence
  Description of Artificial Sequence: Synthetic polypeptide
DETEIRCTNPVATEQYGETTWSEEDLAEPKGGI

SEQ ID NO: 166918 - protein, 33 aa, Artificial Sequence
  Description of Artificial Sequence: Synthetic polypeptide
DETEIRCTNPVATEQYGETTWSEEDLAEPKGPI

SEQ ID NO: 166919 - protein, 36 aa, Artificial Sequence
  Description of Artificial Sequence: Synthetic polypeptide
DEEEIRTTNPVATEQYGCVCSNWGEHDQENFNSDQA

SEQ ID NO: 166920 - protein, 32 aa, Artificial Sequence
  Description of Artificial Sequence: Synthetic polypeptide
DEDEIATTNPVATEQWGGCCATNHQAEPPMVS

SEQ ID NO: 166921 - protein, 36 aa, Artificial Sequence
  Description of Artificial Sequence: Synthetic polypeptide
DEEEIRTTNPVATEQYGCVCSNWGEHDQNFNSDTQS

SEQ ID NO: 166922 - protein, 37 aa, Artificial Sequence
  Description of Artificial Sequence: Synthetic polypeptide
DEEEIRTTNPVATEQYGCVCSNWGEHDTENFGSDNQS

SEQ ID NO: 166923 - protein, 35 aa, Artificial Sequence
  Description of Artificial Sequence: Synthetic polypeptide
TEEEIRTTNPVATEQYGSSCVPWALSVETTIEQDN

SEQ ID NO: 166924 - protein, 35 aa, Artificial Sequence
  Description of Artificial Sequence: Synthetic polypeptide
DEMEIVTTNPVATEQYGTVCSATDGPPVEFEGNYD

SEQ ID NO: 166925 - protein, 37 aa, Artificial Sequence
  Description of Artificial Sequence: Synthetic polypeptide
DEEEIRTTNPVATEQYGSVNATINPDDEEGSGQEEIP

SEQ ID NO: 166926 - protein, 36 aa, Artificial Sequence
  Description of Artificial Sequence: Synthetic polypeptide
DEEEIRTTNPVATEQYGSVSTTMEMFMEVVSEEVDN

SEQ ID NO: 166927 - protein, 38 aa, Artificial Sequence
  Description of Artificial Sequence: Synthetic polypeptide
DEEEIRTTNPVATEAYGVVSTVNQQQNTATEQGTNEEE

SEQ ID NO: 166928 - protein, 32 aa, Artificial Sequence
  Description of Artificial Sequence: Synthetic polypeptide
DEDEIATTNPVATEQWGGCCATNHQAEPQPME

SEQ ID NO: 166929 - protein, 35 aa, Artificial Sequence
  Description of Artificial Sequence: Synthetic polypeptide
DEDEIATTNPVATEQWGSVANMNNNQTATPDNDRN

SEQ ID NO: 166930 - protein, 37 aa, Artificial Sequence
  Description of Artificial Sequence: Synthetic polypeptide
AEEEIRTTNPVATEQYGSVVTVVTDGNGNLGGNNDDD

SEQ ID NO: 166931 - protein, 34 aa, Artificial Sequence
  Description of Artificial Sequence: Synthetic polypeptide
DENEIRTTNPVSTEPYGTISTTPAIQQMQNGNPV

SEQ ID NO: 166932 - protein, 33 aa, Artificial Sequence
  Description of Artificial Sequence: Synthetic polypeptide
DDECISTTNPVATEQYGCVCSWEHNQNFNSDLS

SEQ ID NO: 166933 - protein, 36 aa, Artificial Sequence
  Description of Artificial Sequence: Synthetic polypeptide
AEEEIRATNPCATEQYGVVSTVTNQQGNQQIGTNQD

SEQ ID NO: 166934 - protein, 37 aa, Artificial Sequence
  Description of Artificial Sequence: Synthetic polypeptide
AEEEIRTTNPVATEQYGSVVTVVTDGGNNNLNGTNDD

SEQ ID NO: 166935 - protein, 36 aa, Artificial Sequence
  Description of Artificial Sequence: Synthetic polypeptide
DEEEISTTNPVATEQYGCVCSNTGEHNTENFGSEQA

SEQ ID NO: 166936 - protein, 37 aa, Artificial Sequence
  Description of Artificial Sequence: Synthetic polypeptide
AEEEIRTTNPVATEQYGSVVTVVTDGGNNNNLGGNDD

SEQ ID NO: 166937 - protein, 36 aa, Artificial Sequence
  Description of Artificial Sequence: Synthetic polypeptide
AEEEIRATNPVATEQWGGCVAITNPLEQTGMEEDRT

SEQ ID NO: 166938 - protein, 37 aa, Artificial Sequence
  Description of Artificial Sequence: Synthetic polypeptide
DEEEIATTNPVATEMWGSVSMNNGELPDDQGGGENHD

SEQ ID NO: 166939 - protein, 37 aa, Artificial Sequence
  Description of Artificial Sequence: Synthetic polypeptide
DEEEIRTTNPVATEQYGSVGYPLMNGHEQMIMNAEEL

SEQ ID NO: 166940 - protein, 35 aa, Artificial Sequence
  Description of Artificial Sequence: Synthetic polypeptide
DEDEIATTNPVATEQWGSVAITNNPEQGNQDNSDA

SEQ ID NO: 166941 - protein, 38 aa, Artificial Sequence
  Description of Artificial Sequence: Synthetic polypeptide
DEEEIRTTNPVATEQYGVVSTTNNNNAEQGTNTEDETD

SEQ ID NO: 166942 - protein, 38 aa, Artificial Sequence
  Description of Artificial Sequence: Synthetic polypeptide
DEEEIRTTNPVATEQYGSVASQCVLQEDATRMEVVQFI

SEQ ID NO: 166943 - protein, 36 aa, Artificial Sequence
  Description of Artificial Sequence: Synthetic polypeptide
DETEIRATNPVAFEQYGSVIDGQTNGQQEGGNGNGE

SEQ ID NO: 166944 - protein, 34 aa, Artificial Sequence
  Description of Artificial Sequence: Synthetic polypeptide
DENEIRTTNPVSTEPYGTISTTPAGQQMQNGNPV

SEQ ID NO: 166945 - protein, 34 aa, Artificial Sequence
  Description of Artificial Sequence: Synthetic polypeptide
DETEIRATNPVATEFYGSVYTQGQNEMGELDGQG

SEQ ID NO: 166946 - protein, 37 aa, Artificial Sequence
  Description of Artificial Sequence: Synthetic polypeptide
DEEEIRTTNPVATEQYGCVCSNWGEDHQENFGSDNQS

SEQ ID NO: 166947 - protein, 37 aa, Artificial Sequence
  Description of Artificial Sequence: Synthetic polypeptide
DEEEIRTTNPVATEQYGCVCSNWGEDHQENFGSENQD

SEQ ID NO: 166948 - protein, 37 aa, Artificial Sequence
  Description of Artificial Sequence: Synthetic polypeptide
DEEEIRTTNPVATEQYGCVCSNWGEDHQEYFGSDNQS

SEQ ID NO: 166949 - protein, 36 aa, Artificial Sequence
  Description of Artificial Sequence: Synthetic polypeptide
DEEEIRTTNPVATEQYGSVSTTMHWFMEPVSEEPDN

SEQ ID NO: 166950 - protein, 35 aa, Artificial Sequence
  Description of Artificial Sequence: Synthetic polypeptide
DEDEIATTNPVATEQWGSVAIANPLDDQGGGMGME

SEQ ID NO: 166951 - protein, 36 aa, Artificial Sequence
  Description of Artificial Sequence: Synthetic polypeptide
DEEEIRTTNPVATEQYGCVCSNWGEDNQNFNSETQS

SEQ ID NO: 166952 - protein, 35 aa, Artificial Sequence
  Description of Artificial Sequence: Synthetic polypeptide
DEDEIATTNPVATEQWGSVAIANNLDDQGGGMDHE

SEQ ID NO: 166953 - protein, 36 aa, Artificial Sequence
  Description of Artificial Sequence: Synthetic polypeptide
DEEEIRTTNPVATEQYGSVSTTMEMFMVPVSLEPDP

SEQ ID NO: 166954 - protein, 36 aa, Artificial Sequence
  Description of Artificial Sequence: Synthetic polypeptide
DEEEIRTTNPVATEQYGSVSTTMEMFMPPVSSEPIM

SEQ ID NO: 166955 - protein, 36 aa, Artificial Sequence
  Description of Artificial Sequence: Synthetic polypeptide
DEEEIRTTNPVATEQYGCVCSNWGEDQENFNSDTQS

SEQ ID NO: 166956 - protein, 31 aa, Artificial Sequence
  Description of Artificial Sequence: Synthetic polypeptide
DETEIRCTNPIATECWGSTWSEDWAEPKGPR

SEQ ID NO: 166957 - protein, 33 aa, Artificial Sequence
  Description of Artificial Sequence: Synthetic polypeptide
DETEIRCTNPIATECYGATVWSNADWAEPKGNR

SEQ ID NO: 166958 - protein, 35 aa, Artificial Sequence
  Description of Artificial Sequence: Synthetic polypeptide
DETEIRATNPVATEGYGSVVSDDNQAEGQTGGEGE

SEQ ID NO: 166959 - protein, 32 aa, Artificial Sequence
  Description of Artificial Sequence: Synthetic polypeptide
AEEEIATTNPVATEQYGCYCPWVDQHFNSEQF

SEQ ID NO: 166960 - protein, 31 aa, Artificial Sequence
  Description of Artificial Sequence: Synthetic polypeptide
QEEEIATTNPVATEQYGCYPWADNQHFESEQ

SEQ ID NO: 166961 - protein, 34 aa, Artificial Sequence
  Description of Artificial Sequence: Synthetic polypeptide
TEEGIRTTNPVAYEAYGKTVACTSLLTHVGNDRT

SEQ ID NO: 166962 - protein, 38 aa, Artificial Sequence
  Description of Artificial Sequence: Synthetic polypeptide
DEEEIRTTNPVATEQYGTVVVTNVATEQYGSVTQNTQE

SEQ ID NO: 166963 - protein, 35 aa, Artificial Sequence
  Description of Artificial Sequence: Synthetic polypeptide
DEQEIATTNPVATEQYGCVSTTDLNEEHFGSEDQA

SEQ ID NO: 166964 - protein, 34 aa, Artificial Sequence
  Description of Artificial Sequence: Synthetic polypeptide
DESEIRTTNPVAYEQWGSVSGGNGNEAGPIGDEE

SEQ ID NO: 166965 - protein, 34 aa, Artificial Sequence
  Description of Artificial Sequence: Synthetic polypeptide
DEQEIATTNPCATNQYGSVSATRDLVEDHEGEDL

SEQ ID NO: 166966 - protein, 38 aa, Artificial Sequence
  Description of Artificial Sequence: Synthetic polypeptide
DEEEIRTTNPVATEQYGSVCSNEPHNNGQFQTGTELEE

SEQ ID NO: 166967 - protein, 35 aa, Artificial Sequence
  Description of Artificial Sequence: Synthetic polypeptide
DESEIRTTNPVAYEQWGSVSGGNGPNSAGEGNNTS

SEQ ID NO: 166968 - protein, 35 aa, Artificial Sequence
  Description of Artificial Sequence: Synthetic polypeptide
DEQEIATTNPCATEQYGSTVFCTGLSEDHEGGENL

SEQ ID NO: 166969 - protein, 35 aa, Artificial Sequence
  Description of Artificial Sequence: Synthetic polypeptide
DEQEIATTNPVATEQYGCVSTTELNEDHFGSEDLS

SEQ ID NO: 166970 - protein, 39 aa, Artificial Sequence
  Description of Artificial Sequence: Synthetic polypeptide
DEEEIRTTNPVATEQYGVVSTVVNNNQAGTQNAGNEEDE

SEQ ID NO: 166971 - protein, 36 aa, Artificial Sequence
  Description of Artificial Sequence: Synthetic polypeptide
DEEEIRTTNPVATEQYGCTCSNTMEHNQENFGSDQA

SEQ ID NO: 166972 - protein, 39 aa, Artificial Sequence
  Description of Artificial Sequence: Synthetic polypeptide
DEEEIRTTNPVATEQYGTVTVVVTNNNLQQGEQETNNND

SEQ ID NO: 166973 - protein, 37 aa, Artificial Sequence
  Description of Artificial Sequence: Synthetic polypeptide
DEEEIRTTNPVATEQYGSVIGPTNNLEHMPVLEIEDH

SEQ ID NO: 166974 - protein, 38 aa, Artificial Sequence
  Description of Artificial Sequence: Synthetic polypeptide
DEEEIRTTNPVATEQYGTVTVVTTNNNNQQGENETNND

SEQ ID NO: 166975 - protein, 34 aa, Artificial Sequence
  Description of Artificial Sequence: Synthetic polypeptide
DEQEIATTNPVATEQYGCWNAATPGPLQAPMENN

SEQ ID NO: 166976 - protein, 34 aa, Artificial Sequence
  Description of Artificial Sequence: Synthetic polypeptide
CSEEIATTNPVGYEQWGGMCVSITTNLEQHGGER

SEQ ID NO: 166977 - protein, 40 aa, Artificial Sequence
  Description of Artificial Sequence: Synthetic polypeptide
DEEEIRTTNPVATEQYGSVSTVVGNQNNNQQGTEQGTNDE

SEQ ID NO: 166978 - protein, 35 aa, Artificial Sequence
  Description of Artificial Sequence: Synthetic polypeptide
DEEEISCTNPVATEQYGCVCSWEEHNQNFGSENQL

SEQ ID NO: 166979 - protein, 38 aa, Artificial Sequence
  Description of Artificial Sequence: Synthetic polypeptide
DEEEIRTTNPVATEQYGTVTVTTNVATEQYGSTTNEDD

SEQ ID NO: 166980 - protein, 40 aa, Artificial Sequence
  Description of Artificial Sequence: Synthetic polypeptide
DEEEIRTTNPVATEQYGSVSTVVGNSNNGQQGTEAGTNDE

SEQ ID NO: 166981 - protein, 35 aa, Artificial Sequence
  Description of Artificial Sequence: Synthetic polypeptide
DEDEIRGTNPVATEFWGSVVSAINEGQDGQGENQG

SEQ ID NO: 166982 - protein, 35 aa, Artificial Sequence
  Description of Artificial Sequence: Synthetic polypeptide
DEMEIRTTNPVATEQYGTVWSNAEGPVAEPEGNYI

SEQ ID NO: 166983 - protein, 36 aa, Artificial Sequence
  Description of Artificial Sequence: Synthetic polypeptide
DEEEIRTTNPVATEQYGCVCSDWGEHNINFSSDNQS

SEQ ID NO: 166984 - protein, 34 aa, Artificial Sequence
  Description of Artificial Sequence: Synthetic polypeptide
DEEEISCTNPVATEQYGCVCSWGEHQNFNSNTQS

SEQ ID NO: 166985 - protein, 36 aa, Artificial Sequence
  Description of Artificial Sequence: Synthetic polypeptide
DEEEIRTTNPVATEQYGCVCSDWGEHNQNFNSETQS

SEQ ID NO: 166986 - protein, 39 aa, Artificial Sequence
  Description of Artificial Sequence: Synthetic polypeptide
DEEEIRTTNPVATEQYGTVTVTSTNVATEQYGSTDNGDD

SEQ ID NO: 166987 - protein, 35 aa, Artificial Sequence
  Description of Artificial Sequence: Synthetic polypeptide
DESEIRTTNPVAYEQWGSVCYNNDQDMPNHGENSE

SEQ ID NO: 166988 - protein, 33 aa, Artificial Sequence
  Description of Artificial Sequence: Synthetic polypeptide
DEAEIATTNPVAYEQWGEVSGGNADEGDRNGDH

SEQ ID NO: 166989 - protein, 35 aa, Artificial Sequence
  Description of Artificial Sequence: Synthetic polypeptide
DEDEIATTNPVAYEQYGSVAACPNGLATGTNDSVG

SEQ ID NO: 166990 - protein, 33 aa, Artificial Sequence
  Description of Artificial Sequence: Synthetic polypeptide
QEMEIVTTNPCASEQYGTVCSATDNPVESEGND

SEQ ID NO: 166991 - protein, 31 aa, Artificial Sequence
  Description of Artificial Sequence: Synthetic polypeptide
DDSEVASTNPVSTEGYGCVAANTEQSRVGQR

SEQ ID NO: 166992 - protein, 35 aa, Artificial Sequence
  Description of Artificial Sequence: Synthetic polypeptide
DEEEIATTNPVAYEQWGVVCSNQNDGNQQRQGEHE

SEQ ID NO: 166993 - protein, 31 aa, Artificial Sequence
  Description of Artificial Sequence: Synthetic polypeptide
DDSEVASTNPVSTEGYGCVAANTIQSRVGQR

SEQ ID NO: 166994 - protein, 36 aa, Artificial Sequence
  Description of Artificial Sequence: Synthetic polypeptide
DEEEISCTNPVATEQYGCVCSTGEHNQENFGSDNQS

SEQ ID NO: 166995 - protein, 36 aa, Artificial Sequence
  Description of Artificial Sequence: Synthetic polypeptide
QEGEIRTTNPVATEQYGSVCSTMLLSEVEGGDGAFE

SEQ ID NO: 166996 - protein, 36 aa, Artificial Sequence
  Description of Artificial Sequence: Synthetic polypeptide
DEAEIATTNPVATEQYGSVCSMTDLNEDHEGSEDLA

SEQ ID NO: 166997 - protein, 36 aa, Artificial Sequence
  Description of Artificial Sequence: Synthetic polypeptide
DEEEIRTTNPVATEQYGSVCSNSYNSMEVPSTFQQD

SEQ ID NO: 166998 - protein, 36 aa, Artificial Sequence
  Description of Artificial Sequence: Synthetic polypeptide
DEEEIRTTNPVATEQYGCTCSTNEHNAENFNSDTQA

SEQ ID NO: 166999 - protein, 35 aa, Artificial Sequence
  Description of Artificial Sequence: Synthetic polypeptide
DEMEIRTTNPVATEQYGSYTTYVDDLETQDPTQME

SEQ ID NO: 167000 - protein, 33 aa, Artificial Sequence
  Description of Artificial Sequence: Synthetic polypeptide
TSSEIATTNPVAYDHYGSVNYTNELSQRVLNKE

SEQ ID NO: 167001 - protein, 35 aa, Artificial Sequence
  Description of Artificial Sequence: Synthetic polypeptide
DEMEIRTTNPVATEQYGSYTTYVDDLETRDPTQKE

SEQ ID NO: 167002 - protein, 33 aa, Artificial Sequence
  Description of Artificial Sequence: Synthetic polypeptide
VEEEIHGTNPVATFFYNGESVSMMGLRGDGNGP

SEQ ID NO: 167003 - protein, 38 aa, Artificial Sequence
  Description of Artificial Sequence: Synthetic polypeptide
DEEEIRTTNPVAYEQYGNSVCSQLNDLLDAQSGQIFKN

SEQ ID NO: 167004 - protein, 37 aa, Artificial Sequence
  Description of Artificial Sequence: Synthetic polypeptide
DEEEIRTTNPVATEQYGSVCSNPPHNNGQFQTVTTLE

SEQ ID NO: 167005 - protein, 32 aa, Artificial Sequence
  Description of Artificial Sequence: Synthetic polypeptide
DESEIRTTNPVAYEQWGCVSYSGGDNHGGHDG

SEQ ID NO: 167006 - protein, 32 aa, Artificial Sequence
  Description of Artificial Sequence: Synthetic polypeptide
TSNEIATTNPVAYEQWGSVMWTEGDQRGTTEP

SEQ ID NO: 167007 - protein, 35 aa, Artificial Sequence
  Description of Artificial Sequence: Synthetic polypeptide
DEAEIATTNPVAYEQWGCVCTGGNDMQQDRGGNHY

SEQ ID NO: 167008 - protein, 36 aa, Artificial Sequence
  Description of Artificial Sequence: Synthetic polypeptide
DEAEIATTNPVATEQYGSVCSATLALTNHQDDIAAE

SEQ ID NO: 167009 - protein, 31 aa, Artificial Sequence
  Description of Artificial Sequence: Synthetic polypeptide
DEAEIATTNPVAYEQWGCVYNMDDQMNGGIS

SEQ ID NO: 167010 - protein, 37 aa, Artificial Sequence
  Description of Artificial Sequence: Synthetic polypeptide
DEEEIRTTNPVATEQYGSVIGPTNNLMHMPVLSIEDT

SEQ ID NO: 167011 - protein, 32 aa, Artificial Sequence
  Description of Artificial Sequence: Synthetic polypeptide
QEMEIVSTNPVATEQYGTVCAASDGPVEFGND

SEQ ID NO: 167012 - protein, 36 aa, Artificial Sequence
  Description of Artificial Sequence: Synthetic polypeptide
DEDEIATTNPVAYEQYGSVAACPPNPLATGTNDSRG

SEQ ID NO: 167013 - protein, 32 aa, Artificial Sequence
  Description of Artificial Sequence: Synthetic polypeptide
DESEIRTTNPVAYEQWGMTCPTDNGDERQSQV

SEQ ID NO: 167014 - protein, 36 aa, Artificial Sequence
  Description of Artificial Sequence: Synthetic polypeptide
DEEEIATTNPVATEQWGSVSMNGNPEPGGNQMENNN

SEQ ID NO: 167015 - protein, 35 aa, Artificial Sequence
  Description of Artificial Sequence: Synthetic polypeptide
DESEIRTTNPVAYEQWGSCVYSDEWNDGQRSQTDP

SEQ ID NO: 167016 - protein, 37 aa, Artificial Sequence
  Description of Artificial Sequence: Synthetic polypeptide
DEEEIRTTNPVATEQYGSVIGPTNNLLGWPDLEIEDT

SEQ ID NO: 167017 - protein, 31 aa, Artificial Sequence
  Description of Artificial Sequence: Synthetic polypeptide
DDSEVASTNPVSTEGYGCVAASTIQNRMGQR

SEQ ID NO: 167018 - protein, 38 aa, Artificial Sequence
  Description of Artificial Sequence: Synthetic polypeptide
DEEEIRTTNPVATEQYGTVTVTNNVATEQYGSTDNLDD

SEQ ID NO: 167019 - protein, 36 aa, Artificial Sequence
  Description of Artificial Sequence: Synthetic polypeptide
DEEEIRTTNPVATEQYGCVCSMSEEHNQNFGSDTQP

SEQ ID NO: 167020 - protein, 33 aa, Artificial Sequence
  Description of Artificial Sequence: Synthetic polypeptide
DESEIRTTNPVAYEQWGTVCSNWEHQEQDMISR

SEQ ID NO: 167021 - protein, 37 aa, Artificial Sequence
  Description of Artificial Sequence: Synthetic polypeptide
DEEEIRTTNPVATEQYGSVIGPTNNLDHMPVEEIEDL

SEQ ID NO: 167022 - protein, 35 aa, Artificial Sequence
  Description of Artificial Sequence: Synthetic polypeptide
TSEEIRTTNPTATEHYGQSVGCQNNMLSQGEGNPE

SEQ ID NO: 167023 - protein, 34 aa, Artificial Sequence
  Description of Artificial Sequence: Synthetic polypeptide
AEVDEIATTNPVAYEQWGEVTTGNQQDRDGDNQG

SEQ ID NO: 167024 - protein, 35 aa, Artificial Sequence
  Description of Artificial Sequence: Synthetic polypeptide
TSEEIRTTNPTATEHYGISVCCENNMLSQGEGNPA

SEQ ID NO: 167025 - protein, 34 aa, Artificial Sequence
  Description of Artificial Sequence: Synthetic polypeptide
DEQEIATTNPAVATVQYGGSVSATDLEPVEDEDL

SEQ ID NO: 167026 - protein, 32 aa, Artificial Sequence
  Description of Artificial Sequence: Synthetic polypeptide
AETEIRTTNPVATEQYGEAWANEENWAEPGGI

SEQ ID NO: 167027 - protein, 34 aa, Artificial Sequence
  Description of Artificial Sequence: Synthetic polypeptide
DEQEIATTNPAVATVQYFGSVSATDLEDHETEDL

SEQ ID NO: 167028 - protein, 32 aa, Artificial Sequence
  Description of Artificial Sequence: Synthetic polypeptide
QEMEIVTTNPVATEQYGTVCSTDGPVEFEEEK

SEQ ID NO: 167029 - protein, 37 aa, Artificial Sequence
  Description of Artificial Sequence: Synthetic polypeptide
DEEEIRTTNPVATEQYGSVIGPTNNLDHMPALEIEDT

SEQ ID NO: 167030 - protein, 34 aa, Artificial Sequence
  Description of Artificial Sequence: Synthetic polypeptide
DEDEIRGTNPVATEGWGSVSAGMEGQDGEDEQNG

SEQ ID NO: 167031 - protein, 34 aa, Artificial Sequence
  Description of Artificial Sequence: Synthetic polypeptide
AETEIRTTNPVATEQWGATAWANAEDWQERGPYR

SEQ ID NO: 167032 - protein, 34 aa, Artificial Sequence
  Description of Artificial Sequence: Synthetic polypeptide
DEQEIATTNPAVATVQIYGSVSATDIEDHEGEDL

SEQ ID NO: 167033 - protein, 37 aa, Artificial Sequence
  Description of Artificial Sequence: Synthetic polypeptide
DEEEIRTTNPVATEQYGSVIGPTNNLDHYPVLEFEDT

SEQ ID NO: 167034 - protein, 39 aa, Artificial Sequence
  Description of Artificial Sequence: Synthetic polypeptide
DEEEIRTTNPVATEQYGTVTTGQSGTISTNTQEQEVGNV

SEQ ID NO: 167035 - protein, 39 aa, Artificial Sequence
  Description of Artificial Sequence: Synthetic polypeptide
DEEEIRTTNPVATEQYGTVTTGQSGTIGTNTQMQEVGNP

SEQ ID NO: 167036 - protein, 39 aa, Artificial Sequence
  Description of Artificial Sequence: Synthetic polypeptide
DEEEIRTTNPVATEQYGTVTTDQSGTISTNTQQGEVGNP

SEQ ID NO: 167037 - protein, 34 aa, Artificial Sequence
  Description of Artificial Sequence: Synthetic polypeptide
DEDEIRGTNPVATEGWGSVSAGMEGQDGEGENIG

SEQ ID NO: 167038 - protein, 38 aa, Artificial Sequence
  Description of Artificial Sequence: Synthetic polypeptide
DEEEIRTTNPVATEQYGSVCSMPAELLQEQDQETNLVT

SEQ ID NO: 167039 - protein, 35 aa, Artificial Sequence
  Description of Artificial Sequence: Synthetic polypeptide
CETEIATTNPVAYEQYGSVCSTNPQQEHQDGDEMK

SEQ ID NO: 167040 - protein, 34 aa, Artificial Sequence
  Description of Artificial Sequence: Synthetic polypeptide
TSEEIRCTNPTATEHYGSVFCINNMLSQGEGNPE

SEQ ID NO: 167041 - protein, 33 aa, Artificial Sequence
  Description of Artificial Sequence: Synthetic polypeptide
DEMEIRTTNPVATQQYGTVSTIAGEEVEVAEGV

SEQ ID NO: 167042 - protein, 35 aa, Artificial Sequence
  Description of Artificial Sequence: Synthetic polypeptide
DESEIRTTNPVAYEQYGTVVCIEQDQNDSRGGNVN

SEQ ID NO: 167043 - protein, 33 aa, Artificial Sequence
  Description of Artificial Sequence: Synthetic polypeptide
DESEIRTTNPVAYERWGSVCVNDHAGDRGGDAG

SEQ ID NO: 167044 - protein, 35 aa, Artificial Sequence
  Description of Artificial Sequence: Synthetic polypeptide
DESEIRTTNPVAYERWGSVVSCSGNEPQDTEGENG

SEQ ID NO: 167045 - protein, 39 aa, Artificial Sequence
  Description of Artificial Sequence: Synthetic polypeptide
DEEEIRTTNPVATEQYGVVSTVVNNNTNLQQGTTDEQQD

SEQ ID NO: 167046 - protein, 35 aa, Artificial Sequence
  Description of Artificial Sequence: Synthetic polypeptide
DEAEIATTNPVAYEQWGSVAHTDDGGQDRNGGPER

SEQ ID NO: 167047 - protein, 32 aa, Artificial Sequence
  Description of Artificial Sequence: Synthetic polypeptide
AETEIRTTNPVATECWGETWANEEDLARKGPI

SEQ ID NO: 167048 - protein, 34 aa, Artificial Sequence
  Description of Artificial Sequence: Synthetic polypeptide
DESEIRTTNPVAYEPYGQSVAINEGSTSPPGAPR

SEQ ID NO: 167049 - protein, 34 aa, Artificial Sequence
  Description of Artificial Sequence: Synthetic polypeptide
TSEEIRTTNPTATEHYGSVGCINNMVSQGEGNPI

SEQ ID NO: 167050 - protein, 32 aa, Artificial Sequence
  Description of Artificial Sequence: Synthetic polypeptide
AEVEIATTNPIATECWGSCSKNEDDQGGGNQM

SEQ ID NO: 167051 - protein, 33 aa, Artificial Sequence
  Description of Artificial Sequence: Synthetic polypeptide
DEQEIATTNPCATEHWGSVCYNNDDQDHGDQDR

SEQ ID NO: 167052 - protein, 40 aa, Artificial Sequence
  Description of Artificial Sequence: Synthetic polypeptide
DEEEIRTTNPVATEQYGSVSTVVGTNNNNQQGTEAGTNDD

SEQ ID NO: 167053 - protein, 33 aa, Artificial Sequence
  Description of Artificial Sequence: Synthetic polypeptide
QEMEIVTTNPVATEQYGTVCSATDGCVEFEGED

SEQ ID NO: 167054 - protein, 35 aa, Artificial Sequence
  Description of Artificial Sequence: Synthetic polypeptide
DEQEIATTNPAVATVQYNGISVSATDLEDHEGEDL

SEQ ID NO: 167055 - protein, 32 aa, Artificial Sequence
  Description of Artificial Sequence: Synthetic polypeptide
QEMEIVTTNPVATEQYGTVCSATDGPEHEEEL

SEQ ID NO: 167056 - protein, 36 aa, Artificial Sequence
  Description of Artificial Sequence: Synthetic polypeptide
DEEEIATTNPVATEQWGSVSGTGPPIDNSEHNTGMF

SEQ ID NO: 167057 - protein, 35 aa, Artificial Sequence
  Description of Artificial Sequence: Synthetic polypeptide
DESEIRTTNPVAYEQWGVVCSTPNGGNHGQGGGHN

SEQ ID NO: 167058 - protein, 37 aa, Artificial Sequence
  Description of Artificial Sequence: Synthetic polypeptide
DEEEIRTTNPVATEQYGCVCSMSGEHETENFGSDNQQ

SEQ ID NO: 167059 - protein, 35 aa, Artificial Sequence
  Description of Artificial Sequence: Synthetic polypeptide
CSEEIATTNPVGTEQWGEMCVMSTTNILQNGGMER

SEQ ID NO: 167060 - protein, 34 aa, Artificial Sequence
  Description of Artificial Sequence: Synthetic polypeptide
DEQEIATTNPAVATVQYGTSVSATDLEDHELEDL

SEQ ID NO: 167061 - protein, 35 aa, Artificial Sequence
  Description of Artificial Sequence: Synthetic polypeptide
DDAEIRTTNPVATEQYGCVCSTGPDHNQSFGSDQA

SEQ ID NO: 167062 - protein, 36 aa, Artificial Sequence
  Description of Artificial Sequence: Synthetic polypeptide
TSEEIRTTNPVATEQYGSVPNAESNELSTRVTNYEG

SEQ ID NO: 167063 - protein, 38 aa, Artificial Sequence
  Description of Artificial Sequence: Synthetic polypeptide
DEEEIRTTNPVATEQYGVVSTVVNNNQQQGEEEEEEDE

SEQ ID NO: 167064 - protein, 35 aa, Artificial Sequence
  Description of Artificial Sequence: Synthetic polypeptide
DEDEIRGTNPVATEFWGWVSATNGEGQRGQGEQGF

SEQ ID NO: 167065 - protein, 37 aa, Artificial Sequence
  Description of Artificial Sequence: Synthetic polypeptide
DEEEIRTTNPVATEQYGCVCSMTEDHNQENFGSETQA

SEQ ID NO: 167066 - protein, 34 aa, Artificial Sequence
  Description of Artificial Sequence: Synthetic polypeptide
QEMEIVTTNPVATEQYGTVCSATDGPVEFEGNDS

SEQ ID NO: 167067 - protein, 37 aa, Artificial Sequence
  Description of Artificial Sequence: Synthetic polypeptide
DEEEIRTTNPVATEQYGCVCSMTEEHNQENFGSDTQA

SEQ ID NO: 167068 - protein, 34 aa, Artificial Sequence
  Description of Artificial Sequence: Synthetic polypeptide
DEMEIRTTNPVATQQYGCVCSTGEHEYFGSDTQA

SEQ ID NO: 167069 - protein, 31 aa, Artificial Sequence
  Description of Artificial Sequence: Synthetic polypeptide
AEEEIACTNPVAYEQWGCLSCFEHDQRQGES

SEQ ID NO: 167070 - protein, 35 aa, Artificial Sequence
  Description of Artificial Sequence: Synthetic polypeptide
TSEEIRTTNPTATESYGSVLACINNMLSQGEGNPE

SEQ ID NO: 167071 - protein, 31 aa, Artificial Sequence
  Description of Artificial Sequence: Synthetic polypeptide
AEVEIATTNPVAYEQWGCTVTNHMMEDGNTM

SEQ ID NO: 167072 - protein, 31 aa, Artificial Sequence
  Description of Artificial Sequence: Synthetic polypeptide
AEVEIATTNPVAYEQWGCSWSNHMMEDGNTQ

SEQ ID NO: 167073 - protein, 31 aa, Artificial Sequence
  Description of Artificial Sequence: Synthetic polypeptide
DEQEIATTNPVATEQYGEAPEVCQDHEEEDL

SEQ ID NO: 167074 - protein, 36 aa, Artificial Sequence
  Description of Artificial Sequence: Synthetic polypeptide
DEEEIATTNPVATEQWGSVSGTGDPPGLNHDENGHN

SEQ ID NO: 167075 - protein, 31 aa, Artificial Sequence
  Description of Artificial Sequence: Synthetic polypeptide
CQGEIAPTNPCSYEQYGKVSCNHSQSGGTNR

SEQ ID NO: 167076 - protein, 35 aa, Artificial Sequence
  Description of Artificial Sequence: Synthetic polypeptide
AEVEIATTNPVATESYGCVATGNGLNDTERGGDDR

SEQ ID NO: 167077 - protein, 39 aa, Artificial Sequence
  Description of Artificial Sequence: Synthetic polypeptide
DEEEIRTTNPVATEQYGTVTTVVNVTISTNTQEQEVGNP

SEQ ID NO: 167078 - protein, 35 aa, Artificial Sequence
  Description of Artificial Sequence: Synthetic polypeptide
DEMEIRTTNPVATEQYGSYCYATPDEWNIMGGDEE

SEQ ID NO: 167079 - protein, 36 aa, Artificial Sequence
  Description of Artificial Sequence: Synthetic polypeptide
QEGEIRTTNPVATEQYGSVSFTMPDENQENSQEEIF

SEQ ID NO: 167080 - protein, 33 aa, Artificial Sequence
  Description of Artificial Sequence: Synthetic polypeptide
DEQEIATTNPIATECYGAVSATEDLEDPKGEDL

SEQ ID NO: 167081 - protein, 39 aa, Artificial Sequence
  Description of Artificial Sequence: Synthetic polypeptide
DEEEIRTTNPVATEQYGVVSTVVNNLQQSATEEGVVTQQ

SEQ ID NO: 167082 - protein, 34 aa, Artificial Sequence
  Description of Artificial Sequence: Synthetic polypeptide
CEEEIRCTNPVATEQYGTTVWHENSPPSHKENRA

SEQ ID NO: 167083 - protein, 34 aa, Artificial Sequence
  Description of Artificial Sequence: Synthetic polypeptide
TTEEIRGTNPVATEQYGSVSNGIDGQENGEGQGM

SEQ ID NO: 167084 - protein, 35 aa, Artificial Sequence
  Description of Artificial Sequence: Synthetic polypeptide
TTEEIRGTNPVATEQYGSVSNGEPNGQENGEGQGT

SEQ ID NO: 167085 - protein, 35 aa, Artificial Sequence
  Description of Artificial Sequence: Synthetic polypeptide
DEEEIRTTNPVATEQYGVCVHPSPVNMINVDMAEL

SEQ ID NO: 167086 - protein, 36 aa, Artificial Sequence
  Description of Artificial Sequence: Synthetic polypeptide
DEEEIRTTNPVATEQYGCVCSDTGEDHNQYFSSDQS

SEQ ID NO: 167087 - protein, 37 aa, Artificial Sequence
  Description of Artificial Sequence: Synthetic polypeptide
DEEEIRTTNPVATEQYGCVCSDTGEDHQENFGSETQP

SEQ ID NO: 167088 - protein, 37 aa, Artificial Sequence
  Description of Artificial Sequence: Synthetic polypeptide
DEEEIRTTNPVATEQYGCVCSDTGEDLNQENFSSDQA

SEQ ID NO: 167089 - protein, 35 aa, Artificial Sequence
  Description of Artificial Sequence: Synthetic polypeptide
DESEIRTTNPVAYECWGCTVSCGNEEPQDRTGENG

SEQ ID NO: 167090 - protein, 33 aa, Artificial Sequence
  Description of Artificial Sequence: Synthetic polypeptide
DEQEIATTNPVATECWGSVWSATDWEDHEGPDL

SEQ ID NO: 167091 - protein, 34 aa, Artificial Sequence
  Description of Artificial Sequence: Synthetic polypeptide
DESEIRTTNPVAYECWGISVSQANSSSDREGGMV

SEQ ID NO: 167092 - protein, 33 aa, Artificial Sequence
  Description of Artificial Sequence: Synthetic polypeptide
DEQEIATTNPVATECWGSVWANTDLADHEGPDL

SEQ ID NO: 167093 - protein, 36 aa, Artificial Sequence
  Description of Artificial Sequence: Synthetic polypeptide
DEEEIRTTNPVATEQYGCTCSTWGEHNQNFGSDTQS

SEQ ID NO: 167094 - protein, 33 aa, Artificial Sequence
  Description of Artificial Sequence: Synthetic polypeptide
DEQEIATTNPVATECWGSVWAATDLEEHEGPDI

SEQ ID NO: 167095 - protein, 36 aa, Artificial Sequence
  Description of Artificial Sequence: Synthetic polypeptide
DEEEIRTVNPVATEAYGSVVNGGQRGLQGQNGQGEI

SEQ ID NO: 167096 - protein, 33 aa, Artificial Sequence
  Description of Artificial Sequence: Synthetic polypeptide
DEEEIATTNPVATEQWGTNCSAAALMNNSNDAW

SEQ ID NO: 167097 - protein, 35 aa, Artificial Sequence
  Description of Artificial Sequence: Synthetic polypeptide
TTEEIATTNPVATTQWGSVAWTENGDQDQRGGNKS

SEQ ID NO: 167098 - protein, 36 aa, Artificial Sequence
  Description of Artificial Sequence: Synthetic polypeptide
DEEEIRTTNPVATEQYGVCVHPSPVHMPNYVDMGED

SEQ ID NO: 167099 - protein, 35 aa, Artificial Sequence
  Description of Artificial Sequence: Synthetic polypeptide
DESEIRTTNPVAYECWGSVSCANFSDDREGGNQGC

SEQ ID NO: 167100 - protein, 35 aa, Artificial Sequence
  Description of Artificial Sequence: Synthetic polypeptide
TTEEIATTNPVATTQWGSVAWTENGDQDQKGMNPR

SEQ ID NO: 167101 - protein, 34 aa, Artificial Sequence
  Description of Artificial Sequence: Synthetic polypeptide
DEQEIATTNPVATEQYGCVANPNGDPAAEANPER

SEQ ID NO: 167102 - protein, 35 aa, Artificial Sequence
  Description of Artificial Sequence: Synthetic polypeptide
DESEIRTTNPVAYECWGSVSCANSSDDREGGNDVE

SEQ ID NO: 167103 - protein, 36 aa, Artificial Sequence
  Description of Artificial Sequence: Synthetic polypeptide
DEAEIRTTNPVATEQYGSVSVMAPNTDTGQGEEVES

SEQ ID NO: 167104 - protein, 39 aa, Artificial Sequence
  Description of Artificial Sequence: Synthetic polypeptide
DEEEIRTTNPVATEQYGSVSTVNTNNQQNNQQGTEQGSE

SEQ ID NO: 167105 - protein, 34 aa, Artificial Sequence
  Description of Artificial Sequence: Synthetic polypeptide
TTEEIATTNPVATTQWGSVAWTENGDQDNGNTTK

SEQ ID NO: 167106 - protein, 34 aa, Artificial Sequence
  Description of Artificial Sequence: Synthetic polypeptide
TTEEIATTNPVATTQWGSVAWTENGDQDNGKSDR

SEQ ID NO: 167107 - protein, 35 aa, Artificial Sequence
  Description of Artificial Sequence: Synthetic polypeptide
TTEEIATTNPVATTQWGSVAWTENGDQDQRGPNHP

SEQ ID NO: 167108 - protein, 33 aa, Artificial Sequence
  Description of Artificial Sequence: Synthetic polypeptide
TTEECIATTNPVAYEQWGSVSKTNPEDGMGKDQ

SEQ ID NO: 167109 - protein, 36 aa, Artificial Sequence
  Description of Artificial Sequence: Synthetic polypeptide
DEEEIRTTNPVATEQYGVCVHPSPVNMLNAVDMFEM

SEQ ID NO: 167110 - protein, 34 aa, Artificial Sequence
  Description of Artificial Sequence: Synthetic polypeptide
DESEIRTTNPVAYEAWGISVSCANSSTTREGGMV

SEQ ID NO: 167111 - protein, 31 aa, Artificial Sequence
  Description of Artificial Sequence: Synthetic polypeptide
DDSEVASTNPVATECWGNVAANTIQSREGQR

SEQ ID NO: 167112 - protein, 31 aa, Artificial Sequence
  Description of Artificial Sequence: Synthetic polypeptide
DDSEVASTNPVATECWGNVAANTIQDREGQR

SEQ ID NO: 167113 - protein, 35 aa, Artificial Sequence
  Description of Artificial Sequence: Synthetic polypeptide
DEEEIRTTNPVATEQYGCVCQWEEHQENFGSETQS

SEQ ID NO: 167114 - protein, 36 aa, Artificial Sequence
  Description of Artificial Sequence: Synthetic polypeptide
QEGEIRTTNPVATEQYGSVSWTMPDLNTNTSQEHTF

SEQ ID NO: 167115 - protein, 37 aa, Artificial Sequence
  Description of Artificial Sequence: Synthetic polypeptide
DEEEIRTTNPVATEQYGSVIGPTNTLLGMPVLEQEDT

SEQ ID NO: 167116 - protein, 31 aa, Artificial Sequence
  Description of Artificial Sequence: Synthetic polypeptide
QEMEIATTNPVATEQYGEACSTDVCEFEEEK

SEQ ID NO: 167117 - protein, 35 aa, Artificial Sequence
  Description of Artificial Sequence: Synthetic polypeptide
DEQEIATTNPVATEFYGSVSATMDGEDQEGGEDGD

SEQ ID NO: 167118 - protein, 36 aa, Artificial Sequence
  Description of Artificial Sequence: Synthetic polypeptide
DEQEIATTNPVATEFYGSVSATGDNGEDQIGGEDGD

SEQ ID NO: 167119 - protein, 35 aa, Artificial Sequence
  Description of Artificial Sequence: Synthetic polypeptide
DCEEIRTTNPVATEQYGSYSDWVNIETTMETNNES

SEQ ID NO: 167120 - protein, 32 aa, Artificial Sequence
  Description of Artificial Sequence: Synthetic polypeptide
QEMEIATTNPVATEQYGEVCSATDVCEHEEEK

SEQ ID NO: 167121 - protein, 35 aa, Artificial Sequence
  Description of Artificial Sequence: Synthetic polypeptide
DEEEIRTTNPVATEQYGCVCQWGEHQENFISENQT

SEQ ID NO: 167122 - protein, 34 aa, Artificial Sequence
  Description of Artificial Sequence: Synthetic polypeptide
DEDEIATTNPVAYEQYGSVACAGPLNAAAGDNWT

SEQ ID NO: 167123 - protein, 35 aa, Artificial Sequence
  Description of Artificial Sequence: Synthetic polypeptide
TTEEIRGTNPVATEQYGSVSVNGINGQENEGEGQG

SEQ ID NO: 167124 - protein, 33 aa, Artificial Sequence
  Description of Artificial Sequence: Synthetic polypeptide
DEEEISATNPVAYEQWGMVTGWNDHQGQRGSDL

SEQ ID NO: 167125 - protein, 32 aa, Artificial Sequence
  Description of Artificial Sequence: Synthetic polypeptide
DEEEISATNPVAYEQWGMVTGWNDHQQQGGDL

SEQ ID NO: 167126 - protein, 32 aa, Artificial Sequence
  Description of Artificial Sequence: Synthetic polypeptide
QEEEIATTNPVATEQYGEAPSEPVEQMTSEQQ

SEQ ID NO: 167127 - protein, 32 aa, Artificial Sequence
  Description of Artificial Sequence: Synthetic polypeptide
QEEEIATTNPVATEQYGEAPSEPVEQMSETQD

SEQ ID NO: 167128 - protein, 31 aa, Artificial Sequence
  Description of Artificial Sequence: Synthetic polypeptide
QEEEIATTNPVATEQYGEAPSEPVEHMSECQ

SEQ ID NO: 167129 - protein, 36 aa, Artificial Sequence
  Description of Artificial Sequence: Synthetic polypeptide
DEEEIRTTNPVATEQYGVCVHPSPVNMPGNVDMFEL

SEQ ID NO: 167130 - protein, 37 aa, Artificial Sequence
  Description of Artificial Sequence: Synthetic polypeptide
DEEEIRTTNPVATEQYGCVCSDTEDHNQENFNSDTQS

SEQ ID NO: 167131 - protein, 36 aa, Artificial Sequence
  Description of Artificial Sequence: Synthetic polypeptide
DEEEIRTTNPVATEQYGCVCSDTEEHNQENFSSDQS

SEQ ID NO: 167132 - protein, 33 aa, Artificial Sequence
  Description of Artificial Sequence: Synthetic polypeptide
QEMEIATTNPVATEQYGTVCSAEDGPVQFEGED

SEQ ID NO: 167133 - protein, 35 aa, Artificial Sequence
  Description of Artificial Sequence: Synthetic polypeptide
DDAEIATTNPVATEQYGCVSTLLATQFNGLQDQEN

SEQ ID NO: 167134 - protein, 35 aa, Artificial Sequence
  Description of Artificial Sequence: Synthetic polypeptide
DEEEIRTTNPVATEQYGVCVHPSPVNMPEDVDMFE

SEQ ID NO: 167135 - protein, 36 aa, Artificial Sequence
  Description of Artificial Sequence: Synthetic polypeptide
DEEEISCTNPVATEQYGCVCSMTGEDFQGFGSDNQA

SEQ ID NO: 167136 - protein, 35 aa, Artificial Sequence
  Description of Artificial Sequence: Synthetic polypeptide
DEMEIRTTNPVATEQYGSVTTTYVDDLELDPTQME

SEQ ID NO: 167137 - protein, 35 aa, Artificial Sequence
  Description of Artificial Sequence: Synthetic polypeptide
DEEEIRTTNPVATEQYGVCVHPSPVNMPNVDMEDE

SEQ ID NO: 167138 - protein, 34 aa, Artificial Sequence
  Description of Artificial Sequence: Synthetic polypeptide
DDAEIRTTNPVATEQYGCVCSWGEDHNQSFNSDQ

SEQ ID NO: 167139 - protein, 34 aa, Artificial Sequence
  Description of Artificial Sequence: Synthetic polypeptide
CEEEIKTTNPCAYEQWGSVYCTDNHQHRNDHNDS

SEQ ID NO: 167140 - protein, 31 aa, Artificial Sequence
  Description of Artificial Sequence: Synthetic polypeptide
DDSEVASTNPVSTEGYGAVAVNTIQSRVGQR

SEQ ID NO: 167141 - protein, 34 aa, Artificial Sequence
  Description of Artificial Sequence: Synthetic polypeptide
DESEIRTTNPVAYECWGTVYRINENQDRRGINGF

SEQ ID NO: 167142 - protein, 34 aa, Artificial Sequence
  Description of Artificial Sequence: Synthetic polypeptide
DESEIRTTNPVAYECWGTVYRINENQMRRGENGI

SEQ ID NO: 167143 - protein, 37 aa, Artificial Sequence
  Description of Artificial Sequence: Synthetic polypeptide
DEEEIRTTNPVATEQYGSVIGPTNNNDGMPVLEFEDQ

SEQ ID NO: 167144 - protein, 37 aa, Artificial Sequence
  Description of Artificial Sequence: Synthetic polypeptide
DEMEIRTTNPVATEQYGSVWSVPLEVETDRFDGSIME

SEQ ID NO: 167145 - protein, 31 aa, Artificial Sequence
  Description of Artificial Sequence: Synthetic polypeptide
QEMEIATTNPVAYEQYGEASPSEVPCQHLEK

SEQ ID NO: 167146 - protein, 37 aa, Artificial Sequence
  Description of Artificial Sequence: Synthetic polypeptide
DEEEIRTTNPVATEQYGSVIGPTNNLVDMPVLEIEDT

SEQ ID NO: 167147 - protein, 34 aa, Artificial Sequence
  Description of Artificial Sequence: Synthetic polypeptide
DESEIRTTNPVAYEHWGISVSCANGSGDREGGMV

SEQ ID NO: 167148 - protein, 34 aa, Artificial Sequence
  Description of Artificial Sequence: Synthetic polypeptide
DESEIRTTNPVAYEHWGISVSCANSSNDFEGGNV

SEQ ID NO: 167149 - protein, 34 aa, Artificial Sequence
  Description of Artificial Sequence: Synthetic polypeptide
DESEIRTTNPVAYEHWGISVSCANTSSDRPGGMV

SEQ ID NO: 167150 - protein, 35 aa, Artificial Sequence
  Description of Artificial Sequence: Synthetic polypeptide
DESEIRTTNPVAYEHWGISVSCANWSSSDRPGGNV

SEQ ID NO: 167151 - protein, 34 aa, Artificial Sequence
  Description of Artificial Sequence: Synthetic polypeptide
DESEIRTTNPVAYEHWGISVSCLNSSSDRHGGEV

SEQ ID NO: 167152 - protein, 35 aa, Artificial Sequence
  Description of Artificial Sequence: Synthetic polypeptide
DEEEIATTNPVAYEQWGVVCSNQNDGNQERQGEDT

SEQ ID NO: 167153 - protein, 32 aa, Artificial Sequence
  Description of Artificial Sequence: Synthetic polypeptide
CSGEIATTNPVGTEQWGGMCVSITNLDHGGET

SEQ ID NO: 167154 - protein, 35 aa, Artificial Sequence
  Description of Artificial Sequence: Synthetic polypeptide
DESEIRTTNPVAYEHWGISVSCVNSSSDREGGNVT

SEQ ID NO: 167155 - protein, 31 aa, Artificial Sequence
  Description of Artificial Sequence: Synthetic polypeptide
DDSEVASTNPVSTEGYGCVAANEIQNRVGQR

SEQ ID NO: 167156 - protein, 31 aa, Artificial Sequence
  Description of Artificial Sequence: Synthetic polypeptide
QEEEIATTNPVATEQYGEAPHEVEQEHTSEQ

SEQ ID NO: 167157 - protein, 37 aa, Artificial Sequence
  Description of Artificial Sequence: Synthetic polypeptide
DEMEIRTTNPVATEQYGSVYELWTPNAEIRFGIDQMN

SEQ ID NO: 167158 - protein, 37 aa, Artificial Sequence
  Description of Artificial Sequence: Synthetic polypeptide
DEMEIRTTNPVATEQYGSVYEVWTPNAEMRFGIEMMN

SEQ ID NO: 167159 - protein, 34 aa, Artificial Sequence
  Description of Artificial Sequence: Synthetic polypeptide
TTAEIATTNPVATEWWGSVYITDNHDQRNGDQER

SEQ ID NO: 167160 - protein, 35 aa, Artificial Sequence
  Description of Artificial Sequence: Synthetic polypeptide
TTAEIATTNPVATECYGSVSGGPLNDDRQDQGNDR

SEQ ID NO: 167161 - protein, 35 aa, Artificial Sequence
  Description of Artificial Sequence: Synthetic polypeptide
DEMEIRTTNPVATEQYGSVYQCWTLNEEDFSDQEF

SEQ ID NO: 167162 - protein, 35 aa, Artificial Sequence
  Description of Artificial Sequence: Synthetic polypeptide
DDAEIRTTNPVATEQYGCCCSTWGELNQHFGSDQS

SEQ ID NO: 167163 - protein, 36 aa, Artificial Sequence
  Description of Artificial Sequence: Synthetic polypeptide
DEAEIRTTNPVATEQYGSVSVTAANQDTSYIEEVES

SEQ ID NO: 167164 - protein, 36 aa, Artificial Sequence
  Description of Artificial Sequence: Synthetic polypeptide
DEMEIRTTNPVATEQYGSVYTWNWMGQTESSEEHTQ

SEQ ID NO: 167165 - protein, 36 aa, Artificial Sequence
  Description of Artificial Sequence: Synthetic polypeptide
DESEIRTTNPVAYEPWGSVVSCCGNEPQDREGENGP

SEQ ID NO: 167166 - protein, 36 aa, Artificial Sequence
  Description of Artificial Sequence: Synthetic polypeptide
DEMEIRTTNPVATEQYGSVYVPKNLTEEEIVQESRF

SEQ ID NO: 167167 - protein, 38 aa, Artificial Sequence
  Description of Artificial Sequence: Synthetic polypeptide
DEEEIRTTNPVATEQYGVVSTVVNNNNQQGEQEEDEDE

SEQ ID NO: 167168 - protein, 33 aa, Artificial Sequence
  Description of Artificial Sequence: Synthetic polypeptide
QEMEIATTNPVATEQYGTVCSATDGPVEFEGED

SEQ ID NO: 167169 - protein, 34 aa, Artificial Sequence
  Description of Artificial Sequence: Synthetic polypeptide
DESEIRTTNPVAYECWGTVYRINENQDRRGDNQG

SEQ ID NO: 167170 - protein, 34 aa, Artificial Sequence
  Description of Artificial Sequence: Synthetic polypeptide
DESEIRTTNPVAYECWGTVVSCGNESQDHEGENG

SEQ ID NO: 167171 - protein, 37 aa, Artificial Sequence
  Description of Artificial Sequence: Synthetic polypeptide
DEEEIRTTNPVATEQYGCVCSDTGEHNQENFNSETQP

SEQ ID NO: 167172 - protein, 33 aa, Artificial Sequence
  Description of Artificial Sequence: Synthetic polypeptide
QEMEIATTNPVATEQYGTVCSATDGPVEFEGEK

SEQ ID NO: 167173 - protein, 34 aa, Artificial Sequence
  Description of Artificial Sequence: Synthetic polypeptide
DEEEIATTNPVAYEQWGVVASCENLTQAALDDIH

SEQ ID NO: 167174 - protein, 35 aa, Artificial Sequence
  Description of Artificial Sequence: Synthetic polypeptide
DEEEIRTTNPVATEQYGVCVHPSPPVMPNAVDMFE

SEQ ID NO: 167175 - protein, 35 aa, Artificial Sequence
  Description of Artificial Sequence: Synthetic polypeptide
DEEEIATTNPVAYEQWGVVCSNQNDGNEQRQGEDL

SEQ ID NO: 167176 - protein, 34 aa, Artificial Sequence
  Description of Artificial Sequence: Synthetic polypeptide
DEQEIATTNPVATAFWGSVSGPNEPQDTAGGNGM

SEQ ID NO: 167177 - protein, 37 aa, Artificial Sequence
  Description of Artificial Sequence: Synthetic polypeptide
DEHEIRTTNPVATEQYGSVSTTANYDETPENTNDPEV

SEQ ID NO: 167178 - protein, 34 aa, Artificial Sequence
  Description of Artificial Sequence: Synthetic polypeptide
DEQEIATTNPVATEQYGCVCSNTDPEEHFGSETL

SEQ ID NO: 167179 - protein, 34 aa, Artificial Sequence
  Description of Artificial Sequence: Synthetic polypeptide
DEQEIATTNPVATEQYGCVCSNTDPEEHSGEDLS

SEQ ID NO: 167180 - protein, 34 aa, Artificial Sequence
  Description of Artificial Sequence: Synthetic polypeptide
DEQEIATTNPVASEQYGCVSATSDLEDHEGMCDL

SEQ ID NO: 167181 - protein, 34 aa, Artificial Sequence
  Description of Artificial Sequence: Synthetic polypeptide
DEQEIATTNPVATEQYGCVCSNTGDPEDHFGEDL

SEQ ID NO: 167182 - protein, 36 aa, Artificial Sequence
  Description of Artificial Sequence: Synthetic polypeptide
DEQEIATTNPVATEQYGCVCSTTDLNEEHEGSENLS

SEQ ID NO: 167183 - protein, 36 aa, Artificial Sequence
  Description of Artificial Sequence: Synthetic polypeptide
DESEIRTTNPVATEQWGSVSGGEPAGPNMRNGMNPV

SEQ ID NO: 167184 - protein, 35 aa, Artificial Sequence
  Description of Artificial Sequence: Synthetic polypeptide
DESEIRTTNPVAYECWGSVSYCANFSDDREGGNVA

SEQ ID NO: 167185 - protein, 35 aa, Artificial Sequence
  Description of Artificial Sequence: Synthetic polypeptide
DESEIRTTNPVAYECWGSVVSCCGNEPQDAEGENG

SEQ ID NO: 167186 - protein, 36 aa, Artificial Sequence
  Description of Artificial Sequence: Synthetic polypeptide
DEAEIRTTNPVATEQYGSVSVPNNNTEEEIWQESRF

SEQ ID NO: 167187 - protein, 30 aa, Artificial Sequence
  Description of Artificial Sequence: Synthetic polypeptide
CSNEIATTNPVAYEAYGKVSNHLSQHETEL

SEQ ID NO: 167188 - protein, 35 aa, Artificial Sequence
  Description of Artificial Sequence: Synthetic polypeptide
DEAEIATTNPVATEQYGSVCSPMNHQFNQAEEEGD

SEQ ID NO: 167189 - protein, 35 aa, Artificial Sequence
  Description of Artificial Sequence: Synthetic polypeptide
DEEEIATTNPVAYEQWGVVCSNQNDGNQDRQGESD

SEQ ID NO: 167190 - protein, 35 aa, Artificial Sequence
  Description of Artificial Sequence: Synthetic polypeptide
DESEIRTTNPVAYECWGSVYQRINENQDRRGENGY

SEQ ID NO: 167191 - protein, 41 aa, Artificial Sequence
  Description of Artificial Sequence: Synthetic polypeptide
DEEEIRTTNPVATEQYGSVSTVNLQLGNATTEQGTNNNTTE

SEQ ID NO: 167192 - protein, 36 aa, Artificial Sequence
  Description of Artificial Sequence: Synthetic polypeptide
DEAEIRTTNPVATEQYGSVSVSAANTATGQEEEQES

SEQ ID NO: 167193 - protein, 34 aa, Artificial Sequence
  Description of Artificial Sequence: Synthetic polypeptide
DEDEIATTNPVAYEQYGSVAATAHGAAAPGGDRK

SEQ ID NO: 167194 - protein, 33 aa, Artificial Sequence
  Description of Artificial Sequence: Synthetic polypeptide
DEDEIATTNPVAYEQYGSVAATAGTPTANNIEN

SEQ ID NO: 167195 - protein, 35 aa, Artificial Sequence
  Description of Artificial Sequence: Synthetic polypeptide
DEDEIATTNPVAYEQYGSVAATAGGQAAPGTNSNN

SEQ ID NO: 167196 - protein, 37 aa, Artificial Sequence
  Description of Artificial Sequence: Synthetic polypeptide
DEAEIRTTNPVATEQYGSVSVTAANEDATGQGEEQES

SEQ ID NO: 167197 - protein, 36 aa, Artificial Sequence
  Description of Artificial Sequence: Synthetic polypeptide
DEQEIATTNPVAHEQYGSTVSCTGMLSEDHEGGENL

SEQ ID NO: 167198 - protein, 34 aa, Artificial Sequence
  Description of Artificial Sequence: Synthetic polypeptide
DEDEIATTNPVAYEQYGSTVAANNDQTATPNVNQ

SEQ ID NO: 167199 - protein, 33 aa, Artificial Sequence
  Description of Artificial Sequence: Synthetic polypeptide
QEMEIVTTNPVGTEQYGTVCSATDGPVEFEGND

SEQ ID NO: 167200 - protein, 34 aa, Artificial Sequence
  Description of Artificial Sequence: Synthetic polypeptide
DEMEIRTTNPVAVECWGSVSNCIEEPQDREVENS

SEQ ID NO: 167201 - protein, 35 aa, Artificial Sequence
  Description of Artificial Sequence: Synthetic polypeptide
DEQAEIATTNPVAYECWGSVATGNDLGDQQGMNHE

SEQ ID NO: 167202 - protein, 34 aa, Artificial Sequence
  Description of Artificial Sequence: Synthetic polypeptide
DEEEISTTNPCATEQYGCVCPTNHQENFISDTQA

SEQ ID NO: 167203 - protein, 35 aa, Artificial Sequence
  Description of Artificial Sequence: Synthetic polypeptide
DEMEISTTNPVATEQYGCVCSNTDEPNEFEGSDQA

SEQ ID NO: 167204 - protein, 37 aa, Artificial Sequence
  Description of Artificial Sequence: Synthetic polypeptide
DEEEIRTTNPVATEQYGSVIGPTNALLGMPVLEIEDD

SEQ ID NO: 167205 - protein, 34 aa, Artificial Sequence
  Description of Artificial Sequence: Synthetic polypeptide
DEPEIVTTNPVATEQYGTVCSATSGPVEFEHNDE

SEQ ID NO: 167206 - protein, 34 aa, Artificial Sequence
  Description of Artificial Sequence: Synthetic polypeptide
DEPEIVTTNPVATEQYGTVCSATLGPVEFEQNVD

SEQ ID NO: 167207 - protein, 37 aa, Artificial Sequence
  Description of Artificial Sequence: Synthetic polypeptide
DEEEIRTTNPVATEQYGSVIGPTMNLDGYPVLEIEDT

SEQ ID NO: 167208 - protein, 36 aa, Artificial Sequence
  Description of Artificial Sequence: Synthetic polypeptide
DEMEISTTNPVATEQYGCVCSNTGEHQENFGSDNQS

SEQ ID NO: 167209 - protein, 35 aa, Artificial Sequence
  Description of Artificial Sequence: Synthetic polypeptide
DEPEISTTNPVATEQYGTVVSATDGDDEEGEEGND

SEQ ID NO: 167210 - protein, 33 aa, Artificial Sequence
  Description of Artificial Sequence: Synthetic polypeptide
DESEIRTTNPVSTEPYGTISPMEDIQQQQNGNH

SEQ ID NO: 167211 - protein, 36 aa, Artificial Sequence
  Description of Artificial Sequence: Synthetic polypeptide
DEQEIATTNPVATEQYGSACSANPNLQDSPDENAPE

SEQ ID NO: 167212 - protein, 30 aa, Artificial Sequence
  Description of Artificial Sequence: Synthetic polypeptide
QENEIAPTNPVSSEQYGTISCDIQQQQGNH

SEQ ID NO: 167213 - protein, 38 aa, Artificial Sequence
  Description of Artificial Sequence: Synthetic polypeptide
DEEEIRTTNPVATEQYGVVSTVVNNQNNNNQQGTTEES

SEQ ID NO: 167214 - protein, 35 aa, Artificial Sequence
  Description of Artificial Sequence: Synthetic polypeptide
DEQEIATTNPVATEQYGSACSANPPAEAEMGNGHQ

SEQ ID NO: 167215 - protein, 35 aa, Artificial Sequence
  Description of Artificial Sequence: Synthetic polypeptide
DEMEISTTNPVATEQYGCVCSNTGEPNEFFGSDDS

SEQ ID NO: 167216 - protein, 34 aa, Artificial Sequence
  Description of Artificial Sequence: Synthetic polypeptide
DESEIRTTNPVSTEPYGTVCSCMEDIGQQQNGNH

SEQ ID NO: 167217 - protein, 35 aa, Artificial Sequence
  Description of Artificial Sequence: Synthetic polypeptide
DEMEISTTNPVATEQYGCVCSNTGEPNEFFGSQQA

SEQ ID NO: 167218 - protein, 34 aa, Artificial Sequence
  Description of Artificial Sequence: Synthetic polypeptide
DESEIRTTNPVSTEPYGTVCSMWDIQQQQMGKNH

SEQ ID NO: 167219 - protein, 36 aa, Artificial Sequence
  Description of Artificial Sequence: Synthetic polypeptide
DEEEIATTNPVATEQWGSVAIEPNHDQGAGNNTGDN

SEQ ID NO: 167220 - protein, 35 aa, Artificial Sequence
  Description of Artificial Sequence: Synthetic polypeptide
DEEEIATTNPVATEQWGSVAGTNPTAEAPIGTEDK

SEQ ID NO: 167221 - protein, 36 aa, Artificial Sequence
  Description of Artificial Sequence: Synthetic polypeptide
DEEEIRTTNPVATEQYGSVIGPRNNLLDMPLEIEDL

SEQ ID NO: 167222 - protein, 33 aa, Artificial Sequence
  Description of Artificial Sequence: Synthetic polypeptide
DEDEIATTNPVAYEQWGVVSGGNLNGDHPNMGS

SEQ ID NO: 167223 - protein, 38 aa, Artificial Sequence
  Description of Artificial Sequence: Synthetic polypeptide
DEEEIRTTNPVATEQYGSVSTVVTNNNNNNQGDEDTED

SEQ ID NO: 167224 - protein, 33 aa, Artificial Sequence
  Description of Artificial Sequence: Synthetic polypeptide
DEPEIRTTNPVSTEPYGTISMEDIQQQQNGNNH

SEQ ID NO: 167225 - protein, 36 aa, Artificial Sequence
  Description of Artificial Sequence: Synthetic polypeptide
TNEEIATTNPVAYEQWGSVSHTQNGLDQGGQNGMQM

SEQ ID NO: 167226 - protein, 33 aa, Artificial Sequence
  Description of Artificial Sequence: Synthetic polypeptide
DEDEIATTNPVAYEQWGVVSGGNGTQDHPNNGS

SEQ ID NO: 167227 - protein, 40 aa, Artificial Sequence
  Description of Artificial Sequence: Synthetic polypeptide
DEEEIRTTNPVATEQYGSVSTVVTNNNNGQQGTEGGTNLE

SEQ ID NO: 167228 - protein, 30 aa, Artificial Sequence
  Description of Artificial Sequence: Synthetic polypeptide
DDSEVASTNPISTEGYGNVAANTIQRVGQR

SEQ ID NO: 167229 - protein, 36 aa, Artificial Sequence
  Description of Artificial Sequence: Synthetic polypeptide
DEEEIATTNPVATEQWGSVAITNAPEQSGDGMGSVA

SEQ ID NO: 167230 - protein, 35 aa, Artificial Sequence
  Description of Artificial Sequence: Synthetic polypeptide
DEQAEIATTNPVAYEQWGSTSTNGNGNGQEGQNDP

SEQ ID NO: 167231 - protein, 35 aa, Artificial Sequence
  Description of Artificial Sequence: Synthetic polypeptide
DEEEISTTNPCATEQYGCVCPTELNQENFNSNTQA

SEQ ID NO: 167232 - protein, 34 aa, Artificial Sequence
  Description of Artificial Sequence: Synthetic polypeptide
AEEEIACTNPVATEQWGCVAGNGQLQNRMGGTLI

SEQ ID NO: 167233 - protein, 31 aa, Artificial Sequence
  Description of Artificial Sequence: Synthetic polypeptide
DDSEVASTNPVSTEGYGCVATSEIQSRMGQR

SEQ ID NO: 167234 - protein, 36 aa, Artificial Sequence
  Description of Artificial Sequence: Synthetic polypeptide
DEEEIATTNPVAYEQYGSCAAAVGNGLNHDDGDNRW

SEQ ID NO: 167235 - protein, 34 aa, Artificial Sequence
  Description of Artificial Sequence: Synthetic polypeptide
DEMEISTTNPVATEQYGAVCSAWDGPVEFEGNEP

SEQ ID NO: 167236 - protein, 33 aa, Artificial Sequence
  Description of Artificial Sequence: Synthetic polypeptide
DEMEISTTNPVATEQYGAVCTATDGPVEFEGFS

SEQ ID NO: 167237 - protein, 34 aa, Artificial Sequence
  Description of Artificial Sequence: Synthetic polypeptide
DEMEISTTNPVATEQYGAVCTATDGPVEFEGSNE

SEQ ID NO: 167238 - protein, 37 aa, Artificial Sequence
  Description of Artificial Sequence: Synthetic polypeptide
DEEEIRTTNPVATEQYGSVIGPTNKLDGMPVLVIEDT

SEQ ID NO: 167239 - protein, 34 aa, Artificial Sequence
  Description of Artificial Sequence: Synthetic polypeptide
DEDEIATTNPVAYEQYGCVAANNGLQAAPAGAPN

SEQ ID NO: 167240 - protein, 34 aa, Artificial Sequence
  Description of Artificial Sequence: Synthetic polypeptide
DEQCIATTNPVAYECYGSTVAIENELSQSVGGNM

SEQ ID NO: 167241 - protein, 40 aa, Artificial Sequence
  Description of Artificial Sequence: Synthetic polypeptide
DEEEIRTTNPVATEQYGSVSTVVSTSNNTQQGTEAGTNDE

SEQ ID NO: 167242 - protein, 34 aa, Artificial Sequence
  Description of Artificial Sequence: Synthetic polypeptide
DEDEIATTNPVAYEQYGCVAANGGQAAPGPNENP

SEQ ID NO: 167243 - protein, 31 aa, Artificial Sequence
  Description of Artificial Sequence: Synthetic polypeptide
QENEIAPTNPVSSEPYGIISCENLQQSNGNH

SEQ ID NO: 167244 - protein, 36 aa, Artificial Sequence
  Description of Artificial Sequence: Synthetic polypeptide
DEEEIRTTNPVATEQYGSVCPMLLMEGEMAQDEMYD

SEQ ID NO: 167245 - protein, 34 aa, Artificial Sequence
  Description of Artificial Sequence: Synthetic polypeptide
DEQAIRTTNPVATEQYGSYFISTLTMIEGGQISP

SEQ ID NO: 167246 - protein, 35 aa, Artificial Sequence
  Description of Artificial Sequence: Synthetic polypeptide
DEDEIATTNPVAYEQWGVVVPTDNGDQAGGNMNRG

SEQ ID NO: 167247 - protein, 32 aa, Artificial Sequence
  Description of Artificial Sequence: Synthetic polypeptide
DESEIRTTNPVSTEPWGTISMEDIQQQQNGNH

SEQ ID NO: 167248 - protein, 37 aa, Artificial Sequence
  Description of Artificial Sequence: Synthetic polypeptide
DEQAIRTTNPVATEQYGSVSTVLDANEIWEGMQNGQI

SEQ ID NO: 167249 - protein, 35 aa, Artificial Sequence
  Description of Artificial Sequence: Synthetic polypeptide
DEDEIATTNPVAYEQWGVVVPTDNGDDQAGNMNRS

SEQ ID NO: 167250 - protein, 37 aa, Artificial Sequence
  Description of Artificial Sequence: Synthetic polypeptide
DEEEIRTTNPVATEQYGSVIGPTNIQLNMPHHEIEDP

SEQ ID NO: 167251 - protein, 34 aa, Artificial Sequence
  Description of Artificial Sequence: Synthetic polypeptide
DEMEISTTNPVATEQYGCTCSSGNHNQNFGSDQS

SEQ ID NO: 167252 - protein, 34 aa, Artificial Sequence
  Description of Artificial Sequence: Synthetic polypeptide
DEQAIRCTNPVATEQYGSFISTLTQIEGGQISPA

SEQ ID NO: 167253 - protein, 37 aa, Artificial Sequence
  Description of Artificial Sequence: Synthetic polypeptide
DEEEIRTTNPVATEQYGSVCPELNQAAEPSNVEHIFT

SEQ ID NO: 167254 - protein, 39 aa, Artificial Sequence
  Description of Artificial Sequence: Synthetic polypeptide
DEEEIRTTNPVATEQYGTVTNLQSGVIGTNTQNQEVGNV

SEQ ID NO: 167255 - protein, 33 aa, Artificial Sequence
  Description of Artificial Sequence: Synthetic polypeptide
AEEEIASVNPVCTEQYGVVCSSGNLQSFGSQQS

SEQ ID NO: 167256 - protein, 29 aa, Artificial Sequence
  Description of Artificial Sequence: Synthetic peptide
QENEIAPTNPVSSEPYGIISCENIQQGTH

SEQ ID NO: 167257 - protein, 33 aa, Artificial Sequence
  Description of Artificial Sequence: Synthetic polypeptide
DEQAISCTNPVATEQYGSSISTLTLIEGGQISP

SEQ ID NO: 167258 - protein, 35 aa, Artificial Sequence
  Description of Artificial Sequence: Synthetic polypeptide
DEMEISTTNPVATEQYGAVCSATDGPVEFEGNIKG

SEQ ID NO: 167259 - protein, 33 aa, Artificial Sequence
  Description of Artificial Sequence: Synthetic polypeptide
DEDEIATTNPVAYEQWGVVAGDNGNQGAMNGND

SEQ ID NO: 167260 - protein, 33 aa, Artificial Sequence
  Description of Artificial Sequence: Synthetic polypeptide
DEDEIRTTNPCAYEEWGSVAMDNDHNGGRRGNA

SEQ ID NO: 167261 - protein, 38 aa, Artificial Sequence
  Description of Artificial Sequence: Synthetic polypeptide
DEEEIRTTNPVATEQYGSVIGLLPNYNQANVEGDNNVF

SEQ ID NO: 167262 - protein, 35 aa, Artificial Sequence
  Description of Artificial Sequence: Synthetic polypeptide
DEEEIATTNPVATEQWGNVASGSEHGNNHQDGEAW

SEQ ID NO: 167263 - protein, 32 aa, Artificial Sequence
  Description of Artificial Sequence: Synthetic polypeptide
AETEIATTNPIATECYGATWANEENLAERGGR

SEQ ID NO: 167264 - protein, 39 aa, Artificial Sequence
  Description of Artificial Sequence: Synthetic polypeptide
DEEEIRTTNPVATEQYGSVSTVVTNQQQNNQNGTEQGSE

SEQ ID NO: 167265 - protein, 35 aa, Artificial Sequence
  Description of Artificial Sequence: Synthetic polypeptide
DEDEIRTTNPCAYEQWGSVYCGENGLQDHHGPNNE

SEQ ID NO: 167266 - protein, 39 aa, Artificial Sequence
  Description of Artificial Sequence: Synthetic polypeptide
DEEEIRTTNPVATEQYGTVTNLQSGTISTTTNNQEVGNV

SEQ ID NO: 167267 - protein, 37 aa, Artificial Sequence
  Description of Artificial Sequence: Synthetic polypeptide
DEHEIRTTNPVATEQYGSVESTPTNWAEEAIGDEPQN

SEQ ID NO: 167268 - protein, 37 aa, Artificial Sequence
  Description of Artificial Sequence: Synthetic polypeptide
DEHEIRTTNPVATEQYGSVESTPMNWLEEIKIDEPQI

SEQ ID NO: 167269 - protein, 34 aa, Artificial Sequence
  Description of Artificial Sequence: Synthetic polypeptide
CEEEIRTTNPVATEGYGVVGDDNNNGQGEGEFGQ

SEQ ID NO: 167270 - protein, 34 aa, Artificial Sequence
  Description of Artificial Sequence: Synthetic polypeptide
DESEIRVTNPVAYECWGSVYRINENQDRRGENFG

SEQ ID NO: 167271 - protein, 35 aa, Artificial Sequence
  Description of Artificial Sequence: Synthetic polypeptide
CEEEIRTTNPVATEIYGVVTMQDGDNGQRFNDEGQ

SEQ ID NO: 167272 - protein, 40 aa, Artificial Sequence
  Description of Artificial Sequence: Synthetic polypeptide
DEEEIRTTNPVATEQYGSVSTVVTTNNNGQQGTEEGTNDM

SEQ ID NO: 167273 - protein, 35 aa, Artificial Sequence
  Description of Artificial Sequence: Synthetic polypeptide
DEDEIRTTNPCAYEQWGSVYCGENGLQDGHGVDNE

SEQ ID NO: 167274 - protein, 36 aa, Artificial Sequence
  Description of Artificial Sequence: Synthetic polypeptide
DEHEIRTTNPVATEQYGSVESTPLYWAEEIVDEPQI

SEQ ID NO: 167275 - protein, 36 aa, Artificial Sequence
  Description of Artificial Sequence: Synthetic polypeptide
DEEEIRTTNPVATEQYGSVIGINMGEEEPEGEVPEI

SEQ ID NO: 167276 - protein, 33 aa, Artificial Sequence
  Description of Artificial Sequence: Synthetic polypeptide
DEEEIATTNPVATEQYGEVCPATDGCVEFEEEK

SEQ ID NO: 167277 - protein, 34 aa, Artificial Sequence
  Description of Artificial Sequence: Synthetic polypeptide
CEEEIRTTNPVATEQYGAVNTDTDDSNEFEADDG

SEQ ID NO: 167278 - protein, 33 aa, Artificial Sequence
  Description of Artificial Sequence: Synthetic polypeptide
TGEEIATTNPVAYEQWGWVSGGNGNSQGEGDTR

SEQ ID NO: 167279 - protein, 32 aa, Artificial Sequence
  Description of Artificial Sequence: Synthetic polypeptide
AETEIATTNPIATECYGATWANEEDLAERGPR

SEQ ID NO: 167280 - protein, 35 aa, Artificial Sequence
  Description of Artificial Sequence: Synthetic polypeptide
DEEEIRTTNPVATEQYGCVCSMWEDHQENFSSDQS

SEQ ID NO: 167281 - protein, 34 aa, Artificial Sequence
  Description of Artificial Sequence: Synthetic polypeptide
DESEISTTNPEATECWGSVSCINEPRDREGENGS

SEQ ID NO: 167282 - protein, 33 aa, Artificial Sequence
  Description of Artificial Sequence: Synthetic polypeptide
DESEISTTNPVATAHWGSVCTWEDQQRDTHNNA

SEQ ID NO: 167283 - protein, 34 aa, Artificial Sequence
  Description of Artificial Sequence: Synthetic polypeptide
DEMEISTTNPVATEQYGCVCSWGELNAHFNSDQA

SEQ ID NO: 167284 - protein, 37 aa, Artificial Sequence
  Description of Artificial Sequence: Synthetic polypeptide
DEHEIRTTNPVATEQYGSVESTPLSWAEEIDGDEPQI

SEQ ID NO: 167285 - protein, 39 aa, Artificial Sequence
  Description of Artificial Sequence: Synthetic polypeptide
DEEEIRTTNPVATEQYGTVTNLQSGTISTTLQNQEQGNN

SEQ ID NO: 167286 - protein, 31 aa, Artificial Sequence
  Description of Artificial Sequence: Synthetic polypeptide
DDSEVASTNPVSTEGYGCVAVNTIQNRIGQR

SEQ ID NO: 167287 - protein, 38 aa, Artificial Sequence
  Description of Artificial Sequence: Synthetic polypeptide
DEEEIRTTNPVATEQYGSVSTVVTTNNNNEQGEEQSTE

SEQ ID NO: 167288 - protein, 35 aa, Artificial Sequence
  Description of Artificial Sequence: Synthetic polypeptide
CEEEIRTTNPVATEFYGATVMGGNGEGQNEGGNEE

SEQ ID NO: 167289 - protein, 35 aa, Artificial Sequence
  Description of Artificial Sequence: Synthetic polypeptide
DEDEIRTTNPCAYEQWGSVYCGENGLQDGHGSSNH

SEQ ID NO: 167290 - protein, 36 aa, Artificial Sequence
  Description of Artificial Sequence: Synthetic polypeptide
DEHEIRTTNPVATEQYGSVEVTPLNWAEEIGDEPQQ

SEQ ID NO: 167291 - protein, 34 aa, Artificial Sequence
  Description of Artificial Sequence: Synthetic polypeptide
DEDEIRTTNPCAYEEWGSVAMTLNDHSGGRGNAS

SEQ ID NO: 167292 - protein, 32 aa, Artificial Sequence
  Description of Artificial Sequence: Synthetic polypeptide
TNEEIATTNPVAYEGWGTVYTNDQGEHGNDSM

SEQ ID NO: 167293 - protein, 36 aa, Artificial Sequence
  Description of Artificial Sequence: Synthetic polypeptide
DEHEIRTTNPVATEQYGSVIVFPPMHENLDMGSIVE

SEQ ID NO: 167294 - protein, 33 aa, Artificial Sequence
  Description of Artificial Sequence: Synthetic polypeptide
AETEIATTNPVATEQWGATAANAEDWQERGPYR

SEQ ID NO: 167295 - protein, 37 aa, Artificial Sequence
  Description of Artificial Sequence: Synthetic polypeptide
DEEEIATTNPVATEQWGSVAAASNGNAEDQTAGMPRA

SEQ ID NO: 167296 - protein, 35 aa, Artificial Sequence
  Description of Artificial Sequence: Synthetic polypeptide
DEEEIATTNPVATEQWGSTTAGNGLPAEAENNERF

SEQ ID NO: 167297 - protein, 37 aa, Artificial Sequence
  Description of Artificial Sequence: Synthetic polypeptide
DEEEIATTNPVAYEQYGSTVCQAANDLQAAGEHANDS

SEQ ID NO: 167298 - protein, 34 aa, Artificial Sequence
  Description of Artificial Sequence: Synthetic polypeptide
TNEDEIATTNPVAYEQWGSVSGDNAGEHNRGDNM

SEQ ID NO: 167299 - protein, 35 aa, Artificial Sequence
  Description of Artificial Sequence: Synthetic polypeptide
DEAEIRTTNPVATEQYGSVSVWHNSVEVTAPESQD

SEQ ID NO: 167300 - protein, 36 aa, Artificial Sequence
  Description of Artificial Sequence: Synthetic polypeptide
DEPEIRTTNPVATEQYGSYSPAPELEIEPGNVNTVI

SEQ ID NO: 167301 - protein, 37 aa, Artificial Sequence
  Description of Artificial Sequence: Synthetic polypeptide
DEEEIATTNPVAYEQYGSVAAITNPEEAPGNQTEGNP

SEQ ID NO: 167302 - protein, 34 aa, Artificial Sequence
  Description of Artificial Sequence: Synthetic polypeptide
DEDEIRTTNPCAYEQWGSVCGDNNNDQRGQTGDD

SEQ ID NO: 167303 - protein, 35 aa, Artificial Sequence
  Description of Artificial Sequence: Synthetic polypeptide
DEPEIRTTNPVATEQYGSVSVIPPKLPVTAVDVEN

SEQ ID NO: 167304 - protein, 33 aa, Artificial Sequence
  Description of Artificial Sequence: Synthetic polypeptide
DEDEIATTNPVAYEQWGVTPTGNMQGNHGEGNH

SEQ ID NO: 167305 - protein, 35 aa, Artificial Sequence
  Description of Artificial Sequence: Synthetic polypeptide
DEEEIATTNPVAYEQYGSVAANNLGQLHQDDQAEE

SEQ ID NO: 167306 - protein, 34 aa, Artificial Sequence
  Description of Artificial Sequence: Synthetic polypeptide
CEEEIRTTNPVATEFYGQVNDIMNGEGQDDGEGG

SEQ ID NO: 167307 - protein, 33 aa, Artificial Sequence
  Description of Artificial Sequence: Synthetic polypeptide
DEDEIRTTNPCAYEQWGSVCYNIEESQDGQMDS

SEQ ID NO: 167308 - protein, 35 aa, Artificial Sequence
  Description of Artificial Sequence: Synthetic polypeptide
DEPEIRTTNPVATEQYGSVVSVIPPKLPPTVDVED

SEQ ID NO: 167309 - protein, 36 aa, Artificial Sequence
  Description of Artificial Sequence: Synthetic polypeptide
DEPEIRTTNPVATEQYGSVTPTNGDETTQSVQDMAQ

SEQ ID NO: 167310 - protein, 35 aa, Artificial Sequence
  Description of Artificial Sequence: Synthetic polypeptide
DEPEIRTTNPVATEQYGSVTPMNGDETTQSIQDAQ

SEQ ID NO: 167311 - protein, 35 aa, Artificial Sequence
  Description of Artificial Sequence: Synthetic polypeptide
DEMEISTTNPVATEQYGCVCSNWGEPNEFEGSNDS

SEQ ID NO: 167312 - protein, 37 aa, Artificial Sequence
  Description of Artificial Sequence: Synthetic polypeptide
DEAEIRTTNPVATEQYGSVSWPENWNEEIPNGYQNDN

SEQ ID NO: 167313 - protein, 34 aa, Artificial Sequence
  Description of Artificial Sequence: Synthetic polypeptide
DEEEIATTNPVATEQWGSICAMNNNDDQGENNDD

SEQ ID NO: 167314 - protein, 34 aa, Artificial Sequence
  Description of Artificial Sequence: Synthetic polypeptide
DEMEISTTNPVATEQYGCVCSNWGEPNEFFGDQA

SEQ ID NO: 167315 - protein, 36 aa, Artificial Sequence
  Description of Artificial Sequence: Synthetic polypeptide
DEEEIRTTNPVATEQYGSVIGPANLLNMDPHEIEDT

SEQ ID NO: 167316 - protein, 33 aa, Artificial Sequence
  Description of Artificial Sequence: Synthetic polypeptide
DEQEIATTNPVATEQYGSCSAGPPEEHGDQDAP

SEQ ID NO: 167317 - protein, 36 aa, Artificial Sequence
  Description of Artificial Sequence: Synthetic polypeptide
DEDEIRTTNPCAYEQWGSVCSTNDWNQGDTGQNNES

SEQ ID NO: 167318 - protein, 31 aa, Artificial Sequence
  Description of Artificial Sequence: Synthetic polypeptide
QEEEIATTNPVATEQYGEAPTEVCPNHEMEK

SEQ ID NO: 167319 - protein, 34 aa, Artificial Sequence
  Description of Artificial Sequence: Synthetic polypeptide
DEAEIATTNPVATEQYGSVCANNNEEAPDNQENH

SEQ ID NO: 167320 - protein, 37 aa, Artificial Sequence
  Description of Artificial Sequence: Synthetic polypeptide
DEEEIRTTNPVATEQYGSVIGPTNMLDGEPVLEIEDQ

SEQ ID NO: 167321 - protein, 34 aa, Artificial Sequence
  Description of Artificial Sequence: Synthetic polypeptide
DEMEIRTTNPVSTEQYGTICSAMDDIQEQQNGNH

SEQ ID NO: 167322 - protein, 34 aa, Artificial Sequence
  Description of Artificial Sequence: Synthetic polypeptide
DEAEIATTNPVAYEQWGSVAHTDDMGGDRNGGMR

SEQ ID NO: 167323 - protein, 35 aa, Artificial Sequence
  Description of Artificial Sequence: Synthetic polypeptide
DEDEIRSTNPVGTEQYGSVVTGDNTEQGEEGQEEE

SEQ ID NO: 167324 - protein, 35 aa, Artificial Sequence
  Description of Artificial Sequence: Synthetic polypeptide
DEEEIATTNPVAYEQYGSACAAMNPLQNSMNPENN

SEQ ID NO: 167325 - protein, 36 aa, Artificial Sequence
  Description of Artificial Sequence: Synthetic polypeptide
DEDEIRSTNPVGTEQYGSVVTGDNTGLQGENGQEEE

SEQ ID NO: 167326 - protein, 34 aa, Artificial Sequence
  Description of Artificial Sequence: Synthetic polypeptide
DEDEIRTTNCVATEAWGSVSAINEGGDGEGENEG

SEQ ID NO: 167327 - protein, 40 aa, Artificial Sequence
  Description of Artificial Sequence: Synthetic polypeptide
DEEEIRTTNPVATEQYGSVSTVNGQQLQQGTEQYGTTVET

SEQ ID NO: 167328 - protein, 36 aa, Artificial Sequence
  Description of Artificial Sequence: Synthetic polypeptide
DEEEIATTNPVATEQWGSVSGEGMNPGQAAGPPDEM

SEQ ID NO: 167329 - protein, 34 aa, Artificial Sequence
  Description of Artificial Sequence: Synthetic polypeptide
DEDEIRTTNCVATEGWGSVSAINEGGDGEGENGI

SEQ ID NO: 167330 - protein, 34 aa, Artificial Sequence
  Description of Artificial Sequence: Synthetic polypeptide
DEEEIATTNPVAYEQYGSACAANNNNQTAGEGTD

SEQ ID NO: 167331 - protein, 35 aa, Artificial Sequence
  Description of Artificial Sequence: Synthetic polypeptide
DDAEIRTTNPVATEQYGSVISTTTIMDSDEDFEND

SEQ ID NO: 167332 - protein, 35 aa, Artificial Sequence
  Description of Artificial Sequence: Synthetic polypeptide
DEEEIATTNPVAYEQYGSACAAVATGVNTMGGDTA

SEQ ID NO: 167333 - protein, 35 aa, Artificial Sequence
  Description of Artificial Sequence: Synthetic polypeptide
CETEIACTNPVATEQYGSVCSTNPQQEHQDGTAMK

SEQ ID NO: 167334 - protein, 37 aa, Artificial Sequence
  Description of Artificial Sequence: Synthetic polypeptide
DEEEIRTTNPVATEQYGSVIGPTNNLDGMEVLEMEDQ

SEQ ID NO: 167335 - protein, 34 aa, Artificial Sequence
  Description of Artificial Sequence: Synthetic polypeptide
DEDEIATTNPVAYEQYGSTAATAHGQAAPGGNNQ

SEQ ID NO: 167336 - protein, 40 aa, Artificial Sequence
  Description of Artificial Sequence: Synthetic polypeptide
DEEEIRTTNPVATEQYGSVSTVNGNQLQQGTEQYGTVVEE

SEQ ID NO: 167337 - protein, 35 aa, Artificial Sequence
  Description of Artificial Sequence: Synthetic polypeptide
DEEEIATTNPVAYEQYGSACATNPELQEHQDDTAG

SEQ ID NO: 167338 - protein, 34 aa, Artificial Sequence
  Description of Artificial Sequence: Synthetic polypeptide
TSEEIATTNPVAWEQYGSVSCTGQAPVRTVANNE

SEQ ID NO: 167339 - protein, 33 aa, Artificial Sequence
  Description of Artificial Sequence: Synthetic polypeptide
DESEIRTTNPVGTECWGVMSCINEPQDREGEDG

SEQ ID NO: 167340 - protein, 36 aa, Artificial Sequence
  Description of Artificial Sequence: Synthetic polypeptide
DEEEIATTNPVAYEQYGSACSAANDLAEAEIGNDNA

SEQ ID NO: 167341 - protein, 38 aa, Artificial Sequence
  Description of Artificial Sequence: Synthetic polypeptide
DEEEIRTTNPVATEQYGSVSTVVNNNNEQGTTTDEDEE

SEQ ID NO: 167342 - protein, 35 aa, Artificial Sequence
  Description of Artificial Sequence: Synthetic polypeptide
DEEEIATTNPVATEQWGSVSGEGGPLNHGEEMSAE

SEQ ID NO: 167343 - protein, 40 aa, Artificial Sequence
  Description of Artificial Sequence: Synthetic polypeptide
DEEEIRTTNPVATEQYGSVSTVNGNQLQEGTEQYGTVVTT

SEQ ID NO: 167344 - protein, 38 aa, Artificial Sequence
  Description of Artificial Sequence: Synthetic polypeptide
DEEEIRTTNPVATEQYGSVSTVVNNNNNDEQGTTEEQE

SEQ ID NO: 167345 - protein, 37 aa, Artificial Sequence
  Description of Artificial Sequence: Synthetic polypeptide
AETEICTTNPVATEAYGSVSTNSTEQLGNLQTGNEDM

SEQ ID NO: 167346 - protein, 37 aa, Artificial Sequence
  Description of Artificial Sequence: Synthetic polypeptide
DEEEIRTTNPVATEQYGSVIGPTNNLDGIPVLEEEDQ

SEQ ID NO: 167347 - protein, 40 aa, Artificial Sequence
  Description of Artificial Sequence: Synthetic polypeptide
DEEEIRTTNPVATEQYGSVSTVNGNTLQAGTEQYGTTQGD

SEQ ID NO: 167348 - protein, 35 aa, Artificial Sequence
  Description of Artificial Sequence: Synthetic polypeptide
DEDEIATTNPVAYEQYGSCAAATNLQAAPDGSWHW

SEQ ID NO: 167349 - protein, 33 aa, Artificial Sequence
  Description of Artificial Sequence: Synthetic polypeptide
DEMEIRTTNPVSTEPYGVTISMEDIQQQQNGNH

SEQ ID NO: 167350 - protein, 37 aa, Artificial Sequence
  Description of Artificial Sequence: Synthetic polypeptide
DEAEIRTTNPVATEQYGSVSVTAPNQCDTGYSEEVES

SEQ ID NO: 167351 - protein, 36 aa, Artificial Sequence
  Description of Artificial Sequence: Synthetic polypeptide
DDAEIRTTNPVATEQYGCVSITLLATQFNGLQDQEE

SEQ ID NO: 167352 - protein, 34 aa, Artificial Sequence
  Description of Artificial Sequence: Synthetic polypeptide
DEDEIRGTNPVATEGWGSVSAINEGGDGEGENEG

SEQ ID NO: 167353 - protein, 40 aa, Artificial Sequence
  Description of Artificial Sequence: Synthetic polypeptide
DEEEIRTTNPVATEQYGSVSTVNLNALQEGTEQYGTTVED

SEQ ID NO: 167354 - protein, 37 aa, Artificial Sequence
  Description of Artificial Sequence: Synthetic polypeptide
DEEEIRTTNPVATEQYGSVIGPTNNLDGMPHLEIEAQ

SEQ ID NO: 167355 - protein, 35 aa, Artificial Sequence
  Description of Artificial Sequence: Synthetic polypeptide
DEDEIRGTNPVATEGWGVSVSAINGEGQDGEGENG

SEQ ID NO: 167356 - protein, 33 aa, Artificial Sequence
  Description of Artificial Sequence: Synthetic polypeptide
DESEIRTTNPVAYMQWGVVPTWEHDQHQGNQDH

SEQ ID NO: 167357 - protein, 35 aa, Artificial Sequence
  Description of Artificial Sequence: Synthetic polypeptide
DDAEIRTTNPVATEQYGQCVCSTEDHNQSFGSDQS

SEQ ID NO: 167358 - protein, 35 aa, Artificial Sequence
  Description of Artificial Sequence: Synthetic polypeptide
DEEEIATTNPVATEQWGSVSGEGPPPDNAGPEGHT

SEQ ID NO: 167359 - protein, 35 aa, Artificial Sequence
  Description of Artificial Sequence: Synthetic polypeptide
DEDEIRGTNPVGTEQYGSVCTDNDGQTGEGGQEEE

SEQ ID NO: 167360 - protein, 36 aa, Artificial Sequence
  Description of Artificial Sequence: Synthetic polypeptide
DESEIRTTNPVAYQQYGCVCCWTNDDQEDRQGHNNP

SEQ ID NO: 167361 - protein, 35 aa, Artificial Sequence
  Description of Artificial Sequence: Synthetic polypeptide
DESEIRTTNPVAYQQYGCVCCWTNDQEDRQGHGTP

SEQ ID NO: 167362 - protein, 36 aa, Artificial Sequence
  Description of Artificial Sequence: Synthetic polypeptide
DESEIRTTNPVAYQQYGCVCCWTNDQEIRQGMNNQQ

SEQ ID NO: 167363 - protein, 34 aa, Artificial Sequence
  Description of Artificial Sequence: Synthetic polypeptide
DEQEIATTNPAVAMVQYGGSVSATGLEDHEGEDL

SEQ ID NO: 167364 - protein, 35 aa, Artificial Sequence
  Description of Artificial Sequence: Synthetic polypeptide
DESEIRTTNPVAYQQYGCVCCWTNDQEQKQGDNDP

SEQ ID NO: 167365 - protein, 36 aa, Artificial Sequence
  Description of Artificial Sequence: Synthetic polypeptide
DDAEIRTTNPVATEQYGQCVCSTNDHNQSFGSDTQA

SEQ ID NO: 167366 - protein, 33 aa, Artificial Sequence
  Description of Artificial Sequence: Synthetic polypeptide
DESEIRTTNPVAYQQYGCVCIWINDDERGGHDP

SEQ ID NO: 167367 - protein, 36 aa, Artificial Sequence
  Description of Artificial Sequence: Synthetic polypeptide
DEEEIRTTNPVATEQYGSVCSFPNPNIVHVESDVDI

SEQ ID NO: 167368 - protein, 33 aa, Artificial Sequence
  Description of Artificial Sequence: Synthetic polypeptide
DEEEIATTNPVAYEQYGSACAAANGDQSEQPDS

SEQ ID NO: 167369 - protein, 38 aa, Artificial Sequence
  Description of Artificial Sequence: Synthetic polypeptide
AEEEIRTTNPVATEQYGSVVTTTTNNTEQGTEGGNNTE

SEQ ID NO: 167370 - protein, 38 aa, Artificial Sequence
  Description of Artificial Sequence: Synthetic polypeptide
DEEEIRTTNPVATEQYGVVSTVVNNQAGTEAGEEEEED

SEQ ID NO: 167371 - protein, 34 aa, Artificial Sequence
  Description of Artificial Sequence: Synthetic polypeptide
DESEIRTTNPVAYQQYGCVCIWINDDQERRGHDP

SEQ ID NO: 167372 - protein, 36 aa, Artificial Sequence
  Description of Artificial Sequence: Synthetic polypeptide
DEAEIRTTNPVATEQYGSVSVTAPDTTTGQGLEVEI

SEQ ID NO: 167373 - protein, 33 aa, Artificial Sequence
  Description of Artificial Sequence: Synthetic polypeptide
DEMEIRTTNPVSTEPYGTICSMDDIQEQQNGNH

SEQ ID NO: 167374 - protein, 32 aa, Artificial Sequence
  Description of Artificial Sequence: Synthetic polypeptide
DEMEIRTTNPVSTEPYGTIMMEDIQQQQNGNH

SEQ ID NO: 167375 - protein, 35 aa, Artificial Sequence
  Description of Artificial Sequence: Synthetic polypeptide
DEDEIRGTNPVGTEQYGSVCTDNTGQAGEGGQEES

SEQ ID NO: 167376 - protein, 33 aa, Artificial Sequence
  Description of Artificial Sequence: Synthetic polypeptide
DEMEIRTTNPVSTEPYGTISAMEDIQEQQNGNH

SEQ ID NO: 167377 - protein, 34 aa, Artificial Sequence
  Description of Artificial Sequence: Synthetic polypeptide
DESEIRTTNPVAYQQYGCVCIWINDDEERGHNAS

SEQ ID NO: 167378 - protein, 35 aa, Artificial Sequence
  Description of Artificial Sequence: Synthetic polypeptide
DEEEISTTNPCATEQYGCVCPTEHNQEYFGSENQA

SEQ ID NO: 167379 - protein, 35 aa, Artificial Sequence
  Description of Artificial Sequence: Synthetic polypeptide
DESEIRTTNPVGTEGYGVVSSTTPAGPNRNGMNPV

SEQ ID NO: 167380 - protein, 39 aa, Artificial Sequence
  Description of Artificial Sequence: Synthetic polypeptide
DEEEIRTTNPVATEQYGSVSTVVNNNNTDEQGTNANTTD

SEQ ID NO: 167381 - protein, 39 aa, Artificial Sequence
  Description of Artificial Sequence: Synthetic polypeptide
DEEEIRTTNPVATEQYGSVSTVNAEQGNNTGQEGTEDTE

SEQ ID NO: 167382 - protein, 35 aa, Artificial Sequence
  Description of Artificial Sequence: Synthetic polypeptide
VEEEIRTTNPVATDQYGSVVNNMNVDINGGNEGNG

SEQ ID NO: 167383 - protein, 34 aa, Artificial Sequence
  Description of Artificial Sequence: Synthetic polypeptide
DEDEIATTNPVAYEQYGSACAATNNNQTAGGGIT

SEQ ID NO: 167384 - protein, 35 aa, Artificial Sequence
  Description of Artificial Sequence: Synthetic polypeptide
DEEEIATTNPVAYEQYGSACSANPVAEAEMGNGNE

SEQ ID NO: 167385 - protein, 37 aa, Artificial Sequence
  Description of Artificial Sequence: Synthetic polypeptide
DEQEIATTNPVATEQYGQSTVSCTALDSEDHEGGENL

SEQ ID NO: 167386 - protein, 35 aa, Artificial Sequence
  Description of Artificial Sequence: Synthetic polypeptide
VEEEIRTTNPVATDQYGVVNDNSIGQNGGQGDNEE

SEQ ID NO: 167387 - protein, 32 aa, Artificial Sequence
  Description of Artificial Sequence: Synthetic polypeptide
DESEIRTTNPVSTEGYGTIAMEDIQQQHNGNI

SEQ ID NO: 167388 - protein, 39 aa, Artificial Sequence
  Description of Artificial Sequence: Synthetic polypeptide
DEEEIRTTNPVATEQYGSVSTVNAEQGNNNQQLGTEDED

SEQ ID NO: 167389 - protein, 36 aa, Artificial Sequence
  Description of Artificial Sequence: Synthetic polypeptide
DEEEIATTNPVATEQWGSVSATTPAITNQGNGMEPV

SEQ ID NO: 167390 - protein, 34 aa, Artificial Sequence
  Description of Artificial Sequence: Synthetic polypeptide
DEQCIATTNPVAYECYGSVATENESSQTSVGGNM

SEQ ID NO: 167391 - protein, 37 aa, Artificial Sequence
  Description of Artificial Sequence: Synthetic polypeptide
DEEEIATTNPVATEQWGSVSAQATPGNQTAGNPNDNN

SEQ ID NO: 167392 - protein, 34 aa, Artificial Sequence
  Description of Artificial Sequence: Synthetic polypeptide
DEDEIRTTNPCATECYGSVTTGNTNGNAGEHGDE

SEQ ID NO: 167393 - protein, 36 aa, Artificial Sequence
  Description of Artificial Sequence: Synthetic polypeptide
DEEEIRTTNPVATEQYGCTCSMWEEHNQSIGSNNQS

SEQ ID NO: 167394 - protein, 30 aa, Artificial Sequence
  Description of Artificial Sequence: Synthetic polypeptide
TQAEIATTNPVAYEQWGCCGTWEDQGHGNN

SEQ ID NO: 167395 - protein, 31 aa, Artificial Sequence
  Description of Artificial Sequence: Synthetic polypeptide
TQAEIATTNPVAYEQWGCCGTWDQGHEGNDR

SEQ ID NO: 167396 - protein, 35 aa, Artificial Sequence
  Description of Artificial Sequence: Synthetic polypeptide
TNTEIATTNPVAYEQWGSVSHTQNGLDQGGQNGME

SEQ ID NO: 167397 - protein, 35 aa, Artificial Sequence
  Description of Artificial Sequence: Synthetic polypeptide
DESEIRTTNPVATEPYGSVFVWINGEQERKFSDDS

SEQ ID NO: 167398 - protein, 36 aa, Artificial Sequence
  Description of Artificial Sequence: Synthetic polypeptide
DEEEIATTNPVATEQWGSVSAGGPEGQNHQDDNLAE

SEQ ID NO: 167399 - protein, 38 aa, Artificial Sequence
  Description of Artificial Sequence: Synthetic polypeptide
AEEEIRTTNPVATEQYGSVSTVVQNNMEQGTNNVTEES

SEQ ID NO: 167400 - protein, 37 aa, Artificial Sequence
  Description of Artificial Sequence: Synthetic polypeptide
DEEEIRTTNPVATEQYGSVIGPTNMLSHMPVLEIEDT

SEQ ID NO: 167401 - protein, 34 aa, Artificial Sequence
  Description of Artificial Sequence: Synthetic polypeptide
TNQEIATTNPVGTEQYGSVSWNEGEKQRQRGDTP

SEQ ID NO: 167402 - protein, 38 aa, Artificial Sequence
  Description of Artificial Sequence: Synthetic polypeptide
DEEEIRTTNPVATEQYGSVCPYTNNLLPEAIIGDEYQE

SEQ ID NO: 167403 - protein, 32 aa, Artificial Sequence
  Description of Artificial Sequence: Synthetic polypeptide
TNMEEIATTNPVAYEQWGTVYTNDRGEHGNDS

SEQ ID NO: 167404 - protein, 29 aa, Artificial Sequence
  Description of Artificial Sequence: Synthetic peptide
QENEIAPTNPCSSEPYGTISCDLQQSGTR

SEQ ID NO: 167405 - protein, 32 aa, Artificial Sequence
  Description of Artificial Sequence: Synthetic polypeptide
TNETEIATTNPVAYEQWGSVSWGEDLGGDNGS

SEQ ID NO: 167406 - protein, 36 aa, Artificial Sequence
  Description of Artificial Sequence: Synthetic polypeptide
DEEEIRTTNPVATEQYGSVCPTYTVQLTAPTPPSEV

SEQ ID NO: 167407 - protein, 37 aa, Artificial Sequence
  Description of Artificial Sequence: Synthetic polypeptide
DEMEIRTTNPVATEQYGSVNSVMLEVELDRFDGSQPE

SEQ ID NO: 167408 - protein, 33 aa, Artificial Sequence
  Description of Artificial Sequence: Synthetic polypeptide
DEDEIRTTNPCATECWGEVSTGNTGTNAGEDSE

SEQ ID NO: 167409 - protein, 38 aa, Artificial Sequence
  Description of Artificial Sequence: Synthetic polypeptide
AEEEIRTTNPVATEQYGSVVTTTNNNLQQGTEGGVATD

SEQ ID NO: 167410 - protein, 37 aa, Artificial Sequence
  Description of Artificial Sequence: Synthetic polypeptide
DEEEIRTTNPVATEQYGSVIGPTNNFDHAPVLEIEDT

SEQ ID NO: 167411 - protein, 33 aa, Artificial Sequence
  Description of Artificial Sequence: Synthetic polypeptide
DEQEIAPTNPVATERYGSVGATQDLEDHEGEDL

SEQ ID NO: 167412 - protein, 32 aa, Artificial Sequence
  Description of Artificial Sequence: Synthetic polypeptide
DEQEIAPTNPCATEPYGSWSATDLEDHEGEDL

SEQ ID NO: 167413 - protein, 36 aa, Artificial Sequence
  Description of Artificial Sequence: Synthetic polypeptide
DEEEIRTTNPVATEQYGCVCSMTGEDIENFGSETQA

SEQ ID NO: 167414 - protein, 36 aa, Artificial Sequence
  Description of Artificial Sequence: Synthetic polypeptide
DEEEIRTTNPVATEQYGCVCSMTGEHDQEFFFSDQS

SEQ ID NO: 167415 - protein, 36 aa, Artificial Sequence
  Description of Artificial Sequence: Synthetic polypeptide
DEEEIRTTNPVATEQYGCVCSMTGEHEANFNSDPQS

SEQ ID NO: 167416 - protein, 35 aa, Artificial Sequence
  Description of Artificial Sequence: Synthetic polypeptide
DEAAEIATTNPVAYEQWGSVTGPNPGNQGGTNGSR

SEQ ID NO: 167417 - protein, 40 aa, Artificial Sequence
  Description of Artificial Sequence: Synthetic polypeptide
DEEEIRTTNPVATEQYGSVSTVNGNLLQEATEQYGTVVVT

SEQ ID NO: 167418 - protein, 40 aa, Artificial Sequence
  Description of Artificial Sequence: Synthetic polypeptide
DEEEIRTTNPVATEQYGSVSTVNGNELQAGTEQYGTTDED

SEQ ID NO: 167419 - protein, 40 aa, Artificial Sequence
  Description of Artificial Sequence: Synthetic polypeptide
DEEEIRTTNPVATEQYGSVSTVNGNALQAGTEQYGTTVEN

SEQ ID NO: 167420 - protein, 37 aa, Artificial Sequence
  Description of Artificial Sequence: Synthetic polypeptide
DEEEIRTTNPVATEQYGSVIGPTNNLDCMPVFEIEDT

SEQ ID NO: 167421 - protein, 36 aa, Artificial Sequence
  Description of Artificial Sequence: Synthetic polypeptide
DEDEIATTNPVAYEQYGSACSPANPLQEAEIGNDNE

SEQ ID NO: 167422 - protein, 36 aa, Artificial Sequence
  Description of Artificial Sequence: Synthetic polypeptide
DEMEIRTTNPVATEQYGSVNYEPMNVDSNGEEQNNG

SEQ ID NO: 167423 - protein, 39 aa, Artificial Sequence
  Description of Artificial Sequence: Synthetic polypeptide
DEEEIRTTNPVATEQYGSVSTVNAEQGSNENQQGTEDED

SEQ ID NO: 167424 - protein, 37 aa, Artificial Sequence
  Description of Artificial Sequence: Synthetic polypeptide
DEEEIRTTNPVATEQYGSVIGPTNNHDHMPVLEIDDT

SEQ ID NO: 167425 - protein, 35 aa, Artificial Sequence
  Description of Artificial Sequence: Synthetic polypeptide
CEEEIRTTNPVATDQYGVVNDNSIGQNGQGDNDDD

SEQ ID NO: 167426 - protein, 40 aa, Artificial Sequence
  Description of Artificial Sequence: Synthetic polypeptide
DEEEIRTTNPVATEQYGSVSTVVNTQGNGQQGTEGGTNDQ

SEQ ID NO: 167427 - protein, 36 aa, Artificial Sequence
  Description of Artificial Sequence: Synthetic polypeptide
DEEEIATTNPVAYEQYGSACSANPNLQDSPDESARE

SEQ ID NO: 167428 - protein, 34 aa, Artificial Sequence
  Description of Artificial Sequence: Synthetic polypeptide
DEQEIATTNPVATEQYGLQSATDLEDHQGLEDLF

SEQ ID NO: 167429 - protein, 33 aa, Artificial Sequence
  Description of Artificial Sequence: Synthetic polypeptide
DEAEIATTNPVAYEQWGSVAIEGNDHNMNGNEQ

SEQ ID NO: 167430 - protein, 33 aa, Artificial Sequence
  Description of Artificial Sequence: Synthetic polypeptide
DESEIRTTNPVATEQWGDVSCIIEPMDREEEDA

SEQ ID NO: 167431 - protein, 39 aa, Artificial Sequence
  Description of Artificial Sequence: Synthetic polypeptide
DEEEIRTTNPVATEQYGSVSTVNAESGNNTQQNGTEDEE

SEQ ID NO: 167432 - protein, 39 aa, Artificial Sequence
  Description of Artificial Sequence: Synthetic polypeptide
DEEEIRTTNPVATEQYGSVSTVNAEQGSNGTQEGTEDTD

SEQ ID NO: 167433 - protein, 36 aa, Artificial Sequence
  Description of Artificial Sequence: Synthetic polypeptide
DEEEIRTTNPVATEQYGCVCSMTGEHQENSISETQA

SEQ ID NO: 167434 - protein, 35 aa, Artificial Sequence
  Description of Artificial Sequence: Synthetic polypeptide
DEEEIATTNPVATEQWGSVSGAGPPGANGALMGED

SEQ ID NO: 167435 - protein, 35 aa, Artificial Sequence
  Description of Artificial Sequence: Synthetic polypeptide
DEEEIATTNPVAYEQYGSACSANPPAEAEMGNGHT

SEQ ID NO: 167436 - protein, 34 aa, Artificial Sequence
  Description of Artificial Sequence: Synthetic polypeptide
DEEEISTTNPCATEQYGCVCGSNHNQNFGSDTAS

SEQ ID NO: 167437 - protein, 40 aa, Artificial Sequence
  Description of Artificial Sequence: Synthetic polypeptide
DEEEIRTTNPVATEQYGSVSTVVNTNTNGQQGTEGGTNDE

SEQ ID NO: 167438 - protein, 34 aa, Artificial Sequence
  Description of Artificial Sequence: Synthetic polypeptide
ASEEIRTTNPVAYEQYGQSVVNIVHASSNNGGNI

SEQ ID NO: 167439 - protein, 30 aa, Artificial Sequence
  Description of Artificial Sequence: Synthetic polypeptide
DDSEVASTNPVATEGWGNVSNIIMSRVGDR

SEQ ID NO: 167440 - protein, 37 aa, Artificial Sequence
  Description of Artificial Sequence: Synthetic polypeptide
DEEEIRTTNPVATEQYGSVIGPTNVLDHMPVLEIEDQ

SEQ ID NO: 167441 - protein, 35 aa, Artificial Sequence
  Description of Artificial Sequence: Synthetic polypeptide
DEEEIRTTNPVATEAYGVVDGGETEGDEEGNGGEI

SEQ ID NO: 167442 - protein, 37 aa, Artificial Sequence
  Description of Artificial Sequence: Synthetic polypeptide
DEEEIRTTNPVAYEQYGQCVCSNTGEDLNQYFGSEQA

SEQ ID NO: 167443 - protein, 33 aa, Artificial Sequence
  Description of Artificial Sequence: Synthetic polypeptide
VEDEIATTNPVAYEQYGSVATASGTPTANNDER

SEQ ID NO: 167444 - protein, 35 aa, Artificial Sequence
  Description of Artificial Sequence: Synthetic polypeptide
CEAEIATTNPVAYEQYGSVCSTNPQQEHQDGTVMK

SEQ ID NO: 167445 - protein, 37 aa, Artificial Sequence
  Description of Artificial Sequence: Synthetic polypeptide
DEDEIATTNPVAYEQYGSVCSPAGNLGQPRSGMGAQV

SEQ ID NO: 167446 - protein, 35 aa, Artificial Sequence
  Description of Artificial Sequence: Synthetic polypeptide
DEAEIATTNPVATEVWGSVCYMNDLQQDTHGGNAM

SEQ ID NO: 167447 - protein, 34 aa, Artificial Sequence
  Description of Artificial Sequence: Synthetic polypeptide
CEAEIATTNPVATEQYGCCATNQDTQHQGDNEDA

SEQ ID NO: 167448 - protein, 37 aa, Artificial Sequence
  Description of Artificial Sequence: Synthetic polypeptide
DEEEIRTTNPVATEQYGSVIQTTPDGPNMGNGDDDDN

SEQ ID NO: 167449 - protein, 34 aa, Artificial Sequence
  Description of Artificial Sequence: Synthetic polypeptide
VEDEIATTNPVAYEQYGSVAITHGEQTANGDNQM

SEQ ID NO: 167450 - protein, 29 aa, Artificial Sequence
  Description of Artificial Sequence: Synthetic peptide
CEAEIACTNPVGTEGWGVSASGLQGGDIQ

SEQ ID NO: 167451 - protein, 33 aa, Artificial Sequence
  Description of Artificial Sequence: Synthetic polypeptide
DEQEIATTNPVATEQYGCVAANGDATPGGDPPN

SEQ ID NO: 167452 - protein, 34 aa, Artificial Sequence
  Description of Artificial Sequence: Synthetic polypeptide
VEDEIATTNPVAYEQYGSVAIANNDTQDNGNNQH

SEQ ID NO: 167453 - protein, 34 aa, Artificial Sequence
  Description of Artificial Sequence: Synthetic polypeptide
CEAEIQCTNPVAYESYGSVVQSCNEQFDRGGNNV

SEQ ID NO: 167454 - protein, 35 aa, Artificial Sequence
  Description of Artificial Sequence: Synthetic polypeptide
DEAEIATTNPVATEVWGSVCYNNDLQDQGGQNGEH

SEQ ID NO: 167455 - protein, 34 aa, Artificial Sequence
  Description of Artificial Sequence: Synthetic polypeptide
VEDEIATTNPVAYEQYGSVAIANNDTQDNGDNSM

SEQ ID NO: 167456 - protein, 32 aa, Artificial Sequence
  Description of Artificial Sequence: Synthetic polypeptide
VEDEIATTNPVAYEQYGSVAIAHDQDSGSDEF

SEQ ID NO: 167457 - protein, 33 aa, Artificial Sequence
  Description of Artificial Sequence: Synthetic polypeptide
VEDEIATTNPVAYEQYGSVAATTDTATGDNQDE

SEQ ID NO: 167458 - protein, 33 aa, Artificial Sequence
  Description of Artificial Sequence: Synthetic polypeptide
DAAEIATTNPVATEQWGSVASAPQEHADGNGNH

SEQ ID NO: 167459 - protein, 37 aa, Artificial Sequence
  Description of Artificial Sequence: Synthetic polypeptide
DEEEIRTTNPVATEQYGSVISAEFPGTQEREQPQHDD

SEQ ID NO: 167460 - protein, 37 aa, Artificial Sequence
  Description of Artificial Sequence: Synthetic polypeptide
DEEEIRTTNPVAYEQYGQCVCSNTEDLNQEYFGSEQG

SEQ ID NO: 167461 - protein, 37 aa, Artificial Sequence
  Description of Artificial Sequence: Synthetic polypeptide
DEEEIRTTNPVAYEQYGQCVCSNSGNDLNQYFNSQQA

SEQ ID NO: 167462 - protein, 30 aa, Artificial Sequence
  Description of Artificial Sequence: Synthetic polypeptide
QEHEIAPTNPCSYEQWGITSCNLQSDGDTR

SEQ ID NO: 167463 - protein, 37 aa, Artificial Sequence
  Description of Artificial Sequence: Synthetic polypeptide
DEEEIRTTNPVATEQYGSVISAIDVFEGVRINVEVQD

SEQ ID NO: 167464 - protein, 31 aa, Artificial Sequence
  Description of Artificial Sequence: Synthetic polypeptide
DDSEVASTNPVSTEFYGNVAANTIQSRVGQR

SEQ ID NO: 167465 - protein, 31 aa, Artificial Sequence
  Description of Artificial Sequence: Synthetic polypeptide
DDSEVASTNPVSTEEYGNVAANTIQSRVGQR

SEQ ID NO: 167466 - protein, 31 aa, Artificial Sequence
  Description of Artificial Sequence: Synthetic polypeptide
DDSEVASTNPVSTEEYGNVAANTHQSRVGQR

SEQ ID NO: 167467 - protein, 34 aa, Artificial Sequence
  Description of Artificial Sequence: Synthetic polypeptide
VEDEIATTNPVAYEQYGSVAIANNDTQDNGENTD

SEQ ID NO: 167468 - protein, 31 aa, Artificial Sequence
  Description of Artificial Sequence: Synthetic polypeptide
DDSEVASTNPVSTEEYGNVAANQIQSRVGQR

SEQ ID NO: 167469 - protein, 35 aa, Artificial Sequence
  Description of Artificial Sequence: Synthetic polypeptide
CEAEIRTTNPVATEAYGKTVSCQGTSDQVKGGNTS

SEQ ID NO: 167470 - protein, 37 aa, Artificial Sequence
  Description of Artificial Sequence: Synthetic polypeptide
DEEEIRTTNPVATEQYGSVIQPPATIVIQPEQQLSNL

SEQ ID NO: 167471 - protein, 35 aa, Artificial Sequence
  Description of Artificial Sequence: Synthetic polypeptide
DEQEIATTNPVATEQWGSVSATGDPLNDHQGEDLH

SEQ ID NO: 167472 - protein, 35 aa, Artificial Sequence
  Description of Artificial Sequence: Synthetic polypeptide
DEQEIATTNPVATEQWGSVSATGDPLIDHQGDEDN

SEQ ID NO: 167473 - protein, 35 aa, Artificial Sequence
  Description of Artificial Sequence: Synthetic polypeptide
DEQEIATTNPVATEQWGSVSATGDPLEADTPGEDA

SEQ ID NO: 167474 - protein, 36 aa, Artificial Sequence
  Description of Artificial Sequence: Synthetic polypeptide
DAAEIATTNPVATEQYGSVAATAHLPQDSMIGNHGN

SEQ ID NO: 167475 - protein, 36 aa, Artificial Sequence
  Description of Artificial Sequence: Synthetic polypeptide
DEEEIRTTNPVATEQYGVVDSVTIVGVSEPDIIEER

SEQ ID NO: 167476 - protein, 33 aa, Artificial Sequence
  Description of Artificial Sequence: Synthetic polypeptide
VEDEIATTNPVAYEQYGSVSANNPGNTGPPEEQ

SEQ ID NO: 167477 - protein, 34 aa, Artificial Sequence
  Description of Artificial Sequence: Synthetic polypeptide
VEDEIATTNPVAYEQYGSVSAAGNDQDDNNNNHN

SEQ ID NO: 167478 - protein, 36 aa, Artificial Sequence
  Description of Artificial Sequence: Synthetic polypeptide
DEQEIATTNPVATEQWGSVSATGDPLDEDHQGEDNN

SEQ ID NO: 167479 - protein, 36 aa, Artificial Sequence
  Description of Artificial Sequence: Synthetic polypeptide
VEDEIATTNPVAYEQYGSVCTANPELQEHQDGNQHQ

SEQ ID NO: 167480 - protein, 36 aa, Artificial Sequence
  Description of Artificial Sequence: Synthetic polypeptide
DEEEIRTVNPVATEQYGCVCSTWEEHNQEYFNSQQA

SEQ ID NO: 167481 - protein, 37 aa, Artificial Sequence
  Description of Artificial Sequence: Synthetic polypeptide
DEMEIRTTNPVATEQYGSVSPFPNNLTEEEIKQESIF

SEQ ID NO: 167482 - protein, 37 aa, Artificial Sequence
  Description of Artificial Sequence: Synthetic polypeptide
DEEEIRTTNPVATEQYGSVIPVSVIVHPNTPQNNETN

SEQ ID NO: 167483 - protein, 35 aa, Artificial Sequence
  Description of Artificial Sequence: Synthetic polypeptide
DEAEIATTNPVATESYGSVAMNNDTNPDNQTENNN

SEQ ID NO: 167484 - protein, 32 aa, Artificial Sequence
  Description of Artificial Sequence: Synthetic polypeptide
DCNEIRTTNPVSTEPYGTISMDDIQQQQNGNH

SEQ ID NO: 167485 - protein, 36 aa, Artificial Sequence
  Description of Artificial Sequence: Synthetic polypeptide
DEEEIRTTNPVATEQYGVVDNFTQNNGEEDGQGQIT

SEQ ID NO: 167486 - protein, 35 aa, Artificial Sequence
  Description of Artificial Sequence: Synthetic polypeptide
DEDEIATTNPVAYEQYGSVCSAPALPQAHMDLNAM

SEQ ID NO: 167487 - protein, 36 aa, Artificial Sequence
  Description of Artificial Sequence: Synthetic polypeptide
DEEEIRTTNPVATEQYGSVIQPFNIVIQPEQQLSEL

SEQ ID NO: 167488 - protein, 35 aa, Artificial Sequence
  Description of Artificial Sequence: Synthetic polypeptide
VEDEIATTNPVAYEQYGSVCATNPMQQGNQTEGAD

SEQ ID NO: 167489 - protein, 32 aa, Artificial Sequence
  Description of Artificial Sequence: Synthetic polypeptide
DCNEIRTTNPVSTEPYGTISMEDIQQQQNGNH

SEQ ID NO: 167490 - protein, 37 aa, Artificial Sequence
  Description of Artificial Sequence: Synthetic polypeptide
DEEEIRTTNPVATEQYGVVDNFTNNDTGQEDGQGQET

SEQ ID NO: 167491 - protein, 36 aa, Artificial Sequence
  Description of Artificial Sequence: Synthetic polypeptide
DEEEIRTTNPVATEQYGVVDIMTQGTGQEDGQGQEV

SEQ ID NO: 167492 - protein, 33 aa, Artificial Sequence
  Description of Artificial Sequence: Synthetic polypeptide
DEQEIATTNPVATEQYGCVAANGDATMPPGDPG

SEQ ID NO: 167493 - protein, 39 aa, Artificial Sequence
  Description of Artificial Sequence: Synthetic polypeptide
DEEEIRTTNPVATEQYGVVSNTVNNNLQQGTEQGTTVTE

SEQ ID NO: 167494 - protein, 36 aa, Artificial Sequence
  Description of Artificial Sequence: Synthetic polypeptide
DEEEIRTTNPVAYEQYGQCVCSNTGNHISFNSETQS

SEQ ID NO: 167495 - protein, 38 aa, Artificial Sequence
  Description of Artificial Sequence: Synthetic polypeptide
DEEEIRTTNPVATEQYGVVSTVVNNNNQQGDEEETETE

SEQ ID NO: 167496 - protein, 38 aa, Artificial Sequence
  Description of Artificial Sequence: Synthetic polypeptide
DEEEIRTTNPVATEQYGVVSTVVNNNNQQGEEEEEEEQ

SEQ ID NO: 167497 - protein, 37 aa, Artificial Sequence
  Description of Artificial Sequence: Synthetic polypeptide
DEMEIRTTNPVATEQYGSVSPFMNNLTEEEIDQESRF

SEQ ID NO: 167498 - protein, 36 aa, Artificial Sequence
  Description of Artificial Sequence: Synthetic polypeptide
DEEEIRTTNPVATEQYGSVIPTTTMEGMEMEGQFLQ

SEQ ID NO: 167499 - protein, 31 aa, Artificial Sequence
  Description of Artificial Sequence: Synthetic polypeptide
DDSEVASTNPVSTECYGSVSNTEQDREGEQG

SEQ ID NO: 167500 - protein, 31 aa, Artificial Sequence
  Description of Artificial Sequence: Synthetic polypeptide
DCSEVASTNPVSTEGYGNVAANTIQSRVGQR

SEQ ID NO: 167501 - protein, 35 aa, Artificial Sequence
  Description of Artificial Sequence: Synthetic polypeptide
VEDEIATTNPVAYEQYGQSTATNNDLTQDGMGDRH

SEQ ID NO: 167502 - protein, 34 aa, Artificial Sequence
  Description of Artificial Sequence: Synthetic polypeptide
DEQEIATTNPVATEQWGSVSATGDMPGDHQGEDN

SEQ ID NO: 167503 - protein, 32 aa, Artificial Sequence
  Description of Artificial Sequence: Synthetic polypeptide
VEDEIATTNPVAYEQWGSVAATNDTATDDNQD

SEQ ID NO: 167504 - protein, 34 aa, Artificial Sequence
  Description of Artificial Sequence: Synthetic polypeptide
DEAEIATTNPVAYEAWGSVSGGNADDSRNGGGNA

SEQ ID NO: 167505 - protein, 36 aa, Artificial Sequence
  Description of Artificial Sequence: Synthetic polypeptide
DEDEIATTNPVAYEQYGSVCSPTNNLGQTHADITEA

SEQ ID NO: 167506 - protein, 31 aa, Artificial Sequence
  Description of Artificial Sequence: Synthetic polypeptide
DDSEVASTNPVSTAGYGNVATNTIQSRVGQR

SEQ ID NO: 167507 - protein, 37 aa, Artificial Sequence
  Description of Artificial Sequence: Synthetic polypeptide
DEEEIRTTNPVATEQYGSVISESNGHEVPRVIMDQVN

SEQ ID NO: 167508 - protein, 33 aa, Artificial Sequence
  Description of Artificial Sequence: Synthetic polypeptide
DEAEIATTNPVAYEAWGVVTGGNGNQGEGNADR

SEQ ID NO: 167509 - protein, 34 aa, Artificial Sequence
  Description of Artificial Sequence: Synthetic polypeptide
DEQEIATTNPVATEQWGSVSATGDMPEDHGGEDQ

SEQ ID NO: 167510 - protein, 29 aa, Artificial Sequence
  Description of Artificial Sequence: Synthetic peptide
QEHEIASTNPVGTEGYGVMASTTEHVGAI

SEQ ID NO: 167511 - protein, 31 aa, Artificial Sequence
  Description of Artificial Sequence: Synthetic polypeptide
DDSEVASTNPVSSEGYGSVAANTIQSRVGQR

SEQ ID NO: 167512 - protein, 34 aa, Artificial Sequence
  Description of Artificial Sequence: Synthetic polypeptide
DEDEIATTNPVAYEQYGSVCSVDGPGNHGDNEAM

SEQ ID NO: 167513 - protein, 35 aa, Artificial Sequence
  Description of Artificial Sequence: Synthetic polypeptide
DEAEIATTNPVATEYYGSTVSCTLPSEDHEGGENF

SEQ ID NO: 167514 - protein, 35 aa, Artificial Sequence
  Description of Artificial Sequence: Synthetic polypeptide
DEQEIATTNPVATEQWGSVSATGDMGEDHQWGEDN

SEQ ID NO: 167515 - protein, 35 aa, Artificial Sequence
  Description of Artificial Sequence: Synthetic polypeptide
VEDEIATTNPVATEQYGSVCATNPEQQANQTEGTM

SEQ ID NO: 167516 - protein, 33 aa, Artificial Sequence
  Description of Artificial Sequence: Synthetic polypeptide
DEAEIATTNPVAYECWGCVCPTDNQDQQHGDNP

SEQ ID NO: 167517 - protein, 36 aa, Artificial Sequence
  Description of Artificial Sequence: Synthetic polypeptide
DEEEIATTNPVATEQYGCVVATNQLDEATPDDNEHW

SEQ ID NO: 167518 - protein, 30 aa, Artificial Sequence
  Description of Artificial Sequence: Synthetic polypeptide
DDSEVASTNPVSSEGYGIVAACNIQSRGQR

SEQ ID NO: 167519 - protein, 36 aa, Artificial Sequence
  Description of Artificial Sequence: Synthetic polypeptide
DEEEIRTTNPVATEQYGSVIGPVNNELNMPHEIEQT

SEQ ID NO: 167520 - protein, 35 aa, Artificial Sequence
  Description of Artificial Sequence: Synthetic polypeptide
DEAEIATTNPVAYECWGSVASNDNLGEERGGEGSR

SEQ ID NO: 167521 - protein, 35 aa, Artificial Sequence
  Description of Artificial Sequence: Synthetic polypeptide
DEAEIATTNPVAYECWGSVASNDNLGNERNGENSD

SEQ ID NO: 167522 - protein, 36 aa, Artificial Sequence
  Description of Artificial Sequence: Synthetic polypeptide
DEAEIATTNPVAYECWGSVATGNGPLQDDRGQNGTN

SEQ ID NO: 167523 - protein, 36 aa, Artificial Sequence
  Description of Artificial Sequence: Synthetic polypeptide
DEDEIATTNPVAYEQYGSVCSVDNLPQDSMDGAEAW

SEQ ID NO: 167524 - protein, 36 aa, Artificial Sequence
  Description of Artificial Sequence: Synthetic polypeptide
DEDEIATTNPVAYEQYGSVCSVGNDGQDSMNGNMAD

SEQ ID NO: 167525 - protein, 34 aa, Artificial Sequence
  Description of Artificial Sequence: Synthetic polypeptide
DEAEIATTNPVAYECWGSVATGNMLGDAQGMNKE

SEQ ID NO: 167526 - protein, 33 aa, Artificial Sequence
  Description of Artificial Sequence: Synthetic polypeptide
DEAEIATTNPVAYECWGSVAWTDDQDDRNGGDH

SEQ ID NO: 167527 - protein, 31 aa, Artificial Sequence
  Description of Artificial Sequence: Synthetic polypeptide
QEHEIASTNPVGTEGYGVMASTVLESHGDNI

SEQ ID NO: 167528 - protein, 32 aa, Artificial Sequence
  Description of Artificial Sequence: Synthetic polypeptide
DDSEVASTNPVSTECYGNVSANITEQSRVGQR

SEQ ID NO: 167529 - protein, 30 aa, Artificial Sequence
  Description of Artificial Sequence: Synthetic polypeptide
QEHEIASTNPVGTEGYGVCMASTLEQHGDI

SEQ ID NO: 167530 - protein, 33 aa, Artificial Sequence
  Description of Artificial Sequence: Synthetic polypeptide
VEDEIATTNPVAYEQYGSTAGTNLTGTPDGSEN

SEQ ID NO: 167531 - protein, 31 aa, Artificial Sequence
  Description of Artificial Sequence: Synthetic polypeptide
CEDEIACTNPVATEQWGCVAGTNLAMPMEME

SEQ ID NO: 167532 - protein, 31 aa, Artificial Sequence
  Description of Artificial Sequence: Synthetic polypeptide
DDSEVASTNPVSTECYGNVAANTIQVRVGQR

SEQ ID NO: 167533 - protein, 31 aa, Artificial Sequence
  Description of Artificial Sequence: Synthetic polypeptide
DDSEVASTNPVSTECYGNVAANTIQSRVGQR

SEQ ID NO: 167534 - protein, 33 aa, Artificial Sequence
  Description of Artificial Sequence: Synthetic polypeptide
CEDEIACTNPVATEQWGCVAGTNLQMQGDEKAM

SEQ ID NO: 167535 - protein, 31 aa, Artificial Sequence
  Description of Artificial Sequence: Synthetic polypeptide
DDSEVASTNPVSTECYGNVAANTIQSREGQR

SEQ ID NO: 167536 - protein, 34 aa, Artificial Sequence
  Description of Artificial Sequence: Synthetic polypeptide
VEDEIATTNPVAYEQYGSVAATNDTATGGGNMDA

SEQ ID NO: 167537 - protein, 33 aa, Artificial Sequence
  Description of Artificial Sequence: Synthetic polypeptide
VEDEIATTNPVAYEQYGSVAATNDTATGGEIDN

SEQ ID NO: 167538 - protein, 35 aa, Artificial Sequence
  Description of Artificial Sequence: Synthetic polypeptide
DEEEIRTTNPVATEQYGSVIGPWVATVGIGMEEQQ

SEQ ID NO: 167539 - protein, 33 aa, Artificial Sequence
  Description of Artificial Sequence: Synthetic polypeptide
VEDEIATTNPVAYEQYGSVAATNDTATGDSQDN

SEQ ID NO: 167540 - protein, 36 aa, Artificial Sequence
  Description of Artificial Sequence: Synthetic polypeptide
VEEEIATTNPVATEQWGSVSMNGDTPTNNDDGMGNQ

SEQ ID NO: 167541 - protein, 36 aa, Artificial Sequence
  Description of Artificial Sequence: Synthetic polypeptide
VEEEIATTNPVATEQWGSVSMSGDTPTNNDDGGNFV

SEQ ID NO: 167542 - protein, 34 aa, Artificial Sequence
  Description of Artificial Sequence: Synthetic polypeptide
VEDEIATTNPVAYEQYGSVAATNDTATGDDNQDD

SEQ ID NO: 167543 - protein, 31 aa, Artificial Sequence
  Description of Artificial Sequence: Synthetic polypeptide
DDSEVASTNPVSTDGYGNVAANTLQSRVGQR

SEQ ID NO: 167544 - protein, 33 aa, Artificial Sequence
  Description of Artificial Sequence: Synthetic polypeptide
DAAEIATTNPVATAQWGSVSGTGNPDNANPGEH

SEQ ID NO: 167545 - protein, 34 aa, Artificial Sequence
  Description of Artificial Sequence: Synthetic polypeptide
VEDEIATTNPVAYEQYGSVAATANGTAAPGINNQ

SEQ ID NO: 167546 - protein, 31 aa, Artificial Sequence
  Description of Artificial Sequence: Synthetic polypeptide
DDSEVASTNPVSTEAYGNVAANTPQSRVGQR

SEQ ID NO: 167547 - protein, 31 aa, Artificial Sequence
  Description of Artificial Sequence: Synthetic polypeptide
DCSEVASTNPVSTEGYGNVAANTIQTRVGQR

SEQ ID NO: 167548 - protein, 34 aa, Artificial Sequence
  Description of Artificial Sequence: Synthetic polypeptide
DEAEIATTNPVATEWWGSVYITDNHEQQHGGDSA

SEQ ID NO: 167549 - protein, 31 aa, Artificial Sequence
  Description of Artificial Sequence: Synthetic polypeptide
DDSEVASTNPVSTEAYGNVAANTIQSRVGQR

SEQ ID NO: 167550 - protein, 31 aa, Artificial Sequence
  Description of Artificial Sequence: Synthetic polypeptide
DDSEVASTNPVSTEAYGNVAANTIQSRPGQR

SEQ ID NO: 167551 - protein, 31 aa, Artificial Sequence
  Description of Artificial Sequence: Synthetic polypeptide
DDSEVASTNPVSTEAYGNVAANTGQSRVGQR

SEQ ID NO: 167552 - protein, 31 aa, Artificial Sequence
  Description of Artificial Sequence: Synthetic polypeptide
DDSEVASTNPVSTEAYGKVACNTIQSRVGQR

SEQ ID NO: 167553 - protein, 33 aa, Artificial Sequence
  Description of Artificial Sequence: Synthetic polypeptide
VEDEIATTNPVAYEQYGSVAAAGNDQDDNNNNN

SEQ ID NO: 167554 - protein, 29 aa, Artificial Sequence
  Description of Artificial Sequence: Synthetic peptide
QEHEIASTNPVGTEGYGCMASYTLEHGDI

SEQ ID NO: 167555 - protein, 34 aa, Artificial Sequence
  Description of Artificial Sequence: Synthetic polypeptide
DEAEIATTNPVATEYWGCVSGGNADDSRGGNGNS

SEQ ID NO: 167556 - protein, 34 aa, Artificial Sequence
  Description of Artificial Sequence: Synthetic polypeptide
VEDEIATTNPVAYEQYGSTVAGANDQAQGPNESQ

SEQ ID NO: 167557 - protein, 33 aa, Artificial Sequence
  Description of Artificial Sequence: Synthetic polypeptide
QEEEIATTNPVATEQYGETAPCEVPSQHEGENK

SEQ ID NO: 167558 - protein, 36 aa, Artificial Sequence
  Description of Artificial Sequence: Synthetic polypeptide
DEEEIRTTNPVATEQYGCVCENSGELNIENFGSDQS

SEQ ID NO: 167559 - protein, 34 aa, Artificial Sequence
  Description of Artificial Sequence: Synthetic polypeptide
DEDEIATTNPVAYEQYGSVCSANPALEHMDLTAM

SEQ ID NO: 167560 - protein, 36 aa, Artificial Sequence
  Description of Artificial Sequence: Synthetic polypeptide
DEEEIRTTNPVATEQYGVVDTDNTMEGDGEGQEAGE

SEQ ID NO: 167561 - protein, 32 aa, Artificial Sequence
  Description of Artificial Sequence: Synthetic polypeptide
VEEEIACTNPVATEQWGCVAGTGELIDNMMRG

SEQ ID NO: 167562 - protein, 34 aa, Artificial Sequence
  Description of Artificial Sequence: Synthetic polypeptide
DAAEIATTNPVATEQYGSVCSANPADNDANPAEM

SEQ ID NO: 167563 - protein, 37 aa, Artificial Sequence
  Description of Artificial Sequence: Synthetic polypeptide
DEEEIRTTNPVATEQYGVVMGNDENSNEQGQGGNGGT

SEQ ID NO: 167564 - protein, 36 aa, Artificial Sequence
  Description of Artificial Sequence: Synthetic polypeptide
DCMEIRTTNPVAVEQYGSVSTVNKHSSETPMGSDRG

SEQ ID NO: 167565 - protein, 31 aa, Artificial Sequence
  Description of Artificial Sequence: Synthetic polypeptide
VEEEIACTNPVATASWGCVAGTMLQHDDNAP

SEQ ID NO: 167566 - protein, 35 aa, Artificial Sequence
  Description of Artificial Sequence: Synthetic polypeptide
VEEEIACTNPVATEQYGSVAITNHDENGMPMENDA

SEQ ID NO: 167567 - protein, 38 aa, Artificial Sequence
  Description of Artificial Sequence: Synthetic polypeptide
DEEEIRTTNPVATEAYGVVSTSTNNQQQGNQQGTTNTD

SEQ ID NO: 167568 - protein, 33 aa, Artificial Sequence
  Description of Artificial Sequence: Synthetic polypeptide
VEECIATTNPVAYEQYSEEVTTTGDNHQGGGMR

SEQ ID NO: 167569 - protein, 36 aa, Artificial Sequence
  Description of Artificial Sequence: Synthetic polypeptide
DEEEIRTTNPVATEQYGVVMGNDENIEQEQGGEGGV

SEQ ID NO: 167570 - protein, 35 aa, Artificial Sequence
  Description of Artificial Sequence: Synthetic polypeptide
VEDVIRTTNPVATEQYGASVMAGINQDQTRILQLR

SEQ ID NO: 167571 - protein, 33 aa, Artificial Sequence
  Description of Artificial Sequence: Synthetic polypeptide
DEDEIATTNPVAYEQYGSVCAANNDQDATLTGD

SEQ ID NO: 167572 - protein, 36 aa, Artificial Sequence
  Description of Artificial Sequence: Synthetic polypeptide
DAAEIATTNPVATEQYGSVCSPDGTGNEAMIGNAEN

SEQ ID NO: 167573 - protein, 31 aa, Artificial Sequence
  Description of Artificial Sequence: Synthetic polypeptide
VEEEIACTNPVATEQWGCVAGTGELINMMED

SEQ ID NO: 167574 - protein, 36 aa, Artificial Sequence
  Description of Artificial Sequence: Synthetic polypeptide
DESEIRTTNPVATEQYGSVSALWDVQQTEGMGTPQE

SEQ ID NO: 167575 - protein, 33 aa, Artificial Sequence
  Description of Artificial Sequence: Synthetic polypeptide
DEDEIATTNPVAYEQYGSVCAANNEQDDATVTD

SEQ ID NO: 167576 - protein, 35 aa, Artificial Sequence
  Description of Artificial Sequence: Synthetic polypeptide
DEEEIRTTNPVATEQYGVVMGINDNEGGDDDEIEE

SEQ ID NO: 167577 - protein, 33 aa, Artificial Sequence
  Description of Artificial Sequence: Synthetic polypeptide
VEDEVATTNPVAYEQWGSTCVTWENMDRRVGNR

SEQ ID NO: 167578 - protein, 35 aa, Artificial Sequence
  Description of Artificial Sequence: Synthetic polypeptide
DEDEIATTNPVAYEQYGSVATPAHQGADSDGNAAS

SEQ ID NO: 167579 - protein, 36 aa, Artificial Sequence
  Description of Artificial Sequence: Synthetic polypeptide
DEAEIATTNPVATEQYGSVTATWPAGPDMQNGGNPV

SEQ ID NO: 167580 - protein, 37 aa, Artificial Sequence
  Description of Artificial Sequence: Synthetic polypeptide
DEEEIRTTNPVATEAYGVVSTTLQLQIGTTESGTTDE

SEQ ID NO: 167581 - protein, 37 aa, Artificial Sequence
  Description of Artificial Sequence: Synthetic polypeptide
DEEEIRTTNPVATEAYGVVSTTLQQQQNATTNVATEE

SEQ ID NO: 167582 - protein, 38 aa, Artificial Sequence
  Description of Artificial Sequence: Synthetic polypeptide
DEEEIRTTNPVATEAYGVVSTTNAEQGNNQQGNTEQGS

SEQ ID NO: 167583 - protein, 35 aa, Artificial Sequence
  Description of Artificial Sequence: Synthetic polypeptide
DEEEIRTTNPVATEQYGSVIMVWEGVPITQGEEED

SEQ ID NO: 167584 - protein, 37 aa, Artificial Sequence
  Description of Artificial Sequence: Synthetic polypeptide
DEEEIRTTNPVATEQYGSVIHRTPLGMPERQLQVEIT

SEQ ID NO: 167585 - protein, 34 aa, Artificial Sequence
  Description of Artificial Sequence: Synthetic polypeptide
VEDEVATTNPVAYEQWGSTCSTWEQLDQRDGAND

SEQ ID NO: 167586 - protein, 34 aa, Artificial Sequence
  Description of Artificial Sequence: Synthetic polypeptide
DEDEIATTNPVAYEQYGSVCAAVANAQTAMDPNN

SEQ ID NO: 167587 - protein, 35 aa, Artificial Sequence
  Description of Artificial Sequence: Synthetic polypeptide
DEMEIRTTNPVATEQYGSVSSEDMGAEISGGEEDH

SEQ ID NO: 167588 - protein, 36 aa, Artificial Sequence
  Description of Artificial Sequence: Synthetic polypeptide
VEEEIACTNPVATEQYGSVCATNPQLNPDDQTGGQM

SEQ ID NO: 167589 - protein, 36 aa, Artificial Sequence
  Description of Artificial Sequence: Synthetic polypeptide
DESEIRTTNPVATEQYGSVNSPVNNESHEILEEHKI

SEQ ID NO: 167590 - protein, 37 aa, Artificial Sequence
  Description of Artificial Sequence: Synthetic polypeptide
DESEIRTTNPVATEQYGSVNSDGMQGLTGGNGQENID

SEQ ID NO: 167591 - protein, 35 aa, Artificial Sequence
  Description of Artificial Sequence: Synthetic polypeptide
DCEVISTTNPVAYEQYGQVSCTSLSQTGPGGLNVI

SEQ ID NO: 167592 - protein, 35 aa, Artificial Sequence
  Description of Artificial Sequence: Synthetic polypeptide
DCEVISTTNPVAYEPYGQVSCTSLSQLRPGGTNVI

SEQ ID NO: 167593 - protein, 35 aa, Artificial Sequence
  Description of Artificial Sequence: Synthetic polypeptide
DEMEIRTTNPVATEQYGSVSPTVHGPEESFEQFEM

SEQ ID NO: 167594 - protein, 35 aa, Artificial Sequence
  Description of Artificial Sequence: Synthetic polypeptide
DESEIRTTNPVATEQYGSVEPPWHEEEGTEGNNMK

SEQ ID NO: 167595 - protein, 37 aa, Artificial Sequence
  Description of Artificial Sequence: Synthetic polypeptide
DEEEIRTTNPVATEQYGSVILGIADHTMEEPEQEGTP

SEQ ID NO: 167596 - protein, 32 aa, Artificial Sequence
  Description of Artificial Sequence: Synthetic polypeptide
VEEEIACTNPVATEQYGCAPIHGQDSEGENKM

SEQ ID NO: 167597 - protein, 31 aa, Artificial Sequence
  Description of Artificial Sequence: Synthetic polypeptide
VEEEIACTNPVATEQYGCAPIHGQDSEGEDN

SEQ ID NO: 167598 - protein, 33 aa, Artificial Sequence
  Description of Artificial Sequence: Synthetic polypeptide
CECSIMTTNPVATECYGMVYNENTLERIGNNME

SEQ ID NO: 167599 - protein, 36 aa, Artificial Sequence
  Description of Artificial Sequence: Synthetic polypeptide
DESEIRTTNPVATEQYGSVISYEHYSEQLETQADEG

SEQ ID NO: 167600 - protein, 40 aa, Artificial Sequence
  Description of Artificial Sequence: Synthetic polypeptide
DEEEIRTTNPVATEQYGSVSTVNLQQLQQGTEQYGTVVED

SEQ ID NO: 167601 - protein, 33 aa, Artificial Sequence
  Description of Artificial Sequence: Synthetic polypeptide
VEEEIACTNPVATEQWGSVANGGNGEYGAEGGR

SEQ ID NO: 167602 - protein, 36 aa, Artificial Sequence
  Description of Artificial Sequence: Synthetic polypeptide
DEAEIRTTNPVATEQYGSVSVDAPNDTTGQHLEVES

SEQ ID NO: 167603 - protein, 37 aa, Artificial Sequence
  Description of Artificial Sequence: Synthetic polypeptide
DESEIRTTNPVATEQYGSVNSDGMQGLTMGEGDQNGD

SEQ ID NO: 167604 - protein, 36 aa, Artificial Sequence
  Description of Artificial Sequence: Synthetic polypeptide
DESEIRTTNPVATEQYGSVIVDFGNGGFDSGDGNTN

SEQ ID NO: 167605 - protein, 37 aa, Artificial Sequence
  Description of Artificial Sequence: Synthetic polypeptide
DESEIRTTNPVATEQYGSVIVDFGNGGFDTGDRGNTI

SEQ ID NO: 167606 - protein, 37 aa, Artificial Sequence
  Description of Artificial Sequence: Synthetic polypeptide
DEMEIRTTNPVATEQYGSVSPTYGPGAEQDFGDQVEK

SEQ ID NO: 167607 - protein, 36 aa, Artificial Sequence
  Description of Artificial Sequence: Synthetic polypeptide
DEEEIRTTNPVATEQYGSVIIINMGEEQPEMEVPEI

SEQ ID NO: 167608 - protein, 37 aa, Artificial Sequence
  Description of Artificial Sequence: Synthetic polypeptide
DEEEIRTTNPVATEQYGSVILPAYNQQFINTIELSEV

SEQ ID NO: 167609 - protein, 35 aa, Artificial Sequence
  Description of Artificial Sequence: Synthetic polypeptide
DEEEIRTTNPVATEQYGSVILPIFMIPTVVEQEQV

SEQ ID NO: 167610 - protein, 36 aa, Artificial Sequence
  Description of Artificial Sequence: Synthetic polypeptide
DESEIRTTNPVATEQYGSVDDNTDNDNNNEEAEGGG

SEQ ID NO: 167611 - protein, 35 aa, Artificial Sequence
  Description of Artificial Sequence: Synthetic polypeptide
DEMEIRTTNPVATEQYGSVSPVPWTQQEESFEFHN

SEQ ID NO: 167612 - protein, 34 aa, Artificial Sequence
  Description of Artificial Sequence: Synthetic polypeptide
DEDEIATTNPVAYEQYGSVCAAGPEDQMQMGNNS

SEQ ID NO: 167613 - protein, 35 aa, Artificial Sequence
  Description of Artificial Sequence: Synthetic polypeptide
VEEEIACTNPVATEQWGCVASTNNLENGMPGENDH

SEQ ID NO: 167614 - protein, 32 aa, Artificial Sequence
  Description of Artificial Sequence: Synthetic polypeptide
VEEEIACTNPVATEQWGCVAGTGLSINMMTRD

SEQ ID NO: 167615 - protein, 32 aa, Artificial Sequence
  Description of Artificial Sequence: Synthetic polypeptide
VEEEIACTNPVATEQWGCVAGTGLIGNMMEDD

SEQ ID NO: 167616 - protein, 37 aa, Artificial Sequence
  Description of Artificial Sequence: Synthetic polypeptide
DESEIRTTNPVATEQYGSVNSDGMQGLTDGEGDNGDE

SEQ ID NO: 167617 - protein, 31 aa, Artificial Sequence
  Description of Artificial Sequence: Synthetic polypeptide
QEEEIATTNPVATEQYGEYCPSVDQEHISEQ

SEQ ID NO: 167618 - protein, 35 aa, Artificial Sequence
  Description of Artificial Sequence: Synthetic polypeptide
DEDEIATTNPVAYEQYGSVCSAGNLNGEAGGPGDP

SEQ ID NO: 167619 - protein, 35 aa, Artificial Sequence
  Description of Artificial Sequence: Synthetic polypeptide
DEQEIATTNPVATEQYGCVAAGANQPTLAEGPNND

SEQ ID NO: 167620 - protein, 34 aa, Artificial Sequence
  Description of Artificial Sequence: Synthetic polypeptide
VEDEVATTNPVAYEQWGSTCSTWEHTDQRIGNTR

SEQ ID NO: 167621 - protein, 35 aa, Artificial Sequence
  Description of Artificial Sequence: Synthetic polypeptide
DEDEIATTNPVAYEQYGSVCANSLQPPDGMDPLEE

SEQ ID NO: 167622 - protein, 36 aa, Artificial Sequence
  Description of Artificial Sequence: Synthetic polypeptide
DEEEIRTTNPVATEQYGSVIPPAPVGEQEHMEIQRN

SEQ ID NO: 167623 - protein, 35 aa, Artificial Sequence
  Description of Artificial Sequence: Synthetic polypeptide
DEEEIRTTNPVATEQYGSVIPPLIEEVTMFPLEQV

SEQ ID NO: 167624 - protein, 33 aa, Artificial Sequence
  Description of Artificial Sequence: Synthetic polypeptide
VEDEIATVNPVATEQYGCVAGTNLATMPGGEHH

SEQ ID NO: 167625 - protein, 32 aa, Artificial Sequence
  Description of Artificial Sequence: Synthetic polypeptide
VEDEIATVNPVATEQYGCVAGTGLATATGEEH

SEQ ID NO: 167626 - protein, 35 aa, Artificial Sequence
  Description of Artificial Sequence: Synthetic polypeptide
DEEEIRTVNPVATEQYGCVCSWEDHNQNFNSQTQG

SEQ ID NO: 167627 - protein, 32 aa, Artificial Sequence
  Description of Artificial Sequence: Synthetic polypeptide
VEDEIATVNPVATEQYGCVAGTGLADAPGGEH

SEQ ID NO: 167628 - protein, 36 aa, Artificial Sequence
  Description of Artificial Sequence: Synthetic polypeptide
DEMEIRTTNPVATEQYGSVSSVPLHNNIEWSMENNM

SEQ ID NO: 167629 - protein, 32 aa, Artificial Sequence
  Description of Artificial Sequence: Synthetic polypeptide
VEDEIATVNPVATEQWGCVAGTNLATAGGEHH

SEQ ID NO: 167630 - protein, 37 aa, Artificial Sequence
  Description of Artificial Sequence: Synthetic polypeptide
DEMEIRTTNPVATEQYGSVSSVPSNLTEEEIDQESRF

SEQ ID NO: 167631 - protein, 31 aa, Artificial Sequence
  Description of Artificial Sequence: Synthetic polypeptide
VEDEIATVNPVATEQWGCVAGTGLADAGHGH

SEQ ID NO: 167632 - protein, 32 aa, Artificial Sequence
  Description of Artificial Sequence: Synthetic polypeptide
VEDEIATVNPVATEQWGCVAGTGLADAGGNHQ

SEQ ID NO: 167633 - protein, 33 aa, Artificial Sequence
  Description of Artificial Sequence: Synthetic polypeptide
DEQEIATTNPVATEQYGCVAANGDAMPMGEPHH

SEQ ID NO: 167634 - protein, 34 aa, Artificial Sequence
  Description of Artificial Sequence: Synthetic polypeptide
QEEEIATTNPVATEQYGEVPTEVGPNMRNEMNPV

SEQ ID NO: 167635 - protein, 33 aa, Artificial Sequence
  Description of Artificial Sequence: Synthetic polypeptide
DCMEIVTTNPVATETYGTVCSATDGPVEFEGND

SEQ ID NO: 167636 - protein, 38 aa, Artificial Sequence
  Description of Artificial Sequence: Synthetic polypeptide
DEEEIRTTNPVATEQYGSVCSPTELWLEDPQQPSVVVV

SEQ ID NO: 167637 - protein, 35 aa, Artificial Sequence
  Description of Artificial Sequence: Synthetic polypeptide
DEDEIATTNPVAYEQYGSVCATNNPMNQGNQTEGD

SEQ ID NO: 167638 - protein, 36 aa, Artificial Sequence
  Description of Artificial Sequence: Synthetic polypeptide
DEQEIATTNPVATEQWGSVSATGTPGNDHQGDEDNH

SEQ ID NO: 167639 - protein, 35 aa, Artificial Sequence
  Description of Artificial Sequence: Synthetic polypeptide
DEQEIATTNPVATEQWGSVSATGTPGEDHQGDENN

SEQ ID NO: 167640 - protein, 35 aa, Artificial Sequence
  Description of Artificial Sequence: Synthetic polypeptide
VEEEIATTNPVATEQWGCVAGNNGLPQTAAAEGFR

SEQ ID NO: 167641 - protein, 31 aa, Artificial Sequence
  Description of Artificial Sequence: Synthetic polypeptide
DCNEIRTTNPVATEQWGDVNSEIEMNAAEDA

SEQ ID NO: 167642 - protein, 36 aa, Artificial Sequence
  Description of Artificial Sequence: Synthetic polypeptide
DEDEIATTNPVAYEQYGSVCATNPPMQQGNQTEGDD

SEQ ID NO: 167643 - protein, 36 aa, Artificial Sequence
  Description of Artificial Sequence: Synthetic polypeptide
DCNEIRTTNPVATEQYGSVSTTPDMHNSSQEVSFED

SEQ ID NO: 167644 - protein, 35 aa, Artificial Sequence
  Description of Artificial Sequence: Synthetic polypeptide
DEDEIATTNPVAYEQYGSVCMDNLTNPRDQTEGDN

SEQ ID NO: 167645 - protein, 35 aa, Artificial Sequence
  Description of Artificial Sequence: Synthetic polypeptide
DAAEIATTNPVATEQYGSVCAADNGDEQGMDINNR

SEQ ID NO: 167646 - protein, 37 aa, Artificial Sequence
  Description of Artificial Sequence: Synthetic polypeptide
DEEEIRTTNPVATEQYGVVDTGTMNGTGGDENGNGQY

SEQ ID NO: 167647 - protein, 34 aa, Artificial Sequence
  Description of Artificial Sequence: Synthetic polypeptide
DEAEIATTNPVATEQYGTVCAATDGHPAEAEGND

SEQ ID NO: 167648 - protein, 36 aa, Artificial Sequence
  Description of Artificial Sequence: Synthetic polypeptide
DEEEIRTTNPVATEQYGSVINMLLMELEPAQDEMFD

SEQ ID NO: 167649 - protein, 36 aa, Artificial Sequence
  Description of Artificial Sequence: Synthetic polypeptide
DEEEIRTTNPVATEQYGVVFGNFEDDEGGNDQDNIV

SEQ ID NO: 167650 - protein, 38 aa, Artificial Sequence
  Description of Artificial Sequence: Synthetic polypeptide
DESEIRTTNPVATEQYGSVSNMNLVGDDQDQEDDDGEM

SEQ ID NO: 167651 - protein, 34 aa, Artificial Sequence
  Description of Artificial Sequence: Synthetic polypeptide
DEQEIATTNPVATEQYGCVAANGDAATAPGTPRY

SEQ ID NO: 167652 - protein, 33 aa, Artificial Sequence
  Description of Artificial Sequence: Synthetic polypeptide
DEQEIATTNPVATEQYGCVAANGDAATMGGDPA

SEQ ID NO: 167653 - protein, 36 aa, Artificial Sequence
  Description of Artificial Sequence: Synthetic polypeptide
DESEIRTTNPVATEQYGSVCEMEYDVLTDQMEINED

SEQ ID NO: 167654 - protein, 37 aa, Artificial Sequence
  Description of Artificial Sequence: Synthetic polypeptide
DEMEIRTTNPVATEQYGSVSSTTPAMPNMENMMNPKN

SEQ ID NO: 167655 - protein, 33 aa, Artificial Sequence
  Description of Artificial Sequence: Synthetic polypeptide
VEDEVATTNPVAYEQWGSTCSTWEHIEQRVGND

SEQ ID NO: 167656 - protein, 31 aa, Artificial Sequence
  Description of Artificial Sequence: Synthetic polypeptide
CEDEIACTNPVATEQWGCVAGTGDAMMNERV

SEQ ID NO: 167657 - protein, 41 aa, Artificial Sequence
  Description of Artificial Sequence: Synthetic polypeptide
DEEEIRTTNPVATEQYGSVSTVNLQYGNNANEQGTNNNTDD

SEQ ID NO: 167658 - protein, 38 aa, Artificial Sequence
  Description of Artificial Sequence: Synthetic polypeptide
DEEEIRTTNPVATEAYGVVSTTNDQAGNTESGGVTTDN

SEQ ID NO: 167659 - protein, 33 aa, Artificial Sequence
  Description of Artificial Sequence: Synthetic polypeptide
DEDEIATTNPVAYEQYGSVCAINPAWIPRDMEE

SEQ ID NO: 167660 - protein, 35 aa, Artificial Sequence
  Description of Artificial Sequence: Synthetic polypeptide
DEDEIATTNPVAYEQYGSVCALANHGQDSDGNDNH

SEQ ID NO: 167661 - protein, 38 aa, Artificial Sequence
  Description of Artificial Sequence: Synthetic polypeptide
DEEEIRTTNPVATEAYGVVSTTNDQAGNTTEQGSTDNQ

SEQ ID NO: 167662 - protein, 37 aa, Artificial Sequence
  Description of Artificial Sequence: Synthetic polypeptide
DEEEIRTTNPVATEQYGSVINTTPDGPNMGNGEDDGD

SEQ ID NO: 167663 - protein, 35 aa, Artificial Sequence
  Description of Artificial Sequence: Synthetic polypeptide
VEDEIRGTNPVATEAYGSVVDTNGLEQQGGGQQLG

SEQ ID NO: 167664 - protein, 37 aa, Artificial Sequence
  Description of Artificial Sequence: Synthetic polypeptide
DEEEIRTTNPVATEQYGVVGGPSNQNPQSLENNVDQL

SEQ ID NO: 167665 - protein, 37 aa, Artificial Sequence
  Description of Artificial Sequence: Synthetic polypeptide
VEDEIRTTNPVATEQYGSVMSGMFNIDIQEEGFNEII

SEQ ID NO: 167666 - protein, 37 aa, Artificial Sequence
  Description of Artificial Sequence: Synthetic polypeptide
DEEEIRTTNPVATEQYGSVIHPPKMLVIQPEQQLSNL

SEQ ID NO: 167667 - protein, 37 aa, Artificial Sequence
  Description of Artificial Sequence: Synthetic polypeptide
DESEIRTTNPVATEQYGSVSCVLDINEDPEGMQNNQI

SEQ ID NO: 167668 - protein, 36 aa, Artificial Sequence
  Description of Artificial Sequence: Synthetic polypeptide
DESEIRTTNPVATEQYGSVSCVVDDLNQPNSQIYEQ

SEQ ID NO: 167669 - protein, 37 aa, Artificial Sequence
  Description of Artificial Sequence: Synthetic polypeptide
VEDEIRTTNPVATEQYGSVMSGMFNFDLQEEGFEEII

SEQ ID NO: 167670 - protein, 36 aa, Artificial Sequence
  Description of Artificial Sequence: Synthetic polypeptide
VEDEIRTTNPVATEQYGSVMSGMFEQDGQEEGFNII

SEQ ID NO: 167671 - protein, 35 aa, Artificial Sequence
  Description of Artificial Sequence: Synthetic polypeptide
CEAEISTTNPVATEQYGCVCSNTEHQENFGSNTQS

SEQ ID NO: 167672 - protein, 37 aa, Artificial Sequence
  Description of Artificial Sequence: Synthetic polypeptide
VEDEIRTTNPVATEQYGSVMSDMFNIDLQEEGFGAII

SEQ ID NO: 167673 - protein, 39 aa, Artificial Sequence
  Description of Artificial Sequence: Synthetic polypeptide
DEEEIRTTNPVATEAYGVVSTNQQNLQANTTEQGTNVAE

SEQ ID NO: 167674 - protein, 34 aa, Artificial Sequence
  Description of Artificial Sequence: Synthetic polypeptide
DEDEIATTNPVAYEQYGSVCANAQAQEHNDNAAM

SEQ ID NO: 167675 - protein, 31 aa, Artificial Sequence
  Description of Artificial Sequence: Synthetic polypeptide
VEDEIRTTNPVATEQWGCVSEGVEMNAAEDA

SEQ ID NO: 167676 - protein, 35 aa, Artificial Sequence
  Description of Artificial Sequence: Synthetic polypeptide
VEEEIATTNPVATEEYGCICCCTNFSMRPGGNNVR

SEQ ID NO: 167677 - protein, 37 aa, Artificial Sequence
  Description of Artificial Sequence: Synthetic polypeptide
VEDEIRTTNPVATEQYGSVMSGMFNIDLTEEGFNDII

SEQ ID NO: 167678 - protein, 37 aa, Artificial Sequence
  Description of Artificial Sequence: Synthetic polypeptide
DEHEIRTTNPVATEQYGSVESTPLNWAEEVIGDEPQE

SEQ ID NO: 167679 - protein, 31 aa, Artificial Sequence
  Description of Artificial Sequence: Synthetic polypeptide
DDSEVASTNPVGTEHYGNVAANTIQSRVGQR

SEQ ID NO: 167680 - protein, 37 aa, Artificial Sequence
  Description of Artificial Sequence: Synthetic polypeptide
DEEEIRTTNPVATEQYGSVIGPTYNLAGMPVLEIEDT

SEQ ID NO: 167681 - protein, 34 aa, Artificial Sequence
  Description of Artificial Sequence: Synthetic polypeptide
DEEEIATTNPVAYEQWGSVYHPINDRQKTKGAES

SEQ ID NO: 167682 - protein, 35 aa, Artificial Sequence
  Description of Artificial Sequence: Synthetic polypeptide
DEEEIATTNPVATEQYGCVAANNGDTTTDDGNQEM

SEQ ID NO: 167683 - protein, 31 aa, Artificial Sequence
  Description of Artificial Sequence: Synthetic polypeptide
DDSEVASTNPVATEGYGNVANATIQSRVGQR

SEQ ID NO: 167684 - protein, 32 aa, Artificial Sequence
  Description of Artificial Sequence: Synthetic polypeptide
VEDEIACTNPVATEQWGCTAGNNLQDQGDNDQ

SEQ ID NO: 167685 - protein, 32 aa, Artificial Sequence
  Description of Artificial Sequence: Synthetic polypeptide
VEDEIACTNPVATEQWGCTAGNNLQDDGMDNN

SEQ ID NO: 167686 - protein, 35 aa, Artificial Sequence
  Description of Artificial Sequence: Synthetic polypeptide
CAEEIATTNPVAYEQYGSVCSTNPQQEHQDGTEMK

SEQ ID NO: 167687 - protein, 35 aa, Artificial Sequence
  Description of Artificial Sequence: Synthetic polypeptide
DEEEIATTNPVATEQYGCVAANHSGDPAMQPGEEG

SEQ ID NO: 167688 - protein, 35 aa, Artificial Sequence
  Description of Artificial Sequence: Synthetic polypeptide
DEEEIATTNPVATEQYGCVAANHSGDAMNPAEQGN

SEQ ID NO: 167689 - protein, 31 aa, Artificial Sequence
  Description of Artificial Sequence: Synthetic polypeptide
VEDEIACTNPVATEQWGCTAGNGLARPDNSE

SEQ ID NO: 167690 - protein, 31 aa, Artificial Sequence
  Description of Artificial Sequence: Synthetic polypeptide
VEDEIACTNPVATEQWGCTAGNGLARDHDNY

SEQ ID NO: 167691 - protein, 34 aa, Artificial Sequence
  Description of Artificial Sequence: Synthetic polypeptide
DEEEIATTNPVATEQYGCVAAKPGEEMDEQNNNM

SEQ ID NO: 167692 - protein, 34 aa, Artificial Sequence
  Description of Artificial Sequence: Synthetic polypeptide
DEEEIATTNPVATEQYGCVAAKPGEEMDEQGERM

SEQ ID NO: 167693 - protein, 36 aa, Artificial Sequence
  Description of Artificial Sequence: Synthetic polypeptide
QEGEIRTTNPVATEQYGSVYPDVTDDNQDEEGNEMP

SEQ ID NO: 167694 - protein, 35 aa, Artificial Sequence
  Description of Artificial Sequence: Synthetic polypeptide
DEEEIATTNPVATEQYGCVAAGTGNPAANGMMGQF

SEQ ID NO: 167695 - protein, 35 aa, Artificial Sequence
  Description of Artificial Sequence: Synthetic polypeptide
DEEEIRTTNPVATEQYGVCVYPSPVNMPNDVQMFE

SEQ ID NO: 167696 - protein, 33 aa, Artificial Sequence
  Description of Artificial Sequence: Synthetic polypeptide
DEDEIATTNPVAYERWGVVSGGNGLQDHPNDGS

SEQ ID NO: 167697 - protein, 35 aa, Artificial Sequence
  Description of Artificial Sequence: Synthetic polypeptide
DEEEIATTNPVATEQYGCVAAGAQPTLAEGPNNHQ

SEQ ID NO: 167698 - protein, 35 aa, Artificial Sequence
  Description of Artificial Sequence: Synthetic polypeptide
DEEEIRTTNPVATEQYGVCVYPSPVMMPNVDMFEG

SEQ ID NO: 167699 - protein, 32 aa, Artificial Sequence
  Description of Artificial Sequence: Synthetic polypeptide
CEDEIACTNPVATEQYGCVAGTGLAANPGQHN

SEQ ID NO: 167700 - protein, 35 aa, Artificial Sequence
  Description of Artificial Sequence: Synthetic polypeptide
DEEEIATTNPVATEQYGCVAAGANQPTLAEMPNNS

SEQ ID NO: 167701 - protein, 37 aa, Artificial Sequence
  Description of Artificial Sequence: Synthetic polypeptide
DEMEIRTTNPVATEQYGSVSWPPNNLNDEEIWQESRF

SEQ ID NO: 167702 - protein, 36 aa, Artificial Sequence
  Description of Artificial Sequence: Synthetic polypeptide
DEEEIRTTNPVATEQYGCTCSWNEDHNQENFGSEQA

SEQ ID NO: 167703 - protein, 34 aa, Artificial Sequence
  Description of Artificial Sequence: Synthetic polypeptide
DEDEIATTNPVAYEQYGSVAIANNDTQDQGDDTW

SEQ ID NO: 167704 - protein, 32 aa, Artificial Sequence
  Description of Artificial Sequence: Synthetic polypeptide
DDSEVASTNPVATEGYGNVAANTIQSRVGGQR

SEQ ID NO: 167705 - protein, 33 aa, Artificial Sequence
  Description of Artificial Sequence: Synthetic polypeptide
VDHEIGTTNPVATEPYGTVFIYTNLGHGGGNTS

SEQ ID NO: 167706 - protein, 31 aa, Artificial Sequence
  Description of Artificial Sequence: Synthetic polypeptide
DDSEVASTNPVATEGYGNVAANTIQSRVEQR

SEQ ID NO: 167707 - protein, 37 aa, Artificial Sequence
  Description of Artificial Sequence: Synthetic polypeptide
DEEEIRTTNPVATEQYGSVIGPTSNLDGMPVLEIEMQ

SEQ ID NO: 167708 - protein, 35 aa, Artificial Sequence
  Description of Artificial Sequence: Synthetic polypeptide
DEQEIATTNPVATEQYGCVAATAGLTATMNGNDQM

SEQ ID NO: 167709 - protein, 32 aa, Artificial Sequence
  Description of Artificial Sequence: Synthetic polypeptide
CAEEIATTNPVGTEQWGGCVAGNGLATMNPDR

SEQ ID NO: 167710 - protein, 34 aa, Artificial Sequence
  Description of Artificial Sequence: Synthetic polypeptide
DEEEIATTNPVAYEQWGSVVIVNGNDEHGGTNIQ

SEQ ID NO: 167711 - protein, 35 aa, Artificial Sequence
  Description of Artificial Sequence: Synthetic polypeptide
CTGEIRTTNPVATEQYGSVNTDNNGQNNNGEMGQG

SEQ ID NO: 167712 - protein, 31 aa, Artificial Sequence
  Description of Artificial Sequence: Synthetic polypeptide
CAEEIATTNPVGTEQWGGCVAGTNLAMNPDH

SEQ ID NO: 167713 - protein, 38 aa, Artificial Sequence
  Description of Artificial Sequence: Synthetic polypeptide
DEEEIRTTNPVATEQYGVVSTVVNNNNGNQQGEEDEES

SEQ ID NO: 167714 - protein, 35 aa, Artificial Sequence
  Description of Artificial Sequence: Synthetic polypeptide
DEQEIATTNPVATEQWGHCNVAATANGLQAAPGGF

SEQ ID NO: 167715 - protein, 31 aa, Artificial Sequence
  Description of Artificial Sequence: Synthetic polypeptide
QEMEIACTNPCSYEQYGCVSWNHQSFGSDRS

SEQ ID NO: 167716 - protein, 34 aa, Artificial Sequence
  Description of Artificial Sequence: Synthetic polypeptide
DEQEIATTNPVATEQYGCVAANNNNVTTDDGNEN

SEQ ID NO: 167717 - protein, 34 aa, Artificial Sequence
  Description of Artificial Sequence: Synthetic polypeptide
DEAEIATTNPVAYEKWGVVCSTDNGDERDGDHRQ

SEQ ID NO: 167718 - protein, 35 aa, Artificial Sequence
  Description of Artificial Sequence: Synthetic polypeptide
DESEIRTTNPVATEVYGETTSCTNNAHSARGGDSE

SEQ ID NO: 167719 - protein, 35 aa, Artificial Sequence
  Description of Artificial Sequence: Synthetic polypeptide
DESEIRTTNPVATEVYGETTSCTNNAHSQDGGDSG

SEQ ID NO: 167720 - protein, 33 aa, Artificial Sequence
  Description of Artificial Sequence: Synthetic polypeptide
DEQEIATTNPVATEQYGCVAANPDATMPPGEHA

SEQ ID NO: 167721 - protein, 36 aa, Artificial Sequence
  Description of Artificial Sequence: Synthetic polypeptide
DEMEIRTTNPVATEQYGSVSEVPLHDNSEWSEENNM

SEQ ID NO: 167722 - protein, 35 aa, Artificial Sequence
  Description of Artificial Sequence: Synthetic polypeptide
DEEEIATTNPVATEQYGCVAGTGDTADTMGGDNNY

SEQ ID NO: 167723 - protein, 35 aa, Artificial Sequence
  Description of Artificial Sequence: Synthetic polypeptide
DEQEIATTNPVATEQWGCVAGTGQLDNQMGNGELH

SEQ ID NO: 167724 - protein, 36 aa, Artificial Sequence
  Description of Artificial Sequence: Synthetic polypeptide
CTGEIRTTNPVATEQYGSVDTTGDNGQEEGGNGGGS

SEQ ID NO: 167725 - protein, 31 aa, Artificial Sequence
  Description of Artificial Sequence: Synthetic polypeptide
QEMEIACTNPCSYEQYGCVSWNLQSFGSEAS

SEQ ID NO: 167726 - protein, 29 aa, Artificial Sequence
  Description of Artificial Sequence: Synthetic peptide
QEMEIACTNPVATEQYGEAPEVCQHEEDK

SEQ ID NO: 167727 - protein, 36 aa, Artificial Sequence
  Description of Artificial Sequence: Synthetic polypeptide
DESEIRTTNPVATEWYGETTQSCTNFAHSQREGGDS

SEQ ID NO: 167728 - protein, 35 aa, Artificial Sequence
  Description of Artificial Sequence: Synthetic polypeptide
DESEIRTTNPVATEWYGETTSCTNFAHSNRTGGDS

SEQ ID NO: 167729 - protein, 35 aa, Artificial Sequence
  Description of Artificial Sequence: Synthetic polypeptide
DESEIRTTNPVATEWYGETTSCTNFAHSQNHGGDS

SEQ ID NO: 167730 - protein, 35 aa, Artificial Sequence
  Description of Artificial Sequence: Synthetic polypeptide
VEEEIATTNPVATEQYGSVCAMNNGGTEAGDVNNA

SEQ ID NO: 167731 - protein, 35 aa, Artificial Sequence
  Description of Artificial Sequence: Synthetic polypeptide
DEEEIATTNPVAYEQWGSVVCNTPDDDHRQNHNDR

SEQ ID NO: 167732 - protein, 33 aa, Artificial Sequence
  Description of Artificial Sequence: Synthetic polypeptide
DEQEIATTNPVATEQWGCVSGEGEMNAAEDNAA

SEQ ID NO: 167733 - protein, 36 aa, Artificial Sequence
  Description of Artificial Sequence: Synthetic polypeptide
DEEEIATTNPVATEQYGCVAAVTHMNATASGDNNQD

SEQ ID NO: 167734 - protein, 34 aa, Artificial Sequence
  Description of Artificial Sequence: Synthetic polypeptide
CTGEIRTTNPVATEQYGSVDQEQNNEQEEGGGGT

SEQ ID NO: 167735 - protein, 36 aa, Artificial Sequence
  Description of Artificial Sequence: Synthetic polypeptide
DESEIRTTNPVATEQYGDVVVDDFNVQQGEGDENEG

SEQ ID NO: 167736 - protein, 35 aa, Artificial Sequence
  Description of Artificial Sequence: Synthetic polypeptide
DEEEIATTNPVATEQYGCVAATNDGATPSPMENGM

SEQ ID NO: 167737 - protein, 36 aa, Artificial Sequence
  Description of Artificial Sequence: Synthetic polypeptide
CTGEIRTTNPVATEQYGSVDQTQNNFQEENGNGGGI

SEQ ID NO: 167738 - protein, 36 aa, Artificial Sequence
  Description of Artificial Sequence: Synthetic polypeptide
DEEEIRTTNPVATEQYGSVISPTLSYVIMHATLDDQ

SEQ ID NO: 167739 - protein, 34 aa, Artificial Sequence
  Description of Artificial Sequence: Synthetic polypeptide
DEDEIATTNPVAYEQYGSVAIANNDTDDQGNDTV

SEQ ID NO: 167740 - protein, 34 aa, Artificial Sequence
  Description of Artificial Sequence: Synthetic polypeptide
TTTEIATTNPVVTEQYGSVSWNEGEGRQRGDTPG

SEQ ID NO: 167741 - protein, 35 aa, Artificial Sequence
  Description of Artificial Sequence: Synthetic polypeptide
DEQEIATTNPVATEPYGSTVSATGDSEDHEGGENL

SEQ ID NO: 167742 - protein, 36 aa, Artificial Sequence
  Description of Artificial Sequence: Synthetic polypeptide
DEEEIRTVNPVATEGYGSVVVGGQRGLQGQNGQGED

SEQ ID NO: 167743 - protein, 35 aa, Artificial Sequence
  Description of Artificial Sequence: Synthetic polypeptide
DEQEIATTNPVATEPWGISVRTWNDDQDRQQKNDA

SEQ ID NO: 167744 - protein, 33 aa, Artificial Sequence
  Description of Artificial Sequence: Synthetic polypeptide
DEDEICTTNPVAYECWGSVCSTIDGGQHGMGDA

SEQ ID NO: 167745 - protein, 34 aa, Artificial Sequence
  Description of Artificial Sequence: Synthetic polypeptide
DEDEICTTNPVAYEQWGEVATGGNQNDHQGGNIM

SEQ ID NO: 167746 - protein, 33 aa, Artificial Sequence
  Description of Artificial Sequence: Synthetic polypeptide
QEEEIATTNPVATEQYGEAPTEVGPNMREMNPV

SEQ ID NO: 167747 - protein, 35 aa, Artificial Sequence
  Description of Artificial Sequence: Synthetic polypeptide
DEDEICTTNPVAYEQWGSVCPNDQDRAMGDHNNEQ

SEQ ID NO: 167748 - protein, 33 aa, Artificial Sequence
  Description of Artificial Sequence: Synthetic polypeptide
QEEEIATTNPVATEQYGEAPTEVGPNMREMNPK

SEQ ID NO: 167749 - protein, 34 aa, Artificial Sequence
  Description of Artificial Sequence: Synthetic polypeptide
DEDEICTTNPVAYEQWGSVCSTDNNDHHAGQGDN

SEQ ID NO: 167750 - protein, 35 aa, Artificial Sequence
  Description of Artificial Sequence: Synthetic polypeptide
DEEEIRTTNPVATEQYGVCVHPSPVNMSNVDMFGE

SEQ ID NO: 167751 - protein, 36 aa, Artificial Sequence
  Description of Artificial Sequence: Synthetic polypeptide
DEDEICTTNPVAYEQWGSVCSTENLGDQDIQKEGDM

SEQ ID NO: 167752 - protein, 31 aa, Artificial Sequence
  Description of Artificial Sequence: Synthetic polypeptide
DDSEVASTNPVATEGYGNAAANTIQSRVGQR

SEQ ID NO: 167753 - protein, 33 aa, Artificial Sequence
  Description of Artificial Sequence: Synthetic polypeptide
CEDEIACTNPVATEQYGCVATNHAEAEGGNMEN

SEQ ID NO: 167754 - protein, 34 aa, Artificial Sequence
  Description of Artificial Sequence: Synthetic polypeptide
DEEEIATTNPVAYEQWGTVCSTENDEHDGKGEQE

SEQ ID NO: 167755 - protein, 33 aa, Artificial Sequence
  Description of Artificial Sequence: Synthetic polypeptide
QEMEIATTNPVATEGYGVVCAASDTLVEFEGND

SEQ ID NO: 167756 - protein, 36 aa, Artificial Sequence
  Description of Artificial Sequence: Synthetic polypeptide
QEGEIRTTNPVATEQYGSVSWTMPDPNTNGSQEHIF

SEQ ID NO: 167757 - protein, 33 aa, Artificial Sequence
  Description of Artificial Sequence: Synthetic polypeptide
DEDEICTTNPVAYEQYGSVCAAAFTNHDDTEAW

SEQ ID NO: 167758 - protein, 36 aa, Artificial Sequence
  Description of Artificial Sequence: Synthetic polypeptide
DEQEIATTNPVATEQYGCVAATSGNPQAEMEPENRH

SEQ ID NO: 167759 - protein, 36 aa, Artificial Sequence
  Description of Artificial Sequence: Synthetic polypeptide
DEMEIRTTNPVATEQYGSVTPWTNSTESFPGDVFAW

SEQ ID NO: 167760 - protein, 36 aa, Artificial Sequence
  Description of Artificial Sequence: Synthetic polypeptide
DEQEIATTNPVATEQYGCVAATTNMNQTASGDNNQG

SEQ ID NO: 167761 - protein, 34 aa, Artificial Sequence
  Description of Artificial Sequence: Synthetic polypeptide
DEDEIATTNPVAYEQYGSVAGTGGVTTAENGNEK

SEQ ID NO: 167762 - protein, 35 aa, Artificial Sequence
  Description of Artificial Sequence: Synthetic polypeptide
DEEEIRTTNPVATEQYGCTCSWGEHNQNFNSDNQA

SEQ ID NO: 167763 - protein, 37 aa, Artificial Sequence
  Description of Artificial Sequence: Synthetic polypeptide
DEEEIRTTNPVATEQYGSVIGPTPNLDGMPVLEDEDQ

SEQ ID NO: 167764 - protein, 35 aa, Artificial Sequence
  Description of Artificial Sequence: Synthetic polypeptide
VEEEIATTNPVATEQYGVVPCWDNHGQDRQGGKTT

SEQ ID NO: 167765 - protein, 36 aa, Artificial Sequence
  Description of Artificial Sequence: Synthetic polypeptide
DESEIRTTNPVATEQYGCVCSNTGEDHNQNFGSEQA

SEQ ID NO: 167766 - protein, 31 aa, Artificial Sequence
  Description of Artificial Sequence: Synthetic polypeptide
DDSEVASTNPVSTEGYGAVAANTIQSRVGQR

SEQ ID NO: 167767 - protein, 35 aa, Artificial Sequence
  Description of Artificial Sequence: Synthetic polypeptide
DEEEIRTTNPVATEQYGVCVHPSPVNMSNPDMFEL

SEQ ID NO: 167768 - protein, 31 aa, Artificial Sequence
  Description of Artificial Sequence: Synthetic polypeptide
QEEEIATTNPVATEQYGEAPYEVCEQHEESK

SEQ ID NO: 167769 - protein, 36 aa, Artificial Sequence
  Description of Artificial Sequence: Synthetic polypeptide
DEAEIRTTNPVATEQYGSVSVGAANQDTGYSEEVEG

SEQ ID NO: 167770 - protein, 31 aa, Artificial Sequence
  Description of Artificial Sequence: Synthetic polypeptide
DDSEVASTNPVATEGYGNVAANTIESREGER

SEQ ID NO: 167771 - protein, 35 aa, Artificial Sequence
  Description of Artificial Sequence: Synthetic polypeptide
DEEEIRTTNPVATEQYGVCVYPSPNNEPEVDMFEA

SEQ ID NO: 167772 - protein, 35 aa, Artificial Sequence
  Description of Artificial Sequence: Synthetic polypeptide
DEEEIRTTNPVATEQYGVCVYPSPMNMPNVDMFEA

SEQ ID NO: 167773 - protein, 36 aa, Artificial Sequence
  Description of Artificial Sequence: Synthetic polypeptide
DEEEIRTTNPVATEQYGVCVVPSPVSMVNFVDMFEG

SEQ ID NO: 167774 - protein, 32 aa, Artificial Sequence
  Description of Artificial Sequence: Synthetic polypeptide
TTTEIATTNPVAYEQWGSVSHMLDLNQQGGEE

SEQ ID NO: 167775 - protein, 36 aa, Artificial Sequence
  Description of Artificial Sequence: Synthetic polypeptide
DEDEIATTNPVAYEQYGSVAIANNDLDPATGNDSRY

SEQ ID NO: 167776 - protein, 32 aa, Artificial Sequence
  Description of Artificial Sequence: Synthetic polypeptide
QEMEIATTNPVATECYGTVCSAEDGLEFEEND

SEQ ID NO: 167777 - protein, 36 aa, Artificial Sequence
  Description of Artificial Sequence: Synthetic polypeptide
DEMEIRTTNPVATEQYGSVTATVPSHEERDEDGMMD

SEQ ID NO: 167778 - protein, 32 aa, Artificial Sequence
  Description of Artificial Sequence: Synthetic polypeptide
CEDEIACTNPVATEQYGCVAGTGLAANPTNQD

SEQ ID NO: 167779 - protein, 37 aa, Artificial Sequence
  Description of Artificial Sequence: Synthetic polypeptide
DEEEIRTTNPVATEQYGSVIGPTQNLDHMPVLEIEPT

SEQ ID NO: 167780 - protein, 31 aa, Artificial Sequence
  Description of Artificial Sequence: Synthetic polypeptide
QEMEIATTNPVATECYGTVCSATDCPEHEEL

SEQ ID NO: 167781 - protein, 36 aa, Artificial Sequence
  Description of Artificial Sequence: Synthetic polypeptide
DEMEIRTTNPVATEQYGSVTATVPSHEERDMGEMMN

SEQ ID NO: 167782 - protein, 34 aa, Artificial Sequence
  Description of Artificial Sequence: Synthetic polypeptide
CEDEIACTNPVATEQYGCVAGTNHHQAEAAGMNN

SEQ ID NO: 167783 - protein, 34 aa, Artificial Sequence
  Description of Artificial Sequence: Synthetic polypeptide
CAEEIATTNPVATAQWGSVSGTGNPDNADGEGNH

SEQ ID NO: 167784 - protein, 35 aa, Artificial Sequence
  Description of Artificial Sequence: Synthetic polypeptide
TTTEIATTNPVATEQYGSVSWNDNQEQERGGGDGA

SEQ ID NO: 167785 - protein, 31 aa, Artificial Sequence
  Description of Artificial Sequence: Synthetic polypeptide
QEMEIATTNPVATECYGTVCSATDGPEHEEL

SEQ ID NO: 167786 - protein, 34 aa, Artificial Sequence
  Description of Artificial Sequence: Synthetic polypeptide
CAEEIATTNPVATEQWGSVSPGPEPQEHGDNSAA

SEQ ID NO: 167787 - protein, 31 aa, Artificial Sequence
  Description of Artificial Sequence: Synthetic polypeptide
DDSEVASTNPVATEGYGNVAANTIESRVGER

SEQ ID NO: 167788 - protein, 34 aa, Artificial Sequence
  Description of Artificial Sequence: Synthetic polypeptide
DEEEIATTNPVATEQYGCSAANGPEATMPNGEMR

SEQ ID NO: 167789 - protein, 34 aa, Artificial Sequence
  Description of Artificial Sequence: Synthetic polypeptide
TTGEEIRTTNPVAYEQWGTVSGGNAGDLREGNSP

SEQ ID NO: 167790 - protein, 33 aa, Artificial Sequence
  Description of Artificial Sequence: Synthetic polypeptide
DEQEIATTNPVATEQWGATVSAADLEEHKGPYI

SEQ ID NO: 167791 - protein, 33 aa, Artificial Sequence
  Description of Artificial Sequence: Synthetic polypeptide
DEQEIATTNPVATEQWGATVSAADLAEHKGPYI

SEQ ID NO: 167792 - protein, 35 aa, Artificial Sequence
  Description of Artificial Sequence: Synthetic polypeptide
DEDEICTTNPVATECYGVVATGNEGNQGGHGNGNA

SEQ ID NO: 167793 - protein, 34 aa, Artificial Sequence
  Description of Artificial Sequence: Synthetic polypeptide
DEQEIATTNPVATEQWGANTTAATNHLAGMPNRN

SEQ ID NO: 167794 - protein, 37 aa, Artificial Sequence
  Description of Artificial Sequence: Synthetic polypeptide
DEEEIATTNPVATEQYGCSAAAVTNDLTQTDDGMGEH

SEQ ID NO: 167795 - protein, 33 aa, Artificial Sequence
  Description of Artificial Sequence: Synthetic polypeptide
DEQEIATTNPVATEPYGTISATEDLEDHEGEDL

SEQ ID NO: 167796 - protein, 33 aa, Artificial Sequence
  Description of Artificial Sequence: Synthetic polypeptide
CEEEIKTTNPTATEPYGKVVPFTTALSHPEGNP

SEQ ID NO: 167797 - protein, 31 aa, Artificial Sequence
  Description of Artificial Sequence: Synthetic polypeptide
DDSEVASTNPVATEGYGNVAANTIESRVGQR

SEQ ID NO: 167798 - protein, 31 aa, Artificial Sequence
  Description of Artificial Sequence: Synthetic polypeptide
QEEEIATTNPVATEQYGEIAPEVEQHEVEKY

SEQ ID NO: 167799 - protein, 32 aa, Artificial Sequence
  Description of Artificial Sequence: Synthetic polypeptide
DEDEIATTNPVAYERWGCVCDTNDQHDGDDAS

SEQ ID NO: 167800 - protein, 32 aa, Artificial Sequence
  Description of Artificial Sequence: Synthetic polypeptide
QEMEIACTNPCSYEQYGCVCSWNLQSSGSERA

SEQ ID NO: 167801 - protein, 38 aa, Artificial Sequence
  Description of Artificial Sequence: Synthetic polypeptide
DEEEIRTTNPVATEQYGVVSTVVNNNNQQGEEETEEDT

SEQ ID NO: 167802 - protein, 35 aa, Artificial Sequence
  Description of Artificial Sequence: Synthetic polypeptide
DEQEIATTNPVATEQWGSVSATGDMADSGGDEDNP

SEQ ID NO: 167803 - protein, 36 aa, Artificial Sequence
  Description of Artificial Sequence: Synthetic polypeptide
DEEEIRTTNPVATEQYGCVCGNSGEHNIEHFNSDQS

SEQ ID NO: 167804 - protein, 33 aa, Artificial Sequence
  Description of Artificial Sequence: Synthetic polypeptide
DEQEIATTNPVATEQYGCVAANGDEPTGEGGTP

SEQ ID NO: 167805 - protein, 31 aa, Artificial Sequence
  Description of Artificial Sequence: Synthetic polypeptide
DDSEVASTNPVGTEGYGNVAANTIQDRVGQR

SEQ ID NO: 167806 - protein, 34 aa, Artificial Sequence
  Description of Artificial Sequence: Synthetic polypeptide
DEAEIATTNPVAYEEWGVVCSTDNGNEQDGDGRR

SEQ ID NO: 167807 - protein, 33 aa, Artificial Sequence
  Description of Artificial Sequence: Synthetic polypeptide
DEQEIATTNPVATEQYGCVAANGDGATHNGDPV

SEQ ID NO: 167808 - protein, 39 aa, Artificial Sequence
  Description of Artificial Sequence: Synthetic polypeptide
DEEEIRTTNPVATEAYGVVSTTNLQSGNNQNQNGTEQGS

SEQ ID NO: 167809 - protein, 35 aa, Artificial Sequence
  Description of Artificial Sequence: Synthetic polypeptide
DEQEIATTNPVATEQWGSVSATGDLEADTPQGEDH

SEQ ID NO: 167810 - protein, 37 aa, Artificial Sequence
  Description of Artificial Sequence: Synthetic polypeptide
DEEEIRTTNPVATEQYGCVCGNSGEHNQEGFNSDNQG

SEQ ID NO: 167811 - protein, 35 aa, Artificial Sequence
  Description of Artificial Sequence: Synthetic polypeptide
DEQEIATTNPVATEQWGSVSATGDLEADTPGEDQM

SEQ ID NO: 167812 - protein, 35 aa, Artificial Sequence
  Description of Artificial Sequence: Synthetic polypeptide
DEQEIATTNPVATEQWGSVSATGDLEADTEIGEDA

SEQ ID NO: 167813 - protein, 33 aa, Artificial Sequence
  Description of Artificial Sequence: Synthetic polypeptide
VEDEIATTNPVATEPYGNVCAGNNLTTAGGNEQ

SEQ ID NO: 167814 - protein, 35 aa, Artificial Sequence
  Description of Artificial Sequence: Synthetic polypeptide
DEQEIATTNPVATEQWGSVSATGDLDTDHQGDEDN

SEQ ID NO: 167815 - protein, 35 aa, Artificial Sequence
  Description of Artificial Sequence: Synthetic polypeptide
DEAEIATTNPVATEQYGSVPCWDNHGQQGQGGKAS

SEQ ID NO: 167816 - protein, 35 aa, Artificial Sequence
  Description of Artificial Sequence: Synthetic polypeptide
DEDEIATTNPVAYEQYGSVSANGPTGPDDQMNNNM

SEQ ID NO: 167817 - protein, 37 aa, Artificial Sequence
  Description of Artificial Sequence: Synthetic polypeptide
DEEEIRTTNPVATEQYGSVIGPTWNLDGMPVLEIPDQ

SEQ ID NO: 167818 - protein, 38 aa, Artificial Sequence
  Description of Artificial Sequence: Synthetic polypeptide
DEEEIRTTNPVATEQYGSVCSPEGNTHDIPQQNEVNNI

SEQ ID NO: 167819 - protein, 35 aa, Artificial Sequence
  Description of Artificial Sequence: Synthetic polypeptide
DEEEIRTTNPVATEQYGCVCGNSMEDIENFGSDQA

SEQ ID NO: 167820 - protein, 36 aa, Artificial Sequence
  Description of Artificial Sequence: Synthetic polypeptide
DEEEIRTTNPVATEQYGCVCGNTEEHNQYFNSENQA

SEQ ID NO: 167821 - protein, 30 aa, Artificial Sequence
  Description of Artificial Sequence: Synthetic polypeptide
DDSEVASTNPVCTEGYGVVADNIQSRVGQQ

SEQ ID NO: 167822 - protein, 37 aa, Artificial Sequence
  Description of Artificial Sequence: Synthetic polypeptide
DEEEIRTTNPVATEQYGVVATVTQQQGNQALGTEQGQ

SEQ ID NO: 167823 - protein, 35 aa, Artificial Sequence
  Description of Artificial Sequence: Synthetic polypeptide
DESEIRTTNPVATEQYGVIVSDMEGGGEQDIEGGD

SEQ ID NO: 167824 - protein, 34 aa, Artificial Sequence
  Description of Artificial Sequence: Synthetic polypeptide
DEQEIATTNPVATEQYGCVAANGGDATMPGGDPR

SEQ ID NO: 167825 - protein, 33 aa, Artificial Sequence
  Description of Artificial Sequence: Synthetic polypeptide
DEDEIATTNPVAYEQYGSVATHGTGAPDGSMIN

SEQ ID NO: 167826 - protein, 35 aa, Artificial Sequence
  Description of Artificial Sequence: Synthetic polypeptide
DEDEIATTNPVAYEQYGSVSANNLGQLHQDDTMEH

SEQ ID NO: 167827 - protein, 35 aa, Artificial Sequence
  Description of Artificial Sequence: Synthetic polypeptide
DEQEIATTNPVATEQWGSVSATGDLDNHQGEEDLN

SEQ ID NO: 167828 - protein, 31 aa, Artificial Sequence
  Description of Artificial Sequence: Synthetic polypeptide
DDSEVASTNPVCTEGYGVVAANNIQSRVGQR

SEQ ID NO: 167829 - protein, 34 aa, Artificial Sequence
  Description of Artificial Sequence: Synthetic polypeptide
DEAEIATTNPVAYECWGVVSNDNLGEERSGEDSR

SEQ ID NO: 167830 - protein, 35 aa, Artificial Sequence
  Description of Artificial Sequence: Synthetic polypeptide
DEQEIATTNPVATEQWGSVSATGDMADTGGGEDNV

SEQ ID NO: 167831 - protein, 39 aa, Artificial Sequence
  Description of Artificial Sequence: Synthetic polypeptide
DEEEIRTTNPVATEAYGVVSTTNLQQGNLQGQIGTEQGS

SEQ ID NO: 167832 - protein, 36 aa, Artificial Sequence
  Description of Artificial Sequence: Synthetic polypeptide
CTGEIRTTNPVATEQYGSVVDQTENAFQEEGNGGGI

SEQ ID NO: 167833 - protein, 30 aa, Artificial Sequence
  Description of Artificial Sequence: Synthetic polypeptide
DDSEVASTNPVGTEGYGNVASTIQSRVGDI

SEQ ID NO: 167834 - protein, 39 aa, Artificial Sequence
  Description of Artificial Sequence: Synthetic polypeptide
DEEEIRTTNPVATEAYGVVSTTNLQQGNNNQQQGTEQGS

SEQ ID NO: 167835 - protein, 36 aa, Artificial Sequence
  Description of Artificial Sequence: Synthetic polypeptide
DEEEIRTVNPVATEQYGCVCSTEEHNQEYFNSQNQS

SEQ ID NO: 167836 - protein, 34 aa, Artificial Sequence
  Description of Artificial Sequence: Synthetic polypeptide
VEDEIATTNPVATEQWGSVSATGDLDNHQGEDAD

SEQ ID NO: 167837 - protein, 31 aa, Artificial Sequence
  Description of Artificial Sequence: Synthetic polypeptide
DDSEVASTNPVGTEGYGNVAASTIQSRVGDR

SEQ ID NO: 167838 - protein, 31 aa, Artificial Sequence
  Description of Artificial Sequence: Synthetic polypeptide
QEEEIATTNPVATEQYGEIAPEVAQHEVETV

SEQ ID NO: 167839 - protein, 34 aa, Artificial Sequence
  Description of Artificial Sequence: Synthetic polypeptide
VEDEIATTNPVATEQWGSVAITNNPEDPGEENNM

SEQ ID NO: 167840 - protein, 29 aa, Artificial Sequence
  Description of Artificial Sequence: Synthetic peptide
QEHEIATTNPVATEIYGEAPEVCCQHEEK

SEQ ID NO: 167841 - protein, 39 aa, Artificial Sequence
  Description of Artificial Sequence: Synthetic polypeptide
DEEEIRTTNPVATEAYGVVSTTNLQQGNNQGQQGTEQGT

SEQ ID NO: 167842 - protein, 39 aa, Artificial Sequence
  Description of Artificial Sequence: Synthetic polypeptide
DESEIRTTNPVATEQYGSVVSNMNLVGDDQDQGDDDGNT

SEQ ID NO: 167843 - protein, 35 aa, Artificial Sequence
  Description of Artificial Sequence: Synthetic polypeptide
DEEEIRTTNPVATEQYGCVCGNSGEDAENFNSDQS

SEQ ID NO: 167844 - protein, 37 aa, Artificial Sequence
  Description of Artificial Sequence: Synthetic polypeptide
DEEEIRTTNPVATEQYGVVCSPENQVDQPDQNEQNNI

SEQ ID NO: 167845 - protein, 33 aa, Artificial Sequence
  Description of Artificial Sequence: Synthetic polypeptide
VEDEIATTNPVATEQWGCVAGTGLVIDNMEMRD

SEQ ID NO: 167846 - protein, 32 aa, Artificial Sequence
  Description of Artificial Sequence: Synthetic polypeptide
VEDEIATTNPVATEQWGCVAGTGLISNMEMRG

SEQ ID NO: 167847 - protein, 31 aa, Artificial Sequence
  Description of Artificial Sequence: Synthetic polypeptide
QEEEIATTNPVATEQYGEFCPWADNQHNSEQ

SEQ ID NO: 167848 - protein, 36 aa, Artificial Sequence
  Description of Artificial Sequence: Synthetic polypeptide
DEQEIATTNPVATEQWGSVSATGDMGADHQGGEDNH

SEQ ID NO: 167849 - protein, 34 aa, Artificial Sequence
  Description of Artificial Sequence: Synthetic polypeptide
DEAEIATTNPVAYECWGVVCSTDNGMEQDGDIRR

SEQ ID NO: 167850 - protein, 36 aa, Artificial Sequence
  Description of Artificial Sequence: Synthetic polypeptide
CDEEEVIRTTNPVAYECWGVVSYTEMLSFRTVDNNR

SEQ ID NO: 167851 - protein, 36 aa, Artificial Sequence
  Description of Artificial Sequence: Synthetic polypeptide
DESEIRTTNPVATEQYGSVVVDGFGQENDQDEDGST

SEQ ID NO: 167852 - protein, 34 aa, Artificial Sequence
  Description of Artificial Sequence: Synthetic polypeptide
DEQEIATTNPVATEQWGSVSATGDMEDHQGEEDA

SEQ ID NO: 167853 - protein, 31 aa, Artificial Sequence
  Description of Artificial Sequence: Synthetic polypeptide
DDSEVASTNPVGTEGYGNVAANTIQSRVGQR

SEQ ID NO: 167854 - protein, 34 aa, Artificial Sequence
  Description of Artificial Sequence: Synthetic polypeptide
DEAEIATTNPVAYECWGVVCSTWNGQEQDGDGER

SEQ ID NO: 167855 - protein, 35 aa, Artificial Sequence
  Description of Artificial Sequence: Synthetic polypeptide
DEQEIATTNPVATEQWGSVSATGDMEDHGGGEDNH

SEQ ID NO: 167856 - protein, 34 aa, Artificial Sequence
  Description of Artificial Sequence: Synthetic polypeptide
DEQEIATTNPVATEQWGSVSATGDMEDHELGEDN

SEQ ID NO: 167857 - protein, 39 aa, Artificial Sequence
  Description of Artificial Sequence: Synthetic polypeptide
DEEEIRTTNPVATEAYGVVSTTNLQQGNNQQQNGTEQGA

SEQ ID NO: 167858 - protein, 34 aa, Artificial Sequence
  Description of Artificial Sequence: Synthetic polypeptide
DEDEIATTNPVAYEQYGSVAMNDTATGNGNDEHL

SEQ ID NO: 167859 - protein, 37 aa, Artificial Sequence
  Description of Artificial Sequence: Synthetic polypeptide
DEEEIRTTNPVATEQYGVVATVTQQLQAGTEQGSTDD

SEQ ID NO: 167860 - protein, 35 aa, Artificial Sequence
  Description of Artificial Sequence: Synthetic polypeptide
DEQEIATTNPVATEQWGSVSATDPLEDHGGIEDHQ

SEQ ID NO: 167861 - protein, 36 aa, Artificial Sequence
  Description of Artificial Sequence: Synthetic polypeptide
DEMEIRTTNPVATEQYGSVSVPSMLTEEEYTQESRF

SEQ ID NO: 167862 - protein, 35 aa, Artificial Sequence
  Description of Artificial Sequence: Synthetic polypeptide
DEDEIATTNPVAYEQYGSVTSAANQLDSNNPPVPQ

SEQ ID NO: 167863 - protein, 36 aa, Artificial Sequence
  Description of Artificial Sequence: Synthetic polypeptide
DEDEIATTNPVAYEQYGSVVAAANGELQDSKGGNMS

SEQ ID NO: 167864 - protein, 34 aa, Artificial Sequence
  Description of Artificial Sequence: Synthetic polypeptide
VEEEIATTNPVATEQYGSVCAMNNEEAPDNQENH

SEQ ID NO: 167865 - protein, 32 aa, Artificial Sequence
  Description of Artificial Sequence: Synthetic polypeptide
VEDEIACTNPVATEQYGCVATNLADAPAEDTA

SEQ ID NO: 167866 - protein, 32 aa, Artificial Sequence
  Description of Artificial Sequence: Synthetic polypeptide
DEQEIATTNPVATEQWGSVSAEDEMDHAEEDL

SEQ ID NO: 167867 - protein, 32 aa, Artificial Sequence
  Description of Artificial Sequence: Synthetic polypeptide
DEQEIATTNPVATEQWGSVSAEDEMDHAEEDA

SEQ ID NO: 167868 - protein, 34 aa, Artificial Sequence
  Description of Artificial Sequence: Synthetic polypeptide
DEDEIATTNPVAYEQYGSVANMNDTATGNGDEHP

SEQ ID NO: 167869 - protein, 37 aa, Artificial Sequence
  Description of Artificial Sequence: Synthetic polypeptide
DEEEIRTTNPVATEQYGVVATQLQQLQAGTEQGTTDD

SEQ ID NO: 167870 - protein, 37 aa, Artificial Sequence
  Description of Artificial Sequence: Synthetic polypeptide
DEEEIRTTNPVATEQYGVVATNVATEQYGSTTQQSQD

SEQ ID NO: 167871 - protein, 33 aa, Artificial Sequence
  Description of Artificial Sequence: Synthetic polypeptide
DDSEVASTNPVATEGYGTVAANDTIVQSRVGNR

SEQ ID NO: 167872 - protein, 35 aa, Artificial Sequence
  Description of Artificial Sequence: Synthetic polypeptide
DEAEIATTNPVAYEGWGSVCSGTDNQDRDGGQNKQ

SEQ ID NO: 167873 - protein, 35 aa, Artificial Sequence
  Description of Artificial Sequence: Synthetic polypeptide
DEEEIRTTNPVATEQYGCVCGWEEHNEENFNSDQA

SEQ ID NO: 167874 - protein, 31 aa, Artificial Sequence
  Description of Artificial Sequence: Synthetic polypeptide
QEMEIACTNPCSYEQYGCVCSWELQSSGSDR

SEQ ID NO: 167875 - protein, 32 aa, Artificial Sequence
  Description of Artificial Sequence: Synthetic polypeptide
VEDEIACTNPVATEQYGCVAGTGLAANPNQDE

SEQ ID NO: 167876 - protein, 31 aa, Artificial Sequence
  Description of Artificial Sequence: Synthetic polypeptide
DDSEVASTNPVATEGYGSVAATDIESHEGER

SEQ ID NO: 167877 - protein, 34 aa, Artificial Sequence
  Description of Artificial Sequence: Synthetic polypeptide
DEAEIATTNPVAYEGWGSVCSGTDNQDRHGGPEQ

SEQ ID NO: 167878 - protein, 34 aa, Artificial Sequence
  Description of Artificial Sequence: Synthetic polypeptide
DEQEIATTNPVATEQWGSVAATGDLEADTPGEDH

SEQ ID NO: 167879 - protein, 35 aa, Artificial Sequence
  Description of Artificial Sequence: Synthetic polypeptide
DEDEIATTNPVAYEQYGTVATSNGGMQNGGQRGED

SEQ ID NO: 167880 - protein, 34 aa, Artificial Sequence
  Description of Artificial Sequence: Synthetic polypeptide
DEQEIATTNPVATEQWGSCSATGDLDNHQGEDAM

SEQ ID NO: 167881 - protein, 31 aa, Artificial Sequence
  Description of Artificial Sequence: Synthetic polypeptide
DDSEVASTNPVATEGYGSVAANTIESHEGER

SEQ ID NO: 167882 - protein, 36 aa, Artificial Sequence
  Description of Artificial Sequence: Synthetic polypeptide
DEEEIRTTNPVATEQYGCVCQNTGEDLIEYFGSDQS

SEQ ID NO: 167883 - protein, 32 aa, Artificial Sequence
  Description of Artificial Sequence: Synthetic polypeptide
QEMEIACTNPCSYEQYGCVCSWNLNQSFGSER

SEQ ID NO: 167884 - protein, 31 aa, Artificial Sequence
  Description of Artificial Sequence: Synthetic polypeptide
DDSEVASTNPVATEGYGSVAANDIESHEGER

SEQ ID NO: 167885 - protein, 32 aa, Artificial Sequence
  Description of Artificial Sequence: Synthetic polypeptide
DDSEVASTNPVATEGYGNVWAANTIQSRVGQR

SEQ ID NO: 167886 - protein, 35 aa, Artificial Sequence
  Description of Artificial Sequence: Synthetic polypeptide
DEQEIATTNPVATEQWGHVVANTGNGEAGAEGGNR

SEQ ID NO: 167887 - protein, 35 aa, Artificial Sequence
  Description of Artificial Sequence: Synthetic polypeptide
DEDEIATTNPVAYEQYGTVATNMGGQQNGGQRGEA

SEQ ID NO: 167888 - protein, 37 aa, Artificial Sequence
  Description of Artificial Sequence: Synthetic polypeptide
DEEEIRTTNPVATEAYGVVSTTNNGEQGNNQEDEEDE

SEQ ID NO: 167889 - protein, 36 aa, Artificial Sequence
  Description of Artificial Sequence: Synthetic polypeptide
DEAEIATTNPVATEQYGSVCSVAPPAQAHQGDNEGP

SEQ ID NO: 167890 - protein, 32 aa, Artificial Sequence
  Description of Artificial Sequence: Synthetic polypeptide
DDSEVASTNPVATEQYGNVAANTIQSHVGQDR

SEQ ID NO: 167891 - protein, 38 aa, Artificial Sequence
  Description of Artificial Sequence: Synthetic polypeptide
DEEEIRTTNPVATEAYGVVSTTNNGNQQGNNQNDEEDE

SEQ ID NO: 167892 - protein, 37 aa, Artificial Sequence
  Description of Artificial Sequence: Synthetic polypeptide
DEEEIRTTNPVATEQYGVVATVNPNNQQQGEGDEEDE

SEQ ID NO: 167893 - protein, 37 aa, Artificial Sequence
  Description of Artificial Sequence: Synthetic polypeptide
DEEEIRTTNPVATEQYGVVATVNPNNNQQGEEDEETE

SEQ ID NO: 167894 - protein, 38 aa, Artificial Sequence
  Description of Artificial Sequence: Synthetic polypeptide
DEEEIRTTNPVATEQYGVVATVNNNNLQQGEQDEEDES

SEQ ID NO: 167895 - protein, 37 aa, Artificial Sequence
  Description of Artificial Sequence: Synthetic polypeptide
DEEEIRTTNPVATEQYGVVATTQQQLQAGTEEGTEDE

SEQ ID NO: 167896 - protein, 37 aa, Artificial Sequence
  Description of Artificial Sequence: Synthetic polypeptide
DEEEIRTTNPVATEQYGSVISPAMSTQTIVTTQVLDG

SEQ ID NO: 167897 - protein, 33 aa, Artificial Sequence
  Description of Artificial Sequence: Synthetic polypeptide
DEQEIATTNPVATEQYGCVAANHSGDAMNPAEG

SEQ ID NO: 167898 - protein, 34 aa, Artificial Sequence
  Description of Artificial Sequence: Synthetic polypeptide
DEQEIATTNPVATEQYGCVAANNALEATMNPENM

SEQ ID NO: 167899 - protein, 31 aa, Artificial Sequence
  Description of Artificial Sequence: Synthetic polypeptide
DDSEVASTNPVCTEGYGNVAANTNQSRVGQR

SEQ ID NO: 167900 - protein, 36 aa, Artificial Sequence
  Description of Artificial Sequence: Synthetic polypeptide
DEEEIRTTNPVATEQYGCVCGNTGEHQENFNSQNQA

SEQ ID NO: 167901 - protein, 35 aa, Artificial Sequence
  Description of Artificial Sequence: Synthetic polypeptide
DEEEIRTTNPVATEQYGCVCGNTGELIEHFISDQS

SEQ ID NO: 167902 - protein, 35 aa, Artificial Sequence
  Description of Artificial Sequence: Synthetic polypeptide
DEEEIRTTNPVATEQYGCVCGNTGEPIEYFGSDQS

SEQ ID NO: 167903 - protein, 33 aa, Artificial Sequence
  Description of Artificial Sequence: Synthetic polypeptide
DEQEIATTNPVATEQYGCVAANNGDADTGGDPE

SEQ ID NO: 167904 - protein, 31 aa, Artificial Sequence
  Description of Artificial Sequence: Synthetic polypeptide
DDSEVASTNPVCTEGYGNVAANTIQSRVGQR

SEQ ID NO: 167905 - protein, 33 aa, Artificial Sequence
  Description of Artificial Sequence: Synthetic polypeptide
DEDEIATTNPVAYEQYGSVATAGTPTANNDELN

SEQ ID NO: 167906 - protein, 31 aa, Artificial Sequence
  Description of Artificial Sequence: Synthetic polypeptide
DDSEVASTNPVATVGYGNVAANTIQSRVGQR

SEQ ID NO: 167907 - protein, 32 aa, Artificial Sequence
  Description of Artificial Sequence: Synthetic polypeptide
DDSEVASTNPVATEQYGSVAATTIQDHVGQDL

SEQ ID NO: 167908 - protein, 36 aa, Artificial Sequence
  Description of Artificial Sequence: Synthetic polypeptide
DEEEIRTTNPVATEQYGCVCGNTGPHNQNFNSENQS

SEQ ID NO: 167909 - protein, 36 aa, Artificial Sequence
  Description of Artificial Sequence: Synthetic polypeptide
DEEEIRTVNPVATEQYGCVCSNTEEDNQEYFNSQQS

SEQ ID NO: 167910 - protein, 34 aa, Artificial Sequence
  Description of Artificial Sequence: Synthetic polypeptide
DEAEIATTNPVATEQYGSVHVSQLNTVEDEEEQN

SEQ ID NO: 167911 - protein, 36 aa, Artificial Sequence
  Description of Artificial Sequence: Synthetic polypeptide
DEEEIRTTNPVATEQYGCVCGSGEHNQENFNSETQA

SEQ ID NO: 167912 - protein, 33 aa, Artificial Sequence
  Description of Artificial Sequence: Synthetic polypeptide
DEQEIATTNPVATEQYGCVAANNDATMPPGETH

SEQ ID NO: 167913 - protein, 35 aa, Artificial Sequence
  Description of Artificial Sequence: Synthetic polypeptide
DEQEIATTNPVATEQWGSVSANGDMEDHQGEEDNP

SEQ ID NO: 167914 - protein, 34 aa, Artificial Sequence
  Description of Artificial Sequence: Synthetic polypeptide
DEQEIATTNPVATEQWGSVSANGDMADTGGGEDL

SEQ ID NO: 167915 - protein, 35 aa, Artificial Sequence
  Description of Artificial Sequence: Synthetic polypeptide
DEQEIATTNPVATEQWGSVSANGDLEADTPGEDHW

SEQ ID NO: 167916 - protein, 35 aa, Artificial Sequence
  Description of Artificial Sequence: Synthetic polypeptide
DEQEIATTNPVATEQYGCVAANNGALTQNDHNNPE

SEQ ID NO: 167917 - protein, 36 aa, Artificial Sequence
  Description of Artificial Sequence: Synthetic polypeptide
DEMEIRTTNPVATEQYGSVSVMNEVEQDSFEDSIME

SEQ ID NO: 167918 - protein, 34 aa, Artificial Sequence
  Description of Artificial Sequence: Synthetic polypeptide
DEEEISTTNPVATEQYGCVCSNWPHANFNSETQA

SEQ ID NO: 167919 - protein, 37 aa, Artificial Sequence
  Description of Artificial Sequence: Synthetic polypeptide
DEHEIRTTNPVATEQYGSVESTPLNWAEEIYGDDIQI

SEQ ID NO: 167920 - protein, 37 aa, Artificial Sequence
  Description of Artificial Sequence: Synthetic polypeptide
DEHEIRTTNPVATEQYGSVESTPLNWAEEIGGDEVQN

SEQ ID NO: 167921 - protein, 35 aa, Artificial Sequence
  Description of Artificial Sequence: Synthetic polypeptide
DEMEIRTTNPVATEQYGSTTSNDVIMNQESIENPQ

SEQ ID NO: 167922 - protein, 33 aa, Artificial Sequence
  Description of Artificial Sequence: Synthetic polypeptide
DENEIVTTNPVSTEPYGTVCSATDDPVEFEGND

SEQ ID NO: 167923 - protein, 36 aa, Artificial Sequence
  Description of Artificial Sequence: Synthetic polypeptide
DEEEIRTTNPVATEQYGCVCSNSGEDHNAFFGSEQP

SEQ ID NO: 167924 - protein, 32 aa, Artificial Sequence
  Description of Artificial Sequence: Synthetic polypeptide
DENEIVTTNPVSTEPYGTISMEDIQQQQNGNH

SEQ ID NO: 167925 - protein, 32 aa, Artificial Sequence
  Description of Artificial Sequence: Synthetic polypeptide
DENEIVTTNPVSTEPYGTISMEDIQQQQNGND

SEQ ID NO: 167926 - protein, 32 aa, Artificial Sequence
  Description of Artificial Sequence: Synthetic polypeptide
DENEIVTTNPVSTEPYGTISMEDIQQQQIGNH

SEQ ID NO: 167927 - protein, 32 aa, Artificial Sequence
  Description of Artificial Sequence: Synthetic polypeptide
DENEIVTTNPVSTEPYGTISMDDIQQQQNGNH

SEQ ID NO: 167928 - protein, 32 aa, Artificial Sequence
  Description of Artificial Sequence: Synthetic polypeptide
DENEIVTTNPVSTEPYGTISMDDIQQQFNGNH

SEQ ID NO: 167929 - protein, 35 aa, Artificial Sequence
  Description of Artificial Sequence: Synthetic polypeptide
DEQEIATTNPVATEQYGSVAATMTPLDNGMMGETA

SEQ ID NO: 167930 - protein, 34 aa, Artificial Sequence
  Description of Artificial Sequence: Synthetic polypeptide
DEDEIATTNPVAYEQWGQSVAQNDGDQTAGGITR

SEQ ID NO: 167931 - protein, 34 aa, Artificial Sequence
  Description of Artificial Sequence: Synthetic polypeptide
DEEEIATTNPVAYEQWGSVSGGNGNEVGEEGDTS

SEQ ID NO: 167932 - protein, 35 aa, Artificial Sequence
  Description of Artificial Sequence: Synthetic polypeptide
DEAEIRTTNPVATEQYGSVNNTIEPEVEMGHEVSL

SEQ ID NO: 167933 - protein, 36 aa, Artificial Sequence
  Description of Artificial Sequence: Synthetic polypeptide
DEAEIRTTNPVATEQYGSVNNTIEPDLVEGGGEESA

SEQ ID NO: 167934 - protein, 36 aa, Artificial Sequence
  Description of Artificial Sequence: Synthetic polypeptide
DEEEIATTNPVATEQWGCVAATATLTQPDDGMGDRM

SEQ ID NO: 167935 - protein, 35 aa, Artificial Sequence
  Description of Artificial Sequence: Synthetic polypeptide
DEAEIRTTNPVATEQYGSVNNPIEPLVEGGSEVSW

SEQ ID NO: 167936 - protein, 33 aa, Artificial Sequence
  Description of Artificial Sequence: Synthetic polypeptide
TENEIRTTNPVSTEPYGTITSMSDIQVQQNGNH

SEQ ID NO: 167937 - protein, 32 aa, Artificial Sequence
  Description of Artificial Sequence: Synthetic polypeptide
TENEIRTTNPVSTEPYGTISMEDIQQVQNGNH

SEQ ID NO: 167938 - protein, 33 aa, Artificial Sequence
  Description of Artificial Sequence: Synthetic polypeptide
TENEIRTTNPVSTEPYGTISMEDIQQQQNGNHR

SEQ ID NO: 167939 - protein, 36 aa, Artificial Sequence
  Description of Artificial Sequence: Synthetic polypeptide
DEAEIRTTNPVATEQYGSVNNPEMTTLWEGGSEISG

SEQ ID NO: 167940 - protein, 35 aa, Artificial Sequence
  Description of Artificial Sequence: Synthetic polypeptide
DEDEIATTNPVAYEQWGQSTATNNDLTQPDGMGDR

SEQ ID NO: 167941 - protein, 32 aa, Artificial Sequence
  Description of Artificial Sequence: Synthetic polypeptide
TENEIRTTNPVSTEPYGTISMEDIQQQQNGNH

SEQ ID NO: 167942 - protein, 36 aa, Artificial Sequence
  Description of Artificial Sequence: Synthetic polypeptide
DEEEIRTTNPVATEQYGCSCSTGEDHNAENFISDQA

SEQ ID NO: 167943 - protein, 32 aa, Artificial Sequence
  Description of Artificial Sequence: Synthetic polypeptide
TENEIRTTNPVSTEPYGTISMEDIQQNQNGNH

SEQ ID NO: 167944 - protein, 32 aa, Artificial Sequence
  Description of Artificial Sequence: Synthetic polypeptide
TENEIRTTNPVSTEPYGTISMEDHSQQQNGNH

SEQ ID NO: 167945 - protein, 35 aa, Artificial Sequence
  Description of Artificial Sequence: Synthetic polypeptide
DEAEIRTTNPVATEQYGSVNNIEPVLVEGGSEESL

SEQ ID NO: 167946 - protein, 33 aa, Artificial Sequence
  Description of Artificial Sequence: Synthetic polypeptide
DESVIAATNPVAYEQWGCVPTWDLDQRMGDNKH

SEQ ID NO: 167947 - protein, 35 aa, Artificial Sequence
  Description of Artificial Sequence: Synthetic polypeptide
TEPEIRTTNPVATEQYGSVGPEYELMEINGNPTGI

SEQ ID NO: 167948 - protein, 33 aa, Artificial Sequence
  Description of Artificial Sequence: Synthetic polypeptide
DEMEIVTTNPCATEQYGTVCSARDGPVEFEGND

SEQ ID NO: 167949 - protein, 31 aa, Artificial Sequence
  Description of Artificial Sequence: Synthetic polypeptide
QEEEIATTNPVATEQYGTACPAEVCQHEEED

SEQ ID NO: 167950 - protein, 37 aa, Artificial Sequence
  Description of Artificial Sequence: Synthetic polypeptide
VEEEIRTTNPVATEQYGSVITVGVNGLGGDGEDADEF

SEQ ID NO: 167951 - protein, 36 aa, Artificial Sequence
  Description of Artificial Sequence: Synthetic polypeptide
TEQEIATTNPVATEQYGSTVSATGLSEDMEGGENVM

SEQ ID NO: 167952 - protein, 35 aa, Artificial Sequence
  Description of Artificial Sequence: Synthetic polypeptide
DEAEIATTNPVAYEQWGSVCSTWNDIQNQGDMEQP

SEQ ID NO: 167953 - protein, 30 aa, Artificial Sequence
  Description of Artificial Sequence: Synthetic polypeptide
DENEIYTTNPVAFEQWGDVSEIEMNAAEDA

SEQ ID NO: 167954 - protein, 33 aa, Artificial Sequence
  Description of Artificial Sequence: Synthetic polypeptide
DENEIWTTNPVSTEPYGTISMEDIQQQQNGNHR

SEQ ID NO: 167955 - protein, 31 aa, Artificial Sequence
  Description of Artificial Sequence: Synthetic polypeptide
AETEIACTNPIATEQYGETWSNEDLQPGGYI

SEQ ID NO: 167956 - protein, 32 aa, Artificial Sequence
  Description of Artificial Sequence: Synthetic polypeptide
DENEIWTTNPVSTEPYGTISMEDIQQQQNGNH

SEQ ID NO: 167957 - protein, 35 aa, Artificial Sequence
  Description of Artificial Sequence: Synthetic polypeptide
DEAEIATTNPVAYEQWGSVCSVNDNMDERQGGNSK

SEQ ID NO: 167958 - protein, 32 aa, Artificial Sequence
  Description of Artificial Sequence: Synthetic polypeptide
DENEIWTTNPVSTEPYGTISMEDEQQQQNGNH

SEQ ID NO: 167959 - protein, 36 aa, Artificial Sequence
  Description of Artificial Sequence: Synthetic polypeptide
DESTIRTTNPVATEFYGQVSIVSINGQGGGGDNDDE

SEQ ID NO: 167960 - protein, 37 aa, Artificial Sequence
  Description of Artificial Sequence: Synthetic polypeptide
DEHEIRTTNPVATEQYGSVSVANDVTEEIFMLQDHPI

SEQ ID NO: 167961 - protein, 38 aa, Artificial Sequence
  Description of Artificial Sequence: Synthetic polypeptide
DEEEIRTTNPVATEQYGTVSTVTNNNTTQQGTEEGSTD

SEQ ID NO: 167962 - protein, 35 aa, Artificial Sequence
  Description of Artificial Sequence: Synthetic polypeptide
DEAEIRTTNPVATEQYGSVNNIEPSLVEGGGEIML

SEQ ID NO: 167963 - protein, 34 aa, Artificial Sequence
  Description of Artificial Sequence: Synthetic polypeptide
DEEEIATTNPVATEQWGCVAGEGQLDNQMGGELH

SEQ ID NO: 167964 - protein, 36 aa, Artificial Sequence
  Description of Artificial Sequence: Synthetic polypeptide
DEAEIRTTNPVATEQYGSVNPGWNSLEFGEFEQQVM

SEQ ID NO: 167965 - protein, 34 aa, Artificial Sequence
  Description of Artificial Sequence: Synthetic polypeptide
DDECIRTTNPVATEQYGCVCSTEHNQNFISDTLS

SEQ ID NO: 167966 - protein, 37 aa, Artificial Sequence
  Description of Artificial Sequence: Synthetic polypeptide
DEHEIRTTNPVATEQYGSVSVPYRDLDEPRLQEDERQ

SEQ ID NO: 167967 - protein, 34 aa, Artificial Sequence
  Description of Artificial Sequence: Synthetic polypeptide
DESTIRTTNPVATEQYGDIVVIMNNDDEGGDNDQ

SEQ ID NO: 167968 - protein, 34 aa, Artificial Sequence
  Description of Artificial Sequence: Synthetic polypeptide
DEMEIRTTNPVATEQYGSVAFMPDLNKIEDSQSM

SEQ ID NO: 167969 - protein, 38 aa, Artificial Sequence
  Description of Artificial Sequence: Synthetic polypeptide
DEEEIRTTNPVATEAYGVVSTTNQQAGNTEQGGVTEDN

SEQ ID NO: 167970 - protein, 34 aa, Artificial Sequence
  Description of Artificial Sequence: Synthetic polypeptide
DENEIVTTNPVSTEQYGTVCSAMEDIQQQFNGNH

SEQ ID NO: 167971 - protein, 36 aa, Artificial Sequence
  Description of Artificial Sequence: Synthetic polypeptide
VEEEIRTTNPVATEQYGSVNGNVITAQALEIGQLDV

SEQ ID NO: 167972 - protein, 35 aa, Artificial Sequence
  Description of Artificial Sequence: Synthetic polypeptide
DEEEIRTTNPVAYEQYGQCVCSSGEHQENFGSDQS

SEQ ID NO: 167973 - protein, 34 aa, Artificial Sequence
  Description of Artificial Sequence: Synthetic polypeptide
CEDEIATTNPVATASWGSVSAANNEPLDRGDENG

SEQ ID NO: 167974 - protein, 34 aa, Artificial Sequence
  Description of Artificial Sequence: Synthetic polypeptide
CEDEIATTNPVATASWGSVSVANNTPQDRGGENG

SEQ ID NO: 167975 - protein, 36 aa, Artificial Sequence
  Description of Artificial Sequence: Synthetic polypeptide
CEDEIATTNPVATEIYGSVCSNWNDGQDRQGHGTER

SEQ ID NO: 167976 - protein, 35 aa, Artificial Sequence
  Description of Artificial Sequence: Synthetic polypeptide
DESTIRTTNPVATEQYGDIVLGIMNNDQGGGDNIQ

SEQ ID NO: 167977 - protein, 35 aa, Artificial Sequence
  Description of Artificial Sequence: Synthetic polypeptide
DEEEIRTTNPVAYEQYGQCVCSSNDDNINFGSDQF

SEQ ID NO: 167978 - protein, 33 aa, Artificial Sequence
  Description of Artificial Sequence: Synthetic polypeptide
DESVIATTNPVAYEQWGCVPTWNDQDWGGNGHP

SEQ ID NO: 167979 - protein, 40 aa, Artificial Sequence
  Description of Artificial Sequence: Synthetic polypeptide
DEEEIRTTNPVATEQYGTVSTVNLQSGSNDEQGTNNTTDD

SEQ ID NO: 167980 - protein, 34 aa, Artificial Sequence
  Description of Artificial Sequence: Synthetic polypeptide
DEEEISTTNPVATEEYGCVCSWGEHNQNFGSEQA

SEQ ID NO: 167981 - protein, 34 aa, Artificial Sequence
  Description of Artificial Sequence: Synthetic polypeptide
DEEEIATTNPVAYEQWGSVSGGNGNESKGEGDTS

SEQ ID NO: 167982 - protein, 36 aa, Artificial Sequence
  Description of Artificial Sequence: Synthetic polypeptide
DEAEIRTTNPVATEQYGSVMVTAANPDTGYSEEEES

SEQ ID NO: 167983 - protein, 38 aa, Artificial Sequence
  Description of Artificial Sequence: Synthetic polypeptide
DEEEIRTTNPVATEQYGVVSTVVNQNNTEQGTTEQGSE

SEQ ID NO: 167984 - protein, 35 aa, Artificial Sequence
  Description of Artificial Sequence: Synthetic polypeptide
DEAEIRTTNPVATEQYGSVMPIDAFVEHEIEMGQR

SEQ ID NO: 167985 - protein, 35 aa, Artificial Sequence
  Description of Artificial Sequence: Synthetic polypeptide
DEMEIRTTNPVATEQYGSSCPAVAGNAESEGQEML

SEQ ID NO: 167986 - protein, 35 aa, Artificial Sequence
  Description of Artificial Sequence: Synthetic polypeptide
DEAEIRTTNPVATEQYGSVLVTIGWNTEHDEEEFN

SEQ ID NO: 167987 - protein, 36 aa, Artificial Sequence
  Description of Artificial Sequence: Synthetic polypeptide
DEHEIRTTNPVATEHWGSVCSTWEQGNDTNGGMGER

SEQ ID NO: 167988 - protein, 35 aa, Artificial Sequence
  Description of Artificial Sequence: Synthetic polypeptide
CEEEIRTTNPVATEQYGCVCSWGEHDTENFNSDQF

SEQ ID NO: 167989 - protein, 35 aa, Artificial Sequence
  Description of Artificial Sequence: Synthetic polypeptide
CEEEIRTTNPVATEQYGCVCSWGEHFANFNSDNQS

SEQ ID NO: 167990 - protein, 35 aa, Artificial Sequence
  Description of Artificial Sequence: Synthetic polypeptide
DEHEIRTTNPVATEHWGCVSGGNADDSRQGGNGNS

SEQ ID NO: 167991 - protein, 37 aa, Artificial Sequence
  Description of Artificial Sequence: Synthetic polypeptide
VEEEIRTTNPVATEQYGSVQPAAVPLDIQNIEPGNIL

SEQ ID NO: 167992 - protein, 36 aa, Artificial Sequence
  Description of Artificial Sequence: Synthetic polypeptide
DEAEIRTTNPVATEQYGSVMVTAANQDTGYSEEVQS

SEQ ID NO: 167993 - protein, 36 aa, Artificial Sequence
  Description of Artificial Sequence: Synthetic polypeptide
VEEEIRTTNPVATEQYGSVQSPPQYLAQENVLMEGD

SEQ ID NO: 167994 - protein, 36 aa, Artificial Sequence
  Description of Artificial Sequence: Synthetic polypeptide
DEAEIRTTNPVATEQYGSVLDASAEVESQRQQEDVI

SEQ ID NO: 167995 - protein, 38 aa, Artificial Sequence
  Description of Artificial Sequence: Synthetic polypeptide
DEEEIRTTNPVATEQYGVVSTVVNQNQQATTTTNVATE

SEQ ID NO: 167996 - protein, 35 aa, Artificial Sequence
  Description of Artificial Sequence: Synthetic polypeptide
DEAEIRTTNPVATEQYGSVIYHDPGTPEILMEDEL

SEQ ID NO: 167997 - protein, 32 aa, Artificial Sequence
  Description of Artificial Sequence: Synthetic polypeptide
DDSEVASTNPVSTEGYGCVGTNTIQERMGSQR

SEQ ID NO: 167998 - protein, 32 aa, Artificial Sequence
  Description of Artificial Sequence: Synthetic polypeptide
QEGEIRPTNPVSSEPYGTVSCENIQQQSNGNH

SEQ ID NO: 167999 - protein, 36 aa, Artificial Sequence
  Description of Artificial Sequence: Synthetic polypeptide
DEAEIRTTNPVATEQYGSVIYAVWLETEGNEMVQQE

SEQ ID NO: 168000 - protein, 31 aa, Artificial Sequence
  Description of Artificial Sequence: Synthetic polypeptide
DENEIVTTNPVATEQWGTVSEIEVENAEEDA

SEQ ID NO: 168001 - protein, 37 aa, Artificial Sequence
  Description of Artificial Sequence: Synthetic polypeptide
DEAEIRTTNPVATEQYGSVISVWNQELETFGSGEDKY

SEQ ID NO: 168002 - protein, 37 aa, Artificial Sequence
  Description of Artificial Sequence: Synthetic polypeptide
DEEEIRTTNPVATEQYGSVLSTTMNMVMPPVFEEPEM

SEQ ID NO: 168003 - protein, 34 aa, Artificial Sequence
  Description of Artificial Sequence: Synthetic polypeptide
DETAEIACTNPVAYEQWGSVASGAGEGQHGENTR

SEQ ID NO: 168004 - protein, 34 aa, Artificial Sequence
  Description of Artificial Sequence: Synthetic polypeptide
DEDEIATTNPVAYEQWGEVSGGNGLLQDHPNGDS

SEQ ID NO: 168005 - protein, 34 aa, Artificial Sequence
  Description of Artificial Sequence: Synthetic polypeptide
DENEIVTTNPVATEQWGTVCSATDIEVENFAGNA

SEQ ID NO: 168006 - protein, 38 aa, Artificial Sequence
  Description of Artificial Sequence: Synthetic polypeptide
DEEEIRTTNPVATEQYGVVSTVVNQNQLQGEEEEEEDG

SEQ ID NO: 168007 - protein, 35 aa, Artificial Sequence
  Description of Artificial Sequence: Synthetic polypeptide
DEMEIRTTNPVATEQYGSVAFMPDQTNWKIESSQS

SEQ ID NO: 168008 - protein, 36 aa, Artificial Sequence
  Description of Artificial Sequence: Synthetic polypeptide
DEAEIRTTNPVATEQYGSVMVTAANQDTGYTEETES

SEQ ID NO: 168009 - protein, 38 aa, Artificial Sequence
  Description of Artificial Sequence: Synthetic polypeptide
DEEEIRTTNPVATEQYGVVSTVVNQNNQQGTTEQGEDE

SEQ ID NO: 168010 - protein, 37 aa, Artificial Sequence
  Description of Artificial Sequence: Synthetic polypeptide
DEEEIRTTNPVATEQYGVVSTVVNQNNNTEQGTEEQD

SEQ ID NO: 168011 - protein, 35 aa, Artificial Sequence
  Description of Artificial Sequence: Synthetic polypeptide
DEAEIRTTNPVATEQYGSVNNIEPLPEGGGEVEME

SEQ ID NO: 168012 - protein, 32 aa, Artificial Sequence
  Description of Artificial Sequence: Synthetic polypeptide
TENEIRTTNPVSTEPYGQISMEDIQQQQNGNH

SEQ ID NO: 168013 - protein, 34 aa, Artificial Sequence
  Description of Artificial Sequence: Synthetic polypeptide
DEQEIATTNPVATEQYGSVANMNNDEATANPEEA

SEQ ID NO: 168014 - protein, 32 aa, Artificial Sequence
  Description of Artificial Sequence: Synthetic polypeptide
TENEIRTTNPVSTEPYGEISMEDIQQQQNGNH

SEQ ID NO: 168015 - protein, 32 aa, Artificial Sequence
  Description of Artificial Sequence: Synthetic polypeptide
TENEIRTTNPVGTEPYGTISMEDIQQQQNGNH

SEQ ID NO: 168016 - protein, 34 aa, Artificial Sequence
  Description of Artificial Sequence: Synthetic polypeptide
DENEIVTTNPVATEQYGTVCSATDIEVENAEEDA

SEQ ID NO: 168017 - protein, 36 aa, Artificial Sequence
  Description of Artificial Sequence: Synthetic polypeptide
DEQEIATTNPVATEQYGSVASATDGGTEDQEGEDGE

SEQ ID NO: 168018 - protein, 38 aa, Artificial Sequence
  Description of Artificial Sequence: Synthetic polypeptide
DEEEIRTTNPVATEQYGVVSTVVNQNNQAGTEQGSTTQ

SEQ ID NO: 168019 - protein, 35 aa, Artificial Sequence
  Description of Artificial Sequence: Synthetic polypeptide
DEAEIRTTNPVATEQYGSVWMVVPTEQISDQNPEN

SEQ ID NO: 168020 - protein, 38 aa, Artificial Sequence
  Description of Artificial Sequence: Synthetic polypeptide
DEEEIRTTNPVATEQYGVVSTVVNQNNQAGTEQGVTVS

SEQ ID NO: 168021 - protein, 36 aa, Artificial Sequence
  Description of Artificial Sequence: Synthetic polypeptide
DEDEIRTTNPVATEGYGVVCSGLNDHQQERNGGGDS

SEQ ID NO: 168022 - protein, 36 aa, Artificial Sequence
  Description of Artificial Sequence: Synthetic polypeptide
DEAEIRTTNPVATEQYGSVMVTAANQDTGYVQEVES

SEQ ID NO: 168023 - protein, 34 aa, Artificial Sequence
  Description of Artificial Sequence: Synthetic polypeptide
DEAEIRTTNPVATEQYGSVNNIEPEVEGGSEVIL

SEQ ID NO: 168024 - protein, 34 aa, Artificial Sequence
  Description of Artificial Sequence: Synthetic polypeptide
DEDEIATTNPVAYEQWGMTCSTNGLQEGDGDDSS

SEQ ID NO: 168025 - protein, 34 aa, Artificial Sequence
  Description of Artificial Sequence: Synthetic polypeptide
AESEIRTTNPVAYECWGSVYRINENQDRRGENQG

SEQ ID NO: 168026 - protein, 35 aa, Artificial Sequence
  Description of Artificial Sequence: Synthetic polypeptide
DEEEIRTTNPVATEQYGCSCSSGEMHNQYFDSDQS

SEQ ID NO: 168027 - protein, 38 aa, Artificial Sequence
  Description of Artificial Sequence: Synthetic polypeptide
DEEEIRTTNPVATEQYGVVSTVVNQNNQQGTEEEEEDE

SEQ ID NO: 168028 - protein, 36 aa, Artificial Sequence
  Description of Artificial Sequence: Synthetic polypeptide
DEAEIRTTNPVATEQYGSVMVTAFNQDTGYSEEDES

SEQ ID NO: 168029 - protein, 36 aa, Artificial Sequence
  Description of Artificial Sequence: Synthetic polypeptide
TENEIRTTNPVATEQYGSVPNCELHELSQRVTNYEG

SEQ ID NO: 168030 - protein, 36 aa, Artificial Sequence
  Description of Artificial Sequence: Synthetic polypeptide
DEEEIRTTNPVATEQYGCSCSSGEDHNQEYFNSDQS

SEQ ID NO: 168031 - protein, 36 aa, Artificial Sequence
  Description of Artificial Sequence: Synthetic polypeptide
DEAEIRTTNPVATEQYGSVMVTAANSDTGYSEEVEG

SEQ ID NO: 168032 - protein, 38 aa, Artificial Sequence
  Description of Artificial Sequence: Synthetic polypeptide
DEEEIRTTNPVATEQYGVVSTVVNQNNQQGTEEEEEED

SEQ ID NO: 168033 - protein, 34 aa, Artificial Sequence
  Description of Artificial Sequence: Synthetic polypeptide
AESEIRTTNPVATEEYGCCWYNIGVSQRGENIQE

SEQ ID NO: 168034 - protein, 34 aa, Artificial Sequence
  Description of Artificial Sequence: Synthetic polypeptide
DEAEIATTNPVATEQYGSVCAANNGEEAPDNMNN

SEQ ID NO: 168035 - protein, 38 aa, Artificial Sequence
  Description of Artificial Sequence: Synthetic polypeptide
DEEEIRTTNPVATEQYGVVSTVVNQNNQQGTTDEETTD

SEQ ID NO: 168036 - protein, 39 aa, Artificial Sequence
  Description of Artificial Sequence: Synthetic polypeptide
DEEEIRTTNPVATEQYGVVSTVVNDQQGNTQSNTTNVAE

SEQ ID NO: 168037 - protein, 34 aa, Artificial Sequence
  Description of Artificial Sequence: Synthetic polypeptide
DEMEIVSTNPVATEQYGTVCSATDGPVEFEGNTD

SEQ ID NO: 168038 - protein, 37 aa, Artificial Sequence
  Description of Artificial Sequence: Synthetic polypeptide
VEEEIRTTNPVATEQYGSVITVGVNGLEGGGEDQDEF

SEQ ID NO: 168039 - protein, 37 aa, Artificial Sequence
  Description of Artificial Sequence: Synthetic polypeptide
VEEEIRTTNPVATEQYGSVITVGDNGMGGGNEDNDEF

SEQ ID NO: 168040 - protein, 30 aa, Artificial Sequence
  Description of Artificial Sequence: Synthetic polypeptide
TESEIASTNPVGTEGYGVIASTLQHTGGDI

SEQ ID NO: 168041 - protein, 35 aa, Artificial Sequence
  Description of Artificial Sequence: Synthetic polypeptide
DEMEIRTTNPVATEQYGSVCPDYCDLEEHEDINDQ

SEQ ID NO: 168042 - protein, 31 aa, Artificial Sequence
  Description of Artificial Sequence: Synthetic polypeptide
TESEIASTNPVGTEGYGVIASTELSQHGGDE

SEQ ID NO: 168043 - protein, 36 aa, Artificial Sequence
  Description of Artificial Sequence: Synthetic polypeptide
DEEEIRTTNPVATEQYGSVICVTPMIIPTLANSFLD

SEQ ID NO: 168044 - protein, 37 aa, Artificial Sequence
  Description of Artificial Sequence: Synthetic polypeptide
DEDEIRTTNPVATEAYGVVSTVVTNQQLQQLGTTDDE

SEQ ID NO: 168045 - protein, 31 aa, Artificial Sequence
  Description of Artificial Sequence: Synthetic polypeptide
DENEVASTNPVSTEQYGDVAANIIQNAVEQR

SEQ ID NO: 168046 - protein, 34 aa, Artificial Sequence
  Description of Artificial Sequence: Synthetic polypeptide
DEMEIVATNPVATEQYGTVCSATDGMPVEFEGND

SEQ ID NO: 168047 - protein, 29 aa, Artificial Sequence
  Description of Artificial Sequence: Synthetic peptide
TESEIASTNPVGTEGYGVIASKLQHGDIT

SEQ ID NO: 168048 - protein, 39 aa, Artificial Sequence
  Description of Artificial Sequence: Synthetic polypeptide
DEEEIRTTNPVATEQYGTVTNLQSGTIGTNTQNNEVGNN

SEQ ID NO: 168049 - protein, 39 aa, Artificial Sequence
  Description of Artificial Sequence: Synthetic polypeptide
DEEEIRTTNPVATEQYGTVTNLQSGTIGTNQQNQEQGNN

SEQ ID NO: 168050 - protein, 35 aa, Artificial Sequence
  Description of Artificial Sequence: Synthetic polypeptide
DEDEIATTNPVAYEQWGSVCSTENDTQGDTQNGGA

SEQ ID NO: 168051 - protein, 30 aa, Artificial Sequence
  Description of Artificial Sequence: Synthetic polypeptide
DEEEIATTNPVATEQWGEAAAVCAEHKEEI

SEQ ID NO: 168052 - protein, 36 aa, Artificial Sequence
  Description of Artificial Sequence: Synthetic polypeptide
DEEEIRTTNPVATEQYGSVLPPVLAAQEFEIVLDQE

SEQ ID NO: 168053 - protein, 33 aa, Artificial Sequence
  Description of Artificial Sequence: Synthetic polypeptide
DEMEIVCTNPVATEQYGEACSATDGPVEFEGND

SEQ ID NO: 168054 - protein, 34 aa, Artificial Sequence
  Description of Artificial Sequence: Synthetic polypeptide
DEAEIRTTNPVATEQYGSVWEDQLNTVEEDEEQN

SEQ ID NO: 168055 - protein, 29 aa, Artificial Sequence
  Description of Artificial Sequence: Synthetic peptide
TESEIASTNPVGTEGWGVAYSTLQHGDIP

SEQ ID NO: 168056 - protein, 29 aa, Artificial Sequence
  Description of Artificial Sequence: Synthetic peptide
TESEIASTNPVGTEGWGVAASTLQHDGDA

SEQ ID NO: 168057 - protein, 35 aa, Artificial Sequence
  Description of Artificial Sequence: Synthetic polypeptide
DEEEIRTTNPVAYEQYGQCVCSSEDHQHFNSDFQS

SEQ ID NO: 168058 - protein, 31 aa, Artificial Sequence
  Description of Artificial Sequence: Synthetic polypeptide
DENEVASTNPVSTEPYGNIAMTIQQQRVGNH

SEQ ID NO: 168059 - protein, 31 aa, Artificial Sequence
  Description of Artificial Sequence: Synthetic polypeptide
DENEVASTNPVSTEGYGNVAAETIQSRVGQR

SEQ ID NO: 168060 - protein, 30 aa, Artificial Sequence
  Description of Artificial Sequence: Synthetic polypeptide
DENEVASTNPVSTEGYGNAAAETIQRVGQR

SEQ ID NO: 168061 - protein, 36 aa, Artificial Sequence
  Description of Artificial Sequence: Synthetic polypeptide
DEQEIATTNPVATEQYGSTVSCTASVSEDHEGGGNL

SEQ ID NO: 168062 - protein, 30 aa, Artificial Sequence
  Description of Artificial Sequence: Synthetic polypeptide
DENEVASTNPVSTEGYGEAAAETIQRVGQR

SEQ ID NO: 168063 - protein, 37 aa, Artificial Sequence
  Description of Artificial Sequence: Synthetic polypeptide
DEMEIRTTNPVATEQYGSVCEMEYDVTHQDQMEGNED

SEQ ID NO: 168064 - protein, 36 aa, Artificial Sequence
  Description of Artificial Sequence: Synthetic polypeptide
DEEEIATTNPVATEQWGCVSANSGGNPEDQTAGMIR

SEQ ID NO: 168065 - protein, 38 aa, Artificial Sequence
  Description of Artificial Sequence: Synthetic polypeptide
DEEEIRTTNPVATEQYGSVSVLGIADMTMEEPEQEGTP

SEQ ID NO: 168066 - protein, 31 aa, Artificial Sequence
  Description of Artificial Sequence: Synthetic polypeptide
QEEEIATTNPVATEQYGEAPERVCPQHEEGK

SEQ ID NO: 168067 - protein, 28 aa, Artificial Sequence
  Description of Artificial Sequence: Synthetic peptide
TESEIASTNPVGTEGWGVAAATLQHGDY

SEQ ID NO: 168068 - protein, 36 aa, Artificial Sequence
  Description of Artificial Sequence: Synthetic polypeptide
DEEEIRTTNPVATEQYGSVLPHYNQEIENTIELSEL

SEQ ID NO: 168069 - protein, 35 aa, Artificial Sequence
  Description of Artificial Sequence: Synthetic polypeptide
DEMEITTTNPVATEQYGTVCSATSGPVEFQMENIE

SEQ ID NO: 168070 - protein, 31 aa, Artificial Sequence
  Description of Artificial Sequence: Synthetic polypeptide
DENGIRTTNPVATEQWGDVSESIEMNAAEMA

SEQ ID NO: 168071 - protein, 30 aa, Artificial Sequence
  Description of Artificial Sequence: Synthetic polypeptide
TESEIASTNPVGTEGYGVMASTLQHFGSDI

SEQ ID NO: 168072 - protein, 37 aa, Artificial Sequence
  Description of Artificial Sequence: Synthetic polypeptide
DEEEIRTTNPVATEQYGSVLPAYNEQYSFNTIELSTL

SEQ ID NO: 168073 - protein, 31 aa, Artificial Sequence
  Description of Artificial Sequence: Synthetic polypeptide
DENGIRTTNPVATEQWGDVSEIVEMNAAEDA

SEQ ID NO: 168074 - protein, 34 aa, Artificial Sequence
  Description of Artificial Sequence: Synthetic polypeptide
DESIIRATNPVATECWGSVRCCINEPQDREGENG

SEQ ID NO: 168075 - protein, 32 aa, Artificial Sequence
  Description of Artificial Sequence: Synthetic polypeptide
DENEVRTTNPVSTEPYGTISMIDIQVQQNGNT

SEQ ID NO: 168076 - protein, 36 aa, Artificial Sequence
  Description of Artificial Sequence: Synthetic polypeptide
VEEEIRTTNPVATEQYGSVIDQNNNVGQETGEGGFE

SEQ ID NO: 168077 - protein, 36 aa, Artificial Sequence
  Description of Artificial Sequence: Synthetic polypeptide
DEQEIATTNPVATEQYGSTVACTALVSEDHEGGENL

SEQ ID NO: 168078 - protein, 35 aa, Artificial Sequence
  Description of Artificial Sequence: Synthetic polypeptide
DEMEITTTNPVATEQYGTVCSATSGPVEDQHENTD

SEQ ID NO: 168079 - protein, 32 aa, Artificial Sequence
  Description of Artificial Sequence: Synthetic polypeptide
DENEVRTTNPVSTEPYGTISMEDIQQQQNGNH

SEQ ID NO: 168080 - protein, 35 aa, Artificial Sequence
  Description of Artificial Sequence: Synthetic polypeptide
DEMEITTTNPVATEQYGTVCSATSGPVEEFEGTND

SEQ ID NO: 168081 - protein, 35 aa, Artificial Sequence
  Description of Artificial Sequence: Synthetic polypeptide
DESEIRTTNPVATEFYGSVVQGLNIEGQGNEDEIS

SEQ ID NO: 168082 - protein, 36 aa, Artificial Sequence
  Description of Artificial Sequence: Synthetic polypeptide
DEEEIRTTNPVATEQYGSVLPAYNQFIDNTIELSVQ

SEQ ID NO: 168083 - protein, 34 aa, Artificial Sequence
  Description of Artificial Sequence: Synthetic polypeptide
DEQEIATTNPVATEQYGSTVANAEDLADHEGEYL

SEQ ID NO: 168084 - protein, 37 aa, Artificial Sequence
  Description of Artificial Sequence: Synthetic polypeptide
DEDEIRTTNPVATEAYGVVSTVVNNLQQQQGTTTTTE

SEQ ID NO: 168085 - protein, 33 aa, Artificial Sequence
  Description of Artificial Sequence: Synthetic polypeptide
DESKIRTTNPVATEIWGSFGCINEPEAREGENG

SEQ ID NO: 168086 - protein, 37 aa, Artificial Sequence
  Description of Artificial Sequence: Synthetic polypeptide
DEDEIRTTNPVATEAYGVVSTVVNNLQQQQNEETTTE

SEQ ID NO: 168087 - protein, 34 aa, Artificial Sequence
  Description of Artificial Sequence: Synthetic polypeptide
DESKIRTTNSVATECWGSCSCINEPQDREGENMG

SEQ ID NO: 168088 - protein, 31 aa, Artificial Sequence
  Description of Artificial Sequence: Synthetic polypeptide
DENEVRTTNPVATEQWGDVAAEIEMNAAEDR

SEQ ID NO: 168089 - protein, 35 aa, Artificial Sequence
  Description of Artificial Sequence: Synthetic polypeptide
DEMEITTTNPVATEQYGTVCSATSGPVEFEGPNDE

SEQ ID NO: 168090 - protein, 35 aa, Artificial Sequence
  Description of Artificial Sequence: Synthetic polypeptide
DEMEITTTNPVATEQYGTVCSATSGPVEFQHEGQD

SEQ ID NO: 168091 - protein, 35 aa, Artificial Sequence
  Description of Artificial Sequence: Synthetic polypeptide
DEMEITTTNPVATEQYGTVCSATSGPVEFQHENLC

SEQ ID NO: 168092 - protein, 37 aa, Artificial Sequence
  Description of Artificial Sequence: Synthetic polypeptide
DEDEIRTTNPVATEAYGVVSTVVTNLQGQQTGTTTDE

SEQ ID NO: 168093 - protein, 36 aa, Artificial Sequence
  Description of Artificial Sequence: Synthetic polypeptide
DESEIRTTNPVATEFYGSVNVDGTNEQNVGEEEEMQ

SEQ ID NO: 168094 - protein, 35 aa, Artificial Sequence
  Description of Artificial Sequence: Synthetic polypeptide
DESEIRTTNPVATEFYGSVIVDFGNGGFDTGNQGT

SEQ ID NO: 168095 - protein, 32 aa, Artificial Sequence
  Description of Artificial Sequence: Synthetic polypeptide
DENEVRSTNPVSTEPYGNIAANDIQQQRNGQR

SEQ ID NO: 168096 - protein, 37 aa, Artificial Sequence
  Description of Artificial Sequence: Synthetic polypeptide
DEMEIRTTNPVATEQYGSVCPWEYDVLGQDQMEGNED

SEQ ID NO: 168097 - protein, 34 aa, Artificial Sequence
  Description of Artificial Sequence: Synthetic polypeptide
DENEIVTTNPVATEQWGTVCSATDGPVENFEGND

SEQ ID NO: 168098 - protein, 30 aa, Artificial Sequence
  Description of Artificial Sequence: Synthetic polypeptide
TESEIASTNPVGTEAYGVTMASTLQHGGDI

SEQ ID NO: 168099 - protein, 36 aa, Artificial Sequence
  Description of Artificial Sequence: Synthetic polypeptide
DEEEIRTTNPVATEQYGTVTCTEMQEEVPEGEGPEI

SEQ ID NO: 168100 - protein, 35 aa, Artificial Sequence
  Description of Artificial Sequence: Synthetic polypeptide
DEDEIATTNPVAYEQWGSVCAANNLQEAPGGTDNQ

SEQ ID NO: 168101 - protein, 31 aa, Artificial Sequence
  Description of Artificial Sequence: Synthetic polypeptide
DENELRTTNPVATEQWGDVKSEIEMNAAQDA

SEQ ID NO: 168102 - protein, 39 aa, Artificial Sequence
  Description of Artificial Sequence: Synthetic polypeptide
DEEEIRTTNPVATEQYGSVSTTVTNQNNTEQGTNANTTD

SEQ ID NO: 168103 - protein, 32 aa, Artificial Sequence
  Description of Artificial Sequence: Synthetic polypeptide
DENEIYTTNPVSTEPYGTISMEDIQQSQNGNH

SEQ ID NO: 168104 - protein, 35 aa, Artificial Sequence
  Description of Artificial Sequence: Synthetic polypeptide
DEQEIATTNPVATEQYGSTVSCVGFSEDHEGGENL

SEQ ID NO: 168105 - protein, 32 aa, Artificial Sequence
  Description of Artificial Sequence: Synthetic polypeptide
DENEIYTTNPVSTEPYGTISMEDIQQQQNGNH

SEQ ID NO: 168106 - protein, 35 aa, Artificial Sequence
  Description of Artificial Sequence: Synthetic polypeptide
DEAEIATTNPVAYEQWGSVCSMNDNGDERQGGNVK

SEQ ID NO: 168107 - protein, 34 aa, Artificial Sequence
  Description of Artificial Sequence: Synthetic polypeptide
AEEEIATTNPVATEEYGCISCINNDSTRNGGNNV

SEQ ID NO: 168108 - protein, 33 aa, Artificial Sequence
  Description of Artificial Sequence: Synthetic polypeptide
DEMEIVQTNPVATEQWGTVCSATDGPVEFEGND

SEQ ID NO: 168109 - protein, 34 aa, Artificial Sequence
  Description of Artificial Sequence: Synthetic polypeptide
TEQEIRTTNPVAYEAYGTVPFYTQNASGRGNNAP

SEQ ID NO: 168110 - protein, 31 aa, Artificial Sequence
  Description of Artificial Sequence: Synthetic polypeptide
AETEIACTNPVATEQWGEAANAEDWQERGPR

SEQ ID NO: 168111 - protein, 34 aa, Artificial Sequence
  Description of Artificial Sequence: Synthetic polypeptide
DEDEIATTNPVAYEQWGSVASGNLGIPTPDGDGN

SEQ ID NO: 168112 - protein, 34 aa, Artificial Sequence
  Description of Artificial Sequence: Synthetic polypeptide
DEDEIRTTNPVATEFYGQMTSGNVDQDGGGEDGN

SEQ ID NO: 168113 - protein, 32 aa, Artificial Sequence
  Description of Artificial Sequence: Synthetic polypeptide
DENEIYTTNPVSTEPYGTISMEDIQCQQNGNH

SEQ ID NO: 168114 - protein, 34 aa, Artificial Sequence
  Description of Artificial Sequence: Synthetic polypeptide
DESTEIATTNPVAYEQWGSVSWGEDQNGQGGGSQ

SEQ ID NO: 168115 - protein, 36 aa, Artificial Sequence
  Description of Artificial Sequence: Synthetic polypeptide
DEAEIATTNPVAYEQWGSVCSTNDNMDERQDGNHKV

SEQ ID NO: 168116 - protein, 36 aa, Artificial Sequence
  Description of Artificial Sequence: Synthetic polypeptide
TEQEIRTTNPVATEQYGSVSVTPLMEIIDMVPVERG

SEQ ID NO: 168117 - protein, 35 aa, Artificial Sequence
  Description of Artificial Sequence: Synthetic polypeptide
DEAEIATTNPVAYEQWGSVCSTNDQGEHQVDNQEG

SEQ ID NO: 168118 - protein, 33 aa, Artificial Sequence
  Description of Artificial Sequence: Synthetic polypeptide
DEMEIVSTNPVATEQYGTVCAASDGPVEFEGND

SEQ ID NO: 168119 - protein, 37 aa, Artificial Sequence
  Description of Artificial Sequence: Synthetic polypeptide
DEEEIRTTNPVATEQYGCSCSTWGEPPNQENFNSDQA

SEQ ID NO: 168120 - protein, 33 aa, Artificial Sequence
  Description of Artificial Sequence: Synthetic polypeptide
DEMEIVSTNPVATEQYGTVCAATDTPVEFEGND

SEQ ID NO: 168121 - protein, 35 aa, Artificial Sequence
  Description of Artificial Sequence: Synthetic polypeptide
TEQEIATTNPVSTEQYGSVSWNEGEKQRQRGGTEP

SEQ ID NO: 168122 - protein, 33 aa, Artificial Sequence
  Description of Artificial Sequence: Synthetic polypeptide
DEMEIVSTNPVATEQYGTVCAATDTPVEHEGND

SEQ ID NO: 168123 - protein, 38 aa, Artificial Sequence
  Description of Artificial Sequence: Synthetic polypeptide
DEEEIRTTNPVATEQYGSVSTTVTNNNNNDEQGTEEED

SEQ ID NO: 168124 - protein, 34 aa, Artificial Sequence
  Description of Artificial Sequence: Synthetic polypeptide
DEDEIATTNPVAYEQWGSVAATAHGQAAPGNSHN

SEQ ID NO: 168125 - protein, 34 aa, Artificial Sequence
  Description of Artificial Sequence: Synthetic polypeptide
DEMEIRTTNPVATEQYGSVAFMPDYNAKIESHQS

SEQ ID NO: 168126 - protein, 35 aa, Artificial Sequence
  Description of Artificial Sequence: Synthetic polypeptide
DEDEIATTNPVAYEQWGSVAIANNLQDQGGDQDRH

SEQ ID NO: 168127 - protein, 30 aa, Artificial Sequence
  Description of Artificial Sequence: Synthetic polypeptide
TESEIASTNPVGTEAYGVIASTLSQHGGDI

SEQ ID NO: 168128 - protein, 33 aa, Artificial Sequence
  Description of Artificial Sequence: Synthetic polypeptide
DEDEIATTNPVAYEQWGSVCGDSGGQHQGNSMP

SEQ ID NO: 168129 - protein, 32 aa, Artificial Sequence
  Description of Artificial Sequence: Synthetic polypeptide
DENELRTTNPVSTEPYGTISMEDIQQQQNGNH

SEQ ID NO: 168130 - protein, 36 aa, Artificial Sequence
  Description of Artificial Sequence: Synthetic polypeptide
DEMEIRTTNPVATEQYGSVCEMEYDVNQDQMEINEA

SEQ ID NO: 168131 - protein, 36 aa, Artificial Sequence
  Description of Artificial Sequence: Synthetic polypeptide
DEEEIRTTNPVATEQYGCSCSWNEHNAENFNSDNQS

SEQ ID NO: 168132 - protein, 32 aa, Artificial Sequence
  Description of Artificial Sequence: Synthetic polypeptide
DENETRTTNPVSTEPYGTISMEMIQQQQNGNH

SEQ ID NO: 168133 - protein, 34 aa, Artificial Sequence
  Description of Artificial Sequence: Synthetic polypeptide
DEDEIRTTNPVATECWGMHCWTMNEQDRRTNDAD

SEQ ID NO: 168134 - protein, 35 aa, Artificial Sequence
  Description of Artificial Sequence: Synthetic polypeptide
DESQIRTTNPVATEWWGSVSKCIIEPQDREGENKG

SEQ ID NO: 168135 - protein, 32 aa, Artificial Sequence
  Description of Artificial Sequence: Synthetic polypeptide
DENETRTTNPVSTEPYGTISMEDIQQQQNGNH

SEQ ID NO: 168136 - protein, 36 aa, Artificial Sequence
  Description of Artificial Sequence: Synthetic polypeptide
DEEEIRTTNPVATEQYGCSCSWMEDHNQNFDSNTQS

SEQ ID NO: 168137 - protein, 36 aa, Artificial Sequence
  Description of Artificial Sequence: Synthetic polypeptide
DESRIRTTNPVATECWGSVPSCINKEPQDREGENLG

SEQ ID NO: 168138 - protein, 35 aa, Artificial Sequence
  Description of Artificial Sequence: Synthetic polypeptide
DENESEIRTTNPVAYEGWGSVATTNLGGDTQGDGD

SEQ ID NO: 168139 - protein, 36 aa, Artificial Sequence
  Description of Artificial Sequence: Synthetic polypeptide
DEEEIRTTNPVATEQYGSVICMPESLQQHFPVEIEN

SEQ ID NO: 168140 - protein, 34 aa, Artificial Sequence
  Description of Artificial Sequence: Synthetic polypeptide
DENENATTNPVAYEQWGSVCSGDHNLNDRGEGHQ

SEQ ID NO: 168141 - protein, 37 aa, Artificial Sequence
  Description of Artificial Sequence: Synthetic polypeptide
DEMEIRTTNPVATEQYGSVCEMEYDVLQDQGMEGNEN

SEQ ID NO: 168142 - protein, 32 aa, Artificial Sequence
  Description of Artificial Sequence: Synthetic polypeptide
DENELRTTNPVSTEPYGTISMEDIGQQQNGNH

SEQ ID NO: 168143 - protein, 35 aa, Artificial Sequence
  Description of Artificial Sequence: Synthetic polypeptide
DESSIASTNPVATEQYGSVSWNEGEQERQRMNGET

SEQ ID NO: 168144 - protein, 35 aa, Artificial Sequence
  Description of Artificial Sequence: Synthetic polypeptide
DEDEIRTTNPVATECYGSVVGFGNNLTDGMEGGQT

SEQ ID NO: 168145 - protein, 36 aa, Artificial Sequence
  Description of Artificial Sequence: Synthetic polypeptide
DEQEIATTNPVATEQYGSTVSCTGLSEDHEGGEQLL

SEQ ID NO: 168146 - protein, 39 aa, Artificial Sequence
  Description of Artificial Sequence: Synthetic polypeptide
DEEEIRTTNPVATEQYGSVSTTVTNQQQSTTEQGTEQGS

SEQ ID NO: 168147 - protein, 38 aa, Artificial Sequence
  Description of Artificial Sequence: Synthetic polypeptide
DEEEIRTTNPVATEQYGSVLSLTPPVIQQIRTIPQEDD

SEQ ID NO: 168148 - protein, 34 aa, Artificial Sequence
  Description of Artificial Sequence: Synthetic polypeptide
DEMEIVCTNPVATEQYGTVCSATDGPVEFEGFND

SEQ ID NO: 168149 - protein, 32 aa, Artificial Sequence
  Description of Artificial Sequence: Synthetic polypeptide
DEDEIATTNPVAYEQWGSVCPGDNDDQQDTMP

SEQ ID NO: 168150 - protein, 36 aa, Artificial Sequence
  Description of Artificial Sequence: Synthetic polypeptide
DEEEIATTNPVAYEQYGSVCSVAPHLNEAPNGEANN

SEQ ID NO: 168151 - protein, 37 aa, Artificial Sequence
  Description of Artificial Sequence: Synthetic polypeptide
DEQEIATTNPVATEQYGSTVSCTLGLSEDHEGGENLW

SEQ ID NO: 168152 - protein, 33 aa, Artificial Sequence
  Description of Artificial Sequence: Synthetic polypeptide
DEMEIVCTNPVATYQYGTVCSATDGPVEFEGND

SEQ ID NO: 168153 - protein, 34 aa, Artificial Sequence
  Description of Artificial Sequence: Synthetic polypeptide
DEMEIVGTNPVATEQYGTVCSATDGFPVEFEGND

SEQ ID NO: 168154 - protein, 32 aa, Artificial Sequence
  Description of Artificial Sequence: Synthetic polypeptide
DENELRTTNPVSTEPYGTISMEDISQQQNGNH

SEQ ID NO: 168155 - protein, 34 aa, Artificial Sequence
  Description of Artificial Sequence: Synthetic polypeptide
TESAIRTTNPVAYEAYGTVPSYTQNASSRGTNAP

SEQ ID NO: 168156 - protein, 33 aa, Artificial Sequence
  Description of Artificial Sequence: Synthetic polypeptide
DEMEIVCTNPVATEQYGTVCSAEDGPVEFEGND

SEQ ID NO: 168157 - protein, 36 aa, Artificial Sequence
  Description of Artificial Sequence: Synthetic polypeptide
DEMEIRTTNPVATEQYGSMCSVTANENEMNTQDSEG

SEQ ID NO: 168158 - protein, 32 aa, Artificial Sequence
  Description of Artificial Sequence: Synthetic polypeptide
DEDEIATTNPVAYEQWGETYYTNQQLGEDDSD

SEQ ID NO: 168159 - protein, 33 aa, Artificial Sequence
  Description of Artificial Sequence: Synthetic polypeptide
AEEEIATTNPVATEMWGSVAAPPLGEATGDNAM

SEQ ID NO: 168160 - protein, 34 aa, Artificial Sequence
  Description of Artificial Sequence: Synthetic polypeptide
AEEEIATTNPVATEQYGCSCGSEDNQEHFNSETQ

SEQ ID NO: 168161 - protein, 33 aa, Artificial Sequence
  Description of Artificial Sequence: Synthetic polypeptide
AEEEIATTNPVATEQYGCSCGWEDNQHISENQS

SEQ ID NO: 168162 - protein, 34 aa, Artificial Sequence
  Description of Artificial Sequence: Synthetic polypeptide
DEMEIVTTNPVATEAYGQTVCSATDGPVEFEGND

SEQ ID NO: 168163 - protein, 33 aa, Artificial Sequence
  Description of Artificial Sequence: Synthetic polypeptide
DEMEIVTTNPVATEAYGTVCKATDGPVEFEGND

SEQ ID NO: 168164 - protein, 34 aa, Artificial Sequence
  Description of Artificial Sequence: Synthetic polypeptide
DEMEIVTTNPVATEAYGTVCSATDGFPVEFEGND

SEQ ID NO: 168165 - protein, 34 aa, Artificial Sequence
  Description of Artificial Sequence: Synthetic polypeptide
DEEEISTTNPVATEGYGCVCSNWEHQEHFNSQQS

SEQ ID NO: 168166 - protein, 36 aa, Artificial Sequence
  Description of Artificial Sequence: Synthetic polypeptide
DEEEIRTTNPVATEQYGCVCSNSGEHQENFGSDDQS

SEQ ID NO: 168167 - protein, 35 aa, Artificial Sequence
  Description of Artificial Sequence: Synthetic polypeptide
TEGEIATTNPVATEQYGSVPSCTDALSEDHEGEDL

SEQ ID NO: 168168 - protein, 36 aa, Artificial Sequence
  Description of Artificial Sequence: Synthetic polypeptide
DEEEIRTTNPVATEQYGCVCSNSGEHQENMNSEPQS

SEQ ID NO: 168169 - protein, 31 aa, Artificial Sequence
  Description of Artificial Sequence: Synthetic polypeptide
TEGEIAPTNPCSYEQYGKTVSCNELSQSGTP

SEQ ID NO: 168170 - protein, 32 aa, Artificial Sequence
  Description of Artificial Sequence: Synthetic polypeptide
TEGEIAPTNPCSYEQYGIVPSCCNALSQSGTR

SEQ ID NO: 168171 - protein, 36 aa, Artificial Sequence
  Description of Artificial Sequence: Synthetic polypeptide
DEMEIRTTNPVATEQYGSISSSALTEQAETDDEGKG

SEQ ID NO: 168172 - protein, 34 aa, Artificial Sequence
  Description of Artificial Sequence: Synthetic polypeptide
DEMEIVTTNPVATDQYGTVCSATDGPVEFEGNDA

SEQ ID NO: 168173 - protein, 36 aa, Artificial Sequence
  Description of Artificial Sequence: Synthetic polypeptide
DEEEIRTTNPVATEQYGCVCSNSGEPQEFFNSDTQA

SEQ ID NO: 168174 - protein, 35 aa, Artificial Sequence
  Description of Artificial Sequence: Synthetic polypeptide
DEEEIATTNPVATEQYGSACAANNGEAPDNGDENS

SEQ ID NO: 168175 - protein, 34 aa, Artificial Sequence
  Description of Artificial Sequence: Synthetic polypeptide
DEMEIVTTNPVATECWGTVCSATINPVEFEGENG

SEQ ID NO: 168176 - protein, 34 aa, Artificial Sequence
  Description of Artificial Sequence: Synthetic polypeptide
TEGEEIATTNPVAYEQWGSVTGGNAGDLREGNNM

SEQ ID NO: 168177 - protein, 35 aa, Artificial Sequence
  Description of Artificial Sequence: Synthetic polypeptide
DEQEIATTNPVATEQYGSVCAANNGDEQGMDDNNN

SEQ ID NO: 168178 - protein, 31 aa, Artificial Sequence
  Description of Artificial Sequence: Synthetic polypeptide
DDSEVASTNPVSTEGYGDVAANTNTSRVGQR

SEQ ID NO: 168179 - protein, 37 aa, Artificial Sequence
  Description of Artificial Sequence: Synthetic polypeptide
DEEEIRTTNPVATEQYGCVCSNSGNHNQENFNSDNQS

SEQ ID NO: 168180 - protein, 38 aa, Artificial Sequence
  Description of Artificial Sequence: Synthetic polypeptide
DEEEIRTTNPVATEQYGVVSTVVNQQGNQQGTTEQGSE

SEQ ID NO: 168181 - protein, 36 aa, Artificial Sequence
  Description of Artificial Sequence: Synthetic polypeptide
DEEEIRTTNPVAYEQYGQCVCSTGEDTNQSFGSEQA

SEQ ID NO: 168182 - protein, 34 aa, Artificial Sequence
  Description of Artificial Sequence: Synthetic polypeptide
DEQEIATTNPVATEQYGSVCAAPLQDHQMDQFQH

SEQ ID NO: 168183 - protein, 36 aa, Artificial Sequence
  Description of Artificial Sequence: Synthetic polypeptide
DEHEIRTTNPVATEEYGKTISTNEFSGVREGGSNQG

SEQ ID NO: 168184 - protein, 32 aa, Artificial Sequence
  Description of Artificial Sequence: Synthetic polypeptide
AEEEIATTNPVATEQYGCSCPWADNQHSISEQ

SEQ ID NO: 168185 - protein, 36 aa, Artificial Sequence
  Description of Artificial Sequence: Synthetic polypeptide
DEEEIATTNPVAYEQYGSVVAAAAGELQDDLGLNNS

SEQ ID NO: 168186 - protein, 36 aa, Artificial Sequence
  Description of Artificial Sequence: Synthetic polypeptide
DEEEIATTNPVAYEQYGSVSSTTPAGTNMRNLMEPV

SEQ ID NO: 168187 - protein, 33 aa, Artificial Sequence
  Description of Artificial Sequence: Synthetic polypeptide
AEEEIATTNPVATEQYGCSCPWVDQHFISENQF

SEQ ID NO: 168188 - protein, 38 aa, Artificial Sequence
  Description of Artificial Sequence: Synthetic polypeptide
DEEEIRTTNPVATEQYGSVLWVNLGHSEEARSDVNLNQ

SEQ ID NO: 168189 - protein, 36 aa, Artificial Sequence
  Description of Artificial Sequence: Synthetic polypeptide
DEEEIATTNPVATEQYGSACAAANPLAEAEMGNMFF

SEQ ID NO: 168190 - protein, 33 aa, Artificial Sequence
  Description of Artificial Sequence: Synthetic polypeptide
DEMEIVTTNPVATAQYGTVCDATDGPVEFEGND

SEQ ID NO: 168191 - protein, 30 aa, Artificial Sequence
  Description of Artificial Sequence: Synthetic polypeptide
QEEEIATTNPVATEQYGEAPAEPVEEMSEQ

SEQ ID NO: 168192 - protein, 36 aa, Artificial Sequence
  Description of Artificial Sequence: Synthetic polypeptide
DEEEIRTTNPVATEQYGCVCSNSGEHNQENFVSNQS

SEQ ID NO: 168193 - protein, 33 aa, Artificial Sequence
  Description of Artificial Sequence: Synthetic polypeptide
DESEIRTTNPVATECWTSFGCINEEEAREGENG

SEQ ID NO: 168194 - protein, 36 aa, Artificial Sequence
  Description of Artificial Sequence: Synthetic polypeptide
TEHEIRTTNPVATEQYGSVPFCEINELSQIVTNYEG

SEQ ID NO: 168195 - protein, 30 aa, Artificial Sequence
  Description of Artificial Sequence: Synthetic polypeptide
QEEEIATTNPVATEQYGEAPAEGCEHEEEK

SEQ ID NO: 168196 - protein, 34 aa, Artificial Sequence
  Description of Artificial Sequence: Synthetic polypeptide
DEMEIVTTNPVATAQYGTVCSATDGPVEFEGNDS

SEQ ID NO: 168197 - protein, 36 aa, Artificial Sequence
  Description of Artificial Sequence: Synthetic polypeptide
DEEEIRTTNPVATEQYGCVCSNSGEHNQFFGSDFQS

SEQ ID NO: 168198 - protein, 36 aa, Artificial Sequence
  Description of Artificial Sequence: Synthetic polypeptide
DEEEIRTTNPVATEQYGCVCSNSGEHNQHFNSDNQG

SEQ ID NO: 168199 - protein, 31 aa, Artificial Sequence
  Description of Artificial Sequence: Synthetic polypeptide
DETEIACTNPIATECYGETWSNADLQPGGYI

SEQ ID NO: 168200 - protein, 34 aa, Artificial Sequence
  Description of Artificial Sequence: Synthetic polypeptide
DEMEIVTTNPVATAQYGTVCSATDGPVEVFEGND

SEQ ID NO: 168201 - protein, 38 aa, Artificial Sequence
  Description of Artificial Sequence: Synthetic polypeptide
DEEEIRTTNPVATEAYGVVSTTNQQQGNNLQAGTEQGA

SEQ ID NO: 168202 - protein, 35 aa, Artificial Sequence
  Description of Artificial Sequence: Synthetic polypeptide
DEEEIRTTNPVATEQYGCVCSNSGEHQEFFISDQD

SEQ ID NO: 168203 - protein, 35 aa, Artificial Sequence
  Description of Artificial Sequence: Synthetic polypeptide
DEEEISTTNPVATEGYGCVCSNTEHNQENFNSDQI

SEQ ID NO: 168204 - protein, 36 aa, Artificial Sequence
  Description of Artificial Sequence: Synthetic polypeptide
DEQEIATTNPVATEQYGSVCAANNGDEDGMDINNRH

SEQ ID NO: 168205 - protein, 34 aa, Artificial Sequence
  Description of Artificial Sequence: Synthetic polypeptide
DEMEIVTTNPVATCQYGTVCSATDGCPVEFEGND

SEQ ID NO: 168206 - protein, 35 aa, Artificial Sequence
  Description of Artificial Sequence: Synthetic polypeptide
DEQEIATTNPVATEQYGSVCAANNGDENGMDIDNN

SEQ ID NO: 168207 - protein, 35 aa, Artificial Sequence
  Description of Artificial Sequence: Synthetic polypeptide
DEEEIRTTNPVATEQYGCVCSNSGEHNQNFISDQA

SEQ ID NO: 168208 - protein, 35 aa, Artificial Sequence
  Description of Artificial Sequence: Synthetic polypeptide
DEEEIRTTNPVATEQYGCVCSNSGEHNQNFISQQS

SEQ ID NO: 168209 - protein, 34 aa, Artificial Sequence
  Description of Artificial Sequence: Synthetic polypeptide
DEMEIVTTNPVATDQYGTTVCSATDGPVEFEGND

SEQ ID NO: 168210 - protein, 33 aa, Artificial Sequence
  Description of Artificial Sequence: Synthetic polypeptide
DETEIACTNPVATAQWGSVAAGNLFTPNPMGRE

SEQ ID NO: 168211 - protein, 36 aa, Artificial Sequence
  Description of Artificial Sequence: Synthetic polypeptide
DEEEIRTTNPVATEQYGCVCSNSGEHNQNFNSETQS

SEQ ID NO: 168212 - protein, 36 aa, Artificial Sequence
  Description of Artificial Sequence: Synthetic polypeptide
DEEEIRTTNPVATEQYGCVCSNSGEHNQNFNSQTQN

SEQ ID NO: 168213 - protein, 31 aa, Artificial Sequence
  Description of Artificial Sequence: Synthetic polypeptide
DDSEVASTNPVSTEGYGDVAANTIQSRVGQR

SEQ ID NO: 168214 - protein, 30 aa, Artificial Sequence
  Description of Artificial Sequence: Synthetic polypeptide
DEEEIATTNPVATEQWGAAPEEVCAEHEEK

SEQ ID NO: 168215 - protein, 38 aa, Artificial Sequence
  Description of Artificial Sequence: Synthetic polypeptide
DEEEIRTTNPVATEQYGSVLWINLGSSEEARSTVNLNQ

SEQ ID NO: 168216 - protein, 35 aa, Artificial Sequence
  Description of Artificial Sequence: Synthetic polypeptide
DEEEISTTNPVATEGYGCVCSNTEHNQNFGSETQA

SEQ ID NO: 168217 - protein, 37 aa, Artificial Sequence
  Description of Artificial Sequence: Synthetic polypeptide
DCEEIRGTNPVATEQYGSASLTPNLAAQQEISPNHNG

SEQ ID NO: 168218 - protein, 30 aa, Artificial Sequence
  Description of Artificial Sequence: Synthetic polypeptide
QEEEIATTNPVATEQYGEAAPEVCVHEEGK

SEQ ID NO: 168219 - protein, 35 aa, Artificial Sequence
  Description of Artificial Sequence: Synthetic polypeptide
DETEIACTNPVATEQWGSVAAANNLQEAGGENGTE

SEQ ID NO: 168220 - protein, 35 aa, Artificial Sequence
  Description of Artificial Sequence: Synthetic polypeptide
DENEISTTNPVATEQYGSVCTPPCLETGYMEDMQD

SEQ ID NO: 168221 - protein, 31 aa, Artificial Sequence
  Description of Artificial Sequence: Synthetic polypeptide
DEDEIATTNPVAYEPWGSFTAATGEQNIGSE

SEQ ID NO: 168222 - protein, 33 aa, Artificial Sequence
  Description of Artificial Sequence: Synthetic polypeptide
QEEEIATTNPVATEQYGDVAGPGETGEGQGEEQ

SEQ ID NO: 168223 - protein, 33 aa, Artificial Sequence
  Description of Artificial Sequence: Synthetic polypeptide
QEEEIATTNPVATEQYGDVAGPGEGDGQTGEEQ

SEQ ID NO: 168224 - protein, 35 aa, Artificial Sequence
  Description of Artificial Sequence: Synthetic polypeptide
DEMEIVTTNPVATEFYGTVCSATDGDPVEFEGNRD

SEQ ID NO: 168225 - protein, 33 aa, Artificial Sequence
  Description of Artificial Sequence: Synthetic polypeptide
QEEEIATTNPVATEQYGDVAGPEGGQGGEDEGQ

SEQ ID NO: 168226 - protein, 31 aa, Artificial Sequence
  Description of Artificial Sequence: Synthetic polypeptide
AEEEIATTNPVATEQYGCYCPWEDNQHFIEQ

SEQ ID NO: 168227 - protein, 32 aa, Artificial Sequence
  Description of Artificial Sequence: Synthetic polypeptide
QEEEIATTNPVATEQYGDVAGPEGGGQGEEDQ

SEQ ID NO: 168228 - protein, 33 aa, Artificial Sequence
  Description of Artificial Sequence: Synthetic polypeptide
QEEEIATTNPVATEQYGDVAGPEGDGQGENEQE

SEQ ID NO: 168229 - protein, 32 aa, Artificial Sequence
  Description of Artificial Sequence: Synthetic polypeptide
DETEIACTNPVATEQYGETTWSEEDLAPKGGI

SEQ ID NO: 168230 - protein, 32 aa, Artificial Sequence
  Description of Artificial Sequence: Synthetic polypeptide
QEEEIATTNPVATEQYGDVAGPEGDGQGEEGQ

SEQ ID NO: 168231 - protein, 35 aa, Artificial Sequence
  Description of Artificial Sequence: Synthetic polypeptide
DEEEISTTNPVATEGYGCVCSWGEHQEHFGSDNQS

SEQ ID NO: 168232 - protein, 32 aa, Artificial Sequence
  Description of Artificial Sequence: Synthetic polypeptide
QEEEIATTNPVATEQYGVVAGPEVGQGEAEED

SEQ ID NO: 168233 - protein, 37 aa, Artificial Sequence
  Description of Artificial Sequence: Synthetic polypeptide
DEEEIRTTNPVATEQYGSVSTIMNMFMPPVSMEPDMF

SEQ ID NO: 168234 - protein, 34 aa, Artificial Sequence
  Description of Artificial Sequence: Synthetic polypeptide
DEMEIVTTNPVATEFYGTVCSATDGPVEFEGNQD

SEQ ID NO: 168235 - protein, 33 aa, Artificial Sequence
  Description of Artificial Sequence: Synthetic polypeptide
DEMEIVTTNPVATEFYGTVCSATDGPVEFEGTD

SEQ ID NO: 168236 - protein, 34 aa, Artificial Sequence
  Description of Artificial Sequence: Synthetic polypeptide
DEMEIVTTNPVATEFYGTVCSATDGTVEWFEGND

SEQ ID NO: 168237 - protein, 34 aa, Artificial Sequence
  Description of Artificial Sequence: Synthetic polypeptide
DEMEIVTTNPVATEFYGTVCSATDGYPVEFEGND

SEQ ID NO: 168238 - protein, 38 aa, Artificial Sequence
  Description of Artificial Sequence: Synthetic polypeptide
DEEEIRTTNPVATEQYGSVMGELLDTIGQEGGGGNDEE

SEQ ID NO: 168239 - protein, 35 aa, Artificial Sequence
  Description of Artificial Sequence: Synthetic polypeptide
DEQEIATTNPVATEQYGSVCAHNHPEAPDNQEHNH

SEQ ID NO: 168240 - protein, 34 aa, Artificial Sequence
  Description of Artificial Sequence: Synthetic polypeptide
DDECIRTTNPVATEQYGCVCSWGNHNQNFQSDQA

SEQ ID NO: 168241 - protein, 35 aa, Artificial Sequence
  Description of Artificial Sequence: Synthetic polypeptide
DEMEIVTTNPVATEGYGCVCSNTGEPNEFFGSNDS

SEQ ID NO: 168242 - protein, 35 aa, Artificial Sequence
  Description of Artificial Sequence: Synthetic polypeptide
VEEEIRTTNPVATEQYGSVSLSPWLYMVSMEEEEL

SEQ ID NO: 168243 - protein, 31 aa, Artificial Sequence
  Description of Artificial Sequence: Synthetic polypeptide
DEMEIVTTNPVATEGYGTMCAATDTPEFGDD

SEQ ID NO: 168244 - protein, 39 aa, Artificial Sequence
  Description of Artificial Sequence: Synthetic polypeptide
DEEEIRTTNPVATEAYGTVTNLQSGTISTNLQNTEAGNV

SEQ ID NO: 168245 - protein, 34 aa, Artificial Sequence
  Description of Artificial Sequence: Synthetic polypeptide
TEEGIRTTNPVAYEAYGKTVNCTSLAMMVGNDRT

SEQ ID NO: 168246 - protein, 34 aa, Artificial Sequence
  Description of Artificial Sequence: Synthetic polypeptide
DEEEISTTNPVATEGYGCVCSWGEPQENFNSDQS

SEQ ID NO: 168247 - protein, 33 aa, Artificial Sequence
  Description of Artificial Sequence: Synthetic polypeptide
DEMEIVTTNPVATECYGTVCAATDGPVEPEGND

SEQ ID NO: 168248 - protein, 32 aa, Artificial Sequence
  Description of Artificial Sequence: Synthetic polypeptide
QEEEIATTNPVATEQYGVVAGPEGEGGQGEED

SEQ ID NO: 168249 - protein, 33 aa, Artificial Sequence
  Description of Artificial Sequence: Synthetic polypeptide
DETEIACTNPVATEQYGCVATNHQDADDPQIEQ

SEQ ID NO: 168250 - protein, 33 aa, Artificial Sequence
  Description of Artificial Sequence: Synthetic polypeptide
DEMEIVTTNPVATECYGTVCAATEGPVEPEGND

SEQ ID NO: 168251 - protein, 33 aa, Artificial Sequence
  Description of Artificial Sequence: Synthetic polypeptide
DETEIACTNPVATEQWGSVAANTPTQEHNNQAE

SEQ ID NO: 168252 - protein, 37 aa, Artificial Sequence
  Description of Artificial Sequence: Synthetic polypeptide
DEEEIATTNPVATEQYGSACAANNGLTQQDDGNPLQW

SEQ ID NO: 168253 - protein, 33 aa, Artificial Sequence
  Description of Artificial Sequence: Synthetic polypeptide
DEMEIVTTNPVATECYGTVCSAEDCPVQFEGED

SEQ ID NO: 168254 - protein, 33 aa, Artificial Sequence
  Description of Artificial Sequence: Synthetic polypeptide
DEMEIVTTNPVATECYGTVCSAEDGPVEFEGND

SEQ ID NO: 168255 - protein, 36 aa, Artificial Sequence
  Description of Artificial Sequence: Synthetic polypeptide
DEEEIRTTNPVATEQYGCVCSNSPEHNQENFGSEQS

SEQ ID NO: 168256 - protein, 36 aa, Artificial Sequence
  Description of Artificial Sequence: Synthetic polypeptide
DEEEIRTTNPVATEQYGCVCSNSPHNQENFNSETQS

SEQ ID NO: 168257 - protein, 33 aa, Artificial Sequence
  Description of Artificial Sequence: Synthetic polypeptide
DEMEIVTTNPVATECYGTVCSAEDGPVQFEGED

SEQ ID NO: 168258 - protein, 34 aa, Artificial Sequence
  Description of Artificial Sequence: Synthetic polypeptide
DEEEISTTNPVATEGYGCVCSTGEHQENFFSEQS

SEQ ID NO: 168259 - protein, 34 aa, Artificial Sequence
  Description of Artificial Sequence: Synthetic polypeptide
DEMEIVTTNPVATECYGTVCSATDDPVEFKGNYD

SEQ ID NO: 168260 - protein, 34 aa, Artificial Sequence
  Description of Artificial Sequence: Synthetic polypeptide
DEMEIVTTNPVATECYGTVCSATDGPVEDFEGND

SEQ ID NO: 168261 - protein, 34 aa, Artificial Sequence
  Description of Artificial Sequence: Synthetic polypeptide
DEMEIVTTNPVATECYGTVCSATDGPVEFEGENG

SEQ ID NO: 168262 - protein, 34 aa, Artificial Sequence
  Description of Artificial Sequence: Synthetic polypeptide
DENEISTTNPVATEQYGVVCSWGEHQNFGSETQS

SEQ ID NO: 168263 - protein, 33 aa, Artificial Sequence
  Description of Artificial Sequence: Synthetic polypeptide
DEDEIATTNPVAYEPWGSVYCTNQGEDAGNNGS

SEQ ID NO: 168264 - protein, 35 aa, Artificial Sequence
  Description of Artificial Sequence: Synthetic polypeptide
DETEIACTNPVATEQWGSVSGEGPPQGATMGNPRG

SEQ ID NO: 168265 - protein, 33 aa, Artificial Sequence
  Description of Artificial Sequence: Synthetic polypeptide
DEMEIVTTNPVATECYGTVCSATDGPVEFERND

SEQ ID NO: 168266 - protein, 34 aa, Artificial Sequence
  Description of Artificial Sequence: Synthetic polypeptide
DEEEISTTNPVATEGYGCVCSWEEHQYFNSDNQD

SEQ ID NO: 168267 - protein, 35 aa, Artificial Sequence
  Description of Artificial Sequence: Synthetic polypeptide
VEEEIRTTNPVATEQYGSVSLSPWLADVSMPEEEL

SEQ ID NO: 168268 - protein, 34 aa, Artificial Sequence
  Description of Artificial Sequence: Synthetic polypeptide
DEMEIVTTNPVATECYGTVCSATDGSPVEFEGND

SEQ ID NO: 168269 - protein, 34 aa, Artificial Sequence
  Description of Artificial Sequence: Synthetic polypeptide
DEMEIVTTNPVATECYGTVCSATIGPVEFEGENG

SEQ ID NO: 168270 - protein, 37 aa, Artificial Sequence
  Description of Artificial Sequence: Synthetic polypeptide
DEEEIRTTNPVATEQYGCVCSNTEDHNQEAFNSENQD

SEQ ID NO: 168271 - protein, 35 aa, Artificial Sequence
  Description of Artificial Sequence: Synthetic polypeptide
TEESEIATTNPVAYECWGSVATGQLEGDIQGGNQR

SEQ ID NO: 168272 - protein, 37 aa, Artificial Sequence
  Description of Artificial Sequence: Synthetic polypeptide
DEEEIRTTNPVATEQYGCVCSNTEDHNQENFGSDTQG

SEQ ID NO: 168273 - protein, 34 aa, Artificial Sequence
  Description of Artificial Sequence: Synthetic polypeptide
DETEIACTNPVATEQYGATTWAEENLQERKGPYI

SEQ ID NO: 168274 - protein, 33 aa, Artificial Sequence
  Description of Artificial Sequence: Synthetic polypeptide
DEMEIVTTNPVATEEYGTCCSATDGPVEFEGND

SEQ ID NO: 168275 - protein, 33 aa, Artificial Sequence
  Description of Artificial Sequence: Synthetic polypeptide
DEMEIVTTNPVATEEYGTVCQATDGPVEFEGND

SEQ ID NO: 168276 - protein, 37 aa, Artificial Sequence
  Description of Artificial Sequence: Synthetic polypeptide
DEAEIRTTNPVATEQYGSVWSSSIMLEELINGNEEVF

SEQ ID NO: 168277 - protein, 31 aa, Artificial Sequence
  Description of Artificial Sequence: Synthetic polypeptide
TESEIASTNPVGTEGYGVSCGSTLQHGSDIA

SEQ ID NO: 168278 - protein, 35 aa, Artificial Sequence
  Description of Artificial Sequence: Synthetic polypeptide
DEQEIATTNPVATEQYGSVCAANMGEEQPDDQNNH

SEQ ID NO: 168279 - protein, 33 aa, Artificial Sequence
  Description of Artificial Sequence: Synthetic polypeptide
DEMEIVTTNPVASEQYGTVCSATDGPVEFENND

SEQ ID NO: 168280 - protein, 32 aa, Artificial Sequence
  Description of Artificial Sequence: Synthetic polypeptide
DETAEIATTNPVAYEQWGVVAAAGELDQGPRH

SEQ ID NO: 168281 - protein, 32 aa, Artificial Sequence
  Description of Artificial Sequence: Synthetic polypeptide
DETAEIATTNPVAYEQWGVVAAGELDQGPPRM

SEQ ID NO: 168282 - protein, 35 aa, Artificial Sequence
  Description of Artificial Sequence: Synthetic polypeptide
DETAEIATTNPVAYEQYGSVAGAGNGLPQDSENGS

SEQ ID NO: 168283 - protein, 33 aa, Artificial Sequence
  Description of Artificial Sequence: Synthetic polypeptide
DETAEIATTNPVAYEQYGSVAGSGDPAENPNTD

SEQ ID NO: 168284 - protein, 33 aa, Artificial Sequence
  Description of Artificial Sequence: Synthetic polypeptide
DENEIVTTNPVATECYGTVCSAEDCPVQFEGED

SEQ ID NO: 168285 - protein, 38 aa, Artificial Sequence
  Description of Artificial Sequence: Synthetic polypeptide
DEEEIRTTNPVATEAYGVVSTTNQQALGNTEQGNTNAQ

SEQ ID NO: 168286 - protein, 38 aa, Artificial Sequence
  Description of Artificial Sequence: Synthetic polypeptide
DEEEIRTTNPVATEAYGVVSTTNQQGGNNTQQGTEQGS

SEQ ID NO: 168287 - protein, 33 aa, Artificial Sequence
  Description of Artificial Sequence: Synthetic polypeptide
DEMEIVTTNPMATEQYGTVCSAHDGPVEFEGND

SEQ ID NO: 168288 - protein, 33 aa, Artificial Sequence
  Description of Artificial Sequence: Synthetic polypeptide
DEMEIVTTNPTACEQYGTVCSATDGPVEFEGND

SEQ ID NO: 168289 - protein, 36 aa, Artificial Sequence
  Description of Artificial Sequence: Synthetic polypeptide
DEEEIRTTNPVATEQYGSVSVPNFKEASIEMIELVQ

SEQ ID NO: 168290 - protein, 32 aa, Artificial Sequence
  Description of Artificial Sequence: Synthetic polypeptide
TENEIATTNPVATEGYGCVCSWGELQHISELA

SEQ ID NO: 168291 - protein, 35 aa, Artificial Sequence
  Description of Artificial Sequence: Synthetic polypeptide
DETAEIATTNPVAYEQYGSVANPGNGDPAEGENER

SEQ ID NO: 168292 - protein, 34 aa, Artificial Sequence
  Description of Artificial Sequence: Synthetic polypeptide
DETAEIATTNPVAYEQWGTVVPTDDNDQRGTGDQ

SEQ ID NO: 168293 - protein, 35 aa, Artificial Sequence
  Description of Artificial Sequence: Synthetic polypeptide
CEEEIRTTNPVATEQYGCVCSWGEHQENFGSETQS

SEQ ID NO: 168294 - protein, 34 aa, Artificial Sequence
  Description of Artificial Sequence: Synthetic polypeptide
DETAEIATTNPVAYEQYGSVATHGQDSQGGQLDE

SEQ ID NO: 168295 - protein, 34 aa, Artificial Sequence
  Description of Artificial Sequence: Synthetic polypeptide
DETAEIATTNPVAYEQYGSVATHGQGSDINNTDE

SEQ ID NO: 168296 - protein, 36 aa, Artificial Sequence
  Description of Artificial Sequence: Synthetic polypeptide
DEMEIRTTNPVATEQYGSISVPSNLTEEEITQESRF

SEQ ID NO: 168297 - protein, 38 aa, Artificial Sequence
  Description of Artificial Sequence: Synthetic polypeptide
DEEEIRTTNPVATEAYGVVSTTNQQGNNQNQNGNQNDD

SEQ ID NO: 168298 - protein, 36 aa, Artificial Sequence
  Description of Artificial Sequence: Synthetic polypeptide
DEDEIATTNPVAYEPYGSVVAATMNGLPQDNNNVRN

SEQ ID NO: 168299 - protein, 37 aa, Artificial Sequence
  Description of Artificial Sequence: Synthetic polypeptide
DEAEIRTTNPVATEQYGSVIEPTWIYDNQDEGFEHNG

SEQ ID NO: 168300 - protein, 32 aa, Artificial Sequence
  Description of Artificial Sequence: Synthetic polypeptide
DENEITTTNPVSTEPYGTISMEDIQQQQNGNH

SEQ ID NO: 168301 - protein, 34 aa, Artificial Sequence
  Description of Artificial Sequence: Synthetic polypeptide
DEMEIVTTNPTATEQYGTVCSATDGPVEFSGNDC

SEQ ID NO: 168302 - protein, 32 aa, Artificial Sequence
  Description of Artificial Sequence: Synthetic polypeptide
DENEITTTNPVSTEPYGTISCEDIQQQQNGNH

SEQ ID NO: 168303 - protein, 31 aa, Artificial Sequence
  Description of Artificial Sequence: Synthetic polypeptide
DDSEVASTNPVSTEGYGDVAANIIQSRAGQR

SEQ ID NO: 168304 - protein, 32 aa, Artificial Sequence
  Description of Artificial Sequence: Synthetic polypeptide
TENEIATTNPVATEGYGCVCSWELNQHNSELA

SEQ ID NO: 168305 - protein, 31 aa, Artificial Sequence
  Description of Artificial Sequence: Synthetic polypeptide
DENEITTTNPVATEQWGDVSEIAEMNAAEDA

SEQ ID NO: 168306 - protein, 34 aa, Artificial Sequence
  Description of Artificial Sequence: Synthetic polypeptide
DETAEIATTNPVAYEQYGSVATHGPLGSDINLDE

SEQ ID NO: 168307 - protein, 33 aa, Artificial Sequence
  Description of Artificial Sequence: Synthetic polypeptide
DEMEIVTTNPVACELYGTVCSATDGPVEFEGND

SEQ ID NO: 168308 - protein, 34 aa, Artificial Sequence
  Description of Artificial Sequence: Synthetic polypeptide
DETAEIATTNPVAYEQWGTVCSTENDEHDGDNAQ

SEQ ID NO: 168309 - protein, 33 aa, Artificial Sequence
  Description of Artificial Sequence: Synthetic polypeptide
DDECIRTTNPVATEQYGCVCSWEHNAYFNSDQS

SEQ ID NO: 168310 - protein, 40 aa, Artificial Sequence
  Description of Artificial Sequence: Synthetic polypeptide
DEEEIRTTNPVATEQYGTVSTVNLQSGNNNQAEGTNVATE

SEQ ID NO: 168311 - protein, 40 aa, Artificial Sequence
  Description of Artificial Sequence: Synthetic polypeptide
DEEEIRTTNPVATEQYGTVSTVNLQQSATTEQGTNNVTTE

SEQ ID NO: 168312 - protein, 39 aa, Artificial Sequence
  Description of Artificial Sequence: Synthetic polypeptide
DEEEIRTTNPVATEQYGVVSTVVNDQQGNQQGTTTNVTE

SEQ ID NO: 168313 - protein, 35 aa, Artificial Sequence
  Description of Artificial Sequence: Synthetic polypeptide
DETAEIATTNPVAYECWGSVATGNGLGDAQGMGKR

SEQ ID NO: 168314 - protein, 34 aa, Artificial Sequence
  Description of Artificial Sequence: Synthetic polypeptide
DEMEIVTTNPIATEQYGTVCSATDGPVEFEGGND

SEQ ID NO: 168315 - protein, 34 aa, Artificial Sequence
  Description of Artificial Sequence: Synthetic polypeptide
DEMEIRTTNPVATEQYGSLWSDVVTQFEETFDLP

SEQ ID NO: 168316 - protein, 35 aa, Artificial Sequence
  Description of Artificial Sequence: Synthetic polypeptide
DEAEIRTTNPVATEQYGSVISVLDLENFETTEQQE

SEQ ID NO: 168317 - protein, 36 aa, Artificial Sequence
  Description of Artificial Sequence: Synthetic polypeptide
DEEEIRTTNPVATEQYGCSCSNWMEDLNQNFDSDQS

SEQ ID NO: 168318 - protein, 31 aa, Artificial Sequence
  Description of Artificial Sequence: Synthetic polypeptide
DENEIVTTNPVATEQWGDVSEGEVMNAAEDA

SEQ ID NO: 168319 - protein, 36 aa, Artificial Sequence
  Description of Artificial Sequence: Synthetic polypeptide
DEEEIRTTNPVATEQYGCSCSNWGEPHQEYFNSDQS

SEQ ID NO: 168320 - protein, 40 aa, Artificial Sequence
  Description of Artificial Sequence: Synthetic polypeptide
DEEEIRTTNPVATEQYGTVSTVNLQQSATNEQGTNNQTDE

SEQ ID NO: 168321 - protein, 40 aa, Artificial Sequence
  Description of Artificial Sequence: Synthetic polypeptide
DEEEIRTTNPVATEQYGTVSTVNLQQSATNEEGTNVNTTE

SEQ ID NO: 168322 - protein, 35 aa, Artificial Sequence
  Description of Artificial Sequence: Synthetic polypeptide
DEMEIRTTNPVATEQYGSLFTTDHNGEIYDNEIED

SEQ ID NO: 168323 - protein, 30 aa, Artificial Sequence
  Description of Artificial Sequence: Synthetic polypeptide
DENEIVTTNPVATEQWGDVCEIEMNAAEDA

SEQ ID NO: 168324 - protein, 34 aa, Artificial Sequence
  Description of Artificial Sequence: Synthetic polypeptide
DETAEIATTNPVAYEQWGSTSTNDANGNHGQNGS

SEQ ID NO: 168325 - protein, 31 aa, Artificial Sequence
  Description of Artificial Sequence: Synthetic polypeptide
DDSEVASTNPVSTEGYGCVGYNTIQSRMGQR

SEQ ID NO: 168326 - protein, 33 aa, Artificial Sequence
  Description of Artificial Sequence: Synthetic polypeptide
DETAEIATTNPVAYEQWGSVAGQGPGQNAGNSD

SEQ ID NO: 168327 - protein, 36 aa, Artificial Sequence
  Description of Artificial Sequence: Synthetic polypeptide
VEEEIRTTNPVATEQYGSVSELVVGGLLHVGPVLPD

SEQ ID NO: 168328 - protein, 36 aa, Artificial Sequence
  Description of Artificial Sequence: Synthetic polypeptide
VEEEIRTTNPVATEQYGSVSELVVGGLNPELMVPPM

SEQ ID NO: 168329 - protein, 31 aa, Artificial Sequence
  Description of Artificial Sequence: Synthetic polypeptide
TENEIATTNPVAYEPYGKVSNHLSQHSTEDL

SEQ ID NO: 168330 - protein, 37 aa, Artificial Sequence
  Description of Artificial Sequence: Synthetic polypeptide
DEEEIRTTNPVATEQYGCSCSNTGEPHNAENFNSDQA

SEQ ID NO: 168331 - protein, 32 aa, Artificial Sequence
  Description of Artificial Sequence: Synthetic polypeptide
DDSEVASTNPVSTEGYGCVQTNTIQSRFGSQR

SEQ ID NO: 168332 - protein, 33 aa, Artificial Sequence
  Description of Artificial Sequence: Synthetic polypeptide
DETAEIATTNPVAYEQWGSVPTPMLGEDHNGEN

SEQ ID NO: 168333 - protein, 34 aa, Artificial Sequence
  Description of Artificial Sequence: Synthetic polypeptide
DETAEIATTNPVAYEQWGSVSGGGNHQDQQNDNE

SEQ ID NO: 168334 - protein, 35 aa, Artificial Sequence
  Description of Artificial Sequence: Synthetic polypeptide
DETAEIATTNPVAYEQWGSVSHTMNDRGNDGDQDS

SEQ ID NO: 168335 - protein, 36 aa, Artificial Sequence
  Description of Artificial Sequence: Synthetic polypeptide
DEEEIRTTNPVATEQYGCSCSMWGNPHQNFISDTQS

SEQ ID NO: 168336 - protein, 36 aa, Artificial Sequence
  Description of Artificial Sequence: Synthetic polypeptide
DEMEIRTTNPVATEQYGSLHWYVDGNGEIRDNLIED

SEQ ID NO: 168337 - protein, 35 aa, Artificial Sequence
  Description of Artificial Sequence: Synthetic polypeptide
TEIEIATTNPVATEQYGSVSATPDLNEDHQGLEDE

SEQ ID NO: 168338 - protein, 37 aa, Artificial Sequence
  Description of Artificial Sequence: Synthetic polypeptide
DEEEIATTNPVAYEQYGSVSGTGEAGINPRDGMNPVM

SEQ ID NO: 168339 - protein, 33 aa, Artificial Sequence
  Description of Artificial Sequence: Synthetic polypeptide
DDECIRTTNPVATEQYGCVCSWEHNQNFSSDQS

SEQ ID NO: 168340 - protein, 37 aa, Artificial Sequence
  Description of Artificial Sequence: Synthetic polypeptide
DEEEIRTTNPVATEQYGCVCSNSGEHNQEGFISDNQA

SEQ ID NO: 168341 - protein, 33 aa, Artificial Sequence
  Description of Artificial Sequence: Synthetic polypeptide
DEEEISTTNPVATEGYGCVCFWEHNTNFGSDQS

SEQ ID NO: 168342 - protein, 36 aa, Artificial Sequence
  Description of Artificial Sequence: Synthetic polypeptide
DEEEIRTTNPVATEQYGCVCSNSGEHNQEHFNSDQT

SEQ ID NO: 168343 - protein, 34 aa, Artificial Sequence
  Description of Artificial Sequence: Synthetic polypeptide
DEMEIVTTNPVAIEQYGTIVCSATDGPVEFEGND

SEQ ID NO: 168344 - protein, 34 aa, Artificial Sequence
  Description of Artificial Sequence: Synthetic polypeptide
DEMEIVTTNPVAIEQYGTVCSATDGPVENFEGND

SEQ ID NO: 168345 - protein, 36 aa, Artificial Sequence
  Description of Artificial Sequence: Synthetic polypeptide
DEEEIRTTNPVATEQYGCVCSNSGEHNQENFGSEQA

SEQ ID NO: 168346 - protein, 36 aa, Artificial Sequence
  Description of Artificial Sequence: Synthetic polypeptide
DEEEIRTTNPVATEQYGCVCSNSGEHNQENFGSQQT

SEQ ID NO: 168347 - protein, 38 aa, Artificial Sequence
  Description of Artificial Sequence: Synthetic polypeptide
DEEEIRTTNPVATEAYGVVSTTNQQQGNGNQNGTEQGE

SEQ ID NO: 168348 - protein, 31 aa, Artificial Sequence
  Description of Artificial Sequence: Synthetic polypeptide
QEEEIATTNPVATEQYGEAPCEVAISQHEEK

SEQ ID NO: 168349 - protein, 36 aa, Artificial Sequence
  Description of Artificial Sequence: Synthetic polypeptide
DEEEIATTNPVATEQYGSACAAANPAEADREQGDRV

SEQ ID NO: 168350 - protein, 31 aa, Artificial Sequence
  Description of Artificial Sequence: Synthetic polypeptide
DENEISTTNPVAYEQWGTVSKEIENNGKEDA

SEQ ID NO: 168351 - protein, 31 aa, Artificial Sequence
  Description of Artificial Sequence: Synthetic polypeptide
DENEISTTNPVAYEQWGTVSKEIEMNTANDA

SEQ ID NO: 168352 - protein, 34 aa, Artificial Sequence
  Description of Artificial Sequence: Synthetic polypeptide
AEEEIATTNPVATEMWGSVSAPPLGEATGDNMGM

SEQ ID NO: 168353 - protein, 31 aa, Artificial Sequence
  Description of Artificial Sequence: Synthetic polypeptide
DENEISTTNPVAYEQWGTVSKEIEMNANEDA

SEQ ID NO: 168354 - protein, 36 aa, Artificial Sequence
  Description of Artificial Sequence: Synthetic polypeptide
DEEEIRTTNPVATEQYGCVCSNSGEHNQENFNSDIA

SEQ ID NO: 168355 - protein, 33 aa, Artificial Sequence
  Description of Artificial Sequence: Synthetic polypeptide
TEMEIWTTNPIATEQYGTVCSATDGPVEFEGND

SEQ ID NO: 168356 - protein, 40 aa, Artificial Sequence
  Description of Artificial Sequence: Synthetic polypeptide
DEEEIRTTNPVATEQYGTVSTVNLQQNATTEQGTNNNTTE

SEQ ID NO: 168357 - protein, 34 aa, Artificial Sequence
  Description of Artificial Sequence: Synthetic polypeptide
TEMEIVTTNPVATEQYGTVCSATDGPPVEFEGND

SEQ ID NO: 168358 - protein, 33 aa, Artificial Sequence
  Description of Artificial Sequence: Synthetic polypeptide
TEMEIVTTNPTATEQYGTVCSATDGPVEFEGND

SEQ ID NO: 168359 - protein, 35 aa, Artificial Sequence
  Description of Artificial Sequence: Synthetic polypeptide
TEMEIRTTNPVATEQYGSIHNTTLEDQNGESDEQE

SEQ ID NO: 168360 - protein, 33 aa, Artificial Sequence
  Description of Artificial Sequence: Synthetic polypeptide
TEMEIATTNPVAYEQYGTVCSCTPGPSEFEGND

SEQ ID NO: 168361 - protein, 36 aa, Artificial Sequence
  Description of Artificial Sequence: Synthetic polypeptide
DEEEISTTNPVATEGYGCVCSMTGEHNQNFGSDNQA

SEQ ID NO: 168362 - protein, 31 aa, Artificial Sequence
  Description of Artificial Sequence: Synthetic polypeptide
DDSEVASTNPVSTEGYGDVAANTIQSRAGQR

SEQ ID NO: 168363 - protein, 34 aa, Artificial Sequence
  Description of Artificial Sequence: Synthetic polypeptide
DEMEIVTTNPVASEQYGTVCSATDGPVEFEGHND

SEQ ID NO: 168364 - protein, 30 aa, Artificial Sequence
  Description of Artificial Sequence: Synthetic polypeptide
TEMEIACTNPCSYEQYGCVCSWELQSGSDA

SEQ ID NO: 168365 - protein, 36 aa, Artificial Sequence
  Description of Artificial Sequence: Synthetic polypeptide
DEQEIATTNPVATEQYGSVCAAMNPLNDMDGNNENE

SEQ ID NO: 168366 - protein, 32 aa, Artificial Sequence
  Description of Artificial Sequence: Synthetic polypeptide
AESEIATTNPVATTQWGMVRTWDQHQQRQNDE

SEQ ID NO: 168367 - protein, 34 aa, Artificial Sequence
  Description of Artificial Sequence: Synthetic polypeptide
DEMEIVTTNPVAFEQYGTVCSATDGPVEFEGKND

SEQ ID NO: 168368 - protein, 36 aa, Artificial Sequence
  Description of Artificial Sequence: Synthetic polypeptide
DEEEIRTTNPVATEQYGCVCSNSGEHNQEFFNSDQN

SEQ ID NO: 168369 - protein, 34 aa, Artificial Sequence
  Description of Artificial Sequence: Synthetic polypeptide
DEEEISTTNPVATEGYGCVCFTGELNTYFGSDQS

SEQ ID NO: 168370 - protein, 35 aa, Artificial Sequence
  Description of Artificial Sequence: Synthetic polypeptide
DEAEIRTTNPVATEQYGSVWPTHQYITPEGTEDSM

SEQ ID NO: 168371 - protein, 35 aa, Artificial Sequence
  Description of Artificial Sequence: Synthetic polypeptide
DEEEIRTTNPVATEQYGCVCSNSGEHAEFFGSDQA

SEQ ID NO: 168372 - protein, 33 aa, Artificial Sequence
  Description of Artificial Sequence: Synthetic polypeptide
DENEISTTNPVSTEPYGTISMEDTIQQQQNGNH

SEQ ID NO: 168373 - protein, 32 aa, Artificial Sequence
  Description of Artificial Sequence: Synthetic polypeptide
DENEISTTNPVSTEPYGTISMEDIQQQQNGNH

SEQ ID NO: 168374 - protein, 32 aa, Artificial Sequence
  Description of Artificial Sequence: Synthetic polypeptide
DENEISTTNPVSTEPYGTISMEDIQQQGNGNH

SEQ ID NO: 168375 - protein, 32 aa, Artificial Sequence
  Description of Artificial Sequence: Synthetic polypeptide
DENEISTTNPVSTEPYGTISMDDIQQQQNGNH

SEQ ID NO: 168376 - protein, 32 aa, Artificial Sequence
  Description of Artificial Sequence: Synthetic polypeptide
DENEISTTNPVSTEPYGTCSMEDIQTQQNGNH

SEQ ID NO: 168377 - protein, 36 aa, Artificial Sequence
  Description of Artificial Sequence: Synthetic polypeptide
DEAEIRTTNPVATEQYGSVWSEMWGDSQQEGGEFEG

SEQ ID NO: 168378 - protein, 37 aa, Artificial Sequence
  Description of Artificial Sequence: Synthetic polypeptide
DEEEIATTNPVAYEQYGSVSSTTPAGGPNQRNGMEPV

SEQ ID NO: 168379 - protein, 34 aa, Artificial Sequence
  Description of Artificial Sequence: Synthetic polypeptide
DEMEIVTTNPVAFEQYGTVCSATDGPVEFEGNDL

SEQ ID NO: 168380 - protein, 37 aa, Artificial Sequence
  Description of Artificial Sequence: Synthetic polypeptide
DEEEIRTTNPVATEQYGCVCSNSGEHNAENFGSDNQS

SEQ ID NO: 168381 - protein, 34 aa, Artificial Sequence
  Description of Artificial Sequence: Synthetic polypeptide
DEMEIVTTNPVAGEQYGTVCSATDGMPVEFEGND

SEQ ID NO: 168382 - protein, 36 aa, Artificial Sequence
  Description of Artificial Sequence: Synthetic polypeptide
DEQEIATTNPVATEQYGSVCAAMNHLQAMAPDDGRP

SEQ ID NO: 168383 - protein, 36 aa, Artificial Sequence
  Description of Artificial Sequence: Synthetic polypeptide
DEMEIRTTNPVATEQYGSISSSLSTEQAETDDEGKF

SEQ ID NO: 168384 - protein, 36 aa, Artificial Sequence
  Description of Artificial Sequence: Synthetic polypeptide
DEEEIRTTNPVATEQYGCVCSNSGEHNAENFGSDQS

SEQ ID NO: 168385 - protein, 34 aa, Artificial Sequence
  Description of Artificial Sequence: Synthetic polypeptide
DEQEIATTNPVATEQYGSVCAAMHGPADSGENHH

SEQ ID NO: 168386 - protein, 36 aa, Artificial Sequence
  Description of Artificial Sequence: Synthetic polypeptide
DEEEIRTTNPVATEQYGCVCSNSGEHNAENFNSDQQ

SEQ ID NO: 168387 - protein, 34 aa, Artificial Sequence
  Description of Artificial Sequence: Synthetic polypeptide
DEQEIATTNPVATEQYGSVCAAMHLQAMAPDDHN

SEQ ID NO: 168388 - protein, 31 aa, Artificial Sequence
  Description of Artificial Sequence: Synthetic polypeptide
QEEEIATTNPVATEQYGEAPCEVMHSQHEEE

SEQ ID NO: 168389 - protein, 32 aa, Artificial Sequence
  Description of Artificial Sequence: Synthetic polypeptide
QEEEIATTNPVATEQYGEAPCEVHSQHVGSYK

SEQ ID NO: 168390 - protein, 33 aa, Artificial Sequence
  Description of Artificial Sequence: Synthetic polypeptide
QEEEIATTNPVATEQYGEAPCEVESSQHTEGEK

SEQ ID NO: 168391 - protein, 36 aa, Artificial Sequence
  Description of Artificial Sequence: Synthetic polypeptide
DEEEIRTTNPVATEQYGCVCSNSGEHNAENFNSQQS

SEQ ID NO: 168392 - protein, 36 aa, Artificial Sequence
  Description of Artificial Sequence: Synthetic polypeptide
DEEEIATTNPVATEQYGSACAAANPAEADREGNDAV

SEQ ID NO: 168393 - protein, 33 aa, Artificial Sequence
  Description of Artificial Sequence: Synthetic polypeptide
DETCIRTTNPLATEQFGCVCSSELQESFGSDQS

SEQ ID NO: 168394 - protein, 37 aa, Artificial Sequence
  Description of Artificial Sequence: Synthetic polypeptide
DEEEIRTTNPVATEQYGCVCSNSGEHNIENFGSDNQD

SEQ ID NO: 168395 - protein, 35 aa, Artificial Sequence
  Description of Artificial Sequence: Synthetic polypeptide
DEQEIATTNPVATEQYGSVCAAMNHDQAMAPDDNP

SEQ ID NO: 168396 - protein, 31 aa, Artificial Sequence
  Description of Artificial Sequence: Synthetic polypeptide
QEEEIATTNPVATEQYGEAPCIVCPQHEEEK

SEQ ID NO: 168397 - protein, 35 aa, Artificial Sequence
  Description of Artificial Sequence: Synthetic polypeptide
DEEEIRTTNPVAYEQYGQCVCSSADDNQGFGSDQA

SEQ ID NO: 168398 - protein, 35 aa, Artificial Sequence
  Description of Artificial Sequence: Synthetic polypeptide
DEMEITTTNPVATEQYGTVCSANSGPVEQFQHEND

SEQ ID NO: 168399 - protein, 32 aa, Artificial Sequence
  Description of Artificial Sequence: Synthetic polypeptide
DENGIRTTNPVSTEPYGTISMEDIQQQQNGNH

SEQ ID NO: 168400 - protein, 36 aa, Artificial Sequence
  Description of Artificial Sequence: Synthetic polypeptide
DESELIGTTNPVATECWGSVASCINEPQDREGENGH

SEQ ID NO: 168401 - protein, 31 aa, Artificial Sequence
  Description of Artificial Sequence: Synthetic polypeptide
DEPEIRTTNPVATEQWGAVTVIEMIAAEDEV

SEQ ID NO: 168402 - protein, 35 aa, Artificial Sequence
  Description of Artificial Sequence: Synthetic polypeptide
DEDEIRTTNPVATEAWGSVSTVVNNEQGTTDEDEG

SEQ ID NO: 168403 - protein, 36 aa, Artificial Sequence
  Description of Artificial Sequence: Synthetic polypeptide
DEAEIRTTNPVATEQYGSVSPEMWGDSQQEGSEDEG

SEQ ID NO: 168404 - protein, 36 aa, Artificial Sequence
  Description of Artificial Sequence: Synthetic polypeptide
DEEEIRTTNPVATEQYGCVCSMWGEHNQENFNSDQS

SEQ ID NO: 168405 - protein, 33 aa, Artificial Sequence
  Description of Artificial Sequence: Synthetic polypeptide
TESEIRTTNPVAYEQWGSTCPTDNGDQKRQSQN

SEQ ID NO: 168406 - protein, 33 aa, Artificial Sequence
  Description of Artificial Sequence: Synthetic polypeptide
DEPEIRTTNPVATEQWGACVSVIEQMIAVETHE

SEQ ID NO: 168407 - protein, 32 aa, Artificial Sequence
  Description of Artificial Sequence: Synthetic polypeptide
QENEIATTNPVATECWGDVSCICLPQDREEEG

SEQ ID NO: 168408 - protein, 36 aa, Artificial Sequence
  Description of Artificial Sequence: Synthetic polypeptide
DEHEIRTTNPVATEQYGMVESTPLVWAEEIGDEPQN

SEQ ID NO: 168409 - protein, 30 aa, Artificial Sequence
  Description of Artificial Sequence: Synthetic polypeptide
QENEIATTNPVATECWGDVSECEQNAAEDA

SEQ ID NO: 168410 - protein, 34 aa, Artificial Sequence
  Description of Artificial Sequence: Synthetic polypeptide
TESEIRTTNPVAYEPYGTVPFYTFNASSRGNNAP

SEQ ID NO: 168411 - protein, 34 aa, Artificial Sequence
  Description of Artificial Sequence: Synthetic polypeptide
DEMEISTTNPVATEQYGTVCTATDGPVEFEGQND

SEQ ID NO: 168412 - protein, 36 aa, Artificial Sequence
  Description of Artificial Sequence: Synthetic polypeptide
DEMEIRTTNPVATEQYGSVCWPPNNPNEDEIQQESR

SEQ ID NO: 168413 - protein, 36 aa, Artificial Sequence
  Description of Artificial Sequence: Synthetic polypeptide
DEEEIRTTNPVATEQYGCVCSMWGEHNQEYFNSDQS

SEQ ID NO: 168414 - protein, 35 aa, Artificial Sequence
  Description of Artificial Sequence: Synthetic polypeptide
DEMEIRTTNPVATEQYGSVCTVTDIDTHPGSDGTM

SEQ ID NO: 168415 - protein, 35 aa, Artificial Sequence
  Description of Artificial Sequence: Synthetic polypeptide
CEEEIRTTNPVATEQYGCVCSSGEHNAENFNSDQA

SEQ ID NO: 168416 - protein, 39 aa, Artificial Sequence
  Description of Artificial Sequence: Synthetic polypeptide
DEEEIRTTNPVATEQYGTVTNLQSGTISTNQQNTEEGNE

SEQ ID NO: 168417 - protein, 39 aa, Artificial Sequence
  Description of Artificial Sequence: Synthetic polypeptide
DEEEIRTTNPVATEQYGTVTNLQSGTISTNGQNQEQGNA

SEQ ID NO: 168418 - protein, 36 aa, Artificial Sequence
  Description of Artificial Sequence: Synthetic polypeptide
DEDEIATTNPVAYEQWGSVTSANPNLQDRPVPNAQM

SEQ ID NO: 168419 - protein, 36 aa, Artificial Sequence
  Description of Artificial Sequence: Synthetic polypeptide
DEDEIRTTNPVATEAWGSVSTVVNNNEQGTNNEQGT

SEQ ID NO: 168420 - protein, 35 aa, Artificial Sequence
  Description of Artificial Sequence: Synthetic polypeptide
DEDEIRTTNPVATEAWGSVSTVVNNNGNDEGEEQG

SEQ ID NO: 168421 - protein, 35 aa, Artificial Sequence
  Description of Artificial Sequence: Synthetic polypeptide
CEEEIRTTNPVATEQYGCVCSSGEHQEHFQSDNQE

SEQ ID NO: 168422 - protein, 34 aa, Artificial Sequence
  Description of Artificial Sequence: Synthetic polypeptide
CEEEIRTTNPVATEQYGCVCSSGEHQENFFSDQA

SEQ ID NO: 168423 - protein, 35 aa, Artificial Sequence
  Description of Artificial Sequence: Synthetic polypeptide
CEEEIRTTNPVATEQYGCVCSSGELNEENFNSDQE

SEQ ID NO: 168424 - protein, 35 aa, Artificial Sequence
  Description of Artificial Sequence: Synthetic polypeptide
DEQEIATTNPVATEQYGSHSATDLNEDHQGLEDEY

SEQ ID NO: 168425 - protein, 36 aa, Artificial Sequence
  Description of Artificial Sequence: Synthetic polypeptide
DEMEIRTTNPVATEQYGSVCTPDEGSTTFSEEPGHL

SEQ ID NO: 168426 - protein, 33 aa, Artificial Sequence
  Description of Artificial Sequence: Synthetic polypeptide
DESENRTTNPVATECWGSFGCITEPEAREGENG

SEQ ID NO: 168427 - protein, 38 aa, Artificial Sequence
  Description of Artificial Sequence: Synthetic polypeptide
DEEEIRTTNPVATEAYGVVSTTNNQNQQGNNQEDEEDA

SEQ ID NO: 168428 - protein, 36 aa, Artificial Sequence
  Description of Artificial Sequence: Synthetic polypeptide
DESEIRTTNPVATEGYGSVNMSGTFGEMNEGGDGEN

SEQ ID NO: 168429 - protein, 34 aa, Artificial Sequence
  Description of Artificial Sequence: Synthetic polypeptide
DEEEIATTNPVAYEQWGSVSGIGNGNESGEGDTP

SEQ ID NO: 168430 - protein, 36 aa, Artificial Sequence
  Description of Artificial Sequence: Synthetic polypeptide
DEEEIRTTNPVATEQYGSVIFISMGEEVIAGEVPEI

SEQ ID NO: 168431 - protein, 36 aa, Artificial Sequence
  Description of Artificial Sequence: Synthetic polypeptide
DEEEIRTTNPVATEQYGSVIFISFGEEVPEGWVPEI

SEQ ID NO: 168432 - protein, 37 aa, Artificial Sequence
  Description of Artificial Sequence: Synthetic polypeptide
DEEEIRTTNPVATEQYGCVCSMWGEHNQENFGSDNQS

SEQ ID NO: 168433 - protein, 35 aa, Artificial Sequence
  Description of Artificial Sequence: Synthetic polypeptide
VEEEIRTTNPVATEQYGDVSIDGMGENGNIDDGEN

SEQ ID NO: 168434 - protein, 36 aa, Artificial Sequence
  Description of Artificial Sequence: Synthetic polypeptide
DEDEIRTTNPVATEAWGSVSTVNNANEQGTNNEQGV

SEQ ID NO: 168435 - protein, 39 aa, Artificial Sequence
  Description of Artificial Sequence: Synthetic polypeptide
DEEEIRTTNPVATEQYGTVTNLQSGTISTNTGNQEVGNM

SEQ ID NO: 168436 - protein, 35 aa, Artificial Sequence
  Description of Artificial Sequence: Synthetic polypeptide
DESEIVTTNPVATEQYGTVVSATDGDDEEGEGNDT

SEQ ID NO: 168437 - protein, 36 aa, Artificial Sequence
  Description of Artificial Sequence: Synthetic polypeptide
DESEIVTTNPVATEQYGTVVSATDGDDEENGEGGND

SEQ ID NO: 168438 - protein, 35 aa, Artificial Sequence
  Description of Artificial Sequence: Synthetic polypeptide
DEPEIRTTNPVATEQYGCISSTGTSQQAEGVEEWN

SEQ ID NO: 168439 - protein, 35 aa, Artificial Sequence
  Description of Artificial Sequence: Synthetic polypeptide
DEDEIRTTNPVATEAWGSVSTVNNNEQGTTDEQGT

SEQ ID NO: 168440 - protein, 33 aa, Artificial Sequence
  Description of Artificial Sequence: Synthetic polypeptide
DEPEIRTTNPVATEQWGQCVSVIEQMIAVTDQA

SEQ ID NO: 168441 - protein, 35 aa, Artificial Sequence
  Description of Artificial Sequence: Synthetic polypeptide
VEEEIRTTNPVATEQYGDVVGTVGNMTDGDGGQGI

SEQ ID NO: 168442 - protein, 36 aa, Artificial Sequence
  Description of Artificial Sequence: Synthetic polypeptide
DEAEIATTNPVATEQYGSVCAMNNGGLEAGDVNNAD

SEQ ID NO: 168443 - protein, 31 aa, Artificial Sequence
  Description of Artificial Sequence: Synthetic polypeptide
DEPEIRTTNPVATEQWGDVTVIEMIAAEVDP

SEQ ID NO: 168444 - protein, 34 aa, Artificial Sequence
  Description of Artificial Sequence: Synthetic polypeptide
CEDEIACTNPVATEQYGSVCATGLQPDNQTEGAM

SEQ ID NO: 168445 - protein, 35 aa, Artificial Sequence
  Description of Artificial Sequence: Synthetic polypeptide
VEEEIRTTNPVATEQYGDVVGVGNMTNGFNVEEIG

SEQ ID NO: 168446 - protein, 36 aa, Artificial Sequence
  Description of Artificial Sequence: Synthetic polypeptide
DEDEIRTTNPVATEAWGSVSTVVNANEIGTNNEQGG

SEQ ID NO: 168447 - protein, 31 aa, Artificial Sequence
  Description of Artificial Sequence: Synthetic polypeptide
QEGEIRTTNPCSTEQYGIISCDIQQQQNGTH

SEQ ID NO: 168448 - protein, 35 aa, Artificial Sequence
  Description of Artificial Sequence: Synthetic polypeptide
VEEEIRTTNPVATEQYGDVVGVGNQMTNGNGGQGG

SEQ ID NO: 168449 - protein, 36 aa, Artificial Sequence
  Description of Artificial Sequence: Synthetic polypeptide
DEDEIRTTNPVATEAWGSVSTVVNANEQGTNNEEGN

SEQ ID NO: 168450 - protein, 35 aa, Artificial Sequence
  Description of Artificial Sequence: Synthetic polypeptide
VEEEIRTTNPVATEQYGDVVNGFGTEDQEGGDEQT

SEQ ID NO: 168451 - protein, 36 aa, Artificial Sequence
  Description of Artificial Sequence: Synthetic polypeptide
CEDEIACTNPVATEQYGSVCATNPELQEHQDGNQHQ

SEQ ID NO: 168452 - protein, 36 aa, Artificial Sequence
  Description of Artificial Sequence: Synthetic polypeptide
CEDEIACTNPVATEQYGSVCATNPMLQEHQDGNQMH

SEQ ID NO: 168453 - protein, 35 aa, Artificial Sequence
  Description of Artificial Sequence: Synthetic polypeptide
DEAEIATTNPVATEQYGSVCAMNNGLNPTAGPSES

SEQ ID NO: 168454 - protein, 36 aa, Artificial Sequence
  Description of Artificial Sequence: Synthetic polypeptide
DCEEIRTTNPVATEQWGKAVTSLVALLVPRVGENEG

SEQ ID NO: 168455 - protein, 35 aa, Artificial Sequence
  Description of Artificial Sequence: Synthetic polypeptide
DEAEIATTNPVATEQYGSVCAMNNGLEPDSGGEMD

SEQ ID NO: 168456 - protein, 35 aa, Artificial Sequence
  Description of Artificial Sequence: Synthetic polypeptide
DESEIVTTNPVATEQYGTVVSTTDGGDEEGEGNEQ

SEQ ID NO: 168457 - protein, 35 aa, Artificial Sequence
  Description of Artificial Sequence: Synthetic polypeptide
CEEEIRTTNPVATEQYGCVCSNWGEHQYFNSNPQS

SEQ ID NO: 168458 - protein, 35 aa, Artificial Sequence
  Description of Artificial Sequence: Synthetic polypeptide
DEDEIATTNPVAYEQWGSVSTTNAGNQNIDMNMGN

SEQ ID NO: 168459 - protein, 36 aa, Artificial Sequence
  Description of Artificial Sequence: Synthetic polypeptide
DEAEIRTTNPVATEQYGSVSEMWGDSQQEGSEFEGG

SEQ ID NO: 168460 - protein, 33 aa, Artificial Sequence
  Description of Artificial Sequence: Synthetic polypeptide
DEPEIATTNPVAYEAWGSVCSGENDQHLTNDMP

SEQ ID NO: 168461 - protein, 34 aa, Artificial Sequence
  Description of Artificial Sequence: Synthetic polypeptide
DESEVASTNPVATEGYGNVSAATAGQMRVGMQPR

SEQ ID NO: 168462 - protein, 37 aa, Artificial Sequence
  Description of Artificial Sequence: Synthetic polypeptide
DEAEIRTTNPVATEQYGSVQWWTQVMQIIGNGTQEFE

SEQ ID NO: 168463 - protein, 37 aa, Artificial Sequence
  Description of Artificial Sequence: Synthetic polypeptide
DEDEIRTTNPVATEAWGSVSTVVNNNQQGTNNEQLGE

SEQ ID NO: 168464 - protein, 32 aa, Artificial Sequence
  Description of Artificial Sequence: Synthetic polypeptide
DESEVASTNPVATEGYGNVWAANTIQSRVGQI

SEQ ID NO: 168465 - protein, 34 aa, Artificial Sequence
  Description of Artificial Sequence: Synthetic polypeptide
DEPEIATTNPVATWQYGMVSDATLEFQQAQSGGN

SEQ ID NO: 168466 - protein, 37 aa, Artificial Sequence
  Description of Artificial Sequence: Synthetic polypeptide
DEDEIRTTNPVATEAWGSVSTVVNNNQQGTNVEQYGS

SEQ ID NO: 168467 - protein, 36 aa, Artificial Sequence
  Description of Artificial Sequence: Synthetic polypeptide
DEDEIRTTNPVATEAWGSVSTVVNNNQQGTTDEGTG

SEQ ID NO: 168468 - protein, 36 aa, Artificial Sequence
  Description of Artificial Sequence: Synthetic polypeptide
DEDEIRTTNPVATEAWGSVSTVVNNNQQGTTDEQGD

SEQ ID NO: 168469 - protein, 33 aa, Artificial Sequence
  Description of Artificial Sequence: Synthetic polypeptide
DEPEIATTNPVATWQYGMVCTALEFQQATSLGT

SEQ ID NO: 168470 - protein, 37 aa, Artificial Sequence
  Description of Artificial Sequence: Synthetic polypeptide
DEAEIRTTNPVATEQYGSVVDYTIMLEELANGNEEVF

SEQ ID NO: 168471 - protein, 36 aa, Artificial Sequence
  Description of Artificial Sequence: Synthetic polypeptide
DEHEIRTTNPVATEQYGKTISVTNEFSGLREGGSGQ

SEQ ID NO: 168472 - protein, 37 aa, Artificial Sequence
  Description of Artificial Sequence: Synthetic polypeptide
DEAEIRTTNPVATEQYGSVVDPTIMLEELRNINEEVF

SEQ ID NO: 168473 - protein, 37 aa, Artificial Sequence
  Description of Artificial Sequence: Synthetic polypeptide
DEPEIATTNPVATEQYGSVVSATGDLEEDQEEGEDGM

SEQ ID NO: 168474 - protein, 34 aa, Artificial Sequence
  Description of Artificial Sequence: Synthetic polypeptide
DEDEIATTNPVAYEQWGSVSGQGGNHQGEGGGEN

SEQ ID NO: 168475 - protein, 36 aa, Artificial Sequence
  Description of Artificial Sequence: Synthetic polypeptide
CEEEIRTTNPVATEQYGCVCSTGEHNEENFNSNTQE

SEQ ID NO: 168476 - protein, 35 aa, Artificial Sequence
  Description of Artificial Sequence: Synthetic polypeptide
CEEEIRTTNPVATEQYGCVCSTGEHNQENFISDQA

SEQ ID NO: 168477 - protein, 34 aa, Artificial Sequence
  Description of Artificial Sequence: Synthetic polypeptide
DEDEIATTNPVAYEQWGSVSGPNEGNQGQMNGDD

SEQ ID NO: 168478 - protein, 35 aa, Artificial Sequence
  Description of Artificial Sequence: Synthetic polypeptide
DEDEIATTNPVAYEQWGSVSGGTGPNHQGQGGGEN

SEQ ID NO: 168479 - protein, 34 aa, Artificial Sequence
  Description of Artificial Sequence: Synthetic polypeptide
DEDEIATTNPVAYEQWGSVSGGPGNHQGEHNNSS

SEQ ID NO: 168480 - protein, 30 aa, Artificial Sequence
  Description of Artificial Sequence: Synthetic polypeptide
DESEVASTNPVGTEGYGVMAASTIQSHGDR

SEQ ID NO: 168481 - protein, 30 aa, Artificial Sequence
  Description of Artificial Sequence: Synthetic polypeptide
QENEIATTNPVATECWGDVSEIEQNAAEDA

SEQ ID NO: 168482 - protein, 38 aa, Artificial Sequence
  Description of Artificial Sequence: Synthetic polypeptide
DEEEIRTTNPVATEAYGVVSTTNNQQGNQQQNGTEQGQ

SEQ ID NO: 168483 - protein, 31 aa, Artificial Sequence
  Description of Artificial Sequence: Synthetic polypeptide
DESEVASTNPVSTECYGNVAAECIQSRVGER

SEQ ID NO: 168484 - protein, 36 aa, Artificial Sequence
  Description of Artificial Sequence: Synthetic polypeptide
DEAEIRTTNPVATEQYGSVPETAANQDTGYSEEVES

SEQ ID NO: 168485 - protein, 35 aa, Artificial Sequence
  Description of Artificial Sequence: Synthetic polypeptide
DEPEIATTNPVATEQYGSVPSSNINQAEVEFEEQI

SEQ ID NO: 168486 - protein, 36 aa, Artificial Sequence
  Description of Artificial Sequence: Synthetic polypeptide
VEEEIRTTNPVATEQYGDVVTGIQNDGQEGDTQQEG

SEQ ID NO: 168487 - protein, 39 aa, Artificial Sequence
  Description of Artificial Sequence: Synthetic polypeptide
DEEEIRTTNPVATEQYGTVTNLQSGTISTNANNQELGNV

SEQ ID NO: 168488 - protein, 37 aa, Artificial Sequence
  Description of Artificial Sequence: Synthetic polypeptide
DEAEIRTTNPVATEQYGSVQWWTQVMQQIGNLGQEFE

SEQ ID NO: 168489 - protein, 33 aa, Artificial Sequence
  Description of Artificial Sequence: Synthetic polypeptide
DEDEIATTNPVAYEQWGSVSHTGAPGEHGGDDD

SEQ ID NO: 168490 - protein, 36 aa, Artificial Sequence
  Description of Artificial Sequence: Synthetic polypeptide
DEDEIRTTNPVATEAWGSVSTVVNNNNGTDEGENGT

SEQ ID NO: 168491 - protein, 35 aa, Artificial Sequence
  Description of Artificial Sequence: Synthetic polypeptide
TESEIRTTNPVAYEAYGTVPSYTQNAVSTREGNAP

SEQ ID NO: 168492 - protein, 33 aa, Artificial Sequence
  Description of Artificial Sequence: Synthetic polypeptide
TESEIRTTNPVAYEAYGTVPFYTQNASSRQNSP

SEQ ID NO: 168493 - protein, 35 aa, Artificial Sequence
  Description of Artificial Sequence: Synthetic polypeptide
DEDEIRTTNPVATEAWGSVSTVVNNNNNDEEENNG

SEQ ID NO: 168494 - protein, 34 aa, Artificial Sequence
  Description of Artificial Sequence: Synthetic polypeptide
TESEIRTTNPVAYEAYGTVPFYTQNASSRGNLAK

SEQ ID NO: 168495 - protein, 31 aa, Artificial Sequence
  Description of Artificial Sequence: Synthetic polypeptide
DESEVAPTNPVSTEGYGNVAANTIQSSVGQR

SEQ ID NO: 168496 - protein, 34 aa, Artificial Sequence
  Description of Artificial Sequence: Synthetic polypeptide
TESEIRTTNPVAYEAYGTVPFYTQNASGLRGNAP

SEQ ID NO: 168497 - protein, 34 aa, Artificial Sequence
  Description of Artificial Sequence: Synthetic polypeptide
TESEIRTTNPVAYEAYGTVPFYTGNASSRGNNPP

SEQ ID NO: 168498 - protein, 34 aa, Artificial Sequence
  Description of Artificial Sequence: Synthetic polypeptide
TESEIRTTNPVAYEAYGTVPFYTANASSIRGNAP

SEQ ID NO: 168499 - protein, 34 aa, Artificial Sequence
  Description of Artificial Sequence: Synthetic polypeptide
TESEIRTTNPVAYEAYGTVPFTTINADSRGNNAP

SEQ ID NO: 168500 - protein, 30 aa, Artificial Sequence
  Description of Artificial Sequence: Synthetic polypeptide
DESEVASTNPISTEGYGNVAAETIQRVGQR

SEQ ID NO: 168501 - protein, 30 aa, Artificial Sequence
  Description of Artificial Sequence: Synthetic polypeptide
QENEIATTNPVATECWGDVSECEQNAAEDL

SEQ ID NO: 168502 - protein, 33 aa, Artificial Sequence
  Description of Artificial Sequence: Synthetic polypeptide
DESEVASTNPVATEGYGNVAATPTIPQMRVGQR

SEQ ID NO: 168503 - protein, 34 aa, Artificial Sequence
  Description of Artificial Sequence: Synthetic polypeptide
TESEIRTTNPVAYEAYGTVPFQTQNASSRGNNAN

SEQ ID NO: 168504 - protein, 35 aa, Artificial Sequence
  Description of Artificial Sequence: Synthetic polypeptide
DEDEIRTTNPVATEAWGSVSTVVNNNNNNDEGETG

SEQ ID NO: 168505 - protein, 38 aa, Artificial Sequence
  Description of Artificial Sequence: Synthetic polypeptide
DEAEIRTTNPVATEQYGSVVCPTGIMLEELRNGNEEVF

SEQ ID NO: 168506 - protein, 36 aa, Artificial Sequence
  Description of Artificial Sequence: Synthetic polypeptide
DEPEIHTTNPVATEQYGSVVSATGDMEDQEEGEDGG

SEQ ID NO: 168507 - protein, 36 aa, Artificial Sequence
  Description of Artificial Sequence: Synthetic polypeptide
DEAEIRTTNPVATEQYGSVSDWAPNTTTGQHLEVES

SEQ ID NO: 168508 - protein, 37 aa, Artificial Sequence
  Description of Artificial Sequence: Synthetic polypeptide
DEEEIRTTNPVATEQYGSVIEPTPIMGAEPGLNVPLQ

SEQ ID NO: 168509 - protein, 30 aa, Artificial Sequence
  Description of Artificial Sequence: Synthetic polypeptide
QENEIATTNPVATECWGDVSECEQNHAEDL

SEQ ID NO: 168510 - protein, 36 aa, Artificial Sequence
  Description of Artificial Sequence: Synthetic polypeptide
VEEEIRTTNPVATEQYGDVVTGIQNDGQEEDGDQEF

SEQ ID NO: 168511 - protein, 35 aa, Artificial Sequence
  Description of Artificial Sequence: Synthetic polypeptide
DEPEICTTNPVATEQYGTVNSATDGPEEGEGENED

SEQ ID NO: 168512 - protein, 37 aa, Artificial Sequence
  Description of Artificial Sequence: Synthetic polypeptide
DEPEICTTNPVATEQYGSVVSSATGDLEDQEEGEDGG

SEQ ID NO: 168513 - protein, 34 aa, Artificial Sequence
  Description of Artificial Sequence: Synthetic polypeptide
TESEIRTTNPVAYEAYGTVPAYTINASSRGNQAP

SEQ ID NO: 168514 - protein, 34 aa, Artificial Sequence
  Description of Artificial Sequence: Synthetic polypeptide
TESEIRTTNPVAYEAWGNVSCINESQDREGGNTG

SEQ ID NO: 168515 - protein, 36 aa, Artificial Sequence
  Description of Artificial Sequence: Synthetic polypeptide
DEEEIATTNPVATEQWGHCNVSATNGLPAEAPGGFP

SEQ ID NO: 168516 - protein, 36 aa, Artificial Sequence
  Description of Artificial Sequence: Synthetic polypeptide
DEPEIKTTNPVATEQYGSVITNDQNIGGEDGGQEEN

SEQ ID NO: 168517 - protein, 33 aa, Artificial Sequence
  Description of Artificial Sequence: Synthetic polypeptide
DESEVASTNPVSTECYGNVSANTIPQDRVGEQR

SEQ ID NO: 168518 - protein, 35 aa, Artificial Sequence
  Description of Artificial Sequence: Synthetic polypeptide
DEQEIATTNPVATEQYGSGSATDGLNEDHQGLEDE

SEQ ID NO: 168519 - protein, 31 aa, Artificial Sequence
  Description of Artificial Sequence: Synthetic polypeptide
AEEEIASVNPVCTEQYGVVSWEDQSFGSEQS

SEQ ID NO: 168520 - protein, 34 aa, Artificial Sequence
  Description of Artificial Sequence: Synthetic polypeptide
DESEISTTNPVAYECWGSVSCANSSDDREGGNVH

SEQ ID NO: 168521 - protein, 37 aa, Artificial Sequence
  Description of Artificial Sequence: Synthetic polypeptide
DEMEIRTTNPVATEQYGSVMSTTHNIIETEGQEEDTH

SEQ ID NO: 168522 - protein, 37 aa, Artificial Sequence
  Description of Artificial Sequence: Synthetic polypeptide
DEAEIRTTNPVATEQYGSVTSFEWNSLEFGQFEQQVP

SEQ ID NO: 168523 - protein, 32 aa, Artificial Sequence
  Description of Artificial Sequence: Synthetic polypeptide
DESEISTTNPVAYEQWGMTCPTDNDDQGQPQR

SEQ ID NO: 168524 - protein, 36 aa, Artificial Sequence
  Description of Artificial Sequence: Synthetic polypeptide
DEMEIRTTNPVATEQYGSVMNTPLWEQQMEYDEIDN

SEQ ID NO: 168525 - protein, 28 aa, Artificial Sequence
  Description of Artificial Sequence: Synthetic peptide
QENEIASTNPVGTEGYGVMAETLQHEDI

SEQ ID NO: 168526 - protein, 28 aa, Artificial Sequence
  Description of Artificial Sequence: Synthetic peptide
QENEIASTNPVGTEGYGVMAETLQHEDL

SEQ ID NO: 168527 - protein, 33 aa, Artificial Sequence
  Description of Artificial Sequence: Synthetic polypeptide
DESEISTTNPVAYEQWGMTCVTDNDDQRQRQNH

SEQ ID NO: 168528 - protein, 34 aa, Artificial Sequence
  Description of Artificial Sequence: Synthetic polypeptide
DEEEISTTNPCATEQYGCVCSWNHNANFGSDTQS

SEQ ID NO: 168529 - protein, 29 aa, Artificial Sequence
  Description of Artificial Sequence: Synthetic peptide
QENEIASTNPVGTEQWGVMASTLMNAGDI

SEQ ID NO: 168530 - protein, 36 aa, Artificial Sequence
  Description of Artificial Sequence: Synthetic polypeptide
DEDEIRTTNPVATDAYGSVVVQTNNGLGQRFDEEDT

SEQ ID NO: 168531 - protein, 37 aa, Artificial Sequence
  Description of Artificial Sequence: Synthetic polypeptide
VEEEIRTTNPVATEQYGAVITDDLDDEGQTDDGGNNL

SEQ ID NO: 168532 - protein, 36 aa, Artificial Sequence
  Description of Artificial Sequence: Synthetic polypeptide
CEEEIRTTNPVATEQYGCVCSMTEEHNQEHFGSDQS

SEQ ID NO: 168533 - protein, 34 aa, Artificial Sequence
  Description of Artificial Sequence: Synthetic polypeptide
DEAEIATTNPVATEQYGSVCAMTGVEPEDMSNFP

SEQ ID NO: 168534 - protein, 35 aa, Artificial Sequence
  Description of Artificial Sequence: Synthetic polypeptide
VEEEIRTTNPVATEQYGAVIVGGDTGQGGENNDNG

SEQ ID NO: 168535 - protein, 38 aa, Artificial Sequence
  Description of Artificial Sequence: Synthetic polypeptide
DEEEIRTTNPVATEQYGSVSTVVVNNNNNDEQGTEEQD

SEQ ID NO: 168536 - protein, 37 aa, Artificial Sequence
  Description of Artificial Sequence: Synthetic polypeptide
DEEEIRTTNPVATEQYGSVCNENTGWLLEERLELDVF

SEQ ID NO: 168537 - protein, 36 aa, Artificial Sequence
  Description of Artificial Sequence: Synthetic polypeptide
DEEEIRTTNPVATEQYGCVCSMWGEEHQENFGSEQA

SEQ ID NO: 168538 - protein, 34 aa, Artificial Sequence
  Description of Artificial Sequence: Synthetic polypeptide
DEDEIRTTNPVATEAWGCVSAINEGGDGEGENGI

SEQ ID NO: 168539 - protein, 34 aa, Artificial Sequence
  Description of Artificial Sequence: Synthetic polypeptide
DEDEIRTTNPVATEAWGDVSAGMEGQDGEGENDG

SEQ ID NO: 168540 - protein, 40 aa, Artificial Sequence
  Description of Artificial Sequence: Synthetic polypeptide
DEEEIRTTNPVATEQYGSVSTVVVTENNNQQGTEQGTNDE

SEQ ID NO: 168541 - protein, 39 aa, Artificial Sequence
  Description of Artificial Sequence: Synthetic polypeptide
DEEEIRTTNPVATEQYGSVSTVVVTNLGNNNDEGTTEDE

SEQ ID NO: 168542 - protein, 37 aa, Artificial Sequence
  Description of Artificial Sequence: Synthetic polypeptide
CEEEIRTTNPVATEQYGCVCSMTGEHMQENFGSDNQS

SEQ ID NO: 168543 - protein, 31 aa, Artificial Sequence
  Description of Artificial Sequence: Synthetic polypeptide
DDSEVASTNPVSTEGYGCVCANTIQSRVGQR

SEQ ID NO: 168544 - protein, 33 aa, Artificial Sequence
  Description of Artificial Sequence: Synthetic polypeptide
DESEIVTTNPVATECWGSVSCIGEPEDFEGENG

SEQ ID NO: 168545 - protein, 37 aa, Artificial Sequence
  Description of Artificial Sequence: Synthetic polypeptide
DEEEIRTTNPVATEQYGSVIFPTYNQETESDDEQNVT

SEQ ID NO: 168546 - protein, 37 aa, Artificial Sequence
  Description of Artificial Sequence: Synthetic polypeptide
DEPEIRTTNPVATEQYGSVSSTTPAMPNMENQMNPVL

SEQ ID NO: 168547 - protein, 38 aa, Artificial Sequence
  Description of Artificial Sequence: Synthetic polypeptide
DEEEIRTTNPVATEQYGSVIFPTFVQETEHRSDEQNVT

SEQ ID NO: 168548 - protein, 28 aa, Artificial Sequence
  Description of Artificial Sequence: Synthetic peptide
QENEIASTNPVGTECYGVMASCLQHEEL

SEQ ID NO: 168549 - protein, 28 aa, Artificial Sequence
  Description of Artificial Sequence: Synthetic peptide
QENEIASTNPVGTECYGVMASCLQHEEI

SEQ ID NO: 168550 - protein, 33 aa, Artificial Sequence
  Description of Artificial Sequence: Synthetic polypeptide
TGEEIATTNPVAYEQWGSVTGGNAGDNREGNSP

SEQ ID NO: 168551 - protein, 34 aa, Artificial Sequence
  Description of Artificial Sequence: Synthetic polypeptide
TGEEIATTNPVAYEQWGSVTGGNAGDLRREGNGP

SEQ ID NO: 168552 - protein, 33 aa, Artificial Sequence
  Description of Artificial Sequence: Synthetic polypeptide
TGEEIATTNPVAYEQWGSVTGGNAGDLREGNQG

SEQ ID NO: 168553 - protein, 35 aa, Artificial Sequence
  Description of Artificial Sequence: Synthetic polypeptide
DEEEISTTNPCATEQYGCVCSTGEHNQNFNSDNQL

SEQ ID NO: 168554 - protein, 34 aa, Artificial Sequence
  Description of Artificial Sequence: Synthetic polypeptide
TGEEIATTNPVAYEQWGSVMWMTNEGDQRGTTEP

SEQ ID NO: 168555 - protein, 34 aa, Artificial Sequence
  Description of Artificial Sequence: Synthetic polypeptide
DESEISTTNPVATEGWGCVCSWMEENQERFGSNQ

SEQ ID NO: 168556 - protein, 34 aa, Artificial Sequence
  Description of Artificial Sequence: Synthetic polypeptide
DESEISTTNPVATEGWGCVCSWMNENQDHFGSNQ

SEQ ID NO: 168557 - protein, 36 aa, Artificial Sequence
  Description of Artificial Sequence: Synthetic polypeptide
DEHEIRTTNPVATEQYGSVESTPLNWAEEIDDEIQN

SEQ ID NO: 168558 - protein, 36 aa, Artificial Sequence
  Description of Artificial Sequence: Synthetic polypeptide
DEEEIATTNPVAYEQYGSVANANHADQTGQDGMNNN

SEQ ID NO: 168559 - protein, 36 aa, Artificial Sequence
  Description of Artificial Sequence: Synthetic polypeptide
DEMEISTTNPVATEQYGITVCSATDGVQVEFQGNDN

SEQ ID NO: 168560 - protein, 36 aa, Artificial Sequence
  Description of Artificial Sequence: Synthetic polypeptide
DESEISTTNPVATEQYGCVCSMTENHQESFNSNNQS

SEQ ID NO: 168561 - protein, 36 aa, Artificial Sequence
  Description of Artificial Sequence: Synthetic polypeptide
TEYEIRTTNPVATEQYGSVNNNEVELEVLGNDETQD

SEQ ID NO: 168562 - protein, 35 aa, Artificial Sequence
  Description of Artificial Sequence: Synthetic polypeptide
CEEEIRTTNPVATEQYGCVCSMSGEHNQGFGSDQS

SEQ ID NO: 168563 - protein, 34 aa, Artificial Sequence
  Description of Artificial Sequence: Synthetic polypeptide
TEYEIRTTNPVATEQYGCTNTSVLFTTRPENKEA

SEQ ID NO: 168564 - protein, 37 aa, Artificial Sequence
  Description of Artificial Sequence: Synthetic polypeptide
DEHEIRTTNPVATEQYGSVESTPLNWAEEEIGDEMQN

SEQ ID NO: 168565 - protein, 36 aa, Artificial Sequence
  Description of Artificial Sequence: Synthetic polypeptide
DEHEIRTTNPVATEQYGSVESSPLSWAEEIGDEPQN

SEQ ID NO: 168566 - protein, 37 aa, Artificial Sequence
  Description of Artificial Sequence: Synthetic polypeptide
DEAEIRTTNPVATEQYGSVTSDTYDPTVQDREESQED

SEQ ID NO: 168567 - protein, 40 aa, Artificial Sequence
  Description of Artificial Sequence: Synthetic polypeptide
DEEEIRTTNPVATEQYGSVSTVVTTTNNNQQGTEAGTNDE

SEQ ID NO: 168568 - protein, 37 aa, Artificial Sequence
  Description of Artificial Sequence: Synthetic polypeptide
DEEEIATTNPVATEQWGHVVANTGNGEYGAEQMGNRP

SEQ ID NO: 168569 - protein, 36 aa, Artificial Sequence
  Description of Artificial Sequence: Synthetic polypeptide
DEHEIRTTNPVATEQYGSVEQTPVNWAEEIGDDPQN

SEQ ID NO: 168570 - protein, 35 aa, Artificial Sequence
  Description of Artificial Sequence: Synthetic polypeptide
DEEEIATTNPVAYEQYGSVANMNNDTATGNGDEHW

SEQ ID NO: 168571 - protein, 34 aa, Artificial Sequence
  Description of Artificial Sequence: Synthetic polypeptide
DESEISTTNPVATEQYGQCVCSTGEHIFFGSDQS

SEQ ID NO: 168572 - protein, 35 aa, Artificial Sequence
  Description of Artificial Sequence: Synthetic polypeptide
CEEEIRTTNPVATEQYGCVCPWEEHQENFGSDNQE

SEQ ID NO: 168573 - protein, 35 aa, Artificial Sequence
  Description of Artificial Sequence: Synthetic polypeptide
DEEEIRTTNPVATEQYGSVIVLVGMGEGDITTDDE

SEQ ID NO: 168574 - protein, 36 aa, Artificial Sequence
  Description of Artificial Sequence: Synthetic polypeptide
DEEEIATTNPVATEQWGHVVANTGNGEYGAEAGNRG

SEQ ID NO: 168575 - protein, 34 aa, Artificial Sequence
  Description of Artificial Sequence: Synthetic polypeptide
CEEEIRTTNPVATEQYGCVCPWGEHQNFNSDNQE

SEQ ID NO: 168576 - protein, 36 aa, Artificial Sequence
  Description of Artificial Sequence: Synthetic polypeptide
DEEEIRTTNPVATEQYGCVCSMWEHNQENFNSNTQS

SEQ ID NO: 168577 - protein, 35 aa, Artificial Sequence
  Description of Artificial Sequence: Synthetic polypeptide
DEEEISTTNPCATEQYGQCVCSTEHNQNFNSDNQS

SEQ ID NO: 168578 - protein, 36 aa, Artificial Sequence
  Description of Artificial Sequence: Synthetic polypeptide
DEEEIRTTNPVATEQYGCTCSMTEEDSQENINSDQS

SEQ ID NO: 168579 - protein, 36 aa, Artificial Sequence
  Description of Artificial Sequence: Synthetic polypeptide
DEEEIRTTNPVATEQYGCTCSMTEEDNQEHIGSEQA

SEQ ID NO: 168580 - protein, 36 aa, Artificial Sequence
  Description of Artificial Sequence: Synthetic polypeptide
TETEIATTNPVAYEQWGSVNKTDNLTQKRSDNGHRN

SEQ ID NO: 168581 - protein, 35 aa, Artificial Sequence
  Description of Artificial Sequence: Synthetic polypeptide
DESEIVTTNPVATEQYGFVCSATDGPVEFEGDNDL

SEQ ID NO: 168582 - protein, 37 aa, Artificial Sequence
  Description of Artificial Sequence: Synthetic polypeptide
DEEEIRTTNPVTTEHWGSVYCWHPNDQDDQRQGGNSR

SEQ ID NO: 168583 - protein, 35 aa, Artificial Sequence
  Description of Artificial Sequence: Synthetic polypeptide
TETEIATTNPVAYEQWGSVNKTDNDTQKRSDNGQR

SEQ ID NO: 168584 - protein, 36 aa, Artificial Sequence
  Description of Artificial Sequence: Synthetic polypeptide
DEPEIRTTNPVATEQYGSVCSWTYDTEIDREDLQID

SEQ ID NO: 168585 - protein, 35 aa, Artificial Sequence
  Description of Artificial Sequence: Synthetic polypeptide
DEEEIATTNPVATEQWGHSNVAATAGGLEAAPGGF

SEQ ID NO: 168586 - protein, 36 aa, Artificial Sequence
  Description of Artificial Sequence: Synthetic polypeptide
DEAEIRTTNPVATEQYGSVSPTVQPSTPEGTEVDSM

SEQ ID NO: 168587 - protein, 32 aa, Artificial Sequence
  Description of Artificial Sequence: Synthetic polypeptide
QENEIATTNPVATEAYGCVCSSELNQHFESEQ

SEQ ID NO: 168588 - protein, 35 aa, Artificial Sequence
  Description of Artificial Sequence: Synthetic polypeptide
DEMEISTTNPVATEQYGQCVCSTGEHQENFGSQQA

SEQ ID NO: 168589 - protein, 37 aa, Artificial Sequence
  Description of Artificial Sequence: Synthetic polypeptide
DEAEIRTTNPVATEQYGSVTTVPNGVEQTISPNEYHQ

SEQ ID NO: 168590 - protein, 37 aa, Artificial Sequence
  Description of Artificial Sequence: Synthetic polypeptide
DEMEIRTTNPVATEQYGSVFSVPSNLTEEEITQESSF

SEQ ID NO: 168591 - protein, 32 aa, Artificial Sequence
  Description of Artificial Sequence: Synthetic polypeptide
QENEIATTNPVATEAYGCVCSWGELQHFSSEL

SEQ ID NO: 168592 - protein, 37 aa, Artificial Sequence
  Description of Artificial Sequence: Synthetic polypeptide
DEEEIRTTNPVATEQYGSVIFPSFSTLELEIVETQVP

SEQ ID NO: 168593 - protein, 36 aa, Artificial Sequence
  Description of Artificial Sequence: Synthetic polypeptide
DEEEIRTTNPVATEQYGSVCCTPWQIQTSLISDPIE

SEQ ID NO: 168594 - protein, 35 aa, Artificial Sequence
  Description of Artificial Sequence: Synthetic polypeptide
DEMEISTTNPVATEQYGTQCSATLGPVEQEGTNVD

SEQ ID NO: 168595 - protein, 35 aa, Artificial Sequence
  Description of Artificial Sequence: Synthetic polypeptide
DEPEIRTTNPVATEQYGSISSWTGTSQQAELEEWN

SEQ ID NO: 168596 - protein, 36 aa, Artificial Sequence
  Description of Artificial Sequence: Synthetic polypeptide
DEPEIRTTNPVATEQYGSISHGVGTSQQHEGSEETN

SEQ ID NO: 168597 - protein, 36 aa, Artificial Sequence
  Description of Artificial Sequence: Synthetic polypeptide
DEEEIRTTNPVATEQYGCVCSMWGEHEQESSNSEQS

SEQ ID NO: 168598 - protein, 38 aa, Artificial Sequence
  Description of Artificial Sequence: Synthetic polypeptide
DEEEIRTTNPVATEAYGVVSTTNNQAGNNTEQGNNVAQ

SEQ ID NO: 168599 - protein, 34 aa, Artificial Sequence
  Description of Artificial Sequence: Synthetic polypeptide
DEMEISTTNPVATEQYGTVCSATDGPVEVFEHND

SEQ ID NO: 168600 - protein, 36 aa, Artificial Sequence
  Description of Artificial Sequence: Synthetic polypeptide
DEEEIRTTNPVATEQYGCVCSMWGEHNENFGSETQG

SEQ ID NO: 168601 - protein, 37 aa, Artificial Sequence
  Description of Artificial Sequence: Synthetic polypeptide
DEPEIRTTNPVATEQYGETTSTTPNPHENFRQGDNSV

SEQ ID NO: 168602 - protein, 36 aa, Artificial Sequence
  Description of Artificial Sequence: Synthetic polypeptide
DEMEISTTNPVATEQYGTVCSATDGVQVEQFQGGND

SEQ ID NO: 168603 - protein, 34 aa, Artificial Sequence
  Description of Artificial Sequence: Synthetic polypeptide
TESEIRTTNPVAYERYGITVPFYTQNASSRGNAP

SEQ ID NO: 168604 - protein, 35 aa, Artificial Sequence
  Description of Artificial Sequence: Synthetic polypeptide
CEEEIRTTNPVATEQYGCVCSNWGEHANFGSNFQS

SEQ ID NO: 168605 - protein, 36 aa, Artificial Sequence
  Description of Artificial Sequence: Synthetic polypeptide
DEEEIRTTNPVATEQYGCVCSMWGEHNQEGFGSDQS

SEQ ID NO: 168606 - protein, 36 aa, Artificial Sequence
  Description of Artificial Sequence: Synthetic polypeptide
DEEEIRTTNPVATEQYGSVCCMLLMNHEPAQDEMLD

SEQ ID NO: 168607 - protein, 39 aa, Artificial Sequence
  Description of Artificial Sequence: Synthetic polypeptide
DEEEIRTTNPVATEQYGSVSTVVVVQNGTTEQGTEQGTD

SEQ ID NO: 168608 - protein, 36 aa, Artificial Sequence
  Description of Artificial Sequence: Synthetic polypeptide
DEPEIRTTNPVATEQYGSVIPTVPNGEVPIGEAFDP

SEQ ID NO: 168609 - protein, 37 aa, Artificial Sequence
  Description of Artificial Sequence: Synthetic polypeptide
DEPEIRTTNPVATEQYGSVISPANNEIEPGPNVNTVI

SEQ ID NO: 168610 - protein, 36 aa, Artificial Sequence
  Description of Artificial Sequence: Synthetic polypeptide
DEEEIRTTNPVATEQYGSVCMPESSLQQTDPVEIEA

SEQ ID NO: 168611 - protein, 36 aa, Artificial Sequence
  Description of Artificial Sequence: Synthetic polypeptide
DEEEIRTTNPVATEQYGCTCSMSEEDHNQSIGSDQS

SEQ ID NO: 168612 - protein, 34 aa, Artificial Sequence
  Description of Artificial Sequence: Synthetic polypeptide
CEEEIRTTNPVATEQYGCVCSMWGEHQGFISDQS

SEQ ID NO: 168613 - protein, 29 aa, Artificial Sequence
  Description of Artificial Sequence: Synthetic peptide
QENEIATTNPIATECYGATWSECWQPEEL

SEQ ID NO: 168614 - protein, 36 aa, Artificial Sequence
  Description of Artificial Sequence: Synthetic polypeptide
DEEEIRTTNPVATEQYGCVCSMWGEHAENFNSNNQL

SEQ ID NO: 168615 - protein, 35 aa, Artificial Sequence
  Description of Artificial Sequence: Synthetic polypeptide
VEEEIRTTNPVATEQYGAVTVDVNGGQQNGQGEGD

SEQ ID NO: 168616 - protein, 35 aa, Artificial Sequence
  Description of Artificial Sequence: Synthetic polypeptide
DEEEIRTTNPVATEQYGCVCSMWGEHAENFPSDQP

SEQ ID NO: 168617 - protein, 34 aa, Artificial Sequence
  Description of Artificial Sequence: Synthetic polypeptide
DESEIVTTNPVATECYGTVCSACDNPPEDFEGND

SEQ ID NO: 168618 - protein, 37 aa, Artificial Sequence
  Description of Artificial Sequence: Synthetic polypeptide
DEEEIRTTNPVATEQYGSVIFPTFNQETEESNEQNVT

SEQ ID NO: 168619 - protein, 34 aa, Artificial Sequence
  Description of Artificial Sequence: Synthetic polypeptide
DESEIVTTNPVATECYGTVCSACINEPEDFEGND

SEQ ID NO: 168620 - protein, 34 aa, Artificial Sequence
  Description of Artificial Sequence: Synthetic polypeptide
DESEIVTTNPVATECYGTVCSACINPPEDFEGND

SEQ ID NO: 168621 - protein, 29 aa, Artificial Sequence
  Description of Artificial Sequence: Synthetic peptide
QENEIATTNPIATECYGDVAAECLAPEEI

SEQ ID NO: 168622 - protein, 36 aa, Artificial Sequence
  Description of Artificial Sequence: Synthetic polypeptide
DEPEIRTTNPVATEQYGSVISNSHDNGTETFGSIQI

SEQ ID NO: 168623 - protein, 36 aa, Artificial Sequence
  Description of Artificial Sequence: Synthetic polypeptide
DEEEIRTTNPVATEQYGSVCMPEQSLQQHDPVEIEF

SEQ ID NO: 168624 - protein, 34 aa, Artificial Sequence
  Description of Artificial Sequence: Synthetic polypeptide
DESEIVTTNPVATECYGTVSATDGEVEDFEGENG

SEQ ID NO: 168625 - protein, 36 aa, Artificial Sequence
  Description of Artificial Sequence: Synthetic polypeptide
DEPEIRTTNPVATEQYGSVPPAVNLEIEPENVNTVI

SEQ ID NO: 168626 - protein, 33 aa, Artificial Sequence
  Description of Artificial Sequence: Synthetic polypeptide
DESEIVTTNPVATECYGTVSCIGEPEDFEGENG

SEQ ID NO: 168627 - protein, 36 aa, Artificial Sequence
  Description of Artificial Sequence: Synthetic polypeptide
DEEEIRTTNPVATEQYGSVIYISMGEEVPEGEDPEI

SEQ ID NO: 168628 - protein, 35 aa, Artificial Sequence
  Description of Artificial Sequence: Synthetic polypeptide
CEEEIRTTNPVATEQYGCVCSNTGEDQENFFSDQA

SEQ ID NO: 168629 - protein, 35 aa, Artificial Sequence
  Description of Artificial Sequence: Synthetic polypeptide
CEEEIRTTNPVATEQYGCVCSNTGEHDQNFISDQF

SEQ ID NO: 168630 - protein, 36 aa, Artificial Sequence
  Description of Artificial Sequence: Synthetic polypeptide
DEEEIRTTNPVATEQYGSVCHNSVNSMEVPSFAQQD

SEQ ID NO: 168631 - protein, 34 aa, Artificial Sequence
  Description of Artificial Sequence: Synthetic polypeptide
DEDEIRTTNPVATEAWGSVSAGMEEGGDGEGENG

SEQ ID NO: 168632 - protein, 37 aa, Artificial Sequence
  Description of Artificial Sequence: Synthetic polypeptide
DEAEIRTTNPVATEQYGSVTSVMLEVELDRFDGSIME

SEQ ID NO: 168633 - protein, 37 aa, Artificial Sequence
  Description of Artificial Sequence: Synthetic polypeptide
DEEEIRTTNPVATEQYGSVCFPSFMTQELEIVEVQVL

SEQ ID NO: 168634 - protein, 36 aa, Artificial Sequence
  Description of Artificial Sequence: Synthetic polypeptide
CEEEIRTTNPVATEQYGCVCSNTGEHNQEHFNSEQI

SEQ ID NO: 168635 - protein, 37 aa, Artificial Sequence
  Description of Artificial Sequence: Synthetic polypeptide
DEEEIRTTNPVATEQYGSVCEVIENILEDPQQPVPVQ

SEQ ID NO: 168636 - protein, 34 aa, Artificial Sequence
  Description of Artificial Sequence: Synthetic polypeptide
DESEIVTTNPVATECYGTVSATDGEPEDFEGENG

SEQ ID NO: 168637 - protein, 36 aa, Artificial Sequence
  Description of Artificial Sequence: Synthetic polypeptide
DEEEIRTTNPVATEQYGCVCSMWEEHNTENFNSDQA

SEQ ID NO: 168638 - protein, 36 aa, Artificial Sequence
  Description of Artificial Sequence: Synthetic polypeptide
DEPEIATTNPVATEQYGSVIDTMNANGQGEGGGQQQ

SEQ ID NO: 168639 - protein, 36 aa, Artificial Sequence
  Description of Artificial Sequence: Synthetic polypeptide
DEPEIATTNPVATEQYGSVIDDTNGNGQGEQGGQQQ

SEQ ID NO: 168640 - protein, 32 aa, Artificial Sequence
  Description of Artificial Sequence: Synthetic polypeptide
DENNIRTTNPVSTEPYGTISMEDVQQQQNGNH

SEQ ID NO: 168641 - protein, 32 aa, Artificial Sequence
  Description of Artificial Sequence: Synthetic polypeptide
DENNIRTTNPVSTEPYGTISMEDIQQQQNGNH

SEQ ID NO: 168642 - protein, 35 aa, Artificial Sequence
  Description of Artificial Sequence: Synthetic polypeptide
DESEIRTTNPVATEGWGCVCSWMEENAERFGSNQS

SEQ ID NO: 168643 - protein, 36 aa, Artificial Sequence
  Description of Artificial Sequence: Synthetic polypeptide
DEEEIRTTNPVSTETYGSVSMVYTAQQKTEEVGLLN

SEQ ID NO: 168644 - protein, 38 aa, Artificial Sequence
  Description of Artificial Sequence: Synthetic polypeptide
DEEEIRTTNPVATEQYGVVSTVVNNQQQGTEAGTEEQD

SEQ ID NO: 168645 - protein, 35 aa, Artificial Sequence
  Description of Artificial Sequence: Synthetic polypeptide
DEEEIRTTNPVSTETYGSVSMVYTAEQKTEVVVLN

SEQ ID NO: 168646 - protein, 38 aa, Artificial Sequence
  Description of Artificial Sequence: Synthetic polypeptide
DEEEIRTTNPVATEQYGVVSTVVNNTEQGNNNTEQGED

SEQ ID NO: 168647 - protein, 37 aa, Artificial Sequence
  Description of Artificial Sequence: Synthetic polypeptide
DEEEIRTTNPVATEQYGSVAYYLMNGEEQMIMNAEEL

SEQ ID NO: 168648 - protein, 31 aa, Artificial Sequence
  Description of Artificial Sequence: Synthetic polypeptide
QENEIATTNPVATECYGDVSAECPVQFEEEL

SEQ ID NO: 168649 - protein, 35 aa, Artificial Sequence
  Description of Artificial Sequence: Synthetic polypeptide
TESEIRTTNPSATEEWGSTVSYTNAISQSGGNPWD

SEQ ID NO: 168650 - protein, 31 aa, Artificial Sequence
  Description of Artificial Sequence: Synthetic polypeptide
DDSEVAPTNPVSTEGYGNVAANTIQSRLGQR

SEQ ID NO: 168651 - protein, 35 aa, Artificial Sequence
  Description of Artificial Sequence: Synthetic polypeptide
DEEEIATTNPVAYEQYGSVCQAANVNDGMAEANDS

SEQ ID NO: 168652 - protein, 32 aa, Artificial Sequence
  Description of Artificial Sequence: Synthetic polypeptide
DENNIRTTNPVSTEPYGTISMEPIQQQQNGNH

SEQ ID NO: 168653 - protein, 35 aa, Artificial Sequence
  Description of Artificial Sequence: Synthetic polypeptide
DEEEIRTTNPVSTETYGSVSMVYTAAKTEVVGYLE

SEQ ID NO: 168654 - protein, 34 aa, Artificial Sequence
  Description of Artificial Sequence: Synthetic polypeptide
AEEEIATTNPVATEEYGCICCCNDSTRPGTNNVR

SEQ ID NO: 168655 - protein, 32 aa, Artificial Sequence
  Description of Artificial Sequence: Synthetic polypeptide
DESEVRSTNPVATECWGNVWAANDWQSRKGQI

SEQ ID NO: 168656 - protein, 37 aa, Artificial Sequence
  Description of Artificial Sequence: Synthetic polypeptide
DEEEIRTTNPVATEQYGSVAYLMNMEEQMIMNEEPIL

SEQ ID NO: 168657 - protein, 36 aa, Artificial Sequence
  Description of Artificial Sequence: Synthetic polypeptide
DEEEIRTTNPVATEQYGSVSVESVHSDDPNVLEFEE

SEQ ID NO: 168658 - protein, 34 aa, Artificial Sequence
  Description of Artificial Sequence: Synthetic polypeptide
DESEIRTTNPVATEGWGCVCSWMAENQEHEGSNQ

SEQ ID NO: 168659 - protein, 33 aa, Artificial Sequence
  Description of Artificial Sequence: Synthetic polypeptide
AEEEIATTNPVATEEYGCICCCTLSGRPGGNNV

SEQ ID NO: 168660 - protein, 31 aa, Artificial Sequence
  Description of Artificial Sequence: Synthetic polypeptide
DESEVRSTNPVATEGYGDVAAEIIQSAAGDA

SEQ ID NO: 168661 - protein, 36 aa, Artificial Sequence
  Description of Artificial Sequence: Synthetic polypeptide
DEEEIRTTNPVATEQYGCVCSNSEHNIENFNSDNQS

SEQ ID NO: 168662 - protein, 35 aa, Artificial Sequence
  Description of Artificial Sequence: Synthetic polypeptide
DEEEIRTTNPVATEQYGCVCSNSEHNQENFISDQT

SEQ ID NO: 168663 - protein, 31 aa, Artificial Sequence
  Description of Artificial Sequence: Synthetic polypeptide
DESEVRSTNPVSTEGWGNVAANIIMSRVGQR

SEQ ID NO: 168664 - protein, 36 aa, Artificial Sequence
  Description of Artificial Sequence: Synthetic polypeptide
DEEEIRTTNPVATEQYGSVAYCMQGEEQMIMNAEEL

SEQ ID NO: 168665 - protein, 32 aa, Artificial Sequence
  Description of Artificial Sequence: Synthetic polypeptide
DENMIRTTNPVSTEPYGTISMEDIQQQQNGNH

SEQ ID NO: 168666 - protein, 35 aa, Artificial Sequence
  Description of Artificial Sequence: Synthetic polypeptide
DEEEIRTTNPVATEQYGCVCSNSEHNEEGFISEQA

SEQ ID NO: 168667 - protein, 35 aa, Artificial Sequence
  Description of Artificial Sequence: Synthetic polypeptide
VEEEIRTTNPVATEQYGSVDNLMNANEEGGGGETN

SEQ ID NO: 168668 - protein, 35 aa, Artificial Sequence
  Description of Artificial Sequence: Synthetic polypeptide
DEEEIRTTNPVSTETYGSVSMVYTAQSTESVGYLN

SEQ ID NO: 168669 - protein, 35 aa, Artificial Sequence
  Description of Artificial Sequence: Synthetic polypeptide
DESEIRTTNPVATEGWGCVCSWMEENQDRFGSNNQ

SEQ ID NO: 168670 - protein, 35 aa, Artificial Sequence
  Description of Artificial Sequence: Synthetic polypeptide
DEDEIRTTNPVATEAWGVVSTVVNNEQGTNNQQGE

SEQ ID NO: 168671 - protein, 36 aa, Artificial Sequence
  Description of Artificial Sequence: Synthetic polypeptide
CEEEIRTTNPVATEQYGCVCSTWPEHNQNFNSENQS

SEQ ID NO: 168672 - protein, 34 aa, Artificial Sequence
  Description of Artificial Sequence: Synthetic polypeptide
DAAEIATTNPVAYEQYGSVAITNQDGNGNGTEGD

SEQ ID NO: 168673 - protein, 34 aa, Artificial Sequence
  Description of Artificial Sequence: Synthetic polypeptide
DAAEIATTNPVAYEQYGSVAITNQDNGNPTEGDD

SEQ ID NO: 168674 - protein, 35 aa, Artificial Sequence
  Description of Artificial Sequence: Synthetic polypeptide
DEDEIRTTNPVATEAWGVVSTVVNSEQGTNNEQGT

SEQ ID NO: 168675 - protein, 36 aa, Artificial Sequence
  Description of Artificial Sequence: Synthetic polypeptide
VEEEIRTTNPVATEQYGSVCESTVIEVAERQLLDID

SEQ ID NO: 168676 - protein, 39 aa, Artificial Sequence
  Description of Artificial Sequence: Synthetic polypeptide
DEEEIRTTNPVATEQYGVVSTVVNNQQLGGNQQGTEEQD

SEQ ID NO: 168677 - protein, 36 aa, Artificial Sequence
  Description of Artificial Sequence: Synthetic polypeptide
DEEEIRTTNPVATEQYGSVLPADNQFIPNTIELSEL

SEQ ID NO: 168678 - protein, 38 aa, Artificial Sequence
  Description of Artificial Sequence: Synthetic polypeptide
DEEEIRTTNPVATEQYGVVSTVVNNQQNLNQGEEEEEE

SEQ ID NO: 168679 - protein, 34 aa, Artificial Sequence
  Description of Artificial Sequence: Synthetic polypeptide
DEDEIRTTNPVATEAWGVVTVVNNNNNQDEGENG

SEQ ID NO: 168680 - protein, 36 aa, Artificial Sequence
  Description of Artificial Sequence: Synthetic polypeptide
DEEEIATTNPVAYEQYGSVCGPLNAGPQEAEDGNEN

SEQ ID NO: 168681 - protein, 31 aa, Artificial Sequence
  Description of Artificial Sequence: Synthetic polypeptide
DESEVATTNPVSTEGWGNVAACTEQSRVGQR

SEQ ID NO: 168682 - protein, 36 aa, Artificial Sequence
  Description of Artificial Sequence: Synthetic polypeptide
DEEEIATTNPVAYEQYGSVCQAANVLDQMALEANDN

SEQ ID NO: 168683 - protein, 31 aa, Artificial Sequence
  Description of Artificial Sequence: Synthetic polypeptide
DESEVATTNPVSTEGYGEAAAETCQSRVGQR

SEQ ID NO: 168684 - protein, 33 aa, Artificial Sequence
  Description of Artificial Sequence: Synthetic polypeptide
DESEVATTNPVSTEGYGNVAACTEPQSREGEQR

SEQ ID NO: 168685 - protein, 37 aa, Artificial Sequence
  Description of Artificial Sequence: Synthetic polypeptide
DEEEIRTTNPVATEQYGCVCSNSEETNQEYFNSENQS

SEQ ID NO: 168686 - protein, 32 aa, Artificial Sequence
  Description of Artificial Sequence: Synthetic polypeptide
DENPIRTTNPVSTEPYGTISMYDIQQQQNGNH

SEQ ID NO: 168687 - protein, 34 aa, Artificial Sequence
  Description of Artificial Sequence: Synthetic polypeptide
DESEIRTTNPVATEGWGCVCSWMEENQEREGSQQ

SEQ ID NO: 168688 - protein, 35 aa, Artificial Sequence
  Description of Artificial Sequence: Synthetic polypeptide
DEEEIATTNPVAYEQYGSVCQAANDLPAAEHANDS

SEQ ID NO: 168689 - protein, 32 aa, Artificial Sequence
  Description of Artificial Sequence: Synthetic polypeptide
DENPIRTTNPVSTEPYGTISMEDIQQQQPGNH

SEQ ID NO: 168690 - protein, 30 aa, Artificial Sequence
  Description of Artificial Sequence: Synthetic polypeptide
DESEVATTNPVSTEGYGNVAETIQSHVGQK

SEQ ID NO: 168691 - protein, 32 aa, Artificial Sequence
  Description of Artificial Sequence: Synthetic polypeptide
DENPIRTTNPVSTEPYGTISMEDIQQQQNGNH

SEQ ID NO: 168692 - protein, 33 aa, Artificial Sequence
  Description of Artificial Sequence: Synthetic polypeptide
DEEEISTTNPEATCQYGCVCPTEHNQYFGSDFS

SEQ ID NO: 168693 - protein, 35 aa, Artificial Sequence
  Description of Artificial Sequence: Synthetic polypeptide
VEEEIRTTNPVATEQYGSVCYPELQDEQEASPVIE

SEQ ID NO: 168694 - protein, 34 aa, Artificial Sequence
  Description of Artificial Sequence: Synthetic polypeptide
DESEVATTNPVSTEGYGNVSAANAIPQSRVGMQR

SEQ ID NO: 168695 - protein, 31 aa, Artificial Sequence
  Description of Artificial Sequence: Synthetic polypeptide
DENPILTTNPVATEQWGFVSVIEMNAAEDTA

SEQ ID NO: 168696 - protein, 39 aa, Artificial Sequence
  Description of Artificial Sequence: Synthetic polypeptide
DEEEIRTTNPVATEQYGVVSTVVNNQQNTQQGTTNQEQD

SEQ ID NO: 168697 - protein, 32 aa, Artificial Sequence
  Description of Artificial Sequence: Synthetic polypeptide
DENQIRTTNPVSTEPYGIISMEDIQQQQNGNH

SEQ ID NO: 168698 - protein, 35 aa, Artificial Sequence
  Description of Artificial Sequence: Synthetic polypeptide
AEEEIATTNPVATEEYGCINCCTNLSMRPGGNNVY

SEQ ID NO: 168699 - protein, 34 aa, Artificial Sequence
  Description of Artificial Sequence: Synthetic polypeptide
DEEEISTTNPEATEQYGCVCPTEEDNANFGSDQS

SEQ ID NO: 168700 - protein, 35 aa, Artificial Sequence
  Description of Artificial Sequence: Synthetic polypeptide
DEEEIRTTNPVSTETYGSVSMVITAEQDTELMFLN

SEQ ID NO: 168701 - protein, 32 aa, Artificial Sequence
  Description of Artificial Sequence: Synthetic polypeptide
DESEVRTTNPVSTEGYGTISMEDIQQSQVGQR

SEQ ID NO: 168702 - protein, 39 aa, Artificial Sequence
  Description of Artificial Sequence: Synthetic polypeptide
DEEEIRTTNPVATEQYGTVTNLQSGTIGTNTQNSEQGNQ

SEQ ID NO: 168703 - protein, 32 aa, Artificial Sequence
  Description of Artificial Sequence: Synthetic polypeptide
DESEVRTTNPVSTEPYGTISMEDIQQQQVGNH

SEQ ID NO: 168704 - protein, 32 aa, Artificial Sequence
  Description of Artificial Sequence: Synthetic polypeptide
DENIIRTTNPVSTEPYGTISMEDIQQQQNGNH

SEQ ID NO: 168705 - protein, 32 aa, Artificial Sequence
  Description of Artificial Sequence: Synthetic polypeptide
DENIIRTTNPVSTEPYGTISMEDIQQQNNGNH

SEQ ID NO: 168706 - protein, 32 aa, Artificial Sequence
  Description of Artificial Sequence: Synthetic polypeptide
DENIIRTTNPVSTEPYGTISGEDIQQQQNGNH

SEQ ID NO: 168707 - protein, 34 aa, Artificial Sequence
  Description of Artificial Sequence: Synthetic polypeptide
DEAEIRTTNPVATEQYGSVWDTYDVTTIDTESED

SEQ ID NO: 168708 - protein, 37 aa, Artificial Sequence
  Description of Artificial Sequence: Synthetic polypeptide
DEDEIRTTNPVATEAYGSVSTVVNNNNQQQTNETTTE

SEQ ID NO: 168709 - protein, 30 aa, Artificial Sequence
  Description of Artificial Sequence: Synthetic polypeptide
DENIIRTTNPVATEPWGDVSEIEMNAAEDA

SEQ ID NO: 168710 - protein, 37 aa, Artificial Sequence
  Description of Artificial Sequence: Synthetic polypeptide
DEDEIRTTNPVATEAYGSVSTVVNNQNQNQQGTTTTE

SEQ ID NO: 168711 - protein, 34 aa, Artificial Sequence
  Description of Artificial Sequence: Synthetic polypeptide
DEMEISTVNPVATEQYGCVCSWEELANFGSDNQS

SEQ ID NO: 168712 - protein, 32 aa, Artificial Sequence
  Description of Artificial Sequence: Synthetic polypeptide
DESEVRTTNPVSTEGYGTISMEDIQQSQVGNH

SEQ ID NO: 168713 - protein, 33 aa, Artificial Sequence
  Description of Artificial Sequence: Synthetic polypeptide
DEMEISTVNPVATEQYGCVCSWEHANFGSNNQS

SEQ ID NO: 168714 - protein, 32 aa, Artificial Sequence
  Description of Artificial Sequence: Synthetic polypeptide
DENHIRTTNPVSTEPYGTISMEDIGQQQNGNH

SEQ ID NO: 168715 - protein, 38 aa, Artificial Sequence
  Description of Artificial Sequence: Synthetic polypeptide
DEEEIRTTNPVATEAYGVVSTTNQAQGNNNQQGTNQDT

SEQ ID NO: 168716 - protein, 33 aa, Artificial Sequence
  Description of Artificial Sequence: Synthetic polypeptide
DESEVVTTNPVSTEQYGTVCAATTPVESREGND

SEQ ID NO: 168717 - protein, 34 aa, Artificial Sequence
  Description of Artificial Sequence: Synthetic polypeptide
DAAEIATTNPVAYEQYGSVCTANIGERPDDQGAE

SEQ ID NO: 168718 - protein, 36 aa, Artificial Sequence
  Description of Artificial Sequence: Synthetic polypeptide
DEAEIATTNPVATEQYGSVCADHNHPLENGMPMENH

SEQ ID NO: 168719 - protein, 37 aa, Artificial Sequence
  Description of Artificial Sequence: Synthetic polypeptide
DEEEIRTTNPVATEAYGVVSTTNQNNNQQGTTDEEED

SEQ ID NO: 168720 - protein, 35 aa, Artificial Sequence
  Description of Artificial Sequence: Synthetic polypeptide
DEMEITTTNPVATEQYGAVCSATSGWVEFQHENID

SEQ ID NO: 168721 - protein, 35 aa, Artificial Sequence
  Description of Artificial Sequence: Synthetic polypeptide
DEHEIRTTNPVATENYGCVATTPGMQQDRQGGDHP

SEQ ID NO: 168722 - protein, 31 aa, Artificial Sequence
  Description of Artificial Sequence: Synthetic polypeptide
TESEIASTNPVGTEGYGVTIASTLQHGGDNI

SEQ ID NO: 168723 - protein, 36 aa, Artificial Sequence
  Description of Artificial Sequence: Synthetic polypeptide
DEEEIRTTNPVAYEQYGQCVCSNWMNDHNQNFGSQQ

SEQ ID NO: 168724 - protein, 34 aa, Artificial Sequence
  Description of Artificial Sequence: Synthetic polypeptide
DEMEITTTNPVATEQYGTVCSANSGPVEFEMEND

SEQ ID NO: 168725 - protein, 32 aa, Artificial Sequence
  Description of Artificial Sequence: Synthetic polypeptide
DENGIRTTNPVSTEPYGTISMEDIQQVQNGNH

SEQ ID NO: 168726 - protein, 32 aa, Artificial Sequence
  Description of Artificial Sequence: Synthetic polypeptide
DENHIRTTNPVSTEPYGTISMEDIQQQQNGNH

SEQ ID NO: 168727 - protein, 36 aa, Artificial Sequence
  Description of Artificial Sequence: Synthetic polypeptide
DEEEIRTTNPVATEQYGCVCSNSEHNQENFNSDTQS

SEQ ID NO: 168728 - protein, 32 aa, Artificial Sequence
  Description of Artificial Sequence: Synthetic polypeptide
DESEVRTTNPVSTEGYGTISMEDIQQQQVGNH

SEQ ID NO: 168729 - protein, 32 aa, Artificial Sequence
  Description of Artificial Sequence: Synthetic polypeptide
DENKIRTTNPVSTEPYGTISMCDIQQQQNGNH

SEQ ID NO: 168730 - protein, 35 aa, Artificial Sequence
  Description of Artificial Sequence: Synthetic polypeptide
DEEEIRTTNPVATEQYGCVCSNSEHNQEYFSSDQA

SEQ ID NO: 168731 - protein, 35 aa, Artificial Sequence
  Description of Artificial Sequence: Synthetic polypeptide
DESEIRTTNPVATEGWGCVCSWGNENQEYIGSNQM

SEQ ID NO: 168732 - protein, 36 aa, Artificial Sequence
  Description of Artificial Sequence: Synthetic polypeptide
DEHEIRTTNPVATEPYGKTISTGNEFEGLNESGSNQ

SEQ ID NO: 168733 - protein, 31 aa, Artificial Sequence
  Description of Artificial Sequence: Synthetic polypeptide
DDSEVAPTNPCSTEGYGIVSANNLQSSVGQR

SEQ ID NO: 168734 - protein, 34 aa, Artificial Sequence
  Description of Artificial Sequence: Synthetic polypeptide
DESEIRTTNPVATEGWGCVCSWGNENQEYENSNQ

SEQ ID NO: 168735 - protein, 34 aa, Artificial Sequence
  Description of Artificial Sequence: Synthetic polypeptide
DEEEIRTTNPVSTETYGSVSMVSTLGADTEVELQ

SEQ ID NO: 168736 - protein, 35 aa, Artificial Sequence
  Description of Artificial Sequence: Synthetic polypeptide
DEHEIRTTNPVATEPWGVVCFTNEDQHHRGGTGSE

SEQ ID NO: 168737 - protein, 36 aa, Artificial Sequence
  Description of Artificial Sequence: Synthetic polypeptide
DEEEIATTNPVAYEQYGSVCSPAPHLNEAPMGEARN

SEQ ID NO: 168738 - protein, 29 aa, Artificial Sequence
  Description of Artificial Sequence: Synthetic peptide
TESEIASTNPVGYEPYGVIASTLQHGGDI

SEQ ID NO: 168739 - protein, 37 aa, Artificial Sequence
  Description of Artificial Sequence: Synthetic polypeptide
DEEEIATTNPVAYEQYGSVCSPPNAGPQEAEIGNEND

SEQ ID NO: 168740 - protein, 36 aa, Artificial Sequence
  Description of Artificial Sequence: Synthetic polypeptide
DEMEIRTTNPVATEQYGSVCSHPDVLDSRFVEFFEM

SEQ ID NO: 168741 - protein, 30 aa, Artificial Sequence
  Description of Artificial Sequence: Synthetic polypeptide
TESEIASTNPVGYEGYGVMACSTELQHGDI

SEQ ID NO: 168742 - protein, 37 aa, Artificial Sequence
  Description of Artificial Sequence: Synthetic polypeptide
DEEEIRTTNPVATEQYGSVIECRMSEDLEIQLSEDIQ

SEQ ID NO: 168743 - protein, 34 aa, Artificial Sequence
  Description of Artificial Sequence: Synthetic polypeptide
DESEVRTTNPVATEGWGNVSACINEPQSRVGEQG

SEQ ID NO: 168744 - protein, 32 aa, Artificial Sequence
  Description of Artificial Sequence: Synthetic polypeptide
DENLIRTTNPVSTEPYGTISMEDIQQQVNGNH

SEQ ID NO: 168745 - protein, 32 aa, Artificial Sequence
  Description of Artificial Sequence: Synthetic polypeptide
DENLIRTTNPVSTEPYGTISMEDIQQQQNGNL

SEQ ID NO: 168746 - protein, 32 aa, Artificial Sequence
  Description of Artificial Sequence: Synthetic polypeptide
DENLIRTTNPVSTEPYGTISMEDIQQQQNGNH

SEQ ID NO: 168747 - protein, 32 aa, Artificial Sequence
  Description of Artificial Sequence: Synthetic polypeptide
DENLIRTTNPVSTEPYGTISMCDIQQQQNGNH

SEQ ID NO: 168748 - protein, 34 aa, Artificial Sequence
  Description of Artificial Sequence: Synthetic polypeptide
DESEIRTTNPVATEGWGCVCSWGEENQEYSGSNQ

SEQ ID NO: 168749 - protein, 36 aa, Artificial Sequence
  Description of Artificial Sequence: Synthetic polypeptide
VEEEIRTTNPVATEQYGSVGLTPWLIVSQPPESQLP

SEQ ID NO: 168750 - protein, 30 aa, Artificial Sequence
  Description of Artificial Sequence: Synthetic polypeptide
DENLIGTTNPVATEQWGDVSEIEMNAAEDA

SEQ ID NO: 168751 - protein, 32 aa, Artificial Sequence
  Description of Artificial Sequence: Synthetic polypeptide
DENKIRTTNPVSTEPYGTISMIDIQQQQNGNH

SEQ ID NO: 168752 - protein, 32 aa, Artificial Sequence
  Description of Artificial Sequence: Synthetic polypeptide
DENKIRTTNPVSTEPYGTISMEDIQQSQNGNH

SEQ ID NO: 168753 - protein, 32 aa, Artificial Sequence
  Description of Artificial Sequence: Synthetic polypeptide
DENKIRTTNPVSTEPYGTISMEDIQQQQNGNH

SEQ ID NO: 168754 - protein, 32 aa, Artificial Sequence
  Description of Artificial Sequence: Synthetic polypeptide
DENKIRTTNPVSTEPYGTISMEDIQGQQNGNH

SEQ ID NO: 168755 - protein, 36 aa, Artificial Sequence
  Description of Artificial Sequence: Synthetic polypeptide
VEEEIRTTNPVATEQYGSVGLTPWLTVSQMPEEQLF

SEQ ID NO: 168756 - protein, 32 aa, Artificial Sequence
  Description of Artificial Sequence: Synthetic polypeptide
DENLIRTTNPVSTEPYGTISMEQIQQQQNGNH

SEQ ID NO: 168757 - protein, 35 aa, Artificial Sequence
  Description of Artificial Sequence: Synthetic polypeptide
DEAEIRTTNPVATEQYGSVVEWEVQEQFVFGSDQF

SEQ ID NO: 168758 - protein, 32 aa, Artificial Sequence
  Description of Artificial Sequence: Synthetic polypeptide
DENQIRTTNPVSTEPYGTISMEDIQQQQIGNH

SEQ ID NO: 168759 - protein, 36 aa, Artificial Sequence
  Description of Artificial Sequence: Synthetic polypeptide
DEEEIRTTNPVATEQYGSVIEPALNNVEPRLELEGY

SEQ ID NO: 168760 - protein, 32 aa, Artificial Sequence
  Description of Artificial Sequence: Synthetic polypeptide
DENVIRTTNPVSTEPYGTIVMEDIQQQQNGNH

SEQ ID NO: 168761 - protein, 32 aa, Artificial Sequence
  Description of Artificial Sequence: Synthetic polypeptide
DENVIRTTNPVSTEPYGTISMEHIQQQQNGNH

SEQ ID NO: 168762 - protein, 32 aa, Artificial Sequence
  Description of Artificial Sequence: Synthetic polypeptide
DENVIRTTNPVSTEPYGTISMEDIQQQQNGNH

SEQ ID NO: 168763 - protein, 32 aa, Artificial Sequence
  Description of Artificial Sequence: Synthetic polypeptide
DESEVASTNPVSTEGYGNVAANTIQSRVGEQR

SEQ ID NO: 168764 - protein, 32 aa, Artificial Sequence
  Description of Artificial Sequence: Synthetic polypeptide
DESEVASTNPVSTEGYGNVAANTIQSRVGFQR

SEQ ID NO: 168765 - protein, 32 aa, Artificial Sequence
  Description of Artificial Sequence: Synthetic polypeptide
DDAVIRYTNPVACEQYGSVSVPEQNDTGSESM

SEQ ID NO: 168766 - protein, 31 aa, Artificial Sequence
  Description of Artificial Sequence: Synthetic polypeptide
DESEVASTNPVSTEGYGNVAANTIQSRVGQI

SEQ ID NO: 168767 - protein, 31 aa, Artificial Sequence
  Description of Artificial Sequence: Synthetic polypeptide
DESEVASTNPVSTEGYGNVAANTIQSRVGQL

SEQ ID NO: 168768 - protein, 37 aa, Artificial Sequence
  Description of Artificial Sequence: Synthetic polypeptide
DEAEIRTTNPVATEQYGSVVKSGIMLEELFNGNEEAF

SEQ ID NO: 168769 - protein, 31 aa, Artificial Sequence
  Description of Artificial Sequence: Synthetic polypeptide
DESEVASTNPVSTEGYGNVAANTIQSSVGTR

SEQ ID NO: 168770 - protein, 31 aa, Artificial Sequence
  Description of Artificial Sequence: Synthetic polypeptide
DESEVASTNPVSTEGYGNVAANTIQSTVGQR

SEQ ID NO: 168771 - protein, 35 aa, Artificial Sequence
  Description of Artificial Sequence: Synthetic polypeptide
DEDEIRTTNPVATEAWGSVSTVVNVNEQGTTDEQG

SEQ ID NO: 168772 - protein, 36 aa, Artificial Sequence
  Description of Artificial Sequence: Synthetic polypeptide
DEDEIRTTNPVATEAWGSVSTVVNVNEQGTNNNQQG

SEQ ID NO: 168773 - protein, 36 aa, Artificial Sequence
  Description of Artificial Sequence: Synthetic polypeptide
CEEEIRTTNPVATEQYGCVCSTGEPNQENFNSDTQS

SEQ ID NO: 168774 - protein, 31 aa, Artificial Sequence
  Description of Artificial Sequence: Synthetic polypeptide
DESEVASTNPVSTEGYGNVAASTIQSRVGQI

SEQ ID NO: 168775 - protein, 30 aa, Artificial Sequence
  Description of Artificial Sequence: Synthetic polypeptide
DESEVASTNPVSTEGYGNVAETIQSRVGQK

SEQ ID NO: 168776 - protein, 36 aa, Artificial Sequence
  Description of Artificial Sequence: Synthetic polypeptide
VEEEIRTTNPVATEQYGSAGSVTTGDNGLGGEQEDT

SEQ ID NO: 168777 - protein, 30 aa, Artificial Sequence
  Description of Artificial Sequence: Synthetic polypeptide
DESEVASTNPVSTEGYGNVANTIQSAVGQR

SEQ ID NO: 168778 - protein, 30 aa, Artificial Sequence
  Description of Artificial Sequence: Synthetic polypeptide
DESEVASTNPVSTEGYGNVANTIQSRVGQI

SEQ ID NO: 168779 - protein, 38 aa, Artificial Sequence
  Description of Artificial Sequence: Synthetic polypeptide
AEEEIRTTNPVATEQYGSVSTVVTDGGNNNLGGNNDDQ

SEQ ID NO: 168780 - protein, 37 aa, Artificial Sequence
  Description of Artificial Sequence: Synthetic polypeptide
DEAEIRTTNPVATEQYGSVVSFGIMLEELFNGNEEQF

SEQ ID NO: 168781 - protein, 37 aa, Artificial Sequence
  Description of Artificial Sequence: Synthetic polypeptide
DEEEIRTTNPVATEQYGVVSTVVNNGNNQETETEEED

SEQ ID NO: 168782 - protein, 36 aa, Artificial Sequence
  Description of Artificial Sequence: Synthetic polypeptide
DEDEIRTTNPVATEAWGSVSTVVTANEQGTNNEQGS

SEQ ID NO: 168783 - protein, 36 aa, Artificial Sequence
  Description of Artificial Sequence: Synthetic polypeptide
DEAEIRTTNPVATEQYGSVNWDIETPLWEGGSEISG

SEQ ID NO: 168784 - protein, 36 aa, Artificial Sequence
  Description of Artificial Sequence: Synthetic polypeptide
DEDEIRTTNPVATEAWGSVSTVVTNNEQGTNVEQGD

SEQ ID NO: 168785 - protein, 37 aa, Artificial Sequence
  Description of Artificial Sequence: Synthetic polypeptide
VEEEIRTTNPVATEQYGSAVSPWVNITEVQINNNVIS

SEQ ID NO: 168786 - protein, 38 aa, Artificial Sequence
  Description of Artificial Sequence: Synthetic polypeptide
DEEEIRTTNPVATEAYGVVSTTNNQQNGQQQGTEQGND

SEQ ID NO: 168787 - protein, 38 aa, Artificial Sequence
  Description of Artificial Sequence: Synthetic polypeptide
VEEEIRTTNPVATEQYGSCGSVTTGDNGLGGEQEDNIT

SEQ ID NO: 168788 - protein, 32 aa, Artificial Sequence
  Description of Artificial Sequence: Synthetic polypeptide
DESEVASTNPVSTEGYGNVAANTIQQSRVGQR

SEQ ID NO: 168789 - protein, 35 aa, Artificial Sequence
  Description of Artificial Sequence: Synthetic polypeptide
DEEEIRTTNPVSYEQWGSCYTIDNHGQNGNGQTGN

SEQ ID NO: 168790 - protein, 34 aa, Artificial Sequence
  Description of Artificial Sequence: Synthetic polypeptide
DESEVASTNPVSTECYGSVSANINEPQDREGEQR

SEQ ID NO: 168791 - protein, 34 aa, Artificial Sequence
  Description of Artificial Sequence: Synthetic polypeptide
DESEVASTNPVSTECYGSVSANITEPQDREGEQR

SEQ ID NO: 168792 - protein, 34 aa, Artificial Sequence
  Description of Artificial Sequence: Synthetic polypeptide
DEPEIATTNPVATDQYGVVSTGDEGQGGDGEETG

SEQ ID NO: 168793 - protein, 31 aa, Artificial Sequence
  Description of Artificial Sequence: Synthetic polypeptide
DESEVASTNPVSTEGYGEAAANTCQSRVGQR

SEQ ID NO: 168794 - protein, 32 aa, Artificial Sequence
  Description of Artificial Sequence: Synthetic polypeptide
QENEIATTNPVATECWGSVSCICEPQDREEEG

SEQ ID NO: 168795 - protein, 34 aa, Artificial Sequence
  Description of Artificial Sequence: Synthetic polypeptide
DEPEIATTNPVATDQYGVVSTDGEQGGQGGEETF

SEQ ID NO: 168796 - protein, 36 aa, Artificial Sequence
  Description of Artificial Sequence: Synthetic polypeptide
VEEEIRTTNPVATEQYGDVVTGIQNDNGQQGDGGEQ

SEQ ID NO: 168797 - protein, 31 aa, Artificial Sequence
  Description of Artificial Sequence: Synthetic polypeptide
DESEVASTNPVSTEGYGNIAANTIQSRVGQR

SEQ ID NO: 168798 - protein, 32 aa, Artificial Sequence
  Description of Artificial Sequence: Synthetic polypeptide
DESEVASTNPVSTEGYGNISANETIQSRVGQR

SEQ ID NO: 168799 - protein, 35 aa, Artificial Sequence
  Description of Artificial Sequence: Synthetic polypeptide
DEPEIATTNPVATDQYGVVSTDDGEQGGQGENETF

SEQ ID NO: 168800 - protein, 31 aa, Artificial Sequence
  Description of Artificial Sequence: Synthetic polypeptide
DESEVASTNPVSTEGYGNTANNTWQSRVGQR

SEQ ID NO: 168801 - protein, 36 aa, Artificial Sequence
  Description of Artificial Sequence: Synthetic polypeptide
DEEEIATTNPVAYEQYGSVCAAIEHLQPDDQMGQRP

SEQ ID NO: 168802 - protein, 32 aa, Artificial Sequence
  Description of Artificial Sequence: Synthetic polypeptide
DESEVASTNPVSTEGYGNVAANTIPQSRVGQR

SEQ ID NO: 168803 - protein, 31 aa, Artificial Sequence
  Description of Artificial Sequence: Synthetic polypeptide
DESEVASTNPVSTEGYGNVAACTIQSRVGQR

SEQ ID NO: 168804 - protein, 36 aa, Artificial Sequence
  Description of Artificial Sequence: Synthetic polypeptide
DEEEIATTNPVAYEQYGSVCADSNDGQEHQGGNLMK

SEQ ID NO: 168805 - protein, 36 aa, Artificial Sequence
  Description of Artificial Sequence: Synthetic polypeptide
DEEEIRTTNPVATEQYGSVCAPVMLDPNIQAPVQVP

SEQ ID NO: 168806 - protein, 36 aa, Artificial Sequence
  Description of Artificial Sequence: Synthetic polypeptide
DEDEIRTTNPVATEAWGSVSTVVNNTEQGTTNEQGE

SEQ ID NO: 168807 - protein, 37 aa, Artificial Sequence
  Description of Artificial Sequence: Synthetic polypeptide
DEMEIRTTNPVATEQYGSVCSVTQIVDETLGGQAVQF

SEQ ID NO: 168808 - protein, 36 aa, Artificial Sequence
  Description of Artificial Sequence: Synthetic polypeptide
DEEEIRTTNPVATEQYGCVCSMWGEPQEHFNSETQA

SEQ ID NO: 168809 - protein, 37 aa, Artificial Sequence
  Description of Artificial Sequence: Synthetic polypeptide
DEEEIRTTNPVATEQYGSVCAMNGNLEPDADIPNDAM

SEQ ID NO: 168810 - protein, 36 aa, Artificial Sequence
  Description of Artificial Sequence: Synthetic polypeptide
DEAEIRTTNPVATEQYGSVNWYTLDMTQFSDQNEGN

SEQ ID NO: 168811 - protein, 32 aa, Artificial Sequence
  Description of Artificial Sequence: Synthetic polypeptide
DESEVASTNPVSTEGYGNVAANDTIQSRVGQR

SEQ ID NO: 168812 - protein, 31 aa, Artificial Sequence
  Description of Artificial Sequence: Synthetic polypeptide
DESEVASTNPVSTEGYGNVAANIIMSRVGQR

SEQ ID NO: 168813 - protein, 36 aa, Artificial Sequence
  Description of Artificial Sequence: Synthetic polypeptide
DEAEIRTTNPVATEQYGSVNWWLLDLEQGSDQNEGN

SEQ ID NO: 168814 - protein, 30 aa, Artificial Sequence
  Description of Artificial Sequence: Synthetic polypeptide
DDSEVASTNPCSTEGYGNVAANNIQSRGTR

SEQ ID NO: 168815 - protein, 31 aa, Artificial Sequence
  Description of Artificial Sequence: Synthetic polypeptide
DESEVASTNPVSTEGYGNVAANTIESRVGQR

SEQ ID NO: 168816 - protein, 31 aa, Artificial Sequence
  Description of Artificial Sequence: Synthetic polypeptide
DESEVASTNPVSTEGYGNVAAECIQSRVGQR

SEQ ID NO: 168817 - protein, 32 aa, Artificial Sequence
  Description of Artificial Sequence: Synthetic polypeptide
DENQIRTTNPVSTEPYGTISMEDIQQQQNGNH

SEQ ID NO: 168818 - protein, 37 aa, Artificial Sequence
  Description of Artificial Sequence: Synthetic polypeptide
DEEEIRTTNPVATEAYGVVSTTNNQQQANTTTNVATE

SEQ ID NO: 168819 - protein, 36 aa, Artificial Sequence
  Description of Artificial Sequence: Synthetic polypeptide
DEEEIATTNPVAYEQYGSVCATNPQDNPDDQTGGTA

SEQ ID NO: 168820 - protein, 32 aa, Artificial Sequence
  Description of Artificial Sequence: Synthetic polypeptide
DENSIRTTNPVSTEPYGTISMEDIAQQQNGNH

SEQ ID NO: 168821 - protein, 31 aa, Artificial Sequence
  Description of Artificial Sequence: Synthetic polypeptide
DDSEVAPTNPVSTEGYGNVAANTIQSRVGQR

SEQ ID NO: 168822 - protein, 37 aa, Artificial Sequence
  Description of Artificial Sequence: Synthetic polypeptide
CEEEIRTTNPVATEQYGCVCSTWGEHNQENFGSENQS

SEQ ID NO: 168823 - protein, 30 aa, Artificial Sequence
  Description of Artificial Sequence: Synthetic polypeptide
DENSIRTTNPVATEQWGDVYEIEMNAAEDA

SEQ ID NO: 168824 - protein, 33 aa, Artificial Sequence
  Description of Artificial Sequence: Synthetic polypeptide
DAAEIATTNPVAYEQYGSTTAGTNLTAEDNNDN

SEQ ID NO: 168825 - protein, 33 aa, Artificial Sequence
  Description of Artificial Sequence: Synthetic polypeptide
DESEVASTNPVSTEQYGTVCSANDGIQSFVGND

SEQ ID NO: 168826 - protein, 31 aa, Artificial Sequence
  Description of Artificial Sequence: Synthetic polypeptide
DESEVASVNPVCTEGYGNVAANTIQSSVGNR

SEQ ID NO: 168827 - protein, 35 aa, Artificial Sequence
  Description of Artificial Sequence: Synthetic polypeptide
DEDEIRTTNPVATEAWGVVSTVNNTEQGTNNEQGE

SEQ ID NO: 168828 - protein, 34 aa, Artificial Sequence
  Description of Artificial Sequence: Synthetic polypeptide
DEDEIATTNPVAYEQWGSVCYTEQGLGDTQNGGA

SEQ ID NO: 168829 - protein, 35 aa, Artificial Sequence
  Description of Artificial Sequence: Synthetic polypeptide
DESEIRTTNPVATEGWGCVCSWMPENQDRFGSNQS

SEQ ID NO: 168830 - protein, 35 aa, Artificial Sequence
  Description of Artificial Sequence: Synthetic polypeptide
DESEIRTTNPVATEGWGCVCSWMNENQENSGSNQG

SEQ ID NO: 168831 - protein, 35 aa, Artificial Sequence
  Description of Artificial Sequence: Synthetic polypeptide
DEDEIRTTNPVATEAWGVVSTVTNVEQGTNVEQGS

SEQ ID NO: 168832 - protein, 32 aa, Artificial Sequence
  Description of Artificial Sequence: Synthetic polypeptide
DESEVASTNPVSTEQYGNVCAATTPQSRVGQD

SEQ ID NO: 168833 - protein, 32 aa, Artificial Sequence
  Description of Artificial Sequence: Synthetic polypeptide
QENEIATTNPVATECYGDVCSAECPVQFEGEL

SEQ ID NO: 168834 - protein, 36 aa, Artificial Sequence
  Description of Artificial Sequence: Synthetic polypeptide
DEEEIRTTNPVATEQYGCVCSNSEEHNENFGSDTQS

SEQ ID NO: 168835 - protein, 34 aa, Artificial Sequence
  Description of Artificial Sequence: Synthetic polypeptide
DESEIRTTNPVATEGWGCVCSWMNENQENEGSVQ

SEQ ID NO: 168836 - protein, 36 aa, Artificial Sequence
  Description of Artificial Sequence: Synthetic polypeptide
DEEEIRTTNPVATEQYGCVCSNSEEHQEYFGSDTQV

SEQ ID NO: 168837 - protein, 33 aa, Artificial Sequence
  Description of Artificial Sequence: Synthetic polypeptide
DESEVATTNPVATEGWGNVAACTEPQSREGEQR

SEQ ID NO: 168838 - protein, 37 aa, Artificial Sequence
  Description of Artificial Sequence: Synthetic polypeptide
DEEEIRTTNPVATEQYGSVLGPTNNLLVMPVLEIEDT

SEQ ID NO: 168839 - protein, 34 aa, Artificial Sequence
  Description of Artificial Sequence: Synthetic polypeptide
DENSEIATTNPVAYEQWGSVSGGNGNPAGEGNTM

SEQ ID NO: 168840 - protein, 35 aa, Artificial Sequence
  Description of Artificial Sequence: Synthetic polypeptide
DESEIRTTNPVATEGWGCVCSWMNENQEGEGSNQA

SEQ ID NO: 168841 - protein, 35 aa, Artificial Sequence
  Description of Artificial Sequence: Synthetic polypeptide
DEDEIRTTNPVATEAWGVVSTVVNNEQGTNDEQGQ

SEQ ID NO: 168842 - protein, 36 aa, Artificial Sequence
  Description of Artificial Sequence: Synthetic polypeptide
DEQEIATTNPVATEQYGSSVTSATDDLEDHEGSEDL

SEQ ID NO: 168843 - protein, 35 aa, Artificial Sequence
  Description of Artificial Sequence: Synthetic polypeptide
CEEEIRTTNPVATEQYGCVCSTWGEHQENFFSDQS

SEQ ID NO: 168844 - protein, 36 aa, Artificial Sequence
  Description of Artificial Sequence: Synthetic polypeptide
DEEEIRTTNPVATEQYGSVLNPLWLEEVPMGPLEFG

SEQ ID NO: 168845 - protein, 34 aa, Artificial Sequence
  Description of Artificial Sequence: Synthetic polypeptide
DESEIRTTNPVATEGWGCVCSWMNENQDNFNSDQ

SEQ ID NO: 168846 - protein, 37 aa, Artificial Sequence
  Description of Artificial Sequence: Synthetic polypeptide
DEEEIRTTNPVATEQYGCVCSNSEEHNAENFGSDNQS

SEQ ID NO: 168847 - protein, 32 aa, Artificial Sequence
  Description of Artificial Sequence: Synthetic polypeptide
DESEVASTNPVSTEGYGNVSACTIQSREGEQR

SEQ ID NO: 168848 - protein, 32 aa, Artificial Sequence
  Description of Artificial Sequence: Synthetic polypeptide
DENSIRTTNPVSTEPYGTISMEDIDQQQNGNH

SEQ ID NO: 168849 - protein, 32 aa, Artificial Sequence
  Description of Artificial Sequence: Synthetic polypeptide
DENSIRTTNPVSTEPYGTISMEDIQQQQNGNH

SEQ ID NO: 168850 - protein, 32 aa, Artificial Sequence
  Description of Artificial Sequence: Synthetic polypeptide
DENTIRTTNPVSTEPYGTISMEDIQQQQNGNH

SEQ ID NO: 168851 - protein, 33 aa, Artificial Sequence
  Description of Artificial Sequence: Synthetic polypeptide
DESEVASTNPVSTEGYGNVSANTIPQDRVGEQR

SEQ ID NO: 168852 - protein, 33 aa, Artificial Sequence
  Description of Artificial Sequence: Synthetic polypeptide
DESEVASTNPVSTEGYGNVSANTIPQSRVGEQR

SEQ ID NO: 168853 - protein, 32 aa, Artificial Sequence
  Description of Artificial Sequence: Synthetic polypeptide
DENTIRTTNPVSTEPYGTCSMVAIQHVPNGNG

SEQ ID NO: 168854 - protein, 37 aa, Artificial Sequence
  Description of Artificial Sequence: Synthetic polypeptide
DEEEIRTTNPVATEQYGCVCSNSEEDDQEGFNSDNQS

SEQ ID NO: 168855 - protein, 36 aa, Artificial Sequence
  Description of Artificial Sequence: Synthetic polypeptide
DEAEIRTTNPVATEQYGSVNVTALTSHQGFIEIIES

SEQ ID NO: 168856 - protein, 35 aa, Artificial Sequence
  Description of Artificial Sequence: Synthetic polypeptide
CEEEIRTTNPVATEQYGCVCSTPEHAENFGSETQS

SEQ ID NO: 168857 - protein, 32 aa, Artificial Sequence
  Description of Artificial Sequence: Synthetic polypeptide
DESEVASTNPVSTEGYGSVAANTLEDREGQDL

SEQ ID NO: 168858 - protein, 37 aa, Artificial Sequence
  Description of Artificial Sequence: Synthetic polypeptide
DEEEIRTTNPVATEQYGSVLENSHNTEQMQEAESQIL

SEQ ID NO: 168859 - protein, 35 aa, Artificial Sequence
  Description of Artificial Sequence: Synthetic polypeptide
CEEEIRTTNPVATEQYGCVCSTPEHNQENFISEQS

SEQ ID NO: 168860 - protein, 37 aa, Artificial Sequence
  Description of Artificial Sequence: Synthetic polypeptide
DEEEIRTTNPVATEQYGVVSTVVNNANAEQGTTEEED

SEQ ID NO: 168861 - protein, 36 aa, Artificial Sequence
  Description of Artificial Sequence: Synthetic polypeptide
VEEEIRTTNPVATEQYGSIGSVTDGDTGQGGETEGG

SEQ ID NO: 168862 - protein, 34 aa, Artificial Sequence
  Description of Artificial Sequence: Synthetic polypeptide
DEDEIRTTNPVATEAWGTVVTVVNNNNDDEGENG

SEQ ID NO: 168863 - protein, 34 aa, Artificial Sequence
  Description of Artificial Sequence: Synthetic polypeptide
DEEEIRTTNPVSYEAYGSVSTFSYHATQTEQQTK

SEQ ID NO: 168864 - protein, 36 aa, Artificial Sequence
  Description of Artificial Sequence: Synthetic polypeptide
CEEEIRTTNPVATEQYGCVCSTWGEDTQNFNSDTQS

SEQ ID NO: 168865 - protein, 37 aa, Artificial Sequence
  Description of Artificial Sequence: Synthetic polypeptide
DEAEIRTTNPVATEQYGSVVSSGIMSEELFSGNEEVF

SEQ ID NO: 168866 - protein, 30 aa, Artificial Sequence
  Description of Artificial Sequence: Synthetic polypeptide
DESEVASTNPVSTEGYGVMAANTLQHVGDI

SEQ ID NO: 168867 - protein, 37 aa, Artificial Sequence
  Description of Artificial Sequence: Synthetic polypeptide
DEAEIRTTNPVATEQYGSVVSSSQMLEELPNGNEEVF

SEQ ID NO: 168868 - protein, 31 aa, Artificial Sequence
  Description of Artificial Sequence: Synthetic polypeptide
DESEVASTNPVSTEGYGVMAANTLQSHVGDR

SEQ ID NO: 168869 - protein, 32 aa, Artificial Sequence
  Description of Artificial Sequence: Synthetic polypeptide
DENSIRTTNPVSTEPYGTISMFDIQQQQNGNH

SEQ ID NO: 168870 - protein, 30 aa, Artificial Sequence
  Description of Artificial Sequence: Synthetic polypeptide
DESEVASTNPVSTEPYGTVAMTIQSRNGQH

SEQ ID NO: 168871 - protein, 30 aa, Artificial Sequence
  Description of Artificial Sequence: Synthetic polypeptide
DESEVASTNPVSTEQWGNVANIIQSAVGQR

SEQ ID NO: 168872 - protein, 30 aa, Artificial Sequence
  Description of Artificial Sequence: Synthetic polypeptide
DESEVASTNPVSTEQWGNVANTIQSAVGQR

SEQ ID NO: 168873 - protein, 30 aa, Artificial Sequence
  Description of Artificial Sequence: Synthetic polypeptide
DESEVASTNPVSTEQYGNAANTIQSHVGQR

SEQ ID NO: 168874 - protein, 37 aa, Artificial Sequence
  Description of Artificial Sequence: Synthetic polypeptide
DEAEIRTTNPVATEQYGSVVSTMIMLEELENLNEEVF

SEQ ID NO: 168875 - protein, 31 aa, Artificial Sequence
  Description of Artificial Sequence: Synthetic polypeptide
DESEVASTNPVSTEQYGNVAANTEMSAVGDR

SEQ ID NO: 168876 - protein, 32 aa, Artificial Sequence
  Description of Artificial Sequence: Synthetic polypeptide
DAAEIATTNPVAYEQYGSACAANPVDDGGTRM

SEQ ID NO: 168877 - protein, 35 aa, Artificial Sequence
  Description of Artificial Sequence: Synthetic polypeptide
DEAEIRTTNPVAYEQWGSVCVTDNNEQNMQHGDDM

SEQ ID NO: 168878 - protein, 33 aa, Artificial Sequence
  Description of Artificial Sequence: Synthetic polypeptide
DENEIRTTNPVSTEPYGTISSMPDIQQQQNGNH

SEQ ID NO: 168879 - protein, 35 aa, Artificial Sequence
  Description of Artificial Sequence: Synthetic polypeptide
DEEEISTTNPVATEQYGCVCSSEDHNQNFNSDTQS

SEQ ID NO: 168880 - protein, 33 aa, Artificial Sequence
  Description of Artificial Sequence: Synthetic polypeptide
DENEIRTTNPVSTEPYGTISMEDIQQYQNGNDH

SEQ ID NO: 168881 - protein, 33 aa, Artificial Sequence
  Description of Artificial Sequence: Synthetic polypeptide
DENEIRTTNPVSTEPYGTISMEDIQQWQNGNQH

SEQ ID NO: 168882 - protein, 36 aa, Artificial Sequence
  Description of Artificial Sequence: Synthetic polypeptide
DEEEIRTTNPVATEQYGCVCSTTGEHNQENFISDQA

SEQ ID NO: 168883 - protein, 33 aa, Artificial Sequence
  Description of Artificial Sequence: Synthetic polypeptide
DECEIYTTNPVATEAYGMTVSGSALMYPGEILP

SEQ ID NO: 168884 - protein, 38 aa, Artificial Sequence
  Description of Artificial Sequence: Synthetic polypeptide
DEEEIRTTNPVATEQYGVVSTTNQQQQSATEQGTTDED

SEQ ID NO: 168885 - protein, 33 aa, Artificial Sequence
  Description of Artificial Sequence: Synthetic polypeptide
DESEIRTTNPVATECWGHVGCINEPEAREYENG

SEQ ID NO: 168886 - protein, 33 aa, Artificial Sequence
  Description of Artificial Sequence: Synthetic polypeptide
DENEIRTTNPVSTEPYGTISMEDIQQSQNGNHY

SEQ ID NO: 168887 - protein, 31 aa, Artificial Sequence
  Description of Artificial Sequence: Synthetic polypeptide
DDSEVASTNPVSTEGYGNVAANTDQSRVGQR

SEQ ID NO: 168888 - protein, 32 aa, Artificial Sequence
  Description of Artificial Sequence: Synthetic polypeptide
DENEIRTTNPVSTEPYGTISMEDIQQQYNVNH

SEQ ID NO: 168889 - protein, 34 aa, Artificial Sequence
  Description of Artificial Sequence: Synthetic polypeptide
DEMEIRTTNPVATECWGTVCSTIGEPEDFEGENG

SEQ ID NO: 168890 - protein, 33 aa, Artificial Sequence
  Description of Artificial Sequence: Synthetic polypeptide
DEMEIRTTNPVATECYGATWAATEDWEPKGNYD

SEQ ID NO: 168891 - protein, 31 aa, Artificial Sequence
  Description of Artificial Sequence: Synthetic polypeptide
SENEIRTTNPVATEQWGDVMECNEMNAAEDA

SEQ ID NO: 168892 - protein, 37 aa, Artificial Sequence
  Description of Artificial Sequence: Synthetic polypeptide
AEDEICTTNPVATEAYGSVSTVVTEQNGNLQTGNDTM

SEQ ID NO: 168893 - protein, 31 aa, Artificial Sequence
  Description of Artificial Sequence: Synthetic polypeptide
AEQEIAPTNPCSYEQWGIVSKNLEQISGDTR

SEQ ID NO: 168894 - protein, 32 aa, Artificial Sequence
  Description of Artificial Sequence: Synthetic polypeptide
DENEIRTTNPVSTEPYGTISMEDIQQQVNGQH

SEQ ID NO: 168895 - protein, 33 aa, Artificial Sequence
  Description of Artificial Sequence: Synthetic polypeptide
DENEIRTTNPVSTEPYGTISMEDIQQQVNGNVH

SEQ ID NO: 168896 - protein, 34 aa, Artificial Sequence
  Description of Artificial Sequence: Synthetic polypeptide
DENAEIATTNPVAYESWGSVSGGDLQDPNGGNTQ

SEQ ID NO: 168897 - protein, 33 aa, Artificial Sequence
  Description of Artificial Sequence: Synthetic polypeptide
DECEIYTTNPVATEAYGITVSGSELVYPGEILP

SEQ ID NO: 168898 - protein, 34 aa, Artificial Sequence
  Description of Artificial Sequence: Synthetic polypeptide
DENAEIATTNPVAYESWGSVSGGNLGDPSGGNTS

SEQ ID NO: 168899 - protein, 32 aa, Artificial Sequence
  Description of Artificial Sequence: Synthetic polypeptide
DEMEIRTTNPVATECWGTVCANADGPEPKGPD

SEQ ID NO: 168900 - protein, 35 aa, Artificial Sequence
  Description of Artificial Sequence: Synthetic polypeptide
DEEEIRTTNPVATEQYGSSLCTEVGQQVSFVEESA

SEQ ID NO: 168901 - protein, 28 aa, Artificial Sequence
  Description of Artificial Sequence: Synthetic peptide
QEGEIAPTNPVSTEQYGEAPEVCQHETK

SEQ ID NO: 168902 - protein, 34 aa, Artificial Sequence
  Description of Artificial Sequence: Synthetic polypeptide
DENAEIATTNPVAYERWGSVTGGNLQDPSGGNTQ

SEQ ID NO: 168903 - protein, 37 aa, Artificial Sequence
  Description of Artificial Sequence: Synthetic polypeptide
DEEEIRTTNPVATEQYGCVCSTTGEHNQENFGSDTQL

SEQ ID NO: 168904 - protein, 35 aa, Artificial Sequence
  Description of Artificial Sequence: Synthetic polypeptide
DECENATTNPVAYEQWGSVSNNNDDHQEGRGENSP

SEQ ID NO: 168905 - protein, 37 aa, Artificial Sequence
  Description of Artificial Sequence: Synthetic polypeptide
DEEEIRTTNPVATEQYGCVCSTTGEHNEENFGSDTQS

SEQ ID NO: 168906 - protein, 33 aa, Artificial Sequence
  Description of Artificial Sequence: Synthetic polypeptide
DENEIRTTNPVSTEPYGTISMEDKIQQQQNGNH

SEQ ID NO: 168907 - protein, 35 aa, Artificial Sequence
  Description of Artificial Sequence: Synthetic polypeptide
SENEIRTTNPVATEQYGCVCTTDNDISRDNSNQQS

SEQ ID NO: 168908 - protein, 31 aa, Artificial Sequence
  Description of Artificial Sequence: Synthetic polypeptide
DDSEVASTNPVSTEGYGNVAANTAQSRVGQR

SEQ ID NO: 168909 - protein, 33 aa, Artificial Sequence
  Description of Artificial Sequence: Synthetic polypeptide
DETEIRTTNPVATEQYGETAWANEENWAEPGGI

SEQ ID NO: 168910 - protein, 35 aa, Artificial Sequence
  Description of Artificial Sequence: Synthetic polypeptide
DENAEIATTNPVAYECWGSVSGGPNLQDPDGGNTQ

SEQ ID NO: 168911 - protein, 34 aa, Artificial Sequence
  Description of Artificial Sequence: Synthetic polypeptide
DEMEIRTTNPVATECYGTTTCSATEGPVEFEGNI

SEQ ID NO: 168912 - protein, 31 aa, Artificial Sequence
  Description of Artificial Sequence: Synthetic polypeptide
DDSEVASTNPVSTEGYGNVAANTCQERVGQR

SEQ ID NO: 168913 - protein, 37 aa, Artificial Sequence
  Description of Artificial Sequence: Synthetic polypeptide
CEEEIATTNPVATEQYGSVCSATLALPQNHQDGATAN

SEQ ID NO: 168914 - protein, 33 aa, Artificial Sequence
  Description of Artificial Sequence: Synthetic polypeptide
DENEIRTTNPVSTEPYGTISMEDISQQQTGGNQ

SEQ ID NO: 168915 - protein, 39 aa, Artificial Sequence
  Description of Artificial Sequence: Synthetic polypeptide
DEEEIRTTNPVATEQYGVVSTVTNNQQGNQQGTTTNNAE

SEQ ID NO: 168916 - protein, 33 aa, Artificial Sequence
  Description of Artificial Sequence: Synthetic polypeptide
DENEIRTTNPVSTEPYGTISMEDISQQQNGTND

SEQ ID NO: 168917 - protein, 33 aa, Artificial Sequence
  Description of Artificial Sequence: Synthetic polypeptide
DEMEIRTTNPVATECYGAVWANADDWEEFKGPD

SEQ ID NO: 168918 - protein, 34 aa, Artificial Sequence
  Description of Artificial Sequence: Synthetic polypeptide
DEMEIRTTNPVATECYGAVWAATEGPVEPKGNYD

SEQ ID NO: 168919 - protein, 32 aa, Artificial Sequence
  Description of Artificial Sequence: Synthetic polypeptide
DENEIRTTNPVSTEPYGTISMEDIQYQQNFNH

SEQ ID NO: 168920 - protein, 31 aa, Artificial Sequence
  Description of Artificial Sequence: Synthetic polypeptide
DDSEVASTNPVSTEGYGNVAANTDQSRLGQR

SEQ ID NO: 168921 - protein, 35 aa, Artificial Sequence
  Description of Artificial Sequence: Synthetic polypeptide
DECNIACTNPVATEQYGSVSWNEGEQERQRMNGET

SEQ ID NO: 168922 - protein, 33 aa, Artificial Sequence
  Description of Artificial Sequence: Synthetic polypeptide
DENEIRTTNPVSTEPYGTISMEDIQVQQNGDNH

SEQ ID NO: 168923 - protein, 36 aa, Artificial Sequence
  Description of Artificial Sequence: Synthetic polypeptide
CEEEIATTNPVATEQYGSVCSAPALGQDHQGDQDAQ

SEQ ID NO: 168924 - protein, 32 aa, Artificial Sequence
  Description of Artificial Sequence: Synthetic polypeptide
DENEIRTTNPVSTEPYGTISMEDIQTQQNGQH

SEQ ID NO: 168925 - protein, 35 aa, Artificial Sequence
  Description of Artificial Sequence: Synthetic polypeptide
DENAEIATTNPVAYEQWGSVSHTMNDRGNDGTGDT

SEQ ID NO: 168926 - protein, 34 aa, Artificial Sequence
  Description of Artificial Sequence: Synthetic polypeptide
QENEIATTNPVATEQYGSVCAATNPEEAEAEMNN

SEQ ID NO: 168927 - protein, 34 aa, Artificial Sequence
  Description of Artificial Sequence: Synthetic polypeptide
DENAEIATTNPVAYERWGSVSGGDLQDANGGNVS

SEQ ID NO: 168928 - protein, 34 aa, Artificial Sequence
  Description of Artificial Sequence: Synthetic polypeptide
SENEIRTTNPVATEQYGCCSTAEVLEQTPIEDSI

SEQ ID NO: 168929 - protein, 28 aa, Artificial Sequence
  Description of Artificial Sequence: Synthetic peptide
QEGEIAPTNPVSTEQYGEAPEVCQHEEK

SEQ ID NO: 168930 - protein, 35 aa, Artificial Sequence
  Description of Artificial Sequence: Synthetic polypeptide
DEQEIATTNPVATHQYGSVSATWDLEDHEGFEDLP

SEQ ID NO: 168931 - protein, 35 aa, Artificial Sequence
  Description of Artificial Sequence: Synthetic polypeptide
DETEIRTTNPVATEQYGSTVWANAEDWEEHEGEDI

SEQ ID NO: 168932 - protein, 35 aa, Artificial Sequence
  Description of Artificial Sequence: Synthetic polypeptide
DETEIRTTNPVATEQYGSTVWANAEDWEEPEGEDI

SEQ ID NO: 168933 - protein, 37 aa, Artificial Sequence
  Description of Artificial Sequence: Synthetic polypeptide
DETEIRTTNPVATEQYGSVNPDGPGNLDTGENEDEDA

SEQ ID NO: 168934 - protein, 32 aa, Artificial Sequence
  Description of Artificial Sequence: Synthetic polypeptide
DENEIRTTNPVSTEPYGTISMEDIQQQQNPNH

SEQ ID NO: 168935 - protein, 32 aa, Artificial Sequence
  Description of Artificial Sequence: Synthetic polypeptide
DENEIRTTNPVSTEPYGTISMEDIQQQQNNNH

SEQ ID NO: 168936 - protein, 32 aa, Artificial Sequence
  Description of Artificial Sequence: Synthetic polypeptide
DENEIRTTNPVSTEPYGTISMEDIQQQQNMNN

SEQ ID NO: 168937 - protein, 37 aa, Artificial Sequence
  Description of Artificial Sequence: Synthetic polypeptide
DETEIRTTNPVATEQYGSVNYDGPGNLDTGENEEEDD

SEQ ID NO: 168938 - protein, 37 aa, Artificial Sequence
  Description of Artificial Sequence: Synthetic polypeptide
DETEIRTTNPVATEQYGSVNYDGPGNLDTGENENADE

SEQ ID NO: 168939 - protein, 31 aa, Artificial Sequence
  Description of Artificial Sequence: Synthetic polypeptide
DENAICTTNPVATEQWGDVSTEIEMNAAEDA

SEQ ID NO: 168940 - protein, 37 aa, Artificial Sequence
  Description of Artificial Sequence: Synthetic polypeptide
DETEIRTTNPVATEQYGSVNYDGPGNLDTGGNQNEDI

SEQ ID NO: 168941 - protein, 32 aa, Artificial Sequence
  Description of Artificial Sequence: Synthetic polypeptide
DENEIRTTNPVSTEPYGTISMEDIQQQQNMNH

SEQ ID NO: 168942 - protein, 32 aa, Artificial Sequence
  Description of Artificial Sequence: Synthetic polypeptide
DENEIRTTNPVSTEPYGTISMEDIQQQQNLNH

SEQ ID NO: 168943 - protein, 35 aa, Artificial Sequence
  Description of Artificial Sequence: Synthetic polypeptide
DEHEIATTNPVATEPYGEVSWNDNHQQQDGHGGNH

SEQ ID NO: 168944 - protein, 33 aa, Artificial Sequence
  Description of Artificial Sequence: Synthetic polypeptide
DENEIRTTNPVSTEPYGTISMEDIQQQQNKNRH

SEQ ID NO: 168945 - protein, 32 aa, Artificial Sequence
  Description of Artificial Sequence: Synthetic polypeptide
DENEIRTTNPVSTEPYGTISMEDIQQQQNKNH

SEQ ID NO: 168946 - protein, 32 aa, Artificial Sequence
  Description of Artificial Sequence: Synthetic polypeptide
DENEIRTTNPVSTEPYGTISMEDIQQQQNINH

SEQ ID NO: 168947 - protein, 32 aa, Artificial Sequence
  Description of Artificial Sequence: Synthetic polypeptide
AEQEIACTNPVATEQYGEVSAEDLEDHEGEDL

SEQ ID NO: 168948 - protein, 32 aa, Artificial Sequence
  Description of Artificial Sequence: Synthetic polypeptide
DENEIRTTNPVSTEPYGTISMEDIQQQQNHNH

SEQ ID NO: 168949 - protein, 33 aa, Artificial Sequence
  Description of Artificial Sequence: Synthetic polypeptide
DENEIRTTNPVSTEPYGTISMEDIQQQQNGYNH

SEQ ID NO: 168950 - protein, 32 aa, Artificial Sequence
  Description of Artificial Sequence: Synthetic polypeptide
DENEIRTTNPVSTEPYGTISMEDIQQQQNGYH

SEQ ID NO: 168951 - protein, 35 aa, Artificial Sequence
  Description of Artificial Sequence: Synthetic polypeptide
DEHEIATTNPVATEPWGISVRTWNDEQDRQQQNDA

SEQ ID NO: 168952 - protein, 33 aa, Artificial Sequence
  Description of Artificial Sequence: Synthetic polypeptide
DENEIRTTNPVSTEPYGTISMEDIQQQQNGWNH

SEQ ID NO: 168953 - protein, 32 aa, Artificial Sequence
  Description of Artificial Sequence: Synthetic polypeptide
DENEIRTTNPVSTEPYGTISMEDIQQQQNGWH

SEQ ID NO: 168954 - protein, 33 aa, Artificial Sequence
  Description of Artificial Sequence: Synthetic polypeptide
DENEIRTTNPVSTEPYGTISMEDIQQQQNGVNH

SEQ ID NO: 168955 - protein, 32 aa, Artificial Sequence
  Description of Artificial Sequence: Synthetic polypeptide
DENEIRTTNPVSTEPYGTISMEDIQQQQNGVH

SEQ ID NO: 168956 - protein, 37 aa, Artificial Sequence
  Description of Artificial Sequence: Synthetic polypeptide
DETEIRTTNPVATEQYGSVNADGPGNLDTGENEVEDI

SEQ ID NO: 168957 - protein, 36 aa, Artificial Sequence
  Description of Artificial Sequence: Synthetic polypeptide
DEEEIACTNPVAYEQYGSACATNPQLNPDDQMGGRM

SEQ ID NO: 168958 - protein, 32 aa, Artificial Sequence
  Description of Artificial Sequence: Synthetic polypeptide
DENEIRTTNPVSTEPYGTISMEDIQQQQNQNE

SEQ ID NO: 168959 - protein, 30 aa, Artificial Sequence
  Description of Artificial Sequence: Synthetic polypeptide
SENEIRTTNPIATEQWGDVSEIEMNAAEDA

SEQ ID NO: 168960 - protein, 33 aa, Artificial Sequence
  Description of Artificial Sequence: Synthetic polypeptide
DETEIRTTNPVATEQYGSTWAAADWADPEGEDI

SEQ ID NO: 168961 - protein, 37 aa, Artificial Sequence
  Description of Artificial Sequence: Synthetic polypeptide
AEDEICTTNPVATEAYGSVSTVVTEQAGNLQTGNETE

SEQ ID NO: 168962 - protein, 34 aa, Artificial Sequence
  Description of Artificial Sequence: Synthetic polypeptide
DETEIRTTNPVATEQYGSTWAATEDWEEHKGEDI

SEQ ID NO: 168963 - protein, 38 aa, Artificial Sequence
  Description of Artificial Sequence: Synthetic polypeptide
DEEEIRTTNPVATEQYGVVSTVTNNQNQEQGTTEGGTD

SEQ ID NO: 168964 - protein, 37 aa, Artificial Sequence
  Description of Artificial Sequence: Synthetic polypeptide
DEEEIRTTNPVATEQYGSVGQYLMGGEEQMIMNEEEL

SEQ ID NO: 168965 - protein, 39 aa, Artificial Sequence
  Description of Artificial Sequence: Synthetic polypeptide
DEEEIRTTNPVATEAYGVVSTVVNTNLQAGSNGQGNDDG

SEQ ID NO: 168966 - protein, 32 aa, Artificial Sequence
  Description of Artificial Sequence: Synthetic polypeptide
DENEIRTTNPVSTEPYGTISMEDIQQQQVGSH

SEQ ID NO: 168967 - protein, 30 aa, Artificial Sequence
  Description of Artificial Sequence: Synthetic polypeptide
QEGEIAPTNPVSTEQWGIVSENEQNAAEDA

SEQ ID NO: 168968 - protein, 36 aa, Artificial Sequence
  Description of Artificial Sequence: Synthetic polypeptide
DEEEIRTTNPVATEQYGSVGQVMVIEEGQNGQPEDN

SEQ ID NO: 168969 - protein, 34 aa, Artificial Sequence
  Description of Artificial Sequence: Synthetic polypeptide
DAEEIATTNPVATEQYGSTCAMIEHLEATGDMDR

SEQ ID NO: 168970 - protein, 33 aa, Artificial Sequence
  Description of Artificial Sequence: Synthetic polypeptide
DENEIRTTNPVSTEPYGTISMEDIQQQQPGNDH

SEQ ID NO: 168971 - protein, 32 aa, Artificial Sequence
  Description of Artificial Sequence: Synthetic polypeptide
DENEIRTTNPVSTEPYGTISMEDIQQQQNYNH

SEQ ID NO: 168972 - protein, 37 aa, Artificial Sequence
  Description of Artificial Sequence: Synthetic polypeptide
DEEEIRTTNPVATEQYGCVCSTTMAHNNENSGSDPVS

SEQ ID NO: 168973 - protein, 32 aa, Artificial Sequence
  Description of Artificial Sequence: Synthetic polypeptide
DENEIRTTNPVSTEPYGTISMEDIQQQQNWNH

SEQ ID NO: 168974 - protein, 36 aa, Artificial Sequence
  Description of Artificial Sequence: Synthetic polypeptide
DEEEIRTTNPVATEQYGSSAVTLNHNDPEYMQIMRV

SEQ ID NO: 168975 - protein, 32 aa, Artificial Sequence
  Description of Artificial Sequence: Synthetic polypeptide
DENEIRTTNPVSTEPYGTISMEDIQQQQNVNH

SEQ ID NO: 168976 - protein, 32 aa, Artificial Sequence
  Description of Artificial Sequence: Synthetic polypeptide
DENEIRTTNPVSTEPYGTISMEDIQQQQNTNH

SEQ ID NO: 168977 - protein, 32 aa, Artificial Sequence
  Description of Artificial Sequence: Synthetic polypeptide
DENEIRTTNPVSTEPYGTISMEDIQQQQNSNH

SEQ ID NO: 168978 - protein, 32 aa, Artificial Sequence
  Description of Artificial Sequence: Synthetic polypeptide
DENEIRTTNPVSTEPYGTISMEDIQQQQNSNG

SEQ ID NO: 168979 - protein, 33 aa, Artificial Sequence
  Description of Artificial Sequence: Synthetic polypeptide
DENEIRTTNPVSTEPYGTISMEDIQQQQNRTNH

SEQ ID NO: 168980 - protein, 31 aa, Artificial Sequence
  Description of Artificial Sequence: Synthetic polypeptide
DDSEVASTNPVSTEGYGNVAANTEQSRVGQR

SEQ ID NO: 168981 - protein, 33 aa, Artificial Sequence
  Description of Artificial Sequence: Synthetic polypeptide
DENEIRTTNPVSTEPYGTISMEDIQQQQNRNHY

SEQ ID NO: 168982 - protein, 31 aa, Artificial Sequence
  Description of Artificial Sequence: Synthetic polypeptide
DDSEVASTNPVSTEGYGNVAANTEQSRVGVR

SEQ ID NO: 168983 - protein, 32 aa, Artificial Sequence
  Description of Artificial Sequence: Synthetic polypeptide
DENEIRTTNPVSTEPYGTISMEDIQQQQNQNH

SEQ ID NO: 168984 - protein, 35 aa, Artificial Sequence
  Description of Artificial Sequence: Synthetic polypeptide
SENEIRTTNPVATEQYGCVDTEENGSQEQGGSQVE

SEQ ID NO: 168985 - protein, 32 aa, Artificial Sequence
  Description of Artificial Sequence: Synthetic polypeptide
DENEIRTTNPVSTEPYGTISMEDKQQQQNGKH

SEQ ID NO: 168986 - protein, 37 aa, Artificial Sequence
  Description of Artificial Sequence: Synthetic polypeptide
QEEEIRATNPVATEQYGSVVVDDTMDNIGQSGENSGD

SEQ ID NO: 168987 - protein, 35 aa, Artificial Sequence
  Description of Artificial Sequence: Synthetic polypeptide
DEQEIATTNPVATEQYGVVCSNTDLNEDHFGSEDL

SEQ ID NO: 168988 - protein, 33 aa, Artificial Sequence
  Description of Artificial Sequence: Synthetic polypeptide
DEMNIVTTNPVATEQYGTVCSATDGPVEFEGKD

SEQ ID NO: 168989 - protein, 36 aa, Artificial Sequence
  Description of Artificial Sequence: Synthetic polypeptide
SENEIRTTNPVATEQYGSTCCSTTLNLIEIIQDPQQ

SEQ ID NO: 168990 - protein, 36 aa, Artificial Sequence
  Description of Artificial Sequence: Synthetic polypeptide
QEEEIRATNPVATEQWGGCVAITNNLEQTGMEGDRT

SEQ ID NO: 168991 - protein, 34 aa, Artificial Sequence
  Description of Artificial Sequence: Synthetic polypeptide
DEMPIVTTNPVATEQYGTVCSATDGPVEFEGTND

SEQ ID NO: 168992 - protein, 39 aa, Artificial Sequence
  Description of Artificial Sequence: Synthetic polypeptide
DEEEIRTTNPVATEQYGVVSTVVTNLNGNQQQGTVTEEN

SEQ ID NO: 168993 - protein, 35 aa, Artificial Sequence
  Description of Artificial Sequence: Synthetic polypeptide
DEEEIGTTNPVATEQYGQCICSTGEHQENFGSEQA

SEQ ID NO: 168994 - protein, 36 aa, Artificial Sequence
  Description of Artificial Sequence: Synthetic polypeptide
DEEEIGTTNPVATEQYGQCVCSMTGEHQNFGSDTQA

SEQ ID NO: 168995 - protein, 34 aa, Artificial Sequence
  Description of Artificial Sequence: Synthetic polypeptide
NNNEIATTNPVAYEQWGSVSTTNGLNDTMGGNED

SEQ ID NO: 168996 - protein, 37 aa, Artificial Sequence
  Description of Artificial Sequence: Synthetic polypeptide
DEEEIRTTNPVATEQYGAVMGGGTDQLIDEGEGGNDT

SEQ ID NO: 168997 - protein, 34 aa, Artificial Sequence
  Description of Artificial Sequence: Synthetic polypeptide
DEMQIVTTNPVATEQYGTVCSATDGPVEFEGNGD

SEQ ID NO: 168998 - protein, 35 aa, Artificial Sequence
  Description of Artificial Sequence: Synthetic polypeptide
NNEEISTTNPVATEQYGVVWVTQNLDQQDGGPEMI

SEQ ID NO: 168999 - protein, 33 aa, Artificial Sequence
  Description of Artificial Sequence: Synthetic polypeptide
DEMQIVTTNPVATEQYGTVCSATDGPVEFEKND

SEQ ID NO: 169000 - protein, 33 aa, Artificial Sequence
  Description of Artificial Sequence: Synthetic polypeptide
DEMSIVTTNPVATEQYGTVCSATDGPVEFEGVD

SEQ ID NO: 169001 - protein, 32 aa, Artificial Sequence
  Description of Artificial Sequence: Synthetic polypeptide
DETEIRTTNPVATEQWGATWPNEEVWAEHGEI

SEQ ID NO: 169002 - protein, 32 aa, Artificial Sequence
  Description of Artificial Sequence: Synthetic polypeptide
DETEIRTTNPVATEQWGATWPNEEVWAEHGEK

SEQ ID NO: 169003 - protein, 33 aa, Artificial Sequence
  Description of Artificial Sequence: Synthetic polypeptide
DETEIRTTNPVATEQWGATWSNADLADPKGEYI

SEQ ID NO: 169004 - protein, 33 aa, Artificial Sequence
  Description of Artificial Sequence: Synthetic polypeptide
DEMSIVTTNPVATEQYGTVCTATDGPVEFEGND

SEQ ID NO: 169005 - protein, 36 aa, Artificial Sequence
  Description of Artificial Sequence: Synthetic polypeptide
DETEIRTTNPVATEQWGAVSSNTEAGPNERNGMNPV

SEQ ID NO: 169006 - protein, 33 aa, Artificial Sequence
  Description of Artificial Sequence: Synthetic polypeptide
DEMTIVTTNPVATECYGTVCSATDGPVEFEGND

SEQ ID NO: 169007 - protein, 34 aa, Artificial Sequence
  Description of Artificial Sequence: Synthetic polypeptide
DEMTIVTTNPVATEQYGTVVCSATDGPVEFEGND

SEQ ID NO: 169008 - protein, 33 aa, Artificial Sequence
  Description of Artificial Sequence: Synthetic polypeptide
DETEIRTTNPVATEQWGDTVWSNEIEMNAAEPA

SEQ ID NO: 169009 - protein, 33 aa, Artificial Sequence
  Description of Artificial Sequence: Synthetic polypeptide
DETEIRTTNPVATEQWGDTVWSNEIEMNAAGPA

SEQ ID NO: 169010 - protein, 36 aa, Artificial Sequence
  Description of Artificial Sequence: Synthetic polypeptide
DEEEIATTNPVATEQYGSVAATTPAITNGGNGMEPV

SEQ ID NO: 169011 - protein, 35 aa, Artificial Sequence
  Description of Artificial Sequence: Synthetic polypeptide
NNEEIRTTNPVATEQYGVVWVPQNLQQDGGLEIMI

SEQ ID NO: 169012 - protein, 35 aa, Artificial Sequence
  Description of Artificial Sequence: Synthetic polypeptide
DEEEIGTTNPVATEQYGCVCSWGEHNQENFNSEQS

SEQ ID NO: 169013 - protein, 31 aa, Artificial Sequence
  Description of Artificial Sequence: Synthetic polypeptide
DETEIRTTNPVATEQWGATPNEEVWAEHGEK

SEQ ID NO: 169014 - protein, 32 aa, Artificial Sequence
  Description of Artificial Sequence: Synthetic polypeptide
YEEEIASVNPIATEQWGVTVSNAENLQSKGPI

SEQ ID NO: 169015 - protein, 35 aa, Artificial Sequence
  Description of Artificial Sequence: Synthetic polypeptide
CEEEIATTNPVATEQYGSVCSTGTGSNSMNNKEHY

SEQ ID NO: 169016 - protein, 36 aa, Artificial Sequence
  Description of Artificial Sequence: Synthetic polypeptide
DECTICTTNPVATEQWGSVSTTNQNNANQQGNNTDQ

SEQ ID NO: 169017 - protein, 34 aa, Artificial Sequence
  Description of Artificial Sequence: Synthetic polypeptide
DEMHIHTTNPVATEQYGTVCSATDGPVEAVEGND

SEQ ID NO: 169018 - protein, 33 aa, Artificial Sequence
  Description of Artificial Sequence: Synthetic polypeptide
DEMHIVTTNPVATEQYGTVCSAKDGPVEFEGND

SEQ ID NO: 169019 - protein, 36 aa, Artificial Sequence
  Description of Artificial Sequence: Synthetic polypeptide
SENEIRTTNPVATEQYGSVMSWWDMLEEQGNGQEKF

SEQ ID NO: 169020 - protein, 34 aa, Artificial Sequence
  Description of Artificial Sequence: Synthetic polypeptide
DEMHIVTTNPVATEQYGTVCSATDGPVEDFEGND

SEQ ID NO: 169021 - protein, 33 aa, Artificial Sequence
  Description of Artificial Sequence: Synthetic polypeptide
DEMHIVTTNPVATEQYGTVCSATDGPVEFEIND

SEQ ID NO: 169022 - protein, 33 aa, Artificial Sequence
  Description of Artificial Sequence: Synthetic polypeptide
DETEIRTTNPVATEPWGTIWANAEDIQQPNGNH

SEQ ID NO: 169023 - protein, 33 aa, Artificial Sequence
  Description of Artificial Sequence: Synthetic polypeptide
DETEIRTTNPVATEPWGTIWANAEDWAQPNGNH

SEQ ID NO: 169024 - protein, 33 aa, Artificial Sequence
  Description of Artificial Sequence: Synthetic polypeptide
DETEIRTTNPVATEPWGTIWANAEDWAQPNGNI

SEQ ID NO: 169025 - protein, 34 aa, Artificial Sequence
  Description of Artificial Sequence: Synthetic polypeptide
NQQEIRTTNPVATEQYGSVSVMNEIITEDMNIEM

SEQ ID NO: 169026 - protein, 32 aa, Artificial Sequence
  Description of Artificial Sequence: Synthetic polypeptide
YEEEIASVNPIATEQWGVTVSNDENLQSKGPI

SEQ ID NO: 169027 - protein, 37 aa, Artificial Sequence
  Description of Artificial Sequence: Synthetic polypeptide
AEEEIRTTNPVATEQYGSVVVSVTVNNNNQEQEETED

SEQ ID NO: 169028 - protein, 33 aa, Artificial Sequence
  Description of Artificial Sequence: Synthetic polypeptide
DEMLIVTTNPVATEQYGTVCSAYDGPVEFEGND

SEQ ID NO: 169029 - protein, 36 aa, Artificial Sequence
  Description of Artificial Sequence: Synthetic polypeptide
SENEIRTTNPVATEQYGSVFYPTADNDSNGFENNMD

SEQ ID NO: 169030 - protein, 31 aa, Artificial Sequence
  Description of Artificial Sequence: Synthetic polypeptide
DDSEVASTNPVSTEGYGNVAANNLQSRVGQQ

SEQ ID NO: 169031 - protein, 33 aa, Artificial Sequence
  Description of Artificial Sequence: Synthetic polypeptide
DENEIRTTNPVSTEPYGTISMEDRIQQQQNGNH

SEQ ID NO: 169032 - protein, 33 aa, Artificial Sequence
  Description of Artificial Sequence: Synthetic polypeptide
AEQEIATVNPVATEQYGCVAGNGLQSNNNSQAE

SEQ ID NO: 169033 - protein, 36 aa, Artificial Sequence
  Description of Artificial Sequence: Synthetic polypeptide
SENEIRTTNPVATEQYGSVFYPTADNDNNGIENNMV

SEQ ID NO: 169034 - protein, 33 aa, Artificial Sequence
  Description of Artificial Sequence: Synthetic polypeptide
DENEIRTTNPVSTEPYGTISMEDRIQQQQMGNH

SEQ ID NO: 169035 - protein, 32 aa, Artificial Sequence
  Description of Artificial Sequence: Synthetic polypeptide
YEEEIASVNPIATEQYGAVADENLQESKGPYQ

SEQ ID NO: 169036 - protein, 36 aa, Artificial Sequence
  Description of Artificial Sequence: Synthetic polypeptide
SENEIRTTNPVATEQYGSVFYPTADNDNNGFENNGM

SEQ ID NO: 169037 - protein, 35 aa, Artificial Sequence
  Description of Artificial Sequence: Synthetic polypeptide
DETEIRTTNPVATEQWGATSATTPDWPNERNGNPV

SEQ ID NO: 169038 - protein, 33 aa, Artificial Sequence
  Description of Artificial Sequence: Synthetic polypeptide
DENEIRTTNPVSTEPYGTISMEDIQQQQNGTNH

SEQ ID NO: 169039 - protein, 34 aa, Artificial Sequence
  Description of Artificial Sequence: Synthetic polypeptide
NNEEIRTTNPVATEQYGVVWVPQNAQQDGHPEMI

SEQ ID NO: 169040 - protein, 32 aa, Artificial Sequence
  Description of Artificial Sequence: Synthetic polypeptide
DETEIRTTNPVATEQWGDTWSNEIWAEAKGDA

SEQ ID NO: 169041 - protein, 36 aa, Artificial Sequence
  Description of Artificial Sequence: Synthetic polypeptide
DETEIRTTNPVATEQWGSTVSANAPDWPNMRKGPPV

SEQ ID NO: 169042 - protein, 35 aa, Artificial Sequence
  Description of Artificial Sequence: Synthetic polypeptide
SENEIRTTNPVATEQYGSCITVWQQNEQIGFSELN

SEQ ID NO: 169043 - protein, 34 aa, Artificial Sequence
  Description of Artificial Sequence: Synthetic polypeptide
DEMVIVTTNPVATEQYGHTVCSATDGPVEFEGND

SEQ ID NO: 169044 - protein, 33 aa, Artificial Sequence
  Description of Artificial Sequence: Synthetic polypeptide
DECSIMTTNPVATECYGSVYNEPTLERIPNNME

SEQ ID NO: 169045 - protein, 31 aa, Artificial Sequence
  Description of Artificial Sequence: Synthetic polypeptide
DDSEVASTNPVSTEGYGNVAANSIQSRVGQR

SEQ ID NO: 169046 - protein, 34 aa, Artificial Sequence
  Description of Artificial Sequence: Synthetic polypeptide
DEHEIRTTNPVAYECWGSVSGGGNQGGPQGDGGN

SEQ ID NO: 169047 - protein, 33 aa, Artificial Sequence
  Description of Artificial Sequence: Synthetic polypeptide
DENEIRTTNPVSTEPYGTISMEDLIQQQQNNNH

SEQ ID NO: 169048 - protein, 33 aa, Artificial Sequence
  Description of Artificial Sequence: Synthetic polypeptide
DENEIRTTNPVSTEPYGTISMEDLIQQQQNLNH

SEQ ID NO: 169049 - protein, 34 aa, Artificial Sequence
  Description of Artificial Sequence: Synthetic polypeptide
DEMEIRTTNPVATECYGTTTCSATEGWVEPKGNI

SEQ ID NO: 169050 - protein, 34 aa, Artificial Sequence
  Description of Artificial Sequence: Synthetic polypeptide
DEHEIRTTNPVAYECWGSVSGGGNQGGPQGDNDE

SEQ ID NO: 169051 - protein, 39 aa, Artificial Sequence
  Description of Artificial Sequence: Synthetic polypeptide
DEEEIRTTNPVATEQYGVVSTVTNNQQGNQQGTTTNVTD

SEQ ID NO: 169052 - protein, 34 aa, Artificial Sequence
  Description of Artificial Sequence: Synthetic polypeptide
DEMEIRTTNPVATECYGTTTCSATEGWVEFKGNI

SEQ ID NO: 169053 - protein, 31 aa, Artificial Sequence
  Description of Artificial Sequence: Synthetic polypeptide
DDSEVASTNPVSTEGYGNVAANTAQGRVGQR

SEQ ID NO: 169054 - protein, 37 aa, Artificial Sequence
  Description of Artificial Sequence: Synthetic polypeptide
DEHEIATTNPVATEQYGCSTVSCTALVSEDHEGGENL

SEQ ID NO: 169055 - protein, 34 aa, Artificial Sequence
  Description of Artificial Sequence: Synthetic polypeptide
DEHEIATTNPVATEQYGCSAANGLATMPGGEPRH

SEQ ID NO: 169056 - protein, 36 aa, Artificial Sequence
  Description of Artificial Sequence: Synthetic polypeptide
DEHEIATTNPVATEQYGAVCQTNDQGQQQQGEGNVN

SEQ ID NO: 169057 - protein, 35 aa, Artificial Sequence
  Description of Artificial Sequence: Synthetic polypeptide
SENEIRTTNPVATEQYGCVSSLWNLEETIHQQYEQ

SEQ ID NO: 169058 - protein, 34 aa, Artificial Sequence
  Description of Artificial Sequence: Synthetic polypeptide
DEMEIRTTNPVATECYGTTTCSATEGPVEFKGNI

SEQ ID NO: 169059 - protein, 33 aa, Artificial Sequence
  Description of Artificial Sequence: Synthetic polypeptide
DEHEIATTNPVATEQWGTVCAATDGPEVDEGND

SEQ ID NO: 169060 - protein, 36 aa, Artificial Sequence
  Description of Artificial Sequence: Synthetic polypeptide
DETEIRTTNPVATEQYGAVNVDGTGNLTGENEGDDD

SEQ ID NO: 169061 - protein, 35 aa, Artificial Sequence
  Description of Artificial Sequence: Synthetic polypeptide
SENEIRTTNPVATEQYGCVSPSLWNSEETIGQNEQ

SEQ ID NO: 169062 - protein, 36 aa, Artificial Sequence
  Description of Artificial Sequence: Synthetic polypeptide
DEHEIATTNPVATEQWGSVSGGTPAGPNMRNGMNPV

SEQ ID NO: 169063 - protein, 32 aa, Artificial Sequence
  Description of Artificial Sequence: Synthetic polypeptide
DENEIRTTNPVSTEPYGTISMEDKQQQQNGPH

SEQ ID NO: 169064 - protein, 33 aa, Artificial Sequence
  Description of Artificial Sequence: Synthetic polypeptide
DENEIRTTNPVSTEPYGTISMEDMIQQQQNGNH

SEQ ID NO: 169065 - protein, 32 aa, Artificial Sequence
  Description of Artificial Sequence: Synthetic polypeptide
DETEIRTTNPVATEQWGDTWSNEIEMNAKEDA

SEQ ID NO: 169066 - protein, 31 aa, Artificial Sequence
  Description of Artificial Sequence: Synthetic polypeptide
DDSEVASTNPVSTEGYGNVAANREQSRVGQR

SEQ ID NO: 169067 - protein, 34 aa, Artificial Sequence
  Description of Artificial Sequence: Synthetic polypeptide
DEAEICTTNPFATETYGSVPTPDPQHASGENFMG

SEQ ID NO: 169068 - protein, 30 aa, Artificial Sequence
  Description of Artificial Sequence: Synthetic polypeptide
QENEIATTNPVATEQYGEAPEICQNHAEDK

SEQ ID NO: 169069 - protein, 33 aa, Artificial Sequence
  Description of Artificial Sequence: Synthetic polypeptide
DENEIRTTNPVSTEPYGTISMEDQIQQQQNGNH

SEQ ID NO: 169070 - protein, 36 aa, Artificial Sequence
  Description of Artificial Sequence: Synthetic polypeptide
QEEEIRATNPVATEQYGQVVGTDTMDNIGQSGGNGD

SEQ ID NO: 169071 - protein, 31 aa, Artificial Sequence
  Description of Artificial Sequence: Synthetic polypeptide
DDSEVASTNPVSTEGYGNVAANPIQSRVGQR

SEQ ID NO: 169072 - protein, 33 aa, Artificial Sequence
  Description of Artificial Sequence: Synthetic polypeptide
DENEIRTTNPVSTEPYGTISMEDPIQVQQNGNH

SEQ ID NO: 169073 - protein, 33 aa, Artificial Sequence
  Description of Artificial Sequence: Synthetic polypeptide
DENEIRTTNPVSTEPYGTISMEDPIQQQQNGNH

SEQ ID NO: 169074 - protein, 33 aa, Artificial Sequence
  Description of Artificial Sequence: Synthetic polypeptide
DENEIRTTNPVSTEPYGTISMEDNIQQQQNGTH

SEQ ID NO: 169075 - protein, 34 aa, Artificial Sequence
  Description of Artificial Sequence: Synthetic polypeptide
DEMEIRTTNPVATECYGTVCAATEGPVEPKGNYD

SEQ ID NO: 169076 - protein, 33 aa, Artificial Sequence
  Description of Artificial Sequence: Synthetic polypeptide
DEAEISTTNGVAYCQYGCVCSWNLQENFGSDQA

SEQ ID NO: 169077 - protein, 37 aa, Artificial Sequence
  Description of Artificial Sequence: Synthetic polypeptide
DEEEIRTTNPVATEQYGSVGSLMPMILPEILNENLID

SEQ ID NO: 169078 - protein, 32 aa, Artificial Sequence
  Description of Artificial Sequence: Synthetic polypeptide
DETEIRTTNPVATEQWGDVWSNEDEAEAAEDA

SEQ ID NO: 169079 - protein, 32 aa, Artificial Sequence
  Description of Artificial Sequence: Synthetic polypeptide
DETEIRTTNPVATEQWGDVWSNEDEAEAAEPA

SEQ ID NO: 169080 - protein, 33 aa, Artificial Sequence
  Description of Artificial Sequence: Synthetic polypeptide
DETEIRTTNPVATEQWGDVWSNEEDEANAKEDA

SEQ ID NO: 169081 - protein, 32 aa, Artificial Sequence
  Description of Artificial Sequence: Synthetic polypeptide
DETEIRTTNPVATEQWGDVWSNEIEAEAAEDA

SEQ ID NO: 169082 - protein, 31 aa, Artificial Sequence
  Description of Artificial Sequence: Synthetic polypeptide
DETEIRTTNPVATEQWGETPNEEVWAEHGEK

SEQ ID NO: 169083 - protein, 35 aa, Artificial Sequence
  Description of Artificial Sequence: Synthetic polypeptide
DEEEIACTNPVAYEQYGSVCAGTGLAPGEQMEGRH

SEQ ID NO: 169084 - protein, 36 aa, Artificial Sequence
  Description of Artificial Sequence: Synthetic polypeptide
QEEEIRATNPVATEQYGSVNQTDNNDNQEEGGFGET

SEQ ID NO: 169085 - protein, 33 aa, Artificial Sequence
  Description of Artificial Sequence: Synthetic polypeptide
DENEIRTTNPVSTEPYGTISMEDMISQQQNGNV

SEQ ID NO: 169086 - protein, 34 aa, Artificial Sequence
  Description of Artificial Sequence: Synthetic polypeptide
DEMVIGTTNPVATEQWGCVCSTEDLQEYFGSDQA

SEQ ID NO: 169087 - protein, 36 aa, Artificial Sequence
  Description of Artificial Sequence: Synthetic polypeptide
DEEEIRTTNPVATEQYGAVIVNGFGNGQTDQTTGFQ

SEQ ID NO: 169088 - protein, 36 aa, Artificial Sequence
  Description of Artificial Sequence: Synthetic polypeptide
DEEEIRTTNPVATEQYGTTVQTMLDDGSQHIVMEIA

SEQ ID NO: 169089 - protein, 34 aa, Artificial Sequence
  Description of Artificial Sequence: Synthetic polypeptide
DEMEIRTTNPVATECYGTVCAATDGPVEEFEGND

SEQ ID NO: 169090 - protein, 34 aa, Artificial Sequence
  Description of Artificial Sequence: Synthetic polypeptide
SENEIRTTNPVATEQYGSFYNEHDTENRPEDSQR

SEQ ID NO: 169091 - protein, 31 aa, Artificial Sequence
  Description of Artificial Sequence: Synthetic polypeptide
DDSEVASTNPVSTEGYGNVAANQIQSRVGQR

SEQ ID NO: 169092 - protein, 31 aa, Artificial Sequence
  Description of Artificial Sequence: Synthetic polypeptide
DDSEVASTNPVSTEGYGNVAANNIQSRVGQR

SEQ ID NO: 169093 - protein, 32 aa, Artificial Sequence
  Description of Artificial Sequence: Synthetic polypeptide
DENEIRTTNPVSTEPYGTISMEDIQQQQNGTH

SEQ ID NO: 169094 - protein, 32 aa, Artificial Sequence
  Description of Artificial Sequence: Synthetic polypeptide
DENEIRTTNPVSTEPYGTISMEDIQQQQNGSH

SEQ ID NO: 169095 - protein, 37 aa, Artificial Sequence
  Description of Artificial Sequence: Synthetic polypeptide
DEEEIRTTNPVATEQYGSVGPPWNNLENTTQQEELFQ

SEQ ID NO: 169096 - protein, 38 aa, Artificial Sequence
  Description of Artificial Sequence: Synthetic polypeptide
DEEEIRTTNPVATEQYGVVSTTQQQQQNGTEQGSTNDE

SEQ ID NO: 169097 - protein, 34 aa, Artificial Sequence
  Description of Artificial Sequence: Synthetic polypeptide
DEQEIATTNPVAYEEWGSVTGMNENDRGNMGNQR

SEQ ID NO: 169098 - protein, 33 aa, Artificial Sequence
  Description of Artificial Sequence: Synthetic polypeptide
DENEIRTTNPVSTEPYGTISMEDIQQQNGYNHT

SEQ ID NO: 169099 - protein, 33 aa, Artificial Sequence
  Description of Artificial Sequence: Synthetic polypeptide
DESEIRTTNPVATECWGDVSCINEPMNAEGEDG

SEQ ID NO: 169100 - protein, 36 aa, Artificial Sequence
  Description of Artificial Sequence: Synthetic polypeptide
DEEEIRTTNPVATEQYGSVGPMIEQQQNQAQNMMEL

SEQ ID NO: 169101 - protein, 33 aa, Artificial Sequence
  Description of Artificial Sequence: Synthetic polypeptide
DENEIRTTNPVSTEPYGTISMEDIQQQKNGNHH

SEQ ID NO: 169102 - protein, 33 aa, Artificial Sequence
  Description of Artificial Sequence: Synthetic polypeptide
DESEIRTTNPVATECWGDVSCIIEPMDREGEDA

SEQ ID NO: 169103 - protein, 34 aa, Artificial Sequence
  Description of Artificial Sequence: Synthetic polypeptide
DEHEIATTNPEATDQYGQVCCCDQDQKREGNNAR

SEQ ID NO: 169104 - protein, 36 aa, Artificial Sequence
  Description of Artificial Sequence: Synthetic polypeptide
DETEIRTTNPVATEQYGVVVTMNGFNGEGGFLDNTD

SEQ ID NO: 169105 - protein, 35 aa, Artificial Sequence
  Description of Artificial Sequence: Synthetic polypeptide
DAEEIATTNPVATEQYGSVCAAGPEQDDNASIDRN

SEQ ID NO: 169106 - protein, 36 aa, Artificial Sequence
  Description of Artificial Sequence: Synthetic polypeptide
DEEEIRTTNPVATEQYGAVDIDTNMNTEEGGGQDIT

SEQ ID NO: 169107 - protein, 37 aa, Artificial Sequence
  Description of Artificial Sequence: Synthetic polypeptide
DEEEIRTTNPVATEQYGCVCSTWEEHNQENFNSDNQY

SEQ ID NO: 169108 - protein, 37 aa, Artificial Sequence
  Description of Artificial Sequence: Synthetic polypeptide
DEEEIRTTNPVATEQYGCVCSTWEEHNQENFNSDTQA

SEQ ID NO: 169109 - protein, 37 aa, Artificial Sequence
  Description of Artificial Sequence: Synthetic polypeptide
DEEEIACTNPVATEQYGSVSSTGEPGGINPRDGMEKV

SEQ ID NO: 169110 - protein, 37 aa, Artificial Sequence
  Description of Artificial Sequence: Synthetic polypeptide
DEEEIRTTNPVATEQYGAVDIDTNMNLIETGGGQDVD

SEQ ID NO: 169111 - protein, 33 aa, Artificial Sequence
  Description of Artificial Sequence: Synthetic polypeptide
DENEIRTTNPVSTEPYGTISMEDIQQQHNGNDH

SEQ ID NO: 169112 - protein, 36 aa, Artificial Sequence
  Description of Artificial Sequence: Synthetic polypeptide
DEEEIRTTNPVATEQYGAVDIDTNMNEEEGGGQDVV

SEQ ID NO: 169113 - protein, 34 aa, Artificial Sequence
  Description of Artificial Sequence: Synthetic polypeptide
DEQEIATTNPVAYEGWGSVATSNQLQGDVQNNQQ

SEQ ID NO: 169114 - protein, 32 aa, Artificial Sequence
  Description of Artificial Sequence: Synthetic polypeptide
DENAIRTTNPVATEQWGDVSEIVEMNAAEDCA

SEQ ID NO: 169115 - protein, 31 aa, Artificial Sequence
  Description of Artificial Sequence: Synthetic polypeptide
DENAIRTTNPVATEQWGDVVSEIEMNAAEDA

SEQ ID NO: 169116 - protein, 34 aa, Artificial Sequence
  Description of Artificial Sequence: Synthetic polypeptide
DENAIRTTNPVATEQYGCVCSWEEHQENFGSEQT

SEQ ID NO: 169117 - protein, 33 aa, Artificial Sequence
  Description of Artificial Sequence: Synthetic polypeptide
AENEIVCTNPVATEQYGTACSAEDNPVQFEGGR

SEQ ID NO: 169118 - protein, 33 aa, Artificial Sequence
  Description of Artificial Sequence: Synthetic polypeptide
DENEIRTTNPVSTEPYGTISMEDIQQQQEGNDH

SEQ ID NO: 169119 - protein, 35 aa, Artificial Sequence
  Description of Artificial Sequence: Synthetic polypeptide
DEDEIRTTNPVATEPWGVVCFTNEDQHHRGGTDET

SEQ ID NO: 169120 - protein, 34 aa, Artificial Sequence
  Description of Artificial Sequence: Synthetic polypeptide
DECEIRTTNPVAYEQWGSVCYMNDNHDLGGGGIN

SEQ ID NO: 169121 - protein, 37 aa, Artificial Sequence
  Description of Artificial Sequence: Synthetic polypeptide
DETEIRTTNPVATEQYGSVVTTGDDNEEGEGGEGNET

SEQ ID NO: 169122 - protein, 37 aa, Artificial Sequence
  Description of Artificial Sequence: Synthetic polypeptide
DETEIRTTNPVATEQYGSVVTTGDNNEEGETGGGNET

SEQ ID NO: 169123 - protein, 35 aa, Artificial Sequence
  Description of Artificial Sequence: Synthetic polypeptide
DEEEISTTNPVATEQYGQCVCSNWEDPQNFGSDQA

SEQ ID NO: 169124 - protein, 39 aa, Artificial Sequence
  Description of Artificial Sequence: Synthetic polypeptide
DEEEIRTTNPVATEQYGSQIVTPSVNDEEQNNEPEINRV

SEQ ID NO: 169125 - protein, 32 aa, Artificial Sequence
  Description of Artificial Sequence: Synthetic polypeptide
DENEIRTTNPVSTEPYGTISMEDIQQQQNCNH

SEQ ID NO: 169126 - protein, 32 aa, Artificial Sequence
  Description of Artificial Sequence: Synthetic polypeptide
DENEIRTTNPVSTEPYGTISMEDIQQQQNCCP

SEQ ID NO: 169127 - protein, 32 aa, Artificial Sequence
  Description of Artificial Sequence: Synthetic polypeptide
DENEIRTTNPVSTEPYGTISMEDIQQQQNANH

SEQ ID NO: 169128 - protein, 39 aa, Artificial Sequence
  Description of Artificial Sequence: Synthetic polypeptide
DEEEIRTTNPVATEQYGSQIVMWSVNDEEQNAEPEINRV

SEQ ID NO: 169129 - protein, 30 aa, Artificial Sequence
  Description of Artificial Sequence: Synthetic polypeptide
DENAIRETNPVATEQWGDVSEIEMNAAEDA

SEQ ID NO: 169130 - protein, 36 aa, Artificial Sequence
  Description of Artificial Sequence: Synthetic polypeptide
DETEIRTTNPVATEQYGSYGVGTDDDDEGEGQNAQD

SEQ ID NO: 169131 - protein, 32 aa, Artificial Sequence
  Description of Artificial Sequence: Synthetic polypeptide
DENEIRTTNPVSTEPYGTISMEDIQQQQMYNH

SEQ ID NO: 169132 - protein, 33 aa, Artificial Sequence
  Description of Artificial Sequence: Synthetic polypeptide
DEHEIATTNPEATDQYGQVCCCDQDQKREGTER

SEQ ID NO: 169133 - protein, 35 aa, Artificial Sequence
  Description of Artificial Sequence: Synthetic polypeptide
NETEIRTTNPVAYEQWGSVCSTDNNDHHIGNNQDT

SEQ ID NO: 169134 - protein, 35 aa, Artificial Sequence
  Description of Artificial Sequence: Synthetic polypeptide
DEQEIATTNPVAYECWGSVATGNMLGDQQGMNDHD

SEQ ID NO: 169135 - protein, 31 aa, Artificial Sequence
  Description of Artificial Sequence: Synthetic polypeptide
DESEIRTTNPVATECWGDVSEIIEMNAAEDA

SEQ ID NO: 169136 - protein, 34 aa, Artificial Sequence
  Description of Artificial Sequence: Synthetic polypeptide
DEQEIATTNPVAYECWGSVATGNMLGDTQGMGGE

SEQ ID NO: 169137 - protein, 34 aa, Artificial Sequence
  Description of Artificial Sequence: Synthetic polypeptide
DEDEIRTTNPVATEPWGVVCFTNEDQDHKGGTSH

SEQ ID NO: 169138 - protein, 32 aa, Artificial Sequence
  Description of Artificial Sequence: Synthetic polypeptide
DENEIRTTNPVSTEPYGTISMEDIQQQQGGQH

SEQ ID NO: 169139 - protein, 36 aa, Artificial Sequence
  Description of Artificial Sequence: Synthetic polypeptide
DEDEIRTTNPVATEPWGVVCFTNEDQHHQGHNNERM

SEQ ID NO: 169140 - protein, 35 aa, Artificial Sequence
  Description of Artificial Sequence: Synthetic polypeptide
DEDEIRTTNPVATEPWGVVCFTNEDQHHQGHNNIT

SEQ ID NO: 169141 - protein, 31 aa, Artificial Sequence
  Description of Artificial Sequence: Synthetic polypeptide
DDSEVASTNPVSTEGYGNVAANTHQSRIGQR

SEQ ID NO: 169142 - protein, 31 aa, Artificial Sequence
  Description of Artificial Sequence: Synthetic polypeptide
DDSEVASTNPVSTEGYGNVAANTHQSRVGQR

SEQ ID NO: 169143 - protein, 33 aa, Artificial Sequence
  Description of Artificial Sequence: Synthetic polypeptide
AENEIVTTNPVATEQYGTACSAEDNPVEFEGGR

SEQ ID NO: 169144 - protein, 35 aa, Artificial Sequence
  Description of Artificial Sequence: Synthetic polypeptide
DEEEISTTNPVATEQYGQCVCSNWEEHQFFGSDQA

SEQ ID NO: 169145 - protein, 35 aa, Artificial Sequence
  Description of Artificial Sequence: Synthetic polypeptide
DEEEIACTNPVATEQYGSVPAITGHGEYGAEGGNN

SEQ ID NO: 169146 - protein, 36 aa, Artificial Sequence
  Description of Artificial Sequence: Synthetic polypeptide
DEEEIACTNPVATEQYGSVCSVGDDINIDALAENNV

SEQ ID NO: 169147 - protein, 32 aa, Artificial Sequence
  Description of Artificial Sequence: Synthetic polypeptide
SENEIATTNPVATEGYGCVSWELNQHFISELM

SEQ ID NO: 169148 - protein, 33 aa, Artificial Sequence
  Description of Artificial Sequence: Synthetic polypeptide
DENEIRTTNPVSTEPYGTISMEDIQQIQNGNHF

SEQ ID NO: 169149 - protein, 39 aa, Artificial Sequence
  Description of Artificial Sequence: Synthetic polypeptide
DEEEIRTTNPVATEQYGVVSTTSVNQQAGNTEQGTVTTQ

SEQ ID NO: 169150 - protein, 35 aa, Artificial Sequence
  Description of Artificial Sequence: Synthetic polypeptide
DEDEIRTTNPVATEQWGAVCSQNPVETAGNPTASN

SEQ ID NO: 169151 - protein, 36 aa, Artificial Sequence
  Description of Artificial Sequence: Synthetic polypeptide
DECEIRTTNPVATEQYGSVFSWPLNWAEEIGDEPQN

SEQ ID NO: 169152 - protein, 37 aa, Artificial Sequence
  Description of Artificial Sequence: Synthetic polypeptide
DECEIRTTNPVATEQYGSQVESTPLNNAEEIGDEPQN

SEQ ID NO: 169153 - protein, 33 aa, Artificial Sequence
  Description of Artificial Sequence: Synthetic polypeptide
DENEIRTTNPVSTEPYGTISMEDIQQHQNGNHL

SEQ ID NO: 169154 - protein, 37 aa, Artificial Sequence
  Description of Artificial Sequence: Synthetic polypeptide
DEHEIASTNPVAYEQYGSVVSYTLNEHAQLRVGNMAT

SEQ ID NO: 169155 - protein, 37 aa, Artificial Sequence
  Description of Artificial Sequence: Synthetic polypeptide
DEEEIRTTNPVATEQYGCVCSTWGEHNTENFNSDNQS

SEQ ID NO: 169156 - protein, 34 aa, Artificial Sequence
  Description of Artificial Sequence: Synthetic polypeptide
DECEIRTTNPVATEQYGSFWYTWLMESESIEDQC

SEQ ID NO: 169157 - protein, 36 aa, Artificial Sequence
  Description of Artificial Sequence: Synthetic polypeptide
DEEEIACTNPVATEQYGSVCATNPQLNPDDGMGGQA

SEQ ID NO: 169158 - protein, 36 aa, Artificial Sequence
  Description of Artificial Sequence: Synthetic polypeptide
DEEEIRTTNPVATEQYGSNYVAGEEQIENTEEDNDM

SEQ ID NO: 169159 - protein, 36 aa, Artificial Sequence
  Description of Artificial Sequence: Synthetic polypeptide
DEEEISTTNPVATEQYGQCVCSNWEHNQNFGSENQA

SEQ ID NO: 169160 - protein, 35 aa, Artificial Sequence
  Description of Artificial Sequence: Synthetic polypeptide
DEEEIACTNPVATEQYGSVCATNPPEAPDGMETWA

SEQ ID NO: 169161 - protein, 38 aa, Artificial Sequence
  Description of Artificial Sequence: Synthetic polypeptide
DEEEIRTTNPVATEQYGSNVWVTLENEDTGPNESITEI

SEQ ID NO: 169162 - protein, 38 aa, Artificial Sequence
  Description of Artificial Sequence: Synthetic polypeptide
QEEEIRGTNPVATEQYGSVVCTGNLNLEGGGQTEGENG

SEQ ID NO: 169163 - protein, 36 aa, Artificial Sequence
  Description of Artificial Sequence: Synthetic polypeptide
QEEEIRGTNPVATEQYGSVVIDGTDLEIQNEGQGGQ

SEQ ID NO: 169164 - protein, 34 aa, Artificial Sequence
  Description of Artificial Sequence: Synthetic polypeptide
DETEIRTTNPVAYECWGSVCYTNIDNDHGNDGDN

SEQ ID NO: 169165 - protein, 33 aa, Artificial Sequence
  Description of Artificial Sequence: Synthetic polypeptide
DESEIRTTNPVATECWGAVACIDWPQDREGEPG

SEQ ID NO: 169166 - protein, 35 aa, Artificial Sequence
  Description of Artificial Sequence: Synthetic polypeptide
DETEIRTTNPVAYECWGSVSGGNADDSRNGGNGNQ

SEQ ID NO: 169167 - protein, 33 aa, Artificial Sequence
  Description of Artificial Sequence: Synthetic polypeptide
DENEIRTTNPVSTEPYGTISMEDIQQDENGNTH

SEQ ID NO: 169168 - protein, 33 aa, Artificial Sequence
  Description of Artificial Sequence: Synthetic polypeptide
DENEIRTTNPVSTEPYGTISMEDIQQCQNGDNH

SEQ ID NO: 169169 - protein, 33 aa, Artificial Sequence
  Description of Artificial Sequence: Synthetic polypeptide
DENEIRTTNPVSTEPYGTISMEDIQQAQNGNHG

SEQ ID NO: 169170 - protein, 36 aa, Artificial Sequence
  Description of Artificial Sequence: Synthetic polypeptide
DEEEISTTNPVATEQYGQCVCSNWETNQEYFNSEQS

SEQ ID NO: 169171 - protein, 37 aa, Artificial Sequence
  Description of Artificial Sequence: Synthetic polypeptide
DEEEIRTTNPVATEQYGCVCSTWGEHNQENFNSETQA

SEQ ID NO: 169172 - protein, 37 aa, Artificial Sequence
  Description of Artificial Sequence: Synthetic polypeptide
DEEEIRTTNPVATEQYGCVCSTTPAHNIENSGSDPQS

SEQ ID NO: 169173 - protein, 36 aa, Artificial Sequence
  Description of Artificial Sequence: Synthetic polypeptide
DEDEIRTTNPVATEQWGAVCSQNPPVQETAGNPTGS

SEQ ID NO: 169174 - protein, 37 aa, Artificial Sequence
  Description of Artificial Sequence: Synthetic polypeptide
DEEEIRTTNPVATEQYGCVCSTWGEHNQENFNSDTQT

SEQ ID NO: 169175 - protein, 38 aa, Artificial Sequence
  Description of Artificial Sequence: Synthetic polypeptide
DEEEIRTTNPVATEQYGSYVSPELANLMEMPSLAEGGE

SEQ ID NO: 169176 - protein, 36 aa, Artificial Sequence
  Description of Artificial Sequence: Synthetic polypeptide
DEEEIRTTNPVATEQYGAVDIDNNMNLEEGGGQDTV

SEQ ID NO: 169177 - protein, 32 aa, Artificial Sequence
  Description of Artificial Sequence: Synthetic polypeptide
SENEIATTNPVATEGYGCVCSWELQEHISELA

SEQ ID NO: 169178 - protein, 32 aa, Artificial Sequence
  Description of Artificial Sequence: Synthetic polypeptide
SENEIATTNPVATEGYGCVCSWELNQHISEAA

SEQ ID NO: 169179 - protein, 32 aa, Artificial Sequence
  Description of Artificial Sequence: Synthetic polypeptide
DENEIRTTNPVSTEPYGTISMEDIQQQCNGMH

SEQ ID NO: 169180 - protein, 35 aa, Artificial Sequence
  Description of Artificial Sequence: Synthetic polypeptide
DAEEIATTNPVATEQYGSVCAANANDTDMPGENAN

SEQ ID NO: 169181 - protein, 32 aa, Artificial Sequence
  Description of Artificial Sequence: Synthetic polypeptide
DENEIRTTNPVSTEPYGTISMEDIQQQANGDA

SEQ ID NO: 169182 - protein, 35 aa, Artificial Sequence
  Description of Artificial Sequence: Synthetic polypeptide
DEEEIACTNPVATEQYGSVCSPVDNNHNIDAMGEN

SEQ ID NO: 169183 - protein, 32 aa, Artificial Sequence
  Description of Artificial Sequence: Synthetic polypeptide
DENEIRTTNPVSTEPYGTISMEDIQQNANGDA

SEQ ID NO: 169184 - protein, 31 aa, Artificial Sequence
  Description of Artificial Sequence: Synthetic polypeptide
SENEIATTNPVATEGYGCVCSWEDQHMSELA

SEQ ID NO: 169185 - protein, 33 aa, Artificial Sequence
  Description of Artificial Sequence: Synthetic polypeptide
DENEIRTTNPVSTEPYGTISMEDIQQMQNGNIH

SEQ ID NO: 169186 - protein, 32 aa, Artificial Sequence
  Description of Artificial Sequence: Synthetic polypeptide
DENAIRTTNPVSTEPYGIISMEDIQQQQNGNH

SEQ ID NO: 169187 - protein, 34 aa, Artificial Sequence
  Description of Artificial Sequence: Synthetic polypeptide
DESEIRTTNPVATECWGAVWACINEPQDPKGNYG

SEQ ID NO: 169188 - protein, 32 aa, Artificial Sequence
  Description of Artificial Sequence: Synthetic polypeptide
DENAIRTTNPVSTEPYGTISMEDCQQQQNGNH

SEQ ID NO: 169189 - protein, 36 aa, Artificial Sequence
  Description of Artificial Sequence: Synthetic polypeptide
QEEEIRGTNPVATEQYGSVNMTFGEAFEERGENGDT

SEQ ID NO: 169190 - protein, 36 aa, Artificial Sequence
  Description of Artificial Sequence: Synthetic polypeptide
DEEEIACTNPVATEQYGSVCSAPALGQDHQGDQDAE

SEQ ID NO: 169191 - protein, 32 aa, Artificial Sequence
  Description of Artificial Sequence: Synthetic polypeptide
DENAIRTTNPVSTEPYGTISMEDIQQQQNGNH

SEQ ID NO: 169192 - protein, 35 aa, Artificial Sequence
  Description of Artificial Sequence: Synthetic polypeptide
DEEEIACTNPVATEQYGSVCAVGDDGNNEMGNNQN

SEQ ID NO: 169193 - protein, 36 aa, Artificial Sequence
  Description of Artificial Sequence: Synthetic polypeptide
DEEEIRTTNPVATEQYGCVCSTWGEHNENFNSETQT

SEQ ID NO: 169194 - protein, 35 aa, Artificial Sequence
  Description of Artificial Sequence: Synthetic polypeptide
DEEEIACTNPVATEQYGSVCAVGDDGNNAMGNAQV

SEQ ID NO: 169195 - protein, 30 aa, Artificial Sequence
  Description of Artificial Sequence: Synthetic polypeptide
DENAIRTTNVVATEQWGDVSEIEMNAAEDA

SEQ ID NO: 169196 - protein, 33 aa, Artificial Sequence
  Description of Artificial Sequence: Synthetic polypeptide
DENEIRTTNPVSTEPYGTISMEDIQQMQNGGNH

SEQ ID NO: 169197 - protein, 35 aa, Artificial Sequence
  Description of Artificial Sequence: Synthetic polypeptide
DEEEIACTNPVATEQYGSVCATPEEAGDMQMGKLH

SEQ ID NO: 169198 - protein, 36 aa, Artificial Sequence
  Description of Artificial Sequence: Synthetic polypeptide
DEEEIRTTNPVATEQYGATVSPIFNNVSDPNMDEVP

SEQ ID NO: 169199 - protein, 37 aa, Artificial Sequence
  Description of Artificial Sequence: Synthetic polypeptide
DETEIRTTNPVATEQYGSVVTTDGMNDNQTGEGEQGE

SEQ ID NO: 169200 - protein, 37 aa, Artificial Sequence
  Description of Artificial Sequence: Synthetic polypeptide
DEEEIRTTNPVATEQYGCVCSTTPAHNAENSGSDPVL

SEQ ID NO: 169201 - protein, 36 aa, Artificial Sequence
  Description of Artificial Sequence: Synthetic polypeptide
DEEEISTTNPVATEQYGQCVCSNTMELANFGSEFQG

SEQ ID NO: 169202 - protein, 33 aa, Artificial Sequence
  Description of Artificial Sequence: Synthetic polypeptide
DENEIRTTNPVSTEPYGTISMEDIQQQQNGNKH

SEQ ID NO: 169203 - protein, 33 aa, Artificial Sequence
  Description of Artificial Sequence: Synthetic polypeptide
DENEIRTTNPVSTEPYGTISMEDIQQQQNGNIH

SEQ ID NO: 169204 - protein, 38 aa, Artificial Sequence
  Description of Artificial Sequence: Synthetic polypeptide
DEEEIRTTNPVATEQYGVVSTVTNNQNNQQGTTEEGTD

SEQ ID NO: 169205 - protein, 33 aa, Artificial Sequence
  Description of Artificial Sequence: Synthetic polypeptide
DENEIRTTNPVSTEPYGTISMEDIQQQQNGNHY

SEQ ID NO: 169206 - protein, 34 aa, Artificial Sequence
  Description of Artificial Sequence: Synthetic polypeptide
AEPEIRTTNPVATEEYGCCWYNIGVTLQRTMNQE

SEQ ID NO: 169207 - protein, 38 aa, Artificial Sequence
  Description of Artificial Sequence: Synthetic polypeptide
DEEEIRTTNPVATEQYGSQVGGPSNNNTQSLENNVDQL

SEQ ID NO: 169208 - protein, 33 aa, Artificial Sequence
  Description of Artificial Sequence: Synthetic polypeptide
DENEIRTTNPVSTEPYGTISMEDIQQQQNGNHW

SEQ ID NO: 169209 - protein, 33 aa, Artificial Sequence
  Description of Artificial Sequence: Synthetic polypeptide
DENEIRTTNPVSTEPYGTISMEDIQQQQNGNHV

SEQ ID NO: 169210 - protein, 33 aa, Artificial Sequence
  Description of Artificial Sequence: Synthetic polypeptide
DENEIRTTNPVSTEPYGTISMEDIQQQQNGNHT

SEQ ID NO: 169211 - protein, 32 aa, Artificial Sequence
  Description of Artificial Sequence: Synthetic polypeptide
AEPEIRTTNPVATEEYGCCWNIVLERGGDQQE

SEQ ID NO: 169212 - protein, 33 aa, Artificial Sequence
  Description of Artificial Sequence: Synthetic polypeptide
DENEIRTTNPVSTEPYGTISMEDIQQQQNGNHS

SEQ ID NO: 169213 - protein, 39 aa, Artificial Sequence
  Description of Artificial Sequence: Synthetic polypeptide
DEEEIRTTNPVATEQYGVVSTVTNNQLNQQQATTNVATE

SEQ ID NO: 169214 - protein, 33 aa, Artificial Sequence
  Description of Artificial Sequence: Synthetic polypeptide
DENEIRTTNPVSTEPYGTISMEDIQQQQNGNHQ

SEQ ID NO: 169215 - protein, 33 aa, Artificial Sequence
  Description of Artificial Sequence: Synthetic polypeptide
DENEIRTTNPVSTEPYGTISMEDIQQQQNGNHP

SEQ ID NO: 169216 - protein, 37 aa, Artificial Sequence
  Description of Artificial Sequence: Synthetic polypeptide
DEEEIRTTNPVATEQYGSVNSWPNGMVLESLLEVAES

SEQ ID NO: 169217 - protein, 31 aa, Artificial Sequence
  Description of Artificial Sequence: Synthetic polypeptide
DDSEVASTNPVSTEGYGNVAANTGQSRMGQR

SEQ ID NO: 169218 - protein, 33 aa, Artificial Sequence
  Description of Artificial Sequence: Synthetic polypeptide
DENEIRTTNPVSTEPYGTISMEDIQQQQNGNHN

SEQ ID NO: 169219 - protein, 33 aa, Artificial Sequence
  Description of Artificial Sequence: Synthetic polypeptide
DENEIRTTNPVSTEPYGTISMEDIQQQQNGNHM

SEQ ID NO: 169220 - protein, 33 aa, Artificial Sequence
  Description of Artificial Sequence: Synthetic polypeptide
DENEIRTTNPVSTEPYGTISMEDIQQQQNGNHL

SEQ ID NO: 169221 - protein, 33 aa, Artificial Sequence
  Description of Artificial Sequence: Synthetic polypeptide
DENEIRTTNPVSTEPYGTISMEDIQQQQNGNHK

SEQ ID NO: 169222 - protein, 33 aa, Artificial Sequence
  Description of Artificial Sequence: Synthetic polypeptide
DENEIRTTNPVSTEPYGTISMEDIQQQQNGNHI

SEQ ID NO: 169223 - protein, 33 aa, Artificial Sequence
  Description of Artificial Sequence: Synthetic polypeptide
DENEIRTTNPVSTEPYGTISMEDIQQQQNGNHH

SEQ ID NO: 169224 - protein, 33 aa, Artificial Sequence
  Description of Artificial Sequence: Synthetic polypeptide
DENEIRTTNPVSTEPYGTISMEDIQQQQNGNHG

SEQ ID NO: 169225 - protein, 34 aa, Artificial Sequence
  Description of Artificial Sequence: Synthetic polypeptide
DEHEIATTNPVATEGYGVVCSGDNHDRNDGGQGL

SEQ ID NO: 169226 - protein, 33 aa, Artificial Sequence
  Description of Artificial Sequence: Synthetic polypeptide
DENEIRTTNPVSTEPYGTISMEDIQQQQNGNHF

SEQ ID NO: 169227 - protein, 36 aa, Artificial Sequence
  Description of Artificial Sequence: Synthetic polypeptide
DEEEISTTNPVATEQYGQCVCSNTEHQENFSSDNQF

SEQ ID NO: 169228 - protein, 33 aa, Artificial Sequence
  Description of Artificial Sequence: Synthetic polypeptide
DENEIRTTNPVSTEPYGTISMEDIQQQQNGNMH

SEQ ID NO: 169229 - protein, 33 aa, Artificial Sequence
  Description of Artificial Sequence: Synthetic polypeptide
DENEIRTTNPVSTEPYGTISMEDIQQQQNGRNH

SEQ ID NO: 169230 - protein, 33 aa, Artificial Sequence
  Description of Artificial Sequence: Synthetic polypeptide
DENEIRTTNPVSTEPYGTISMEDIQQQQNGQNH

SEQ ID NO: 169231 - protein, 32 aa, Artificial Sequence
  Description of Artificial Sequence: Synthetic polypeptide
DENEIRTTNPVSTEPYGTISMEDIQQQQNGQH

SEQ ID NO: 169232 - protein, 31 aa, Artificial Sequence
  Description of Artificial Sequence: Synthetic polypeptide
DDSEVASTNPVSTEGYGNVAANTFQSRVGQR

SEQ ID NO: 169233 - protein, 33 aa, Artificial Sequence
  Description of Artificial Sequence: Synthetic polypeptide
DENEIRTTNPVSTEPYGTISMEDIQQQQNGPNH

SEQ ID NO: 169234 - protein, 32 aa, Artificial Sequence
  Description of Artificial Sequence: Synthetic polypeptide
DENEIRTTNPVSTEPYGTISMEDIQQQQNGPH

SEQ ID NO: 169235 - protein, 33 aa, Artificial Sequence
  Description of Artificial Sequence: Synthetic polypeptide
DENEIRTTNPVSTEPYGTISMEDIQQQQNGNYH

SEQ ID NO: 169236 - protein, 38 aa, Artificial Sequence
  Description of Artificial Sequence: Synthetic polypeptide
DEEEIRTTNPVATEQYGVVSTTQQLQAGTEQGTEQGSE

SEQ ID NO: 169237 - protein, 33 aa, Artificial Sequence
  Description of Artificial Sequence: Synthetic polypeptide
DENEIRTTNPVSTEPYGTISMEDIQQQQNGNWH

SEQ ID NO: 169238 - protein, 36 aa, Artificial Sequence
  Description of Artificial Sequence: Synthetic polypeptide
DETEIRTTNPVATEQYGSVSMSPAALDMEVENEEEV

SEQ ID NO: 169239 - protein, 38 aa, Artificial Sequence
  Description of Artificial Sequence: Synthetic polypeptide
DEEEIRTTNPVATEQYGVVSTTQQLQQGSEQGGTTTDD

SEQ ID NO: 169240 - protein, 33 aa, Artificial Sequence
  Description of Artificial Sequence: Synthetic polypeptide
DENEIRTTNPVSTEPYGTISMEDIQQQQNGNVH

SEQ ID NO: 169241 - protein, 33 aa, Artificial Sequence
  Description of Artificial Sequence: Synthetic polypeptide
DENEIRTTNPVSTEPYGTISMEDIQQQQNGNTH

SEQ ID NO: 169242 - protein, 35 aa, Artificial Sequence
  Description of Artificial Sequence: Synthetic polypeptide
DESEIRTTNPVATECWGFSETVCINEPSDREGENG

SEQ ID NO: 169243 - protein, 33 aa, Artificial Sequence
  Description of Artificial Sequence: Synthetic polypeptide
DENEIRTTNPVSTEPYGTISMEDIQQQQNGNSH

SEQ ID NO: 169244 - protein, 37 aa, Artificial Sequence
  Description of Artificial Sequence: Synthetic polypeptide
AEDEICTTNPVATEAYGSVSTVNTEQIGNLQIGNEEM

SEQ ID NO: 169245 - protein, 35 aa, Artificial Sequence
  Description of Artificial Sequence: Synthetic polypeptide
DEMEIRTTNPVATECWGSVCSACINEPEDFEGENG

SEQ ID NO: 169246 - protein, 33 aa, Artificial Sequence
  Description of Artificial Sequence: Synthetic polypeptide
DENEIRTTNPVSTEPYGTISMEDIQQQQNGNQH

SEQ ID NO: 169247 - protein, 33 aa, Artificial Sequence
  Description of Artificial Sequence: Synthetic polypeptide
DENEIRTTNPVSTEPYGTISMEDIQQQQNGNPP

SEQ ID NO: 169248 - protein, 33 aa, Artificial Sequence
  Description of Artificial Sequence: Synthetic polypeptide
DENEIRTTNPVSTEPYGTISMEDIQQQQNGNPH

SEQ ID NO: 169249 - protein, 33 aa, Artificial Sequence
  Description of Artificial Sequence: Synthetic polypeptide
DENEIRTTNPVSTEPYGTISMEDIQQQQNGNPA

SEQ ID NO: 169250 - protein, 33 aa, Artificial Sequence
  Description of Artificial Sequence: Synthetic polypeptide
DENEIRTTNPVSTEPYGTISMEDIQQQQNGNNH

SEQ ID NO: 169251 - protein, 32 aa, Artificial Sequence
  Description of Artificial Sequence: Synthetic polypeptide
QEGEIAPTNPVSTEPYGTVSMEDLQQQQNGNH

SEQ ID NO: 169252 - protein, 33 aa, Artificial Sequence
  Description of Artificial Sequence: Synthetic polypeptide
DENEIRTTNPVSTEPYGTISMEDIQQQQNGNLH

SEQ ID NO: 169253 - protein, 33 aa, Artificial Sequence
  Description of Artificial Sequence: Synthetic polypeptide
DENEIRTTNPVSTEPYGTISMEDIQQQQNGSNH

SEQ ID NO: 169254 - protein, 33 aa, Artificial Sequence
  Description of Artificial Sequence: Synthetic polypeptide
DENEIRTTNPVSTEPYGTISMEDIQQQQNGNHE

SEQ ID NO: 169255 - protein, 33 aa, Artificial Sequence
  Description of Artificial Sequence: Synthetic polypeptide
DENEIRTTNPVSTEPYGTISMEDIQQQQNGNHC

SEQ ID NO: 169256 - protein, 32 aa, Artificial Sequence
  Description of Artificial Sequence: Synthetic polypeptide
DENEIRTTNPVSTEPYGTISMEDIQQQQNGGH

SEQ ID NO: 169257 - protein, 33 aa, Artificial Sequence
  Description of Artificial Sequence: Synthetic polypeptide
DENEIRTTNPVSTEPYGTISMEDIQQQQNGFNH

SEQ ID NO: 169258 - protein, 32 aa, Artificial Sequence
  Description of Artificial Sequence: Synthetic polypeptide
DENEIRTTNPVSTEPYGTISMEDIQQQQNGFH

SEQ ID NO: 169259 - protein, 33 aa, Artificial Sequence
  Description of Artificial Sequence: Synthetic polypeptide
DENEIRTTNPVSTEPYGTISMEDIQQQQNGENH

SEQ ID NO: 169260 - protein, 33 aa, Artificial Sequence
  Description of Artificial Sequence: Synthetic polypeptide
DENEIRTTNPVSTEPYGTISMEDIQQQQNGEND

SEQ ID NO: 169261 - protein, 32 aa, Artificial Sequence
  Description of Artificial Sequence: Synthetic polypeptide
DENEIRTTNPVSTEPYGTISMEDIQQQQNGEH

SEQ ID NO: 169262 - protein, 33 aa, Artificial Sequence
  Description of Artificial Sequence: Synthetic polypeptide
DENEIRTTNPVSTEPYGTISMEDIQQQQNGDNH

SEQ ID NO: 169263 - protein, 32 aa, Artificial Sequence
  Description of Artificial Sequence: Synthetic polypeptide
DENEIRTTNPVSTEPYGTISMEDIQQQQNGDH

SEQ ID NO: 169264 - protein, 32 aa, Artificial Sequence
  Description of Artificial Sequence: Synthetic polypeptide
DENEIRTTNPVSTEPYGTISMEDIQQQQNGCH

SEQ ID NO: 169265 - protein, 33 aa, Artificial Sequence
  Description of Artificial Sequence: Synthetic polypeptide
DENEIRTTNPVSTEPYGTISMEDIQQQQNGANH

SEQ ID NO: 169266 - protein, 32 aa, Artificial Sequence
  Description of Artificial Sequence: Synthetic polypeptide
DENEIRTTNPVSTEPYGTISMEDIQQQQNGAH

SEQ ID NO: 169267 - protein, 32 aa, Artificial Sequence
  Description of Artificial Sequence: Synthetic polypeptide
DENEIRTTNPVSTEPYGTISMEDIQQQQNFNH

SEQ ID NO: 169268 - protein, 35 aa, Artificial Sequence
  Description of Artificial Sequence: Synthetic polypeptide
DEEEIACTNPVATESYGSVAMNNDTNPDNQTEGAD

SEQ ID NO: 169269 - protein, 32 aa, Artificial Sequence
  Description of Artificial Sequence: Synthetic polypeptide
DENEIRTTNPVSTEPYGTISMEDIQQQQNENH

SEQ ID NO: 169270 - protein, 32 aa, Artificial Sequence
  Description of Artificial Sequence: Synthetic polypeptide
DENEIRTTNPVSTEPYGTISMEDIQQQQNDNH

SEQ ID NO: 169271 - protein, 36 aa, Artificial Sequence
  Description of Artificial Sequence: Synthetic polypeptide
DDEEIRATNPVATEQYGAVVINDTGNLDIGQGNQGE

SEQ ID NO: 169272 - protein, 37 aa, Artificial Sequence
  Description of Artificial Sequence: Synthetic polypeptide
DEEEIRTTNPVATEQYGCVCSTTPADNNEHFGSDPVI

SEQ ID NO: 169273 - protein, 35 aa, Artificial Sequence
  Description of Artificial Sequence: Synthetic polypeptide
DEQEIATTNPVAYECWGSVATGNMLGDAGGMNTPR

SEQ ID NO: 169274 - protein, 33 aa, Artificial Sequence
  Description of Artificial Sequence: Synthetic polypeptide
DEHEIATTNPVATAQWGSVAAGNLFTPNNMGTV

SEQ ID NO: 169275 - protein, 37 aa, Artificial Sequence
  Description of Artificial Sequence: Synthetic polypeptide
DEEEISTTNPVATEQYGQCVCSNTGPHNANFGSDNQS

SEQ ID NO: 169276 - protein, 32 aa, Artificial Sequence
  Description of Artificial Sequence: Synthetic polypeptide
DESEIRTTNPVATECWGEAPCVCPQDREGEEK

SEQ ID NO: 169277 - protein, 38 aa, Artificial Sequence
  Description of Artificial Sequence: Synthetic polypeptide
DETEIRTTNPVATEQYGSVVSTGGDNNVEGEEGEGNET

SEQ ID NO: 169278 - protein, 33 aa, Artificial Sequence
  Description of Artificial Sequence: Synthetic polypeptide
DEHEIATTNPVATAQWGGCVAISNALTQDGPDM

SEQ ID NO: 169279 - protein, 33 aa, Artificial Sequence
  Description of Artificial Sequence: Synthetic polypeptide
DENEIRTTNPVSTEPYGTISMEDIQQQQNGGND

SEQ ID NO: 169280 - protein, 33 aa, Artificial Sequence
  Description of Artificial Sequence: Synthetic polypeptide
DENEIRTTNPVSTEPYGTISMEDIQQQQNGNHD

SEQ ID NO: 169281 - protein, 33 aa, Artificial Sequence
  Description of Artificial Sequence: Synthetic polypeptide
DENEIRTTNPVSTEPYGTISMEDIQQQQNGGNH

SEQ ID NO: 169282 - protein, 33 aa, Artificial Sequence
  Description of Artificial Sequence: Synthetic polypeptide
DENEIRTTNPVSTEPYGTISMEDIQQQQNGHNH

SEQ ID NO: 169283 - protein, 33 aa, Artificial Sequence
  Description of Artificial Sequence: Synthetic polypeptide
DENEIRTTNPVSTEPYGTISMEDIQQQQNGNHA

SEQ ID NO: 169284 - protein, 33 aa, Artificial Sequence
  Description of Artificial Sequence: Synthetic polypeptide
DENEIRTTNPVSTEPYGTISMEDIQQQQNGNGH

SEQ ID NO: 169285 - protein, 37 aa, Artificial Sequence
  Description of Artificial Sequence: Synthetic polypeptide
DEEEIRTTNPVATEQYGSVGQPLMNYEEQMIMNAEEL

SEQ ID NO: 169286 - protein, 33 aa, Artificial Sequence
  Description of Artificial Sequence: Synthetic polypeptide
DENEIRTTNPVSTEPYGTISMEDIQQQQNGNFH

SEQ ID NO: 169287 - protein, 31 aa, Artificial Sequence
  Description of Artificial Sequence: Synthetic polypeptide
DDSEVASTNPVSTEGYGNVAANTGQSRVGQR

SEQ ID NO: 169288 - protein, 33 aa, Artificial Sequence
  Description of Artificial Sequence: Synthetic polypeptide
DENEIRTTNPVSTEPYGTISMEDIQQQQNGNEH

SEQ ID NO: 169289 - protein, 38 aa, Artificial Sequence
  Description of Artificial Sequence: Synthetic polypeptide
DEEEIRTTNPVATEQYGVVSTVTNNNTEQGTNNTNDTD

SEQ ID NO: 169290 - protein, 33 aa, Artificial Sequence
  Description of Artificial Sequence: Synthetic polypeptide
DENEIRTTNPVSTEPYGTISMEDIQQQQNGNDH

SEQ ID NO: 169291 - protein, 33 aa, Artificial Sequence
  Description of Artificial Sequence: Synthetic polypeptide
DENEIRTTNPVSTEPYGTISMEDIQQQQNGNCH

SEQ ID NO: 169292 - protein, 33 aa, Artificial Sequence
  Description of Artificial Sequence: Synthetic polypeptide
DENEIRTTNPVSTEPYGTISMEDIQQQQNGNAH

SEQ ID NO: 169293 - protein, 33 aa, Artificial Sequence
  Description of Artificial Sequence: Synthetic polypeptide
DENEIRTTNPVSTEPYGTISMEDIQQQQNGMNH

SEQ ID NO: 169294 - protein, 32 aa, Artificial Sequence
  Description of Artificial Sequence: Synthetic polypeptide
DENEIRTTNPVSTEPYGTISMEDIQQQQNGMH

SEQ ID NO: 169295 - protein, 33 aa, Artificial Sequence
  Description of Artificial Sequence: Synthetic polypeptide
DENEIRTTNPVSTEPYGTISMEDIQQQQNGLNH

SEQ ID NO: 169296 - protein, 32 aa, Artificial Sequence
  Description of Artificial Sequence: Synthetic polypeptide
DENEIRTTNPVSTEPYGTISMEDIQQQQNGLH

SEQ ID NO: 169297 - protein, 33 aa, Artificial Sequence
  Description of Artificial Sequence: Synthetic polypeptide
DENEIRTTNPVSTEPYGTISMEDIQQQQNGKNH

SEQ ID NO: 169298 - protein, 32 aa, Artificial Sequence
  Description of Artificial Sequence: Synthetic polypeptide
DENEIRTTNPVSTEPYGTISMEDIQQQQNGKH

SEQ ID NO: 169299 - protein, 34 aa, Artificial Sequence
  Description of Artificial Sequence: Synthetic polypeptide
DENEIRTTNPVSTEPYGTISMEDIQQQQNGINHR

SEQ ID NO: 169300 - protein, 33 aa, Artificial Sequence
  Description of Artificial Sequence: Synthetic polypeptide
DENEIRTTNPVSTEPYGTISMEDIQQQQNGINH

SEQ ID NO: 169301 - protein, 32 aa, Artificial Sequence
  Description of Artificial Sequence: Synthetic polypeptide
DENEIRTTNPVSTEPYGTISMEDIQQQQNGIH

SEQ ID NO: 169302 - protein, 32 aa, Artificial Sequence
  Description of Artificial Sequence: Synthetic polypeptide
DENEIRTTNPVSTEPYGTISMEDIQQQQNGID

SEQ ID NO: 169303 - protein, 32 aa, Artificial Sequence
  Description of Artificial Sequence: Synthetic polypeptide
DENEIRTTNPVSTEPYGTISMEDIQQQQNGHY

SEQ ID NO: 169304 - protein, 32 aa, Artificial Sequence
  Description of Artificial Sequence: Synthetic polypeptide
DENEIRTTNPVSTEPYGTISMEDIQQQQNGHV

SEQ ID NO: 169305 - protein, 33 aa, Artificial Sequence
  Description of Artificial Sequence: Synthetic polypeptide
DENEIRTTNPVSTEPYGTISMEDIQQQQNGHNI

SEQ ID NO: 169306 - protein, 32 aa, Artificial Sequence
  Description of Artificial Sequence: Synthetic polypeptide
DENEIRTTNPVSTEPYGTISMEDIQQQQNGHH

SEQ ID NO: 169307 - protein, 32 aa, Artificial Sequence
  Description of Artificial Sequence: Synthetic polypeptide
DENEIRTTNPVSTEPYGTISMEDIQQAQNFNH

SEQ ID NO: 169308 - protein, 34 aa, Artificial Sequence
  Description of Artificial Sequence: Synthetic polypeptide
DENEIRTTNPVSTEPYGTISMEDSIQQQQNGNHD

SEQ ID NO: 169309 - protein, 34 aa, Artificial Sequence
  Description of Artificial Sequence: Synthetic polypeptide
DEMEVVTTNPVATEQYGTVCSATDGPVEFEGNDG

SEQ ID NO: 169310 - protein, 36 aa, Artificial Sequence
  Description of Artificial Sequence: Synthetic polypeptide
DDSEIRTTNPVATEQYGSVCNTDNSYQENDFDNNQE

SEQ ID NO: 169311 - protein, 37 aa, Artificial Sequence
  Description of Artificial Sequence: Synthetic polypeptide
SESEVRTTNPVATEQYGSVSETWILTDQQRIGMIPMH

SEQ ID NO: 169312 - protein, 36 aa, Artificial Sequence
  Description of Artificial Sequence: Synthetic polypeptide
DDSEIRTTNPVATEQYGSCNNTDNSYQERFVDNNQE

SEQ ID NO: 169313 - protein, 36 aa, Artificial Sequence
  Description of Artificial Sequence: Synthetic polypeptide
DDEEIATTNPVSTEQYGNVSSTTPAGPQSRNGMNPV

SEQ ID NO: 169314 - protein, 32 aa, Artificial Sequence
  Description of Artificial Sequence: Synthetic polypeptide
DETEIRTTNPISTEPYGATSMEDIQAEQNGNH

SEQ ID NO: 169315 - protein, 30 aa, Artificial Sequence
  Description of Artificial Sequence: Synthetic polypeptide
SESEVASTNPVSTEQYGNVAAETIMRVGQR

SEQ ID NO: 169316 - protein, 32 aa, Artificial Sequence
  Description of Artificial Sequence: Synthetic polypeptide
QENEIATTNPVATEQWGCVSEGEGMNAAEDND

SEQ ID NO: 169317 - protein, 32 aa, Artificial Sequence
  Description of Artificial Sequence: Synthetic polypeptide
QENEIATTNPVATEQWGCVSEGEMNAAEDNAN

SEQ ID NO: 169318 - protein, 29 aa, Artificial Sequence
  Description of Artificial Sequence: Synthetic peptide
QENEIATTNPVATEQWGDASEIEMNHEEA

SEQ ID NO: 169319 - protein, 32 aa, Artificial Sequence
  Description of Artificial Sequence: Synthetic polypeptide
DETEIRTTNPISTEPYGTTISMEDWQEQKGNH

SEQ ID NO: 169320 - protein, 36 aa, Artificial Sequence
  Description of Artificial Sequence: Synthetic polypeptide
DAEEIATTNPVATEQYGSACSATNDQQEHQDGTADK

SEQ ID NO: 169321 - protein, 32 aa, Artificial Sequence
  Description of Artificial Sequence: Synthetic polypeptide
DETEIRTTNPISTEPYGTTSMEDIQAEQNGNH

SEQ ID NO: 169322 - protein, 32 aa, Artificial Sequence
  Description of Artificial Sequence: Synthetic polypeptide
DENEIRTTNPVSTEPYGTISMWDIQQQQNNNH

SEQ ID NO: 169323 - protein, 33 aa, Artificial Sequence
  Description of Artificial Sequence: Synthetic polypeptide
QAEEIATTNPVATEQYGCTAGNNLQTADNPQEN

SEQ ID NO: 169324 - protein, 34 aa, Artificial Sequence
  Description of Artificial Sequence: Synthetic polypeptide
DEEEIRTTNPVSTEAYGSVNVFYHLTQNTEQQTK

SEQ ID NO: 169325 - protein, 30 aa, Artificial Sequence
  Description of Artificial Sequence: Synthetic polypeptide
SESEVACTNPISTEGYGNVSAETIQRVGQR

SEQ ID NO: 169326 - protein, 34 aa, Artificial Sequence
  Description of Artificial Sequence: Synthetic polypeptide
DEMEIVTTNPVATWQYGTVCSATDGPVEFEGNDN

SEQ ID NO: 169327 - protein, 34 aa, Artificial Sequence
  Description of Artificial Sequence: Synthetic polypeptide
SESEIRTTNPVATGHYGSVSDVLNMLTEGTIDMT

SEQ ID NO: 169328 - protein, 33 aa, Artificial Sequence
  Description of Artificial Sequence: Synthetic polypeptide
DENEIRTTNPVSTEPYGTISMWDIQQQQNGNCH

SEQ ID NO: 169329 - protein, 35 aa, Artificial Sequence
  Description of Artificial Sequence: Synthetic polypeptide
DETEIRTTNPVAFEGYGVVIITDNGGQEGGNGEGN

SEQ ID NO: 169330 - protein, 36 aa, Artificial Sequence
  Description of Artificial Sequence: Synthetic polypeptide
DETEIRTTNPVAFEQYGSVIDGDQNGQQEGGNGNGD

SEQ ID NO: 169331 - protein, 37 aa, Artificial Sequence
  Description of Artificial Sequence: Synthetic polypeptide
DETEIRTTNPVAFEQYGSVIDGEQDNGLQEGGNGNGE

SEQ ID NO: 169332 - protein, 32 aa, Artificial Sequence
  Description of Artificial Sequence: Synthetic polypeptide
DETEIRTTNPISTEPYGTTSMEDIQQQQNGNH

SEQ ID NO: 169333 - protein, 36 aa, Artificial Sequence
  Description of Artificial Sequence: Synthetic polypeptide
DDSEIRTTNPVATEQYGSVCNYDNSYQERFPDNNQE

SEQ ID NO: 169334 - protein, 34 aa, Artificial Sequence
  Description of Artificial Sequence: Synthetic polypeptide
QAEEIATTNPVATEQYGCVAGNGENQTADGPNDN

SEQ ID NO: 169335 - protein, 34 aa, Artificial Sequence
  Description of Artificial Sequence: Synthetic polypeptide
DEMEIVTTNPVATWQYGTVCSATDGPVEFEGDND

SEQ ID NO: 169336 - protein, 33 aa, Artificial Sequence
  Description of Artificial Sequence: Synthetic polypeptide
DEACIRTTNPLATEQFGCVCSWEDQSFGSNTQS

SEQ ID NO: 169337 - protein, 35 aa, Artificial Sequence
  Description of Artificial Sequence: Synthetic polypeptide
DEEEIRTTNPVATDQYGVVVDQNDNDQGQEFEGED

SEQ ID NO: 169338 - protein, 34 aa, Artificial Sequence
  Description of Artificial Sequence: Synthetic polypeptide
DEAEIRTTNPVCTECWGSFSIINETQHRGSEYMP

SEQ ID NO: 169339 - protein, 34 aa, Artificial Sequence
  Description of Artificial Sequence: Synthetic polypeptide
DDSEIRTTNPVSTECWGNVSANITEPQDREGEQR

SEQ ID NO: 169340 - protein, 34 aa, Artificial Sequence
  Description of Artificial Sequence: Synthetic polypeptide
QAEEIATTNPVATEQYGCVAGTGGLQPADQPNNQ

SEQ ID NO: 169341 - protein, 36 aa, Artificial Sequence
  Description of Artificial Sequence: Synthetic polypeptide
DEEEIRTTNPVATDQYGVVNDNSIGQNNGQEDNNQD

SEQ ID NO: 169342 - protein, 37 aa, Artificial Sequence
  Description of Artificial Sequence: Synthetic polypeptide
DEEEIRTTNPVATDQYGVVNDNSIGQNGQGLDNGNID

SEQ ID NO: 169343 - protein, 35 aa, Artificial Sequence
  Description of Artificial Sequence: Synthetic polypeptide
DEEEIATTNPVATEQYGSTCAMTEHGEADDGDGRD

SEQ ID NO: 169344 - protein, 34 aa, Artificial Sequence
  Description of Artificial Sequence: Synthetic polypeptide
QAEEIATTNPVATEQYGCVAGTGGLIADGPNDNH

SEQ ID NO: 169345 - protein, 36 aa, Artificial Sequence
  Description of Artificial Sequence: Synthetic polypeptide
DEEEIRTTNPVATDQYGVVNDNSIGQNGQGDNNDDE

SEQ ID NO: 169346 - protein, 31 aa, Artificial Sequence
  Description of Artificial Sequence: Synthetic polypeptide
DETEIRTTNPISTECWGAVWANCDLAPKGTI

SEQ ID NO: 169347 - protein, 33 aa, Artificial Sequence
  Description of Artificial Sequence: Synthetic polypeptide
DEACIRTTNPLATEQFGCVCSWELQESFGSDQA

SEQ ID NO: 169348 - protein, 35 aa, Artificial Sequence
  Description of Artificial Sequence: Synthetic polypeptide
DDSEIRTTNPVATEQYGSVSVIELNQMEMIFEEFA

SEQ ID NO: 169349 - protein, 37 aa, Artificial Sequence
  Description of Artificial Sequence: Synthetic polypeptide
DEEEIRTTNPVATDQYGVVNDNSIGQNGGQGDNGNTD

SEQ ID NO: 169350 - protein, 35 aa, Artificial Sequence
  Description of Artificial Sequence: Synthetic polypeptide
DEEEIRTTNPVAYEQWGSTVYHEINDHQKTKGKES

SEQ ID NO: 169351 - protein, 36 aa, Artificial Sequence
  Description of Artificial Sequence: Synthetic polypeptide
DEEEIRTTNPVATDQYGVVNDNSIGQEGGELDNNED

SEQ ID NO: 169352 - protein, 32 aa, Artificial Sequence
  Description of Artificial Sequence: Synthetic polypeptide
DEACIRTTNPLATEQFGCVCSWGEDQSFGSDQ

SEQ ID NO: 169353 - protein, 37 aa, Artificial Sequence
  Description of Artificial Sequence: Synthetic polypeptide
DEEEIRTTNPVATDQYGSVSLTVWDPTQDQTNNFEQD

SEQ ID NO: 169354 - protein, 35 aa, Artificial Sequence
  Description of Artificial Sequence: Synthetic polypeptide
DEAEIRTTNPVSTECWGSVSRCINEPQVTDGENFG

SEQ ID NO: 169355 - protein, 34 aa, Artificial Sequence
  Description of Artificial Sequence: Synthetic polypeptide
QAEEIATTNPVATEQYGCVAGNGGLTTADGPNDN

SEQ ID NO: 169356 - protein, 35 aa, Artificial Sequence
  Description of Artificial Sequence: Synthetic polypeptide
SETEIATTNPVATESYGCVATGNGLNDTERGGDMR

SEQ ID NO: 169357 - protein, 35 aa, Artificial Sequence
  Description of Artificial Sequence: Synthetic polypeptide
SETEIACTNPVATEQYGSVYCTWNDQHHQGMNMQE

SEQ ID NO: 169358 - protein, 35 aa, Artificial Sequence
  Description of Artificial Sequence: Synthetic polypeptide
SETEIACTNPVATEQYGSVYCTWNDQHHQGHNQGH

SEQ ID NO: 169359 - protein, 35 aa, Artificial Sequence
  Description of Artificial Sequence: Synthetic polypeptide
DEEEIRTTNPVSTEAYGSVNTFHYHLTQTMEQQTK

SEQ ID NO: 169360 - protein, 34 aa, Artificial Sequence
  Description of Artificial Sequence: Synthetic polypeptide
DEAEIRTTNPVSTEGYGSVSREAFLEDRVTEFEP

SEQ ID NO: 169361 - protein, 36 aa, Artificial Sequence
  Description of Artificial Sequence: Synthetic polypeptide
DEEEIATTNPVATEQYGSTCPAGTGNPQETEDNEDN

SEQ ID NO: 169362 - protein, 38 aa, Artificial Sequence
  Description of Artificial Sequence: Synthetic polypeptide
DEEEIRTTNPVAYEQYGQSVCSQLGDLHQARSGQITKN

SEQ ID NO: 169363 - protein, 32 aa, Artificial Sequence
  Description of Artificial Sequence: Synthetic polypeptide
DEAEIRTTNPVSTEPYGCISMEDEQQPQSGEH

SEQ ID NO: 169364 - protein, 33 aa, Artificial Sequence
  Description of Artificial Sequence: Synthetic polypeptide
DENEIRTTNPVSTEPYGTISMMEDIQQQQNGNH

SEQ ID NO: 169365 - protein, 33 aa, Artificial Sequence
  Description of Artificial Sequence: Synthetic polypeptide
DEAEIRTTNPVSTEPYGTIASMEDISQQQNGNH

SEQ ID NO: 169366 - protein, 33 aa, Artificial Sequence
  Description of Artificial Sequence: Synthetic polypeptide
DENEIRTTNPVSTEPYGTISMMEDIQQQQLGNH

SEQ ID NO: 169367 - protein, 34 aa, Artificial Sequence
  Description of Artificial Sequence: Synthetic polypeptide
DEAEIRTTNPVSTEPYGTICSWEDINQEQFGNQM

SEQ ID NO: 169368 - protein, 34 aa, Artificial Sequence
  Description of Artificial Sequence: Synthetic polypeptide
DEAEIRTTNPVSTEPYGTICSWEEINQEQFGSNQ

SEQ ID NO: 169369 - protein, 32 aa, Artificial Sequence
  Description of Artificial Sequence: Synthetic polypeptide
DEAEIRTTNPVSTEPYGTIQMEDIQQQQNGNH

SEQ ID NO: 169370 - protein, 36 aa, Artificial Sequence
  Description of Artificial Sequence: Synthetic polypeptide
DEEEIRTTNPVATEQYGSTIEPTIGMEQEEIENMLF

SEQ ID NO: 169371 - protein, 34 aa, Artificial Sequence
  Description of Artificial Sequence: Synthetic polypeptide
QAEEIATTNPVATEQWGSVSGTGNPPDNNSNDVD

SEQ ID NO: 169372 - protein, 34 aa, Artificial Sequence
  Description of Artificial Sequence: Synthetic polypeptide
QAEEIATTNPVATEQWGSVSGTGNPDNANPSNPL

SEQ ID NO: 169373 - protein, 30 aa, Artificial Sequence
  Description of Artificial Sequence: Synthetic polypeptide
QENEIATTNPVATEQWGDVSEIEMNAAEDA

SEQ ID NO: 169374 - protein, 36 aa, Artificial Sequence
  Description of Artificial Sequence: Synthetic polypeptide
DECTICTTNPVATEQYGVVSTVTTNQQQQNGNNQVD

SEQ ID NO: 169375 - protein, 36 aa, Artificial Sequence
  Description of Artificial Sequence: Synthetic polypeptide
DECTICTTNPVATEQYGVVSTVTTNQQNQQGNGNVD

SEQ ID NO: 169376 - protein, 30 aa, Artificial Sequence
  Description of Artificial Sequence: Synthetic polypeptide
QENEIATTNPVATEQWGDVSEIEMNAAEDI

SEQ ID NO: 169377 - protein, 31 aa, Artificial Sequence
  Description of Artificial Sequence: Synthetic polypeptide
DENEIRTTNPVSTEPYGTISMIIQQQQAEDH

SEQ ID NO: 169378 - protein, 35 aa, Artificial Sequence
  Description of Artificial Sequence: Synthetic polypeptide
DEHEIATTNPVATEQYGTVCSATDGHPVEFGGNED

SEQ ID NO: 169379 - protein, 31 aa, Artificial Sequence
  Description of Artificial Sequence: Synthetic polypeptide
DETEIRTTNPVATECWGAAAANWAEPKGGYI

SEQ ID NO: 169380 - protein, 33 aa, Artificial Sequence
  Description of Artificial Sequence: Synthetic polypeptide
DENEIRTTNPVSTEPYGTISMIDIVVQQNGHNH

SEQ ID NO: 169381 - protein, 36 aa, Artificial Sequence
  Description of Artificial Sequence: Synthetic polypeptide
DEEEIRTTNPVATEQYGSTGPISNTLVPTQGEVEQV

SEQ ID NO: 169382 - protein, 33 aa, Artificial Sequence
  Description of Artificial Sequence: Synthetic polypeptide
DEHEIATTNPVATEQYGTVCSAADGPVEDENND

SEQ ID NO: 169383 - protein, 36 aa, Artificial Sequence
  Description of Artificial Sequence: Synthetic polypeptide
DECTICTTNPVATEQYGVVSTVTTNNQQQGNGNVDQ

SEQ ID NO: 169384 - protein, 29 aa, Artificial Sequence
  Description of Artificial Sequence: Synthetic peptide
QEGEIASTNPCSYECWGIVSCNWQSGDTR

SEQ ID NO: 169385 - protein, 36 aa, Artificial Sequence
  Description of Artificial Sequence: Synthetic polypeptide
DECTICTTNPVATEQYGVVSTVTNQQQQNGNGNTDN

SEQ ID NO: 169386 - protein, 35 aa, Artificial Sequence
  Description of Artificial Sequence: Synthetic polypeptide
QEEEICTTNPVCYEPYGSVSCNPNFSQNRMVGNND

SEQ ID NO: 169387 - protein, 37 aa, Artificial Sequence
  Description of Artificial Sequence: Synthetic polypeptide
AEDEIRATNPVATEQYGSVSTTNQQLLQLQQGTTTTD

SEQ ID NO: 169388 - protein, 36 aa, Artificial Sequence
  Description of Artificial Sequence: Synthetic polypeptide
DEACIRTTNPVATEQWGSVGTTGNMESIYNGGNNRN

SEQ ID NO: 169389 - protein, 33 aa, Artificial Sequence
  Description of Artificial Sequence: Synthetic polypeptide
DENEIRTTNPVSTEPYGTISMPAIQQQQNGNPV

SEQ ID NO: 169390 - protein, 31 aa, Artificial Sequence
  Description of Artificial Sequence: Synthetic polypeptide
QEGEIASTNPCSYEQWGIVSCNLQSGGDTTR

SEQ ID NO: 169391 - protein, 31 aa, Artificial Sequence
  Description of Artificial Sequence: Synthetic polypeptide
QAEEIATTNPVATEQYGCAPMHGTDSEGEGN

SEQ ID NO: 169392 - protein, 31 aa, Artificial Sequence
  Description of Artificial Sequence: Synthetic polypeptide
QAEEIATTNPVATEQYGCAPIHGQDSEENKN

SEQ ID NO: 169393 - protein, 34 aa, Artificial Sequence
  Description of Artificial Sequence: Synthetic polypeptide
DEEEIRTTNPVSTEAYGIVSTNKVHETETEQQTK

SEQ ID NO: 169394 - protein, 34 aa, Artificial Sequence
  Description of Artificial Sequence: Synthetic polypeptide
AESEEIATTNPVAYEQWGSVSTQGNAGEHQGTDE

SEQ ID NO: 169395 - protein, 35 aa, Artificial Sequence
  Description of Artificial Sequence: Synthetic polypeptide
AESEEIATTNPVAYEQWGSVSTGGNAGEHQTGDDE

SEQ ID NO: 169396 - protein, 34 aa, Artificial Sequence
  Description of Artificial Sequence: Synthetic polypeptide
DEEEIRTTNPVSTEAYGIVSTFRYHETNTEQQTK

SEQ ID NO: 169397 - protein, 35 aa, Artificial Sequence
  Description of Artificial Sequence: Synthetic polypeptide
AESEEIATTNPVAYEQWGSVSTGGNAGEHQQGTDA

SEQ ID NO: 169398 - protein, 30 aa, Artificial Sequence
  Description of Artificial Sequence: Synthetic polypeptide
QEGEIASTNPCSYEQWGIVSCNDQSGDTDR

SEQ ID NO: 169399 - protein, 29 aa, Artificial Sequence
  Description of Artificial Sequence: Synthetic peptide
QAEEIATTNPVATEQYGCAPEHGTDSEEL

SEQ ID NO: 169400 - protein, 35 aa, Artificial Sequence
  Description of Artificial Sequence: Synthetic polypeptide
AESEEIATTNPVAYEQWGSVSTGGNAGEHQEGTAE

SEQ ID NO: 169401 - protein, 35 aa, Artificial Sequence
  Description of Artificial Sequence: Synthetic polypeptide
SESEIRTTNPVATEQYGSVSWILNDNNEEELNEIL

SEQ ID NO: 169402 - protein, 33 aa, Artificial Sequence
  Description of Artificial Sequence: Synthetic polypeptide
DEEEIRTTNPVSTEAYGIVSAFQHETETEQQTK

SEQ ID NO: 169403 - protein, 35 aa, Artificial Sequence
  Description of Artificial Sequence: Synthetic polypeptide
AESEEIATTNPVATESWGSVSTGGNAGEHQGTDER

SEQ ID NO: 169404 - protein, 33 aa, Artificial Sequence
  Description of Artificial Sequence: Synthetic polypeptide
DENEIRTTNPVSTEPYGTISMQDGIQQQQNGNH

SEQ ID NO: 169405 - protein, 35 aa, Artificial Sequence
  Description of Artificial Sequence: Synthetic polypeptide
DEEEIRTTNPVATDAYGVVNDNSIGQNGGQGDNET

SEQ ID NO: 169406 - protein, 36 aa, Artificial Sequence
  Description of Artificial Sequence: Synthetic polypeptide
DEEEIRTTNPVATDAYGTVVMSDTNMLINEGMGQGN

SEQ ID NO: 169407 - protein, 31 aa, Artificial Sequence
  Description of Artificial Sequence: Synthetic polypeptide
QAEEIATTNPVATEQYGCAAMHGQDSNGEMD

SEQ ID NO: 169408 - protein, 32 aa, Artificial Sequence
  Description of Artificial Sequence: Synthetic polypeptide
QAEEIATTNPVATEQYGCAAMHGLDSEGENKD

SEQ ID NO: 169409 - protein, 34 aa, Artificial Sequence
  Description of Artificial Sequence: Synthetic polypeptide
SESEIRTTNPVATEQYGCYSWTLYDNNEELNEIL

SEQ ID NO: 169410 - protein, 33 aa, Artificial Sequence
  Description of Artificial Sequence: Synthetic polypeptide
DEMEIVTTNPVATYCYGTVCSATDGPVEFEGND

SEQ ID NO: 169411 - protein, 33 aa, Artificial Sequence
  Description of Artificial Sequence: Synthetic polypeptide
DEMEIVTTNPVATYPYGTVCSATDGPVEFEGND

SEQ ID NO: 169412 - protein, 31 aa, Artificial Sequence
  Description of Artificial Sequence: Synthetic polypeptide
DDSEVASTNPVSTEGYGNVAANFIQSRVGQR

SEQ ID NO: 169413 - protein, 33 aa, Artificial Sequence
  Description of Artificial Sequence: Synthetic polypeptide
DENEIRTTNPVSTEPYGTISMPAIQQQQNGNPH

SEQ ID NO: 169414 - protein, 33 aa, Artificial Sequence
  Description of Artificial Sequence: Synthetic polypeptide
DEDCIACTNPVAYEPWDYSTVASNLQRGDNSRA

SEQ ID NO: 169415 - protein, 35 aa, Artificial Sequence
  Description of Artificial Sequence: Synthetic polypeptide
AEEEIRTTNPVATEQYGSVSPTTTEGMEMEDQFLQ

SEQ ID NO: 169416 - protein, 34 aa, Artificial Sequence
  Description of Artificial Sequence: Synthetic polypeptide
DEAEIRTTNPVAYESWGSVCYTNIDNDHGQEGHN

SEQ ID NO: 169417 - protein, 30 aa, Artificial Sequence
  Description of Artificial Sequence: Synthetic polypeptide
DETEIRTTNPIATEQWGDVAEIEMNAAEDA

SEQ ID NO: 169418 - protein, 31 aa, Artificial Sequence
  Description of Artificial Sequence: Synthetic polypeptide
DETEIRTTNPIATEQWGDVAEIEMNAAEDYA

SEQ ID NO: 169419 - protein, 31 aa, Artificial Sequence
  Description of Artificial Sequence: Synthetic polypeptide
DETEIRTTNPIATEQWGDVAEIEMNAAEPYA

SEQ ID NO: 169420 - protein, 31 aa, Artificial Sequence
  Description of Artificial Sequence: Synthetic polypeptide
DETEIRTTNPIATEQWGDVAEIEMNAKEPYA

SEQ ID NO: 169421 - protein, 30 aa, Artificial Sequence
  Description of Artificial Sequence: Synthetic polypeptide
DETEIRTTNPIATEQWGEAWPEVWAHKGEK

SEQ ID NO: 169422 - protein, 37 aa, Artificial Sequence
  Description of Artificial Sequence: Synthetic polypeptide
DEEEISTTNPVATEQYGCVCSWGNDHEQENFGSDNQD

SEQ ID NO: 169423 - protein, 37 aa, Artificial Sequence
  Description of Artificial Sequence: Synthetic polypeptide
DEEEIRTTNPVAYEQWGSVSGGEPAGPNMQNGGGNMY

SEQ ID NO: 169424 - protein, 36 aa, Artificial Sequence
  Description of Artificial Sequence: Synthetic polypeptide
DEEEIRTTNPVAYEQWGSVSGGEPAGPNMQNGGGLQ

SEQ ID NO: 169425 - protein, 31 aa, Artificial Sequence
  Description of Artificial Sequence: Synthetic polypeptide
QENEIATTNPVATEPYGNVAGEHGQHMNPKL

SEQ ID NO: 169426 - protein, 33 aa, Artificial Sequence
  Description of Artificial Sequence: Synthetic polypeptide
SEYEIRCTNPVATEQYGCVCEWEHQEHFGSNQS

SEQ ID NO: 169427 - protein, 32 aa, Artificial Sequence
  Description of Artificial Sequence: Synthetic polypeptide
QENEIATTNPVATEPYGNVNSGEHLQHEEELM

SEQ ID NO: 169428 - protein, 33 aa, Artificial Sequence
  Description of Artificial Sequence: Synthetic polypeptide
QENEIATTNPVATEPYGNVPSGEHGQHGMMQNW

SEQ ID NO: 169429 - protein, 33 aa, Artificial Sequence
  Description of Artificial Sequence: Synthetic polypeptide
QENEIATTNPVATEPYGNVPSGEHLNQHGMMLF

SEQ ID NO: 169430 - protein, 35 aa, Artificial Sequence
  Description of Artificial Sequence: Synthetic polypeptide
DETEIRTTNPIATEQWGSTSANTPDGPNMPNGNYV

SEQ ID NO: 169431 - protein, 35 aa, Artificial Sequence
  Description of Artificial Sequence: Synthetic polypeptide
DETEIRTTNPIATEQWGSTSSNTPDGPNMPNGNYV

SEQ ID NO: 169432 - protein, 35 aa, Artificial Sequence
  Description of Artificial Sequence: Synthetic polypeptide
DETEIRTTNPIATEQWGSTSSNTPDGPNMRNGNPV

SEQ ID NO: 169433 - protein, 33 aa, Artificial Sequence
  Description of Artificial Sequence: Synthetic polypeptide
SEYEIRCTNPVATEQYGCVCEWEDLQHFGSEQA

SEQ ID NO: 169434 - protein, 33 aa, Artificial Sequence
  Description of Artificial Sequence: Synthetic polypeptide
QENEIATTNPVATEPYGNVPSGEHLQAHGMMLM

SEQ ID NO: 169435 - protein, 35 aa, Artificial Sequence
  Description of Artificial Sequence: Synthetic polypeptide
DEEEISTTNPVATEQYGCVCSWMEHEQENFGSDQY

SEQ ID NO: 169436 - protein, 35 aa, Artificial Sequence
  Description of Artificial Sequence: Synthetic polypeptide
DEEEISTTNPVATEQYGCVCSWMEHNEEHFNSDQS

SEQ ID NO: 169437 - protein, 36 aa, Artificial Sequence
  Description of Artificial Sequence: Synthetic polypeptide
DEEEISTTNPVATEQYGCVCSWMEHNQEGFNSDNQS

SEQ ID NO: 169438 - protein, 34 aa, Artificial Sequence
  Description of Artificial Sequence: Synthetic polypeptide
DETEIRTTNPIATEQWGSTWANAEAGNERNGNYI

SEQ ID NO: 169439 - protein, 34 aa, Artificial Sequence
  Description of Artificial Sequence: Synthetic polypeptide
DETEIRTTNPIATEQWGSTWANAEAGNERNGPYI

SEQ ID NO: 169440 - protein, 31 aa, Artificial Sequence
  Description of Artificial Sequence: Synthetic polypeptide
QENEIATTNPVATEPYGEISMEDIQQQQGEH

SEQ ID NO: 169441 - protein, 34 aa, Artificial Sequence
  Description of Artificial Sequence: Synthetic polypeptide
DETEIRTTNPIATEQWGSTWATAEAGNERNGNPI

SEQ ID NO: 169442 - protein, 35 aa, Artificial Sequence
  Description of Artificial Sequence: Synthetic polypeptide
DEEEISTTNPVATEQYGCVCSWGEWHQENFGSDQE

SEQ ID NO: 169443 - protein, 30 aa, Artificial Sequence
  Description of Artificial Sequence: Synthetic polypeptide
QENEIATTNPVATEPYGEIPMVIQQQNEEK

SEQ ID NO: 169444 - protein, 30 aa, Artificial Sequence
  Description of Artificial Sequence: Synthetic polypeptide
QENEIATTNPVATEPYGEAPMVCQQHNEEK

SEQ ID NO: 169445 - protein, 36 aa, Artificial Sequence
  Description of Artificial Sequence: Synthetic polypeptide
SEYEIRMTNPVATEQYGSVETVNALTEEHTGSNQQA

SEQ ID NO: 169446 - protein, 33 aa, Artificial Sequence
  Description of Artificial Sequence: Synthetic polypeptide
DEMEIRTTNPVATEQWGDVCSAEIPVENAEGDD

SEQ ID NO: 169447 - protein, 33 aa, Artificial Sequence
  Description of Artificial Sequence: Synthetic polypeptide
DEMEIRTTNPVATEQWGCVCSSPEANAFNSDAA

SEQ ID NO: 169448 - protein, 34 aa, Artificial Sequence
  Description of Artificial Sequence: Synthetic polypeptide
DEEEISTTNPVATEQYGCVCSWGEPAENFGSEQS

SEQ ID NO: 169449 - protein, 36 aa, Artificial Sequence
  Description of Artificial Sequence: Synthetic polypeptide
DEEEISTTNPVATEQYGCVCSWGEPNEENFGSDNQS

SEQ ID NO: 169450 - protein, 35 aa, Artificial Sequence
  Description of Artificial Sequence: Synthetic polypeptide
DEEEISTTNPVATEQYGCVCSWGEPNQENFGSEQA

SEQ ID NO: 169451 - protein, 35 aa, Artificial Sequence
  Description of Artificial Sequence: Synthetic polypeptide
DEEEISTTNPVATEQYGCVCSWGEPNQENFNSEQA

SEQ ID NO: 169452 - protein, 34 aa, Artificial Sequence
  Description of Artificial Sequence: Synthetic polypeptide
SEYEIRMTNPVATEQYGSVEEVNLDEEKIGSTQQ

SEQ ID NO: 169453 - protein, 31 aa, Artificial Sequence
  Description of Artificial Sequence: Synthetic polypeptide
QENEIATTNPVATEPYGEASEEDIQQQQGEH

SEQ ID NO: 169454 - protein, 34 aa, Artificial Sequence
  Description of Artificial Sequence: Synthetic polypeptide
SEYEIRMTNPVATEQYGCVETVNLDEEIIGSTQQ

SEQ ID NO: 169455 - protein, 37 aa, Artificial Sequence
  Description of Artificial Sequence: Synthetic polypeptide
DEEEIRTTNPVATEAYGEISTIGTVNVATNNTQIGTQ

SEQ ID NO: 169456 - protein, 35 aa, Artificial Sequence
  Description of Artificial Sequence: Synthetic polypeptide
DEEEIRTTNPVATEAYGDVVDGFNGEDFQEDGEQA

SEQ ID NO: 169457 - protein, 31 aa, Artificial Sequence
  Description of Artificial Sequence: Synthetic polypeptide
QENEIATTNPVATEPYGEASEEVIQQQQGEH

SEQ ID NO: 169458 - protein, 34 aa, Artificial Sequence
  Description of Artificial Sequence: Synthetic polypeptide
SEYEIRCTNPVATEQYGSVETVNLDEEHIISTQQ

SEQ ID NO: 169459 - protein, 33 aa, Artificial Sequence
  Description of Artificial Sequence: Synthetic polypeptide
DEHEIATTNPVAYEAWGSVCPTDQGDQERNGDM

SEQ ID NO: 169460 - protein, 34 aa, Artificial Sequence
  Description of Artificial Sequence: Synthetic polypeptide
DEEEISTTNPVATEQYGCVCSWGEPQNFFSETQS

SEQ ID NO: 169461 - protein, 30 aa, Artificial Sequence
  Description of Artificial Sequence: Synthetic polypeptide
QENEIATTNPVATEPYGEIPMVIQQQNEEH

SEQ ID NO: 169462 - protein, 35 aa, Artificial Sequence
  Description of Artificial Sequence: Synthetic polypeptide
DEEEISTTNPVATEQYGCVCSWGETDQENFGSDQS

SEQ ID NO: 169463 - protein, 33 aa, Artificial Sequence
  Description of Artificial Sequence: Synthetic polypeptide
DESEIRTTNPVATECWGSTSNCIDEQDPEGPYI

SEQ ID NO: 169464 - protein, 32 aa, Artificial Sequence
  Description of Artificial Sequence: Synthetic polypeptide
DETEIRTTNPIATEQWGAVANAENWAPKGPYI

SEQ ID NO: 169465 - protein, 33 aa, Artificial Sequence
  Description of Artificial Sequence: Synthetic polypeptide
SEYEIRCTNPVATEQYGQCVCEWEHQHFGSNQA

SEQ ID NO: 169466 - protein, 33 aa, Artificial Sequence
  Description of Artificial Sequence: Synthetic polypeptide
DESEIRTTNPVATECWGSTSNCIDEPQDPEGPI

SEQ ID NO: 169467 - protein, 31 aa, Artificial Sequence
  Description of Artificial Sequence: Synthetic polypeptide
QENEIATTNPVATEPYGEISEEDIQQQQGEH

SEQ ID NO: 169468 - protein, 32 aa, Artificial Sequence
  Description of Artificial Sequence: Synthetic polypeptide
DETEIRTTNPVATECWGAIWSAEDWQEPKGPI

SEQ ID NO: 169469 - protein, 34 aa, Artificial Sequence
  Description of Artificial Sequence: Synthetic polypeptide
DETEIRTTNPIATEQWGSTWATAPAGNERNGNPI

SEQ ID NO: 169470 - protein, 36 aa, Artificial Sequence
  Description of Artificial Sequence: Synthetic polypeptide
DETEIRTTNPIATEQWGSVWSTAEDGPNERKGMNYV

SEQ ID NO: 169471 - protein, 32 aa, Artificial Sequence
  Description of Artificial Sequence: Synthetic polypeptide
QENEIATTNPVATEPYGNVSGEHLPQHQEEEL

SEQ ID NO: 169472 - protein, 34 aa, Artificial Sequence
  Description of Artificial Sequence: Synthetic polypeptide
SEVEIATTNPVATEQYGSVCAAANGLDEANNNNN

SEQ ID NO: 169473 - protein, 32 aa, Artificial Sequence
  Description of Artificial Sequence: Synthetic polypeptide
QENEIATTNPVATEPYGNVSGEHLQHEEEKMM

SEQ ID NO: 169474 - protein, 32 aa, Artificial Sequence
  Description of Artificial Sequence: Synthetic polypeptide
QENEIATTNPVATEPYGNVSGEHLQHMDDSLM

SEQ ID NO: 169475 - protein, 32 aa, Artificial Sequence
  Description of Artificial Sequence: Synthetic polypeptide
QENEIATTNPVATEPYGNVSGEHLQTHWDEQL

SEQ ID NO: 169476 - protein, 34 aa, Artificial Sequence
  Description of Artificial Sequence: Synthetic polypeptide
DEMEIVTTNPVATRQYGTVCSATDGPVEFEGHND

SEQ ID NO: 169477 - protein, 37 aa, Artificial Sequence
  Description of Artificial Sequence: Synthetic polypeptide
DEAEIRTTNPVAYERYGISTVSYEGNELSAVRGPHRM

SEQ ID NO: 169478 - protein, 33 aa, Artificial Sequence
  Description of Artificial Sequence: Synthetic polypeptide
SEVEIATTNPVATEPYGSVAGSNPANPNPGAQP

SEQ ID NO: 169479 - protein, 37 aa, Artificial Sequence
  Description of Artificial Sequence: Synthetic polypeptide
DEAEIRTTNPVAYERYGISTVSYEGNELSDVRGPSRE

SEQ ID NO: 169480 - protein, 36 aa, Artificial Sequence
  Description of Artificial Sequence: Synthetic polypeptide
SEVEIATTNPVATEIYGSVCSNWNDGQDRQGIGGER

SEQ ID NO: 169481 - protein, 34 aa, Artificial Sequence
  Description of Artificial Sequence: Synthetic polypeptide
DEMEIVTTNPVATRQYGTVCSATDGPVEFEGNND

SEQ ID NO: 169482 - protein, 36 aa, Artificial Sequence
  Description of Artificial Sequence: Synthetic polypeptide
DEEEIATTNPVATEQYGSTACAPANPDLPLGSEGNN

SEQ ID NO: 169483 - protein, 37 aa, Artificial Sequence
  Description of Artificial Sequence: Synthetic polypeptide
DEAEIRTTNPVAYERYGISTVSYEGNNLSDVRGPDRF

SEQ ID NO: 169484 - protein, 34 aa, Artificial Sequence
  Description of Artificial Sequence: Synthetic polypeptide
DEMEIVTTNPVATRQYGTVCSATDGPVEMFEGND

SEQ ID NO: 169485 - protein, 33 aa, Artificial Sequence
  Description of Artificial Sequence: Synthetic polypeptide
DDSEIRTTNPVSTEPYGTISAMETIQQSQNGNH

SEQ ID NO: 169486 - protein, 33 aa, Artificial Sequence
  Description of Artificial Sequence: Synthetic polypeptide
DEMEIVTTNPVATRQYGTVCVATDGPVEFEGND

SEQ ID NO: 169487 - protein, 37 aa, Artificial Sequence
  Description of Artificial Sequence: Synthetic polypeptide
DEAEIRTTNPVAYERYGISTVSYYGNELSDVRGSERF

SEQ ID NO: 169488 - protein, 35 aa, Artificial Sequence
  Description of Artificial Sequence: Synthetic polypeptide
CEEEIATTNPVATEQYGSVSAGPPGANGAGMGSHD

SEQ ID NO: 169489 - protein, 34 aa, Artificial Sequence
  Description of Artificial Sequence: Synthetic polypeptide
DEEEIRTTNPVAYEQWGSVCVNWEHQEQDMHQPS

SEQ ID NO: 169490 - protein, 34 aa, Artificial Sequence
  Description of Artificial Sequence: Synthetic polypeptide
SETEIRTTNPIATECYGSTTWSNAENLAERGPYI

SEQ ID NO: 169491 - protein, 32 aa, Artificial Sequence
  Description of Artificial Sequence: Synthetic polypeptide
DDSEIRTTNPVSTEPYGNISMEDIQQSQNGNH

SEQ ID NO: 169492 - protein, 33 aa, Artificial Sequence
  Description of Artificial Sequence: Synthetic polypeptide
SETEIRTTNPIATECYGSTTWAEEDLARKGNYI

SEQ ID NO: 169493 - protein, 39 aa, Artificial Sequence
  Description of Artificial Sequence: Synthetic polypeptide
DEEEIRTTNPVATEQYGVVSTTNQQQQNGTTEQGSNNDE

SEQ ID NO: 169494 - protein, 37 aa, Artificial Sequence
  Description of Artificial Sequence: Synthetic polypeptide
DEAEIRTTNPVAYERYGISTVSYEGNELAGVRGPERF

SEQ ID NO: 169495 - protein, 35 aa, Artificial Sequence
  Description of Artificial Sequence: Synthetic polypeptide
DETEIRTTNPIATEQWGSVWATAEDGPNERKGNYV

SEQ ID NO: 169496 - protein, 38 aa, Artificial Sequence
  Description of Artificial Sequence: Synthetic polypeptide
AEDEIRATNPVATEQYGSVSTTNQQLQLQLQQGTNQQA

SEQ ID NO: 169497 - protein, 38 aa, Artificial Sequence
  Description of Artificial Sequence: Synthetic polypeptide
DEEEIRTTNPVATEQYGVVSTTNQQQQNGTEQGSTQGV

SEQ ID NO: 169498 - protein, 36 aa, Artificial Sequence
  Description of Artificial Sequence: Synthetic polypeptide
DEEEISTTNPVATEQYGCVCSWMEHNQENFGSDNQS

SEQ ID NO: 169499 - protein, 32 aa, Artificial Sequence
  Description of Artificial Sequence: Synthetic polypeptide
DETEIRTTNPIATEQYGATANADLEEHKGEDL

SEQ ID NO: 169500 - protein, 35 aa, Artificial Sequence
  Description of Artificial Sequence: Synthetic polypeptide
DETEIRTTNPIATEQYGATAWANAEDWQERKGGYR

SEQ ID NO: 169501 - protein, 33 aa, Artificial Sequence
  Description of Artificial Sequence: Synthetic polypeptide
QENEIATTNPVATEPYGNVPSGEHLQHGMMGMM

SEQ ID NO: 169502 - protein, 33 aa, Artificial Sequence
  Description of Artificial Sequence: Synthetic polypeptide
QENEIATTNPVATEPYGNVPSGEHLQHQMEGFH

SEQ ID NO: 169503 - protein, 33 aa, Artificial Sequence
  Description of Artificial Sequence: Synthetic polypeptide
DETEIRTTNPIATEQYGATWANADLEEHKGEDL

SEQ ID NO: 169504 - protein, 35 aa, Artificial Sequence
  Description of Artificial Sequence: Synthetic polypeptide
DETEIRTTNPIATEQYGSTWATAPAGNERNGMNPI

SEQ ID NO: 169505 - protein, 33 aa, Artificial Sequence
  Description of Artificial Sequence: Synthetic polypeptide
DEAEIRTTNPVAYERWGVCATNLPGDHQNNQNP

SEQ ID NO: 169506 - protein, 36 aa, Artificial Sequence
  Description of Artificial Sequence: Synthetic polypeptide
DEQEIATTNPVATEQYGSVSTTGDQDQEDQEGGEDG

SEQ ID NO: 169507 - protein, 37 aa, Artificial Sequence
  Description of Artificial Sequence: Synthetic polypeptide
AEEEIRTTNPVATEQYGSVSVVSVSTQQGTNGTNNQD

SEQ ID NO: 169508 - protein, 35 aa, Artificial Sequence
  Description of Artificial Sequence: Synthetic polypeptide
DEEEISTTNPVATEQYGCVCSWMEHNQNFNSDTQS

SEQ ID NO: 169509 - protein, 36 aa, Artificial Sequence
  Description of Artificial Sequence: Synthetic polypeptide
DEEEISTTNPVATEQYGCVCSWMELHFQENFGSEQS

SEQ ID NO: 169510 - protein, 32 aa, Artificial Sequence
  Description of Artificial Sequence: Synthetic polypeptide
SEYEIRCTNPVATEQYGCVCESEHQHFGSQQS

SEQ ID NO: 169511 - protein, 34 aa, Artificial Sequence
  Description of Artificial Sequence: Synthetic polypeptide
DEHEIRTTNPVAYEAYGSVCSQIISAPSVGGNQC

SEQ ID NO: 169512 - protein, 36 aa, Artificial Sequence
  Description of Artificial Sequence: Synthetic polypeptide
DEEEISTTNPVATEQYGCVCSWNEHNQENFNSENQA

SEQ ID NO: 169513 - protein, 33 aa, Artificial Sequence
  Description of Artificial Sequence: Synthetic polypeptide
QENEIATTNPVATEPYGNVPSGSHLQHGMMQLN

SEQ ID NO: 169514 - protein, 36 aa, Artificial Sequence
  Description of Artificial Sequence: Synthetic polypeptide
DEEEIRTTNPVAYEQWGSVSGGEPAGPNERNGMGMV

SEQ ID NO: 169515 - protein, 36 aa, Artificial Sequence
  Description of Artificial Sequence: Synthetic polypeptide
DEEEIRTTNPVAYEQWGSVSGGEPAGGNMRNDVNDA

SEQ ID NO: 169516 - protein, 30 aa, Artificial Sequence
  Description of Artificial Sequence: Synthetic polypeptide
DDSEIRTTNPVSTEQWGNVSEIEMNAAEDA

SEQ ID NO: 169517 - protein, 37 aa, Artificial Sequence
  Description of Artificial Sequence: Synthetic polypeptide
DEEEIRTTNPVATEQYGCVCSTLFNANPEGAEESIQD

SEQ ID NO: 169518 - protein, 36 aa, Artificial Sequence
  Description of Artificial Sequence: Synthetic polypeptide
DEEEIRTTNPVATEAWGISVRTWNDDDDRRREANDA

SEQ ID NO: 169519 - protein, 37 aa, Artificial Sequence
  Description of Artificial Sequence: Synthetic polypeptide
DEEEIRTTNPVATEQYGCVCSTMEDHNQENFNSDTQS

SEQ ID NO: 169520 - protein, 30 aa, Artificial Sequence
  Description of Artificial Sequence: Synthetic polypeptide
DDSEIRTTNPVSTEQWGDVSEIEMNAAEDA

SEQ ID NO: 169521 - protein, 36 aa, Artificial Sequence
  Description of Artificial Sequence: Synthetic polypeptide
DEEEIRTTNPVATEQYGSTILCTESNTVERQQTDQG

SEQ ID NO: 169522 - protein, 36 aa, Artificial Sequence
  Description of Artificial Sequence: Synthetic polypeptide
DEEEIATTNPVATEQYGSVAATTPAGPNMRAGMEPV

SEQ ID NO: 169523 - protein, 32 aa, Artificial Sequence
  Description of Artificial Sequence: Synthetic polypeptide
DETEIRTTNPVATECWGAIWSAEDWQQPKGPI

SEQ ID NO: 169524 - protein, 32 aa, Artificial Sequence
  Description of Artificial Sequence: Synthetic polypeptide
DEAEIRTTNPVSTEPYGTISMEDIQQQQNYNH

SEQ ID NO: 169525 - protein, 33 aa, Artificial Sequence
  Description of Artificial Sequence: Synthetic polypeptide
DESEIRTTNPVATECWGSFGCDNEPEAREFSNG

SEQ ID NO: 169526 - protein, 35 aa, Artificial Sequence
  Description of Artificial Sequence: Synthetic polypeptide
DETEIRTTNPVATECWGSTVSNAENWPQEPEGEPG

SEQ ID NO: 169527 - protein, 33 aa, Artificial Sequence
  Description of Artificial Sequence: Synthetic polypeptide
DETEIRTTNPVATECWGSTWANCEDWQDPKGPI

SEQ ID NO: 169528 - protein, 33 aa, Artificial Sequence
  Description of Artificial Sequence: Synthetic polypeptide
DETEIRTTNPVATECWGSTWANCIDWQDPKGPI

SEQ ID NO: 169529 - protein, 34 aa, Artificial Sequence
  Description of Artificial Sequence: Synthetic polypeptide
DEHEIRTTNPVAYECWGCVSGGNGEERNQMNGND

SEQ ID NO: 169530 - protein, 33 aa, Artificial Sequence
  Description of Artificial Sequence: Synthetic polypeptide
DENEIRTTNPVSTEPYGTISMEPIQQQQNGNIH

SEQ ID NO: 169531 - protein, 34 aa, Artificial Sequence
  Description of Artificial Sequence: Synthetic polypeptide
DEHEIRTTNPVAYECWGCVSGGNGNERPNMNGNA

SEQ ID NO: 169532 - protein, 36 aa, Artificial Sequence
  Description of Artificial Sequence: Synthetic polypeptide
DEQEIATTNPVATEQYGSVYSITDLNEDHQGLEDEN

SEQ ID NO: 169533 - protein, 32 aa, Artificial Sequence
  Description of Artificial Sequence: Synthetic polypeptide
DENEIRTTNPVSTEPYGTISMEKIQQQQNSNH

SEQ ID NO: 169534 - protein, 32 aa, Artificial Sequence
  Description of Artificial Sequence: Synthetic polypeptide
DENEIRTTNPVSTEPYGTISMEIIQQQQNQNH

SEQ ID NO: 169535 - protein, 36 aa, Artificial Sequence
  Description of Artificial Sequence: Synthetic polypeptide
DEEEISTTNPVATEQYGQCVCSDWGEDLQNFGSDQP

SEQ ID NO: 169536 - protein, 35 aa, Artificial Sequence
  Description of Artificial Sequence: Synthetic polypeptide
DEHEIRTTNPVAYECWGSVCFTNEDNQDRGGGDQE

SEQ ID NO: 169537 - protein, 33 aa, Artificial Sequence
  Description of Artificial Sequence: Synthetic polypeptide
DENEIRTTNPVSTEPYGTISMEIDIQQQQNGNH

SEQ ID NO: 169538 - protein, 32 aa, Artificial Sequence
  Description of Artificial Sequence: Synthetic polypeptide
DENEIRTTNPVSTEPYGTISMEHISQQQNVNH

SEQ ID NO: 169539 - protein, 32 aa, Artificial Sequence
  Description of Artificial Sequence: Synthetic polypeptide
DENEIRTTNPVSTEPYGTISMEHIQQQQNGQH

SEQ ID NO: 169540 - protein, 36 aa, Artificial Sequence
  Description of Artificial Sequence: Synthetic polypeptide
DEEEIRTTNPVATEQYGAVMSNGFGNGQEQIQEEQN

SEQ ID NO: 169541 - protein, 33 aa, Artificial Sequence
  Description of Artificial Sequence: Synthetic polypeptide
DEQEIATTNPVATEQYGTISATEDIEDHEGEDL

SEQ ID NO: 169542 - protein, 33 aa, Artificial Sequence
  Description of Artificial Sequence: Synthetic polypeptide
DENEIRTTNPVSTEPYGTISMEEYQQQQNGNDH

SEQ ID NO: 169543 - protein, 32 aa, Artificial Sequence
  Description of Artificial Sequence: Synthetic polypeptide
DENEIRTTNPVSTEPYGTISMEEIQQQQNTNH

SEQ ID NO: 169544 - protein, 36 aa, Artificial Sequence
  Description of Artificial Sequence: Synthetic polypeptide
DEQEIATTNPVATEQYGTTVSCTALVSEDHPGGENL

SEQ ID NO: 169545 - protein, 36 aa, Artificial Sequence
  Description of Artificial Sequence: Synthetic polypeptide
DESEIRTTNPVATECWGSCVASCANQEPDDREGENG

SEQ ID NO: 169546 - protein, 35 aa, Artificial Sequence
  Description of Artificial Sequence: Synthetic polypeptide
DEQEIATTNPVATEQYGTTVSCTLGSEDHNGGENF

SEQ ID NO: 169547 - protein, 34 aa, Artificial Sequence
  Description of Artificial Sequence: Synthetic polypeptide
QEEEILTTNPVAPEQYGMMVNTFNLIGKQMNLIE

SEQ ID NO: 169548 - protein, 34 aa, Artificial Sequence
  Description of Artificial Sequence: Synthetic polypeptide
DESEIRTTNPVATECWGSFGCINAEPENREGENG

SEQ ID NO: 169549 - protein, 34 aa, Artificial Sequence
  Description of Artificial Sequence: Synthetic polypeptide
DEMEIVTTNPVSTEQYGTVCSAMDGIVEQQNGNH

SEQ ID NO: 169550 - protein, 36 aa, Artificial Sequence
  Description of Artificial Sequence: Synthetic polypeptide
DEEEIRTTNPVATEQYGCVCSTTEDHQEYFMSDTQS

SEQ ID NO: 169551 - protein, 38 aa, Artificial Sequence
  Description of Artificial Sequence: Synthetic polypeptide
DECTICTTNPVATEQYGSVTVVVSTNLQAGIIGTNTDE

SEQ ID NO: 169552 - protein, 31 aa, Artificial Sequence
  Description of Artificial Sequence: Synthetic polypeptide
DDSEVASTNPVSTEGYGNVAANHIQTRVGQR

SEQ ID NO: 169553 - protein, 31 aa, Artificial Sequence
  Description of Artificial Sequence: Synthetic polypeptide
DETEIRTTNPVATECWGAVSNEIEMEAAEDA

SEQ ID NO: 169554 - protein, 34 aa, Artificial Sequence
  Description of Artificial Sequence: Synthetic polypeptide
DEMEIVTTNPVSTEQYGTVCSAMDDIQEQQNGNH

SEQ ID NO: 169555 - protein, 34 aa, Artificial Sequence
  Description of Artificial Sequence: Synthetic polypeptide
DEMEIVTTNPVSTEQYGTVCSAMDDIVEQQNGNH

SEQ ID NO: 169556 - protein, 37 aa, Artificial Sequence
  Description of Artificial Sequence: Synthetic polypeptide
DEEEIRTTNPVATEQYGCVCSTSGEHNQENFNSEPQS

SEQ ID NO: 169557 - protein, 34 aa, Artificial Sequence
  Description of Artificial Sequence: Synthetic polypeptide
DEEEISTTNPVATEQYGQCVCSDWEHANFGSDQA

SEQ ID NO: 169558 - protein, 34 aa, Artificial Sequence
  Description of Artificial Sequence: Synthetic polypeptide
DESEIRTTNPVATECWGSFIGCIQEPEAREGENG

SEQ ID NO: 169559 - protein, 33 aa, Artificial Sequence
  Description of Artificial Sequence: Synthetic polypeptide
DEMEIVTTNPVSTEQYGTVCSAMDGIVEFNGNH

SEQ ID NO: 169560 - protein, 34 aa, Artificial Sequence
  Description of Artificial Sequence: Synthetic polypeptide
DEEEIGTTNPVATEQYGCVCSWEEHDQNFISEQS

SEQ ID NO: 169561 - protein, 32 aa, Artificial Sequence
  Description of Artificial Sequence: Synthetic polypeptide
DETEIRTTNPVATECWGETTANAEDWQHGPYK

SEQ ID NO: 169562 - protein, 34 aa, Artificial Sequence
  Description of Artificial Sequence: Synthetic polypeptide
DESEIRTTNPVATECWGSFGLCINEPEAREGENH

SEQ ID NO: 169563 - protein, 33 aa, Artificial Sequence
  Description of Artificial Sequence: Synthetic polypeptide
DESEIRTTNPVATECWGSFGGINEPEAEEGENG

SEQ ID NO: 169564 - protein, 33 aa, Artificial Sequence
  Description of Artificial Sequence: Synthetic polypeptide
DETEIRTTNPVATECWGETWANAEDLARKGPYI

SEQ ID NO: 169565 - protein, 31 aa, Artificial Sequence
  Description of Artificial Sequence: Synthetic polypeptide
DEEEIASTNPVSTEQYGEAAAEVCQSRVEEK

SEQ ID NO: 169566 - protein, 35 aa, Artificial Sequence
  Description of Artificial Sequence: Synthetic polypeptide
DEEEIATTNPVATESWGSVAWNDNHQQMNDGGDRN

SEQ ID NO: 169567 - protein, 33 aa, Artificial Sequence
  Description of Artificial Sequence: Synthetic polypeptide
DESEIRTTNPVATECWGSFGCRDEPEAREGENG

SEQ ID NO: 169568 - protein, 32 aa, Artificial Sequence
  Description of Artificial Sequence: Synthetic polypeptide
DENEIRTTNPVSTEPYGTISMERIQQQQNGDH

SEQ ID NO: 169569 - protein, 36 aa, Artificial Sequence
  Description of Artificial Sequence: Synthetic polypeptide
QEEEIKTTNPVATEQYGSVSTDGDETGTQTGQDEIG

SEQ ID NO: 169570 - protein, 35 aa, Artificial Sequence
  Description of Artificial Sequence: Synthetic polypeptide
DETEIRTTNPVATECWGSTTSSNTPDGNMRKGNYI

SEQ ID NO: 169571 - protein, 33 aa, Artificial Sequence
  Description of Artificial Sequence: Synthetic polypeptide
NTEHEIATTNPVAYEQWGSVCSTNDINDGGGET

SEQ ID NO: 169572 - protein, 36 aa, Artificial Sequence
  Description of Artificial Sequence: Synthetic polypeptide
SEPEIRTTNPVATEQYGSVSVPLDKNHELSVQEVKQ

SEQ ID NO: 169573 - protein, 37 aa, Artificial Sequence
  Description of Artificial Sequence: Synthetic polypeptide
DEEEIRTTNPVATEQYGCVCSTSPAHNAENSNSDPVS

SEQ ID NO: 169574 - protein, 33 aa, Artificial Sequence
  Description of Artificial Sequence: Synthetic polypeptide
DENEIRTTNPVSTEPYGTISMEDYIQTQQNGNH

SEQ ID NO: 169575 - protein, 30 aa, Artificial Sequence
  Description of Artificial Sequence: Synthetic polypeptide
DETEIRTTNPVATECYGATPNEDWAHKEPI

SEQ ID NO: 169576 - protein, 32 aa, Artificial Sequence
  Description of Artificial Sequence: Synthetic polypeptide
SENEIRTTNPVSTEPYGTISMEDVQQQQNGNH

SEQ ID NO: 169577 - protein, 32 aa, Artificial Sequence
  Description of Artificial Sequence: Synthetic polypeptide
SENEIRTTNPVSTEPYGTISMEDMQQQQNGNH

SEQ ID NO: 169578 - protein, 31 aa, Artificial Sequence
  Description of Artificial Sequence: Synthetic polypeptide
DDSEVASTNPVSTEGYGNVAANIIQSRVGQR

SEQ ID NO: 169579 - protein, 33 aa, Artificial Sequence
  Description of Artificial Sequence: Synthetic polypeptide
DEMELVTTNPVATEIYGTVCSATDGPVEFEGND

SEQ ID NO: 169580 - protein, 33 aa, Artificial Sequence
  Description of Artificial Sequence: Synthetic polypeptide
DEMELVTTNPVATEQYGTVCSACDGPVEFEGND

SEQ ID NO: 169581 - protein, 34 aa, Artificial Sequence
  Description of Artificial Sequence: Synthetic polypeptide
DEMEIRTTNPVATECYGTVWAATEGPVEPKGNYD

SEQ ID NO: 169582 - protein, 37 aa, Artificial Sequence
  Description of Artificial Sequence: Synthetic polypeptide
DEEEISTTNPVATEQYGQCVCSMTEELNQENFGSDQV

SEQ ID NO: 169583 - protein, 34 aa, Artificial Sequence
  Description of Artificial Sequence: Synthetic polypeptide
DEMELVTTNPVATEQYGTVCSATDGEPVEFEGND

SEQ ID NO: 169584 - protein, 34 aa, Artificial Sequence
  Description of Artificial Sequence: Synthetic polypeptide
DETEIRTTNPVATECYGTTTCSATDGPVEFEGND

SEQ ID NO: 169585 - protein, 34 aa, Artificial Sequence
  Description of Artificial Sequence: Synthetic polypeptide
DETEIRTTNPVATECYGTTTCSATDGPVEFKGND

SEQ ID NO: 169586 - protein, 33 aa, Artificial Sequence
  Description of Artificial Sequence: Synthetic polypeptide
DETEIRTTNPVATECYGTTTWAATEGWAFKGNI

SEQ ID NO: 169587 - protein, 38 aa, Artificial Sequence
  Description of Artificial Sequence: Synthetic polypeptide
AEEEIRTTNPVATEQYGSVVVSVTTNNNNQEQGETEDT

SEQ ID NO: 169588 - protein, 32 aa, Artificial Sequence
  Description of Artificial Sequence: Synthetic polypeptide
DDSEVASTNPVSTEGYGNVAANLTIQSRIGQR

SEQ ID NO: 169589 - protein, 32 aa, Artificial Sequence
  Description of Artificial Sequence: Synthetic polypeptide
DDSEVASTNPVSTEGYGNVAANLTIQSRVGQR

SEQ ID NO: 169590 - protein, 33 aa, Artificial Sequence
  Description of Artificial Sequence: Synthetic polypeptide
DEMELVTTNPVAYEQYGTVCSATDGPVEFEGND

SEQ ID NO: 169591 - protein, 36 aa, Artificial Sequence
  Description of Artificial Sequence: Synthetic polypeptide
DETEIRTTNPVATEFYGSVNYDGTGNLTGEQEEEDD

SEQ ID NO: 169592 - protein, 35 aa, Artificial Sequence
  Description of Artificial Sequence: Synthetic polypeptide
DECTICTTNPVATEQWGSVSTTNQNNTEQGTNTDQ

SEQ ID NO: 169593 - protein, 35 aa, Artificial Sequence
  Description of Artificial Sequence: Synthetic polypeptide
SENEIRTTNPVATEQYGSVTWTVPLENINLENDST

SEQ ID NO: 169594 - protein, 37 aa, Artificial Sequence
  Description of Artificial Sequence: Synthetic polypeptide
DEEEIRTTNPVATEQYGAVMGQGTDQLIIENEGGNVT

SEQ ID NO: 169595 - protein, 37 aa, Artificial Sequence
  Description of Artificial Sequence: Synthetic polypeptide
DEEEIRTTNPVATEQYGAVMGQGTDQLIDEGEGGNGD

SEQ ID NO: 169596 - protein, 32 aa, Artificial Sequence
  Description of Artificial Sequence: Synthetic polypeptide
DDSEVASTNPVSTEGYGNVAANLYIQSRVGQR

SEQ ID NO: 169597 - protein, 31 aa, Artificial Sequence
  Description of Artificial Sequence: Synthetic polypeptide
DDSEVASTNPVSTEGYGNVAANMIQSRVGQR

SEQ ID NO: 169598 - protein, 36 aa, Artificial Sequence
  Description of Artificial Sequence: Synthetic polypeptide
DETEIRTTNPVATEGYGSVMGQNVGGQENGNGGNQE

SEQ ID NO: 169599 - protein, 37 aa, Artificial Sequence
  Description of Artificial Sequence: Synthetic polypeptide
DETEIRTTNPVATEGYGSVMGSDGTDQRNQGEDNTGD

SEQ ID NO: 169600 - protein, 36 aa, Artificial Sequence
  Description of Artificial Sequence: Synthetic polypeptide
DECTICTTNPVATEQWGSVSTTNQNNNQQQGNNEDQ

SEQ ID NO: 169601 - protein, 34 aa, Artificial Sequence
  Description of Artificial Sequence: Synthetic polypeptide
DDEEIKTTNPVATEQYGDVSDGVNEGDGGQGETG

SEQ ID NO: 169602 - protein, 36 aa, Artificial Sequence
  Description of Artificial Sequence: Synthetic polypeptide
DEEEIRTTNPVATEQYGSYVYPDSLSGQVSMEVEYI

SEQ ID NO: 169603 - protein, 31 aa, Artificial Sequence
  Description of Artificial Sequence: Synthetic polypeptide
DDSEVASTNPVSTEGYGNVAANIIQSRPGQR

SEQ ID NO: 169604 - protein, 35 aa, Artificial Sequence
  Description of Artificial Sequence: Synthetic polypeptide
DEEEIGTTNPVATEQYGCVCSWEHDQENFISENQS

SEQ ID NO: 169605 - protein, 32 aa, Artificial Sequence
  Description of Artificial Sequence: Synthetic polypeptide
SENEIRTTNPVSTEPYGTISMEDIQQQQNGNH

SEQ ID NO: 169606 - protein, 32 aa, Artificial Sequence
  Description of Artificial Sequence: Synthetic polypeptide
SENEIRTTNPVSTEPYGTISMEDIQQQQGGNH

SEQ ID NO: 169607 - protein, 35 aa, Artificial Sequence
  Description of Artificial Sequence: Synthetic polypeptide
DEEEIGTTNPVATEQYGCVCSWEEHNQENFNSDQS

SEQ ID NO: 169608 - protein, 33 aa, Artificial Sequence
  Description of Artificial Sequence: Synthetic polypeptide
DENEIRTTNPVSTEPYGTISMEDYIQQQQNGNH

SEQ ID NO: 169609 - protein, 39 aa, Artificial Sequence
  Description of Artificial Sequence: Synthetic polypeptide
DEEEIRTTNPVATEQYGVVSTVVTNLNGNQEQGTQEEEN

SEQ ID NO: 169610 - protein, 34 aa, Artificial Sequence
  Description of Artificial Sequence: Synthetic polypeptide
DEQEIATTNPVATEQYGTVCAANDGPVENDEGND

SEQ ID NO: 169611 - protein, 32 aa, Artificial Sequence
  Description of Artificial Sequence: Synthetic polypeptide
DETEIRTTNPVATECYGAVANDDWAEPKGPYI

SEQ ID NO: 169612 - protein, 33 aa, Artificial Sequence
  Description of Artificial Sequence: Synthetic polypeptide
DEQEIATTNPVATEQYGTVCAATDGPMEFEIND

SEQ ID NO: 169613 - protein, 33 aa, Artificial Sequence
  Description of Artificial Sequence: Synthetic polypeptide
DEMEIVTVNPVATEQYGTVCSATDGPVEFEGQD

SEQ ID NO: 169614 - protein, 33 aa, Artificial Sequence
  Description of Artificial Sequence: Synthetic polypeptide
DENEIRTTNPVSTEPYGTISMEDYIQQCQNGNH

SEQ ID NO: 169615 - protein, 33 aa, Artificial Sequence
  Description of Artificial Sequence: Synthetic polypeptide
DENEIRTTNPVSTEPYGTISMEDYDQQQQNGNH

SEQ ID NO: 169616 - protein, 33 aa, Artificial Sequence
  Description of Artificial Sequence: Synthetic polypeptide
DENEIRTTNPVSTEPYGTISMEDWQQQQNGLNH

SEQ ID NO: 169617 - protein, 31 aa, Artificial Sequence
  Description of Artificial Sequence: Synthetic polypeptide
DDSEVASTNPVSTEGYGNVAANIIQSRNGQR

SEQ ID NO: 169618 - protein, 33 aa, Artificial Sequence
  Description of Artificial Sequence: Synthetic polypeptide
DENEIRTTNPVSTEPYGTISMEDWIQQQQNGNH

SEQ ID NO: 169619 - protein, 35 aa, Artificial Sequence
  Description of Artificial Sequence: Synthetic polypeptide
DECTICTTNPVATEQWGSVSTTQQGNNDEQGTNTD

SEQ ID NO: 169620 - protein, 35 aa, Artificial Sequence
  Description of Artificial Sequence: Synthetic polypeptide
DEQEIATTNPVATEQYGTVCSATDDLVEDHEGEDD

SEQ ID NO: 169621 - protein, 35 aa, Artificial Sequence
  Description of Artificial Sequence: Synthetic polypeptide
DEQEIATTNPVATEQYGTVCSATDDLVEDHEGEDL

SEQ ID NO: 169622 - protein, 32 aa, Artificial Sequence
  Description of Artificial Sequence: Synthetic polypeptide
SENEIRTTNPVSTEPYGTISEEDIQQQQNGNH

SEQ ID NO: 169623 - protein, 34 aa, Artificial Sequence
  Description of Artificial Sequence: Synthetic polypeptide
DETEIRTTNPVATECYGSTTSNTEDWEEHKGPYI

SEQ ID NO: 169624 - protein, 36 aa, Artificial Sequence
  Description of Artificial Sequence: Synthetic polypeptide
DETEIRTTNPVATECYGSTTSSNTPDGNMRKGMNYI

SEQ ID NO: 169625 - protein, 37 aa, Artificial Sequence
  Description of Artificial Sequence: Synthetic polypeptide
DEEEIRTTNPVAYEQYGQSVEPVTSGYLQMRETVEQT

SEQ ID NO: 169626 - protein, 37 aa, Artificial Sequence
  Description of Artificial Sequence: Synthetic polypeptide
DEHEIRTTNPVAYECWGSVCYSTDNQDQDLRGQNGVN

SEQ ID NO: 169627 - protein, 33 aa, Artificial Sequence
  Description of Artificial Sequence: Synthetic polypeptide
DENEIRTTNPVSTEPYGTISMEDVIQQQQNRNH

SEQ ID NO: 169628 - protein, 34 aa, Artificial Sequence
  Description of Artificial Sequence: Synthetic polypeptide
NSEEISTTNPVAYEQWGSVNKNDNLDQQGEHGRI

SEQ ID NO: 169629 - protein, 33 aa, Artificial Sequence
  Description of Artificial Sequence: Synthetic polypeptide
DEMEIVTTNPVSTEPYGTVCSATDDPVEFEGND

SEQ ID NO: 169630 - protein, 31 aa, Artificial Sequence
  Description of Artificial Sequence: Synthetic polypeptide
DEEEIASVNPIATEQYGAVSNDEDWAEPGPQ

SEQ ID NO: 169631 - protein, 34 aa, Artificial Sequence
  Description of Artificial Sequence: Synthetic polypeptide
DEQEIATTNPVATEQYGSVWSNAEDWAEPEGPYI

SEQ ID NO: 169632 - protein, 31 aa, Artificial Sequence
  Description of Artificial Sequence: Synthetic polypeptide
DETEIRTTNPVATECWGATTWAAEDWARGPI

SEQ ID NO: 169633 - protein, 35 aa, Artificial Sequence
  Description of Artificial Sequence: Synthetic polypeptide
DEEEIRTTNPVATEQYGSTGGQWYTSEVPQHVELN

SEQ ID NO: 169634 - protein, 30 aa, Artificial Sequence
  Description of Artificial Sequence: Synthetic polypeptide
QENEIATTNPVATEQYGDAPEICQNAAEDK

SEQ ID NO: 169635 - protein, 30 aa, Artificial Sequence
  Description of Artificial Sequence: Synthetic polypeptide
QENEIATTNPVATEQYGDAPEICQNHAEDK

SEQ ID NO: 169636 - protein, 36 aa, Artificial Sequence
  Description of Artificial Sequence: Synthetic polypeptide
CEEEIATTNPVATEQYGSVCSTNPQGQEHQIDTEMK

SEQ ID NO: 169637 - protein, 33 aa, Artificial Sequence
  Description of Artificial Sequence: Synthetic polypeptide
DEHEIATTNPVATEQYGTVCAATDGPEEDELND

SEQ ID NO: 169638 - protein, 34 aa, Artificial Sequence
  Description of Artificial Sequence: Synthetic polypeptide
DEHEIATTNPVATEQYGTVCAATDGPEEAEGNVD

SEQ ID NO: 169639 - protein, 37 aa, Artificial Sequence
  Description of Artificial Sequence: Synthetic polypeptide
DEEEIRTTNPVAFEGYGSVVSTGGDLGQEEQGEGDGF

SEQ ID NO: 169640 - protein, 32 aa, Artificial Sequence
  Description of Artificial Sequence: Synthetic polypeptide
DETEIRTTNPVATECWGATTWANADWQPKGPI

SEQ ID NO: 169641 - protein, 31 aa, Artificial Sequence
  Description of Artificial Sequence: Synthetic polypeptide
SESEIASTNPVGTEGYGVSGSTLQHFGSDIS

SEQ ID NO: 169642 - protein, 35 aa, Artificial Sequence
  Description of Artificial Sequence: Synthetic polypeptide
DEQEIATTNPVATEQYGSVVATGDGEDQEGEGDVG

SEQ ID NO: 169643 - protein, 30 aa, Artificial Sequence
  Description of Artificial Sequence: Synthetic polypeptide
SESEIASTNPVGTEGYGVSCASELQHGSDI

SEQ ID NO: 169644 - protein, 37 aa, Artificial Sequence
  Description of Artificial Sequence: Synthetic polypeptide
DEEEIRTTNPVAFEGYGSVTVNGLNDLGQQIGQRFDQ

SEQ ID NO: 169645 - protein, 36 aa, Artificial Sequence
  Description of Artificial Sequence: Synthetic polypeptide
DEEEIRTTNPVAFEFYGVVVNGQEDLGQRGGQRGGQ

SEQ ID NO: 169646 - protein, 38 aa, Artificial Sequence
  Description of Artificial Sequence: Synthetic polypeptide
DEEEIRTTNPVAYEQYGQSVCSQLNDILDAQSGQIMKN

SEQ ID NO: 169647 - protein, 34 aa, Artificial Sequence
  Description of Artificial Sequence: Synthetic polypeptide
SESEIACTNPVAYEQYGISVVCTNEFQPHGGNSN

SEQ ID NO: 169648 - protein, 34 aa, Artificial Sequence
  Description of Artificial Sequence: Synthetic polypeptide
SESEIACTNPVAYEQYGISVPCCNELQPPGGNNN

SEQ ID NO: 169649 - protein, 39 aa, Artificial Sequence
  Description of Artificial Sequence: Synthetic polypeptide
DEEEIRTTNPVATEQYGVVSTVVTNLGGNDEIGNNEQGQ

SEQ ID NO: 169650 - protein, 35 aa, Artificial Sequence
  Description of Artificial Sequence: Synthetic polypeptide
DEMEIRTTNPVATEGWGCVCSWMNENQDNFGSNQG

SEQ ID NO: 169651 - protein, 35 aa, Artificial Sequence
  Description of Artificial Sequence: Synthetic polypeptide
DEEEIRTTNPTAVEQYGSVSTVKHSSETPMGSIPI

SEQ ID NO: 169652 - protein, 33 aa, Artificial Sequence
  Description of Artificial Sequence: Synthetic polypeptide
QEEEIKTTNPVATEQYGAVAGPEVGQGEGFGQG

SEQ ID NO: 169653 - protein, 35 aa, Artificial Sequence
  Description of Artificial Sequence: Synthetic polypeptide
DEEEIRTTNPTAVEQYGCVSTNKHSSETPMGSDDN

SEQ ID NO: 169654 - protein, 36 aa, Artificial Sequence
  Description of Artificial Sequence: Synthetic polypeptide
DEEEIRTTNPVATEQYGSTCAPEQTLDQIMQGMTAD

SEQ ID NO: 169655 - protein, 33 aa, Artificial Sequence
  Description of Artificial Sequence: Synthetic polypeptide
DENEIRTTNPVSTEPYGTISMGDIQQQQMGNAH

SEQ ID NO: 169656 - protein, 35 aa, Artificial Sequence
  Description of Artificial Sequence: Synthetic polypeptide
SESCIRCTNPVAYEQYGISVPPCTNELQPHGGNNN

SEQ ID NO: 169657 - protein, 35 aa, Artificial Sequence
  Description of Artificial Sequence: Synthetic polypeptide
DEQEIATTNPVATEQYGSVTATGDGEDQEGEGDGD

SEQ ID NO: 169658 - protein, 32 aa, Artificial Sequence
  Description of Artificial Sequence: Synthetic polypeptide
QAEEIATTNPVATEQWGCVAGTMHQNHDDNPH

SEQ ID NO: 169659 - protein, 31 aa, Artificial Sequence
  Description of Artificial Sequence: Synthetic polypeptide
DDSEIRSTNPVSTEPYGTISMEDIQQQNGQR

SEQ ID NO: 169660 - protein, 31 aa, Artificial Sequence
  Description of Artificial Sequence: Synthetic polypeptide
DDSEIRSTNPVSTEPYGNIAMETIQSRNGQR

SEQ ID NO: 169661 - protein, 31 aa, Artificial Sequence
  Description of Artificial Sequence: Synthetic polypeptide
DDSEIRSTNPVSTEGYGTVANEDIQSQNGQR

SEQ ID NO: 169662 - protein, 37 aa, Artificial Sequence
  Description of Artificial Sequence: Synthetic polypeptide
DEEEIRTTNPVATEQYGSTGISESNLVHVPQMVPLVS

SEQ ID NO: 169663 - protein, 36 aa, Artificial Sequence
  Description of Artificial Sequence: Synthetic polypeptide
DECTICTTNPVATEQYGVVSTVNNQQQQNGNGNQDQ

SEQ ID NO: 169664 - protein, 37 aa, Artificial Sequence
  Description of Artificial Sequence: Synthetic polypeptide
DEEEIRTTNPVAFEQYGSVVVNGQADDNGQRGQTDEQ

SEQ ID NO: 169665 - protein, 33 aa, Artificial Sequence
  Description of Artificial Sequence: Synthetic polypeptide
QAEEIATTNPVATEQWGCVATGHGQDSNGNDDH

SEQ ID NO: 169666 - protein, 36 aa, Artificial Sequence
  Description of Artificial Sequence: Synthetic polypeptide
DECTICTTNPVATEQYGVVSTVNGNQQQQNGNGNVD

SEQ ID NO: 169667 - protein, 36 aa, Artificial Sequence
  Description of Artificial Sequence: Synthetic polypeptide
DECTICTTNPVATEQYGVVSTTTNQNQQQGNGNNVD

SEQ ID NO: 169668 - protein, 30 aa, Artificial Sequence
  Description of Artificial Sequence: Synthetic polypeptide
QENEIATTNPVATEQWGEVSEIEMNHAEEA

SEQ ID NO: 169669 - protein, 33 aa, Artificial Sequence
  Description of Artificial Sequence: Synthetic polypeptide
DETEIRTTNPVATECWGATAWSNANWARKGGYI

SEQ ID NO: 169670 - protein, 34 aa, Artificial Sequence
  Description of Artificial Sequence: Synthetic polypeptide
SESEIRCTNPVAYEQYGICVPCTNELQPPGGQQN

SEQ ID NO: 169671 - protein, 36 aa, Artificial Sequence
  Description of Artificial Sequence: Synthetic polypeptide
DEEEISTTNPVATEQYGQCQVCSDTEYHQENFNSEQ

SEQ ID NO: 169672 - protein, 33 aa, Artificial Sequence
  Description of Artificial Sequence: Synthetic polypeptide
DENEIRTTNPVSTEPYGTISMHDIQQQQNGNHH

SEQ ID NO: 169673 - protein, 31 aa, Artificial Sequence
  Description of Artificial Sequence: Synthetic polypeptide
DDSEVASTNPVSTEGYGNVAANGIQSREGQR

SEQ ID NO: 169674 - protein, 33 aa, Artificial Sequence
  Description of Artificial Sequence: Synthetic polypeptide
DENEIRTTNPVSTEPYGTISMHDHIQQQQNGNH

SEQ ID NO: 169675 - protein, 33 aa, Artificial Sequence
  Description of Artificial Sequence: Synthetic polypeptide
DEMEIVTTNPVAVEQYGTVCCATDGPVEFEGND

SEQ ID NO: 169676 - protein, 37 aa, Artificial Sequence
  Description of Artificial Sequence: Synthetic polypeptide
DEEEIRTTNPVATEQYGSVSTPMNMFMPPVSEEPDMI

SEQ ID NO: 169677 - protein, 31 aa, Artificial Sequence
  Description of Artificial Sequence: Synthetic polypeptide
DETEIRTTNPVATECWGATTAAECLAPGPYI

SEQ ID NO: 169678 - protein, 36 aa, Artificial Sequence
  Description of Artificial Sequence: Synthetic polypeptide
DEEEIRTTNPVAFEQYGSVVITGGDPGQEEQGEGGA

SEQ ID NO: 169679 - protein, 33 aa, Artificial Sequence
  Description of Artificial Sequence: Synthetic polypeptide
DEMEIVTTNPVAVEQYGTVCSATDGPVEFEGED

SEQ ID NO: 169680 - protein, 31 aa, Artificial Sequence
  Description of Artificial Sequence: Synthetic polypeptide
DDSEVASTNPVSTEGYGNVAANGIQSRVGQR

SEQ ID NO: 169681 - protein, 36 aa, Artificial Sequence
  Description of Artificial Sequence: Synthetic polypeptide
DEEEISTTNPVATEQYGQCQVCSTGEHQENFGSDQS

SEQ ID NO: 169682 - protein, 37 aa, Artificial Sequence
  Description of Artificial Sequence: Synthetic polypeptide
DEEEIRTTNPVAFEQYGDVVTGGDTDDEDQQRGIRGG

SEQ ID NO: 169683 - protein, 31 aa, Artificial Sequence
  Description of Artificial Sequence: Synthetic polypeptide
DETEIRTTNPVATECWGATAANWAEPKGGYI

SEQ ID NO: 169684 - protein, 33 aa, Artificial Sequence
  Description of Artificial Sequence: Synthetic polypeptide
DEMEIVTTNPVAYEQYGTRCSATDGPVEFEGND

SEQ ID NO: 169685 - protein, 33 aa, Artificial Sequence
  Description of Artificial Sequence: Synthetic polypeptide
DEAEIRTTNPVSYEQWGSCYTVDNHQNGGKQET

SEQ ID NO: 169686 - protein, 35 aa, Artificial Sequence
  Description of Artificial Sequence: Synthetic polypeptide
DEMEIRTTNPVATEGWGCVCSWGNDENQEYEGSNQ

SEQ ID NO: 169687 - protein, 33 aa, Artificial Sequence
  Description of Artificial Sequence: Synthetic polypeptide
DEEEIASVNPVATECYGVTVANDENLQEPGPYQ

SEQ ID NO: 169688 - protein, 36 aa, Artificial Sequence
  Description of Artificial Sequence: Synthetic polypeptide
DEEEIGTTNPVATEQYGCVCSWEDHNQENFGSNTQS

SEQ ID NO: 169689 - protein, 33 aa, Artificial Sequence
  Description of Artificial Sequence: Synthetic polypeptide
DEMEIVTTNPVGTEQYGVVCAASDGPVEFEGND

SEQ ID NO: 169690 - protein, 34 aa, Artificial Sequence
  Description of Artificial Sequence: Synthetic polypeptide
DEQEIATTNPVATEQYGSVWSAAEDWAEPEGPYI

SEQ ID NO: 169691 - protein, 36 aa, Artificial Sequence
  Description of Artificial Sequence: Synthetic polypeptide
DEEEISTTNPVATEQYGQCVCSDTGEHQENFGSDQP

SEQ ID NO: 169692 - protein, 37 aa, Artificial Sequence
  Description of Artificial Sequence: Synthetic polypeptide
DEEEIRTTNPVATEQYGCVCSTSGEHNQEFFNSDNQE

SEQ ID NO: 169693 - protein, 38 aa, Artificial Sequence
  Description of Artificial Sequence: Synthetic polypeptide
AEDEICTTNPVATEQYGSVSTVVTEQAGNNLQTGNETM

SEQ ID NO: 169694 - protein, 35 aa, Artificial Sequence
  Description of Artificial Sequence: Synthetic polypeptide
SEQEIATTNPVATEQYGSVSAMDLNEDHQLLENLN

SEQ ID NO: 169695 - protein, 38 aa, Artificial Sequence
  Description of Artificial Sequence: Synthetic polypeptide
DEEEIRTTNPVATEQYGVVSTVVTNLNGNNEQGTDEEE

SEQ ID NO: 169696 - protein, 37 aa, Artificial Sequence
  Description of Artificial Sequence: Synthetic polypeptide
DEEEIRTTNPVATEQYGCVCSTSGEHNQENFGSETQP

SEQ ID NO: 169697 - protein, 37 aa, Artificial Sequence
  Description of Artificial Sequence: Synthetic polypeptide
DEEEIRTTNPVATEQYGCVCSTSGEHNQENFNSDTQS

SEQ ID NO: 169698 - protein, 33 aa, Artificial Sequence
  Description of Artificial Sequence: Synthetic polypeptide
DETEIRTTNPVATECWGATWANAEDLARKGPYI

SEQ ID NO: 169699 - protein, 35 aa, Artificial Sequence
  Description of Artificial Sequence: Synthetic polypeptide
DEHEIRTTNPVAYECWGCVSGGMNMGNQRGEGDDR

SEQ ID NO: 169700 - protein, 31 aa, Artificial Sequence
  Description of Artificial Sequence: Synthetic polypeptide
DDSEVASTNPVSTEGYGNVAANHIQSRVGQR

SEQ ID NO: 169701 - protein, 29 aa, Artificial Sequence
  Description of Artificial Sequence: Synthetic peptide
NTSEIASTNPVGTEGYGVMASTLQHGDFI

SEQ ID NO: 169702 - protein, 33 aa, Artificial Sequence
  Description of Artificial Sequence: Synthetic polypeptide
DESEIRTTNPVATECWGSFWCINEPEAREFPNG

SEQ ID NO: 169703 - protein, 32 aa, Artificial Sequence
  Description of Artificial Sequence: Synthetic polypeptide
DETEIRTTNPVATECWGATWANSETLAPGPYI

SEQ ID NO: 169704 - protein, 33 aa, Artificial Sequence
  Description of Artificial Sequence: Synthetic polypeptide
DEMEIVTTNPVGTEQYGVVCAATDGPVEFEGND

SEQ ID NO: 169705 - protein, 33 aa, Artificial Sequence
  Description of Artificial Sequence: Synthetic polypeptide
DEMEIVTTNPVGTERYGTVCSATDGPVEFEGND

SEQ ID NO: 169706 - protein, 37 aa, Artificial Sequence
  Description of Artificial Sequence: Synthetic polypeptide
DECTICTTNPVATEQYGSVTVVVTTNLQAGNGTNQDE

SEQ ID NO: 169707 - protein, 32 aa, Artificial Sequence
  Description of Artificial Sequence: Synthetic polypeptide
DEMEIVTTNPVSTEPYGTISMDDIVQQFNGNH

SEQ ID NO: 169708 - protein, 34 aa, Artificial Sequence
  Description of Artificial Sequence: Synthetic polypeptide
DEEEIATTNPVATESYGVVAGTNPPGANPMDDAS

SEQ ID NO: 169709 - protein, 34 aa, Artificial Sequence
  Description of Artificial Sequence: Synthetic polypeptide
DETEIRTTNPVATECWGATVSNAENWPQEPEGPI

SEQ ID NO: 169710 - protein, 33 aa, Artificial Sequence
  Description of Artificial Sequence: Synthetic polypeptide
DEMEIVTTNPVAYEQYGTVCKATDGPVEFEGND

SEQ ID NO: 169711 - protein, 34 aa, Artificial Sequence
  Description of Artificial Sequence: Synthetic polypeptide
DETEIRTTNPVATECWGATVSNAENWPQEPEGPG

SEQ ID NO: 169712 - protein, 35 aa, Artificial Sequence
  Description of Artificial Sequence: Synthetic polypeptide
SEQEIATTNPVATEQYGSVSWTDLNEDHQTLEDEN

SEQ ID NO: 169713 - protein, 33 aa, Artificial Sequence
  Description of Artificial Sequence: Synthetic polypeptide
QAEEIATTNPVATAQWGSVSGTGNPDNANPNHN

SEQ ID NO: 169714 - protein, 32 aa, Artificial Sequence
  Description of Artificial Sequence: Synthetic polypeptide
DENEIRTTNPVSTEPYGTISMFDGQQQQNGDH

SEQ ID NO: 169715 - protein, 35 aa, Artificial Sequence
  Description of Artificial Sequence: Synthetic polypeptide
DEEEISTTNPVATEQYGQCVCGSEEHNINFGSDQS

SEQ ID NO: 169716 - protein, 35 aa, Artificial Sequence
  Description of Artificial Sequence: Synthetic polypeptide
DEEEISTTNPVATEQYGQCVCGSEHNQNFISDNQS

SEQ ID NO: 169717 - protein, 34 aa, Artificial Sequence
  Description of Artificial Sequence: Synthetic polypeptide
QAEEIATTNPVATAQWGSVSGTGNPDNANPGNHK

SEQ ID NO: 169718 - protein, 35 aa, Artificial Sequence
  Description of Artificial Sequence: Synthetic polypeptide
DEAEIRTTNPVTTEHWGSVYCMPNDQDQPRQGNQL

SEQ ID NO: 169719 - protein, 36 aa, Artificial Sequence
  Description of Artificial Sequence: Synthetic polypeptide
DECTICTTNPVATEQYGVVSTSTNNPNQETGTNDED

SEQ ID NO: 169720 - protein, 38 aa, Artificial Sequence
  Description of Artificial Sequence: Synthetic polypeptide
DEEEIRTTNPVAYEQYGQSVCSQLNDLLDAQSGEITPN

SEQ ID NO: 169721 - protein, 36 aa, Artificial Sequence
  Description of Artificial Sequence: Synthetic polypeptide
DEEEIGTTNPVATEQYGCVCSTTEEHNQNFNSDTQD

SEQ ID NO: 169722 - protein, 33 aa, Artificial Sequence
  Description of Artificial Sequence: Synthetic polypeptide
SEQEIRTTNPVATEQYGCYAPCATLQPESQFVR

SEQ ID NO: 169723 - protein, 38 aa, Artificial Sequence
  Description of Artificial Sequence: Synthetic polypeptide
DEEEIRTTNPVAYEQYGQSVCSQLNDLLWAQSGQLTKN

SEQ ID NO: 169724 - protein, 34 aa, Artificial Sequence
  Description of Artificial Sequence: Synthetic polypeptide
DEEEIRTTNPMSYEGYGSCSCTYELSGNVGDNVC

SEQ ID NO: 169725 - protein, 35 aa, Artificial Sequence
  Description of Artificial Sequence: Synthetic polypeptide
DEMEIRTTNPVATEGWGCVCSWGNENQDYFGSNQL

SEQ ID NO: 169726 - protein, 33 aa, Artificial Sequence
  Description of Artificial Sequence: Synthetic polypeptide
DEEEIRTTNPMSYEGYGSCSCTYELSGGVGDVY

SEQ ID NO: 169727 - protein, 34 aa, Artificial Sequence
  Description of Artificial Sequence: Synthetic polypeptide
DETEIRTTNPVATECWGATVANAEDEQEREGENG

SEQ ID NO: 169728 - protein, 33 aa, Artificial Sequence
  Description of Artificial Sequence: Synthetic polypeptide
DETEIRTTNPVATECWGATVANAEDEQEREGPG

SEQ ID NO: 169729 - protein, 33 aa, Artificial Sequence
  Description of Artificial Sequence: Synthetic polypeptide
DETEIRTTNPVATECWGATVANAEDEQEREGPI

SEQ ID NO: 169730 - protein, 32 aa, Artificial Sequence
  Description of Artificial Sequence: Synthetic polypeptide
DENEIRTTNPVSTEPYGTISMEYIQQQQNWNH

SEQ ID NO: 169731 - protein, 33 aa, Artificial Sequence
  Description of Artificial Sequence: Synthetic polypeptide
DEMEIVTTNPVCTEQYGVVCSADDGPVESEGNQ

SEQ ID NO: 169732 - protein, 35 aa, Artificial Sequence
  Description of Artificial Sequence: Synthetic polypeptide
DEEEIRTTNPMAYEGYGSCSSCTPYELSGRVGDVC

SEQ ID NO: 169733 - protein, 34 aa, Artificial Sequence
  Description of Artificial Sequence: Synthetic polypeptide
DEEEIGTTNPVATEQYGCVCSWEDHAENMGSDQS

SEQ ID NO: 169734 - protein, 34 aa, Artificial Sequence
  Description of Artificial Sequence: Synthetic polypeptide
SEQEIATTNPVAYEQYGSVAANGNLMRNGGTPHA

SEQ ID NO: 169735 - protein, 34 aa, Artificial Sequence
  Description of Artificial Sequence: Synthetic polypeptide
DEMEIVTTNPVGTEQYGTVASATDGPVEFEGNDF

SEQ ID NO: 169736 - protein, 33 aa, Artificial Sequence
  Description of Artificial Sequence: Synthetic polypeptide
DEMEIVTTNPVGTEQYGTVCSAKDGPVEFEGND

SEQ ID NO: 169737 - protein, 35 aa, Artificial Sequence
  Description of Artificial Sequence: Synthetic polypeptide
DEEEISTTNPVATEQYGCVCSWGEHQESFGSDTQA

SEQ ID NO: 169738 - protein, 37 aa, Artificial Sequence
  Description of Artificial Sequence: Synthetic polypeptide
DEEEIRTTNPVATEQYGCVCSTWPADNAEYFGSDPQS

SEQ ID NO: 169739 - protein, 35 aa, Artificial Sequence
  Description of Artificial Sequence: Synthetic polypeptide
DESEIRTTNPVATECWGATVANCENEPQDREGENG

SEQ ID NO: 169740 - protein, 33 aa, Artificial Sequence
  Description of Artificial Sequence: Synthetic polypeptide
DENEIRTTNPVSTEPYGTCSMVAIQHVPNGNND

SEQ ID NO: 169741 - protein, 33 aa, Artificial Sequence
  Description of Artificial Sequence: Synthetic polypeptide
DENEIRTTNPVSTEPYGTCSMVAIQHVPNGNAE

SEQ ID NO: 169742 - protein, 36 aa, Artificial Sequence
  Description of Artificial Sequence: Synthetic polypeptide
AEDEICATNPVATEQYGVVSTTNQNLQQLQGNGEDE

SEQ ID NO: 169743 - protein, 36 aa, Artificial Sequence
  Description of Artificial Sequence: Synthetic polypeptide
DEVEIATTNPVATEAWGSVCSTWEQNQQPDGMNDGN

SEQ ID NO: 169744 - protein, 38 aa, Artificial Sequence
  Description of Artificial Sequence: Synthetic polypeptide
DEDEIRTTNPVATEQYGSVSATTPAGGTNQRNPMEPVH

SEQ ID NO: 169745 - protein, 37 aa, Artificial Sequence
  Description of Artificial Sequence: Synthetic polypeptide
DEDEIRTTNPVATEQYGSVSATTPAGPNMRNGMEPVH

SEQ ID NO: 169746 - protein, 33 aa, Artificial Sequence
  Description of Artificial Sequence: Synthetic polypeptide
DENEIRTTNPVSTEPYGTCSMIDDQQQQNGGNH

SEQ ID NO: 169747 - protein, 33 aa, Artificial Sequence
  Description of Artificial Sequence: Synthetic polypeptide
DENEIRTTNPVSTEPYGTCSMIDDIQQQQNGNH

SEQ ID NO: 169748 - protein, 37 aa, Artificial Sequence
  Description of Artificial Sequence: Synthetic polypeptide
DEDEIRTTNPVATEQYGSVSATWPAGTNQGNPMEPVE

SEQ ID NO: 169749 - protein, 37 aa, Artificial Sequence
  Description of Artificial Sequence: Synthetic polypeptide
DEDEIRTTNPVATEQYGSVSCVLDANEDPEGMQQNQI

SEQ ID NO: 169750 - protein, 35 aa, Artificial Sequence
  Description of Artificial Sequence: Synthetic polypeptide
DEVEIATTNPVATDQYGVVSTGDGEQGGQGENETS

SEQ ID NO: 169751 - protein, 32 aa, Artificial Sequence
  Description of Artificial Sequence: Synthetic polypeptide
DENEIRTTNPVSTEPYGTCSMEGIQQQQNGDH

SEQ ID NO: 169752 - protein, 35 aa, Artificial Sequence
  Description of Artificial Sequence: Synthetic polypeptide
DEVEIATTNPVATECWGSVCFTNEDAQDGQRGGTG

SEQ ID NO: 169753 - protein, 35 aa, Artificial Sequence
  Description of Artificial Sequence: Synthetic polypeptide
DEVEIATTNPVATECWGSVCFTNEDKQDGERGGED

SEQ ID NO: 169754 - protein, 38 aa, Artificial Sequence
  Description of Artificial Sequence: Synthetic polypeptide
DEEEIRTTNPVATEQYGSVPPENLNILQEERIQLTDVF

SEQ ID NO: 169755 - protein, 35 aa, Artificial Sequence
  Description of Artificial Sequence: Synthetic polypeptide
DEVEIATTNPVATECWGSVCFTNWDMQDGQRGGDD

SEQ ID NO: 169756 - protein, 37 aa, Artificial Sequence
  Description of Artificial Sequence: Synthetic polypeptide
DEEEIRTTNPVATEQYGSVPPENTDLPEERVLLDDVF

SEQ ID NO: 169757 - protein, 33 aa, Artificial Sequence
  Description of Artificial Sequence: Synthetic polypeptide
DENEIRTTNPVSTEPYGTCSMEDIQQQQNGNTH

SEQ ID NO: 169758 - protein, 34 aa, Artificial Sequence
  Description of Artificial Sequence: Synthetic polypeptide
DEHEIRTTNPVAYEPWGSVSGEGNGNHGNGKGGN

SEQ ID NO: 169759 - protein, 31 aa, Artificial Sequence
  Description of Artificial Sequence: Synthetic polypeptide
QENEIRTTNPCSTEQYGTISCDIQQQQNGTH

SEQ ID NO: 169760 - protein, 33 aa, Artificial Sequence
  Description of Artificial Sequence: Synthetic polypeptide
DENEIRTTNPVSTEPYGTCSMEDIQQQQNGGNG

SEQ ID NO: 169761 - protein, 32 aa, Artificial Sequence
  Description of Artificial Sequence: Synthetic polypeptide
DENEIRTTNPVSTEPYGTCSMEDIQQQQIGEH

SEQ ID NO: 169762 - protein, 38 aa, Artificial Sequence
  Description of Artificial Sequence: Synthetic polypeptide
DEEEIRTTNPVATEQYGSVPPENGNILQEERDLLTDVF

SEQ ID NO: 169763 - protein, 37 aa, Artificial Sequence
  Description of Artificial Sequence: Synthetic polypeptide
DEEEIRTTNPVATEQYGSNCILPLISPQPENINRVND

SEQ ID NO: 169764 - protein, 34 aa, Artificial Sequence
  Description of Artificial Sequence: Synthetic polypeptide
DEVEIATTNPVATDQYGVVSTGDEGGNGQGEETS

SEQ ID NO: 169765 - protein, 36 aa, Artificial Sequence
  Description of Artificial Sequence: Synthetic polypeptide
DEEEIRTTNPVATEQYGCVCSWGEHNQENFNSDTQL

SEQ ID NO: 169766 - protein, 32 aa, Artificial Sequence
  Description of Artificial Sequence: Synthetic polypeptide
DENEIRTTNPVSTEPYGTIAMEDIQQQQNGNH

SEQ ID NO: 169767 - protein, 36 aa, Artificial Sequence
  Description of Artificial Sequence: Synthetic polypeptide
DESEIRTTNPVATDQYGSVVDFEDDNEQNEGNEEGD

SEQ ID NO: 169768 - protein, 32 aa, Artificial Sequence
  Description of Artificial Sequence: Synthetic polypeptide
DENEIRTTNPVSTEPYGTIAMEDIQQQHNGNI

SEQ ID NO: 169769 - protein, 32 aa, Artificial Sequence
  Description of Artificial Sequence: Synthetic polypeptide
DENEIRTTNPVSTEPYGTIAMEDIQAQQNGNH

SEQ ID NO: 169770 - protein, 36 aa, Artificial Sequence
  Description of Artificial Sequence: Synthetic polypeptide
DESEIRTTNPVATDQYGSVTVNDGGEQGQGGGEANE

SEQ ID NO: 169771 - protein, 37 aa, Artificial Sequence
  Description of Artificial Sequence: Synthetic polypeptide
DEEEIATTNPVATEQYGSVSGTGEAGINPHDGMEKVH

SEQ ID NO: 169772 - protein, 35 aa, Artificial Sequence
  Description of Artificial Sequence: Synthetic polypeptide
SEEEISTTNPVATEQYGCVCSNTGPHQENFGSDQL

SEQ ID NO: 169773 - protein, 33 aa, Artificial Sequence
  Description of Artificial Sequence: Synthetic polypeptide
DENEIRTTNPVSTEPYGTGISMEDIQQWQNGNH

SEQ ID NO: 169774 - protein, 34 aa, Artificial Sequence
  Description of Artificial Sequence: Synthetic polypeptide
DEVEIATTNPVATDQYGVVSSTGDEGQGGQGETD

SEQ ID NO: 169775 - protein, 33 aa, Artificial Sequence
  Description of Artificial Sequence: Synthetic polypeptide
DENEIRTTNPVSTEPYGTGISMEDIQQQQNGNV

SEQ ID NO: 169776 - protein, 33 aa, Artificial Sequence
  Description of Artificial Sequence: Synthetic polypeptide
DENEIRTTNPVSTEPYGTGISMEDIQQQQNGNH

SEQ ID NO: 169777 - protein, 35 aa, Artificial Sequence
  Description of Artificial Sequence: Synthetic polypeptide
DEGTIRTTNPVATEQYGDVADDQNEGNQGGGNGGE

SEQ ID NO: 169778 - protein, 36 aa, Artificial Sequence
  Description of Artificial Sequence: Synthetic polypeptide
DEDEIRTTNPVATEQYGSVCCAANNLDQETTPPDLM

SEQ ID NO: 169779 - protein, 33 aa, Artificial Sequence
  Description of Artificial Sequence: Synthetic polypeptide
DEQEIATTNPVAYEQWGSCSATDNNDHEGSEEL

SEQ ID NO: 169780 - protein, 37 aa, Artificial Sequence
  Description of Artificial Sequence: Synthetic polypeptide
DEDEIRTTNPVATEQYGSVCSAANNNATAHGGDNEAM

SEQ ID NO: 169781 - protein, 38 aa, Artificial Sequence
  Description of Artificial Sequence: Synthetic polypeptide
DEDEIRTTNPVATEQYGSVCSAANNNLDQDRTTPPDLM

SEQ ID NO: 169782 - protein, 33 aa, Artificial Sequence
  Description of Artificial Sequence: Synthetic polypeptide
DENEIRTTNPVSTEPYGTFSMEDIQQQPNGVNH

SEQ ID NO: 169783 - protein, 38 aa, Artificial Sequence
  Description of Artificial Sequence: Synthetic polypeptide
DEEEIRTTNPVATEQYGVVSTVTNNNNDEQGTNAQTTD

SEQ ID NO: 169784 - protein, 35 aa, Artificial Sequence
  Description of Artificial Sequence: Synthetic polypeptide
DEGTIRTTNPVATEQYGDIVNGIMNNDQGGGDNDQ

SEQ ID NO: 169785 - protein, 37 aa, Artificial Sequence
  Description of Artificial Sequence: Synthetic polypeptide
DEEEIRTTNPVATEQYGSNCNTFVDEDTQMEGNNAVN

SEQ ID NO: 169786 - protein, 33 aa, Artificial Sequence
  Description of Artificial Sequence: Synthetic polypeptide
DEQEIATTNPVAYEQWGSCSATDNNDHEREDLS

SEQ ID NO: 169787 - protein, 33 aa, Artificial Sequence
  Description of Artificial Sequence: Synthetic polypeptide
DENEIRTTNPVSTEPYGTFSMEDIIQMQNGVNV

SEQ ID NO: 169788 - protein, 38 aa, Artificial Sequence
  Description of Artificial Sequence: Synthetic polypeptide
DEEEIRTTNPVATEQWGYVNVAATGELQHQRPGQGNMV

SEQ ID NO: 169789 - protein, 34 aa, Artificial Sequence
  Description of Artificial Sequence: Synthetic polypeptide
DEHEIRTTNPVAYEPWGSVSGEGNGNHGNGQNHS

SEQ ID NO: 169790 - protein, 33 aa, Artificial Sequence
  Description of Artificial Sequence: Synthetic polypeptide
DEQEIATTNPVAYEQWGSCSATDNNDHQGMEDQ

SEQ ID NO: 169791 - protein, 38 aa, Artificial Sequence
  Description of Artificial Sequence: Synthetic polypeptide
DEEEIATTNPVATEQYGSVSATTPAVIPNMRMGMNPVD

SEQ ID NO: 169792 - protein, 36 aa, Artificial Sequence
  Description of Artificial Sequence: Synthetic polypeptide
QEEEIRTTNPVATEAYGSVSTMIEDGQGEQGGEETG

SEQ ID NO: 169793 - protein, 33 aa, Artificial Sequence
  Description of Artificial Sequence: Synthetic polypeptide
DENEIRTTNPVSTEPYGSISAMEDIQDQNGEDH

SEQ ID NO: 169794 - protein, 33 aa, Artificial Sequence
  Description of Artificial Sequence: Synthetic polypeptide
DENEIRTTNPVSTEPYGRTISMEDIQQQQNGNH

SEQ ID NO: 169795 - protein, 33 aa, Artificial Sequence
  Description of Artificial Sequence: Synthetic polypeptide
DENEIRTTNPVSTEPYGRISNMEDIQQQQNGNH

SEQ ID NO: 169796 - protein, 33 aa, Artificial Sequence
  Description of Artificial Sequence: Synthetic polypeptide
DENEIRTTNPVSTEPYGRISMEDIQQQQNGNHG

SEQ ID NO: 169797 - protein, 36 aa, Artificial Sequence
  Description of Artificial Sequence: Synthetic polypeptide
QEEEIRTTNPVATECYGSVMDNGDNALDREGQDQQE

SEQ ID NO: 169798 - protein, 36 aa, Artificial Sequence
  Description of Artificial Sequence: Synthetic polypeptide
QEEEIRTTNPVATECYGSVMDNGGNALDQEGGDQQT

SEQ ID NO: 169799 - protein, 33 aa, Artificial Sequence
  Description of Artificial Sequence: Synthetic polypeptide
DENEIRTTNPVSTEPYGRISAMEDIQQQQNGNH

SEQ ID NO: 169800 - protein, 37 aa, Artificial Sequence
  Description of Artificial Sequence: Synthetic polypeptide
DECEICTVNPVATEQYGSVSTTNQQGNTEQGNNEDED

SEQ ID NO: 169801 - protein, 33 aa, Artificial Sequence
  Description of Artificial Sequence: Synthetic polypeptide
DENEIRTTNPVSTEPYGQTISMEDIQQQQNGNH

SEQ ID NO: 169802 - protein, 33 aa, Artificial Sequence
  Description of Artificial Sequence: Synthetic polypeptide
DENEIRTTNPVSTEPYGQTISMEDGQQQQNGNH

SEQ ID NO: 169803 - protein, 36 aa, Artificial Sequence
  Description of Artificial Sequence: Synthetic polypeptide
DEEEIKTTNPVATEQYGDVVDVDNNEQIGGQNGEEG

SEQ ID NO: 169804 - protein, 33 aa, Artificial Sequence
  Description of Artificial Sequence: Synthetic polypeptide
DENEIRTTNPVSTEPYGQMISMEDIQQQQNGNH

SEQ ID NO: 169805 - protein, 36 aa, Artificial Sequence
  Description of Artificial Sequence: Synthetic polypeptide
QEEEIRTTNPVATECYGSVMDNGGNALDREGGDIQD

SEQ ID NO: 169806 - protein, 36 aa, Artificial Sequence
  Description of Artificial Sequence: Synthetic polypeptide
DEEEIRTTNPVATEQYGSVSSEPPWLELIHVPPMDE

SEQ ID NO: 169807 - protein, 32 aa, Artificial Sequence
  Description of Artificial Sequence: Synthetic polypeptide
DENEIRTTNPVSTEPYGQISMEDIQQQQNLNH

SEQ ID NO: 169808 - protein, 37 aa, Artificial Sequence
  Description of Artificial Sequence: Synthetic polypeptide
DECEICTVNPVATEQYGSVSTTNQQGNSEQGNNQTED

SEQ ID NO: 169809 - protein, 35 aa, Artificial Sequence
  Description of Artificial Sequence: Synthetic polypeptide
DEEEIRTTNPVATEQYGSVPPPLDEEVTMTPLEVV

SEQ ID NO: 169810 - protein, 33 aa, Artificial Sequence
  Description of Artificial Sequence: Synthetic polypeptide
DENEIRTTNPVSTEPYGQISAMEDIQQQDNGNH

SEQ ID NO: 169811 - protein, 34 aa, Artificial Sequence
  Description of Artificial Sequence: Synthetic polypeptide
CEDEIRTTNPVATEQYGDVVTGPGEGQGNDNENQ

SEQ ID NO: 169812 - protein, 31 aa, Artificial Sequence
  Description of Artificial Sequence: Synthetic polypeptide
AENEIATTNPVAYEPYGKVSQIHLSQHETEL

SEQ ID NO: 169813 - protein, 33 aa, Artificial Sequence
  Description of Artificial Sequence: Synthetic polypeptide
DENEIRTTNPVSTEPYGNVCYCGDIQQQQNGNH

SEQ ID NO: 169814 - protein, 34 aa, Artificial Sequence
  Description of Artificial Sequence: Synthetic polypeptide
DENEIRTTNPVSTEPYGNVCSGMEDIQQQQNGNS

SEQ ID NO: 169815 - protein, 36 aa, Artificial Sequence
  Description of Artificial Sequence: Synthetic polypeptide
DEEEIRTTNPVATEQYGCVCSWGEHNQENFNSDTQS

SEQ ID NO: 169816 - protein, 33 aa, Artificial Sequence
  Description of Artificial Sequence: Synthetic polypeptide
DENEIRTTNPVSTEPYGSISAMEDIQDQNGEDL

SEQ ID NO: 169817 - protein, 36 aa, Artificial Sequence
  Description of Artificial Sequence: Synthetic polypeptide
DESEIRTTNPVATDQYGSVVDFQGDNDQEEGNEEGD

SEQ ID NO: 169818 - protein, 32 aa, Artificial Sequence
  Description of Artificial Sequence: Synthetic polypeptide
AENEIATTNPVSTEQYGEASMEDIQQQQNGNH

SEQ ID NO: 169819 - protein, 35 aa, Artificial Sequence
  Description of Artificial Sequence: Synthetic polypeptide
CEDEIRTTNPVATEQYGAVVGNTDDQAGEGGNEGN

SEQ ID NO: 169820 - protein, 33 aa, Artificial Sequence
  Description of Artificial Sequence: Synthetic polypeptide
DENEIRTTNPVSTEPYGTCISMWDIQQQQNGNH

SEQ ID NO: 169821 - protein, 33 aa, Artificial Sequence
  Description of Artificial Sequence: Synthetic polypeptide
DENEIRTTNPVSTEPYGTCISMEDIQQQQNGNH

SEQ ID NO: 169822 - protein, 33 aa, Artificial Sequence
  Description of Artificial Sequence: Synthetic polypeptide
DENEIRTTNPVSTEPYGTAYSMEDIQQQQNGNH

SEQ ID NO: 169823 - protein, 33 aa, Artificial Sequence
  Description of Artificial Sequence: Synthetic polypeptide
DENEIRTTNPVSTEPYGTASMEDIQQQQNGNTH

SEQ ID NO: 169824 - protein, 37 aa, Artificial Sequence
  Description of Artificial Sequence: Synthetic polypeptide
DEEEIATTNPVATEQYGSVSATTPAITNTGNGMEPVH

SEQ ID NO: 169825 - protein, 33 aa, Artificial Sequence
  Description of Artificial Sequence: Synthetic polypeptide
DEQEIATTNPVAYEQWGSCSATDNNDHQQESDI

SEQ ID NO: 169826 - protein, 35 aa, Artificial Sequence
  Description of Artificial Sequence: Synthetic polypeptide
CEDEIRTTNPVATEFYGSVVGNTMDQAGEGNGETE

SEQ ID NO: 169827 - protein, 33 aa, Artificial Sequence
  Description of Artificial Sequence: Synthetic polypeptide
DENEIRTTNPVSTEPYGTAISMEDIQQQQNGNH

SEQ ID NO: 169828 - protein, 33 aa, Artificial Sequence
  Description of Artificial Sequence: Synthetic polypeptide
DENEIRTTNPVSTEPYGTAISMEDCQQQQNGNH

SEQ ID NO: 169829 - protein, 35 aa, Artificial Sequence
  Description of Artificial Sequence: Synthetic polypeptide
CEDEIRTTNPVATEFYGSVVGNVMDQNGEGGNENE

SEQ ID NO: 169830 - protein, 34 aa, Artificial Sequence
  Description of Artificial Sequence: Synthetic polypeptide
DENEIRTTNPVSTEPYGSVSAMEDIQEQQNGEDH

SEQ ID NO: 169831 - protein, 34 aa, Artificial Sequence
  Description of Artificial Sequence: Synthetic polypeptide
DENEIRTTNPVSTEPYGSVSAMEDIQEQQEGEDH

SEQ ID NO: 169832 - protein, 36 aa, Artificial Sequence
  Description of Artificial Sequence: Synthetic polypeptide
CEDEIRTTNPVATEFYGSVVGVTMNDQAGEGGGENE

SEQ ID NO: 169833 - protein, 38 aa, Artificial Sequence
  Description of Artificial Sequence: Synthetic polypeptide
DEEEIRTTNPVATEQYGVVSTTTTNQNQQQATTNVATE

SEQ ID NO: 169834 - protein, 35 aa, Artificial Sequence
  Description of Artificial Sequence: Synthetic polypeptide
DEEEIRTTNPVGTEQYGCVCSWEEDHNINFGSDQA

SEQ ID NO: 169835 - protein, 36 aa, Artificial Sequence
  Description of Artificial Sequence: Synthetic polypeptide
DEEEIRTTNPVGTEQYGCVCSTTGEDHGNFGSDNQA

SEQ ID NO: 169836 - protein, 35 aa, Artificial Sequence
  Description of Artificial Sequence: Synthetic polypeptide
DEGTIGTTNPVATEQYGDVADDTNEGEQGGGNGQE

SEQ ID NO: 169837 - protein, 31 aa, Artificial Sequence
  Description of Artificial Sequence: Synthetic polypeptide
DDSEVASTNPVSTEGYGNVAANTIQARVGQR

SEQ ID NO: 169838 - protein, 39 aa, Artificial Sequence
  Description of Artificial Sequence: Synthetic polypeptide
DEEEIRTTNPVATEQYGVVSTTTVNQQAGNTEQGVVNTQ

SEQ ID NO: 169839 - protein, 34 aa, Artificial Sequence
  Description of Artificial Sequence: Synthetic polypeptide
DENEIRTTNPVSTEPYGSISMEAIQQQQNGMNPV

SEQ ID NO: 169840 - protein, 34 aa, Artificial Sequence
  Description of Artificial Sequence: Synthetic polypeptide
DENEIRTTNPVSTEPYGSISMEAIQQQQNGMNPH

SEQ ID NO: 169841 - protein, 36 aa, Artificial Sequence
  Description of Artificial Sequence: Synthetic polypeptide
QEEEIRTTNPVATECYGSVDDLMNNDLQSEMNNEDD

SEQ ID NO: 169842 - protein, 36 aa, Artificial Sequence
  Description of Artificial Sequence: Synthetic polypeptide
DEVEIATTNPVATEHYGSVCQTNDQQQDNRGQDDES

SEQ ID NO: 169843 - protein, 35 aa, Artificial Sequence
  Description of Artificial Sequence: Synthetic polypeptide
CEDEIRTTNPVATEQYGDVGTDQENNGQGEGEFGQ

SEQ ID NO: 169844 - protein, 36 aa, Artificial Sequence
  Description of Artificial Sequence: Synthetic polypeptide
DEAEICTTNPVATECWGVVSTGNGLLDDDRGQNDEV

SEQ ID NO: 169845 - protein, 37 aa, Artificial Sequence
  Description of Artificial Sequence: Synthetic polypeptide
DEEEIRTTNPVATEQYGSYTSSEVGESTPVVVSNPLI

SEQ ID NO: 169846 - protein, 32 aa, Artificial Sequence
  Description of Artificial Sequence: Synthetic polypeptide
DENEIRTTNPVSTEPYGTIAMEDIQQQQNGQR

SEQ ID NO: 169847 - protein, 35 aa, Artificial Sequence
  Description of Artificial Sequence: Synthetic polypeptide
DEEEISTTNPVATEQYGQCVCSSGEHNQHFGSDQA

SEQ ID NO: 169848 - protein, 32 aa, Artificial Sequence
  Description of Artificial Sequence: Synthetic polypeptide
DENEIRTTNPVSTEPYGTIMMEDYQQQQNGNH

SEQ ID NO: 169849 - protein, 32 aa, Artificial Sequence
  Description of Artificial Sequence: Synthetic polypeptide
DENEIRTTNPVSTEPYGTIMMEDIQQQQNGNH

SEQ ID NO: 169850 - protein, 37 aa, Artificial Sequence
  Description of Artificial Sequence: Synthetic polypeptide
DEEEISTTNPVATEQYGQCVCSSGENNQENFGSENQS

SEQ ID NO: 169851 - protein, 32 aa, Artificial Sequence
  Description of Artificial Sequence: Synthetic polypeptide
DEQEIATTNPVAYEQWGSCSATDNNDHEDTDP

SEQ ID NO: 169852 - protein, 34 aa, Artificial Sequence
  Description of Artificial Sequence: Synthetic polypeptide
NESEIATTNPVAYECWGSVATGQLNGDHQGGNQR

SEQ ID NO: 169853 - protein, 34 aa, Artificial Sequence
  Description of Artificial Sequence: Synthetic polypeptide
DETVIQTTNPVAYEQWGICVAACNNPSQRGGNER

SEQ ID NO: 169854 - protein, 28 aa, Artificial Sequence
  Description of Artificial Sequence: Synthetic peptide
NESEIASTNPVGTEHWGVAAATLQHGDI

SEQ ID NO: 169855 - protein, 36 aa, Artificial Sequence
  Description of Artificial Sequence: Synthetic polypeptide
DEEEISTTNPVATEQYGQCVCSTEDHNQGFGSDPQS

SEQ ID NO: 169856 - protein, 33 aa, Artificial Sequence
  Description of Artificial Sequence: Synthetic polypeptide
DENEIRTTNPVSTEPYGTILSMEDIQQQQNGNH

SEQ ID NO: 169857 - protein, 33 aa, Artificial Sequence
  Description of Artificial Sequence: Synthetic polypeptide
DEQEIATTNPVAYEQWGSCSATDNNDHEEREDN

SEQ ID NO: 169858 - protein, 33 aa, Artificial Sequence
  Description of Artificial Sequence: Synthetic polypeptide
DEQEIATTNPVAYEQWGSCSATDNNDHEGEGVA

SEQ ID NO: 169859 - protein, 37 aa, Artificial Sequence
  Description of Artificial Sequence: Synthetic polypeptide
DEEEISTTNPVATEQYGQCVCSTEELNQENFNSQTQS

SEQ ID NO: 169860 - protein, 36 aa, Artificial Sequence
  Description of Artificial Sequence: Synthetic polypeptide
DEEEIRTTNPVATEQYGSYVEPAINNLVNIIEEWQQ

SEQ ID NO: 169861 - protein, 33 aa, Artificial Sequence
  Description of Artificial Sequence: Synthetic polypeptide
DENEIRTTNPVSTEPYGTILSEEDIQQQQNGNH

SEQ ID NO: 169862 - protein, 32 aa, Artificial Sequence
  Description of Artificial Sequence: Synthetic polypeptide
DENEIRTTNPVSTEPYGTILMEDIQQQQNGNH

SEQ ID NO: 169863 - protein, 32 aa, Artificial Sequence
  Description of Artificial Sequence: Synthetic polypeptide
DENEIRTTNPVSTEPYGTILMEDIQQQNNGNH

SEQ ID NO: 169864 - protein, 33 aa, Artificial Sequence
  Description of Artificial Sequence: Synthetic polypeptide
DENEIRTTNPVSTEPYGTIKSMERIQQQQNGNH

SEQ ID NO: 169865 - protein, 33 aa, Artificial Sequence
  Description of Artificial Sequence: Synthetic polypeptide
DENEIRTTNPVSTEPYGTIKSMEDIQQQQNGNM

SEQ ID NO: 169866 - protein, 33 aa, Artificial Sequence
  Description of Artificial Sequence: Synthetic polypeptide
DEVAEIATTNPVAYERWGSVSGGNGNSGEGNTS

SEQ ID NO: 169867 - protein, 36 aa, Artificial Sequence
  Description of Artificial Sequence: Synthetic polypeptide
DEDEIRTTNPVATEQYGSVATTQQGNQAGTTEAGSE

SEQ ID NO: 169868 - protein, 35 aa, Artificial Sequence
  Description of Artificial Sequence: Synthetic polypeptide
CEDEIATTNPVAYEQYGSVSANDGPPQENGDNEAM

SEQ ID NO: 169869 - protein, 33 aa, Artificial Sequence
  Description of Artificial Sequence: Synthetic polypeptide
DENEIRTTNPVSTEPYGTIKSMEDIQQQQNGNH

SEQ ID NO: 169870 - protein, 36 aa, Artificial Sequence
  Description of Artificial Sequence: Synthetic polypeptide
DEEEIRTTNPVATEQYGCVCSWGEHNQEFFGSEFQS

SEQ ID NO: 169871 - protein, 32 aa, Artificial Sequence
  Description of Artificial Sequence: Synthetic polypeptide
DENEIRTTNPVSTEPYGTIKMEDIQYQQNGNH

SEQ ID NO: 169872 - protein, 33 aa, Artificial Sequence
  Description of Artificial Sequence: Synthetic polypeptide
CEDEIATTNPVAYEQYGSVSAGNPTPDNDNNNA

SEQ ID NO: 169873 - protein, 37 aa, Artificial Sequence
  Description of Artificial Sequence: Synthetic polypeptide
DECEICTVNPVATEQYGSVSTTQNQQNSTEQGTTNTQ

SEQ ID NO: 169874 - protein, 33 aa, Artificial Sequence
  Description of Artificial Sequence: Synthetic polypeptide
DENEIRTTNPVSTEPYGTIQSMEDIQQQQNGNH

SEQ ID NO: 169875 - protein, 38 aa, Artificial Sequence
  Description of Artificial Sequence: Synthetic polypeptide
DEEEIRTTNPVATEQYGSYVQTPIMVQEGPINQHNVNQ

SEQ ID NO: 169876 - protein, 33 aa, Artificial Sequence
  Description of Artificial Sequence: Synthetic polypeptide
DENEIRTTNPVSTEPYGTIQMEDNIQQQQLGNH

SEQ ID NO: 169877 - protein, 32 aa, Artificial Sequence
  Description of Artificial Sequence: Synthetic polypeptide
DENEIRTTNPVSTEPYGTIQMEDIQQQQNGNH

SEQ ID NO: 169878 - protein, 33 aa, Artificial Sequence
  Description of Artificial Sequence: Synthetic polypeptide
DENEIRTTNPVSTEPYGTIPTMEDIQQQQNGNH

SEQ ID NO: 169879 - protein, 33 aa, Artificial Sequence
  Description of Artificial Sequence: Synthetic polypeptide
DENEIRTTNPVSTEPYGTIPSMEDIQQQQNGNH

SEQ ID NO: 169880 - protein, 35 aa, Artificial Sequence
  Description of Artificial Sequence: Synthetic polypeptide
DENEAEIATTNPVAYERWGSVSGGDLQDTNGGNTS

SEQ ID NO: 169881 - protein, 33 aa, Artificial Sequence
  Description of Artificial Sequence: Synthetic polypeptide
DENEIRTTNPVSTEPYGTIPSCEDISQQQNGNH

SEQ ID NO: 169882 - protein, 32 aa, Artificial Sequence
  Description of Artificial Sequence: Synthetic polypeptide
DENEIRTTNPVSTEPYGTIPMEDIQQQQNGNP

SEQ ID NO: 169883 - protein, 32 aa, Artificial Sequence
  Description of Artificial Sequence: Synthetic polypeptide
DENEIRTTNPVSTEPYGTIPMEDIQQQQNGNH

SEQ ID NO: 169884 - protein, 32 aa, Artificial Sequence
  Description of Artificial Sequence: Synthetic polypeptide
DENEIRTTNPVSTEPYGTIPMEDIQHQQNGNH

SEQ ID NO: 169885 - protein, 33 aa, Artificial Sequence
  Description of Artificial Sequence: Synthetic polypeptide
DENEIRTTNPVSTEPYGTINSMEDIQQQQNGNH

SEQ ID NO: 169886 - protein, 36 aa, Artificial Sequence
  Description of Artificial Sequence: Synthetic polypeptide
DEEEIRTTNPVATEQYGCVCSWGEHNEEHFNSDNQA

SEQ ID NO: 169887 - protein, 34 aa, Artificial Sequence
  Description of Artificial Sequence: Synthetic polypeptide
DETTIRTTNPVATEQYGSVGGDGGGDGNGQEEGQ

SEQ ID NO: 169888 - protein, 34 aa, Artificial Sequence
  Description of Artificial Sequence: Synthetic polypeptide
DETTIRTTNPVATEQYGSVGGDGGGDNDGQEEII

SEQ ID NO: 169889 - protein, 34 aa, Artificial Sequence
  Description of Artificial Sequence: Synthetic polypeptide
DETTIRTTNPVATEQYGSVGGDNGGGDNGQEEIM

SEQ ID NO: 169890 - protein, 32 aa, Artificial Sequence
  Description of Artificial Sequence: Synthetic polypeptide
DENEIRTTNPVSTEPYGTINMEDIQQQQNRNH

SEQ ID NO: 169891 - protein, 32 aa, Artificial Sequence
  Description of Artificial Sequence: Synthetic polypeptide
DENEIRTTNPVSTEPYGTINMEDIQQQQNGRH

SEQ ID NO: 169892 - protein, 32 aa, Artificial Sequence
  Description of Artificial Sequence: Synthetic polypeptide
DENEIRTTNPVSTEPYGTINMEDIQQQQNGNH

SEQ ID NO: 169893 - protein, 38 aa, Artificial Sequence
  Description of Artificial Sequence: Synthetic polypeptide
DEEEIRTTNPVATEQYGVVSTVTNNNNNDEQIGTEEED

SEQ ID NO: 169894 - protein, 33 aa, Artificial Sequence
  Description of Artificial Sequence: Synthetic polypeptide
DENEIRTTNPVSTEPYGTIMVMEDIQQQQNGNH

SEQ ID NO: 169895 - protein, 33 aa, Artificial Sequence
  Description of Artificial Sequence: Synthetic polypeptide
DENEIRTTNPVSTEPYGTIMSMEDIQQQQNGNH

SEQ ID NO: 169896 - protein, 36 aa, Artificial Sequence
  Description of Artificial Sequence: Synthetic polypeptide
DEEEIRTTNPVATEQYGCVCSWGEHNEENFNSDNQS

SEQ ID NO: 169897 - protein, 36 aa, Artificial Sequence
  Description of Artificial Sequence: Synthetic polypeptide
DEEEIRTTNPVATEQYGCVCSWGEHNIENFNSDTQS

SEQ ID NO: 169898 - protein, 35 aa, Artificial Sequence
  Description of Artificial Sequence: Synthetic polypeptide
DEEEISTTNPVATEQYGQCVCSTEHQEYFISETQA

SEQ ID NO: 169899 - protein, 35 aa, Artificial Sequence
  Description of Artificial Sequence: Synthetic polypeptide
DEEEIRTTNPVATEQYGCVCSWGEHNQENFISEQS

SEQ ID NO: 169900 - protein, 33 aa, Artificial Sequence
  Description of Artificial Sequence: Synthetic polypeptide
DENEIRTTNPVSTEPYGTIISMEQIQQQQWGNH

SEQ ID NO: 169901 - protein, 33 aa, Artificial Sequence
  Description of Artificial Sequence: Synthetic polypeptide
DENEIRTTNPVSTEPYGTIFSMEDIQQQQNGNH

SEQ ID NO: 169902 - protein, 32 aa, Artificial Sequence
  Description of Artificial Sequence: Synthetic polypeptide
DENEIRTTNPVSTEPYGTIFMQDIQQQQNGNH

SEQ ID NO: 169903 - protein, 32 aa, Artificial Sequence
  Description of Artificial Sequence: Synthetic polypeptide
DENEIRTTNPVSTEPYGTIFMEDIQQQQNGNH

SEQ ID NO: 169904 - protein, 34 aa, Artificial Sequence
  Description of Artificial Sequence: Synthetic polypeptide
NEREIRTTNPVAYEAWGQVVWTNNLSQIAGGSRD

SEQ ID NO: 169905 - protein, 32 aa, Artificial Sequence
  Description of Artificial Sequence: Synthetic polypeptide
DENEIRTTNPVSTEPYGTIDMEDIQQQQNGNH

SEQ ID NO: 169906 - protein, 32 aa, Artificial Sequence
  Description of Artificial Sequence: Synthetic polypeptide
DENEIRTTNPVSTEPYGTICVEDIQQQQNGQH

SEQ ID NO: 169907 - protein, 36 aa, Artificial Sequence
  Description of Artificial Sequence: Synthetic polypeptide
DESEIRTTNPVATDQYGSVVDTTDENDQNEDNEEGD

SEQ ID NO: 169908 - protein, 33 aa, Artificial Sequence
  Description of Artificial Sequence: Synthetic polypeptide
DENEIRTTNPVSTEPYGTICSWEDINQNYFGNQ

SEQ ID NO: 169909 - protein, 37 aa, Artificial Sequence
  Description of Artificial Sequence: Synthetic polypeptide
DEEEIATTNPVATEQYGSVSGTGNPPPDAAPSENDAD

SEQ ID NO: 169910 - protein, 34 aa, Artificial Sequence
  Description of Artificial Sequence: Synthetic polypeptide
DENEIRTTNPVSTEPYGTICSMEDTIQQQQNGNH

SEQ ID NO: 169911 - protein, 33 aa, Artificial Sequence
  Description of Artificial Sequence: Synthetic polypeptide
DENEIRTTNPVSTEPYGTICSMEDIQQQQNGNH

SEQ ID NO: 169912 - protein, 33 aa, Artificial Sequence
  Description of Artificial Sequence: Synthetic polypeptide
DENEIRTTNPVSTEPYGTICSMEDIQEQQNGNH

SEQ ID NO: 169913 - protein, 33 aa, Artificial Sequence
  Description of Artificial Sequence: Synthetic polypeptide
DENEIRTTNPVSTEPYGTICSMEDCQQQQNGNH

SEQ ID NO: 169914 - protein, 33 aa, Artificial Sequence
  Description of Artificial Sequence: Synthetic polypeptide
DENEIRTTNPVSTEPYGTICSMECIQQQQNGNH

SEQ ID NO: 169915 - protein, 33 aa, Artificial Sequence
  Description of Artificial Sequence: Synthetic polypeptide
DENEIRTTNPVSTEPYGTICSMDDIQEQQNGNH

SEQ ID NO: 169916 - protein, 38 aa, Artificial Sequence
  Description of Artificial Sequence: Synthetic polypeptide
DEEEIRTTNPVATEQYGVVSTVTNNNNGEQGNNANTTD

SEQ ID NO: 169917 - protein, 32 aa, Artificial Sequence
  Description of Artificial Sequence: Synthetic polypeptide
DENEIRTTNPVSTEPYGTICMEDIQQQQNGNH

SEQ ID NO: 169918 - protein, 36 aa, Artificial Sequence
  Description of Artificial Sequence: Synthetic polypeptide
DEDEIRTTNPVATEQYGSVCAATGPGVQDAGMGDAM

SEQ ID NO: 169919 - protein, 32 aa, Artificial Sequence
  Description of Artificial Sequence: Synthetic polypeptide
DENEIRTTNPVSTEPYGTICMEDIQQQPNGNH

SEQ ID NO: 169920 - protein, 33 aa, Artificial Sequence
  Description of Artificial Sequence: Synthetic polypeptide
DENEIRTTNPVSTEPYGTIASMEDIQQQQNGNH

SEQ ID NO: 169921 - protein, 37 aa, Artificial Sequence
  Description of Artificial Sequence: Synthetic polypeptide
DEEEIRTTNPVATEQYGSNCNTFVTDDLTWMEGNNVN

SEQ ID NO: 169922 - protein, 33 aa, Artificial Sequence
  Description of Artificial Sequence: Synthetic polypeptide
DENEIRTTNPVSTEPYGTIASMEDIQQQQAGNH

SEQ ID NO: 169923 - protein, 36 aa, Artificial Sequence
  Description of Artificial Sequence: Synthetic polypeptide
DESEIRTTNPVATDQYGSVVDFTDGNEQEEGEEEGD

SEQ ID NO: 169924 - protein, 36 aa, Artificial Sequence
  Description of Artificial Sequence: Synthetic polypeptide
DEEEIRTTNPVATEQYGSVPNPPLLEEVVMGPLEQV

SEQ ID NO: 169925 - protein, 32 aa, Artificial Sequence
  Description of Artificial Sequence: Synthetic polypeptide
DENEIRTTNPVSTEPYGTIKMEDIQQQQNGNH

SEQ ID NO: 169926 - protein, 32 aa, Artificial Sequence
  Description of Artificial Sequence: Synthetic polypeptide
DENEIRTTNPVSTEPYGTIGMEDIQQGQNGNH

SEQ ID NO: 169927 - protein, 33 aa, Artificial Sequence
  Description of Artificial Sequence: Synthetic polypeptide
DENEIRTTNPVSTEPYGTIGSMEDIQQQQNGNH

SEQ ID NO: 169928 - protein, 33 aa, Artificial Sequence
  Description of Artificial Sequence: Synthetic polypeptide
DENEIRTTNPVSTEPYGTIISMEDIQQQQNGRH

SEQ ID NO: 169929 - protein, 33 aa, Artificial Sequence
  Description of Artificial Sequence: Synthetic polypeptide
DENEIRTTNPVSTEPYGTIISMEDIQQQQNGNH

SEQ ID NO: 169930 - protein, 33 aa, Artificial Sequence
  Description of Artificial Sequence: Synthetic polypeptide
DENEIRTTNPVSTEPYGTIISMEDIQCQQNGNH

SEQ ID NO: 169931 - protein, 33 aa, Artificial Sequence
  Description of Artificial Sequence: Synthetic polypeptide
DENEIRTTNPVSTEPYGTIISIEDIQQQQNGNH

SEQ ID NO: 169932 - protein, 32 aa, Artificial Sequence
  Description of Artificial Sequence: Synthetic polypeptide
DENEIRTTNPVSTEPYGTIIMEFIQQQQNGNH

SEQ ID NO: 169933 - protein, 32 aa, Artificial Sequence
  Description of Artificial Sequence: Synthetic polypeptide
DENEIRTTNPVSTEPYGTIIMEDIQQWQNGNH

SEQ ID NO: 169934 - protein, 32 aa, Artificial Sequence
  Description of Artificial Sequence: Synthetic polypeptide
DENEIRTTNPVSTEPYGTIIMEDIQQQQNGNH

SEQ ID NO: 169935 - protein, 39 aa, Artificial Sequence
  Description of Artificial Sequence: Synthetic polypeptide
DEEEIRTTNPVATEQYGSNIVTVSVNDEEQNNEPEINRA

SEQ ID NO: 169936 - protein, 39 aa, Artificial Sequence
  Description of Artificial Sequence: Synthetic polypeptide
DEEEIRTTNPVATEQYGSNIVTPSGNDEEQNSEPEINRV

SEQ ID NO: 169937 - protein, 33 aa, Artificial Sequence
  Description of Artificial Sequence: Synthetic polypeptide
SEEEISTTNPVATEQYGCVCSWEHAHFNSQFQA

SEQ ID NO: 169938 - protein, 34 aa, Artificial Sequence
  Description of Artificial Sequence: Synthetic polypeptide
SEEEISTTNPVATEQYGCVCSVWEHNQGFGSDQM

SEQ ID NO: 169939 - protein, 36 aa, Artificial Sequence
  Description of Artificial Sequence: Synthetic polypeptide
DEVEIATTNPIATEQWGSIVPTLNWDQHEGGQNGRH

SEQ ID NO: 169940 - protein, 33 aa, Artificial Sequence
  Description of Artificial Sequence: Synthetic polypeptide
DENEIRTTNPVSTEPYGTIHSMEDIQQQQNGNH

SEQ ID NO: 169941 - protein, 36 aa, Artificial Sequence
  Description of Artificial Sequence: Synthetic polypeptide
DEEEIRTTNPVATEQYGCVCSWGEHNQENFNSDFQA

SEQ ID NO: 169942 - protein, 36 aa, Artificial Sequence
  Description of Artificial Sequence: Synthetic polypeptide
DEEEISTTNPVATEQYGQCVCSTEHNQEYFGSETQA

SEQ ID NO: 169943 - protein, 35 aa, Artificial Sequence
  Description of Artificial Sequence: Synthetic polypeptide
DDEEIRCTNPVATEQYGCVCSNTEHNQENSGSQQA

SEQ ID NO: 169944 - protein, 36 aa, Artificial Sequence
  Description of Artificial Sequence: Synthetic polypeptide
DDEEIRCTNPVATEQYGCVCSNTELNQENSGSQTQS

SEQ ID NO: 169945 - protein, 36 aa, Artificial Sequence
  Description of Artificial Sequence: Synthetic polypeptide
DEEEIRTTNPVATEQYGSVPNPLWIEEVPMGPMEFG

SEQ ID NO: 169946 - protein, 36 aa, Artificial Sequence
  Description of Artificial Sequence: Synthetic polypeptide
DEEEIRTTNPVATEQYGCVCSWGEHNQENFNSDTQA

SEQ ID NO: 169947 - protein, 33 aa, Artificial Sequence
  Description of Artificial Sequence: Synthetic polypeptide
DENEIRTTNPVSTEPYGTIHSMEDIQGQQNGNH

SEQ ID NO: 169948 - protein, 32 aa, Artificial Sequence
  Description of Artificial Sequence: Synthetic polypeptide
DENEIRTTNPVSTEPYGTIHMEDIQQQQNGNH

SEQ ID NO: 169949 - protein, 30 aa, Artificial Sequence
  Description of Artificial Sequence: Synthetic polypeptide
QENEIRSTNPVATEQWGDVAEILMNHAEDA

SEQ ID NO: 169950 - protein, 32 aa, Artificial Sequence
  Description of Artificial Sequence: Synthetic polypeptide
DENEIRTTNPVSTEPYGTIHMEDIDQQQNGNH

SEQ ID NO: 169951 - protein, 32 aa, Artificial Sequence
  Description of Artificial Sequence: Synthetic polypeptide
DENEIRTTNPVSTEPYGTIGMEDIQQQQNGNH

SEQ ID NO: 169952 - protein, 32 aa, Artificial Sequence
  Description of Artificial Sequence: Synthetic polypeptide
QEGEIAPTNPTSYEQYGVTVSCCNLSQSGGTR

SEQ ID NO: 169953 - protein, 39 aa, Artificial Sequence
  Description of Artificial Sequence: Synthetic polypeptide
AEEEIRTTNPVATEQYGSVVVTVNNNQAGNTEQGTNDER

SEQ ID NO: 169954 - protein, 33 aa, Artificial Sequence
  Description of Artificial Sequence: Synthetic polypeptide
DEQEIATTNPVAYEQWGSCSATNDNNDHQQEGD

SEQ ID NO: 169955 - protein, 32 aa, Artificial Sequence
  Description of Artificial Sequence: Synthetic polypeptide
DENEIRTTNPVSTEPYGAISMEDIQQQQNGKH

SEQ ID NO: 169956 - protein, 36 aa, Artificial Sequence
  Description of Artificial Sequence: Synthetic polypeptide
DEEEISTTNPVATEQYGQCVCSTGEPNQNFNSQTQA

SEQ ID NO: 169957 - protein, 38 aa, Artificial Sequence
  Description of Artificial Sequence: Synthetic polypeptide
DEDEIRTTNPVATEQYGSVSTVVNNNQQQNQQGTEEDT

SEQ ID NO: 169958 - protein, 38 aa, Artificial Sequence
  Description of Artificial Sequence: Synthetic polypeptide
DEDEIRTTNPVATEQYGSVSTVVNNNTQQGQEETEEQD

SEQ ID NO: 169959 - protein, 34 aa, Artificial Sequence
  Description of Artificial Sequence: Synthetic polypeptide
DEHEIRTTNPVAYEQWGEVMWTEHDNRGGGMMSR

SEQ ID NO: 169960 - protein, 34 aa, Artificial Sequence
  Description of Artificial Sequence: Synthetic polypeptide
DESEIRTTNPVATAHWGSVCTWEDQQRQERGGAS

SEQ ID NO: 169961 - protein, 32 aa, Artificial Sequence
  Description of Artificial Sequence: Synthetic polypeptide
DENEIRTTNPVSTEPYGAIAMEDIQAQQNGNI

SEQ ID NO: 169962 - protein, 32 aa, Artificial Sequence
  Description of Artificial Sequence: Synthetic polypeptide
DENEIRTTNPVSTEPYATISMEDIQQQQNGNH

SEQ ID NO: 169963 - protein, 38 aa, Artificial Sequence
  Description of Artificial Sequence: Synthetic polypeptide
DEDEIRTTNPVATEQYGSVSTVVVTNDEAGNNNTTEDE

SEQ ID NO: 169964 - protein, 31 aa, Artificial Sequence
  Description of Artificial Sequence: Synthetic polypeptide
DENEIRTTNPVSTEPWGTVSMIIQMQQAEDH

SEQ ID NO: 169965 - protein, 38 aa, Artificial Sequence
  Description of Artificial Sequence: Synthetic polypeptide
DEEEIATTNPVATEQYGSVSAMTPAGGTNQRNGMEPVH

SEQ ID NO: 169966 - protein, 33 aa, Artificial Sequence
  Description of Artificial Sequence: Synthetic polypeptide
DEHEIRTTNPVAYEQWGEVMWTEHDNRGGGSGN

SEQ ID NO: 169967 - protein, 34 aa, Artificial Sequence
  Description of Artificial Sequence: Synthetic polypeptide
DEQEIATTNPVAYEQWGSTSTNPNGNGMGGNEGP

SEQ ID NO: 169968 - protein, 34 aa, Artificial Sequence
  Description of Artificial Sequence: Synthetic polypeptide
DESEIRTTNPVATAHWGSVCTWEDMQRDEHGGTS

SEQ ID NO: 169969 - protein, 37 aa, Artificial Sequence
  Description of Artificial Sequence: Synthetic polypeptide
DEDEIRTTNPVATEQYGTVSTVVNNQNNEEEEEEEND

SEQ ID NO: 169970 - protein, 34 aa, Artificial Sequence
  Description of Artificial Sequence: Synthetic polypeptide
DEGNEIATTNPVAYEQWGVVSGTNMNLNDEHGRM

SEQ ID NO: 169971 - protein, 33 aa, Artificial Sequence
  Description of Artificial Sequence: Synthetic polypeptide
DENEIRTTNPVSTEPWGTVSMEDEPQQQNGENH

SEQ ID NO: 169972 - protein, 31 aa, Artificial Sequence
  Description of Artificial Sequence: Synthetic polypeptide
DENEIRTTNPVSTEPWGTVSEIIQMQQAEDH

SEQ ID NO: 169973 - protein, 35 aa, Artificial Sequence
  Description of Artificial Sequence: Synthetic polypeptide
DEEEIRTTNPVATEQYGCVCSWGEHQENFISDTQN

SEQ ID NO: 169974 - protein, 31 aa, Artificial Sequence
  Description of Artificial Sequence: Synthetic polypeptide
DENEIRTTNPVSTEPWGTVSEIIQMQAAEDH

SEQ ID NO: 169975 - protein, 36 aa, Artificial Sequence
  Description of Artificial Sequence: Synthetic polypeptide
DEDEIRTTNPVATEQYGVVATTNQQQQIGTTEQGQE

SEQ ID NO: 169976 - protein, 31 aa, Artificial Sequence
  Description of Artificial Sequence: Synthetic polypeptide
DENEIRTTNPVSTEPWGTVSEIIQMNAAEDH

SEQ ID NO: 169977 - protein, 33 aa, Artificial Sequence
  Description of Artificial Sequence: Synthetic polypeptide
DESEIRTTNPVATAHWGSVCTWEDQQQTNNGME

SEQ ID NO: 169978 - protein, 33 aa, Artificial Sequence
  Description of Artificial Sequence: Synthetic polypeptide
DENEIRTTNPVSTEPYGAISNMEDIQQQPKGNH

SEQ ID NO: 169979 - protein, 33 aa, Artificial Sequence
  Description of Artificial Sequence: Synthetic polypeptide
DENEIRTTNPVSTEPYGAISNMEDIQQQQNGNI

SEQ ID NO: 169980 - protein, 36 aa, Artificial Sequence
  Description of Artificial Sequence: Synthetic polypeptide
DEEEISTTNPVATEQYGQCVCSTGEMLQENFISDQA

SEQ ID NO: 169981 - protein, 34 aa, Artificial Sequence
  Description of Artificial Sequence: Synthetic polypeptide
DESEIRTTNPVATCGYGCVCSTNHNQENFTSDQA

SEQ ID NO: 169982 - protein, 34 aa, Artificial Sequence
  Description of Artificial Sequence: Synthetic polypeptide
DEVEIATTNPVATEQYGSVPATADPVTDDLGEQM

SEQ ID NO: 169983 - protein, 39 aa, Artificial Sequence
  Description of Artificial Sequence: Synthetic polypeptide
DEEEIRTTNPVATEQWGYSNVCSATNELQHQAPGQLVFS

SEQ ID NO: 169984 - protein, 37 aa, Artificial Sequence
  Description of Artificial Sequence: Synthetic polypeptide
DEEEIRTTNPVATEQYGSVGEYLMNGQEQMIMNEEEI

SEQ ID NO: 169985 - protein, 38 aa, Artificial Sequence
  Description of Artificial Sequence: Synthetic polypeptide
DEDEIRTTNPVATEQYGSVSTTVNNNTQQGTEGTEEQD

SEQ ID NO: 169986 - protein, 32 aa, Artificial Sequence
  Description of Artificial Sequence: Synthetic polypeptide
DENEIRTTNPVSTEPYGCISMEDIQQQQNGHH

SEQ ID NO: 169987 - protein, 36 aa, Artificial Sequence
  Description of Artificial Sequence: Synthetic polypeptide
DEEEIRTTNPVGTEQYGCVCSTMEDPNTENFGSDQA

SEQ ID NO: 169988 - protein, 34 aa, Artificial Sequence
  Description of Artificial Sequence: Synthetic polypeptide
DENEIRTTNPVSTEPYGCISMEDCILQPQSGNEH

SEQ ID NO: 169989 - protein, 32 aa, Artificial Sequence
  Description of Artificial Sequence: Synthetic polypeptide
DENEIRTTNPVSTEPYGCISAEDIQQQQHGEH

SEQ ID NO: 169990 - protein, 38 aa, Artificial Sequence
  Description of Artificial Sequence: Synthetic polypeptide
DEDEIRTTNPVATEQYGSVSTVNNNNTQQGQEGEEEQD

SEQ ID NO: 169991 - protein, 36 aa, Artificial Sequence
  Description of Artificial Sequence: Synthetic polypeptide
DEEEIRTTNPVATEQYGCVCSWGEHNTENFNSDTQA

SEQ ID NO: 169992 - protein, 36 aa, Artificial Sequence
  Description of Artificial Sequence: Synthetic polypeptide
DEEEISTTNPVATEQYGQCVCSTGEHNQNFGSETQM

SEQ ID NO: 169993 - protein, 33 aa, Artificial Sequence
  Description of Artificial Sequence: Synthetic polypeptide
DENEIRTTNPVSTEPYGCAISMEDIQQQQNGNH

SEQ ID NO: 169994 - protein, 34 aa, Artificial Sequence
  Description of Artificial Sequence: Synthetic polypeptide
DEGQEIATTNPVAYEQWGSTVTNLNGEEGENDSN

SEQ ID NO: 169995 - protein, 33 aa, Artificial Sequence
  Description of Artificial Sequence: Synthetic polypeptide
DENEIRTTNPVSTEPYGATISNMEDIAQPKGNH

SEQ ID NO: 169996 - protein, 38 aa, Artificial Sequence
  Description of Artificial Sequence: Synthetic polypeptide
DEEEIRTTNPVATEQWGYSNVAASAELQHQRPGQGMFV

SEQ ID NO: 169997 - protein, 35 aa, Artificial Sequence
  Description of Artificial Sequence: Synthetic polypeptide
DEGQEIATTNPVAYECWGSVATGNMLGDQQGMNHE

SEQ ID NO: 169998 - protein, 36 aa, Artificial Sequence
  Description of Artificial Sequence: Synthetic polypeptide
QEEEIRTTNPVATECYGSVVDNGGNALDREGGDQQE

SEQ ID NO: 169999 - protein, 33 aa, Artificial Sequence
  Description of Artificial Sequence: Synthetic polypeptide
DENEIRTTNPVSTEPYGATISMEDIQQQQNGNH

SEQ ID NO: 170000 - protein, 36 aa, Artificial Sequence
  Description of Artificial Sequence: Synthetic polypeptide
DEEEISTTNPVATEQYGQCVCSTGEHNQNSLSENQA

SEQ ID NO: 170001 - protein, 36 aa, Artificial Sequence
  Description of Artificial Sequence: Synthetic polypeptide
DEEEIRTTNPVATEQYGSMSNEFHQDSIYVNSPNVS

SEQ ID NO: 170002 - protein, 36 aa, Artificial Sequence
  Description of Artificial Sequence: Synthetic polypeptide
DEEEIRTTNPVATEQYGSMSIEVQDSIMVNSSPNES

SEQ ID NO: 170003 - protein, 36 aa, Artificial Sequence
  Description of Artificial Sequence: Synthetic polypeptide
DEEEISTTNPVATEQYGQCVCSTGEHQENFNSQTQS

SEQ ID NO: 170004 - protein, 31 aa, Artificial Sequence
  Description of Artificial Sequence: Synthetic polypeptide
DENEIRTTNPVSTEPWGTVSEIIQMNAAEDA

SEQ ID NO: 170005 - protein, 30 aa, Artificial Sequence
  Description of Artificial Sequence: Synthetic polypeptide
DENEIRTTNPVSTEPWGTVSEIIMNAAEDA

SEQ ID NO: 170006 - protein, 30 aa, Artificial Sequence
  Description of Artificial Sequence: Synthetic polypeptide
DENEIRTTNPVSTEPWGTVSEIEMNAAEDA

SEQ ID NO: 170007 - protein, 34 aa, Artificial Sequence
  Description of Artificial Sequence: Synthetic polypeptide
DEQEIATTNPVAYEQWGSTSTNPNGNGMGGNNMS

SEQ ID NO: 170008 - protein, 35 aa, Artificial Sequence
  Description of Artificial Sequence: Synthetic polypeptide
DEVEIATTNPVATEQYGVVVHTDNKDQQQGQGDAA

SEQ ID NO: 170009 - protein, 36 aa, Artificial Sequence
  Description of Artificial Sequence: Synthetic polypeptide
DEEEIRTTNPVATEQYGSVPPPLWTEEVPMGPHEQG

SEQ ID NO: 170010 - protein, 36 aa, Artificial Sequence
  Description of Artificial Sequence: Synthetic polypeptide
SEEEIRTTNPVAYEQWGSVSGGNPEGGNMRNGMNME

SEQ ID NO: 170011 - protein, 36 aa, Artificial Sequence
  Description of Artificial Sequence: Synthetic polypeptide
NEQEIATTNPVATEQYGSTVSCTGLVSEDHEGGPNG

SEQ ID NO: 170012 - protein, 35 aa, Artificial Sequence
  Description of Artificial Sequence: Synthetic polypeptide
DEVEIATTNPVATESWGSVYITDNHQQQHTGDGER

SEQ ID NO: 170013 - protein, 36 aa, Artificial Sequence
  Description of Artificial Sequence: Synthetic polypeptide
NEQEIATTNPVATEQYGSTVSCTALVSENHTGGENL

SEQ ID NO: 170014 - protein, 36 aa, Artificial Sequence
  Description of Artificial Sequence: Synthetic polypeptide
NEQEIATTNPVATEQYGSTVSCTALVSEDVEVGDNG

SEQ ID NO: 170015 - protein, 31 aa, Artificial Sequence
  Description of Artificial Sequence: Synthetic polypeptide
AENEIATTNPVATEGYGCVCSWEPQHESELA

SEQ ID NO: 170016 - protein, 32 aa, Artificial Sequence
  Description of Artificial Sequence: Synthetic polypeptide
AENEIATTNPVATEGYGCVCSWELQHSSSELA

SEQ ID NO: 170017 - protein, 32 aa, Artificial Sequence
  Description of Artificial Sequence: Synthetic polypeptide
DENEIRTTNPVSTEPWGTISMEDIGQQQNGNH

SEQ ID NO: 170018 - protein, 33 aa, Artificial Sequence
  Description of Artificial Sequence: Synthetic polypeptide
AENEIATTNPVATEGYGCVCSWELQHFESENLA

SEQ ID NO: 170019 - protein, 36 aa, Artificial Sequence
  Description of Artificial Sequence: Synthetic polypeptide
DEEEIRTTNPVATEQYGSVPPPLYLEEVPMGPMEFG

SEQ ID NO: 170020 - protein, 33 aa, Artificial Sequence
  Description of Artificial Sequence: Synthetic polypeptide
AENEIATTNPVATEGYGCVCSWELNQHFISENQ

SEQ ID NO: 170021 - protein, 36 aa, Artificial Sequence
  Description of Artificial Sequence: Synthetic polypeptide
DEEEIRTTNPVATEQYGSVPPPLYLEEVTMGVLEQV

SEQ ID NO: 170022 - protein, 33 aa, Artificial Sequence
  Description of Artificial Sequence: Synthetic polypeptide
DENEIACTNPVATEQYGEASSEPAGPQMRGGPV

SEQ ID NO: 170023 - protein, 35 aa, Artificial Sequence
  Description of Artificial Sequence: Synthetic polypeptide
NEPEIATTNPVATEQYGSVWMANVEVLTNGPSTRV

SEQ ID NO: 170024 - protein, 35 aa, Artificial Sequence
  Description of Artificial Sequence: Synthetic polypeptide
DEQEIATTNPVAYEQWGSVCSTIWDGQDGHGNTEQ

SEQ ID NO: 170025 - protein, 39 aa, Artificial Sequence
  Description of Artificial Sequence: Synthetic polypeptide
DEDEIRTTNPVATEQYGVVSTSNNGNQLQGIGTNNQTED

SEQ ID NO: 170026 - protein, 35 aa, Artificial Sequence
  Description of Artificial Sequence: Synthetic polypeptide
SEEEIRTTNPVAYEQWGQVVSSCTQMHSADPGNRA

SEQ ID NO: 170027 - protein, 39 aa, Artificial Sequence
  Description of Artificial Sequence: Synthetic polypeptide
DEDEIRTTNPVATEQYGVVSTSNNGNQLQGIGTTNPNEE

SEQ ID NO: 170028 - protein, 38 aa, Artificial Sequence
  Description of Artificial Sequence: Synthetic polypeptide
DEEEIRTTNPVATEQYGVVSTTVDQQGNTEQGSTTTTD

SEQ ID NO: 170029 - protein, 35 aa, Artificial Sequence
  Description of Artificial Sequence: Synthetic polypeptide
DEQEIATTNPVAYEQWGSVSCTANPWPDHQMQGEQ

SEQ ID NO: 170030 - protein, 36 aa, Artificial Sequence
  Description of Artificial Sequence: Synthetic polypeptide
QEEEIRTTNPVATEFYGSVDIGNLEDFGNGGGENDI

SEQ ID NO: 170031 - protein, 31 aa, Artificial Sequence
  Description of Artificial Sequence: Synthetic polypeptide
DENEIRTTNPVSTEPWGTISMEDIQNANGDA

SEQ ID NO: 170032 - protein, 33 aa, Artificial Sequence
  Description of Artificial Sequence: Synthetic polypeptide
DENEIRTTNPVSTEPYGCISMEDTEMQQQNGQH

SEQ ID NO: 170033 - protein, 36 aa, Artificial Sequence
  Description of Artificial Sequence: Synthetic polypeptide
DEEEIRTTNPVATEQYGSVPPPLWLEVVPMGPLEVG

SEQ ID NO: 170034 - protein, 34 aa, Artificial Sequence
  Description of Artificial Sequence: Synthetic polypeptide
DEHEIRTTNPVAYEQWGEVMWTEHDNRGGGSRDM

SEQ ID NO: 170035 - protein, 36 aa, Artificial Sequence
  Description of Artificial Sequence: Synthetic polypeptide
DEDEIRTTNPVATEQYGVVATTQQTAQIGTTEQGNE

SEQ ID NO: 170036 - protein, 35 aa, Artificial Sequence
  Description of Artificial Sequence: Synthetic polypeptide
DEAEIRTTNPVATEQYGSVCFPVLNEEEFDGKIET

SEQ ID NO: 170037 - protein, 35 aa, Artificial Sequence
  Description of Artificial Sequence: Synthetic polypeptide
QEEEIRTTNPVATEFYGAVDVGVFNGQGGEDDDNQ

SEQ ID NO: 170038 - protein, 35 aa, Artificial Sequence
  Description of Artificial Sequence: Synthetic polypeptide
CESCIRTTNPVATEQYGVTVPNTNETSQTTGGSRP

SEQ ID NO: 170039 - protein, 32 aa, Artificial Sequence
  Description of Artificial Sequence: Synthetic polypeptide
DENEIRTTNPVSTEPWGTTSMGDGQQQTNGNH

SEQ ID NO: 170040 - protein, 36 aa, Artificial Sequence
  Description of Artificial Sequence: Synthetic polypeptide
DEEEIRTTNPVATEQYGSMSIEPQDFIEVNVIPNVS

SEQ ID NO: 170041 - protein, 34 aa, Artificial Sequence
  Description of Artificial Sequence: Synthetic polypeptide
DEQEIATTNPVAYEQWGSTSTNPNGNGMGQNDGM

SEQ ID NO: 170042 - protein, 37 aa, Artificial Sequence
  Description of Artificial Sequence: Synthetic polypeptide
DEEEISTTNPVATEQYGQCVCSTMEHNQENFGSENQA

SEQ ID NO: 170043 - protein, 34 aa, Artificial Sequence
  Description of Artificial Sequence: Synthetic polypeptide
DEQEIATTNPVAYEQWGSTSTNPNGNGMGQNNPN

SEQ ID NO: 170044 - protein, 32 aa, Artificial Sequence
  Description of Artificial Sequence: Synthetic polypeptide
DENEIRTTNPVSTEPWGTISMIDIQQDQNGNG

SEQ ID NO: 170045 - protein, 39 aa, Artificial Sequence
  Description of Artificial Sequence: Synthetic polypeptide
DEDEIRTTNPVATEQYGVVSTSNGNNQLQGIGTTNQNEE

SEQ ID NO: 170046 - protein, 39 aa, Artificial Sequence
  Description of Artificial Sequence: Synthetic polypeptide
AEEEIRTTNPVATEQYGSVVVTVNVNNLEQGTEGGNTTV

SEQ ID NO: 170047 - protein, 31 aa, Artificial Sequence
  Description of Artificial Sequence: Synthetic polypeptide
DDSEIRSTNPVSTEGYGTVAMEDIQSQNGQR

SEQ ID NO: 170048 - protein, 32 aa, Artificial Sequence
  Description of Artificial Sequence: Synthetic polypeptide
QEGEIAPTNPCSYEQYGKVSCNLSTSGGTNRH

SEQ ID NO: 170049 - protein, 36 aa, Artificial Sequence
  Description of Artificial Sequence: Synthetic polypeptide
DEEEIRTTNPVATEQYGSVPPPLWLEEVPTGPEEFG

SEQ ID NO: 170050 - protein, 35 aa, Artificial Sequence
  Description of Artificial Sequence: Synthetic polypeptide
CEREIRTTNPVATEQYGCVCSNTGEHNQNFGSEQS

SEQ ID NO: 170051 - protein, 35 aa, Artificial Sequence
  Description of Artificial Sequence: Synthetic polypeptide
DEGNEIATTNPVAYEQWGSVSHTMNDRGNDGGNDP

SEQ ID NO: 170052 - protein, 30 aa, Artificial Sequence
  Description of Artificial Sequence: Synthetic polypeptide
QENEIRTTNPVATEQWGEVPEIEMNAAEEA

SEQ ID NO: 170053 - protein, 32 aa, Artificial Sequence
  Description of Artificial Sequence: Synthetic polypeptide
DENEIRTTNPVSTEPWGTISMEDIQQQQNGNH

SEQ ID NO: 170054 - protein, 37 aa, Artificial Sequence
  Description of Artificial Sequence: Synthetic polypeptide
DEEEIRTTNPVATEQYGCVCSWGELHNQENFNSDNQS

SEQ ID NO: 170055 - protein, 37 aa, Artificial Sequence
  Description of Artificial Sequence: Synthetic polypeptide
DEVEIATTNPVATEQYGTVSWNEGDLQDQERGGGGSS

SEQ ID NO: 170056 - protein, 32 aa, Artificial Sequence
  Description of Artificial Sequence: Synthetic polypeptide
QEGEIAPTNPCSYEQYGKVSCNLSQSNGGTNQ

SEQ ID NO: 170057 - protein, 33 aa, Artificial Sequence
  Description of Artificial Sequence: Synthetic polypeptide
DEQEIATTNPVAYEQWGSVCHGENDQHLTNDEP

SEQ ID NO: 170058 - protein, 32 aa, Artificial Sequence
  Description of Artificial Sequence: Synthetic polypeptide
DENEIRTTNPVSTEPWGTISMEDIQQEQNGNH

SEQ ID NO: 170059 - protein, 36 aa, Artificial Sequence
  Description of Artificial Sequence: Synthetic polypeptide
DEEEISTTNPVATEQYGQCVCSTGEHNQEHFGSEQM

SEQ ID NO: 170060 - protein, 34 aa, Artificial Sequence
  Description of Artificial Sequence: Synthetic polypeptide
DENEIRTTNPVSTEPYGCISMEDWILQPQSGMNH

SEQ ID NO: 170061 - protein, 32 aa, Artificial Sequence
  Description of Artificial Sequence: Synthetic polypeptide
DENEIRTTNPVSTEPYGCISPLDIQQQQNGQH

SEQ ID NO: 170062 - protein, 39 aa, Artificial Sequence
  Description of Artificial Sequence: Synthetic polypeptide
DEEEIRTTNPVATEQYGVVSTVVTNLQQLEQGTTETGSE

SEQ ID NO: 170063 - protein, 39 aa, Artificial Sequence
  Description of Artificial Sequence: Synthetic polypeptide
DEEEIRTTNPVATEQWGYSNVTAASGNELQHTRVGQGQV

SEQ ID NO: 170064 - protein, 33 aa, Artificial Sequence
  Description of Artificial Sequence: Synthetic polypeptide
DEVEIATTNPVATEQWGTNCSANAHMNRSNDSW

SEQ ID NO: 170065 - protein, 36 aa, Artificial Sequence
  Description of Artificial Sequence: Synthetic polypeptide
DEEEISTTNPVATEQYGQCVCSTGEDDQENFNSDQA

SEQ ID NO: 170066 - protein, 37 aa, Artificial Sequence
  Description of Artificial Sequence: Synthetic polypeptide
CEDEIRTTNPVATEQYGSVSILIATGDPNQEGGNDGD

SEQ ID NO: 170067 - protein, 33 aa, Artificial Sequence
  Description of Artificial Sequence: Synthetic polypeptide
DENEIRTTNPVSTEPYGLISMEDMIQQQQNGNH

SEQ ID NO: 170068 - protein, 36 aa, Artificial Sequence
  Description of Artificial Sequence: Synthetic polypeptide
CEDEIRTTNPVATEQYGSVVGDTTQDQAGEGGNEGN

SEQ ID NO: 170069 - protein, 34 aa, Artificial Sequence
  Description of Artificial Sequence: Synthetic polypeptide
DEQEIATTNPVAYEQWGSCSPTDNNEHQDDRSDP

SEQ ID NO: 170070 - protein, 37 aa, Artificial Sequence
  Description of Artificial Sequence: Synthetic polypeptide
DEEEISTTNPVATEQYGQCVCSTGEDHNQNFGSDNQM

SEQ ID NO: 170071 - protein, 33 aa, Artificial Sequence
  Description of Artificial Sequence: Synthetic polypeptide
DENEIRTTNPVSTEPYGKTISMEDIQQQQNGNH

SEQ ID NO: 170072 - protein, 33 aa, Artificial Sequence
  Description of Artificial Sequence: Synthetic polypeptide
DENEIRTTNPVSTEPYGKTISMEDIQQQQDGNH

SEQ ID NO: 170073 - protein, 36 aa, Artificial Sequence
  Description of Artificial Sequence: Synthetic polypeptide
CEDEIRTTNPVATEQYGSVVGNTTMNNAGEGGNEGN

SEQ ID NO: 170074 - protein, 33 aa, Artificial Sequence
  Description of Artificial Sequence: Synthetic polypeptide
DENEIRTTNPVSTEPYGKISVLDEQQQQGGIHE

SEQ ID NO: 170075 - protein, 39 aa, Artificial Sequence
  Description of Artificial Sequence: Synthetic polypeptide
DEEEIRTTNPVATEQYGVVSTVTNNLQQSATEEGVVVVQ

SEQ ID NO: 170076 - protein, 33 aa, Artificial Sequence
  Description of Artificial Sequence: Synthetic polypeptide
DENEIRTTNPVSTEPYGKISMEDIQQQQNGNAH

SEQ ID NO: 170077 - protein, 33 aa, Artificial Sequence
  Description of Artificial Sequence: Synthetic polypeptide
DENEIRTTNPVSTEPYGKISMEDIQQQQNGKNH

SEQ ID NO: 170078 - protein, 33 aa, Artificial Sequence
  Description of Artificial Sequence: Synthetic polypeptide
DENEIRTTNPVSTEPYGKISMEDIQQQQNGINH

SEQ ID NO: 170079 - protein, 36 aa, Artificial Sequence
  Description of Artificial Sequence: Synthetic polypeptide
QEEEIRTTNPVATECYGSVNTDNMIETGGGQTENGN

SEQ ID NO: 170080 - protein, 34 aa, Artificial Sequence
  Description of Artificial Sequence: Synthetic polypeptide
DESEIRTTNPVATCHYGQCVCSTEHNQYFTSNQS

SEQ ID NO: 170081 - protein, 33 aa, Artificial Sequence
  Description of Artificial Sequence: Synthetic polypeptide
DENEIRTTNPVSTEPYGITISMEDIQQQTNGNH

SEQ ID NO: 170082 - protein, 33 aa, Artificial Sequence
  Description of Artificial Sequence: Synthetic polypeptide
DENEIRTTNPVSTEPYGITISMEDIQQQQNGNH

SEQ ID NO: 170083 - protein, 33 aa, Artificial Sequence
  Description of Artificial Sequence: Synthetic polypeptide
DEQEIATTNPVAYEQWGSCSPTDNNEHQGDDDE

SEQ ID NO: 170084 - protein, 34 aa, Artificial Sequence
  Description of Artificial Sequence: Synthetic polypeptide
DEQEIATTNPVAYEQWGSCSPTDNNEQQDDRMDM

SEQ ID NO: 170085 - protein, 37 aa, Artificial Sequence
  Description of Artificial Sequence: Synthetic polypeptide
DEEEIRTTNPVATEQWGYSNVTATGEEQHQRPGQVMV

SEQ ID NO: 170086 - protein, 35 aa, Artificial Sequence
  Description of Artificial Sequence: Synthetic polypeptide
DEVEIATTNPVATEQYGCVCTIEGNQDQHGQGDSG

SEQ ID NO: 170087 - protein, 36 aa, Artificial Sequence
  Description of Artificial Sequence: Synthetic polypeptide
DEVEIATTNPVATEQWGSVAITNHGEEATGNQDGNP

SEQ ID NO: 170088 - protein, 31 aa, Artificial Sequence
  Description of Artificial Sequence: Synthetic polypeptide
DDSEVASTNPVSTEGYGNVAANTIQDRVGQR

SEQ ID NO: 170089 - protein, 36 aa, Artificial Sequence
  Description of Artificial Sequence: Synthetic polypeptide
DEEEIRTTNPVATEQYGCVCSWGEHNQENFNSETQA

SEQ ID NO: 170090 - protein, 36 aa, Artificial Sequence
  Description of Artificial Sequence: Synthetic polypeptide
DEEEIRTTNPVATEQYGCVCSWGEHNQENFNSNNQF

SEQ ID NO: 170091 - protein, 33 aa, Artificial Sequence
  Description of Artificial Sequence: Synthetic polypeptide
DEGTEIATTNPVAYEEWGSVTGGNGNAGNDNQR

SEQ ID NO: 170092 - protein, 33 aa, Artificial Sequence
  Description of Artificial Sequence: Synthetic polypeptide
DENEIRTTNPVSTEPYGNTISMEDIQQQQNGNH

SEQ ID NO: 170093 - protein, 32 aa, Artificial Sequence
  Description of Artificial Sequence: Synthetic polypeptide
AENEIATTNPVATEYYGCVCSWELQEHFESEL

SEQ ID NO: 170094 - protein, 33 aa, Artificial Sequence
  Description of Artificial Sequence: Synthetic polypeptide
DEQEIATTNPVAYEQWGSCSATPDNNDHDGEDS

SEQ ID NO: 170095 - protein, 37 aa, Artificial Sequence
  Description of Artificial Sequence: Synthetic polypeptide
DECEICTVNPVATEQYGSVSTTNQLEQGTEQGSTVTD

SEQ ID NO: 170096 - protein, 33 aa, Artificial Sequence
  Description of Artificial Sequence: Synthetic polypeptide
DEHEIRTTNPVAYEQWGAVCMEQLQDVGGGDTE

SEQ ID NO: 170097 - protein, 33 aa, Artificial Sequence
  Description of Artificial Sequence: Synthetic polypeptide
DENEIRTTNPVSTEPYGNISMEDIQQQQNGNAH

SEQ ID NO: 170098 - protein, 32 aa, Artificial Sequence
  Description of Artificial Sequence: Synthetic polypeptide
DENEIRTTNPVSTEPYGNISMEDIQQQQNGDH

SEQ ID NO: 170099 - protein, 33 aa, Artificial Sequence
  Description of Artificial Sequence: Synthetic polypeptide
DENEIRTTNPVSTEPYGNISMEDGIAQQQNGNH

SEQ ID NO: 170100 - protein, 33 aa, Artificial Sequence
  Description of Artificial Sequence: Synthetic polypeptide
DEQEIATTNPVAYEQWGSCSATQDNNDHQGESQ

SEQ ID NO: 170101 - protein, 33 aa, Artificial Sequence
  Description of Artificial Sequence: Synthetic polypeptide
DEQEIATTNPVAYEQWGSCSLGDNNEHQGDRDD

SEQ ID NO: 170102 - protein, 32 aa, Artificial Sequence
  Description of Artificial Sequence: Synthetic polypeptide
DENEIRTTNPVSTEPYGNISAMDIQQSQNGQH

SEQ ID NO: 170103 - protein, 32 aa, Artificial Sequence
  Description of Artificial Sequence: Synthetic polypeptide
DENEIRTTNPVSTEPYGNIAANTIQQSQNGQH

SEQ ID NO: 170104 - protein, 36 aa, Artificial Sequence
  Description of Artificial Sequence: Synthetic polypeptide
DEEEIRTTNPVATEQYGCVCSWGEHNQESFNSDNQS

SEQ ID NO: 170105 - protein, 33 aa, Artificial Sequence
  Description of Artificial Sequence: Synthetic polypeptide
DEACIRTTNPVATEQYGCVCETEPAEYFGSDQS

SEQ ID NO: 170106 - protein, 34 aa, Artificial Sequence
  Description of Artificial Sequence: Synthetic polypeptide
DEQEIATTNPVAYEQWGSCSPTADNNEHQGDEND

SEQ ID NO: 170107 - protein, 33 aa, Artificial Sequence
  Description of Artificial Sequence: Synthetic polypeptide
DENEIRTTNPVSTEPYGMTISMEDIQQQQNGNH

SEQ ID NO: 170108 - protein, 33 aa, Artificial Sequence
  Description of Artificial Sequence: Synthetic polypeptide
DENEIRTTNPVSTEPYGMTISMCDIQQQQNGNH

SEQ ID NO: 170109 - protein, 37 aa, Artificial Sequence
  Description of Artificial Sequence: Synthetic polypeptide
DEEEIATTNPVATEQYGSVSATTPAGTNMRNGMEPVM

SEQ ID NO: 170110 - protein, 33 aa, Artificial Sequence
  Description of Artificial Sequence: Synthetic polypeptide
DEHEIRTTNPVAYEQWGCVCMDDLQDIDGGDSD

SEQ ID NO: 170111 - protein, 32 aa, Artificial Sequence
  Description of Artificial Sequence: Synthetic polypeptide
DENEIACTNPIATECYGETSNAENLAEPKGPR

SEQ ID NO: 170112 - protein, 33 aa, Artificial Sequence
  Description of Artificial Sequence: Synthetic polypeptide
DENEIRTTNPVSTEPYGMISNMEDIQQQQNGNH

SEQ ID NO: 170113 - protein, 33 aa, Artificial Sequence
  Description of Artificial Sequence: Synthetic polypeptide
DENEIRTTNPVSTEPYGNTISMLDIQQQQNGNH

SEQ ID NO: 170114 - protein, 33 aa, Artificial Sequence
  Description of Artificial Sequence: Synthetic polypeptide
DEQEIATTNPVAYEQWGSCSPTDNNEQQQDEDD

SEQ ID NO: 170115 - protein, 34 aa, Artificial Sequence
  Description of Artificial Sequence: Synthetic polypeptide
DEQEIATTNPVAYEQWGSCSPTDNNHVQDDRDDS

SEQ ID NO: 170116 - protein, 34 aa, Artificial Sequence
  Description of Artificial Sequence: Synthetic polypeptide
DEMEIRTTNPVATCQYGCVCNNTEHNQNFGSDQS

SEQ ID NO: 170117 - protein, 32 aa, Artificial Sequence
  Description of Artificial Sequence: Synthetic polypeptide
DDSEVRTTNPVSTEPYGTISAMETIQSQNGNH

SEQ ID NO: 170118 - protein, 36 aa, Artificial Sequence
  Description of Artificial Sequence: Synthetic polypeptide
DEEEISTTNPVATEQYGQCVCSTGEHDQGFGSDTQA

SEQ ID NO: 170119 - protein, 35 aa, Artificial Sequence
  Description of Artificial Sequence: Synthetic polypeptide
DEEEIRTTNPVATEQYGSVPPPLLETVDMAPLEQV

SEQ ID NO: 170120 - protein, 33 aa, Artificial Sequence
  Description of Artificial Sequence: Synthetic polypeptide
DENEIRTTNPVSTEPYGCTISMLDIQQQQNGNA

SEQ ID NO: 170121 - protein, 33 aa, Artificial Sequence
  Description of Artificial Sequence: Synthetic polypeptide
DENEIRTTNPVSTEPYGCTISMEDISQQQNGNH

SEQ ID NO: 170122 - protein, 33 aa, Artificial Sequence
  Description of Artificial Sequence: Synthetic polypeptide
DENEIRTTNPVSTEPYGCTISMEDIQQQQNGNH

SEQ ID NO: 170123 - protein, 33 aa, Artificial Sequence
  Description of Artificial Sequence: Synthetic polypeptide
DENEIRTTNPVSTEPYGCTISMEDIQQQQNGNG

SEQ ID NO: 170124 - protein, 35 aa, Artificial Sequence
  Description of Artificial Sequence: Synthetic polypeptide
DEVEIATTNPVATEQYGSVCAADNHLEAMNMDINK

SEQ ID NO: 170125 - protein, 33 aa, Artificial Sequence
  Description of Artificial Sequence: Synthetic polypeptide
DENEIRTTNPVSTEPYGCITSMEDIQQPQSGNH

SEQ ID NO: 170126 - protein, 37 aa, Artificial Sequence
  Description of Artificial Sequence: Synthetic polypeptide
DEEEIKTTNPVATEQYGSVDTDDTGEQDQEGNENAGQ

SEQ ID NO: 170127 - protein, 37 aa, Artificial Sequence
  Description of Artificial Sequence: Synthetic polypeptide
DEEEISTTNPVATEQYGQCVCSTGEHNAENFGSDNQL

SEQ ID NO: 170128 - protein, 33 aa, Artificial Sequence
  Description of Artificial Sequence: Synthetic polypeptide
DENEIRTTNPVSTEPYGCISWEDPQQEQFGNAA

SEQ ID NO: 170129 - protein, 36 aa, Artificial Sequence
  Description of Artificial Sequence: Synthetic polypeptide
DEVEIATTNPVATEQYGSVCADTNPLTNADNLNNVE

SEQ ID NO: 170130 - protein, 36 aa, Artificial Sequence
  Description of Artificial Sequence: Synthetic polypeptide
DEVEIATTNPVATEQYGSVCADTNPLTNPDMGGEHE

SEQ ID NO: 170131 - protein, 38 aa, Artificial Sequence
  Description of Artificial Sequence: Synthetic polypeptide
DEEEIRTTNPVATEQWGYSNVIAASNELQHTRVGQMFV

SEQ ID NO: 170132 - protein, 35 aa, Artificial Sequence
  Description of Artificial Sequence: Synthetic polypeptide
DEVEIATTNPVATEQYGSVCADWNPGIEHGDNEAM

SEQ ID NO: 170133 - protein, 37 aa, Artificial Sequence
  Description of Artificial Sequence: Synthetic polypeptide
DEEEISTTNPVATEQYGQCVCSTGEHNAENFGSDNQS

SEQ ID NO: 170134 - protein, 34 aa, Artificial Sequence
  Description of Artificial Sequence: Synthetic polypeptide
NEREIRTTNPVATEQYGCVCGWGNPNQNFGSDQS

SEQ ID NO: 170135 - protein, 34 aa, Artificial Sequence
  Description of Artificial Sequence: Synthetic polypeptide
DENEIRTTNPVSTEPYGCISTWEDINQEQFGSDQ

SEQ ID NO: 170136 - protein, 31 aa, Artificial Sequence
  Description of Artificial Sequence: Synthetic polypeptide
DECEICTTNPVAYEQWGSVGWIEDTQAMDSH

SEQ ID NO: 170137 - protein, 37 aa, Artificial Sequence
  Description of Artificial Sequence: Synthetic polypeptide
DEEEISTTNPVATEQYGQCVCSTGEHNAESFGSDNQA

SEQ ID NO: 170138 - protein, 36 aa, Artificial Sequence
  Description of Artificial Sequence: Synthetic polypeptide
DEVEIATTNPVATEQYGSVCSATLALPQNHSDAEAN

SEQ ID NO: 170139 - protein, 31 aa, Artificial Sequence
  Description of Artificial Sequence: Synthetic polypeptide
DDSEVASTNPVSTEGYGNVAANTIQERVGQR

SEQ ID NO: 170140 - protein, 35 aa, Artificial Sequence
  Description of Artificial Sequence: Synthetic polypeptide
QEEEIRTTNPVATECYGSVNTDNMIETGGGQTEQN

SEQ ID NO: 170141 - protein, 31 aa, Artificial Sequence
  Description of Artificial Sequence: Synthetic polypeptide
DENEIRTTNPVSTEPYGEIPMEVIQQQNEEH

SEQ ID NO: 170142 - protein, 34 aa, Artificial Sequence
  Description of Artificial Sequence: Synthetic polypeptide
DESEIRTTNPVATCHYGCVCSTELNQENFTSDQM

SEQ ID NO: 170143 - protein, 39 aa, Artificial Sequence
  Description of Artificial Sequence: Synthetic polypeptide
DEEEIRTTNPVATEQYGVVSTVTNNLQQSATEEGVTDAQ

SEQ ID NO: 170144 - protein, 31 aa, Artificial Sequence
  Description of Artificial Sequence: Synthetic polypeptide
DDSEVASTNPVSTEGYGNVAANTIQERVGHR

SEQ ID NO: 170145 - protein, 32 aa, Artificial Sequence
  Description of Artificial Sequence: Synthetic polypeptide
DENEIRTTNPVSTEPYGHIMMEDRQQQQNGNH

SEQ ID NO: 170146 - protein, 33 aa, Artificial Sequence
  Description of Artificial Sequence: Synthetic polypeptide
DENEIRTTNPVSTEPYGGIWVEDINQQQGGEHC

SEQ ID NO: 170147 - protein, 37 aa, Artificial Sequence
  Description of Artificial Sequence: Synthetic polypeptide
DEEEIRTTNPVATEQYGVVSTTVANQQGTTTEEEEDE

SEQ ID NO: 170148 - protein, 32 aa, Artificial Sequence
  Description of Artificial Sequence: Synthetic polypeptide
DENEIACTNPVATECYGETTSNEEDWARGPYR

SEQ ID NO: 170149 - protein, 34 aa, Artificial Sequence
  Description of Artificial Sequence: Synthetic polypeptide
DENEIRTTNPVSTEPYGGISVEDINQPQNGEKHP

SEQ ID NO: 170150 - protein, 33 aa, Artificial Sequence
  Description of Artificial Sequence: Synthetic polypeptide
DECEICTTNPVAYEQWGTISHTDNHKREGTGSE

SEQ ID NO: 170151 - protein, 32 aa, Artificial Sequence
  Description of Artificial Sequence: Synthetic polypeptide
DENEIRTTNPVSTEPYGGISMEDIQQQQNGFH

SEQ ID NO: 170152 - protein, 34 aa, Artificial Sequence
  Description of Artificial Sequence: Synthetic polypeptide
DEMEIRTTNPVATCQYGCVCNTEHNQENFGSDQG

SEQ ID NO: 170153 - protein, 32 aa, Artificial Sequence
  Description of Artificial Sequence: Synthetic polypeptide
DENEIRTTNPVSTEPYGGIPMEDIQQQQNGNH

SEQ ID NO: 170154 - protein, 35 aa, Artificial Sequence
  Description of Artificial Sequence: Synthetic polypeptide
AENEIATTNPVATEQYGSASSTTPAGPNRNGMNPV

SEQ ID NO: 170155 - protein, 33 aa, Artificial Sequence
  Description of Artificial Sequence: Synthetic polypeptide
DENEIRTTNPVSTEPYGFTISMEDIQQQQNGNH

SEQ ID NO: 170156 - protein, 34 aa, Artificial Sequence
  Description of Artificial Sequence: Synthetic polypeptide
DESEIRTTNPVATCHYGCVCSTGNHQEYFTSDQS

SEQ ID NO: 170157 - protein, 37 aa, Artificial Sequence
  Description of Artificial Sequence: Synthetic polypeptide
DEEEIRTTNPVATEQYGSMVLGIADMTIEEPEQEGTS

SEQ ID NO: 170158 - protein, 33 aa, Artificial Sequence
  Description of Artificial Sequence: Synthetic polypeptide
DENEIRTTNPVSTEPYGETISWEDIQQQQNGNH

SEQ ID NO: 170159 - protein, 33 aa, Artificial Sequence
  Description of Artificial Sequence: Synthetic polypeptide
DENEIRTTNPVSTEPYGETISMEDIQQYQNGNH

SEQ ID NO: 170160 - protein, 36 aa, Artificial Sequence
  Description of Artificial Sequence: Synthetic polypeptide
QEEEIRTTNPVATECYGSVSSTTPCGPNMRNGMEPL

SEQ ID NO: 170161 - protein, 33 aa, Artificial Sequence
  Description of Artificial Sequence: Synthetic polypeptide
DENEIRTTNPVSTEPYGETISMEDIQQQQNGNH

SEQ ID NO: 170162 - protein, 33 aa, Artificial Sequence
  Description of Artificial Sequence: Synthetic polypeptide
DENEIRTTNPVSTEPYGETISMEDIHQQQNGNH

SEQ ID NO: 170163 - protein, 34 aa, Artificial Sequence
  Description of Artificial Sequence: Synthetic polypeptide
DEHEIRTTNPVAYEQWGCVTGNGMNEQNHGENDK

SEQ ID NO: 170164 - protein, 35 aa, Artificial Sequence
  Description of Artificial Sequence: Synthetic polypeptide
DEEEISTTNPVATEQYGQCVCSTGEHANFGSQTQS

SEQ ID NO: 170165 - protein, 34 aa, Artificial Sequence
  Description of Artificial Sequence: Synthetic polypeptide
NEREIRTTNPVATEQYGCVCQWNPNQENFGSDQS

SEQ ID NO: 170166 - protein, 34 aa, Artificial Sequence
  Description of Artificial Sequence: Synthetic polypeptide
DESEIRTTNPVATCHYGCVCSTEHQEYFTSNTQS

SEQ ID NO: 170167 - protein, 35 aa, Artificial Sequence
  Description of Artificial Sequence: Synthetic polypeptide
DEEEIRTTNPLAYEPYGTVPSYCVNIFNRTGGNND

SEQ ID NO: 170168 - protein, 36 aa, Artificial Sequence
  Description of Artificial Sequence: Synthetic polypeptide
NESEIRTTNPVATEQWGAVAWTDNMQQQDRGDSPRM

SEQ ID NO: 170169 - protein, 32 aa, Artificial Sequence
  Description of Artificial Sequence: Synthetic polypeptide
DENEIRTTNPVSTEPYGTIRMEDIQQQVNGNH

SEQ ID NO: 170170 - protein, 32 aa, Artificial Sequence
  Description of Artificial Sequence: Synthetic polypeptide
AENEIRTTNPVATEQWGCVCSSPEANAFISDA

SEQ ID NO: 170171 - protein, 30 aa, Artificial Sequence
  Description of Artificial Sequence: Synthetic polypeptide
SEMEIACTNPCSYEQYGCVSWNHQSGSQQA

SEQ ID NO: 170172 - protein, 31 aa, Artificial Sequence
  Description of Artificial Sequence: Synthetic polypeptide
QENEIATTNPVAYEPYGNVSGEHLQHMIEGL

SEQ ID NO: 170173 - protein, 32 aa, Artificial Sequence
  Description of Artificial Sequence: Synthetic polypeptide
QENEIATTNPVAYEPYGNVSGEHLQHMNPKSH

SEQ ID NO: 170174 - protein, 31 aa, Artificial Sequence
  Description of Artificial Sequence: Synthetic polypeptide
QENEIATTNPVAYEPYGNVSGEHLQHMYTLS

SEQ ID NO: 170175 - protein, 35 aa, Artificial Sequence
  Description of Artificial Sequence: Synthetic polypeptide
DEDEIRTTNPVATEQWGTVVSTEQQGTNVATEDGS

SEQ ID NO: 170176 - protein, 36 aa, Artificial Sequence
  Description of Artificial Sequence: Synthetic polypeptide
DEEEIACTNPVATEQYGSVCAGTNGLADPPGDEHAM

SEQ ID NO: 170177 - protein, 36 aa, Artificial Sequence
  Description of Artificial Sequence: Synthetic polypeptide
DEEEIRTTNPVATEQYGAIMWDTINFIQQGGEGDIT

SEQ ID NO: 170178 - protein, 36 aa, Artificial Sequence
  Description of Artificial Sequence: Synthetic polypeptide
DEEEIACTNPVATEQYGSVCAGTGGLADRPGDEAAM

SEQ ID NO: 170179 - protein, 31 aa, Artificial Sequence
  Description of Artificial Sequence: Synthetic polypeptide
SEMEIACTNPCSYEQYGCVCSWNLQSIGSEQ

SEQ ID NO: 170180 - protein, 33 aa, Artificial Sequence
  Description of Artificial Sequence: Synthetic polypeptide
DENEIRTTNPVSTEPYGTISMEDAQQQQNGNHH

SEQ ID NO: 170181 - protein, 33 aa, Artificial Sequence
  Description of Artificial Sequence: Synthetic polypeptide
DENEIRTTNPVSTEPYGTISMEDAIQQQQNGNH

SEQ ID NO: 170182 - protein, 36 aa, Artificial Sequence
  Description of Artificial Sequence: Synthetic polypeptide
DEDEIRTTNPVATEQWGTVVSTLQQGTNVATEDGAV

SEQ ID NO: 170183 - protein, 34 aa, Artificial Sequence
  Description of Artificial Sequence: Synthetic polypeptide
DEEEIACTNPVATEQYGSVCAGTDPPTDDMNNDP

SEQ ID NO: 170184 - protein, 33 aa, Artificial Sequence
  Description of Artificial Sequence: Synthetic polypeptide
SEMEIACTNPCSYEQYGCVCSWNLQSFGSDNRS

SEQ ID NO: 170185 - protein, 36 aa, Artificial Sequence
  Description of Artificial Sequence: Synthetic polypeptide
DEEEIRTTNPVATEQYGSVPANVSNAPQFQEVELEV

SEQ ID NO: 170186 - protein, 36 aa, Artificial Sequence
  Description of Artificial Sequence: Synthetic polypeptide
DEEEIRTTNPVATEQYGSVPAPPLMEDVEMGPLEQG

SEQ ID NO: 170187 - protein, 32 aa, Artificial Sequence
  Description of Artificial Sequence: Synthetic polypeptide
DETEIRTTNPVSSEPYGTISMEDIQQQQNGNH

SEQ ID NO: 170188 - protein, 31 aa, Artificial Sequence
  Description of Artificial Sequence: Synthetic polypeptide
SEMEIACTNPCSYEQYGCVCSWNDLQSGSQQ

SEQ ID NO: 170189 - protein, 35 aa, Artificial Sequence
  Description of Artificial Sequence: Synthetic polypeptide
DEEEIACTNPVATEQYGSVCAAVNGLENDDLGAQA

SEQ ID NO: 170190 - protein, 34 aa, Artificial Sequence
  Description of Artificial Sequence: Synthetic polypeptide
CEDEIATTNPVAYEQYGSVAAIANNDTQDNPNNR

SEQ ID NO: 170191 - protein, 32 aa, Artificial Sequence
  Description of Artificial Sequence: Synthetic polypeptide
SEMEIACTNPCSYEQYGCVCSNWNLQSFGSDR

SEQ ID NO: 170192 - protein, 37 aa, Artificial Sequence
  Description of Artificial Sequence: Synthetic polypeptide
DEEEIATTNPVATEQYGSVSSTTPAGGPNMANGMEPV

SEQ ID NO: 170193 - protein, 35 aa, Artificial Sequence
  Description of Artificial Sequence: Synthetic polypeptide
DEDEIRTTNPVATEQWGTVTTNQQQATNVATEDGS

SEQ ID NO: 170194 - protein, 31 aa, Artificial Sequence
  Description of Artificial Sequence: Synthetic polypeptide
DDSEVASTNPVSTEGYGNVAANTILSRVGDR

SEQ ID NO: 170195 - protein, 33 aa, Artificial Sequence
  Description of Artificial Sequence: Synthetic polypeptide
DENEIRTTNPVSTEPYGTISMEDCIQQQQNGNH

SEQ ID NO: 170196 - protein, 33 aa, Artificial Sequence
  Description of Artificial Sequence: Synthetic polypeptide
DENEIRTTNPVSTEPYGTISMEDDIQQQCNGNH

SEQ ID NO: 170197 - protein, 35 aa, Artificial Sequence
  Description of Artificial Sequence: Synthetic polypeptide
DEEEIRTTNPVATEQYGAINSAVNDFDPNNMDEDG

SEQ ID NO: 170198 - protein, 36 aa, Artificial Sequence
  Description of Artificial Sequence: Synthetic polypeptide
DEDEIRTTNPVATEQWGTVSTNQQQATNVATEDGEE

SEQ ID NO: 170199 - protein, 38 aa, Artificial Sequence
  Description of Artificial Sequence: Synthetic polypeptide
DEEEIRTTNPVATEQYGAIMWESTINFIQVGNEGQIED

SEQ ID NO: 170200 - protein, 32 aa, Artificial Sequence
  Description of Artificial Sequence: Synthetic polypeptide
DECEINTTNPVSTEPYGTISMEDIQQQQNGNH

SEQ ID NO: 170201 - protein, 33 aa, Artificial Sequence
  Description of Artificial Sequence: Synthetic polypeptide
DENEIRTTNPVSTEPYGTISMEDCQQQQNGNHM

SEQ ID NO: 170202 - protein, 35 aa, Artificial Sequence
  Description of Artificial Sequence: Synthetic polypeptide
DEDEIRTTNPVATEQWGTVSTVNIGTTNAEEEDTD

SEQ ID NO: 170203 - protein, 36 aa, Artificial Sequence
  Description of Artificial Sequence: Synthetic polypeptide
DEDEIRTTNPVATEQWGTVSTVQQQGTNVATEDGTV

SEQ ID NO: 170204 - protein, 32 aa, Artificial Sequence
  Description of Artificial Sequence: Synthetic polypeptide
DDSEVASTNPVSTEGYGNVAANTILQSRVGQR

SEQ ID NO: 170205 - protein, 34 aa, Artificial Sequence
  Description of Artificial Sequence: Synthetic polypeptide
DEDEIRTTNPVATEQWGTVSTVTIGTNADEEATD

SEQ ID NO: 170206 - protein, 34 aa, Artificial Sequence
  Description of Artificial Sequence: Synthetic polypeptide
DEDEIRTTNPVATEQWGTVSTVTIGTNADEQDED

SEQ ID NO: 170207 - protein, 34 aa, Artificial Sequence
  Description of Artificial Sequence: Synthetic polypeptide
DEDEIRTTNPVATEQWGTVSTVTIGTNAEEDTDE

SEQ ID NO: 170208 - protein, 31 aa, Artificial Sequence
  Description of Artificial Sequence: Synthetic polypeptide
SEMEIACTNPCSYEQYGCVSWNLQESFGSQQ

SEQ ID NO: 170209 - protein, 31 aa, Artificial Sequence
  Description of Artificial Sequence: Synthetic polypeptide
QENEIATTNPVAYEPYGNVSGEHLQHMDMSL

SEQ ID NO: 170210 - protein, 34 aa, Artificial Sequence
  Description of Artificial Sequence: Synthetic polypeptide
DEDEIRTTNPVATEQWGTVSTVTIGTTNAEENDD

SEQ ID NO: 170211 - protein, 34 aa, Artificial Sequence
  Description of Artificial Sequence: Synthetic polypeptide
DEDEIRTTNPVATEQWGTVSTVTIGTTNATEDTD

SEQ ID NO: 170212 - protein, 33 aa, Artificial Sequence
  Description of Artificial Sequence: Synthetic polypeptide
DENEIRTTNPVSTEPYGTISMEDCQQQQNGNFH

SEQ ID NO: 170213 - protein, 34 aa, Artificial Sequence
  Description of Artificial Sequence: Synthetic polypeptide
DEDEIRTTNPVATEQWGTVSTVVIGTNAEENDED

SEQ ID NO: 170214 - protein, 34 aa, Artificial Sequence
  Description of Artificial Sequence: Synthetic polypeptide
DEDEIRTTNPVATEQWGTVSTVVIGTNATEEDTD

SEQ ID NO: 170215 - protein, 35 aa, Artificial Sequence
  Description of Artificial Sequence: Synthetic polypeptide
DEDEIRTTNPVATEQWGTVSTVVIGTTNATEDNDD

SEQ ID NO: 170216 - protein, 34 aa, Artificial Sequence
  Description of Artificial Sequence: Synthetic polypeptide
DEDEIRTTNPVATEQWGTVSTVVIGTTNATEEQD

SEQ ID NO: 170217 - protein, 33 aa, Artificial Sequence
  Description of Artificial Sequence: Synthetic polypeptide
DENEIRTTNPVSTEPYGTISMEDCQQPQSGLNH

SEQ ID NO: 170218 - protein, 32 aa, Artificial Sequence
  Description of Artificial Sequence: Synthetic polypeptide
QENEIATTNPVAYEPYGNVSGEHLQHMGMQLN

SEQ ID NO: 170219 - protein, 38 aa, Artificial Sequence
  Description of Artificial Sequence: Synthetic polypeptide
DEEEIRTTNPVATEQYGSNVQPITPMNMPLDQNEEQLN

SEQ ID NO: 170220 - protein, 38 aa, Artificial Sequence
  Description of Artificial Sequence: Synthetic polypeptide
DEEEIRTTNPVATEQYGSNVQPITPMMPLQDQNEEQVT

SEQ ID NO: 170221 - protein, 32 aa, Artificial Sequence
  Description of Artificial Sequence: Synthetic polypeptide
DENEIRTTNPVSTEPYGTISMECIQQQQNENH

SEQ ID NO: 170222 - protein, 39 aa, Artificial Sequence
  Description of Artificial Sequence: Synthetic polypeptide
DEEEIRTTNPVATEQYGVVSTVTNNNQQSATEEGVVSNQ

SEQ ID NO: 170223 - protein, 33 aa, Artificial Sequence
  Description of Artificial Sequence: Synthetic polypeptide
CEDEIATTNPVAYEQYGSVAIANNDTQDNNNQH

SEQ ID NO: 170224 - protein, 36 aa, Artificial Sequence
  Description of Artificial Sequence: Synthetic polypeptide
DEEEIRTTNPVATEQYGCVCSWEEHNQEFFNSDNQS

SEQ ID NO: 170225 - protein, 36 aa, Artificial Sequence
  Description of Artificial Sequence: Synthetic polypeptide
DEEEIRTTNPVATEQYGCVCSWEEHNQEHFNSDTQS

SEQ ID NO: 170226 - protein, 36 aa, Artificial Sequence
  Description of Artificial Sequence: Synthetic polypeptide
DEEEIRTTNPVATEQYGCVCSWEEHNQENFGSDFQV

SEQ ID NO: 170227 - protein, 36 aa, Artificial Sequence
  Description of Artificial Sequence: Synthetic polypeptide
DENCIRTTNPVATEQWGSTVNTGNMESIYNGGNNRN

SEQ ID NO: 170228 - protein, 35 aa, Artificial Sequence
  Description of Artificial Sequence: Synthetic polypeptide
DEEEIRTTNPVATEQYGCVCSWEEHNQENFISDQP

SEQ ID NO: 170229 - protein, 36 aa, Artificial Sequence
  Description of Artificial Sequence: Synthetic polypeptide
DEEEIRTTNPVATEQYGCVCSWEEHNQENFNSDNQN

SEQ ID NO: 170230 - protein, 36 aa, Artificial Sequence
  Description of Artificial Sequence: Synthetic polypeptide
DEEEIRTTNPVATEQYGCVCSWEEHNQENFNSDPQA

SEQ ID NO: 170231 - protein, 36 aa, Artificial Sequence
  Description of Artificial Sequence: Synthetic polypeptide
DEEEIRTTNPVATEQYGCVCSWEEHNQENFNSETQS

SEQ ID NO: 170232 - protein, 37 aa, Artificial Sequence
  Description of Artificial Sequence: Synthetic polypeptide
DEEEIRTTNPVATEQYGSNVQPITLMMPNDQNNTQVT

SEQ ID NO: 170233 - protein, 39 aa, Artificial Sequence
  Description of Artificial Sequence: Synthetic polypeptide
DEEEIRTTNPVATEQYGVVSTVVTNLQLEQQGTTTEESE

SEQ ID NO: 170234 - protein, 33 aa, Artificial Sequence
  Description of Artificial Sequence: Synthetic polypeptide
DETEIVTTNPIATEQWGTVCSATDGPVEFKGND

SEQ ID NO: 170235 - protein, 33 aa, Artificial Sequence
  Description of Artificial Sequence: Synthetic polypeptide
DETEIVTTNPIATEQWGTVCSATDGPVEFKGNI

SEQ ID NO: 170236 - protein, 33 aa, Artificial Sequence
  Description of Artificial Sequence: Synthetic polypeptide
DETEIVTTNPIATEQYGTTCSATDDPVAFKGND

SEQ ID NO: 170237 - protein, 38 aa, Artificial Sequence
  Description of Artificial Sequence: Synthetic polypeptide
DEEEIRTTNPVATEQYGVVSTTTNNQAGTEQGSTEDDE

SEQ ID NO: 170238 - protein, 32 aa, Artificial Sequence
  Description of Artificial Sequence: Synthetic polypeptide
DENCIRTTNPVSTEPYGTISMEDIQQQQNGNH

SEQ ID NO: 170239 - protein, 32 aa, Artificial Sequence
  Description of Artificial Sequence: Synthetic polypeptide
DEGVIATVNPVAYEPYGSVSNAGNLEMNMNNN

SEQ ID NO: 170240 - protein, 33 aa, Artificial Sequence
  Description of Artificial Sequence: Synthetic polypeptide
DEGVIATVNPVAYEPYGSVSNAGNLEMNGNANL

SEQ ID NO: 170241 - protein, 34 aa, Artificial Sequence
  Description of Artificial Sequence: Synthetic polypeptide
DETEIVTTNPVATECYGTTVCSATDGPVEFEGND

SEQ ID NO: 170242 - protein, 33 aa, Artificial Sequence
  Description of Artificial Sequence: Synthetic polypeptide
DENEIRTTNPVSTEPYGTISMEAIQQQQNGMNH

SEQ ID NO: 170243 - protein, 31 aa, Artificial Sequence
  Description of Artificial Sequence: Synthetic polypeptide
DDSEVASTNPVSTEGYGNVAANTILSRVGQR

SEQ ID NO: 170244 - protein, 36 aa, Artificial Sequence
  Description of Artificial Sequence: Synthetic polypeptide
DEEEIRTTNPVATEQYGACTATSPGLQQEVGETEES

SEQ ID NO: 170245 - protein, 33 aa, Artificial Sequence
  Description of Artificial Sequence: Synthetic polypeptide
DETEIVTTNPVATEQYGATCSATDDPEFEGPYD

SEQ ID NO: 170246 - protein, 33 aa, Artificial Sequence
  Description of Artificial Sequence: Synthetic polypeptide
NETEIATTNPVAYEQWGCTSTGNMQGNHGEGNA

SEQ ID NO: 170247 - protein, 33 aa, Artificial Sequence
  Description of Artificial Sequence: Synthetic polypeptide
DENEIRTTNPVSTEPYGTISMEDDIQQQQNGNH

SEQ ID NO: 170248 - protein, 32 aa, Artificial Sequence
  Description of Artificial Sequence: Synthetic polypeptide
NETEIATTNPVAYEQWGCVYSMDMQMNGGAPR

SEQ ID NO: 170249 - protein, 34 aa, Artificial Sequence
  Description of Artificial Sequence: Synthetic polypeptide
NETEIATTNPVAYEQWGSVCSTDNNDHHIGNNDP

SEQ ID NO: 170250 - protein, 37 aa, Artificial Sequence
  Description of Artificial Sequence: Synthetic polypeptide
DEEEIRTTNPVATEQYGSVGGYLMNGEEQMIMNAEEV

SEQ ID NO: 170251 - protein, 32 aa, Artificial Sequence
  Description of Artificial Sequence: Synthetic polypeptide
CEDEIATTNPVAYEQYGSVAANNTDNDNATAH

SEQ ID NO: 170252 - protein, 37 aa, Artificial Sequence
  Description of Artificial Sequence: Synthetic polypeptide
DEEEIRTTNPVATEQYGAIMWDSTINFIQEGGEGQQT

SEQ ID NO: 170253 - protein, 33 aa, Artificial Sequence
  Description of Artificial Sequence: Synthetic polypeptide
DETEIRTTNPVSTEPYGTTISMEDIQQQQNGNI

SEQ ID NO: 170254 - protein, 32 aa, Artificial Sequence
  Description of Artificial Sequence: Synthetic polypeptide
DENEIRTTNPVSTEPYGTISMEAIQQQQNHNH

SEQ ID NO: 170255 - protein, 32 aa, Artificial Sequence
  Description of Artificial Sequence: Synthetic polypeptide
DENCIRTTNPVATEQWGDTVSEIEMNAAEADA

SEQ ID NO: 170256 - protein, 37 aa, Artificial Sequence
  Description of Artificial Sequence: Synthetic polypeptide
DEEEIRTTNPVATEQYGSNVQPITPMMPLDQNNTQDT

SEQ ID NO: 170257 - protein, 35 aa, Artificial Sequence
  Description of Artificial Sequence: Synthetic polypeptide
DEHEIRTTNPVAYEEWGSVATGMMGGDQGQGGNNR

SEQ ID NO: 170258 - protein, 39 aa, Artificial Sequence
  Description of Artificial Sequence: Synthetic polypeptide
DEEEIRTTNPVATEQYGVVSTVTNNNQQSATEEGVVNQD

SEQ ID NO: 170259 - protein, 34 aa, Artificial Sequence
  Description of Artificial Sequence: Synthetic polypeptide
CEDEIATTNPVAYEQYGSVAIANNDTQDNGNNSF

SEQ ID NO: 170260 - protein, 36 aa, Artificial Sequence
  Description of Artificial Sequence: Synthetic polypeptide
DEDEIRTTNPVATEQWGTVVTNQQRTTNVATEDGSD

SEQ ID NO: 170261 - protein, 37 aa, Artificial Sequence
  Description of Artificial Sequence: Synthetic polypeptide
DEEEIRTTNPVATEQYGCVCSWEEDHNQEGFNSDNQP

SEQ ID NO: 170262 - protein, 36 aa, Artificial Sequence
  Description of Artificial Sequence: Synthetic polypeptide
QEEEIRTCNPVATEAYGSVSVGGQRGLQGINGQGEI

SEQ ID NO: 170263 - protein, 35 aa, Artificial Sequence
  Description of Artificial Sequence: Synthetic polypeptide
DEEEIACTNPVATEQYGSVCAATHLEGRSLAEDAH

SEQ ID NO: 170264 - protein, 31 aa, Artificial Sequence
  Description of Artificial Sequence: Synthetic polypeptide
DENCIRTTNPVATEQWGDVSEMIEMNAAEDA

SEQ ID NO: 170265 - protein, 33 aa, Artificial Sequence
  Description of Artificial Sequence: Synthetic polypeptide
NETEIATTNPVAYEQWGSVSGNPNGDTDGNNEV

SEQ ID NO: 170266 - protein, 37 aa, Artificial Sequence
  Description of Artificial Sequence: Synthetic polypeptide
DEEEIRTTNPVATEQYGCVCSWEEDHNTENFPSENQS

SEQ ID NO: 170267 - protein, 35 aa, Artificial Sequence
  Description of Artificial Sequence: Synthetic polypeptide
QEEEIRTTNCVATEFYGSVDLEVNGQNEGQGNEQE

SEQ ID NO: 170268 - protein, 32 aa, Artificial Sequence
  Description of Artificial Sequence: Synthetic polypeptide
SEGEIRTTNPVSTEPYGTISMEDIQQQQNGNH

SEQ ID NO: 170269 - protein, 36 aa, Artificial Sequence
  Description of Artificial Sequence: Synthetic polypeptide
DEEEIRTTNPVATEQYGCVCSWEEHFQENFNSETQA

SEQ ID NO: 170270 - protein, 35 aa, Artificial Sequence
  Description of Artificial Sequence: Synthetic polypeptide
DEEEIRTTNPVATEQYGCVCSWEEHIEFFGSETQS

SEQ ID NO: 170271 - protein, 35 aa, Artificial Sequence
  Description of Artificial Sequence: Synthetic polypeptide
DEEEIRTTNPVATEQYGCVCSWEEHIENFNSDTQI

SEQ ID NO: 170272 - protein, 33 aa, Artificial Sequence
  Description of Artificial Sequence: Synthetic polypeptide
DENEIRTTNPVSTEPYGTISMEAIQQQQNGNHD

SEQ ID NO: 170273 - protein, 36 aa, Artificial Sequence
  Description of Artificial Sequence: Synthetic polypeptide
DEEEIRTTNPVATEQYGCVCSWEEHNAENFNSETQA

SEQ ID NO: 170274 - protein, 32 aa, Artificial Sequence
  Description of Artificial Sequence: Synthetic polypeptide
QENEIATTNPVAYEPYGNVPSGEHLQHMNYTL

SEQ ID NO: 170275 - protein, 35 aa, Artificial Sequence
  Description of Artificial Sequence: Synthetic polypeptide
DEDEIRTTNPVATEQWGTVSTLQQEATNVATEDGA

SEQ ID NO: 170276 - protein, 35 aa, Artificial Sequence
  Description of Artificial Sequence: Synthetic polypeptide
AENEIRTTNPVATEQYGSVCSVTWPLEDTTFVHEM

SEQ ID NO: 170277 - protein, 33 aa, Artificial Sequence
  Description of Artificial Sequence: Synthetic polypeptide
DENEIRTTNPVSTEPYGTISMEDIPQQQNGNHH

SEQ ID NO: 170278 - protein, 32 aa, Artificial Sequence
  Description of Artificial Sequence: Synthetic polypeptide
DENEIRTTNPVSTEPYGTISMEDIMQQQTGEH

SEQ ID NO: 170279 - protein, 33 aa, Artificial Sequence
  Description of Artificial Sequence: Synthetic polypeptide
DENEIRTTNPVSTEPYGTISMEDIMQQQNGWNH

SEQ ID NO: 170280 - protein, 33 aa, Artificial Sequence
  Description of Artificial Sequence: Synthetic polypeptide
DENEIRTTNPVSTEPYGTISMEDIMQQQNGNHN

SEQ ID NO: 170281 - protein, 37 aa, Artificial Sequence
  Description of Artificial Sequence: Synthetic polypeptide
DETEIRTTNPVAYEQWGSVCSTENLGDQDIHDNGGQN

SEQ ID NO: 170282 - protein, 32 aa, Artificial Sequence
  Description of Artificial Sequence: Synthetic polypeptide
DANEIRTTNPVSTEPYGTISMEDIQQQQNGNH

SEQ ID NO: 170283 - protein, 37 aa, Artificial Sequence
  Description of Artificial Sequence: Synthetic polypeptide
DETEIRTTNPVAYEQWGSVCSTENLGDQDIQNQGGQK

SEQ ID NO: 170284 - protein, 32 aa, Artificial Sequence
  Description of Artificial Sequence: Synthetic polypeptide
DANEIRTTNPVSTEPYGTISMEDIQQAQNGNH

SEQ ID NO: 170285 - protein, 31 aa, Artificial Sequence
  Description of Artificial Sequence: Synthetic polypeptide
QEGEIAPTNPVSSECYGIVSCNEQDSEGETR

SEQ ID NO: 170286 - protein, 37 aa, Artificial Sequence
  Description of Artificial Sequence: Synthetic polypeptide
DEEEIRTTNPVATEQYGSVGMPLMNGEEEMIMNAEEL

SEQ ID NO: 170287 - protein, 33 aa, Artificial Sequence
  Description of Artificial Sequence: Synthetic polypeptide
DENEIRTTNPVSTEPYGTISMEDIIQQQQNGNV

SEQ ID NO: 170288 - protein, 31 aa, Artificial Sequence
  Description of Artificial Sequence: Synthetic polypeptide
DEHCISTTNPVAYEQWGCFSWDNDDHGKGNK

SEQ ID NO: 170289 - protein, 33 aa, Artificial Sequence
  Description of Artificial Sequence: Synthetic polypeptide
DENEIRTTNPVSTEPYGTISMEDIIQQQQNGNH

SEQ ID NO: 170290 - protein, 39 aa, Artificial Sequence
  Description of Artificial Sequence: Synthetic polypeptide
DEEEIRTTNPVATEQYGVVSTTTNEQQGNQQGTTTNVAE

SEQ ID NO: 170291 - protein, 33 aa, Artificial Sequence
  Description of Artificial Sequence: Synthetic polypeptide
DEQEIATTNPVAYEQWGCVAANTNLATPANNPM

SEQ ID NO: 170292 - protein, 33 aa, Artificial Sequence
  Description of Artificial Sequence: Synthetic polypeptide
DENEIRTTNPVSTEPYGTISMEDIHQQQNGNHV

SEQ ID NO: 170293 - protein, 33 aa, Artificial Sequence
  Description of Artificial Sequence: Synthetic polypeptide
DENEIRTTNPVSTEPYGTISMEDIGQQQNGNNH

SEQ ID NO: 170294 - protein, 35 aa, Artificial Sequence
  Description of Artificial Sequence: Synthetic polypeptide
DETEIRTTNPVAYEQWGSVCYMQNDDLDRGGGGIM

SEQ ID NO: 170295 - protein, 33 aa, Artificial Sequence
  Description of Artificial Sequence: Synthetic polypeptide
DENEIRTTNPVSTEPYGTISMEDIGQQQNGNHV

SEQ ID NO: 170296 - protein, 34 aa, Artificial Sequence
  Description of Artificial Sequence: Synthetic polypeptide
DEEEIACTNPVATEQYGSVCAMTHDPTDSEENNQ

SEQ ID NO: 170297 - protein, 36 aa, Artificial Sequence
  Description of Artificial Sequence: Synthetic polypeptide
DEEEIACTNPVATEQYGSVCAMNNNGLPTGDVPNPQ

SEQ ID NO: 170298 - protein, 33 aa, Artificial Sequence
  Description of Artificial Sequence: Synthetic polypeptide
DENEIRTTNPVSTEPYGTISMEDICQQQNGNHN

SEQ ID NO: 170299 - protein, 35 aa, Artificial Sequence
  Description of Artificial Sequence: Synthetic polypeptide
DEDEIRTTNPVATEQWGSVTSAAANPQATTPPDDE

SEQ ID NO: 170300 - protein, 32 aa, Artificial Sequence
  Description of Artificial Sequence: Synthetic polypeptide
DENEIRTTNPVSTEPYGTISMEDIPQQQNGSH

SEQ ID NO: 170301 - protein, 32 aa, Artificial Sequence
  Description of Artificial Sequence: Synthetic polypeptide
QENEIATTNPVAYECYGKVSEVSLSQQEVGEL

SEQ ID NO: 170302 - protein, 32 aa, Artificial Sequence
  Description of Artificial Sequence: Synthetic polypeptide
DENEIRTTNPVSTEPYGTISMEDIQAQQNGHH

SEQ ID NO: 170303 - protein, 33 aa, Artificial Sequence
  Description of Artificial Sequence: Synthetic polypeptide
DENEIRTTNPVSTEPYGTISMEDIQCQQNGNCH

SEQ ID NO: 170304 - protein, 35 aa, Artificial Sequence
  Description of Artificial Sequence: Synthetic polypeptide
DEEEIRTTNPLAYEPYGTVPSYCVNEDERTGTNND

SEQ ID NO: 170305 - protein, 33 aa, Artificial Sequence
  Description of Artificial Sequence: Synthetic polypeptide
SEMEIVTTNPVATEQYGTVCSACDGPVEFEGND

SEQ ID NO: 170306 - protein, 35 aa, Artificial Sequence
  Description of Artificial Sequence: Synthetic polypeptide
SEMEIVTTNPVATEQYGCVCSNTGEPNAFFGSNQS

SEQ ID NO: 170307 - protein, 32 aa, Artificial Sequence
  Description of Artificial Sequence: Synthetic polypeptide
DENEIRTTNPVSTEPYGTISMEDIQMQQNENH

SEQ ID NO: 170308 - protein, 38 aa, Artificial Sequence
  Description of Artificial Sequence: Synthetic polypeptide
DEEEIRTTNPVATEQYGVVSTVTNNNTEQGNNTTQDTD

SEQ ID NO: 170309 - protein, 34 aa, Artificial Sequence
  Description of Artificial Sequence: Synthetic polypeptide
DEQEIATTNPVAYEPWGSVYCTDNQGEQMGNNGS

SEQ ID NO: 170310 - protein, 36 aa, Artificial Sequence
  Description of Artificial Sequence: Synthetic polypeptide
DEEEIRTTNPVATEQYGCVCSVSGEHNIENFISDQS

SEQ ID NO: 170311 - protein, 33 aa, Artificial Sequence
  Description of Artificial Sequence: Synthetic polypeptide
SEMEIVTTNPIATEQYGTVCSATDGPVEFEGND

SEQ ID NO: 170312 - protein, 34 aa, Artificial Sequence
  Description of Artificial Sequence: Synthetic polypeptide
DESEIRTTNPVATECWGATVAAINWQEPKGENYG

SEQ ID NO: 170313 - protein, 32 aa, Artificial Sequence
  Description of Artificial Sequence: Synthetic polypeptide
DEHCISTTNPVAYEQWGSVFQHEDLRLQGNTY

SEQ ID NO: 170314 - protein, 35 aa, Artificial Sequence
  Description of Artificial Sequence: Synthetic polypeptide
DEEEIACTNPVATEQYGSVCATHLEAPDDLANMAV

SEQ ID NO: 170315 - protein, 32 aa, Artificial Sequence
  Description of Artificial Sequence: Synthetic polypeptide
DEHCISTTNPVAYEQWGCFSWNNLEDHDKGNK

SEQ ID NO: 170316 - protein, 35 aa, Artificial Sequence
  Description of Artificial Sequence: Synthetic polypeptide
DEEEIACTNPVATEQYGSVCAPNNLENDDDLGAQM

SEQ ID NO: 170317 - protein, 33 aa, Artificial Sequence
  Description of Artificial Sequence: Synthetic polypeptide
DENEIRTTNPVSTEPYGTISMEDIQIQQNGNHA

SEQ ID NO: 170318 - protein, 32 aa, Artificial Sequence
  Description of Artificial Sequence: Synthetic polypeptide
DENEIRTTNPVSTEPYGTISMEDIQHQQNKNH

SEQ ID NO: 170319 - protein, 31 aa, Artificial Sequence
  Description of Artificial Sequence: Synthetic polypeptide
QENEIATTNPVAYECYGKVSCESELSQHEEL

SEQ ID NO: 170320 - protein, 32 aa, Artificial Sequence
  Description of Artificial Sequence: Synthetic polypeptide
DEHCISTTNPVAYEQWGCFSWDNLGDFDKGND

SEQ ID NO: 170321 - protein, 38 aa, Artificial Sequence
  Description of Artificial Sequence: Synthetic polypeptide
DEEEIRTTNPVATEAYGVVSTVVNTNNQAGNINDEQED

SEQ ID NO: 170322 - protein, 38 aa, Artificial Sequence
  Description of Artificial Sequence: Synthetic polypeptide
DEEEIRTTNPVATEAYGVVSTVVNTNQQAGNGNDEQND

SEQ ID NO: 170323 - protein, 32 aa, Artificial Sequence
  Description of Artificial Sequence: Synthetic polypeptide
DENEIRTTNPVSTEPYGTISMEDIQFQQNGKH

SEQ ID NO: 170324 - protein, 33 aa, Artificial Sequence
  Description of Artificial Sequence: Synthetic polypeptide
DENEIRTTNPVSTEPYGTISMEDIQFQQNGGNH

SEQ ID NO: 170325 - protein, 35 aa, Artificial Sequence
  Description of Artificial Sequence: Synthetic polypeptide
DEEEIATTNPVATEQYGSVANPGNGPADSGEGGQD

SEQ ID NO: 170326 - protein, 34 aa, Artificial Sequence
  Description of Artificial Sequence: Synthetic polypeptide
DEDEIRTTNPVATEQWGGCCAAANHQEAEGDPMR

SEQ ID NO: 170327 - protein, 33 aa, Artificial Sequence
  Description of Artificial Sequence: Synthetic polypeptide
DENEIRTTNPVSTEPYGTISMEDIQCQQNGLNH

SEQ ID NO: 170328 - protein, 33 aa, Artificial Sequence
  Description of Artificial Sequence: Synthetic polypeptide
DETEIVTTNPVATEQYGAVCAATDGPVEFKGPD

SEQ ID NO: 170329 - protein, 38 aa, Artificial Sequence
  Description of Artificial Sequence: Synthetic polypeptide
DEEEIRTTNPVATEQYGVVSTTTNNNQQGTEAGTEESD

SEQ ID NO: 170330 - protein, 36 aa, Artificial Sequence
  Description of Artificial Sequence: Synthetic polypeptide
DEDEIRTTNPVATEQWGTVATNQQRTTNVATEDGVQ

SEQ ID NO: 170331 - protein, 33 aa, Artificial Sequence
  Description of Artificial Sequence: Synthetic polypeptide
DENEIRTTNPVSTEPYGTISMEDFIQIQQNGNH

SEQ ID NO: 170332 - protein, 32 aa, Artificial Sequence
  Description of Artificial Sequence: Synthetic polypeptide
AENEIRTTNPVSTEFYGTISMEDIQQQQNGNH

SEQ ID NO: 170333 - protein, 34 aa, Artificial Sequence
  Description of Artificial Sequence: Synthetic polypeptide
SEMEIRTTNPVATEQYGSCYPCNIEQQGTEDVEL

SEQ ID NO: 170334 - protein, 32 aa, Artificial Sequence
  Description of Artificial Sequence: Synthetic polypeptide
QENEIATTNPVAYEPYGNTVSGEHLQHMNMKN

SEQ ID NO: 170335 - protein, 36 aa, Artificial Sequence
  Description of Artificial Sequence: Synthetic polypeptide
DEEEIRTTNPVATEQYGSVNVNINNLEHLVTEEVEY

SEQ ID NO: 170336 - protein, 33 aa, Artificial Sequence
  Description of Artificial Sequence: Synthetic polypeptide
DENEIRTTNPVSTEPYGTISMEDEQQQQNGENH

SEQ ID NO: 170337 - protein, 32 aa, Artificial Sequence
  Description of Artificial Sequence: Synthetic polypeptide
DENEIRTTNPVSTEPYGTISMEDEQQQQNENH

SEQ ID NO: 170338 - protein, 35 aa, Artificial Sequence
  Description of Artificial Sequence: Synthetic polypeptide
DEDEIRTTNPVATEQWGTVSTEQQGTNVATEDGTT

SEQ ID NO: 170339 - protein, 35 aa, Artificial Sequence
  Description of Artificial Sequence: Synthetic polypeptide
DEDEIRTTNPVATEQWGTVSTEQQGTNVATEEGEE

SEQ ID NO: 170340 - protein, 36 aa, Artificial Sequence
  Description of Artificial Sequence: Synthetic polypeptide
QEEEIRSTNPVATEQYGSVYNDNDNNFQGEDGNDEG

SEQ ID NO: 170341 - protein, 33 aa, Artificial Sequence
  Description of Artificial Sequence: Synthetic polypeptide
DETEIRTTNPVAYEQWGVVTGGNMGNDRGGDGD

SEQ ID NO: 170342 - protein, 35 aa, Artificial Sequence
  Description of Artificial Sequence: Synthetic polypeptide
DETEIRTTNPVAYEQWGVVVHTDNHNQPQGQGPDR

SEQ ID NO: 170343 - protein, 33 aa, Artificial Sequence
  Description of Artificial Sequence: Synthetic polypeptide
DENEIRTTNPVSTEPYGTISMEDEIQQQQNGNH

SEQ ID NO: 170344 - protein, 34 aa, Artificial Sequence
  Description of Artificial Sequence: Synthetic polypeptide
DETEIRTTNPVAYEQWGVVVHTDNHNQQDGSSPQ

SEQ ID NO: 170345 - protein, 34 aa, Artificial Sequence
  Description of Artificial Sequence: Synthetic polypeptide
DETEIRTTNPVAYEQWGVVVHTDNHNQQDHGSSG

SEQ ID NO: 170346 - protein, 34 aa, Artificial Sequence
  Description of Artificial Sequence: Synthetic polypeptide
DETEIRTTNPVAYEQWGVVVHTDNHNQQDKGDSQ

SEQ ID NO: 170347 - protein, 36 aa, Artificial Sequence
  Description of Artificial Sequence: Synthetic polypeptide
DEEEIRTTNPVATEQYGAIREAPTNVVQIEDEDNGQ

SEQ ID NO: 170348 - protein, 36 aa, Artificial Sequence
  Description of Artificial Sequence: Synthetic polypeptide
DEEEIRTTNPVATEQYGAINSTVNYDFDPNNEDEDG

SEQ ID NO: 170349 - protein, 35 aa, Artificial Sequence
  Description of Artificial Sequence: Synthetic polypeptide
DEDEIRTTNPVATEQWGTVSTEQQQATNVATEDGN

SEQ ID NO: 170350 - protein, 35 aa, Artificial Sequence
  Description of Artificial Sequence: Synthetic polypeptide
AENEIRTTNPVATEQYGSVSVLWDNTMMENDIEIN

SEQ ID NO: 170351 - protein, 36 aa, Artificial Sequence
  Description of Artificial Sequence: Synthetic polypeptide
DEEEIACTNPVATEQYGSVCAMNNGELNANPGEHNL

SEQ ID NO: 170352 - protein, 35 aa, Artificial Sequence
  Description of Artificial Sequence: Synthetic polypeptide
DEDEIRTTNPVATEQWGTVSTLNQSATNVATEDGS

SEQ ID NO: 170353 - protein, 36 aa, Artificial Sequence
  Description of Artificial Sequence: Synthetic polypeptide
DEEEIRTTNPVATEQYGCVCSWEDHNQENFNSDTQS

SEQ ID NO: 170354 - protein, 31 aa, Artificial Sequence
  Description of Artificial Sequence: Synthetic polypeptide
QENEIATTNPVAYEPYGNTVSGEHLQHMDEL

SEQ ID NO: 170355 - protein, 36 aa, Artificial Sequence
  Description of Artificial Sequence: Synthetic polypeptide
DEDEIRTTNPVATEQWGTVATNQQNGTNVATEDGAF

SEQ ID NO: 170356 - protein, 33 aa, Artificial Sequence
  Description of Artificial Sequence: Synthetic polypeptide
DENEIRTTNPVSTEPYGTISMEDFIQQQQNGNH

SEQ ID NO: 170357 - protein, 35 aa, Artificial Sequence
  Description of Artificial Sequence: Synthetic polypeptide
DEDEIRTTNPVATEQWGTVSTEQIGTNVATEDGAD

SEQ ID NO: 170358 - protein, 36 aa, Artificial Sequence
  Description of Artificial Sequence: Synthetic polypeptide
DEEEIRTTNPVATEQYGAMTGTDQGIQGGNQGNGGI

SEQ ID NO: 170359 - protein, 35 aa, Artificial Sequence
  Description of Artificial Sequence: Synthetic polypeptide
DEDEIRTTNPVATEQWGTVSTAQQGTNVATEDGEQ

SEQ ID NO: 170360 - protein, 37 aa, Artificial Sequence
  Description of Artificial Sequence: Synthetic polypeptide
DEEEIRTTNPVATEAYGVVSTVVSNNQNQQGTDEETD

SEQ ID NO: 170361 - protein, 32 aa, Artificial Sequence
  Description of Artificial Sequence: Synthetic polypeptide
AENEIRTTNPVSTEPYGTISNEDIQQQQNGNH

SEQ ID NO: 170362 - protein, 33 aa, Artificial Sequence
  Description of Artificial Sequence: Synthetic polypeptide
DEHCISTTNPVAYEQWGCFSPDNNQDFDKGDNR

SEQ ID NO: 170363 - protein, 35 aa, Artificial Sequence
  Description of Artificial Sequence: Synthetic polypeptide
DEDEIRTTNPVATEQWGTVSTDQQGATNVATEDGS

SEQ ID NO: 170364 - protein, 39 aa, Artificial Sequence
  Description of Artificial Sequence: Synthetic polypeptide
DEEEIRTTNPVATEQYGVVSTVVTNLQGNQQGTTDEESE

SEQ ID NO: 170365 - protein, 34 aa, Artificial Sequence
  Description of Artificial Sequence: Synthetic polypeptide
DEDEIRTTNPVATEQWGTVSTEAIGTNNATEDGS

SEQ ID NO: 170366 - protein, 32 aa, Artificial Sequence
  Description of Artificial Sequence: Synthetic polypeptide
AENEIRTTNPVSTEPYGTISMEDIQQQQNGNH

SEQ ID NO: 170367 - protein, 36 aa, Artificial Sequence
  Description of Artificial Sequence: Synthetic polypeptide
DEEEIRTTNPVATEQYGSVNVAIEEEIENTEEANDM

SEQ ID NO: 170368 - protein, 35 aa, Artificial Sequence
  Description of Artificial Sequence: Synthetic polypeptide
DAEEIATTNPVATEQYGSVCAATAGLAAPAENGHM

SEQ ID NO: 170369 - protein, 32 aa, Artificial Sequence
  Description of Artificial Sequence: Synthetic polypeptide
AENEIRTTNPVSTEPYGTISMEDFQQQQNGNH

SEQ ID NO: 170370 - protein, 33 aa, Artificial Sequence
  Description of Artificial Sequence: Synthetic polypeptide
DENEIRTTNPVSTEPYGTISMEDHIQQQQNGNH

SEQ ID NO: 170371 - protein, 34 aa, Artificial Sequence
  Description of Artificial Sequence: Synthetic polypeptide
DEDEIRTTNPVATEQWGTVSTEAIGTNVATEEGA

SEQ ID NO: 170372 - protein, 33 aa, Artificial Sequence
  Description of Artificial Sequence: Synthetic polypeptide
DENEIRTTNPVSTEPYGTISMEDHIGQQQNGNH

SEQ ID NO: 170373 - protein, 33 aa, Artificial Sequence
  Description of Artificial Sequence: Synthetic polypeptide
DENEIRTTNPVSTEPYGTISMEDGQQQQNGCNH

SEQ ID NO: 170374 - protein, 31 aa, Artificial Sequence
  Description of Artificial Sequence: Synthetic polypeptide
AENEIRTTNPVSTEPYGTASMEDIQQQNGGH

SEQ ID NO: 170375 - protein, 33 aa, Artificial Sequence
  Description of Artificial Sequence: Synthetic polypeptide
DENEIRTTNPVSTEPYGTISMEDGIQQQQNGNH

SEQ ID NO: 170376 - protein, 36 aa, Artificial Sequence
  Description of Artificial Sequence: Synthetic polypeptide
DEEEIRTTNPVATEQYGSVNVGIEEQIENTEEDNDI

SEQ ID NO: 170377 - protein, 36 aa, Artificial Sequence
  Description of Artificial Sequence: Synthetic polypeptide
DEDEIRTTNPVATEQWGTVSTELQVATNVATEDGSM

SEQ ID NO: 170378 - protein, 36 aa, Artificial Sequence
  Description of Artificial Sequence: Synthetic polypeptide
DEDEIRTTNPVATEQWGTVSTENQNGTNVATEDGAE

SEQ ID NO: 170379 - protein, 34 aa, Artificial Sequence
  Description of Artificial Sequence: Synthetic polypeptide
DEDEIRTTNPVATEQWGTVSTEQAATNVATEDGA

SEQ ID NO: 170380 - protein, 35 aa, Artificial Sequence
  Description of Artificial Sequence: Synthetic polypeptide
DEDEIRTTNPVATEQWGTVSTEQAGTNVATEDGSG

SEQ ID NO: 170381 - protein, 32 aa, Artificial Sequence
  Description of Artificial Sequence: Synthetic polypeptide
QENEIATTNPVAYEPYGNTVSGEHLQHGMMQK

SEQ ID NO: 170382 - protein, 32 aa, Artificial Sequence
  Description of Artificial Sequence: Synthetic polypeptide
DENEIRTTNPVSTEPYGTIRMEDIQQQQNGNH

SEQ ID NO: 170383 - protein, 34 aa, Artificial Sequence
  Description of Artificial Sequence: Synthetic polypeptide
DAEEIATTNPVATEQYGSVCAGTDPPTDDQGQDI

SEQ ID NO: 170384 - protein, 36 aa, Artificial Sequence
  Description of Artificial Sequence: Synthetic polypeptide
DEEEIRTTNPVATEQYGSNVNNNIEESDPSNNDSTL

SEQ ID NO: 170385 - protein, 33 aa, Artificial Sequence
  Description of Artificial Sequence: Synthetic polypeptide
DENEIRTTNPVSTEPYGTISEMEDIQQQQNGNH

SEQ ID NO: 170386 - protein, 33 aa, Artificial Sequence
  Description of Artificial Sequence: Synthetic polypeptide
DENEIRTTNPVSTEPYGTISEMEDIQMQQNGNH

SEQ ID NO: 170387 - protein, 33 aa, Artificial Sequence
  Description of Artificial Sequence: Synthetic polypeptide
DENEIRTTNPVSTEPYGTISEIEDIQQQQNGNH

SEQ ID NO: 170388 - protein, 37 aa, Artificial Sequence
  Description of Artificial Sequence: Synthetic polypeptide
DECEICTVNPVATEQYGSVSTTVNNLNEGEQGTNNTD

SEQ ID NO: 170389 - protein, 37 aa, Artificial Sequence
  Description of Artificial Sequence: Synthetic polypeptide
DECEICTVNPVATEQYGSVSTTVNNLEENEIGTNPTD

SEQ ID NO: 170390 - protein, 37 aa, Artificial Sequence
  Description of Artificial Sequence: Synthetic polypeptide
DECEICTVNPVATEQYGSVSTTVNLQQGTEQGSTVTD

SEQ ID NO: 170391 - protein, 36 aa, Artificial Sequence
  Description of Artificial Sequence: Synthetic polypeptide
DEEEIRTTNPVGTEQYGQCVCSWEDPNANFGSQNQS

SEQ ID NO: 170392 - protein, 36 aa, Artificial Sequence
  Description of Artificial Sequence: Synthetic polypeptide
DEEEIRTTNPVGTEQYGQCVCSTEEDHNGNFGSDQA

SEQ ID NO: 170393 - protein, 38 aa, Artificial Sequence
  Description of Artificial Sequence: Synthetic polypeptide
DEEEIRTTNPVATEQYGVVSTTTNNQAGTEQGTEEEEE

SEQ ID NO: 170394 - protein, 34 aa, Artificial Sequence
  Description of Artificial Sequence: Synthetic polypeptide
DAGEIATTNPVAYEQWGSVCYTENDLHDLLGDAR

SEQ ID NO: 170395 - protein, 33 aa, Artificial Sequence
  Description of Artificial Sequence: Synthetic polypeptide
DENEIRTTNPVSTEPYGTISEMEDIQQQQNGNQ

SEQ ID NO: 170396 - protein, 37 aa, Artificial Sequence
  Description of Artificial Sequence: Synthetic polypeptide
DECEICTVNPVATEQYGSVSTTTNQQSNNEQGTNNTD

SEQ ID NO: 170397 - protein, 37 aa, Artificial Sequence
  Description of Artificial Sequence: Synthetic polypeptide
DEEEIRTTNPVATEQYGSVGGPSNWNQSSHENVVDLE

SEQ ID NO: 170398 - protein, 33 aa, Artificial Sequence
  Description of Artificial Sequence: Synthetic polypeptide
DENEIRTTNPVSTEPYGTISDMEDIQQQQNGNH

SEQ ID NO: 170399 - protein, 34 aa, Artificial Sequence
  Description of Artificial Sequence: Synthetic polypeptide
DESEIRTTNPVATEAWGCVCSWMNENQENFGSEQ

SEQ ID NO: 170400 - protein, 34 aa, Artificial Sequence
  Description of Artificial Sequence: Synthetic polypeptide
DAGEIATTNPVAYEQWGSVCYTENDLDDLRGMTM

SEQ ID NO: 170401 - protein, 35 aa, Artificial Sequence
  Description of Artificial Sequence: Synthetic polypeptide
DEEEISTTNPVATEQYGQCVCSSEHQENFGSQTQS

SEQ ID NO: 170402 - protein, 35 aa, Artificial Sequence
  Description of Artificial Sequence: Synthetic polypeptide
DEEEIRTTNPVATEQYGCVCSWGEHAENFGSETQA

SEQ ID NO: 170403 - protein, 35 aa, Artificial Sequence
  Description of Artificial Sequence: Synthetic polypeptide
DESEIRTTNPVATEAWGCVCSWMNENQDNSGSNQS

SEQ ID NO: 170404 - protein, 35 aa, Artificial Sequence
  Description of Artificial Sequence: Synthetic polypeptide
DESEIRTTNPVATEAWGCVCSWMNENQDHFGSNQA

SEQ ID NO: 170405 - protein, 37 aa, Artificial Sequence
  Description of Artificial Sequence: Synthetic polypeptide
DEEEIATTNPVATEQYGSVSSMTPAGGPNQRDPMEPV

SEQ ID NO: 170406 - protein, 37 aa, Artificial Sequence
  Description of Artificial Sequence: Synthetic polypeptide
DEDEIRTTNPVATEQYGMSTIMTNGTDDQGGGENEGI

SEQ ID NO: 170407 - protein, 33 aa, Artificial Sequence
  Description of Artificial Sequence: Synthetic polypeptide
DEQEIATTNPVAYEQWGMTSTGPLNQGDGDDSS

SEQ ID NO: 170408 - protein, 34 aa, Artificial Sequence
  Description of Artificial Sequence: Synthetic polypeptide
DETSICTTNPCATEQWGVVSTVVTNQQSGTNVAD

SEQ ID NO: 170409 - protein, 34 aa, Artificial Sequence
  Description of Artificial Sequence: Synthetic polypeptide
DETSICTTNPCATEQWGVVSTVVTNLQSGTTDGY

SEQ ID NO: 170410 - protein, 34 aa, Artificial Sequence
  Description of Artificial Sequence: Synthetic polypeptide
DETSICTTNPCATEQWGVVSTVVTNLQSGTEQGD

SEQ ID NO: 170411 - protein, 37 aa, Artificial Sequence
  Description of Artificial Sequence: Synthetic polypeptide
DEEEIRTTNPVATEQYGSNLGNATVLEDTRTVFVGEG

SEQ ID NO: 170412 - protein, 36 aa, Artificial Sequence
  Description of Artificial Sequence: Synthetic polypeptide
DEEEISTTNPVATEQYGQCVCSSEEHNQNFGSDNQM

SEQ ID NO: 170413 - protein, 35 aa, Artificial Sequence
  Description of Artificial Sequence: Synthetic polypeptide
DEDEIRTTNPVATEQYGCVDTDENGSVETEGDQVE

SEQ ID NO: 170414 - protein, 37 aa, Artificial Sequence
  Description of Artificial Sequence: Synthetic polypeptide
DEEEIRTTNPVATEQYGCVCSWGEDTNQENFNSENQY

SEQ ID NO: 170415 - protein, 31 aa, Artificial Sequence
  Description of Artificial Sequence: Synthetic polypeptide
DDSEVVSTNPVATEGYGTVAATGIVEREGQR

SEQ ID NO: 170416 - protein, 34 aa, Artificial Sequence
  Description of Artificial Sequence: Synthetic polypeptide
DAGEIATTNPVAYEQWGSVYYTENDLDDLGDMRG

SEQ ID NO: 170417 - protein, 33 aa, Artificial Sequence
  Description of Artificial Sequence: Synthetic polypeptide
DENEIRTTNPVSTEPYGTISGMEDIQQQQQGNH

SEQ ID NO: 170418 - protein, 33 aa, Artificial Sequence
  Description of Artificial Sequence: Synthetic polypeptide
DENEIRTTNPVSTEPYGTISGMEDIQQQQNGNH

SEQ ID NO: 170419 - protein, 33 aa, Artificial Sequence
  Description of Artificial Sequence: Synthetic polypeptide
DENEIRTTNPVSTEPYGTISGMEDIHQQQNGNH

SEQ ID NO: 170420 - protein, 31 aa, Artificial Sequence
  Description of Artificial Sequence: Synthetic polypeptide
DDSEVVSTNPVATEGYGTVAANGIVEREGQR

SEQ ID NO: 170421 - protein, 32 aa, Artificial Sequence
  Description of Artificial Sequence: Synthetic polypeptide
DENEIRTTNPVSTEPYGTISGEDIQQQQNGPH

SEQ ID NO: 170422 - protein, 31 aa, Artificial Sequence
  Description of Artificial Sequence: Synthetic polypeptide
DDSEVSSTNPVSTEGYGNVAANTIQSRVGQR

SEQ ID NO: 170423 - protein, 37 aa, Artificial Sequence
  Description of Artificial Sequence: Synthetic polypeptide
DECEICTVNPVATEQYGSVSTVTNLEQGTEQGSTVTD

SEQ ID NO: 170424 - protein, 32 aa, Artificial Sequence
  Description of Artificial Sequence: Synthetic polypeptide
DENEIRTTNPVSTEPYGTISFRDIQQQQMSNH

SEQ ID NO: 170425 - protein, 33 aa, Artificial Sequence
  Description of Artificial Sequence: Synthetic polypeptide
DENEIRTTNPVSTEPYGTISFMEDIQQQQNGNH

SEQ ID NO: 170426 - protein, 34 aa, Artificial Sequence
  Description of Artificial Sequence: Synthetic polypeptide
DEMEIRTTNPVATCQYGCVCSWEPNENFGSDTQA

SEQ ID NO: 170427 - protein, 32 aa, Artificial Sequence
  Description of Artificial Sequence: Synthetic polypeptide
DENEIRTTNPVSTEPYGTISFEDIQQQQNQNH

SEQ ID NO: 170428 - protein, 37 aa, Artificial Sequence
  Description of Artificial Sequence: Synthetic polypeptide
DECEICTVNPVATEQYGSVSTVQNQQQGNEQGTNVTE

SEQ ID NO: 170429 - protein, 35 aa, Artificial Sequence
  Description of Artificial Sequence: Synthetic polypeptide
DEEEISTTNPVATEQYGQCVCSSEHNQEGFGSDQD

SEQ ID NO: 170430 - protein, 34 aa, Artificial Sequence
  Description of Artificial Sequence: Synthetic polypeptide
DEMEIRTTNPVATCQYGCVCSWELNEENFGSDQA

SEQ ID NO: 170431 - protein, 37 aa, Artificial Sequence
  Description of Artificial Sequence: Synthetic polypeptide
DEEEIRTTNPVATEQYGSVPLANPTPQPQDVLLIQNG

SEQ ID NO: 170432 - protein, 37 aa, Artificial Sequence
  Description of Artificial Sequence: Synthetic polypeptide
DECEICTVNPVATEQYGSVSTVNQQGISEQGTNQDED

SEQ ID NO: 170433 - protein, 34 aa, Artificial Sequence
  Description of Artificial Sequence: Synthetic polypeptide
DETSICTTNPCATEQWGVVSTVVTNLQQGTTDED

SEQ ID NO: 170434 - protein, 36 aa, Artificial Sequence
  Description of Artificial Sequence: Synthetic polypeptide
DEEEIRTTNPVATEQYGCVCSWGEHDQENFNSDTQA

SEQ ID NO: 170435 - protein, 34 aa, Artificial Sequence
  Description of Artificial Sequence: Synthetic polypeptide
DEEEIRTTNPVATEQYGCVCSWGEHEEHFISDQS

SEQ ID NO: 170436 - protein, 37 aa, Artificial Sequence
  Description of Artificial Sequence: Synthetic polypeptide
DEEEIATTNPVATEQYGSVSSMTPAGGPNQGAGMEPV

SEQ ID NO: 170437 - protein, 33 aa, Artificial Sequence
  Description of Artificial Sequence: Synthetic polypeptide
DEMEIRTTNPVATCQYGCVCQWEHQENFGSDQA

SEQ ID NO: 170438 - protein, 33 aa, Artificial Sequence
  Description of Artificial Sequence: Synthetic polypeptide
DENEIRTTNPVSTEPYGTISAMEDIVQQQCGNH

SEQ ID NO: 170439 - protein, 33 aa, Artificial Sequence
  Description of Artificial Sequence: Synthetic polypeptide
DENEIRTTNPVSTEPYGTISAMEDIQQSQNGNH

SEQ ID NO: 170440 - protein, 33 aa, Artificial Sequence
  Description of Artificial Sequence: Synthetic polypeptide
DENEIRTTNPVSTEPYGTISAMEDIQQQQNGNM

SEQ ID NO: 170441 - protein, 33 aa, Artificial Sequence
  Description of Artificial Sequence: Synthetic polypeptide
DENEIRTTNPVSTEPYGTISAMEDIQQQQNGNH

SEQ ID NO: 170442 - protein, 35 aa, Artificial Sequence
  Description of Artificial Sequence: Synthetic polypeptide
DEDEIRTTNPVATEQYGSCSAGDALGQNHPDAQAE

SEQ ID NO: 170443 - protein, 37 aa, Artificial Sequence
  Description of Artificial Sequence: Synthetic polypeptide
NESEIRTTNPVATEQYGSIVYTVPNNLGQPIGFSKHT

SEQ ID NO: 170444 - protein, 37 aa, Artificial Sequence
  Description of Artificial Sequence: Synthetic polypeptide
DEEEIRTTNPVATEQYGSVPLWSYGLLLVQEAPEVVE

SEQ ID NO: 170445 - protein, 34 aa, Artificial Sequence
  Description of Artificial Sequence: Synthetic polypeptide
DEEEIRTTNPVATEQYGCVCSWGEHEHFISETQT

SEQ ID NO: 170446 - protein, 35 aa, Artificial Sequence
  Description of Artificial Sequence: Synthetic polypeptide
DEDEIRTTNPVATEQYGSCSAGPALGQEHPDAQAK

SEQ ID NO: 170447 - protein, 35 aa, Artificial Sequence
  Description of Artificial Sequence: Synthetic polypeptide
DETTEIATTNPVAYEQWGSTSTSNDNQGNHGGNGS

SEQ ID NO: 170448 - protein, 36 aa, Artificial Sequence
  Description of Artificial Sequence: Synthetic polypeptide
DEEEIRTTNPVATEQYGCVCSWGEHEQEFFNSDTQS

SEQ ID NO: 170449 - protein, 35 aa, Artificial Sequence
  Description of Artificial Sequence: Synthetic polypeptide
NESEIRTTNPVATEQYGAASDVYQDLNNQDGQEHN

SEQ ID NO: 170450 - protein, 32 aa, Artificial Sequence
  Description of Artificial Sequence: Synthetic polypeptide
DENEIRTTNPVSTEPYGTISAMDIQQSQNGQH

SEQ ID NO: 170451 - protein, 32 aa, Artificial Sequence
  Description of Artificial Sequence: Synthetic polypeptide
DENEIRTTNPVSTEPYGTISAMDIQQQQNGQH

SEQ ID NO: 170452 - protein, 33 aa, Artificial Sequence
  Description of Artificial Sequence: Synthetic polypeptide
DETTICTTNCVATEQYGSVMGDGGGDNGQEGGM

SEQ ID NO: 170453 - protein, 36 aa, Artificial Sequence
  Description of Artificial Sequence: Synthetic polypeptide
DEEEIRTTNPVATEQYGSYVSAPIGIQQLSVEEADW

SEQ ID NO: 170454 - protein, 35 aa, Artificial Sequence
  Description of Artificial Sequence: Synthetic polypeptide
CEDEIATTNPVAYEQYGSVCATNPMQQGNQTEGTM

SEQ ID NO: 170455 - protein, 34 aa, Artificial Sequence
  Description of Artificial Sequence: Synthetic polypeptide
DETTIRGTNPVATEFYGSVSIDNPGLGGGGDDGE

SEQ ID NO: 170456 - protein, 35 aa, Artificial Sequence
  Description of Artificial Sequence: Synthetic polypeptide
QEEEIRTTNPLCYEAYGSVSCDLNFSQNRNGGNND

SEQ ID NO: 170457 - protein, 34 aa, Artificial Sequence
  Description of Artificial Sequence: Synthetic polypeptide
DEHEIRTTNPVAYEKWGEVSGGNGEERNNMNGNQ

SEQ ID NO: 170458 - protein, 31 aa, Artificial Sequence
  Description of Artificial Sequence: Synthetic polypeptide
QEGEIAPTNPVASECYGIVSCNEQDSEGETG

SEQ ID NO: 170459 - protein, 33 aa, Artificial Sequence
  Description of Artificial Sequence: Synthetic polypeptide
DENEIRTTNPVSTEPYGTIRSMEDIQQQQNGNH

SEQ ID NO: 170460 - protein, 34 aa, Artificial Sequence
  Description of Artificial Sequence: Synthetic polypeptide
DETTIRTTNCVATEQYGSVGGNNGGGDNDQEGGD

SEQ ID NO: 170461 - protein, 37 aa, Artificial Sequence
  Description of Artificial Sequence: Synthetic polypeptide
DECEICTVNPVATEQYGSVSTTTNLQQGTEQGTVVTD

SEQ ID NO: 170462 - protein, 33 aa, Artificial Sequence
  Description of Artificial Sequence: Synthetic polypeptide
DENEIRTTNPVSTEPYGTISHMEDIQQQQNGNH

SEQ ID NO: 170463 - protein, 37 aa, Artificial Sequence
  Description of Artificial Sequence: Synthetic polypeptide
DECEICTVNPVATEQYGSVSTTTNNQQEGEQGTNNTD

SEQ ID NO: 170464 - protein, 33 aa, Artificial Sequence
  Description of Artificial Sequence: Synthetic polypeptide
DENEIRTTNPVSTEPYGTISCEDEHSQQQNGNH

SEQ ID NO: 170465 - protein, 36 aa, Artificial Sequence
  Description of Artificial Sequence: Synthetic polypeptide
AEDEICATNPVATEQYGVVSTTNQQLQQLQGNTEDD

SEQ ID NO: 170466 - protein, 35 aa, Artificial Sequence
  Description of Artificial Sequence: Synthetic polypeptide
DEEEIRTTNPVATEQYGCVCSWGEHEESFGSETQS

SEQ ID NO: 170467 - protein, 32 aa, Artificial Sequence
  Description of Artificial Sequence: Synthetic polypeptide
DEQEIATTNPVAYEQWGSCSAGDNNDHQGESD

SEQ ID NO: 170468 - protein, 32 aa, Artificial Sequence
  Description of Artificial Sequence: Synthetic polypeptide
DEQEIATTNPVAYEQWGSCSAGDNNDHQQEDS

SEQ ID NO: 170469 - protein, 33 aa, Artificial Sequence
  Description of Artificial Sequence: Synthetic polypeptide
DENEIRTTNPVSTEPYGTISCMEDISQQTNGNH

SEQ ID NO: 170470 - protein, 36 aa, Artificial Sequence
  Description of Artificial Sequence: Synthetic polypeptide
DEEEIRTTNPVATEQYGSVPLPPLILEVPMGPLEQG

SEQ ID NO: 170471 - protein, 36 aa, Artificial Sequence
  Description of Artificial Sequence: Synthetic polypeptide
NESEIRTTNPVATEQYGSVSPTAFTQEVLTEPGQQD

SEQ ID NO: 170472 - protein, 32 aa, Artificial Sequence
  Description of Artificial Sequence: Synthetic polypeptide
DENDIRTTNPVSTEPYGTISMEDIQQQNNGNH

SEQ ID NO: 170473 - protein, 33 aa, Artificial Sequence
  Description of Artificial Sequence: Synthetic polypeptide
DENEIRTTNPVSTEPYGTISCMEDIQQQQNGNH

SEQ ID NO: 170474 - protein, 33 aa, Artificial Sequence
  Description of Artificial Sequence: Synthetic polypeptide
DENEIRTTNPVSTEPYGTISCMEDIQMQQNGNH

SEQ ID NO: 170475 - protein, 39 aa, Artificial Sequence
  Description of Artificial Sequence: Synthetic polypeptide
AEEEIRTTNPVATEQYGSVVVTTTTNNLQQGTEAGNNTD

SEQ ID NO: 170476 - protein, 33 aa, Artificial Sequence
  Description of Artificial Sequence: Synthetic polypeptide
AENEIRCTNPVATEQWGATSNEENLQEPKGGYI

SEQ ID NO: 170477 - protein, 32 aa, Artificial Sequence
  Description of Artificial Sequence: Synthetic polypeptide
DENDIRTTNPVSTEPYGTISMEDIQQQQNGNH

SEQ ID NO: 170478 - protein, 33 aa, Artificial Sequence
  Description of Artificial Sequence: Synthetic polypeptide
DEQEIATTNPVAYEQWGSCSAGDNNDHQQTGDD

SEQ ID NO: 170479 - protein, 32 aa, Artificial Sequence
  Description of Artificial Sequence: Synthetic polypeptide
DEQEIATTNPVAYEQWGSCSAPDNNDHNGEDL

SEQ ID NO: 170480 - protein, 33 aa, Artificial Sequence
  Description of Artificial Sequence: Synthetic polypeptide
DENEIRTTNPVSTEPYGTISCIDEQQDQNGENG

SEQ ID NO: 170481 - protein, 32 aa, Artificial Sequence
  Description of Artificial Sequence: Synthetic polypeptide
DENDIRTTNPVSTEPYGTISMEDIWQQQNGNH

SEQ ID NO: 170482 - protein, 33 aa, Artificial Sequence
  Description of Artificial Sequence: Synthetic polypeptide
DEQEIATTNPVAYEQWGSCSATDNGNDHNGEDV

SEQ ID NO: 170483 - protein, 32 aa, Artificial Sequence
  Description of Artificial Sequence: Synthetic polypeptide
AENEIRCTNPIATEQWGAAWANAEDLQPKGPR

SEQ ID NO: 170484 - protein, 33 aa, Artificial Sequence
  Description of Artificial Sequence: Synthetic polypeptide
CEDEIATTNPVAYEQYGSVATAGTPTANNDERG

SEQ ID NO: 170485 - protein, 36 aa, Artificial Sequence
  Description of Artificial Sequence: Synthetic polypeptide
DEDEIRTTNPVATEQYGSACSAANDNLQATTPPDQE

SEQ ID NO: 170486 - protein, 33 aa, Artificial Sequence
  Description of Artificial Sequence: Synthetic polypeptide
CEDEIATTNPVAYEQYGSVATHGQDSPNGSMEH

SEQ ID NO: 170487 - protein, 32 aa, Artificial Sequence
  Description of Artificial Sequence: Synthetic polypeptide
DENDIRTTNPVSTEPYGTYSMEDIQQQQNGNH

SEQ ID NO: 170488 - protein, 33 aa, Artificial Sequence
  Description of Artificial Sequence: Synthetic polypeptide
DENEIRTTNPVSTEPYGTISCEDAIQQQQNGNH

SEQ ID NO: 170489 - protein, 33 aa, Artificial Sequence
  Description of Artificial Sequence: Synthetic polypeptide
DENEIRTTNPVSTEPYGTISHMEDYQQQQNGNH

SEQ ID NO: 170490 - protein, 33 aa, Artificial Sequence
  Description of Artificial Sequence: Synthetic polypeptide
DENEIRTTNPVSTEPYGTISHMEKIQQQQNGNH

SEQ ID NO: 170491 - protein, 32 aa, Artificial Sequence
  Description of Artificial Sequence: Synthetic polypeptide
DETSIATTNPTAYESWGSYYSNDNDQQSGNDR

SEQ ID NO: 170492 - protein, 33 aa, Artificial Sequence
  Description of Artificial Sequence: Synthetic polypeptide
DENEIRTTNPVSTEPYGTISLMEMIQQQQNGNH

SEQ ID NO: 170493 - protein, 35 aa, Artificial Sequence
  Description of Artificial Sequence: Synthetic polypeptide
DDEEIRCTNPVATEQYGCSCSNTGEDNQNFGSDQA

SEQ ID NO: 170494 - protein, 36 aa, Artificial Sequence
  Description of Artificial Sequence: Synthetic polypeptide
DEEEISTTNPVATEQYGQCVCSNWGNHQENFNSEAE

SEQ ID NO: 170495 - protein, 35 aa, Artificial Sequence
  Description of Artificial Sequence: Synthetic polypeptide
QEEEIRTTNPCSTEQYGSVSSTPAGPNMRNGMTPV

SEQ ID NO: 170496 - protein, 37 aa, Artificial Sequence
  Description of Artificial Sequence: Synthetic polypeptide
DEEEIACTNPVATEQYGSVCAATENLEAGGEQGENAD

SEQ ID NO: 170497 - protein, 31 aa, Artificial Sequence
  Description of Artificial Sequence: Synthetic polypeptide
QENEIATTNPVSTEPYGDISMDIQQQQNGNL

SEQ ID NO: 170498 - protein, 36 aa, Artificial Sequence
  Description of Artificial Sequence: Synthetic polypeptide
DEEEIRTTNPVATEQYGCVCSWGEDDQENFNSDNQS

SEQ ID NO: 170499 - protein, 35 aa, Artificial Sequence
  Description of Artificial Sequence: Synthetic polypeptide
DEEEIRTTNPVATEQYGCVCSWGEDHANFGSETQT

SEQ ID NO: 170500 - protein, 33 aa, Artificial Sequence
  Description of Artificial Sequence: Synthetic polypeptide
DENEIRTTNPVSTEPYGTISLMEDIQQQQNGNL

SEQ ID NO: 170501 - protein, 36 aa, Artificial Sequence
  Description of Artificial Sequence: Synthetic polypeptide
DEEEIRTTNPVATEQYGCVCSWGEDHDQEFFNSDQS

SEQ ID NO: 170502 - protein, 35 aa, Artificial Sequence
  Description of Artificial Sequence: Synthetic polypeptide
DEEEIRTTNPVATEQYGCVCSWGEDHNANFNSDQS

SEQ ID NO: 170503 - protein, 36 aa, Artificial Sequence
  Description of Artificial Sequence: Synthetic polypeptide
DEEEIACTNPVATEQYGSVCAATENLEAGEQDETAD

SEQ ID NO: 170504 - protein, 37 aa, Artificial Sequence
  Description of Artificial Sequence: Synthetic polypeptide
DEEEIRTTNPVATEQYGSVPFPNLAESQAVAFLVLVA

SEQ ID NO: 170505 - protein, 37 aa, Artificial Sequence
  Description of Artificial Sequence: Synthetic polypeptide
DEEEIRTTNPVATEQYGCVCSWGEDHNIENFGSENQA

SEQ ID NO: 170506 - protein, 37 aa, Artificial Sequence
  Description of Artificial Sequence: Synthetic polypeptide
DEEEIRTTNPVATEQYGCVCSWGEDHNIENFGSENQS

SEQ ID NO: 170507 - protein, 32 aa, Artificial Sequence
  Description of Artificial Sequence: Synthetic polypeptide
QENEIATTNPVSTEPYGIISMENIQQQSNGNH

SEQ ID NO: 170508 - protein, 36 aa, Artificial Sequence
  Description of Artificial Sequence: Synthetic polypeptide
DEEEIRTTNPVATEQYGCVCSWGEDHNIEYFNSDQS

SEQ ID NO: 170509 - protein, 36 aa, Artificial Sequence
  Description of Artificial Sequence: Synthetic polypeptide
DECEICTVNPVATEQYGVVSTTNQQQLLQGNNEDED

SEQ ID NO: 170510 - protein, 39 aa, Artificial Sequence
  Description of Artificial Sequence: Synthetic polypeptide
DEEEIRTTNPVATEQYGVVSTVVTNLQQGTEQGGTTQDN

SEQ ID NO: 170511 - protein, 31 aa, Artificial Sequence
  Description of Artificial Sequence: Synthetic polypeptide
QENEIATTNPVSTEPYGTASMDIQQQHNGNH

SEQ ID NO: 170512 - protein, 36 aa, Artificial Sequence
  Description of Artificial Sequence: Synthetic polypeptide
DEEEIRTTNPVATEQYGCVCSWGEDHNQEHFNSQQS

SEQ ID NO: 170513 - protein, 37 aa, Artificial Sequence
  Description of Artificial Sequence: Synthetic polypeptide
DEEEIRTTNPVATEQYGCVCSWGEDHNQENFGSDNQA

SEQ ID NO: 170514 - protein, 37 aa, Artificial Sequence
  Description of Artificial Sequence: Synthetic polypeptide
DEEEIRTTNPVATEQYGCVCSWGEDHNQENFGSDNQS

SEQ ID NO: 170515 - protein, 37 aa, Artificial Sequence
  Description of Artificial Sequence: Synthetic polypeptide
DEEEISTTNPVATEQYGQCVCSNWGETNQNFGSDNQA

SEQ ID NO: 170516 - protein, 30 aa, Artificial Sequence
  Description of Artificial Sequence: Synthetic polypeptide
QENEIATTNPVSTEPYGTISECIQQQHENL

SEQ ID NO: 170517 - protein, 33 aa, Artificial Sequence
  Description of Artificial Sequence: Synthetic polypeptide
DENEIRTTNPVSTEPYGTISLYEDIQQQQHGNH

SEQ ID NO: 170518 - protein, 37 aa, Artificial Sequence
  Description of Artificial Sequence: Synthetic polypeptide
DEEEIRTTNPVATEQYGSVPENVSNDLPQFQEVELEV

SEQ ID NO: 170519 - protein, 31 aa, Artificial Sequence
  Description of Artificial Sequence: Synthetic polypeptide
DENEIRTTNPVSTEPYGTISMDIQQQQAEDH

SEQ ID NO: 170520 - protein, 36 aa, Artificial Sequence
  Description of Artificial Sequence: Synthetic polypeptide
SEFEIRTTNPVATEQYGSVPSCTVELTQMETSEDIQ

SEQ ID NO: 170521 - protein, 37 aa, Artificial Sequence
  Description of Artificial Sequence: Synthetic polypeptide
DEEEIRTTNPVATEQYGSVPDPEMLLQALTEVEQGMV

SEQ ID NO: 170522 - protein, 36 aa, Artificial Sequence
  Description of Artificial Sequence: Synthetic polypeptide
DEEEIRTTNPVATEQYGSVPDPPLDEEATMGPLEQV

SEQ ID NO: 170523 - protein, 36 aa, Artificial Sequence
  Description of Artificial Sequence: Synthetic polypeptide
DEAEIRTTNPVATEQYGSVCSPEGCHLEGGPEPQPE

SEQ ID NO: 170524 - protein, 34 aa, Artificial Sequence
  Description of Artificial Sequence: Synthetic polypeptide
DETEIVTTNPVATEQYGTVCSAADDWVAFEGNYD

SEQ ID NO: 170525 - protein, 34 aa, Artificial Sequence
  Description of Artificial Sequence: Synthetic polypeptide
DETEIVTTNPVATEQYGTVCSAADGWVAFEGNYD

SEQ ID NO: 170526 - protein, 33 aa, Artificial Sequence
  Description of Artificial Sequence: Synthetic polypeptide
DENEIRTTNPVSTEPYGTISMDDIQQQQNGNQH

SEQ ID NO: 170527 - protein, 37 aa, Artificial Sequence
  Description of Artificial Sequence: Synthetic polypeptide
DECEICTVNPVATEQYGVVSTVNQQQLQLQGNNEDED

SEQ ID NO: 170528 - protein, 36 aa, Artificial Sequence
  Description of Artificial Sequence: Synthetic polypeptide
DECEICTVNPVATEQYGVVSTVNQQGSEQGNNQDQD

SEQ ID NO: 170529 - protein, 35 aa, Artificial Sequence
  Description of Artificial Sequence: Synthetic polypeptide
DEEEIKTTNPCAYEQWGSVYCTDNDHHRQGHNHSH

SEQ ID NO: 170530 - protein, 32 aa, Artificial Sequence
  Description of Artificial Sequence: Synthetic polypeptide
SEETIRSTNPVATEQWGAVEVGWLVIAGVNDE

SEQ ID NO: 170531 - protein, 36 aa, Artificial Sequence
  Description of Artificial Sequence: Synthetic polypeptide
DECEICTVNPVATEQYGVVSTTTNQQEAEQGTNNTD

SEQ ID NO: 170532 - protein, 36 aa, Artificial Sequence
  Description of Artificial Sequence: Synthetic polypeptide
DEEEIRTTNPVATEQYGSVPEHVSVLSQFQEVELEV

SEQ ID NO: 170533 - protein, 34 aa, Artificial Sequence
  Description of Artificial Sequence: Synthetic polypeptide
DESEIRTTNPVATEAWGSVSVVNNNNNNDEGEEG

SEQ ID NO: 170534 - protein, 31 aa, Artificial Sequence
  Description of Artificial Sequence: Synthetic polypeptide
QENEIATTNPVSSEPYGIISCENIQQSNGNH

SEQ ID NO: 170535 - protein, 39 aa, Artificial Sequence
  Description of Artificial Sequence: Synthetic polypeptide
AEEEIRTTNPVATEQYGSVVVTTTGTNLQQGTEGGNNTD

SEQ ID NO: 170536 - protein, 36 aa, Artificial Sequence
  Description of Artificial Sequence: Synthetic polypeptide
DEEEIRTTNPVATEQYGSVPELWSNMPQFQEVELEV

SEQ ID NO: 170537 - protein, 31 aa, Artificial Sequence
  Description of Artificial Sequence: Synthetic polypeptide
QENEIATTNPVSSEPYGIISMENIQQSNGNH

SEQ ID NO: 170538 - protein, 36 aa, Artificial Sequence
  Description of Artificial Sequence: Synthetic polypeptide
DEEEIRTTNPVATEQYGCVCSWENDHNAENFGSQQS

SEQ ID NO: 170539 - protein, 31 aa, Artificial Sequence
  Description of Artificial Sequence: Synthetic polypeptide
DEGVIATVNPVAYEPWGSVTNAGNLEMNGNN

SEQ ID NO: 170540 - protein, 37 aa, Artificial Sequence
  Description of Artificial Sequence: Synthetic polypeptide
DEEEIRTTNPVATEQYGACAQPEMYESTVLENGTLND

SEQ ID NO: 170541 - protein, 36 aa, Artificial Sequence
  Description of Artificial Sequence: Synthetic polypeptide
DECEICTVNPVATEQYGVVSTTNQQQQQQGNNEDED

SEQ ID NO: 170542 - protein, 36 aa, Artificial Sequence
  Description of Artificial Sequence: Synthetic polypeptide
DECEICTVNPVATEQYGVVSTTNQQQQGQGNNQDED

SEQ ID NO: 170543 - protein, 36 aa, Artificial Sequence
  Description of Artificial Sequence: Synthetic polypeptide
DEEEIRTTNPVATEQYGSNVNNNINESDMDNNDSGD

SEQ ID NO: 170544 - protein, 35 aa, Artificial Sequence
  Description of Artificial Sequence: Synthetic polypeptide
SEEEVRTTNPVATEQYGQCVCSWEEHDQNIGSNQS

SEQ ID NO: 170545 - protein, 34 aa, Artificial Sequence
  Description of Artificial Sequence: Synthetic polypeptide
DETNEIATTNPVAYEQWGVCSTNLQGDLLQNGDA

SEQ ID NO: 170546 - protein, 37 aa, Artificial Sequence
  Description of Artificial Sequence: Synthetic polypeptide
DEEEIRTTNPVATEQYGSVGGPTNNLDGMPVLEIEIT

SEQ ID NO: 170547 - protein, 33 aa, Artificial Sequence
  Description of Artificial Sequence: Synthetic polypeptide
DENEIRTTNPVSTEPYGTISKEDRIQQQQNGNH

SEQ ID NO: 170548 - protein, 35 aa, Artificial Sequence
  Description of Artificial Sequence: Synthetic polypeptide
DEDEIRTTNPVATEQWGVVSTEQQSATNVATEDGQ

SEQ ID NO: 170549 - protein, 31 aa, Artificial Sequence
  Description of Artificial Sequence: Synthetic polypeptide
QENEIATTNPVSTEPYGVIAMETLQQQNGNH

SEQ ID NO: 170550 - protein, 37 aa, Artificial Sequence
  Description of Artificial Sequence: Synthetic polypeptide
DEDEIRTTNPVATEQWGVVVSTNQQRTTNVATEDGSM

SEQ ID NO: 170551 - protein, 33 aa, Artificial Sequence
  Description of Artificial Sequence: Synthetic polypeptide
DEEEIACTNPVATEQYGSVCAATAGEEMMMPEG

SEQ ID NO: 170552 - protein, 34 aa, Artificial Sequence
  Description of Artificial Sequence: Synthetic polypeptide
DEEEISTTNPVATEQYGQCVCSSEDDEFFGSEQA

SEQ ID NO: 170553 - protein, 34 aa, Artificial Sequence
  Description of Artificial Sequence: Synthetic polypeptide
DEMEIRTTNPVATCQYGCVCSWNHNEENFGSDQS

SEQ ID NO: 170554 - protein, 30 aa, Artificial Sequence
  Description of Artificial Sequence: Synthetic polypeptide
QENEIATTNPVSTEQYGEAPEEDCQQHGEH

SEQ ID NO: 170555 - protein, 37 aa, Artificial Sequence
  Description of Artificial Sequence: Synthetic polypeptide
DECEICTVNPVATEQYGVVSTTNQQLQGQQGNNQDEE

SEQ ID NO: 170556 - protein, 33 aa, Artificial Sequence
  Description of Artificial Sequence: Synthetic polypeptide
DENEIRTTNPVSTEPYGTISIMQDGQQQQNGNH

SEQ ID NO: 170557 - protein, 33 aa, Artificial Sequence
  Description of Artificial Sequence: Synthetic polypeptide
DENEIRTTNPVSTEPYGTISIMEPIQQQQNGNH

SEQ ID NO: 170558 - protein, 36 aa, Artificial Sequence
  Description of Artificial Sequence: Synthetic polypeptide
DEEEIRTTNPVATEQYGSNLGNNLGEDTVTVDVGEV

SEQ ID NO: 170559 - protein, 33 aa, Artificial Sequence
  Description of Artificial Sequence: Synthetic polypeptide
DENEIRTTNPVSTEPYGTISIMEDIQQQQNGNH

SEQ ID NO: 170560 - protein, 33 aa, Artificial Sequence
  Description of Artificial Sequence: Synthetic polypeptide
DETSIATTNPTAYEQWGSYYSIDNDQNERGNAF

SEQ ID NO: 170561 - protein, 37 aa, Artificial Sequence
  Description of Artificial Sequence: Synthetic polypeptide
DEEEIRTTNPVATEQYGSVPIHNMITIGPHQVFTENG

SEQ ID NO: 170562 - protein, 36 aa, Artificial Sequence
  Description of Artificial Sequence: Synthetic polypeptide
DECEICTVNPVATEQYGVVSTTNQQLGNQGNDEDED

SEQ ID NO: 170563 - protein, 33 aa, Artificial Sequence
  Description of Artificial Sequence: Synthetic polypeptide
DENEIRTTNPVSTEPYGTISIEDISQQQNGQNH

SEQ ID NO: 170564 - protein, 33 aa, Artificial Sequence
  Description of Artificial Sequence: Synthetic polypeptide
DETSIATTNPTAYEQWGSYYSPDNDQQEGLNDR

SEQ ID NO: 170565 - protein, 34 aa, Artificial Sequence
  Description of Artificial Sequence: Synthetic polypeptide
DETSIATTNPTAYEQWGSYYSPDNDSQQSRGNDR

SEQ ID NO: 170566 - protein, 34 aa, Artificial Sequence
  Description of Artificial Sequence: Synthetic polypeptide
DETSIATTNPTAYEQWGSYYSVDNPDQNERGNAR

SEQ ID NO: 170567 - protein, 33 aa, Artificial Sequence
  Description of Artificial Sequence: Synthetic polypeptide
DENEIRTTNPVSTEPYGTISIEDIQQQQNGNNH

SEQ ID NO: 170568 - protein, 31 aa, Artificial Sequence
  Description of Artificial Sequence: Synthetic polypeptide
DAGEVASTNPVSTEGYGNVAANTIQSRGGQR

SEQ ID NO: 170569 - protein, 33 aa, Artificial Sequence
  Description of Artificial Sequence: Synthetic polypeptide
DENEIRTTNPVSTEPYGTISKMEDIQQQINGNT

SEQ ID NO: 170570 - protein, 34 aa, Artificial Sequence
  Description of Artificial Sequence: Synthetic polypeptide
DETNEIATTNPVAYEQWGSVSGPNGNQGTMNGDD

SEQ ID NO: 170571 - protein, 34 aa, Artificial Sequence
  Description of Artificial Sequence: Synthetic polypeptide
DETSIATTNPLAYEQFGSVSCFATLSQSVGNNRE

SEQ ID NO: 170572 - protein, 34 aa, Artificial Sequence
  Description of Artificial Sequence: Synthetic polypeptide
DEGVEIATTNPVAYEQWGVVTGGNGNQGEGNADR

SEQ ID NO: 170573 - protein, 34 aa, Artificial Sequence
  Description of Artificial Sequence: Synthetic polypeptide
SEEEVRTTNPVATEQYGCVCSWEEHNQNIGSDQS

SEQ ID NO: 170574 - protein, 33 aa, Artificial Sequence
  Description of Artificial Sequence: Synthetic polypeptide
DENEIRTTNPVSTEPYGTISLMEDIQQQQNGNH

SEQ ID NO: 170575 - protein, 36 aa, Artificial Sequence
  Description of Artificial Sequence: Synthetic polypeptide
DEEEIRTTNPVATEQYGCVCSWGEDHNQGFNSDNQS

SEQ ID NO: 170576 - protein, 34 aa, Artificial Sequence
  Description of Artificial Sequence: Synthetic polypeptide
SEEEVRTTNPVATEQYGCVCSTEEHDQNIISDQA

SEQ ID NO: 170577 - protein, 38 aa, Artificial Sequence
  Description of Artificial Sequence: Synthetic polypeptide
DEEEIRTTNPVATEQYGSVPGTNANNLGVETQEMMTGE

SEQ ID NO: 170578 - protein, 38 aa, Artificial Sequence
  Description of Artificial Sequence: Synthetic polypeptide
DEEEIRTTNPVATEQYGSVPGTNNMNLGPETQEMMVYE

SEQ ID NO: 170579 - protein, 31 aa, Artificial Sequence
  Description of Artificial Sequence: Synthetic polypeptide
QENEIATTNPVSTEPYGTISMEDIQQQQGNH

SEQ ID NO: 170580 - protein, 32 aa, Artificial Sequence
  Description of Artificial Sequence: Synthetic polypeptide
NESEIRTTNPVGYEAWGCVVTTGNLSNNEGSR

SEQ ID NO: 170581 - protein, 35 aa, Artificial Sequence
  Description of Artificial Sequence: Synthetic polypeptide
DEEEIRTTNPVATEQYGCVCSWGEDHQEHFMSEQS

SEQ ID NO: 170582 - protein, 38 aa, Artificial Sequence
  Description of Artificial Sequence: Synthetic polypeptide
DEEEIRTTNPVATEQYGSVPGTNSNNLGPETQEMMVSE

SEQ ID NO: 170583 - protein, 32 aa, Artificial Sequence
  Description of Artificial Sequence: Synthetic polypeptide
DDSEVVTTNPVSTEQYGTVCAATTIESFEGNR

SEQ ID NO: 170584 - protein, 36 aa, Artificial Sequence
  Description of Artificial Sequence: Synthetic polypeptide
DEEEIRTTNPVATEQYGSVPHPMMEEEAIEGPEQRQ

SEQ ID NO: 170585 - protein, 35 aa, Artificial Sequence
  Description of Artificial Sequence: Synthetic polypeptide
DEEEIRTTNPVATEQYGCVCSWGEDHQENFISDQA

SEQ ID NO: 170586 - protein, 34 aa, Artificial Sequence
  Description of Artificial Sequence: Synthetic polypeptide
DETSEIATTNPVAYEQWGSTVTGNDSQNGGQNNG

SEQ ID NO: 170587 - protein, 32 aa, Artificial Sequence
  Description of Artificial Sequence: Synthetic polypeptide
QENEIATTNPVSTEPYGTVSEECLQQQQNENL

SEQ ID NO: 170588 - protein, 37 aa, Artificial Sequence
  Description of Artificial Sequence: Synthetic polypeptide
DEEEIRTTNPVATEQYGSNPCVVMNSSVVIQGQLGSE

SEQ ID NO: 170589 - protein, 36 aa, Artificial Sequence
  Description of Artificial Sequence: Synthetic polypeptide
DEEEIRTTNPVATEQYGCVCSWGEDHQENFLSDNQS

SEQ ID NO: 170590 - protein, 37 aa, Artificial Sequence
  Description of Artificial Sequence: Synthetic polypeptide
DEDEIRTTNPVATEQWGVVAVTNPPGNGDVQDRKGNM

SEQ ID NO: 170591 - protein, 30 aa, Artificial Sequence
  Description of Artificial Sequence: Synthetic polypeptide
DETSIASTNPLTTAQWGSVAANGLQSGDSE

SEQ ID NO: 170592 - protein, 37 aa, Artificial Sequence
  Description of Artificial Sequence: Synthetic polypeptide
DEEEISTTNPVATEQYGQCVCSNWMETNQNFGSENQS

SEQ ID NO: 170593 - protein, 33 aa, Artificial Sequence
  Description of Artificial Sequence: Synthetic polypeptide
DENEIRTTNPVSTEPYGTISKMFDIQQQQNGNH

SEQ ID NO: 170594 - protein, 33 aa, Artificial Sequence
  Description of Artificial Sequence: Synthetic polypeptide
DENEIRTTNPVSTEPYGTISKMEDIQQQQNGNH

SEQ ID NO: 170595 - protein, 33 aa, Artificial Sequence
  Description of Artificial Sequence: Synthetic polypeptide
DETSIATTNPLAYEAFGSVSCFANQSQSGTNNR

SEQ ID NO: 170596 - protein, 35 aa, Artificial Sequence
  Description of Artificial Sequence: Synthetic polypeptide
DETSIATTNPLAYEQFGSVSCFANLSQSTGGNNRF

SEQ ID NO: 170597 - protein, 38 aa, Artificial Sequence
  Description of Artificial Sequence: Synthetic polypeptide
DEEEIRTTNPVATEAYGVVSTVVNNQQNQQEGTNVATE

SEQ ID NO: 170598 - protein, 34 aa, Artificial Sequence
  Description of Artificial Sequence: Synthetic polypeptide
DEMEIRTTNPVATECYGTVCAATDGPVEEPEGND

SEQ ID NO: 170599 - protein, 34 aa, Artificial Sequence
  Description of Artificial Sequence: Synthetic polypeptide
DEEEISTTNPVATEQYGCVCSWGEHQENFTSDDN

SEQ ID NO: 170600 - protein, 33 aa, Artificial Sequence
  Description of Artificial Sequence: Synthetic polypeptide
TEECIRTTNPVATEQYGCVCSSEHNANFLSQQA

SEQ ID NO: 170601 - protein, 35 aa, Artificial Sequence
  Description of Artificial Sequence: Synthetic polypeptide
DEEEIATTNPVATEQYGSCATGAAIQEDAGEEGMW

SEQ ID NO: 170602 - protein, 36 aa, Artificial Sequence
  Description of Artificial Sequence: Synthetic polypeptide
DEHEICTTNPVAYEQWGSVCPNDLDRNNMGDHNREQ

SEQ ID NO: 170603 - protein, 29 aa, Artificial Sequence
  Description of Artificial Sequence: Synthetic peptide
YDSEIASVNPVSTEGYGVVSNTIQSSGNQ

SEQ ID NO: 170604 - protein, 39 aa, Artificial Sequence
  Description of Artificial Sequence: Synthetic polypeptide
DEEEIRTTNPVATEAYGSVSVTVTTQAGNNQQGTNVATE

SEQ ID NO: 170605 - protein, 30 aa, Artificial Sequence
  Description of Artificial Sequence: Synthetic polypeptide
DEEEIATTNPIATECWGETPAVCQEPGEYK

SEQ ID NO: 170606 - protein, 34 aa, Artificial Sequence
  Description of Artificial Sequence: Synthetic polypeptide
DEMEIVTTNPVATESYGTVPSATDGPVEGFFGND

SEQ ID NO: 170607 - protein, 31 aa, Artificial Sequence
  Description of Artificial Sequence: Synthetic polypeptide
QECEICATNPCTTEIYGVVATNNTTLQNGDT

SEQ ID NO: 170608 - protein, 34 aa, Artificial Sequence
  Description of Artificial Sequence: Synthetic polypeptide
TEECIRTTNPVATEQYGCVCSTGELAEYFLSDQS

SEQ ID NO: 170609 - protein, 34 aa, Artificial Sequence
  Description of Artificial Sequence: Synthetic polypeptide
TEECIRTTNPVATEQYGCVCSTGNHNAYFISDQS

SEQ ID NO: 170610 - protein, 37 aa, Artificial Sequence
  Description of Artificial Sequence: Synthetic polypeptide
DEEEIATTNPVAYECYGISTVSYEGNELSGVRGPVRF

SEQ ID NO: 170611 - protein, 30 aa, Artificial Sequence
  Description of Artificial Sequence: Synthetic polypeptide
DEEEIATTNPIATECWGETAAVWQEPGEYK

SEQ ID NO: 170612 - protein, 36 aa, Artificial Sequence
  Description of Artificial Sequence: Synthetic polypeptide
DEEEIRTTNPVATEQYGSVAAVLCMEIQETSSEQEE

SEQ ID NO: 170613 - protein, 37 aa, Artificial Sequence
  Description of Artificial Sequence: Synthetic polypeptide
DEEEIRTTNPVAYEQYGCVCSNTGEHNQEGFNSNNQE

SEQ ID NO: 170614 - protein, 36 aa, Artificial Sequence
  Description of Artificial Sequence: Synthetic polypeptide
SQEEIRTTNPVAYEQYGQVVVVTNGLSQYRGGEYQG

SEQ ID NO: 170615 - protein, 36 aa, Artificial Sequence
  Description of Artificial Sequence: Synthetic polypeptide
DEEEIRTTNPVAYEQYGCVCSNTGEHQENFISNPQT

SEQ ID NO: 170616 - protein, 35 aa, Artificial Sequence
  Description of Artificial Sequence: Synthetic polypeptide
DEHEIATTNPVAYEQWGSVCPNDLHRDNGDHNNEQ

SEQ ID NO: 170617 - protein, 35 aa, Artificial Sequence
  Description of Artificial Sequence: Synthetic polypeptide
DEEEIATTNPVATEQYGSCATGAAIDNPDAGGEMW

SEQ ID NO: 170618 - protein, 34 aa, Artificial Sequence
  Description of Artificial Sequence: Synthetic polypeptide
DEMEIVTTNPVATESYGTVCSATDGPVEFEGEND

SEQ ID NO: 170619 - protein, 36 aa, Artificial Sequence
  Description of Artificial Sequence: Synthetic polypeptide
DEHEICTTNPVATECYGSVTTGNQGNQGGHGGNGND

SEQ ID NO: 170620 - protein, 35 aa, Artificial Sequence
  Description of Artificial Sequence: Synthetic polypeptide
DEDEIACTNPVATEQYGSVCAMANHGQDSDGNENH

SEQ ID NO: 170621 - protein, 36 aa, Artificial Sequence
  Description of Artificial Sequence: Synthetic polypeptide
DEEEISTTNPVATEQYGCVCSWEEHNIENFGSDNQS

SEQ ID NO: 170622 - protein, 35 aa, Artificial Sequence
  Description of Artificial Sequence: Synthetic polypeptide
DEDCIRTTNPVATEQWGSVAWGNMFSIYNGGNNRN

SEQ ID NO: 170623 - protein, 35 aa, Artificial Sequence
  Description of Artificial Sequence: Synthetic polypeptide
DEEEISTTNPVATEQYGCVCSWEEHNINFNSQNQA

SEQ ID NO: 170624 - protein, 39 aa, Artificial Sequence
  Description of Artificial Sequence: Synthetic polypeptide
DEEEIRTTNPVATEQYGVVSTVVSVNNQQLGNNDEEGED

SEQ ID NO: 170625 - protein, 36 aa, Artificial Sequence
  Description of Artificial Sequence: Synthetic polypeptide
TEECIRTTNPVATEQYGCTVSCTQWEPSQFLGGNDP

SEQ ID NO: 170626 - protein, 35 aa, Artificial Sequence
  Description of Artificial Sequence: Synthetic polypeptide
DEHEICTTNPVAYEQWGSVCPNDLDRNEGDHNNED

SEQ ID NO: 170627 - protein, 36 aa, Artificial Sequence
  Description of Artificial Sequence: Synthetic polypeptide
DEHEIATTNPVAYEQWGSVCSNQANDHQEGRGGNSP

SEQ ID NO: 170628 - protein, 38 aa, Artificial Sequence
  Description of Artificial Sequence: Synthetic polypeptide
AEDEIRATNPVATEQYGSVSTTNQQQLENLQQGTNTQD

SEQ ID NO: 170629 - protein, 36 aa, Artificial Sequence
  Description of Artificial Sequence: Synthetic polypeptide
DEEEISTTNPVATEQYGCVCSWEEHNQEGFGSNNQD

SEQ ID NO: 170630 - protein, 31 aa, Artificial Sequence
  Description of Artificial Sequence: Synthetic polypeptide
QENEIATTNPVATECYGTVCSATDCPEHEEL

SEQ ID NO: 170631 - protein, 35 aa, Artificial Sequence
  Description of Artificial Sequence: Synthetic polypeptide
CEEEIATTNPVAYEQPYGVACSANLQPAAEGGNDM

SEQ ID NO: 170632 - protein, 33 aa, Artificial Sequence
  Description of Artificial Sequence: Synthetic polypeptide
DEAEIRTTNPVAYEQWGVVMGDNGNHQNGSGDE

SEQ ID NO: 170633 - protein, 34 aa, Artificial Sequence
  Description of Artificial Sequence: Synthetic polypeptide
TEECIRTTNPVATEQYGCVCSWEDHNANFLSNQA

SEQ ID NO: 170634 - protein, 35 aa, Artificial Sequence
  Description of Artificial Sequence: Synthetic polypeptide
DEEEISTTNPVATEQYGCVCSWEEHNQNFGSDTQS

SEQ ID NO: 170635 - protein, 33 aa, Artificial Sequence
  Description of Artificial Sequence: Synthetic polypeptide
TEECIRTTNPVATEQYGCVCSWEHNAYFISDQA

SEQ ID NO: 170636 - protein, 33 aa, Artificial Sequence
  Description of Artificial Sequence: Synthetic polypeptide
DEMEIVTTNPVATETYGTVCSATDGPVEFEGYD

SEQ ID NO: 170637 - protein, 38 aa, Artificial Sequence
  Description of Artificial Sequence: Synthetic polypeptide
AEDEIRATNPVATEQYGSVSTTNQQNNNQLQQGTNQQQ

SEQ ID NO: 170638 - protein, 32 aa, Artificial Sequence
  Description of Artificial Sequence: Synthetic polypeptide
DEHEIFTTNPVSTEPYGTISMEDIQQQQNGNH

SEQ ID NO: 170639 - protein, 36 aa, Artificial Sequence
  Description of Artificial Sequence: Synthetic polypeptide
CEEEIATTNPVAYEPQWGQSVSTVNDLMQDGIGDDE

SEQ ID NO: 170640 - protein, 33 aa, Artificial Sequence
  Description of Artificial Sequence: Synthetic polypeptide
DENEIRTTNPVSTEPYGTISPMEDIQQQQNGNH

SEQ ID NO: 170641 - protein, 32 aa, Artificial Sequence
  Description of Artificial Sequence: Synthetic polypeptide
DETEIRTTNPIATECWGSTTSEEDLMPKGPYI

SEQ ID NO: 170642 - protein, 38 aa, Artificial Sequence
  Description of Artificial Sequence: Synthetic polypeptide
DEEEIRTTNPVATEAYGVVSTVVNDQQGNNDTEGNNDD

SEQ ID NO: 170643 - protein, 35 aa, Artificial Sequence
  Description of Artificial Sequence: Synthetic polypeptide
DEEEISTTNPVATEQYGCVCSWEEHTESFGSNTQS

SEQ ID NO: 170644 - protein, 36 aa, Artificial Sequence
  Description of Artificial Sequence: Synthetic polypeptide
CEEEIATTNPVAYEPQWGQSVSTNDLMQDAGIGDDQ

SEQ ID NO: 170645 - protein, 38 aa, Artificial Sequence
  Description of Artificial Sequence: Synthetic polypeptide
DEEEIRTTNPVATEQYGVVSTVVSNQNQQGIGTTEQGQ

SEQ ID NO: 170646 - protein, 35 aa, Artificial Sequence
  Description of Artificial Sequence: Synthetic polypeptide
DESEIRTTNPVATECWGSVANCIDWPQEREGENYG

SEQ ID NO: 170647 - protein, 34 aa, Artificial Sequence
  Description of Artificial Sequence: Synthetic polypeptide
DEEEISTTNPVATEQYGCVCSWEHNANFNSDTQS

SEQ ID NO: 170648 - protein, 35 aa, Artificial Sequence
  Description of Artificial Sequence: Synthetic polypeptide
DEEEISTTNPVATEQYGCVCSWEHNEENFGSDTQA

SEQ ID NO: 170649 - protein, 33 aa, Artificial Sequence
  Description of Artificial Sequence: Synthetic polypeptide
DESEIRTTNPVATECWGSVANCIDEPAEREGPI

SEQ ID NO: 170650 - protein, 36 aa, Artificial Sequence
  Description of Artificial Sequence: Synthetic polypeptide
DEEEIRTTNPVAYEQYGCVCSNWEEHNQNFGSDNQS

SEQ ID NO: 170651 - protein, 30 aa, Artificial Sequence
  Description of Artificial Sequence: Synthetic polypeptide
QECEICATNPCTTEIYGVVATNTTQNGDTA

SEQ ID NO: 170652 - protein, 32 aa, Artificial Sequence
  Description of Artificial Sequence: Synthetic polypeptide
DETEIRTTNPIATECWGSTSNTDWADHKGEDI

SEQ ID NO: 170653 - protein, 34 aa, Artificial Sequence
  Description of Artificial Sequence: Synthetic polypeptide
DEHEIATTNPVAYEQWGSVAKTNDEQENGHGQVK

SEQ ID NO: 170654 - protein, 30 aa, Artificial Sequence
  Description of Artificial Sequence: Synthetic polypeptide
QECEICATNPCTTEIYGVVATNQELQNEDT

SEQ ID NO: 170655 - protein, 30 aa, Artificial Sequence
  Description of Artificial Sequence: Synthetic polypeptide
DEEEIATTNPIATECWGETAAVCQEPGEYK

SEQ ID NO: 170656 - protein, 35 aa, Artificial Sequence
  Description of Artificial Sequence: Synthetic polypeptide
DEEEISTTNPVATEQYGCVCSWEEHNQNFISDNQS

SEQ ID NO: 170657 - protein, 30 aa, Artificial Sequence
  Description of Artificial Sequence: Synthetic polypeptide
QECEICATNPCTTEIYGVVATNTLGNEGDT

SEQ ID NO: 170658 - protein, 35 aa, Artificial Sequence
  Description of Artificial Sequence: Synthetic polypeptide
DEEEISTTNPVATEQYGCVCSWEEHNQNFNSDTQA

SEQ ID NO: 170659 - protein, 35 aa, Artificial Sequence
  Description of Artificial Sequence: Synthetic polypeptide
TEECIRTTNPVATEQYGCVSCLQEEPSQFTGGNDP

SEQ ID NO: 170660 - protein, 31 aa, Artificial Sequence
  Description of Artificial Sequence: Synthetic polypeptide
SQEEIRTTNPVATEVWGTYSWNWTEVPINKT

SEQ ID NO: 170661 - protein, 35 aa, Artificial Sequence
  Description of Artificial Sequence: Synthetic polypeptide
DEEEISTTNPVATEQYGCVCSWEEHNQSFNSDTQA

SEQ ID NO: 170662 - protein, 37 aa, Artificial Sequence
  Description of Artificial Sequence: Synthetic polypeptide
DEEEIRTTNPVATEQYGSTTSSTTPAGPNMRNGMPPV

SEQ ID NO: 170663 - protein, 35 aa, Artificial Sequence
  Description of Artificial Sequence: Synthetic polypeptide
DEEEISTTNPVATEQYGCVCSWEEHQENFGSQFQG

SEQ ID NO: 170664 - protein, 29 aa, Artificial Sequence
  Description of Artificial Sequence: Synthetic peptide
QECEICATNPCTTEIYGVVATNTNQNEDT

SEQ ID NO: 170665 - protein, 35 aa, Artificial Sequence
  Description of Artificial Sequence: Synthetic polypeptide
DEEEISTTNPVATEQYGCVCSWEEHQENFNSDNQS

SEQ ID NO: 170666 - protein, 31 aa, Artificial Sequence
  Description of Artificial Sequence: Synthetic polypeptide
QECEICATNPCTTEIYGVVATNTNQNGNDTT

SEQ ID NO: 170667 - protein, 36 aa, Artificial Sequence
  Description of Artificial Sequence: Synthetic polypeptide
DEDCIRTTNPVATEQWGSVATTGNMSSMYNGGNNRN

SEQ ID NO: 170668 - protein, 33 aa, Artificial Sequence
  Description of Artificial Sequence: Synthetic polypeptide
DENEIRTTNPVSTEPYGTISPMEPIQQQQNGNH

SEQ ID NO: 170669 - protein, 34 aa, Artificial Sequence
  Description of Artificial Sequence: Synthetic polypeptide
DEMEIVTTNPVATERYGTVCSATDGPVEFEGNDP

SEQ ID NO: 170670 - protein, 35 aa, Artificial Sequence
  Description of Artificial Sequence: Synthetic polypeptide
QAEEIATTNPVAYEQYGSVATPHLPQDSMNDNDRM

SEQ ID NO: 170671 - protein, 38 aa, Artificial Sequence
  Description of Artificial Sequence: Synthetic polypeptide
DEEEIRTTNPVATEQYGVVSTVVSNQQQGTEQGTTVTE

SEQ ID NO: 170672 - protein, 34 aa, Artificial Sequence
  Description of Artificial Sequence: Synthetic polypeptide
DEHEIATTNPVAYEQWGSVCSTGDNQGEDHNKGQ

SEQ ID NO: 170673 - protein, 34 aa, Artificial Sequence
  Description of Artificial Sequence: Synthetic polypeptide
DEEEIATTNPVATEQYGSCAAGAPDFPMEMGNNE

SEQ ID NO: 170674 - protein, 37 aa, Artificial Sequence
  Description of Artificial Sequence: Synthetic polypeptide
DEEEISTTNPVATEQYGCVCSTGEDHNQEGFLSDNQS

SEQ ID NO: 170675 - protein, 36 aa, Artificial Sequence
  Description of Artificial Sequence: Synthetic polypeptide
DEEEISTTNPVATEQYGCVCSTGEDHNQEFFGSDQN

SEQ ID NO: 170676 - protein, 36 aa, Artificial Sequence
  Description of Artificial Sequence: Synthetic polypeptide
DEEEISTTNPVATEQYGCVCSTGEDHNIENFNSDAP

SEQ ID NO: 170677 - protein, 36 aa, Artificial Sequence
  Description of Artificial Sequence: Synthetic polypeptide
DEEEISTTNPVATEQYGCVCSTGEDHFQVYFGSEQS

SEQ ID NO: 170678 - protein, 36 aa, Artificial Sequence
  Description of Artificial Sequence: Synthetic polypeptide
DEEEIATTNPVATEQYGSCAAGNPLFNNQEPEEGVE

SEQ ID NO: 170679 - protein, 37 aa, Artificial Sequence
  Description of Artificial Sequence: Synthetic polypeptide
DEEEISTTNPVATEQYGCVCSTGEDHNQENFGSDNQL

SEQ ID NO: 170680 - protein, 35 aa, Artificial Sequence
  Description of Artificial Sequence: Synthetic polypeptide
DEEEIATTNPVATEQYGSCAAGPPGANGALMGNED

SEQ ID NO: 170681 - protein, 39 aa, Artificial Sequence
  Description of Artificial Sequence: Synthetic polypeptide
DEEEIRTTNPVATEAYGSVSVTVTLQQGNNQQGTNVATD

SEQ ID NO: 170682 - protein, 36 aa, Artificial Sequence
  Description of Artificial Sequence: Synthetic polypeptide
DEEEISTTNPVATEQYGCVCSTGEDDNQENFNSDQM

SEQ ID NO: 170683 - protein, 36 aa, Artificial Sequence
  Description of Artificial Sequence: Synthetic polypeptide
DEEEISTTNPVATEQYGCVCSTGEDDNQENFGSDQA

SEQ ID NO: 170684 - protein, 38 aa, Artificial Sequence
  Description of Artificial Sequence: Synthetic polypeptide
DEEEIRTTNPVAYEQYGQSTCSQLNDLLQARSGQITKN

SEQ ID NO: 170685 - protein, 34 aa, Artificial Sequence
  Description of Artificial Sequence: Synthetic polypeptide
SSEEIRTTNPVATCQYGCVCSWEHNQNFGSDNFA

SEQ ID NO: 170686 - protein, 33 aa, Artificial Sequence
  Description of Artificial Sequence: Synthetic polypeptide
SSEEIRTTNPVATCQYGCVCSWEDQENFGSDQS

SEQ ID NO: 170687 - protein, 34 aa, Artificial Sequence
  Description of Artificial Sequence: Synthetic polypeptide
DEMEIVTTNPVATEQYGYTVCSATDGPVEFESND

SEQ ID NO: 170688 - protein, 36 aa, Artificial Sequence
  Description of Artificial Sequence: Synthetic polypeptide
DEEEISTTNPVATEQYGCVCSTGEDHNQENFGSQQG

SEQ ID NO: 170689 - protein, 31 aa, Artificial Sequence
  Description of Artificial Sequence: Synthetic polypeptide
CEEEIATTNPVAYEQYGEAPCEVQSQHEGEK

SEQ ID NO: 170690 - protein, 39 aa, Artificial Sequence
  Description of Artificial Sequence: Synthetic polypeptide
DEEEIRTTNPVATEQYGVVSTTNQQLQQGTAEQGTTQDE

SEQ ID NO: 170691 - protein, 38 aa, Artificial Sequence
  Description of Artificial Sequence: Synthetic polypeptide
DEEEIRTTNPVATEQYGVVSTTNQQQQNATEQGVTVSE

SEQ ID NO: 170692 - protein, 33 aa, Artificial Sequence
  Description of Artificial Sequence: Synthetic polypeptide
DEMEIVTTNPVATEQYGVVCAATDGPVEHEGDD

SEQ ID NO: 170693 - protein, 33 aa, Artificial Sequence
  Description of Artificial Sequence: Synthetic polypeptide
TEECIATTNPVAYEQWGVVSKTNPEDGMGKNQE

SEQ ID NO: 170694 - protein, 35 aa, Artificial Sequence
  Description of Artificial Sequence: Synthetic polypeptide
DEAEIATTNPVAYEQYGSVATNNLEAEAPPDNLSN

SEQ ID NO: 170695 - protein, 36 aa, Artificial Sequence
  Description of Artificial Sequence: Synthetic polypeptide
DEEEIRTTNPVAYEQWGSVSGGESAGPNMRNGMNEV

SEQ ID NO: 170696 - protein, 37 aa, Artificial Sequence
  Description of Artificial Sequence: Synthetic polypeptide
AEDEIRATNPVATEQYGVVSTTNQQLNQLQQGTNQND

SEQ ID NO: 170697 - protein, 32 aa, Artificial Sequence
  Description of Artificial Sequence: Synthetic polypeptide
QAEEIATTNPVGTEQWGGCVAGNGLAANPGDR

SEQ ID NO: 170698 - protein, 38 aa, Artificial Sequence
  Description of Artificial Sequence: Synthetic polypeptide
DEEEIRTTNPVATEQYGVVSTTNQQQQNATESGSTDGE

SEQ ID NO: 170699 - protein, 36 aa, Artificial Sequence
  Description of Artificial Sequence: Synthetic polypeptide
DEEEISTTNPVATEQYGCVCSTGEDHNTNFGSDTQA

SEQ ID NO: 170700 - protein, 36 aa, Artificial Sequence
  Description of Artificial Sequence: Synthetic polypeptide
DEEEISTTNPVATEQYGCVCSWEDHNQENFGSDNQV

SEQ ID NO: 170701 - protein, 34 aa, Artificial Sequence
  Description of Artificial Sequence: Synthetic polypeptide
DEMEIVTTNPVATEQYGWTVCSATDGPVEFEGSD

SEQ ID NO: 170702 - protein, 39 aa, Artificial Sequence
  Description of Artificial Sequence: Synthetic polypeptide
DEEEIRTTNPVATEQYGVVSTTNQQLQQGTTEQGSTDDE

SEQ ID NO: 170703 - protein, 38 aa, Artificial Sequence
  Description of Artificial Sequence: Synthetic polypeptide
DEEEIRTTNPVATEQYGSYVYSEAPNGEIQVNGQGQPD

SEQ ID NO: 170704 - protein, 36 aa, Artificial Sequence
  Description of Artificial Sequence: Synthetic polypeptide
DEEEISTTNPVATEQYGCVCSTGEDHNQSSNSDNQG

SEQ ID NO: 170705 - protein, 37 aa, Artificial Sequence
  Description of Artificial Sequence: Synthetic polypeptide
DEEEIRTTNPVAYEQYGQSNCSQLNDLLQAMGQITKN

SEQ ID NO: 170706 - protein, 31 aa, Artificial Sequence
  Description of Artificial Sequence: Synthetic polypeptide
DDSEVASTNPVSTEGYGNVAANDIQSRVGQR

SEQ ID NO: 170707 - protein, 33 aa, Artificial Sequence
  Description of Artificial Sequence: Synthetic polypeptide
DESEIRTTNPVATECWGSVANCIDEPAEREGPG

SEQ ID NO: 170708 - protein, 35 aa, Artificial Sequence
  Description of Artificial Sequence: Synthetic polypeptide
QAEEIATTNPVAYEQYGSVPAIANNLTGQGGENEN

SEQ ID NO: 170709 - protein, 34 aa, Artificial Sequence
  Description of Artificial Sequence: Synthetic polypeptide
SSEEIRTTNPVATCQYGCVCSTGEHNQYFGSDQA

SEQ ID NO: 170710 - protein, 36 aa, Artificial Sequence
  Description of Artificial Sequence: Synthetic polypeptide
DEQEIATTNPVATEQYGSVSCTGDELSEDHEGGEDL

SEQ ID NO: 170711 - protein, 36 aa, Artificial Sequence
  Description of Artificial Sequence: Synthetic polypeptide
DEEEISTTNPVATEQYGCVCSWEEDHNQNFGSENQS

SEQ ID NO: 170712 - protein, 34 aa, Artificial Sequence
  Description of Artificial Sequence: Synthetic polypeptide
SSEEIATTNPVAYHQYGSVVSTQVHSQSGGNNFQ

SEQ ID NO: 170713 - protein, 39 aa, Artificial Sequence
  Description of Artificial Sequence: Synthetic polypeptide
DEEEIRTTNPVATEQYGSTVNTDLVNMEEQAIIGPVQNS

SEQ ID NO: 170714 - protein, 37 aa, Artificial Sequence
  Description of Artificial Sequence: Synthetic polypeptide
DEEEIRTTNPVATEQYGSTVISPIFNNVVMPINDEVP

SEQ ID NO: 170715 - protein, 37 aa, Artificial Sequence
  Description of Artificial Sequence: Synthetic polypeptide
DEAEIRTTNPVAYEQWGVVSVSPNNLVDQDNGGGMNH

SEQ ID NO: 170716 - protein, 39 aa, Artificial Sequence
  Description of Artificial Sequence: Synthetic polypeptide
DEEEIRTTNPVATEQYGSTVNTQLVNYEEQIIVGPPQNS

SEQ ID NO: 170717 - protein, 34 aa, Artificial Sequence
  Description of Artificial Sequence: Synthetic polypeptide
TEECIRSTNPVAYEQYGSTVSCMGEMLDHGENNA

SEQ ID NO: 170718 - protein, 34 aa, Artificial Sequence
  Description of Artificial Sequence: Synthetic polypeptide
DEDCIRTTNPVATEQWGVVFWNNNAAQELGQNKQ

SEQ ID NO: 170719 - protein, 35 aa, Artificial Sequence
  Description of Artificial Sequence: Synthetic polypeptide
DEEEISTTNPVATEQYGCVCSWEEDHNQNFNSQQA

SEQ ID NO: 170720 - protein, 34 aa, Artificial Sequence
  Description of Artificial Sequence: Synthetic polypeptide
DEAEIRTTNPVAYEQWGVVSHTGAPGEHQGQNDH

SEQ ID NO: 170721 - protein, 34 aa, Artificial Sequence
  Description of Artificial Sequence: Synthetic polypeptide
DEEEIATTNPVATEQYGSCATGAAIDNDAGETMW

SEQ ID NO: 170722 - protein, 35 aa, Artificial Sequence
  Description of Artificial Sequence: Synthetic polypeptide
DEEEISTTNPVATEQYGCVCSWEEDNQNFNSETQS

SEQ ID NO: 170723 - protein, 35 aa, Artificial Sequence
  Description of Artificial Sequence: Synthetic polypeptide
DEEEISTTNPVATEQYGCVCSWEEDQENFFSENQS

SEQ ID NO: 170724 - protein, 36 aa, Artificial Sequence
  Description of Artificial Sequence: Synthetic polypeptide
DEEEIRTTNPVATEQYGSTVGCPTPAGESQIMVLEV

SEQ ID NO: 170725 - protein, 36 aa, Artificial Sequence
  Description of Artificial Sequence: Synthetic polypeptide
AEEEIRTTNPVATEQYGQCVCSTGEHNENFGSETQA

SEQ ID NO: 170726 - protein, 35 aa, Artificial Sequence
  Description of Artificial Sequence: Synthetic polypeptide
DEAEIRTTNPVAYEQWGVVTGGNAGNQGIEGNADR

SEQ ID NO: 170727 - protein, 35 aa, Artificial Sequence
  Description of Artificial Sequence: Synthetic polypeptide
QAEEIATTNPVAYEQYGSVCSAANALEEADGNENQ

SEQ ID NO: 170728 - protein, 33 aa, Artificial Sequence
  Description of Artificial Sequence: Synthetic polypeptide
CEEEIATTNPVAYEQWGSVCAAANGLQSEEDDS

SEQ ID NO: 170729 - protein, 35 aa, Artificial Sequence
  Description of Artificial Sequence: Synthetic polypeptide
TEECIRATNPVATEQYGCVSCTLNEVSQFLPGDDC

SEQ ID NO: 170730 - protein, 31 aa, Artificial Sequence
  Description of Artificial Sequence: Synthetic polypeptide
DDSEVASTNPVSTEGYGNVAANDIQSRMGMR

SEQ ID NO: 170731 - protein, 31 aa, Artificial Sequence
  Description of Artificial Sequence: Synthetic polypeptide
DDSEVASTNPVSTEGYGNVAANEIQFREGQR

SEQ ID NO: 170732 - protein, 33 aa, Artificial Sequence
  Description of Artificial Sequence: Synthetic polypeptide
CEEEIATTNPVAYEQYGSCSAGPAPNNGLDNDN

SEQ ID NO: 170733 - protein, 32 aa, Artificial Sequence
  Description of Artificial Sequence: Synthetic polypeptide
DEHEIATTNPVAYMQWGCVPTWEKDQEQGNDS

SEQ ID NO: 170734 - protein, 30 aa, Artificial Sequence
  Description of Artificial Sequence: Synthetic polypeptide
DEDDCIACTNPVAYEQWGQVSAISVQNDNN

SEQ ID NO: 170735 - protein, 36 aa, Artificial Sequence
  Description of Artificial Sequence: Synthetic polypeptide
AEEEIRTTNPVATEQYGQCVCSSGEHNQNFGSENQS

SEQ ID NO: 170736 - protein, 32 aa, Artificial Sequence
  Description of Artificial Sequence: Synthetic polypeptide
DETEIRTTNPIATECWGITWANAENWQPKGTR

SEQ ID NO: 170737 - protein, 35 aa, Artificial Sequence
  Description of Artificial Sequence: Synthetic polypeptide
DEEEIATTNPVAYECWGSVCSGTDNQDRIDGGQEL

SEQ ID NO: 170738 - protein, 34 aa, Artificial Sequence
  Description of Artificial Sequence: Synthetic polypeptide
DEAEIRTTNPVAYEQWGVVTGGNGNQAGEGGADR

SEQ ID NO: 170739 - protein, 36 aa, Artificial Sequence
  Description of Artificial Sequence: Synthetic polypeptide
AEEEIRTTNPVATEQYGQCVCSTEEHNQENFGSDQA

SEQ ID NO: 170740 - protein, 33 aa, Artificial Sequence
  Description of Artificial Sequence: Synthetic polypeptide
QAEEIATTNPVAYEQYGSVCSAPPGGAEAINER

SEQ ID NO: 170741 - protein, 33 aa, Artificial Sequence
  Description of Artificial Sequence: Synthetic polypeptide
DEHEIATTNPVAYMQWGSVCTWEKDQPDQGNDS

SEQ ID NO: 170742 - protein, 36 aa, Artificial Sequence
  Description of Artificial Sequence: Synthetic polypeptide
AEEEIRTTNPVATEQYGQCVCSTEHNAEYFNSDFQA

SEQ ID NO: 170743 - protein, 39 aa, Artificial Sequence
  Description of Artificial Sequence: Synthetic polypeptide
DEEEIRTTNPVATEQYGVVSTVTNQQAGNQQGTTTNVAE

SEQ ID NO: 170744 - protein, 35 aa, Artificial Sequence
  Description of Artificial Sequence: Synthetic polypeptide
DEAEIRTTNPVAYEQWGVVCSGDHNLQDDKGDQMP

SEQ ID NO: 170745 - protein, 33 aa, Artificial Sequence
  Description of Artificial Sequence: Synthetic polypeptide
DESEIRTTNPVATECWGSVANAIDWPAEREGPI

SEQ ID NO: 170746 - protein, 35 aa, Artificial Sequence
  Description of Artificial Sequence: Synthetic polypeptide
CEEEIATTNPVAYEPQWGQSVAQNDGLQTDGITRD

SEQ ID NO: 170747 - protein, 34 aa, Artificial Sequence
  Description of Artificial Sequence: Synthetic polypeptide
CEEEIATTNPVATESYGSVAATAGGTTAEGPNNQ

SEQ ID NO: 170748 - protein, 35 aa, Artificial Sequence
  Description of Artificial Sequence: Synthetic polypeptide
DEEEIRTTNPVAYEQYGCVCSSGEHNQENFGSEQS

SEQ ID NO: 170749 - protein, 33 aa, Artificial Sequence
  Description of Artificial Sequence: Synthetic polypeptide
CEEEIATTNPVAYEQYGSCSQGPALNNGLDQQN

SEQ ID NO: 170750 - protein, 38 aa, Artificial Sequence
  Description of Artificial Sequence: Synthetic polypeptide
AEDEIRTTNPVATEQYGVVSTVTNNQQQLQGEGTTNVD

SEQ ID NO: 170751 - protein, 36 aa, Artificial Sequence
  Description of Artificial Sequence: Synthetic polypeptide
DEEEISTTNPVATEQYGCVCSWGEDHNQGFGSENQS

SEQ ID NO: 170752 - protein, 33 aa, Artificial Sequence
  Description of Artificial Sequence: Synthetic polypeptide
QAEEIATTNPVAYEPYGSVANTNADQTANPANN

SEQ ID NO: 170753 - protein, 37 aa, Artificial Sequence
  Description of Artificial Sequence: Synthetic polypeptide
AEEEIRTTNPVATEQYGSVATTTQQLQQANNNTEQGT

SEQ ID NO: 170754 - protein, 33 aa, Artificial Sequence
  Description of Artificial Sequence: Synthetic polypeptide
TEECISTTNPVATEQYGCVCSTEHNAYFLSDQA

SEQ ID NO: 170755 - protein, 37 aa, Artificial Sequence
  Description of Artificial Sequence: Synthetic polypeptide
DEEEIRTTNPVATEQYGVVSTVVTNGNEQGTTEEEDE

SEQ ID NO: 170756 - protein, 35 aa, Artificial Sequence
  Description of Artificial Sequence: Synthetic polypeptide
CEEEIATTNPVAYEQYGSCSTGQAGENNNLEDQRN

SEQ ID NO: 170757 - protein, 33 aa, Artificial Sequence
  Description of Artificial Sequence: Synthetic polypeptide
TEECISTTNPVATEQYGCVCSWEHNQNFGSDQF

SEQ ID NO: 170758 - protein, 37 aa, Artificial Sequence
  Description of Artificial Sequence: Synthetic polypeptide
AEEEIRTTNPVATEQYGSVATVTNNSEQGTTNVTTEA

SEQ ID NO: 170759 - protein, 36 aa, Artificial Sequence
  Description of Artificial Sequence: Synthetic polypeptide
DEEEIRTTNPVATEQYGAVVDGFTQDQTEEDGGGQD

SEQ ID NO: 170760 - protein, 35 aa, Artificial Sequence
  Description of Artificial Sequence: Synthetic polypeptide
DEEEISTTNPVATEQYGCVCSWGEDHNQYFGSEQS

SEQ ID NO: 170761 - protein, 33 aa, Artificial Sequence
  Description of Artificial Sequence: Synthetic polypeptide
TEECISTTNPVATEQYGCVCSTELNANFLSQQA

SEQ ID NO: 170762 - protein, 38 aa, Artificial Sequence
  Description of Artificial Sequence: Synthetic polypeptide
AEEEIRTTNPVATEQYGSVATTTNQQQGNNQQGTNNAE

SEQ ID NO: 170763 - protein, 35 aa, Artificial Sequence
  Description of Artificial Sequence: Synthetic polypeptide
DEEEIGTTNPVATEQYGCVCSMWGEHQNFNSDTQA

SEQ ID NO: 170764 - protein, 30 aa, Artificial Sequence
  Description of Artificial Sequence: Synthetic polypeptide
QENEIATTNPVATEFYGDVAVEGGGQGEEL

SEQ ID NO: 170765 - protein, 37 aa, Artificial Sequence
  Description of Artificial Sequence: Synthetic polypeptide
DEEEIRTTNPVATEQYGAVVDGFTQDLTNQIGGGQDS

SEQ ID NO: 170766 - protein, 31 aa, Artificial Sequence
  Description of Artificial Sequence: Synthetic polypeptide
YDSEIASTNPVCTEGYGVVAANNIQSRVGQR

SEQ ID NO: 170767 - protein, 36 aa, Artificial Sequence
  Description of Artificial Sequence: Synthetic polypeptide
DEEEISTTNPVATEQYGCVCSTEEDHNQNFGSDTQA

SEQ ID NO: 170768 - protein, 33 aa, Artificial Sequence
  Description of Artificial Sequence: Synthetic polypeptide
TEECIRTTNPVAYEQYGTTVSCFQNVSQSSDEN

SEQ ID NO: 170769 - protein, 31 aa, Artificial Sequence
  Description of Artificial Sequence: Synthetic polypeptide
QENEIATTNPVATECYGVVGEVEGELQTEEL

SEQ ID NO: 170770 - protein, 34 aa, Artificial Sequence
  Description of Artificial Sequence: Synthetic polypeptide
DEEEIGTTNPCAYAPYGESVAYTANEHSGQGGNG

SEQ ID NO: 170771 - protein, 36 aa, Artificial Sequence
  Description of Artificial Sequence: Synthetic polypeptide
DEEEIGTTNPVATEQYGCQVCSWGEHQENFGSENQS

SEQ ID NO: 170772 - protein, 39 aa, Artificial Sequence
  Description of Artificial Sequence: Synthetic polypeptide
DEEEIRTTNPVATEQYGVVSTVVSVTNTQQGTEEEEEEE

SEQ ID NO: 170773 - protein, 38 aa, Artificial Sequence
  Description of Artificial Sequence: Synthetic polypeptide
DEEEIRTTNPVATEQYGVVSTVVTDQAGTEQGTNQQQA

SEQ ID NO: 170774 - protein, 32 aa, Artificial Sequence
  Description of Artificial Sequence: Synthetic polypeptide
DETEIRTTNPIATECWGTVWSNAEGPAFKGND

SEQ ID NO: 170775 - protein, 36 aa, Artificial Sequence
  Description of Artificial Sequence: Synthetic polypeptide
DEEEISTTNPVATEQYGCVCSTEEDDQENFGSETQP

SEQ ID NO: 170776 - protein, 36 aa, Artificial Sequence
  Description of Artificial Sequence: Synthetic polypeptide
DEEEIGTTNPVATEQYGCVCSMTGEHNQNFNSDTQS

SEQ ID NO: 170777 - protein, 35 aa, Artificial Sequence
  Description of Artificial Sequence: Synthetic polypeptide
DEEEIRTTNPVAYEQYGCVCSSGEDHQNFGSDTQS

SEQ ID NO: 170778 - protein, 33 aa, Artificial Sequence
  Description of Artificial Sequence: Synthetic polypeptide
DEHEIATTNPVAYEQWGCVCDQDNQEQHNGNAN

SEQ ID NO: 170779 - protein, 38 aa, Artificial Sequence
  Description of Artificial Sequence: Synthetic polypeptide
DEHEIRSTNPVAYEQYGSVVSYTLNEQAQLRTVGNMAT

SEQ ID NO: 170780 - protein, 36 aa, Artificial Sequence
  Description of Artificial Sequence: Synthetic polypeptide
DEEEIRTTNPVAYEQYGCVCSTEEHEQEYFNSDTQS

SEQ ID NO: 170781 - protein, 36 aa, Artificial Sequence
  Description of Artificial Sequence: Synthetic polypeptide
DEHEIATTNPVAYEQWGEVSIPNAGDDQDRQGDDNR

SEQ ID NO: 170782 - protein, 35 aa, Artificial Sequence
  Description of Artificial Sequence: Synthetic polypeptide
DEEEISTTNPVATEQYGCVCSWGEDHNQYFNSEQA

SEQ ID NO: 170783 - protein, 35 aa, Artificial Sequence
  Description of Artificial Sequence: Synthetic polypeptide
DEEEISTTNPVATEQYGCVCSWGEDHQNFNSQTQS

SEQ ID NO: 170784 - protein, 31 aa, Artificial Sequence
  Description of Artificial Sequence: Synthetic polypeptide
DDSEVASTNPVSTEGYGNVAANDHQNRVGQR

SEQ ID NO: 170785 - protein, 33 aa, Artificial Sequence
  Description of Artificial Sequence: Synthetic polypeptide
DEHEIATTNPVAYEPWGSVYCTNQGEDMGNNGH

SEQ ID NO: 170786 - protein, 34 aa, Artificial Sequence
  Description of Artificial Sequence: Synthetic polypeptide
SQEEIRTTNPVATEQWGCVCSWEDNQNFGSENQA

SEQ ID NO: 170787 - protein, 36 aa, Artificial Sequence
  Description of Artificial Sequence: Synthetic polypeptide
QAEEIATTNPVATEQYGSVCSTNPLPLDSMIGDAEE

SEQ ID NO: 170788 - protein, 36 aa, Artificial Sequence
  Description of Artificial Sequence: Synthetic polypeptide
DEEEIRTTNPVAYEQYGCVCSTGEHNQENFGSETQS

SEQ ID NO: 170789 - protein, 33 aa, Artificial Sequence
  Description of Artificial Sequence: Synthetic polypeptide
DEMEIVTTNPVATEYYGTVCSAWDGPVEFEGND

SEQ ID NO: 170790 - protein, 34 aa, Artificial Sequence
  Description of Artificial Sequence: Synthetic polypeptide
DEEEISTTNPVATEQYGCVCSSPHAENFNSETQS

SEQ ID NO: 170791 - protein, 35 aa, Artificial Sequence
  Description of Artificial Sequence: Synthetic polypeptide
DESEIRTTNPVATECWGSTWSNCINEPAERKGENI

SEQ ID NO: 170792 - protein, 36 aa, Artificial Sequence
  Description of Artificial Sequence: Synthetic polypeptide
DEEEIRTTNPVAYEQYGCVCSTGEHNQENFNSETQS

SEQ ID NO: 170793 - protein, 34 aa, Artificial Sequence
  Description of Artificial Sequence: Synthetic polypeptide
SQEEIRTTNPVATEQWGCVCSTGEDNQNFNSDQA

SEQ ID NO: 170794 - protein, 37 aa, Artificial Sequence
  Description of Artificial Sequence: Synthetic polypeptide
DEEEIRTTNPVATEQYGCVCSTEEDHNQENFNSDTQA

SEQ ID NO: 170795 - protein, 29 aa, Artificial Sequence
  Description of Artificial Sequence: Synthetic peptide
DDSEVASVNPVSTEGYGNVANTIQSRGNQ

SEQ ID NO: 170796 - protein, 33 aa, Artificial Sequence
  Description of Artificial Sequence: Synthetic polypeptide
CEEEIATTNPVAYEQYGSTAGTHLTGTPDGSEN

SEQ ID NO: 170797 - protein, 37 aa, Artificial Sequence
  Description of Artificial Sequence: Synthetic polypeptide
DEEEIRTTNPVATEQYGCVCSTEEDHNQEGFGSDTQS

SEQ ID NO: 170798 - protein, 36 aa, Artificial Sequence
  Description of Artificial Sequence: Synthetic polypeptide
DEEEIRTTNPVAYEQYGQCVCSWNDDNQEGFGSDQF

SEQ ID NO: 170799 - protein, 33 aa, Artificial Sequence
  Description of Artificial Sequence: Synthetic polypeptide
SQEEIRTTNPVATEQWGCVCSWEHNQGFGSQQA

SEQ ID NO: 170800 - protein, 33 aa, Artificial Sequence
  Description of Artificial Sequence: Synthetic polypeptide
DEMEIVTTNPVATEYYGTVCSATDGPVEFEGSD

SEQ ID NO: 170801 - protein, 34 aa, Artificial Sequence
  Description of Artificial Sequence: Synthetic polypeptide
SQEEIRTTNPVATEQWGCVCSWGNHNQNFNSNQA

SEQ ID NO: 170802 - protein, 38 aa, Artificial Sequence
  Description of Artificial Sequence: Synthetic polypeptide
DEEEIRTTNPVATEQYGVVSTVVTNGNNNNQQGTEETE

SEQ ID NO: 170803 - protein, 37 aa, Artificial Sequence
  Description of Artificial Sequence: Synthetic polypeptide
AEEEIRTTNPVATEQYGSVATVTNVTNNAEDGTNNAT

SEQ ID NO: 170804 - protein, 36 aa, Artificial Sequence
  Description of Artificial Sequence: Synthetic polypeptide
DEEEISTTNPVATEQYGCVCSTEDHNQESSNSDNQS

SEQ ID NO: 170805 - protein, 37 aa, Artificial Sequence
  Description of Artificial Sequence: Synthetic polypeptide
AEEEIRTTNPVATEQYGSVATVTTNAEQGTTNVTTED

SEQ ID NO: 170806 - protein, 36 aa, Artificial Sequence
  Description of Artificial Sequence: Synthetic polypeptide
DEEEISTTNPVATEQYGCVCSWGEDNQENFGSENQA

SEQ ID NO: 170807 - protein, 35 aa, Artificial Sequence
  Description of Artificial Sequence: Synthetic polypeptide
TEECISTTNPVAYEHYGQSTVAVTCELAQRGGERG

SEQ ID NO: 170808 - protein, 32 aa, Artificial Sequence
  Description of Artificial Sequence: Synthetic polypeptide
QENEIATTNPVATEGYGCVCSSELNQHESEQA

SEQ ID NO: 170809 - protein, 33 aa, Artificial Sequence
  Description of Artificial Sequence: Synthetic polypeptide
DEDEIACTNPVAYEQWGCVATNLQDDPGEETAN

SEQ ID NO: 170810 - protein, 35 aa, Artificial Sequence
  Description of Artificial Sequence: Synthetic polypeptide
DEEEIRTTNPVAYEQYGCVCSTEEHNQENFISDQA

SEQ ID NO: 170811 - protein, 32 aa, Artificial Sequence
  Description of Artificial Sequence: Synthetic polypeptide
QENEIATTNPVATEGYGCVCSWEDLQHISELA

SEQ ID NO: 170812 - protein, 36 aa, Artificial Sequence
  Description of Artificial Sequence: Synthetic polypeptide
DEEEISTTNPVATEQYGCVCSTEAHNQENFGSETQA

SEQ ID NO: 170813 - protein, 31 aa, Artificial Sequence
  Description of Artificial Sequence: Synthetic polypeptide
QENEIATTNPVATEGYGCVCSWEDQHESEQA

SEQ ID NO: 170814 - protein, 35 aa, Artificial Sequence
  Description of Artificial Sequence: Synthetic polypeptide
DEEEISTTNPVATEQYGCVCSWGEDNQFFNSDNQS

SEQ ID NO: 170815 - protein, 35 aa, Artificial Sequence
  Description of Artificial Sequence: Synthetic polypeptide
DEEEISTTNPVATEQYGCVCSWGEDNQGFNSENQG

SEQ ID NO: 170816 - protein, 36 aa, Artificial Sequence
  Description of Artificial Sequence: Synthetic polypeptide
DEEEISTTNPVATEQYGCVCSWGEDNTENFNSDNQS

SEQ ID NO: 170817 - protein, 36 aa, Artificial Sequence
  Description of Artificial Sequence: Synthetic polypeptide
DEAEIRTTNPVAYEQYGQVWVTAATNDLLQERSQIP

SEQ ID NO: 170818 - protein, 33 aa, Artificial Sequence
  Description of Artificial Sequence: Synthetic polypeptide
DEMEIRTTNPVATEQWGTVCAAADGPVAFEGND

SEQ ID NO: 170819 - protein, 36 aa, Artificial Sequence
  Description of Artificial Sequence: Synthetic polypeptide
DEEEISTTNPVATEQYGCVCSTEEDNQENFISDNQA

SEQ ID NO: 170820 - protein, 30 aa, Artificial Sequence
  Description of Artificial Sequence: Synthetic polypeptide
YDSEIASTNPVSTEGYGNVAADNIQSSGQR

SEQ ID NO: 170821 - protein, 34 aa, Artificial Sequence
  Description of Artificial Sequence: Synthetic polypeptide
AEEEIRTTNPVATEEYGQCSCSWEHNQYFGSDQG

SEQ ID NO: 170822 - protein, 31 aa, Artificial Sequence
  Description of Artificial Sequence: Synthetic polypeptide
DEAEIRTTNPVAYEQWGTVSKEIEKNAAEDA

SEQ ID NO: 170823 - protein, 34 aa, Artificial Sequence
  Description of Artificial Sequence: Synthetic polypeptide
QAEEIATTNPVAYEQYGSTTAGTNLTTAEGGNEN

SEQ ID NO: 170824 - protein, 31 aa, Artificial Sequence
  Description of Artificial Sequence: Synthetic polypeptide
DETEIRTTNPIATECWGSTWSEDWAEPKGPI

SEQ ID NO: 170825 - protein, 34 aa, Artificial Sequence
  Description of Artificial Sequence: Synthetic polypeptide
DEHEIATTNPVAYEQWGSVAGGPNGNQGAMNGND

SEQ ID NO: 170826 - protein, 34 aa, Artificial Sequence
  Description of Artificial Sequence: Synthetic polypeptide
DEHEIATTNPVAYEQWGSTVTGPNGNQGAGNGPM

SEQ ID NO: 170827 - protein, 37 aa, Artificial Sequence
  Description of Artificial Sequence: Synthetic polypeptide
DEEEIRTTNPVATEQYGAVVDGFTQDLTNQDIGGQDI

SEQ ID NO: 170828 - protein, 36 aa, Artificial Sequence
  Description of Artificial Sequence: Synthetic polypeptide
DEEEIRTTNPVAYEQWGSVSGGEPPGPNMRNGMNMQ

SEQ ID NO: 170829 - protein, 32 aa, Artificial Sequence
  Description of Artificial Sequence: Synthetic polypeptide
DENEIRTTNPVSTEPYGTISPEDIQQQQNQNH

SEQ ID NO: 170830 - protein, 33 aa, Artificial Sequence
  Description of Artificial Sequence: Synthetic polypeptide
DETEIRTTNPIATECWGSVWAAINWAEPKGNYI

SEQ ID NO: 170831 - protein, 33 aa, Artificial Sequence
  Description of Artificial Sequence: Synthetic polypeptide
DETEIRTTNPIATECWGSVWACINEADPKGNYI

SEQ ID NO: 170832 - protein, 33 aa, Artificial Sequence
  Description of Artificial Sequence: Synthetic polypeptide
TEECIRTTNPVAYDQYGTTVSCTQHVSQSSGEN

SEQ ID NO: 170833 - protein, 35 aa, Artificial Sequence
  Description of Artificial Sequence: Synthetic polypeptide
DEEEIRTTNPVAYEQYGCVCSNWGEDQENFNSNQS

SEQ ID NO: 170834 - protein, 37 aa, Artificial Sequence
  Description of Artificial Sequence: Synthetic polypeptide
DEEEIRTTNPVATEAYGVVSTVVNNNNDEQGTNDEDE

SEQ ID NO: 170835 - protein, 34 aa, Artificial Sequence
  Description of Artificial Sequence: Synthetic polypeptide
AEEEIRTTNPVATEEYGCYCSWNHQEYFGSDTQA

SEQ ID NO: 170836 - protein, 31 aa, Artificial Sequence
  Description of Artificial Sequence: Synthetic polypeptide
DDSEVASTNPVSTEGYGNVAANEIQSRVGQR

SEQ ID NO: 170837 - protein, 35 aa, Artificial Sequence
  Description of Artificial Sequence: Synthetic polypeptide
DETEIRTTNPIATECWGSTVWSNCIDEPQERKGNG

SEQ ID NO: 170838 - protein, 30 aa, Artificial Sequence
  Description of Artificial Sequence: Synthetic polypeptide
YDSEIASVNPVSTEGYGNVAADNIQSSGNR

SEQ ID NO: 170839 - protein, 34 aa, Artificial Sequence
  Description of Artificial Sequence: Synthetic polypeptide
DEMEIVTTNPVATEWYGTVCSATDGPVEFEGNDH

SEQ ID NO: 170840 - protein, 35 aa, Artificial Sequence
  Description of Artificial Sequence: Synthetic polypeptide
QAEEIATTNPVAYEQYGSVAAIANNLQDQGGGNEN

SEQ ID NO: 170841 - protein, 38 aa, Artificial Sequence
  Description of Artificial Sequence: Synthetic polypeptide
DEEEIRTTNPVATEQYGVVSTVTNQQGNQETATNVATE

SEQ ID NO: 170842 - protein, 35 aa, Artificial Sequence
  Description of Artificial Sequence: Synthetic polypeptide
DEMEIRTTNPVATEQYGCNVSCPHNSEDSESQQRE

SEQ ID NO: 170843 - protein, 35 aa, Artificial Sequence
  Description of Artificial Sequence: Synthetic polypeptide
DEEEIRTTNPVAYEQYGCVCSNWEHQEYFNSETQS

SEQ ID NO: 170844 - protein, 35 aa, Artificial Sequence
  Description of Artificial Sequence: Synthetic polypeptide
DEEEISTTNPVATEQYGCVCSWEHNQEHFNSDTQA

SEQ ID NO: 170845 - protein, 35 aa, Artificial Sequence
  Description of Artificial Sequence: Synthetic polypeptide
DEHEINTTNPVATEEWGETVVSINELSQESNGGNQ

SEQ ID NO: 170846 - protein, 36 aa, Artificial Sequence
  Description of Artificial Sequence: Synthetic polypeptide
DEHEINTTNPVATEQYGKTISYTNEFSGVREGGSNQ

SEQ ID NO: 170847 - protein, 34 aa, Artificial Sequence
  Description of Artificial Sequence: Synthetic polypeptide
DEEEISTTNPVATEQYGCVCSWEHNQENFSSEQS

SEQ ID NO: 170848 - protein, 36 aa, Artificial Sequence
  Description of Artificial Sequence: Synthetic polypeptide
AEEEIRTTNPVATEQYGSAQPAAVNLDIMIEPGNAL

SEQ ID NO: 170849 - protein, 36 aa, Artificial Sequence
  Description of Artificial Sequence: Synthetic polypeptide
DEDCIRTTNPVATEQWGSVATCPNMESTYNGGNNRN

SEQ ID NO: 170850 - protein, 35 aa, Artificial Sequence
  Description of Artificial Sequence: Synthetic polypeptide
DEEEISTTNPVATEQYGCVCSWEHNQEYFNSENQA

SEQ ID NO: 170851 - protein, 36 aa, Artificial Sequence
  Description of Artificial Sequence: Synthetic polypeptide
DEDCIRTTNPVATEQWGSVATAGNMESAYNGGNNRN

SEQ ID NO: 170852 - protein, 34 aa, Artificial Sequence
  Description of Artificial Sequence: Synthetic polypeptide
DEEEIRTTNPVSTEGYGSVSREAFASERVTFEPP

SEQ ID NO: 170853 - protein, 35 aa, Artificial Sequence
  Description of Artificial Sequence: Synthetic polypeptide
DEDEIACTNPVATEQYGSVCATNNPEQQANQTEGT

SEQ ID NO: 170854 - protein, 34 aa, Artificial Sequence
  Description of Artificial Sequence: Synthetic polypeptide
DEAEIRTTNPVAYEQWGSVVIVNGNDDHHGTNDQ

SEQ ID NO: 170855 - protein, 34 aa, Artificial Sequence
  Description of Artificial Sequence: Synthetic polypeptide
DEHEIATTNPVAYEQWGEVVPTDNGNQSNGGERN

SEQ ID NO: 170856 - protein, 33 aa, Artificial Sequence
  Description of Artificial Sequence: Synthetic polypeptide
TEECIRTTNPVAYENYGTTISCTQNVSQSSGEN

SEQ ID NO: 170857 - protein, 36 aa, Artificial Sequence
  Description of Artificial Sequence: Synthetic polypeptide
DEEEIRTTNPVAYEQWGSVSGGEPPGPNMRNGGNPV

SEQ ID NO: 170858 - protein, 36 aa, Artificial Sequence
  Description of Artificial Sequence: Synthetic polypeptide
DEEEIRTTNPVAYEQWGSVSGGEPAGPNMRNGGGTM

SEQ ID NO: 170859 - protein, 38 aa, Artificial Sequence
  Description of Artificial Sequence: Synthetic polypeptide
DEEEIRTTNPVATEAYGVVSTVVNNNQEQGNNQNEEDE

SEQ ID NO: 170860 - protein, 35 aa, Artificial Sequence
  Description of Artificial Sequence: Synthetic polypeptide
DEAEIRTTNPVAYEQWGSVVCNTPDDDHRGHTDRE

SEQ ID NO: 170861 - protein, 36 aa, Artificial Sequence
  Description of Artificial Sequence: Synthetic polypeptide
DEEEISTTNPVATEQYGCVCSWGADHQENFGSDNQA

SEQ ID NO: 170862 - protein, 37 aa, Artificial Sequence
  Description of Artificial Sequence: Synthetic polypeptide
DEEEIRTTNPVATEAYGVVSTVVNNNQQGTTTEEEED

SEQ ID NO: 170863 - protein, 34 aa, Artificial Sequence
  Description of Artificial Sequence: Synthetic polypeptide
DEHEIATTNPVAYEQWGSTSTNPNGNGMGGGNNM

SEQ ID NO: 170864 - protein, 35 aa, Artificial Sequence
  Description of Artificial Sequence: Synthetic polypeptide
DEEEIRTTNPVAYEQYGCVCSNWGEHQENFGSEAL

SEQ ID NO: 170865 - protein, 34 aa, Artificial Sequence
  Description of Artificial Sequence: Synthetic polypeptide
DEHEIATTNPVAYEQWGSTSTNNPNGDADGGNTE

SEQ ID NO: 170866 - protein, 33 aa, Artificial Sequence
  Description of Artificial Sequence: Synthetic polypeptide
CEEEIATTNPVAWEQYGSTSCTGPAPVMTVNNE

SEQ ID NO: 170867 - protein, 36 aa, Artificial Sequence
  Description of Artificial Sequence: Synthetic polypeptide
DEEEISTTNPVATEQYGCVCSTEEHNQENFQSNTQA

SEQ ID NO: 170868 - protein, 35 aa, Artificial Sequence
  Description of Artificial Sequence: Synthetic polypeptide
DEEEISTTNPVATEQYGCVCSWGEDDQENFNSDQG

SEQ ID NO: 170869 - protein, 38 aa, Artificial Sequence
  Description of Artificial Sequence: Synthetic polypeptide
DEHEIRSTNPVAYEQYGISVVSYTLNEQAQLRVGNPAT

SEQ ID NO: 170870 - protein, 36 aa, Artificial Sequence
  Description of Artificial Sequence: Synthetic polypeptide
DEEEISTTNPVATEQYGCVCSTEEHNQENFGSQPQL

SEQ ID NO: 170871 - protein, 30 aa, Artificial Sequence
  Description of Artificial Sequence: Synthetic polypeptide
YDSEIASTNPVSTEGYGNVAANNIQSSGQR

SEQ ID NO: 170872 - protein, 36 aa, Artificial Sequence
  Description of Artificial Sequence: Synthetic polypeptide
DEEEIRTTNPVATEQYGCVCSTEEHNEENFISDPQA

SEQ ID NO: 170873 - protein, 36 aa, Artificial Sequence
  Description of Artificial Sequence: Synthetic polypeptide
DEEEIRTTNPVATEQYGCVCSTEEHNQENFISDPQL

SEQ ID NO: 170874 - protein, 36 aa, Artificial Sequence
  Description of Artificial Sequence: Synthetic polypeptide
DEEEIRTTNPVAYEQWGSVSGGEPAGPNMRNGMGNS

SEQ ID NO: 170875 - protein, 35 aa, Artificial Sequence
  Description of Artificial Sequence: Synthetic polypeptide
DEEEISTTNPVATEQYGCVCSTEEHTESFGSDTQA

SEQ ID NO: 170876 - protein, 36 aa, Artificial Sequence
  Description of Artificial Sequence: Synthetic polypeptide
DEEEIRTTNPVAYEQWGSVSGGEPPGGNMRNGMNPE

SEQ ID NO: 170877 - protein, 37 aa, Artificial Sequence
  Description of Artificial Sequence: Synthetic polypeptide
DEEEIRTTNPVAYEQWGSVSGGEPGNGGNMRNMGNEM

SEQ ID NO: 170878 - protein, 38 aa, Artificial Sequence
  Description of Artificial Sequence: Synthetic polypeptide
AEDEIRATNPVATEQYGSVSTTNQQNLNQLQQGTNQDT

SEQ ID NO: 170879 - protein, 37 aa, Artificial Sequence
  Description of Artificial Sequence: Synthetic polypeptide
DEEEIRTTNPVAYEQWGSVSGGEPGNGGNMRNGSNPE

SEQ ID NO: 170880 - protein, 35 aa, Artificial Sequence
  Description of Artificial Sequence: Synthetic polypeptide
TEECIRTTNPVAYEQFGTTVSCTQNVSQQSSGENI

SEQ ID NO: 170881 - protein, 37 aa, Artificial Sequence
  Description of Artificial Sequence: Synthetic polypeptide
DEEEIRTTNPVAYEQWGSVSGGEPGNGGNMRNGQNDS

SEQ ID NO: 170882 - protein, 37 aa, Artificial Sequence
  Description of Artificial Sequence: Synthetic polypeptide
DEEEIRTTNPVAYEQWGSVSGGEPGNGGNMRGGVNME

SEQ ID NO: 170883 - protein, 37 aa, Artificial Sequence
  Description of Artificial Sequence: Synthetic polypeptide
AEEEIRTTNPVATEQYGSVATTLVNNGNEEIGTTTDD

SEQ ID NO: 170884 - protein, 38 aa, Artificial Sequence
  Description of Artificial Sequence: Synthetic polypeptide
DEEEIRTTNPVATEQYGVVSTVVSNNQNSEQGTTEEED

SEQ ID NO: 170885 - protein, 37 aa, Artificial Sequence
  Description of Artificial Sequence: Synthetic polypeptide
DEEEIRTTNPVAYEQWGSVSGGEPGNGGNMQNGMNGM

SEQ ID NO: 170886 - protein, 39 aa, Artificial Sequence
  Description of Artificial Sequence: Synthetic polypeptide
DEEEIRTTNPVATEQYGVVSTVVSNNQAGTENGGNEEDE

SEQ ID NO: 170887 - protein, 36 aa, Artificial Sequence
  Description of Artificial Sequence: Synthetic polypeptide
DEEEIRTTNPVATEQYGSVADPENGVQMQYTVEAED

SEQ ID NO: 170888 - protein, 35 aa, Artificial Sequence
  Description of Artificial Sequence: Synthetic polypeptide
DEEEIRTTNPVAYEQYGCVCSNWGEHNQYFGSDQS

SEQ ID NO: 170889 - protein, 38 aa, Artificial Sequence
  Description of Artificial Sequence: Synthetic polypeptide
AEEEIRTTNPVATEQYGSVATTNNQQQGNNQAGNNQAN

SEQ ID NO: 170890 - protein, 36 aa, Artificial Sequence
  Description of Artificial Sequence: Synthetic polypeptide
DEEEIRTTNPVAYEQWGSVSGGEPAGPNMRNGMNTE

SEQ ID NO: 170891 - protein, 32 aa, Artificial Sequence
  Description of Artificial Sequence: Synthetic polypeptide
DDEEIASTNPVSTEGYGNVAANTINMRNGMQR

SEQ ID NO: 170892 - protein, 35 aa, Artificial Sequence
  Description of Artificial Sequence: Synthetic polypeptide
DEEEISTTNPVATEQYGCVCSSMEHQEHFGSDTQS

SEQ ID NO: 170893 - protein, 36 aa, Artificial Sequence
  Description of Artificial Sequence: Synthetic polypeptide
DEEEISTTNPVATEQYGCVCSTWMEHQEGFGSEFQG

SEQ ID NO: 170894 - protein, 37 aa, Artificial Sequence
  Description of Artificial Sequence: Synthetic polypeptide
DEEEISTTNPVATEQYGCVCSTWGEHNTEGFGSENQA

SEQ ID NO: 170895 - protein, 36 aa, Artificial Sequence
  Description of Artificial Sequence: Synthetic polypeptide
DEEEIRTTNPVATEQYGTQIDNTNMIEQHQVAHMNE

SEQ ID NO: 170896 - protein, 36 aa, Artificial Sequence
  Description of Artificial Sequence: Synthetic polypeptide
DEQEIATTNPVATEQYGSVSSATPDGPNDHEGMEDV

SEQ ID NO: 170897 - protein, 35 aa, Artificial Sequence
  Description of Artificial Sequence: Synthetic polypeptide
DEMEIRTTNPVATEQYGCICSWGEDTQYFGSDNQS

SEQ ID NO: 170898 - protein, 33 aa, Artificial Sequence
  Description of Artificial Sequence: Synthetic polypeptide
DEAEIRTTNPVAYEQYGCICSTEHNENFNSDQA

SEQ ID NO: 170899 - protein, 34 aa, Artificial Sequence
  Description of Artificial Sequence: Synthetic polypeptide
DEMEIRTTNPVATEQYGCICSWGETNINFNSDQS

SEQ ID NO: 170900 - protein, 38 aa, Artificial Sequence
  Description of Artificial Sequence: Synthetic polypeptide
DEEEICTTNPVATEQYGSVSGNVTNGGEGQNEDQDEEQ

SEQ ID NO: 170901 - protein, 35 aa, Artificial Sequence
  Description of Artificial Sequence: Synthetic polypeptide
SSSEIRTTNPVATEQYGASACVATVNHLEQEEDQE

SEQ ID NO: 170902 - protein, 35 aa, Artificial Sequence
  Description of Artificial Sequence: Synthetic polypeptide
SSSEIRCTNPVAYEQYGISVPCTGNELQPHGGNNN

SEQ ID NO: 170903 - protein, 36 aa, Artificial Sequence
  Description of Artificial Sequence: Synthetic polypeptide
DEEEISTTNPVATEQYGCVCSTGPHNEENFGSDTQS

SEQ ID NO: 170904 - protein, 34 aa, Artificial Sequence
  Description of Artificial Sequence: Synthetic polypeptide
DEEEIATTNPSATEQYGSVPPCVTQDHWQNQFVD

SEQ ID NO: 170905 - protein, 37 aa, Artificial Sequence
  Description of Artificial Sequence: Synthetic polypeptide
DEEEIRTTNPVAYEQWGSVSSGDPLNGPNMRNGDNPV

SEQ ID NO: 170906 - protein, 32 aa, Artificial Sequence
  Description of Artificial Sequence: Synthetic polypeptide
DDSEIVSTNPVATEGYGNVAATDTIQSREGQD

SEQ ID NO: 170907 - protein, 32 aa, Artificial Sequence
  Description of Artificial Sequence: Synthetic polypeptide
DDSEIVSTNPVATEGYGNVAANDTIQSREGQD

SEQ ID NO: 170908 - protein, 37 aa, Artificial Sequence
  Description of Artificial Sequence: Synthetic polypeptide
AEEEIRTTNPVATEQYGCVCSNTGEHNQENFGSDNQS

SEQ ID NO: 170909 - protein, 35 aa, Artificial Sequence
  Description of Artificial Sequence: Synthetic polypeptide
DEMEIVTTNPVATEQYGTVSSTTPAPVEFEGMNPD

SEQ ID NO: 170910 - protein, 33 aa, Artificial Sequence
  Description of Artificial Sequence: Synthetic polypeptide
DEAEIRTTNPVAYEQYGCICSTEDLENFPSDQA

SEQ ID NO: 170911 - protein, 34 aa, Artificial Sequence
  Description of Artificial Sequence: Synthetic polypeptide
DEAEIRTTNPVAYEQYGCICSTELEENFPSDNQA

SEQ ID NO: 170912 - protein, 34 aa, Artificial Sequence
  Description of Artificial Sequence: Synthetic polypeptide
DEHEIATTNPVAYEQWGSVTGPNGNQQAGQNGID

SEQ ID NO: 170913 - protein, 36 aa, Artificial Sequence
  Description of Artificial Sequence: Synthetic polypeptide
DEEEISTTNPVATEQYGCVCSTMEHNAENFNSENQA

SEQ ID NO: 170914 - protein, 33 aa, Artificial Sequence
  Description of Artificial Sequence: Synthetic polypeptide
DEAEIRTTNPVAYEQYGCICSTGEDERFPSDQS

SEQ ID NO: 170915 - protein, 32 aa, Artificial Sequence
  Description of Artificial Sequence: Synthetic polypeptide
YEDEIRCTNPAATEQYGAVVSEGGLGGEGGET

SEQ ID NO: 170916 - protein, 34 aa, Artificial Sequence
  Description of Artificial Sequence: Synthetic polypeptide
DEMEIRTTNPVATEQYGCICSWETQEYFNSDNQS

SEQ ID NO: 170917 - protein, 38 aa, Artificial Sequence
  Description of Artificial Sequence: Synthetic polypeptide
DEEEIRTTNPVATEAYGSVSTTQQQGNNNQQATNVATE

SEQ ID NO: 170918 - protein, 35 aa, Artificial Sequence
  Description of Artificial Sequence: Synthetic polypeptide
SSYEIRMTNPVATEQYGSVETVNLTEEHTGSNQQV

SEQ ID NO: 170919 - protein, 36 aa, Artificial Sequence
  Description of Artificial Sequence: Synthetic polypeptide
DEEEIRTTNPVATEQYGTAYEICTTLPLQPRAEEEQ

SEQ ID NO: 170920 - protein, 35 aa, Artificial Sequence
  Description of Artificial Sequence: Synthetic polypeptide
DEMEIRTTNPVATEQYGCCSVADNDVEQLEPDEDT

SEQ ID NO: 170921 - protein, 31 aa, Artificial Sequence
  Description of Artificial Sequence: Synthetic polypeptide
QDNEIATTNPVSTECYGNVSAECLQSRVEEL

SEQ ID NO: 170922 - protein, 39 aa, Artificial Sequence
  Description of Artificial Sequence: Synthetic polypeptide
DEEEIRTTNPVATEAYGSVSTTVNSQQGNNQQGTNVATE

SEQ ID NO: 170923 - protein, 35 aa, Artificial Sequence
  Description of Artificial Sequence: Synthetic polypeptide
SSSEIRTTNPVATEQYGSVIIVSLDTQEGGIENFG

SEQ ID NO: 170924 - protein, 34 aa, Artificial Sequence
  Description of Artificial Sequence: Synthetic polypeptide
DESEIRTTNPVATECWGSVNGCINEPEAREGEWG

SEQ ID NO: 170925 - protein, 34 aa, Artificial Sequence
  Description of Artificial Sequence: Synthetic polypeptide
SSSEIRTTNPVATEQYGSFTMSLDTQEGGIENFG

SEQ ID NO: 170926 - protein, 36 aa, Artificial Sequence
  Description of Artificial Sequence: Synthetic polypeptide
DEMEIVTTNPVATEQYGTVSSATPAPPNMFEGMNPV

SEQ ID NO: 170927 - protein, 35 aa, Artificial Sequence
  Description of Artificial Sequence: Synthetic polypeptide
SSSEIRTTNPVATEQYGSVSMSLDTQTEGGIETFG

SEQ ID NO: 170928 - protein, 32 aa, Artificial Sequence
  Description of Artificial Sequence: Synthetic polypeptide
DENEIRTTNPVSTEPYGTISQEDIQQQQNGVH

SEQ ID NO: 170929 - protein, 32 aa, Artificial Sequence
  Description of Artificial Sequence: Synthetic polypeptide
DENEIRTTNPVSTEPYGTISQEDIQQQQNGSH

SEQ ID NO: 170930 - protein, 38 aa, Artificial Sequence
  Description of Artificial Sequence: Synthetic polypeptide
AEEEIRTTNPVATEQYGSVVVSVTNNNNNQEQGEQTED

SEQ ID NO: 170931 - protein, 34 aa, Artificial Sequence
  Description of Artificial Sequence: Synthetic polypeptide
DDEEIASTNPVSTEQYGSVATTTIPNMRNGMNPV

SEQ ID NO: 170932 - protein, 38 aa, Artificial Sequence
  Description of Artificial Sequence: Synthetic polypeptide
DEEEISTTNPVATEQYGCVCSTTGEDLNQENFGSENQS

SEQ ID NO: 170933 - protein, 36 aa, Artificial Sequence
  Description of Artificial Sequence: Synthetic polypeptide
DEEEIATTNPVATEQYGSACSANPAEADAEIGENNA

SEQ ID NO: 170934 - protein, 36 aa, Artificial Sequence
  Description of Artificial Sequence: Synthetic polypeptide
DEEEIATTNPMATEQYGSVRPPTVTQLDHWQGQNND

SEQ ID NO: 170935 - protein, 36 aa, Artificial Sequence
  Description of Artificial Sequence: Synthetic polypeptide
DEEEISTTNPVATEQYGCVCSTTGEDNQENFNSQQS

SEQ ID NO: 170936 - protein, 37 aa, Artificial Sequence
  Description of Artificial Sequence: Synthetic polypeptide
DEEEIRTTNPVAYEQWGSVSGPEPGNGGNMRTGMNQE

SEQ ID NO: 170937 - protein, 39 aa, Artificial Sequence
  Description of Artificial Sequence: Synthetic polypeptide
DEEEIRTTNPVATEAYGVVSTVSTTNLQQGTEQGTEEEE

SEQ ID NO: 170938 - protein, 36 aa, Artificial Sequence
  Description of Artificial Sequence: Synthetic polypeptide
AEEEIRTTNPVATEQYGCVCSTGEHNQENFNSDPQL

SEQ ID NO: 170939 - protein, 36 aa, Artificial Sequence
  Description of Artificial Sequence: Synthetic polypeptide
QDEEIRTTNPVATEQYGCVCSYTDNLDEERFEDQVW

SEQ ID NO: 170940 - protein, 32 aa, Artificial Sequence
  Description of Artificial Sequence: Synthetic polypeptide
DETEIRTTNPIATECWGATWANAENWQPKGTR

SEQ ID NO: 170941 - protein, 36 aa, Artificial Sequence
  Description of Artificial Sequence: Synthetic polypeptide
DEEEIRTTNPVAYEQYGQSASVANNAASVRSNVEEY

SEQ ID NO: 170942 - protein, 35 aa, Artificial Sequence
  Description of Artificial Sequence: Synthetic polypeptide
DEEEICTTNPVAYEQWGEVATDNDGNQGQQGENET

SEQ ID NO: 170943 - protein, 35 aa, Artificial Sequence
  Description of Artificial Sequence: Synthetic polypeptide
DDEEIASTNPVSTEQYGNVSSTNPAGPNMRVGNPV

SEQ ID NO: 170944 - protein, 35 aa, Artificial Sequence
  Description of Artificial Sequence: Synthetic polypeptide
DESEIRTTNPVATECWGSVSCCIKEPQDREHENEP

SEQ ID NO: 170945 - protein, 36 aa, Artificial Sequence
  Description of Artificial Sequence: Synthetic polypeptide
AEEEIRTTNPVATEQYGCVCSTGEHNQENFNSDTQA

SEQ ID NO: 170946 - protein, 38 aa, Artificial Sequence
  Description of Artificial Sequence: Synthetic polypeptide
DEEEICTTNPVATEQYGSVSGNNTNGGEGQNEDEDEDG

SEQ ID NO: 170947 - protein, 37 aa, Artificial Sequence
  Description of Artificial Sequence: Synthetic polypeptide
DEEEISTTNPVATEQYGCVCSTTGEDHQENFGSDNQS

SEQ ID NO: 170948 - protein, 34 aa, Artificial Sequence
  Description of Artificial Sequence: Synthetic polypeptide
DEEEIRTTNPVAYEQYGCVCFWEHNQYFDSDNQS

SEQ ID NO: 170949 - protein, 36 aa, Artificial Sequence
  Description of Artificial Sequence: Synthetic polypeptide
DEEEISTTNPVATEQYGCVCSTSEHNAENFNSDTQS

SEQ ID NO: 170950 - protein, 36 aa, Artificial Sequence
  Description of Artificial Sequence: Synthetic polypeptide
DEEEISTTNPVATEQYGCVCSTSEHNQEFFNSDTQD

SEQ ID NO: 170951 - protein, 33 aa, Artificial Sequence
  Description of Artificial Sequence: Synthetic polypeptide
DEAEIRTTNPVAYEQWGYCLQEDLKRGVDNAGK

SEQ ID NO: 170952 - protein, 36 aa, Artificial Sequence
  Description of Artificial Sequence: Synthetic polypeptide
DEEEISTTNPVATEQYGCVCSTSGEHAEFFGSDNQF

SEQ ID NO: 170953 - protein, 33 aa, Artificial Sequence
  Description of Artificial Sequence: Synthetic polypeptide
DEHEIATTNPVAYEQWGSVTGPNGNQGAMNKGD

SEQ ID NO: 170954 - protein, 35 aa, Artificial Sequence
  Description of Artificial Sequence: Synthetic polypeptide
AEEEIRTTNPVATEQYGCVCSNSEHNQNFNSETQA

SEQ ID NO: 170955 - protein, 33 aa, Artificial Sequence
  Description of Artificial Sequence: Synthetic polypeptide
DEHEIATTNPVAYEQWGSVTGPNGNQGAMNGLK

SEQ ID NO: 170956 - protein, 38 aa, Artificial Sequence
  Description of Artificial Sequence: Synthetic polypeptide
DEEEICTTNPVATEQYGSVSGNNTNGQEGQEEDQDEDQ

SEQ ID NO: 170957 - protein, 33 aa, Artificial Sequence
  Description of Artificial Sequence: Synthetic polypeptide
DEAEIATTNPVAYERWGSVCVNDDMGDRQGDSR

SEQ ID NO: 170958 - protein, 33 aa, Artificial Sequence
  Description of Artificial Sequence: Synthetic polypeptide
SSEEIRTTNPVAYHQYGCVCSTEDQNFGSDTQS

SEQ ID NO: 170959 - protein, 38 aa, Artificial Sequence
  Description of Artificial Sequence: Synthetic polypeptide
DEEEIRTTNPVATEAYGVVSTVTNNNNQQSGNQNQDED

SEQ ID NO: 170960 - protein, 36 aa, Artificial Sequence
  Description of Artificial Sequence: Synthetic polypeptide
DEEEISTTNPVATEQYGCVCSTTEHDQEHFNSDNQY

SEQ ID NO: 170961 - protein, 31 aa, Artificial Sequence
  Description of Artificial Sequence: Synthetic polypeptide
DEEEIATTNPVAYEAWGVVTGGNANDTGGED

SEQ ID NO: 170962 - protein, 35 aa, Artificial Sequence
  Description of Artificial Sequence: Synthetic polypeptide
DEAEIRTTNPVAYEQWGVVYVDTGLVQDEGGGGNH

SEQ ID NO: 170963 - protein, 34 aa, Artificial Sequence
  Description of Artificial Sequence: Synthetic polypeptide
DEEEIRTTNPVAYEQYGCVCFSGEHNQYFDSDQS

SEQ ID NO: 170964 - protein, 36 aa, Artificial Sequence
  Description of Artificial Sequence: Synthetic polypeptide
DEEEIRTTNPVATEQYGTCSLGNWHELDNTQSETIE

SEQ ID NO: 170965 - protein, 34 aa, Artificial Sequence
  Description of Artificial Sequence: Synthetic polypeptide
DEHEIATTNPVAYEQWGSVTGPNGNQQGPGNGQD

SEQ ID NO: 170966 - protein, 35 aa, Artificial Sequence
  Description of Artificial Sequence: Synthetic polypeptide
DESEIRTTNPVATECWGSVSACINEPEDHEGENDG

SEQ ID NO: 170967 - protein, 36 aa, Artificial Sequence
  Description of Artificial Sequence: Synthetic polypeptide
DEEEISTTNPVATEQYGCVCSTMEHNQESFNSDNQS

SEQ ID NO: 170968 - protein, 33 aa, Artificial Sequence
  Description of Artificial Sequence: Synthetic polypeptide
DAQEIATTNPVAYEQWGSVRCTENQDQDDLGMG

SEQ ID NO: 170969 - protein, 36 aa, Artificial Sequence
  Description of Artificial Sequence: Synthetic polypeptide
DEEEIRTTNPVAYEQYGQSASVMNQAASVREVEGEY

SEQ ID NO: 170970 - protein, 36 aa, Artificial Sequence
  Description of Artificial Sequence: Synthetic polypeptide
DEEEIRTTNPVATEQYGTQIDNTNKIEQHQVAIVNE

SEQ ID NO: 170971 - protein, 31 aa, Artificial Sequence
  Description of Artificial Sequence: Synthetic polypeptide
DDSEVAATNPVSTEGYGNVAANTIQVRVGQR

SEQ ID NO: 170972 - protein, 33 aa, Artificial Sequence
  Description of Artificial Sequence: Synthetic polypeptide
DEAEIRTTNPVAYEQYGCICSTWEHENFPSNQA

SEQ ID NO: 170973 - protein, 36 aa, Artificial Sequence
  Description of Artificial Sequence: Synthetic polypeptide
DEEEIRTTNPVATEQYGSTVSPIWNNVVMPIMPEVP

SEQ ID NO: 170974 - protein, 34 aa, Artificial Sequence
  Description of Artificial Sequence: Synthetic polypeptide
AEEEIRTTNPVATEQYGCVCSSEHAEYFNSDFQA

SEQ ID NO: 170975 - protein, 34 aa, Artificial Sequence
  Description of Artificial Sequence: Synthetic polypeptide
TAEEIATTNPVATEAYGCVCTIDNQQDDGRNGDD

SEQ ID NO: 170976 - protein, 39 aa, Artificial Sequence
  Description of Artificial Sequence: Synthetic polypeptide
DEEEIRTTNPVATEAYGVVSTVTNLNLQQGTEQGTEENQ

SEQ ID NO: 170977 - protein, 34 aa, Artificial Sequence
  Description of Artificial Sequence: Synthetic polypeptide
DEMEIVTTNPVATEQYGTVSATDGPVEDFEGEDL

SEQ ID NO: 170978 - protein, 37 aa, Artificial Sequence
  Description of Artificial Sequence: Synthetic polypeptide
DEEEIRTTNPVATEQYGSVNPTTETSQIINVQVNPCM

SEQ ID NO: 170979 - protein, 34 aa, Artificial Sequence
  Description of Artificial Sequence: Synthetic polypeptide
DEMEIVTTNPVATEQYGTVSATDGPVEDHEGEDL

SEQ ID NO: 170980 - protein, 35 aa, Artificial Sequence
  Description of Artificial Sequence: Synthetic polypeptide
AEEEIRTTNPVATEQYGCVCSSEHNQENFNSENQS

SEQ ID NO: 170981 - protein, 34 aa, Artificial Sequence
  Description of Artificial Sequence: Synthetic polypeptide
DEEEICTTNPVAYEAYGHVIHCSNSLSQVSGGEQ

SEQ ID NO: 170982 - protein, 31 aa, Artificial Sequence
  Description of Artificial Sequence: Synthetic polypeptide
DDSEVAATNPVSTEGYGNVAANTIQSRVGQR

SEQ ID NO: 170983 - protein, 30 aa, Artificial Sequence
  Description of Artificial Sequence: Synthetic polypeptide
QDSEIATTNPVSTEGYGEVAETCQSRVEQR

SEQ ID NO: 170984 - protein, 34 aa, Artificial Sequence
  Description of Artificial Sequence: Synthetic polypeptide
TEAEIATTNPVATEQYGTVCSCTDGPSEFEGGND

SEQ ID NO: 170985 - protein, 36 aa, Artificial Sequence
  Description of Artificial Sequence: Synthetic polypeptide
DEEEIATTNPVATEQYGSACSATMPHAEAPPEDGNH

SEQ ID NO: 170986 - protein, 38 aa, Artificial Sequence
  Description of Artificial Sequence: Synthetic polypeptide
DEEEIRTTNPVATEAYGVVSTVTNGNNQQGGNQNTDED

SEQ ID NO: 170987 - protein, 33 aa, Artificial Sequence
  Description of Artificial Sequence: Synthetic polypeptide
TEADEIATTNPVAYERWGSVSWTDEHDQRGGEH

SEQ ID NO: 170988 - protein, 36 aa, Artificial Sequence
  Description of Artificial Sequence: Synthetic polypeptide
DEEEIRTTNPVATEQYGTQIDNTNHTEQHQVAIMNE

SEQ ID NO: 170989 - protein, 36 aa, Artificial Sequence
  Description of Artificial Sequence: Synthetic polypeptide
YEDTIRTTNPVATEQYGSVMGSAMNLIMIGGGNEIE

SEQ ID NO: 170990 - protein, 31 aa, Artificial Sequence
  Description of Artificial Sequence: Synthetic polypeptide
QEAEIACTNPCSYEQYGCVSWNLQESGSEQA

SEQ ID NO: 170991 - protein, 36 aa, Artificial Sequence
  Description of Artificial Sequence: Synthetic polypeptide
DEEEIRTTNPVATEQYGTQIDNTNFIEQHQVETMNE

SEQ ID NO: 170992 - protein, 33 aa, Artificial Sequence
  Description of Artificial Sequence: Synthetic polypeptide
DEHEIATTNPVAYEQWGVVAGPNGNQGAMNGNH

SEQ ID NO: 170993 - protein, 32 aa, Artificial Sequence
  Description of Artificial Sequence: Synthetic polypeptide
TEAEIASVNPVCYEQYGVVSCDNELSQSGGNQ

SEQ ID NO: 170994 - protein, 29 aa, Artificial Sequence
  Description of Artificial Sequence: Synthetic peptide
QEAEIACTNPVGTEGWGVSASDLQDGDIQ

SEQ ID NO: 170995 - protein, 29 aa, Artificial Sequence
  Description of Artificial Sequence: Synthetic peptide
QEAEIACTNPVGTEGWGVSASDLQHGDMK

SEQ ID NO: 170996 - protein, 36 aa, Artificial Sequence
  Description of Artificial Sequence: Synthetic polypeptide
YEDEIRTTNPVATEQYGSVVTFGMNGDEGGQTQNID

SEQ ID NO: 170997 - protein, 36 aa, Artificial Sequence
  Description of Artificial Sequence: Synthetic polypeptide
AEEEIRTTNPVATEQYGCVCSNWGEHQENFGSDNQS

SEQ ID NO: 170998 - protein, 38 aa, Artificial Sequence
  Description of Artificial Sequence: Synthetic polypeptide
DEEEIRTTNPVATEQYGVVSTTNQQQLNGTEQGSTQTE

SEQ ID NO: 170999 - protein, 30 aa, Artificial Sequence
  Description of Artificial Sequence: Synthetic polypeptide
QDSEVASTNPVSTEGYGIVACNIQSRVGTR

SEQ ID NO: 171000 - protein, 37 aa, Artificial Sequence
  Description of Artificial Sequence: Synthetic polypeptide
DEEEIRTTNPVATEQYGTQAIDTTNLIEQHQVATNNE

SEQ ID NO: 171001 - protein, 34 aa, Artificial Sequence
  Description of Artificial Sequence: Synthetic polypeptide
DEEEIATTNPVATAQWGCNVATNGLEATANGEFG

SEQ ID NO: 171002 - protein, 34 aa, Artificial Sequence
  Description of Artificial Sequence: Synthetic polypeptide
DEAEIRTTNPVAYEQWGVVYGGNNGNQGEGNADQ

SEQ ID NO: 171003 - protein, 34 aa, Artificial Sequence
  Description of Artificial Sequence: Synthetic polypeptide
DEHEIATTNPVAYEQWGVVATGPNGNQGAMNGND

SEQ ID NO: 171004 - protein, 29 aa, Artificial Sequence
  Description of Artificial Sequence: Synthetic peptide
QDSEIATTNPVATEGYGNAANVCQHVGEK

SEQ ID NO: 171005 - protein, 32 aa, Artificial Sequence
  Description of Artificial Sequence: Synthetic polypeptide
DDSEIVSTNPVATEGYGTVCAATGIVEREGQR

SEQ ID NO: 171006 - protein, 35 aa, Artificial Sequence
  Description of Artificial Sequence: Synthetic polypeptide
DEMEIRTTNPVATEQYGCICSTGETNQGFGSDTQA

SEQ ID NO: 171007 - protein, 33 aa, Artificial Sequence
  Description of Artificial Sequence: Synthetic polypeptide
DEAEIRTTNPVAYEQYGCICSWGNLENFPSEQS

SEQ ID NO: 171008 - protein, 34 aa, Artificial Sequence
  Description of Artificial Sequence: Synthetic polypeptide
DEACIGTTNPVATEQWGCVCSTEDHNQYFGSNQA

SEQ ID NO: 171009 - protein, 35 aa, Artificial Sequence
  Description of Artificial Sequence: Synthetic polypeptide
DEMEIRTTNPVATEQYGCICSTGETNQYFNSDTQS

SEQ ID NO: 171010 - protein, 35 aa, Artificial Sequence
  Description of Artificial Sequence: Synthetic polypeptide
DEAEIATTNPVAYEQYGTVATQNGGQQNGGQRGQS

SEQ ID NO: 171011 - protein, 33 aa, Artificial Sequence
  Description of Artificial Sequence: Synthetic polypeptide
DDSEIVSTNPVATEQYGTVAATDTPVQSREGQD

SEQ ID NO: 171012 - protein, 33 aa, Artificial Sequence
  Description of Artificial Sequence: Synthetic polypeptide
YEEAIATTNPVSTEVYAPIVTSMSNQDRGSNRD

SEQ ID NO: 171013 - protein, 34 aa, Artificial Sequence
  Description of Artificial Sequence: Synthetic polypeptide
DEHEIATTNPVAYEQWGSVTGPNMNQQGAGNGGT

SEQ ID NO: 171014 - protein, 36 aa, Artificial Sequence
  Description of Artificial Sequence: Synthetic polypeptide
DEEEIRTTNPVAYEQYGATVVACEGNALSQWVTDSR

SEQ ID NO: 171015 - protein, 36 aa, Artificial Sequence
  Description of Artificial Sequence: Synthetic polypeptide
DEHEIATTNPVAYEQWGVVYSEGNDTEQRGGAGGNR

SEQ ID NO: 171016 - protein, 34 aa, Artificial Sequence
  Description of Artificial Sequence: Synthetic polypeptide
DEHEIATTNPVAYEQWGSVTGPNGNQTGAGNGNL

SEQ ID NO: 171017 - protein, 35 aa, Artificial Sequence
  Description of Artificial Sequence: Synthetic polypeptide
DEEEISTTNPVATEQYGCVCSTMEHQENFISDTQA

SEQ ID NO: 171018 - protein, 34 aa, Artificial Sequence
  Description of Artificial Sequence: Synthetic polypeptide
DEMEIRTTNPVATEQYGCICSWEDTQENFGSDQS

SEQ ID NO: 171019 - protein, 35 aa, Artificial Sequence
  Description of Artificial Sequence: Synthetic polypeptide
DEAEIATTNPVAYEQYGTVATSGGGQQNGGQRGEA

SEQ ID NO: 171020 - protein, 31 aa, Artificial Sequence
  Description of Artificial Sequence: Synthetic polypeptide
DDSEIVSTNPVSTEGYGTVAATGPVERVGQR

SEQ ID NO: 171021 - protein, 32 aa, Artificial Sequence
  Description of Artificial Sequence: Synthetic polypeptide
DDSEIVTTNPVSTEGYGTVAATDGPVERVGQR

SEQ ID NO: 171022 - protein, 35 aa, Artificial Sequence
  Description of Artificial Sequence: Synthetic polypeptide
DEMEIRTTNPVATEQYGCICSNTETNAENFGSDQA

SEQ ID NO: 171023 - protein, 29 aa, Artificial Sequence
  Description of Artificial Sequence: Synthetic peptide
QDSEIATTNPVATEGYGNAAEVCQHVGEK

SEQ ID NO: 171024 - protein, 35 aa, Artificial Sequence
  Description of Artificial Sequence: Synthetic polypeptide
TEAEIATTNPVAYCAYGQIVPSTNLAQNKGTSNPR

SEQ ID NO: 171025 - protein, 30 aa, Artificial Sequence
  Description of Artificial Sequence: Synthetic polypeptide
QDSEIASTNPVSTEQYGNAAAETCQRVGQR

SEQ ID NO: 171026 - protein, 34 aa, Artificial Sequence
  Description of Artificial Sequence: Synthetic polypeptide
AEEEIRTTNPVATEQYGCVCSSGEHANFNSQFQA

SEQ ID NO: 171027 - protein, 34 aa, Artificial Sequence
  Description of Artificial Sequence: Synthetic polypeptide
DEEEICTTNPVAYEAYGHVSCMSSLSQVSGGEFP

SEQ ID NO: 171028 - protein, 35 aa, Artificial Sequence
  Description of Artificial Sequence: Synthetic polypeptide
DEHEIATTNPVAYEQWGVVSGGNDNEQRGGGGGER

SEQ ID NO: 171029 - protein, 34 aa, Artificial Sequence
  Description of Artificial Sequence: Synthetic polypeptide
DEHEIATTNPVAYEQWGSVTGPNTGNQGAGNGQH

SEQ ID NO: 171030 - protein, 31 aa, Artificial Sequence
  Description of Artificial Sequence: Synthetic polypeptide
QEAEIAPTNPVAYEQWGEAFCENLSQRVGGS

SEQ ID NO: 171031 - protein, 35 aa, Artificial Sequence
  Description of Artificial Sequence: Synthetic polypeptide
DEEEIATTNPVATEQYGSACSANPPAEAEMSNGHP

SEQ ID NO: 171032 - protein, 31 aa, Artificial Sequence
  Description of Artificial Sequence: Synthetic polypeptide
DDSELASTNPVSTEGYGNVAANTIQSRVGQR

SEQ ID NO: 171033 - protein, 31 aa, Artificial Sequence
  Description of Artificial Sequence: Synthetic polypeptide
QDSEIASTNPVSTECYGNVSANCIQSRVGQL

SEQ ID NO: 171034 - protein, 28 aa, Artificial Sequence
  Description of Artificial Sequence: Synthetic peptide
QDSEIASTNPVGYEGYGVMASTLQHGDI

SEQ ID NO: 171035 - protein, 32 aa, Artificial Sequence
  Description of Artificial Sequence: Synthetic polypeptide
QEAEIAPTNPVAYEQYGEASCENLSQQTVGDS

SEQ ID NO: 171036 - protein, 31 aa, Artificial Sequence
  Description of Artificial Sequence: Synthetic polypeptide
QEAEIAPTNPVAYEQYGETSCENSSQQVGGS

SEQ ID NO: 171037 - protein, 34 aa, Artificial Sequence
  Description of Artificial Sequence: Synthetic polypeptide
DEEEICTTNPVAYECWGSVATTGGNTGADGMGRT

SEQ ID NO: 171038 - protein, 31 aa, Artificial Sequence
  Description of Artificial Sequence: Synthetic polypeptide
DDSEVAATNPVSTEGYGNVAANTHQSRVGQR

SEQ ID NO: 171039 - protein, 36 aa, Artificial Sequence
  Description of Artificial Sequence: Synthetic polypeptide
DEHEIATTNPVAYEQYGSVCSPTNNLGQTHADITEQ

SEQ ID NO: 171040 - protein, 35 aa, Artificial Sequence
  Description of Artificial Sequence: Synthetic polypeptide
AEEEIRTTNPVATEQYGCVCSTGEHQENFISDTQA

SEQ ID NO: 171041 - protein, 36 aa, Artificial Sequence
  Description of Artificial Sequence: Synthetic polypeptide
DEEEIATTNPVATEQYGSACSAVNPDEAEAEIGNMT

SEQ ID NO: 171042 - protein, 35 aa, Artificial Sequence
  Description of Artificial Sequence: Synthetic polypeptide
DEAEIATTNPVAYEQYGSVCAAANVLQEAEHANDS

SEQ ID NO: 171043 - protein, 35 aa, Artificial Sequence
  Description of Artificial Sequence: Synthetic polypeptide
DEHEIATTNPVAYEQWGSVSWGDNLQPNADGQGDQ

SEQ ID NO: 171044 - protein, 33 aa, Artificial Sequence
  Description of Artificial Sequence: Synthetic polypeptide
DESEIRTTNPVATECWGSVGCINEPEAWELENG

SEQ ID NO: 171045 - protein, 36 aa, Artificial Sequence
  Description of Artificial Sequence: Synthetic polypeptide
DEEEISTTNPVATEQYGCVCSTGEHNQENFNSDNQA

SEQ ID NO: 171046 - protein, 37 aa, Artificial Sequence
  Description of Artificial Sequence: Synthetic polypeptide
DEEEIRTTNPVATEQYGTSICTTPSLSDNFELMVGME

SEQ ID NO: 171047 - protein, 38 aa, Artificial Sequence
  Description of Artificial Sequence: Synthetic polypeptide
DEEEIRTTNPVATEQYGVVSTTNQQQQNATEQGTTEEQ

SEQ ID NO: 171048 - protein, 36 aa, Artificial Sequence
  Description of Artificial Sequence: Synthetic polypeptide
AEEEIRTTNPVATEQYGCAVCSTGEHQENFGSDTQS

SEQ ID NO: 171049 - protein, 32 aa, Artificial Sequence
  Description of Artificial Sequence: Synthetic polypeptide
DETEIRTTNPIATECWGAVWSEEDWQEPKGPL

SEQ ID NO: 171050 - protein, 39 aa, Artificial Sequence
  Description of Artificial Sequence: Synthetic polypeptide
DEEEIRTTNPVATEQYGVVSTTNQQNQNGTNEQGSTQEE

SEQ ID NO: 171051 - protein, 36 aa, Artificial Sequence
  Description of Artificial Sequence: Synthetic polypeptide
DEEEISTTNPVATEQYGCVCSTGEHNQEHFFSDNQS

SEQ ID NO: 171052 - protein, 31 aa, Artificial Sequence
  Description of Artificial Sequence: Synthetic polypeptide
DETEIRTTNPIATECWGAVWSNADWAPGPYI

SEQ ID NO: 171053 - protein, 38 aa, Artificial Sequence
  Description of Artificial Sequence: Synthetic polypeptide
DEEEIRTTNPVATEQYGSVGSVPWNNLENTTQQEELTQ

SEQ ID NO: 171054 - protein, 36 aa, Artificial Sequence
  Description of Artificial Sequence: Synthetic polypeptide
DEEEIRTTNPVATEQYGCVCSTGEDHNQNFPSETQS

SEQ ID NO: 171055 - protein, 34 aa, Artificial Sequence
  Description of Artificial Sequence: Synthetic polypeptide
SSEEIRTTNPVATHQYGCVCSTEDDQENFGSDQS

SEQ ID NO: 171056 - protein, 33 aa, Artificial Sequence
  Description of Artificial Sequence: Synthetic polypeptide
CEEEIATTNPVAYEQYGSCATAALTQNNLDQAQ

SEQ ID NO: 171057 - protein, 36 aa, Artificial Sequence
  Description of Artificial Sequence: Synthetic polypeptide
DEEEISTTNPVATEQYGCVCSTGEHNQENFNSQNQA

SEQ ID NO: 171058 - protein, 35 aa, Artificial Sequence
  Description of Artificial Sequence: Synthetic polypeptide
DEEEICTTNPVAYEQWGEVSTGGPLQDHQGGGKGE

SEQ ID NO: 171059 - protein, 38 aa, Artificial Sequence
  Description of Artificial Sequence: Synthetic polypeptide
DEEEIRTTNPVATEQYGVVSTTNQQQQNATEQGTTDDE

SEQ ID NO: 171060 - protein, 36 aa, Artificial Sequence
  Description of Artificial Sequence: Synthetic polypeptide
DEEEIRTTNPVATEQYGCVCSTGEDHNQEYFMSDQA

SEQ ID NO: 171061 - protein, 35 aa, Artificial Sequence
  Description of Artificial Sequence: Synthetic polypeptide
DEEEIRTTNPVSTEPYGTISTTPAGQQMQNGMNPV

SEQ ID NO: 171062 - protein, 38 aa, Artificial Sequence
  Description of Artificial Sequence: Synthetic polypeptide
DEEEIRTTNPVATEQYGVVSTTNQQQNQQQATNVATEQ

SEQ ID NO: 171063 - protein, 37 aa, Artificial Sequence
  Description of Artificial Sequence: Synthetic polypeptide
DEEEICTTNPVATEQYGLVYSPTTMAGPNMRNGMNPV

SEQ ID NO: 171064 - protein, 34 aa, Artificial Sequence
  Description of Artificial Sequence: Synthetic polypeptide
DEHEIATTNPVAYEQWGSVTGPNEGNQGAGNGND

SEQ ID NO: 171065 - protein, 36 aa, Artificial Sequence
  Description of Artificial Sequence: Synthetic polypeptide
DEEEIRTTNPVATEAYGSVSTVVNNNNDTTEEEEEQ

SEQ ID NO: 171066 - protein, 34 aa, Artificial Sequence
  Description of Artificial Sequence: Synthetic polypeptide
DEHEIATTNPVAYEQWGSVTGPNDNQQGAMNGGD

SEQ ID NO: 171067 - protein, 35 aa, Artificial Sequence
  Description of Artificial Sequence: Synthetic polypeptide
DEEEISTTNPVATEQYGCVCSTGEHNQNFFSDTQQ

SEQ ID NO: 171068 - protein, 36 aa, Artificial Sequence
  Description of Artificial Sequence: Synthetic polypeptide
DEAEIATTNPVAYEQYGSVCSATLALQNHQDGAFAN

SEQ ID NO: 171069 - protein, 34 aa, Artificial Sequence
  Description of Artificial Sequence: Synthetic polypeptide
DEHEIATTNPVAYEQWGSVTGGNGNQGAGQNGEL

SEQ ID NO: 171070 - protein, 33 aa, Artificial Sequence
  Description of Artificial Sequence: Synthetic polypeptide
CEEEIATTNPVAYEQYGSCATAALTANNLDQDS

SEQ ID NO: 171071 - protein, 31 aa, Artificial Sequence
  Description of Artificial Sequence: Synthetic polypeptide
DETEIRTTNPIATECWGAVWANADWAPGPYI

SEQ ID NO: 171072 - protein, 39 aa, Artificial Sequence
  Description of Artificial Sequence: Synthetic polypeptide
DEEEIRTTNPVATEAYGVVSTVTNQQLQQGTEQGTEGNE

SEQ ID NO: 171073 - protein, 38 aa, Artificial Sequence
  Description of Artificial Sequence: Synthetic polypeptide
DEEEIRTTNPVATEQYGVVSTTNQQQQNATEQGSTVEG

SEQ ID NO: 171074 - protein, 38 aa, Artificial Sequence
  Description of Artificial Sequence: Synthetic polypeptide
DEEEIRTTNPVATEAYGVVSTVTNQQNGGNEQGTEEEE

SEQ ID NO: 171075 - protein, 36 aa, Artificial Sequence
  Description of Artificial Sequence: Synthetic polypeptide
DEEEISTTNPVATEQYGCVCSTWGEHDQNFNSDNQA

SEQ ID NO: 171076 - protein, 37 aa, Artificial Sequence
  Description of Artificial Sequence: Synthetic polypeptide
DEEEIRTTNPVATEQYGCVCSTGEDHNQESFNSDNQS

SEQ ID NO: 171077 - protein, 37 aa, Artificial Sequence
  Description of Artificial Sequence: Synthetic polypeptide
DEEEISTTNPVATEQYGCVCSTWGEHFQENFGSDNQV

SEQ ID NO: 171078 - protein, 35 aa, Artificial Sequence
  Description of Artificial Sequence: Synthetic polypeptide
DEMEIVTTNPVATEQYGVTVCSATDGPVEFEGNDD

SEQ ID NO: 171079 - protein, 36 aa, Artificial Sequence
  Description of Artificial Sequence: Synthetic polypeptide
DEEEICTTNPVAYEQWGSVCSGEGNQQATNGNNGSS

SEQ ID NO: 171080 - protein, 34 aa, Artificial Sequence
  Description of Artificial Sequence: Synthetic polypeptide
DEEEIRTTNPVAYEQYGCVCQWEELNQYFDSDQS

SEQ ID NO: 171081 - protein, 35 aa, Artificial Sequence
  Description of Artificial Sequence: Synthetic polypeptide
DEEEIRTTNPVAYEQYGCVCQWELNQEYFNSDTQS

SEQ ID NO: 171082 - protein, 33 aa, Artificial Sequence
  Description of Artificial Sequence: Synthetic polypeptide
TEECIATTNPVAYEQWGSVSKTNNPEDGMGKDD

SEQ ID NO: 171083 - protein, 32 aa, Artificial Sequence
  Description of Artificial Sequence: Synthetic polypeptide
DEEEIATTNPVATASWGCIATTNAEQDMDNNN

SEQ ID NO: 171084 - protein, 33 aa, Artificial Sequence
  Description of Artificial Sequence: Synthetic polypeptide
DDEEIASTNPVSTEQYGNVAANTINMRNGMNPV

SEQ ID NO: 171085 - protein, 36 aa, Artificial Sequence
  Description of Artificial Sequence: Synthetic polypeptide
AEEEIRTTNPVATEQYGQCVCSMTEEHNQNFGSDQV

SEQ ID NO: 171086 - protein, 33 aa, Artificial Sequence
  Description of Artificial Sequence: Synthetic polypeptide
DDEEIATTNPVAYEQWGSVCSNWEHGEQDEHNP

SEQ ID NO: 171087 - protein, 33 aa, Artificial Sequence
  Description of Artificial Sequence: Synthetic polypeptide
DEMEIRTTNPVATEQWGTVCSAEIPVENAEGDD

SEQ ID NO: 171088 - protein, 33 aa, Artificial Sequence
  Description of Artificial Sequence: Synthetic polypeptide
DEAEIRTTNPVAYEQWGVVTGGNGNQGELNDDY

SEQ ID NO: 171089 - protein, 36 aa, Artificial Sequence
  Description of Artificial Sequence: Synthetic polypeptide
DEEEISTTNPVATEQYGCVCSTWGEHNQNFNSDTQS

SEQ ID NO: 171090 - protein, 33 aa, Artificial Sequence
  Description of Artificial Sequence: Synthetic polypeptide
DEAEIRTTNPVAYEQWGVVTGGNGNQGEHQADR

SEQ ID NO: 171091 - protein, 33 aa, Artificial Sequence
  Description of Artificial Sequence: Synthetic polypeptide
TEECIATTNPVAYEQWGSVSKTNPEPDGMGKEA

SEQ ID NO: 171092 - protein, 34 aa, Artificial Sequence
  Description of Artificial Sequence: Synthetic polypeptide
TEECIATTNPVAYEQWGSVSKTNPPEDGMGKNQQ

SEQ ID NO: 171093 - protein, 30 aa, Artificial Sequence
  Description of Artificial Sequence: Synthetic polypeptide
DETEIRTTNPIATECWGETAAVWQEPGEYK

SEQ ID NO: 171094 - protein, 35 aa, Artificial Sequence
  Description of Artificial Sequence: Synthetic polypeptide
DEEEICTTNPVAYEQWGSVCSGEGNQATNGNMGGS

SEQ ID NO: 171095 - protein, 36 aa, Artificial Sequence
  Description of Artificial Sequence: Synthetic polypeptide
DEEEISTTNPVATEQYGCVCSTWGEHNQESFNSDQQ

SEQ ID NO: 171096 - protein, 35 aa, Artificial Sequence
  Description of Artificial Sequence: Synthetic polypeptide
DEEEICTTNPVAYEQWGSVCSGEGNQATNGGNGES

SEQ ID NO: 171097 - protein, 36 aa, Artificial Sequence
  Description of Artificial Sequence: Synthetic polypeptide
DEEEISTTNPVATEQYGCVCSTGEHNAENFNSQTQA

SEQ ID NO: 171098 - protein, 34 aa, Artificial Sequence
  Description of Artificial Sequence: Synthetic polypeptide
DEAEIRTTNPVAYEQWGVVTGGNGNQGGEKNDDE

SEQ ID NO: 171099 - protein, 39 aa, Artificial Sequence
  Description of Artificial Sequence: Synthetic polypeptide
DEEEIRTTNPVATEQYGVVSTTNQQNQNGTNEQGSTEDQ

SEQ ID NO: 171100 - protein, 36 aa, Artificial Sequence
  Description of Artificial Sequence: Synthetic polypeptide
DEEEISTTNPVATEQYGCVCSTWGEHNANSNSENQS

SEQ ID NO: 171101 - protein, 36 aa, Artificial Sequence
  Description of Artificial Sequence: Synthetic polypeptide
DEEEISTTNPVATEQYGCVCSTWGEHNENFGSDTQA

SEQ ID NO: 171102 - protein, 36 aa, Artificial Sequence
  Description of Artificial Sequence: Synthetic polypeptide
DEEEISTTNPVATEQYGCVCSTGEHNAENFNSETQS

SEQ ID NO: 171103 - protein, 37 aa, Artificial Sequence
  Description of Artificial Sequence: Synthetic polypeptide
DEEEISTTNPVATEQYGCVCSTWGEHNQEGFNSDTQA

SEQ ID NO: 171104 - protein, 35 aa, Artificial Sequence
  Description of Artificial Sequence: Synthetic polypeptide
DEEEICTTNPVAYEQWGSVCSGEGNQAPNNQGNMN

SEQ ID NO: 171105 - protein, 33 aa, Artificial Sequence
  Description of Artificial Sequence: Synthetic polypeptide
DDEEIASTNPVSTEQYGNVAANTINMRNGMQPR

SEQ ID NO: 171106 - protein, 33 aa, Artificial Sequence
  Description of Artificial Sequence: Synthetic polypeptide
DEAEIRTTNPVAYEQWGVVTGGNGNQGEVNDSK

SEQ ID NO: 171107 - protein, 39 aa, Artificial Sequence
  Description of Artificial Sequence: Synthetic polypeptide
DEEEIRTTNPVATEQYGVVSTVVSTTNNQQGTEDEEEEE

SEQ ID NO: 171108 - protein, 36 aa, Artificial Sequence
  Description of Artificial Sequence: Synthetic polypeptide
DEEEISTTNPVATEQYGCVCSTWGEHNQENFGSDQS

SEQ ID NO: 171109 - protein, 32 aa, Artificial Sequence
  Description of Artificial Sequence: Synthetic polypeptide
DEEEIATTNPVATASWGCIATTNAEGQTDNNN

SEQ ID NO: 171110 - protein, 35 aa, Artificial Sequence
  Description of Artificial Sequence: Synthetic polypeptide
DEEEICTTNPVAYEQWGSVCSGEGNQAPNQNNGMS

SEQ ID NO: 171111 - protein, 33 aa, Artificial Sequence
  Description of Artificial Sequence: Synthetic polypeptide
DEAEIRTTNPVAYEQWGVVTGGNGNQGETRDDE

SEQ ID NO: 171112 - protein, 34 aa, Artificial Sequence
  Description of Artificial Sequence: Synthetic polypeptide
DEAEIRTTNPVAYEQWGVVTGGNGNQGGETNDQE

SEQ ID NO: 171113 - protein, 37 aa, Artificial Sequence
  Description of Artificial Sequence: Synthetic polypeptide
DEEEISTTNPVATEQYGCVCSTWGNHNQENFNSDNQL

SEQ ID NO: 171114 - protein, 37 aa, Artificial Sequence
  Description of Artificial Sequence: Synthetic polypeptide
AEDEIRTTNPVATEQYGVVSTVTNDQQGSEGGVSNVD

SEQ ID NO: 171115 - protein, 35 aa, Artificial Sequence
  Description of Artificial Sequence: Synthetic polypeptide
DEHEIATTNPVAYEQYGTVCSTGNNGGQPHMDNDN

SEQ ID NO: 171116 - protein, 36 aa, Artificial Sequence
  Description of Artificial Sequence: Synthetic polypeptide
DEEEIRTTNPVATEQYGCVCSTGEDHIENFISDTQA

SEQ ID NO: 171117 - protein, 32 aa, Artificial Sequence
  Description of Artificial Sequence: Synthetic polypeptide
DEDEIACTNPVATEQWGCVAGTGLAAMDGGML

SEQ ID NO: 171118 - protein, 35 aa, Artificial Sequence
  Description of Artificial Sequence: Synthetic polypeptide
DEEEICTTNPVAYEQWGEVATGGNQQDHQAGNDEL

SEQ ID NO: 171119 - protein, 33 aa, Artificial Sequence
  Description of Artificial Sequence: Synthetic polypeptide
DDEEIASTNPVSTEQYGNVATTTINMRNGMNPV

SEQ ID NO: 171120 - protein, 35 aa, Artificial Sequence
  Description of Artificial Sequence: Synthetic polypeptide
DEEEIRTTNPVATEQYGSYWYTMTMDDENGIMEFQ

SEQ ID NO: 171121 - protein, 37 aa, Artificial Sequence
  Description of Artificial Sequence: Synthetic polypeptide
DEEEISTTNPVATEQYGCVCSTWEEHNQENFGSDNQA

SEQ ID NO: 171122 - protein, 37 aa, Artificial Sequence
  Description of Artificial Sequence: Synthetic polypeptide
DEEEIRTTNPVAYEQWGSVSGGLPANGGNMRNGMGTT

SEQ ID NO: 171123 - protein, 36 aa, Artificial Sequence
  Description of Artificial Sequence: Synthetic polypeptide
DEEEISTTNPVATEQYGCVCSTWEEHNQENFGSDQA

SEQ ID NO: 171124 - protein, 28 aa, Artificial Sequence
  Description of Artificial Sequence: Synthetic peptide
QECEIAGTNPVGYEGYGVMASTTQHGDI

SEQ ID NO: 171125 - protein, 33 aa, Artificial Sequence
  Description of Artificial Sequence: Synthetic polypeptide
DEEEIRTTNPVAYEQYGCVCGWEHNQHFDSDQS

SEQ ID NO: 171126 - protein, 33 aa, Artificial Sequence
  Description of Artificial Sequence: Synthetic polypeptide
DEHEIATTNPVAYEQWGSVTGPNGNPGAMNGGA

SEQ ID NO: 171127 - protein, 33 aa, Artificial Sequence
  Description of Artificial Sequence: Synthetic polypeptide
DDEEIASTNPVSTEQYGNVAATTINMRNGMNPV

SEQ ID NO: 171128 - protein, 36 aa, Artificial Sequence
  Description of Artificial Sequence: Synthetic polypeptide
DEEEIATTNPVATEQYGSACSTNPEQQEHQDDTVAG

SEQ ID NO: 171129 - protein, 34 aa, Artificial Sequence
  Description of Artificial Sequence: Synthetic polypeptide
DEAEIRTTNPVAYEQWGVVTGGNGNQTGEGNADV

SEQ ID NO: 171130 - protein, 35 aa, Artificial Sequence
  Description of Artificial Sequence: Synthetic polypeptide
DEEEIRTTNPVAYEQYGCVCGTWGNHNQYFDSDQS

SEQ ID NO: 171131 - protein, 33 aa, Artificial Sequence
  Description of Artificial Sequence: Synthetic polypeptide
TEDEIATTNPVAYERWGSVCVNDDQGDRQGGMR

SEQ ID NO: 171132 - protein, 36 aa, Artificial Sequence
  Description of Artificial Sequence: Synthetic polypeptide
DEEEIRTTNPVAYEQWGSVSGGMPAGGNMRNGMGMD

SEQ ID NO: 171133 - protein, 32 aa, Artificial Sequence
  Description of Artificial Sequence: Synthetic polypeptide
DEDEIACTNPVATEQWGCVAGTGLADAMEGTL

SEQ ID NO: 171134 - protein, 35 aa, Artificial Sequence
  Description of Artificial Sequence: Synthetic polypeptide
TEDEIACTNPVATEQYGSVYCTWNDQHHQGHNQGE

SEQ ID NO: 171135 - protein, 36 aa, Artificial Sequence
  Description of Artificial Sequence: Synthetic polypeptide
DEEEISTTNPVATEQYGCVCSTGEPNQENFNSETQS

SEQ ID NO: 171136 - protein, 33 aa, Artificial Sequence
  Description of Artificial Sequence: Synthetic polypeptide
DEAEIRTTNPVAYEQWGVVYGDNGNMQPNGDVE

SEQ ID NO: 171137 - protein, 36 aa, Artificial Sequence
  Description of Artificial Sequence: Synthetic polypeptide
DEEEIATTNPMATEQYGSVPVPTVTQIDHWQGQNND

SEQ ID NO: 171138 - protein, 36 aa, Artificial Sequence
  Description of Artificial Sequence: Synthetic polypeptide
DEEEIATTNPVATAQWGSVSATGAGGQAEMGNGSND

SEQ ID NO: 171139 - protein, 34 aa, Artificial Sequence
  Description of Artificial Sequence: Synthetic polypeptide
DEAEIRTTNPVAYEQWGVVVPTDNQDDQNNGGFS

SEQ ID NO: 171140 - protein, 35 aa, Artificial Sequence
  Description of Artificial Sequence: Synthetic polypeptide
AEEEIRTTNPVATEQYGCVCSAMNHNDEFFGSDQA

SEQ ID NO: 171141 - protein, 33 aa, Artificial Sequence
  Description of Artificial Sequence: Synthetic polypeptide
DEDEIACTNPVATEQWGCVAGTNSLFQVDDPGF

SEQ ID NO: 171142 - protein, 30 aa, Artificial Sequence
  Description of Artificial Sequence: Synthetic polypeptide
QEGEIATTNPCASEQYGIVSCNEMNAAEDA

SEQ ID NO: 171143 - protein, 32 aa, Artificial Sequence
  Description of Artificial Sequence: Synthetic polypeptide
DETEIRTTNPIATECWGATWANENLMERGPYI

SEQ ID NO: 171144 - protein, 33 aa, Artificial Sequence
  Description of Artificial Sequence: Synthetic polypeptide
DEDEIACTNPVATEQWGCVAGTGQLQNEMGGLH

SEQ ID NO: 171145 - protein, 35 aa, Artificial Sequence
  Description of Artificial Sequence: Synthetic polypeptide
DEEEISTTNPVATEQYGCVCSTTGPDAENFNSEQS

SEQ ID NO: 171146 - protein, 34 aa, Artificial Sequence
  Description of Artificial Sequence: Synthetic polypeptide
DEHEIATTNPVAYEQWGSVTGPNGNQGAGQNGMH

SEQ ID NO: 171147 - protein, 34 aa, Artificial Sequence
  Description of Artificial Sequence: Synthetic polypeptide
DEEEIATTNPVATAQWGSVSATGAGGTAPQDAAK

SEQ ID NO: 171148 - protein, 37 aa, Artificial Sequence
  Description of Artificial Sequence: Synthetic polypeptide
DEEEIRTTNPVAYEQWGSVSGGNPGNGGNMRNMENLM

SEQ ID NO: 171149 - protein, 36 aa, Artificial Sequence
  Description of Artificial Sequence: Synthetic polypeptide
DEEEIRTTNPVATEQYGCVCSTGEDHNENFNSDTQS

SEQ ID NO: 171150 - protein, 37 aa, Artificial Sequence
  Description of Artificial Sequence: Synthetic polypeptide
DEEEIRTTNPVATEQYGCVCSTGEDHNQENFNSDTQA

SEQ ID NO: 171151 - protein, 34 aa, Artificial Sequence
  Description of Artificial Sequence: Synthetic polypeptide
DEAEIRTTNPVAYEQWGVVTGGNGNQQPEGNADK

SEQ ID NO: 171152 - protein, 37 aa, Artificial Sequence
  Description of Artificial Sequence: Synthetic polypeptide
DEEEICTTNPVATEQYGSAVSSTTPAGPNMRMDMNPV

SEQ ID NO: 171153 - protein, 37 aa, Artificial Sequence
  Description of Artificial Sequence: Synthetic polypeptide
DEEEIRTTNPVATEQYGTQSCDNTNTIEQHQVAIMNE

SEQ ID NO: 171154 - protein, 34 aa, Artificial Sequence
  Description of Artificial Sequence: Synthetic polypeptide
DEMEIVTTNPVATEQYGTVWSNADGPVAEFEGNI

SEQ ID NO: 171155 - protein, 35 aa, Artificial Sequence
  Description of Artificial Sequence: Synthetic polypeptide
TEDEIRTTNPVAYEQWGSVCSTTDDQDHQGRNDKE

SEQ ID NO: 171156 - protein, 35 aa, Artificial Sequence
  Description of Artificial Sequence: Synthetic polypeptide
DEEEIRTTNPVAYEQYGQSARSVANDAAEVREVEE

SEQ ID NO: 171157 - protein, 38 aa, Artificial Sequence
  Description of Artificial Sequence: Synthetic polypeptide
DEEEIRTTNPVATEAYGVVSTVTNQQGNNDEQGTNNTE

SEQ ID NO: 171158 - protein, 29 aa, Artificial Sequence
  Description of Artificial Sequence: Synthetic peptide
QCEEINTTNPVATEHYGEAPEVACQHEEK

SEQ ID NO: 171159 - protein, 36 aa, Artificial Sequence
  Description of Artificial Sequence: Synthetic polypeptide
DEEEISTTNPVATEQYGCVCSTGEHNTEAFNSENQA

SEQ ID NO: 171160 - protein, 33 aa, Artificial Sequence
  Description of Artificial Sequence: Synthetic polypeptide
DEHEIATTNPVAYEQWGSVTGPNGNHGAGNGID

SEQ ID NO: 171161 - protein, 34 aa, Artificial Sequence
  Description of Artificial Sequence: Synthetic polypeptide
TEDEIRTTNPVAYEQWGSVSGGGGNHQGQPGGEN

SEQ ID NO: 171162 - protein, 31 aa, Artificial Sequence
  Description of Artificial Sequence: Synthetic polypeptide
DDTEIATTNPVSTEGWGATAANTIQSRVGPR

SEQ ID NO: 171163 - protein, 30 aa, Artificial Sequence
  Description of Artificial Sequence: Synthetic polypeptide
DETEIRTTNPIATECWGAVSEIWMEAKEDA

SEQ ID NO: 171164 - protein, 32 aa, Artificial Sequence
  Description of Artificial Sequence: Synthetic polypeptide
DDSEVASTNPVSTEGYGNVAANDTLQSRVGQR

SEQ ID NO: 171165 - protein, 37 aa, Artificial Sequence
  Description of Artificial Sequence: Synthetic polypeptide
DEEEIRTTNPVATEQYGCVCSTGEDHNQENFGSQTQS

SEQ ID NO: 171166 - protein, 33 aa, Artificial Sequence
  Description of Artificial Sequence: Synthetic polypeptide
DEEEIRTTNPVAYEQYGCVCQWAHNQYFDSDQS

SEQ ID NO: 171167 - protein, 34 aa, Artificial Sequence
  Description of Artificial Sequence: Synthetic polypeptide
DEMEIVTTNPVATEQYGTVWSNAEGPVAEFEGNI

SEQ ID NO: 171168 - protein, 36 aa, Artificial Sequence
  Description of Artificial Sequence: Synthetic polypeptide
AEEEIRTTNPVATEQYGCVCSWGEHNQENFGSENQP

SEQ ID NO: 171169 - protein, 28 aa, Artificial Sequence
  Description of Artificial Sequence: Synthetic peptide
QCSEIASTNPVGTEGYGVMASTWQHGDI

SEQ ID NO: 171170 - protein, 29 aa, Artificial Sequence
  Description of Artificial Sequence: Synthetic peptide
QDEEIASTNPVSTEQYGEVAEVCQSHEQK

SEQ ID NO: 171171 - protein, 37 aa, Artificial Sequence
  Description of Artificial Sequence: Synthetic polypeptide
DEEEISTTNPVATEQYGCVCSTGELHNQESFNSDTQS

SEQ ID NO: 171172 - protein, 35 aa, Artificial Sequence
  Description of Artificial Sequence: Synthetic polypeptide
DEMEIVTTNPVATEQYGTVVCSATDGPVEFEGNWD

SEQ ID NO: 171173 - protein, 39 aa, Artificial Sequence
  Description of Artificial Sequence: Synthetic polypeptide
DEEEIRTTNPVATEQYGVVSTTNQQQAGTNTEQGSTQDD

SEQ ID NO: 171174 - protein, 36 aa, Artificial Sequence
  Description of Artificial Sequence: Synthetic polypeptide
DEEEIRTTNPVATEQYGTQIDTTTLMEQHQVATMNE

SEQ ID NO: 171175 - protein, 34 aa, Artificial Sequence
  Description of Artificial Sequence: Synthetic polypeptide
DEHEIATTNPVAYEQYGTVCSATDGPIEFEGNDE

SEQ ID NO: 171176 - protein, 36 aa, Artificial Sequence
  Description of Artificial Sequence: Synthetic polypeptide
DEEEIATTNPVATEQYGSACSVAGPLNQNEMNDNFN

SEQ ID NO: 171177 - protein, 36 aa, Artificial Sequence
  Description of Artificial Sequence: Synthetic polypeptide
DEEEISTTNPVATEQYGCVCSTWEHNQENFNSDNQA

SEQ ID NO: 171178 - protein, 38 aa, Artificial Sequence
  Description of Artificial Sequence: Synthetic polypeptide
DEEEIRTTNPVATEAYGSVSTVTNNENNNQEGTEQGTE

SEQ ID NO: 171179 - protein, 35 aa, Artificial Sequence
  Description of Artificial Sequence: Synthetic polypeptide
AEEEIRTTNPVATEQYGCVCGNSGELAENFGSDQS

SEQ ID NO: 171180 - protein, 37 aa, Artificial Sequence
  Description of Artificial Sequence: Synthetic polypeptide
DEEEIRTTNPVATEQYGCVCSTGEDHNIENFNSDTQS

SEQ ID NO: 171181 - protein, 36 aa, Artificial Sequence
  Description of Artificial Sequence: Synthetic polypeptide
AEEEIRTTNPVATEQYGCVCSWGEDNQENFGSNTQA

SEQ ID NO: 171182 - protein, 36 aa, Artificial Sequence
  Description of Artificial Sequence: Synthetic polypeptide
DEEEIRTTNPVATEQYGTQINDNTLHIEQHQVTMNE

SEQ ID NO: 171183 - protein, 35 aa, Artificial Sequence
  Description of Artificial Sequence: Synthetic polypeptide
AEEEIRTTNPVATEQYGCSCSWGEHNAEHFQSDQA

SEQ ID NO: 171184 - protein, 34 aa, Artificial Sequence
  Description of Artificial Sequence: Synthetic polypeptide
DEEEIRTTNPVAYEQYGCVCQTEDNQENFDSDQS

SEQ ID NO: 171185 - protein, 38 aa, Artificial Sequence
  Description of Artificial Sequence: Synthetic polypeptide
DEEEIRTTNPVATEAYGVVSTVTNQGQAGNQQGTTDDE

SEQ ID NO: 171186 - protein, 32 aa, Artificial Sequence
  Description of Artificial Sequence: Synthetic polypeptide
DEDEIACTNPVATEQWGCVAGTGLAAEMNGTL

SEQ ID NO: 171187 - protein, 36 aa, Artificial Sequence
  Description of Artificial Sequence: Synthetic polypeptide
DEEEIRTTNPVATEQYGCVCSTEEDHNANFNSDTQG

SEQ ID NO: 171188 - protein, 30 aa, Artificial Sequence
  Description of Artificial Sequence: Synthetic polypeptide
YDSEIASVNPVSTEGYGVVSANTIQSSGNQ

SEQ ID NO: 171189 - protein, 36 aa, Artificial Sequence
  Description of Artificial Sequence: Synthetic polypeptide
DEEEIGTTNPVATEQYGCVCSNWEDHDQNFGSENQS

SEQ ID NO: 171190 - protein, 39 aa, Artificial Sequence
  Description of Artificial Sequence: Synthetic polypeptide
DEEEIRTTNPVATEQYGVVSTVTNQQQGNEQGTTTNNTE

SEQ ID NO: 171191 - protein, 36 aa, Artificial Sequence
  Description of Artificial Sequence: Synthetic polypeptide
DEAEIRTTNPVAYEQWGSVSGGEQQGGNQRNGMNEV

SEQ ID NO: 171192 - protein, 38 aa, Artificial Sequence
  Description of Artificial Sequence: Synthetic polypeptide
DEEEIRTTNPVATEQYGVVSTTNQQQQNGTEQGSTDVE

SEQ ID NO: 171193 - protein, 32 aa, Artificial Sequence
  Description of Artificial Sequence: Synthetic polypeptide
TEEEIASVNPVCYEQWGVVSINLSQEGGGNNQ

SEQ ID NO: 171194 - protein, 35 aa, Artificial Sequence
  Description of Artificial Sequence: Synthetic polypeptide
DEEEISTTNPVATEQYGCVCSWGEHNQHFNSDTQG

SEQ ID NO: 171195 - protein, 35 aa, Artificial Sequence
  Description of Artificial Sequence: Synthetic polypeptide
DEEEISTTNPVATEQYGCVCSWGEHNQESFNSDQS

SEQ ID NO: 171196 - protein, 35 aa, Artificial Sequence
  Description of Artificial Sequence: Synthetic polypeptide
DEEEISTTNPVATEQYGCVCSSEHNQEAFNSDNQA

SEQ ID NO: 171197 - protein, 34 aa, Artificial Sequence
  Description of Artificial Sequence: Synthetic polypeptide
DEMEIRTTNPVATEQYGCVCQTGAHNINFMSDQG

SEQ ID NO: 171198 - protein, 34 aa, Artificial Sequence
  Description of Artificial Sequence: Synthetic polypeptide
DEMEIVTTNPVATQQYGTVCSATDGPVEFEGSND

SEQ ID NO: 171199 - protein, 35 aa, Artificial Sequence
  Description of Artificial Sequence: Synthetic polypeptide
DEEEISTTNPVATEQYGCVCSSGEHQEYFGSDTQG

SEQ ID NO: 171200 - protein, 36 aa, Artificial Sequence
  Description of Artificial Sequence: Synthetic polypeptide
DEMEIRTTNPVATEQYGCVCSDTGEHNQNFSSDNQS

SEQ ID NO: 171201 - protein, 35 aa, Artificial Sequence
  Description of Artificial Sequence: Synthetic polypeptide
SNEEIRTTNPVATEQYGSVWAEDPTNMASDFQERI

SEQ ID NO: 171202 - protein, 35 aa, Artificial Sequence
  Description of Artificial Sequence: Synthetic polypeptide
DEEEISTTNPVATEQYGCVCSWGEHNQENFNSDQA

SEQ ID NO: 171203 - protein, 37 aa, Artificial Sequence
  Description of Artificial Sequence: Synthetic polypeptide
AEDEIRTTNPVATEQYGVVSTVTNQQQQQQIGTTNTD

SEQ ID NO: 171204 - protein, 35 aa, Artificial Sequence
  Description of Artificial Sequence: Synthetic polypeptide
DEEEISTTNPVATEQYGCVCSWGEHNQHFNSDTQA

SEQ ID NO: 171205 - protein, 34 aa, Artificial Sequence
  Description of Artificial Sequence: Synthetic polypeptide
DEEEISTTNPVATEQYGCVCSWGEHIENFNSNQS

SEQ ID NO: 171206 - protein, 32 aa, Artificial Sequence
  Description of Artificial Sequence: Synthetic polypeptide
SQEEIRTTNPVATEHWGTYTSWNLTEEPINKF

SEQ ID NO: 171207 - protein, 31 aa, Artificial Sequence
  Description of Artificial Sequence: Synthetic polypeptide
SQDEIRTTNPVATEHWGTYSWNLTEEPIENK

SEQ ID NO: 171208 - protein, 33 aa, Artificial Sequence
  Description of Artificial Sequence: Synthetic polypeptide
DEHEIATTNPVAYECWGSVAWSDDQQDRNGGDS

SEQ ID NO: 171209 - protein, 35 aa, Artificial Sequence
  Description of Artificial Sequence: Synthetic polypeptide
DEAEIRTTNPVAYEQWGSVCYTQDNHDQHTGGGTN

SEQ ID NO: 171210 - protein, 35 aa, Artificial Sequence
  Description of Artificial Sequence: Synthetic polypeptide
DEMEIVTTNPVATEQYGTVCSNWGEPNEFFGSNDN

SEQ ID NO: 171211 - protein, 39 aa, Artificial Sequence
  Description of Artificial Sequence: Synthetic polypeptide
DEEEIRTTNPVATEQYGVVSTVVTNGTQAGNTEAGSTTE

SEQ ID NO: 171212 - protein, 34 aa, Artificial Sequence
  Description of Artificial Sequence: Synthetic polypeptide
QECEICTTNPVATEAYGVVSTELQLNQQGSEELG

SEQ ID NO: 171213 - protein, 32 aa, Artificial Sequence
  Description of Artificial Sequence: Synthetic polypeptide
TEEEIASVNPVCYEPYGVVVSINLSQSGGNNQ

SEQ ID NO: 171214 - protein, 37 aa, Artificial Sequence
  Description of Artificial Sequence: Synthetic polypeptide
DEAEIRTTNPVAYEQWGSVSGGTPANGPNMRNGGNPV

SEQ ID NO: 171215 - protein, 35 aa, Artificial Sequence
  Description of Artificial Sequence: Synthetic polypeptide
DEEEIGTTNPVATEQYGCVCSSGEDHQNFGSETQQ

SEQ ID NO: 171216 - protein, 36 aa, Artificial Sequence
  Description of Artificial Sequence: Synthetic polypeptide
DEEEISTTNPVATEQYGCVCSSGEHNTENFGSENQA

SEQ ID NO: 171217 - protein, 34 aa, Artificial Sequence
  Description of Artificial Sequence: Synthetic polypeptide
DEMEIRTTNPVATEQYGCVCQWAHNIENFNSDQS

SEQ ID NO: 171218 - protein, 34 aa, Artificial Sequence
  Description of Artificial Sequence: Synthetic polypeptide
DEMEIVTTNPVATQQYGTVCSATDGPVEFFEGND

SEQ ID NO: 171219 - protein, 31 aa, Artificial Sequence
  Description of Artificial Sequence: Synthetic polypeptide
SQEEIRTTNPVATEHWGTYSWNQTEVPINHT

SEQ ID NO: 171220 - protein, 36 aa, Artificial Sequence
  Description of Artificial Sequence: Synthetic polypeptide
DEEEIATTNPVATEQYGSTACAANDGLPLGSEGNID

SEQ ID NO: 171221 - protein, 33 aa, Artificial Sequence
  Description of Artificial Sequence: Synthetic polypeptide
TEEEIASVNPVCYEQYGIVVVSDNLSQSGGNNE

SEQ ID NO: 171222 - protein, 35 aa, Artificial Sequence
  Description of Artificial Sequence: Synthetic polypeptide
DEMEIVTTNPVATEQYGTVCSNTGEPDEFEGSNQM

SEQ ID NO: 171223 - protein, 36 aa, Artificial Sequence
  Description of Artificial Sequence: Synthetic polypeptide
AEEEIRTTNPVATEQYGSVQPPAVPLDIMIEVGNIL

SEQ ID NO: 171224 - protein, 34 aa, Artificial Sequence
  Description of Artificial Sequence: Synthetic polypeptide
DEMEIVTTNPVATMQYGTVCSATDGPVEFEGNKD

SEQ ID NO: 171225 - protein, 34 aa, Artificial Sequence
  Description of Artificial Sequence: Synthetic polypeptide
AEEEIRTTNPVATEEYGCSCSSGEDNQNFISNQS

SEQ ID NO: 171226 - protein, 37 aa, Artificial Sequence
  Description of Artificial Sequence: Synthetic polypeptide
AEDEIRTTNPVATEQYGVVSTVTNQQQNNQQGTTNVD

SEQ ID NO: 171227 - protein, 35 aa, Artificial Sequence
  Description of Artificial Sequence: Synthetic polypeptide
DEEEISTTNPVATEQYGCVCSSGEDHNQNFGSDQG

SEQ ID NO: 171228 - protein, 35 aa, Artificial Sequence
  Description of Artificial Sequence: Synthetic polypeptide
DEEEISTTNPVATEQYGCVCSWGEHNQSFNSDNQE

SEQ ID NO: 171229 - protein, 36 aa, Artificial Sequence
  Description of Artificial Sequence: Synthetic polypeptide
DEEEISTTNPVATEQYGCVCSWGEHNAENFGSDNQA

SEQ ID NO: 171230 - protein, 33 aa, Artificial Sequence
  Description of Artificial Sequence: Synthetic polypeptide
TEEEIASVNPVCYEQYGVTVSCDPNLSQTGGNQ

SEQ ID NO: 171231 - protein, 35 aa, Artificial Sequence
  Description of Artificial Sequence: Synthetic polypeptide
DETEIRTTNPIATECYGSTTWSNAENLAERKGPYI

SEQ ID NO: 171232 - protein, 35 aa, Artificial Sequence
  Description of Artificial Sequence: Synthetic polypeptide
AEEEIRTTNPVATEQYGSVIEPSNAGFEMHDNTEI

SEQ ID NO: 171233 - protein, 34 aa, Artificial Sequence
  Description of Artificial Sequence: Synthetic polypeptide
SQEEIGTTNPVATHQYGSVSWNGVTTEGSENHYI

SEQ ID NO: 171234 - protein, 36 aa, Artificial Sequence
  Description of Artificial Sequence: Synthetic polypeptide
DEEEIRTTNPVATEQYGSTPPPLNTLVPTQGEQEHV

SEQ ID NO: 171235 - protein, 36 aa, Artificial Sequence
  Description of Artificial Sequence: Synthetic polypeptide
DEEEISTTNPVATEQYGCVCSSGEDNQEGFNSETQS

SEQ ID NO: 171236 - protein, 33 aa, Artificial Sequence
  Description of Artificial Sequence: Synthetic polypeptide
TEEEIATTNPEATDQYGQVCCCDQDQKREGNDE

SEQ ID NO: 171237 - protein, 35 aa, Artificial Sequence
  Description of Artificial Sequence: Synthetic polypeptide
DEEEISTTNPVATEQYGCVCSWGEHNQNFNSDTQA

SEQ ID NO: 171238 - protein, 32 aa, Artificial Sequence
  Description of Artificial Sequence: Synthetic polypeptide
TEEEIASVNPVCYEQYGVTVSCDNLSQSGGVQ

SEQ ID NO: 171239 - protein, 36 aa, Artificial Sequence
  Description of Artificial Sequence: Synthetic polypeptide
DEMEIVTTNPVATEQYGTVCSNTGEPNEFFGSDNQQ

SEQ ID NO: 171240 - protein, 35 aa, Artificial Sequence
  Description of Artificial Sequence: Synthetic polypeptide
DEEEISTTNPVATEQYGCVCSWGEHNQNFNSDNQI

SEQ ID NO: 171241 - protein, 33 aa, Artificial Sequence
  Description of Artificial Sequence: Synthetic polypeptide
TEEEIASVNPVCYEQYGVTVSCDNLSQQGGNQQ

SEQ ID NO: 171242 - protein, 36 aa, Artificial Sequence
  Description of Artificial Sequence: Synthetic polypeptide
DEEEISTTNPVATEQYGCVCSWGEHNIENFGSDNQS

SEQ ID NO: 171243 - protein, 36 aa, Artificial Sequence
  Description of Artificial Sequence: Synthetic polypeptide
DEEEISTTNPVATEQYGCVCSWGEHNQESFGSDNQL

SEQ ID NO: 171244 - protein, 34 aa, Artificial Sequence
  Description of Artificial Sequence: Synthetic polypeptide
DEEEISTTNPVATEQYGCVCSWGEHNQNFISDQL

SEQ ID NO: 171245 - protein, 36 aa, Artificial Sequence
  Description of Artificial Sequence: Synthetic polypeptide
DEEEIRTTNPVAYEQYGQCVCSWMNDHNQNIGSQQS

SEQ ID NO: 171246 - protein, 33 aa, Artificial Sequence
  Description of Artificial Sequence: Synthetic polypeptide
SNEEIRTTNPVATEQWGCVSLANTYWEGVQDPP

SEQ ID NO: 171247 - protein, 35 aa, Artificial Sequence
  Description of Artificial Sequence: Synthetic polypeptide
DEEEISTTNPVATEQYGCVCSWGEHNAEHFNSDQE

SEQ ID NO: 171248 - protein, 33 aa, Artificial Sequence
  Description of Artificial Sequence: Synthetic polypeptide
DEMEIVTTNPVATNQYGTVCSATDGPVEFEGHD

SEQ ID NO: 171249 - protein, 36 aa, Artificial Sequence
  Description of Artificial Sequence: Synthetic polypeptide
DEEEIRTTNPVATEQYGCVCSTEDHNQENFISQTQS

SEQ ID NO: 171250 - protein, 35 aa, Artificial Sequence
  Description of Artificial Sequence: Synthetic polypeptide
DEEEIGTTNPVATEQYGCVCSNWEDDQENMGSDQS

SEQ ID NO: 171251 - protein, 32 aa, Artificial Sequence
  Description of Artificial Sequence: Synthetic polypeptide
TEEEIASVNPVCYEPYGVTVSINLSQSGGNEV

SEQ ID NO: 171252 - protein, 32 aa, Artificial Sequence
  Description of Artificial Sequence: Synthetic polypeptide
DDSEVASTNPVSTEGYGNVAANETIQSRVGNR

SEQ ID NO: 171253 - protein, 34 aa, Artificial Sequence
  Description of Artificial Sequence: Synthetic polypeptide
QECEICTTNPVATEAYGVVSTELQLQQQGEEQLG

SEQ ID NO: 171254 - protein, 35 aa, Artificial Sequence
  Description of Artificial Sequence: Synthetic polypeptide
DEMEIVTTNPVATEQYGTVCSNTGEPVEFFGSNTQ

SEQ ID NO: 171255 - protein, 35 aa, Artificial Sequence
  Description of Artificial Sequence: Synthetic polypeptide
DEEEISTTNPVATEQYGCVCSSGEHNQGFNSDTQS

SEQ ID NO: 171256 - protein, 34 aa, Artificial Sequence
  Description of Artificial Sequence: Synthetic polypeptide
DEMEIVTTNPVATRQYGTVCSATDGPVEFEGDND

SEQ ID NO: 171257 - protein, 35 aa, Artificial Sequence
  Description of Artificial Sequence: Synthetic polypeptide
DEEEISTTNPVATEQYGCVCSSEEHNQGFNSDTQD

SEQ ID NO: 171258 - protein, 35 aa, Artificial Sequence
  Description of Artificial Sequence: Synthetic polypeptide
DEEEISTTNPVATEQYGCVCSSGEHNQGFNSDPQA

SEQ ID NO: 171259 - protein, 35 aa, Artificial Sequence
  Description of Artificial Sequence: Synthetic polypeptide
DEEEISTTNPVATEQYGCVCSWGEHNQGFNSDTQS

SEQ ID NO: 171260 - protein, 35 aa, Artificial Sequence
  Description of Artificial Sequence: Synthetic polypeptide
DEEEISTTNPVATEQYGCVCSWGEHNAHFNSDNQS

SEQ ID NO: 171261 - protein, 33 aa, Artificial Sequence
  Description of Artificial Sequence: Synthetic polypeptide
QAEEIATTNPVATEQYGSVCATPQEDINHPDTM

SEQ ID NO: 171262 - protein, 35 aa, Artificial Sequence
  Description of Artificial Sequence: Synthetic polypeptide
DEMEIVTTNPVATLQYGTVCSATDGPVERFEGYND

SEQ ID NO: 171263 - protein, 34 aa, Artificial Sequence
  Description of Artificial Sequence: Synthetic polypeptide
DEDEIATTNPVATAAWGSVSGANEPQDPGGENTG

SEQ ID NO: 171264 - protein, 35 aa, Artificial Sequence
  Description of Artificial Sequence: Synthetic polypeptide
DEEEISTTNPVATEQYGCVCSWGEHNQGFGSETQA

SEQ ID NO: 171265 - protein, 34 aa, Artificial Sequence
  Description of Artificial Sequence: Synthetic polypeptide
DEMEIVTTNPVATMQYGTVCSATDGFPVEFEGND

SEQ ID NO: 171266 - protein, 36 aa, Artificial Sequence
  Description of Artificial Sequence: Synthetic polypeptide
DEEEISTTNPVATEQYGCVCSWGEHDQENFGSENQS

SEQ ID NO: 171267 - protein, 35 aa, Artificial Sequence
  Description of Artificial Sequence: Synthetic polypeptide
DEAEIRTTNPVAYEQWGSVSGGLGNTAGELDGGQN

SEQ ID NO: 171268 - protein, 35 aa, Artificial Sequence
  Description of Artificial Sequence: Synthetic polypeptide
DEEEISTTNPVATEQYGCVCSSGEHNQGFGSDTQS

SEQ ID NO: 171269 - protein, 37 aa, Artificial Sequence
  Description of Artificial Sequence: Synthetic polypeptide
DEEEIRTTNPVATEQYGSVNSLPNIMVLESALEVAES

SEQ ID NO: 171270 - protein, 35 aa, Artificial Sequence
  Description of Artificial Sequence: Synthetic polypeptide
DEEEISTTNPVATEQYGCVCSSGEHNQFFNSDNQE

SEQ ID NO: 171271 - protein, 34 aa, Artificial Sequence
  Description of Artificial Sequence: Synthetic polypeptide
QECEICTTNPVATEAYGVVSTELQQLLQGTEEGQ

SEQ ID NO: 171272 - protein, 35 aa, Artificial Sequence
  Description of Artificial Sequence: Synthetic polypeptide
DEEEISTTNPVATEQYGCVCSSGEHNQEYFGSEQS

SEQ ID NO: 171273 - protein, 33 aa, Artificial Sequence
  Description of Artificial Sequence: Synthetic polypeptide
DEMEIVTTNPVATMQYGTVCFATDGPVEFEGND

SEQ ID NO: 171274 - protein, 34 aa, Artificial Sequence
  Description of Artificial Sequence: Synthetic polypeptide
DEEEIRTTNPVAYEQYGCVCSWEEDAENFGSQQA

SEQ ID NO: 171275 - protein, 34 aa, Artificial Sequence
  Description of Artificial Sequence: Synthetic polypeptide
QECEICTTNPVATEAYGVVSTELQQLQAGTEELQ

SEQ ID NO: 171276 - protein, 35 aa, Artificial Sequence
  Description of Artificial Sequence: Synthetic polypeptide
QECEICTTNPVATEAYGVVSTELQQLQAGNDEQSE

SEQ ID NO: 171277 - protein, 34 aa, Artificial Sequence
  Description of Artificial Sequence: Synthetic polypeptide
QECEICTTNPVATEAYGVVSTELQLLQQGTEELQ

SEQ ID NO: 171278 - protein, 36 aa, Artificial Sequence
  Description of Artificial Sequence: Synthetic polypeptide
DEEEISTTNPVATEQYGCVCSSGEHNQENFGSDNQA

SEQ ID NO: 171279 - protein, 35 aa, Artificial Sequence
  Description of Artificial Sequence: Synthetic polypeptide
DEEEISTTNPVATEQYGCVCSSEEHNQSFGSETQP

SEQ ID NO: 171280 - protein, 36 aa, Artificial Sequence
  Description of Artificial Sequence: Synthetic polypeptide
DEEEIRTTNPVATEAYGMVGSVTAGFGEGGGEGNTG

SEQ ID NO: 171281 - protein, 34 aa, Artificial Sequence
  Description of Artificial Sequence: Synthetic polypeptide
DEAEIRTTNPVAYEQWGSVCYTQDNDDHTGGGTA

SEQ ID NO: 171282 - protein, 35 aa, Artificial Sequence
  Description of Artificial Sequence: Synthetic polypeptide
DEMEIVTTNPVATEQYGTVCSATPGAPVEFEGQND

SEQ ID NO: 171283 - protein, 35 aa, Artificial Sequence
  Description of Artificial Sequence: Synthetic polypeptide
DEEEISTTNPVATEQYGCVCSWGEHNANFGSETQA

SEQ ID NO: 171284 - protein, 35 aa, Artificial Sequence
  Description of Artificial Sequence: Synthetic polypeptide
DEEEISTTNPVATEQYGCVCSWGEHNQENFNSDQV

SEQ ID NO: 171285 - protein, 36 aa, Artificial Sequence
  Description of Artificial Sequence: Synthetic polypeptide
DEEEIRTTNPVATEQYGAVVDNGFNTTDTGEGEENI

SEQ ID NO: 171286 - protein, 33 aa, Artificial Sequence
  Description of Artificial Sequence: Synthetic polypeptide
DEMEIVTTNPVATLQYGTVCSATDGPVEFEGAD

SEQ ID NO: 171287 - protein, 35 aa, Artificial Sequence
  Description of Artificial Sequence: Synthetic polypeptide
DEMEIVTTNPVATEQYGTVCSNTGEPNEHFGSDQA

SEQ ID NO: 171288 - protein, 33 aa, Artificial Sequence
  Description of Artificial Sequence: Synthetic polypeptide
DEMEIVTTNPVATQQYGTVCSAWDGPVEFEGND

SEQ ID NO: 171289 - protein, 36 aa, Artificial Sequence
  Description of Artificial Sequence: Synthetic polypeptide
DEEEISTTNPVATEQYGCVCSSGEHNTENFGSDNQQ

SEQ ID NO: 171290 - protein, 35 aa, Artificial Sequence
  Description of Artificial Sequence: Synthetic polypeptide
DEEEISTTNPVATEQYGCVCSSGEDQENFGSETQS

SEQ ID NO: 171291 - protein, 33 aa, Artificial Sequence
  Description of Artificial Sequence: Synthetic polypeptide
DETEIRTTNPIATEPYGAIWSNMEDWQEPKGNI

SEQ ID NO: 171292 - protein, 35 aa, Artificial Sequence
  Description of Artificial Sequence: Synthetic polypeptide
DESEIRTTNPVATECWGSTVACINEPQDRKGEPYG

SEQ ID NO: 171293 - protein, 37 aa, Artificial Sequence
  Description of Artificial Sequence: Synthetic polypeptide
DEEEIRTTNPVATEQYGSVGSWNPNVVQLTLMVQEAD

SEQ ID NO: 171294 - protein, 35 aa, Artificial Sequence
  Description of Artificial Sequence: Synthetic polypeptide
DEEEIGTTNPVATEQYGCVCSNWGEHDQNFGSDQS

SEQ ID NO: 171295 - protein, 35 aa, Artificial Sequence
  Description of Artificial Sequence: Synthetic polypeptide
DEEEISTTNPVATEQYGCVCSSGEHNAENFGSDQA

SEQ ID NO: 171296 - protein, 33 aa, Artificial Sequence
  Description of Artificial Sequence: Synthetic polypeptide
DETEIRTTNPIATEPYGAIWSNMEDIQEPNGNI

SEQ ID NO: 171297 - protein, 35 aa, Artificial Sequence
  Description of Artificial Sequence: Synthetic polypeptide
DEEEISTTNPVATEQYGCVCSWGEHNQEYFNSDQG

SEQ ID NO: 171298 - protein, 35 aa, Artificial Sequence
  Description of Artificial Sequence: Synthetic polypeptide
DEEEISTTNPVATEQYGCVCSSGEHNQYFGSETQS

SEQ ID NO: 171299 - protein, 39 aa, Artificial Sequence
  Description of Artificial Sequence: Synthetic polypeptide
DEEEIRTTNPVATEQYGVVSTTNQLQQNATNEQGSVDDE

SEQ ID NO: 171300 - protein, 33 aa, Artificial Sequence
  Description of Artificial Sequence: Synthetic polypeptide
DETEIRTTNPIATEPYGAIWSNMEDIQEPKGNI

SEQ ID NO: 171301 - protein, 39 aa, Artificial Sequence
  Description of Artificial Sequence: Synthetic polypeptide
DEEEIRTTNPVATEQYGVVSTTNQQQQNGNTEQGSTQEE

SEQ ID NO: 171302 - protein, 36 aa, Artificial Sequence
  Description of Artificial Sequence: Synthetic polypeptide
DEEEISTTNPVATEQYGCVCSSEEHNQEHFGSDNQA

SEQ ID NO: 171303 - protein, 34 aa, Artificial Sequence
  Description of Artificial Sequence: Synthetic polypeptide
DEMEIVTTNPVATLQYGTVCSATDGPVEFEGNDC

SEQ ID NO: 171304 - protein, 33 aa, Artificial Sequence
  Description of Artificial Sequence: Synthetic polypeptide
DETEIRTTNPIATECYGTVWSNADGPVAFKGND

SEQ ID NO: 171305 - protein, 35 aa, Artificial Sequence
  Description of Artificial Sequence: Synthetic polypeptide
DEEEISTTNPVATEQYGCVCSWGEHNQEYFNSEQA

SEQ ID NO: 171306 - protein, 31 aa, Artificial Sequence
  Description of Artificial Sequence: Synthetic polypeptide
QEGEIATTNPCSSEQWGIVSCINLQDSEGTG

SEQ ID NO: 171307 - protein, 35 aa, Artificial Sequence
  Description of Artificial Sequence: Synthetic polypeptide
DEEEISTTNPVATEQYGCVCSSGEHNQHFNSDTQA

SEQ ID NO: 171308 - protein, 35 aa, Artificial Sequence
  Description of Artificial Sequence: Synthetic polypeptide
DEMEIVTTNPVATEQYGTVCSNTGEPVEEFFGSND

SEQ ID NO: 171309 - protein, 32 aa, Artificial Sequence
  Description of Artificial Sequence: Synthetic polypeptide
DEMEIRTTNPVATEQWGDVCSEIPVMNAAEDA

SEQ ID NO: 171310 - protein, 33 aa, Artificial Sequence
  Description of Artificial Sequence: Synthetic polypeptide
DETEIRTTNPIATECYGTVWSNAEGPVAFKGND

SEQ ID NO: 171311 - protein, 35 aa, Artificial Sequence
  Description of Artificial Sequence: Synthetic polypeptide
DEMEIVTTNPVATEQYGTVCSATPGPVEAFEGNDD

SEQ ID NO: 171312 - protein, 36 aa, Artificial Sequence
  Description of Artificial Sequence: Synthetic polypeptide
DEEEISTTNPVATEQYGCVCSSEEHNQEYFGSDNQS

SEQ ID NO: 171313 - protein, 35 aa, Artificial Sequence
  Description of Artificial Sequence: Synthetic polypeptide
DEEEISTTNPVATEQYGCVCSWGEHNQENFNSDQI

SEQ ID NO: 171314 - protein, 34 aa, Artificial Sequence
  Description of Artificial Sequence: Synthetic polypeptide
DEEEISTTNPVATEQYGCVCSWGEHNANFNSDQG

SEQ ID NO: 171315 - protein, 34 aa, Artificial Sequence
  Description of Artificial Sequence: Synthetic polypeptide
DEDEIATTNPCATEHYGSVCYNNDDQDHGDNDTG

SEQ ID NO: 171316 - protein, 37 aa, Artificial Sequence
  Description of Artificial Sequence: Synthetic polypeptide
AEEEIRTTNPVATEQYGSVQPAAVPLDIQTIEPGNNL

SEQ ID NO: 171317 - protein, 35 aa, Artificial Sequence
  Description of Artificial Sequence: Synthetic polypeptide
DEEEIATTNPCATEQYGSVPPTFVQDHFQVDNDWD

SEQ ID NO: 171318 - protein, 31 aa, Artificial Sequence
  Description of Artificial Sequence: Synthetic polypeptide
QENEIATTNPVATEPWGNVSGEHLQHWDELD

SEQ ID NO: 171319 - protein, 32 aa, Artificial Sequence
  Description of Artificial Sequence: Synthetic polypeptide
TEEEIASVNPVCYEAYGVVSINELSQSGGNMQ

SEQ ID NO: 171320 - protein, 37 aa, Artificial Sequence
  Description of Artificial Sequence: Synthetic polypeptide
DEEEIRTTNPVAYEQYGQCVCSWMNDHNQNFGSQNQL

SEQ ID NO: 171321 - protein, 33 aa, Artificial Sequence
  Description of Artificial Sequence: Synthetic polypeptide
DENEIRTTNPVSTEPYGTISNMEDIQQQQNGNH

SEQ ID NO: 171322 - protein, 31 aa, Artificial Sequence
  Description of Artificial Sequence: Synthetic polypeptide
DETEIRTTNPIATECYGAVSNEECWAEHEEI

SEQ ID NO: 171323 - protein, 33 aa, Artificial Sequence
  Description of Artificial Sequence: Synthetic polypeptide
SQAEIRTTNPVATEQYGCCSIVTLTQHGQDSKQ

SEQ ID NO: 171324 - protein, 35 aa, Artificial Sequence
  Description of Artificial Sequence: Synthetic polypeptide
DEEEIATTNPFATEQYGSVPPTFVQDHFQVDNGDD

SEQ ID NO: 171325 - protein, 34 aa, Artificial Sequence
  Description of Artificial Sequence: Synthetic polypeptide
DEEEISTTNPVATEQYGCVCSSEHNAENFFSEQS

SEQ ID NO: 171326 - protein, 38 aa, Artificial Sequence
  Description of Artificial Sequence: Synthetic polypeptide
DEEEIRTTNPVATEAYGVVSTVVNNQQAGNNNDEEEQD

SEQ ID NO: 171327 - protein, 33 aa, Artificial Sequence
  Description of Artificial Sequence: Synthetic polypeptide
DEMEIVTTNPVATGQYGTVCSATDGPVEFEGYD

SEQ ID NO: 171328 - protein, 33 aa, Artificial Sequence
  Description of Artificial Sequence: Synthetic polypeptide
TEEEIASVNPVCYEQYGWVSCINALSQSGGNTQ

SEQ ID NO: 171329 - protein, 33 aa, Artificial Sequence
  Description of Artificial Sequence: Synthetic polypeptide
DEMEIVTTNPVATEQYGTVCSAWDGPVEFEGWD

SEQ ID NO: 171330 - protein, 33 aa, Artificial Sequence
  Description of Artificial Sequence: Synthetic polypeptide
DEMEIVTTNPVATKQWGTVCSATDGPVEFEGND

SEQ ID NO: 171331 - protein, 31 aa, Artificial Sequence
  Description of Artificial Sequence: Synthetic polypeptide
QENEIATTNPVATEGYGCVSWEHNQHFISEL

SEQ ID NO: 171332 - protein, 34 aa, Artificial Sequence
  Description of Artificial Sequence: Synthetic polypeptide
QAEEIATTNPVATEQYGSVCSPPGPLDSMINVEE

SEQ ID NO: 171333 - protein, 33 aa, Artificial Sequence
  Description of Artificial Sequence: Synthetic polypeptide
DEEEIATTNPCAYEQWGVVCPTWENDQNKGGEQ

SEQ ID NO: 171334 - protein, 32 aa, Artificial Sequence
  Description of Artificial Sequence: Synthetic polypeptide
DETEIRTTNPIATEPYGATWAMEDWAQQKGNI

SEQ ID NO: 171335 - protein, 38 aa, Artificial Sequence
  Description of Artificial Sequence: Synthetic polypeptide
DEEEIRTTNPVATEAYGVVSTVVNNQQLGTNNDEEEND

SEQ ID NO: 171336 - protein, 37 aa, Artificial Sequence
  Description of Artificial Sequence: Synthetic polypeptide
DEEEIRTTNPVATEQYGTTQCDNTNLIEQHQVDIMNE

SEQ ID NO: 171337 - protein, 34 aa, Artificial Sequence
  Description of Artificial Sequence: Synthetic polypeptide
DEHEIATTNPVAYEEWGSVATGGNTGNAGNDNQR

SEQ ID NO: 171338 - protein, 35 aa, Artificial Sequence
  Description of Artificial Sequence: Synthetic polypeptide
DEEEISTTNPVATEQYGCVCSWGEHNTNFNSDPQS

SEQ ID NO: 171339 - protein, 35 aa, Artificial Sequence
  Description of Artificial Sequence: Synthetic polypeptide
DEEEIRTTNPVSTEQYGCVCGTWGEHNQGFGSQQG

SEQ ID NO: 171340 - protein, 35 aa, Artificial Sequence
  Description of Artificial Sequence: Synthetic polypeptide
DEEEISTTNPVATEQYGCVCSWGEHNTENFNSEQA

SEQ ID NO: 171341 - protein, 36 aa, Artificial Sequence
  Description of Artificial Sequence: Synthetic polypeptide
DEEEISTTNPVATEQYGCVCSWGEHNQENSGSENQQ

SEQ ID NO: 171342 - protein, 35 aa, Artificial Sequence
  Description of Artificial Sequence: Synthetic polypeptide
DEEEIRTTNPVAYEQYGCVCSWEEHNAEHFGSQQS

SEQ ID NO: 171343 - protein, 37 aa, Artificial Sequence
  Description of Artificial Sequence: Synthetic polypeptide
DEEEIRTTNPVATEQYGVVSTTNQNGTEAGSTQEDEE

SEQ ID NO: 171344 - protein, 33 aa, Artificial Sequence
  Description of Artificial Sequence: Synthetic polypeptide
TEEEIATTNPEATDQYGQVCCCDQDQKREGDNK

SEQ ID NO: 171345 - protein, 36 aa, Artificial Sequence
  Description of Artificial Sequence: Synthetic polypeptide
DEEEISTTNPVATEQYGCVCSWGEHNQEGFISDNQS

SEQ ID NO: 171346 - protein, 38 aa, Artificial Sequence
  Description of Artificial Sequence: Synthetic polypeptide
DEEEIRTTNPVATEQYGVVSTTNQQQQNGTEAGSTQEE

SEQ ID NO: 171347 - protein, 36 aa, Artificial Sequence
  Description of Artificial Sequence: Synthetic polypeptide
DEEEIRTTNPVATEAYGMVSVEGMGGNQGQEGEFGT

SEQ ID NO: 171348 - protein, 36 aa, Artificial Sequence
  Description of Artificial Sequence: Synthetic polypeptide
DEEEISTTNPVATEQYGCVCSWGEHNQENFGSENQV

SEQ ID NO: 171349 - protein, 35 aa, Artificial Sequence
  Description of Artificial Sequence: Synthetic polypeptide
DEEEISTTNPVATEQYGCVCSWGEHNQENFGSDQS

SEQ ID NO: 171350 - protein, 32 aa, Artificial Sequence
  Description of Artificial Sequence: Synthetic polypeptide
TEEEIATTNPCAYEKWGSVPTWENDQNKGGEQ

SEQ ID NO: 171351 - protein, 35 aa, Artificial Sequence
  Description of Artificial Sequence: Synthetic polypeptide
DEAEIRTTNPVAYEQYGTVCATWDNQDRNDSNGDQ

SEQ ID NO: 171352 - protein, 35 aa, Artificial Sequence
  Description of Artificial Sequence: Synthetic polypeptide
DEEEISTTNPVATEQYGCVCSWGEHNQENSGSEQA

SEQ ID NO: 171353 - protein, 35 aa, Artificial Sequence
  Description of Artificial Sequence: Synthetic polypeptide
DEEEIRTTNPVATEQYGAVVDIMNMDSNEEGGQGQ

SEQ ID NO: 171354 - protein, 32 aa, Artificial Sequence
  Description of Artificial Sequence: Synthetic polypeptide
WENEIRTTNPVSTEPYGTISMEDIQQQQNGNH

SEQ ID NO: 171355 - protein, 36 aa, Artificial Sequence
  Description of Artificial Sequence: Synthetic polypeptide
DEEEISTTNPVATEQYGCVCSSGEDDNQNFGSENQS

SEQ ID NO: 171356 - protein, 33 aa, Artificial Sequence
  Description of Artificial Sequence: Synthetic polypeptide
TEEEIASVNPVCYEQYGVVSINMLSQSTGGNQC

SEQ ID NO: 171357 - protein, 35 aa, Artificial Sequence
  Description of Artificial Sequence: Synthetic polypeptide
QECEICTTNPVATEAYGVVSTDQQQLQQGTEENES

SEQ ID NO: 171358 - protein, 33 aa, Artificial Sequence
  Description of Artificial Sequence: Synthetic polypeptide
DEEEIATTNPEATDAYGQVCCCDQDQKREGNQS

SEQ ID NO: 171359 - protein, 33 aa, Artificial Sequence
  Description of Artificial Sequence: Synthetic polypeptide
TEEEIASVNPVCYEQYGVVSYINLSQNSGGNNQ

SEQ ID NO: 171360 - protein, 38 aa, Artificial Sequence
  Description of Artificial Sequence: Synthetic polypeptide
DEEEIRTTNPVATEAYGVVSTVVNNQELGGNNDEEEQG

SEQ ID NO: 171361 - protein, 35 aa, Artificial Sequence
  Description of Artificial Sequence: Synthetic polypeptide
DEEEISTTNPVATEQYGCVCSWGEHNQENFGSDQA

SEQ ID NO: 171362 - protein, 35 aa, Artificial Sequence
  Description of Artificial Sequence: Synthetic polypeptide
SQEEIRTTNPVATEQWGCVCSTGEDLNQNFGSDQA

SEQ ID NO: 171363 - protein, 33 aa, Artificial Sequence
  Description of Artificial Sequence: Synthetic polypeptide
DEMEIVTTNPVATFQYGTVCNATDGPVEFEGND

SEQ ID NO: 171364 - protein, 34 aa, Artificial Sequence
  Description of Artificial Sequence: Synthetic polypeptide
SNEEIRTTNPVATEQWGCVSLLNTYPEGVQNPPS

SEQ ID NO: 171365 - protein, 35 aa, Artificial Sequence
  Description of Artificial Sequence: Synthetic polypeptide
DEEEISTTNPVATEQYGCVCSSMEHNQGFNSDNQS

SEQ ID NO: 171366 - protein, 35 aa, Artificial Sequence
  Description of Artificial Sequence: Synthetic polypeptide
DEAEIRTTNPVAYEQWGSVCYTQDNDDQHGGGGTS

SEQ ID NO: 171367 - protein, 38 aa, Artificial Sequence
  Description of Artificial Sequence: Synthetic polypeptide
DEEEIRTTNPVATEQYGVVSTVTNQQNQQQSTTNVATE

SEQ ID NO: 171368 - protein, 36 aa, Artificial Sequence
  Description of Artificial Sequence: Synthetic polypeptide
DEEEISTTNPVATEQYGCVCSSGPHNQENFGSDNQA

SEQ ID NO: 171369 - protein, 33 aa, Artificial Sequence
  Description of Artificial Sequence: Synthetic polypeptide
DEMEIVTTNPVATHQYGTVCSATDGPVEFEGFD

SEQ ID NO: 171370 - protein, 36 aa, Artificial Sequence
  Description of Artificial Sequence: Synthetic polypeptide
QAEEIATTNPVATEQYGSVCSTGPGPLDSMNGNAEE

SEQ ID NO: 171371 - protein, 35 aa, Artificial Sequence
  Description of Artificial Sequence: Synthetic polypeptide
DEEEISTTNPVATEQYGCVCSSGEDHNANFGSDQS

SEQ ID NO: 171372 - protein, 36 aa, Artificial Sequence
  Description of Artificial Sequence: Synthetic polypeptide
DESEIRTTNPVATECWGSTVWSNCIDEPQERKGENG

SEQ ID NO: 171373 - protein, 34 aa, Artificial Sequence
  Description of Artificial Sequence: Synthetic polypeptide
QAEEIATTNPVATEQYGSVANTGNGEYGAEGGHN

SEQ ID NO: 171374 - protein, 35 aa, Artificial Sequence
  Description of Artificial Sequence: Synthetic polypeptide
DESEIRTTNPVATECWGSTVACINEPQDREGEPYG

SEQ ID NO: 171375 - protein, 36 aa, Artificial Sequence
  Description of Artificial Sequence: Synthetic polypeptide
DESEIRTTNPVATECWGSTVWSNCIDEPQDRKGENG

SEQ ID NO: 171376 - protein, 31 aa, Artificial Sequence
  Description of Artificial Sequence: Synthetic polypeptide
QENEIATTNPVATEGYGCVSWEHNQHNSELA

SEQ ID NO: 171377 - protein, 39 aa, Artificial Sequence
  Description of Artificial Sequence: Synthetic polypeptide
DEEEIRTTNPVATEQYGVVSTTNQNQQAGNSEQGVVTTQ

SEQ ID NO: 171378 - protein, 30 aa, Artificial Sequence
  Description of Artificial Sequence: Synthetic polypeptide
QENEIATTNPVATEPYGEAPMVCQQHNEEH

SEQ ID NO: 171379 - protein, 31 aa, Artificial Sequence
  Description of Artificial Sequence: Synthetic polypeptide
QENEIATTNPVATEPWGNVSGEHLQHMMSLN

SEQ ID NO: 171380 - protein, 35 aa, Artificial Sequence
  Description of Artificial Sequence: Synthetic polypeptide
DEAEIRTTNPVAYEQWGSVCYNENGQQDRQDNESQ

SEQ ID NO: 171381 - protein, 36 aa, Artificial Sequence
  Description of Artificial Sequence: Synthetic polypeptide
DEAEIRTTNPVAYEQWGSVSHTMNDRGNEDQGNNDP

SEQ ID NO: 171382 - protein, 35 aa, Artificial Sequence
  Description of Artificial Sequence: Synthetic polypeptide
DEEEISTTNPVATEQYGCVCSWGEHNAENFGSDQS

SEQ ID NO: 171383 - protein, 33 aa, Artificial Sequence
  Description of Artificial Sequence: Synthetic polypeptide
DEHEIATTNPVAYECWGSVAWTDDQDDRNTGDM

SEQ ID NO: 171384 - protein, 36 aa, Artificial Sequence
  Description of Artificial Sequence: Synthetic polypeptide
DEEEISTTNPVATEQYGCVCSSGETNQEHFNSDNQA

SEQ ID NO: 171385 - protein, 35 aa, Artificial Sequence
  Description of Artificial Sequence: Synthetic polypeptide
DEEEISTTNPVATEQYGCVCSSGELNQENFISEQP

SEQ ID NO: 171386 - protein, 32 aa, Artificial Sequence
  Description of Artificial Sequence: Synthetic polypeptide
SQAEIRTTNPVATEQYGCCSIDVLSLSQNSKQ

SEQ ID NO: 171387 - protein, 33 aa, Artificial Sequence
  Description of Artificial Sequence: Synthetic polypeptide
TEEEIASVNPVCYEQYGVVCSCINALSQSGGNQ

SEQ ID NO: 171388 - protein, 33 aa, Artificial Sequence
  Description of Artificial Sequence: Synthetic polypeptide
DEMEIVTTNPVATGQFGTVCSATDGPVEFEGND

SEQ ID NO: 171389 - protein, 36 aa, Artificial Sequence
  Description of Artificial Sequence: Synthetic polypeptide
DEEEIRTTNPVAYEQYGQCVCSWMNDTNQSFGSQQS

SEQ ID NO: 171390 - protein, 32 aa, Artificial Sequence
  Description of Artificial Sequence: Synthetic polypeptide
DENEIRTTNPVSTEPYGTISNEDIQQQQNGIH

SEQ ID NO: 171391 - protein, 33 aa, Artificial Sequence
  Description of Artificial Sequence: Synthetic polypeptide
QENEIATTNPVATEPWGNVSGEHLQHGMNPKLH

SEQ ID NO: 171392 - protein, 35 aa, Artificial Sequence
  Description of Artificial Sequence: Synthetic polypeptide
DEAEIRTTNPVAYEQYGSVSSQILLEFEPINMISH

SEQ ID NO: 171393 - protein, 35 aa, Artificial Sequence
  Description of Artificial Sequence: Synthetic polypeptide
DEEEISTTNPVATEQYGCVCSSGEDHNQHFNSDQD

SEQ ID NO: 171394 - protein, 33 aa, Artificial Sequence
  Description of Artificial Sequence: Synthetic polypeptide
QAEEIATTNPVATEQYGSVCAAGPEQDNASINN

SEQ ID NO: 171395 - protein, 35 aa, Artificial Sequence
  Description of Artificial Sequence: Synthetic polypeptide
DEEEISTTNPVATEQYGCVCSSEDNQENFNSNNQS

SEQ ID NO: 171396 - protein, 34 aa, Artificial Sequence
  Description of Artificial Sequence: Synthetic polypeptide
SNEEIRTTNPVATEQWGCVSLLNTETNEGVQNPS

SEQ ID NO: 171397 - protein, 35 aa, Artificial Sequence
  Description of Artificial Sequence: Synthetic polypeptide
SNGEIRTTNPVATEQYGCSWSFNINPLEERENQYE

SEQ ID NO: 171398 - protein, 32 aa, Artificial Sequence
  Description of Artificial Sequence: Synthetic polypeptide
DEMEIRTTNPVATEQWGDVCSEIPVENAEEDA

SEQ ID NO: 171399 - protein, 34 aa, Artificial Sequence
  Description of Artificial Sequence: Synthetic polypeptide
QECEICTTNPVATEAYGVVSTDQLQLQQGTEEQD

SEQ ID NO: 171400 - protein, 30 aa, Artificial Sequence
  Description of Artificial Sequence: Synthetic polypeptide
DETEIRTTNPIATEQWGAAWPEVWAHKGPK

SEQ ID NO: 171401 - protein, 36 aa, Artificial Sequence
  Description of Artificial Sequence: Synthetic polypeptide
DEEEISTTNPVATEQYGCVCSWGEHNTENFGSDNQA

SEQ ID NO: 171402 - protein, 35 aa, Artificial Sequence
  Description of Artificial Sequence: Synthetic polypeptide
DEMEIVTTNPVATEQYGTVCSATSGTPVEVEGNED

SEQ ID NO: 171403 - protein, 37 aa, Artificial Sequence
  Description of Artificial Sequence: Synthetic polypeptide
DEEEIRTTNPVATEQYGSVNSPDAYVLEVNGVEDMSN

SEQ ID NO: 171404 - protein, 39 aa, Artificial Sequence
  Description of Artificial Sequence: Synthetic polypeptide
DEEEIRTTNPVATEQYGVVSTTVGTNNQQGTEQGTEEEE

SEQ ID NO: 171405 - protein, 38 aa, Artificial Sequence
  Description of Artificial Sequence: Synthetic polypeptide
DEEEIATTNPVATEQYGSVCAMNNGALEPPDDQANGAE

SEQ ID NO: 171406 - protein, 35 aa, Artificial Sequence
  Description of Artificial Sequence: Synthetic polypeptide
DEEEIACTNPVATEQYGSVANPHGDTGSGEENNDD

SEQ ID NO: 171407 - protein, 36 aa, Artificial Sequence
  Description of Artificial Sequence: Synthetic polypeptide
DEEEIATTNPVATEQWGSVSGAGPPGANGAGMGADD

SEQ ID NO: 171408 - protein, 32 aa, Artificial Sequence
  Description of Artificial Sequence: Synthetic polypeptide
CEHEIATTNPVAYEPYGKVSIMGHLSQHETET

SEQ ID NO: 171409 - protein, 32 aa, Artificial Sequence
  Description of Artificial Sequence: Synthetic polypeptide
QESEIASTNPVGTEGYGSVACITEQDHEGENI

SEQ ID NO: 171410 - protein, 38 aa, Artificial Sequence
  Description of Artificial Sequence: Synthetic polypeptide
DDEEIRTTNPVATEFYGSVNSTDGFGLEQGEDGDGTTV

SEQ ID NO: 171411 - protein, 37 aa, Artificial Sequence
  Description of Artificial Sequence: Synthetic polypeptide
DEGEIATTNPVATEQYGCVTAATANGLQPADQPNNNN

SEQ ID NO: 171412 - protein, 36 aa, Artificial Sequence
  Description of Artificial Sequence: Synthetic polypeptide
DEGVEIATTNPVAYEQWGSVSTTNAGNQNIDHNPGE

SEQ ID NO: 171413 - protein, 31 aa, Artificial Sequence
  Description of Artificial Sequence: Synthetic polypeptide
QENEIATTNPVSTEPYGTISMCIQQQQNENH

SEQ ID NO: 171414 - protein, 37 aa, Artificial Sequence
  Description of Artificial Sequence: Synthetic polypeptide
DEEEIRTTNPVATEQYGSNLGNNLGLEDTVTVPVGEV

SEQ ID NO: 171415 - protein, 36 aa, Artificial Sequence
  Description of Artificial Sequence: Synthetic polypeptide
DEEEIATTNPVAYEQYGSACSVAPHLNEAPGEEARF

SEQ ID NO: 171416 - protein, 30 aa, Artificial Sequence
  Description of Artificial Sequence: Synthetic polypeptide
QEGEIAPTNPCASEQYGIVSCNEMNAAEDA

SEQ ID NO: 171417 - protein, 31 aa, Artificial Sequence
  Description of Artificial Sequence: Synthetic polypeptide
QENEIATTNPVSTEPYGTISMEDIQQQQGEH

SEQ ID NO: 171418 - protein, 34 aa, Artificial Sequence
  Description of Artificial Sequence: Synthetic polypeptide
DEMEISTTNPVATEQYGAVCFAWDGPVEFEGNNE

SEQ ID NO: 171419 - protein, 36 aa, Artificial Sequence
  Description of Artificial Sequence: Synthetic polypeptide
DEEEIATTNPVATEQYGSVCAGMTHGGAEAPIGDEK

SEQ ID NO: 171420 - protein, 37 aa, Artificial Sequence
  Description of Artificial Sequence: Synthetic polypeptide
DEEEIRTTNPVATEQYGSVPGPTLTNPEDVVTMEDIV

SEQ ID NO: 171421 - protein, 36 aa, Artificial Sequence
  Description of Artificial Sequence: Synthetic polypeptide
DEGVEIATTNPVAYEQWGSVSHTMNDRGNDTGDNDS

SEQ ID NO: 171422 - protein, 31 aa, Artificial Sequence
  Description of Artificial Sequence: Synthetic polypeptide
QENEIATTNPVSTEPYGTISMCIQQQHNENL

SEQ ID NO: 171423 - protein, 36 aa, Artificial Sequence
  Description of Artificial Sequence: Synthetic polypeptide
MEEEIATTNPVATEQYGCVCSVTEHNQEGFGSDTQM

SEQ ID NO: 171424 - protein, 38 aa, Artificial Sequence
  Description of Artificial Sequence: Synthetic polypeptide
QEEEIRTTNPVATEQYGSVNNSDTPQGPEMGQGENEEG

SEQ ID NO: 171425 - protein, 36 aa, Artificial Sequence
  Description of Artificial Sequence: Synthetic polypeptide
DAEEIATTNPVATEQYGSVCAMANHADSKAPAGVNN

SEQ ID NO: 171426 - protein, 39 aa, Artificial Sequence
  Description of Artificial Sequence: Synthetic polypeptide
AEEEIRTTNPVATEQYGSVVVTVTQNNLGGTEQGTNTNQ

SEQ ID NO: 171427 - protein, 32 aa, Artificial Sequence
  Description of Artificial Sequence: Synthetic polypeptide
NENEIATTNPVAYEQWGCLYCFEHDQRQNGER

SEQ ID NO: 171428 - protein, 36 aa, Artificial Sequence
  Description of Artificial Sequence: Synthetic polypeptide
DEEEIATTNPVAYEQYGSACTPANPHNNEAEIGNDN

SEQ ID NO: 171429 - protein, 32 aa, Artificial Sequence
  Description of Artificial Sequence: Synthetic polypeptide
DENEIRATNPVSTCPYGTISMEDIQQQQNGNH

SEQ ID NO: 171430 - protein, 30 aa, Artificial Sequence
  Description of Artificial Sequence: Synthetic polypeptide
QEGEIACTNPVGTEGWGVSASMLQHGDDIQ

SEQ ID NO: 171431 - protein, 37 aa, Artificial Sequence
  Description of Artificial Sequence: Synthetic polypeptide
NEEEIRTTNPVATEQYGVVDNNTQNEVGQEEGGQEQG

SEQ ID NO: 171432 - protein, 37 aa, Artificial Sequence
  Description of Artificial Sequence: Synthetic polypeptide
AEEEIRTTNPVATEQYGVVVVTVTTNTNQEQGEETED

SEQ ID NO: 171433 - protein, 38 aa, Artificial Sequence
  Description of Artificial Sequence: Synthetic polypeptide
DEEEIRTTNPVATEQYGSVCPENTGFLLEERSLELDPF

SEQ ID NO: 171434 - protein, 37 aa, Artificial Sequence
  Description of Artificial Sequence: Synthetic polypeptide
DEEEIRTTNPVATEQYGSTVYGPTFPDTQPPMQQEPK

SEQ ID NO: 171435 - protein, 36 aa, Artificial Sequence
  Description of Artificial Sequence: Synthetic polypeptide
MEEEIATTNPVATEQYGCVCSVTGEDHNQGFGSDQF

SEQ ID NO: 171436 - protein, 35 aa, Artificial Sequence
  Description of Artificial Sequence: Synthetic polypeptide
QEEEIRTTNPVATEFYGSVVDGLNFTGEGGEDETS

SEQ ID NO: 171437 - protein, 35 aa, Artificial Sequence
  Description of Artificial Sequence: Synthetic polypeptide
DEEEIATTNPVATAQWGSVSATGAGGTAPQDNAMN

SEQ ID NO: 171438 - protein, 30 aa, Artificial Sequence
  Description of Artificial Sequence: Synthetic polypeptide
QEQEIASTNPVGTEQYGVMAASDLEDHGDL

SEQ ID NO: 171439 - protein, 36 aa, Artificial Sequence
  Description of Artificial Sequence: Synthetic polypeptide
DEMEIRTTNPVATEQYGSVSSVPLHDNIEWSEEDDM

SEQ ID NO: 171440 - protein, 34 aa, Artificial Sequence
  Description of Artificial Sequence: Synthetic polypeptide
DEGNEIATTNPVAYEQWGSVTGPNGNQGAMNGGV

SEQ ID NO: 171441 - protein, 37 aa, Artificial Sequence
  Description of Artificial Sequence: Synthetic polypeptide
DEEEIRTTNPVATEQYGSTVTCYEMQEEVPEGEVPEI

SEQ ID NO: 171442 - protein, 37 aa, Artificial Sequence
  Description of Artificial Sequence: Synthetic polypeptide
DEMEIRTTNPVATEQYGSVNSVMKEVELDMFDGSIME

SEQ ID NO: 171443 - protein, 32 aa, Artificial Sequence
  Description of Artificial Sequence: Synthetic polypeptide
QENEIRTTNPVSTEPYGTISMECIQQQQNGEH

SEQ ID NO: 171444 - protein, 31 aa, Artificial Sequence
  Description of Artificial Sequence: Synthetic polypeptide
QESEIASTNPVSTEQYGNAAAETCQSRVEER

SEQ ID NO: 171445 - protein, 37 aa, Artificial Sequence
  Description of Artificial Sequence: Synthetic polypeptide
DEEEIRTTNPVATEQYGSGIASANTSQEPVLEPEIGE

SEQ ID NO: 171446 - protein, 37 aa, Artificial Sequence
  Description of Artificial Sequence: Synthetic polypeptide
DEEEIRTTNPVATEQYGSVPHPPLGLEEVPMGPLEFG

SEQ ID NO: 171447 - protein, 38 aa, Artificial Sequence
  Description of Artificial Sequence: Synthetic polypeptide
DEEEIRTTNPVATEQYGSVIPEAEPLQQEAAVNHDEWV

SEQ ID NO: 171448 - protein, 37 aa, Artificial Sequence
  Description of Artificial Sequence: Synthetic polypeptide
DEEEIATTNPVATEQYGSACAATNPLEADDPGVGDDN

SEQ ID NO: 171449 - protein, 34 aa, Artificial Sequence
  Description of Artificial Sequence: Synthetic polypeptide
DENEIRATNPVATWHYGSVSTMNQEEVMPTEEDF

SEQ ID NO: 171450 - protein, 32 aa, Artificial Sequence
  Description of Artificial Sequence: Synthetic polypeptide
QEQEIASTNPVGTEQYGSVAASDLEDHEGEDI

SEQ ID NO: 171451 - protein, 32 aa, Artificial Sequence
  Description of Artificial Sequence: Synthetic polypeptide
QENEIRTTNPVSTEPYGTISMECIQQQHNGEH

SEQ ID NO: 171452 - protein, 33 aa, Artificial Sequence
  Description of Artificial Sequence: Synthetic polypeptide
DENEIRATNPVATWHYGSVSLMNQEVVETEEDL

SEQ ID NO: 171453 - protein, 35 aa, Artificial Sequence
  Description of Artificial Sequence: Synthetic polypeptide
QECEICTTNPVATEAYGVVSTEQQQLQQGTEEGEV

SEQ ID NO: 171454 - protein, 39 aa, Artificial Sequence
  Description of Artificial Sequence: Synthetic polypeptide
DEEEIRTTNPVATEQYGVVSTVVVTTQAGTEAGTNQQQQ

SEQ ID NO: 171455 - protein, 37 aa, Artificial Sequence
  Description of Artificial Sequence: Synthetic polypeptide
DEEEIATTNPVAYEQYGSACSPANPHNQEAEIGNDNT

SEQ ID NO: 171456 - protein, 36 aa, Artificial Sequence
  Description of Artificial Sequence: Synthetic polypeptide
DENEIATTNPVATEQYGSVCAAANDLPLDSGEGEEN

SEQ ID NO: 171457 - protein, 37 aa, Artificial Sequence
  Description of Artificial Sequence: Synthetic polypeptide
MEEEIATTNPVATEQYGCVCSNTGEDNQEGFGSDNQA

SEQ ID NO: 171458 - protein, 37 aa, Artificial Sequence
  Description of Artificial Sequence: Synthetic polypeptide
DEGEIATTNPVATEQYGCVTAATANGLQPADDPNDNT

SEQ ID NO: 171459 - protein, 37 aa, Artificial Sequence
  Description of Artificial Sequence: Synthetic polypeptide
DEGEIRTTNPVATEQYGSCCYTANNSYTEEGNNTDMI

SEQ ID NO: 171460 - protein, 38 aa, Artificial Sequence
  Description of Artificial Sequence: Synthetic polypeptide
DEEEIRTTNPVATEQYGSTYVLGIADMTMEEIEQEGTP

SEQ ID NO: 171461 - protein, 36 aa, Artificial Sequence
  Description of Artificial Sequence: Synthetic polypeptide
NDEEIRTTNPVATEQYGQCVCSWGNHNQNFGSDTQS

SEQ ID NO: 171462 - protein, 38 aa, Artificial Sequence
  Description of Artificial Sequence: Synthetic polypeptide
DEEEIRTTNPVATEQYGVVSTVVVTQQGTEDEEGEEED

SEQ ID NO: 171463 - protein, 36 aa, Artificial Sequence
  Description of Artificial Sequence: Synthetic polypeptide
DENEIATTNPVATEQYGSVPANANNMPEQGNMPGDP

SEQ ID NO: 171464 - protein, 37 aa, Artificial Sequence
  Description of Artificial Sequence: Synthetic polypeptide
AEEEIRTTNPVATEQYGVVVVVNTTNDESGTVNNATD

SEQ ID NO: 171465 - protein, 36 aa, Artificial Sequence
  Description of Artificial Sequence: Synthetic polypeptide
DEEEIRTTNPVATEQYGSGIRIAENLEVEIEVSAFN

SEQ ID NO: 171466 - protein, 36 aa, Artificial Sequence
  Description of Artificial Sequence: Synthetic polypeptide
MEEEIATTNPVATEQYGCVCSNWEELNQEGFGSDQA

SEQ ID NO: 171467 - protein, 38 aa, Artificial Sequence
  Description of Artificial Sequence: Synthetic polypeptide
DEEEIRTTNPVATEQYGVVTVVVTNNQNQNQNQNNETD

SEQ ID NO: 171468 - protein, 38 aa, Artificial Sequence
  Description of Artificial Sequence: Synthetic polypeptide
DEEEIRTTNPVATEQYGVVTVVVTNNQNQNQNQQGETT

SEQ ID NO: 171469 - protein, 37 aa, Artificial Sequence
  Description of Artificial Sequence: Synthetic polypeptide
DEEEIRTTNPVATEQYGVVGNSGMGQDNQTAIAGADD

SEQ ID NO: 171470 - protein, 37 aa, Artificial Sequence
  Description of Artificial Sequence: Synthetic polypeptide
DEEEIRTTNPVATEQYGSVYPEYMDHIEQFQGVGESL

SEQ ID NO: 171471 - protein, 37 aa, Artificial Sequence
  Description of Artificial Sequence: Synthetic polypeptide
DEEEIRTTNPVATEQYGSVCQVAVEEIIENEEEANDM

SEQ ID NO: 171472 - protein, 37 aa, Artificial Sequence
  Description of Artificial Sequence: Synthetic polypeptide
MEEEIATTNPVATEQYGCVCSTTGEHNAEGFGSDNQA

SEQ ID NO: 171473 - protein, 34 aa, Artificial Sequence
  Description of Artificial Sequence: Synthetic polypeptide
DENEIRATNPVATWHYGSVSTMNQEVVEDTEEDF

SEQ ID NO: 171474 - protein, 34 aa, Artificial Sequence
  Description of Artificial Sequence: Synthetic polypeptide
DEECLRTTNPCAYEQYGCVCSWGEHNTNFGSNQA

SEQ ID NO: 171475 - protein, 36 aa, Artificial Sequence
  Description of Artificial Sequence: Synthetic polypeptide
MEEEIATTNPVATEQYGCVCSTWEEHNQGFGSDTQA

SEQ ID NO: 171476 - protein, 36 aa, Artificial Sequence
  Description of Artificial Sequence: Synthetic polypeptide
DEEEIATTNPVATEQWGSVAKAGFNPLDSDINNMSE

SEQ ID NO: 171477 - protein, 36 aa, Artificial Sequence
  Description of Artificial Sequence: Synthetic polypeptide
MEEEIATTNPVATEQYGCVCSVWGEHQEGFGSDNQA

SEQ ID NO: 171478 - protein, 36 aa, Artificial Sequence
  Description of Artificial Sequence: Synthetic polypeptide
DEEEIRTTNPVATEQYGSGPPPLFDEEVTMGPLEQV

SEQ ID NO: 171479 - protein, 36 aa, Artificial Sequence
  Description of Artificial Sequence: Synthetic polypeptide
DEMEIATTNPVATEQYGCVTSNTDHNEEHFGSETQA

SEQ ID NO: 171480 - protein, 37 aa, Artificial Sequence
  Description of Artificial Sequence: Synthetic polypeptide
DEEEIRTTNPVATEQYGSVCQVAVSEQIENTEEAHIT

SEQ ID NO: 171481 - protein, 37 aa, Artificial Sequence
  Description of Artificial Sequence: Synthetic polypeptide
DEEEIRTTNPVATEQYGSVCPPPLWLEEVPMGPLEFM

SEQ ID NO: 171482 - protein, 35 aa, Artificial Sequence
  Description of Artificial Sequence: Synthetic polypeptide
MEEEIATTNPVATEQYGAVAGPENVGQGEGEGEED

SEQ ID NO: 171483 - protein, 37 aa, Artificial Sequence
  Description of Artificial Sequence: Synthetic polypeptide
DEEEIRTTNPVATEQYGSVYPEVMDHIEQFQGVGMGL

SEQ ID NO: 171484 - protein, 39 aa, Artificial Sequence
  Description of Artificial Sequence: Synthetic polypeptide
DEEEIRTTNPVATEQYGVVSTVVVTQAGNNGTEENNNDT

SEQ ID NO: 171485 - protein, 35 aa, Artificial Sequence
  Description of Artificial Sequence: Synthetic polypeptide
QECEICTTNPVATEAYGVVSTEQQQGNQQGTEEQD

SEQ ID NO: 171486 - protein, 36 aa, Artificial Sequence
  Description of Artificial Sequence: Synthetic polypeptide
DEMEIATTNPVATEQYGCVTSNTEDNEEHFGSEDQA

SEQ ID NO: 171487 - protein, 35 aa, Artificial Sequence
  Description of Artificial Sequence: Synthetic polypeptide
NEAEIATTNPVATECYGSVSWNDNHQQQDGHGGGD

SEQ ID NO: 171488 - protein, 32 aa, Artificial Sequence
  Description of Artificial Sequence: Synthetic polypeptide
QEGEIAPTNPCSYEQYGKVSYCNELSQNVTNS

SEQ ID NO: 171489 - protein, 33 aa, Artificial Sequence
  Description of Artificial Sequence: Synthetic polypeptide
DEECLRTTNPCAYEQYGCVCSWEHNQNFGSEQA

SEQ ID NO: 171490 - protein, 32 aa, Artificial Sequence
  Description of Artificial Sequence: Synthetic polypeptide
NENEIKTTNPVSTEPYGTISMEDIQQQQNGNH

SEQ ID NO: 171491 - protein, 35 aa, Artificial Sequence
  Description of Artificial Sequence: Synthetic polypeptide
DEMEIRTTNPVATCHYGCVCSTEHNQENFTSDNQA

SEQ ID NO: 171492 - protein, 36 aa, Artificial Sequence
  Description of Artificial Sequence: Synthetic polypeptide
DEEEIACTNPVATEQYGSVCAATEGLAGTPGAEDAH

SEQ ID NO: 171493 - protein, 38 aa, Artificial Sequence
  Description of Artificial Sequence: Synthetic polypeptide
DEEEIRTTNPVATEQYGVVTVVVVSNNQQAGTTTTATE

SEQ ID NO: 171494 - protein, 29 aa, Artificial Sequence
  Description of Artificial Sequence: Synthetic peptide
QESEIASTNPVSTEQYGNAAETIQHVEQK

SEQ ID NO: 171495 - protein, 39 aa, Artificial Sequence
  Description of Artificial Sequence: Synthetic polypeptide
DEEEIRTTNPVATEQYGVVSTVVVTTTNQQQGTTDEETD

SEQ ID NO: 171496 - protein, 35 aa, Artificial Sequence
  Description of Artificial Sequence: Synthetic polypeptide
DAMEISTTNPVATEQYGTVCSATSGPVEFQHENLD

SEQ ID NO: 171497 - protein, 33 aa, Artificial Sequence
  Description of Artificial Sequence: Synthetic polypeptide
DENEIRATNPVSTEPYGTISMEDIQQQQNGWNH

SEQ ID NO: 171498 - protein, 36 aa, Artificial Sequence
  Description of Artificial Sequence: Synthetic polypeptide
DEEEIATTNPVATAQWGSVSATGAGGTAPQDIAEFR

SEQ ID NO: 171499 - protein, 37 aa, Artificial Sequence
  Description of Artificial Sequence: Synthetic polypeptide
DEEEIRTTNPVATEQYGSVCQVAVDEPIENTEEANIM

SEQ ID NO: 171500 - protein, 37 aa, Artificial Sequence
  Description of Artificial Sequence: Synthetic polypeptide
DEEEIATTNPVATEQYGSVCAMNNGQLEPPDDQANAN

SEQ ID NO: 171501 - protein, 34 aa, Artificial Sequence
  Description of Artificial Sequence: Synthetic polypeptide
DEHEIATTNPVAYEQYGTVCSATDGGPVEFEIND

SEQ ID NO: 171502 - protein, 36 aa, Artificial Sequence
  Description of Artificial Sequence: Synthetic polypeptide
QECEICTTNPVATEAYGVVSTNQQQLGQQGTEEQEG

SEQ ID NO: 171503 - protein, 35 aa, Artificial Sequence
  Description of Artificial Sequence: Synthetic polypeptide
DEMEIRTTNPVATCQYGCVCSWEDHNENFGSDTQS

SEQ ID NO: 171504 - protein, 30 aa, Artificial Sequence
  Description of Artificial Sequence: Synthetic polypeptide
QESEIASTNPVGTEGWGVCAPTDLQHGDGQ

SEQ ID NO: 171505 - protein, 35 aa, Artificial Sequence
  Description of Artificial Sequence: Synthetic polypeptide
DEGEIATTNPVATEQYGCVAATNDIATPSPMENGH

SEQ ID NO: 171506 - protein, 35 aa, Artificial Sequence
  Description of Artificial Sequence: Synthetic polypeptide
DENEIATTNPVATEQYGSVCAAMMHGQDEMGGSGE

SEQ ID NO: 171507 - protein, 37 aa, Artificial Sequence
  Description of Artificial Sequence: Synthetic polypeptide
IEEEIRTTNPVATEQYGSVYMEAPLLEIQVNSQGQPD

SEQ ID NO: 171508 - protein, 39 aa, Artificial Sequence
  Description of Artificial Sequence: Synthetic polypeptide
DEEEIRTTNPVATEQYGVVSTVVTNNNNNATEQGTNEDE

SEQ ID NO: 171509 - protein, 36 aa, Artificial Sequence
  Description of Artificial Sequence: Synthetic polypeptide
QECEICTTNPVATEAYGVVSTNQQQLEQQGTEEGED

SEQ ID NO: 171510 - protein, 36 aa, Artificial Sequence
  Description of Artificial Sequence: Synthetic polypeptide
DDEEIRTTNPVATEFYGQVSIVNMDGQGEFDDNEQF

SEQ ID NO: 171511 - protein, 37 aa, Artificial Sequence
  Description of Artificial Sequence: Synthetic polypeptide
DEEEIATTNPVATEQYGSVCAANNGEEPTDDGPGESR

SEQ ID NO: 171512 - protein, 33 aa, Artificial Sequence
  Description of Artificial Sequence: Synthetic polypeptide
NEEEIRTTNPVAYEKWGSVCWIEQGQPDHKTNN

SEQ ID NO: 171513 - protein, 36 aa, Artificial Sequence
  Description of Artificial Sequence: Synthetic polypeptide
MEAEIRTTNPVATEQYGSHYYYDDNDLQTMELNEDM

SEQ ID NO: 171514 - protein, 32 aa, Artificial Sequence
  Description of Artificial Sequence: Synthetic polypeptide
NENCIRTTNPVSTEPYGTISMEDPQQQQNGNM

SEQ ID NO: 171515 - protein, 30 aa, Artificial Sequence
  Description of Artificial Sequence: Synthetic polypeptide
QESEIASTNPVGTEGWGVCAPTDLQHGDPN

SEQ ID NO: 171516 - protein, 36 aa, Artificial Sequence
  Description of Artificial Sequence: Synthetic polypeptide
DEEEIATTNPVATEQYGSVCAANNGEEPTDDGGQSM

SEQ ID NO: 171517 - protein, 39 aa, Artificial Sequence
  Description of Artificial Sequence: Synthetic polypeptide
DEEEIRTTNPVATEQYGVVSTTNQQNQQGTTEQGSTEEE

SEQ ID NO: 171518 - protein, 39 aa, Artificial Sequence
  Description of Artificial Sequence: Synthetic polypeptide
DEEEIRTTNPVATEQYGVVSTTVNTTNTEQGSNDEQGSQ

SEQ ID NO: 171519 - protein, 38 aa, Artificial Sequence
  Description of Artificial Sequence: Synthetic polypeptide
DEEEIRTTNPVATEQYGSVIGPTNNLDGMIPVLESEDQ

SEQ ID NO: 171520 - protein, 32 aa, Artificial Sequence
  Description of Artificial Sequence: Synthetic polypeptide
NEEEIRTTNPVAYEKWGSVCWIEGGHQPDHKN

SEQ ID NO: 171521 - protein, 39 aa, Artificial Sequence
  Description of Artificial Sequence: Synthetic polypeptide
AEEEIRTTNPVATEQYGSVVVTVTNDQEGNSEQGTNDEE

SEQ ID NO: 171522 - protein, 39 aa, Artificial Sequence
  Description of Artificial Sequence: Synthetic polypeptide
DEEEIRTTNPVATEQYGSNIVTWSWNDEEQNAEPEINNV

SEQ ID NO: 171523 - protein, 39 aa, Artificial Sequence
  Description of Artificial Sequence: Synthetic polypeptide
AEEEIRTTNPVATEQYGVVVVTVTTNNLEQGTEQGNTTM

SEQ ID NO: 171524 - protein, 40 aa, Artificial Sequence
  Description of Artificial Sequence: Synthetic polypeptide
DEEEIRTTNPVATEQYGVVVVVVVVTNLQAGNTAEEGNTE

SEQ ID NO: 171525 - protein, 30 aa, Artificial Sequence
  Description of Artificial Sequence: Synthetic polypeptide
QESEIASTNPVGTEGWGNVAADDLDQHGDI

SEQ ID NO: 171526 - protein, 37 aa, Artificial Sequence
  Description of Artificial Sequence: Synthetic polypeptide
DEMEIRTTNPVATEQYGSVSPPDTKSMIEIPNSNQNE

SEQ ID NO: 171527 - protein, 34 aa, Artificial Sequence
  Description of Artificial Sequence: Synthetic polypeptide
NEEEIRTTNPVAYEHWGCFSWPNDLQRQTQDQQM

SEQ ID NO: 171528 - protein, 37 aa, Artificial Sequence
  Description of Artificial Sequence: Synthetic polypeptide
MEDEIRCTNPVATEQYGSVSNGVTGQSGQEGGQNDTF

SEQ ID NO: 171529 - protein, 31 aa, Artificial Sequence
  Description of Artificial Sequence: Synthetic polypeptide
QESEIASTNPVGTEGYGVTCASTLSQHGGDE

SEQ ID NO: 171530 - protein, 37 aa, Artificial Sequence
  Description of Artificial Sequence: Synthetic polypeptide
DCNEIRTTNPVATEQYGSVSDYDDALNQPQTGEDDSP

SEQ ID NO: 171531 - protein, 39 aa, Artificial Sequence
  Description of Artificial Sequence: Synthetic polypeptide
DEEEIRTTNPVATEQYGVVSTVVVTQAGNNNTEEGNNDM

SEQ ID NO: 171532 - protein, 39 aa, Artificial Sequence
  Description of Artificial Sequence: Synthetic polypeptide
AEEEIRTTNPVATEQYGSVVVTTTNNNLEQGTEGGTTTQ

SEQ ID NO: 171533 - protein, 33 aa, Artificial Sequence
  Description of Artificial Sequence: Synthetic polypeptide
NEEEIRTTNPVAYEHWGCFSWPNDQNQRQTQKQ

SEQ ID NO: 171534 - protein, 36 aa, Artificial Sequence
  Description of Artificial Sequence: Synthetic polypeptide
CETEIACTNPVATEQYGSVCSTNPAQNEHQIGTEMK

SEQ ID NO: 171535 - protein, 37 aa, Artificial Sequence
  Description of Artificial Sequence: Synthetic polypeptide
DEEEIATTNPVATEQYGSVCAANNGEGAPDNGMENSN

SEQ ID NO: 171536 - protein, 36 aa, Artificial Sequence
  Description of Artificial Sequence: Synthetic polypeptide
DENEIATTNPVATEQYGSVCAAMMHGGEQNEMGNSG

SEQ ID NO: 171537 - protein, 30 aa, Artificial Sequence
  Description of Artificial Sequence: Synthetic polypeptide
QESEIASTNPVGTEGWGNVAASDLQDHGDI

SEQ ID NO: 171538 - protein, 35 aa, Artificial Sequence
  Description of Artificial Sequence: Synthetic polypeptide
QECEICTTNPVATEAYGVVSTNQQQAGQQGTEEQD

SEQ ID NO: 171539 - protein, 37 aa, Artificial Sequence
  Description of Artificial Sequence: Synthetic polypeptide
QEEEIRTTNPVATEFYGSVVQLENLDGFGNGGQEGGA

SEQ ID NO: 171540 - protein, 35 aa, Artificial Sequence
  Description of Artificial Sequence: Synthetic polypeptide
MEAEIRTTNPVATEGYGSVCDVNPIDGLFDSIERV

SEQ ID NO: 171541 - protein, 30 aa, Artificial Sequence
  Description of Artificial Sequence: Synthetic polypeptide
QESEIASTNPVGTEGYGVTWASTWAEHGDI

SEQ ID NO: 171542 - protein, 34 aa, Artificial Sequence
  Description of Artificial Sequence: Synthetic polypeptide
DEEEIATTNPVAYEQYGSACAAANGLPDSEVDDD

SEQ ID NO: 171543 - protein, 37 aa, Artificial Sequence
  Description of Artificial Sequence: Synthetic polypeptide
IEEEIRTTNPVATEQYGSYSCPITAEPNMRVGEPPVQ

SEQ ID NO: 171544 - protein, 36 aa, Artificial Sequence
  Description of Artificial Sequence: Synthetic polypeptide
QECEICTTNPVATEAYGVVSTNQQQLQQGTDEEQTE

SEQ ID NO: 171545 - protein, 37 aa, Artificial Sequence
  Description of Artificial Sequence: Synthetic polypeptide
IEEEIRTTNPVATEQYGSYSFPITAEPNIRVGHPPVL

SEQ ID NO: 171546 - protein, 31 aa, Artificial Sequence
  Description of Artificial Sequence: Synthetic polypeptide
QEGEIACTNPVGTAGWGGVSASTGLQHGDIQ

SEQ ID NO: 171547 - protein, 30 aa, Artificial Sequence
  Description of Artificial Sequence: Synthetic polypeptide
QESEIASTNPVGTEGWGVMACNEQREGEDI

SEQ ID NO: 171548 - protein, 37 aa, Artificial Sequence
  Description of Artificial Sequence: Synthetic polypeptide
DEEEIRTTNPVATEQYGSVDNPRIVSLNPNNFVQEDE

SEQ ID NO: 171549 - protein, 36 aa, Artificial Sequence
  Description of Artificial Sequence: Synthetic polypeptide
DEEEIATTNPVATEQWGSVSGENPNPEANNSMEEAW

SEQ ID NO: 171550 - protein, 39 aa, Artificial Sequence
  Description of Artificial Sequence: Synthetic polypeptide
DEEEIRTTNPVATEQYGVVSTTNNQNQNGTTEQGSTEDE

SEQ ID NO: 171551 - protein, 37 aa, Artificial Sequence
  Description of Artificial Sequence: Synthetic polypeptide
DEEEIATTNPVATEQYGSVCAGMTHGGAEAPIGDNHH

SEQ ID NO: 171552 - protein, 38 aa, Artificial Sequence
  Description of Artificial Sequence: Synthetic polypeptide
DEEEIRTTNPVATEQYGSVIPVSVIVHPNTPVENNDTN

SEQ ID NO: 171553 - protein, 39 aa, Artificial Sequence
  Description of Artificial Sequence: Synthetic polypeptide
DEEEIRTTNPVATEQYGVVSTVVTNQQGNQQQGTTEEED

SEQ ID NO: 171554 - protein, 30 aa, Artificial Sequence
  Description of Artificial Sequence: Synthetic polypeptide
QEGEIACTNPVGTAGWGGVSASGLQDGDIQ

SEQ ID NO: 171555 - protein, 35 aa, Artificial Sequence
  Description of Artificial Sequence: Synthetic polypeptide
DEGEIATTNPVATEQYGCVAANPNALTNTADQGSN

SEQ ID NO: 171556 - protein, 30 aa, Artificial Sequence
  Description of Artificial Sequence: Synthetic polypeptide
QEGEIAPTNPCSYEQWGHVYCRNDQSGDTR

SEQ ID NO: 171557 - protein, 37 aa, Artificial Sequence
  Description of Artificial Sequence: Synthetic polypeptide
DDAEIRTTNPVATEQYGCVCSWEEDLNQESFGSDNQA

SEQ ID NO: 171558 - protein, 37 aa, Artificial Sequence
  Description of Artificial Sequence: Synthetic polypeptide
DEEEIRTTNPVATEQYGSVIPVSVIVHPVTPVENPTN

SEQ ID NO: 171559 - protein, 36 aa, Artificial Sequence
  Description of Artificial Sequence: Synthetic polypeptide
DDAEIRTTNPVATEQYGCVCSWEEDHNQSFGSDNQS

SEQ ID NO: 171560 - protein, 37 aa, Artificial Sequence
  Description of Artificial Sequence: Synthetic polypeptide
DEMEIATTNPVATEQYGQCVCSTWELNEEHFGSENLA

SEQ ID NO: 171561 - protein, 39 aa, Artificial Sequence
  Description of Artificial Sequence: Synthetic polypeptide
DEEEIRTTNPVATEQYGVVVVVVSTDTQAGNSEQGSTNM

SEQ ID NO: 171562 - protein, 30 aa, Artificial Sequence
  Description of Artificial Sequence: Synthetic polypeptide
QEGEIACTNPVGTAGWGGVSASTLQHAGDI

SEQ ID NO: 171563 - protein, 37 aa, Artificial Sequence
  Description of Artificial Sequence: Synthetic polypeptide
DEEEIATTNPVATEQWGSVSGENPNPEANGVSMENAW

SEQ ID NO: 171564 - protein, 35 aa, Artificial Sequence
  Description of Artificial Sequence: Synthetic polypeptide
DEMEIRTTNPVAYEQYGCICSWEETNQENFGSDQS

SEQ ID NO: 171565 - protein, 35 aa, Artificial Sequence
  Description of Artificial Sequence: Synthetic polypeptide
DEEEIATTNPVAYEQYGSACAAANGLAQSEHVDDD

SEQ ID NO: 171566 - protein, 34 aa, Artificial Sequence
  Description of Artificial Sequence: Synthetic polypeptide
NEEEIRTTNPVAYEKWGSVCWIEQNQQHEHSGIF

SEQ ID NO: 171567 - protein, 39 aa, Artificial Sequence
  Description of Artificial Sequence: Synthetic polypeptide
DEEEIRTTNPVATEQYGVVSVTVNQAGNNNNQQGTDETD

SEQ ID NO: 171568 - protein, 35 aa, Artificial Sequence
  Description of Artificial Sequence: Synthetic polypeptide
DAGEIATTNPVAYEQWGSVCYTENQLDDLLGDMGR

SEQ ID NO: 171569 - protein, 30 aa, Artificial Sequence
  Description of Artificial Sequence: Synthetic polypeptide
QESEIASTNPVGTEGYGVVAETEQNHAGDI

SEQ ID NO: 171570 - protein, 39 aa, Artificial Sequence
  Description of Artificial Sequence: Synthetic polypeptide
DEEEIRTTNPVATEQYGVVSTVVTNQQGNTEAGSVTEGS

SEQ ID NO: 171571 - protein, 33 aa, Artificial Sequence
  Description of Artificial Sequence: Synthetic polypeptide
NEAEIRTTNPVAYECWGSVYHENNDQAEGGGSP

SEQ ID NO: 171572 - protein, 35 aa, Artificial Sequence
  Description of Artificial Sequence: Synthetic polypeptide
DEEEIATTNPVAYEQYGSACAAANGDQDSEGVDDD

SEQ ID NO: 171573 - protein, 35 aa, Artificial Sequence
  Description of Artificial Sequence: Synthetic polypeptide
DEMEIRTTNPVATEQYGCVSCEQNMDEDSESQQDE

SEQ ID NO: 171574 - protein, 37 aa, Artificial Sequence
  Description of Artificial Sequence: Synthetic polypeptide
MDSEIRTTNPVATEQYGSVFAVSANNLEITGNEDPEI

SEQ ID NO: 171575 - protein, 40 aa, Artificial Sequence
  Description of Artificial Sequence: Synthetic polypeptide
DEEEIRTTNPVATEQYGVVVVVVVVVTNLQAGTNADEEDE

SEQ ID NO: 171576 - protein, 38 aa, Artificial Sequence
  Description of Artificial Sequence: Synthetic polypeptide
DEEEIRTTNPVATEQYGVVSTTVTNNNNNTEQGTEEQD

SEQ ID NO: 171577 - protein, 30 aa, Artificial Sequence
  Description of Artificial Sequence: Synthetic polypeptide
QEGEIAPTNPCSYEQWGCIVCWNDQSGDTR

SEQ ID NO: 171578 - protein, 32 aa, Artificial Sequence
  Description of Artificial Sequence: Synthetic polypeptide
QEGEIAPTNPCSYEQWGCTVSCNELSQSGGTR

SEQ ID NO: 171579 - protein, 36 aa, Artificial Sequence
  Description of Artificial Sequence: Synthetic polypeptide
QECEICTTNPVATEAYGVVSTNQQQLNQQGTEEGTQ

SEQ ID NO: 171580 - protein, 36 aa, Artificial Sequence
  Description of Artificial Sequence: Synthetic polypeptide
DEGEIRTTNPVATEQYGMVEVTPWEEGTENPQDHMI

SEQ ID NO: 171581 - protein, 34 aa, Artificial Sequence
  Description of Artificial Sequence: Synthetic polypeptide
MDPEIRTTNPVATEQYGSVTTYVDSDELDNEQIE

SEQ ID NO: 171582 - protein, 39 aa, Artificial Sequence
  Description of Artificial Sequence: Synthetic polypeptide
DEEEIRTTNPVATEQYGVVSTVVVTVTNNQQGTTDEEQD

SEQ ID NO: 171583 - protein, 37 aa, Artificial Sequence
  Description of Artificial Sequence: Synthetic polypeptide
DAAEIATTNPVATEQYGSVCTDNPLLDAETNIGNENA

SEQ ID NO: 171584 - protein, 37 aa, Artificial Sequence
  Description of Artificial Sequence: Synthetic polypeptide
DEEEIATTNPVAYEQYGSACATNPELGQNHQDDENAH

SEQ ID NO: 171585 - protein, 35 aa, Artificial Sequence
  Description of Artificial Sequence: Synthetic polypeptide
CEEVIACTNPVATEQYGSVAAANNNQTAGGPNVSN

SEQ ID NO: 171586 - protein, 36 aa, Artificial Sequence
  Description of Artificial Sequence: Synthetic polypeptide
DEEEIATTNPVAYEQYGSACSANPAEADAEIGNWTV

SEQ ID NO: 171587 - protein, 32 aa, Artificial Sequence
  Description of Artificial Sequence: Synthetic polypeptide
QESEIASTNPVGTEGYGSMSASPTLQHNGDPV

SEQ ID NO: 171588 - protein, 36 aa, Artificial Sequence
  Description of Artificial Sequence: Synthetic polypeptide
DEEEIRTTNPVATEQYGSVDNPRIVLNPNTFVAEDE

SEQ ID NO: 171589 - protein, 36 aa, Artificial Sequence
  Description of Artificial Sequence: Synthetic polypeptide
DEEEIATTNPVATEQYGSVCSAPAEGQDHQDDQDAQ

SEQ ID NO: 171590 - protein, 38 aa, Artificial Sequence
  Description of Artificial Sequence: Synthetic polypeptide
AEEEIRTTNPVATEQYGVVTVVTTNANQQGNNNEENEL

SEQ ID NO: 171591 - protein, 37 aa, Artificial Sequence
  Description of Artificial Sequence: Synthetic polypeptide
DEEEIATTNPVATEQWGSVSGEGGPGENTRDGMNPVD

SEQ ID NO: 171592 - protein, 39 aa, Artificial Sequence
  Description of Artificial Sequence: Synthetic polypeptide
DEEEIRTTNPVATEQYGVVSVTVTNNNNGEQGTNATTTD

SEQ ID NO: 171593 - protein, 36 aa, Artificial Sequence
  Description of Artificial Sequence: Synthetic polypeptide
DDEEIRTTNPVATEFYGSVIVDTLGPEGQNFDDNGD

SEQ ID NO: 171594 - protein, 36 aa, Artificial Sequence
  Description of Artificial Sequence: Synthetic polypeptide
DEHEIRTTNPVAYEQWGSVCSTGDRQMEDTGEKGDQ

SEQ ID NO: 171595 - protein, 35 aa, Artificial Sequence
  Description of Artificial Sequence: Synthetic polypeptide
NDEEIRTTNPVATEQYGCVCSWEHNQEHFNSDNQA

SEQ ID NO: 171596 - protein, 36 aa, Artificial Sequence
  Description of Artificial Sequence: Synthetic polypeptide
DEEEIATTNPVATEQWGSVSGEGGPLGINHDDMSDA

SEQ ID NO: 171597 - protein, 30 aa, Artificial Sequence
  Description of Artificial Sequence: Synthetic polypeptide
QEGEIACTNPVGTEGWGVSASGLQNHGDSL

SEQ ID NO: 171598 - protein, 35 aa, Artificial Sequence
  Description of Artificial Sequence: Synthetic polypeptide
DEHEIRTTNPVAYESWGCVSGGNGEERNNMQNGNK

SEQ ID NO: 171599 - protein, 36 aa, Artificial Sequence
  Description of Artificial Sequence: Synthetic polypeptide
DEEEIATTNPVATEQWGSVSGEGGPLGINHDDNSAH

SEQ ID NO: 171600 - protein, 36 aa, Artificial Sequence
  Description of Artificial Sequence: Synthetic polypeptide
DENEIRATNPVATEQYGTVHTVWLPDEQENLQIDEF

SEQ ID NO: 171601 - protein, 34 aa, Artificial Sequence
  Description of Artificial Sequence: Synthetic polypeptide
DEGVEIATTNPVAYECWGSVYIAENDQQQDGGNP

SEQ ID NO: 171602 - protein, 35 aa, Artificial Sequence
  Description of Artificial Sequence: Synthetic polypeptide
DEMEISTTNPVATCQYGCVCSWGEDNENFGSDNQA

SEQ ID NO: 171603 - protein, 34 aa, Artificial Sequence
  Description of Artificial Sequence: Synthetic polypeptide
CEEVIACTNPVATEQYGSVAMNNNQTAGGPQVSN

SEQ ID NO: 171604 - protein, 36 aa, Artificial Sequence
  Description of Artificial Sequence: Synthetic polypeptide
NEAEIATTNPVATEPYGSVAITNIDHGERQGQGNEQ

SEQ ID NO: 171605 - protein, 39 aa, Artificial Sequence
  Description of Artificial Sequence: Synthetic polypeptide
DEEEIRTTNPVATEQYGVVSTVVVTQNQQQGTEEEEETD

SEQ ID NO: 171606 - protein, 33 aa, Artificial Sequence
  Description of Artificial Sequence: Synthetic polypeptide
QEGEIAPTNPCSYEAYGITVSCNLSQSGGTNRH

SEQ ID NO: 171607 - protein, 40 aa, Artificial Sequence
  Description of Artificial Sequence: Synthetic polypeptide
DEEEIRTTNPVATEQYGVVSTVNGNQLQAGTEQYGTTVEE

SEQ ID NO: 171608 - protein, 35 aa, Artificial Sequence
  Description of Artificial Sequence: Synthetic polypeptide
NEAEIRTTNPVAYEQWGSVCYTQDNDDQLTGGGTP

SEQ ID NO: 171609 - protein, 38 aa, Artificial Sequence
  Description of Artificial Sequence: Synthetic polypeptide
DEEEIRTTNPVATEQYGSVPIDNNYSDAVMRVLVNENS

SEQ ID NO: 171610 - protein, 35 aa, Artificial Sequence
  Description of Artificial Sequence: Synthetic polypeptide
NEAEIRTTNPVAYEQWGSVCYTQDNDDQHTGGGPH

SEQ ID NO: 171611 - protein, 33 aa, Artificial Sequence
  Description of Artificial Sequence: Synthetic polypeptide
NESEIRTTNPVAYEAWGCVVHTTDNLSNNEGSS

SEQ ID NO: 171612 - protein, 33 aa, Artificial Sequence
  Description of Artificial Sequence: Synthetic polypeptide
CEEVIACTNPVATEQYGSVAMNPDNAAGGPGEQ

SEQ ID NO: 171613 - protein, 35 aa, Artificial Sequence
  Description of Artificial Sequence: Synthetic polypeptide
DEGVEIATTNPVAYEPWGSVYCTNLGEDAGGNGGN

SEQ ID NO: 171614 - protein, 33 aa, Artificial Sequence
  Description of Artificial Sequence: Synthetic polypeptide
DENEIRCTNPIATEQWGATWANAEDLAPKGPYR

SEQ ID NO: 171615 - protein, 32 aa, Artificial Sequence
  Description of Artificial Sequence: Synthetic polypeptide
QEQEIASTNPVGTEQYGSVAASDLEDHEGDDI

SEQ ID NO: 171616 - protein, 38 aa, Artificial Sequence
  Description of Artificial Sequence: Synthetic polypeptide
AEEEIRTTNPVATEQYGVVSVVVVNNQQQGTNATNTQD

SEQ ID NO: 171617 - protein, 34 aa, Artificial Sequence
  Description of Artificial Sequence: Synthetic polypeptide
DENEIRCTNPIATEQWGATWANEEDWQERKGPYR

SEQ ID NO: 171618 - protein, 34 aa, Artificial Sequence
  Description of Artificial Sequence: Synthetic polypeptide
CEEVIACTNPVATEQYGSVAMNNSNAAGGPGEND

SEQ ID NO: 171619 - protein, 35 aa, Artificial Sequence
  Description of Artificial Sequence: Synthetic polypeptide
DEMEIRCTNPVATEQYGSVWVSPNDGESIFEVFIS

SEQ ID NO: 171620 - protein, 33 aa, Artificial Sequence
  Description of Artificial Sequence: Synthetic polypeptide
QESEIASTNPVGTEGYGSVACINEPQDHEGENI

SEQ ID NO: 171621 - protein, 36 aa, Artificial Sequence
  Description of Artificial Sequence: Synthetic polypeptide
QECEICTTNPVATEAYGVVSTNLQQLQLQGTEEGTE

SEQ ID NO: 171622 - protein, 32 aa, Artificial Sequence
  Description of Artificial Sequence: Synthetic polypeptide
QENEIATTNPVSTEQYGTIPMEDIQQQHNGNK

SEQ ID NO: 171623 - protein, 33 aa, Artificial Sequence
  Description of Artificial Sequence: Synthetic polypeptide
NEEEIRTTNPVAYEHWGCFSWIDDLDRQGQQHV

SEQ ID NO: 171624 - protein, 39 aa, Artificial Sequence
  Description of Artificial Sequence: Synthetic polypeptide
DEEEIRTTNPVATEQYGVVSTTVVTNQQQQIGTTEETTE

SEQ ID NO: 171625 - protein, 34 aa, Artificial Sequence
  Description of Artificial Sequence: Synthetic polypeptide
DEHEIRTTNPVAYESWGCVSGGNGEERNNMNGPD

SEQ ID NO: 171626 - protein, 33 aa, Artificial Sequence
  Description of Artificial Sequence: Synthetic polypeptide
QEGEIAPTNPCSYEQYGQTVSCCNMLSQSSGTR

SEQ ID NO: 171627 - protein, 37 aa, Artificial Sequence
  Description of Artificial Sequence: Synthetic polypeptide
DEEEIATTNPVATEQWGSVSGEGGPLGINHQDDNSLA

SEQ ID NO: 171628 - protein, 34 aa, Artificial Sequence
  Description of Artificial Sequence: Synthetic polypeptide
DAGEIATTNPVAYEQWGSVRCTENKDQHDLGMGN

SEQ ID NO: 171629 - protein, 35 aa, Artificial Sequence
  Description of Artificial Sequence: Synthetic polypeptide
DDAEIRTTNPVATEQYGSYASVDAVWDERESNLFE

SEQ ID NO: 171630 - protein, 37 aa, Artificial Sequence
  Description of Artificial Sequence: Synthetic polypeptide
MEDEIRTTNPVATEGYGSVYDDDIMNLGQTEEERGGQ

SEQ ID NO: 171631 - protein, 36 aa, Artificial Sequence
  Description of Artificial Sequence: Synthetic polypeptide
DEEEIATTNPVAYEQYGSACSAANHLDGTANPNAAM

SEQ ID NO: 171632 - protein, 37 aa, Artificial Sequence
  Description of Artificial Sequence: Synthetic polypeptide
DEEEIATTNPVATEQYGSACAPVNPAEGQNHQDGEMK

SEQ ID NO: 171633 - protein, 38 aa, Artificial Sequence
  Description of Artificial Sequence: Synthetic polypeptide
DEEEIRTTNPVATEQYGVVVTNVATEQYGTSTTQETQE

SEQ ID NO: 171634 - protein, 36 aa, Artificial Sequence
  Description of Artificial Sequence: Synthetic polypeptide
DDAEIRTTNPVATEQYGSVSPDFLNGMDTTNKPQEE

SEQ ID NO: 171635 - protein, 36 aa, Artificial Sequence
  Description of Artificial Sequence: Synthetic polypeptide
DEEEIATTNPVAYEQYGSACGATMTLQNSMNGEAAN

SEQ ID NO: 171636 - protein, 35 aa, Artificial Sequence
  Description of Artificial Sequence: Synthetic polypeptide
DEEEIATTNPVAYEQYGSACAVPAEGQNHQDDMMA

SEQ ID NO: 171637 - protein, 36 aa, Artificial Sequence
  Description of Artificial Sequence: Synthetic polypeptide
MEDEIRGTNPVATEQYGSVSMGMGIGQNNNDQEGGG

SEQ ID NO: 171638 - protein, 32 aa, Artificial Sequence
  Description of Artificial Sequence: Synthetic polypeptide
QENEIRTTNPVSTEPYGTISMEDIQQQQNENH

SEQ ID NO: 171639 - protein, 32 aa, Artificial Sequence
  Description of Artificial Sequence: Synthetic polypeptide
QESEIASTNPVGTEGYGVSCGSGELQHFGSDQ

SEQ ID NO: 171640 - protein, 37 aa, Artificial Sequence
  Description of Artificial Sequence: Synthetic polypeptide
DEEEIATTNPVATEQYGSACAPVPAEGQNHQDGMEMM

SEQ ID NO: 171641 - protein, 38 aa, Artificial Sequence
  Description of Artificial Sequence: Synthetic polypeptide
DEEEIRTTNPVATEQYGSGCSPTINAVIEFEQQPEAET

SEQ ID NO: 171642 - protein, 37 aa, Artificial Sequence
  Description of Artificial Sequence: Synthetic polypeptide
DEEEIRTTNPVATEQYGSVPPPPLWLEEVTMGPLEFG

SEQ ID NO: 171643 - protein, 37 aa, Artificial Sequence
  Description of Artificial Sequence: Synthetic polypeptide
DEEEIATTNPVATEQWGSVSGEGGPLGINHQDDNAAE

SEQ ID NO: 171644 - protein, 34 aa, Artificial Sequence
  Description of Artificial Sequence: Synthetic polypeptide
DEMEIRTTNPVATCQYGCVCSWGEDENFGSDTQS

SEQ ID NO: 171645 - protein, 36 aa, Artificial Sequence
  Description of Artificial Sequence: Synthetic polypeptide
DEGEIATTNPVATEQYGCVAATSGNPQAEPEPNHHH

SEQ ID NO: 171646 - protein, 35 aa, Artificial Sequence
  Description of Artificial Sequence: Synthetic polypeptide
DEMEIRTTNPVATCQYGCVCGTGEHNQEHFGSDQS

SEQ ID NO: 171647 - protein, 37 aa, Artificial Sequence
  Description of Artificial Sequence: Synthetic polypeptide
DEEEIATTNPVAYEQYGSACSAANPGPLDSMIGQDNW

SEQ ID NO: 171648 - protein, 36 aa, Artificial Sequence
  Description of Artificial Sequence: Synthetic polypeptide
QECEICTTNPVATEAYGVVSTNNQQLGQQGTEEQTE

SEQ ID NO: 171649 - protein, 37 aa, Artificial Sequence
  Description of Artificial Sequence: Synthetic polypeptide
DEGEIATTNPVATEQYGCVAATTGDSNATPDGDNNRD

SEQ ID NO: 171650 - protein, 33 aa, Artificial Sequence
  Description of Artificial Sequence: Synthetic polypeptide
NEEEIRTTNPVAYEHWGCFSWINDINKRQGQQQ

SEQ ID NO: 171651 - protein, 35 aa, Artificial Sequence
  Description of Artificial Sequence: Synthetic polypeptide
QEEEIRTTNPVATEFYGAVDVGVFNGQGGDDDDIE

SEQ ID NO: 171652 - protein, 36 aa, Artificial Sequence
  Description of Artificial Sequence: Synthetic polypeptide
MEDEITTTNPVATEQYGDVSVVTGEGQQGGQGNFEI

SEQ ID NO: 171653 - protein, 36 aa, Artificial Sequence
  Description of Artificial Sequence: Synthetic polypeptide
DDEEIRTTNPVATEFYGSVINADQGGQERGEGQEQF

SEQ ID NO: 171654 - protein, 37 aa, Artificial Sequence
  Description of Artificial Sequence: Synthetic polypeptide
DEEEIATTNPVAYEQYGSACSAANPGPLDSMIGNDDY

SEQ ID NO: 171655 - protein, 37 aa, Artificial Sequence
  Description of Artificial Sequence: Synthetic polypeptide
DEEEIATTNPVATEQYGSACAPVNPAEGQNHQDEMNM

SEQ ID NO: 171656 - protein, 35 aa, Artificial Sequence
  Description of Artificial Sequence: Synthetic polypeptide
DENEIATTNPVATEQYGSVCAAHNGAEEADNQENH

SEQ ID NO: 171657 - protein, 36 aa, Artificial Sequence
  Description of Artificial Sequence: Synthetic polypeptide
DEMEIRTTNPVATCQYGCVCSWGEHNEENFGSDNQA

SEQ ID NO: 171658 - protein, 38 aa, Artificial Sequence
  Description of Artificial Sequence: Synthetic polypeptide
DDEEIRTTNPVATEFYGSVCSTDGQGLEQGEDGDQTTN

SEQ ID NO: 171659 - protein, 35 aa, Artificial Sequence
  Description of Artificial Sequence: Synthetic polypeptide
MEDEIRTTNPVGTEQYGSVTMENNGQLGEGGQSGG

SEQ ID NO: 171660 - protein, 36 aa, Artificial Sequence
  Description of Artificial Sequence: Synthetic polypeptide
DEEEIATTNPVATEQWGSVSGEGGPLGINHDGMSAD

SEQ ID NO: 171661 - protein, 35 aa, Artificial Sequence
  Description of Artificial Sequence: Synthetic polypeptide
MEDEIRTTNPVGTEQYGSVNMGNNGQLGEGGQSGG

SEQ ID NO: 171662 - protein, 37 aa, Artificial Sequence
  Description of Artificial Sequence: Synthetic polypeptide
DEEEIATTNPVAYEQYGSACSAANPGPLDSMIGLHNH

SEQ ID NO: 171663 - protein, 30 aa, Artificial Sequence
  Description of Artificial Sequence: Synthetic polypeptide
QEGEIACTNPVGTEGWGVSASGLQGGDKIA

SEQ ID NO: 171664 - protein, 36 aa, Artificial Sequence
  Description of Artificial Sequence: Synthetic polypeptide
MEDEIRTTNPVGTEQYGSVITDGNNGQLGEGGQSGG

SEQ ID NO: 171665 - protein, 36 aa, Artificial Sequence
  Description of Artificial Sequence: Synthetic polypeptide
DEEEIATTNPVATEQYGSACSANPAEADAEIGEDTV

SEQ ID NO: 171666 - protein, 39 aa, Artificial Sequence
  Description of Artificial Sequence: Synthetic polypeptide
AEEEIRTTNPVATEQYGSVVVTVTTNEQGGTEQGSNTNQ

SEQ ID NO: 171667 - protein, 31 aa, Artificial Sequence
  Description of Artificial Sequence: Synthetic polypeptide
QENEIATTNPVSTEPYGTISMCIQQQHNENH

SEQ ID NO: 171668 - protein, 36 aa, Artificial Sequence
  Description of Artificial Sequence: Synthetic polypeptide
DEEEIRTTNPVATEQYGSVIYEAIEEQENTEEDTDH

SEQ ID NO: 171669 - protein, 36 aa, Artificial Sequence
  Description of Artificial Sequence: Synthetic polypeptide
DEEEIATTNPVATEQYGSACAATMTGQNEMGPEGTH

SEQ ID NO: 171670 - protein, 36 aa, Artificial Sequence
  Description of Artificial Sequence: Synthetic polypeptide
DEGEIATTNPVATEQYGSSFSATDTLEPHEGQEDTC

SEQ ID NO: 171671 - protein, 39 aa, Artificial Sequence
  Description of Artificial Sequence: Synthetic polypeptide
DEEEIRTTNPVATEQYGVVSTVTNQNTNQQNATTNVATE

SEQ ID NO: 171672 - protein, 35 aa, Artificial Sequence
  Description of Artificial Sequence: Synthetic polypeptide
QECEICTTNPVATEAYGVVSTELQQLQQGTEEQEN

SEQ ID NO: 171673 - protein, 36 aa, Artificial Sequence
  Description of Artificial Sequence: Synthetic polypeptide
DEGEIATTNPVATEQYGSSFSAPDTLEPHEGEEDKR

SEQ ID NO: 171674 - protein, 38 aa, Artificial Sequence
  Description of Artificial Sequence: Synthetic polypeptide
DEEEIATTNPVATEQYGSVCAMNNGELTNPDDQMEGRM

SEQ ID NO: 171675 - protein, 35 aa, Artificial Sequence
  Description of Artificial Sequence: Synthetic polypeptide
DEGEIATTNPVATEQYGSSFSAPDTLEPHEGEDTI

SEQ ID NO: 171676 - protein, 36 aa, Artificial Sequence
  Description of Artificial Sequence: Synthetic polypeptide
DEGEIATTNPVATEQYGSSFSATDTLFEPHEGEDTP

SEQ ID NO: 171677 - protein, 37 aa, Artificial Sequence
  Description of Artificial Sequence: Synthetic polypeptide
DDEEIRTTNPVATEFYGSVSIVNMDNGQGEFDDNEEF

SEQ ID NO: 171678 - protein, 35 aa, Artificial Sequence
  Description of Artificial Sequence: Synthetic polypeptide
DDEEIRSTNPVATEQYGCVCSNWEHQENSGSQTQS

SEQ ID NO: 171679 - protein, 37 aa, Artificial Sequence
  Description of Artificial Sequence: Synthetic polypeptide
MEEEIRGTNPAATEQYGSVSITGLGDIEQEGGGGQET

SEQ ID NO: 171680 - protein, 35 aa, Artificial Sequence
  Description of Artificial Sequence: Synthetic polypeptide
DEGEIATTNPVATEQYGSSFSAADTLEPHGGEDTQ

SEQ ID NO: 171681 - protein, 36 aa, Artificial Sequence
  Description of Artificial Sequence: Synthetic polypeptide
QEEEIRTTNCVATEFYGSVVMGMTNNEQITEGQGAG

SEQ ID NO: 171682 - protein, 37 aa, Artificial Sequence
  Description of Artificial Sequence: Synthetic polypeptide
DEHEIRTTNPVATEQYGSIVNSAMHDESSAEGLNENN

SEQ ID NO: 171683 - protein, 32 aa, Artificial Sequence
  Description of Artificial Sequence: Synthetic polypeptide
DENEIATTNPSSTEPYGTISMEDIQQQQNGNH

SEQ ID NO: 171684 - protein, 37 aa, Artificial Sequence
  Description of Artificial Sequence: Synthetic polypeptide
DEEEIRTTNPVATEQYGSYAEPGPLMEQWRDEVESTA

SEQ ID NO: 171685 - protein, 37 aa, Artificial Sequence
  Description of Artificial Sequence: Synthetic polypeptide
DDEEIRTTNPVATEFYGSVSIVNMDMQQGEFDDDEQF

SEQ ID NO: 171686 - protein, 35 aa, Artificial Sequence
  Description of Artificial Sequence: Synthetic polypeptide
QEEEIRTTNPVATEFYGNVMNINLNDGEGEGQGDD

SEQ ID NO: 171687 - protein, 37 aa, Artificial Sequence
  Description of Artificial Sequence: Synthetic polypeptide
DEGEIATTNPVATEQYGSSFSATDTLREPHEGEEDTR

SEQ ID NO: 171688 - protein, 38 aa, Artificial Sequence
  Description of Artificial Sequence: Synthetic polypeptide
DEEEIRTTNPVATEQYGSNVQPITMMMPLLEQNNMQVT

SEQ ID NO: 171689 - protein, 39 aa, Artificial Sequence
  Description of Artificial Sequence: Synthetic polypeptide
AEEEIRTTNPVATEQYGSVVVTVTTNQLGGTEQGTNSND

SEQ ID NO: 171690 - protein, 38 aa, Artificial Sequence
  Description of Artificial Sequence: Synthetic polypeptide
DENEIRGTNPVATEQYGSVYGQVNGILEQGEGGGQDNE

SEQ ID NO: 171691 - protein, 37 aa, Artificial Sequence
  Description of Artificial Sequence: Synthetic polypeptide
QEEEIRTTNPVATEFYGSVNMTDLNDEQEEDGGFGEN

SEQ ID NO: 171692 - protein, 31 aa, Artificial Sequence
  Description of Artificial Sequence: Synthetic polypeptide
QESEIASTNPVGTECYGVVSSTEQDHEGEDG

SEQ ID NO: 171693 - protein, 39 aa, Artificial Sequence
  Description of Artificial Sequence: Synthetic polypeptide
AEEEIRTTNPVATEQYGSVVVTVTENQQGGTEQGSNDNQ

SEQ ID NO: 171694 - protein, 38 aa, Artificial Sequence
  Description of Artificial Sequence: Synthetic polypeptide
DEEEIRTTNPVATEQYGSVIFPTFSTLNEAEIVEVQVL

SEQ ID NO: 171695 - protein, 35 aa, Artificial Sequence
  Description of Artificial Sequence: Synthetic polypeptide
DENCIRTTNPVATEQWGKVPSEGAESMNAAEGDAR

SEQ ID NO: 171696 - protein, 34 aa, Artificial Sequence
  Description of Artificial Sequence: Synthetic polypeptide
DEHEIRTTNPVAYESWGSVCYNNDDQDQDNQHEN

SEQ ID NO: 171697 - protein, 37 aa, Artificial Sequence
  Description of Artificial Sequence: Synthetic polypeptide
DEMEIATTNPVATEQYGCVCSTWGYHNEEHFGSENQA

SEQ ID NO: 171698 - protein, 38 aa, Artificial Sequence
  Description of Artificial Sequence: Synthetic polypeptide
DEEEIRTTNPVATEQYGSNVQPITPMMELPDQMEEQVT

SEQ ID NO: 171699 - protein, 30 aa, Artificial Sequence
  Description of Artificial Sequence: Synthetic polypeptide
QENEIATTNPIATECYGATWSECWQEPEEL

SEQ ID NO: 171700 - protein, 39 aa, Artificial Sequence
  Description of Artificial Sequence: Synthetic polypeptide
DEEEIRTTNPVATEQYGVVSTVVTQQGNQAGTTEQGVSE

SEQ ID NO: 171701 - protein, 34 aa, Artificial Sequence
  Description of Artificial Sequence: Synthetic polypeptide
NETEIATTNPVAYEQWGMVSGGNGPLDDTQGNLM

SEQ ID NO: 171702 - protein, 35 aa, Artificial Sequence
  Description of Artificial Sequence: Synthetic polypeptide
MEEEIRGTNPVATEQYGMVNIMGGFEGGNGQEGFD

SEQ ID NO: 171703 - protein, 31 aa, Artificial Sequence
  Description of Artificial Sequence: Synthetic polypeptide
NETEIATTNPVAYEQWGEAYYVEQRPEEEGR

SEQ ID NO: 171704 - protein, 39 aa, Artificial Sequence
  Description of Artificial Sequence: Synthetic polypeptide
DEEEIRTTNPVATEQYGSFMTNSTFHNMEELEQAVEPTQ

SEQ ID NO: 171705 - protein, 34 aa, Artificial Sequence
  Description of Artificial Sequence: Synthetic polypeptide
DEAEIRATNPVAYEQWGSVCYTNDNNDHGHGTQK

SEQ ID NO: 171706 - protein, 38 aa, Artificial Sequence
  Description of Artificial Sequence: Synthetic polypeptide
DEEEIRTTNPVATEQYGSNVQPITMMMQLPDQNNTQVT

SEQ ID NO: 171707 - protein, 30 aa, Artificial Sequence
  Description of Artificial Sequence: Synthetic polypeptide
QEAEIAPTNPCSYEQWGIVCWNDQSGGDTR

SEQ ID NO: 171708 - protein, 37 aa, Artificial Sequence
  Description of Artificial Sequence: Synthetic polypeptide
DEGEIATTNPVATEQYGSSFSATMDTLEPHEGIEDTR

SEQ ID NO: 171709 - protein, 36 aa, Artificial Sequence
  Description of Artificial Sequence: Synthetic polypeptide
MEEEIRCTNPVATEQYGVVSNGVNGQSGQEGGDIDT

SEQ ID NO: 171710 - protein, 31 aa, Artificial Sequence
  Description of Artificial Sequence: Synthetic polypeptide
QESEIASTNPVGTEGYGVMCASETLQHGADI

SEQ ID NO: 171711 - protein, 35 aa, Artificial Sequence
  Description of Artificial Sequence: Synthetic polypeptide
DEGEIATTNPVATEQYGSSFSAADALEPHEGEDTV

SEQ ID NO: 171712 - protein, 36 aa, Artificial Sequence
  Description of Artificial Sequence: Synthetic polypeptide
DEEEIRTTNPVATEQYGSYAEPMECMQQRDLVESTA

SEQ ID NO: 171713 - protein, 37 aa, Artificial Sequence
  Description of Artificial Sequence: Synthetic polypeptide
DEHEIRTTNPVATEQYGSVEGTPLNWLEEILTDEPQI

SEQ ID NO: 171714 - protein, 36 aa, Artificial Sequence
  Description of Artificial Sequence: Synthetic polypeptide
DEHEIRTTNPVATEQYGSVEQTPLSWAEEISDEPQN

SEQ ID NO: 171715 - protein, 38 aa, Artificial Sequence
  Description of Artificial Sequence: Synthetic polypeptide
DEEEIRTTNPVATEQYGTVATVTQNNTGEQGTEEGSTD

SEQ ID NO: 171716 - protein, 32 aa, Artificial Sequence
  Description of Artificial Sequence: Synthetic polypeptide
DENCIRTTNPVSTEPYGTIPMEDIQQQQNGNH

SEQ ID NO: 171717 - protein, 39 aa, Artificial Sequence
  Description of Artificial Sequence: Synthetic polypeptide
AEEEIRTTNPVATEQYGSVVVTVTTNNLGGTEQGTNDNE

SEQ ID NO: 171718 - protein, 37 aa, Artificial Sequence
  Description of Artificial Sequence: Synthetic polypeptide
DEHEIATTNPVAYEQWGVVYSAIGNDTEQRGQGGGNR

SEQ ID NO: 171719 - protein, 36 aa, Artificial Sequence
  Description of Artificial Sequence: Synthetic polypeptide
DDEEIRCTNPVATEQYGQCQVCSTEHQENFGSDTQS

SEQ ID NO: 171720 - protein, 39 aa, Artificial Sequence
  Description of Artificial Sequence: Synthetic polypeptide
AEEEIRTTNPVATEQYGSVVVTVTTNNLEQGTEGGVTTF

SEQ ID NO: 171721 - protein, 37 aa, Artificial Sequence
  Description of Artificial Sequence: Synthetic polypeptide
DEEEIACTNPVATEQYGSVAITPHGLPTGSGEENNAD

SEQ ID NO: 171722 - protein, 33 aa, Artificial Sequence
  Description of Artificial Sequence: Synthetic polypeptide
DEECNATTNPIAYEKWGEVCYTNDHQDHDGDNR

SEQ ID NO: 171723 - protein, 39 aa, Artificial Sequence
  Description of Artificial Sequence: Synthetic polypeptide
DEEEIRTTNPVATEQYGVVSTVVSNNNNNNTEQGTNEDN

SEQ ID NO: 171724 - protein, 33 aa, Artificial Sequence
  Description of Artificial Sequence: Synthetic polypeptide
DENEIKTTNPVSTEPYGTISMEDIQQQQNGNHL

SEQ ID NO: 171725 - protein, 37 aa, Artificial Sequence
  Description of Artificial Sequence: Synthetic polypeptide
DEHEIRTTNPVATEQYGSVEQTVLNWAEEGIGDEPQN

SEQ ID NO: 171726 - protein, 33 aa, Artificial Sequence
  Description of Artificial Sequence: Synthetic polypeptide
DENCIRTTNPVSTEPYGTISMEDIQQQQNGNHP

SEQ ID NO: 171727 - protein, 36 aa, Artificial Sequence
  Description of Artificial Sequence: Synthetic polypeptide
DDEEIRATNPVATEQYGSVVQTDDEMVEQGGGGGET

SEQ ID NO: 171728 - protein, 30 aa, Artificial Sequence
  Description of Artificial Sequence: Synthetic polypeptide
QENEIATTNPVGTEGYGTIAMEDIQQQGDH

SEQ ID NO: 171729 - protein, 37 aa, Artificial Sequence
  Description of Artificial Sequence: Synthetic polypeptide
NEEEIRTTNPVATEQYGSVVLGIADMTMEEPEQPGTP

SEQ ID NO: 171730 - protein, 35 aa, Artificial Sequence
  Description of Artificial Sequence: Synthetic polypeptide
DDEEIRATNPVATEQYGSVYGEDGDEGNQGGQGEG

SEQ ID NO: 171731 - protein, 37 aa, Artificial Sequence
  Description of Artificial Sequence: Synthetic polypeptide
DEGEIRTTNPVATEQYGSVCFEPVPSNEQQMEVNLND

SEQ ID NO: 171732 - protein, 33 aa, Artificial Sequence
  Description of Artificial Sequence: Synthetic polypeptide
DENEIKTTNPVSTEPYGATISMEDIQQQQNGNH

SEQ ID NO: 171733 - protein, 33 aa, Artificial Sequence
  Description of Artificial Sequence: Synthetic polypeptide
DEHEIATTNPVAYEQWGVVVGPNGNQGEMNGGD

SEQ ID NO: 171734 - protein, 36 aa, Artificial Sequence
  Description of Artificial Sequence: Synthetic polypeptide
QEEEIRTTNPVATEFYGSVNTFGSTGQADEGGGQEI

SEQ ID NO: 171735 - protein, 36 aa, Artificial Sequence
  Description of Artificial Sequence: Synthetic polypeptide
DEGEIATTNPVATEQYGSSFGATDTLEPHEGFEDTR

SEQ ID NO: 171736 - protein, 33 aa, Artificial Sequence
  Description of Artificial Sequence: Synthetic polypeptide
DEEEIATTNPVAYEMWGSIAAAGEEQDSGNEEG

SEQ ID NO: 171737 - protein, 37 aa, Artificial Sequence
  Description of Artificial Sequence: Synthetic polypeptide
DEEEIRTTNPVATEQYGSNVQPITMMMPEDQNNTQPQ

SEQ ID NO: 171738 - protein, 38 aa, Artificial Sequence
  Description of Artificial Sequence: Synthetic polypeptide
DEEEIRTTNPVATEQYGSYVSHAMNPDDDISNEYQEET

SEQ ID NO: 171739 - protein, 33 aa, Artificial Sequence
  Description of Artificial Sequence: Synthetic polypeptide
MEEEIRCTNPTAYECWGSVYGENDDMHRGDDGR

SEQ ID NO: 171740 - protein, 36 aa, Artificial Sequence
  Description of Artificial Sequence: Synthetic polypeptide
NEQEIATTNPVATEQYGSTVSCTAAVSEDHEGGPNL

SEQ ID NO: 171741 - protein, 38 aa, Artificial Sequence
  Description of Artificial Sequence: Synthetic polypeptide
DEEEIRTTNPVATEQYGTVATNVATEQYGVSTTQQQQD

SEQ ID NO: 171742 - protein, 36 aa, Artificial Sequence
  Description of Artificial Sequence: Synthetic polypeptide
DEMEIRTTNPVATEQYGCVCSNWGEHNAEYFNSDQA

SEQ ID NO: 171743 - protein, 35 aa, Artificial Sequence
  Description of Artificial Sequence: Synthetic polypeptide
DEHEIATTNPVAYEQWGVVSGGNDTEQRGGQGGKQ

SEQ ID NO: 171744 - protein, 37 aa, Artificial Sequence
  Description of Artificial Sequence: Synthetic polypeptide
DEEEIRTTNPVATEQYGSNVQPIRPMMPLDQMEEQVT

SEQ ID NO: 171745 - protein, 34 aa, Artificial Sequence
  Description of Artificial Sequence: Synthetic polypeptide
DEHEIRTTNPVAYEEWGSVCGDQGEGDRQGDNGQ

SEQ ID NO: 171746 - protein, 37 aa, Artificial Sequence
  Description of Artificial Sequence: Synthetic polypeptide
DEEEIRTTNPVATEQYGSNVQPIPPMMPLDQIEEQET

SEQ ID NO: 171747 - protein, 37 aa, Artificial Sequence
  Description of Artificial Sequence: Synthetic polypeptide
QEETICTTNPVATEQYGSVSATDNGGEEGGNQGNQGN

SEQ ID NO: 171748 - protein, 36 aa, Artificial Sequence
  Description of Artificial Sequence: Synthetic polypeptide
DDEEIRSTNPVATEQYGCVCSNTEEHNQENSGSQQS

SEQ ID NO: 171749 - protein, 30 aa, Artificial Sequence
  Description of Artificial Sequence: Synthetic polypeptide
DENEIATTNPIATECYGDVANADWAHEEYL

SEQ ID NO: 171750 - protein, 35 aa, Artificial Sequence
  Description of Artificial Sequence: Synthetic polypeptide
DEMEIRTTNPVATCQYGQCVCNTGEHNQHFGSDQA

SEQ ID NO: 171751 - protein, 32 aa, Artificial Sequence
  Description of Artificial Sequence: Synthetic polypeptide
DENCIRTTNPVSTEPYGTICMEPIQQQQNGNH

SEQ ID NO: 171752 - protein, 37 aa, Artificial Sequence
  Description of Artificial Sequence: Synthetic polypeptide
NEQEIATTNPVATEQYGSTVSCTALVSEDHESGENLG

SEQ ID NO: 171753 - protein, 30 aa, Artificial Sequence
  Description of Artificial Sequence: Synthetic polypeptide
QEAEIASTNPVGTEGWGVCAPTDLQHGDID

SEQ ID NO: 171754 - protein, 37 aa, Artificial Sequence
  Description of Artificial Sequence: Synthetic polypeptide
DEEEIRTTNPVATEQYGSVIFPWFEQETMDSDEQNVT

SEQ ID NO: 171755 - protein, 35 aa, Artificial Sequence
  Description of Artificial Sequence: Synthetic polypeptide
DAEEIATTNPVATEQWGSVAITNAPEPTGDGDSQA

SEQ ID NO: 171756 - protein, 33 aa, Artificial Sequence
  Description of Artificial Sequence: Synthetic polypeptide
QENEIATTNPVATECYGHVRDECALEQHGEEDL

SEQ ID NO: 171757 - protein, 36 aa, Artificial Sequence
  Description of Artificial Sequence: Synthetic polypeptide
DEEEIRTTNPVATEQYGSVPPPMHEQAEQFVVLYTP

SEQ ID NO: 171758 - protein, 36 aa, Artificial Sequence
  Description of Artificial Sequence: Synthetic polypeptide
DEGEIRTTNPVATEQYGTCVATEVDNEIGIIVDFRS

SEQ ID NO: 171759 - protein, 36 aa, Artificial Sequence
  Description of Artificial Sequence: Synthetic polypeptide
QEEEIRTTNPVATEQYGSVMGVDINQSNDGGGEDGT

SEQ ID NO: 171760 - protein, 38 aa, Artificial Sequence
  Description of Artificial Sequence: Synthetic polypeptide
DEGEIRTTNPVATEQYGVAVNSALTGSNILEESNDELQ

SEQ ID NO: 171761 - protein, 37 aa, Artificial Sequence
  Description of Artificial Sequence: Synthetic polypeptide
DEHEIRTTNPVATEQYGSCWESTPLNWAEEIGDEPQN

SEQ ID NO: 171762 - protein, 30 aa, Artificial Sequence
  Description of Artificial Sequence: Synthetic polypeptide
QESEIASTNPVGTEGYGVMAWTLQHGDSIS

SEQ ID NO: 171763 - protein, 37 aa, Artificial Sequence
  Description of Artificial Sequence: Synthetic polypeptide
DEEEIRTTNPVATEQYGSVCDEPEAMAIHQMLVNPLD

SEQ ID NO: 171764 - protein, 36 aa, Artificial Sequence
  Description of Artificial Sequence: Synthetic polypeptide
DEEEIRTTNPVATEQYGSVCDEPWVCAHQFAESIQD

SEQ ID NO: 171765 - protein, 35 aa, Artificial Sequence
  Description of Artificial Sequence: Synthetic polypeptide
DCEQISTTNPVAYEQYGQTVSCTSHSQNRPGGMVI

SEQ ID NO: 171766 - protein, 35 aa, Artificial Sequence
  Description of Artificial Sequence: Synthetic polypeptide
DEHEIATTNPVAYEQWGVVASGPNTGNQGAMNGND

SEQ ID NO: 171767 - protein, 38 aa, Artificial Sequence
  Description of Artificial Sequence: Synthetic polypeptide
DEEEICTTNPVATESYGSVSGNNTNGGEGNNEDQDEDQ

SEQ ID NO: 171768 - protein, 36 aa, Artificial Sequence
  Description of Artificial Sequence: Synthetic polypeptide
DEEEIRTTNPVATEQYGSVDNPEIVENENNFVAEDI

SEQ ID NO: 171769 - protein, 31 aa, Artificial Sequence
  Description of Artificial Sequence: Synthetic polypeptide
QESEIATTNPIATECWGAMWASEDLQPKGPI

SEQ ID NO: 171770 - protein, 37 aa, Artificial Sequence
  Description of Artificial Sequence: Synthetic polypeptide
DEEEIRTTNPVATEQYGSVIFPSFSTFEDEIVEVQVL

SEQ ID NO: 171771 - protein, 33 aa, Artificial Sequence
  Description of Artificial Sequence: Synthetic polypeptide
DCEEISTTNPVAYEQWGSVCVNWEQGEQDMHTP

SEQ ID NO: 171772 - protein, 36 aa, Artificial Sequence
  Description of Artificial Sequence: Synthetic polypeptide
DEMEIATTNPVATEQYGCVCSTWETNEEHFGSETLA

SEQ ID NO: 171773 - protein, 35 aa, Artificial Sequence
  Description of Artificial Sequence: Synthetic polypeptide
DEHEIRTTNPVATEQYGSFYTWLNMESETSIEDQC

SEQ ID NO: 171774 - protein, 37 aa, Artificial Sequence
  Description of Artificial Sequence: Synthetic polypeptide
DEKEIATTNPVAYEQYGTVCSYTDGLVEGVQRPRGEM

SEQ ID NO: 171775 - protein, 38 aa, Artificial Sequence
  Description of Artificial Sequence: Synthetic polypeptide
MEEEIRGTNPVATEQYGSVYSDIMDNGNDQDEGQDTNT

SEQ ID NO: 171776 - protein, 36 aa, Artificial Sequence
  Description of Artificial Sequence: Synthetic polypeptide
MEEEIRGTNPVATEQYGVVMGGDDENDNNQDIGSNG

SEQ ID NO: 171777 - protein, 36 aa, Artificial Sequence
  Description of Artificial Sequence: Synthetic polypeptide
DEEEIACTNPVATEQYGSVCAATHPLEARDLAEMAM

SEQ ID NO: 171778 - protein, 35 aa, Artificial Sequence
  Description of Artificial Sequence: Synthetic polypeptide
DDEEIRTTNPVATEQYGCTCSMVVPVIEPSMQEMN

SEQ ID NO: 171779 - protein, 38 aa, Artificial Sequence
  Description of Artificial Sequence: Synthetic polypeptide
DEEEIRTTNPVATEQYGVVTVVVSVTNNDEQGSTDQED

SEQ ID NO: 171780 - protein, 37 aa, Artificial Sequence
  Description of Artificial Sequence: Synthetic polypeptide
DEEEIRTTNPVATEQYGSVPAVWQMVDVEGVEPEQID

SEQ ID NO: 171781 - protein, 36 aa, Artificial Sequence
  Description of Artificial Sequence: Synthetic polypeptide
DEMEIATTNPVATEQYGCVCSTWELNEEHFGSEDAA

SEQ ID NO: 171782 - protein, 35 aa, Artificial Sequence
  Description of Artificial Sequence: Synthetic polypeptide
MEEEIRSTNPVATEQYGSVQGLGPGEGGQEADGDN

SEQ ID NO: 171783 - protein, 37 aa, Artificial Sequence
  Description of Artificial Sequence: Synthetic polypeptide
DEEEIRTTNPVATEQYGSVPAVWQMVKVEGVPPEQHD

SEQ ID NO: 171784 - protein, 39 aa, Artificial Sequence
  Description of Artificial Sequence: Synthetic polypeptide
DEEEIRTTNPVATEQYGVVTVVTNNQQGNQQGTTTNTEE

SEQ ID NO: 171785 - protein, 36 aa, Artificial Sequence
  Description of Artificial Sequence: Synthetic polypeptide
DEEEIRTTNPVATEQYGSVIFISMGIEVPEDEDPEI

SEQ ID NO: 171786 - protein, 31 aa, Artificial Sequence
  Description of Artificial Sequence: Synthetic polypeptide
QENEIATTNPVAYQPYGNTVAGEHLQHMNMK

SEQ ID NO: 171787 - protein, 38 aa, Artificial Sequence
  Description of Artificial Sequence: Synthetic polypeptide
DEEEIRTTNPVATEQYGVVTVVTTNNNNQNNNQQGTTE

SEQ ID NO: 171788 - protein, 39 aa, Artificial Sequence
  Description of Artificial Sequence: Synthetic polypeptide
DEEEIRTTNPVATEQYGVVSVTVTQQNNNNNQQGTEQGS

SEQ ID NO: 171789 - protein, 34 aa, Artificial Sequence
  Description of Artificial Sequence: Synthetic polypeptide
NDEEISTTNPVATEQYGVVCSNWEHNQNFGSDQS

SEQ ID NO: 171790 - protein, 35 aa, Artificial Sequence
  Description of Artificial Sequence: Synthetic polypeptide
MEEEIRSTNPVATEGYGVVVNNVDDEDQQEGGNID

SEQ ID NO: 171791 - protein, 36 aa, Artificial Sequence
  Description of Artificial Sequence: Synthetic polypeptide
MEEEIRSTNPVATEFYGSVYDQTNFNLGMEGDGGET

SEQ ID NO: 171792 - protein, 37 aa, Artificial Sequence
  Description of Artificial Sequence: Synthetic polypeptide
DDEEIRTTNPVATEQYGCVCSMTGEDHNAENFGSEQA

SEQ ID NO: 171793 - protein, 37 aa, Artificial Sequence
  Description of Artificial Sequence: Synthetic polypeptide
QENEIRTTNPVATEQYGSVYDDQTDLINQNEGGDGQT

SEQ ID NO: 171794 - protein, 33 aa, Artificial Sequence
  Description of Artificial Sequence: Synthetic polypeptide
DENCIRTTNPVATEQWGCVCSSPEANAFISDAA

SEQ ID NO: 171795 - protein, 37 aa, Artificial Sequence
  Description of Artificial Sequence: Synthetic polypeptide
DDEEIRTTNPVATEQYGCVCGNSGEHNAENFGSDNQA

SEQ ID NO: 171796 - protein, 39 aa, Artificial Sequence
  Description of Artificial Sequence: Synthetic polypeptide
DEEEIRTTNPVATEQYGVVTVVVSTTNNVTEQGSVNQDD

SEQ ID NO: 171797 - protein, 36 aa, Artificial Sequence
  Description of Artificial Sequence: Synthetic polypeptide
DEEEIRTTNPVATEQYGSITILMEEMIESEGSLQSI

SEQ ID NO: 171798 - protein, 36 aa, Artificial Sequence
  Description of Artificial Sequence: Synthetic polypeptide
DENEIATTNPVATEQYGSVANMNNNPNAMGEGNENT

SEQ ID NO: 171799 - protein, 34 aa, Artificial Sequence
  Description of Artificial Sequence: Synthetic polypeptide
DEHEIRTTNPVAYESWGSVCYNNDEQDQDNQNGA

SEQ ID NO: 171800 - protein, 38 aa, Artificial Sequence
  Description of Artificial Sequence: Synthetic polypeptide
DEEEIRTTNPVATEQYGVVSTVVNNNNNQEDEETEEED

SEQ ID NO: 171801 - protein, 36 aa, Artificial Sequence
  Description of Artificial Sequence: Synthetic polypeptide
DEEEICTTNPVATECYGVVTTGNQGNQGGHGGGKDD

SEQ ID NO: 171802 - protein, 36 aa, Artificial Sequence
  Description of Artificial Sequence: Synthetic polypeptide
DEMEIRTTNPVATEQYGSVFTPWTNWSESFPIDVFA

SEQ ID NO: 171803 - protein, 35 aa, Artificial Sequence
  Description of Artificial Sequence: Synthetic polypeptide
DEAEIRTTNPCAYEEWGSVAMTLNDHAGGRGMNQA

SEQ ID NO: 171804 - protein, 38 aa, Artificial Sequence
  Description of Artificial Sequence: Synthetic polypeptide
DEEEIRTTNPVATEQYGSVCMFPNLGLSQADAFLVQVA

SEQ ID NO: 171805 - protein, 36 aa, Artificial Sequence
  Description of Artificial Sequence: Synthetic polypeptide
MEEEIRGTNPVATEQYGSVVMGDDINQNNQDIEGQG

SEQ ID NO: 171806 - protein, 37 aa, Artificial Sequence
  Description of Artificial Sequence: Synthetic polypeptide
MEEEIRGTNPVATEQYGSVVIPGNLNEGGGQTEGEGI

SEQ ID NO: 171807 - protein, 36 aa, Artificial Sequence
  Description of Artificial Sequence: Synthetic polypeptide
MEEEIRGTNPVATEQYGSVVFNNDINQNNQDQEGEG

SEQ ID NO: 171808 - protein, 34 aa, Artificial Sequence
  Description of Artificial Sequence: Synthetic polypeptide
NETEIATTNPVAYEQWGVVAHTLDGEQDRNGNME

SEQ ID NO: 171809 - protein, 35 aa, Artificial Sequence
  Description of Artificial Sequence: Synthetic polypeptide
NEPEIATTNPVATEQYGSVWMANYEVLINGQSTHV

SEQ ID NO: 171810 - protein, 36 aa, Artificial Sequence
  Description of Artificial Sequence: Synthetic polypeptide
DEEEIATTNPVATEQYGSACSAPASEQDDDSMGAQM

SEQ ID NO: 171811 - protein, 37 aa, Artificial Sequence
  Description of Artificial Sequence: Synthetic polypeptide
MEEEIRGTNPVATEQYGSVVEMNNDINQNNQDQEGNG

SEQ ID NO: 171812 - protein, 37 aa, Artificial Sequence
  Description of Artificial Sequence: Synthetic polypeptide
DEEEIRTTNPVATEQYGSHVYVMYVPGESGIQSPQRH

SEQ ID NO: 171813 - protein, 39 aa, Artificial Sequence
  Description of Artificial Sequence: Synthetic polypeptide
DEEEIRTTNPVATEQYGVVSTVVTTGTQAGNTEAGSTVQ

SEQ ID NO: 171814 - protein, 39 aa, Artificial Sequence
  Description of Artificial Sequence: Synthetic polypeptide
AEEEIRTTNPVATEQYGSVVTTVTTNNAEQGSEGGNTTE

SEQ ID NO: 171815 - protein, 39 aa, Artificial Sequence
  Description of Artificial Sequence: Synthetic polypeptide
AEEEIRTTNPVATEQYGSVVVTVVTNLLGGTEQGTNDNQ

SEQ ID NO: 171816 - protein, 30 aa, Artificial Sequence
  Description of Artificial Sequence: Synthetic polypeptide
QENEIATTNPIATECYGDVAEDLAEHKEEL

SEQ ID NO: 171817 - protein, 36 aa, Artificial Sequence
  Description of Artificial Sequence: Synthetic polypeptide
QENEIRTTNPVATEQYGSVNVITGEGIGQGQDNEEI

SEQ ID NO: 171818 - protein, 36 aa, Artificial Sequence
  Description of Artificial Sequence: Synthetic polypeptide
DCHEIRTTNPVATESYGKTISTNEFSGLSEGGSNQL

SEQ ID NO: 171819 - protein, 37 aa, Artificial Sequence
  Description of Artificial Sequence: Synthetic polypeptide
DEEEIRTTNPVATEQYGVVQLGIADMTIEEPEQEGTP

SEQ ID NO: 171820 - protein, 36 aa, Artificial Sequence
  Description of Artificial Sequence: Synthetic polypeptide
QEEEIRTTNPVATEFYGSVMGFNTDFEGEGGEGNTL

SEQ ID NO: 171821 - protein, 36 aa, Artificial Sequence
  Description of Artificial Sequence: Synthetic polypeptide
DEEEIRATNPVATEQWGGCVAITNHGDEQAPMEENN

SEQ ID NO: 171822 - protein, 36 aa, Artificial Sequence
  Description of Artificial Sequence: Synthetic polypeptide
DDEEIRSTNPVATEQYGCVCSTGEHNQENSNSQTQS

SEQ ID NO: 171823 - protein, 37 aa, Artificial Sequence
  Description of Artificial Sequence: Synthetic polypeptide
DEEEIATTNPVATEQYGSVCAMNNGEDIQDSPDENGN

SEQ ID NO: 171824 - protein, 35 aa, Artificial Sequence
  Description of Artificial Sequence: Synthetic polypeptide
NEPEIATTNPVATEQYGSVWMANCEVLINGQSTDI

SEQ ID NO: 171825 - protein, 37 aa, Artificial Sequence
  Description of Artificial Sequence: Synthetic polypeptide
MEEEIRGTNPVATEQYGSVVMNNDLINQNNQDQEGDG

SEQ ID NO: 171826 - protein, 34 aa, Artificial Sequence
  Description of Artificial Sequence: Synthetic polypeptide
DEGENATTNPVAYEQWGVVSGGNMQQLNDQHGGI

SEQ ID NO: 171827 - protein, 38 aa, Artificial Sequence
  Description of Artificial Sequence: Synthetic polypeptide
DEEEIRTTNPVATEQYGSVADQNMVTHTETENLIPHED

SEQ ID NO: 171828 - protein, 37 aa, Artificial Sequence
  Description of Artificial Sequence: Synthetic polypeptide
MEEEIRGTNPVATEQYGSVVVMGNDINQNNQDQEGNG

SEQ ID NO: 171829 - protein, 37 aa, Artificial Sequence
  Description of Artificial Sequence: Synthetic polypeptide
DEEEIATTNPVATEQYGSVCAMNNGEPTNDDGMENQM

SEQ ID NO: 171830 - protein, 36 aa, Artificial Sequence
  Description of Artificial Sequence: Synthetic polypeptide
DEGEIRTTNPVATEQYGVCYSAVSEPTSTDETLESD

SEQ ID NO: 171831 - protein, 38 aa, Artificial Sequence
  Description of Artificial Sequence: Synthetic polypeptide
DEEEIRTTNPVATEQYGSVADQNMSTHCEPENGPPHED

SEQ ID NO: 171832 - protein, 35 aa, Artificial Sequence
  Description of Artificial Sequence: Synthetic polypeptide
DEEEIACTNPVATEQYGSVCAATHPEADDLAEDAH

SEQ ID NO: 171833 - protein, 35 aa, Artificial Sequence
  Description of Artificial Sequence: Synthetic polypeptide
QEEEIRTTNPVATEFYGQVTDIMNGEMQDNDGGGI

SEQ ID NO: 171834 - protein, 35 aa, Artificial Sequence
  Description of Artificial Sequence: Synthetic polypeptide
DEMEIRTTNPVATEQYGCVCSMWGEDAENFNSDQA

SEQ ID NO: 171835 - protein, 36 aa, Artificial Sequence
  Description of Artificial Sequence: Synthetic polypeptide
DEMEIRTTNPVATEQYGSVFVMQEVENDRFEGSIME

SEQ ID NO: 171836 - protein, 37 aa, Artificial Sequence
  Description of Artificial Sequence: Synthetic polypeptide
DEEEIRTTNPVATEQYGSVDNPEIVLANEVNFVAEDI

SEQ ID NO: 171837 - protein, 35 aa, Artificial Sequence
  Description of Artificial Sequence: Synthetic polypeptide
DDEEIRCTNPVATEQYGCVCSWMEHQENSGSQTQS

SEQ ID NO: 171838 - protein, 37 aa, Artificial Sequence
  Description of Artificial Sequence: Synthetic polypeptide
DEGEIRTTNPVATEQYGSCNTSEDTMLEHHYGEDQID

SEQ ID NO: 171839 - protein, 34 aa, Artificial Sequence
  Description of Artificial Sequence: Synthetic polypeptide
DEHEIRTTNPVAYESWGSVCYNNDEQDQDNQHNV

SEQ ID NO: 171840 - protein, 37 aa, Artificial Sequence
  Description of Artificial Sequence: Synthetic polypeptide
DENEIRGTNPVATEQYGSVYVQVNGLEQGIGQGQDDD

SEQ ID NO: 171841 - protein, 38 aa, Artificial Sequence
  Description of Artificial Sequence: Synthetic polypeptide
DEEEIRTTNPVATEQYGSVIFPSFVTLPELEIVELQVL

SEQ ID NO: 171842 - protein, 37 aa, Artificial Sequence
  Description of Artificial Sequence: Synthetic polypeptide
DEMEIRTTNPVATEQYGCICSTGEDTNAENFGSDNQA

SEQ ID NO: 171843 - protein, 39 aa, Artificial Sequence
  Description of Artificial Sequence: Synthetic polypeptide
DEEEIRTTNPVATEQYGVVSTVTNNNQQSATEEGVTQGD

SEQ ID NO: 171844 - protein, 37 aa, Artificial Sequence
  Description of Artificial Sequence: Synthetic polypeptide
DENEIRGTNPVATEQYGSVYVQVNGLEQGEGEGEDDE

SEQ ID NO: 171845 - protein, 34 aa, Artificial Sequence
  Description of Artificial Sequence: Synthetic polypeptide
DEHEIRTTNPVAYEQWGEVMWTEHDNRGGGTGQQ

SEQ ID NO: 171846 - protein, 35 aa, Artificial Sequence
  Description of Artificial Sequence: Synthetic polypeptide
DEAEIATTNPVAYEQYGSVANPGHGLAAGGDNPDD

SEQ ID NO: 171847 - protein, 40 aa, Artificial Sequence
  Description of Artificial Sequence: Synthetic polypeptide
DEEEIRTTNPVATEQYGVVSTVVVTTNNQNQGTEENEEED

SEQ ID NO: 171848 - protein, 32 aa, Artificial Sequence
  Description of Artificial Sequence: Synthetic polypeptide
DENCIRTTNPVSYEPYGTISMEDIQQQQNGNH

SEQ ID NO: 171849 - protein, 34 aa, Artificial Sequence
  Description of Artificial Sequence: Synthetic polypeptide
DEEEIATTNPVATAQWGCVAGTAALEATANGEFG

SEQ ID NO: 171850 - protein, 37 aa, Artificial Sequence
  Description of Artificial Sequence: Synthetic polypeptide
DEEEIRTTNPVATEQYGSVIGPMNNLLNMEPLEIEDT

SEQ ID NO: 171851 - protein, 38 aa, Artificial Sequence
  Description of Artificial Sequence: Synthetic polypeptide
IEEEIRTTNPVATEQYGSVQSEAPLKMPHDRLDVEENG

SEQ ID NO: 171852 - protein, 30 aa, Artificial Sequence
  Description of Artificial Sequence: Synthetic polypeptide
QENEIATTNPVSTEPYGEIPMVIQQQNEEH

SEQ ID NO: 171853 - protein, 31 aa, Artificial Sequence
  Description of Artificial Sequence: Synthetic polypeptide
QENEIATTNPVSTEPYGEISMEDIQQQQGEH

SEQ ID NO: 171854 - protein, 32 aa, Artificial Sequence
  Description of Artificial Sequence: Synthetic polypeptide
DENEIQTTNPVSTEPYGTISMEDIQQQQNPNH

SEQ ID NO: 171855 - protein, 39 aa, Artificial Sequence
  Description of Artificial Sequence: Synthetic polypeptide
DEEEIRTTNPVATEQYGVVSTTNNQNGTEQGSTTQQETE

SEQ ID NO: 171856 - protein, 32 aa, Artificial Sequence
  Description of Artificial Sequence: Synthetic polypeptide
DENEIQTTNPVSTEPYGTISMFDIQQQQNQNH

SEQ ID NO: 171857 - protein, 37 aa, Artificial Sequence
  Description of Artificial Sequence: Synthetic polypeptide
DEEEIRATNPVATEQWGSVSVTDSPEGAGNVQDNTAM

SEQ ID NO: 171858 - protein, 37 aa, Artificial Sequence
  Description of Artificial Sequence: Synthetic polypeptide
DEEEIATTNPVAYEQYGSTVCAVAEAGLGQADGDNDQ

SEQ ID NO: 171859 - protein, 37 aa, Artificial Sequence
  Description of Artificial Sequence: Synthetic polypeptide
DEEEIATTNPVAYEQYGSTVCASNDLPQEHQDGAEAN

SEQ ID NO: 171860 - protein, 39 aa, Artificial Sequence
  Description of Artificial Sequence: Synthetic polypeptide
DEEEIRTTNPVATEQYGVVSTVVTNQQQGTEQGTQQQEQ

SEQ ID NO: 171861 - protein, 38 aa, Artificial Sequence
  Description of Artificial Sequence: Synthetic polypeptide
DEMEIRTTNPVATEQYGSVNSPDADVLEVNGVEANMSD

SEQ ID NO: 171862 - protein, 33 aa, Artificial Sequence
  Description of Artificial Sequence: Synthetic polypeptide
DEMAIVTTNAVATEVYGTVCSATDGEVEFEGND

SEQ ID NO: 171863 - protein, 35 aa, Artificial Sequence
  Description of Artificial Sequence: Synthetic polypeptide
DENEIRATNPVATEQYGCVACTPWDSNQAETQNVQ

SEQ ID NO: 171864 - protein, 36 aa, Artificial Sequence
  Description of Artificial Sequence: Synthetic polypeptide
QEEEIRTTNPVATEQYGAVVVDGGDLEQNEGGGEII

SEQ ID NO: 171865 - protein, 38 aa, Artificial Sequence
  Description of Artificial Sequence: Synthetic polypeptide
DDEEIRTTNPVATEFYGSVSIVNMAPGQVGEFDDNEQF

SEQ ID NO: 171866 - protein, 36 aa, Artificial Sequence
  Description of Artificial Sequence: Synthetic polypeptide
DEMEIRTTNPVATEQYGCVSLCPQNMQEDSEVQQDE

SEQ ID NO: 171867 - protein, 37 aa, Artificial Sequence
  Description of Artificial Sequence: Synthetic polypeptide
DEEEIRTTNPVATEQYGSVWPPPLWLEEVPMGILEQG

SEQ ID NO: 171868 - protein, 37 aa, Artificial Sequence
  Description of Artificial Sequence: Synthetic polypeptide
DEEEIRTTNPVATEQYGSVFYPINNMNFQEQMQEIQD

SEQ ID NO: 171869 - protein, 36 aa, Artificial Sequence
  Description of Artificial Sequence: Synthetic polypeptide
DEGEIATTNPVATEQYGSACSATAPGAEAAPGDGRN

SEQ ID NO: 171870 - protein, 32 aa, Artificial Sequence
  Description of Artificial Sequence: Synthetic polypeptide
DENEIQTTNPVSTEPYGTISMEDIQQQQNGAH

SEQ ID NO: 171871 - protein, 37 aa, Artificial Sequence
  Description of Artificial Sequence: Synthetic polypeptide
DEEEIRTTNPVATEQYGSVPEPPLWLEEVPMQPLEFG

SEQ ID NO: 171872 - protein, 30 aa, Artificial Sequence
  Description of Artificial Sequence: Synthetic polypeptide
QENEIATTNPVSTEGYGTIAMEDIQQQGDH

SEQ ID NO: 171873 - protein, 37 aa, Artificial Sequence
  Description of Artificial Sequence: Synthetic polypeptide
NEAAIRTTNPVATEKYGIKTVNTPNELSTQDTGGNQR

SEQ ID NO: 171874 - protein, 36 aa, Artificial Sequence
  Description of Artificial Sequence: Synthetic polypeptide
MESEIRTTNPVATCQYGCCVATGVPNLDSRGTQQED

SEQ ID NO: 171875 - protein, 30 aa, Artificial Sequence
  Description of Artificial Sequence: Synthetic polypeptide
QESEIASTNPVGTECYGVMSSTEQDHEGDG

SEQ ID NO: 171876 - protein, 39 aa, Artificial Sequence
  Description of Artificial Sequence: Synthetic polypeptide
DEEEIRTTNPVATEQYGVVSVTVTNNNTTEQGTNPNTTD

SEQ ID NO: 171877 - protein, 35 aa, Artificial Sequence
  Description of Artificial Sequence: Synthetic polypeptide
DEMEISTTNPVATEQYGCVCSNWGEHQNFGSETQA

SEQ ID NO: 171878 - protein, 36 aa, Artificial Sequence
  Description of Artificial Sequence: Synthetic polypeptide
DEEEIATTNPVATEQWGSTTAGNGLPAEAENGNVDD

SEQ ID NO: 171879 - protein, 37 aa, Artificial Sequence
  Description of Artificial Sequence: Synthetic polypeptide
DEEEIRTTNPVATEQYGSVDNPRIVLEHLNNFVAEDE

SEQ ID NO: 171880 - protein, 37 aa, Artificial Sequence
  Description of Artificial Sequence: Synthetic polypeptide
DEEEIRTTNPVATEQYGSVIGPLNMLDGMPVLEIEDT

SEQ ID NO: 171881 - protein, 36 aa, Artificial Sequence
  Description of Artificial Sequence: Synthetic polypeptide
DDEEIRCTNPVATEQYGCSCSTGEDHNQNFGSDTQS

SEQ ID NO: 171882 - protein, 35 aa, Artificial Sequence
  Description of Artificial Sequence: Synthetic polypeptide
DDEEIRCTNPVATEQYGCVCSWEEHNTENSGSQQA

SEQ ID NO: 171883 - protein, 39 aa, Artificial Sequence
  Description of Artificial Sequence: Synthetic polypeptide
AEEEIRTTNPVATEQYGSVVVTVTTNLLGGTEQGVTVNQ

SEQ ID NO: 171884 - protein, 36 aa, Artificial Sequence
  Description of Artificial Sequence: Synthetic polypeptide
DDEEIRTTNPVATDQYGSVSVDQQGGEQGIEGGQGN

SEQ ID NO: 171885 - protein, 36 aa, Artificial Sequence
  Description of Artificial Sequence: Synthetic polypeptide
DEMEIRTTNPVATEQYGCICSWGETNQENFGSDFQS

SEQ ID NO: 171886 - protein, 37 aa, Artificial Sequence
  Description of Artificial Sequence: Synthetic polypeptide
DEEEIRTTNPVATEQYGSVVYDGEFGQLGDDEEDDGN

SEQ ID NO: 171887 - protein, 32 aa, Artificial Sequence
  Description of Artificial Sequence: Synthetic polypeptide
DENEIQTTNPVSTEPYGTISMEDIQQQQNDNH

SEQ ID NO: 171888 - protein, 34 aa, Artificial Sequence
  Description of Artificial Sequence: Synthetic polypeptide
DEEEIATTNPVATAQWGCVAGNPGLEATANGEQF

SEQ ID NO: 171889 - protein, 39 aa, Artificial Sequence
  Description of Artificial Sequence: Synthetic polypeptide
AEEEIRTTNPVATEQYGSVVVTVTTNLLGGTEEGVNSNQ

SEQ ID NO: 171890 - protein, 38 aa, Artificial Sequence
  Description of Artificial Sequence: Synthetic polypeptide
MESEIRTTNPVATEFYGSVSNMNLVGDDQDQEDDDGNP

SEQ ID NO: 171891 - protein, 34 aa, Artificial Sequence
  Description of Artificial Sequence: Synthetic polypeptide
DEECLSTTNPCAYEQYGCVCSTNHNQEYFGSDQS

SEQ ID NO: 171892 - protein, 36 aa, Artificial Sequence
  Description of Artificial Sequence: Synthetic polypeptide
DENEIRATNPVATEQYGQVTTVWLPDEGENMQIDEI

SEQ ID NO: 171893 - protein, 36 aa, Artificial Sequence
  Description of Artificial Sequence: Synthetic polypeptide
DEEEIATTNPVATECYGSVCAAVANLADTPAEEGRH

SEQ ID NO: 171894 - protein, 38 aa, Artificial Sequence
  Description of Artificial Sequence: Synthetic polypeptide
DEEEICTTNPVATEQYGSVSGNNTDGGQGQNEDQDEDQ

SEQ ID NO: 171895 - protein, 37 aa, Artificial Sequence
  Description of Artificial Sequence: Synthetic polypeptide
DEEEIRTTNPVATEQYGSVDNPRIVLNNLNNFVAEME

SEQ ID NO: 171896 - protein, 34 aa, Artificial Sequence
  Description of Artificial Sequence: Synthetic polypeptide
MEEEIATTNPVATEQYGVVAGPGEGEGGQGGEED

SEQ ID NO: 171897 - protein, 37 aa, Artificial Sequence
  Description of Artificial Sequence: Synthetic polypeptide
DEEEIRTTNPVATEQYGSVWPPNMDEEAESGQELSSE

SEQ ID NO: 171898 - protein, 36 aa, Artificial Sequence
  Description of Artificial Sequence: Synthetic polypeptide
DENEIRATNPVATEQYGSVTAVTVWDSNSAETQNVQ

SEQ ID NO: 171899 - protein, 38 aa, Artificial Sequence
  Description of Artificial Sequence: Synthetic polypeptide
DEEEIRTTNPVATEQYGSVINPWSPMLGIERLDSIATY

SEQ ID NO: 171900 - protein, 38 aa, Artificial Sequence
  Description of Artificial Sequence: Synthetic polypeptide
DEEEIRTTNPVATEQYGVVTVVVTNNQNNNQNQNEGTD

SEQ ID NO: 171901 - protein, 32 aa, Artificial Sequence
  Description of Artificial Sequence: Synthetic polypeptide
QENEIATTNPVSTEPYGTISEECIQQQQNGNL

SEQ ID NO: 171902 - protein, 36 aa, Artificial Sequence
  Description of Artificial Sequence: Synthetic polypeptide
DEEEIATTNPVATEQYGSACAATNPEEAEAEMNNNN

SEQ ID NO: 171903 - protein, 39 aa, Artificial Sequence
  Description of Artificial Sequence: Synthetic polypeptide
DEEEIRTTNPVATEQYGVVSTTVVTNQQQGTEQGTEEED

SEQ ID NO: 171904 - protein, 34 aa, Artificial Sequence
  Description of Artificial Sequence: Synthetic polypeptide
DEHEIRTTNPVAYEQWGSVCYTGEGEHGEDSDGD

SEQ ID NO: 171905 - protein, 37 aa, Artificial Sequence
  Description of Artificial Sequence: Synthetic polypeptide
QEEEIRTTNPVATEQYGAVVDGFTNDQTNEDGGGQDP

SEQ ID NO: 171906 - protein, 31 aa, Artificial Sequence
  Description of Artificial Sequence: Synthetic polypeptide
QENEIAPTNPVSSEPYGIISCENIQQSNGNH

SEQ ID NO: 171907 - protein, 37 aa, Artificial Sequence
  Description of Artificial Sequence: Synthetic polypeptide
DEEEIRTTNPVATEQYGSVPGLWPNTKHETVSQEQEM

SEQ ID NO: 171908 - protein, 38 aa, Artificial Sequence
  Description of Artificial Sequence: Synthetic polypeptide
DEEEIRTTNPVATEQYGSTVTCIEMQIEEVPEGEVNEI

SEQ ID NO: 171909 - protein, 35 aa, Artificial Sequence
  Description of Artificial Sequence: Synthetic polypeptide
DEHEIRTTNPVAYEQWGSVCYMNDNHDLGDGGGII

SEQ ID NO: 171910 - protein, 35 aa, Artificial Sequence
  Description of Artificial Sequence: Synthetic polypeptide
DENEIRATNPVATEQYGSVVDLEVEQGIGGQSGET

SEQ ID NO: 171911 - protein, 36 aa, Artificial Sequence
  Description of Artificial Sequence: Synthetic polypeptide
DEEEIRTTNPVATEQYGSVPPPLWIEEVPMDPLEFG

SEQ ID NO: 171912 - protein, 32 aa, Artificial Sequence
  Description of Artificial Sequence: Synthetic polypeptide
QENEIATTNPVSTEPYGTISEECLQQQQNENL

SEQ ID NO: 171913 - protein, 31 aa, Artificial Sequence
  Description of Artificial Sequence: Synthetic polypeptide
QENEIATTNPVSTEPYGTISECIQQQHNENL

SEQ ID NO: 171914 - protein, 35 aa, Artificial Sequence
  Description of Artificial Sequence: Synthetic polypeptide
DEGEIATTNPVATEQYGNSFSAADTSEPHEGEDTG

SEQ ID NO: 171915 - protein, 30 aa, Artificial Sequence
  Description of Artificial Sequence: Synthetic polypeptide
QEGEIACTNPVGYAGWGGCSASMNLQHGDQ

SEQ ID NO: 171916 - protein, 35 aa, Artificial Sequence
  Description of Artificial Sequence: Synthetic polypeptide
DENEIRATNPVATEQYGSVAVWPWDSEQAETQNVQ

SEQ ID NO: 171917 - protein, 36 aa, Artificial Sequence
  Description of Artificial Sequence: Synthetic polypeptide
DENEIRATNPVATEQYGSVAYTPWDSNQAETQNEMQ

SEQ ID NO: 171918 - protein, 36 aa, Artificial Sequence
  Description of Artificial Sequence: Synthetic polypeptide
IEEEIRTTNPVATEQYGSVQVAVDEIIENTEEANIM

SEQ ID NO: 171919 - protein, 30 aa, Artificial Sequence
  Description of Artificial Sequence: Synthetic polypeptide
QENEIATTNPVSTEPYGTAPEDCQQQNENK

SEQ ID NO: 171920 - protein, 36 aa, Artificial Sequence
  Description of Artificial Sequence: Synthetic polypeptide
DDEEIRCTNPVATEQYGCVCSTSEHNQENSGSQTQS

SEQ ID NO: 171921 - protein, 37 aa, Artificial Sequence
  Description of Artificial Sequence: Synthetic polypeptide
DEGEIATTNPVATEQYGSACAATNPQEAGDSGMGNGM

SEQ ID NO: 171922 - protein, 30 aa, Artificial Sequence
  Description of Artificial Sequence: Synthetic polypeptide
QENEIATTNPVSTEPYGTAPEDIQQQNENK

SEQ ID NO: 171923 - protein, 37 aa, Artificial Sequence
  Description of Artificial Sequence: Synthetic polypeptide
DEEEIRTTNPVATEQYGSMSIEFSQDSINVNSNPNVS

SEQ ID NO: 171924 - protein, 36 aa, Artificial Sequence
  Description of Artificial Sequence: Synthetic polypeptide
DEMEISTTNPVATEQYGCVCSNTGEPNEEFEGSDQS

SEQ ID NO: 171925 - protein, 37 aa, Artificial Sequence
  Description of Artificial Sequence: Synthetic polypeptide
DEEEIRTTNPVATEQYGSVDNPRIVLLNENNFVAEDI

SEQ ID NO: 171926 - protein, 34 aa, Artificial Sequence
  Description of Artificial Sequence: Synthetic polypeptide
DEHEIRTTNPVAYEQWGSVCYTGEGNHGETEDGQ

SEQ ID NO: 171927 - protein, 33 aa, Artificial Sequence
  Description of Artificial Sequence: Synthetic polypeptide
DEEEIATTNPVAYECWGCVSGGNGNEAGGEGMA

SEQ ID NO: 171928 - protein, 37 aa, Artificial Sequence
  Description of Artificial Sequence: Synthetic polypeptide
DEGEIATTNPVATEQYGSACAATNPEEAGDSEMGNRM

SEQ ID NO: 171929 - protein, 35 aa, Artificial Sequence
  Description of Artificial Sequence: Synthetic polypeptide
DEGNEIATTNPVAYEQWGEVSCTNLQLNDHDESGA

SEQ ID NO: 171930 - protein, 34 aa, Artificial Sequence
  Description of Artificial Sequence: Synthetic polypeptide
MEEEIATTNPVAYEQYGCVCSVWEHQEGFGSDQA

SEQ ID NO: 171931 - protein, 38 aa, Artificial Sequence
  Description of Artificial Sequence: Synthetic polypeptide
DEEEIRTTNPVATEQYGVVSTVVNNQNNQETTEEEEED

SEQ ID NO: 171932 - protein, 36 aa, Artificial Sequence
  Description of Artificial Sequence: Synthetic polypeptide
DEGEIATTNPVATEQYGSACAANHGPLDSMIGNDNL

SEQ ID NO: 171933 - protein, 38 aa, Artificial Sequence
  Description of Artificial Sequence: Synthetic polypeptide
DEEEIRTTNPVATEQYGSVIGPTLNLDHMPPVLEIEDT

SEQ ID NO: 171934 - protein, 37 aa, Artificial Sequence
  Description of Artificial Sequence: Synthetic polypeptide
DDEEIRTTNPVATEFYGAVSIVNVDGQQGEFDDNEQF

SEQ ID NO: 171935 - protein, 36 aa, Artificial Sequence
  Description of Artificial Sequence: Synthetic polypeptide
DENEIRATNPVATEQYGSVAVTPWDSNQAETQVVVQ

SEQ ID NO: 171936 - protein, 36 aa, Artificial Sequence
  Description of Artificial Sequence: Synthetic polypeptide
DEMEIRTTNPVATEQYGSVNNPEMDVDSNAEETNNQ

SEQ ID NO: 171937 - protein, 36 aa, Artificial Sequence
  Description of Artificial Sequence: Synthetic polypeptide
DDEEIRATNPVATEQYGSVYGNIGDEGGNQGNENDI

SEQ ID NO: 171938 - protein, 38 aa, Artificial Sequence
  Description of Artificial Sequence: Synthetic polypeptide
DAEEIATTNPVATEQYGSVCAMTNGELTNNDDGMENQM

SEQ ID NO: 171939 - protein, 36 aa, Artificial Sequence
  Description of Artificial Sequence: Synthetic polypeptide
DAEEIATTNPVATEQYGSVCADTPLPDDSGDGMQMN

SEQ ID NO: 171940 - protein, 35 aa, Artificial Sequence
  Description of Artificial Sequence: Synthetic polypeptide
MEEEIRATNPVATEQYGDVVQTDNMNGTGGEEEGE

SEQ ID NO: 171941 - protein, 34 aa, Artificial Sequence
  Description of Artificial Sequence: Synthetic polypeptide
DCEEISTTNPVAYEQWGSVCVNWEHGEQDMNHAP

SEQ ID NO: 171942 - protein, 39 aa, Artificial Sequence
  Description of Artificial Sequence: Synthetic polypeptide
DEEEIRTTNPVATEQYGVVSTVVVTQAGNNDTTEEGNND

SEQ ID NO: 171943 - protein, 35 aa, Artificial Sequence
  Description of Artificial Sequence: Synthetic polypeptide
DEMEISTTNPVATEQYGCVCSWGELAEYFNSDTQS

SEQ ID NO: 171944 - protein, 36 aa, Artificial Sequence
  Description of Artificial Sequence: Synthetic polypeptide
DEEEIATTNPVATEQYGSVCAAMNHDQAMAPDDDHP

SEQ ID NO: 171945 - protein, 37 aa, Artificial Sequence
  Description of Artificial Sequence: Synthetic polypeptide
DEEEIATTNPVATEQYGSVCAMNNGDLTPADGSGDDP

SEQ ID NO: 171946 - protein, 37 aa, Artificial Sequence
  Description of Artificial Sequence: Synthetic polypeptide
DEMEIRTTNPVATEQYGCICSWGEDTNIENFGSDNQS

SEQ ID NO: 171947 - protein, 36 aa, Artificial Sequence
  Description of Artificial Sequence: Synthetic polypeptide
DDEEIRCTNPVATEQYGCVCSWGEHNTENSGSQNQS

SEQ ID NO: 171948 - protein, 37 aa, Artificial Sequence
  Description of Artificial Sequence: Synthetic polypeptide
DEMEIRTTNPVATEQYGSVNNNEEVELEVLDNKVTQT

SEQ ID NO: 171949 - protein, 37 aa, Artificial Sequence
  Description of Artificial Sequence: Synthetic polypeptide
DEEEIRATNPVATEQWGGCVAITNNDEQAGMENNDTN

SEQ ID NO: 171950 - protein, 36 aa, Artificial Sequence
  Description of Artificial Sequence: Synthetic polypeptide
DAEEIATTNPVATEQYGSVCAGVDGLTNNDDLGAQA

SEQ ID NO: 171951 - protein, 35 aa, Artificial Sequence
  Description of Artificial Sequence: Synthetic polypeptide
DEMEISTTNPVATEQYGCVCSWGEHQENFISDNQS

SEQ ID NO: 171952 - protein, 34 aa, Artificial Sequence
  Description of Artificial Sequence: Synthetic polypeptide
NEAEISTTNPVAYEQWGSTVTVENNQGDAGQNDA

SEQ ID NO: 171953 - protein, 37 aa, Artificial Sequence
  Description of Artificial Sequence: Synthetic polypeptide
DEGEIATTNPVATEQYGSCSFTAPDTLREPHEGEDTR

SEQ ID NO: 171954 - protein, 38 aa, Artificial Sequence
  Description of Artificial Sequence: Synthetic polypeptide
AEEEIRTTNPVATEQYGVVSTVVTDAGNNNLGGNNDDG

SEQ ID NO: 171955 - protein, 37 aa, Artificial Sequence
  Description of Artificial Sequence: Synthetic polypeptide
DEEEIRTTNPVATEQYGSMLEVLMMNIIEERSPQADN

SEQ ID NO: 171956 - protein, 35 aa, Artificial Sequence
  Description of Artificial Sequence: Synthetic polypeptide
DEMEIRCTNPVATEQYGCICSTGETNQNFGSDTQS

SEQ ID NO: 171957 - protein, 37 aa, Artificial Sequence
  Description of Artificial Sequence: Synthetic polypeptide
DAEEIATTNPVATEQYGSVCAPTNHGPLDSGEGIDGQ

SEQ ID NO: 171958 - protein, 36 aa, Artificial Sequence
  Description of Artificial Sequence: Synthetic polypeptide
DAEEIATTNPVATEQYGSVCAATNPEEAEAEMNMNN

SEQ ID NO: 171959 - protein, 35 aa, Artificial Sequence
  Description of Artificial Sequence: Synthetic polypeptide
DEEEIATTNPVATEQWGNTTSASNEDAGMPGGNNH

SEQ ID NO: 171960 - protein, 37 aa, Artificial Sequence
  Description of Artificial Sequence: Synthetic polypeptide
DEEEIRTTNPVATEQYGSNVNNNINESDPSNNDSSLQ

SEQ ID NO: 171961 - protein, 38 aa, Artificial Sequence
  Description of Artificial Sequence: Synthetic polypeptide
DEHEIRTTNPVATEQYGSVESTPLNWAEEHIWGDEPQN

SEQ ID NO: 171962 - protein, 37 aa, Artificial Sequence
  Description of Artificial Sequence: Synthetic polypeptide
DEEEIRTTNPVATEQYGYSAFQSPTTEGEEENELDIP

SEQ ID NO: 171963 - protein, 35 aa, Artificial Sequence
  Description of Artificial Sequence: Synthetic polypeptide
DCMEIVTTNPVATEQYGTIVCSATDGPVEFEGQND

SEQ ID NO: 171964 - protein, 37 aa, Artificial Sequence
  Description of Artificial Sequence: Synthetic polypeptide
DEEEIRTTNPVATEQYGSMHCLSSNGIEAIANTVSLQ

SEQ ID NO: 171965 - protein, 34 aa, Artificial Sequence
  Description of Artificial Sequence: Synthetic polypeptide
QEEVIACTNPVATEQYGSVAMNNSEQLAMGPQEN

SEQ ID NO: 171966 - protein, 36 aa, Artificial Sequence
  Description of Artificial Sequence: Synthetic polypeptide
DEMEIRTTNPVATEQYGSVNNEEMVHDSNAEETNNQ

SEQ ID NO: 171967 - protein, 35 aa, Artificial Sequence
  Description of Artificial Sequence: Synthetic polypeptide
DEEEIATTNPVATEQWGISTWCTVEHDTSSTDNRM

SEQ ID NO: 171968 - protein, 36 aa, Artificial Sequence
  Description of Artificial Sequence: Synthetic polypeptide
DENEIRGTNPVATEQYGSVVPGGMNQDIGGNGEEGG

SEQ ID NO: 171969 - protein, 39 aa, Artificial Sequence
  Description of Artificial Sequence: Synthetic polypeptide
DEEEIRTTNPVATEQYGVVSTVTNNNQQSATEEGVTDQE

SEQ ID NO: 171970 - protein, 35 aa, Artificial Sequence
  Description of Artificial Sequence: Synthetic polypeptide
DEGEIATTNPVATEQYGSLSFSAWDTLEPHEGEDT

SEQ ID NO: 171971 - protein, 39 aa, Artificial Sequence
  Description of Artificial Sequence: Synthetic polypeptide
DEEEIRTTNPVATEQYGVVSTVTNNNQQSATEEGVTADQ

SEQ ID NO: 171972 - protein, 35 aa, Artificial Sequence
  Description of Artificial Sequence: Synthetic polypeptide
MEEEIRATNPVATEQYGVVGDDDQNQGEGDNGNEI

SEQ ID NO: 171973 - protein, 37 aa, Artificial Sequence
  Description of Artificial Sequence: Synthetic polypeptide
DEEEIATTNPVATEQYGSVCAMNNGDNNQTAPGPMES

SEQ ID NO: 171974 - protein, 37 aa, Artificial Sequence
  Description of Artificial Sequence: Synthetic polypeptide
DEEEIRTTNPVATEQYGSFPCFSLSNDNHAVTQLVSA

SEQ ID NO: 171975 - protein, 31 aa, Artificial Sequence
  Description of Artificial Sequence: Synthetic polypeptide
DENEIATTNPIATECYGATWSNACWQEPEPL

SEQ ID NO: 171976 - protein, 37 aa, Artificial Sequence
  Description of Artificial Sequence: Synthetic polypeptide
DEEEIRTTNPVATEQYGSVPSVMNFGEASIEMVELVQ

SEQ ID NO: 171977 - protein, 31 aa, Artificial Sequence
  Description of Artificial Sequence: Synthetic polypeptide
DENEIATTNPIATECYGATWSNACWQEPEEL

SEQ ID NO: 171978 - protein, 35 aa, Artificial Sequence
  Description of Artificial Sequence: Synthetic polypeptide
NEAVIRCTNPVATEQYGSCFYSMTNQENQGENNQH

SEQ ID NO: 171979 - protein, 30 aa, Artificial Sequence
  Description of Artificial Sequence: Synthetic polypeptide
QENEIATTNPVGTEGYGVIAMEDIQQQGDH

SEQ ID NO: 171980 - protein, 37 aa, Artificial Sequence
  Description of Artificial Sequence: Synthetic polypeptide
DAEEIATTNPVATEQYGSVCAIHNTEEAPDNQAEGNP

SEQ ID NO: 171981 - protein, 37 aa, Artificial Sequence
  Description of Artificial Sequence: Synthetic polypeptide
DEEEIRTTNPVATEQYGSMMEWMVIATENENTEETDQ

SEQ ID NO: 171982 - protein, 39 aa, Artificial Sequence
  Description of Artificial Sequence: Synthetic polypeptide
AEEEIRTTNPVATEQYGVVSTVVTDGGNNNLLGGNNDDT

SEQ ID NO: 171983 - protein, 33 aa, Artificial Sequence
  Description of Artificial Sequence: Synthetic polypeptide
DCEEISTTNPVAYEQWGSVCVNWEHGEQDHHGP

SEQ ID NO: 171984 - protein, 36 aa, Artificial Sequence
  Description of Artificial Sequence: Synthetic polypeptide
NEAEISTTNPVATEIYGSVCSNWNDGQDRQGQGGVD

SEQ ID NO: 171985 - protein, 38 aa, Artificial Sequence
  Description of Artificial Sequence: Synthetic polypeptide
DEEEIRTTNPVATEQYGSYAEPTELNMMQMRDEVESTA

SEQ ID NO: 171986 - protein, 35 aa, Artificial Sequence
  Description of Artificial Sequence: Synthetic polypeptide
DEMEISTTNPVATEQYGCVCSNWMEPNEFFGSQQS

SEQ ID NO: 171987 - protein, 35 aa, Artificial Sequence
  Description of Artificial Sequence: Synthetic polypeptide
DEMEIVTTNPVATEQYGTVCSATDVTDVEVFETND

SEQ ID NO: 171988 - protein, 37 aa, Artificial Sequence
  Description of Artificial Sequence: Synthetic polypeptide
DEEEIRTTNPVATEQYGSVIGPANNILNMPFHEIEDT

SEQ ID NO: 171989 - protein, 32 aa, Artificial Sequence
  Description of Artificial Sequence: Synthetic polypeptide
QENEIATTNPVSSEPYGTISMENIQQQQNGNH

SEQ ID NO: 171990 - protein, 29 aa, Artificial Sequence
  Description of Artificial Sequence: Synthetic peptide
QEGEIACTNPVGYEGWGVSASMLQHGDEI

SEQ ID NO: 171991 - protein, 35 aa, Artificial Sequence
  Description of Artificial Sequence: Synthetic polypeptide
DEGEIATTNPVATEQYGSCSAGPPGANGALMGAQE

SEQ ID NO: 171992 - protein, 29 aa, Artificial Sequence
  Description of Artificial Sequence: Synthetic peptide
QEGEIACTNPVGYAGWGGVSASMLQHGDH

SEQ ID NO: 171993 - protein, 37 aa, Artificial Sequence
  Description of Artificial Sequence: Synthetic polypeptide
DEEEIRTTNPVATEQYGSVDNPRIVIGNLNNFVAEDE

SEQ ID NO: 171994 - protein, 36 aa, Artificial Sequence
  Description of Artificial Sequence: Synthetic polypeptide
DEHEIATTNPVAYEQWGVVYSGPNDTEQRGEGGGMR

SEQ ID NO: 171995 - protein, 37 aa, Artificial Sequence
  Description of Artificial Sequence: Synthetic polypeptide
DEEEIRTTNPVATEQYGSVIGPCNNLDGMPVLEIEGT

SEQ ID NO: 171996 - protein, 35 aa, Artificial Sequence
  Description of Artificial Sequence: Synthetic polypeptide
DEHEIRTTNPVAYESWGCVSGGNGETERNNMNGNN

SEQ ID NO: 171997 - protein, 37 aa, Artificial Sequence
  Description of Artificial Sequence: Synthetic polypeptide
DDEEIRTTNPVATDQYGSVSVDQQGEEQGNEGGNGND

SEQ ID NO: 171998 - protein, 37 aa, Artificial Sequence
  Description of Artificial Sequence: Synthetic polypeptide
DEEEIRTTNPVATEQYGSVIGPDNNLLGMPVLEIEQT

SEQ ID NO: 171999 - protein, 36 aa, Artificial Sequence
  Description of Artificial Sequence: Synthetic polypeptide
IEEEIRTTNPVATEQYGSVCVAVEEQIENTEEANDY

SEQ ID NO: 172000 - protein, 39 aa, Artificial Sequence
  Description of Artificial Sequence: Synthetic polypeptide
DEEEIRTTNPVATEQYGVVSTVVVTQQLEEQGTTEQGSE

SEQ ID NO: 172001 - protein, 36 aa, Artificial Sequence
  Description of Artificial Sequence: Synthetic polypeptide
DEEEIKTTNPVATDQYGVVNDNSIGQNNGQEDNNDD

SEQ ID NO: 172002 - protein, 35 aa, Artificial Sequence
  Description of Artificial Sequence: Synthetic polypeptide
QEAEIATTNPVATEQWGGCVAGNGELAQNNSGNHE

SEQ ID NO: 172003 - protein, 36 aa, Artificial Sequence
  Description of Artificial Sequence: Synthetic polypeptide
DEEEIRTTNPVATEQYGTQIDNTNMIEQQQVAQMKE

SEQ ID NO: 172004 - protein, 37 aa, Artificial Sequence
  Description of Artificial Sequence: Synthetic polypeptide
DEEEIRTTNPVATEQYGYSAFQSPTTEGEEEQELVIL

SEQ ID NO: 172005 - protein, 35 aa, Artificial Sequence
  Description of Artificial Sequence: Synthetic polypeptide
DEMEISTTNPVATEQYGCVCSTGEDDEENFNSEQS

SEQ ID NO: 172006 - protein, 37 aa, Artificial Sequence
  Description of Artificial Sequence: Synthetic polypeptide
DEEEIATTNPVATEQYGSACSANPAEPADAEIGNHTV

SEQ ID NO: 172007 - protein, 39 aa, Artificial Sequence
  Description of Artificial Sequence: Synthetic polypeptide
DEEEIRTTNPVATEQYGVVSTVTNNNQQSATEEGSTQQQ

SEQ ID NO: 172008 - protein, 34 aa, Artificial Sequence
  Description of Artificial Sequence: Synthetic polypeptide
DEEEIACTNPVATEQWGCVAGTGQDQNPMGGTLI

SEQ ID NO: 172009 - protein, 39 aa, Artificial Sequence
  Description of Artificial Sequence: Synthetic polypeptide
DEEEIRTTNPVATEQYGVVSTTVVTNNNNNNQQGTDETD

SEQ ID NO: 172010 - protein, 36 aa, Artificial Sequence
  Description of Artificial Sequence: Synthetic polypeptide
DAEEIATTNPVATEQYGSVCALNNPENQANQTEGTM

SEQ ID NO: 172011 - protein, 37 aa, Artificial Sequence
  Description of Artificial Sequence: Synthetic polypeptide
DEEEIKTTNPAATEQYGSVSVLEDINGQEEEEGEQGD

SEQ ID NO: 172012 - protein, 36 aa, Artificial Sequence
  Description of Artificial Sequence: Synthetic polypeptide
NEQEIATTNPVATERYGSTVSCTELVSEDHEGGDNG

SEQ ID NO: 172013 - protein, 38 aa, Artificial Sequence
  Description of Artificial Sequence: Synthetic polypeptide
DEEEIRTTNPVATEQYGYSAFQSPLTNEGEEEQELDIF

SEQ ID NO: 172014 - protein, 39 aa, Artificial Sequence
  Description of Artificial Sequence: Synthetic polypeptide
DEEEIRTTNPVATEQYGVVSTVVVTQAGNNDTTEENTED

SEQ ID NO: 172015 - protein, 35 aa, Artificial Sequence
  Description of Artificial Sequence: Synthetic polypeptide
DEMEISTTNPVATEQYGCVCSWEEHNQENFNSDQS

SEQ ID NO: 172016 - protein, 38 aa, Artificial Sequence
  Description of Artificial Sequence: Synthetic polypeptide
AEEEIRTTNPVATEQYGVVSTVVTDQGNNNLGGNNDDT

SEQ ID NO: 172017 - protein, 30 aa, Artificial Sequence
  Description of Artificial Sequence: Synthetic polypeptide
QENEIATTNPVGTEQWGDVSEIEMNAAEDA

SEQ ID NO: 172018 - protein, 36 aa, Artificial Sequence
  Description of Artificial Sequence: Synthetic polypeptide
DEEEIRTTNPVATEQYGSVPECIHQGQEIMFMPADI

SEQ ID NO: 172019 - protein, 37 aa, Artificial Sequence
  Description of Artificial Sequence: Synthetic polypeptide
DEHEIRTTNPVATEQYGSVETTPLNWAEEIQGDEPQN

SEQ ID NO: 172020 - protein, 38 aa, Artificial Sequence
  Description of Artificial Sequence: Synthetic polypeptide
DEEEIRTTNPVATEQYGSVNGQLWNYEEQIIIPPNQNS

SEQ ID NO: 172021 - protein, 36 aa, Artificial Sequence
  Description of Artificial Sequence: Synthetic polypeptide
DEEEIATTNPVATEQYGSVCAMNNGDGPADGSGGQP

SEQ ID NO: 172022 - protein, 39 aa, Artificial Sequence
  Description of Artificial Sequence: Synthetic polypeptide
DEEEIRTTNPVATEQYGVVSTVVVTQAGNNGETEEENEQ

SEQ ID NO: 172023 - protein, 34 aa, Artificial Sequence
  Description of Artificial Sequence: Synthetic polypeptide
NEQEIATTNPVAYEQWGSVTGGNGNQGAGQNGTL

SEQ ID NO: 172024 - protein, 36 aa, Artificial Sequence
  Description of Artificial Sequence: Synthetic polypeptide
NEQEICTTNPVATEQYGSLVSATRDDLEPHEGMEDT

SEQ ID NO: 172025 - protein, 36 aa, Artificial Sequence
  Description of Artificial Sequence: Synthetic polypeptide
DEMEISTTNPVATEQYGCVCSTGEHEQENFGSDTQS

SEQ ID NO: 172026 - protein, 32 aa, Artificial Sequence
  Description of Artificial Sequence: Synthetic polypeptide
QENEIATTNPVSSEPYGIISMENIQQQSNGNH

SEQ ID NO: 172027 - protein, 31 aa, Artificial Sequence
  Description of Artificial Sequence: Synthetic polypeptide
QEGEIAPTNPCSYEQWGIVAKNLEQKSGDTR

SEQ ID NO: 172028 - protein, 38 aa, Artificial Sequence
  Description of Artificial Sequence: Synthetic polypeptide
DEEEIRTTNPVATEQYGSLYSESPQMLDAPIDQVNERT

SEQ ID NO: 172029 - protein, 38 aa, Artificial Sequence
  Description of Artificial Sequence: Synthetic polypeptide
DEEEIRTTNPVATEQYGSVIGPTNNLDGMVPVEEIEDQ

SEQ ID NO: 172030 - protein, 33 aa, Artificial Sequence
  Description of Artificial Sequence: Synthetic polypeptide
DEMEIRTTNPIATEQWGTVCAAADGWAPKGNYD

SEQ ID NO: 172031 - protein, 37 aa, Artificial Sequence
  Description of Artificial Sequence: Synthetic polypeptide
DEEEIRTTNPVATEQYGVVCSNWGEHNQENFNSDNQS

SEQ ID NO: 172032 - protein, 35 aa, Artificial Sequence
  Description of Artificial Sequence: Synthetic polypeptide
DEEEIATTNPVAYEQWGTVCAATGQDDDSGPNDRV

SEQ ID NO: 172033 - protein, 35 aa, Artificial Sequence
  Description of Artificial Sequence: Synthetic polypeptide
NEGEIATTNPVATEQYGSSFSATDTLEPHEGEDTQ

SEQ ID NO: 172034 - protein, 32 aa, Artificial Sequence
  Description of Artificial Sequence: Synthetic polypeptide
DENEIACTNPVATECWGATTANEEDWARGPYR

SEQ ID NO: 172035 - protein, 35 aa, Artificial Sequence
  Description of Artificial Sequence: Synthetic polypeptide
QEDEIRTTNPVAYEQYGTICSCTVNSFSGTSTENP

SEQ ID NO: 172036 - protein, 31 aa, Artificial Sequence
  Description of Artificial Sequence: Synthetic polypeptide
QECEICATNPCTTEIYGVVATTNTNQNQGDT

SEQ ID NO: 172037 - protein, 34 aa, Artificial Sequence
  Description of Artificial Sequence: Synthetic polypeptide
DEHEIRTTNPCAYEQWGSVCGDNNNDQQGQMGDS

SEQ ID NO: 172038 - protein, 37 aa, Artificial Sequence
  Description of Artificial Sequence: Synthetic polypeptide
DEEEIRTTNPVATEQYGSVPPWNYMNVQNLMMEVAEI

SEQ ID NO: 172039 - protein, 35 aa, Artificial Sequence
  Description of Artificial Sequence: Synthetic polypeptide
DEAEIATTNPVAYECWGVVCSTDNGHQEQDGGGRR

SEQ ID NO: 172040 - protein, 31 aa, Artificial Sequence
  Description of Artificial Sequence: Synthetic polypeptide
QESEIASTNPVGYEAYGVTIASTLSQHGDNI

SEQ ID NO: 172041 - protein, 36 aa, Artificial Sequence
  Description of Artificial Sequence: Synthetic polypeptide
IEQEICTTNPVATEQYGSVYNTVENLEQHHESLQDE

SEQ ID NO: 172042 - protein, 37 aa, Artificial Sequence
  Description of Artificial Sequence: Synthetic polypeptide
DEEEIRTTNPVATEQYGSFVRFDYDLDMTNNDENIMQ

SEQ ID NO: 172043 - protein, 32 aa, Artificial Sequence
  Description of Artificial Sequence: Synthetic polypeptide
NEAEIATTNPVAYEQWGSVAWNENDNHNGHVS

SEQ ID NO: 172044 - protein, 36 aa, Artificial Sequence
  Description of Artificial Sequence: Synthetic polypeptide
DEEEIRTTNPVATEQYGVCVPPSPVHMPNPVDMFED

SEQ ID NO: 172045 - protein, 30 aa, Artificial Sequence
  Description of Artificial Sequence: Synthetic polypeptide
QESEIASTNPVGYEAYGVTIASTLQHGGDI

SEQ ID NO: 172046 - protein, 33 aa, Artificial Sequence
  Description of Artificial Sequence: Synthetic polypeptide
DEGEIATTNPVATEQWGCVAGEGEMNAALDNAL

SEQ ID NO: 172047 - protein, 33 aa, Artificial Sequence
  Description of Artificial Sequence: Synthetic polypeptide
DEGEIATTNPVATAQWGGCVAISNADTQDGDDQ

SEQ ID NO: 172048 - protein, 35 aa, Artificial Sequence
  Description of Artificial Sequence: Synthetic polypeptide
DEEEIATTNPVATEQYGCSAANGELTITNPEEEAH

SEQ ID NO: 172049 - protein, 35 aa, Artificial Sequence
  Description of Artificial Sequence: Synthetic polypeptide
DEEEIATTNPVAYEQWGTVCAATGQDPDSGGPNDR

SEQ ID NO: 172050 - protein, 38 aa, Artificial Sequence
  Description of Artificial Sequence: Synthetic polypeptide
DEEEIRTTNPVATEQYGSVISLTVNPAIEITATVQDQT

SEQ ID NO: 172051 - protein, 36 aa, Artificial Sequence
  Description of Artificial Sequence: Synthetic polypeptide
QEEEIRTTNPVATECYGSVNNDNTFQEGGGQTEQGV

SEQ ID NO: 172052 - protein, 35 aa, Artificial Sequence
  Description of Artificial Sequence: Synthetic polypeptide
LEDEIRTTNPVATEQYGSVSVSAEDEEEGQMEELQ

SEQ ID NO: 172053 - protein, 33 aa, Artificial Sequence
  Description of Artificial Sequence: Synthetic polypeptide
QEGEIAPTNPCSYEQYGIVSCCNFSQSTGGTNR

SEQ ID NO: 172054 - protein, 38 aa, Artificial Sequence
  Description of Artificial Sequence: Synthetic polypeptide
QEEEIRTTNPVATEGYGMVNGQGTNLQDEPGGNEQFGG

SEQ ID NO: 172055 - protein, 32 aa, Artificial Sequence
  Description of Artificial Sequence: Synthetic polypeptide
DENEIACTNPVATECWGETTANEEDWARGPYR

SEQ ID NO: 172056 - protein, 36 aa, Artificial Sequence
  Description of Artificial Sequence: Synthetic polypeptide
DEEEIRTTNPVATEQYGVCVHPSPVWMPNTVDMFEL

SEQ ID NO: 172057 - protein, 37 aa, Artificial Sequence
  Description of Artificial Sequence: Synthetic polypeptide
DENEIATTNPVATEQYGSVCAMNNGGLEAPGDVNNVA

SEQ ID NO: 172058 - protein, 30 aa, Artificial Sequence
  Description of Artificial Sequence: Synthetic polypeptide
QEHEIASTNPVGTEGYGVYAESTLESHGDI

SEQ ID NO: 172059 - protein, 31 aa, Artificial Sequence
  Description of Artificial Sequence: Synthetic polypeptide
QESEIASTNPVGTEPYGVTTASTLSQHGGDI

SEQ ID NO: 172060 - protein, 38 aa, Artificial Sequence
  Description of Artificial Sequence: Synthetic polypeptide
NEMEIRTTNPVATEQYGSVVSPTLNSGQETLPEGQIED

SEQ ID NO: 172061 - protein, 37 aa, Artificial Sequence
  Description of Artificial Sequence: Synthetic polypeptide
DEEEIRTTNPVATEQYGSVNNNEDVSLEVADDDFTQW

SEQ ID NO: 172062 - protein, 37 aa, Artificial Sequence
  Description of Artificial Sequence: Synthetic polypeptide
DEEEIATTNPVATEQYGSVCAMNNGNLEPTADIPNEA

SEQ ID NO: 172063 - protein, 35 aa, Artificial Sequence
  Description of Artificial Sequence: Synthetic polypeptide
DEEEIATTNPVATEQYGSVCAANMGEEAPDAQMED

SEQ ID NO: 172064 - protein, 36 aa, Artificial Sequence
  Description of Artificial Sequence: Synthetic polypeptide
DEEEIRTTNPVATEQYGVCVHPSVVNMPNAVDMFEG

SEQ ID NO: 172065 - protein, 36 aa, Artificial Sequence
  Description of Artificial Sequence: Synthetic polypeptide
LEDEIRTTNPVATEQYGCVSVSTAEDEVEGQMEDLQ

SEQ ID NO: 172066 - protein, 29 aa, Artificial Sequence
  Description of Artificial Sequence: Synthetic peptide
QESEIASTNPVGTEQWGDMASTEQAAEDI

SEQ ID NO: 172067 - protein, 34 aa, Artificial Sequence
  Description of Artificial Sequence: Synthetic polypeptide
DEGEIRTTNPVATEQYGSGWVREVMEGMELVIME

SEQ ID NO: 172068 - protein, 35 aa, Artificial Sequence
  Description of Artificial Sequence: Synthetic polypeptide
DEAEIATTNPVAYECWGVVCSTDNGEMERDGDQRR

SEQ ID NO: 172069 - protein, 36 aa, Artificial Sequence
  Description of Artificial Sequence: Synthetic polypeptide
DENEIATTNPVATEQYGSVCAMNNGGTEAGDVNNAA

SEQ ID NO: 172070 - protein, 35 aa, Artificial Sequence
  Description of Artificial Sequence: Synthetic polypeptide
DEEEIATTNPVAYEQWGTVCAATGQDPDSGPNTRI

SEQ ID NO: 172071 - protein, 37 aa, Artificial Sequence
  Description of Artificial Sequence: Synthetic polypeptide
DEMEIRTTNPVATEQYGSVTATVPSHSEIRDEINMMD

SEQ ID NO: 172072 - protein, 33 aa, Artificial Sequence
  Description of Artificial Sequence: Synthetic polypeptide
QEGEIAPTNPCSYEQYGVTVSCCNMLSQSGGLR

SEQ ID NO: 172073 - protein, 38 aa, Artificial Sequence
  Description of Artificial Sequence: Synthetic polypeptide
METEIRTTNPVATEQYGSVYGDQSNLNIIQEGGGNQGD

SEQ ID NO: 172074 - protein, 30 aa, Artificial Sequence
  Description of Artificial Sequence: Synthetic polypeptide
QESEIASTNPVGWEGYGVMASTLQQHGDYI

SEQ ID NO: 172075 - protein, 33 aa, Artificial Sequence
  Description of Artificial Sequence: Synthetic polypeptide
DENEIRCTNPVSTEPYGTIASMEDIQQQQNGNH

SEQ ID NO: 172076 - protein, 35 aa, Artificial Sequence
  Description of Artificial Sequence: Synthetic polypeptide
CENEIRTTNPVATEQYGSISLTFEETEIREMDEEG

SEQ ID NO: 172077 - protein, 33 aa, Artificial Sequence
  Description of Artificial Sequence: Synthetic polypeptide
DENEIRCTNPVSTEPYGTIPSMEDIQQQQNGNH

SEQ ID NO: 172078 - protein, 36 aa, Artificial Sequence
  Description of Artificial Sequence: Synthetic polypeptide
DEEEIATTNPVATEQYGSACSADNPGEAEAIGDTHS

SEQ ID NO: 172079 - protein, 35 aa, Artificial Sequence
  Description of Artificial Sequence: Synthetic polypeptide
CENEIRTTNPVATEQYGSISLTFEETEIREELQEG

SEQ ID NO: 172080 - protein, 36 aa, Artificial Sequence
  Description of Artificial Sequence: Synthetic polypeptide
QEEEIRTTNPVATEQYGSVQPAAVPHDIMIEPGNIL

SEQ ID NO: 172081 - protein, 33 aa, Artificial Sequence
  Description of Artificial Sequence: Synthetic polypeptide
DENEIRCTNPVSTEPYGTIQSMEDIQQQQNGNH

SEQ ID NO: 172082 - protein, 38 aa, Artificial Sequence
  Description of Artificial Sequence: Synthetic polypeptide
AEEEIRTTNPVATEQYGVVVVSVTTNANQEQGEETEDD

SEQ ID NO: 172083 - protein, 35 aa, Artificial Sequence
  Description of Artificial Sequence: Synthetic polypeptide
DEHEIRTTNPCAYEEWGSVAWTWNDHQGDRQGGVG

SEQ ID NO: 172084 - protein, 36 aa, Artificial Sequence
  Description of Artificial Sequence: Synthetic polypeptide
DEHEIRTTNPCAYEEWGSVAWTWNDHQGDRQGGNAM

SEQ ID NO: 172085 - protein, 36 aa, Artificial Sequence
  Description of Artificial Sequence: Synthetic polypeptide
DEEEIRTTNPVATEQYGVCVYPSPNNMPNSVDMFQE

SEQ ID NO: 172086 - protein, 37 aa, Artificial Sequence
  Description of Artificial Sequence: Synthetic polypeptide
METEIRTTNPVATEQYGSVNSTTPTGPEMGQGENEQN

SEQ ID NO: 172087 - protein, 36 aa, Artificial Sequence
  Description of Artificial Sequence: Synthetic polypeptide
DEEEIRTTNPVATEQYGSVPPPLKLEEVPMLPLEQG

SEQ ID NO: 172088 - protein, 36 aa, Artificial Sequence
  Description of Artificial Sequence: Synthetic polypeptide
DEEEIRTTNPVATEQYGSVPPPLILEEVSMDPLEFG

SEQ ID NO: 172089 - protein, 37 aa, Artificial Sequence
  Description of Artificial Sequence: Synthetic polypeptide
DEMEIRTTNPVATEQYGSVSWPENWNEEIPNHHQNVN

SEQ ID NO: 172090 - protein, 36 aa, Artificial Sequence
  Description of Artificial Sequence: Synthetic polypeptide
DEEEIRTTNPVATEQYGVCVYPSPNNMPNVDMHFEE

SEQ ID NO: 172091 - protein, 36 aa, Artificial Sequence
  Description of Artificial Sequence: Synthetic polypeptide
DEEEIRTTNPVATEQYGVCVYPSPNNMPNVVMPFEA

SEQ ID NO: 172092 - protein, 35 aa, Artificial Sequence
  Description of Artificial Sequence: Synthetic polypeptide
DEHEIRTTNPCAYEEWGSVAWTWNDHQGDRNGGAQ

SEQ ID NO: 172093 - protein, 37 aa, Artificial Sequence
  Description of Artificial Sequence: Synthetic polypeptide
DEEEIRTTNPVATEQYGSVAPVWMMIEELRIEHPQNN

SEQ ID NO: 172094 - protein, 36 aa, Artificial Sequence
  Description of Artificial Sequence: Synthetic polypeptide
DEEEIRTTNPVATEQYGSVDQPIKGLVPEMMEAELN

SEQ ID NO: 172095 - protein, 35 aa, Artificial Sequence
  Description of Artificial Sequence: Synthetic polypeptide
DEHEINTTNPVAYEQYGETVVSINEQSQESNGGVQ

SEQ ID NO: 172096 - protein, 37 aa, Artificial Sequence
  Description of Artificial Sequence: Synthetic polypeptide
DEEEIRTTNPVATEQYGSVVYDGMFGQLGDIEEDADG

SEQ ID NO: 172097 - protein, 30 aa, Artificial Sequence
  Description of Artificial Sequence: Synthetic polypeptide
QESEIASTNPVGTDGYGEMASTLQHGADIP

SEQ ID NO: 172098 - protein, 33 aa, Artificial Sequence
  Description of Artificial Sequence: Synthetic polypeptide
DEGEIATTNPVATEQWGCVAGEGEGMNHASDNA

SEQ ID NO: 172099 - protein, 37 aa, Artificial Sequence
  Description of Artificial Sequence: Synthetic polypeptide
DEMEIRTTNPVATEQYGSVTATVPSHLEERDEIDQMD

SEQ ID NO: 172100 - protein, 36 aa, Artificial Sequence
  Description of Artificial Sequence: Synthetic polypeptide
QEDEIRTTNPVATEQYGSVYGDDGEGTQGQGEEGGA

SEQ ID NO: 172101 - protein, 33 aa, Artificial Sequence
  Description of Artificial Sequence: Synthetic polypeptide
DEGEIATTNPVATEQWGCVAGEGEANADSDNAV

SEQ ID NO: 172102 - protein, 36 aa, Artificial Sequence
  Description of Artificial Sequence: Synthetic polypeptide
DEMEIRTTNPVATEQYGSVTATVPSHEEYDQIDMMD

SEQ ID NO: 172103 - protein, 33 aa, Artificial Sequence
  Description of Artificial Sequence: Synthetic polypeptide
DEECISTVNPVATEGYGCVCSWEHNENFQSQQS

SEQ ID NO: 172104 - protein, 37 aa, Artificial Sequence
  Description of Artificial Sequence: Synthetic polypeptide
QEDEIRTTNPVATEQYGSVTTGDGNDQFGEGEEGIIP

SEQ ID NO: 172105 - protein, 36 aa, Artificial Sequence
  Description of Artificial Sequence: Synthetic polypeptide
QEEEIRTTNPVATDQYGVVDDLTNMEDQGGAETDDG

SEQ ID NO: 172106 - protein, 36 aa, Artificial Sequence
  Description of Artificial Sequence: Synthetic polypeptide
QEEEIRTTNPVATEGYGSVVMGTQNDDEDEDGFGGI

SEQ ID NO: 172107 - protein, 34 aa, Artificial Sequence
  Description of Artificial Sequence: Synthetic polypeptide
DEMEIRTTNPVATCQYGCVCNWGEHNQNFNSDQS

SEQ ID NO: 172108 - protein, 37 aa, Artificial Sequence
  Description of Artificial Sequence: Synthetic polypeptide
DEEEIATTNPVATEQYGCSSAANTHGPEAGNQMEGNN

SEQ ID NO: 172109 - protein, 33 aa, Artificial Sequence
  Description of Artificial Sequence: Synthetic polypeptide
QEMEIATTNPVATECYGTVCSAEDGPVQFEGED

SEQ ID NO: 172110 - protein, 37 aa, Artificial Sequence
  Description of Artificial Sequence: Synthetic polypeptide
DENEIATTNPVATEQYGSVCAMNNNQLNGMPMGEGRN

SEQ ID NO: 172111 - protein, 35 aa, Artificial Sequence
  Description of Artificial Sequence: Synthetic polypeptide
METEIRTTNPVATEQYGSVVNDLNAEMTNEGEFEE

SEQ ID NO: 172112 - protein, 36 aa, Artificial Sequence
  Description of Artificial Sequence: Synthetic polypeptide
DEEEIATTNPVATEQYGSVCAANMGEEAPDDQMEAM

SEQ ID NO: 172113 - protein, 36 aa, Artificial Sequence
  Description of Artificial Sequence: Synthetic polypeptide
DEEEIRTTNPVATEQYGSVDQPIKGLEPEMMEAEEL

SEQ ID NO: 172114 - protein, 32 aa, Artificial Sequence
  Description of Artificial Sequence: Synthetic polypeptide
DENEIACTNPIATECWGETSNAENLAEPKGPR

SEQ ID NO: 172115 - protein, 36 aa, Artificial Sequence
  Description of Artificial Sequence: Synthetic polypeptide
DEEEIATTNPVATEQYGCTACAVANDGLPLGSEGNH

SEQ ID NO: 172116 - protein, 35 aa, Artificial Sequence
  Description of Artificial Sequence: Synthetic polypeptide
NEGEIRTTNPVATEQYGSVNVQWDVESDGGESNQY

SEQ ID NO: 172117 - protein, 37 aa, Artificial Sequence
  Description of Artificial Sequence: Synthetic polypeptide
DAEEIATTNPVATEQYGSVSPTGEPGINPRDGMEKVE

SEQ ID NO: 172118 - protein, 34 aa, Artificial Sequence
  Description of Artificial Sequence: Synthetic polypeptide
DEEEIATTNPVAYEQWGTACAATGQDDDSGPNTR

SEQ ID NO: 172119 - protein, 37 aa, Artificial Sequence
  Description of Artificial Sequence: Synthetic polypeptide
DEEEIRTTNPVATEQYGSYQFITMGEEQPEVGEVPEI

SEQ ID NO: 172120 - protein, 35 aa, Artificial Sequence
  Description of Artificial Sequence: Synthetic polypeptide
DEGEIATTNPVATEQWGCVAGTAGLPTTAAGDNDI

SEQ ID NO: 172121 - protein, 37 aa, Artificial Sequence
  Description of Artificial Sequence: Synthetic polypeptide
DEEEIRTTNPVATEQYGVCVHPSPVNMPNRVDMAFEG

SEQ ID NO: 172122 - protein, 34 aa, Artificial Sequence
  Description of Artificial Sequence: Synthetic polypeptide
DEEEIATTNPVATEQWGTNTCSAAAHGMRSNDAW

SEQ ID NO: 172123 - protein, 37 aa, Artificial Sequence
  Description of Artificial Sequence: Synthetic polypeptide
DENEIATTNPVATEQYGSVCADHNHPEENGMPMEMNR

SEQ ID NO: 172124 - protein, 33 aa, Artificial Sequence
  Description of Artificial Sequence: Synthetic polypeptide
QEMEIATTNPVATEQYGEVCSATDVCVEHEEEK

SEQ ID NO: 172125 - protein, 35 aa, Artificial Sequence
  Description of Artificial Sequence: Synthetic polypeptide
DEEEIACTNPVATEQWGCVAMTGLTNPDDGMGDNH

SEQ ID NO: 172126 - protein, 37 aa, Artificial Sequence
  Description of Artificial Sequence: Synthetic polypeptide
DEEEIATTNPVATEQYGSVCALAGGLEPTMDGMNGGV

SEQ ID NO: 172127 - protein, 31 aa, Artificial Sequence
  Description of Artificial Sequence: Synthetic polypeptide
QESEIASTNPVGTEAYGVTIASTHSQHGGDI

SEQ ID NO: 172128 - protein, 31 aa, Artificial Sequence
  Description of Artificial Sequence: Synthetic polypeptide
QEGEIACTNPCSYEQWGIVCSWNIDQSGDTR

SEQ ID NO: 172129 - protein, 38 aa, Artificial Sequence
  Description of Artificial Sequence: Synthetic polypeptide
DEEEIRTTNPVATEQYGSHPVLGIADMTMEEPEQEGTP

SEQ ID NO: 172130 - protein, 34 aa, Artificial Sequence
  Description of Artificial Sequence: Synthetic polypeptide
NEAEIATTNPVAYEQWGCVNFTENHDRNQGGNDK

SEQ ID NO: 172131 - protein, 36 aa, Artificial Sequence
  Description of Artificial Sequence: Synthetic polypeptide
DEEEIRTTNPVATEQYGVCVHPSPVNMPNYVDMMFE

SEQ ID NO: 172132 - protein, 33 aa, Artificial Sequence
  Description of Artificial Sequence: Synthetic polypeptide
QEMEIATTNPVATEQYGEVCSATDGCVEHEEEK

SEQ ID NO: 172133 - protein, 37 aa, Artificial Sequence
  Description of Artificial Sequence: Synthetic polypeptide
DEEEIRTTNPVATEQYGSYVAVIGPPGDQTQFNFNQD

SEQ ID NO: 172134 - protein, 38 aa, Artificial Sequence
  Description of Artificial Sequence: Synthetic polypeptide
DEEEIRTTNPVATEQYGTVNTNGNSDEIGTSISTTGNT

SEQ ID NO: 172135 - protein, 29 aa, Artificial Sequence
  Description of Artificial Sequence: Synthetic peptide
QEGEIACTNPCSYEQWGITYCNDQSGDTR

SEQ ID NO: 172136 - protein, 37 aa, Artificial Sequence
  Description of Artificial Sequence: Synthetic polypeptide
DEEEIRTTNPVATEQYGSHNCCCNELPIEMMEQEILI

SEQ ID NO: 172137 - protein, 35 aa, Artificial Sequence
  Description of Artificial Sequence: Synthetic polypeptide
DEMEIVTTNPVATEQYGTVCSNTGEPNEFFISDDA

SEQ ID NO: 172138 - protein, 30 aa, Artificial Sequence
  Description of Artificial Sequence: Synthetic polypeptide
QEHEIASTNPVGTEGYGVTASTLEPHGADI

SEQ ID NO: 172139 - protein, 37 aa, Artificial Sequence
  Description of Artificial Sequence: Synthetic polypeptide
CTGEIRTTNPVATEQYGSVVDQTQNNGQEEFGNGGGI

SEQ ID NO: 172140 - protein, 36 aa, Artificial Sequence
  Description of Artificial Sequence: Synthetic polypeptide
DEEEIRTTNPVATEQYGVCVHPSPVNMPNPVDMFAE

SEQ ID NO: 172141 - protein, 36 aa, Artificial Sequence
  Description of Artificial Sequence: Synthetic polypeptide
DEEEIRTTNPVATEQYGVCVHPSPVNMPNAVMMPFE

SEQ ID NO: 172142 - protein, 37 aa, Artificial Sequence
  Description of Artificial Sequence: Synthetic polypeptide
DEEEIRTTNPVATEQYGSVVYDIMFGQEGEQEEDQDG

SEQ ID NO: 172143 - protein, 32 aa, Artificial Sequence
  Description of Artificial Sequence: Synthetic polypeptide
QEEEIATTNPVATEQYGEIPPCEVEHSQHEEK

SEQ ID NO: 172144 - protein, 34 aa, Artificial Sequence
  Description of Artificial Sequence: Synthetic polypeptide
NEMEIVTTNPVATEQYGAVCTATDGPVEFEGNDE

SEQ ID NO: 172145 - protein, 33 aa, Artificial Sequence
  Description of Artificial Sequence: Synthetic polypeptide
QESEIASTNPVGTECWGSVSCINEPQDHEGENG

SEQ ID NO: 172146 - protein, 36 aa, Artificial Sequence
  Description of Artificial Sequence: Synthetic polypeptide
DEMAIRTTNPVATEQYGCFCSTGEHNAENFGSDNQA

SEQ ID NO: 172147 - protein, 32 aa, Artificial Sequence
  Description of Artificial Sequence: Synthetic polypeptide
QESEIASTNPVGTEPYGVIASTELSQHTGGDI

SEQ ID NO: 172148 - protein, 39 aa, Artificial Sequence
  Description of Artificial Sequence: Synthetic polypeptide
DEEEIRTTNPVATEQYGVVSTVVVVTNTQQGTTEEEETD

SEQ ID NO: 172149 - protein, 33 aa, Artificial Sequence
  Description of Artificial Sequence: Synthetic polypeptide
DEAEIATTNPVAYECWGEVSGGNGNQGEQNDDP

SEQ ID NO: 172150 - protein, 34 aa, Artificial Sequence
  Description of Artificial Sequence: Synthetic polypeptide
DEHEIRTTNPVAYEKWGSVCGDQGEGDRQGNGGI

SEQ ID NO: 172151 - protein, 31 aa, Artificial Sequence
  Description of Artificial Sequence: Synthetic polypeptide
QESEIASTNPVGTEPYGVIPASTLSQHGGDI

SEQ ID NO: 172152 - protein, 38 aa, Artificial Sequence
  Description of Artificial Sequence: Synthetic polypeptide
DEEEIATTNPVATEQYGSVCAMNNGVLTPPDDQAEGAW

SEQ ID NO: 172153 - protein, 38 aa, Artificial Sequence
  Description of Artificial Sequence: Synthetic polypeptide
DEEEIRTTNPVATEQYGSLCILPLWSPQQPENINRVND

SEQ ID NO: 172154 - protein, 31 aa, Artificial Sequence
  Description of Artificial Sequence: Synthetic polypeptide
DENEIASTNPVSTEPYGTMAMETLQQQQGDI

SEQ ID NO: 172155 - protein, 37 aa, Artificial Sequence
  Description of Artificial Sequence: Synthetic polypeptide
DEEEIRTTNPVATEQYGSVIGPVNNLDTMPVLEIEDQ

SEQ ID NO: 172156 - protein, 37 aa, Artificial Sequence
  Description of Artificial Sequence: Synthetic polypeptide
DEEEIATTNPVATEQYGSVCAMNNGVLTEDPLENANQ

SEQ ID NO: 172157 - protein, 37 aa, Artificial Sequence
  Description of Artificial Sequence: Synthetic polypeptide
DEEEIRTTNPVATEQYGSYCYSPTEVLILNTMVEVVP

SEQ ID NO: 172158 - protein, 32 aa, Artificial Sequence
  Description of Artificial Sequence: Synthetic polypeptide
QEEEIATTNPVATEQYGEAPSEPVIEASMSEQ

SEQ ID NO: 172159 - protein, 37 aa, Artificial Sequence
  Description of Artificial Sequence: Synthetic polypeptide
DEEEIATTNPVATEQYGCVTSTWGEDNAEYFNSDPQS

SEQ ID NO: 172160 - protein, 35 aa, Artificial Sequence
  Description of Artificial Sequence: Synthetic polypeptide
DEMAIRTTNPVATEQYGCFCSTEHNIENFISDNQS

SEQ ID NO: 172161 - protein, 33 aa, Artificial Sequence
  Description of Artificial Sequence: Synthetic polypeptide
DEAEIATTNPVAYECWGEVSGGNGNQGETNDGS

SEQ ID NO: 172162 - protein, 35 aa, Artificial Sequence
  Description of Artificial Sequence: Synthetic polypeptide
DEGEIATTNPVATEQWGCVSANGDMGEDHQGGEDN

SEQ ID NO: 172163 - protein, 31 aa, Artificial Sequence
  Description of Artificial Sequence: Synthetic polypeptide
LEEEIATTNPVAYEQYGEIPCEVEHSQHEEK

SEQ ID NO: 172164 - protein, 35 aa, Artificial Sequence
  Description of Artificial Sequence: Synthetic polypeptide
DEMEIRTTNPVATEQYGCVIAPQLMNEDSESSQRE

SEQ ID NO: 172165 - protein, 35 aa, Artificial Sequence
  Description of Artificial Sequence: Synthetic polypeptide
DEAEIATTNPVAYECWGSVATGNMLGDAQGMMREN

SEQ ID NO: 172166 - protein, 34 aa, Artificial Sequence
  Description of Artificial Sequence: Synthetic polypeptide
DEECISTVNPVATEGYGCVCSWELNENFGSENQS

SEQ ID NO: 172167 - protein, 36 aa, Artificial Sequence
  Description of Artificial Sequence: Synthetic polypeptide
MESEIRTTNPVATEQYGSVSPVFNETMTTFPGDVEA

SEQ ID NO: 172168 - protein, 35 aa, Artificial Sequence
  Description of Artificial Sequence: Synthetic polypeptide
NEAEIATTNPVAYEQWGEVVPTDNQLDQHEGNNNP

SEQ ID NO: 172169 - protein, 36 aa, Artificial Sequence
  Description of Artificial Sequence: Synthetic polypeptide
DENEIATTNPVATEQYGSVCAMNGNNLEPDSDQPNA

SEQ ID NO: 172170 - protein, 37 aa, Artificial Sequence
  Description of Artificial Sequence: Synthetic polypeptide
DEEEIATTNPVATEQYGSACSAANPAEADAEIGNDTM

SEQ ID NO: 172171 - protein, 38 aa, Artificial Sequence
  Description of Artificial Sequence: Synthetic polypeptide
DEEEIRTTNPVATEQYGSYTRPTENWLNEIENLVEMME

SEQ ID NO: 172172 - protein, 35 aa, Artificial Sequence
  Description of Artificial Sequence: Synthetic polypeptide
DEGEIATTNPVATEQWGCVAGTGELAQNNSQNDHT

SEQ ID NO: 172173 - protein, 36 aa, Artificial Sequence
  Description of Artificial Sequence: Synthetic polypeptide
DEEEIRTTNPVATEQYGTTQVAIEEQIENTPEANDM

SEQ ID NO: 172174 - protein, 32 aa, Artificial Sequence
  Description of Artificial Sequence: Synthetic polypeptide
DEECISTVNPVATEGYGCVCSWELENFISQQS

SEQ ID NO: 172175 - protein, 38 aa, Artificial Sequence
  Description of Artificial Sequence: Synthetic polypeptide
DEEEIRTTNPVATEQYGSVPQVTPYPQTVPSQGQVFEI

SEQ ID NO: 172176 - protein, 32 aa, Artificial Sequence
  Description of Artificial Sequence: Synthetic polypeptide
DENEIACTNPVATECWGETTSNEEDWARGPYR

SEQ ID NO: 172177 - protein, 37 aa, Artificial Sequence
  Description of Artificial Sequence: Synthetic polypeptide
DEEEIRTTNPVATEQYGSVYLINNMNGQEQMVEIYDT

SEQ ID NO: 172178 - protein, 35 aa, Artificial Sequence
  Description of Artificial Sequence: Synthetic polypeptide
DEAEIATTNPVAYECWGSVSGGNADDARNNGNGNP

SEQ ID NO: 172179 - protein, 37 aa, Artificial Sequence
  Description of Artificial Sequence: Synthetic polypeptide
DEEEIRTTNPVATEQYGSVPQVAIEEQIENTEEDPDM

SEQ ID NO: 172180 - protein, 30 aa, Artificial Sequence
  Description of Artificial Sequence: Synthetic polypeptide
QESEIASTNPVGTEGYGMQAISSTLRHGDI

SEQ ID NO: 172181 - protein, 39 aa, Artificial Sequence
  Description of Artificial Sequence: Synthetic polypeptide
DEEEIRTTNPVATEQYGVVSTVVVTQAGNNTTTEEGNTE

SEQ ID NO: 172182 - protein, 38 aa, Artificial Sequence
  Description of Artificial Sequence: Synthetic polypeptide
DENEIRGTNPVATEQYGSVANTNMQEGLGQIGQGMEEN

SEQ ID NO: 172183 - protein, 41 aa, Artificial Sequence
  Description of Artificial Sequence: Synthetic polypeptide
DEEEIRTTNPVATEQYGVVSTVNLQYGNNTTEQGTNNNTTD

SEQ ID NO: 172184 - protein, 35 aa, Artificial Sequence
  Description of Artificial Sequence: Synthetic polypeptide
DEGEIRTTNPVAYESYGSVCCLGGHSHTEAGTGKL

SEQ ID NO: 172185 - protein, 36 aa, Artificial Sequence
  Description of Artificial Sequence: Synthetic polypeptide
DEEEIRTTNPVATEQYGVCVHPSPVNMSNIVDMPFE

SEQ ID NO: 172186 - protein, 31 aa, Artificial Sequence
  Description of Artificial Sequence: Synthetic polypeptide
QEEEIATTNPVATEQYGEIAPEVASHEVEKD

SEQ ID NO: 172187 - protein, 35 aa, Artificial Sequence
  Description of Artificial Sequence: Synthetic polypeptide
DEMEIRTTNPVATEQYGCVGCPQNMQEDSESQQDK

SEQ ID NO: 172188 - protein, 36 aa, Artificial Sequence
  Description of Artificial Sequence: Synthetic polypeptide
DDEEIRCTNPVATEQYGCVCSTEEHNAENSGSQTQS

SEQ ID NO: 172189 - protein, 37 aa, Artificial Sequence
  Description of Artificial Sequence: Synthetic polypeptide
DEEEIKTTNPVAYETYGISLVACTSNLSQTPSTDNLD

SEQ ID NO: 172190 - protein, 33 aa, Artificial Sequence
  Description of Artificial Sequence: Synthetic polypeptide
QECEICATNPCTTEIYGVVATQSGTNNQNGNDT

SEQ ID NO: 172191 - protein, 35 aa, Artificial Sequence
  Description of Artificial Sequence: Synthetic polypeptide
QEEEIRTTNPVATEGYGSVVTGTMDDEDEGGVGGI

SEQ ID NO: 172192 - protein, 29 aa, Artificial Sequence
  Description of Artificial Sequence: Synthetic peptide
NEAEIATTNPVAYEQWGEAYYVEQHSAEG

SEQ ID NO: 172193 - protein, 34 aa, Artificial Sequence
  Description of Artificial Sequence: Synthetic polypeptide
DEECISTVNPVATEGYGCVCSWGELDENFGSNQS

SEQ ID NO: 172194 - protein, 34 aa, Artificial Sequence
  Description of Artificial Sequence: Synthetic polypeptide
QEEEIATVNPVATEQWGGCVAGNGLQSNNNQQAE

SEQ ID NO: 172195 - protein, 36 aa, Artificial Sequence
  Description of Artificial Sequence: Synthetic polypeptide
DENEIRGTNPVATEQYGSVIFGNNDEGGGQTEGEDG

SEQ ID NO: 172196 - protein, 39 aa, Artificial Sequence
  Description of Artificial Sequence: Synthetic polypeptide
DEEEIRTTNPVATEQYGVVSTVVVTQAGNNTTEEINTET

SEQ ID NO: 172197 - protein, 36 aa, Artificial Sequence
  Description of Artificial Sequence: Synthetic polypeptide
CTGEIRTTNPVATEQYGSVVDQTENNFDEEGNGGGT

SEQ ID NO: 172198 - protein, 36 aa, Artificial Sequence
  Description of Artificial Sequence: Synthetic polypeptide
DEEEIRTTNPVATEQYGVCVHPSPVNMSNAVDMVFP

SEQ ID NO: 172199 - protein, 36 aa, Artificial Sequence
  Description of Artificial Sequence: Synthetic polypeptide
DEEEIATTNPVATEQYGSVCALAGGLEPTSDGMEGN

SEQ ID NO: 172200 - protein, 38 aa, Artificial Sequence
  Description of Artificial Sequence: Synthetic polypeptide
DEEEIATTNPVATEQYGSVCALAGNHLEPTRDGMGAGV

SEQ ID NO: 172201 - protein, 37 aa, Artificial Sequence
  Description of Artificial Sequence: Synthetic polypeptide
DEEEIRTTNPVATEQYGSYVAVIGPMWDETQFNVNQD

SEQ ID NO: 172202 - protein, 35 aa, Artificial Sequence
  Description of Artificial Sequence: Synthetic polypeptide
DEGEIATTNPVATEQWGCVAGTWELAQDNSQNNHQ

SEQ ID NO: 172203 - protein, 36 aa, Artificial Sequence
  Description of Artificial Sequence: Synthetic polypeptide
DDEEIRCTNPVATEQYGCVCSTEDHNQENSGSQTQS

SEQ ID NO: 172204 - protein, 36 aa, Artificial Sequence
  Description of Artificial Sequence: Synthetic polypeptide
DEEEIRTTNPVATEQYGSVPRPPLLEEVPMAPLEQV

SEQ ID NO: 172205 - protein, 35 aa, Artificial Sequence
  Description of Artificial Sequence: Synthetic polypeptide
DEGEIRTTNPVATEQYGCFCYPTNEDWIEPQQEPM

SEQ ID NO: 172206 - protein, 32 aa, Artificial Sequence
  Description of Artificial Sequence: Synthetic polypeptide
QEECIATTNPVATEQYGCYCPWEDNQHFNSEQ

SEQ ID NO: 172207 - protein, 36 aa, Artificial Sequence
  Description of Artificial Sequence: Synthetic polypeptide
DEEEIRTTNPVATEQYGVCVHPSPVNMSNDVDMFED

SEQ ID NO: 172208 - protein, 31 aa, Artificial Sequence
  Description of Artificial Sequence: Synthetic polypeptide
QEMEIATTNPVATEQYGEACSEDVCEFEEEK

SEQ ID NO: 172209 - protein, 37 aa, Artificial Sequence
  Description of Artificial Sequence: Synthetic polypeptide
DEEEIRTTNPVATEQYGSVPPVWQMVKVEGVEPDQTD

SEQ ID NO: 172210 - protein, 39 aa, Artificial Sequence
  Description of Artificial Sequence: Synthetic polypeptide
DEEEIRTTNPVATEQYGVVSTVNAEQGNNQGTEGTEDTT

SEQ ID NO: 172211 - protein, 38 aa, Artificial Sequence
  Description of Artificial Sequence: Synthetic polypeptide
DEEEIRTTNPVATEQYGSVPPVWQMVKVEAGVEPEGRD

SEQ ID NO: 172212 - protein, 37 aa, Artificial Sequence
  Description of Artificial Sequence: Synthetic polypeptide
DEEEIRTTNPVATEQYGSVAEVVPIMGAMVAGSDNEE

SEQ ID NO: 172213 - protein, 32 aa, Artificial Sequence
  Description of Artificial Sequence: Synthetic polypeptide
QEMEIACTNPCSYEQYGCVCSWENLQSGSETQ

SEQ ID NO: 172214 - protein, 35 aa, Artificial Sequence
  Description of Artificial Sequence: Synthetic polypeptide
DEGTEIATTNPVAYEQWGVVSGGNGLQQDHPNMGS

SEQ ID NO: 172215 - protein, 35 aa, Artificial Sequence
  Description of Artificial Sequence: Synthetic polypeptide
DEGTEIATTNPVAYEQWGVVSGGGNMQLNDQHGDM

SEQ ID NO: 172216 - protein, 32 aa, Artificial Sequence
  Description of Artificial Sequence: Synthetic polypeptide
QESEIASTNPVGTEQYGVMAATTLQDHEGDDL

SEQ ID NO: 172217 - protein, 36 aa, Artificial Sequence
  Description of Artificial Sequence: Synthetic polypeptide
DEEEIKTTNPVAYETYGISLVACTCLSQTESTDNVD

SEQ ID NO: 172218 - protein, 36 aa, Artificial Sequence
  Description of Artificial Sequence: Synthetic polypeptide
NEAEIQCTNPVAYEQYGCVVQSTCLNEQVDRGGTNV

SEQ ID NO: 172219 - protein, 35 aa, Artificial Sequence
  Description of Artificial Sequence: Synthetic polypeptide
DENEIRGTNPVATDAYGSVMSNNNIEFQDEMGEGN

SEQ ID NO: 172220 - protein, 36 aa, Artificial Sequence
  Description of Artificial Sequence: Synthetic polypeptide
QEEEIRTTNPVATECYGSVMDIGGNALDAEGGDQQE

SEQ ID NO: 172221 - protein, 38 aa, Artificial Sequence
  Description of Artificial Sequence: Synthetic polypeptide
DEEEIRTTNPVATEQYGSVAETTPNEGAMNGFEGSQQI

SEQ ID NO: 172222 - protein, 35 aa, Artificial Sequence
  Description of Artificial Sequence: Synthetic polypeptide
NEMEIRTTNPVATEQYGCVSCPQNMQEDSESQQDE

SEQ ID NO: 172223 - protein, 35 aa, Artificial Sequence
  Description of Artificial Sequence: Synthetic polypeptide
CEEVIACTNPVATEQYGCVAISNNDQTAGGPNESN

SEQ ID NO: 172224 - protein, 39 aa, Artificial Sequence
  Description of Artificial Sequence: Synthetic polypeptide
DEEEIRTTNPVATEQYGSFVINSLNQNMMSLEQAVVPTA

SEQ ID NO: 172225 - protein, 31 aa, Artificial Sequence
  Description of Artificial Sequence: Synthetic polypeptide
QESEIASTNPVGTEAGFYGVMASTLPQHGDI

SEQ ID NO: 172226 - protein, 39 aa, Artificial Sequence
  Description of Artificial Sequence: Synthetic polypeptide
AEEEIRTTNPVATEQYGVVVVTTTTNNLEQGTEAGNTTT

SEQ ID NO: 172227 - protein, 36 aa, Artificial Sequence
  Description of Artificial Sequence: Synthetic polypeptide
DENEIRGTNPVATEAYGSVMSNQGQNIFQEELNEGE

SEQ ID NO: 172228 - protein, 36 aa, Artificial Sequence
  Description of Artificial Sequence: Synthetic polypeptide
DENEIRGTNPVATEAYGSVMSNQGQNIFQEEMGEGL

SEQ ID NO: 172229 - protein, 35 aa, Artificial Sequence
  Description of Artificial Sequence: Synthetic polypeptide
DEGEIATTNPVATEQWGCCAVTNNLADAPQGDNNP

SEQ ID NO: 172230 - protein, 38 aa, Artificial Sequence
  Description of Artificial Sequence: Synthetic polypeptide
DEEEIRTTNPVATEQYGSVVYDGMFGQEGDQEEDDRGH

SEQ ID NO: 172231 - protein, 32 aa, Artificial Sequence
  Description of Artificial Sequence: Synthetic polypeptide
DENEIACTNPVSTEPYGTISMEDIQQQQNGNH

SEQ ID NO: 172232 - protein, 31 aa, Artificial Sequence
  Description of Artificial Sequence: Synthetic polypeptide
QEMEIACTNPCSYEQYGCVCSWNDQESGSEQ

SEQ ID NO: 172233 - protein, 35 aa, Artificial Sequence
  Description of Artificial Sequence: Synthetic polypeptide
DENEIRGTNPVATEFYGSVYNQQDQEGGQEENGDD

SEQ ID NO: 172234 - protein, 34 aa, Artificial Sequence
  Description of Artificial Sequence: Synthetic polypeptide
DEAEIATTNPVAYEKWGEVSCTNLQLNDHDQSGH

SEQ ID NO: 172235 - protein, 30 aa, Artificial Sequence
  Description of Artificial Sequence: Synthetic polypeptide
QEDEIATTNPVAYEQWGEAYMVEQHDEGEM

SEQ ID NO: 172236 - protein, 36 aa, Artificial Sequence
  Description of Artificial Sequence: Synthetic polypeptide
IESEIRTTNPVATEQYGATASDVQDVNNQDNGQEYI

SEQ ID NO: 172237 - protein, 35 aa, Artificial Sequence
  Description of Artificial Sequence: Synthetic polypeptide
QEEEIRTTNPVATEGYGMVNNDEFDLEFGPGENGA

SEQ ID NO: 172238 - protein, 36 aa, Artificial Sequence
  Description of Artificial Sequence: Synthetic polypeptide
IESEIRTTNPVATEQYGCAASDVQDLNNQDGQEEMS

SEQ ID NO: 172239 - protein, 35 aa, Artificial Sequence
  Description of Artificial Sequence: Synthetic polypeptide
IESEIRTTNPVATEQYGSASDVQDLNNQDTQEHMI

SEQ ID NO: 172240 - protein, 31 aa, Artificial Sequence
  Description of Artificial Sequence: Synthetic polypeptide
QEMEIACTNPCSYEQYGCVCSWNTQSGSEQM

SEQ ID NO: 172241 - protein, 28 aa, Artificial Sequence
  Description of Artificial Sequence: Synthetic peptide
QESEIASTNPVGTDGYGVMAYTLEHGDI

SEQ ID NO: 172242 - protein, 34 aa, Artificial Sequence
  Description of Artificial Sequence: Synthetic polypeptide
NEGEIRTTNPVATGHYGSVSDVLNNITEGTFDMA

SEQ ID NO: 172243 - protein, 35 aa, Artificial Sequence
  Description of Artificial Sequence: Synthetic polypeptide
CENEIKTTNPVATETYGSVSSFNSLIAEVGDTVPA

SEQ ID NO: 172244 - protein, 35 aa, Artificial Sequence
  Description of Artificial Sequence: Synthetic polypeptide
QEDEIATTNPVAYECWGSVSGGNMGNQGGRGNGNM

SEQ ID NO: 172245 - protein, 35 aa, Artificial Sequence
  Description of Artificial Sequence: Synthetic polypeptide
QEEEIRTTNPVATECYGSVDNDNMFETGGGQEEQG

SEQ ID NO: 172246 - protein, 37 aa, Artificial Sequence
  Description of Artificial Sequence: Synthetic polypeptide
DEEEIRTTNPVATEQYGSYNWEANPDDLGGSGQTEGG

SEQ ID NO: 172247 - protein, 34 aa, Artificial Sequence
  Description of Artificial Sequence: Synthetic polypeptide
DEMEIATTNPVATEQYGTVCAANDGPVETDETND

SEQ ID NO: 172248 - protein, 33 aa, Artificial Sequence
  Description of Artificial Sequence: Synthetic polypeptide
DEGEIATTNPVATEQWGCNATIEPGQAPMEPNN

SEQ ID NO: 172249 - protein, 31 aa, Artificial Sequence
  Description of Artificial Sequence: Synthetic polypeptide
QEGEIAPTNPCATEQWGAVSADWQESKGTYI

SEQ ID NO: 172250 - protein, 37 aa, Artificial Sequence
  Description of Artificial Sequence: Synthetic polypeptide
DEEEIRTTNPVATEQYGVTTYQLQVGMGHDAAAAVEK

SEQ ID NO: 172251 - protein, 34 aa, Artificial Sequence
  Description of Artificial Sequence: Synthetic polypeptide
DEECISTVNPVATEGYGCVCSNWELNENFGSNQS

SEQ ID NO: 172252 - protein, 37 aa, Artificial Sequence
  Description of Artificial Sequence: Synthetic polypeptide
DENEIATTNPVATEQYGSVCATNHQAPLASGEEMADD

SEQ ID NO: 172253 - protein, 38 aa, Artificial Sequence
  Description of Artificial Sequence: Synthetic polypeptide
DEEEIRTTNPVATEQYGSYMSLCPNLEAVSRVAMMSED

SEQ ID NO: 172254 - protein, 37 aa, Artificial Sequence
  Description of Artificial Sequence: Synthetic polypeptide
DEEEIKTTNPVATEQYGDVVDDDNNDEQIGGQNGGQG

SEQ ID NO: 172255 - protein, 37 aa, Artificial Sequence
  Description of Artificial Sequence: Synthetic polypeptide
DEEEIRTTNPVATEQYGSYMSLDPNLEAVSEVAEPED

SEQ ID NO: 172256 - protein, 36 aa, Artificial Sequence
  Description of Artificial Sequence: Synthetic polypeptide
DEAEIATTNPVAYEQYGSVAAITNNEEAPDNQEGRM

SEQ ID NO: 172257 - protein, 32 aa, Artificial Sequence
  Description of Artificial Sequence: Synthetic polypeptide
QEMEIACTNPCSYEQYGCVCSSNLQSFGSEAA

SEQ ID NO: 172258 - protein, 36 aa, Artificial Sequence
  Description of Artificial Sequence: Synthetic polypeptide
DENEIRGTNPVATEAYGVVNIDTNQQNEGGNIENDD

SEQ ID NO: 172259 - protein, 32 aa, Artificial Sequence
  Description of Artificial Sequence: Synthetic polypeptide
QEPEIATTNPVATEQYGDVAGPEGEGQGEEQQ

SEQ ID NO: 172260 - protein, 38 aa, Artificial Sequence
  Description of Artificial Sequence: Synthetic polypeptide
INEEIRTTNPVATEQYGSVCEPTDNLAEETEGNGDFET

SEQ ID NO: 172261 - protein, 36 aa, Artificial Sequence
  Description of Artificial Sequence: Synthetic polypeptide
DENEIRGTNPVATECYGSVVMGMGINQNNLDQEGGG

SEQ ID NO: 172262 - protein, 37 aa, Artificial Sequence
  Description of Artificial Sequence: Synthetic polypeptide
DEEEIATTNPVATEQYGSVCAMNNGVGEPPDDQANGA

SEQ ID NO: 172263 - protein, 31 aa, Artificial Sequence
  Description of Artificial Sequence: Synthetic polypeptide
QEMEIACTNPCSYEQYGCVCSNWELQSGSEQ

SEQ ID NO: 172264 - protein, 37 aa, Artificial Sequence
  Description of Artificial Sequence: Synthetic polypeptide
DEEEIATTNPVATEQYGSVCAMNNGVDPEDDGGNEHQ

SEQ ID NO: 172265 - protein, 30 aa, Artificial Sequence
  Description of Artificial Sequence: Synthetic polypeptide
QESEIASTNPVGTEAWGVCAPTDLQHGDTS

SEQ ID NO: 172266 - protein, 34 aa, Artificial Sequence
  Description of Artificial Sequence: Synthetic polypeptide
DEGEIATTNPVATECYGSVCAAGALDEATDNNNP

SEQ ID NO: 172267 - protein, 36 aa, Artificial Sequence
  Description of Artificial Sequence: Synthetic polypeptide
QEEEIRTTNPVATECYGSVNNDNGFETGGGQTEQGR

SEQ ID NO: 172268 - protein, 37 aa, Artificial Sequence
  Description of Artificial Sequence: Synthetic polypeptide
DEEEIRATNPVATEQYGSACAATNPQEQPDDQTGGQM

SEQ ID NO: 172269 - protein, 34 aa, Artificial Sequence
  Description of Artificial Sequence: Synthetic polypeptide
DEGEIATTNPVATASWGCVSVANNTPLDNGGENG

SEQ ID NO: 172270 - protein, 34 aa, Artificial Sequence
  Description of Artificial Sequence: Synthetic polypeptide
DEGEIATTNPVATASWGCVSANNEPTDRGGENTE

SEQ ID NO: 172271 - protein, 37 aa, Artificial Sequence
  Description of Artificial Sequence: Synthetic polypeptide
DEEEIKTTNPVATEQYGDVVVDDNNEQITGGQNGGST

SEQ ID NO: 172272 - protein, 33 aa, Artificial Sequence
  Description of Artificial Sequence: Synthetic polypeptide
QEPEIATTNPVATEQYGAVAGPEVGQGEGEGIG

SEQ ID NO: 172273 - protein, 36 aa, Artificial Sequence
  Description of Artificial Sequence: Synthetic polypeptide
DEEEIRTTNPVATEQYGSHCVTLEQVSDIEMSSEPN

SEQ ID NO: 172274 - protein, 31 aa, Artificial Sequence
  Description of Artificial Sequence: Synthetic polypeptide
QESEIASTNPVGTERYGVMAMSYTELAHGDI

SEQ ID NO: 172275 - protein, 37 aa, Artificial Sequence
  Description of Artificial Sequence: Synthetic polypeptide
DEEEIATTNPVATEQYGSVCAMNNGNPEPGADIANDA

SEQ ID NO: 172276 - protein, 37 aa, Artificial Sequence
  Description of Artificial Sequence: Synthetic polypeptide
DEEEIATTNPVATEQYGSVCAMNNGVLNQTAPDPMES

SEQ ID NO: 172277 - protein, 37 aa, Artificial Sequence
  Description of Artificial Sequence: Synthetic polypeptide
DEEEIRTTNPVATEQYGSVAHPTFSDLELEIVEVQVL

SEQ ID NO: 172278 - protein, 34 aa, Artificial Sequence
  Description of Artificial Sequence: Synthetic polypeptide
DEHEIRTTNPVAYEQWGNVCMEQLGDMQGGGDTE

SEQ ID NO: 172279 - protein, 31 aa, Artificial Sequence
  Description of Artificial Sequence: Synthetic polypeptide
QEMEIACTNPCSYEQYGCVCSWEHQSGSENQ

SEQ ID NO: 172280 - protein, 36 aa, Artificial Sequence
  Description of Artificial Sequence: Synthetic polypeptide
DEEEIKTTNPVATEQYGDVVDDNNDEQIGGQQGGTG

SEQ ID NO: 172281 - protein, 34 aa, Artificial Sequence
  Description of Artificial Sequence: Synthetic polypeptide
DEHEIRTTNPVAYERWGTVYWINENQDRQMINNG

SEQ ID NO: 172282 - protein, 37 aa, Artificial Sequence
  Description of Artificial Sequence: Synthetic polypeptide
DEMEIRTTNPVATEQYGCVCSTTPAHNAEYSGSDPQA

SEQ ID NO: 172283 - protein, 35 aa, Artificial Sequence
  Description of Artificial Sequence: Synthetic polypeptide
QEEEIRTTNPVATEGYGSVNNDNTFETGGGQTEQG

SEQ ID NO: 172284 - protein, 37 aa, Artificial Sequence
  Description of Artificial Sequence: Synthetic polypeptide
DEEEIATTNPVATEQYGSVPANANNMPEQGNNMPGDV

SEQ ID NO: 172285 - protein, 38 aa, Artificial Sequence
  Description of Artificial Sequence: Synthetic polypeptide
DEEEIRTTNPVATEQYGSFVIEAYNEMVQVLQDEQADV

SEQ ID NO: 172286 - protein, 35 aa, Artificial Sequence
  Description of Artificial Sequence: Synthetic polypeptide
QEEEIRTTNPVATEGYGSVIVTMQGEGGGQGEQGQ

SEQ ID NO: 172287 - protein, 36 aa, Artificial Sequence
  Description of Artificial Sequence: Synthetic polypeptide
QEEEIRTTNPVATEGYGSVIDTMTGEGGGQGEQGGQ

SEQ ID NO: 172288 - protein, 37 aa, Artificial Sequence
  Description of Artificial Sequence: Synthetic polypeptide
DEEEIKTTNPVATEQYGDVVDNDNNEQIQGGQNGGTG

SEQ ID NO: 172289 - protein, 38 aa, Artificial Sequence
  Description of Artificial Sequence: Synthetic polypeptide
DEEEIRTTNPVATEQYGYASVINNSKENWDSEQSTTSI

SEQ ID NO: 172290 - protein, 39 aa, Artificial Sequence
  Description of Artificial Sequence: Synthetic polypeptide
DEEEIRTTNPVATEQYGSFVCSPEVNTHDIPQQNEQNNI

SEQ ID NO: 172291 - protein, 36 aa, Artificial Sequence
  Description of Artificial Sequence: Synthetic polypeptide
DEGEIATTNPVATECYGSVCAAVANLADMPPGEARN

SEQ ID NO: 172292 - protein, 34 aa, Artificial Sequence
  Description of Artificial Sequence: Synthetic polypeptide
KEAEIATTNPVAYCAYGQTVPSCNLSQKGTTNQI

SEQ ID NO: 172293 - protein, 39 aa, Artificial Sequence
  Description of Artificial Sequence: Synthetic polypeptide
DEEEIRTTNPVATEQYGSFTTNSTFLNMCELEQAVVTTQ

SEQ ID NO: 172294 - protein, 31 aa, Artificial Sequence
  Description of Artificial Sequence: Synthetic polypeptide
DENEIACTNPVSTEPYGTASEEDIQQQQGGH

SEQ ID NO: 172295 - protein, 32 aa, Artificial Sequence
  Description of Artificial Sequence: Synthetic polypeptide
NELEIRTTNPVAYEAWGCVVWTGESGTEGSRN

SEQ ID NO: 172296 - protein, 36 aa, Artificial Sequence
  Description of Artificial Sequence: Synthetic polypeptide
DEEEIATTNPVATEQYGSVCAANMGEEAPDQGMESH

SEQ ID NO: 172297 - protein, 30 aa, Artificial Sequence
  Description of Artificial Sequence: Synthetic polypeptide
QESEIASTNPVGTEAYGEMASYLQLHNGDI

SEQ ID NO: 172298 - protein, 33 aa, Artificial Sequence
  Description of Artificial Sequence: Synthetic polypeptide
DCEEISTTNPVAYEQWGSVCVNWEHGDQDMHQP

SEQ ID NO: 172299 - protein, 37 aa, Artificial Sequence
  Description of Artificial Sequence: Synthetic polypeptide
QEEEIRTTNPVATECYGSVMNNGGNALDEREGGDQQE

SEQ ID NO: 172300 - protein, 37 aa, Artificial Sequence
  Description of Artificial Sequence: Synthetic polypeptide
DEEEIRTTNPVATEQYGSYNWEYNPDDLGGSGQEEAG

SEQ ID NO: 172301 - protein, 36 aa, Artificial Sequence
  Description of Artificial Sequence: Synthetic polypeptide
DEEEIATTNPVATEQYGCVAQNPHGSNPMAMTGNDE

SEQ ID NO: 172302 - protein, 33 aa, Artificial Sequence
  Description of Artificial Sequence: Synthetic polypeptide
QEDEIACTNPVAYEQWGESYSIENDQDRGQGES

SEQ ID NO: 172303 - protein, 35 aa, Artificial Sequence
  Description of Artificial Sequence: Synthetic polypeptide
DEEEIATTNPVATEQYGCVAANPGGVPAMLHEEHD

SEQ ID NO: 172304 - protein, 38 aa, Artificial Sequence
  Description of Artificial Sequence: Synthetic polypeptide
DEEEIRTTNPVATEQYGVHVGGPSNYNQQSLENNVDQL

SEQ ID NO: 172305 - protein, 36 aa, Artificial Sequence
  Description of Artificial Sequence: Synthetic polypeptide
DEEEIATTNPVAYEQWGSVYSDNGPNDPNNPGGERP

SEQ ID NO: 172306 - protein, 37 aa, Artificial Sequence
  Description of Artificial Sequence: Synthetic polypeptide
DEEEIATTNPVATEQYGSVCAANMGEEAPDNQMEGGD

SEQ ID NO: 172307 - protein, 38 aa, Artificial Sequence
  Description of Artificial Sequence: Synthetic polypeptide
QEEEIRTTNPVATEAYGSVSVTGQNQGDEEGGQGNEED

SEQ ID NO: 172308 - protein, 36 aa, Artificial Sequence
  Description of Artificial Sequence: Synthetic polypeptide
CEGEIATTNPVAYEQYGSVCSTNPAQQEHQDGTGMK

SEQ ID NO: 172309 - protein, 35 aa, Artificial Sequence
  Description of Artificial Sequence: Synthetic polypeptide
DAEEIATTNPVATEYWGTVVSENNATSATTGGNTR

SEQ ID NO: 172310 - protein, 35 aa, Artificial Sequence
  Description of Artificial Sequence: Synthetic polypeptide
DEAEIATTNPVAYEEWGVVCSTDNGNERDGQDAER

SEQ ID NO: 172311 - protein, 38 aa, Artificial Sequence
  Description of Artificial Sequence: Synthetic polypeptide
DEEEIRTTNPVATEQYGVIVSDGENTVVGNFEGQNEGG

SEQ ID NO: 172312 - protein, 37 aa, Artificial Sequence
  Description of Artificial Sequence: Synthetic polypeptide
DEEEIATTNPVATEQYGCVAATAGQSTQPDDGAGERD

SEQ ID NO: 172313 - protein, 37 aa, Artificial Sequence
  Description of Artificial Sequence: Synthetic polypeptide
DEEEIRTTNPVATEQYGVIVSDLENIVNGFEGQGEGI

SEQ ID NO: 172314 - protein, 35 aa, Artificial Sequence
  Description of Artificial Sequence: Synthetic polypeptide
DAGEIATTNPVAYEQWGSVCTENDLDDLGGGMDRM

SEQ ID NO: 172315 - protein, 36 aa, Artificial Sequence
  Description of Artificial Sequence: Synthetic polypeptide
NEMEIRTTNPVATEQYGSVCCPTAFLEVLTDPGQQD

SEQ ID NO: 172316 - protein, 38 aa, Artificial Sequence
  Description of Artificial Sequence: Synthetic polypeptide
DEEEIRTTNPVATEQYGSVDQVMTGNGGDEDEEEDGQN

SEQ ID NO: 172317 - protein, 35 aa, Artificial Sequence
  Description of Artificial Sequence: Synthetic polypeptide
DEEEIATTNPVAYEQWGSVYHPINDHPQKTKGKEV

SEQ ID NO: 172318 - protein, 37 aa, Artificial Sequence
  Description of Artificial Sequence: Synthetic polypeptide
DEEEIACTNPVATEQYGSVCAAANPQQQEHQDGNQHQ

SEQ ID NO: 172319 - protein, 37 aa, Artificial Sequence
  Description of Artificial Sequence: Synthetic polypeptide
DEEEIRTTNPVATEQYGSFVNCWANADIESHGPEFET

SEQ ID NO: 172320 - protein, 35 aa, Artificial Sequence
  Description of Artificial Sequence: Synthetic polypeptide
DEHEIRTTNPCAYECWGSVATPNGNQQLEGGHGSR

SEQ ID NO: 172321 - protein, 37 aa, Artificial Sequence
  Description of Artificial Sequence: Synthetic polypeptide
DEEEIATTNPVATEQYGSVCAMNNGVLPEDMLENDNQ

SEQ ID NO: 172322 - protein, 35 aa, Artificial Sequence
  Description of Artificial Sequence: Synthetic polypeptide
DEHEIRTTNPCAYEEWGSVAMNLNDHSGGRGENGA

SEQ ID NO: 172323 - protein, 35 aa, Artificial Sequence
  Description of Artificial Sequence: Synthetic polypeptide
METEIRTTNPVATEFYGSVYGENDQGGDGEEGQGE

SEQ ID NO: 172324 - protein, 35 aa, Artificial Sequence
  Description of Artificial Sequence: Synthetic polypeptide
DEHEIRTTNPCAYEEWGSVAMTLNDHSGGRGGNAY

SEQ ID NO: 172325 - protein, 37 aa, Artificial Sequence
  Description of Artificial Sequence: Synthetic polypeptide
DEMEIRTTNPVATEQYGCVCSWEEDHNAENFGSQNQS

SEQ ID NO: 172326 - protein, 39 aa, Artificial Sequence
  Description of Artificial Sequence: Synthetic polypeptide
DEEEIRTTNPVATEQYGVVSTVNAEQGNNNEQEGTEDTT

SEQ ID NO: 172327 - protein, 35 aa, Artificial Sequence
  Description of Artificial Sequence: Synthetic polypeptide
DEGSIATTNPVATEQYGSSFSAPDTLYPHEGEDTR

SEQ ID NO: 172328 - protein, 37 aa, Artificial Sequence
  Description of Artificial Sequence: Synthetic polypeptide
DEEEIKTTNPVAYETYGISLVACTQNFSQTRSTENVD

SEQ ID NO: 172329 - protein, 38 aa, Artificial Sequence
  Description of Artificial Sequence: Synthetic polypeptide
DEEEIRTTNPVATEQYGSVPPENTNIYDEERILLTDVF

SEQ ID NO: 172330 - protein, 36 aa, Artificial Sequence
  Description of Artificial Sequence: Synthetic polypeptide
DEEEIRTTNPVATEQYGVGCVFPSPVHMPNVDMFEG

SEQ ID NO: 172331 - protein, 36 aa, Artificial Sequence
  Description of Artificial Sequence: Synthetic polypeptide
DEAEIATTNPVATEQYGSVPMIINDQDQQGQQDSQE

SEQ ID NO: 172332 - protein, 37 aa, Artificial Sequence
  Description of Artificial Sequence: Synthetic polypeptide
DEEEIRTTNPVATEQYGSVPPFTPTMNADDTVILPSE

SEQ ID NO: 172333 - protein, 36 aa, Artificial Sequence
  Description of Artificial Sequence: Synthetic polypeptide
DEEEIATTNPVATEQYGSACSANDASIGDDGMGDQH

SEQ ID NO: 172334 - protein, 37 aa, Artificial Sequence
  Description of Artificial Sequence: Synthetic polypeptide
DEEEIRTTNPVATEQYGSVAPPVPTAGQVQDHVVPPY

SEQ ID NO: 172335 - protein, 37 aa, Artificial Sequence
  Description of Artificial Sequence: Synthetic polypeptide
DEEEIRTTNPVATEQYGSVDQPIVYLWQPEMMEAEEN

SEQ ID NO: 172336 - protein, 36 aa, Artificial Sequence
  Description of Artificial Sequence: Synthetic polypeptide
QEGEIRTTNPVATEQYGSVYPDSNDDTQDEEGSEMP

SEQ ID NO: 172337 - protein, 35 aa, Artificial Sequence
  Description of Artificial Sequence: Synthetic polypeptide
DEHEIRTTNPCAYEEWGSVAWTWNDDQGDRQGGMD

SEQ ID NO: 172338 - protein, 38 aa, Artificial Sequence
  Description of Artificial Sequence: Synthetic polypeptide
DEEEIRTTNPVATEQYGSLAIYLPNTQNQVRENVEDGA

SEQ ID NO: 172339 - protein, 38 aa, Artificial Sequence
  Description of Artificial Sequence: Synthetic polypeptide
AEEEIRTTNPVATEQYGVVVVSVTTNNNNQEQGEETED

SEQ ID NO: 172340 - protein, 34 aa, Artificial Sequence
  Description of Artificial Sequence: Synthetic polypeptide
IESEIRTTNPVATEQYGAASDVQDLNNEDSQEHP

SEQ ID NO: 172341 - protein, 35 aa, Artificial Sequence
  Description of Artificial Sequence: Synthetic polypeptide
CTGEIRTTNPVATEAYGSVDQNLSNGQEEGQGGGI

SEQ ID NO: 172342 - protein, 32 aa, Artificial Sequence
  Description of Artificial Sequence: Synthetic polypeptide
QEMEIASTNPVATEQYGTMCAASDGPVEFGND

SEQ ID NO: 172343 - protein, 33 aa, Artificial Sequence
  Description of Artificial Sequence: Synthetic polypeptide
QEDEIRGTNPVATEGWGSVSGGMEGQGGEGEQG

SEQ ID NO: 172344 - protein, 36 aa, Artificial Sequence
  Description of Artificial Sequence: Synthetic polypeptide
DEEEIATTNPVATEQYGSVCAANMGEEAPDNGMEAN

SEQ ID NO: 172345 - protein, 37 aa, Artificial Sequence
  Description of Artificial Sequence: Synthetic polypeptide
DEEEIATTNPVATEQYGSVCAMNNGVLPMEDLENANQ

SEQ ID NO: 172346 - protein, 37 aa, Artificial Sequence
  Description of Artificial Sequence: Synthetic polypeptide
DEEEIRTTNPVATEQYGSVIGPVNNLIHMPVLEIEDT

SEQ ID NO: 172347 - protein, 36 aa, Artificial Sequence
  Description of Artificial Sequence: Synthetic polypeptide
DEEEIRTTNPVATEQYGVIYVHPSPVHMPNVDMFEG

SEQ ID NO: 172348 - protein, 37 aa, Artificial Sequence
  Description of Artificial Sequence: Synthetic polypeptide
DEEEIRTTNPVATEQYGSFVLSHMIIDGVGGMQEEEQ

SEQ ID NO: 172349 - protein, 38 aa, Artificial Sequence
  Description of Artificial Sequence: Synthetic polypeptide
DEEEIRTTNPVATEQYGVVSTVAQAGTEAGGTTTQDED

SEQ ID NO: 172350 - protein, 33 aa, Artificial Sequence
  Description of Artificial Sequence: Synthetic polypeptide
NEGEIRTTNPVATGHYGSVPDVIENVTEGTFDM

SEQ ID NO: 172351 - protein, 34 aa, Artificial Sequence
  Description of Artificial Sequence: Synthetic polypeptide
NEAEIQCTNPVAYEQYGSTVQPCAHEQFRGGNNV

SEQ ID NO: 172352 - protein, 34 aa, Artificial Sequence
  Description of Artificial Sequence: Synthetic polypeptide
NEGEIRTTNPVATGHYGSVPDVLENLTEGTDDMI

SEQ ID NO: 172353 - protein, 38 aa, Artificial Sequence
  Description of Artificial Sequence: Synthetic polypeptide
DEEEIRTTNPVATEQYGVVSTTVVVNNNNDEQGTEEQD

SEQ ID NO: 172354 - protein, 35 aa, Artificial Sequence
  Description of Artificial Sequence: Synthetic polypeptide
DEAEIATTNPVAYEKWGVVCSTDNGQQERDGDIKQ

SEQ ID NO: 172355 - protein, 37 aa, Artificial Sequence
  Description of Artificial Sequence: Synthetic polypeptide
DEEEIRTTNPVATEQYGSYPPESENSVTEIEIMGIDS

SEQ ID NO: 172356 - protein, 41 aa, Artificial Sequence
  Description of Artificial Sequence: Synthetic polypeptide
DEEEIRTTNPVATEQYGVVSTVNLQSGNNNLNQGTNTNTDD

SEQ ID NO: 172357 - protein, 33 aa, Artificial Sequence
  Description of Artificial Sequence: Synthetic polypeptide
DEGEIRTTNPVSTEPWGTCSGMEDRQQQQNGNH

SEQ ID NO: 172358 - protein, 36 aa, Artificial Sequence
  Description of Artificial Sequence: Synthetic polypeptide
CENEIKTTNPVATETYGSVSPGFNSLIQEVGDTVPA

SEQ ID NO: 172359 - protein, 37 aa, Artificial Sequence
  Description of Artificial Sequence: Synthetic polypeptide
DEEEIATTNPVATEQYGCVAIIHHANDQIDENANMRH

SEQ ID NO: 172360 - protein, 34 aa, Artificial Sequence
  Description of Artificial Sequence: Synthetic polypeptide
DEAEIATTNPVAYEKWGVVCSTDNGDERDGDIKS

SEQ ID NO: 172361 - protein, 35 aa, Artificial Sequence
  Description of Artificial Sequence: Synthetic polypeptide
IESEIRTTNPVATEQYGAAWSDVQDLNNQDEQEHN

SEQ ID NO: 172362 - protein, 37 aa, Artificial Sequence
  Description of Artificial Sequence: Synthetic polypeptide
DEEEIRTTNPVATEQYGSVVYDGMFGQEGEQEEDGDF

SEQ ID NO: 172363 - protein, 37 aa, Artificial Sequence
  Description of Artificial Sequence: Synthetic polypeptide
DAEEIATTNPVATEQYGSVCAMANHADDSKAPGENRN

SEQ ID NO: 172364 - protein, 37 aa, Artificial Sequence
  Description of Artificial Sequence: Synthetic polypeptide
DEEEIRTTNPVATEQYGSVAICAVFGEPVQLEMENAF

SEQ ID NO: 172365 - protein, 35 aa, Artificial Sequence
  Description of Artificial Sequence: Synthetic polypeptide
CTGEIRTTNPVATEQYGSVNNDNNGQTLNGEMGQG

SEQ ID NO: 172366 - protein, 36 aa, Artificial Sequence
  Description of Artificial Sequence: Synthetic polypeptide
DEEEIRTTNPVATEQYGSVPPMVQLEAADPMLEESI

SEQ ID NO: 172367 - protein, 35 aa, Artificial Sequence
  Description of Artificial Sequence: Synthetic polypeptide
NEAEIQCTNPVAYEQYGKVVQSCQNEQEDRGGNNV

SEQ ID NO: 172368 - protein, 38 aa, Artificial Sequence
  Description of Artificial Sequence: Synthetic polypeptide
DEEEIRTTNPVATEQYGSVCSNTSEVETDTQENVEEEF

SEQ ID NO: 172369 - protein, 33 aa, Artificial Sequence
  Description of Artificial Sequence: Synthetic polypeptide
DEECISTVNPVATEGYGCVCSWEEHENFGSNQS

SEQ ID NO: 172370 - protein, 34 aa, Artificial Sequence
  Description of Artificial Sequence: Synthetic polypeptide
DEECISTVNPVATEGYGCVCSTWNHNENFGSEQS

SEQ ID NO: 172371 - protein, 32 aa, Artificial Sequence
  Description of Artificial Sequence: Synthetic polypeptide
QEMEIACTNPCSYEQYGCVCSMWNLQSGSEQS

SEQ ID NO: 172372 - protein, 41 aa, Artificial Sequence
  Description of Artificial Sequence: Synthetic polypeptide
DEEEIRTTNPVATEQYGVVSTVNLQYGNNLNEQGTNNATDD

SEQ ID NO: 172373 - protein, 37 aa, Artificial Sequence
  Description of Artificial Sequence: Synthetic polypeptide
DDEEIRTTNPVATEAYGAVVDGTNMQEDQEGQQNDDE

SEQ ID NO: 172374 - protein, 36 aa, Artificial Sequence
  Description of Artificial Sequence: Synthetic polypeptide
DEEEIRTTNPVATEQYGVLGYLMNGEEQMIMNEEEL

SEQ ID NO: 172375 - protein, 35 aa, Artificial Sequence
  Description of Artificial Sequence: Synthetic polypeptide
METEIRTTNPVAFEQYGSVIDGNNNGQERNQEEGT

SEQ ID NO: 172376 - protein, 35 aa, Artificial Sequence
  Description of Artificial Sequence: Synthetic polypeptide
IESEIRTTNPVATEQYGAASDVQDLNNQDSQEDPN

SEQ ID NO: 172377 - protein, 38 aa, Artificial Sequence
  Description of Artificial Sequence: Synthetic polypeptide
DEEEIATTNPVATEQYGSVSATTPAHITNQGNGMEPVN

SEQ ID NO: 172378 - protein, 37 aa, Artificial Sequence
  Description of Artificial Sequence: Synthetic polypeptide
DEEEIRTTNPVATEQYGVNVQPITPMMPLDQQEEQVT

SEQ ID NO: 172379 - protein, 41 aa, Artificial Sequence
  Description of Artificial Sequence: Synthetic polypeptide
DEEEIRTTNPVATEQYGVVSTVNLQSGNNSDEQGTNNNTDD

SEQ ID NO: 172380 - protein, 35 aa, Artificial Sequence
  Description of Artificial Sequence: Synthetic polypeptide
METEIRTTNPVAFEQYGSVIDGNNNGLERNQFEGD

SEQ ID NO: 172381 - protein, 35 aa, Artificial Sequence
  Description of Artificial Sequence: Synthetic polypeptide
DEAEIATTNPVAYEGWGSVCSGTDGQDRDGGGQEQ

SEQ ID NO: 172382 - protein, 37 aa, Artificial Sequence
  Description of Artificial Sequence: Synthetic polypeptide
DEEEIRTTNPVATEQYGVNVSSVTIVGNSAIEIEEED

SEQ ID NO: 172383 - protein, 36 aa, Artificial Sequence
  Description of Artificial Sequence: Synthetic polypeptide
DEMEIRTTNPVATCQYGCVCNTTGEHNQNFGSDNQS

SEQ ID NO: 172384 - protein, 37 aa, Artificial Sequence
  Description of Artificial Sequence: Synthetic polypeptide
DEEEIRTTNPVATEQYGVQVFPSPVHMPNFVDMNFEG

SEQ ID NO: 172385 - protein, 37 aa, Artificial Sequence
  Description of Artificial Sequence: Synthetic polypeptide
DEEEIRTTNPVATEQYGVSCPPADNDEIVLIQQVEQT

SEQ ID NO: 172386 - protein, 38 aa, Artificial Sequence
  Description of Artificial Sequence: Synthetic polypeptide
DEEEIRTTNPVATEQYGVSGNSGMGQGNQEAEIAGNDD

SEQ ID NO: 172387 - protein, 35 aa, Artificial Sequence
  Description of Artificial Sequence: Synthetic polypeptide
IESEIRTTNPVATEQYGAASDVQDLNNQSHSQEHF

SEQ ID NO: 172388 - protein, 33 aa, Artificial Sequence
  Description of Artificial Sequence: Synthetic polypeptide
DEECISTVNPVATEGYGCVCSWEDNANFGSEQS

SEQ ID NO: 172389 - protein, 35 aa, Artificial Sequence
  Description of Artificial Sequence: Synthetic polypeptide
DEHEIRTTNPCATECWGCVCTIDGGDRQGQGGNNR

SEQ ID NO: 172390 - protein, 37 aa, Artificial Sequence
  Description of Artificial Sequence: Synthetic polypeptide
DEHEIRTTNPVAYEPWGSVYCSETQDDQNQRLNEGND

SEQ ID NO: 172391 - protein, 30 aa, Artificial Sequence
  Description of Artificial Sequence: Synthetic polypeptide
DEAEIATTNPVAYEPVWGCIAGNGLAAPGE

SEQ ID NO: 172392 - protein, 36 aa, Artificial Sequence
  Description of Artificial Sequence: Synthetic polypeptide
DEEEIATTNPVATEQYGSVCAANMGEEAPDAGMGGM

SEQ ID NO: 172393 - protein, 37 aa, Artificial Sequence
  Description of Artificial Sequence: Synthetic polypeptide
DEEEIRTTNPVATEQYGSNCQPITPMMPLDQMIEQVT

SEQ ID NO: 172394 - protein, 38 aa, Artificial Sequence
  Description of Artificial Sequence: Synthetic polypeptide
DEEEIRTTNPVATEQYGSVADQNMNQHVETENGPPHED

SEQ ID NO: 172395 - protein, 35 aa, Artificial Sequence
  Description of Artificial Sequence: Synthetic polypeptide
DENEIRGTNPVATEQYGSVMTDTIMGGQEDDDIFG

SEQ ID NO: 172396 - protein, 34 aa, Artificial Sequence
  Description of Artificial Sequence: Synthetic polypeptide
DEGEIATTNPVATAQWGGCCAITNALTQDGDPDM

SEQ ID NO: 172397 - protein, 34 aa, Artificial Sequence
  Description of Artificial Sequence: Synthetic polypeptide
DEAEIRTTNPCAYEQWGSVCYNIEEVRDGIQDDS

SEQ ID NO: 172398 - protein, 35 aa, Artificial Sequence
  Description of Artificial Sequence: Synthetic polypeptide
DEHEIATTNPVAYERWGSVSGGNADDERNNGNGNM

SEQ ID NO: 172399 - protein, 37 aa, Artificial Sequence
  Description of Artificial Sequence: Synthetic polypeptide
DEEEIRTTNPVATEQYGVYGLDSNFEMGQEGGENFEQ

SEQ ID NO: 172400 - protein, 34 aa, Artificial Sequence
  Description of Artificial Sequence: Synthetic polypeptide
DEMEIRTTNPVATCGYGCVCSWGEHNENFGSDQS

SEQ ID NO: 172401 - protein, 37 aa, Artificial Sequence
  Description of Artificial Sequence: Synthetic polypeptide
DEEEIATTNPVATEQYGSVCAMNNGNLEPGADIPEGA

SEQ ID NO: 172402 - protein, 36 aa, Artificial Sequence
  Description of Artificial Sequence: Synthetic polypeptide
QECEICTTNPVATEAYGVVSTVNQQLEQQGTTDEQE

SEQ ID NO: 172403 - protein, 39 aa, Artificial Sequence
  Description of Artificial Sequence: Synthetic polypeptide
DEEEIRTTNPVATEQYGVVYTQGTDQLIDQEGEGGNQGQ

SEQ ID NO: 172404 - protein, 36 aa, Artificial Sequence
  Description of Artificial Sequence: Synthetic polypeptide
DEEEIACTNPVATEQYGSVCAANNGEEAGDNMENNH

SEQ ID NO: 172405 - protein, 36 aa, Artificial Sequence
  Description of Artificial Sequence: Synthetic polypeptide
DENEIATTNPCATEQYGTVCSCTGGEWSENMNGGND

SEQ ID NO: 172406 - protein, 32 aa, Artificial Sequence
  Description of Artificial Sequence: Synthetic polypeptide
QEGEIAPTNPCSYEQWGIVSKNLEQPSKGDTR

SEQ ID NO: 172407 - protein, 36 aa, Artificial Sequence
  Description of Artificial Sequence: Synthetic polypeptide
DDAEIRTTNPVATEQYGCVCSTEDPNQESFGSDTQA

SEQ ID NO: 172408 - protein, 33 aa, Artificial Sequence
  Description of Artificial Sequence: Synthetic polypeptide
DAAEIATTNPVATEQWGGCCTAATHLQQGGGEH

SEQ ID NO: 172409 - protein, 36 aa, Artificial Sequence
  Description of Artificial Sequence: Synthetic polypeptide
DEAEIATTNPVAYEQWGEVVPTDNLDDQANNGGVNG

SEQ ID NO: 172410 - protein, 39 aa, Artificial Sequence
  Description of Artificial Sequence: Synthetic polypeptide
DEEEIRTTNPVATEQYGSYAISPTATNLHVIVSSQNEAF

SEQ ID NO: 172411 - protein, 35 aa, Artificial Sequence
  Description of Artificial Sequence: Synthetic polypeptide
DEAEIATTNPVAYEQWGEVVPTDNLDDQANNGASG

SEQ ID NO: 172412 - protein, 37 aa, Artificial Sequence
  Description of Artificial Sequence: Synthetic polypeptide
QECEICTTNPVATEAYGVVSTVNQQLLQQGTEDENEG

SEQ ID NO: 172413 - protein, 37 aa, Artificial Sequence
  Description of Artificial Sequence: Synthetic polypeptide
DEEEIATTNPVATEQYGSVCAMNNGNLEPPADQPNAM

SEQ ID NO: 172414 - protein, 33 aa, Artificial Sequence
  Description of Artificial Sequence: Synthetic polypeptide
DAEEIATTNPVAYEPWGSVCTGTGNDGNPTEGM

SEQ ID NO: 172415 - protein, 36 aa, Artificial Sequence
  Description of Artificial Sequence: Synthetic polypeptide
QECEICTTNPVATEAYGVVSTVNLQLQQGTEDETED

SEQ ID NO: 172416 - protein, 36 aa, Artificial Sequence
  Description of Artificial Sequence: Synthetic polypeptide
QECEICTTNPVATEAYGVVSTVNLQLEQQGTEEQEE

SEQ ID NO: 172417 - protein, 36 aa, Artificial Sequence
  Description of Artificial Sequence: Synthetic polypeptide
DEEEIACTNPVATEQWGSVAITNPPEPSGDQMGSDP

SEQ ID NO: 172418 - protein, 36 aa, Artificial Sequence
  Description of Artificial Sequence: Synthetic polypeptide
DEEEIACTNPVATEQWGSVAITNAPEQNGDQMGSDA

SEQ ID NO: 172419 - protein, 33 aa, Artificial Sequence
  Description of Artificial Sequence: Synthetic polypeptide
DENEIRCTNPVATEQWGATSNEEDLAEPKGGYI

SEQ ID NO: 172420 - protein, 32 aa, Artificial Sequence
  Description of Artificial Sequence: Synthetic polypeptide
DEGEIATTNPISTECYGAVWANCNLAPKGTYI

SEQ ID NO: 172421 - protein, 34 aa, Artificial Sequence
  Description of Artificial Sequence: Synthetic polypeptide
DAAEIATTNPVATEQWGSVSGQGPPQEAADGQHE

SEQ ID NO: 172422 - protein, 33 aa, Artificial Sequence
  Description of Artificial Sequence: Synthetic polypeptide
QEEEIACTNPVATEQYGCAPMSHGTDSEGENKM

SEQ ID NO: 172423 - protein, 36 aa, Artificial Sequence
  Description of Artificial Sequence: Synthetic polypeptide
DEMEIRTTNPVATEQYGSVSNALELTDTFDPEEKSI

SEQ ID NO: 172424 - protein, 35 aa, Artificial Sequence
  Description of Artificial Sequence: Synthetic polypeptide
QEEEIRTTNPVATEFYGVVVQTLGEFEGQGQGEQA

SEQ ID NO: 172425 - protein, 36 aa, Artificial Sequence
  Description of Artificial Sequence: Synthetic polypeptide
DEMEIRTTNPVATEQYGVCHTWADHNGEDRDNLIED

SEQ ID NO: 172426 - protein, 37 aa, Artificial Sequence
  Description of Artificial Sequence: Synthetic polypeptide
DEEEIATTNPVATEQYGSVCAANNGEEAGDEMENNNH

SEQ ID NO: 172427 - protein, 33 aa, Artificial Sequence
  Description of Artificial Sequence: Synthetic polypeptide
QEFEIATTNPVAYECYGKVSYESSLSQHEVGEL

SEQ ID NO: 172428 - protein, 37 aa, Artificial Sequence
  Description of Artificial Sequence: Synthetic polypeptide
DEEEIRTTNPVATEQYGSYTISSEVESTPVPVSFPLI

SEQ ID NO: 172429 - protein, 36 aa, Artificial Sequence
  Description of Artificial Sequence: Synthetic polypeptide
DEGEIRTTNPVAYEQWGSVSGGEPAGPNMQNGGGPV

SEQ ID NO: 172430 - protein, 32 aa, Artificial Sequence
  Description of Artificial Sequence: Synthetic polypeptide
QEEEIACTNPVATEQYGCAPIHHGQDSEGEKM

SEQ ID NO: 172431 - protein, 39 aa, Artificial Sequence
  Description of Artificial Sequence: Synthetic polypeptide
DEEEIRTTNPVATEQYGTSVQLTESTAVEPNMLLVEVAY

SEQ ID NO: 172432 - protein, 33 aa, Artificial Sequence
  Description of Artificial Sequence: Synthetic polypeptide
QEEEIACTNPVATEQYGCAPIGHGQDSEGENNH

SEQ ID NO: 172433 - protein, 39 aa, Artificial Sequence
  Description of Artificial Sequence: Synthetic polypeptide
DEEEIRTTNPVATEQYGVVYTQGNDQTIDQEGEGGNQGE

SEQ ID NO: 172434 - protein, 38 aa, Artificial Sequence
  Description of Artificial Sequence: Synthetic polypeptide
DEEEIRTTNPVATEQYGSVADQNMNTHSETENQPPHED

SEQ ID NO: 172435 - protein, 37 aa, Artificial Sequence
  Description of Artificial Sequence: Synthetic polypeptide
DEEEIATTNPVATEQYGSVCAMNNGNLEPDADIPNDM

SEQ ID NO: 172436 - protein, 31 aa, Artificial Sequence
  Description of Artificial Sequence: Synthetic polypeptide
CEGEIATTNPVAYEPYGKVSCMHSSQHETEL

SEQ ID NO: 172437 - protein, 39 aa, Artificial Sequence
  Description of Artificial Sequence: Synthetic polypeptide
DEEEIRTTNPVATEQYGSYVQLTESTAVEPNMLLVEVAG

SEQ ID NO: 172438 - protein, 39 aa, Artificial Sequence
  Description of Artificial Sequence: Synthetic polypeptide
DEEEIRTTNPVATEQYGVVSTVVSNGTQAGTTEQGSTVQ

SEQ ID NO: 172439 - protein, 34 aa, Artificial Sequence
  Description of Artificial Sequence: Synthetic polypeptide
NEREIRTTNPVATEQYGCVCGWMEDNQGFGSDQS

SEQ ID NO: 172440 - protein, 33 aa, Artificial Sequence
  Description of Artificial Sequence: Synthetic polypeptide
DEGEIRTTNPVAYEQWGYCQEDLRNREMDNQGK

SEQ ID NO: 172441 - protein, 39 aa, Artificial Sequence
  Description of Artificial Sequence: Synthetic polypeptide
DEEEIRTTNPVATEQYGSYVPPPAVPNSLEVREMLENIS

SEQ ID NO: 172442 - protein, 36 aa, Artificial Sequence
  Description of Artificial Sequence: Synthetic polypeptide
MESEIRTTNPVATEQYGSVNWPTGGENQFDNNQEKG

SEQ ID NO: 172443 - protein, 36 aa, Artificial Sequence
  Description of Artificial Sequence: Synthetic polypeptide
DEEEIRTTNPVATEQYGSVPMPLWLEEVPMVPLEFG

SEQ ID NO: 172444 - protein, 33 aa, Artificial Sequence
  Description of Artificial Sequence: Synthetic polypeptide
DEAEIATTNPVAYEQWGCVCPNNDEMDAGDNEP

SEQ ID NO: 172445 - protein, 36 aa, Artificial Sequence
  Description of Artificial Sequence: Synthetic polypeptide
LENEIRTTNPVATEQYGTVTTVWLPDEGENLQIDEI

SEQ ID NO: 172446 - protein, 39 aa, Artificial Sequence
  Description of Artificial Sequence: Synthetic polypeptide
DEEEIRTTNPVATEQYGSNIVTWSVNDEEQNNETEINNW

SEQ ID NO: 172447 - protein, 36 aa, Artificial Sequence
  Description of Artificial Sequence: Synthetic polypeptide
QECEICTTNPVATEAYGVVSTVNQQLQQGTEDEQEQ

SEQ ID NO: 172448 - protein, 36 aa, Artificial Sequence
  Description of Artificial Sequence: Synthetic polypeptide
QECEICTTNPVATEAYGVVSTVNQQLQQGTEDTTEG

SEQ ID NO: 172449 - protein, 35 aa, Artificial Sequence
  Description of Artificial Sequence: Synthetic polypeptide
NEREIRTTNPVATEQYGCVCQNWNDNQYFGSDTQA

SEQ ID NO: 172450 - protein, 33 aa, Artificial Sequence
  Description of Artificial Sequence: Synthetic polypeptide
QEMEIVSTNPVATEQYGTVCAASDGPVEFEGND

SEQ ID NO: 172451 - protein, 39 aa, Artificial Sequence
  Description of Artificial Sequence: Synthetic polypeptide
DEEEIRTTNPVATEQYGSNIVTWSVNDEEQNAEPESNFV

SEQ ID NO: 172452 - protein, 36 aa, Artificial Sequence
  Description of Artificial Sequence: Synthetic polypeptide
DEMEIRTTNPVATEQYGSYYSPWDVIHNQESIENPQ

SEQ ID NO: 172453 - protein, 36 aa, Artificial Sequence
  Description of Artificial Sequence: Synthetic polypeptide
DEMEIRTTNPVATEQYGCMCVFASPENESWTQDPEQ

SEQ ID NO: 172454 - protein, 38 aa, Artificial Sequence
  Description of Artificial Sequence: Synthetic polypeptide
DEEEIRTTNPVATEQYGSIVSHVSQPDDDASNEYDEED

SEQ ID NO: 172455 - protein, 37 aa, Artificial Sequence
  Description of Artificial Sequence: Synthetic polypeptide
NEEEIRTTNPVAYEQWGSVSGGEPGNGGNMRNLMGNM

SEQ ID NO: 172456 - protein, 39 aa, Artificial Sequence
  Description of Artificial Sequence: Synthetic polypeptide
DEEEIRTTNPVATEQYGSYAISPTATPLVVVSPGQNEDF

SEQ ID NO: 172457 - protein, 36 aa, Artificial Sequence
  Description of Artificial Sequence: Synthetic polypeptide
DENEIATTNPVATEQYGSVCAANNGDENGMDINLNN

SEQ ID NO: 172458 - protein, 35 aa, Artificial Sequence
  Description of Artificial Sequence: Synthetic polypeptide
DEMEIATTNPVATEQYGTVCSNWGEPNEYFGSDQA

SEQ ID NO: 172459 - protein, 35 aa, Artificial Sequence
  Description of Artificial Sequence: Synthetic polypeptide
NEREIRTTNPVATEQYGCVCGWMNDNQENFGSDQS

SEQ ID NO: 172460 - protein, 36 aa, Artificial Sequence
  Description of Artificial Sequence: Synthetic polypeptide
DEEEIACTNPVATEQWGSVAITNPPEQPGDQMGSDE

SEQ ID NO: 172461 - protein, 37 aa, Artificial Sequence
  Description of Artificial Sequence: Synthetic polypeptide
MESEIRTTNPVATEQYGSVISPDTYLNQPEMVQDKVF

SEQ ID NO: 172462 - protein, 32 aa, Artificial Sequence
  Description of Artificial Sequence: Synthetic polypeptide
CEGEIATTNPVAYEPYGKVSIEGHLSQHETEG

SEQ ID NO: 172463 - protein, 38 aa, Artificial Sequence
  Description of Artificial Sequence: Synthetic polypeptide
DEEEIRTTNPVATEQYGTVYHAMPNLHDQITQNEQATQ

SEQ ID NO: 172464 - protein, 30 aa, Artificial Sequence
  Description of Artificial Sequence: Synthetic polypeptide
QEHEIAPTNPCSYEQWGIVFCVNDQSGDTR

SEQ ID NO: 172465 - protein, 33 aa, Artificial Sequence
  Description of Artificial Sequence: Synthetic polypeptide
QEMEIVTTNPVATEQYGTACSATDGCVEFEGED

SEQ ID NO: 172466 - protein, 36 aa, Artificial Sequence
  Description of Artificial Sequence: Synthetic polypeptide
DDAEIRTTNPVATEQYGCVCSTEDHNQESFGSDPQS

SEQ ID NO: 172467 - protein, 39 aa, Artificial Sequence
  Description of Artificial Sequence: Synthetic polypeptide
DEEEIRTTNPVATEQYGSYAISPTATNLHVVVSPQNEMM

SEQ ID NO: 172468 - protein, 34 aa, Artificial Sequence
  Description of Artificial Sequence: Synthetic polypeptide
DEAEIATTNPVAYEQWGEVCSGGNGNQGETNDDM

SEQ ID NO: 172469 - protein, 31 aa, Artificial Sequence
  Description of Artificial Sequence: Synthetic polypeptide
QEMEIVTTNPVATEQYGEVCPAEVCVEFEEK

SEQ ID NO: 172470 - protein, 37 aa, Artificial Sequence
  Description of Artificial Sequence: Synthetic polypeptide
DEEEIRTTNPVATEQYGSVWDAVPDPMQQLSGSLEDT

SEQ ID NO: 172471 - protein, 30 aa, Artificial Sequence
  Description of Artificial Sequence: Synthetic polypeptide
QESEIASTNPVGTEHWGVAASTLQHGEDGI

SEQ ID NO: 172472 - protein, 38 aa, Artificial Sequence
  Description of Artificial Sequence: Synthetic polypeptide
DEEEIRTTNPVATEQYGSYVQITQLDEPEENSSPNMDL

SEQ ID NO: 172473 - protein, 36 aa, Artificial Sequence
  Description of Artificial Sequence: Synthetic polypeptide
DEGEIATTNPVATEQWGSVSMNGNPEPGGNQMENVV

SEQ ID NO: 172474 - protein, 32 aa, Artificial Sequence
  Description of Artificial Sequence: Synthetic polypeptide
IENCIRTTNPVSTEPYGTISMEDIQQQQNGNH

SEQ ID NO: 172475 - protein, 30 aa, Artificial Sequence
  Description of Artificial Sequence: Synthetic polypeptide
QESEIASTNPVGTEHWGVCAPTDLQHDGDI

SEQ ID NO: 172476 - protein, 36 aa, Artificial Sequence
  Description of Artificial Sequence: Synthetic polypeptide
QEGEIRTTNPVATEQYGCVSSYLGLDIEEGNMLIES

SEQ ID NO: 172477 - protein, 38 aa, Artificial Sequence
  Description of Artificial Sequence: Synthetic polypeptide
DEEEIRTTNPVATEQYGSIVNYTENYESDVNYQMEAIA

SEQ ID NO: 172478 - protein, 36 aa, Artificial Sequence
  Description of Artificial Sequence: Synthetic polypeptide
DEMEIRTTNPVATEQYGTTTCSATDGPVEEFEGNYI

SEQ ID NO: 172479 - protein, 39 aa, Artificial Sequence
  Description of Artificial Sequence: Synthetic polypeptide
DEEEIRTTNPVATEQYGVVSTTVTNQQIGTTEQGTEQGS

SEQ ID NO: 172480 - protein, 36 aa, Artificial Sequence
  Description of Artificial Sequence: Synthetic polypeptide
QECEICTTNPVATEAYGVVSTVNQQLNQQGTEDETE

SEQ ID NO: 172481 - protein, 37 aa, Artificial Sequence
  Description of Artificial Sequence: Synthetic polypeptide
QECEICTTNPVATEAYGVVSTVNQQLNQQGTNDEQEG

SEQ ID NO: 172482 - protein, 32 aa, Artificial Sequence
  Description of Artificial Sequence: Synthetic polypeptide
CEGEIATTNPVAYEPYGKVSQMHLSQHTETEL

SEQ ID NO: 172483 - protein, 39 aa, Artificial Sequence
  Description of Artificial Sequence: Synthetic polypeptide
DEEEIRTTNPVATEQYGVVSTVVTNNNQLQGTEEEETEE

SEQ ID NO: 172484 - protein, 34 aa, Artificial Sequence
  Description of Artificial Sequence: Synthetic polypeptide
DEMEIRTTNPVATCQYGCVCGWGEHQENFGSDQS

SEQ ID NO: 172485 - protein, 37 aa, Artificial Sequence
  Description of Artificial Sequence: Synthetic polypeptide
DEEEIRTTNPVATEQYGSYAEPWILNEQWRDEVESTA

SEQ ID NO: 172486 - protein, 34 aa, Artificial Sequence
  Description of Artificial Sequence: Synthetic polypeptide
DEEEIACTNPVATEQWGCVAGTNSHAEADIGIEH

SEQ ID NO: 172487 - protein, 36 aa, Artificial Sequence
  Description of Artificial Sequence: Synthetic polypeptide
DEEEIRTTNPVATEQYGSVWGAVPDPMQQMISVEET

SEQ ID NO: 172488 - protein, 39 aa, Artificial Sequence
  Description of Artificial Sequence: Synthetic polypeptide
DEEEIRTTNPVATEQYGVVSTVVTNQQGNQQGTTGQQGD

SEQ ID NO: 172489 - protein, 36 aa, Artificial Sequence
  Description of Artificial Sequence: Synthetic polypeptide
NEEEIRTTNPVAYEQWGCSYNVPNDDQDQRGMRPRD

SEQ ID NO: 172490 - protein, 38 aa, Artificial Sequence
  Description of Artificial Sequence: Synthetic polypeptide
AEEEIRTTNPVATEQYGSVTVVVTTNLEAGSEGGVVQG

SEQ ID NO: 172491 - protein, 32 aa, Artificial Sequence
  Description of Artificial Sequence: Synthetic polypeptide
QEGEIAPTNPCSYEQYGKVPSANELSQSVTNS

SEQ ID NO: 172492 - protein, 34 aa, Artificial Sequence
  Description of Artificial Sequence: Synthetic polypeptide
DEGEIRTTNPVATEQWGCVTSLEVEMNIAEDEAN

SEQ ID NO: 172493 - protein, 39 aa, Artificial Sequence
  Description of Artificial Sequence: Synthetic polypeptide
DEEEIRTTNPVATEQYGSFVTNSSFHNMCELEQAVVPEQ

SEQ ID NO: 172494 - protein, 32 aa, Artificial Sequence
  Description of Artificial Sequence: Synthetic polypeptide
DEEEIATTNPVATASWGCIATTNAENDTDNEN

SEQ ID NO: 172495 - protein, 39 aa, Artificial Sequence
  Description of Artificial Sequence: Synthetic polypeptide
DEEEIRTTNPVATEQYGSFVTNSLNQNMDELEQAVHPTT

SEQ ID NO: 172496 - protein, 35 aa, Artificial Sequence
  Description of Artificial Sequence: Synthetic polypeptide
NEEEIRTTNPVAYEQWGCSYNVPRDDRDGRGHQPR

SEQ ID NO: 172497 - protein, 34 aa, Artificial Sequence
  Description of Artificial Sequence: Synthetic polypeptide
DEGEIATTNPVATEQYGCVAANHSGDAMNPADHN

SEQ ID NO: 172498 - protein, 37 aa, Artificial Sequence
  Description of Artificial Sequence: Synthetic polypeptide
IEEEIRTTNPVATEQYGSYSSPITAEPNMMVGHEPVL

SEQ ID NO: 172499 - protein, 37 aa, Artificial Sequence
  Description of Artificial Sequence: Synthetic polypeptide
IEEEIRTTNPVATEQYGSYSSPITAEPNPPVGHPPVL

SEQ ID NO: 172500 - protein, 39 aa, Artificial Sequence
  Description of Artificial Sequence: Synthetic polypeptide
DEEEIRTTNPVATEQYGSNIVTWSVNPEESNNEPEINRF

SEQ ID NO: 172501 - protein, 39 aa, Artificial Sequence
  Description of Artificial Sequence: Synthetic polypeptide
DEEEIRTTNPVATEQYGSNIVTWSVNPEEGNNEPEINEV

SEQ ID NO: 172502 - protein, 39 aa, Artificial Sequence
  Description of Artificial Sequence: Synthetic polypeptide
DEEEIRTTNPVATEQYGSFVTNSGFQNMCELEQIVVPTQ

SEQ ID NO: 172503 - protein, 37 aa, Artificial Sequence
  Description of Artificial Sequence: Synthetic polypeptide
IEEEIRTTNPVATEQYGSYSSPITAEPNSRVGHPPLL

SEQ ID NO: 172504 - protein, 38 aa, Artificial Sequence
  Description of Artificial Sequence: Synthetic polypeptide
DEEEIATTNPVATEQYGSVCAMNNGQLEAPDDQANGAD

SEQ ID NO: 172505 - protein, 32 aa, Artificial Sequence
  Description of Artificial Sequence: Synthetic polypeptide
DCNEIRTTNPVSTEPYGTISMEDIQQQQNGHH

SEQ ID NO: 172506 - protein, 38 aa, Artificial Sequence
  Description of Artificial Sequence: Synthetic polypeptide
DEEEIRTTNPVATEQYGSLYAECTELMPRNVQEVESQR

SEQ ID NO: 172507 - protein, 37 aa, Artificial Sequence
  Description of Artificial Sequence: Synthetic polypeptide
IEEEIRTTNPVATEQYGSYSSPITAEPNMGVGHPHVL

SEQ ID NO: 172508 - protein, 34 aa, Artificial Sequence
  Description of Artificial Sequence: Synthetic polypeptide
DEGEIATTNPVATEQYGCVAANHSGDATMNPAEH

SEQ ID NO: 172509 - protein, 36 aa, Artificial Sequence
  Description of Artificial Sequence: Synthetic polypeptide
DEEEIATTNPVATEQYGSVCAGMTTGGAEAPIGDHV

SEQ ID NO: 172510 - protein, 39 aa, Artificial Sequence
  Description of Artificial Sequence: Synthetic polypeptide
DEEEIRTTNPVATEQYGVVSTTVTNQAGSEQGTNTDTTD

SEQ ID NO: 172511 - protein, 30 aa, Artificial Sequence
  Description of Artificial Sequence: Synthetic polypeptide
QEGEIAPTNPCSYEQWGIVCYCNDQSGDTR

SEQ ID NO: 172512 - protein, 30 aa, Artificial Sequence
  Description of Artificial Sequence: Synthetic polypeptide
QEGEIAPTNPCSYEQWGIVFCNDQSHGDTR

SEQ ID NO: 172513 - protein, 35 aa, Artificial Sequence
  Description of Artificial Sequence: Synthetic polypeptide
CETEIATTNPVAYECWGSVATGQINGDIQGGDNQR

SEQ ID NO: 172514 - protein, 32 aa, Artificial Sequence
  Description of Artificial Sequence: Synthetic polypeptide
CETEIATTNPVAYERYGKVSIIGHLSQHETEG

SEQ ID NO: 172515 - protein, 30 aa, Artificial Sequence
  Description of Artificial Sequence: Synthetic polypeptide
QEGEIACTNPVGTAAWGGCSASMNLNHGDI

SEQ ID NO: 172516 - protein, 35 aa, Artificial Sequence
  Description of Artificial Sequence: Synthetic polypeptide
NEEEIRTTNPVAYEQWGCSYNVPMDDTDQQGHRPR

SEQ ID NO: 172517 - protein, 34 aa, Artificial Sequence
  Description of Artificial Sequence: Synthetic polypeptide
DDAEIRTTNPVATEQYGCVCSWEDHNQSFISDQS

SEQ ID NO: 172518 - protein, 35 aa, Artificial Sequence
  Description of Artificial Sequence: Synthetic polypeptide
DDAEIRTTNPVATEQYGCVCSWEDHNQESFGSDFQ

SEQ ID NO: 172519 - protein, 32 aa, Artificial Sequence
  Description of Artificial Sequence: Synthetic polypeptide
DEEEIATTNPVATASWGCIATTAAEQVTDNFF

SEQ ID NO: 172520 - protein, 30 aa, Artificial Sequence
  Description of Artificial Sequence: Synthetic polypeptide
QEQEIASTNPVGTEGYGVMAASTLEDHGDI

SEQ ID NO: 172521 - protein, 35 aa, Artificial Sequence
  Description of Artificial Sequence: Synthetic polypeptide
DEGEIATTNPVATEQYGCVAANNGDTTTDDGNAEQ

SEQ ID NO: 172522 - protein, 35 aa, Artificial Sequence
  Description of Artificial Sequence: Synthetic polypeptide
DEGEIATTNPVATEQYGCVAANNGDTTAHQGNEHP

SEQ ID NO: 172523 - protein, 35 aa, Artificial Sequence
  Description of Artificial Sequence: Synthetic polypeptide
DEGEIATTNPVATEQYGCVAANNGDATMPPGDPNH

SEQ ID NO: 172524 - protein, 39 aa, Artificial Sequence
  Description of Artificial Sequence: Synthetic polypeptide
DEEEIRTTNPVATEQYGVVSTVVTNQQGNQQGTTTQEDD

SEQ ID NO: 172525 - protein, 37 aa, Artificial Sequence
  Description of Artificial Sequence: Synthetic polypeptide
DEEEIRTTNPVATEQYGSFYNSPAVNTELDPHEVITD

SEQ ID NO: 172526 - protein, 36 aa, Artificial Sequence
  Description of Artificial Sequence: Synthetic polypeptide
DEEEIRTTNPVATEQYGSFYNPEVELDENDNYTFIE

SEQ ID NO: 172527 - protein, 37 aa, Artificial Sequence
  Description of Artificial Sequence: Synthetic polypeptide
DEEEIRTTNPVATEQYGSFYCWAMTVQPGKQEVENEG

SEQ ID NO: 172528 - protein, 34 aa, Artificial Sequence
  Description of Artificial Sequence: Synthetic polypeptide
MESEIRTTNPVATEQYGCCPSQDVSEDEIGSAEK

SEQ ID NO: 172529 - protein, 36 aa, Artificial Sequence
  Description of Artificial Sequence: Synthetic polypeptide
DENEIATTNPVATEQYGSVCAANNGDENGMDINMDD

SEQ ID NO: 172530 - protein, 35 aa, Artificial Sequence
  Description of Artificial Sequence: Synthetic polypeptide
DENEIATTNPVATEQYGSVCAAMNHLNAMAPDDHN

SEQ ID NO: 172531 - protein, 37 aa, Artificial Sequence
  Description of Artificial Sequence: Synthetic polypeptide
IEEEIRTTNPVATEQYGSYSSPSTAEENMRVGHPPVL

SEQ ID NO: 172532 - protein, 36 aa, Artificial Sequence
  Description of Artificial Sequence: Synthetic polypeptide
DEGEIATTNPVATEQYGCNVAAITNGLEAADIDDGN

SEQ ID NO: 172533 - protein, 36 aa, Artificial Sequence
  Description of Artificial Sequence: Synthetic polypeptide
DEEEIACTNPVATEQWGSVAKAGLHNVMTAPDGNAR

SEQ ID NO: 172534 - protein, 35 aa, Artificial Sequence
  Description of Artificial Sequence: Synthetic polypeptide
CSEEIATTNPVGTEQWGEMCVDITTNILQGGGMTR

SEQ ID NO: 172535 - protein, 36 aa, Artificial Sequence
  Description of Artificial Sequence: Synthetic polypeptide
DENEIATTNPVATEQYGSVCAANNGDENGMDIDDNY

SEQ ID NO: 172536 - protein, 36 aa, Artificial Sequence
  Description of Artificial Sequence: Synthetic polypeptide
CSEEIATTNPVGTEQWGEMCVMITDNILQGGNGMER

SEQ ID NO: 172537 - protein, 34 aa, Artificial Sequence
  Description of Artificial Sequence: Synthetic polypeptide
DEGQEIATTNPVAYEQWGTVAWTDNTGEQNGDHP

SEQ ID NO: 172538 - protein, 35 aa, Artificial Sequence
  Description of Artificial Sequence: Synthetic polypeptide
DEMEIRTTNPVATEQYGVYTMYVDDLEDRDPTQME

SEQ ID NO: 172539 - protein, 36 aa, Artificial Sequence
  Description of Artificial Sequence: Synthetic polypeptide
DEEEIACTNPVATEQWGSVAITNPPEQSGDQMGSLS

SEQ ID NO: 172540 - protein, 37 aa, Artificial Sequence
  Description of Artificial Sequence: Synthetic polypeptide
DEEEIRTTNPVATEQYGSYVSAPQSGIQQLMVEEFCN

SEQ ID NO: 172541 - protein, 37 aa, Artificial Sequence
  Description of Artificial Sequence: Synthetic polypeptide
DDEEIRTTNPVATDQYGSVVGVNNNGGEQENEGGNNT

SEQ ID NO: 172542 - protein, 34 aa, Artificial Sequence
  Description of Artificial Sequence: Synthetic polypeptide
DEGEIATTNPVATEQWGTVCAANDGPVPDEGNDV

SEQ ID NO: 172543 - protein, 36 aa, Artificial Sequence
  Description of Artificial Sequence: Synthetic polypeptide
DEAEIATTNPVATESYGSVCQTNDQQQQGGQKGDKE

SEQ ID NO: 172544 - protein, 39 aa, Artificial Sequence
  Description of Artificial Sequence: Synthetic polypeptide
DEEEIRTTNPVATEQYGVVYTQGNDQTIDQEDGGGNQGT

SEQ ID NO: 172545 - protein, 36 aa, Artificial Sequence
  Description of Artificial Sequence: Synthetic polypeptide
DEAEIATTNPVATESYGSVCYNNEGQQQDQQGMNEP

SEQ ID NO: 172546 - protein, 33 aa, Artificial Sequence
  Description of Artificial Sequence: Synthetic polypeptide
DEGEIATTNPVATEQWGTNCAATNGPEEMEIND

SEQ ID NO: 172547 - protein, 36 aa, Artificial Sequence
  Description of Artificial Sequence: Synthetic polypeptide
DEAEIATTNPVATESYGSVCYNNEHQQQDQQGMNMG

SEQ ID NO: 172548 - protein, 34 aa, Artificial Sequence
  Description of Artificial Sequence: Synthetic polypeptide
DEEEIATTNPVAYEKWGCVYNSPDNHNGQLGSGS

SEQ ID NO: 172549 - protein, 39 aa, Artificial Sequence
  Description of Artificial Sequence: Synthetic polypeptide
AEEEIRTTNPVATEQYGVVVVTVTNNNLEQGTEGGNTTV

SEQ ID NO: 172550 - protein, 35 aa, Artificial Sequence
  Description of Artificial Sequence: Synthetic polypeptide
DEMEIRTTNPVATCQYGCVCQTGEDNQENFGSDQA

SEQ ID NO: 172551 - protein, 35 aa, Artificial Sequence
  Description of Artificial Sequence: Synthetic polypeptide
CSEEIATTNPVGTEQWGECCVHITTNILQGGGMER

SEQ ID NO: 172552 - protein, 36 aa, Artificial Sequence
  Description of Artificial Sequence: Synthetic polypeptide
DEGEIATTNPVATEQYGCVAANHALTQGDAALDNHW

SEQ ID NO: 172553 - protein, 34 aa, Artificial Sequence
  Description of Artificial Sequence: Synthetic polypeptide
DAAEIATTNPVATEQYGCVAANNGDTTTDDGNEE

SEQ ID NO: 172554 - protein, 28 aa, Artificial Sequence
  Description of Artificial Sequence: Synthetic peptide
QESEIASTNPVGTEGWGVMASILQHEDI

SEQ ID NO: 172555 - protein, 37 aa, Artificial Sequence
  Description of Artificial Sequence: Synthetic polypeptide
DEEEIRTTNPVATEQYGSVWGAVPDPMMQMPGSLEET

SEQ ID NO: 172556 - protein, 30 aa, Artificial Sequence
  Description of Artificial Sequence: Synthetic polypeptide
QESEIASTNPVGTEGWGVMANSTLQHKGDI

SEQ ID NO: 172557 - protein, 36 aa, Artificial Sequence
  Description of Artificial Sequence: Synthetic polypeptide
MESEIRTTNPVATEQYGCCVATGVPNNDSRGKQQMD

SEQ ID NO: 172558 - protein, 37 aa, Artificial Sequence
  Description of Artificial Sequence: Synthetic polypeptide
DEEEIRTTNPVATEQYGVVSTVVNNNNNTEDEEEEED

SEQ ID NO: 172559 - protein, 36 aa, Artificial Sequence
  Description of Artificial Sequence: Synthetic polypeptide
DENEIATTNPVATEQYGSVCAAMNPDNDMDGNNENN

SEQ ID NO: 172560 - protein, 39 aa, Artificial Sequence
  Description of Artificial Sequence: Synthetic polypeptide
AEEEIRTTNPVATEQYGVVVVTVTTNNLEQGTEGGNTNF

SEQ ID NO: 172561 - protein, 37 aa, Artificial Sequence
  Description of Artificial Sequence: Synthetic polypeptide
DEEEIRTTNPVATEQYGSVPLVWDNSEEVENQGFLES

SEQ ID NO: 172562 - protein, 31 aa, Artificial Sequence
  Description of Artificial Sequence: Synthetic polypeptide
QEGEIAPTNPCSYEQWGIVSCNDQSGGDTER

SEQ ID NO: 172563 - protein, 36 aa, Artificial Sequence
  Description of Artificial Sequence: Synthetic polypeptide
MESEIRTTNPVATEQYGCCVWATGVNNDSDGGNQMD

SEQ ID NO: 172564 - protein, 35 aa, Artificial Sequence
  Description of Artificial Sequence: Synthetic polypeptide
DEGEIATTNPVATEQYGCNVAATPNDATPSPMENG

SEQ ID NO: 172565 - protein, 39 aa, Artificial Sequence
  Description of Artificial Sequence: Synthetic polypeptide
AEEEIRTTNPVATEQYGVVVVTVTTNNLEQGTEGGNQTG

SEQ ID NO: 172566 - protein, 32 aa, Artificial Sequence
  Description of Artificial Sequence: Synthetic polypeptide
QEGEIAPTNPCSYEQYGKVACNELSQSVTNRL

SEQ ID NO: 172567 - protein, 32 aa, Artificial Sequence
  Description of Artificial Sequence: Synthetic polypeptide
QEEEIRTTNPVATEQWGATAWAADWQEHKEPK

SEQ ID NO: 172568 - protein, 36 aa, Artificial Sequence
  Description of Artificial Sequence: Synthetic polypeptide
DCQEIRTTNPVAVEQYGSVFTVNKHSSETPMGSDRN

SEQ ID NO: 172569 - protein, 35 aa, Artificial Sequence
  Description of Artificial Sequence: Synthetic polypeptide
MESEIRTTNPVATEQYGCFVATGVPNNDINGGQMN

SEQ ID NO: 172570 - protein, 37 aa, Artificial Sequence
  Description of Artificial Sequence: Synthetic polypeptide
DEEEIATTNPVATEQYGSVCAANNGEEAGDNMMNDNH

SEQ ID NO: 172571 - protein, 39 aa, Artificial Sequence
  Description of Artificial Sequence: Synthetic polypeptide
DEEEIRTTNPVATEQYGVVSTVVVTQAGNNNTEEGNTEE

SEQ ID NO: 172572 - protein, 33 aa, Artificial Sequence
  Description of Artificial Sequence: Synthetic polypeptide
DEAEIATTNPVAYEQWGSATTGNGNAGEHHGGE

SEQ ID NO: 172573 - protein, 33 aa, Artificial Sequence
  Description of Artificial Sequence: Synthetic polypeptide
DENEIRCTNPVATEQWGATSNAEDLAEPKGGYI

SEQ ID NO: 172574 - protein, 36 aa, Artificial Sequence
  Description of Artificial Sequence: Synthetic polypeptide
MESEIRTTNPVATEQYGCSSWTTDSLVQSFQELNQS

SEQ ID NO: 172575 - protein, 30 aa, Artificial Sequence
  Description of Artificial Sequence: Synthetic polypeptide
QEGEIACTNPVGTAAWGGVSASMLQHGDIQ

SEQ ID NO: 172576 - protein, 36 aa, Artificial Sequence
  Description of Artificial Sequence: Synthetic polypeptide
QECEICTTNPVATEAYGVVSTVNQQLQQGTQGEQED

SEQ ID NO: 172577 - protein, 36 aa, Artificial Sequence
  Description of Artificial Sequence: Synthetic polypeptide
NESEIRCTNPTAYEQWGSTVYGENMDLDQRGGDNKR

SEQ ID NO: 172578 - protein, 37 aa, Artificial Sequence
  Description of Artificial Sequence: Synthetic polypeptide
AEEEIRTTNPVATEQYGVVVTVVTDGGNNNLGGNDDQ

SEQ ID NO: 172579 - protein, 36 aa, Artificial Sequence
  Description of Artificial Sequence: Synthetic polypeptide
DEEEIRTTNPVATEQYGVCVHPSPVHMPNPVAMFEH

SEQ ID NO: 172580 - protein, 35 aa, Artificial Sequence
  Description of Artificial Sequence: Synthetic polypeptide
DEEEINTTNPTAYESYGQVVCCTGNASSTSGDNTR

SEQ ID NO: 172581 - protein, 33 aa, Artificial Sequence
  Description of Artificial Sequence: Synthetic polypeptide
QEEEIATTNPVATEQYGEAPPCEVEHQHTEGEK

SEQ ID NO: 172582 - protein, 30 aa, Artificial Sequence
  Description of Artificial Sequence: Synthetic polypeptide
NESEIASTNPVGTEGWGVCAPTDLDQHGDI

SEQ ID NO: 172583 - protein, 36 aa, Artificial Sequence
  Description of Artificial Sequence: Synthetic polypeptide
QENEIRGTNPVATEQYGSVVNGVNNSGQIEGNENID

SEQ ID NO: 172584 - protein, 33 aa, Artificial Sequence
  Description of Artificial Sequence: Synthetic polypeptide
DEGVVIATVNPVAYEPYGSVSNAGNLEMNMNVN

SEQ ID NO: 172585 - protein, 33 aa, Artificial Sequence
  Description of Artificial Sequence: Synthetic polypeptide
QEMEIATTNPVATEQYGTVCSATDGCVEHEEEK

SEQ ID NO: 172586 - protein, 30 aa, Artificial Sequence
  Description of Artificial Sequence: Synthetic polypeptide
NESEIASTNPVGTEGWGVCAPTDLQHQGDV

SEQ ID NO: 172587 - protein, 31 aa, Artificial Sequence
  Description of Artificial Sequence: Synthetic polypeptide
QECEICATNPCTTEIYGVVATNNTTQNNGDT

SEQ ID NO: 172588 - protein, 31 aa, Artificial Sequence
  Description of Artificial Sequence: Synthetic polypeptide
QECEICATNPCTTEIYGVVATNNTTQQGDTD

SEQ ID NO: 172589 - protein, 28 aa, Artificial Sequence
  Description of Artificial Sequence: Synthetic peptide
QEHEIASTNPVGTEGYGVMASEAEHGDI

SEQ ID NO: 172590 - protein, 36 aa, Artificial Sequence
  Description of Artificial Sequence: Synthetic polypeptide
DEMEIVTTNPVATEQYGTVCSATDGPVEPFEGNYKD

SEQ ID NO: 172591 - protein, 31 aa, Artificial Sequence
  Description of Artificial Sequence: Synthetic polypeptide
QECEICATNPCTTEIYGVVATNPTTNQNGDT

SEQ ID NO: 172592 - protein, 39 aa, Artificial Sequence
  Description of Artificial Sequence: Synthetic polypeptide
DEEEIRTTNPVATEQYGVVSTVVNTTNQQQGTEEEEEEA

SEQ ID NO: 172593 - protein, 36 aa, Artificial Sequence
  Description of Artificial Sequence: Synthetic polypeptide
DEEEIRTTNPVATEQYGVCVHPSPVHMPNVDMSLEG

SEQ ID NO: 172594 - protein, 36 aa, Artificial Sequence
  Description of Artificial Sequence: Synthetic polypeptide
DEEEIRTTNPVATEQYGSVWAVPDPMAPTGSSLEET

SEQ ID NO: 172595 - protein, 36 aa, Artificial Sequence
  Description of Artificial Sequence: Synthetic polypeptide
DEEEIRTTNPVATEQYGVCVHPSPVHMPNVVDMFEM

SEQ ID NO: 172596 - protein, 38 aa, Artificial Sequence
  Description of Artificial Sequence: Synthetic polypeptide
DEEEIRTTNPVATEQYGVVSTTVVNNNNNDEQGTEEDE

SEQ ID NO: 172597 - protein, 37 aa, Artificial Sequence
  Description of Artificial Sequence: Synthetic polypeptide
AEEEIRTTNPVATEQYGVVVTVVTDGGNNNLGGNDDG

SEQ ID NO: 172598 - protein, 36 aa, Artificial Sequence
  Description of Artificial Sequence: Synthetic polypeptide
DEEEIRTTNPVATEQYGVCVHPSPVHMPNNVDMVEQ

SEQ ID NO: 172599 - protein, 36 aa, Artificial Sequence
  Description of Artificial Sequence: Synthetic polypeptide
DEGEIRTTNPVATEQYGSTNTPHWENQMEYDEIDND

SEQ ID NO: 172600 - protein, 36 aa, Artificial Sequence
  Description of Artificial Sequence: Synthetic polypeptide
DEMEIRTTNPVATEQYGCVICPQLMWEDSGESSQRE

SEQ ID NO: 172601 - protein, 35 aa, Artificial Sequence
  Description of Artificial Sequence: Synthetic polypeptide
DEMEIRTTNPVATEQYGCVICPQLGIEDSESTQRE

SEQ ID NO: 172602 - protein, 35 aa, Artificial Sequence
  Description of Artificial Sequence: Synthetic polypeptide
QECEICTTNPVATEAYGVVSTVTQQLQQGTTEEQE

SEQ ID NO: 172603 - protein, 30 aa, Artificial Sequence
  Description of Artificial Sequence: Synthetic polypeptide
QEQEIAPTNPCSYEQWGIVFCNDQGSGDTR

SEQ ID NO: 172604 - protein, 35 aa, Artificial Sequence
  Description of Artificial Sequence: Synthetic polypeptide
MQGEIRTTNPVATEQYGCTSWNEIVTDERFDDNRE

SEQ ID NO: 172605 - protein, 34 aa, Artificial Sequence
  Description of Artificial Sequence: Synthetic polypeptide
DDAEIRCTNPVATEQYGCVSWVDEHEQEGFYVQD

SEQ ID NO: 172606 - protein, 37 aa, Artificial Sequence
  Description of Artificial Sequence: Synthetic polypeptide
DEEEIRTTNPVATEQYGSYCYSPTEVHLPAMHEVVQT

SEQ ID NO: 172607 - protein, 39 aa, Artificial Sequence
  Description of Artificial Sequence: Synthetic polypeptide
DEEEIRTTNPVATEQYGVVSTVVNVTNNQQGTEEEEQQD

SEQ ID NO: 172608 - protein, 31 aa, Artificial Sequence
  Description of Artificial Sequence: Synthetic polypeptide
QENEIKTTNPVATEFYGVVVAGEGGGQGEEF

SEQ ID NO: 172609 - protein, 36 aa, Artificial Sequence
  Description of Artificial Sequence: Synthetic polypeptide
DEEEICTTNPVATEMWGVVSHMNNNPDDRVNGNGDH

SEQ ID NO: 172610 - protein, 35 aa, Artificial Sequence
  Description of Artificial Sequence: Synthetic polypeptide
DEAEIRCTNPVATEPYGSTWPSCTPAPSVSGGNAS

SEQ ID NO: 172611 - protein, 30 aa, Artificial Sequence
  Description of Artificial Sequence: Synthetic polypeptide
QEHEIASTNPVGTEGYGVIFASTLESHGDI

SEQ ID NO: 172612 - protein, 36 aa, Artificial Sequence
  Description of Artificial Sequence: Synthetic polypeptide
DEMEIRTTNPVATEQYGSVVELVPRSAETFDEEISH

SEQ ID NO: 172613 - protein, 39 aa, Artificial Sequence
  Description of Artificial Sequence: Synthetic polypeptide
DEEEIRTTNPVATEQYGVVSTVVNVNNNQQGTEDEEEED

SEQ ID NO: 172614 - protein, 35 aa, Artificial Sequence
  Description of Artificial Sequence: Synthetic polypeptide
DDEEIRSTNPVATEQYGCSCSSGEHNAENFGSDQS

SEQ ID NO: 172615 - protein, 33 aa, Artificial Sequence
  Description of Artificial Sequence: Synthetic polypeptide
DEAEIATTNPVATTQWGMVRTWEDHQQKEQKER

SEQ ID NO: 172616 - protein, 36 aa, Artificial Sequence
  Description of Artificial Sequence: Synthetic polypeptide
DEEEIRTTNPVATEQYGVCVHPSCVNMPNVDMFEEL

SEQ ID NO: 172617 - protein, 35 aa, Artificial Sequence
  Description of Artificial Sequence: Synthetic polypeptide
DEHEICTTNPVAYEQWGSVCPNDQDENMGDHMNEQ

SEQ ID NO: 172618 - protein, 36 aa, Artificial Sequence
  Description of Artificial Sequence: Synthetic polypeptide
DEEEIRTTNPVATEQYGVCVHPSPVHMPNFPDMSEG

SEQ ID NO: 172619 - protein, 34 aa, Artificial Sequence
  Description of Artificial Sequence: Synthetic polypeptide
DAGEIATTNPVAYEQWGSARCTENNDQDDLGQMR

SEQ ID NO: 172620 - protein, 29 aa, Artificial Sequence
  Description of Artificial Sequence: Synthetic peptide
QEGEIAATNPCSYEQWGIVFCCDQSGDTR

SEQ ID NO: 172621 - protein, 32 aa, Artificial Sequence
  Description of Artificial Sequence: Synthetic polypeptide
NESEIACTNPVAYEGYGEASCENLSQTPVGGV

SEQ ID NO: 172622 - protein, 35 aa, Artificial Sequence
  Description of Artificial Sequence: Synthetic polypeptide
DEGEIATTNPVATEQWGCVTAANNGLADANGSNMT

SEQ ID NO: 172623 - protein, 36 aa, Artificial Sequence
  Description of Artificial Sequence: Synthetic polypeptide
DEEEIATTNPVATEQYGSVCAANMGEEAPDAGMEGA

SEQ ID NO: 172624 - protein, 35 aa, Artificial Sequence
  Description of Artificial Sequence: Synthetic polypeptide
IENEIRTTNPVATEQYGSVISPWNGNEESFVEPHS

SEQ ID NO: 172625 - protein, 35 aa, Artificial Sequence
  Description of Artificial Sequence: Synthetic polypeptide
DEEEIATTNPVATEQYGSACGPVDLVQTAEDTIQN

SEQ ID NO: 172626 - protein, 34 aa, Artificial Sequence
  Description of Artificial Sequence: Synthetic polypeptide
DEMAIRTTNPVATEQYGCFCSTGEHNIHFNSDQA

SEQ ID NO: 172627 - protein, 37 aa, Artificial Sequence
  Description of Artificial Sequence: Synthetic polypeptide
IENEIRTTNPVATEQYGSVNSTTPDMHNSRQEVSFED

SEQ ID NO: 172628 - protein, 40 aa, Artificial Sequence
  Description of Artificial Sequence: Synthetic polypeptide
DEEEIRTTNPVATEQYGSVVYTQGNDQTFDQEGEGGNQGT

SEQ ID NO: 172629 - protein, 29 aa, Artificial Sequence
  Description of Artificial Sequence: Synthetic peptide
QEHEIASTNPVGTEGYGVMASTLESVTDI

SEQ ID NO: 172630 - protein, 35 aa, Artificial Sequence
  Description of Artificial Sequence: Synthetic polypeptide
DEMEIRTTNPVATEQYGCVICPLLMPEDSESSQRE

SEQ ID NO: 172631 - protein, 31 aa, Artificial Sequence
  Description of Artificial Sequence: Synthetic polypeptide
QECEICATNPCTTEIYGVVATNTNQQGTDTE

SEQ ID NO: 172632 - protein, 35 aa, Artificial Sequence
  Description of Artificial Sequence: Synthetic polypeptide
DAAEIACTNPVATEQYGSCAAATNLATAPQGEENH

SEQ ID NO: 172633 - protein, 32 aa, Artificial Sequence
  Description of Artificial Sequence: Synthetic polypeptide
QEEEIATTNPVATEQYGEAPREVEVQMHISEQ

SEQ ID NO: 172634 - protein, 36 aa, Artificial Sequence
  Description of Artificial Sequence: Synthetic polypeptide
LEEEIRTTNPVATEQYGSVQVAVEEQIENTEEQNDM

SEQ ID NO: 172635 - protein, 31 aa, Artificial Sequence
  Description of Artificial Sequence: Synthetic polypeptide
QECEICATNPCTTEIYGVVATNTTNQNGDTG

SEQ ID NO: 172636 - protein, 35 aa, Artificial Sequence
  Description of Artificial Sequence: Synthetic polypeptide
DAAEIACTNPVATEQYGSCAAATNLATAPMGEDNN

SEQ ID NO: 172637 - protein, 36 aa, Artificial Sequence
  Description of Artificial Sequence: Synthetic polypeptide
DEEEICTTNPVATEMWGVVSHMNNNEGDDRNGNGDH

SEQ ID NO: 172638 - protein, 37 aa, Artificial Sequence
  Description of Artificial Sequence: Synthetic polypeptide
DEEEIRTTNPVATEQYGSVYLINNMNHQEQMQEIVPG

SEQ ID NO: 172639 - protein, 34 aa, Artificial Sequence
  Description of Artificial Sequence: Synthetic polypeptide
DEEEIACTNPVATEQWGCVAGTNSHQEADIIEDG

SEQ ID NO: 172640 - protein, 38 aa, Artificial Sequence
  Description of Artificial Sequence: Synthetic polypeptide
DEEEIRTTNPVATEQYGSVPSATMEGLGDDEALETEGE

SEQ ID NO: 172641 - protein, 36 aa, Artificial Sequence
  Description of Artificial Sequence: Synthetic polypeptide
DENEIATTNPVATEQYGSVCAATMHGEATADGDDRG

SEQ ID NO: 172642 - protein, 37 aa, Artificial Sequence
  Description of Artificial Sequence: Synthetic polypeptide
DEEEIRTTNPVATEQYGSVAQVAVVEQIENEEEANDM

SEQ ID NO: 172643 - protein, 35 aa, Artificial Sequence
  Description of Artificial Sequence: Synthetic polypeptide
DDAEIRCTNPVATEQYGCVSWVDNHEQEGFGVQMD

SEQ ID NO: 172644 - protein, 37 aa, Artificial Sequence
  Description of Artificial Sequence: Synthetic polypeptide
DEEEIRTTNPVATEQYGSVVYVAIEEQMSNTEEDNDM

SEQ ID NO: 172645 - protein, 35 aa, Artificial Sequence
  Description of Artificial Sequence: Synthetic polypeptide
IENEIRTTNPVATEQYGSVFSPWNGSEFSFVEPHS

SEQ ID NO: 172646 - protein, 35 aa, Artificial Sequence
  Description of Artificial Sequence: Synthetic polypeptide
NEEEISTTNPVAYEQWGCSYNVPRDEQDQRGKRPR

SEQ ID NO: 172647 - protein, 29 aa, Artificial Sequence
  Description of Artificial Sequence: Synthetic peptide
QEHEIASTNPVGTEGYGVMASSLESHGDI

SEQ ID NO: 172648 - protein, 31 aa, Artificial Sequence
  Description of Artificial Sequence: Synthetic polypeptide
QECEICATNPCTTEIYGVVATNTANQNGTDT

SEQ ID NO: 172649 - protein, 30 aa, Artificial Sequence
  Description of Artificial Sequence: Synthetic polypeptide
QEHEIASTNPVGTEGYGVMASTEPESHGDI

SEQ ID NO: 172650 - protein, 35 aa, Artificial Sequence
  Description of Artificial Sequence: Synthetic polypeptide
QEEEIRTTNPVATEPWGKISQTIHEFSLNRVGSFG

SEQ ID NO: 172651 - protein, 36 aa, Artificial Sequence
  Description of Artificial Sequence: Synthetic polypeptide
DELEIRTTNPVAYEHYGSVYACTAAVSQNKGGSPRS

SEQ ID NO: 172652 - protein, 36 aa, Artificial Sequence
  Description of Artificial Sequence: Synthetic polypeptide
NESCIRTTNPVATEQYGSVWMTNNITQPEEGQDDDS

SEQ ID NO: 172653 - protein, 35 aa, Artificial Sequence
  Description of Artificial Sequence: Synthetic polypeptide
QECEICTTNPVATEAYGVVSTDQQQLQQGTEEEQE

SEQ ID NO: 172654 - protein, 39 aa, Artificial Sequence
  Description of Artificial Sequence: Synthetic polypeptide
DEEEIRTTNPVATEQYGSNIVAWSVNDEEQNNEPEINEP

SEQ ID NO: 172655 - protein, 33 aa, Artificial Sequence
  Description of Artificial Sequence: Synthetic polypeptide
NEMEIVTTNPVATEQYGVVCTATDGPVEFEGFD

SEQ ID NO: 172656 - protein, 35 aa, Artificial Sequence
  Description of Artificial Sequence: Synthetic polypeptide
DEMEIRTTNPVATCQYGCVCNTEHNQENFNSDTQS

SEQ ID NO: 172657 - protein, 37 aa, Artificial Sequence
  Description of Artificial Sequence: Synthetic polypeptide
DEEEIRTTNPVATEQYGSYCYSPTEVLIDNAMVEVVQ

SEQ ID NO: 172658 - protein, 31 aa, Artificial Sequence
  Description of Artificial Sequence: Synthetic polypeptide
QECEICATNPCTTEIYGVVATNTNNQENGDT

SEQ ID NO: 172659 - protein, 36 aa, Artificial Sequence
  Description of Artificial Sequence: Synthetic polypeptide
DEEEIRTTNPVATEQYGVCVHPSPVHMPRPVDMFEL

SEQ ID NO: 172660 - protein, 37 aa, Artificial Sequence
  Description of Artificial Sequence: Synthetic polypeptide
DEEEIRTTNPVATEQYGSYVCVERTVEMEEVNEEMDE

SEQ ID NO: 172661 - protein, 37 aa, Artificial Sequence
  Description of Artificial Sequence: Synthetic polypeptide
DEEEIKTTNPVAYETYGISVVACTSNLSQTLSTENVD

SEQ ID NO: 172662 - protein, 39 aa, Artificial Sequence
  Description of Artificial Sequence: Synthetic polypeptide
DEEEIRTTNPVATEQYGVVSTVVVVTNQQQGTEDEEEET

SEQ ID NO: 172663 - protein, 37 aa, Artificial Sequence
  Description of Artificial Sequence: Synthetic polypeptide
DEEEIRTTNPVATEQYGSNGYYLMGGEEQMIMNAEEL

SEQ ID NO: 172664 - protein, 35 aa, Artificial Sequence
  Description of Artificial Sequence: Synthetic polypeptide
DEAEIATTNPVAYEAWGVVCSTDNGQERDGQDEEQ

SEQ ID NO: 172665 - protein, 31 aa, Artificial Sequence
  Description of Artificial Sequence: Synthetic polypeptide
QECEICATNPCTTEIYGVVATNTNNQNEGDT

SEQ ID NO: 172666 - protein, 38 aa, Artificial Sequence
  Description of Artificial Sequence: Synthetic polypeptide
DEEEIRTTNPVATEQYGSMVPPLNLIAEEYLDGELQDI

SEQ ID NO: 172667 - protein, 39 aa, Artificial Sequence
  Description of Artificial Sequence: Synthetic polypeptide
DEEEIRTTNPVATEQYGVVSTVVVTQAGNNNTTEENNDE

SEQ ID NO: 172668 - protein, 38 aa, Artificial Sequence
  Description of Artificial Sequence: Synthetic polypeptide
DEEEIRTTNPVATEQYGSYVEPPAVPNSPEVREMLENI

SEQ ID NO: 172669 - protein, 37 aa, Artificial Sequence
  Description of Artificial Sequence: Synthetic polypeptide
DEGEIRTTNPVATEQYGSFSCVLMANEDPEGMQVNQI

SEQ ID NO: 172670 - protein, 36 aa, Artificial Sequence
  Description of Artificial Sequence: Synthetic polypeptide
MESEIRTTNPVATEQYGSVSDWPNDLEDEIDEIVIK

SEQ ID NO: 172671 - protein, 36 aa, Artificial Sequence
  Description of Artificial Sequence: Synthetic polypeptide
DEEEIRTTNPVATEQYGTYPSPMAVLEAPELGVETH

SEQ ID NO: 172672 - protein, 38 aa, Artificial Sequence
  Description of Artificial Sequence: Synthetic polypeptide
DEEEIRTTNPVATEQYGSVADQNMNTHEETENGNPHEE

SEQ ID NO: 172673 - protein, 35 aa, Artificial Sequence
  Description of Artificial Sequence: Synthetic polypeptide
DEMEIRTTNPVATEQYGSVYFMPDLNWKIESSQSQ

SEQ ID NO: 172674 - protein, 36 aa, Artificial Sequence
  Description of Artificial Sequence: Synthetic polypeptide
DEMEIRTTNPVATEQYGCVINCEQLMIEDSNSSQRE

SEQ ID NO: 172675 - protein, 38 aa, Artificial Sequence
  Description of Artificial Sequence: Synthetic polypeptide
DEEEIKTTNPVATEQYGSVSVGQMEQNSGQNQGQEGIT

SEQ ID NO: 172676 - protein, 29 aa, Artificial Sequence
  Description of Artificial Sequence: Synthetic peptide
QESEIASTNPVGTECWGVTASTLDHGDIQ

SEQ ID NO: 172677 - protein, 31 aa, Artificial Sequence
  Description of Artificial Sequence: Synthetic polypeptide
QECEICATNPCTTEIYGVVATNNTNQGNGDT

SEQ ID NO: 172678 - protein, 37 aa, Artificial Sequence
  Description of Artificial Sequence: Synthetic polypeptide
DEEEIRTTNPVATEQYGSVGFLSYVSVEPVEGELTFW

SEQ ID NO: 172679 - protein, 34 aa, Artificial Sequence
  Description of Artificial Sequence: Synthetic polypeptide
QEEEIATTNPVATEQYGETAPCEVWSQMPEGENK

SEQ ID NO: 172680 - protein, 37 aa, Artificial Sequence
  Description of Artificial Sequence: Synthetic polypeptide
DEMEIRTTNPVATEQYGSVSAVMEEVELDRFEESIME

SEQ ID NO: 172681 - protein, 36 aa, Artificial Sequence
  Description of Artificial Sequence: Synthetic polypeptide
NEEEIRTTNPVAYEQWGYYWSQRNDDLQRQDERDNL

SEQ ID NO: 172682 - protein, 34 aa, Artificial Sequence
  Description of Artificial Sequence: Synthetic polypeptide
DENEIRCTNPVATEQYGCSSWAFITERIQENEQS

SEQ ID NO: 172683 - protein, 36 aa, Artificial Sequence
  Description of Artificial Sequence: Synthetic polypeptide
NEEEIRTTNPVAYEQWGYYWSQRNDDLQRQDERQRD

SEQ ID NO: 172684 - protein, 38 aa, Artificial Sequence
  Description of Artificial Sequence: Synthetic polypeptide
DEEEIRTTNPVATEQYGSVPSHTETGEPNMPEVEVPGF

SEQ ID NO: 172685 - protein, 39 aa, Artificial Sequence
  Description of Artificial Sequence: Synthetic polypeptide
DEEEIRTTNPVATEQYGSNIVTWSVDDEEQNPEPEINRV

SEQ ID NO: 172686 - protein, 32 aa, Artificial Sequence
  Description of Artificial Sequence: Synthetic polypeptide
DCSEVASTNPVSTEGYGNVAANTIQSRVGQRV

SEQ ID NO: 172687 - protein, 36 aa, Artificial Sequence
  Description of Artificial Sequence: Synthetic polypeptide
DENEIRGTNPVATEQYGSVMSDTIEGGQEDDDTVTG

SEQ ID NO: 172688 - protein, 39 aa, Artificial Sequence
  Description of Artificial Sequence: Synthetic polypeptide
DEEEIRTTNPVATEQYGSNIVTWSVEDEEMNNEPEINRV

SEQ ID NO: 172689 - protein, 29 aa, Artificial Sequence
  Description of Artificial Sequence: Synthetic peptide
NESEIATTNPVAYEQWGEAYYVEQPELEG

SEQ ID NO: 172690 - protein, 38 aa, Artificial Sequence
  Description of Artificial Sequence: Synthetic polypeptide
DEEEIRTTNPVATEQYGSVPSHTETMEPNMPEVSVSGF

SEQ ID NO: 172691 - protein, 36 aa, Artificial Sequence
  Description of Artificial Sequence: Synthetic polypeptide
QECEICTTNPVATEAYGVVSTVNQQLQQQGTEEQED

SEQ ID NO: 172692 - protein, 33 aa, Artificial Sequence
  Description of Artificial Sequence: Synthetic polypeptide
QECEICATNPCTTEIYGVVATNNTNLQNGNDTT

SEQ ID NO: 172693 - protein, 36 aa, Artificial Sequence
  Description of Artificial Sequence: Synthetic polypeptide
LENEIRTTNPVATEQYGSVCSVTWPDEDRTFVHEMV

SEQ ID NO: 172694 - protein, 36 aa, Artificial Sequence
  Description of Artificial Sequence: Synthetic polypeptide
QECEICTTNPVATEAYGVVSTVNQQLQQGTTDEDEE

SEQ ID NO: 172695 - protein, 36 aa, Artificial Sequence
  Description of Artificial Sequence: Synthetic polypeptide
DEEEIATTNPVATEQYGSACAVPPAEGQNHQDEMQM

SEQ ID NO: 172696 - protein, 34 aa, Artificial Sequence
  Description of Artificial Sequence: Synthetic polypeptide
NESEIATTNPVAYERWGSVCSQNDGEQNGRNGDQ

SEQ ID NO: 172697 - protein, 37 aa, Artificial Sequence
  Description of Artificial Sequence: Synthetic polypeptide
DEEEIATTNPVATEQYGSVCAANMGEEANDAGMENAN

SEQ ID NO: 172698 - protein, 29 aa, Artificial Sequence
  Description of Artificial Sequence: Synthetic peptide
QESEIASTNPVGYESWGVCAPTDLQHGDI

SEQ ID NO: 172699 - protein, 39 aa, Artificial Sequence
  Description of Artificial Sequence: Synthetic polypeptide
DEEEIRTTNPVATEQYGSNIVTWSVNDEEHNAEPEINRV

SEQ ID NO: 172700 - protein, 36 aa, Artificial Sequence
  Description of Artificial Sequence: Synthetic polypeptide
DENEIRGTNPVATEQYGSVMSDTIMGGQTDDDIIFG

SEQ ID NO: 172701 - protein, 33 aa, Artificial Sequence
  Description of Artificial Sequence: Synthetic polypeptide
NESEIATTNPVAYEQWGSVSGGNGNESGEGDTP

SEQ ID NO: 172702 - protein, 34 aa, Artificial Sequence
  Description of Artificial Sequence: Synthetic polypeptide
DEAEIATTNPVAYEQWGCNVAGNGLQAAPDGSQN

SEQ ID NO: 172703 - protein, 36 aa, Artificial Sequence
  Description of Artificial Sequence: Synthetic polypeptide
DEMEIRTTNPVATEQYGSVYWVTDWIDTFPGSDGTM

SEQ ID NO: 172704 - protein, 37 aa, Artificial Sequence
  Description of Artificial Sequence: Synthetic polypeptide
DEEEIATTNPVATEQYGSACAVPPAEGQNHQDGMAMM

SEQ ID NO: 172705 - protein, 34 aa, Artificial Sequence
  Description of Artificial Sequence: Synthetic polypeptide
DEHEIRTTNPVAYEKWGSVCGDQGEGDRQGDGNN

SEQ ID NO: 172706 - protein, 38 aa, Artificial Sequence
  Description of Artificial Sequence: Synthetic polypeptide
DEEEIRTTNPVATEQYGSVADQNMNTHGETENLPPAED

SEQ ID NO: 172707 - protein, 39 aa, Artificial Sequence
  Description of Artificial Sequence: Synthetic polypeptide
DEEEIRTTNPVATEQYGVVSTVVSTGTQAGTTEAGSTVE

SEQ ID NO: 172708 - protein, 37 aa, Artificial Sequence
  Description of Artificial Sequence: Synthetic polypeptide
DEEEIATTNPVATEQYGSVCAMNNNDLNPADGSGGEP

SEQ ID NO: 172709 - protein, 35 aa, Artificial Sequence
  Description of Artificial Sequence: Synthetic polypeptide
DEEEIATTNPVAYEQWGVVCSNQNDGNQQEQGMED

SEQ ID NO: 172710 - protein, 33 aa, Artificial Sequence
  Description of Artificial Sequence: Synthetic polypeptide
QEGEIAPTNPCSYEQYGCIVSCCNLSTSGGTNR

SEQ ID NO: 172711 - protein, 32 aa, Artificial Sequence
  Description of Artificial Sequence: Synthetic polypeptide
LENEICTTNPVSTEPYGTISMEDIQQQQNGNH

SEQ ID NO: 172712 - protein, 37 aa, Artificial Sequence
  Description of Artificial Sequence: Synthetic polypeptide
DEAEIATTNPVATEQYGSVCSPAGNHMQEAMDPNEHT

SEQ ID NO: 172713 - protein, 33 aa, Artificial Sequence
  Description of Artificial Sequence: Synthetic polypeptide
QEEEIATTNPVATEQYGETAPCEVESQHTEGEK

SEQ ID NO: 172714 - protein, 30 aa, Artificial Sequence
  Description of Artificial Sequence: Synthetic polypeptide
QESEIASTNPVGYEGYGVTACSTLQHGGDI

SEQ ID NO: 172715 - protein, 35 aa, Artificial Sequence
  Description of Artificial Sequence: Synthetic polypeptide
DEEEIRTTNPVATEQYGVCVEPEPVNMPNVDMFEL

SEQ ID NO: 172716 - protein, 35 aa, Artificial Sequence
  Description of Artificial Sequence: Synthetic polypeptide
DEEEIACTNPVATEQYGSVCAAMMHGQDEMGGSGD

SEQ ID NO: 172717 - protein, 39 aa, Artificial Sequence
  Description of Artificial Sequence: Synthetic polypeptide
DEEEIRTTNPVATEQYGVVSTVVVVTNNQQGTEEEEEED

SEQ ID NO: 172718 - protein, 36 aa, Artificial Sequence
  Description of Artificial Sequence: Synthetic polypeptide
DEEEIRTTNPVATEQYGVCVEPNPVHMPNFVDMFEG

SEQ ID NO: 172719 - protein, 31 aa, Artificial Sequence
  Description of Artificial Sequence: Synthetic polypeptide
QEQEIAPTNPCSYEQWGIVYSCNDDQSGDTR

SEQ ID NO: 172720 - protein, 30 aa, Artificial Sequence
  Description of Artificial Sequence: Synthetic polypeptide
QESEIASTNPVGTEGYGCMCASALQHGSDI

SEQ ID NO: 172721 - protein, 39 aa, Artificial Sequence
  Description of Artificial Sequence: Synthetic polypeptide
DEEEIRTTNPVATEQYGSNIVTWSINDEEQNNEPDINEV

SEQ ID NO: 172722 - protein, 36 aa, Artificial Sequence
  Description of Artificial Sequence: Synthetic polypeptide
DENEIATTNPVATEQYGSVCAANNGDEQGMDINNNH

SEQ ID NO: 172723 - protein, 35 aa, Artificial Sequence
  Description of Artificial Sequence: Synthetic polypeptide
DDAEIRCTNPVATEQYGCVSWVYNHEQEGFGDQMH

SEQ ID NO: 172724 - protein, 32 aa, Artificial Sequence
  Description of Artificial Sequence: Synthetic polypeptide
DCSEVASTNPVSTEGYGNVACNTAIQSRVGQR

SEQ ID NO: 172725 - protein, 37 aa, Artificial Sequence
  Description of Artificial Sequence: Synthetic polypeptide
DEEEIRTTNPVATEQYGSGYMGELSTQQMTIVNQSSQ

SEQ ID NO: 172726 - protein, 31 aa, Artificial Sequence
  Description of Artificial Sequence: Synthetic polypeptide
QEHEIASTNPVGTEGYGAVYMASTLESHGDI

SEQ ID NO: 172727 - protein, 39 aa, Artificial Sequence
  Description of Artificial Sequence: Synthetic polypeptide
AEEEIRTTNPVATEQYGSVVVTVTNNQLGNSEQGTNDDD

SEQ ID NO: 172728 - protein, 39 aa, Artificial Sequence
  Description of Artificial Sequence: Synthetic polypeptide
DEEEIRTTNPVATEQYGVVSTVVNVTNNQQGTTEEEEEE

SEQ ID NO: 172729 - protein, 39 aa, Artificial Sequence
  Description of Artificial Sequence: Synthetic polypeptide
DEEEIRTTNPVATEQYGVVSTVVTNNNQQNQNGTEQGSE

SEQ ID NO: 172730 - protein, 34 aa, Artificial Sequence
  Description of Artificial Sequence: Synthetic polypeptide
NEAEIATTNPVAYECWGVVCSTDNGQEQDGDGRR

SEQ ID NO: 172731 - protein, 37 aa, Artificial Sequence
  Description of Artificial Sequence: Synthetic polypeptide
DAEEIATTNPVATEQYGSVCSPAGPNTDNDMSEGAEW

SEQ ID NO: 172732 - protein, 33 aa, Artificial Sequence
  Description of Artificial Sequence: Synthetic polypeptide
QEGCIAPTNPCSYEQYGKVSCNELSQSGGTNRV

SEQ ID NO: 172733 - protein, 39 aa, Artificial Sequence
  Description of Artificial Sequence: Synthetic polypeptide
AEEEIRTTNPVATEQYGSVVVTVTNNQLGGTEQGNNTNQ

SEQ ID NO: 172734 - protein, 36 aa, Artificial Sequence
  Description of Artificial Sequence: Synthetic polypeptide
DEEEIRTTNPVATEQYGVCVCPSPVHIPNPVDMFEG

SEQ ID NO: 172735 - protein, 30 aa, Artificial Sequence
  Description of Artificial Sequence: Synthetic polypeptide
QESEIASTNPVGYEGYGVTASTLSQHTGDI

SEQ ID NO: 172736 - protein, 36 aa, Artificial Sequence
  Description of Artificial Sequence: Synthetic polypeptide
DEEEIRTTNPVATEQYGVCVCPSPNNMPNVDMMFEE

SEQ ID NO: 172737 - protein, 36 aa, Artificial Sequence
  Description of Artificial Sequence: Synthetic polypeptide
DEGEIATTNPVATEQWGSVSATGDMGEDHEGGEDNH

SEQ ID NO: 172738 - protein, 39 aa, Artificial Sequence
  Description of Artificial Sequence: Synthetic polypeptide
DEEEIRTTNPVATEQYGSNIVTWSPNDEEQNNESEIRSV

SEQ ID NO: 172739 - protein, 37 aa, Artificial Sequence
  Description of Artificial Sequence: Synthetic polypeptide
DEEEIRTTNPVATEQYGSYVEPVMVLHANIDNGVETF

SEQ ID NO: 172740 - protein, 36 aa, Artificial Sequence
  Description of Artificial Sequence: Synthetic polypeptide
DELEIATTNPVATEFYGSVSATGDQGEDQEGGEDGD

SEQ ID NO: 172741 - protein, 35 aa, Artificial Sequence
  Description of Artificial Sequence: Synthetic polypeptide
DEMAIRTTNPVATEQYGQCFCSTEHNIENFGSDQA

SEQ ID NO: 172742 - protein, 36 aa, Artificial Sequence
  Description of Artificial Sequence: Synthetic polypeptide
DEEEIRTTNPVATEQYGVAVHPSPVHMPNPVDMFEG

SEQ ID NO: 172743 - protein, 36 aa, Artificial Sequence
  Description of Artificial Sequence: Synthetic polypeptide
DEEEIRTTNPVATEQYGWIYHTTLEDHNDEYGDEDQ

SEQ ID NO: 172744 - protein, 37 aa, Artificial Sequence
  Description of Artificial Sequence: Synthetic polypeptide
DEEEIRTTNPVATEQYGVAVQPWNQEQEFLEQHVSEE

SEQ ID NO: 172745 - protein, 30 aa, Artificial Sequence
  Description of Artificial Sequence: Synthetic polypeptide
QESEIASTNPVGYEGYGVMASTLSQHGGDD

SEQ ID NO: 172746 - protein, 35 aa, Artificial Sequence
  Description of Artificial Sequence: Synthetic polypeptide
QEEEIATTNPVATEQYGETAPCELVESQHPEGENK

SEQ ID NO: 172747 - protein, 38 aa, Artificial Sequence
  Description of Artificial Sequence: Synthetic polypeptide
DEEEIKTTNPVATEQYGSVSVGQVGQNSGQNGGQEGIT

SEQ ID NO: 172748 - protein, 35 aa, Artificial Sequence
  Description of Artificial Sequence: Synthetic polypeptide
DEGEIATTNPVATEQWGSVSATGTPGIDHQGDEDN

SEQ ID NO: 172749 - protein, 36 aa, Artificial Sequence
  Description of Artificial Sequence: Synthetic polypeptide
DEEEIRTTNPVATEQYGVCAYPSPVYMPNVDMYFEG

SEQ ID NO: 172750 - protein, 36 aa, Artificial Sequence
  Description of Artificial Sequence: Synthetic polypeptide
DEEEIRTTNPVATEQYGVCCVHPSPVNMPNAVSMFE

SEQ ID NO: 172751 - protein, 39 aa, Artificial Sequence
  Description of Artificial Sequence: Synthetic polypeptide
DEEEIRTTNPVATEQYGVVSTVVQNGTQAGTTEAGSTTQ

SEQ ID NO: 172752 - protein, 35 aa, Artificial Sequence
  Description of Artificial Sequence: Synthetic polypeptide
LEGEIRTTNPVATEQYGSCWVTEVMPEGMELVIRE

SEQ ID NO: 172753 - protein, 33 aa, Artificial Sequence
  Description of Artificial Sequence: Synthetic polypeptide
DEMEIRTTNPIATECYGATWAATEDWEPKGNYD

SEQ ID NO: 172754 - protein, 36 aa, Artificial Sequence
  Description of Artificial Sequence: Synthetic polypeptide
DEEEIRTTNPVATEQYGVCQHPSPVHMPNPVDMFEQ

SEQ ID NO: 172755 - protein, 39 aa, Artificial Sequence
  Description of Artificial Sequence: Synthetic polypeptide
DEEEIRTTNPVATEQYGVVSTVVNVTTNQQGTEEGEEED

SEQ ID NO: 172756 - protein, 36 aa, Artificial Sequence
  Description of Artificial Sequence: Synthetic polypeptide
DEMEIVTTNPVATEQYGTVCSNTEEPNEEFFGSQQS

SEQ ID NO: 172757 - protein, 39 aa, Artificial Sequence
  Description of Artificial Sequence: Synthetic polypeptide
AEEEIRTTNPVATEQYGSVVVTVTNNQQGNVEQGTNDEE

SEQ ID NO: 172758 - protein, 33 aa, Artificial Sequence
  Description of Artificial Sequence: Synthetic polypeptide
QENEIATTNPVAYEPYGYNVSGEHLQHMNYTLN

SEQ ID NO: 172759 - protein, 37 aa, Artificial Sequence
  Description of Artificial Sequence: Synthetic polypeptide
MEGEIRTTNPVATEQYGSVSSPTPAGPNERFGSSPVQ

SEQ ID NO: 172760 - protein, 37 aa, Artificial Sequence
  Description of Artificial Sequence: Synthetic polypeptide
DDEEIRTTNPVATEQWGQCVTSTGEDNQENFGSDNAS

SEQ ID NO: 172761 - protein, 33 aa, Artificial Sequence
  Description of Artificial Sequence: Synthetic polypeptide
QENEIATTNPVATEGYGCVCSNWELNQHFISEQ

SEQ ID NO: 172762 - protein, 40 aa, Artificial Sequence
  Description of Artificial Sequence: Synthetic polypeptide
DEEEIRTTNPVATEQYGVVSTNVATEQGSEGGNNNTQGDD

SEQ ID NO: 172763 - protein, 36 aa, Artificial Sequence
  Description of Artificial Sequence: Synthetic polypeptide
DEGEIATTNPVAYEQYGSVPSANNHAQENPDENDNN

SEQ ID NO: 172764 - protein, 40 aa, Artificial Sequence
  Description of Artificial Sequence: Synthetic polypeptide
DEEEIRTTNPVATEQYGVVSTNVATEQGSEGGNNNGEQSD

SEQ ID NO: 172765 - protein, 39 aa, Artificial Sequence
  Description of Artificial Sequence: Synthetic polypeptide
DEEEIRTTNPVATEQYGVVSVVVTTNQAGNQQGTTEEGS

SEQ ID NO: 172766 - protein, 33 aa, Artificial Sequence
  Description of Artificial Sequence: Synthetic polypeptide
DENEIATTNPVAYEQWGGVYSIEIEMNQREDKE

SEQ ID NO: 172767 - protein, 37 aa, Artificial Sequence
  Description of Artificial Sequence: Synthetic polypeptide
DEMEIRTTNPVATEQYGSCTQNVVELWPFEGDNEATN

SEQ ID NO: 172768 - protein, 36 aa, Artificial Sequence
  Description of Artificial Sequence: Synthetic polypeptide
MEGEIRTTNPVATEEYGCVSLEVLNQNNIGNNFFMD

SEQ ID NO: 172769 - protein, 31 aa, Artificial Sequence
  Description of Artificial Sequence: Synthetic polypeptide
DENEIATTNPVATEQWGCVAEGEEMNAALDM

SEQ ID NO: 172770 - protein, 36 aa, Artificial Sequence
  Description of Artificial Sequence: Synthetic polypeptide
DEEEIATTNPVAYEQYGWIVVSCTPEGSQTTNVNDD

SEQ ID NO: 172771 - protein, 35 aa, Artificial Sequence
  Description of Artificial Sequence: Synthetic polypeptide
DEMEIVTTNPVATEQYGAVCSAWDGSPVEFEGNNE

SEQ ID NO: 172772 - protein, 37 aa, Artificial Sequence
  Description of Artificial Sequence: Synthetic polypeptide
DEEEIATTNPVAYEQYGWIVCSCTLVEGSQTVNGNND

SEQ ID NO: 172773 - protein, 36 aa, Artificial Sequence
  Description of Artificial Sequence: Synthetic polypeptide
DEEEIGTTNPVATEQYGCVCSWEEDHDQENFGSEQS

SEQ ID NO: 172774 - protein, 36 aa, Artificial Sequence
  Description of Artificial Sequence: Synthetic polypeptide
NEEEIRGTNPVATEQYGSVSVSLLLNEDENTLTVKG

SEQ ID NO: 172775 - protein, 36 aa, Artificial Sequence
  Description of Artificial Sequence: Synthetic polypeptide
DEEEIRTTNPVATEQYGSVEGWNPGMDIPMEFMSQS

SEQ ID NO: 172776 - protein, 37 aa, Artificial Sequence
  Description of Artificial Sequence: Synthetic polypeptide
DEMEIRTTNPVATEQYGSCTQNVVEQWPPEGNNEAYN

SEQ ID NO: 172777 - protein, 35 aa, Artificial Sequence
  Description of Artificial Sequence: Synthetic polypeptide
DEHEIRTTNPVAYECWGCVSGGNGEDERNTMNGNA

SEQ ID NO: 172778 - protein, 32 aa, Artificial Sequence
  Description of Artificial Sequence: Synthetic polypeptide
QESEIASTNPVATECYGVVSSITEQDHEGEDG

SEQ ID NO: 172779 - protein, 35 aa, Artificial Sequence
  Description of Artificial Sequence: Synthetic polypeptide
DEGEIATTNPVAYEEWGSVATGGNTGNAGGNDNNR

SEQ ID NO: 172780 - protein, 39 aa, Artificial Sequence
  Description of Artificial Sequence: Synthetic polypeptide
DEEEIRTTNPVATEQYGVVSTVVVTNNTQQGTEEEEEEA

SEQ ID NO: 172781 - protein, 36 aa, Artificial Sequence
  Description of Artificial Sequence: Synthetic polypeptide
DDEEIATTNPVSTEGYGNVSATNPTIPNSRVGMQPR

SEQ ID NO: 172782 - protein, 36 aa, Artificial Sequence
  Description of Artificial Sequence: Synthetic polypeptide
MEGEIRCTNPVATEQYGSVSVSFNLDTPREVQADIV

SEQ ID NO: 172783 - protein, 37 aa, Artificial Sequence
  Description of Artificial Sequence: Synthetic polypeptide
DEEEIACTNPVATEQYGSACAATNGEEAPGNQMEGNN

SEQ ID NO: 172784 - protein, 34 aa, Artificial Sequence
  Description of Artificial Sequence: Synthetic polypeptide
DEMEIVTTNPVATEQYGAVCTAIDGPVEFEGQFP

SEQ ID NO: 172785 - protein, 35 aa, Artificial Sequence
  Description of Artificial Sequence: Synthetic polypeptide
DEMEIVTTNPVATEQYGAVCTAWDGPVEFEGNNEY

SEQ ID NO: 172786 - protein, 34 aa, Artificial Sequence
  Description of Artificial Sequence: Synthetic polypeptide
DEMEIVTTNPVATEQYGAVWAAADGWVEEFKGND

SEQ ID NO: 172787 - protein, 38 aa, Artificial Sequence
  Description of Artificial Sequence: Synthetic polypeptide
AEEEIRTTNPVATEQYGSVVVVVTTNAQQGTTDEQGET

SEQ ID NO: 172788 - protein, 36 aa, Artificial Sequence
  Description of Artificial Sequence: Synthetic polypeptide
DEEEIATTNPVATEQYGSACAANPAEADAEIGNDTF

SEQ ID NO: 172789 - protein, 36 aa, Artificial Sequence
  Description of Artificial Sequence: Synthetic polypeptide
DEHEISTTNPVAYECWGSVATGNGPLQDDRQQNGTD

SEQ ID NO: 172790 - protein, 38 aa, Artificial Sequence
  Description of Artificial Sequence: Synthetic polypeptide
DEEEIRTTNPVATEQYGVVSVVVNQNGTTEQGTEQGTD

SEQ ID NO: 172791 - protein, 38 aa, Artificial Sequence
  Description of Artificial Sequence: Synthetic polypeptide
AEEEIRTTNPVATEQYGSVVVVVTTNAQQGTTDEGSEE

SEQ ID NO: 172792 - protein, 36 aa, Artificial Sequence
  Description of Artificial Sequence: Synthetic polypeptide
DEGEIATTNPVAYEQYGSVCSVDHLPQDSMDGMDKW

SEQ ID NO: 172793 - protein, 38 aa, Artificial Sequence
  Description of Artificial Sequence: Synthetic polypeptide
AEEEIRTTNPVATEQYGSVVVVVTTNAQQGATDETDET

SEQ ID NO: 172794 - protein, 33 aa, Artificial Sequence
  Description of Artificial Sequence: Synthetic polypeptide
DENEIATTNPVATEQWGCVAGEGEANAASDNQI

SEQ ID NO: 172795 - protein, 34 aa, Artificial Sequence
  Description of Artificial Sequence: Synthetic polypeptide
DEGEIATTNPVAYEQWGSVASGAIGIPTPDGDNP

SEQ ID NO: 172796 - protein, 33 aa, Artificial Sequence
  Description of Artificial Sequence: Synthetic polypeptide
DEEEIASVNPVATECYGVTVANDENWQEPGPYQ

SEQ ID NO: 172797 - protein, 39 aa, Artificial Sequence
  Description of Artificial Sequence: Synthetic polypeptide
DEEEIRTTNPVATEQYGVVSVVVTTNNNQQGTTEQGTSE

SEQ ID NO: 172798 - protein, 34 aa, Artificial Sequence
  Description of Artificial Sequence: Synthetic polypeptide
DEEEIATTNPVAYERWGVCATANLDPGDHPNNDE

SEQ ID NO: 172799 - protein, 39 aa, Artificial Sequence
  Description of Artificial Sequence: Synthetic polypeptide
DEEEIRTTNPVATEQYGVVSTVVVTNNQQQGTEESEEGD

SEQ ID NO: 172800 - protein, 37 aa, Artificial Sequence
  Description of Artificial Sequence: Synthetic polypeptide
DEEEIRTTNPVATEQYGSYVYPTPGFEWQGSIVVEDM

SEQ ID NO: 172801 - protein, 38 aa, Artificial Sequence
  Description of Artificial Sequence: Synthetic polypeptide
AEEEIRTTNPVATEQYGSVVVVVTTNANQNANDENEEA

SEQ ID NO: 172802 - protein, 39 aa, Artificial Sequence
  Description of Artificial Sequence: Synthetic polypeptide
DEEEIRTTNPVATEQYGVVSTVNQQQQNATTEQGSTQDE

SEQ ID NO: 172803 - protein, 38 aa, Artificial Sequence
  Description of Artificial Sequence: Synthetic polypeptide
AEEEIRTTNPVATEQYGSVVVVVTTNAEQGATDENEET

SEQ ID NO: 172804 - protein, 34 aa, Artificial Sequence
  Description of Artificial Sequence: Synthetic polypeptide
DEMEIVTTNPVATEQYGAVWANADGWVEEFKGPD

SEQ ID NO: 172805 - protein, 35 aa, Artificial Sequence
  Description of Artificial Sequence: Synthetic polypeptide
MEGEIRTTNPVATEQYGACSGPDNEGHENGNEDQA

SEQ ID NO: 172806 - protein, 32 aa, Artificial Sequence
  Description of Artificial Sequence: Synthetic polypeptide
DEGEIATTNPVAYEQWGCVAGEGEANAASDNA

SEQ ID NO: 172807 - protein, 33 aa, Artificial Sequence
  Description of Artificial Sequence: Synthetic polypeptide
DENEIATTNPVATEQWGCVAGEGEANAAEDNDN

SEQ ID NO: 172808 - protein, 30 aa, Artificial Sequence
  Description of Artificial Sequence: Synthetic polypeptide
QESEIASTNPVGTEGYGVMASPLRQKHGDI

SEQ ID NO: 172809 - protein, 35 aa, Artificial Sequence
  Description of Artificial Sequence: Synthetic polypeptide
DEEEIGTTNPVATEQYGCVCSWEDHNQENFISDQS

SEQ ID NO: 172810 - protein, 34 aa, Artificial Sequence
  Description of Artificial Sequence: Synthetic polypeptide
DEHEIATTNPVAYEPYGTEVCAAANGDQADGTKR

SEQ ID NO: 172811 - protein, 30 aa, Artificial Sequence
  Description of Artificial Sequence: Synthetic polypeptide
QEEEIATTNPVATEQWGEAPAVCAEHKEEK

SEQ ID NO: 172812 - protein, 37 aa, Artificial Sequence
  Description of Artificial Sequence: Synthetic polypeptide
MEGEIRCTNPVATEQYGSVSSTNMAGPNERFEMLDVA

SEQ ID NO: 172813 - protein, 35 aa, Artificial Sequence
  Description of Artificial Sequence: Synthetic polypeptide
MEGEIRCTNPVATEQYGCCSTVPLHIENGDQNDES

SEQ ID NO: 172814 - protein, 36 aa, Artificial Sequence
  Description of Artificial Sequence: Synthetic polypeptide
DEEEIGTTNPVATEQYGCVCSNSGEHNANFNSDNQS

SEQ ID NO: 172815 - protein, 36 aa, Artificial Sequence
  Description of Artificial Sequence: Synthetic polypeptide
DEEEIRTTNPVATEQYGSIGEPIMSMDDAQAPIQVL

SEQ ID NO: 172816 - protein, 37 aa, Artificial Sequence
  Description of Artificial Sequence: Synthetic polypeptide
QEEEIRTTNPVATEQYGSVEPNENNLHMMTEHVSQNE

SEQ ID NO: 172817 - protein, 36 aa, Artificial Sequence
  Description of Artificial Sequence: Synthetic polypeptide
DENEIATTNPVATEQYGCVAATTGMNATASIDENRM

SEQ ID NO: 172818 - protein, 32 aa, Artificial Sequence
  Description of Artificial Sequence: Synthetic polypeptide
QEEEIATTNPVAYEQYGEAPPCEVDSQHEGEK

SEQ ID NO: 172819 - protein, 35 aa, Artificial Sequence
  Description of Artificial Sequence: Synthetic polypeptide
MEHEIATVNPAATEQYGSVIITNGLGGGQEGGETT

SEQ ID NO: 172820 - protein, 34 aa, Artificial Sequence
  Description of Artificial Sequence: Synthetic polypeptide
MEEPIRCTNPVATEQYGCVTTQNDCQTFMPQSCI

SEQ ID NO: 172821 - protein, 34 aa, Artificial Sequence
  Description of Artificial Sequence: Synthetic polypeptide
DEEEIATTNPVAYEQWGSACAAANGLQSMEVDDE

SEQ ID NO: 172822 - protein, 37 aa, Artificial Sequence
  Description of Artificial Sequence: Synthetic polypeptide
DEMEIRTTNPVATEQYGSDCTPTVGWNQEQREEQYQV

SEQ ID NO: 172823 - protein, 30 aa, Artificial Sequence
  Description of Artificial Sequence: Synthetic polypeptide
NEEEIACTNPVAYEQWGEAYYVEQPNEEGR

SEQ ID NO: 172824 - protein, 35 aa, Artificial Sequence
  Description of Artificial Sequence: Synthetic polypeptide
DENEIATTNPVATEQYGCVAATQGLPPAEAEPNHH

SEQ ID NO: 172825 - protein, 33 aa, Artificial Sequence
  Description of Artificial Sequence: Synthetic polypeptide
QEEEIATTNPVATEQYGAVAGPEGGQGEEDEGQ

SEQ ID NO: 172826 - protein, 36 aa, Artificial Sequence
  Description of Artificial Sequence: Synthetic polypeptide
DEEEIGTTNPVATEQYGCVCSMWEHNQENFNSDNQS

SEQ ID NO: 172827 - protein, 32 aa, Artificial Sequence
  Description of Artificial Sequence: Synthetic polypeptide
NEEEIACTNPVAYEQWGCSATHLAPDQMGQDM

SEQ ID NO: 172828 - protein, 34 aa, Artificial Sequence
  Description of Artificial Sequence: Synthetic polypeptide
DEMEIATTNPVAYEQYGTVCSATDGPIEFEGGDA

SEQ ID NO: 172829 - protein, 34 aa, Artificial Sequence
  Description of Artificial Sequence: Synthetic polypeptide
DEMEIVTTNPVATEQWGTVCSCDGPVEDFEGENG

SEQ ID NO: 172830 - protein, 35 aa, Artificial Sequence
  Description of Artificial Sequence: Synthetic polypeptide
DENEIATTNPVATEQWGCVAANEGLEAPDNQNGRD

SEQ ID NO: 172831 - protein, 34 aa, Artificial Sequence
  Description of Artificial Sequence: Synthetic polypeptide
DEIAEIATTNPVAYERWGSVSWTEHEGDRGGGEH

SEQ ID NO: 172832 - protein, 37 aa, Artificial Sequence
  Description of Artificial Sequence: Synthetic polypeptide
DEEEIATTNPVATEQYGSVCAATMHGEAPIDLMEGRH

SEQ ID NO: 172833 - protein, 35 aa, Artificial Sequence
  Description of Artificial Sequence: Synthetic polypeptide
DEMEIVTTNPVATEQWGTVCSATDGPVEVFEGNKD

SEQ ID NO: 172834 - protein, 32 aa, Artificial Sequence
  Description of Artificial Sequence: Synthetic polypeptide
QEEEIATTNPVATEQYGCACPSEDQEHISEQA

SEQ ID NO: 172835 - protein, 35 aa, Artificial Sequence
  Description of Artificial Sequence: Synthetic polypeptide
DEGEIATTNPVAYEQYGSVSVAPHLNEAPGGEADN

SEQ ID NO: 172836 - protein, 34 aa, Artificial Sequence
  Description of Artificial Sequence: Synthetic polypeptide
DENEIATTNPVATEQWGCVAANNALEATMNPENH

SEQ ID NO: 172837 - protein, 40 aa, Artificial Sequence
  Description of Artificial Sequence: Synthetic polypeptide
DEEEIRTTNPVATEQYGVVSTNVATEQGSEGGNNNEEQDE

SEQ ID NO: 172838 - protein, 39 aa, Artificial Sequence
  Description of Artificial Sequence: Synthetic polypeptide
DEEEIRTTNPVATEQYGTVSTTNQQQQNATTEQGTTEEE

SEQ ID NO: 172839 - protein, 34 aa, Artificial Sequence
  Description of Artificial Sequence: Synthetic polypeptide
DEAEIATTNPVAYEQWGSVSGGNGNEDGEGDDTS

SEQ ID NO: 172840 - protein, 32 aa, Artificial Sequence
  Description of Artificial Sequence: Synthetic polypeptide
DEEEIASVNPIATEQYGAVSNDEDWAEPGPYQ

SEQ ID NO: 172841 - protein, 38 aa, Artificial Sequence
  Description of Artificial Sequence: Synthetic polypeptide
AEEEIRTTNPVATEQYGSVVTVNTNNNDESGTVNNATG

SEQ ID NO: 172842 - protein, 36 aa, Artificial Sequence
  Description of Artificial Sequence: Synthetic polypeptide
DEEEIATTNPVATEQYGSACAANNIETEAPGGNMTQ

SEQ ID NO: 172843 - protein, 36 aa, Artificial Sequence
  Description of Artificial Sequence: Synthetic polypeptide
MEGTIRTTNPVATEQYGSVMGSMDNLIGIGGESGGG

SEQ ID NO: 172844 - protein, 37 aa, Artificial Sequence
  Description of Artificial Sequence: Synthetic polypeptide
DEEEIGTTNPVATEQYGCVCSNSGEHNQEFFGSDNQS

SEQ ID NO: 172845 - protein, 35 aa, Artificial Sequence
  Description of Artificial Sequence: Synthetic polypeptide
DEHEIATTNPVAYEQWGAVYCTENDQHLDKGDNNE

SEQ ID NO: 172846 - protein, 36 aa, Artificial Sequence
  Description of Artificial Sequence: Synthetic polypeptide
MEGEICTTNPVATEQYGSVCPTTLLSEIEGGDGANE

SEQ ID NO: 172847 - protein, 35 aa, Artificial Sequence
  Description of Artificial Sequence: Synthetic polypeptide
MEGEICTTNPVATEQYGSCSCMDHIWQDRENEEHN

SEQ ID NO: 172848 - protein, 35 aa, Artificial Sequence
  Description of Artificial Sequence: Synthetic polypeptide
MEGEICTTNPVATEQYGSCCSTMLLSEEGGDGAFE

SEQ ID NO: 172849 - protein, 34 aa, Artificial Sequence
  Description of Artificial Sequence: Synthetic polypeptide
DEHEIRTTNPVAYECWGCVSGGNGEERNNMDGHQ

SEQ ID NO: 172850 - protein, 37 aa, Artificial Sequence
  Description of Artificial Sequence: Synthetic polypeptide
DEEEIGTTNPVATEQYGCVCSWEEDHNQENFGSDNQS

SEQ ID NO: 172851 - protein, 36 aa, Artificial Sequence
  Description of Artificial Sequence: Synthetic polypeptide
DEEEIRTTNPVATEQYGSVQFIFMGEENPEGEVPEI

SEQ ID NO: 172852 - protein, 35 aa, Artificial Sequence
  Description of Artificial Sequence: Synthetic polypeptide
MEGEIATTNPVATEQYGNTVNNVTMMLQGGQFDPY

SEQ ID NO: 172853 - protein, 33 aa, Artificial Sequence
  Description of Artificial Sequence: Synthetic polypeptide
QAEEIATTNPVAYEPYGSVATGPGQNANPTNGM

SEQ ID NO: 172854 - protein, 37 aa, Artificial Sequence
  Description of Artificial Sequence: Synthetic polypeptide
DEEEIATTNPVATEQYGSICAGTDGVLTDNDGEGEAM

SEQ ID NO: 172855 - protein, 36 aa, Artificial Sequence
  Description of Artificial Sequence: Synthetic polypeptide
DENEIATTNPVAYEQYGSVCSVAPHLNEAPGGEARN

SEQ ID NO: 172856 - protein, 36 aa, Artificial Sequence
  Description of Artificial Sequence: Synthetic polypeptide
MEGTIRTTNPVATEQYGSVMGSMDNPLIGIGGEGGG

SEQ ID NO: 172857 - protein, 41 aa, Artificial Sequence
  Description of Artificial Sequence: Synthetic polypeptide
DEEEIRTTNPVATEQYGVVSTVNLQAGNNLGNQGTNNTTDD

SEQ ID NO: 172858 - protein, 33 aa, Artificial Sequence
  Description of Artificial Sequence: Synthetic polypeptide
DENEIATTNPVAYEQWGGVYSIEIEMNNREDQH

SEQ ID NO: 172859 - protein, 31 aa, Artificial Sequence
  Description of Artificial Sequence: Synthetic polypeptide
QESEIASTNPVGTEGYGVMASTLQHGLDPIK

SEQ ID NO: 172860 - protein, 35 aa, Artificial Sequence
  Description of Artificial Sequence: Synthetic polypeptide
DENEIATTNPVATEQWGCVAATGPLEAPDNQHNRN

SEQ ID NO: 172861 - protein, 37 aa, Artificial Sequence
  Description of Artificial Sequence: Synthetic polypeptide
DEEEIRTTNPVATEQYGSVQVAIEVEQIENTEEYNDM

SEQ ID NO: 172862 - protein, 37 aa, Artificial Sequence
  Description of Artificial Sequence: Synthetic polypeptide
DEGEIATTNPVATEQYGSVTANMNNEEAPDNQAEGNH

SEQ ID NO: 172863 - protein, 36 aa, Artificial Sequence
  Description of Artificial Sequence: Synthetic polypeptide
MEGEIRCTNPVATEQYGSVSSPTPAGPNERFFENNV

SEQ ID NO: 172864 - protein, 37 aa, Artificial Sequence
  Description of Artificial Sequence: Synthetic polypeptide
DEEEIATTNPVATEQYGSVCAATMHGEAPPDGMENQH

SEQ ID NO: 172865 - protein, 36 aa, Artificial Sequence
  Description of Artificial Sequence: Synthetic polypeptide
MEGEIRTTNPVATEQYGCCSDEVLNQNNIDNNGHRD

SEQ ID NO: 172866 - protein, 32 aa, Artificial Sequence
  Description of Artificial Sequence: Synthetic polypeptide
QENEIATTNPVATEGYGCVCSWGEDQHNSELA

SEQ ID NO: 172867 - protein, 36 aa, Artificial Sequence
  Description of Artificial Sequence: Synthetic polypeptide
DEGEIATTNPVAYEQYGSVCSAPALGQDHQDGQDAH

SEQ ID NO: 172868 - protein, 36 aa, Artificial Sequence
  Description of Artificial Sequence: Synthetic polypeptide
MEGEIRTTNPVATEQYGCVSLEVLSLNNIGTNNFID

SEQ ID NO: 172869 - protein, 35 aa, Artificial Sequence
  Description of Artificial Sequence: Synthetic polypeptide
DEHEIRTTNPVAYECWGCVSGGGNMGNQRGEGGGV

SEQ ID NO: 172870 - protein, 37 aa, Artificial Sequence
  Description of Artificial Sequence: Synthetic polypeptide
DEEEIRTTNPVATEQYGSINSEAFNPDDEDSDQEEIG

SEQ ID NO: 172871 - protein, 36 aa, Artificial Sequence
  Description of Artificial Sequence: Synthetic polypeptide
DENEIATTNPVAYEQYGSVCSMANPNAEHQGDNQDM

SEQ ID NO: 172872 - protein, 35 aa, Artificial Sequence
  Description of Artificial Sequence: Synthetic polypeptide
DENEIATTNPVAYEQYGSVCSMTHGGAEAPIGDHN

SEQ ID NO: 172873 - protein, 35 aa, Artificial Sequence
  Description of Artificial Sequence: Synthetic polypeptide
DEMEIVTTNPVATEQYGCVCSNTGEPNEFFISDTQ

SEQ ID NO: 172874 - protein, 37 aa, Artificial Sequence
  Description of Artificial Sequence: Synthetic polypeptide
DEEEIRTTNPVATEQYGSINSEARNPDDEDSEQEEIE

SEQ ID NO: 172875 - protein, 35 aa, Artificial Sequence
  Description of Artificial Sequence: Synthetic polypeptide
NEEEIATTNPVAYEQYGSVATTGPLSENMDIEEGR

SEQ ID NO: 172876 - protein, 36 aa, Artificial Sequence
  Description of Artificial Sequence: Synthetic polypeptide
DEEEIRTTNPVATEQYGSTCTYPHTPLALVPMVDLD

SEQ ID NO: 172877 - protein, 36 aa, Artificial Sequence
  Description of Artificial Sequence: Synthetic polypeptide
DEEEIATTNPVAYETYGSVPYDISLFTVRSGNEEFF

SEQ ID NO: 172878 - protein, 35 aa, Artificial Sequence
  Description of Artificial Sequence: Synthetic polypeptide
DEHEIRTTNPVAYECWGCVSGGGQMGNQKGEGDGR

SEQ ID NO: 172879 - protein, 34 aa, Artificial Sequence
  Description of Artificial Sequence: Synthetic polypeptide
DENEIATTNPVATEQWGCVAGEGVEMNAAQDGAM

SEQ ID NO: 172880 - protein, 36 aa, Artificial Sequence
  Description of Artificial Sequence: Synthetic polypeptide
NEEEIATTNPVAYEQYGSVSSTGEAGINPRDGMEKV

SEQ ID NO: 172881 - protein, 36 aa, Artificial Sequence
  Description of Artificial Sequence: Synthetic polypeptide
DEEEIRTTNPVATEQYGSINTAPAGVEIQQALEDPD

SEQ ID NO: 172882 - protein, 35 aa, Artificial Sequence
  Description of Artificial Sequence: Synthetic polypeptide
NEEEIATTNPVATECWGMHCWTMNEQQRGQDNGTK

SEQ ID NO: 172883 - protein, 36 aa, Artificial Sequence
  Description of Artificial Sequence: Synthetic polypeptide
DEEEIATTNPVATEQYGSACAANPELGQLHQDDQTG

SEQ ID NO: 172884 - protein, 36 aa, Artificial Sequence
  Description of Artificial Sequence: Synthetic polypeptide
DEEEIRTTNPVATEQYGSVEPAPIMPAEPGLGVPLQ

SEQ ID NO: 172885 - protein, 36 aa, Artificial Sequence
  Description of Artificial Sequence: Synthetic polypeptide
DEMEIVTTNPVATEQYGCVCSNTGEPNAFFGSETQS

SEQ ID NO: 172886 - protein, 35 aa, Artificial Sequence
  Description of Artificial Sequence: Synthetic polypeptide
DDEEIRTTNPCATEQYGCVCSWGEHNAEYFGSDQS

SEQ ID NO: 172887 - protein, 35 aa, Artificial Sequence
  Description of Artificial Sequence: Synthetic polypeptide
DEIAEIATTNPVATEPWGVVCFTNEDHQDRGGTTN

SEQ ID NO: 172888 - protein, 37 aa, Artificial Sequence
  Description of Artificial Sequence: Synthetic polypeptide
DEEEIRTTNPVATEQYGSTCQVAIEEQIENTEEANDN

SEQ ID NO: 172889 - protein, 36 aa, Artificial Sequence
  Description of Artificial Sequence: Synthetic polypeptide
DEGEIATTNPVAYEQYGSVCSPAPHLNEAPGGEARE

SEQ ID NO: 172890 - protein, 37 aa, Artificial Sequence
  Description of Artificial Sequence: Synthetic polypeptide
QAEEIATTNPVATEQYGSVCSMTPTGPLDSMIGNDEE

SEQ ID NO: 172891 - protein, 36 aa, Artificial Sequence
  Description of Artificial Sequence: Synthetic polypeptide
MEGEIRTTNPVATEQYGCVSLEVWNQNNIGNNFFHD

SEQ ID NO: 172892 - protein, 35 aa, Artificial Sequence
  Description of Artificial Sequence: Synthetic polypeptide
MEGEIRTTNPVATEQYGCVSMTGPMMHDEYGIEMI

SEQ ID NO: 172893 - protein, 30 aa, Artificial Sequence
  Description of Artificial Sequence: Synthetic polypeptide
QEGEIAPTNPCSTEQWGIVSENEQNAAEDA

SEQ ID NO: 172894 - protein, 36 aa, Artificial Sequence
  Description of Artificial Sequence: Synthetic polypeptide
DENEIATTNPVAYEQYGSVCQAANVLDQMAPEANES

SEQ ID NO: 172895 - protein, 37 aa, Artificial Sequence
  Description of Artificial Sequence: Synthetic polypeptide
DEMEIRTTNPVATEQYGCVTSTWPAHNAEHFNSDTQA

SEQ ID NO: 172896 - protein, 34 aa, Artificial Sequence
  Description of Artificial Sequence: Synthetic polypeptide
DEMEIVTTNPVATEQYGCVCTAYDGPVEFETNDE

SEQ ID NO: 172897 - protein, 33 aa, Artificial Sequence
  Description of Artificial Sequence: Synthetic polypeptide
QENEIATTNPVATEQYGCAPGMHGQDSEGENKD

SEQ ID NO: 172898 - protein, 37 aa, Artificial Sequence
  Description of Artificial Sequence: Synthetic polypeptide
DEEEIRTTNPVATEQYGSVQFITMGEEQPEPQSVAII

SEQ ID NO: 172899 - protein, 31 aa, Artificial Sequence
  Description of Artificial Sequence: Synthetic polypeptide
QENEIATTNPVATEQYGCAPMHGTDSEGEKM

SEQ ID NO: 172900 - protein, 33 aa, Artificial Sequence
  Description of Artificial Sequence: Synthetic polypeptide
QENEIATTNPVATEQYGCAPPEHGQDSEGENKM

SEQ ID NO: 172901 - protein, 37 aa, Artificial Sequence
  Description of Artificial Sequence: Synthetic polypeptide
DEEEIRTTNPVATEQYGSVQFITMGEEQPEILSVPEI

SEQ ID NO: 172902 - protein, 35 aa, Artificial Sequence
  Description of Artificial Sequence: Synthetic polypeptide
DEMEIATTNPVAYERWGSVCSTTDNHDRDGPGEEQ

SEQ ID NO: 172903 - protein, 36 aa, Artificial Sequence
  Description of Artificial Sequence: Synthetic polypeptide
QAEEIATTNPVATEQYGSVCSANPALQIDHDDTEAG

SEQ ID NO: 172904 - protein, 36 aa, Artificial Sequence
  Description of Artificial Sequence: Synthetic polypeptide
DEEEIRTTNPVATEQYGSVQVAIEEEIENTEEDWDM

SEQ ID NO: 172905 - protein, 35 aa, Artificial Sequence
  Description of Artificial Sequence: Synthetic polypeptide
DEMEIATTNPVAYERWGSVCSTTDNHDRGGGQEPG

SEQ ID NO: 172906 - protein, 34 aa, Artificial Sequence
  Description of Artificial Sequence: Synthetic polypeptide
QEEEIRTTNPVATEQYGQVVVDIEGMGGDEEEGI

SEQ ID NO: 172907 - protein, 35 aa, Artificial Sequence
  Description of Artificial Sequence: Synthetic polypeptide
QAEEIATTNPVATEQWGCVAGNGLSQDDAIGDNNN

SEQ ID NO: 172908 - protein, 37 aa, Artificial Sequence
  Description of Artificial Sequence: Synthetic polypeptide
DEEEIGTTNPVATEQYGCVCSNTGEHNEENFGSDPQA

SEQ ID NO: 172909 - protein, 36 aa, Artificial Sequence
  Description of Artificial Sequence: Synthetic polypeptide
MEGEIRTTNPVATEQYGSVWSYNMEEDNIDGEQIIM

SEQ ID NO: 172910 - protein, 35 aa, Artificial Sequence
  Description of Artificial Sequence: Synthetic polypeptide
QEEEIRTTNPVAYEPYGKISQTHEGSSNRVGNQFH

SEQ ID NO: 172911 - protein, 36 aa, Artificial Sequence
  Description of Artificial Sequence: Synthetic polypeptide
DEMEIVTTNPVATEQYGCVCSNWGEPNEFFGSNTDS

SEQ ID NO: 172912 - protein, 34 aa, Artificial Sequence
  Description of Artificial Sequence: Synthetic polypeptide
DENEIATTNPVATEQWGCVAGNPGGDPAEDNPER

SEQ ID NO: 172913 - protein, 35 aa, Artificial Sequence
  Description of Artificial Sequence: Synthetic polypeptide
MEGEIRTTNPVATEQYGCVSTGPMMIDEYNIEEMI

SEQ ID NO: 172914 - protein, 34 aa, Artificial Sequence
  Description of Artificial Sequence: Synthetic polypeptide
DENEIATTNPVATEQYGCVAANPHGDTDSENNNK

SEQ ID NO: 172915 - protein, 35 aa, Artificial Sequence
  Description of Artificial Sequence: Synthetic polypeptide
DEHEIRTTNPVAYECWGCVSGGGNMGNQQGEGDRG

SEQ ID NO: 172916 - protein, 36 aa, Artificial Sequence
  Description of Artificial Sequence: Synthetic polypeptide
DEEEIATTNPVAYETYGSVPTDISLFTVYSGNEEFN

SEQ ID NO: 172917 - protein, 30 aa, Artificial Sequence
  Description of Artificial Sequence: Synthetic polypeptide
QEEEIATTNPVATEQWGEAAAVCAEHKEEK

SEQ ID NO: 172918 - protein, 33 aa, Artificial Sequence
  Description of Artificial Sequence: Synthetic polypeptide
DENEIATTNPVAYEQWGGVYSIEIEMTQREQDQ

SEQ ID NO: 172919 - protein, 36 aa, Artificial Sequence
  Description of Artificial Sequence: Synthetic polypeptide
DEMEIVTTNPVATEQYGCVCSNTGEGPNEFFGSQDA

SEQ ID NO: 172920 - protein, 38 aa, Artificial Sequence
  Description of Artificial Sequence: Synthetic polypeptide
MEGEIRTTNPVATEQYGCSVNSVAFNLTTERGVQDDIV

SEQ ID NO: 172921 - protein, 37 aa, Artificial Sequence
  Description of Artificial Sequence: Synthetic polypeptide
MEGEIRTTNPVATEQYGCSSQVAVNLTTERGVQADIV

SEQ ID NO: 172922 - protein, 37 aa, Artificial Sequence
  Description of Artificial Sequence: Synthetic polypeptide
DEEEIRTTNPVATEQYGSIGEPTMSTDYDGQTPIQVL

SEQ ID NO: 172923 - protein, 39 aa, Artificial Sequence
  Description of Artificial Sequence: Synthetic polypeptide
DEEEIRTTNPVATEQYGVVSTTVNQNGNNNNQQGTDEED

SEQ ID NO: 172924 - protein, 36 aa, Artificial Sequence
  Description of Artificial Sequence: Synthetic polypeptide
QEEEIATTNPVATEQWGCVAGNNGLPQTAAGEGFRD

SEQ ID NO: 172925 - protein, 35 aa, Artificial Sequence
  Description of Artificial Sequence: Synthetic polypeptide
DEHEIRTTNPVAYECWGCVSGGLGEERNNMQNGNQ

SEQ ID NO: 172926 - protein, 38 aa, Artificial Sequence
  Description of Artificial Sequence: Synthetic polypeptide
DEEEIGTTNPVATEQYGCVCSTWEEDHNAENFGSDNQA

SEQ ID NO: 172927 - protein, 37 aa, Artificial Sequence
  Description of Artificial Sequence: Synthetic polypeptide
DEEEIRTTNPVATEQYGSVEHPVNVGVAIRPMMEVGQ

SEQ ID NO: 172928 - protein, 35 aa, Artificial Sequence
  Description of Artificial Sequence: Synthetic polypeptide
DEHEIATTNPVAYEPWGSVYCTNDLGEDHGNNGSS

SEQ ID NO: 172929 - protein, 33 aa, Artificial Sequence
  Description of Artificial Sequence: Synthetic polypeptide
MEGEIRTTNPVATEQYGCCYTTMDTIEIGGQHI

SEQ ID NO: 172930 - protein, 36 aa, Artificial Sequence
  Description of Artificial Sequence: Synthetic polypeptide
QEEEIATTNPVATEQWGCVAGATGALGQNPGDINAM

SEQ ID NO: 172931 - protein, 36 aa, Artificial Sequence
  Description of Artificial Sequence: Synthetic polypeptide
DEEEIATTNPVATEQYGSACAANPAEGQNHQDDEMW

SEQ ID NO: 172932 - protein, 36 aa, Artificial Sequence
  Description of Artificial Sequence: Synthetic polypeptide
QAEEIATTNPVATEQYGSVCSVNPALQIDHQDDTEA

SEQ ID NO: 172933 - protein, 35 aa, Artificial Sequence
  Description of Artificial Sequence: Synthetic polypeptide
MEGEIRTTNPVATEQYGCCTSPASTTIWEHFSSND

SEQ ID NO: 172934 - protein, 34 aa, Artificial Sequence
  Description of Artificial Sequence: Synthetic polypeptide
QENEIATTNPVATEGYGCVCSWGELQHFISENLA

SEQ ID NO: 172935 - protein, 36 aa, Artificial Sequence
  Description of Artificial Sequence: Synthetic polypeptide
QAAEIATTNPVATEQYGSVCSPDGTGNEAGIGNADM

SEQ ID NO: 172936 - protein, 34 aa, Artificial Sequence
  Description of Artificial Sequence: Synthetic polypeptide
NEEEIATTNPVATAQWGHSVAGAGNGDEAGHNNQ

SEQ ID NO: 172937 - protein, 36 aa, Artificial Sequence
  Description of Artificial Sequence: Synthetic polypeptide
QEEEIRTTNPVATEVYGSVSDGMGENEGNDTGEAGQ

SEQ ID NO: 172938 - protein, 30 aa, Artificial Sequence
  Description of Artificial Sequence: Synthetic polypeptide
QEEEIATTNPVATEQWGEAAAVCAEHKEEI

SEQ ID NO: 172939 - protein, 37 aa, Artificial Sequence
  Description of Artificial Sequence: Synthetic polypeptide
DEEEIRTTNPVATEQYGSVCVHPSPVHMPNFVDMFEY

SEQ ID NO: 172940 - protein, 37 aa, Artificial Sequence
  Description of Artificial Sequence: Synthetic polypeptide
DEEEIRTTNPVATEQYGSIGEPTMSTDDIGQAPIQDL

SEQ ID NO: 172941 - protein, 35 aa, Artificial Sequence
  Description of Artificial Sequence: Synthetic polypeptide
MEGEIRTTNPVATEQYGCCSPDNIEGHENGNEDQG

SEQ ID NO: 172942 - protein, 34 aa, Artificial Sequence
  Description of Artificial Sequence: Synthetic polypeptide
MEGEIRTTNPVATEQYGCCWSQDVSEDEIGSAMY

SEQ ID NO: 172943 - protein, 36 aa, Artificial Sequence
  Description of Artificial Sequence: Synthetic polypeptide
DAEEIATTNPVATEQYGSVCAWNHGPLDSGEGSDHN

SEQ ID NO: 172944 - protein, 34 aa, Artificial Sequence
  Description of Artificial Sequence: Synthetic polypeptide
QEEEIATTNPVATEQWGCVAGATGALGNPTDIRL

SEQ ID NO: 172945 - protein, 34 aa, Artificial Sequence
  Description of Artificial Sequence: Synthetic polypeptide
DEEEIATTNPVAYERWGVCATNNQDPGDHPNGAE

SEQ ID NO: 172946 - protein, 36 aa, Artificial Sequence
  Description of Artificial Sequence: Synthetic polypeptide
DEEEIRTTNPVATEQYGSTCCMLMMNAEPAQDEMID

SEQ ID NO: 172947 - protein, 36 aa, Artificial Sequence
  Description of Artificial Sequence: Synthetic polypeptide
MEGEIRTTNPVATEQYGSVYSPDVEMNTETWQDHPS

SEQ ID NO: 172948 - protein, 37 aa, Artificial Sequence
  Description of Artificial Sequence: Synthetic polypeptide
MEGEIRTTNPVATEQYGCVHSLEVLEQNNIGNNPFFE

SEQ ID NO: 172949 - protein, 36 aa, Artificial Sequence
  Description of Artificial Sequence: Synthetic polypeptide
DEEEIRTTNPVATEQYGSVQNCEGTIQVPISEMETQ

SEQ ID NO: 172950 - protein, 37 aa, Artificial Sequence
  Description of Artificial Sequence: Synthetic polypeptide
DEMEIVTTNPVATEQYGCVCSNTGEDPNEFFGSENQS

SEQ ID NO: 172951 - protein, 37 aa, Artificial Sequence
  Description of Artificial Sequence: Synthetic polypeptide
DEEEIRTTNPVATEQYGSTCAPEQTLDEIMQFGMVED

SEQ ID NO: 172952 - protein, 36 aa, Artificial Sequence
  Description of Artificial Sequence: Synthetic polypeptide
DEMEIVTTNPVAYEQYGCVCSNTGEPNEFFGSNNQS

SEQ ID NO: 172953 - protein, 36 aa, Artificial Sequence
  Description of Artificial Sequence: Synthetic polypeptide
NEEEIATTNPVATAQWGSVSATGAGGQAPMGNGNFE

SEQ ID NO: 172954 - protein, 37 aa, Artificial Sequence
  Description of Artificial Sequence: Synthetic polypeptide
MEGEIRTTNPVATEQYGCVHSLEVLEQNNFGNNFFVD

SEQ ID NO: 172955 - protein, 37 aa, Artificial Sequence
  Description of Artificial Sequence: Synthetic polypeptide
DEEEIRTTNPVATEQYGSIPCVTSMMQQEQMEPQTIV

SEQ ID NO: 172956 - protein, 36 aa, Artificial Sequence
  Description of Artificial Sequence: Synthetic polypeptide
DEMEIVTTNPVATEQYGCVCSNTEEDPNEFFGSQQA

SEQ ID NO: 172957 - protein, 34 aa, Artificial Sequence
  Description of Artificial Sequence: Synthetic polypeptide
DEMEIATTNPVAYEQYGTVCSATDGPVEHEGGDS

SEQ ID NO: 172958 - protein, 35 aa, Artificial Sequence
  Description of Artificial Sequence: Synthetic polypeptide
DEMEIVTTNPVATEQYGCVCSNSGEPNEGFGSDTQ

SEQ ID NO: 172959 - protein, 34 aa, Artificial Sequence
  Description of Artificial Sequence: Synthetic polypeptide
DEMEIVTTNPVAYEQYGTVCSATDGMPVEFEGYD

SEQ ID NO: 172960 - protein, 35 aa, Artificial Sequence
  Description of Artificial Sequence: Synthetic polypeptide
MEGEIRTTNPVATEQYGSWSVMPDENVEFKEIGPS

SEQ ID NO: 172961 - protein, 37 aa, Artificial Sequence
  Description of Artificial Sequence: Synthetic polypeptide
MEGEIRTTNPVATEQYGTCCTLEVLNQNNIGNNGHRD

SEQ ID NO: 172962 - protein, 35 aa, Artificial Sequence
  Description of Artificial Sequence: Synthetic polypeptide
NEEEICTTNPVAYEQWGYYWSQRNDDLQRQDMRDN

SEQ ID NO: 172963 - protein, 36 aa, Artificial Sequence
  Description of Artificial Sequence: Synthetic polypeptide
QAEEIATTNPVATEQYGSVCSTNPALDEHHDDTLAM

SEQ ID NO: 172964 - protein, 37 aa, Artificial Sequence
  Description of Artificial Sequence: Synthetic polypeptide
DEEEIGTTNPVATEQYGCVCSNTGEDHDQENFGSEQS

SEQ ID NO: 172965 - protein, 35 aa, Artificial Sequence
  Description of Artificial Sequence: Synthetic polypeptide
QEEEIVTTNPVATEQYGVVMQGPSEGEGGQGENED

SEQ ID NO: 172966 - protein, 33 aa, Artificial Sequence
  Description of Artificial Sequence: Synthetic polypeptide
DEEEIATTNPVAYERWGVVYITGNQGEDQHNQD

SEQ ID NO: 172967 - protein, 36 aa, Artificial Sequence
  Description of Artificial Sequence: Synthetic polypeptide
MEGEIRTTNPVATEQYGCSVSVAFNQTPEGDQADIV

SEQ ID NO: 172968 - protein, 33 aa, Artificial Sequence
  Description of Artificial Sequence: Synthetic polypeptide
DENEIATTNPVATEQWGCVAGEGEGMNAAVDNA

SEQ ID NO: 172969 - protein, 37 aa, Artificial Sequence
  Description of Artificial Sequence: Synthetic polypeptide
AEEEIRTTNPVATEQYGTVVVVVNTNDESGTVNNNTQ

SEQ ID NO: 172970 - protein, 33 aa, Artificial Sequence
  Description of Artificial Sequence: Synthetic polypeptide
DENEIATTNPVAYEQWGGVYSIEIEHNQREDQI

SEQ ID NO: 172971 - protein, 30 aa, Artificial Sequence
  Description of Artificial Sequence: Synthetic polypeptide
QEGEIATTNPVATEQYGCAPMHGTDSEEKH

SEQ ID NO: 172972 - protein, 35 aa, Artificial Sequence
  Description of Artificial Sequence: Synthetic polypeptide
DEHEIRTTNPVAYECWGCVSGGNGEERNNMQQGNA

SEQ ID NO: 172973 - protein, 39 aa, Artificial Sequence
  Description of Artificial Sequence: Synthetic polypeptide
DEEEIRTTNPVATEQYGVVSTTNQQQQNATTEQGSTDEE

SEQ ID NO: 172974 - protein, 32 aa, Artificial Sequence
  Description of Artificial Sequence: Synthetic polypeptide
QEEEIATTNPVAYEQYGEIPTEVEHSQHETEK

SEQ ID NO: 172975 - protein, 36 aa, Artificial Sequence
  Description of Artificial Sequence: Synthetic polypeptide
QEEGIRTTNPVATEAYGSVSVNNGGEETGGQGEMGN

SEQ ID NO: 172976 - protein, 35 aa, Artificial Sequence
  Description of Artificial Sequence: Synthetic polypeptide
DEMEIRTTNPVATECYGTVCANTDGPVEEPEGNYD

SEQ ID NO: 172977 - protein, 39 aa, Artificial Sequence
  Description of Artificial Sequence: Synthetic polypeptide
DEEEIRTTNPVATEQYGVVSVVVVNTQAGTEAGTNQTQD

SEQ ID NO: 172978 - protein, 36 aa, Artificial Sequence
  Description of Artificial Sequence: Synthetic polypeptide
NQAEIRTTNPVATEQYGSVCSLLQQSEMIGQNEDKE

SEQ ID NO: 172979 - protein, 36 aa, Artificial Sequence
  Description of Artificial Sequence: Synthetic polypeptide
DEHEIATTNPVATEQYGSVCAMNNNLEPDSDQPNGA

SEQ ID NO: 172980 - protein, 36 aa, Artificial Sequence
  Description of Artificial Sequence: Synthetic polypeptide
QEEGIRTTNPVATEAYGSVSVTNGGEETGGQGIQGG

SEQ ID NO: 172981 - protein, 37 aa, Artificial Sequence
  Description of Artificial Sequence: Synthetic polypeptide
QEEGIRTTNPVATEFYGSVSATENGGEEGGGQGEQGN

SEQ ID NO: 172982 - protein, 37 aa, Artificial Sequence
  Description of Artificial Sequence: Synthetic polypeptide
DEGEIATTNPVAYEQYGVSVVGGGNGLPQESGENMND

SEQ ID NO: 172983 - protein, 35 aa, Artificial Sequence
  Description of Artificial Sequence: Synthetic polypeptide
DEEEIGTTNPVATEQYGCVCSWGEHEENFGSETQP

SEQ ID NO: 172984 - protein, 37 aa, Artificial Sequence
  Description of Artificial Sequence: Synthetic polypeptide
DEEEIRTTNPVATEQYGSVDYLINPMNFQEQMQEITD

SEQ ID NO: 172985 - protein, 38 aa, Artificial Sequence
  Description of Artificial Sequence: Synthetic polypeptide
DEEEIATTNPVATEQYGSVCAATANVGGEEHQDDNDAQ

SEQ ID NO: 172986 - protein, 35 aa, Artificial Sequence
  Description of Artificial Sequence: Synthetic polypeptide
DEHEIATTNPVATEQYGSVCADNNEPAQMQHQQEN

SEQ ID NO: 172987 - protein, 34 aa, Artificial Sequence
  Description of Artificial Sequence: Synthetic polypeptide
DEAEICTTNPVAYEQWGSVYSGMNDEHHDGGDTE

SEQ ID NO: 172988 - protein, 36 aa, Artificial Sequence
  Description of Artificial Sequence: Synthetic polypeptide
DEMEICTTNPVATEQYGAVCSATDGTVEFEGSNQQY

SEQ ID NO: 172989 - protein, 33 aa, Artificial Sequence
  Description of Artificial Sequence: Synthetic polypeptide
NNNEIRTTNPVATECWGSCVSEIQEGMNGMEEH

SEQ ID NO: 172990 - protein, 37 aa, Artificial Sequence
  Description of Artificial Sequence: Synthetic polypeptide
QEEGIRTTNPVATEQYGSVSANMNGGEEGGNQGNQGN

SEQ ID NO: 172991 - protein, 35 aa, Artificial Sequence
  Description of Artificial Sequence: Synthetic polypeptide
DEAEICTTNPVAYEQWGSCVYSNEWNDGQHRDQGM

SEQ ID NO: 172992 - protein, 33 aa, Artificial Sequence
  Description of Artificial Sequence: Synthetic polypeptide
QEEEIATTNPVATEQYGDVAGPDEVGQGEIEGQ

SEQ ID NO: 172993 - protein, 38 aa, Artificial Sequence
  Description of Artificial Sequence: Synthetic polypeptide
DEEEIRTTNPVATEQYGSVDVPPMDTHIPPRPGMVIET

SEQ ID NO: 172994 - protein, 37 aa, Artificial Sequence
  Description of Artificial Sequence: Synthetic polypeptide
DEHEIRTTNPVATEQYGSVTYPDATRGETDFNSLQVG

SEQ ID NO: 172995 - protein, 37 aa, Artificial Sequence
  Description of Artificial Sequence: Synthetic polypeptide
DEEEIRTTNPVATEQYGSIGEHLICPIIAISMQADNE

SEQ ID NO: 172996 - protein, 36 aa, Artificial Sequence
  Description of Artificial Sequence: Synthetic polypeptide
QEEGIRTTNPVATEAYGSVNVTNGGEETGGQGNQGN

SEQ ID NO: 172997 - protein, 37 aa, Artificial Sequence
  Description of Artificial Sequence: Synthetic polypeptide
QAEEIATTNPVAYEQYGSVAAIANNLPQGQGGGNMRN

SEQ ID NO: 172998 - protein, 39 aa, Artificial Sequence
  Description of Artificial Sequence: Synthetic polypeptide
DEEEIRTTNPVATEQYGVVSVVVATQQQQQQGTNVATEE

SEQ ID NO: 172999 - protein, 33 aa, Artificial Sequence
  Description of Artificial Sequence: Synthetic polypeptide
DEAEICTTNPVAYEQWGVVYHPENDQQHNGGMM

SEQ ID NO: 173000 - protein, 35 aa, Artificial Sequence
  Description of Artificial Sequence: Synthetic polypeptide
DEAEIRATNPTATECWGSVSRCINEPQVRDDENLG

SEQ ID NO: 173001 - protein, 36 aa, Artificial Sequence
  Description of Artificial Sequence: Synthetic polypeptide
DEEEIGTTNPVATEQYGCVCSWGEDHNQENFNSDLA

SEQ ID NO: 173002 - protein, 33 aa, Artificial Sequence
  Description of Artificial Sequence: Synthetic polypeptide
MENEIACTNPVATEFYGACATSEVLQRGDGQQL

SEQ ID NO: 173003 - protein, 34 aa, Artificial Sequence
  Description of Artificial Sequence: Synthetic polypeptide
DEAEIRTTNGVAYCQYGCVCSWENHQENFGSDQA

SEQ ID NO: 173004 - protein, 41 aa, Artificial Sequence
  Description of Artificial Sequence: Synthetic polypeptide
DEEEIRTTNPVATEQYGTVSTVNLQLNNTTTEQGTNNTTTE

SEQ ID NO: 173005 - protein, 35 aa, Artificial Sequence
  Description of Artificial Sequence: Synthetic polypeptide
DEEEIATTNPVAYEQWGSACAAANGLQDSDGVDDS

SEQ ID NO: 173006 - protein, 36 aa, Artificial Sequence
  Description of Artificial Sequence: Synthetic polypeptide
DEEEIACTNPVATEQYGSACATNPELGQEHQDDIAH

SEQ ID NO: 173007 - protein, 37 aa, Artificial Sequence
  Description of Artificial Sequence: Synthetic polypeptide
DEGEIATTNPVATEQYGSVSATTPAGTNPRNGMEPVN

SEQ ID NO: 173008 - protein, 39 aa, Artificial Sequence
  Description of Artificial Sequence: Synthetic polypeptide
DEEEIRTTNPVATEQYGVVSVVVATQQQSQEGTNVATNE

SEQ ID NO: 173009 - protein, 35 aa, Artificial Sequence
  Description of Artificial Sequence: Synthetic polypeptide
QEEEIATTNPVATEQYGVVAGPGEGENGQGGEGDD

SEQ ID NO: 173010 - protein, 36 aa, Artificial Sequence
  Description of Artificial Sequence: Synthetic polypeptide
DEEEIACTNPVATEQYGSACATNPELGQLHQDDEAE

SEQ ID NO: 173011 - protein, 35 aa, Artificial Sequence
  Description of Artificial Sequence: Synthetic polypeptide
QAEEIATTNPVAYEQYGSTVCAANNLQDQGGGMMN

SEQ ID NO: 173012 - protein, 35 aa, Artificial Sequence
  Description of Artificial Sequence: Synthetic polypeptide
DEMEIATTNPVAYEQYGTVCSATDGPDEFEGNDDP

SEQ ID NO: 173013 - protein, 35 aa, Artificial Sequence
  Description of Artificial Sequence: Synthetic polypeptide
DAEEIATTNPVATEQYGSVCAPAPNDNDMSENADW

SEQ ID NO: 173014 - protein, 41 aa, Artificial Sequence
  Description of Artificial Sequence: Synthetic polypeptide
DEEEIRTTNPVATEQYGTVSTVNLQQGNNTNEQGTNNNDTE

SEQ ID NO: 173015 - protein, 29 aa, Artificial Sequence
  Description of Artificial Sequence: Synthetic peptide
QESEIASTNPVGTEGYGVMASIEQNHGDA

SEQ ID NO: 173016 - protein, 34 aa, Artificial Sequence
  Description of Artificial Sequence: Synthetic polypeptide
DEMEICTTNPVATEQYGAVCFAWDGPVEFEGPNY

SEQ ID NO: 173017 - protein, 37 aa, Artificial Sequence
  Description of Artificial Sequence: Synthetic polypeptide
DEEEIRTTNPVATEQYGSVQVDKEMEQIENTEEANSM

SEQ ID NO: 173018 - protein, 36 aa, Artificial Sequence
  Description of Artificial Sequence: Synthetic polypeptide
DEEEIGTTNPVATEQYGCVCSWGEDHNQENMGSDQF

SEQ ID NO: 173019 - protein, 31 aa, Artificial Sequence
  Description of Artificial Sequence: Synthetic polypeptide
QEEEIATTNPVAYEQYGEIPCEVHSQHEEYK

SEQ ID NO: 173020 - protein, 36 aa, Artificial Sequence
  Description of Artificial Sequence: Synthetic polypeptide
NEEEIRTTNPVATEQYGCSCSTGEHNQEYFISDTQS

SEQ ID NO: 173021 - protein, 37 aa, Artificial Sequence
  Description of Artificial Sequence: Synthetic polypeptide
DEEEIACTNPVATEQYGSACATNPELGTEHQDDNEAG

SEQ ID NO: 173022 - protein, 35 aa, Artificial Sequence
  Description of Artificial Sequence: Synthetic polypeptide
DEMEIRTTNPVATECYGTVCANADGPVEEPEGNYD

SEQ ID NO: 173023 - protein, 36 aa, Artificial Sequence
  Description of Artificial Sequence: Synthetic polypeptide
DEHEIRTTNPVAYECWGSVCYTDNQDQDLRGDTGEN

SEQ ID NO: 173024 - protein, 34 aa, Artificial Sequence
  Description of Artificial Sequence: Synthetic polypeptide
DEEEIACTNPVATEQWGAVCAQNPVNTAGNPTDN

SEQ ID NO: 173025 - protein, 33 aa, Artificial Sequence
  Description of Artificial Sequence: Synthetic polypeptide
QEEEIATTNPVATEQYGDVAGPEGGGQGEEEAQ

SEQ ID NO: 173026 - protein, 36 aa, Artificial Sequence
  Description of Artificial Sequence: Synthetic polypeptide
DEGEIRTTNPVATEQYGSVFQEVHLDHDEIIGSHQE

SEQ ID NO: 173027 - protein, 36 aa, Artificial Sequence
  Description of Artificial Sequence: Synthetic polypeptide
DEEEIATTNPVAYEQWGQSVSVTGDIGQAHGMIAEM

SEQ ID NO: 173028 - protein, 35 aa, Artificial Sequence
  Description of Artificial Sequence: Synthetic polypeptide
DEAEICTTNPVAYEQWGEVATGGNQQDHQAGNTEV

SEQ ID NO: 173029 - protein, 37 aa, Artificial Sequence
  Description of Artificial Sequence: Synthetic polypeptide
DEEEIRTTNPVATEQYGSIFNYTENYEDVNNSMEAIA

SEQ ID NO: 173030 - protein, 34 aa, Artificial Sequence
  Description of Artificial Sequence: Synthetic polypeptide
DEMEIVTTNPVATECYGTVCAATEGPVEPKGNYD

SEQ ID NO: 173031 - protein, 34 aa, Artificial Sequence
  Description of Artificial Sequence: Synthetic polypeptide
DEMEIVTTNPVATECYGTVCAATEGPVEPEGNYD

SEQ ID NO: 173032 - protein, 35 aa, Artificial Sequence
  Description of Artificial Sequence: Synthetic polypeptide
DEMVIGTTNPVATEQWGCVCSTEDHNQYFGSDNQS

SEQ ID NO: 173033 - protein, 38 aa, Artificial Sequence
  Description of Artificial Sequence: Synthetic polypeptide
DEEEIRTTNPVATEQYGSVDTVMTGNIGGDEDEEDGQI

SEQ ID NO: 173034 - protein, 34 aa, Artificial Sequence
  Description of Artificial Sequence: Synthetic polypeptide
DEMEIVTTNPVATECYGTVCAATEGPVEEFKGND

SEQ ID NO: 173035 - protein, 35 aa, Artificial Sequence
  Description of Artificial Sequence: Synthetic polypeptide
DEEEIACTNPVAYEQYGSVATNNLEAETPPDEMAD

SEQ ID NO: 173036 - protein, 34 aa, Artificial Sequence
  Description of Artificial Sequence: Synthetic polypeptide
DEHEIATTNPVAYEQWGSVCGTGAPGETQGGDDH

SEQ ID NO: 173037 - protein, 34 aa, Artificial Sequence
  Description of Artificial Sequence: Synthetic polypeptide
DEMEIVTTNPVATECYGTVCAATDGPVEEFKGND

SEQ ID NO: 173038 - protein, 32 aa, Artificial Sequence
  Description of Artificial Sequence: Synthetic polypeptide
DEAEIATTNPVSTEPYGVCYCEDGQQQQNGNS

SEQ ID NO: 173039 - protein, 35 aa, Artificial Sequence
  Description of Artificial Sequence: Synthetic polypeptide
DEMEIVTTNPVATECYGTTVCSATDDPVEFKGNYI

SEQ ID NO: 173040 - protein, 36 aa, Artificial Sequence
  Description of Artificial Sequence: Synthetic polypeptide
DEEEIATTNPVAYEQYGSVVAAVAGELQDTLNLNDS

SEQ ID NO: 173041 - protein, 35 aa, Artificial Sequence
  Description of Artificial Sequence: Synthetic polypeptide
DDECIRTTNPVATEQYGCVCSWGEDHNQNFNSDLS

SEQ ID NO: 173042 - protein, 33 aa, Artificial Sequence
  Description of Artificial Sequence: Synthetic polypeptide
QEEEIATTNPVAYEQYGEVAPEVEQSQHEGEYK

SEQ ID NO: 173043 - protein, 37 aa, Artificial Sequence
  Description of Artificial Sequence: Synthetic polypeptide
DEEEIRTTNPVATEQYGSVDTVMTGDGGGEDTEDGQN

SEQ ID NO: 173044 - protein, 34 aa, Artificial Sequence
  Description of Artificial Sequence: Synthetic polypeptide
DEMEIVTTNPVATECYGTTTCSATDDPEFKGNYI

SEQ ID NO: 173045 - protein, 38 aa, Artificial Sequence
  Description of Artificial Sequence: Synthetic polypeptide
DEEEIRTTNPVATEQYGSVQCTTWLWTPEENSSPNMDL

SEQ ID NO: 173046 - protein, 33 aa, Artificial Sequence
  Description of Artificial Sequence: Synthetic polypeptide
DEMEIVTTNPVATECYGTTCANTEGPEEFKGND

SEQ ID NO: 173047 - protein, 36 aa, Artificial Sequence
  Description of Artificial Sequence: Synthetic polypeptide
DEEEIATTNPVAYEQYGSVSVAPHLNNEAPIGEAEN

SEQ ID NO: 173048 - protein, 33 aa, Artificial Sequence
  Description of Artificial Sequence: Synthetic polypeptide
QEEEIATTNPVAYEQYGEVAPEGVQSQHEGEKW

SEQ ID NO: 173049 - protein, 36 aa, Artificial Sequence
  Description of Artificial Sequence: Synthetic polypeptide
MEEEISTTNPVATEQYGCVCSWEEHNQENFGSENQA

SEQ ID NO: 173050 - protein, 38 aa, Artificial Sequence
  Description of Artificial Sequence: Synthetic polypeptide
DEEEIRTTNPVATEQYGSVDTVMTGNNEGDEDNEDFQE

SEQ ID NO: 173051 - protein, 34 aa, Artificial Sequence
  Description of Artificial Sequence: Synthetic polypeptide
QEEEIATTNPVATEQYGVVAGAGEGEGGQEENED

SEQ ID NO: 173052 - protein, 38 aa, Artificial Sequence
  Description of Artificial Sequence: Synthetic polypeptide
QEEEIRTTNPVATEQYGVVIVDQDTMNLDDGPEINEGQ

SEQ ID NO: 173053 - protein, 39 aa, Artificial Sequence
  Description of Artificial Sequence: Synthetic polypeptide
DEEEIRTTNPVATEQYGVVSTTNQQQQNATNEQGTTQED

SEQ ID NO: 173054 - protein, 38 aa, Artificial Sequence
  Description of Artificial Sequence: Synthetic polypeptide
DEEEIRTTNPVATEQYGSVDVPAMDTHIPPRPGMVVEM

SEQ ID NO: 173055 - protein, 35 aa, Artificial Sequence
  Description of Artificial Sequence: Synthetic polypeptide
DAEEIACTNPVATEQYGSVATPNTETADDPLSNVM

SEQ ID NO: 173056 - protein, 39 aa, Artificial Sequence
  Description of Artificial Sequence: Synthetic polypeptide
DEEEIRTTNPVATEQYGVVSTTNQQQQNATNEQGSTQTE

SEQ ID NO: 173057 - protein, 32 aa, Artificial Sequence
  Description of Artificial Sequence: Synthetic polypeptide
QEEEIATTNPVAYEQYGETAPEVESSQHEGEK

SEQ ID NO: 173058 - protein, 32 aa, Artificial Sequence
  Description of Artificial Sequence: Synthetic polypeptide
QEEEIATTNPVAYEQYGETAPPEVHQHEGEQE

SEQ ID NO: 173059 - protein, 31 aa, Artificial Sequence
  Description of Artificial Sequence: Synthetic polypeptide
QESEIASTNPVGTEGYGVMASGTLSQHGGDE

SEQ ID NO: 173060 - protein, 34 aa, Artificial Sequence
  Description of Artificial Sequence: Synthetic polypeptide
QEEEIATTNPVATEQYGVVAGLENGEGGQGEQED

SEQ ID NO: 173061 - protein, 37 aa, Artificial Sequence
  Description of Artificial Sequence: Synthetic polypeptide
DEEEIATTNPVAYEQWGSVSGGEPGNGGNMRNGMNMM

SEQ ID NO: 173062 - protein, 37 aa, Artificial Sequence
  Description of Artificial Sequence: Synthetic polypeptide
DEEEIRTTNPVATEQYGSVDCCMPESLQQHDPVEIEF

SEQ ID NO: 173063 - protein, 38 aa, Artificial Sequence
  Description of Artificial Sequence: Synthetic polypeptide
DDEEIKTTNPVATEQYGSVNVGNTTINVEGQGGGNEET

SEQ ID NO: 173064 - protein, 38 aa, Artificial Sequence
  Description of Artificial Sequence: Synthetic polypeptide
DEEEIRTTNPVATEQYGSVDTVMTGNTGGDGDEEDGQN

SEQ ID NO: 173065 - protein, 36 aa, Artificial Sequence
  Description of Artificial Sequence: Synthetic polypeptide
NEEEIRTTNPVATEQYGCVCSNWGEHNDENFNSDQS

SEQ ID NO: 173066 - protein, 34 aa, Artificial Sequence
  Description of Artificial Sequence: Synthetic polypeptide
DEMEIATTNPVAYEQYGTVCSAGDGPDEFEGGND

SEQ ID NO: 173067 - protein, 36 aa, Artificial Sequence
  Description of Artificial Sequence: Synthetic polypeptide
DEEEIACTNPVATAQWGSVSLSGNPLENTRGVEESF

SEQ ID NO: 173068 - protein, 37 aa, Artificial Sequence
  Description of Artificial Sequence: Synthetic polypeptide
DEGEIATTNPVATEQYGSVSASNPGITNIGNGMEPVP

SEQ ID NO: 173069 - protein, 37 aa, Artificial Sequence
  Description of Artificial Sequence: Synthetic polypeptide
NEEEIRTTNPVATEQYGCVCSNWGEHNIENFGSDNQS

SEQ ID NO: 173070 - protein, 37 aa, Artificial Sequence
  Description of Artificial Sequence: Synthetic polypeptide
DEEEIATTNPVAYEQWGSVSGGEQQNGGNMRNDMNPV

SEQ ID NO: 173071 - protein, 35 aa, Artificial Sequence
  Description of Artificial Sequence: Synthetic polypeptide
NEEEIRTTNPVATEQYGCVCSSGEDHDEFFGSDQA

SEQ ID NO: 173072 - protein, 34 aa, Artificial Sequence
  Description of Artificial Sequence: Synthetic polypeptide
QEEEIATTNPVATEQYGVVAGLEGEGGQGENEDA

SEQ ID NO: 173073 - protein, 36 aa, Artificial Sequence
  Description of Artificial Sequence: Synthetic polypeptide
DEEEIRTTNPVATEQYGSIFSTQSMKDDVYSMDDGQ

SEQ ID NO: 173074 - protein, 35 aa, Artificial Sequence
  Description of Artificial Sequence: Synthetic polypeptide
DEMEIRTTNPVATECYGTVCAATDGPVEEPEGNYD

SEQ ID NO: 173075 - protein, 37 aa, Artificial Sequence
  Description of Artificial Sequence: Synthetic polypeptide
DEEEIGTTNPVATEQYGQCVCSNTGEHNINFGSDTQS

SEQ ID NO: 173076 - protein, 35 aa, Artificial Sequence
  Description of Artificial Sequence: Synthetic polypeptide
DEMEIVTTNPVATEGYGTVCSATDGPVEYFEGVNM

SEQ ID NO: 173077 - protein, 34 aa, Artificial Sequence
  Description of Artificial Sequence: Synthetic polypeptide
QEEEIATTNPVATEQYGVVAGPGEGNGGQGDEED

SEQ ID NO: 173078 - protein, 40 aa, Artificial Sequence
  Description of Artificial Sequence: Synthetic polypeptide
DEEEIRTTNPVATEQYGVVSVVVATTNTEQGTNTDEQGNQ

SEQ ID NO: 173079 - protein, 35 aa, Artificial Sequence
  Description of Artificial Sequence: Synthetic polypeptide
DEAEIATTNPVAYEQWGSVSGEGPGEQNAMGNSDN

SEQ ID NO: 173080 - protein, 33 aa, Artificial Sequence
  Description of Artificial Sequence: Synthetic polypeptide
QEEEIATTNPVAYEQYGEAWCESETSQHAEGEL

SEQ ID NO: 173081 - protein, 36 aa, Artificial Sequence
  Description of Artificial Sequence: Synthetic polypeptide
QEEEIRTTNPVATEQYGVVVVSIVNGMEGGDEEEGQ

SEQ ID NO: 173082 - protein, 37 aa, Artificial Sequence
  Description of Artificial Sequence: Synthetic polypeptide
AEEEIRTTNPVATEQYGVVATTSQQLQQANNNAEQGS

SEQ ID NO: 173083 - protein, 36 aa, Artificial Sequence
  Description of Artificial Sequence: Synthetic polypeptide
MEHEIGTTNPVATEAYGSVSTTTGGQLQEEMGVGED

SEQ ID NO: 173084 - protein, 38 aa, Artificial Sequence
  Description of Artificial Sequence: Synthetic polypeptide
AEEEIRTTNPVATEQYGVVATVTNNNNNQQGNQTNNQD

SEQ ID NO: 173085 - protein, 35 aa, Artificial Sequence
  Description of Artificial Sequence: Synthetic polypeptide
DDEEIRTTNPCATEHYGQCVCSWELNQEHFNSDQS

SEQ ID NO: 173086 - protein, 34 aa, Artificial Sequence
  Description of Artificial Sequence: Synthetic polypeptide
DEHEIATTNPVAYEQWGSCSPGDNNEHQDDRDDP

SEQ ID NO: 173087 - protein, 33 aa, Artificial Sequence
  Description of Artificial Sequence: Synthetic polypeptide
QEEEIATTNPVAYEQYGEAWCNHEGSQHAEGEL

SEQ ID NO: 173088 - protein, 37 aa, Artificial Sequence
  Description of Artificial Sequence: Synthetic polypeptide
DEEEIRTTNPVATEQYGSYVVVIGPPEDQTQFNNNQD

SEQ ID NO: 173089 - protein, 39 aa, Artificial Sequence
  Description of Artificial Sequence: Synthetic polypeptide
DEEEIRTTNPVATEQYGTVSTVNAEQGNNQNQGTEEDEQ

SEQ ID NO: 173090 - protein, 37 aa, Artificial Sequence
  Description of Artificial Sequence: Synthetic polypeptide
DEMEIRTTNPVATEQYGSFFWSEADHETQPETGEDRF

SEQ ID NO: 173091 - protein, 35 aa, Artificial Sequence
  Description of Artificial Sequence: Synthetic polypeptide
DEEEIACTNPVATEQYGSACAANPIETEAPGGNMT

SEQ ID NO: 173092 - protein, 38 aa, Artificial Sequence
  Description of Artificial Sequence: Synthetic polypeptide
QEEEIRTTNPVATEQYGSVGNGQATDDLGQGGPEITED

SEQ ID NO: 173093 - protein, 36 aa, Artificial Sequence
  Description of Artificial Sequence: Synthetic polypeptide
QEEEIRTTNPVATEQYGVVVVITGMGEGNDDELSED

SEQ ID NO: 173094 - protein, 41 aa, Artificial Sequence
  Description of Artificial Sequence: Synthetic polypeptide
DEEEIRTTNPVATEQYGTVSTVNLQAGNNTDEQGTNNNTTQ

SEQ ID NO: 173095 - protein, 41 aa, Artificial Sequence
  Description of Artificial Sequence: Synthetic polypeptide
DEEEIRTTNPVATEQYGTVSTVNLQAGNNTTEQGSNNNTTE

SEQ ID NO: 173096 - protein, 35 aa, Artificial Sequence
  Description of Artificial Sequence: Synthetic polypeptide
DEMEIATTNPVAYEQYGTVCSATDGPDEHEGNNDE

SEQ ID NO: 173097 - protein, 34 aa, Artificial Sequence
  Description of Artificial Sequence: Synthetic polypeptide
DENEIATTNPVAYEQWGCTAGNGLQAAPDGSNSN

SEQ ID NO: 173098 - protein, 34 aa, Artificial Sequence
  Description of Artificial Sequence: Synthetic polypeptide
DEHEIRTTNPVSYEQWGSCYTIDNHQNGMGKETE

SEQ ID NO: 173099 - protein, 37 aa, Artificial Sequence
  Description of Artificial Sequence: Synthetic polypeptide
DEEEIRTTNPVATEQYGSVQPAAVPHDINEIEPVNIL

SEQ ID NO: 173100 - protein, 36 aa, Artificial Sequence
  Description of Artificial Sequence: Synthetic polypeptide
DEEEIACTNPVATEQYGSACAANPHQAEAEIGNGNF

SEQ ID NO: 173101 - protein, 36 aa, Artificial Sequence
  Description of Artificial Sequence: Synthetic polypeptide
DEIEAEIATTNPVAYEQWGSVSWGGDLQDAQGGKSD

SEQ ID NO: 173102 - protein, 36 aa, Artificial Sequence
  Description of Artificial Sequence: Synthetic polypeptide
DENEIATTNPVAYEQYGSVSANNGLPTENPHGEHPK

SEQ ID NO: 173103 - protein, 34 aa, Artificial Sequence
  Description of Artificial Sequence: Synthetic polypeptide
DEMEIATTNPVAYEQYGTVCSATDGPDEHEQNQD

SEQ ID NO: 173104 - protein, 38 aa, Artificial Sequence
  Description of Artificial Sequence: Synthetic polypeptide
DEEEIRTTNPVATEQYGSVCVVPTDTFQGSSEFLNVQA

SEQ ID NO: 173105 - protein, 32 aa, Artificial Sequence
  Description of Artificial Sequence: Synthetic polypeptide
DEHEIATTNPVAYEQWGCVYNMDMQNNGGADV

SEQ ID NO: 173106 - protein, 34 aa, Artificial Sequence
  Description of Artificial Sequence: Synthetic polypeptide
DENEIATTNPVAYEQWGGTVYSIEHEMMQRTGDH

SEQ ID NO: 173107 - protein, 36 aa, Artificial Sequence
  Description of Artificial Sequence: Synthetic polypeptide
DEEEIRTTNPVATEQYGSIGEPIMFTDMAQEPIQVL

SEQ ID NO: 173108 - protein, 36 aa, Artificial Sequence
  Description of Artificial Sequence: Synthetic polypeptide
DEHEIATTNPVAYEQWGEVCSTNPQGNHGEEGDGRN

SEQ ID NO: 173109 - protein, 34 aa, Artificial Sequence
  Description of Artificial Sequence: Synthetic polypeptide
DEMEIRTTNPVATEGWGCVCSWGEENQEYEGSQQ

SEQ ID NO: 173110 - protein, 36 aa, Artificial Sequence
  Description of Artificial Sequence: Synthetic polypeptide
DEHEISTTNPVATEAWGISVRTWNDDQQDRRTKEER

SEQ ID NO: 173111 - protein, 36 aa, Artificial Sequence
  Description of Artificial Sequence: Synthetic polypeptide
DENEIATTNPVAYEQYGSVCSVPHGPLDSMGGNDEH

SEQ ID NO: 173112 - protein, 38 aa, Artificial Sequence
  Description of Artificial Sequence: Synthetic polypeptide
DEEEIRTTNPVATEQYGSVCVVPTDTEAGSSEFLIVNA

SEQ ID NO: 173113 - protein, 36 aa, Artificial Sequence
  Description of Artificial Sequence: Synthetic polypeptide
AEEEIRTTNPVATEQYGVVATTNNNANDEIGTDEEE

SEQ ID NO: 173114 - protein, 38 aa, Artificial Sequence
  Description of Artificial Sequence: Synthetic polypeptide
DEEEIRTTNPVATEQYGSIQQPSLHWIVTEVEVQKGEQ

SEQ ID NO: 173115 - protein, 36 aa, Artificial Sequence
  Description of Artificial Sequence: Synthetic polypeptide
DDEEIRTTNPVATEQWGCVTSNSGEHNQNFGSDNAS

SEQ ID NO: 173116 - protein, 33 aa, Artificial Sequence
  Description of Artificial Sequence: Synthetic polypeptide
DEMEIVTTNPVATEQWGTVCAAADGPVAFEGND

SEQ ID NO: 173117 - protein, 38 aa, Artificial Sequence
  Description of Artificial Sequence: Synthetic polypeptide
AEEEIRTTNPVATEQYGSVVVVVTNVAEQGNNDENAED

SEQ ID NO: 173118 - protein, 33 aa, Artificial Sequence
  Description of Artificial Sequence: Synthetic polypeptide
DEMEIVTTNPVATEQWGTVCAAADGPAFEGNYD

SEQ ID NO: 173119 - protein, 36 aa, Artificial Sequence
  Description of Artificial Sequence: Synthetic polypeptide
DEHEIATTNPVAYEQWGEVCSTPSQGNHGQAGDGRN

SEQ ID NO: 173120 - protein, 36 aa, Artificial Sequence
  Description of Artificial Sequence: Synthetic polypeptide
DDEEIRTTNPCATEHYGQCVCSWGNLNQENFNSDQS

SEQ ID NO: 173121 - protein, 37 aa, Artificial Sequence
  Description of Artificial Sequence: Synthetic polypeptide
DEEEIRTTNPVATEQYGSVQVAVDCEQIENTEEAHIM

SEQ ID NO: 173122 - protein, 36 aa, Artificial Sequence
  Description of Artificial Sequence: Synthetic polypeptide
DENEIATTNPVAYEQYGSVSAAGPLDNDTPGGNLHM

SEQ ID NO: 173123 - protein, 37 aa, Artificial Sequence
  Description of Artificial Sequence: Synthetic polypeptide
DEEEIATTNPVATEQYGVSACAAMNNDPDDQGIGNDH

SEQ ID NO: 173124 - protein, 34 aa, Artificial Sequence
  Description of Artificial Sequence: Synthetic polypeptide
DENEIATTNPVAYEQWGCVAGNGLQAAPDGSVQN

SEQ ID NO: 173125 - protein, 34 aa, Artificial Sequence
  Description of Artificial Sequence: Synthetic polypeptide
DENEIATTNPVAYEQWGCVAGNGLQAAPDGSESY

SEQ ID NO: 173126 - protein, 33 aa, Artificial Sequence
  Description of Artificial Sequence: Synthetic polypeptide
QEEEIATTNPVAYEQYGEAVPCEVECSQHEGEE

SEQ ID NO: 173127 - protein, 35 aa, Artificial Sequence
  Description of Artificial Sequence: Synthetic polypeptide
DEHEIRTTNPVAYECWGSVCYNNDEQDQDNGQHER

SEQ ID NO: 173128 - protein, 34 aa, Artificial Sequence
  Description of Artificial Sequence: Synthetic polypeptide
MEEEIVTTNPVATEQYGAVAGPGVGQGEGEGEEN

SEQ ID NO: 173129 - protein, 32 aa, Artificial Sequence
  Description of Artificial Sequence: Synthetic polypeptide
QEEEIATTNPVATEQYGCAPMHGTDSEEEKKQ

SEQ ID NO: 173130 - protein, 34 aa, Artificial Sequence
  Description of Artificial Sequence: Synthetic polypeptide
DEHEIRTTNPVSYEQWGSCYTIDNGHQNGGKETG

SEQ ID NO: 173131 - protein, 35 aa, Artificial Sequence
  Description of Artificial Sequence: Synthetic polypeptide
DENEIATTNPVAYEQYGSVSVAPHLNEAPDGEAGN

SEQ ID NO: 173132 - protein, 36 aa, Artificial Sequence
  Description of Artificial Sequence: Synthetic polypeptide
DEEEIRTTNPVATEQYGSVQVAVEEQIETTEEAVDM

SEQ ID NO: 173133 - protein, 34 aa, Artificial Sequence
  Description of Artificial Sequence: Synthetic polypeptide
DEEEIATTNPVAYEQWGSACAAANGLQDSEFDDE

SEQ ID NO: 173134 - protein, 34 aa, Artificial Sequence
  Description of Artificial Sequence: Synthetic polypeptide
DEMEIVTTNPVATEPYGHTVCSAWDGPVEFEGND

SEQ ID NO: 173135 - protein, 37 aa, Artificial Sequence
  Description of Artificial Sequence: Synthetic polypeptide
DENEIATTNPVAYEQYGVSVVGGGNGLPQESNENMRD

SEQ ID NO: 173136 - protein, 34 aa, Artificial Sequence
  Description of Artificial Sequence: Synthetic polypeptide
DEAEIRATNCVAYDQYGSVSSFTHATFPRGIDVP

SEQ ID NO: 173137 - protein, 36 aa, Artificial Sequence
  Description of Artificial Sequence: Synthetic polypeptide
DEHEIRTTNPVAYECWGSVCYTDEQDQDLRGQNGEN

SEQ ID NO: 173138 - protein, 34 aa, Artificial Sequence
  Description of Artificial Sequence: Synthetic polypeptide
DEMEIVTTNPVATENYGTVCSAADGDVEFEGNSD

SEQ ID NO: 173139 - protein, 35 aa, Artificial Sequence
  Description of Artificial Sequence: Synthetic polypeptide
QEEEIATTNPVATEQYGVVMAGDGLGEGGQGDNED

SEQ ID NO: 173140 - protein, 37 aa, Artificial Sequence
  Description of Artificial Sequence: Synthetic polypeptide
DEEEIRTTNPVATEQYGSVQVAVETEQIENEEEAEDM

SEQ ID NO: 173141 - protein, 37 aa, Artificial Sequence
  Description of Artificial Sequence: Synthetic polypeptide
DEEEIRTTNPVATEQYGSVQVAVEVEQIENEVEANDM

SEQ ID NO: 173142 - protein, 32 aa, Artificial Sequence
  Description of Artificial Sequence: Synthetic polypeptide
DENEIATTNPVAYERWGCVSKEIERMNGKEDH

SEQ ID NO: 173143 - protein, 37 aa, Artificial Sequence
  Description of Artificial Sequence: Synthetic polypeptide
NEEEIRTTNPVATEQYGCSCSNWEDDNQENFQSDNQA

SEQ ID NO: 173144 - protein, 31 aa, Artificial Sequence
  Description of Artificial Sequence: Synthetic polypeptide
QESEIASTNPVGTEGYGVMASITEQDHGENI

SEQ ID NO: 173145 - protein, 31 aa, Artificial Sequence
  Description of Artificial Sequence: Synthetic polypeptide
DEEEIATTNPIATECWGATWAAVCQPKGEYI

SEQ ID NO: 173146 - protein, 33 aa, Artificial Sequence
  Description of Artificial Sequence: Synthetic polypeptide
DEHEIRTTNPVAYEAWGVVTGGNANEDRGGASQ

SEQ ID NO: 173147 - protein, 37 aa, Artificial Sequence
  Description of Artificial Sequence: Synthetic polypeptide
NEEEIRTTNPVATEQYGCSCSNWGEDHNQYFQSDNQA

SEQ ID NO: 173148 - protein, 34 aa, Artificial Sequence
  Description of Artificial Sequence: Synthetic polypeptide
DEAEIATTNPVAYEQWGTVCSTENDEHDGQKEQG

SEQ ID NO: 173149 - protein, 36 aa, Artificial Sequence
  Description of Artificial Sequence: Synthetic polypeptide
NEEEIRTTNPVATEQYGCSCSNWGEHNQEYFQSEQA

SEQ ID NO: 173150 - protein, 37 aa, Artificial Sequence
  Description of Artificial Sequence: Synthetic polypeptide
DEEEIRTTNPVATEQYGSVQVAVEWEQIENTEEANIM

SEQ ID NO: 173151 - protein, 36 aa, Artificial Sequence
  Description of Artificial Sequence: Synthetic polypeptide
NEEEIRTTNPVATEQYGCSCSSGEDNQEYFNSDNQS

SEQ ID NO: 173152 - protein, 36 aa, Artificial Sequence
  Description of Artificial Sequence: Synthetic polypeptide
MEEEITTTNPVATEQYGDVSVAQGEGNQGGQGNDTE

SEQ ID NO: 173153 - protein, 35 aa, Artificial Sequence
  Description of Artificial Sequence: Synthetic polypeptide
DEMEIATTNPVAYEQYGTVCSATDGPDEFEGNNED

SEQ ID NO: 173154 - protein, 32 aa, Artificial Sequence
  Description of Artificial Sequence: Synthetic polypeptide
DENEIATTNPVAYERWGTVYSTEIEMNGKEDH

SEQ ID NO: 173155 - protein, 37 aa, Artificial Sequence
  Description of Artificial Sequence: Synthetic polypeptide
DEEEIRTTNPVATEQYGSVQPNGNYMVMMTEHVEQNE

SEQ ID NO: 173156 - protein, 32 aa, Artificial Sequence
  Description of Artificial Sequence: Synthetic polypeptide
QEEEIATTNPVAYEQYGEAPEGVEFSQHEGEK

SEQ ID NO: 173157 - protein, 35 aa, Artificial Sequence
  Description of Artificial Sequence: Synthetic polypeptide
DDEEIRTTNPVATEQWGCVTSSEEHNQNFGSDTAS

SEQ ID NO: 173158 - protein, 34 aa, Artificial Sequence
  Description of Artificial Sequence: Synthetic polypeptide
DEEEICTTNPVAYESWGVVATTLGGNTGADGMMR

SEQ ID NO: 173159 - protein, 37 aa, Artificial Sequence
  Description of Artificial Sequence: Synthetic polypeptide
DENEIATTNPVATEQYGCVTAATANGLQPADMPNTNN

SEQ ID NO: 173160 - protein, 34 aa, Artificial Sequence
  Description of Artificial Sequence: Synthetic polypeptide
DEAEIGTTNPVATEQYGELFTAVDGPVEFEGNKQ

SEQ ID NO: 173161 - protein, 37 aa, Artificial Sequence
  Description of Artificial Sequence: Synthetic polypeptide
AEEEIRTTNPVATEQYGSVVVVVTNNNNQEQEETEDT

SEQ ID NO: 173162 - protein, 35 aa, Artificial Sequence
  Description of Artificial Sequence: Synthetic polypeptide
MEMEIATTNPVATEQYGSVSAPDLNEDHQGLEDEN

SEQ ID NO: 173163 - protein, 36 aa, Artificial Sequence
  Description of Artificial Sequence: Synthetic polypeptide
DEEEIATTNPVAYEQWGSVCSVNDNDQINDTNNQGP

SEQ ID NO: 173164 - protein, 35 aa, Artificial Sequence
  Description of Artificial Sequence: Synthetic polypeptide
DEAEIGTTNPVAYEEWGSVATTGGNTGNAGNDNQR

SEQ ID NO: 173165 - protein, 35 aa, Artificial Sequence
  Description of Artificial Sequence: Synthetic polypeptide
DEMEIATTNPVAYEQYGTVCSATDGPDEHEGDNDH

SEQ ID NO: 173166 - protein, 36 aa, Artificial Sequence
  Description of Artificial Sequence: Synthetic polypeptide
DEIEIATTNPVATEQYGSSFSAPYDTLEPHEGEDHR

SEQ ID NO: 173167 - protein, 37 aa, Artificial Sequence
  Description of Artificial Sequence: Synthetic polypeptide
DEGEIATTNPVAYEQYGSVVANNGHALGARPGDQTNE

SEQ ID NO: 173168 - protein, 36 aa, Artificial Sequence
  Description of Artificial Sequence: Synthetic polypeptide
DEEEIACTNPVATEQYGSACATNHGPLEAMGGTDQE

SEQ ID NO: 173169 - protein, 39 aa, Artificial Sequence
  Description of Artificial Sequence: Synthetic polypeptide
DEEEIRTTNPVATEQYGVVSTVVAVNNNQQGTTEEEEED

SEQ ID NO: 173170 - protein, 35 aa, Artificial Sequence
  Description of Artificial Sequence: Synthetic polypeptide
QEEEIATTNPVATEQYGVVMEGPGLGEGGQGQNED

SEQ ID NO: 173171 - protein, 36 aa, Artificial Sequence
  Description of Artificial Sequence: Synthetic polypeptide
CESEIRTTNPVATEQYGSSCNSTWALDEQMNLDFEI

SEQ ID NO: 173172 - protein, 33 aa, Artificial Sequence
  Description of Artificial Sequence: Synthetic polypeptide
QEEEIATTNPVATEQYGCFCPNWEDQHFISEQM

SEQ ID NO: 173173 - protein, 37 aa, Artificial Sequence
  Description of Artificial Sequence: Synthetic polypeptide
DEEEIRTTNPVATEQYGSIGEPIMFTDDLAQAPIQVS

SEQ ID NO: 173174 - protein, 34 aa, Artificial Sequence
  Description of Artificial Sequence: Synthetic polypeptide
DEEEIATTNPVAYEQWGSACAAANGLQSAEVDLS

SEQ ID NO: 173175 - protein, 35 aa, Artificial Sequence
  Description of Artificial Sequence: Synthetic polypeptide
QAEEIATTNPVAYEQYGSACAVANNLQDSDGSDQY

SEQ ID NO: 173176 - protein, 32 aa, Artificial Sequence
  Description of Artificial Sequence: Synthetic polypeptide
QEEEIATTNPVATEQYGCICPWADNQHSSEQA

SEQ ID NO: 173177 - protein, 32 aa, Artificial Sequence
  Description of Artificial Sequence: Synthetic polypeptide
DENEIATTNPVATEQWGCCAEGVEMNAALDGA

SEQ ID NO: 173178 - protein, 34 aa, Artificial Sequence
  Description of Artificial Sequence: Synthetic polypeptide
DEMEIATTNPVAYEQYGTVCSATDGPDEHEGDDI

SEQ ID NO: 173179 - protein, 33 aa, Artificial Sequence
  Description of Artificial Sequence: Synthetic polypeptide
CENEIATTNPVATECYGCVCSWELNQHFISELA

SEQ ID NO: 173180 - protein, 36 aa, Artificial Sequence
  Description of Artificial Sequence: Synthetic polypeptide
DEEEIRTTNPVATEQYGSIGEPIMFTADAQTPIQVL

SEQ ID NO: 173181 - protein, 37 aa, Artificial Sequence
  Description of Artificial Sequence: Synthetic polypeptide
DENEIATTNPVAYEQYGTVCSYTDGLVEGVQRPQGES

SEQ ID NO: 173182 - protein, 36 aa, Artificial Sequence
  Description of Artificial Sequence: Synthetic polypeptide
QEEEIRTTNPVATEQYGMVGSIMNNIETGGGEDEEG

SEQ ID NO: 173183 - protein, 39 aa, Artificial Sequence
  Description of Artificial Sequence: Synthetic polypeptide
DEEEIRTTNPVATEQYGVVSVVVATQQQNQQGTTNDTNE

SEQ ID NO: 173184 - protein, 39 aa, Artificial Sequence
  Description of Artificial Sequence: Synthetic polypeptide
DEEEIRTTNPVATEQYGVVSTVVTNGNQQGTTEQGSTVE

SEQ ID NO: 173185 - protein, 36 aa, Artificial Sequence
  Description of Artificial Sequence: Synthetic polypeptide
DEGEIATTNPVAYEQYGSVCATNPPMQPDNQMEGTM

SEQ ID NO: 173186 - protein, 34 aa, Artificial Sequence
  Description of Artificial Sequence: Synthetic polypeptide
QAEEIATTNPVATEQYGCVAPGEGGGQESEEGND

SEQ ID NO: 173187 - protein, 36 aa, Artificial Sequence
  Description of Artificial Sequence: Synthetic polypeptide
MEGEIRTTNPVATEQYGSVCSEGNIMNQTEQFEDFP

SEQ ID NO: 173188 - protein, 34 aa, Artificial Sequence
  Description of Artificial Sequence: Synthetic polypeptide
DENEIATTNPVATEQWGSNAGSGAPANPNPGAQP

SEQ ID NO: 173189 - protein, 33 aa, Artificial Sequence
  Description of Artificial Sequence: Synthetic polypeptide
DCEEIRATNPVAYEQWGSSYYAEHMHQQRGGPQ

SEQ ID NO: 173190 - protein, 36 aa, Artificial Sequence
  Description of Artificial Sequence: Synthetic polypeptide
MEGEIRTTNPVATEQYGSVCNNTWHDLDLIFESTQR

SEQ ID NO: 173191 - protein, 39 aa, Artificial Sequence
  Description of Artificial Sequence: Synthetic polypeptide
DEEEIRTTNPVATEQYGVVSTVVTNGTQAGTTEQGSTDE

SEQ ID NO: 173192 - protein, 39 aa, Artificial Sequence
  Description of Artificial Sequence: Synthetic polypeptide
DEEEIRTTNPVATEQYGVVSTVVATQQLGNQGTTEQGSQ

SEQ ID NO: 173193 - protein, 36 aa, Artificial Sequence
  Description of Artificial Sequence: Synthetic polypeptide
DEGEIATTNPVAYEQYGSVCAAPALGQDHQDGNDFH

SEQ ID NO: 173194 - protein, 37 aa, Artificial Sequence
  Description of Artificial Sequence: Synthetic polypeptide
DEEEIATTNPVATEQYGSVCAAMAHLSQAMAPNNKNP

SEQ ID NO: 173195 - protein, 34 aa, Artificial Sequence
  Description of Artificial Sequence: Synthetic polypeptide
QENEIATTNPVATEPYGNVSGEHLNQHGMEMQLN

SEQ ID NO: 173196 - protein, 36 aa, Artificial Sequence
  Description of Artificial Sequence: Synthetic polypeptide
DEEEIRTTNPVATEQYGSIGPPMEIPELEMQPQFGL

SEQ ID NO: 173197 - protein, 36 aa, Artificial Sequence
  Description of Artificial Sequence: Synthetic polypeptide
MEGEIRTTNPVATEQYGSVCGTTLLLSEEGGDGAFE

SEQ ID NO: 173198 - protein, 33 aa, Artificial Sequence
  Description of Artificial Sequence: Synthetic polypeptide
QENEIATTNPVATEPYGNVSGEHLQAHMEMQLN

SEQ ID NO: 173199 - protein, 35 aa, Artificial Sequence
  Description of Artificial Sequence: Synthetic polypeptide
MEGEIRTTNPVATEQYGSVAVMAPASQETFGEVIE

SEQ ID NO: 173200 - protein, 35 aa, Artificial Sequence
  Description of Artificial Sequence: Synthetic polypeptide
DENEIATTNPVATEQWGHCNVAATNGLFHDSGGFM

SEQ ID NO: 173201 - protein, 39 aa, Artificial Sequence
  Description of Artificial Sequence: Synthetic polypeptide
DEEEIRTTNPVATEQYGVVSTVVTNGTQQGTTEAGSTVQ

SEQ ID NO: 173202 - protein, 35 aa, Artificial Sequence
  Description of Artificial Sequence: Synthetic polypeptide
MEGEIRTTNPVATEQYGSVAVMAMSQEQFGEEVIE

SEQ ID NO: 173203 - protein, 35 aa, Artificial Sequence
  Description of Artificial Sequence: Synthetic polypeptide
DEGEIATTNPVAYEQYGSVCAAPDNLENDDLGAQA

SEQ ID NO: 173204 - protein, 38 aa, Artificial Sequence
  Description of Artificial Sequence: Synthetic polypeptide
DEEEIRTTNPVATEQYGSVQIPNTTPLLDHQNVVDPAV

SEQ ID NO: 173205 - protein, 36 aa, Artificial Sequence
  Description of Artificial Sequence: Synthetic polypeptide
DEMEIVTTNPVATEQYGTGVCSATDGKPVEDFEGND

SEQ ID NO: 173206 - protein, 36 aa, Artificial Sequence
  Description of Artificial Sequence: Synthetic polypeptide
DEEEIRTTNPVATEQYGSIIPANMIAISTQMDQVEE

SEQ ID NO: 173207 - protein, 37 aa, Artificial Sequence
  Description of Artificial Sequence: Synthetic polypeptide
DEMEIATTNPVAYEQYGTVCSYTDGLVEEVQRPHGES

SEQ ID NO: 173208 - protein, 35 aa, Artificial Sequence
  Description of Artificial Sequence: Synthetic polypeptide
MEGEIRTTNPVATEQYGSVAVMDMMSQETFGEVIE

SEQ ID NO: 173209 - protein, 37 aa, Artificial Sequence
  Description of Artificial Sequence: Synthetic polypeptide
MEGEIRTTNPVATEQYGSVSSTWPAGPNETFEMNDNA

SEQ ID NO: 173210 - protein, 29 aa, Artificial Sequence
  Description of Artificial Sequence: Synthetic peptide
QEGEIASTNPVGTEGYGVMASLLIHGDIA

SEQ ID NO: 173211 - protein, 31 aa, Artificial Sequence
  Description of Artificial Sequence: Synthetic polypeptide
QEEEIATTNPIATEQYGEAPNAEVCQHEEYK

SEQ ID NO: 173212 - protein, 33 aa, Artificial Sequence
  Description of Artificial Sequence: Synthetic polypeptide
QENEIATTNPVATEPYGNVPSGEHLQHMEMQLF

SEQ ID NO: 173213 - protein, 35 aa, Artificial Sequence
  Description of Artificial Sequence: Synthetic polypeptide
DEMEIATTNPVATCQYGCVCSTGAHNQNFNSDTQS

SEQ ID NO: 173214 - protein, 33 aa, Artificial Sequence
  Description of Artificial Sequence: Synthetic polypeptide
QENEIATTNPVATEPYGNVPSGEHLQHQMIEEH

SEQ ID NO: 173215 - protein, 30 aa, Artificial Sequence
  Description of Artificial Sequence: Synthetic polypeptide
QEGEIATTNPVATEQYWGECPEVCEPIHEK

SEQ ID NO: 173216 - protein, 40 aa, Artificial Sequence
  Description of Artificial Sequence: Synthetic polypeptide
AEEEIRTTNPVATEQYGSVVVVVVTTNNLQQGQEQGNNDE

SEQ ID NO: 173217 - protein, 39 aa, Artificial Sequence
  Description of Artificial Sequence: Synthetic polypeptide
DEEEIRTTNPVATEQYGVVSTVVTNGTQAGTTEAGSTEG

SEQ ID NO: 173218 - protein, 34 aa, Artificial Sequence
  Description of Artificial Sequence: Synthetic polypeptide
QAEEIATTNPVATEQYGCVSPGEGGGNESEEENH

SEQ ID NO: 173219 - protein, 39 aa, Artificial Sequence
  Description of Artificial Sequence: Synthetic polypeptide
AEEEIRTTNPVATEQYGSVVVVVVNTNDEQGSEGGNTNQ

SEQ ID NO: 173220 - protein, 36 aa, Artificial Sequence
  Description of Artificial Sequence: Synthetic polypeptide
DEEEIRTTNPVATEQYGSTNALANMQQQHTLPTEED

SEQ ID NO: 173221 - protein, 36 aa, Artificial Sequence
  Description of Artificial Sequence: Synthetic polypeptide
QEEEIRTTNPVCYEPYGSVSCDPRAFSQNRQGGNND

SEQ ID NO: 173222 - protein, 35 aa, Artificial Sequence
  Description of Artificial Sequence: Synthetic polypeptide
DENEIATTNPVAYEQYGSVAITNQDENNGGMETDD

SEQ ID NO: 173223 - protein, 37 aa, Artificial Sequence
  Description of Artificial Sequence: Synthetic polypeptide
MEGEIRTTNPVATEQYGSVSSTTPAGPNERFEMNDIA

SEQ ID NO: 173224 - protein, 33 aa, Artificial Sequence
  Description of Artificial Sequence: Synthetic polypeptide
QENEIATTNPVATEPYGNVPSGEHLTGHMNEKA

SEQ ID NO: 173225 - protein, 34 aa, Artificial Sequence
  Description of Artificial Sequence: Synthetic polypeptide
DEHEIATTNPVAYECWGCVSGINGEERNNQQGNA

SEQ ID NO: 173226 - protein, 35 aa, Artificial Sequence
  Description of Artificial Sequence: Synthetic polypeptide
DENEIATTNPVATEQWGSVAGSGAPANPNPMGAQA

SEQ ID NO: 173227 - protein, 39 aa, Artificial Sequence
  Description of Artificial Sequence: Synthetic polypeptide
DEEEIRTTNPVATEQYGVVSTVVATQQGTQQGTTNDTDE

SEQ ID NO: 173228 - protein, 34 aa, Artificial Sequence
  Description of Artificial Sequence: Synthetic polypeptide
QENEIATTNPVATEPYGNVPSGENHGQHGMMQLN

SEQ ID NO: 173229 - protein, 37 aa, Artificial Sequence
  Description of Artificial Sequence: Synthetic polypeptide
MEGEIRTTNPVATEQYGSVSSTWIAGPNERFEMNDVE

SEQ ID NO: 173230 - protein, 35 aa, Artificial Sequence
  Description of Artificial Sequence: Synthetic polypeptide
QENEIATTNPVATEPYGNVPSGENHLPQHGMMQLF

SEQ ID NO: 173231 - protein, 34 aa, Artificial Sequence
  Description of Artificial Sequence: Synthetic polypeptide
DEHEIATTNPVAYECWGCVYCTNQDQHDDERGMV

SEQ ID NO: 173232 - protein, 33 aa, Artificial Sequence
  Description of Artificial Sequence: Synthetic polypeptide
QENEIATTNPVATEPYGNVPSGIHLQNHQMEFH

SEQ ID NO: 173233 - protein, 36 aa, Artificial Sequence
  Description of Artificial Sequence: Synthetic polypeptide
QEEEIRTTNPVCYEPYGSVSCDLPMFSQNDQGGNND

SEQ ID NO: 173234 - protein, 35 aa, Artificial Sequence
  Description of Artificial Sequence: Synthetic polypeptide
DENEIATTNPVATEQWGSVAGANDPGAGDPMGNNE

SEQ ID NO: 173235 - protein, 33 aa, Artificial Sequence
  Description of Artificial Sequence: Synthetic polypeptide
DEHEIATTNPVAYECWGSVAWTDDGDDRNGGQS

SEQ ID NO: 173236 - protein, 35 aa, Artificial Sequence
  Description of Artificial Sequence: Synthetic polypeptide
MEGEIRTTNPVATEQYGSVFEDTTYNSGGEAADEE

SEQ ID NO: 173237 - protein, 37 aa, Artificial Sequence
  Description of Artificial Sequence: Synthetic polypeptide
DEEEIRTTNPVATEQYGSVEVPTLTNPEDVVTDPEIV

SEQ ID NO: 173238 - protein, 34 aa, Artificial Sequence
  Description of Artificial Sequence: Synthetic polypeptide
DENEIATTNPVATEQYGCTAGNNGPTGADGENGN

SEQ ID NO: 173239 - protein, 37 aa, Artificial Sequence
  Description of Artificial Sequence: Synthetic polypeptide
DEEEIRTTNPVATEQYGSIGMPIMEIGAPIMNPQFGN

SEQ ID NO: 173240 - protein, 34 aa, Artificial Sequence
  Description of Artificial Sequence: Synthetic polypeptide
DEAEIRTTNGVAYCQYGCVCSTEHNAEHFGSDQS

SEQ ID NO: 173241 - protein, 34 aa, Artificial Sequence
  Description of Artificial Sequence: Synthetic polypeptide
QEEEIATTNPVATAQWGSVSGTGPPDNNNHNPLN

SEQ ID NO: 173242 - protein, 35 aa, Artificial Sequence
  Description of Artificial Sequence: Synthetic polypeptide
MEGEIRTTNPVATEQYGSLSPVKPEGHENGNEDQN

SEQ ID NO: 173243 - protein, 39 aa, Artificial Sequence
  Description of Artificial Sequence: Synthetic polypeptide
DEEEIRTTNPVATEQYGVVSTVVATQQNQQQGTDEEDEE

SEQ ID NO: 173244 - protein, 34 aa, Artificial Sequence
  Description of Artificial Sequence: Synthetic polypeptide
DENEIATTNPVAYEQWGSVCAAANGLQDSDVDDS

SEQ ID NO: 173245 - protein, 36 aa, Artificial Sequence
  Description of Artificial Sequence: Synthetic polypeptide
QAEEIATTNPVATEQYGCVAGTGGLAQPADGPNDNH

SEQ ID NO: 173246 - protein, 35 aa, Artificial Sequence
  Description of Artificial Sequence: Synthetic polypeptide
QEEEIATTNPVATAQWGSVSMSGNGGQPEGEGQFH

SEQ ID NO: 173247 - protein, 34 aa, Artificial Sequence
  Description of Artificial Sequence: Synthetic polypeptide
DEAEIATTNPVAYEQWGSVYGGNGNESQGEGDTS

SEQ ID NO: 173248 - protein, 33 aa, Artificial Sequence
  Description of Artificial Sequence: Synthetic polypeptide
DEGEIATTNPVAYEQYGSVCAATAGEEMMMPEG

SEQ ID NO: 173249 - protein, 35 aa, Artificial Sequence
  Description of Artificial Sequence: Synthetic polypeptide
QEEEIATTNPVATAQWGSVSATGAGGTAPQDIANF

SEQ ID NO: 173250 - protein, 36 aa, Artificial Sequence
  Description of Artificial Sequence: Synthetic polypeptide
DEEEIACTNPVATEQYGSACAGTGLLAPGEQMEGSH

SEQ ID NO: 173251 - protein, 31 aa, Artificial Sequence
  Description of Artificial Sequence: Synthetic polypeptide
QESEIASTNPVGTEGYGVMASTEPQDHEGDI

SEQ ID NO: 173252 - protein, 37 aa, Artificial Sequence
  Description of Artificial Sequence: Synthetic polypeptide
DDEEIRTTNPVATDQYGSVISGSGQGGEGNDGEVGDD

SEQ ID NO: 173253 - protein, 34 aa, Artificial Sequence
  Description of Artificial Sequence: Synthetic polypeptide
DEEEIATVNPVATAQWGCVAGNGLQSNNNQQAHQ

SEQ ID NO: 173254 - protein, 36 aa, Artificial Sequence
  Description of Artificial Sequence: Synthetic polypeptide
DENEIATTNPVATEQYGCVAANHSGDPNGMDPQGGN

SEQ ID NO: 173255 - protein, 36 aa, Artificial Sequence
  Description of Artificial Sequence: Synthetic polypeptide
DEMEIATTNPVAYEQYGTVCSYTDGLNENDRPGQDS

SEQ ID NO: 173256 - protein, 33 aa, Artificial Sequence
  Description of Artificial Sequence: Synthetic polypeptide
DEEEIATVNPVATAQWGCVAGNGLASNNNQQAE

SEQ ID NO: 173257 - protein, 37 aa, Artificial Sequence
  Description of Artificial Sequence: Synthetic polypeptide
DAEEIATTNPVAYEQYGSVCSPTNHGPLDSGEGIDGS

SEQ ID NO: 173258 - protein, 29 aa, Artificial Sequence
  Description of Artificial Sequence: Synthetic peptide
QESEIASTNPIGTECYGVMAAETLQPGDI

SEQ ID NO: 173259 - protein, 35 aa, Artificial Sequence
  Description of Artificial Sequence: Synthetic polypeptide
DEEEIATTNPAATEQYGSVPPCVTQDHWQGQFVDS

SEQ ID NO: 173260 - protein, 37 aa, Artificial Sequence
  Description of Artificial Sequence: Synthetic polypeptide
DDEEIRTTNPVATDQYGSVSGSGQGGPEGNDGETDDT

SEQ ID NO: 173261 - protein, 32 aa, Artificial Sequence
  Description of Artificial Sequence: Synthetic polypeptide
DENEIATTNPVAYEQWGNTVSKEIEMNGKEDK

SEQ ID NO: 173262 - protein, 35 aa, Artificial Sequence
  Description of Artificial Sequence: Synthetic polypeptide
DEEEIATVNPVATEQWGGCVAGNGLQSNNNSQAES

SEQ ID NO: 173263 - protein, 37 aa, Artificial Sequence
  Description of Artificial Sequence: Synthetic polypeptide
DEHEIRTTNPVATEAWGISVRTWNDDQDDRRQKQENQ

SEQ ID NO: 173264 - protein, 38 aa, Artificial Sequence
  Description of Artificial Sequence: Synthetic polypeptide
DEMEIATTNPVAYEQYGTVCSYTDGLVEGDQRGPNGES

SEQ ID NO: 173265 - protein, 38 aa, Artificial Sequence
  Description of Artificial Sequence: Synthetic polypeptide
DEEEIRTTNPVATEQYGSVQIPNTNNYVDHQNVVDPAV

SEQ ID NO: 173266 - protein, 34 aa, Artificial Sequence
  Description of Artificial Sequence: Synthetic polypeptide
DEHEIATTNPVAYECWGSVAWTDDQDDRGHGGDS

SEQ ID NO: 173267 - protein, 37 aa, Artificial Sequence
  Description of Artificial Sequence: Synthetic polypeptide
DEMEIATTNPVAYEQYGTVCSYTDGLVEGDQRGGGGS

SEQ ID NO: 173268 - protein, 37 aa, Artificial Sequence
  Description of Artificial Sequence: Synthetic polypeptide
DEEEIRTTNPVATEQYGSIGPITMEIPELRMQPQFGL

SEQ ID NO: 173269 - protein, 37 aa, Artificial Sequence
  Description of Artificial Sequence: Synthetic polypeptide
DEEEIRTTNPVATEQYGSTPEEPPAQLQSRIEDEVMI

SEQ ID NO: 173270 - protein, 34 aa, Artificial Sequence
  Description of Artificial Sequence: Synthetic polypeptide
DEHEIATTNPVAYECWGSVAWTDDQDDRNGGMTS

SEQ ID NO: 173271 - protein, 35 aa, Artificial Sequence
  Description of Artificial Sequence: Synthetic polypeptide
NEEEIATTNPVATEQYGSVCAANMGEEAPDSGMEG

SEQ ID NO: 173272 - protein, 36 aa, Artificial Sequence
  Description of Artificial Sequence: Synthetic polypeptide
NEEEIATTNPVATEQYGSVCAANMGEEQPDDGDGEW

SEQ ID NO: 173273 - protein, 35 aa, Artificial Sequence
  Description of Artificial Sequence: Synthetic polypeptide
NEEEIATTNPVATEQYGSVCAANNGEEPTDDGGEN

SEQ ID NO: 173274 - protein, 35 aa, Artificial Sequence
  Description of Artificial Sequence: Synthetic polypeptide
DEMEIVTTNPVATEQYGTVCCATDGPVEFEGVNDG

SEQ ID NO: 173275 - protein, 33 aa, Artificial Sequence
  Description of Artificial Sequence: Synthetic polypeptide
QEEEICTTNPVATEQYGVVAGLEGEGGQGEEID

SEQ ID NO: 173276 - protein, 35 aa, Artificial Sequence
  Description of Artificial Sequence: Synthetic polypeptide
QEGEIATTNPVSSEQYGSVSSTTPALPNRNGMTPV

SEQ ID NO: 173277 - protein, 36 aa, Artificial Sequence
  Description of Artificial Sequence: Synthetic polypeptide
DEMEIVTTNPVATEQYGTAVCSATDGPVEFEGFNYD

SEQ ID NO: 173278 - protein, 39 aa, Artificial Sequence
  Description of Artificial Sequence: Synthetic polypeptide
DEEEIRTTNPVATEQYGVVSTVVATQQNNQQNTTEQGSE

SEQ ID NO: 173279 - protein, 36 aa, Artificial Sequence
  Description of Artificial Sequence: Synthetic polypeptide
DEEEIRTTNPVATEQYGSIIRPENPQYVLADYPQEQ

SEQ ID NO: 173280 - protein, 34 aa, Artificial Sequence
  Description of Artificial Sequence: Synthetic polypeptide
QEEEICTTNPVATEQYGVVAGPGEGEGGQGGEID

SEQ ID NO: 173281 - protein, 35 aa, Artificial Sequence
  Description of Artificial Sequence: Synthetic polypeptide
DEMEIRTTNPVATEQYGQCVCQSAHNIENFMSDQS

SEQ ID NO: 173282 - protein, 31 aa, Artificial Sequence
  Description of Artificial Sequence: Synthetic polypeptide
QESEIASTNPIATECYGVTMANSTLQHKGDI

SEQ ID NO: 173283 - protein, 35 aa, Artificial Sequence
  Description of Artificial Sequence: Synthetic polypeptide
DENEIATTNPVAYEQYGSVANADTPAGDPMGNAAE

SEQ ID NO: 173284 - protein, 36 aa, Artificial Sequence
  Description of Artificial Sequence: Synthetic polypeptide
DEHEIRTTNPVATEQYGSVYPDQTEGVEDFGSLQVG

SEQ ID NO: 173285 - protein, 39 aa, Artificial Sequence
  Description of Artificial Sequence: Synthetic polypeptide
DEEEIRTTNPVATEQYGVVSTTNQQQQNGTTEQGSTQDD

SEQ ID NO: 173286 - protein, 34 aa, Artificial Sequence
  Description of Artificial Sequence: Synthetic polypeptide
DEEEIATTNPEATCQYGCVCPTGEDNQNFGSDQS

SEQ ID NO: 173287 - protein, 38 aa, Artificial Sequence
  Description of Artificial Sequence: Synthetic polypeptide
DEEEIRTTNPVATEQYGVVSTTAQAGTEAGGVTTQDTD

SEQ ID NO: 173288 - protein, 30 aa, Artificial Sequence
  Description of Artificial Sequence: Synthetic polypeptide
QEEEIATTNPVAYEQWGEAYYVEQEIESEG

SEQ ID NO: 173289 - protein, 31 aa, Artificial Sequence
  Description of Artificial Sequence: Synthetic polypeptide
QEEEIATTNPVATEAYGETAPCEVQSQHEEK

SEQ ID NO: 173290 - protein, 38 aa, Artificial Sequence
  Description of Artificial Sequence: Synthetic polypeptide
MEGEIRTTNPVATEQYGSVFSPAPQEGPNMRFEENSVE

SEQ ID NO: 173291 - protein, 38 aa, Artificial Sequence
  Description of Artificial Sequence: Synthetic polypeptide
MEGEIRTTNPVATEQYGSVIESTPANGPNERFESNDDA

SEQ ID NO: 173292 - protein, 37 aa, Artificial Sequence
  Description of Artificial Sequence: Synthetic polypeptide
MEGEIRTTNPVATEQYGSVSSCWPAGPNERFEMNDVA

SEQ ID NO: 173293 - protein, 34 aa, Artificial Sequence
  Description of Artificial Sequence: Synthetic polypeptide
QAEEIATTNPVATEQYGCVAPMGHGLDSEGENKD

SEQ ID NO: 173294 - protein, 33 aa, Artificial Sequence
  Description of Artificial Sequence: Synthetic polypeptide
QAEEIATTNPVATEQYGCVAPPEHGLDSEGEGN

SEQ ID NO: 173295 - protein, 37 aa, Artificial Sequence
  Description of Artificial Sequence: Synthetic polypeptide
MEGEIRTTNPVATEQYGSVSPWDPGLEQEQNSGDHPG

SEQ ID NO: 173296 - protein, 37 aa, Artificial Sequence
  Description of Artificial Sequence: Synthetic polypeptide
MEGEIRTTNPVATEQYGSVSPWDHGLEQERNSETHPG

SEQ ID NO: 173297 - protein, 39 aa, Artificial Sequence
  Description of Artificial Sequence: Synthetic polypeptide
DEEEIRTTNPVATEQYGVVSTVVVTNNQEQGTTEEETED

SEQ ID NO: 173298 - protein, 39 aa, Artificial Sequence
  Description of Artificial Sequence: Synthetic polypeptide
DEEEIRTTNPVATEQYGVVSTVVVTNNQEQGTEEEEEEE

SEQ ID NO: 173299 - protein, 35 aa, Artificial Sequence
  Description of Artificial Sequence: Synthetic polypeptide
DEHEIATTNPVAYEAWGSVSGGNADDSRNNGNGNP

SEQ ID NO: 173300 - protein, 34 aa, Artificial Sequence
  Description of Artificial Sequence: Synthetic polypeptide
DEMEIVTTNPVATEQYGTTCANADGPEEFEGNYD

SEQ ID NO: 173301 - protein, 35 aa, Artificial Sequence
  Description of Artificial Sequence: Synthetic polypeptide
DENEIATTNPVAYEQYGSCAATGHGDQGDSGGNFP

SEQ ID NO: 173302 - protein, 39 aa, Artificial Sequence
  Description of Artificial Sequence: Synthetic polypeptide
DEEEIRTTNPVATEQYGVVSTVVVTNNQGQGTTEEEEED

SEQ ID NO: 173303 - protein, 36 aa, Artificial Sequence
  Description of Artificial Sequence: Synthetic polypeptide
DEEEIACTNPVATEQYGSACAATNPPEARDGMETWA

SEQ ID NO: 173304 - protein, 39 aa, Artificial Sequence
  Description of Artificial Sequence: Synthetic polypeptide
DEEEIRTTNPVATEQYGVVSTVTNQNGTEQYGSTQEDEE

SEQ ID NO: 173305 - protein, 35 aa, Artificial Sequence
  Description of Artificial Sequence: Synthetic polypeptide
DEAEIGTTNPVATEQYGAVCSAWDGSPVEFEGNEP

SEQ ID NO: 173306 - protein, 37 aa, Artificial Sequence
  Description of Artificial Sequence: Synthetic polypeptide
DEEEIRTTNPVATEQYGSIGQETMVMNQVQMVTVCED

SEQ ID NO: 173307 - protein, 33 aa, Artificial Sequence
  Description of Artificial Sequence: Synthetic polypeptide
DEHEISTTNPVAYMQWGSVPHWEKDQGQGNADM

SEQ ID NO: 173308 - protein, 36 aa, Artificial Sequence
  Description of Artificial Sequence: Synthetic polypeptide
DENEIATTNPVATEQWGSVSGEGMNPGQATGPPDEP

SEQ ID NO: 173309 - protein, 39 aa, Artificial Sequence
  Description of Artificial Sequence: Synthetic polypeptide
DEEEIRTTNPVATEQYGVVSTVVVTNNNQQGTEDEETEA

SEQ ID NO: 173310 - protein, 37 aa, Artificial Sequence
  Description of Artificial Sequence: Synthetic polypeptide
MEGEIRTTNPVATEQYGSVSSPTYAGPNMRFQENPVH

SEQ ID NO: 173311 - protein, 35 aa, Artificial Sequence
  Description of Artificial Sequence: Synthetic polypeptide
DEMEIVTTNPVATEQYGTTVCSATDGPVEEPEGPD

SEQ ID NO: 173312 - protein, 33 aa, Artificial Sequence
  Description of Artificial Sequence: Synthetic polypeptide
NEEEIATTNPVATEQYGCYCPWEDNQHFNSEQM

SEQ ID NO: 173313 - protein, 38 aa, Artificial Sequence
  Description of Artificial Sequence: Synthetic polypeptide
MEGEIRTTNPVATEQYGSVSEYTPALGPNERFESNDDA

SEQ ID NO: 173314 - protein, 35 aa, Artificial Sequence
  Description of Artificial Sequence: Synthetic polypeptide
DEEEICTTNPMATETYGSVPTFPDPQHVSGEQIMG

SEQ ID NO: 173315 - protein, 37 aa, Artificial Sequence
  Description of Artificial Sequence: Synthetic polypeptide
MEGEIRTTNPVATEQYGSVSSPAPAEGANMRFEANSV

SEQ ID NO: 173316 - protein, 32 aa, Artificial Sequence
  Description of Artificial Sequence: Synthetic polypeptide
DENEIATTNPVATEQWGTNCSAAAHMNSNDAW

SEQ ID NO: 173317 - protein, 34 aa, Artificial Sequence
  Description of Artificial Sequence: Synthetic polypeptide
DEGEIATTNPVAYEQYGSVCAAANGLDSEHQDDS

SEQ ID NO: 173318 - protein, 37 aa, Artificial Sequence
  Description of Artificial Sequence: Synthetic polypeptide
MEGEIRTTNPVATEQYGSVSSPTPAEMPNMRFEMNSS

SEQ ID NO: 173319 - protein, 37 aa, Artificial Sequence
  Description of Artificial Sequence: Synthetic polypeptide
MEGEIRTTNPVATEQYGSVSSPTPAEGPNMSFEMNSA

SEQ ID NO: 173320 - protein, 37 aa, Artificial Sequence
  Description of Artificial Sequence: Synthetic polypeptide
DEEEIATTNPVATEQYGSTACAANDGLPLGSEGNVTA

SEQ ID NO: 173321 - protein, 33 aa, Artificial Sequence
  Description of Artificial Sequence: Synthetic polypeptide
QAEEIATTNPVATEQYGCVAPGMGGGNESEEEK

SEQ ID NO: 173322 - protein, 40 aa, Artificial Sequence
  Description of Artificial Sequence: Synthetic polypeptide
DEEEIRTTNPVATEQYGVVSTVVATNNNNQQGTETGTNDE

SEQ ID NO: 173323 - protein, 36 aa, Artificial Sequence
  Description of Artificial Sequence: Synthetic polypeptide
DEHEIRTTNPVAYEAWGVVYTGNGNQGEARQQNGNA

SEQ ID NO: 173324 - protein, 37 aa, Artificial Sequence
  Description of Artificial Sequence: Synthetic polypeptide
MEGEIRTTNPVATEQYGSVSSPTPAEGPNMDFEMNGT

SEQ ID NO: 173325 - protein, 37 aa, Artificial Sequence
  Description of Artificial Sequence: Synthetic polypeptide
DEEEIATTNPVATEQYGSTACAANDGLPLGSEGNNEN

SEQ ID NO: 173326 - protein, 37 aa, Artificial Sequence
  Description of Artificial Sequence: Synthetic polypeptide
AEEEIRTTNPVATEQYGSYSSPITAEPNSPVGHHPVI

SEQ ID NO: 173327 - protein, 35 aa, Artificial Sequence
  Description of Artificial Sequence: Synthetic polypeptide
DEEEICTTNPMATETYGSVPNTPDPQHVSGEEIMG

SEQ ID NO: 173328 - protein, 37 aa, Artificial Sequence
  Description of Artificial Sequence: Synthetic polypeptide
MEGEIRTTNPVATEQYGSVSSPTPAGPNMRFEANPVE

SEQ ID NO: 173329 - protein, 32 aa, Artificial Sequence
  Description of Artificial Sequence: Synthetic polypeptide
QAEEIATTNPVATEQYGCVAPIHGTDSEEEKV

SEQ ID NO: 173330 - protein, 37 aa, Artificial Sequence
  Description of Artificial Sequence: Synthetic polypeptide
MEGEIRTTNPVATEQYGSVSSPNPAGPNERFEMNDFA

SEQ ID NO: 173331 - protein, 35 aa, Artificial Sequence
  Description of Artificial Sequence: Synthetic polypeptide
DEEEIATTNPVATEQYGSVCAAMAHGQAMAPDDHP

SEQ ID NO: 173332 - protein, 35 aa, Artificial Sequence
  Description of Artificial Sequence: Synthetic polypeptide
DEMEIVTTNPVATEQYGTTCSNTDGPVEEFEGNYD

SEQ ID NO: 173333 - protein, 38 aa, Artificial Sequence
  Description of Artificial Sequence: Synthetic polypeptide
MEGEIRTTNPVATEQYGSVSSPAPQEGPNMRFEGFSQE

SEQ ID NO: 173334 - protein, 38 aa, Artificial Sequence
  Description of Artificial Sequence: Synthetic polypeptide
MEGEIRTTNPVATEQYGSVSSPAPLEGPNMRFEGNSWE

SEQ ID NO: 173335 - protein, 34 aa, Artificial Sequence
  Description of Artificial Sequence: Synthetic polypeptide
DEMEIVTTNPVATEQYGTTCANADGWEEFEGNYD

SEQ ID NO: 173336 - protein, 33 aa, Artificial Sequence
  Description of Artificial Sequence: Synthetic polypeptide
QAEEIATTNPVATEQYGCVAPIHHGLDSEGEGN

SEQ ID NO: 173337 - protein, 34 aa, Artificial Sequence
  Description of Artificial Sequence: Synthetic polypeptide
DEAEIGTTNPVATEQYGCLCTATDGDVEFEGNEQ

SEQ ID NO: 173338 - protein, 35 aa, Artificial Sequence
  Description of Artificial Sequence: Synthetic polypeptide
DEGEIATTNPVAYEQYGSVCAAANGPQEAEHANDS

SEQ ID NO: 173339 - protein, 37 aa, Artificial Sequence
  Description of Artificial Sequence: Synthetic polypeptide
AEEEIRTTNPVATEQYGSYSSPSTEEPNSPVGHTPVC

SEQ ID NO: 173340 - protein, 35 aa, Artificial Sequence
  Description of Artificial Sequence: Synthetic polypeptide
DAEEIATTNPVAYEQYGSVCTGTPGPDDSGDGMNN

SEQ ID NO: 173341 - protein, 38 aa, Artificial Sequence
  Description of Artificial Sequence: Synthetic polypeptide
DEEEIRTTNPVATEQYGSVASVWMMNHEELAIAHPYIN

SEQ ID NO: 173342 - protein, 36 aa, Artificial Sequence
  Description of Artificial Sequence: Synthetic polypeptide
MEGEIRTTNPVATEQYGSVGNVTPLDIAEPNEDEMG

SEQ ID NO: 173343 - protein, 35 aa, Artificial Sequence
  Description of Artificial Sequence: Synthetic polypeptide
DEEEICTTNPEAYTTAAWGSSATNLQHAGGGNEAM

SEQ ID NO: 173344 - protein, 32 aa, Artificial Sequence
  Description of Artificial Sequence: Synthetic polypeptide
QENEIATTNPVATEPYGNTTAGEHLQHGMGMA

SEQ ID NO: 173345 - protein, 37 aa, Artificial Sequence
  Description of Artificial Sequence: Synthetic polypeptide
DEEEIRTTNPVATEQYGSIIHTTNMQAISTQMVQFEE

SEQ ID NO: 173346 - protein, 37 aa, Artificial Sequence
  Description of Artificial Sequence: Synthetic polypeptide
DEEEIATTNPVATEQYGSVCAAMAHLSQAMAPNDDNY

SEQ ID NO: 173347 - protein, 32 aa, Artificial Sequence
  Description of Artificial Sequence: Synthetic polypeptide
QEEEIATTNPIATEQWGATWANEEVWQHGEYK

SEQ ID NO: 173348 - protein, 36 aa, Artificial Sequence
  Description of Artificial Sequence: Synthetic polypeptide
DENEIATTNPVATEQWGSVSAVAHALQEHQDGTQGH

SEQ ID NO: 173349 - protein, 32 aa, Artificial Sequence
  Description of Artificial Sequence: Synthetic polypeptide
QEEEIATTNPIATEQWGATWANEEVWQPGEYK

SEQ ID NO: 173350 - protein, 37 aa, Artificial Sequence
  Description of Artificial Sequence: Synthetic polypeptide
DEEEIATTNPVATEQYGSTACAPANNGLPLGSEGNDH

SEQ ID NO: 173351 - protein, 35 aa, Artificial Sequence
  Description of Artificial Sequence: Synthetic polypeptide
DEHEIRTTNPVATDQYGSVWPMPVWLENRSEDQQP

SEQ ID NO: 173352 - protein, 38 aa, Artificial Sequence
  Description of Artificial Sequence: Synthetic polypeptide
DEEEIRTTNPVATEQYGSIILEESTAVEPNMLLVEVAG

SEQ ID NO: 173353 - protein, 34 aa, Artificial Sequence
  Description of Artificial Sequence: Synthetic polypeptide
DEEEIATTNPVATEQYGSVCAAKAGPEEMMMPEG

SEQ ID NO: 173354 - protein, 36 aa, Artificial Sequence
  Description of Artificial Sequence: Synthetic polypeptide
QEGEIATTNPVATEQYGSVSSTTPAGPNMRNGMTPV

SEQ ID NO: 173355 - protein, 32 aa, Artificial Sequence
  Description of Artificial Sequence: Synthetic polypeptide
QEEEIATTNPIATEQWGATWANEEDWQPGPYK

SEQ ID NO: 173356 - protein, 35 aa, Artificial Sequence
  Description of Artificial Sequence: Synthetic polypeptide
DEEEIACTNPVATAQWGSVSVSGNPGENTRGVEES

SEQ ID NO: 173357 - protein, 30 aa, Artificial Sequence
  Description of Artificial Sequence: Synthetic polypeptide
QEEEIATTNPIATEQWGETWAAVWQHKEEK

SEQ ID NO: 173358 - protein, 34 aa, Artificial Sequence
  Description of Artificial Sequence: Synthetic polypeptide
QENEIATTNPVATEPYGNVPSGEHLQHGMDMSLM

SEQ ID NO: 173359 - protein, 32 aa, Artificial Sequence
  Description of Artificial Sequence: Synthetic polypeptide
QEEEIATTNPIATEQWGETWANEEVWQHGEYK

SEQ ID NO: 173360 - protein, 33 aa, Artificial Sequence
  Description of Artificial Sequence: Synthetic polypeptide
DEMEIVTTNPVATEQYGTMCSAYDGPVEFEGTD

SEQ ID NO: 173361 - protein, 37 aa, Artificial Sequence
  Description of Artificial Sequence: Synthetic polypeptide
DENEIATTNPVATEQWGSVAITNHQEEATGNQDGTNP

SEQ ID NO: 173362 - protein, 34 aa, Artificial Sequence
  Description of Artificial Sequence: Synthetic polypeptide
QENEIATTNPVATEPYGNVPSGEHLQHGMEMTLN

SEQ ID NO: 173363 - protein, 30 aa, Artificial Sequence
  Description of Artificial Sequence: Synthetic polypeptide
QESEIASTNPVGTEGYGVMASTLEFHPGDI

SEQ ID NO: 173364 - protein, 36 aa, Artificial Sequence
  Description of Artificial Sequence: Synthetic polypeptide
MEGEIRTTNPVATEQYGSVIPDWDLQQGIMDIDQEW

SEQ ID NO: 173365 - protein, 31 aa, Artificial Sequence
  Description of Artificial Sequence: Synthetic polypeptide
QEEEIATTNPIATEQYGEAANAEVCQHEEYK

SEQ ID NO: 173366 - protein, 35 aa, Artificial Sequence
  Description of Artificial Sequence: Synthetic polypeptide
MEGEIRTTNPVATEQYGSVINVPWNEDESFGEDSM

SEQ ID NO: 173367 - protein, 34 aa, Artificial Sequence
  Description of Artificial Sequence: Synthetic polypeptide
QENEIATTNPVATEPYGNVPSGEHLQAHGMPQLH

SEQ ID NO: 173368 - protein, 32 aa, Artificial Sequence
  Description of Artificial Sequence: Synthetic polypeptide
QEEEIATTNPIATEQWGATWANEEDWQPGEYK

SEQ ID NO: 173369 - protein, 34 aa, Artificial Sequence
  Description of Artificial Sequence: Synthetic polypeptide
QENEIATTNPVATEPYGNVPSGEGHLQHGMMQQN

SEQ ID NO: 173370 - protein, 34 aa, Artificial Sequence
  Description of Artificial Sequence: Synthetic polypeptide
DEHEISTTNPVAYESWGCVSGGNGEERNNMNGNQ

SEQ ID NO: 173371 - protein, 34 aa, Artificial Sequence
  Description of Artificial Sequence: Synthetic polypeptide
QENEIATTNPVATEPYGNTVAGENGLQHMNPKLN

SEQ ID NO: 173372 - protein, 30 aa, Artificial Sequence
  Description of Artificial Sequence: Synthetic polypeptide
QEEEIATTNPIATECWGATWAADWQHKGEK

SEQ ID NO: 173373 - protein, 34 aa, Artificial Sequence
  Description of Artificial Sequence: Synthetic polypeptide
DEEEICTTNPCAYEQWGSVCYNIEELHDGIQMDS

SEQ ID NO: 173374 - protein, 36 aa, Artificial Sequence
  Description of Artificial Sequence: Synthetic polypeptide
DENEIATTNPVATEQWGSVSGEGGPGENRDGMNPVS

SEQ ID NO: 173375 - protein, 30 aa, Artificial Sequence
  Description of Artificial Sequence: Synthetic polypeptide
QEEEIATTNPIATECWGETWAADWQHKGEK

SEQ ID NO: 173376 - protein, 33 aa, Artificial Sequence
  Description of Artificial Sequence: Synthetic polypeptide
QENEIATTNPVATEPYGNTVSGEHLNQHMDTLH

SEQ ID NO: 173377 - protein, 34 aa, Artificial Sequence
  Description of Artificial Sequence: Synthetic polypeptide
QENEIATTNPVATEPYGNTVSGEHLQHGMDESLA

SEQ ID NO: 173378 - protein, 39 aa, Artificial Sequence
  Description of Artificial Sequence: Synthetic polypeptide
DEEEIRTTNPVATEQYGVVSTVVTNGTQAGTTEAGSVVE

SEQ ID NO: 173379 - protein, 37 aa, Artificial Sequence
  Description of Artificial Sequence: Synthetic polypeptide
MEGEIRTTNPVATEQYGSVSETTPAGPNERFEMDDVA

SEQ ID NO: 173380 - protein, 34 aa, Artificial Sequence
  Description of Artificial Sequence: Synthetic polypeptide
QENEIATTNPVATEPYGNTVSGENHLQHQMDELH

SEQ ID NO: 173381 - protein, 37 aa, Artificial Sequence
  Description of Artificial Sequence: Synthetic polypeptide
MEGEIRTTNPVATEQYGSVSESTPAGPNESFESNDDA

SEQ ID NO: 173382 - protein, 34 aa, Artificial Sequence
  Description of Artificial Sequence: Synthetic polypeptide
DEMEIVTTNPVATEQYGTNACSATDGPWEFEHND

SEQ ID NO: 173383 - protein, 34 aa, Artificial Sequence
  Description of Artificial Sequence: Synthetic polypeptide
DEEEIATTNPVAYEQWGSICAANGPMQNDDGSWN

SEQ ID NO: 173384 - protein, 37 aa, Artificial Sequence
  Description of Artificial Sequence: Synthetic polypeptide
MEGEIRTTNPVATEQYGSVSEDEPAGPNERFESNDVA

SEQ ID NO: 173385 - protein, 34 aa, Artificial Sequence
  Description of Artificial Sequence: Synthetic polypeptide
DEEEIATTNPVAYEQWGSICAAAGELQDSINEEG

SEQ ID NO: 173386 - protein, 36 aa, Artificial Sequence
  Description of Artificial Sequence: Synthetic polypeptide
DDEEIRTTNPVATEGYGICVCSTVNHNQENFISDQA

SEQ ID NO: 173387 - protein, 37 aa, Artificial Sequence
  Description of Artificial Sequence: Synthetic polypeptide
MEGEIRTTNPVATEQYGSVSSPVPAEGPNMRFEENSV

SEQ ID NO: 173388 - protein, 37 aa, Artificial Sequence
  Description of Artificial Sequence: Synthetic polypeptide
MEGEIRTTNPVATEQYGSVSSTIWAGPNERFEMNDVA

SEQ ID NO: 173389 - protein, 39 aa, Artificial Sequence
  Description of Artificial Sequence: Synthetic polypeptide
DEEEIRTTNPVATEQYGVVSTVVTNGTQAGTTEQGSEVG

SEQ ID NO: 173390 - protein, 38 aa, Artificial Sequence
  Description of Artificial Sequence: Synthetic polypeptide
MEGEIRTTNPVATEQYGSVSAPAPQEGPNMRFEGNSVE

SEQ ID NO: 173391 - protein, 36 aa, Artificial Sequence
  Description of Artificial Sequence: Synthetic polypeptide
DEEEIACTNPVATAQWGSVSVSGNPLENTRGVEEFY

SEQ ID NO: 173392 - protein, 33 aa, Artificial Sequence
  Description of Artificial Sequence: Synthetic polypeptide
DEEEICTTNPCAYAEYGSIAYTANEHSGIGGNG

SEQ ID NO: 173393 - protein, 36 aa, Artificial Sequence
  Description of Artificial Sequence: Synthetic polypeptide
DEMEIATTNPVAYEQYGTVCSYTDGLPEGHKGDGNS

SEQ ID NO: 173394 - protein, 37 aa, Artificial Sequence
  Description of Artificial Sequence: Synthetic polypeptide
MEGEIRTTNPVATEQYGSVSETTPAGPNERFESNDHA

SEQ ID NO: 173395 - protein, 37 aa, Artificial Sequence
  Description of Artificial Sequence: Synthetic polypeptide
QEEEIRTTNPVCYEPWGCSVSCDPNLSQNRQGGGNDE

SEQ ID NO: 173396 - protein, 36 aa, Artificial Sequence
  Description of Artificial Sequence: Synthetic polypeptide
DEGEIATTNPVAYEQYGSVANTGHGPLAAGNDNPDD

SEQ ID NO: 173397 - protein, 36 aa, Artificial Sequence
  Description of Artificial Sequence: Synthetic polypeptide
DDEEIATTNPVSTEQYGNVSSTTPAGPNSRNGMNPV

SEQ ID NO: 173398 - protein, 35 aa, Artificial Sequence
  Description of Artificial Sequence: Synthetic polypeptide
QAEEIATTNPVATEQWGSVSGNNGPPDRAATEGAN

SEQ ID NO: 173399 - protein, 34 aa, Artificial Sequence
  Description of Artificial Sequence: Synthetic polypeptide
DENEIATTNPVATEQWGCVSGEGVEMNAAELDNN

SEQ ID NO: 173400 - protein, 34 aa, Artificial Sequence
  Description of Artificial Sequence: Synthetic polypeptide
DENEIATTNPVATEQWGCVSGEGVEMNAAEDNKH

SEQ ID NO: 173401 - protein, 34 aa, Artificial Sequence
  Description of Artificial Sequence: Synthetic polypeptide
DENEIATTNPVATEQWGCVSGEGVEMNAAEDGDW

SEQ ID NO: 173402 - protein, 37 aa, Artificial Sequence
  Description of Artificial Sequence: Synthetic polypeptide
DEMEIRTTNPVATEQYGSCCSTSHVILETGGQEMATW

SEQ ID NO: 173403 - protein, 31 aa, Artificial Sequence
  Description of Artificial Sequence: Synthetic polypeptide
QEEEIATTNPVAYEQYGEAPCEVEHSQHEEV

SEQ ID NO: 173404 - protein, 36 aa, Artificial Sequence
  Description of Artificial Sequence: Synthetic polypeptide
DEEEIRTTNPVATEQYGSINNAPAGVEIQQLLLDPT

SEQ ID NO: 173405 - protein, 37 aa, Artificial Sequence
  Description of Artificial Sequence: Synthetic polypeptide
DEEEIRTTNPVATEQYGSVMGQINMEDETGGEDEQGV

SEQ ID NO: 173406 - protein, 38 aa, Artificial Sequence
  Description of Artificial Sequence: Synthetic polypeptide
AEEEIRTTNPVATEQYGTVSTVTTNNMEQGTNNVTDEN

SEQ ID NO: 173407 - protein, 32 aa, Artificial Sequence
  Description of Artificial Sequence: Synthetic polypeptide
QEEEIATTNPVAYEQYGEAPCEVEQSQHEENK

SEQ ID NO: 173408 - protein, 36 aa, Artificial Sequence
  Description of Artificial Sequence: Synthetic polypeptide
DEEEIRATNPVATEQWGGCNAITNHDEQTGEENNNL

SEQ ID NO: 173409 - protein, 35 aa, Artificial Sequence
  Description of Artificial Sequence: Synthetic polypeptide
MEGEIRTTNPVATEQYGSCSPDLMMTHENGEEDQG

SEQ ID NO: 173410 - protein, 35 aa, Artificial Sequence
  Description of Artificial Sequence: Synthetic polypeptide
DEMEIVTTNPVATEQYGMTVCRATDGPVEREPNDG

SEQ ID NO: 173411 - protein, 32 aa, Artificial Sequence
  Description of Artificial Sequence: Synthetic polypeptide
QEEEIATTNPVAYEQYGEAPCEVGSTHEGEQK

SEQ ID NO: 173412 - protein, 36 aa, Artificial Sequence
  Description of Artificial Sequence: Synthetic polypeptide
DEMEIRTTNPVATEQYGSCCSTSHVITETGFQEMQT

SEQ ID NO: 173413 - protein, 37 aa, Artificial Sequence
  Description of Artificial Sequence: Synthetic polypeptide
DEMEIRTTNPVATEQYGSCFTSETTMLQEHFYDDTDI

SEQ ID NO: 173414 - protein, 36 aa, Artificial Sequence
  Description of Artificial Sequence: Synthetic polypeptide
DEMEIVTTNPVATEQYGKTVCSATDGPVEFEGTNLD

SEQ ID NO: 173415 - protein, 33 aa, Artificial Sequence
  Description of Artificial Sequence: Synthetic polypeptide
DEGEIATTNPVAYEQYGSACAVPAEGQNHQDMM

SEQ ID NO: 173416 - protein, 36 aa, Artificial Sequence
  Description of Artificial Sequence: Synthetic polypeptide
QAEEIATTNPVATEQYGSVCATGPGPLDSMIGNDEE

SEQ ID NO: 173417 - protein, 38 aa, Artificial Sequence
  Description of Artificial Sequence: Synthetic polypeptide
AEEEIRTTNPVATEQYGTVVTVTTNNLGGTEQGTNENQ

SEQ ID NO: 173418 - protein, 33 aa, Artificial Sequence
  Description of Artificial Sequence: Synthetic polypeptide
DENEIATTNPVATEQWGCVSGEGEMNAAEEDTA

SEQ ID NO: 173419 - protein, 35 aa, Artificial Sequence
  Description of Artificial Sequence: Synthetic polypeptide
MEGEIRTTNPVATEQYGSVVEDYYLEFANIQQEET

SEQ ID NO: 173420 - protein, 34 aa, Artificial Sequence
  Description of Artificial Sequence: Synthetic polypeptide
DENEIATTNPVATEQWGCVSGEGGEMNAAEDNAG

SEQ ID NO: 173421 - protein, 35 aa, Artificial Sequence
  Description of Artificial Sequence: Synthetic polypeptide
DENEIATTNPVATEQYGCVAANNNNVTTDDGNPEE

SEQ ID NO: 173422 - protein, 34 aa, Artificial Sequence
  Description of Artificial Sequence: Synthetic polypeptide
DENEIATTNPVATEQWGCYAGSGNPANPNPGAQP

SEQ ID NO: 173423 - protein, 37 aa, Artificial Sequence
  Description of Artificial Sequence: Synthetic polypeptide
QEEEIRTTNPVATEQYGSVDDDDNTDEQEGGGEEDQQ

SEQ ID NO: 173424 - protein, 30 aa, Artificial Sequence
  Description of Artificial Sequence: Synthetic polypeptide
QEGEIASTNPCSYEQWGCGYCNDQSRGDAR

SEQ ID NO: 173425 - protein, 37 aa, Artificial Sequence
  Description of Artificial Sequence: Synthetic polypeptide
NEEEIATTNPVAYEQWGKTFSHCTLNALPQNRVGQNF

SEQ ID NO: 173426 - protein, 35 aa, Artificial Sequence
  Description of Artificial Sequence: Synthetic polypeptide
DEMEIRTTNPVATEQYGSACVFAAPENEMNTQDEG

SEQ ID NO: 173427 - protein, 38 aa, Artificial Sequence
  Description of Artificial Sequence: Synthetic polypeptide
NEEEIATTNPVAYEQWGKTFSVQTLNALPQNRVGNPLF

SEQ ID NO: 173428 - protein, 37 aa, Artificial Sequence
  Description of Artificial Sequence: Synthetic polypeptide
NEEEIATTNPVAYEQWGKTFSVTLNALPQNRVGMNLF

SEQ ID NO: 173429 - protein, 38 aa, Artificial Sequence
  Description of Artificial Sequence: Synthetic polypeptide
DEEEIRTTNPVATEQYGSVNSLPLNYMVLESLLEVKES

SEQ ID NO: 173430 - protein, 36 aa, Artificial Sequence
  Description of Artificial Sequence: Synthetic polypeptide
DEGEIATTNPVAYEQYGSICATNPQLNPDDQTGGVM

SEQ ID NO: 173431 - protein, 35 aa, Artificial Sequence
  Description of Artificial Sequence: Synthetic polypeptide
DEMEIATTNPVAYEQYGTVCSYTDGPVEDTGNNDQ

SEQ ID NO: 173432 - protein, 36 aa, Artificial Sequence
  Description of Artificial Sequence: Synthetic polypeptide
MEGEIRTTNPVATEQYGSVVEDYGNLEFLGISQEET

SEQ ID NO: 173433 - protein, 34 aa, Artificial Sequence
  Description of Artificial Sequence: Synthetic polypeptide
DCEEIRATNPVAYEQWGSSYYIEHMHQREGQNNV

SEQ ID NO: 173434 - protein, 34 aa, Artificial Sequence
  Description of Artificial Sequence: Synthetic polypeptide
MEGEIRTTNPVATEQYGSVVEDYGSEFDSNSQET

SEQ ID NO: 173435 - protein, 36 aa, Artificial Sequence
  Description of Artificial Sequence: Synthetic polypeptide
DEGEIATTNPVAYEQYGSCASAVGNGLNHDDVDNRD

SEQ ID NO: 173436 - protein, 36 aa, Artificial Sequence
  Description of Artificial Sequence: Synthetic polypeptide
DEEEIGTTNPVATEQYGCVCSNWGEHDQNFNSETQS

SEQ ID NO: 173437 - protein, 32 aa, Artificial Sequence
  Description of Artificial Sequence: Synthetic polypeptide
DEAEICTTNPVAYEQWGYCQEDLKRGMDTQGK

SEQ ID NO: 173438 - protein, 39 aa, Artificial Sequence
  Description of Artificial Sequence: Synthetic polypeptide
DEEEIRTTNPVATEQYGVVSTVVNQQQNNQQNATTNVAE

SEQ ID NO: 173439 - protein, 34 aa, Artificial Sequence
  Description of Artificial Sequence: Synthetic polypeptide
QAEEIATTNPVATEQWGSVSGTGPPDNTNPNPLH

SEQ ID NO: 173440 - protein, 35 aa, Artificial Sequence
  Description of Artificial Sequence: Synthetic polypeptide
QEEEIVTTNPVATEQYGSVMLGPMEGEGGQGENED

SEQ ID NO: 173441 - protein, 32 aa, Artificial Sequence
  Description of Artificial Sequence: Synthetic polypeptide
QEEEIATTNPVAYEQYGEAPCEVAPSQHEGEK

SEQ ID NO: 173442 - protein, 35 aa, Artificial Sequence
  Description of Artificial Sequence: Synthetic polypeptide
MEGEIRTTNPVATEQYGSCSPDNSMSHENLNEDQG

SEQ ID NO: 173443 - protein, 36 aa, Artificial Sequence
  Description of Artificial Sequence: Synthetic polypeptide
DEMEIVTTNPVATEQYGQCVCSNTGEPNAFFGSDQS

SEQ ID NO: 173444 - protein, 38 aa, Artificial Sequence
  Description of Artificial Sequence: Synthetic polypeptide
DEMEIATTNPVAYEQYGTVCSYTDGLNEEGQRGQNNEG

SEQ ID NO: 173445 - protein, 36 aa, Artificial Sequence
  Description of Artificial Sequence: Synthetic polypeptide
DDEEIRTTNPVATCQYGCVCSWEGHNQENFGSDNQS

SEQ ID NO: 173446 - protein, 36 aa, Artificial Sequence
  Description of Artificial Sequence: Synthetic polypeptide
MEGEIRTTNPVATEQYGSVVEDYNALEFQNIEQEET

SEQ ID NO: 173447 - protein, 38 aa, Artificial Sequence
  Description of Artificial Sequence: Synthetic polypeptide
DEEEIRTTNPVATEQYGSVEYNTSMNSVAETVNMPAQA

SEQ ID NO: 173448 - protein, 35 aa, Artificial Sequence
  Description of Artificial Sequence: Synthetic polypeptide
MEGEIRTTNPVATEQYGSVVEDYGLEFDNISQEET

SEQ ID NO: 173449 - protein, 35 aa, Artificial Sequence
  Description of Artificial Sequence: Synthetic polypeptide
MEGEIRTTNPVATEQYGSVVEPYTGHEFLSNSQET

SEQ ID NO: 173450 - protein, 35 aa, Artificial Sequence
  Description of Artificial Sequence: Synthetic polypeptide
MEGEIRTTNPVATEQYGSCPPDNEWGHENGNEDQG

SEQ ID NO: 173451 - protein, 38 aa, Artificial Sequence
  Description of Artificial Sequence: Synthetic polypeptide
DEEEIRTTNPVATEQYGSVQFITMGQEEQNEPGSVPEI

SEQ ID NO: 173452 - protein, 34 aa, Artificial Sequence
  Description of Artificial Sequence: Synthetic polypeptide
QAEEIATTNPVATEQWGGCCTAATGLQQMGGEIR

SEQ ID NO: 173453 - protein, 36 aa, Artificial Sequence
  Description of Artificial Sequence: Synthetic polypeptide
MEGEIRTTNPVATEQYGSVWNVTMPEDIEPGEDERL

SEQ ID NO: 173454 - protein, 36 aa, Artificial Sequence
  Description of Artificial Sequence: Synthetic polypeptide
QAEEIATTNPVATEQYGSVCGTPPGPLDSMIGNPEE

SEQ ID NO: 173455 - protein, 35 aa, Artificial Sequence
  Description of Artificial Sequence: Synthetic polypeptide
MEGEIRTTNPVATEQYGSVWNVTPDDIEPWEDERG

SEQ ID NO: 173456 - protein, 36 aa, Artificial Sequence
  Description of Artificial Sequence: Synthetic polypeptide
MEGEIRTTNPVATEQYGSVWNVTPEDISEPNEDERG

SEQ ID NO: 173457 - protein, 38 aa, Artificial Sequence
  Description of Artificial Sequence: Synthetic polypeptide
DDEEIRTTNPVATEGYGSVSIVNMDAGQQGEFDDNEQF

SEQ ID NO: 173458 - protein, 34 aa, Artificial Sequence
  Description of Artificial Sequence: Synthetic polypeptide
DEHEIRTTNPVAYECWGCVFGGNGEERNGMGGNA

SEQ ID NO: 173459 - protein, 34 aa, Artificial Sequence
  Description of Artificial Sequence: Synthetic polypeptide
QEEEIHTTNPVATEQYGVVAGPGEGQGGQGGEED

SEQ ID NO: 173460 - protein, 37 aa, Artificial Sequence
  Description of Artificial Sequence: Synthetic polypeptide
MEGEIRTTNPVATEQYGSVWNVTPGLDIEEPGEDARA

SEQ ID NO: 173461 - protein, 36 aa, Artificial Sequence
  Description of Artificial Sequence: Synthetic polypeptide
DEGEIATTNPVAYEQYGSVCASNDLPQEHQDGTEAN

SEQ ID NO: 173462 - protein, 36 aa, Artificial Sequence
  Description of Artificial Sequence: Synthetic polypeptide
DEMEIATTNPVAYERWGSVCSGTDNHDRDGGDQGER

SEQ ID NO: 173463 - protein, 34 aa, Artificial Sequence
  Description of Artificial Sequence: Synthetic polypeptide
MEGEIRTTNPVATEQYGCVYTLEMEEQMNFIDEE

SEQ ID NO: 173464 - protein, 35 aa, Artificial Sequence
  Description of Artificial Sequence: Synthetic polypeptide
MEGEIRTTNPVATEQYGCVYTLEMEEQDMNGLDEQ

SEQ ID NO: 173465 - protein, 36 aa, Artificial Sequence
  Description of Artificial Sequence: Synthetic polypeptide
DAEEIATTNPVATEQYGSVCAWNPALDGDSPEIDRH

SEQ ID NO: 173466 - protein, 36 aa, Artificial Sequence
  Description of Artificial Sequence: Synthetic polypeptide
MEGEIRTTNPVATEQYGSVWNVTPMMDIEPNEDERG

SEQ ID NO: 173467 - protein, 33 aa, Artificial Sequence
  Description of Artificial Sequence: Synthetic polypeptide
DENEIATTNPVAYEQWGGVYSMEIEMNQREDHP

SEQ ID NO: 173468 - protein, 35 aa, Artificial Sequence
  Description of Artificial Sequence: Synthetic polypeptide
DEAEIATTNPVATEQYGSVCAAMAHDEAGMPPDNP

SEQ ID NO: 173469 - protein, 35 aa, Artificial Sequence
  Description of Artificial Sequence: Synthetic polypeptide
DEMEIATTNPVAYERWGSVCSTNDNHDRAGGQGEN

SEQ ID NO: 173470 - protein, 36 aa, Artificial Sequence
  Description of Artificial Sequence: Synthetic polypeptide
MEGEIRTTNPVATEQYGSVWNVTPTLDIEPNEDEMW

SEQ ID NO: 173471 - protein, 35 aa, Artificial Sequence
  Description of Artificial Sequence: Synthetic polypeptide
DEMEIATTNPVAYERWGSVCSTNDNHDRDGMQEEQ

SEQ ID NO: 173472 - protein, 35 aa, Artificial Sequence
  Description of Artificial Sequence: Synthetic polypeptide
DEAEIATTNPVAYEQWGSVSGGNMTNESGEGDGTS

SEQ ID NO: 173473 - protein, 35 aa, Artificial Sequence
  Description of Artificial Sequence: Synthetic polypeptide
MEGEIRTTNPVATEQYGCVYTLEMEEQMNGIDEDN

SEQ ID NO: 173474 - protein, 37 aa, Artificial Sequence
  Description of Artificial Sequence: Synthetic polypeptide
DEEEIRTTNPVATEQYGSVQFITMGQEEQPEDEVPEI

SEQ ID NO: 173475 - protein, 38 aa, Artificial Sequence
  Description of Artificial Sequence: Synthetic polypeptide
AEEEIRTTNPVATEQYGSVVVVVTTNNANQAGDEQGED

SEQ ID NO: 173476 - protein, 34 aa, Artificial Sequence
  Description of Artificial Sequence: Synthetic polypeptide
QAEEIATTNPVATEQYGSVCATPQLDINHDTAMQ

SEQ ID NO: 173477 - protein, 36 aa, Artificial Sequence
  Description of Artificial Sequence: Synthetic polypeptide
QAEEIATTNPVATEQYGSVCATNHGPLDSMIENDED

SEQ ID NO: 173478 - protein, 36 aa, Artificial Sequence
  Description of Artificial Sequence: Synthetic polypeptide
DEEEIATTNPVATEQYGSVCAATMHGEAPIDGMEGH

SEQ ID NO: 173479 - protein, 39 aa, Artificial Sequence
  Description of Artificial Sequence: Synthetic polypeptide
AEEEIRTTNPVATEQYGTVVTVVTTNNLQQGNNNEENEL

SEQ ID NO: 173480 - protein, 36 aa, Artificial Sequence
  Description of Artificial Sequence: Synthetic polypeptide
DEMEIVTTNPVATEQYGICVCSNTGEPNEFFGSEQS

SEQ ID NO: 173481 - protein, 38 aa, Artificial Sequence
  Description of Artificial Sequence: Synthetic polypeptide
AEEEIRTTNPVATEQYGSVVVVVTTNNAQQGATDEEEE

SEQ ID NO: 173482 - protein, 37 aa, Artificial Sequence
  Description of Artificial Sequence: Synthetic polypeptide
MEGEIRTTNPVATEQYGSVVMWVNEGEQESGDDNYEG

SEQ ID NO: 173483 - protein, 36 aa, Artificial Sequence
  Description of Artificial Sequence: Synthetic polypeptide
DEGEIATTNPVAYEQYGSVCANMNPEEAPDNQEGNH

SEQ ID NO: 173484 - protein, 34 aa, Artificial Sequence
  Description of Artificial Sequence: Synthetic polypeptide
QAEEIATTNPVATEQWGGCVTSAAGLQQGGGEGN

SEQ ID NO: 173485 - protein, 38 aa, Artificial Sequence
  Description of Artificial Sequence: Synthetic polypeptide
AEEEIRTTNPVATEQYGSVVVVVTTNNANQNADENGED

SEQ ID NO: 173486 - protein, 34 aa, Artificial Sequence
  Description of Artificial Sequence: Synthetic polypeptide
QAEEIATTNPVATEQWGGCVTSAAGLDQAGGETN

SEQ ID NO: 173487 - protein, 36 aa, Artificial Sequence
  Description of Artificial Sequence: Synthetic polypeptide
MEGEIRTTNPVATEQYGSCFSPDNETGHENGNEDQG

SEQ ID NO: 173488 - protein, 32 aa, Artificial Sequence
  Description of Artificial Sequence: Synthetic polypeptide
QEGEIASTNPCSYEAYGITVSCNELSQSGGTR

SEQ ID NO: 173489 - protein, 35 aa, Artificial Sequence
  Description of Artificial Sequence: Synthetic polypeptide
MEGEIRTTNPVATEQYGSCFSCMDHIWQSSNEEHN

SEQ ID NO: 173490 - protein, 36 aa, Artificial Sequence
  Description of Artificial Sequence: Synthetic polypeptide
DEGEIATTNPVAYEQYGSACAAVATGVNTAGGPTNA

SEQ ID NO: 173491 - protein, 35 aa, Artificial Sequence
  Description of Artificial Sequence: Synthetic polypeptide
MEGEIRTTNPVATEQYGSCFSCMDHIWDRDNEEHN

SEQ ID NO: 173492 - protein, 36 aa, Artificial Sequence
  Description of Artificial Sequence: Synthetic polypeptide
DEEEIATTNPVATEQYGSVAANHSGDPAMHPGEEGN

SEQ ID NO: 173493 - protein, 35 aa, Artificial Sequence
  Description of Artificial Sequence: Synthetic polypeptide
MEGEIRTTNPVATEQYGSCFSCMDHGWQQENEEHN

SEQ ID NO: 173494 - protein, 37 aa, Artificial Sequence
  Description of Artificial Sequence: Synthetic polypeptide
DEEEIRTTNPVATEQYGSVEICAHFGEVQLEMMENAF

SEQ ID NO: 173495 - protein, 36 aa, Artificial Sequence
  Description of Artificial Sequence: Synthetic polypeptide
MEGEIRTTNPVATEQYGSCCSPDNMWSHENGNEDQG

SEQ ID NO: 173496 - protein, 37 aa, Artificial Sequence
  Description of Artificial Sequence: Synthetic polypeptide
MEGEIRTTNPVATEQYGSVWGTDDNGVHTGFEDNYYD

SEQ ID NO: 173497 - protein, 37 aa, Artificial Sequence
  Description of Artificial Sequence: Synthetic polypeptide
MEGEIRTTNPVATEQYGSVWMWVNELEQEHGDDTYEG

SEQ ID NO: 173498 - protein, 33 aa, Artificial Sequence
  Description of Artificial Sequence: Synthetic polypeptide
QAEEIATTNPVATEQWGGCVTAAAGLDNQGGEG

SEQ ID NO: 173499 - protein, 34 aa, Artificial Sequence
  Description of Artificial Sequence: Synthetic polypeptide
QAEEIATTNPVATEQWGGCHVTAAAGLQQMGGER

SEQ ID NO: 173500 - protein, 35 aa, Artificial Sequence
  Description of Artificial Sequence: Synthetic polypeptide
DEEEIATTNPVAYEQWGSVCQNDNDDQPGQGGDTH

SEQ ID NO: 173501 - protein, 34 aa, Artificial Sequence
  Description of Artificial Sequence: Synthetic polypeptide
DEEEIATTNPVAYEQWGSVCAAANGLDSEHVDDV

SEQ ID NO: 173502 - protein, 35 aa, Artificial Sequence
  Description of Artificial Sequence: Synthetic polypeptide
DEGEIATTNPVAYEQYGSTACAGANGLQDSDGMMD

SEQ ID NO: 173503 - protein, 36 aa, Artificial Sequence
  Description of Artificial Sequence: Synthetic polypeptide
DEGEIATTNPVAYEQYGSTACAGANGLQDSDGNLQD

SEQ ID NO: 173504 - protein, 35 aa, Artificial Sequence
  Description of Artificial Sequence: Synthetic polypeptide
QAEEIATTNPVATEQYGCNVAGNGGHQTADGPNDN

SEQ ID NO: 173505 - protein, 35 aa, Artificial Sequence
  Description of Artificial Sequence: Synthetic polypeptide
NEEEIATTNPVATEQWGGCCTAAAGNLDDGMGNES

SEQ ID NO: 173506 - protein, 36 aa, Artificial Sequence
  Description of Artificial Sequence: Synthetic polypeptide
QAEEIATTNPVATEQYGSVCAANNGLADAPGGEMRE

SEQ ID NO: 173507 - protein, 36 aa, Artificial Sequence
  Description of Artificial Sequence: Synthetic polypeptide
DEHEIRTTNPVATEAWGISVRTWNDDQQDRRQQQEN

SEQ ID NO: 173508 - protein, 33 aa, Artificial Sequence
  Description of Artificial Sequence: Synthetic polypeptide
QAEEIATTNPVATEQYGCAPPEHGQDSEGENKH

SEQ ID NO: 173509 - protein, 36 aa, Artificial Sequence
  Description of Artificial Sequence: Synthetic polypeptide
MEGEIRTTNPVATEQYGSCTSPHSTTINEHFSSNDE

SEQ ID NO: 173510 - protein, 36 aa, Artificial Sequence
  Description of Artificial Sequence: Synthetic polypeptide
MEGEIRTTNPVATEQYGSCTSPDNMVSHENGNEDQG

SEQ ID NO: 173511 - protein, 32 aa, Artificial Sequence
  Description of Artificial Sequence: Synthetic polypeptide
DENEIATTNPVAYEQWGHTVSKEIEMNGKEEA

SEQ ID NO: 173512 - protein, 35 aa, Artificial Sequence
  Description of Artificial Sequence: Synthetic polypeptide
DEAEIATTNPVAYEQWGSVVCNEAMPREDRSDGSR

SEQ ID NO: 173513 - protein, 34 aa, Artificial Sequence
  Description of Artificial Sequence: Synthetic polypeptide
DEMEIRTTNPVATEQYGCYTTYVDDLEDDPTQME

SEQ ID NO: 173514 - protein, 35 aa, Artificial Sequence
  Description of Artificial Sequence: Synthetic polypeptide
QAEEIATTNPVATEQYGCTAGNGGLQTADGPNDNH

SEQ ID NO: 173515 - protein, 37 aa, Artificial Sequence
  Description of Artificial Sequence: Synthetic polypeptide
DEMEIATTNPVAYEQYGTVCSYTDGNPNEEQHGNTDE

SEQ ID NO: 173516 - protein, 37 aa, Artificial Sequence
  Description of Artificial Sequence: Synthetic polypeptide
MEGEIRTTNPVATEQYGSVTSMTVFGNDDEYEENLNE

SEQ ID NO: 173517 - protein, 37 aa, Artificial Sequence
  Description of Artificial Sequence: Synthetic polypeptide
DEEEIATTNPVATEQYGSTCPAGTGNPQEAEDSNDDN

SEQ ID NO: 173518 - protein, 33 aa, Artificial Sequence
  Description of Artificial Sequence: Synthetic polypeptide
QAEEIATTNPVATEQYGCAPMTHGQDSNGEAMD

SEQ ID NO: 173519 - protein, 34 aa, Artificial Sequence
  Description of Artificial Sequence: Synthetic polypeptide
NEEEIATTNPVATEQWGCVAMTALTNPDDGMGDF

SEQ ID NO: 173520 - protein, 37 aa, Artificial Sequence
  Description of Artificial Sequence: Synthetic polypeptide
QEEEIRTTNPVAYEQYGTICWCTVNSLSDNRTEGNPK

SEQ ID NO: 173521 - protein, 38 aa, Artificial Sequence
  Description of Artificial Sequence: Synthetic polypeptide
DEEEIRTTNPVATEQYGSTRYPSISNLTEVTPLVPENL

SEQ ID NO: 173522 - protein, 34 aa, Artificial Sequence
  Description of Artificial Sequence: Synthetic polypeptide
DEAEIATTNPVAYEQWGSVVCNEAMPREDAEDTR

SEQ ID NO: 173523 - protein, 36 aa, Artificial Sequence
  Description of Artificial Sequence: Synthetic polypeptide
DEEEIGTTNPVATEQYGCVCSNWGEHNQNFNSETQQ

SEQ ID NO: 173524 - protein, 36 aa, Artificial Sequence
  Description of Artificial Sequence: Synthetic polypeptide
QAEEIATTNPVATEQYGSVCAANNGLPADAPGGQMR

SEQ ID NO: 173525 - protein, 37 aa, Artificial Sequence
  Description of Artificial Sequence: Synthetic polypeptide
DEMEIATTNPVAYEQYGTVCSYTDGPNEEQHGQNTDH

SEQ ID NO: 173526 - protein, 33 aa, Artificial Sequence
  Description of Artificial Sequence: Synthetic polypeptide
DEMEIACTNPVATEQWGTVCAANDGPVEDEGND

SEQ ID NO: 173527 - protein, 32 aa, Artificial Sequence
  Description of Artificial Sequence: Synthetic polypeptide
DENEIATTNPVAYEQWGHTVSKEIEMNGKKDM

SEQ ID NO: 173528 - protein, 34 aa, Artificial Sequence
  Description of Artificial Sequence: Synthetic polypeptide
DEEEIATTNPVAYEQWGSVCAAANGDQSEHVDDD

SEQ ID NO: 173529 - protein, 36 aa, Artificial Sequence
  Description of Artificial Sequence: Synthetic polypeptide
DEEEIRTTNPVATEQYGSTQVAIEEHIEVNEEANDM

SEQ ID NO: 173530 - protein, 36 aa, Artificial Sequence
  Description of Artificial Sequence: Synthetic polypeptide
DEHEIATTNPVATESYGSVCYNNEHQQQDQQGMNGM

SEQ ID NO: 173531 - protein, 36 aa, Artificial Sequence
  Description of Artificial Sequence: Synthetic polypeptide
DEHEIRTTNPVATEAWGISVRTWNDDQQDQRQKTEN

SEQ ID NO: 173532 - protein, 39 aa, Artificial Sequence
  Description of Artificial Sequence: Synthetic polypeptide
DEEEIRTTNPVATEQYGVVSTTNQQQQNATTEQGSVSDE

SEQ ID NO: 173533 - protein, 39 aa, Artificial Sequence
  Description of Artificial Sequence: Synthetic polypeptide
DEEEIRTTNPVATEQYGVVSTVVVTNNQQQGTEDEEEED

SEQ ID NO: 173534 - protein, 35 aa, Artificial Sequence
  Description of Artificial Sequence: Synthetic polypeptide
DEEEIATTNPVTTEHWGSVYCMDNMQDQQRQGDDL

SEQ ID NO: 173535 - protein, 30 aa, Artificial Sequence
  Description of Artificial Sequence: Synthetic polypeptide
QEEEIATTNPVATECWGEAPEVCPQDHEEK

SEQ ID NO: 173536 - protein, 36 aa, Artificial Sequence
  Description of Artificial Sequence: Synthetic polypeptide
DEHEIATTNPVAYECWGSVCYTDNQDQDLRGQNGEQ

SEQ ID NO: 173537 - protein, 37 aa, Artificial Sequence
  Description of Artificial Sequence: Synthetic polypeptide
DEEEIRTTNPVATEQYGSTIGPTNILDGMPVLEIEDQ

SEQ ID NO: 173538 - protein, 39 aa, Artificial Sequence
  Description of Artificial Sequence: Synthetic polypeptide
DEEEIRTTNPVATEQYGVVSVVVSTQQAGTEAGTNQQSE

SEQ ID NO: 173539 - protein, 31 aa, Artificial Sequence
  Description of Artificial Sequence: Synthetic polypeptide
QEEEIATTNPVATECYGATAAEEDCQEPEPI

SEQ ID NO: 173540 - protein, 35 aa, Artificial Sequence
  Description of Artificial Sequence: Synthetic polypeptide
QAEEIATTNPVATEQYGSVCAAMHGQDSGDGNGNE

SEQ ID NO: 173541 - protein, 38 aa, Artificial Sequence
  Description of Artificial Sequence: Synthetic polypeptide
MEGEIRTTNPVATEQYGSFSSTNPAQGPNERFEMNDVA

SEQ ID NO: 173542 - protein, 35 aa, Artificial Sequence
  Description of Artificial Sequence: Synthetic polypeptide
MEGEIRTTNPVATEQYGSCWWPTVLMPETMGGDTD

SEQ ID NO: 173543 - protein, 37 aa, Artificial Sequence
  Description of Artificial Sequence: Synthetic polypeptide
MEGEIRTTNPVATEQYGSVSYTTPAGPNERFEMNNVA

SEQ ID NO: 173544 - protein, 35 aa, Artificial Sequence
  Description of Artificial Sequence: Synthetic polypeptide
QAEEIATTNPVATEQYGSVCAANMGEEQPDDGGQF

SEQ ID NO: 173545 - protein, 35 aa, Artificial Sequence
  Description of Artificial Sequence: Synthetic polypeptide
DEAEIRTTNGVAYCQYGCVCSTENHQEYFGSDTQS

SEQ ID NO: 173546 - protein, 33 aa, Artificial Sequence
  Description of Artificial Sequence: Synthetic polypeptide
NEEEIATTNPVATEQWGGCCTAAAGNPDNMDNH

SEQ ID NO: 173547 - protein, 34 aa, Artificial Sequence
  Description of Artificial Sequence: Synthetic polypeptide
DEEEIATTNPVAYEQWGSVCAAANGDQDSEQPDS

SEQ ID NO: 173548 - protein, 39 aa, Artificial Sequence
  Description of Artificial Sequence: Synthetic polypeptide
DEEEIRTTNPVATEQYGVVSVVVSTTQAGTEAGTNQQED

SEQ ID NO: 173549 - protein, 39 aa, Artificial Sequence
  Description of Artificial Sequence: Synthetic polypeptide
DEEEIRTTNPVATEQYGVVSTTNQQQQNATTEQGSTQSQ

SEQ ID NO: 173550 - protein, 34 aa, Artificial Sequence
  Description of Artificial Sequence: Synthetic polypeptide
QEEEIATTNPVAYEQWGSVTGGNMGNDRNGGDQV

SEQ ID NO: 173551 - protein, 38 aa, Artificial Sequence
  Description of Artificial Sequence: Synthetic polypeptide
AEEEIRTTNPVATEQYGSVVVVVTTNNDESGTVNNATE

SEQ ID NO: 173552 - protein, 34 aa, Artificial Sequence
  Description of Artificial Sequence: Synthetic polypeptide
DEAEIRTTNGVAYCQYGCVCSTGEDDQHFGSDQA

SEQ ID NO: 173553 - protein, 35 aa, Artificial Sequence
  Description of Artificial Sequence: Synthetic polypeptide
DAEEIATTNPVAYEQYGSVCSPAPNDNDMSEGADE

SEQ ID NO: 173554 - protein, 31 aa, Artificial Sequence
  Description of Artificial Sequence: Synthetic polypeptide
QEEEIATTNPVATECYGEAPCIVCPQHEEEK

SEQ ID NO: 173555 - protein, 37 aa, Artificial Sequence
  Description of Artificial Sequence: Synthetic polypeptide
DEMEIRTTNPVATEQYGCVWGNWYPMMEQRGGDEDTN

SEQ ID NO: 173556 - protein, 34 aa, Artificial Sequence
  Description of Artificial Sequence: Synthetic polypeptide
QAEEIATTNPVATEQYGCAPGMSHGLDSEGENKD

SEQ ID NO: 173557 - protein, 36 aa, Artificial Sequence
  Description of Artificial Sequence: Synthetic polypeptide
DEMEIATTNPVAYEQYGTVCSYTDGLNEEHRGGQDQ

SEQ ID NO: 173558 - protein, 36 aa, Artificial Sequence
  Description of Artificial Sequence: Synthetic polypeptide
MEGEIRTTNPVATEQYGSCTSPASLDIRNEHFSSND

SEQ ID NO: 173559 - protein, 33 aa, Artificial Sequence
  Description of Artificial Sequence: Synthetic polypeptide
QAEEIATTNPVATEQYGCAPAMHGQDSEGENND

SEQ ID NO: 173560 - protein, 35 aa, Artificial Sequence
  Description of Artificial Sequence: Synthetic polypeptide
MEGEIRTTNPVATEQYGSCTPDNTEGHENGNEDQG

SEQ ID NO: 173561 - protein, 34 aa, Artificial Sequence
  Description of Artificial Sequence: Synthetic polypeptide
DEGEIATTNPVAYEQYGSVAATAHHGQAAPPPQN

SEQ ID NO: 173562 - protein, 33 aa, Artificial Sequence
  Description of Artificial Sequence: Synthetic polypeptide
QAEEIATTNPVATEQYGCAPAMHDQDSEGENKM

SEQ ID NO: 173563 - protein, 37 aa, Artificial Sequence
  Description of Artificial Sequence: Synthetic polypeptide
DEEEIATTNPVATEQYGSTVCAMNNNDLPADGSGGDP

SEQ ID NO: 173564 - protein, 37 aa, Artificial Sequence
  Description of Artificial Sequence: Synthetic polypeptide
DEEEIRTTNPVATEQYGSTIFPSFVTLELEDVEVQVL

SEQ ID NO: 173565 - protein, 37 aa, Artificial Sequence
  Description of Artificial Sequence: Synthetic polypeptide
DEEEIRTTNPVATEQYGSVQVAGEHEQIENTEESNIM

SEQ ID NO: 173566 - protein, 36 aa, Artificial Sequence
  Description of Artificial Sequence: Synthetic polypeptide
MEGEIRTTNPVATEQYGSCSTTAIGIENNIGNEDFD

SEQ ID NO: 173567 - protein, 31 aa, Artificial Sequence
  Description of Artificial Sequence: Synthetic polypeptide
NEEEIATTNPVAYEQWGEAYYVEQPEERDGE

SEQ ID NO: 173568 - protein, 36 aa, Artificial Sequence
  Description of Artificial Sequence: Synthetic polypeptide
QAEEIATTNPVATEQYGSVCAATHGPLDSMIGNVEE

SEQ ID NO: 173569 - protein, 31 aa, Artificial Sequence
  Description of Artificial Sequence: Synthetic polypeptide
NEEEIATTNPVAYEQWGEAYYVEQPENEQGE

SEQ ID NO: 173570 - protein, 36 aa, Artificial Sequence
  Description of Artificial Sequence: Synthetic polypeptide
DEMEIATTNPVAYEQYGTVCSYTDGLNEEHREGGDS

SEQ ID NO: 173571 - protein, 36 aa, Artificial Sequence
  Description of Artificial Sequence: Synthetic polypeptide
MEGEIRTTNPVATEQYGSCSSPTPAGPNERFEDNPV

SEQ ID NO: 173572 - protein, 30 aa, Artificial Sequence
  Description of Artificial Sequence: Synthetic polypeptide
QEGEIASTNPCSYEQWGITYCNLQSDGDTR

SEQ ID NO: 173573 - protein, 37 aa, Artificial Sequence
  Description of Artificial Sequence: Synthetic polypeptide
DEGEIATTNPVAYEQYGSVAAITNPAEEAPGNQEGRM

SEQ ID NO: 173574 - protein, 36 aa, Artificial Sequence
  Description of Artificial Sequence: Synthetic polypeptide
DEAEIATTNPVAYEQWGSVSHTMNDRGNDTGNNDPG

SEQ ID NO: 173575 - protein, 35 aa, Artificial Sequence
  Description of Artificial Sequence: Synthetic polypeptide
DEGEIATTNPVAYEQYGSVAAAPNGLATETNGSVG

SEQ ID NO: 173576 - protein, 30 aa, Artificial Sequence
  Description of Artificial Sequence: Synthetic polypeptide
NEEEIATTNPVAYEQWGEAYYVEQQEAEGG

SEQ ID NO: 173577 - protein, 35 aa, Artificial Sequence
  Description of Artificial Sequence: Synthetic polypeptide
DEHEISTTNPVAYEQWGVVCSTDNNDQHQVGDSDK

SEQ ID NO: 173578 - protein, 36 aa, Artificial Sequence
  Description of Artificial Sequence: Synthetic polypeptide
DEEEIRATNPVATEQWGGCNAITNHDEQTGMDNNNE

SEQ ID NO: 173579 - protein, 37 aa, Artificial Sequence
  Description of Artificial Sequence: Synthetic polypeptide
DEEEIRTTNPVATEQYGSTIEPTIGMMDPEEGENMLF

SEQ ID NO: 173580 - protein, 36 aa, Artificial Sequence
  Description of Artificial Sequence: Synthetic polypeptide
MEGEIRTTNPVATEQYGSCTSPASLTINEHFTSNGD

SEQ ID NO: 173581 - protein, 36 aa, Artificial Sequence
  Description of Artificial Sequence: Synthetic polypeptide
DEEEIRTTNPVATEQYGSVEHPVVVKAITPMMEVGQ

SEQ ID NO: 173582 - protein, 34 aa, Artificial Sequence
  Description of Artificial Sequence: Synthetic polypeptide
DEEEIATTNPVAYEQWGSVCAAANGLDSAEVDDD

SEQ ID NO: 173583 - protein, 37 aa, Artificial Sequence
  Description of Artificial Sequence: Synthetic polypeptide
DEEEIGTTNPVATEQYGCVCSNWGEHNQENFGSDNQA

SEQ ID NO: 173584 - protein, 38 aa, Artificial Sequence
  Description of Artificial Sequence: Synthetic polypeptide
DEEEIRTTNPVATEQYGSVCTQLNANEEQSLTTVQMSQ

SEQ ID NO: 173585 - protein, 35 aa, Artificial Sequence
  Description of Artificial Sequence: Synthetic polypeptide
DEEEIACTNPVATEQYGSACAGTGPAPGEQMEGRH

SEQ ID NO: 173586 - protein, 31 aa, Artificial Sequence
  Description of Artificial Sequence: Synthetic polypeptide
QEEEIATTNPVAYEQYGEAEPREVCQHEEYK

SEQ ID NO: 173587 - protein, 39 aa, Artificial Sequence
  Description of Artificial Sequence: Synthetic polypeptide
AEEEIRTTNPVATEQYGSVVVVVTTNNAQQGATDENTEG

SEQ ID NO: 173588 - protein, 35 aa, Artificial Sequence
  Description of Artificial Sequence: Synthetic polypeptide
DEHEIRTTNPVAYECWGCVATGGNMGNDRGEGDGR

SEQ ID NO: 173589 - protein, 37 aa, Artificial Sequence
  Description of Artificial Sequence: Synthetic polypeptide
DDEEIRTTNPVATDQYGSVCGNTDNGDEEDNEGGNNT

SEQ ID NO: 173590 - protein, 36 aa, Artificial Sequence
  Description of Artificial Sequence: Synthetic polypeptide
DEMEIATTNPVAYEQYGTVCSYTDGPNENHMGDTDR

SEQ ID NO: 173591 - protein, 38 aa, Artificial Sequence
  Description of Artificial Sequence: Synthetic polypeptide
DEEEIATTNPVATEQYGSVCANMNPAEEAGASGMENRD

SEQ ID NO: 173592 - protein, 36 aa, Artificial Sequence
  Description of Artificial Sequence: Synthetic polypeptide
MEGEIRTTNPVATEQYGSCTSPASVTINEHISSNND

SEQ ID NO: 173593 - protein, 36 aa, Artificial Sequence
  Description of Artificial Sequence: Synthetic polypeptide
MEGEIRTTNPVATEQYGSCTSPASVTINEHFSSNDT

SEQ ID NO: 173594 - protein, 35 aa, Artificial Sequence
  Description of Artificial Sequence: Synthetic polypeptide
MEGEIRTTNPVATEQYGSCTSPASVTINEHFESFD

SEQ ID NO: 173595 - protein, 36 aa, Artificial Sequence
  Description of Artificial Sequence: Synthetic polypeptide
MEGEIRTTNPVATEQYGSCTSPASVTIMNEHSSSND

SEQ ID NO: 173596 - protein, 37 aa, Artificial Sequence
  Description of Artificial Sequence: Synthetic polypeptide
DEEEIATTNPVATEQYGSVCSPVDNNHNIDAMGMGDW

SEQ ID NO: 173597 - protein, 31 aa, Artificial Sequence
  Description of Artificial Sequence: Synthetic polypeptide
QAEEIATTNPVATEQYGCAPAMHGTDSEGEH

SEQ ID NO: 173598 - protein, 32 aa, Artificial Sequence
  Description of Artificial Sequence: Synthetic polypeptide
QAEEIATTNPVATEQYGCAPAMHGQDSNGEKM

SEQ ID NO: 173599 - protein, 35 aa, Artificial Sequence
  Description of Artificial Sequence: Synthetic polypeptide
MEGEIRTTNPVATEQYGSVVEDYALEHQNIVQEET

SEQ ID NO: 173600 - protein, 34 aa, Artificial Sequence
  Description of Artificial Sequence: Synthetic polypeptide
DEGEIATTNPVAYEQYGSVAGNNGVTTAENPNEK

SEQ ID NO: 173601 - protein, 35 aa, Artificial Sequence
  Description of Artificial Sequence: Synthetic polypeptide
QEEEISTTNPVAYEPYRGQSVSINEGSTSMPGGPR

SEQ ID NO: 173602 - protein, 37 aa, Artificial Sequence
  Description of Artificial Sequence: Synthetic polypeptide
DEHEIRTTNPVATEAWGISVRTWNDDQQDWRQSEENW

SEQ ID NO: 173603 - protein, 39 aa, Artificial Sequence
  Description of Artificial Sequence: Synthetic polypeptide
DEEEIRTTNPVATEQYGVVSVVVTNGTQAGTTESGSTVQ

SEQ ID NO: 173604 - protein, 37 aa, Artificial Sequence
  Description of Artificial Sequence: Synthetic polypeptide
DEEEIGTTNPVATEQYGCVCSNWGEHNQENFGSENQQ

SEQ ID NO: 173605 - protein, 33 aa, Artificial Sequence
  Description of Artificial Sequence: Synthetic polypeptide
QEEEIATTNPVATECYGEVPCIVEPQDHEGEEK

SEQ ID NO: 173606 - protein, 35 aa, Artificial Sequence
  Description of Artificial Sequence: Synthetic polypeptide
MEGEIRTTNPVATEQYGSVVEDYGLEFANNSQEEC

SEQ ID NO: 173607 - protein, 36 aa, Artificial Sequence
  Description of Artificial Sequence: Synthetic polypeptide
QEEEIRTTNPVATEQYGSIIGPTVPEAIERGTQTVG

SEQ ID NO: 173608 - protein, 36 aa, Artificial Sequence
  Description of Artificial Sequence: Synthetic polypeptide
DEEEIGTTNPVATEQYGQCVCSNWEHDQNFGSETQS

SEQ ID NO: 173609 - protein, 39 aa, Artificial Sequence
  Description of Artificial Sequence: Synthetic polypeptide
DEEEIRTTNPVATEQYGVVSTTNQQQQNATNEQGSTDGD

SEQ ID NO: 173610 - protein, 37 aa, Artificial Sequence
  Description of Artificial Sequence: Synthetic polypeptide
DEEEIATTNPVAYEQYGSVSSTTPAGTNPRNGMEPVM

SEQ ID NO: 173611 - protein, 37 aa, Artificial Sequence
  Description of Artificial Sequence: Synthetic polypeptide
DEEEIATTNPVAYEQYGSVCGPLNALPNEAEDGNENF

SEQ ID NO: 173612 - protein, 38 aa, Artificial Sequence
  Description of Artificial Sequence: Synthetic polypeptide
DEEEIRTTNPVATEQYGSNVWVTTENMEDEQWNDSIQE

SEQ ID NO: 173613 - protein, 36 aa, Artificial Sequence
  Description of Artificial Sequence: Synthetic polypeptide
DEECTCTTNPVAVEQYGVVSTVNNNNQDEQGNNTND

SEQ ID NO: 173614 - protein, 38 aa, Artificial Sequence
  Description of Artificial Sequence: Synthetic polypeptide
AEEEIRTTNPVATEQYGVVSTVTQNGDEQGTTNVTTED

SEQ ID NO: 173615 - protein, 35 aa, Artificial Sequence
  Description of Artificial Sequence: Synthetic polypeptide
DEAEIATTNPVAYERWGSVSGGNADDSRNNGNGDM

SEQ ID NO: 173616 - protein, 35 aa, Artificial Sequence
  Description of Artificial Sequence: Synthetic polypeptide
DEEEIACTNPVATEQYGSCAAPGNPQIDPMMEGAN

SEQ ID NO: 173617 - protein, 38 aa, Artificial Sequence
  Description of Artificial Sequence: Synthetic polypeptide
AEEEIRTTNPVATEQYGVVSTVTQNGNEQGATNVATED

SEQ ID NO: 173618 - protein, 33 aa, Artificial Sequence
  Description of Artificial Sequence: Synthetic polypeptide
DEAEIATTNPVAYERWGSVCVNDDDGDRQGDMD

SEQ ID NO: 173619 - protein, 36 aa, Artificial Sequence
  Description of Artificial Sequence: Synthetic polypeptide
DAEEIATTNPVAYEQYGSVCAPAGTPGQTAGGPNSN

SEQ ID NO: 173620 - protein, 36 aa, Artificial Sequence
  Description of Artificial Sequence: Synthetic polypeptide
DEEEIATTNPVATEQYGISTWCTTNEHDTSSTDNSM

SEQ ID NO: 173621 - protein, 36 aa, Artificial Sequence
  Description of Artificial Sequence: Synthetic polypeptide
DEEEIACTNPVATEQYGSCAAMGNGTTNPADGENNN

SEQ ID NO: 173622 - protein, 37 aa, Artificial Sequence
  Description of Artificial Sequence: Synthetic polypeptide
QEEEIRGTNPVATEQYGSVVIMSGMGETDEGQEGEVT

SEQ ID NO: 173623 - protein, 35 aa, Artificial Sequence
  Description of Artificial Sequence: Synthetic polypeptide
DEMEICTTNPVATEQYGTVWTARDGSPVEFEGNEL

SEQ ID NO: 173624 - protein, 37 aa, Artificial Sequence
  Description of Artificial Sequence: Synthetic polypeptide
QEEEIRGTNPVATEQYGSVVIPGNLTEGGGQTEGEFI

SEQ ID NO: 173625 - protein, 34 aa, Artificial Sequence
  Description of Artificial Sequence: Synthetic polypeptide
DEHEIRTTNPVAYECWGTVYWINENQDRPMMNDV

SEQ ID NO: 173626 - protein, 34 aa, Artificial Sequence
  Description of Artificial Sequence: Synthetic polypeptide
DEHEIRTTNPVAYECWGTVYWINENQDRQAMNDG

SEQ ID NO: 173627 - protein, 36 aa, Artificial Sequence
  Description of Artificial Sequence: Synthetic polypeptide
DEEEIATTNPSATEQYGSVPEPCVTQQDHWQGQNVD

SEQ ID NO: 173628 - protein, 35 aa, Artificial Sequence
  Description of Artificial Sequence: Synthetic polypeptide
DENEIATTNPVATEQYGSVAANHSGDPAMHPGESG

SEQ ID NO: 173629 - protein, 38 aa, Artificial Sequence
  Description of Artificial Sequence: Synthetic polypeptide
QEEEIRGTNPVATEQYGSVVITGNLNLEGGGQDEGEDG

SEQ ID NO: 173630 - protein, 34 aa, Artificial Sequence
  Description of Artificial Sequence: Synthetic polypeptide
DEHEIRTTNPVAYECWGTVYWINENQDRQMMNAN

SEQ ID NO: 173631 - protein, 34 aa, Artificial Sequence
  Description of Artificial Sequence: Synthetic polypeptide
DEMEICTTNPVAYEQWGTVCSATDGPSEFTGGND

SEQ ID NO: 173632 - protein, 33 aa, Artificial Sequence
  Description of Artificial Sequence: Synthetic polypeptide
QENEIATTNPVATECYGDVCSAEDGPVQFEGED

SEQ ID NO: 173633 - protein, 34 aa, Artificial Sequence
  Description of Artificial Sequence: Synthetic polypeptide
DEHEIRTTNPVAYECWGTVYWINENDDLQMMNDG

SEQ ID NO: 173634 - protein, 37 aa, Artificial Sequence
  Description of Artificial Sequence: Synthetic polypeptide
DEEEIRTTNPVATEQYGSNWNNNINESVDSSNNDSNE

SEQ ID NO: 173635 - protein, 37 aa, Artificial Sequence
  Description of Artificial Sequence: Synthetic polypeptide
MEEEIRTTNPVATEQYGDVAFTGNGNQDQDEGGDQEQ

SEQ ID NO: 173636 - protein, 36 aa, Artificial Sequence
  Description of Artificial Sequence: Synthetic polypeptide
MENEIRTTNPVATEQYGSVSDALPDEMKPSGQDVEQ

SEQ ID NO: 173637 - protein, 36 aa, Artificial Sequence
  Description of Artificial Sequence: Synthetic polypeptide
DEECTCTTNPVAVEQYGVVSTVNNNQQGSNGTNNND

SEQ ID NO: 173638 - protein, 36 aa, Artificial Sequence
  Description of Artificial Sequence: Synthetic polypeptide
DEEEIATTNPVAYEQWGEVCSTPPQGNHGEAGDGRA

SEQ ID NO: 173639 - protein, 36 aa, Artificial Sequence
  Description of Artificial Sequence: Synthetic polypeptide
MENEIRTTNPVATEQYGSVISVVGFGDGNQEFQDDD

SEQ ID NO: 173640 - protein, 36 aa, Artificial Sequence
  Description of Artificial Sequence: Synthetic polypeptide
QEEEIRGTNPVATEQYGSVNTDNMIETGGGGQEQGQ

SEQ ID NO: 173641 - protein, 32 aa, Artificial Sequence
  Description of Artificial Sequence: Synthetic polypeptide
DENEIETTNPVSTEPYGTISMEDIQQQQNGFH

SEQ ID NO: 173642 - protein, 36 aa, Artificial Sequence
  Description of Artificial Sequence: Synthetic polypeptide
DEEEIATTNPVAYEQWGEVCSTPNQGNHGELGDGRN

SEQ ID NO: 173643 - protein, 36 aa, Artificial Sequence
  Description of Artificial Sequence: Synthetic polypeptide
DEEEIATTNPVAYEQYGSVCQAANVLDQMAPMAADS

SEQ ID NO: 173644 - protein, 36 aa, Artificial Sequence
  Description of Artificial Sequence: Synthetic polypeptide
DEEEIATTNPVAYEQWGEVCSTPNQGNHGEGKGDRN

SEQ ID NO: 173645 - protein, 35 aa, Artificial Sequence
  Description of Artificial Sequence: Synthetic polypeptide
DEEEIATTNPVAYAQWGTSVSATADLGQQHDIAPN

SEQ ID NO: 173646 - protein, 37 aa, Artificial Sequence
  Description of Artificial Sequence: Synthetic polypeptide
DEMEIRTTNPVATEQYGSVCSSIYMEEESNDLALFRQ

SEQ ID NO: 173647 - protein, 36 aa, Artificial Sequence
  Description of Artificial Sequence: Synthetic polypeptide
MEEEIRTTNPVATEQYGDVVQNTDNMNGTGGEEEFD

SEQ ID NO: 173648 - protein, 38 aa, Artificial Sequence
  Description of Artificial Sequence: Synthetic polypeptide
DDEEIRTTNPVATEFYGSVVSTDGFGDEQGEDGDGNTP

SEQ ID NO: 173649 - protein, 37 aa, Artificial Sequence
  Description of Artificial Sequence: Synthetic polypeptide
MEEEIRTTNPVATEQYGDVVFNGSGNMDEDEGQNQEQ

SEQ ID NO: 173650 - protein, 36 aa, Artificial Sequence
  Description of Artificial Sequence: Synthetic polypeptide
MEEEIRTTNPVATEQYGDVVDPNFTIDQFEGQGAFG

SEQ ID NO: 173651 - protein, 35 aa, Artificial Sequence
  Description of Artificial Sequence: Synthetic polypeptide
DEAEIATTNPVAYERWGSVSGGNADDSRNTGNGNE

SEQ ID NO: 173652 - protein, 36 aa, Artificial Sequence
  Description of Artificial Sequence: Synthetic polypeptide
MEEEIRTTNPVATEQYGDVVDNFNMDENGEGQGNEG

SEQ ID NO: 173653 - protein, 38 aa, Artificial Sequence
  Description of Artificial Sequence: Synthetic polypeptide
DEAEIRATNPVATEQYGSVCYSMWNNLQDEGQSDTQQK

SEQ ID NO: 173654 - protein, 32 aa, Artificial Sequence
  Description of Artificial Sequence: Synthetic polypeptide
DENEIETTNPVSTEPYGTIYMEDIQQQQNGNH

SEQ ID NO: 173655 - protein, 36 aa, Artificial Sequence
  Description of Artificial Sequence: Synthetic polypeptide
MENEIRTTNPVATEQYGSVPYQTDEEDQTPSIEEVR

SEQ ID NO: 173656 - protein, 37 aa, Artificial Sequence
  Description of Artificial Sequence: Synthetic polypeptide
DEGEIRTTNPVATEQYGSVTWSPWVWLENPNTDEGGN

SEQ ID NO: 173657 - protein, 36 aa, Artificial Sequence
  Description of Artificial Sequence: Synthetic polypeptide
DEGEIRTTNPVATEQYGSVTYVLDDLVQAEVQDSSQ

SEQ ID NO: 173658 - protein, 36 aa, Artificial Sequence
  Description of Artificial Sequence: Synthetic polypeptide
DEECTCTTNPVAVEQYGVVSTVNNNQGSEQGNNSND

SEQ ID NO: 173659 - protein, 36 aa, Artificial Sequence
  Description of Artificial Sequence: Synthetic polypeptide
DEECTCTTNPVAVEQYGVVSTVNNNNQQGNGNNNND

SEQ ID NO: 173660 - protein, 40 aa, Artificial Sequence
  Description of Artificial Sequence: Synthetic polypeptide
DEEEIRTTNPVATEQYGVVSTVTNGNQQSATNEEGVTNQQ

SEQ ID NO: 173661 - protein, 34 aa, Artificial Sequence
  Description of Artificial Sequence: Synthetic polypeptide
DEHEIATTNPCATEHWGSVCYNNDDQDHGDRDHT

SEQ ID NO: 173662 - protein, 34 aa, Artificial Sequence
  Description of Artificial Sequence: Synthetic polypeptide
DEHEIRTTNPVAYECWGTVYWINENQDRQMQNNH

SEQ ID NO: 173663 - protein, 34 aa, Artificial Sequence
  Description of Artificial Sequence: Synthetic polypeptide
DEHEIRTTNPVAYECWGTVYWINENQDRQPMHND

SEQ ID NO: 173664 - protein, 36 aa, Artificial Sequence
  Description of Artificial Sequence: Synthetic polypeptide
DEEEIACTNPVATEQYGSVCATDIHPDNNESLEGAM

SEQ ID NO: 173665 - protein, 36 aa, Artificial Sequence
  Description of Artificial Sequence: Synthetic polypeptide
DEGEIRATNPVATEPWGVVCFTNEDQHHRGMNKSSG

SEQ ID NO: 173666 - protein, 35 aa, Artificial Sequence
  Description of Artificial Sequence: Synthetic polypeptide
DEAEIRTTNPCAYECWGSVATPNGNQQLEGDHQRQ

SEQ ID NO: 173667 - protein, 35 aa, Artificial Sequence
  Description of Artificial Sequence: Synthetic polypeptide
DEEEIACTNPVATEQYGSVCAPGPLENNDDLGAQM

SEQ ID NO: 173668 - protein, 36 aa, Artificial Sequence
  Description of Artificial Sequence: Synthetic polypeptide
QEEEIRGTNPVATESYGSVSNQNNMTIFGNDNGEDG

SEQ ID NO: 173669 - protein, 34 aa, Artificial Sequence
  Description of Artificial Sequence: Synthetic polypeptide
DEITEIATTNPVAYEAWGVCSTTNLQLGEDQGQQ

SEQ ID NO: 173670 - protein, 38 aa, Artificial Sequence
  Description of Artificial Sequence: Synthetic polypeptide
AEEEIRTTNPVATEQYGVVSTVTQNNDEQGTNNVTEES

SEQ ID NO: 173671 - protein, 35 aa, Artificial Sequence
  Description of Artificial Sequence: Synthetic polypeptide
DEGEIATTNPVATEQYGSVCAAMHGQDSPDGEDAH

SEQ ID NO: 173672 - protein, 38 aa, Artificial Sequence
  Description of Artificial Sequence: Synthetic polypeptide
QEEEIRTTNPVATEQYGSVMGLPTGEGAGNLTNEGGQQ

SEQ ID NO: 173673 - protein, 35 aa, Artificial Sequence
  Description of Artificial Sequence: Synthetic polypeptide
DENCIATVNPVATECYGSVVCIDHDDQERQGQNER

SEQ ID NO: 173674 - protein, 33 aa, Artificial Sequence
  Description of Artificial Sequence: Synthetic polypeptide
DEHCISTTNPVAYEQWGCFSWDNLRDGDKGNQK

SEQ ID NO: 173675 - protein, 36 aa, Artificial Sequence
  Description of Artificial Sequence: Synthetic polypeptide
QEEEIRGTNPVATESYGSVSNQNNMTIFGNTENNDD

SEQ ID NO: 173676 - protein, 32 aa, Artificial Sequence
  Description of Artificial Sequence: Synthetic polypeptide
DENEIGTTNPVSTEPYGTISMEDIQQQQNGMH

SEQ ID NO: 173677 - protein, 35 aa, Artificial Sequence
  Description of Artificial Sequence: Synthetic polypeptide
MENEIRTTNPVATEQYGSVSWCGVAEIPFHQEVFQ

SEQ ID NO: 173678 - protein, 32 aa, Artificial Sequence
  Description of Artificial Sequence: Synthetic polypeptide
DENEIGTTNPVSTEPYGTISMEDIQQQQNGTH

SEQ ID NO: 173679 - protein, 31 aa, Artificial Sequence
  Description of Artificial Sequence: Synthetic polypeptide
QESEIASTNPVATEGYGVMCAASDTLEFGDD

SEQ ID NO: 173680 - protein, 35 aa, Artificial Sequence
  Description of Artificial Sequence: Synthetic polypeptide
DEEEIACTNPVATEQYGSCAQGPQLNPDAQTGGDI

SEQ ID NO: 173681 - protein, 36 aa, Artificial Sequence
  Description of Artificial Sequence: Synthetic polypeptide
MEEEIRTTNPVATEQYGAVMGFGNNDQTGDEQGEGG

SEQ ID NO: 173682 - protein, 37 aa, Artificial Sequence
  Description of Artificial Sequence: Synthetic polypeptide
MEEEIRTTNPVATEQYGAVIVDDLDDEGQTDDEGNNL

SEQ ID NO: 173683 - protein, 37 aa, Artificial Sequence
  Description of Artificial Sequence: Synthetic polypeptide
DEEEIACTNPVATEQYGSVCAMTNPEPTGGDLENDGM

SEQ ID NO: 173684 - protein, 31 aa, Artificial Sequence
  Description of Artificial Sequence: Synthetic polypeptide
QESEIASTNPVGTEGYGVMACSDTLQHHGDI

SEQ ID NO: 173685 - protein, 36 aa, Artificial Sequence
  Description of Artificial Sequence: Synthetic polypeptide
QEEEIRGTNPVATESYGSVSNQNNMTIFGNTNEEQG

SEQ ID NO: 173686 - protein, 36 aa, Artificial Sequence
  Description of Artificial Sequence: Synthetic polypeptide
DDCEIRTTNPVATEQYGSVSPDPENGMDTTNKPQEE

SEQ ID NO: 173687 - protein, 36 aa, Artificial Sequence
  Description of Artificial Sequence: Synthetic polypeptide
DEEEIACTNPVATEQYGSCAAVGNGLTQPDDEMGEH

SEQ ID NO: 173688 - protein, 36 aa, Artificial Sequence
  Description of Artificial Sequence: Synthetic polypeptide
DEHEIRTTNPVATEQYGCVELTPLNWAEEIGDEPQN

SEQ ID NO: 173689 - protein, 35 aa, Artificial Sequence
  Description of Artificial Sequence: Synthetic polypeptide
DAEEIATTNPVATEQYGNTIATNPLENGMPMGEQH

SEQ ID NO: 173690 - protein, 37 aa, Artificial Sequence
  Description of Artificial Sequence: Synthetic polypeptide
QEEEIRGTNPVATEQYGSVVNQNMTNAGQEGGQTGGQ

SEQ ID NO: 173691 - protein, 33 aa, Artificial Sequence
  Description of Artificial Sequence: Synthetic polypeptide
QENEIATTNPVATECYGDVCSAEDCPVQFEGEL

SEQ ID NO: 173692 - protein, 33 aa, Artificial Sequence
  Description of Artificial Sequence: Synthetic polypeptide
QENEIATTNPVATECYGDVCSAEDCPVQFEGED

SEQ ID NO: 173693 - protein, 34 aa, Artificial Sequence
  Description of Artificial Sequence: Synthetic polypeptide
DEHEIRTTNPVAYECWGTVYWSNEQQDRQMMNNG

SEQ ID NO: 173694 - protein, 39 aa, Artificial Sequence
  Description of Artificial Sequence: Synthetic polypeptide
DEEEIRTTNPVATEQYGVVSTVVVTQAGNNDGTEENNEE

SEQ ID NO: 173695 - protein, 34 aa, Artificial Sequence
  Description of Artificial Sequence: Synthetic polypeptide
DEHEIRTTNPVAYECWGTVYYINENQDRQIMNNG

SEQ ID NO: 173696 - protein, 32 aa, Artificial Sequence
  Description of Artificial Sequence: Synthetic polypeptide
QENEIATTNPVATECYGDVCSAECPVQFEEEL

SEQ ID NO: 173697 - protein, 34 aa, Artificial Sequence
  Description of Artificial Sequence: Synthetic polypeptide
DEECNATTNPIAYEQWGEVCYTLNDQDHDGDNKR

SEQ ID NO: 173698 - protein, 39 aa, Artificial Sequence
  Description of Artificial Sequence: Synthetic polypeptide
DEEEIRTTNPVATEQYGVVSTVVVTQAGNNDTEEEETED

SEQ ID NO: 173699 - protein, 38 aa, Artificial Sequence
  Description of Artificial Sequence: Synthetic polypeptide
QEEEIRGTNPVATEQYGSVVTPGNLNEEGGGQTEGEDG

SEQ ID NO: 173700 - protein, 36 aa, Artificial Sequence
  Description of Artificial Sequence: Synthetic polypeptide
QEEEIRGTNPVATEQYGSVVVDTDNTGENIEENEGQ

SEQ ID NO: 173701 - protein, 38 aa, Artificial Sequence
  Description of Artificial Sequence: Synthetic polypeptide
DEEEIRTTNPVATEQYGSVLGFEDVFENGVRGFVEVQD

SEQ ID NO: 173702 - protein, 38 aa, Artificial Sequence
  Description of Artificial Sequence: Synthetic polypeptide
DEEEIRTTNPVATEQYGSICILPLWSPQPENTINRVND

SEQ ID NO: 173703 - protein, 35 aa, Artificial Sequence
  Description of Artificial Sequence: Synthetic polypeptide
DEISEIATTNPVAYEGWGSVATGNMLGDAQGMNHS

SEQ ID NO: 173704 - protein, 37 aa, Artificial Sequence
  Description of Artificial Sequence: Synthetic polypeptide
QEEEIRTTNPVATEQYGSVMGGDETGGQNQGGEAEGV

SEQ ID NO: 173705 - protein, 36 aa, Artificial Sequence
  Description of Artificial Sequence: Synthetic polypeptide
DEEEIACTNPVATEQYGSCAAQGNPLNTAAPGEGNH

SEQ ID NO: 173706 - protein, 36 aa, Artificial Sequence
  Description of Artificial Sequence: Synthetic polypeptide
DEMEIATTNPVAYEGWGSVCSGTDLQDRADGGQEEN

SEQ ID NO: 173707 - protein, 35 aa, Artificial Sequence
  Description of Artificial Sequence: Synthetic polypeptide
DENEIGTTNPVATEQWGKVPSEQIAHSTNAAEGDA

SEQ ID NO: 173708 - protein, 35 aa, Artificial Sequence
  Description of Artificial Sequence: Synthetic polypeptide
DEHEIRTTNPVAYECWGVVCYTDNQDQNLGQNGEN

SEQ ID NO: 173709 - protein, 36 aa, Artificial Sequence
  Description of Artificial Sequence: Synthetic polypeptide
DDEEIRSTNPVATEQYGQCSCSWEHNQENFGSDNQA

SEQ ID NO: 173710 - protein, 31 aa, Artificial Sequence
  Description of Artificial Sequence: Synthetic polypeptide
QDNEIASTNPVSTECYGNVSAECLQSRVEEL

SEQ ID NO: 173711 - protein, 36 aa, Artificial Sequence
  Description of Artificial Sequence: Synthetic polypeptide
DDEEIRTTNPVATEFYGSVVIVNMDGQGEFDDNEND

SEQ ID NO: 173712 - protein, 34 aa, Artificial Sequence
  Description of Artificial Sequence: Synthetic polypeptide
DENCIATVNPVATECYGCVVCIDNDHERPGDNSR

SEQ ID NO: 173713 - protein, 35 aa, Artificial Sequence
  Description of Artificial Sequence: Synthetic polypeptide
DEGEIATTNPVATEQYGSVCAAMIHGDDSDGNDAH

SEQ ID NO: 173714 - protein, 30 aa, Artificial Sequence
  Description of Artificial Sequence: Synthetic polypeptide
QESEIASTNPVGTEGYGVMAATLQPKGDYI

SEQ ID NO: 173715 - protein, 35 aa, Artificial Sequence
  Description of Artificial Sequence: Synthetic polypeptide
DATEIATTNPVAYEQWGSAVCTENNDQDDLHGDAR

SEQ ID NO: 173716 - protein, 32 aa, Artificial Sequence
  Description of Artificial Sequence: Synthetic polypeptide
QENEIATTNPVATHCYGDVASECHLQHTEELI

SEQ ID NO: 173717 - protein, 34 aa, Artificial Sequence
  Description of Artificial Sequence: Synthetic polypeptide
DEEEICTTNPTAYESYGQVVCCIGNANSTSGNTR

SEQ ID NO: 173718 - protein, 32 aa, Artificial Sequence
  Description of Artificial Sequence: Synthetic polypeptide
NETEIRTTNPVAYECWGCVYYGNDNMQDGDSS

SEQ ID NO: 173719 - protein, 38 aa, Artificial Sequence
  Description of Artificial Sequence: Synthetic polypeptide
NEEEIRTTNPVATEQYGSVINCWVNEGFQPRQNELEAL

SEQ ID NO: 173720 - protein, 37 aa, Artificial Sequence
  Description of Artificial Sequence: Synthetic polypeptide
DEEEIACTNPVATEQYGSVSSTGEAGINPDDGMEKVM

SEQ ID NO: 173721 - protein, 35 aa, Artificial Sequence
  Description of Artificial Sequence: Synthetic polypeptide
DEEEIQTTNPTAYEAYGQVVVCCTGNANSTSGNTR

SEQ ID NO: 173722 - protein, 35 aa, Artificial Sequence
  Description of Artificial Sequence: Synthetic polypeptide
DEHEIRTTNPVAYECWGTVYQINENQDRQMGNNGE

SEQ ID NO: 173723 - protein, 34 aa, Artificial Sequence
  Description of Artificial Sequence: Synthetic polypeptide
DEHEIRTTNPVAYECWGTVYQINENQDRQMMNNS

SEQ ID NO: 173724 - protein, 37 aa, Artificial Sequence
  Description of Artificial Sequence: Synthetic polypeptide
MEEEIRTTNPVATEQYGSIIHGTTLEDHNDLEVGDEQ

SEQ ID NO: 173725 - protein, 39 aa, Artificial Sequence
  Description of Artificial Sequence: Synthetic polypeptide
DEEEIRTTNPVATEQYGTVTNLQSGTIGTTTQNQEQGNE

SEQ ID NO: 173726 - protein, 34 aa, Artificial Sequence
  Description of Artificial Sequence: Synthetic polypeptide
DEHEIATTNPEATDQYGQVCCCDQDQKREGGDTR

SEQ ID NO: 173727 - protein, 36 aa, Artificial Sequence
  Description of Artificial Sequence: Synthetic polypeptide
DEEEIATTNPVATEQYGSACSPADTSGPDDSDGEAP

SEQ ID NO: 173728 - protein, 39 aa, Artificial Sequence
  Description of Artificial Sequence: Synthetic polypeptide
DEEEIRTTNPVATEQYGVVSTVVTTTNNNNQQQATNNAE

SEQ ID NO: 173729 - protein, 32 aa, Artificial Sequence
  Description of Artificial Sequence: Synthetic polypeptide
DENEICTTNPVAYEQWGTVSKEIEMNPREDAT

SEQ ID NO: 173730 - protein, 33 aa, Artificial Sequence
  Description of Artificial Sequence: Synthetic polypeptide
DENEICTTNPVAYEQWGTVSKEIEMNPREGDSA

SEQ ID NO: 173731 - protein, 37 aa, Artificial Sequence
  Description of Artificial Sequence: Synthetic polypeptide
DEEEIACTNPVATEQYGSVSGTGEAGINPRDGMEKVP

SEQ ID NO: 173732 - protein, 34 aa, Artificial Sequence
  Description of Artificial Sequence: Synthetic polypeptide
DEMEICTTNPVATEQYGTVCTAWDGSPVEFETNE

SEQ ID NO: 173733 - protein, 34 aa, Artificial Sequence
  Description of Artificial Sequence: Synthetic polypeptide
DEECTRTTNPIAYEQYGCVCSTEHNQENFGSDQS

SEQ ID NO: 173734 - protein, 38 aa, Artificial Sequence
  Description of Artificial Sequence: Synthetic polypeptide
DEEEIATTNPVATEHYGVCIVSCTDEGSQTRTGQNNQF

SEQ ID NO: 173735 - protein, 37 aa, Artificial Sequence
  Description of Artificial Sequence: Synthetic polypeptide
DEEEIACTNPVATEQYGSVSAMTPAGGTNQGNNMEPV

SEQ ID NO: 173736 - protein, 34 aa, Artificial Sequence
  Description of Artificial Sequence: Synthetic polypeptide
DEHEIATTNPVAYEQWGSVTGPNGNQGAGQQGYD

SEQ ID NO: 173737 - protein, 33 aa, Artificial Sequence
  Description of Artificial Sequence: Synthetic polypeptide
DEHEIRTTNPVAYESWGVVSGGNHGNTQGDSQK

SEQ ID NO: 173738 - protein, 36 aa, Artificial Sequence
  Description of Artificial Sequence: Synthetic polypeptide
DEEEIACTNPVATEQYGSVCSVGDDINIDALMEEAM

SEQ ID NO: 173739 - protein, 35 aa, Artificial Sequence
  Description of Artificial Sequence: Synthetic polypeptide
MEEEIRTTNPVATEQYGSIEVAPAGEIQQALLDPG

SEQ ID NO: 173740 - protein, 37 aa, Artificial Sequence
  Description of Artificial Sequence: Synthetic polypeptide
DCEEIRQTNPVATEQYGSSSLTPALNDQQEISPNSNG

SEQ ID NO: 173741 - protein, 35 aa, Artificial Sequence
  Description of Artificial Sequence: Synthetic polypeptide
DEHEIRTTNPVAYEAWGSVAGGPPGNHQNTGDNNH

SEQ ID NO: 173742 - protein, 37 aa, Artificial Sequence
  Description of Artificial Sequence: Synthetic polypeptide
DAEEIATTNPVATEQYGSVCAANAGLPATAPAENARM

SEQ ID NO: 173743 - protein, 34 aa, Artificial Sequence
  Description of Artificial Sequence: Synthetic polypeptide
DEEEIACTNPVATEQYGCVATPAITQLDMEPAEE

SEQ ID NO: 173744 - protein, 36 aa, Artificial Sequence
  Description of Artificial Sequence: Synthetic polypeptide
DEGEICTTNPVAYEQWGSCVYSDEWNDGQRMSQGVE

SEQ ID NO: 173745 - protein, 36 aa, Artificial Sequence
  Description of Artificial Sequence: Synthetic polypeptide
DEECVRTTNPIAYEQWGCTVVSCDNLSQQSGGNYRY

SEQ ID NO: 173746 - protein, 34 aa, Artificial Sequence
  Description of Artificial Sequence: Synthetic polypeptide
DEMEIRTTNPVATDQYGSVPPMCWDENSSEDQES

SEQ ID NO: 173747 - protein, 37 aa, Artificial Sequence
  Description of Artificial Sequence: Synthetic polypeptide
DENEICTTNPVATEQYGSVFTNWTYNPQTQIQDNQIM

SEQ ID NO: 173748 - protein, 37 aa, Artificial Sequence
  Description of Artificial Sequence: Synthetic polypeptide
QEEEIRTTNPVATEQYGSVVEGTMQGGGQNDIDGEGQ

SEQ ID NO: 173749 - protein, 36 aa, Artificial Sequence
  Description of Artificial Sequence: Synthetic polypeptide
DEEEIATTNPVATEQYGSVCAMPVGGEEHQDDNLAK

SEQ ID NO: 173750 - protein, 36 aa, Artificial Sequence
  Description of Artificial Sequence: Synthetic polypeptide
DAEEIATTNPVATEQYGSVCAAGPALGQNHDENGHH

SEQ ID NO: 173751 - protein, 37 aa, Artificial Sequence
  Description of Artificial Sequence: Synthetic polypeptide
DEGEIATTNPVATEQYGSVCAATAHQEADMPPGEANW

SEQ ID NO: 173752 - protein, 36 aa, Artificial Sequence
  Description of Artificial Sequence: Synthetic polypeptide
DEEEIRTTNPVATEQYGSWNWPTQEKDNMGSMEQGE

SEQ ID NO: 173753 - protein, 34 aa, Artificial Sequence
  Description of Artificial Sequence: Synthetic polypeptide
DEEEIATTNPVATEPWGICVCSCAPVSQMMPNNG

SEQ ID NO: 173754 - protein, 34 aa, Artificial Sequence
  Description of Artificial Sequence: Synthetic polypeptide
DEHEIATTNPVAYEQWGSVTGPNGNQAGAGMGGD

SEQ ID NO: 173755 - protein, 34 aa, Artificial Sequence
  Description of Artificial Sequence: Synthetic polypeptide
MENEIRTTNPVATEQYGSCYRPLNDDIIDLNTMQ

SEQ ID NO: 173756 - protein, 34 aa, Artificial Sequence
  Description of Artificial Sequence: Synthetic polypeptide
DEHEIRTTNPVAYECWGTVYQINENQDRQKMNDN

SEQ ID NO: 173757 - protein, 37 aa, Artificial Sequence
  Description of Artificial Sequence: Synthetic polypeptide
DENEICTTNPVATEQYGSVFTWTYNPMQTQAQDNQIM

SEQ ID NO: 173758 - protein, 34 aa, Artificial Sequence
  Description of Artificial Sequence: Synthetic polypeptide
DEMEICTTNPVATEQYGTVCTAREGSPVEFEGDE

SEQ ID NO: 173759 - protein, 34 aa, Artificial Sequence
  Description of Artificial Sequence: Synthetic polypeptide
MENEIRTTNPVATEQYGSCYYPLNDDIIDLNNQS

SEQ ID NO: 173760 - protein, 35 aa, Artificial Sequence
  Description of Artificial Sequence: Synthetic polypeptide
DEMEITTTNPVATEQYGTVCSAPSGPVEFQHENVD

SEQ ID NO: 173761 - protein, 35 aa, Artificial Sequence
  Description of Artificial Sequence: Synthetic polypeptide
QEGEIATTNPVASEQYGSVSSTTPAGPNRNGMTPV

SEQ ID NO: 173762 - protein, 37 aa, Artificial Sequence
  Description of Artificial Sequence: Synthetic polypeptide
NEEEIRTTNPVATEQYGSVGYYLMNGEEQMIMNEELI

SEQ ID NO: 173763 - protein, 35 aa, Artificial Sequence
  Description of Artificial Sequence: Synthetic polypeptide
DEMEITTTNPVATEQYGTVCSANSGPVEFQHEFLD

SEQ ID NO: 173764 - protein, 35 aa, Artificial Sequence
  Description of Artificial Sequence: Synthetic polypeptide
DAAEIATTNPVAYEQYGSVSAGAIGQSDDGNGNQN

SEQ ID NO: 173765 - protein, 37 aa, Artificial Sequence
  Description of Artificial Sequence: Synthetic polypeptide
NEEEIRTTNPVATEQYGSVIGPTNLLDHMPVLEIEDT

SEQ ID NO: 173766 - protein, 29 aa, Artificial Sequence
  Description of Artificial Sequence: Synthetic peptide
QEEEIATTNPVAYERWGEAYMVEQGHEEG

SEQ ID NO: 173767 - protein, 36 aa, Artificial Sequence
  Description of Artificial Sequence: Synthetic polypeptide
DEEEIACTNPVATEQYGSCAAGNPLFDGTETENGVE

SEQ ID NO: 173768 - protein, 31 aa, Artificial Sequence
  Description of Artificial Sequence: Synthetic polypeptide
DENEICTTNPVAYEQWGTVSKEIEPNPAEDA

SEQ ID NO: 173769 - protein, 39 aa, Artificial Sequence
  Description of Artificial Sequence: Synthetic polypeptide
DEEEIRTTNPVATEQYGVVSTVVTTQQQGTEQGTNQQQD

SEQ ID NO: 173770 - protein, 34 aa, Artificial Sequence
  Description of Artificial Sequence: Synthetic polypeptide
DEHEIRTTNPVAYECWGTVYQVNENQDRQMQDNG

SEQ ID NO: 173771 - protein, 31 aa, Artificial Sequence
  Description of Artificial Sequence: Synthetic polypeptide
CENEIATTNPVAYEPYGKVSNGHLSHHETEL

SEQ ID NO: 173772 - protein, 36 aa, Artificial Sequence
  Description of Artificial Sequence: Synthetic polypeptide
DEEEIACTNPVATEQYGSVCSPMHDINTAGEEGAED

SEQ ID NO: 173773 - protein, 33 aa, Artificial Sequence
  Description of Artificial Sequence: Synthetic polypeptide
DENEIATTNPVATECYGATVWAEDWQEHKGEYL

SEQ ID NO: 173774 - protein, 32 aa, Artificial Sequence
  Description of Artificial Sequence: Synthetic polypeptide
CENEIATTNPVAYEPYGKVSNHALSQHETEQL

SEQ ID NO: 173775 - protein, 40 aa, Artificial Sequence
  Description of Artificial Sequence: Synthetic polypeptide
DEEEIRTTNPVATEQYGVVSTVTQNLQQSATNEEGVVVQQ

SEQ ID NO: 173776 - protein, 36 aa, Artificial Sequence
  Description of Artificial Sequence: Synthetic polypeptide
DEEEIATTNPVAYEQWGGCVCAGNGLQAAPDGSLRN

SEQ ID NO: 173777 - protein, 35 aa, Artificial Sequence
  Description of Artificial Sequence: Synthetic polypeptide
DENEIATTNPVATEQYGSTAGANDPAGDPMDNLAE

SEQ ID NO: 173778 - protein, 39 aa, Artificial Sequence
  Description of Artificial Sequence: Synthetic polypeptide
DEEEIRTTNPVATEQYGVVSTVVNNTNNQQGTEEEEEEA

SEQ ID NO: 173779 - protein, 38 aa, Artificial Sequence
  Description of Artificial Sequence: Synthetic polypeptide
DEAEIRATNPVATEQYGSVCYSDWPNLQDERQSDLQQN

SEQ ID NO: 173780 - protein, 34 aa, Artificial Sequence
  Description of Artificial Sequence: Synthetic polypeptide
DEHEIRTTNPVAYECWGTVYQINMEQDRQMMNNG

SEQ ID NO: 173781 - protein, 38 aa, Artificial Sequence
  Description of Artificial Sequence: Synthetic polypeptide
DEEEIRTTNPVATEQYGVVSTVVTTQNGTEAGSTEEDE

SEQ ID NO: 173782 - protein, 36 aa, Artificial Sequence
  Description of Artificial Sequence: Synthetic polypeptide
DEECTCTTNPVAVEQYGVVSTVNNQNNDEQGTNVAE

SEQ ID NO: 173783 - protein, 38 aa, Artificial Sequence
  Description of Artificial Sequence: Synthetic polypeptide
NEEEIRTTNPVATEQYGSVQSPSMNHLEQESMEPPELN

SEQ ID NO: 173784 - protein, 36 aa, Artificial Sequence
  Description of Artificial Sequence: Synthetic polypeptide
DEEEIATTNPVATEQYGSVCCVADGPNDNSLHHNMN

SEQ ID NO: 173785 - protein, 38 aa, Artificial Sequence
  Description of Artificial Sequence: Synthetic polypeptide
DEEEIRTTNPVATEQYGSVAYPTFSTLPELEIVEVQVQ

SEQ ID NO: 173786 - protein, 36 aa, Artificial Sequence
  Description of Artificial Sequence: Synthetic polypeptide
NEEEIRTTNPVATEQYGSVQVWGEEQIENTEEANIL

SEQ ID NO: 173787 - protein, 36 aa, Artificial Sequence
  Description of Artificial Sequence: Synthetic polypeptide
DDEEIRTTNPVATEFYGSVVVGGLGEEGQNFDDGIG

SEQ ID NO: 173788 - protein, 37 aa, Artificial Sequence
  Description of Artificial Sequence: Synthetic polypeptide
MEEEIRTTNPVATEQYGDYGVTGQNNMGERGNGNNDE

SEQ ID NO: 173789 - protein, 37 aa, Artificial Sequence
  Description of Artificial Sequence: Synthetic polypeptide
DEEEIRTTNPVATEQYGSVQQVAIEEQIEMTEEANDM

SEQ ID NO: 173790 - protein, 39 aa, Artificial Sequence
  Description of Artificial Sequence: Synthetic polypeptide
DEEEIRTTNPVATEQYGVVSTVVTTQANGTEQGNNQQQD

SEQ ID NO: 173791 - protein, 33 aa, Artificial Sequence
  Description of Artificial Sequence: Synthetic polypeptide
DENEIDTTNPVSTEPYGTISMEDIQQQQNGTNH

SEQ ID NO: 173792 - protein, 36 aa, Artificial Sequence
  Description of Artificial Sequence: Synthetic polypeptide
MENEIRTTNPVATEQYGSVCSVTWPINEDFFVHEGG

SEQ ID NO: 173793 - protein, 36 aa, Artificial Sequence
  Description of Artificial Sequence: Synthetic polypeptide
DEEEIRTTNPVATEQYGSQCCALLMNMESAQDEMYD

SEQ ID NO: 173794 - protein, 31 aa, Artificial Sequence
  Description of Artificial Sequence: Synthetic polypeptide
QEEEIATTNPVAYERYGEAPEVEQSQHEGEK

SEQ ID NO: 173795 - protein, 34 aa, Artificial Sequence
  Description of Artificial Sequence: Synthetic polypeptide
DEHEIRTTNPVAYECWGTVYQINEQGDRQMMNNG

SEQ ID NO: 173796 - protein, 39 aa, Artificial Sequence
  Description of Artificial Sequence: Synthetic polypeptide
DEEEIRTTNPVATEQYGVVSTVVTTQQGNQQGTNTQEED

SEQ ID NO: 173797 - protein, 37 aa, Artificial Sequence
  Description of Artificial Sequence: Synthetic polypeptide
DEEEIRTTNPVATEQYGSVIECRTSEDDEIQGSEDIQ

SEQ ID NO: 173798 - protein, 36 aa, Artificial Sequence
  Description of Artificial Sequence: Synthetic polypeptide
DEEEIRTTNPVATEQYGSQCCALWMNAEPAQDEMVD

SEQ ID NO: 173799 - protein, 30 aa, Artificial Sequence
  Description of Artificial Sequence: Synthetic polypeptide
QEEEIATTNPVAYERWGEAYMVEQHEGEGQ

SEQ ID NO: 173800 - protein, 39 aa, Artificial Sequence
  Description of Artificial Sequence: Synthetic polypeptide
DEEEIRTTNPVATEQYGVVSTVVTTQQGNQAGNTEEGSD

SEQ ID NO: 173801 - protein, 37 aa, Artificial Sequence
  Description of Artificial Sequence: Synthetic polypeptide
DEGEIATTNPVATEQYGSVCAANNNEEAPDNQGEGND

SEQ ID NO: 173802 - protein, 35 aa, Artificial Sequence
  Description of Artificial Sequence: Synthetic polypeptide
DEGEIATTNPVATEQYGSVCAANNNEEAPDNQENN

SEQ ID NO: 173803 - protein, 36 aa, Artificial Sequence
  Description of Artificial Sequence: Synthetic polypeptide
DEEEIACTNPVATEQYGSCAAATGNPQIDPLENDNN

SEQ ID NO: 173804 - protein, 39 aa, Artificial Sequence
  Description of Artificial Sequence: Synthetic polypeptide
DEEEIRTTNPVATEQYGVVSVVVVTNQAGNQQEGTEQGS

SEQ ID NO: 173805 - protein, 37 aa, Artificial Sequence
  Description of Artificial Sequence: Synthetic polypeptide
MEEEIRTTNPVATEQYGQCVCSNWGEHNQNFGSENQS

SEQ ID NO: 173806 - protein, 37 aa, Artificial Sequence
  Description of Artificial Sequence: Synthetic polypeptide
DEEEIRTTNPVATEQYGSQCCALLMNYEPAQDEMNSD

SEQ ID NO: 173807 - protein, 39 aa, Artificial Sequence
  Description of Artificial Sequence: Synthetic polypeptide
DEEEIRTTNPVATEQYGVVSVVVVTNQNQAIGTTDEESD

SEQ ID NO: 173808 - protein, 36 aa, Artificial Sequence
  Description of Artificial Sequence: Synthetic polypeptide
DEEEIACTNPVATEQYGSCAAATNGPMAGMEIGINS

SEQ ID NO: 173809 - protein, 35 aa, Artificial Sequence
  Description of Artificial Sequence: Synthetic polypeptide
DEGEIATTNPVATEQYGSVCAANNGDENGMDIQLH

SEQ ID NO: 173810 - protein, 36 aa, Artificial Sequence
  Description of Artificial Sequence: Synthetic polypeptide
DENEIATTNPVATEQYGSTACAPANDGLPLGSEGNH

SEQ ID NO: 173811 - protein, 38 aa, Artificial Sequence
  Description of Artificial Sequence: Synthetic polypeptide
DEEEIRTTNPVATEQYGSVAVLDINDVTQEVPEQEGEP

SEQ ID NO: 173812 - protein, 36 aa, Artificial Sequence
  Description of Artificial Sequence: Synthetic polypeptide
DEGEIATTNPVATEQYGSVCAANNGDENGMDIEDNP

SEQ ID NO: 173813 - protein, 34 aa, Artificial Sequence
  Description of Artificial Sequence: Synthetic polypeptide
DEHEIRTTNPVAYECWGTVYQINENQDRREENNP

SEQ ID NO: 173814 - protein, 36 aa, Artificial Sequence
  Description of Artificial Sequence: Synthetic polypeptide
DEEEIATTNPVAYEQYGSVCSPAPHLNEAPGGEAMD

SEQ ID NO: 173815 - protein, 36 aa, Artificial Sequence
  Description of Artificial Sequence: Synthetic polypeptide
DEEEIRTTNPVATEQYGSVASPWEPIPIASMMPMEN

SEQ ID NO: 173816 - protein, 36 aa, Artificial Sequence
  Description of Artificial Sequence: Synthetic polypeptide
DAEEIATTNPVATEQYGSVCAANGGDEATAGEGNEN

SEQ ID NO: 173817 - protein, 38 aa, Artificial Sequence
  Description of Artificial Sequence: Synthetic polypeptide
DEEEIRTTNPVATEQYGSVIEEWTDTLNQPSETEEDDT

SEQ ID NO: 173818 - protein, 36 aa, Artificial Sequence
  Description of Artificial Sequence: Synthetic polypeptide
DEGEIATTNPVATEQYGSVCAANMHGEATADGDGRG

SEQ ID NO: 173819 - protein, 35 aa, Artificial Sequence
  Description of Artificial Sequence: Synthetic polypeptide
DEEEIATTNPVAYAQWGTSVSATADLGQHDIAQAQ

SEQ ID NO: 173820 - protein, 36 aa, Artificial Sequence
  Description of Artificial Sequence: Synthetic polypeptide
QEEEIRGTNPVATESYGSVSNQNNMTIFGNTNGEII

SEQ ID NO: 173821 - protein, 37 aa, Artificial Sequence
  Description of Artificial Sequence: Synthetic polypeptide
MEEEIRTTNPVATEQYGAVDIDTNMNLMIEGGGQDIT

SEQ ID NO: 173822 - protein, 34 aa, Artificial Sequence
  Description of Artificial Sequence: Synthetic polypeptide
DENCIATVNPVATECYGSVVCIDHQDQDRQGNHQ

SEQ ID NO: 173823 - protein, 35 aa, Artificial Sequence
  Description of Artificial Sequence: Synthetic polypeptide
MEEEIRTTNPVATEFYGSVYDDIIDGGQEDTGGIQ

SEQ ID NO: 173824 - protein, 30 aa, Artificial Sequence
  Description of Artificial Sequence: Synthetic polypeptide
QDSEIATTNPVATEGYGNAANVCQSHVGEK

SEQ ID NO: 173825 - protein, 38 aa, Artificial Sequence
  Description of Artificial Sequence: Synthetic polypeptide
DEEEIACTNPVATEQYGSVCAMNGKHGPLDQGMGMMND

SEQ ID NO: 173826 - protein, 38 aa, Artificial Sequence
  Description of Artificial Sequence: Synthetic polypeptide
MEEEIRTTNPVATEFYGSVVQAMTENMQNGFNGEGGTN

SEQ ID NO: 173827 - protein, 35 aa, Artificial Sequence
  Description of Artificial Sequence: Synthetic polypeptide
DAEEIATTNPVATEQWGHCNVAANNGLQATAPGGF

SEQ ID NO: 173828 - protein, 37 aa, Artificial Sequence
  Description of Artificial Sequence: Synthetic polypeptide
MEEEIRTTNPVATEFYGSVVDGGGNATNDDEGGNQGT

SEQ ID NO: 173829 - protein, 39 aa, Artificial Sequence
  Description of Artificial Sequence: Synthetic polypeptide
DEEEIRTTNPVATEQYGVVSVTVVNNQQGTTEQGTEQGS

SEQ ID NO: 173830 - protein, 34 aa, Artificial Sequence
  Description of Artificial Sequence: Synthetic polypeptide
DEKEIATTNPVAYEQWGSVYHPINDNQKTEGKES

SEQ ID NO: 173831 - protein, 32 aa, Artificial Sequence
  Description of Artificial Sequence: Synthetic polypeptide
QENEIATTNPVAYEPYGNVPSGEHLQNHQMEF

SEQ ID NO: 173832 - protein, 34 aa, Artificial Sequence
  Description of Artificial Sequence: Synthetic polypeptide
DENCIATVNPVATECYGSVVCIDNDHERNGDNHM

SEQ ID NO: 173833 - protein, 36 aa, Artificial Sequence
  Description of Artificial Sequence: Synthetic polypeptide
DEEEIRTTNPVATEQYGVVTCIEMTEEVPEGEVPEI

SEQ ID NO: 173834 - protein, 34 aa, Artificial Sequence
  Description of Artificial Sequence: Synthetic polypeptide
QEGEIATTNPCSSEQYGSVSSTTALPNRNGMTPV

SEQ ID NO: 173835 - protein, 38 aa, Artificial Sequence
  Description of Artificial Sequence: Synthetic polypeptide
DEEEIRTTNPVATEQYGSVNDPTRTSDVQQYMVQNELQ

SEQ ID NO: 173836 - protein, 38 aa, Artificial Sequence
  Description of Artificial Sequence: Synthetic polypeptide
DDEEIRTTNPVATEFYGSVSSTDGQGLEQNEDGDQDTN

SEQ ID NO: 173837 - protein, 35 aa, Artificial Sequence
  Description of Artificial Sequence: Synthetic polypeptide
MEEEIRTTNPVATEFYGDVVQTDNMNEGGGEEEGD

SEQ ID NO: 173838 - protein, 35 aa, Artificial Sequence
  Description of Artificial Sequence: Synthetic polypeptide
DDEEIRTTNPVATEQWGCVTSWEEDHNQNFGSDAS

SEQ ID NO: 173839 - protein, 36 aa, Artificial Sequence
  Description of Artificial Sequence: Synthetic polypeptide
DEEEIRTTNPVATEQYGTFNATLEVDDWVGMNENIV

SEQ ID NO: 173840 - protein, 36 aa, Artificial Sequence
  Description of Artificial Sequence: Synthetic polypeptide
DEMEIATTNPVATEQYGCVCSTTEDNEEHFGSEDLM

SEQ ID NO: 173841 - protein, 35 aa, Artificial Sequence
  Description of Artificial Sequence: Synthetic polypeptide
DEMEIITTNPVATEQYGTVCSATDVTSVEVHEMND

SEQ ID NO: 173842 - protein, 35 aa, Artificial Sequence
  Description of Artificial Sequence: Synthetic polypeptide
MEEEIRTTNPVATEFYGCVSNTDGGEEEEEGEEED

SEQ ID NO: 173843 - protein, 34 aa, Artificial Sequence
  Description of Artificial Sequence: Synthetic polypeptide
MEEEIRTTNPVATEFYGCVSNDDGGEEEEGGEEP

SEQ ID NO: 173844 - protein, 36 aa, Artificial Sequence
  Description of Artificial Sequence: Synthetic polypeptide
DDEEIRTTNPVATEQWGCVTSWGEHNAENFGSDNQA

SEQ ID NO: 173845 - protein, 36 aa, Artificial Sequence
  Description of Artificial Sequence: Synthetic polypeptide
DEMEIATTNPVATEQYGCVCSTTDLNEEHFGSEDQF

SEQ ID NO: 173846 - protein, 34 aa, Artificial Sequence
  Description of Artificial Sequence: Synthetic polypeptide
DEMEISTTNPVATQQYGCVCSNWEHNENFGSDQA

SEQ ID NO: 173847 - protein, 37 aa, Artificial Sequence
  Description of Artificial Sequence: Synthetic polypeptide
DEEEIACTNPVATEQYGSVCAMNNGELNPDDQMEHRM

SEQ ID NO: 173848 - protein, 33 aa, Artificial Sequence
  Description of Artificial Sequence: Synthetic polypeptide
QENEIATTNPVAYEPYGNVPSGEHLQHGMMQLF

SEQ ID NO: 173849 - protein, 30 aa, Artificial Sequence
  Description of Artificial Sequence: Synthetic polypeptide
QDSEIASTNPVSTEGYGEVAETCQSRVEQR

SEQ ID NO: 173850 - protein, 34 aa, Artificial Sequence
  Description of Artificial Sequence: Synthetic polypeptide
DEHEIATTNPVAYEQWGSVVCNAAMPREDRSDGS

SEQ ID NO: 173851 - protein, 30 aa, Artificial Sequence
  Description of Artificial Sequence: Synthetic polypeptide
QDSEIASTNPVSTEGYGEVANTCQSRVEQR

SEQ ID NO: 173852 - protein, 36 aa, Artificial Sequence
  Description of Artificial Sequence: Synthetic polypeptide
MEEEIRTTNPVATEFYGVVVDGLGNATNDDEGGNQG

SEQ ID NO: 173853 - protein, 37 aa, Artificial Sequence
  Description of Artificial Sequence: Synthetic polypeptide
MEEEIRTTNPVATEFYGVVVDGGGNATNLDDDGENQG

SEQ ID NO: 173854 - protein, 36 aa, Artificial Sequence
  Description of Artificial Sequence: Synthetic polypeptide
MEEEIRTTNPVATEFYGVVVDGGGNATNGDTGGNQN

SEQ ID NO: 173855 - protein, 33 aa, Artificial Sequence
  Description of Artificial Sequence: Synthetic polypeptide
DENEIATTNPVATASWGCVAANNNLQIDAGGHK

SEQ ID NO: 173856 - protein, 36 aa, Artificial Sequence
  Description of Artificial Sequence: Synthetic polypeptide
QEEEIRSTNPVATEQYGSVYGQDIADTNEQGPEFVD

SEQ ID NO: 173857 - protein, 32 aa, Artificial Sequence
  Description of Artificial Sequence: Synthetic polypeptide
QENEIATTNPVAYEPYGNTVSGEHLQHQMIMK

SEQ ID NO: 173858 - protein, 36 aa, Artificial Sequence
  Description of Artificial Sequence: Synthetic polypeptide
MEEEIRTTNPVATEFYGVVQDGGGNATNDDEGSNQG

SEQ ID NO: 173859 - protein, 35 aa, Artificial Sequence
  Description of Artificial Sequence: Synthetic polypeptide
MEPEICTTNPVATEQYGSVTVTGGQNQEEMGMGEE

SEQ ID NO: 173860 - protein, 31 aa, Artificial Sequence
  Description of Artificial Sequence: Synthetic polypeptide
QDSEIASTNPVSTEGYGNVAANCIQSRVGQL

SEQ ID NO: 173861 - protein, 35 aa, Artificial Sequence
  Description of Artificial Sequence: Synthetic polypeptide
DEMEIATTNPVAYECWGSVCSGTDNQDRDGGMQEQ

SEQ ID NO: 173862 - protein, 38 aa, Artificial Sequence
  Description of Artificial Sequence: Synthetic polypeptide
DEEEIRTTNPVATEQYGVVSVVVVTTTDEQGSNTEEEE

SEQ ID NO: 173863 - protein, 36 aa, Artificial Sequence
  Description of Artificial Sequence: Synthetic polypeptide
DAEEIATTNPVATEQYGSVCAATMGEEAGDNMNGNM

SEQ ID NO: 173864 - protein, 36 aa, Artificial Sequence
  Description of Artificial Sequence: Synthetic polypeptide
DEEEIACTNPVATEQYGSVCAMNNGGTEAGDVNNAP

SEQ ID NO: 173865 - protein, 36 aa, Artificial Sequence
  Description of Artificial Sequence: Synthetic polypeptide
DEMEIRTTNPVATEQYGCICSNWGEDTNQNFGSDQS

SEQ ID NO: 173866 - protein, 33 aa, Artificial Sequence
  Description of Artificial Sequence: Synthetic polypeptide
DENEIATTNPVATASWGCVAANNNLQDAGEGGH

SEQ ID NO: 173867 - protein, 29 aa, Artificial Sequence
  Description of Artificial Sequence: Synthetic peptide
QDSEIASTNPVSTEQYGEVAEVCQSHEQK

SEQ ID NO: 173868 - protein, 32 aa, Artificial Sequence
  Description of Artificial Sequence: Synthetic polypeptide
QESEIASTNPVGTEGYGVIACSTLSQHGGDNE

SEQ ID NO: 173869 - protein, 36 aa, Artificial Sequence
  Description of Artificial Sequence: Synthetic polypeptide
DEMEIATTNPVATEQYGCVCSTSDHNEEHFGSEPQA

SEQ ID NO: 173870 - protein, 35 aa, Artificial Sequence
  Description of Artificial Sequence: Synthetic polypeptide
DEEEIATTNPVATEQYGSVCAATAGEEMMWMQDEG

SEQ ID NO: 173871 - protein, 37 aa, Artificial Sequence
  Description of Artificial Sequence: Synthetic polypeptide
DEEEIRTTNPVATEQYGSIAEPTVNGHEEMNTNGEYH

SEQ ID NO: 173872 - protein, 38 aa, Artificial Sequence
  Description of Artificial Sequence: Synthetic polypeptide
AEEEIRTTNPVATEQYGVVSTVTTNNMEQGTNNVTEEQ

SEQ ID NO: 173873 - protein, 36 aa, Artificial Sequence
  Description of Artificial Sequence: Synthetic polypeptide
DEEEIATTNPVAYEQYGSVATTGHGPLASMENSDDF

SEQ ID NO: 173874 - protein, 37 aa, Artificial Sequence
  Description of Artificial Sequence: Synthetic polypeptide
DDEEIRTTNPVATEFYGSVSIVVNMDGQGEFDDNELF

SEQ ID NO: 173875 - protein, 36 aa, Artificial Sequence
  Description of Artificial Sequence: Synthetic polypeptide
DEHEIATTNPVAYEQWGTVSIPNQGDDQDRQGDVER

SEQ ID NO: 173876 - protein, 38 aa, Artificial Sequence
  Description of Artificial Sequence: Synthetic polypeptide
DEEEIRTTNPVATEQYGVVTLAHATNDQQAMIVFEQRE

SEQ ID NO: 173877 - protein, 38 aa, Artificial Sequence
  Description of Artificial Sequence: Synthetic polypeptide
DEEEIRTTNPVATEQYGSVNGAAINEYHDSRSEENEDA

SEQ ID NO: 173878 - protein, 32 aa, Artificial Sequence
  Description of Artificial Sequence: Synthetic polypeptide
DENCIDTTNPVSTEPYGTISMEDIQQQQNGNH

SEQ ID NO: 173879 - protein, 31 aa, Artificial Sequence
  Description of Artificial Sequence: Synthetic polypeptide
DEGEIRTTNPCCTAQWGCTAGNGLTADGDEQ

SEQ ID NO: 173880 - protein, 37 aa, Artificial Sequence
  Description of Artificial Sequence: Synthetic polypeptide
DEEEIRTTNPVATEQYGSVCCMLLMNAEPAQDEMVVD

SEQ ID NO: 173881 - protein, 38 aa, Artificial Sequence
  Description of Artificial Sequence: Synthetic polypeptide
DEEEIRTTNPVATEQYGSVASPIFSTLDELEMVDVQVL

SEQ ID NO: 173882 - protein, 36 aa, Artificial Sequence
  Description of Artificial Sequence: Synthetic polypeptide
DEMEIATTNPVATEQYGCVCSTWDHNAEHFNSETQA

SEQ ID NO: 173883 - protein, 34 aa, Artificial Sequence
  Description of Artificial Sequence: Synthetic polypeptide
DEHEIRTTNPVAYESWGSVCYNNDEQDQLNQNES

SEQ ID NO: 173884 - protein, 33 aa, Artificial Sequence
  Description of Artificial Sequence: Synthetic polypeptide
DEHCIATTNPVAYEQYSEEVTTTGDNHQGGGIK

SEQ ID NO: 173885 - protein, 36 aa, Artificial Sequence
  Description of Artificial Sequence: Synthetic polypeptide
DEEEIACTNPVATEQYGSVCAGNNGLADSPGDEMAM

SEQ ID NO: 173886 - protein, 38 aa, Artificial Sequence
  Description of Artificial Sequence: Synthetic polypeptide
MEEEIRTTNPVAFEQYGSVVNSVTGGDLGQEEQGEGGI

SEQ ID NO: 173887 - protein, 35 aa, Artificial Sequence
  Description of Artificial Sequence: Synthetic polypeptide
MEEEIRTTNPAATDQYGVVNDNSIGQNGQGDNDDD

SEQ ID NO: 173888 - protein, 33 aa, Artificial Sequence
  Description of Artificial Sequence: Synthetic polypeptide
DEHEIATTNPVAYEQWGVVAGPNGNQGEMGGGP

SEQ ID NO: 173889 - protein, 36 aa, Artificial Sequence
  Description of Artificial Sequence: Synthetic polypeptide
MEEEIRTTNCVATEQYGMVSVDGNNQEGQGEQDDGQ

SEQ ID NO: 173890 - protein, 34 aa, Artificial Sequence
  Description of Artificial Sequence: Synthetic polypeptide
DEHEIATTNPVAYEQWGVVAGPNGNQGEMKGGNM

SEQ ID NO: 173891 - protein, 32 aa, Artificial Sequence
  Description of Artificial Sequence: Synthetic polypeptide
QENEIATTNPVAYEPYGPNVSGEHLQHMEMLN

SEQ ID NO: 173892 - protein, 37 aa, Artificial Sequence
  Description of Artificial Sequence: Synthetic polypeptide
DEKEIATTNPVAYEQYGTVCSYTDGLVEGVQREEGES

SEQ ID NO: 173893 - protein, 36 aa, Artificial Sequence
  Description of Artificial Sequence: Synthetic polypeptide
MEEEIRTTNCVATEQYGMVSNDGNMDEGQEEGDDGQ

SEQ ID NO: 173894 - protein, 34 aa, Artificial Sequence
  Description of Artificial Sequence: Synthetic polypeptide
DEHEIATTNPVAYEQWGVVAGPNPGNQGAMGGNM

SEQ ID NO: 173895 - protein, 39 aa, Artificial Sequence
  Description of Artificial Sequence: Synthetic polypeptide
DEEEIRTTNPVATEQYGTVTNLQSGTISTNTINTEVGNA

SEQ ID NO: 173896 - protein, 35 aa, Artificial Sequence
  Description of Artificial Sequence: Synthetic polypeptide
DEHEIATTNPVAYEQWGVVASGPNGNQGAMRNGTD

SEQ ID NO: 173897 - protein, 37 aa, Artificial Sequence
  Description of Artificial Sequence: Synthetic polypeptide
DEEEIRTTNPVATEQYGSVPAPPLWLEEVPMGPLEQG

SEQ ID NO: 173898 - protein, 36 aa, Artificial Sequence
  Description of Artificial Sequence: Synthetic polypeptide
DEEEIACTNPVATEQYGSVCAGNNGLADAPIGEMAM

SEQ ID NO: 173899 - protein, 37 aa, Artificial Sequence
  Description of Artificial Sequence: Synthetic polypeptide
DEGEIRTTNPVATEQYGSYSENDTGNHTGIAFSNEEE

SEQ ID NO: 173900 - protein, 37 aa, Artificial Sequence
  Description of Artificial Sequence: Synthetic polypeptide
DAEEIATTNPVATEQYGSVCAMTTGGPADQGGGNEND

SEQ ID NO: 173901 - protein, 34 aa, Artificial Sequence
  Description of Artificial Sequence: Synthetic polypeptide
DEHCIATTNPVAYEQYSEEVTTTTGDNHQGGGKR

SEQ ID NO: 173902 - protein, 37 aa, Artificial Sequence
  Description of Artificial Sequence: Synthetic polypeptide
DEEEIRTTNPVATEQYGSVCCMLAMELDEPAQDEMYD

SEQ ID NO: 173903 - protein, 39 aa, Artificial Sequence
  Description of Artificial Sequence: Synthetic polypeptide
DDEEIRTTNPVATEFYGSVSIVTNMDPGQQGEQDDNEQF

SEQ ID NO: 173904 - protein, 36 aa, Artificial Sequence
  Description of Artificial Sequence: Synthetic polypeptide
QEEEIRTTNPVATEQYGDVVGVGNMQTNGFGGEEIG

SEQ ID NO: 173905 - protein, 37 aa, Artificial Sequence
  Description of Artificial Sequence: Synthetic polypeptide
DEGEIRTTNPVATEQYGSVCSEEVPSGEDQMEVNLND

SEQ ID NO: 173906 - protein, 36 aa, Artificial Sequence
  Description of Artificial Sequence: Synthetic polypeptide
DEMEIATTNPVATEQYGCVCSTTEHNEEHFNSETQA

SEQ ID NO: 173907 - protein, 35 aa, Artificial Sequence
  Description of Artificial Sequence: Synthetic polypeptide
DEMEISTTNPVATEQYGTVCSNWEEPNEFEGSDQA

SEQ ID NO: 173908 - protein, 36 aa, Artificial Sequence
  Description of Artificial Sequence: Synthetic polypeptide
MEEEIRTTNPVATECYGSVDDLMNNDLSNEMQEEGI

SEQ ID NO: 173909 - protein, 36 aa, Artificial Sequence
  Description of Artificial Sequence: Synthetic polypeptide
MEEEIRTTNPVATEAYGVVVDGGGNFTNDDTGGNQG

SEQ ID NO: 173910 - protein, 38 aa, Artificial Sequence
  Description of Artificial Sequence: Synthetic polypeptide
DDEEIRTTNPVATEFYGSVSIVSNMDGQQGEFDQNEQF

SEQ ID NO: 173911 - protein, 36 aa, Artificial Sequence
  Description of Artificial Sequence: Synthetic polypeptide
DEEEIATTNPVAYEQWGSVSGGQPAGGNMRNGMNPV

SEQ ID NO: 173912 - protein, 30 aa, Artificial Sequence
  Description of Artificial Sequence: Synthetic polypeptide
QDSEVASTNPVSTEGYGIVACTIQSRVGTR

SEQ ID NO: 173913 - protein, 38 aa, Artificial Sequence
  Description of Artificial Sequence: Synthetic polypeptide
DDEEIRTTNPVATEFYGSVSIVNNMDGQQGEFDDNEQL

SEQ ID NO: 173914 - protein, 36 aa, Artificial Sequence
  Description of Artificial Sequence: Synthetic polypeptide
DEEEIACTNPVATEQYGSVCAIENLDAGTDGAEDAD

SEQ ID NO: 173915 - protein, 36 aa, Artificial Sequence
  Description of Artificial Sequence: Synthetic polypeptide
DEEEIATTNPVATEQYGSACSATMPGAEAPPGDEHN

SEQ ID NO: 173916 - protein, 36 aa, Artificial Sequence
  Description of Artificial Sequence: Synthetic polypeptide
DEMEIATTNPVATEQYGCVCSTTELNEDHFGSETQA

SEQ ID NO: 173917 - protein, 35 aa, Artificial Sequence
  Description of Artificial Sequence: Synthetic polypeptide
DEMEIKTTNPVATEQYGTVCSATSGPVEFEHNSDQ

SEQ ID NO: 173918 - protein, 37 aa, Artificial Sequence
  Description of Artificial Sequence: Synthetic polypeptide
DEKEIATTNPVAYEQYGTVCSYTDGLHEGVQRPGGES

SEQ ID NO: 173919 - protein, 37 aa, Artificial Sequence
  Description of Artificial Sequence: Synthetic polypeptide
DEHEIATTNPVAYEQWGVSYSGGNDTEQRGGGMGGNR

SEQ ID NO: 173920 - protein, 33 aa, Artificial Sequence
  Description of Artificial Sequence: Synthetic polypeptide
DENEIATTNPVATAQWGCVAINNGLEATANGEF

SEQ ID NO: 173921 - protein, 39 aa, Artificial Sequence
  Description of Artificial Sequence: Synthetic polypeptide
DEEEIRTTNPVATEQYGVVSTVVNTNNQEQGTEEGEEED

SEQ ID NO: 173922 - protein, 39 aa, Artificial Sequence
  Description of Artificial Sequence: Synthetic polypeptide
DEEEIRTTNPVATEQYGVVSTVVTTNNNQQGTEDEEEEE

SEQ ID NO: 173923 - protein, 35 aa, Artificial Sequence
  Description of Artificial Sequence: Synthetic polypeptide
DENEIATTNPVATEQYGSVANANDPTAGDPMGEAW

SEQ ID NO: 173924 - protein, 36 aa, Artificial Sequence
  Description of Artificial Sequence: Synthetic polypeptide
DEMEISTTNPVATEQYGTVCSNTGEPNEFFGSDTQG

SEQ ID NO: 173925 - protein, 36 aa, Artificial Sequence
  Description of Artificial Sequence: Synthetic polypeptide
MEEEIRTTNPVATECYGSVVGFGNNLTPEGMEGGQG

SEQ ID NO: 173926 - protein, 34 aa, Artificial Sequence
  Description of Artificial Sequence: Synthetic polypeptide
DEHEIATTNPVAYEQWGSVTGPNNGNQGAMNGID

SEQ ID NO: 173927 - protein, 37 aa, Artificial Sequence
  Description of Artificial Sequence: Synthetic polypeptide
DEAEIATTNPVATEQYGSVCAMNNGELGNANPGEHNL

SEQ ID NO: 173928 - protein, 31 aa, Artificial Sequence
  Description of Artificial Sequence: Synthetic polypeptide
QDSEIASTNPVSTECYGNVAANCIQSRVGQL

SEQ ID NO: 173929 - protein, 37 aa, Artificial Sequence
  Description of Artificial Sequence: Synthetic polypeptide
DEEEIRTTNPVATEQYGSVLATMNMFMPPVSEEPDMF

SEQ ID NO: 173930 - protein, 36 aa, Artificial Sequence
  Description of Artificial Sequence: Synthetic polypeptide
MENEIRTTNPVATEQYGSVYVPPNDHEQEVSSNEDI

SEQ ID NO: 173931 - protein, 37 aa, Artificial Sequence
  Description of Artificial Sequence: Synthetic polypeptide
MENEIRTTNPVATEQYGSVYYVSPNDHEQEVSSNDDI

SEQ ID NO: 173932 - protein, 37 aa, Artificial Sequence
  Description of Artificial Sequence: Synthetic polypeptide
DEGEIRTTNPVATEQYGSVWCVLMANEDPEGMQNNQI

SEQ ID NO: 173933 - protein, 35 aa, Artificial Sequence
  Description of Artificial Sequence: Synthetic polypeptide
MEEEIRTTNPVATEGYGSVYDDIIDGGQEDTGQEI

SEQ ID NO: 173934 - protein, 35 aa, Artificial Sequence
  Description of Artificial Sequence: Synthetic polypeptide
MEEEIRTTNPVATEGYGSVYDDIIDGGQEDTGEEG

SEQ ID NO: 173935 - protein, 31 aa, Artificial Sequence
  Description of Artificial Sequence: Synthetic polypeptide
QESEIASTNPVGTEGYGVMAASDGLVQFGDD

SEQ ID NO: 173936 - protein, 39 aa, Artificial Sequence
  Description of Artificial Sequence: Synthetic polypeptide
DEEEIRTTNPVATEQYGVVSTVVTTNQQGNQQNTTEQGQ

SEQ ID NO: 173937 - protein, 37 aa, Artificial Sequence
  Description of Artificial Sequence: Synthetic polypeptide
DEAEIATTNPVATEQYGSVCAMNGGNLEPGADIANDA

SEQ ID NO: 173938 - protein, 37 aa, Artificial Sequence
  Description of Artificial Sequence: Synthetic polypeptide
DEEEIATTNPVAYEQYGSVCANMNPAEEAGISGENRD

SEQ ID NO: 173939 - protein, 36 aa, Artificial Sequence
  Description of Artificial Sequence: Synthetic polypeptide
NEEEIATTNPVATEQYGSACSANPAEADAEIGNMTV

SEQ ID NO: 173940 - protein, 39 aa, Artificial Sequence
  Description of Artificial Sequence: Synthetic polypeptide
DEEEIRTTNPVATEQYGVVSVVVVTNQQNTEQGTTEAGS

SEQ ID NO: 173941 - protein, 36 aa, Artificial Sequence
  Description of Artificial Sequence: Synthetic polypeptide
MEEEIRTTNPVATEGYGSVVYDNIIQGGQGEEEEQI

SEQ ID NO: 173942 - protein, 36 aa, Artificial Sequence
  Description of Artificial Sequence: Synthetic polypeptide
DEEEIATTNPVAYEQYGSVCAMNNGGTEAGDVNNVA

SEQ ID NO: 173943 - protein, 35 aa, Artificial Sequence
  Description of Artificial Sequence: Synthetic polypeptide
DDASIRTTNPVATEQYGCVQTLLATQFNGLQDQSF

SEQ ID NO: 173944 - protein, 36 aa, Artificial Sequence
  Description of Artificial Sequence: Synthetic polypeptide
MEEEIRTTNPVATEGYGSVVYDNIIQGGEGEEDEQF

SEQ ID NO: 173945 - protein, 35 aa, Artificial Sequence
  Description of Artificial Sequence: Synthetic polypeptide
DEEEIATTNPVAYEAYGWIVSCTGEGSQYTNDNDD

SEQ ID NO: 173946 - protein, 36 aa, Artificial Sequence
  Description of Artificial Sequence: Synthetic polypeptide
DEEEIATTNPVATEQYGSVCAAALHLPLDSEGSAEN

SEQ ID NO: 173947 - protein, 36 aa, Artificial Sequence
  Description of Artificial Sequence: Synthetic polypeptide
QEEEIRSTNPVATEQYGSVDDDNDNNFEGEDGNDDG

SEQ ID NO: 173948 - protein, 31 aa, Artificial Sequence
  Description of Artificial Sequence: Synthetic polypeptide
DDAEVASTNPVSTEGYGNVAANTIQSRVGQQ

SEQ ID NO: 173949 - protein, 37 aa, Artificial Sequence
  Description of Artificial Sequence: Synthetic polypeptide
DEEEIRTTNPVATEQYGSVDNLRIVMLNPNNFVAEDE

SEQ ID NO: 173950 - protein, 32 aa, Artificial Sequence
  Description of Artificial Sequence: Synthetic polypeptide
CENEIATTNPVAYEPYGKVSNQHLSQHVTEDL

SEQ ID NO: 173951 - protein, 38 aa, Artificial Sequence
  Description of Artificial Sequence: Synthetic polypeptide
DEEEIACTNPVATEQYGSVCAMTNGELTNPDDGMEGRA

SEQ ID NO: 173952 - protein, 37 aa, Artificial Sequence
  Description of Artificial Sequence: Synthetic polypeptide
DEEEIRTTNPVATEQYGSGSLGFVEGEKNIVTEPENL

SEQ ID NO: 173953 - protein, 37 aa, Artificial Sequence
  Description of Artificial Sequence: Synthetic polypeptide
MENEIRTTNPVATEQYGSVWSTTTQMEGQHEGEDHDI

SEQ ID NO: 173954 - protein, 30 aa, Artificial Sequence
  Description of Artificial Sequence: Synthetic polypeptide
DENEIATTNPVATECWGATTAACWQEHEPL

SEQ ID NO: 173955 - protein, 38 aa, Artificial Sequence
  Description of Artificial Sequence: Synthetic polypeptide
DEEEIACTNPVATEQYGSVCAMTNGELTNPDDQMENNN

SEQ ID NO: 173956 - protein, 37 aa, Artificial Sequence
  Description of Artificial Sequence: Synthetic polypeptide
MEEEIRTTNPVATEQYGAVDIDTNMNLEMEGGGQDID

SEQ ID NO: 173957 - protein, 34 aa, Artificial Sequence
  Description of Artificial Sequence: Synthetic polypeptide
DEHEIRTTNPVAYECWGVVYQINENQDRQMMDNG

SEQ ID NO: 173958 - protein, 34 aa, Artificial Sequence
  Description of Artificial Sequence: Synthetic polypeptide
DEHEIRTTNPVAYECWGVVYQINEQQDRQRMNNG

SEQ ID NO: 173959 - protein, 37 aa, Artificial Sequence
  Description of Artificial Sequence: Synthetic polypeptide
MEEEIRTTNPVATEQYGAVDIDTNMNLEEEGGDQDVT

SEQ ID NO: 173960 - protein, 39 aa, Artificial Sequence
  Description of Artificial Sequence: Synthetic polypeptide
DEEEIRTTNPVATEQYGVVSTVTNNNTEQGNNENQNDTD

SEQ ID NO: 173961 - protein, 31 aa, Artificial Sequence
  Description of Artificial Sequence: Synthetic polypeptide
QESEIASTNPVGTEGYGVMAATDGLVQFGDD

SEQ ID NO: 173962 - protein, 39 aa, Artificial Sequence
  Description of Artificial Sequence: Synthetic polypeptide
DEEEIRTTNPVATEQYGVVSTVTNNNTEQGNNATTNNTD

SEQ ID NO: 173963 - protein, 33 aa, Artificial Sequence
  Description of Artificial Sequence: Synthetic polypeptide
DANEIRTTNPVSTEPYGTISMEDIQQQQNGNVH

SEQ ID NO: 173964 - protein, 37 aa, Artificial Sequence
  Description of Artificial Sequence: Synthetic polypeptide
DEEEIRTTNPVATEQYGSVGYPLMNGEEAMIMAAEEL

SEQ ID NO: 173965 - protein, 35 aa, Artificial Sequence
  Description of Artificial Sequence: Synthetic polypeptide
DEMEIATTNPVAYECWGSVCSTTDNHDRDGGQEEG

SEQ ID NO: 173966 - protein, 34 aa, Artificial Sequence
  Description of Artificial Sequence: Synthetic polypeptide
DAQEIATTNPVAYEQWGSARCTENHDQDDDGMQR

SEQ ID NO: 173967 - protein, 34 aa, Artificial Sequence
  Description of Artificial Sequence: Synthetic polypeptide
DEEEIACTNPVATEQYGSCATGAAIDNDAGAEMW

SEQ ID NO: 173968 - protein, 35 aa, Artificial Sequence
  Description of Artificial Sequence: Synthetic polypeptide
DEGEIATTNPVATEQYGSVCAAMHEEATAAEENRQ

SEQ ID NO: 173969 - protein, 30 aa, Artificial Sequence
  Description of Artificial Sequence: Synthetic polypeptide
QENEIATTNPVATECYGDVAEECWAEHEEL

SEQ ID NO: 173970 - protein, 35 aa, Artificial Sequence
  Description of Artificial Sequence: Synthetic polypeptide
DEEEIACTNPVATEQYGSCATGAAITNDAGEENMW

SEQ ID NO: 173971 - protein, 39 aa, Artificial Sequence
  Description of Artificial Sequence: Synthetic polypeptide
DEEEIRTTNPVATEQYGVVSTVVVTQAGNNDTEEENEEE

SEQ ID NO: 173972 - protein, 35 aa, Artificial Sequence
  Description of Artificial Sequence: Synthetic polypeptide
DEECNATTNPIAYEQWGEVCSTDNQDVQHHDGKNR

SEQ ID NO: 173973 - protein, 38 aa, Artificial Sequence
  Description of Artificial Sequence: Synthetic polypeptide
AEEEIRTTNPVATEQYGVVSTVTQNNVEQGTNNVTDED

SEQ ID NO: 173974 - protein, 37 aa, Artificial Sequence
  Description of Artificial Sequence: Synthetic polypeptide
DDCEIRTTNPVATEQYGCVSLTTLLATQFNGLQDPEF

SEQ ID NO: 173975 - protein, 36 aa, Artificial Sequence
  Description of Artificial Sequence: Synthetic polypeptide
DAEEIATTNPVATEQYGSVCAANMGEEQPDDQGESM

SEQ ID NO: 173976 - protein, 35 aa, Artificial Sequence
  Description of Artificial Sequence: Synthetic polypeptide
NEDEIATTNPVAYEQYGTVATEPGGQTNGGQRGEA

SEQ ID NO: 173977 - protein, 39 aa, Artificial Sequence
  Description of Artificial Sequence: Synthetic polypeptide
DEEEIRTTNPVATEQYGVVSTVVVTQAGNNDTEEENNDT

SEQ ID NO: 173978 - protein, 38 aa, Artificial Sequence
  Description of Artificial Sequence: Synthetic polypeptide
DEEEIACTNPVATEQYGSVCAMTNGELTNIDDGMENNM

SEQ ID NO: 173979 - protein, 36 aa, Artificial Sequence
  Description of Artificial Sequence: Synthetic polypeptide
DEEEIATTNPVATEQYGSVCDGTPGPDDSGDGMGHN

SEQ ID NO: 173980 - protein, 37 aa, Artificial Sequence
  Description of Artificial Sequence: Synthetic polypeptide
DEEEIRTTNPVATEQYGSVCAMPESSLQQHDPVEIEW

SEQ ID NO: 173981 - protein, 36 aa, Artificial Sequence
  Description of Artificial Sequence: Synthetic polypeptide
MEEEIRTTNPVATEGYGSVVYDNGIQGGQGEETEQN

SEQ ID NO: 173982 - protein, 34 aa, Artificial Sequence
  Description of Artificial Sequence: Synthetic polypeptide
DENCIATVNPVATECYGSVVCIDHQDQHHQGNER

SEQ ID NO: 173983 - protein, 35 aa, Artificial Sequence
  Description of Artificial Sequence: Synthetic polypeptide
MEEEIRTTNPVATEGYGMVVDDNENMVGEGNEEFG

SEQ ID NO: 173984 - protein, 38 aa, Artificial Sequence
  Description of Artificial Sequence: Synthetic polypeptide
DEEEIRTTNPVATEQYGVVSVTVVSNNNNTEQGTEEQD

SEQ ID NO: 173985 - protein, 36 aa, Artificial Sequence
  Description of Artificial Sequence: Synthetic polypeptide
QEEEIRSTNPVATEQYGSVVQNNIDDEEQGNETEND

SEQ ID NO: 173986 - protein, 37 aa, Artificial Sequence
  Description of Artificial Sequence: Synthetic polypeptide
QEEEIRSTNPVATEQYGSVVYDNNNNNFQGEDGNDDD

SEQ ID NO: 173987 - protein, 36 aa, Artificial Sequence
  Description of Artificial Sequence: Synthetic polypeptide
MEEEIRTTNPVATEGYGMVNGQGTFGQEGGGGQNTG

SEQ ID NO: 173988 - protein, 31 aa, Artificial Sequence
  Description of Artificial Sequence: Synthetic polypeptide
MENMIACTNPVATEIYGEASAEVLTRGDGQQ

SEQ ID NO: 173989 - protein, 37 aa, Artificial Sequence
  Description of Artificial Sequence: Synthetic polypeptide
DEEEIRTTNPVATEQYGSIASSYESQTGDISEESEQH

SEQ ID NO: 173990 - protein, 32 aa, Artificial Sequence
  Description of Artificial Sequence: Synthetic polypeptide
DENEIHTTNPVSTEPYGTIHMEDIQQWQNGNH

SEQ ID NO: 173991 - protein, 36 aa, Artificial Sequence
  Description of Artificial Sequence: Synthetic polypeptide
MEEEIRTTNPVATEGYGCTGSIMNDGGQQRGDSGEG

SEQ ID NO: 173992 - protein, 36 aa, Artificial Sequence
  Description of Artificial Sequence: Synthetic polypeptide
DEEEIATTNPVATEQWGHCNVAATANGLDAAAPGGF

SEQ ID NO: 173993 - protein, 33 aa, Artificial Sequence
  Description of Artificial Sequence: Synthetic polypeptide
DEHEIRTTNPVAYESWGVVSGGNHGNTQGDEGM

SEQ ID NO: 173994 - protein, 37 aa, Artificial Sequence
  Description of Artificial Sequence: Synthetic polypeptide
QEEEIRSTNPVATEQYGSVYDDNNINFQNGEDGNDDG

SEQ ID NO: 173995 - protein, 35 aa, Artificial Sequence
  Description of Artificial Sequence: Synthetic polypeptide
MEPEICTTNCVGTEQYGSVSTGNNGQLGEGGQSGG

SEQ ID NO: 173996 - protein, 36 aa, Artificial Sequence
  Description of Artificial Sequence: Synthetic polypeptide
NEDEIATTNPVATEQYGSVCFTENQQQNDQGQQGGQ

SEQ ID NO: 173997 - protein, 33 aa, Artificial Sequence
  Description of Artificial Sequence: Synthetic polypeptide
DENEIATTNPVATASWGCVAINNNLQDAGAGHH

SEQ ID NO: 173998 - protein, 36 aa, Artificial Sequence
  Description of Artificial Sequence: Synthetic polypeptide
MEEEIRTTNPVATEFYGVVVEGNGNATNDDDGGNQG

SEQ ID NO: 173999 - protein, 32 aa, Artificial Sequence
  Description of Artificial Sequence: Synthetic polypeptide
DENEIATTNPVATASWGCVAGNNNDQDAGGGH

SEQ ID NO: 174000 - protein, 34 aa, Artificial Sequence
  Description of Artificial Sequence: Synthetic polypeptide
DEHEIRTTNPVAYESWGVVSGGGNHGNTQGDNGQ

SEQ ID NO: 174001 - protein, 33 aa, Artificial Sequence
  Description of Artificial Sequence: Synthetic polypeptide
DENEIATTNPVATASWGCVAGNNALQEDAGGGH

SEQ ID NO: 174002 - protein, 38 aa, Artificial Sequence
  Description of Artificial Sequence: Synthetic polypeptide
DEEEIRTTNPVATEQYGVVSVVVVTTNVATEQGSTTTE

SEQ ID NO: 174003 - protein, 36 aa, Artificial Sequence
  Description of Artificial Sequence: Synthetic polypeptide
MEEEIRTTNPVATEFYGVVVDQGGNATNDDNGGNQG

SEQ ID NO: 174004 - protein, 35 aa, Artificial Sequence
  Description of Artificial Sequence: Synthetic polypeptide
DEMEIGTTNPVATEQYGCVCTATDVTVEFEGENKA

SEQ ID NO: 174005 - protein, 34 aa, Artificial Sequence
  Description of Artificial Sequence: Synthetic polypeptide
MENEIRTTNPVSTEPYGTITSMSDGQVQGNGNNH

SEQ ID NO: 174006 - protein, 39 aa, Artificial Sequence
  Description of Artificial Sequence: Synthetic polypeptide
DEEEIRTTNPVATEQYGVVSTVVTVTNNQQGTEEEEEDE

SEQ ID NO: 174007 - protein, 35 aa, Artificial Sequence
  Description of Artificial Sequence: Synthetic polypeptide
MEEEIRTTNPVATEGYGMVVEDNENMVGGGNEENG

SEQ ID NO: 174008 - protein, 38 aa, Artificial Sequence
  Description of Artificial Sequence: Synthetic polypeptide
MEEEIRTTNPVATEGYGMVVNNSGMGNNLQENNGGNQD

SEQ ID NO: 174009 - protein, 39 aa, Artificial Sequence
  Description of Artificial Sequence: Synthetic polypeptide
DEEEIRTTNPVATEQYGVVSVTVVTNGNNNNQQGTDEED

SEQ ID NO: 174010 - protein, 36 aa, Artificial Sequence
  Description of Artificial Sequence: Synthetic polypeptide
DEEEIACTNPVATEQWGCNVANMTNLNPDDGMGDRA

SEQ ID NO: 174011 - protein, 36 aa, Artificial Sequence
  Description of Artificial Sequence: Synthetic polypeptide
MEEEIRTTNPVATEGYGSVVGDNIIQGGQGEEDEQD

SEQ ID NO: 174012 - protein, 30 aa, Artificial Sequence
  Description of Artificial Sequence: Synthetic polypeptide
QENEIATTNPVATECYGAVAAECWAEHEPL

SEQ ID NO: 174013 - protein, 36 aa, Artificial Sequence
  Description of Artificial Sequence: Synthetic polypeptide
QEEEIRSTNPVATEQYGSVVQNIDDEEQGNEDEEMD

SEQ ID NO: 174014 - protein, 36 aa, Artificial Sequence
  Description of Artificial Sequence: Synthetic polypeptide
DEEEIACTNPVATEQYGSVCAMNNGVLPEDLENANQ

SEQ ID NO: 174015 - protein, 32 aa, Artificial Sequence
  Description of Artificial Sequence: Synthetic polypeptide
QENEIATTNPVATECYGATTANEECWQHGEYL

SEQ ID NO: 174016 - protein, 31 aa, Artificial Sequence
  Description of Artificial Sequence: Synthetic polypeptide
QENEIATTNPVATECYGATTAEECWQHGEYL

SEQ ID NO: 174017 - protein, 35 aa, Artificial Sequence
  Description of Artificial Sequence: Synthetic polypeptide
DENEIATTNPVATESYGSVCAAANNLPLDSGEGEN

SEQ ID NO: 174018 - protein, 35 aa, Artificial Sequence
  Description of Artificial Sequence: Synthetic polypeptide
DEEEIACTNPVATEQYGSICAMTHDPTDSEENARQ

SEQ ID NO: 174019 - protein, 31 aa, Artificial Sequence
  Description of Artificial Sequence: Synthetic polypeptide
DEGEIRPTNPISTECWGATVWAANLAESGTI

SEQ ID NO: 174020 - protein, 37 aa, Artificial Sequence
  Description of Artificial Sequence: Synthetic polypeptide
QEEEIRSTNPVATEQYGSVVQNIQDEEQGNEGGEEND

SEQ ID NO: 174021 - protein, 39 aa, Artificial Sequence
  Description of Artificial Sequence: Synthetic polypeptide
DEEEIRTTNPVATEQYGVVSTVVTTNNQNQGTEDEEEET

SEQ ID NO: 174022 - protein, 36 aa, Artificial Sequence
  Description of Artificial Sequence: Synthetic polypeptide
DEAEIATTNPVAYEQYGSVVAAVAGELQDSLGLNDS

SEQ ID NO: 174023 - protein, 39 aa, Artificial Sequence
  Description of Artificial Sequence: Synthetic polypeptide
DEEEIRTTNPVATEQYGVVSTVVVTQAGNNDTEEQENET

SEQ ID NO: 174024 - protein, 36 aa, Artificial Sequence
  Description of Artificial Sequence: Synthetic polypeptide
DEEEIATTNPVAYEQYGSVATTGHGPLDSMENTNME

SEQ ID NO: 174025 - protein, 35 aa, Artificial Sequence
  Description of Artificial Sequence: Synthetic polypeptide
NEDEIATTNPVAYEQWGEVCSTENMDLGDTQNGGA

SEQ ID NO: 174026 - protein, 31 aa, Artificial Sequence
  Description of Artificial Sequence: Synthetic polypeptide
QENEIATTNPVAYEPWGKVSEHLSQHETELG

SEQ ID NO: 174027 - protein, 37 aa, Artificial Sequence
  Description of Artificial Sequence: Synthetic polypeptide
MEEEIRTTNPVATEGYGSVNSTTPTGPEMGQGENEEN

SEQ ID NO: 174028 - protein, 37 aa, Artificial Sequence
  Description of Artificial Sequence: Synthetic polypeptide
DEEEIRTTNPVATEQYGSVNCPELNQAAEPSVMAIFT

SEQ ID NO: 174029 - protein, 34 aa, Artificial Sequence
  Description of Artificial Sequence: Synthetic polypeptide
DEEEICTTNPVAYECWGSVATTGGNTGADGQTTD

SEQ ID NO: 174030 - protein, 35 aa, Artificial Sequence
  Description of Artificial Sequence: Synthetic polypeptide
MEEEIRTTNPVATEGYGSVMGIGNDNMNGEEFGQT

SEQ ID NO: 174031 - protein, 36 aa, Artificial Sequence
  Description of Artificial Sequence: Synthetic polypeptide
MEEEIRTTNPVATEGYGSVMEMNQQNEQDNEGEFGT

SEQ ID NO: 174032 - protein, 36 aa, Artificial Sequence
  Description of Artificial Sequence: Synthetic polypeptide
DEEEIATTNPVAYEQYGSVATTGHGPLDSMENGDAF

SEQ ID NO: 174033 - protein, 37 aa, Artificial Sequence
  Description of Artificial Sequence: Synthetic polypeptide
DEEEIACTNPVATEQYGSVSSTGEPGINPDDGMEKAN

SEQ ID NO: 174034 - protein, 38 aa, Artificial Sequence
  Description of Artificial Sequence: Synthetic polypeptide
MEEEIRTTNPVATEQYGSVDSTGPTGGPEMGQGENEQN

SEQ ID NO: 174035 - protein, 34 aa, Artificial Sequence
  Description of Artificial Sequence: Synthetic polypeptide
DEHEIRTTNPVAYECWGTVYQINENQDRDMHNNG

SEQ ID NO: 174036 - protein, 36 aa, Artificial Sequence
  Description of Artificial Sequence: Synthetic polypeptide
QEEEIATTNPVAYEQYGSACSAANGLQDSKDGDKHY

SEQ ID NO: 174037 - protein, 33 aa, Artificial Sequence
  Description of Artificial Sequence: Synthetic polypeptide
DENEIATTNPVSTEPYGTISMEDIGQQQQNGNH

SEQ ID NO: 174038 - protein, 33 aa, Artificial Sequence
  Description of Artificial Sequence: Synthetic polypeptide
DDECISTTNPVATEQYGCVCSWEHNQNFISDQA

SEQ ID NO: 174039 - protein, 38 aa, Artificial Sequence
  Description of Artificial Sequence: Synthetic polypeptide
DCEEIRGTNPVATEQYGSSISLTPALNAQQEISPNGNG

SEQ ID NO: 174040 - protein, 34 aa, Artificial Sequence
  Description of Artificial Sequence: Synthetic polypeptide
DEAEIATTNPVAYEQWGVVASGPNGNQGAMNGMD

SEQ ID NO: 174041 - protein, 37 aa, Artificial Sequence
  Description of Artificial Sequence: Synthetic polypeptide
DENAEICTTNPVAYECWGSVATGNGPLQDDRQQNGND

SEQ ID NO: 174042 - protein, 37 aa, Artificial Sequence
  Description of Artificial Sequence: Synthetic polypeptide
QEQEIRTTNPVATESYGSVVTTDGMNNQTGENEQGET

SEQ ID NO: 174043 - protein, 37 aa, Artificial Sequence
  Description of Artificial Sequence: Synthetic polypeptide
DAEEIATTNPVAYEQYGSVCSAANALPEEAGDGNENQ

SEQ ID NO: 174044 - protein, 36 aa, Artificial Sequence
  Description of Artificial Sequence: Synthetic polypeptide
QEQEIRTTNPVATEQYGSVVITDGMNNETGEDEGTE

SEQ ID NO: 174045 - protein, 36 aa, Artificial Sequence
  Description of Artificial Sequence: Synthetic polypeptide
DEMEIRTTNPVATEQYGSISWSASTEQAETDDEGKH

SEQ ID NO: 174046 - protein, 37 aa, Artificial Sequence
  Description of Artificial Sequence: Synthetic polypeptide
DENAEICTTNPVAYECWGSVATGNGLIQDDRGQNGTP

SEQ ID NO: 174047 - protein, 33 aa, Artificial Sequence
  Description of Artificial Sequence: Synthetic polypeptide
DEHEIRTTNPVAYEAWGVVTGGNANEDLGGNDQ

SEQ ID NO: 174048 - protein, 36 aa, Artificial Sequence
  Description of Artificial Sequence: Synthetic polypeptide
DEEEIACTNPVATEQYGSACAAANPQTEHQDGNQHQ

SEQ ID NO: 174049 - protein, 36 aa, Artificial Sequence
  Description of Artificial Sequence: Synthetic polypeptide
DEEEIACTNPVATEQYGSACAAANPLAEAEMGNGMG

SEQ ID NO: 174050 - protein, 36 aa, Artificial Sequence
  Description of Artificial Sequence: Synthetic polypeptide
DEMEIATTNPVATEQYGCVCSNTELNEEHFNSEDQA

SEQ ID NO: 174051 - protein, 38 aa, Artificial Sequence
  Description of Artificial Sequence: Synthetic polypeptide
MEEEIRTTNPVATEQYGSVVQSVVNGFGQENDQDEGGG

SEQ ID NO: 174052 - protein, 37 aa, Artificial Sequence
  Description of Artificial Sequence: Synthetic polypeptide
DEEEIGTTNPVATEQYGQCVCSWGEDLNQENFGSDLS

SEQ ID NO: 174053 - protein, 36 aa, Artificial Sequence
  Description of Artificial Sequence: Synthetic polypeptide
DEEEIGTTNPVATEQYGQCVCSWGEHNQNFGSETQA

SEQ ID NO: 174054 - protein, 37 aa, Artificial Sequence
  Description of Artificial Sequence: Synthetic polypeptide
DEMEIRTTNPVATEQYGSIVLSTEQEDGFESLGIDEP

SEQ ID NO: 174055 - protein, 37 aa, Artificial Sequence
  Description of Artificial Sequence: Synthetic polypeptide
DEEEIRTTNPVATEQYGSVGQVAIEEQIENTEEANAM

SEQ ID NO: 174056 - protein, 30 aa, Artificial Sequence
  Description of Artificial Sequence: Synthetic polypeptide
QEGEIAPTNPVSTEQWGIVSEIEQNAAEDA

SEQ ID NO: 174057 - protein, 36 aa, Artificial Sequence
  Description of Artificial Sequence: Synthetic polypeptide
DEMEIATTNPVATEQYGCVCSNTENNEEHFGSEDLA

SEQ ID NO: 174058 - protein, 39 aa, Artificial Sequence
  Description of Artificial Sequence: Synthetic polypeptide
DEEEIRTTNPVATEQYGVVSTVVSVGTQAGTTEAGNTVN

SEQ ID NO: 174059 - protein, 36 aa, Artificial Sequence
  Description of Artificial Sequence: Synthetic polypeptide
DCEEIRGTNPVATEQYGSCSLDPNQAAQEISPNSNG

SEQ ID NO: 174060 - protein, 37 aa, Artificial Sequence
  Description of Artificial Sequence: Synthetic polypeptide
DEEEIRTTNPVATEQYGSSGYYLMNGEEVMIMNAEEL

SEQ ID NO: 174061 - protein, 32 aa, Artificial Sequence
  Description of Artificial Sequence: Synthetic polypeptide
QEEEIATTNPVAYEQYGQETAPEVQSQHEGEK

SEQ ID NO: 174062 - protein, 33 aa, Artificial Sequence
  Description of Artificial Sequence: Synthetic polypeptide
DENEIATTNPVSTEPYGTISAMEDIQQQRVGQH

SEQ ID NO: 174063 - protein, 39 aa, Artificial Sequence
  Description of Artificial Sequence: Synthetic polypeptide
DEEEIRTTNPVATEQYGVVSTVVVTNTNQQQGTEDEEQD

SEQ ID NO: 174064 - protein, 35 aa, Artificial Sequence
  Description of Artificial Sequence: Synthetic polypeptide
DEMEICTTNPVATEQYGAVCTATDGVDVEPFEGNE

SEQ ID NO: 174065 - protein, 33 aa, Artificial Sequence
  Description of Artificial Sequence: Synthetic polypeptide
DEMEIRTTNPVATECWGTVWANADGWEEPKGPI

SEQ ID NO: 174066 - protein, 39 aa, Artificial Sequence
  Description of Artificial Sequence: Synthetic polypeptide
DEEEIRTTNPVATEQYGVVSTTNQQQQQGTTEQGSTQTE

SEQ ID NO: 174067 - protein, 33 aa, Artificial Sequence
  Description of Artificial Sequence: Synthetic polypeptide
DENEIATTNPVSTEPYGTISAMEDIQQSRVGQH

SEQ ID NO: 174068 - protein, 39 aa, Artificial Sequence
  Description of Artificial Sequence: Synthetic polypeptide
DEEEIRTTNPVATEQYGSTVNTDLVNYEEQAIIMPTQNY

SEQ ID NO: 174069 - protein, 39 aa, Artificial Sequence
  Description of Artificial Sequence: Synthetic polypeptide
DEEEIRTTNPVATEQYGSTVNTQLVNYEEQIIFTPTQNS

SEQ ID NO: 174070 - protein, 38 aa, Artificial Sequence
  Description of Artificial Sequence: Synthetic polypeptide
QEEEIRTTNPVATEQYGSVVVPTTLEGPEMGQGENEEN

SEQ ID NO: 174071 - protein, 34 aa, Artificial Sequence
  Description of Artificial Sequence: Synthetic polypeptide
DEEEIATTNPVATEQWGCNTAGTGDGDPGDINED

SEQ ID NO: 174072 - protein, 32 aa, Artificial Sequence
  Description of Artificial Sequence: Synthetic polypeptide
DENEIATTNPVSTEPYGTISEEDIQQQQNENH

SEQ ID NO: 174073 - protein, 35 aa, Artificial Sequence
  Description of Artificial Sequence: Synthetic polypeptide
DEEEIRTTNPVATEQYGSIENAPAGEIQQALMDPT

SEQ ID NO: 174074 - protein, 34 aa, Artificial Sequence
  Description of Artificial Sequence: Synthetic polypeptide
DENAEIATTNPVAYERWGVVSGGDLQDANGGNTD

SEQ ID NO: 174075 - protein, 37 aa, Artificial Sequence
  Description of Artificial Sequence: Synthetic polypeptide
DEEEIATTNPVAYEQYGSVSSTGEPGINPRDGMEKVH

SEQ ID NO: 174076 - protein, 37 aa, Artificial Sequence
  Description of Artificial Sequence: Synthetic polypeptide
MEEEIRTTNPVATEQYGSYSSPITAEPNSRVGHPPVF

SEQ ID NO: 174077 - protein, 37 aa, Artificial Sequence
  Description of Artificial Sequence: Synthetic polypeptide
DEEEIATTNPVATEQYGSVCAAMMHGGEQNEMGNSLH

SEQ ID NO: 174078 - protein, 37 aa, Artificial Sequence
  Description of Artificial Sequence: Synthetic polypeptide
MEEEIRTTNPVATEQYGSYGVDGEGEMDDQGGGNQGQ

SEQ ID NO: 174079 - protein, 36 aa, Artificial Sequence
  Description of Artificial Sequence: Synthetic polypeptide
DEAEIATTNPVAYEQWGVASTGGNDTEQRGGGGGDR

SEQ ID NO: 174080 - protein, 34 aa, Artificial Sequence
  Description of Artificial Sequence: Synthetic polypeptide
NEECEIATTNPVATEHWGSVCYNNDDQDHNDQDQ

SEQ ID NO: 174081 - protein, 33 aa, Artificial Sequence
  Description of Artificial Sequence: Synthetic polypeptide
DEAEIATTNPVAYEQWGVVAGPNGNQGQMNGGD

SEQ ID NO: 174082 - protein, 39 aa, Artificial Sequence
  Description of Artificial Sequence: Synthetic polypeptide
DEEEIRTTNPVATEQYGSTVNTQLVNYEEQPSINPTQNS

SEQ ID NO: 174083 - protein, 35 aa, Artificial Sequence
  Description of Artificial Sequence: Synthetic polypeptide
DEHEIRTTNPVATEFYGKTITTNEFSGDSEGGSNQ

SEQ ID NO: 174084 - protein, 39 aa, Artificial Sequence
  Description of Artificial Sequence: Synthetic polypeptide
DEEEIRATNPVATEAYGVVSTVTTNLQQGDEQIGTTNVD

SEQ ID NO: 174085 - protein, 37 aa, Artificial Sequence
  Description of Artificial Sequence: Synthetic polypeptide
MEEEIRTTNPVATEQYGSVVMDNGFNNGNGQDDDFNA

SEQ ID NO: 174086 - protein, 33 aa, Artificial Sequence
  Description of Artificial Sequence: Synthetic polypeptide
DENEIATTNPVSTEPYGTISAMEDIQQQRNGQH

SEQ ID NO: 174087 - protein, 37 aa, Artificial Sequence
  Description of Artificial Sequence: Synthetic polypeptide
DEMEIRTTNPVATEQYGSIVNYTENYEDVNNQMEIIA

SEQ ID NO: 174088 - protein, 36 aa, Artificial Sequence
  Description of Artificial Sequence: Synthetic polypeptide
NNEEIRTTNPVATEQYGVAVGWVPQNLQQDGGPEMI

SEQ ID NO: 174089 - protein, 37 aa, Artificial Sequence
  Description of Artificial Sequence: Synthetic polypeptide
DEEEIRTTNPVATEQYGSYWNYATDILEQVNDQTDVL

SEQ ID NO: 174090 - protein, 36 aa, Artificial Sequence
  Description of Artificial Sequence: Synthetic polypeptide
DEMEIRTTNPVATEQYGSMCVFANMENEMNTQDEEG

SEQ ID NO: 174091 - protein, 37 aa, Artificial Sequence
  Description of Artificial Sequence: Synthetic polypeptide
DEEEIRTTNPVATEQYGSYWNYATNIDQVASDQTQVL

SEQ ID NO: 174092 - protein, 35 aa, Artificial Sequence
  Description of Artificial Sequence: Synthetic polypeptide
DDEEIRTTNPVATEGYGCVCSNWEEHQENFGSDQS

SEQ ID NO: 174093 - protein, 33 aa, Artificial Sequence
  Description of Artificial Sequence: Synthetic polypeptide
QAEEIATTNPVGTEQWGGCSAGNGLAMNPGDWR

SEQ ID NO: 174094 - protein, 35 aa, Artificial Sequence
  Description of Artificial Sequence: Synthetic polypeptide
DEEEIAATNPVATEQYGSVCAANMGEEAGMMDEHG

SEQ ID NO: 174095 - protein, 38 aa, Artificial Sequence
  Description of Artificial Sequence: Synthetic polypeptide
QEEEICTTNPVATEQYGSVSGNTDENGGEGNEDQDEDQ

SEQ ID NO: 174096 - protein, 39 aa, Artificial Sequence
  Description of Artificial Sequence: Synthetic polypeptide
QEEEIRTTNPVATEQYGSVVNSTTDEQGPEMGQGENEEG

SEQ ID NO: 174097 - protein, 37 aa, Artificial Sequence
  Description of Artificial Sequence: Synthetic polypeptide
DEMEIRTTNPVATEQYGSNWWVAEDHETQPNTGEDRF

SEQ ID NO: 174098 - protein, 38 aa, Artificial Sequence
  Description of Artificial Sequence: Synthetic polypeptide
DEEEIRTTNPVATEQYGSQVVSYFGISESGGSNTHDED

SEQ ID NO: 174099 - protein, 38 aa, Artificial Sequence
  Description of Artificial Sequence: Synthetic polypeptide
DEEEIRTTNPVATEQYGSQYVSHEHQPDDDSNEYQEEL

SEQ ID NO: 174100 - protein, 38 aa, Artificial Sequence
  Description of Artificial Sequence: Synthetic polypeptide
QEEEIRTTNPVATEQYGSVVNSQTPQGPEMGQGENEDG

SEQ ID NO: 174101 - protein, 36 aa, Artificial Sequence
  Description of Artificial Sequence: Synthetic polypeptide
DEEEIRATNPVATDQYGVVNDNSIGQNGGQEDNQDG

SEQ ID NO: 174102 - protein, 32 aa, Artificial Sequence
  Description of Artificial Sequence: Synthetic polypeptide
DENEIATTNPVSTEPYGTITMEDIQQQQNGNH

SEQ ID NO: 174103 - protein, 38 aa, Artificial Sequence
  Description of Artificial Sequence: Synthetic polypeptide
DEIEIRTTNPVATEQYGSVCCPSIASEVEPNDLALFNQ

SEQ ID NO: 174104 - protein, 39 aa, Artificial Sequence
  Description of Artificial Sequence: Synthetic polypeptide
AEEEIRTTNPVATEQYGSVVVVVNNNNLEQGSEGGNTEE

SEQ ID NO: 174105 - protein, 32 aa, Artificial Sequence
  Description of Artificial Sequence: Synthetic polypeptide
DENEIATTNPVSTEPYGTMSSEDIQQQHNGDH

SEQ ID NO: 174106 - protein, 33 aa, Artificial Sequence
  Description of Artificial Sequence: Synthetic polypeptide
DENEIATTNPVSTEPYGTTSAGEWGQQQQNGNH

SEQ ID NO: 174107 - protein, 39 aa, Artificial Sequence
  Description of Artificial Sequence: Synthetic polypeptide
AEEEIRTTNPVATEQYGSVVVVTVTNQLNGTEQGSTDNQ

SEQ ID NO: 174108 - protein, 33 aa, Artificial Sequence
  Description of Artificial Sequence: Synthetic polypeptide
DENEIATTNPVSTEPYGTTSAMEWQQQQNNGNH

SEQ ID NO: 174109 - protein, 38 aa, Artificial Sequence
  Description of Artificial Sequence: Synthetic polypeptide
DEEEIRTTNPVATEQYGSVGQSEMSNETHPEPGQVEYP

SEQ ID NO: 174110 - protein, 38 aa, Artificial Sequence
  Description of Artificial Sequence: Synthetic polypeptide
QEEEIRTTNPVATEQYGSVVNSQTPEGPEMGQGENEEE

SEQ ID NO: 174111 - protein, 35 aa, Artificial Sequence
  Description of Artificial Sequence: Synthetic polypeptide
DAECIATTNPVATEPWGTVVSEDNALSATTGGNNR

SEQ ID NO: 174112 - protein, 39 aa, Artificial Sequence
  Description of Artificial Sequence: Synthetic polypeptide
AEEEIRTTNPVATEQYGSVVVVVNTNNAEQGSEGGNTGD

SEQ ID NO: 174113 - protein, 39 aa, Artificial Sequence
  Description of Artificial Sequence: Synthetic polypeptide
AEEEIRTTNPVATEQYGSVVVVVNTNNTEQGSEGGNTQL

SEQ ID NO: 174114 - protein, 35 aa, Artificial Sequence
  Description of Artificial Sequence: Synthetic polypeptide
DEHEIATTNPVAYEQWGSVSSLANNDNHDGGGQRR

SEQ ID NO: 174115 - protein, 36 aa, Artificial Sequence
  Description of Artificial Sequence: Synthetic polypeptide
QAEEIATTNPVAYEQYGSVPAIANNLQEQGNGMDQN

SEQ ID NO: 174116 - protein, 38 aa, Artificial Sequence
  Description of Artificial Sequence: Synthetic polypeptide
MEEEIRTTNPVATEQYGSVVIDGTGNLVTNEGGGQTTI

SEQ ID NO: 174117 - protein, 37 aa, Artificial Sequence
  Description of Artificial Sequence: Synthetic polypeptide
QEQEICTTNPVATEQYGSVNNTGNDNGLGQQEGEGEQ

SEQ ID NO: 174118 - protein, 38 aa, Artificial Sequence
  Description of Artificial Sequence: Synthetic polypeptide
DEAEIRATNPVATEQYGSVCYSDWNLLQDENQSDTQQK

SEQ ID NO: 174119 - protein, 37 aa, Artificial Sequence
  Description of Artificial Sequence: Synthetic polypeptide
DEEEIRTTNPVATEQYGSRYYPELDLDQMRNMEQEEN

SEQ ID NO: 174120 - protein, 36 aa, Artificial Sequence
  Description of Artificial Sequence: Synthetic polypeptide
DEHEIRTTNPVATESYGKTIFTNEFSGLSEEGSNQH

SEQ ID NO: 174121 - protein, 38 aa, Artificial Sequence
  Description of Artificial Sequence: Synthetic polypeptide
DEEEIRTTNPVATEQYGSVGYYLVNGEEQMIMNEEQEL

SEQ ID NO: 174122 - protein, 39 aa, Artificial Sequence
  Description of Artificial Sequence: Synthetic polypeptide
DEEEIRATNPVATEAYGVVSTVTANLQQGTEQGGTNNQD

SEQ ID NO: 174123 - protein, 37 aa, Artificial Sequence
  Description of Artificial Sequence: Synthetic polypeptide
DEAEIRATNPVATEQYGSVCYSDWNNLQDEDQSDTQV

SEQ ID NO: 174124 - protein, 36 aa, Artificial Sequence
  Description of Artificial Sequence: Synthetic polypeptide
DEAEICTTNPVAYECWGSVATGNGPLNDDRGQNGKD

SEQ ID NO: 174125 - protein, 36 aa, Artificial Sequence
  Description of Artificial Sequence: Synthetic polypeptide
DEAEICTTNPVAYECWGSVATGNGPLNDDRGQNDTT

SEQ ID NO: 174126 - protein, 37 aa, Artificial Sequence
  Description of Artificial Sequence: Synthetic polypeptide
QEEEIRTTNPVATEQYGSVVSAIMVGGDTQGNEGGDE

SEQ ID NO: 174127 - protein, 37 aa, Artificial Sequence
  Description of Artificial Sequence: Synthetic polypeptide
QEEEIRTTNPVATEQYGSVVSAIMVGGDIQGNDTGDE

SEQ ID NO: 174128 - protein, 38 aa, Artificial Sequence
  Description of Artificial Sequence: Synthetic polypeptide
QEEEIRTTNPVATEQYGSVVNTTLLEGPEMGQGENEEG

SEQ ID NO: 174129 - protein, 37 aa, Artificial Sequence
  Description of Artificial Sequence: Synthetic polypeptide
DEMEIRTTNPVATEQYGSLIWSPTHPLNDLEINDEQE

SEQ ID NO: 174130 - protein, 37 aa, Artificial Sequence
  Description of Artificial Sequence: Synthetic polypeptide
DEGEIATTNPVATEQYGSVCAMTNNEPTGGDLEEGAM

SEQ ID NO: 174131 - protein, 39 aa, Artificial Sequence
  Description of Artificial Sequence: Synthetic polypeptide
AEEEIRTTNPVATEQYGSVVVVVNTNVTEQGSEGGNNLE

SEQ ID NO: 174132 - protein, 37 aa, Artificial Sequence
  Description of Artificial Sequence: Synthetic polypeptide
DEEEIRTTNPVATEQYGSVGYYLMQGEEQPIMFAEEL

SEQ ID NO: 174133 - protein, 38 aa, Artificial Sequence
  Description of Artificial Sequence: Synthetic polypeptide
AEEEIRTTNPVATEQYGSVVVVVNTNTEQGSEGGTTLL

SEQ ID NO: 174134 - protein, 36 aa, Artificial Sequence
  Description of Artificial Sequence: Synthetic polypeptide
DEEEIRATNPVATDQYGVVNDNSIGQNGGQEDNTVD

SEQ ID NO: 174135 - protein, 34 aa, Artificial Sequence
  Description of Artificial Sequence: Synthetic polypeptide
DEHEIRTTNPVAYEAWGVVTGGNANEDLGGGNHT

SEQ ID NO: 174136 - protein, 37 aa, Artificial Sequence
  Description of Artificial Sequence: Synthetic polypeptide
DCEEIRGTNPVATEQYGSSSLTPALDAQQEISPESNI

SEQ ID NO: 174137 - protein, 35 aa, Artificial Sequence
  Description of Artificial Sequence: Synthetic polypeptide
DDECIRTTNPVATEQYGCVCSWEEHNQEYFNSDQS

SEQ ID NO: 174138 - protein, 37 aa, Artificial Sequence
  Description of Artificial Sequence: Synthetic polypeptide
MEEEIRTTNPVATEQYGSVVLGIADMTHEEPEQEGTP

SEQ ID NO: 174139 - protein, 34 aa, Artificial Sequence
  Description of Artificial Sequence: Synthetic polypeptide
DENAEIATTNPVAYERWGSVTGGNLQDPSGGGQS

SEQ ID NO: 174140 - protein, 32 aa, Artificial Sequence
  Description of Artificial Sequence: Synthetic polypeptide
DENEIATTNPVSTEPYGTIPMEDIQQQQNGNH

SEQ ID NO: 174141 - protein, 34 aa, Artificial Sequence
  Description of Artificial Sequence: Synthetic polypeptide
DENAEIATTNPVAYERWGSVSGGDLQDTQGGQTS

SEQ ID NO: 174142 - protein, 30 aa, Artificial Sequence
  Description of Artificial Sequence: Synthetic polypeptide
DEEEIATTNPIATECWGETPAVCQEPEEYK

SEQ ID NO: 174143 - protein, 32 aa, Artificial Sequence
  Description of Artificial Sequence: Synthetic polypeptide
DENEIATTNPVSTEPYGEIPEEDIQQQHNGNH

SEQ ID NO: 174144 - protein, 36 aa, Artificial Sequence
  Description of Artificial Sequence: Synthetic polypeptide
DEMEIATTNPVAYEQYGTVATENGGNQQNGGQRGGA

SEQ ID NO: 174145 - protein, 35 aa, Artificial Sequence
  Description of Artificial Sequence: Synthetic polypeptide
DEMEIRTTNPVATECYGTTTCSATEGWVEPKGNYI

SEQ ID NO: 174146 - protein, 35 aa, Artificial Sequence
  Description of Artificial Sequence: Synthetic polypeptide
DEAEICTTNPVAYEQWGCVYNSPDNHQGQQGMNGS

SEQ ID NO: 174147 - protein, 35 aa, Artificial Sequence
  Description of Artificial Sequence: Synthetic polypeptide
DEMEICTTNPVATEQYGAVCSATDGVTVEFEGAID

SEQ ID NO: 174148 - protein, 32 aa, Artificial Sequence
  Description of Artificial Sequence: Synthetic polypeptide
DENEIATTNPVSTEPYGETSGEGGPQQQNGDH

SEQ ID NO: 174149 - protein, 31 aa, Artificial Sequence
  Description of Artificial Sequence: Synthetic polypeptide
QESEIASTNPVATEGYGTMCAASDTLEFGDD

SEQ ID NO: 174150 - protein, 33 aa, Artificial Sequence
  Description of Artificial Sequence: Synthetic polypeptide
DEAEICTTNPVAYEQWGCVCMNNDLMDIGGGLP

SEQ ID NO: 174151 - protein, 36 aa, Artificial Sequence
  Description of Artificial Sequence: Synthetic polypeptide
DEEEIACTNPVATEQYGSACATNPQEADAHLDGMAM

SEQ ID NO: 174152 - protein, 32 aa, Artificial Sequence
  Description of Artificial Sequence: Synthetic polypeptide
CESEIATTNPVAYEWYGKVSCIGHLSQHETEG

SEQ ID NO: 174153 - protein, 32 aa, Artificial Sequence
  Description of Artificial Sequence: Synthetic polypeptide
CENEIATTNPVAYEPYGKVFINGALSQHETEG

SEQ ID NO: 174154 - protein, 37 aa, Artificial Sequence
  Description of Artificial Sequence: Synthetic polypeptide
DEEEIRTTNPVATEQYGSTTTYQNVHYAEMREVQQLL

SEQ ID NO: 174155 - protein, 36 aa, Artificial Sequence
  Description of Artificial Sequence: Synthetic polypeptide
DEEEIACTNPVATEQYGSACATNPQENTADPIEGVN

SEQ ID NO: 174156 - protein, 31 aa, Artificial Sequence
  Description of Artificial Sequence: Synthetic polypeptide
DEEEIATTNPVATEQWGAAANAEDCAEHEEK

SEQ ID NO: 174157 - protein, 35 aa, Artificial Sequence
  Description of Artificial Sequence: Synthetic polypeptide
DEHEIATTNPVATEQYGCVYVWEMNDIQQTQPNHV

SEQ ID NO: 174158 - protein, 39 aa, Artificial Sequence
  Description of Artificial Sequence: Synthetic polypeptide
DEEEIRTTNPVATEQYGVVSVVTNNNQQSATEEGTTEQQ

SEQ ID NO: 174159 - protein, 35 aa, Artificial Sequence
  Description of Artificial Sequence: Synthetic polypeptide
DEEEIATTNPVATEQYGSACAAANPLAAAPIDQHQ

SEQ ID NO: 174160 - protein, 31 aa, Artificial Sequence
  Description of Artificial Sequence: Synthetic polypeptide
DEEEIATTNPVATEQWGAAPNAEDCAEHEEK

SEQ ID NO: 174161 - protein, 36 aa, Artificial Sequence
  Description of Artificial Sequence: Synthetic polypeptide
DEIEIGTTNPVATEFYGSVSVTGDTGEDQEGQEDGD

SEQ ID NO: 174162 - protein, 36 aa, Artificial Sequence
  Description of Artificial Sequence: Synthetic polypeptide
DAEEIATTNPVAYEQYGSVCSPAPHLNEAPGGEARW

SEQ ID NO: 174163 - protein, 37 aa, Artificial Sequence
  Description of Artificial Sequence: Synthetic polypeptide
DEEEIRTTNPVATEQYGSTVAVAVDEQIENTEEANIM

SEQ ID NO: 174164 - protein, 32 aa, Artificial Sequence
  Description of Artificial Sequence: Synthetic polypeptide
DENEIATTNPVSTEPYGETSGEGGQQQDNGGH

SEQ ID NO: 174165 - protein, 36 aa, Artificial Sequence
  Description of Artificial Sequence: Synthetic polypeptide
DEEEIATTNPVATEQYGSACAANDHLNGAPMGETAN

SEQ ID NO: 174166 - protein, 33 aa, Artificial Sequence
  Description of Artificial Sequence: Synthetic polypeptide
CESEIRATNPVATECWGSWGCINEPEAREGENG

SEQ ID NO: 174167 - protein, 39 aa, Artificial Sequence
  Description of Artificial Sequence: Synthetic polypeptide
DEEEIRTTNPVATEQYGVVSVVVATQQAGNQQIGTEQGS

SEQ ID NO: 174168 - protein, 35 aa, Artificial Sequence
  Description of Artificial Sequence: Synthetic polypeptide
DEAEICTTNPMATETYGSVPCSPDPQHASGENFMG

SEQ ID NO: 174169 - protein, 38 aa, Artificial Sequence
  Description of Artificial Sequence: Synthetic polypeptide
DEEEIRTTNPVATEQYGSVDTVMNGNTGGDEDTEDGQN

SEQ ID NO: 174170 - protein, 34 aa, Artificial Sequence
  Description of Artificial Sequence: Synthetic polypeptide
DEMEIVTTNPVATECYGAVCSATDGPVEFEGPYD

SEQ ID NO: 174171 - protein, 33 aa, Artificial Sequence
  Description of Artificial Sequence: Synthetic polypeptide
DEMEIVTTNPVATECYGATWANTEGWEEPKGNI

SEQ ID NO: 174172 - protein, 36 aa, Artificial Sequence
  Description of Artificial Sequence: Synthetic polypeptide
MEEEISTTNPVATEQYGCVCSSGEHNQENFGSDNQS

SEQ ID NO: 174173 - protein, 33 aa, Artificial Sequence
  Description of Artificial Sequence: Synthetic polypeptide
DEMEIVTTNPVATECYGATWANTEDWEEPKGNI

SEQ ID NO: 174174 - protein, 33 aa, Artificial Sequence
  Description of Artificial Sequence: Synthetic polypeptide
DEMEIVTTNPVATECYGATCANTEGWEEPKGNI

SEQ ID NO: 174175 - protein, 36 aa, Artificial Sequence
  Description of Artificial Sequence: Synthetic polypeptide
DEGEIATTNPVATEQYGSVCSVGHGPLDSMGGDDMH

SEQ ID NO: 174176 - protein, 33 aa, Artificial Sequence
  Description of Artificial Sequence: Synthetic polypeptide
DEMEIVTTNPVATECYGATCANTEGPEEPKGNI

SEQ ID NO: 174177 - protein, 33 aa, Artificial Sequence
  Description of Artificial Sequence: Synthetic polypeptide
DEMEIVTTNPVATECYGATCANTEGPEEPKGND

SEQ ID NO: 174178 - protein, 33 aa, Artificial Sequence
  Description of Artificial Sequence: Synthetic polypeptide
DEMEIVTTNPVATECYGATCANTEGPEEFKGND

SEQ ID NO: 174179 - protein, 39 aa, Artificial Sequence
  Description of Artificial Sequence: Synthetic polypeptide
DEEEIRTTNPVATEQYGVVSVVVATQQQDEQGTNVATNE

SEQ ID NO: 174180 - protein, 37 aa, Artificial Sequence
  Description of Artificial Sequence: Synthetic polypeptide
DDEEIKTTNPVATEQYGSVVSTMDIQNGEGGGFEEGG

SEQ ID NO: 174181 - protein, 37 aa, Artificial Sequence
  Description of Artificial Sequence: Synthetic polypeptide
DEHEIATTNPVATEQYGCVYVWEMNEIQKQQGDNRDV

SEQ ID NO: 174182 - protein, 33 aa, Artificial Sequence
  Description of Artificial Sequence: Synthetic polypeptide
DENEIATTNPVSTEPWGTCSGMEDIQRQQNGNH

SEQ ID NO: 174183 - protein, 36 aa, Artificial Sequence
  Description of Artificial Sequence: Synthetic polypeptide
DEEEIACTNPVATEQYGSACAANNPPQEAAHQGDNQ

SEQ ID NO: 174184 - protein, 32 aa, Artificial Sequence
  Description of Artificial Sequence: Synthetic polypeptide
DENEIATTNPVSTEPWGTISGEWGQQQQNGNH

SEQ ID NO: 174185 - protein, 34 aa, Artificial Sequence
  Description of Artificial Sequence: Synthetic polypeptide
DEMEIVTTNPVATECWGTVCSATIGPVEFEGENG

SEQ ID NO: 174186 - protein, 39 aa, Artificial Sequence
  Description of Artificial Sequence: Synthetic polypeptide
DEEEIRTTNPVATEQYGVVSVVVATQQQAQQGTNVATNT

SEQ ID NO: 174187 - protein, 36 aa, Artificial Sequence
  Description of Artificial Sequence: Synthetic polypeptide
DEEEIACTNPVATEQYGSACATNPLEADDPAEGAEW

SEQ ID NO: 174188 - protein, 37 aa, Artificial Sequence
  Description of Artificial Sequence: Synthetic polypeptide
DEEEIATTNPVAYEQYGSVSSTTPAGPNQRNPMEPVE

SEQ ID NO: 174189 - protein, 32 aa, Artificial Sequence
  Description of Artificial Sequence: Synthetic polypeptide
DENEIATTNPVSTEPYGEAPEEDIQQQHNGNH

SEQ ID NO: 174190 - protein, 37 aa, Artificial Sequence
  Description of Artificial Sequence: Synthetic polypeptide
DEEEIATTNPVAYEQYGSVSSTTPAGGTNPHNGMEPV

SEQ ID NO: 174191 - protein, 33 aa, Artificial Sequence
  Description of Artificial Sequence: Synthetic polypeptide
QEEEIATTNPVAYEQYGEVAPPEVQSQHEGEKN

SEQ ID NO: 174192 - protein, 34 aa, Artificial Sequence
  Description of Artificial Sequence: Synthetic polypeptide
DEEEIACTNPVAYEQYGSCAAGNGDGREHQNDHE

SEQ ID NO: 174193 - protein, 37 aa, Artificial Sequence
  Description of Artificial Sequence: Synthetic polypeptide
DEEEIATTNPVATEQYGSACAAANPHQAEAEMGNGNS

SEQ ID NO: 174194 - protein, 31 aa, Artificial Sequence
  Description of Artificial Sequence: Synthetic polypeptide
DEEEIATTNPVATEQWGAAPNAEVCAEHEEK

SEQ ID NO: 174195 - protein, 35 aa, Artificial Sequence
  Description of Artificial Sequence: Synthetic polypeptide
DEEEIATTNPVATEQWGATVTSANNGTEPAGDPTT

SEQ ID NO: 174196 - protein, 38 aa, Artificial Sequence
  Description of Artificial Sequence: Synthetic polypeptide
MEEEIRTTNPVATESYGSVMGMNVGNLEDEMQGGQGNT

SEQ ID NO: 174197 - protein, 34 aa, Artificial Sequence
  Description of Artificial Sequence: Synthetic polypeptide
DEMEIVTTNPVATEQYGTVCSAPDGPVEIFEWND

SEQ ID NO: 174198 - protein, 35 aa, Artificial Sequence
  Description of Artificial Sequence: Synthetic polypeptide
DEMEICTTNPVATEQYGAVCSAWDGSPVEFEGNKT

SEQ ID NO: 174199 - protein, 36 aa, Artificial Sequence
  Description of Artificial Sequence: Synthetic polypeptide
DENAEIATTNPVAYEQWGSVCVNENIQQQDGQDNVR

SEQ ID NO: 174200 - protein, 34 aa, Artificial Sequence
  Description of Artificial Sequence: Synthetic polypeptide
NEECIRTTNPVAYEQWGVYWSDQNHDTQRQDERR

SEQ ID NO: 174201 - protein, 35 aa, Artificial Sequence
  Description of Artificial Sequence: Synthetic polypeptide
DEHEIATTNPVAYEQWGSVCSTLNDNQGEDQQSAA

SEQ ID NO: 174202 - protein, 39 aa, Artificial Sequence
  Description of Artificial Sequence: Synthetic polypeptide
DEEEIRTTNPVATEQYGVVSTVVVSNNQNNEQGSTDQDD

SEQ ID NO: 174203 - protein, 36 aa, Artificial Sequence
  Description of Artificial Sequence: Synthetic polypeptide
DENAEIATTNPVAYEQWGSVSHTMNDRGNDAGDNVQ

SEQ ID NO: 174204 - protein, 38 aa, Artificial Sequence
  Description of Artificial Sequence: Synthetic polypeptide
MEEEIRTTNPVATESYGSVMGLNVGNLEDEFQNGNGGT

SEQ ID NO: 174205 - protein, 36 aa, Artificial Sequence
  Description of Artificial Sequence: Synthetic polypeptide
DEEEIATTNPVATEQYGSCAMGNPLFDGPEHEGGVE

SEQ ID NO: 174206 - protein, 38 aa, Artificial Sequence
  Description of Artificial Sequence: Synthetic polypeptide
MEEEIRTTNPVATESYGSVMGLNVGNLEDEFQGGNGQI

SEQ ID NO: 174207 - protein, 35 aa, Artificial Sequence
  Description of Artificial Sequence: Synthetic polypeptide
DENAEIATTNPVAYERWGSVSGGDLQDANGGNTGG

SEQ ID NO: 174208 - protein, 38 aa, Artificial Sequence
  Description of Artificial Sequence: Synthetic polypeptide
DEEEIRTTNPVATEQYGVVSVTVVTTQQQQGTTEETTE

SEQ ID NO: 174209 - protein, 36 aa, Artificial Sequence
  Description of Artificial Sequence: Synthetic polypeptide
DEMEIATTNPVATEQYGCVCSNTEHNEDHEGSETLS

SEQ ID NO: 174210 - protein, 38 aa, Artificial Sequence
  Description of Artificial Sequence: Synthetic polypeptide
QEEEIRTTNPVATEQYGSVYEQTDNFDNQDEGGGGQED

SEQ ID NO: 174211 - protein, 32 aa, Artificial Sequence
  Description of Artificial Sequence: Synthetic polypeptide
DENEIATTNPVSTEPYGTICMEWIQQQQNGNH

SEQ ID NO: 174212 - protein, 35 aa, Artificial Sequence
  Description of Artificial Sequence: Synthetic polypeptide
DEMEIRTTNPVATECYGATTCSATEGWVEPKGNYI

SEQ ID NO: 174213 - protein, 32 aa, Artificial Sequence
  Description of Artificial Sequence: Synthetic polypeptide
DENEIATTNPVSTEPYGTIGMEDIQQQQNGNH

SEQ ID NO: 174214 - protein, 36 aa, Artificial Sequence
  Description of Artificial Sequence: Synthetic polypeptide
DEMEIATTNPVATEQYGCVCSNTEHNEEHEGSEDLM

SEQ ID NO: 174215 - protein, 36 aa, Artificial Sequence
  Description of Artificial Sequence: Synthetic polypeptide
DEMEIATTNPVATEQYGCVCSNTEHNEEHFGSEDQF

SEQ ID NO: 174216 - protein, 33 aa, Artificial Sequence
  Description of Artificial Sequence: Synthetic polypeptide
DENEIATTNPVSTEPYGTILSMEDIQQQQNGNH

SEQ ID NO: 174217 - protein, 32 aa, Artificial Sequence
  Description of Artificial Sequence: Synthetic polypeptide
DENEIATTNPVSTEPYGTIPMEDIQQQHNGNH

SEQ ID NO: 174218 - protein, 38 aa, Artificial Sequence
  Description of Artificial Sequence: Synthetic polypeptide
MEEEIRTTNPVATESYGSVMGTNVGNLEDEFQGGQEDT

SEQ ID NO: 174219 - protein, 40 aa, Artificial Sequence
  Description of Artificial Sequence: Synthetic polypeptide
AEEEIRTTNPVATEQYGSVVVVTVTNNNLLQGTEGGNTTD

SEQ ID NO: 174220 - protein, 35 aa, Artificial Sequence
  Description of Artificial Sequence: Synthetic polypeptide
DEMEIATTNPVATEQYGCVCSNTDPADHFGSEDLA

SEQ ID NO: 174221 - protein, 36 aa, Artificial Sequence
  Description of Artificial Sequence: Synthetic polypeptide
DEMEIATTNPVATEQYGCVCSNTDLNEDHFGSEDAA

SEQ ID NO: 174222 - protein, 32 aa, Artificial Sequence
  Description of Artificial Sequence: Synthetic polypeptide
DENEIATTNPVSTEPYGQTSGEGGQQQQNENH

SEQ ID NO: 174223 - protein, 35 aa, Artificial Sequence
  Description of Artificial Sequence: Synthetic polypeptide
DEHEIATTNPVAYEQWGSVCSGTGAPGEEQGGDDH

SEQ ID NO: 174224 - protein, 31 aa, Artificial Sequence
  Description of Artificial Sequence: Synthetic polypeptide
QESEIASTNPVGTEGYGVMASETLQHEGDAI

SEQ ID NO: 174225 - protein, 37 aa, Artificial Sequence
  Description of Artificial Sequence: Synthetic polypeptide
DEEEIRTTNPVATEQYGSVQYVGIEEQIEDTEEDNDM

SEQ ID NO: 174226 - protein, 31 aa, Artificial Sequence
  Description of Artificial Sequence: Synthetic polypeptide
DEEEIATTNPVATEQWGAAPNEEVCAEHEEK

SEQ ID NO: 174227 - protein, 37 aa, Artificial Sequence
  Description of Artificial Sequence: Synthetic polypeptide
DEEEIRTTNPVATEQYGSSNCCMSELPIEMEEQEINI

SEQ ID NO: 174228 - protein, 37 aa, Artificial Sequence
  Description of Artificial Sequence: Synthetic polypeptide
MEEEIRTTNPVATEVYGSVSDGMGENLGNDTGGEAGQ

SEQ ID NO: 174229 - protein, 34 aa, Artificial Sequence
  Description of Artificial Sequence: Synthetic polypeptide
DENAEIATTNPVAYEAWGVCSTQNDHHGQGGNQT

SEQ ID NO: 174230 - protein, 37 aa, Artificial Sequence
  Description of Artificial Sequence: Synthetic polypeptide
DEEEIRTTNPVATEQYGSVEPQGPIMPAEPGLNVPLM

SEQ ID NO: 174231 - protein, 35 aa, Artificial Sequence
  Description of Artificial Sequence: Synthetic polypeptide
DEEEIATTNPVATEQWGANICTAATPHLAAMMNER

SEQ ID NO: 174232 - protein, 36 aa, Artificial Sequence
  Description of Artificial Sequence: Synthetic polypeptide
DAEEIATTNPVAYEQYGSVCSPAPDTLNNDAGEHKM

SEQ ID NO: 174233 - protein, 30 aa, Artificial Sequence
  Description of Artificial Sequence: Synthetic polypeptide
QESEIASTNPVGTEGYGVMASELQHFGDII

SEQ ID NO: 174234 - protein, 35 aa, Artificial Sequence
  Description of Artificial Sequence: Synthetic polypeptide
DEMEIRTTNPVATEQYGSISSSASTEQAETSDEDK

SEQ ID NO: 174235 - protein, 36 aa, Artificial Sequence
  Description of Artificial Sequence: Synthetic polypeptide
DEMEIATTNPVATEQYGCVCSNTDHNIDHFGSETLS

SEQ ID NO: 174236 - protein, 33 aa, Artificial Sequence
  Description of Artificial Sequence: Synthetic polypeptide
DEEEIATTNPIATEQWGATWANEEDWQEPGPYI

SEQ ID NO: 174237 - protein, 35 aa, Artificial Sequence
  Description of Artificial Sequence: Synthetic polypeptide
DEMEICTTNPVATEQYGAVCSAWDGPVEFEGNEYQ

SEQ ID NO: 174238 - protein, 40 aa, Artificial Sequence
  Description of Artificial Sequence: Synthetic polypeptide
DEEEIRTTNPVATEQYGVVSVVTNNLQQSATNEEGVTVSQ

SEQ ID NO: 174239 - protein, 35 aa, Artificial Sequence
  Description of Artificial Sequence: Synthetic polypeptide
DEMEICTTNPVATEQYGAVCSAWDGPVEFEGNNYF

SEQ ID NO: 174240 - protein, 33 aa, Artificial Sequence
  Description of Artificial Sequence: Synthetic polypeptide
DEEEIATTNPIATEQWGATWANEEDWQEPGPYK

SEQ ID NO: 174241 - protein, 37 aa, Artificial Sequence
  Description of Artificial Sequence: Synthetic polypeptide
NEEEIRTTNPVATEQYGMVSVEGMGDSGQGQEQGEGT

SEQ ID NO: 174242 - protein, 33 aa, Artificial Sequence
  Description of Artificial Sequence: Synthetic polypeptide
QENEIATTNPVATECYGTVCSAEDGPVQFEGED

SEQ ID NO: 174243 - protein, 34 aa, Artificial Sequence
  Description of Artificial Sequence: Synthetic polypeptide
DEMEICTTNPVATEQYGAVCSAWDGSPVEFEGDE

SEQ ID NO: 174244 - protein, 35 aa, Artificial Sequence
  Description of Artificial Sequence: Synthetic polypeptide
DEEEIATTNPVATEQWGANTTAATNHPAGMPGNNN

SEQ ID NO: 174245 - protein, 37 aa, Artificial Sequence
  Description of Artificial Sequence: Synthetic polypeptide
DEEEIRTTNPVATEQYGSISLTMNMFMPPVSEEPDMM

SEQ ID NO: 174246 - protein, 39 aa, Artificial Sequence
  Description of Artificial Sequence: Synthetic polypeptide
DEEEIRTTNPVATEQYGTVTNLQSGTISTNTNNTEQGNV

SEQ ID NO: 174247 - protein, 34 aa, Artificial Sequence
  Description of Artificial Sequence: Synthetic polypeptide
DENEIATTNPVSTEPYGTVCSMWDIQQQQMGNHH

SEQ ID NO: 174248 - protein, 34 aa, Artificial Sequence
  Description of Artificial Sequence: Synthetic polypeptide
DENEIATTNPVSTEPYGTVISCEDISQQQTGGNH

SEQ ID NO: 174249 - protein, 38 aa, Artificial Sequence
  Description of Artificial Sequence: Synthetic polypeptide
DEMEIRTTNPVATEQYGSVCEMEYDVLGFDQYMEGNED

SEQ ID NO: 174250 - protein, 36 aa, Artificial Sequence
  Description of Artificial Sequence: Synthetic polypeptide
DEEEIRTTNPVATEQYGTVTCIEMGEEVPEAEVPER

SEQ ID NO: 174251 - protein, 36 aa, Artificial Sequence
  Description of Artificial Sequence: Synthetic polypeptide
DEEEIRTTNPVATEQYGTVTCISMGEEVPEGEVEEI

SEQ ID NO: 174252 - protein, 37 aa, Artificial Sequence
  Description of Artificial Sequence: Synthetic polypeptide
DEEEIRTTNPVATEQYGSVYVGIEHEQIENTEEDNDE

SEQ ID NO: 174253 - protein, 33 aa, Artificial Sequence
  Description of Artificial Sequence: Synthetic polypeptide
DEHEIRTTNPVAYMQWGAAPTWEKDQNGQGNNH

SEQ ID NO: 174254 - protein, 37 aa, Artificial Sequence
  Description of Artificial Sequence: Synthetic polypeptide
DDEEIRATNPVATEQYGDVSINVNGLGQQEGQGGGDT

SEQ ID NO: 174255 - protein, 34 aa, Artificial Sequence
  Description of Artificial Sequence: Synthetic polypeptide
DEMEICTTNPVATEQYGFVCFAWDGPVEFEGNYA

SEQ ID NO: 174256 - protein, 39 aa, Artificial Sequence
  Description of Artificial Sequence: Synthetic polypeptide
DEEEIRTTNPVATEQYGVVSTVTNNNTEQGSNNTTNDTD

SEQ ID NO: 174257 - protein, 35 aa, Artificial Sequence
  Description of Artificial Sequence: Synthetic polypeptide
DEMEICTTNPVATEQYGGVCTAWDGSPVEFEGNEQ

SEQ ID NO: 174258 - protein, 34 aa, Artificial Sequence
  Description of Artificial Sequence: Synthetic polypeptide
DEHEIRTTNPVAYECWGTVYQINEMQDRQMPNNG

SEQ ID NO: 174259 - protein, 36 aa, Artificial Sequence
  Description of Artificial Sequence: Synthetic polypeptide
DDEEIRATNPVATEQYGAVIVGGTDQNDGEGEGNEG

SEQ ID NO: 174260 - protein, 36 aa, Artificial Sequence
  Description of Artificial Sequence: Synthetic polypeptide
DEEEIRTTNPVATEQYGTVTCNETGEEVPEGEVPEI

SEQ ID NO: 174261 - protein, 31 aa, Artificial Sequence
  Description of Artificial Sequence: Synthetic polypeptide
DENEICTTNPVATEQWGDVLEIEGMNCCEDA

SEQ ID NO: 174262 - protein, 34 aa, Artificial Sequence
  Description of Artificial Sequence: Synthetic polypeptide
DEHEIRTTNPVAYECWGTVYQINENQDQRMMNGP

SEQ ID NO: 174263 - protein, 35 aa, Artificial Sequence
  Description of Artificial Sequence: Synthetic polypeptide
DEEEIATTNPMATEQYGSVPPCVTQDHWQHQEVDS

SEQ ID NO: 174264 - protein, 33 aa, Artificial Sequence
  Description of Artificial Sequence: Synthetic polypeptide
DEHEIRTTNPVAYMQWGAAPTWEGDQQMQNNDR

SEQ ID NO: 174265 - protein, 36 aa, Artificial Sequence
  Description of Artificial Sequence: Synthetic polypeptide
DEEEIATTNPVAYEQYGSVCSVAPHLNEAPGGEAVI

SEQ ID NO: 174266 - protein, 38 aa, Artificial Sequence
  Description of Artificial Sequence: Synthetic polypeptide
DEEEIRTTNPVATEQYGSVLSFIDVFEEGVRINNEVQD

SEQ ID NO: 174267 - protein, 36 aa, Artificial Sequence
  Description of Artificial Sequence: Synthetic polypeptide
DEEEIRTTNPVATEQYGSVYYPIPEKESDGEEEEED

SEQ ID NO: 174268 - protein, 38 aa, Artificial Sequence
  Description of Artificial Sequence: Synthetic polypeptide
QEEGIRTTNPVATEQYGSVTSVTDNGGEEGGGQGNQGN

SEQ ID NO: 174269 - protein, 38 aa, Artificial Sequence
  Description of Artificial Sequence: Synthetic polypeptide
DEEEIRTTNPVATEQYGSVICPGVLTGHHALNGSLTRI

SEQ ID NO: 174270 - protein, 35 aa, Artificial Sequence
  Description of Artificial Sequence: Synthetic polypeptide
DEMEIRTTNPVATEQWGTVWSNAEGWVAEPEGNYI

SEQ ID NO: 174271 - protein, 35 aa, Artificial Sequence
  Description of Artificial Sequence: Synthetic polypeptide
DEMEIRTTNPVATEQWGTVWSNAEGPVAEPEGNYI

SEQ ID NO: 174272 - protein, 35 aa, Artificial Sequence
  Description of Artificial Sequence: Synthetic polypeptide
DEEEIGTTNPVAYEQYGCVCSWGEDDQENMGSDQS

SEQ ID NO: 174273 - protein, 38 aa, Artificial Sequence
  Description of Artificial Sequence: Synthetic polypeptide
DEGEIRTTNPVATEQYGSVESCVLLANEDPEGMQNNQI

SEQ ID NO: 174274 - protein, 37 aa, Artificial Sequence
  Description of Artificial Sequence: Synthetic polypeptide
QEEEIRTTNPVATEQYGSVVMGFPIEMDVNDDEGQNT

SEQ ID NO: 174275 - protein, 36 aa, Artificial Sequence
  Description of Artificial Sequence: Synthetic polypeptide
DEAEIATTNPVAYEQWGSVCSTNDNMDHRQGGGPKV

SEQ ID NO: 174276 - protein, 39 aa, Artificial Sequence
  Description of Artificial Sequence: Synthetic polypeptide
DEEEIRTTNPVATEQYGVVSTVVVNNNQEQGTEETEEED

SEQ ID NO: 174277 - protein, 37 aa, Artificial Sequence
  Description of Artificial Sequence: Synthetic polypeptide
DEEEIRTTNPVATEQYGSVPYVAIEEQIENTEEDNEM

SEQ ID NO: 174278 - protein, 34 aa, Artificial Sequence
  Description of Artificial Sequence: Synthetic polypeptide
DENEIATTNPVATEQYGSACSADGSGPDDSDGAP

SEQ ID NO: 174279 - protein, 37 aa, Artificial Sequence
  Description of Artificial Sequence: Synthetic polypeptide
DEGEIATTNPVATEQYGSVCADGANGSNQDSGMEHNH

SEQ ID NO: 174280 - protein, 36 aa, Artificial Sequence
  Description of Artificial Sequence: Synthetic polypeptide
DEGEICTTNPVATECYGVVTTGNQGNQGGHGQGGND

SEQ ID NO: 174281 - protein, 37 aa, Artificial Sequence
  Description of Artificial Sequence: Synthetic polypeptide
DEECVRTTNPIAYEQYGCEVVQSCDNMLSQTGGNYRD

SEQ ID NO: 174282 - protein, 36 aa, Artificial Sequence
  Description of Artificial Sequence: Synthetic polypeptide
DENEIATTNPVATEQYGSACSANDQPQEHQDGTVMK

SEQ ID NO: 174283 - protein, 37 aa, Artificial Sequence
  Description of Artificial Sequence: Synthetic polypeptide
DEEEIRTTNPVATEQYGSVYVAIEMEQLSNTEEDNDS

SEQ ID NO: 174284 - protein, 36 aa, Artificial Sequence
  Description of Artificial Sequence: Synthetic polypeptide
MEEEIRTTNPVATEQYGSVPADFGMGGQNTGGEDGT

SEQ ID NO: 174285 - protein, 39 aa, Artificial Sequence
  Description of Artificial Sequence: Synthetic polypeptide
DEEEIRTTNPVATEQYGVVSTVVVNNNNQQGTEGEETED

SEQ ID NO: 174286 - protein, 35 aa, Artificial Sequence
  Description of Artificial Sequence: Synthetic polypeptide
DEGEIATTNPVATEQYGSVCAATPGVEPEDSENDD

SEQ ID NO: 174287 - protein, 37 aa, Artificial Sequence
  Description of Artificial Sequence: Synthetic polypeptide
DEEEIRTTNPVATEQYGSVYVAIESEQIDNTEEDWDM

SEQ ID NO: 174288 - protein, 38 aa, Artificial Sequence
  Description of Artificial Sequence: Synthetic polypeptide
MEEEIRTTNPVATEQYGSVNSTGPTPGPEMGQGENEQI

SEQ ID NO: 174289 - protein, 34 aa, Artificial Sequence
  Description of Artificial Sequence: Synthetic polypeptide
DEAEIATTNPVAYEQWGSVCQTFEDRTTRDGGSM

SEQ ID NO: 174290 - protein, 38 aa, Artificial Sequence
  Description of Artificial Sequence: Synthetic polypeptide
MEEEIRTTNPVATEQYGSVNSQGPTQGPEMGQGENEQN

SEQ ID NO: 174291 - protein, 37 aa, Artificial Sequence
  Description of Artificial Sequence: Synthetic polypeptide
DCEEIRGTNPVATEQYGSSSLTPVLAPQQEISPNSNG

SEQ ID NO: 174292 - protein, 36 aa, Artificial Sequence
  Description of Artificial Sequence: Synthetic polypeptide
DEGEIATTNPVATEQYGSVCAATNPEEAEAEMQNNF

SEQ ID NO: 174293 - protein, 35 aa, Artificial Sequence
  Description of Artificial Sequence: Synthetic polypeptide
DEEEIATTNPVATEPWGISVCCYFPVSQEMGGNNG

SEQ ID NO: 174294 - protein, 38 aa, Artificial Sequence
  Description of Artificial Sequence: Synthetic polypeptide
MEEEIRTTNPVATEQYGSVNNSTTAEGPEMGQGENEQG

SEQ ID NO: 174295 - protein, 35 aa, Artificial Sequence
  Description of Artificial Sequence: Synthetic polypeptide
DEMEIRTTNPVATEQYGSVAFPPDLNWKIESSQSL

SEQ ID NO: 174296 - protein, 36 aa, Artificial Sequence
  Description of Artificial Sequence: Synthetic polypeptide
QEEEIRTTNPVATEQYGSVVMGVGFTGGDDGEETQD

SEQ ID NO: 174297 - protein, 36 aa, Artificial Sequence
  Description of Artificial Sequence: Synthetic polypeptide
DEEEIRTTNPVATEQYGSVPWVMEERQEQDELELVQ

SEQ ID NO: 174298 - protein, 36 aa, Artificial Sequence
  Description of Artificial Sequence: Synthetic polypeptide
DAEEIATTNPVATEQYGSVCAADNPAAANEMGNNDN

SEQ ID NO: 174299 - protein, 37 aa, Artificial Sequence
  Description of Artificial Sequence: Synthetic polypeptide
DEEEIRTTNPVATEQYGSVYVAIEIGQIENTEEDNDM

SEQ ID NO: 174300 - protein, 36 aa, Artificial Sequence
  Description of Artificial Sequence: Synthetic polypeptide
DEEEIACTNPVATEQYGSACSAPNPPQEAAHQVDNE

SEQ ID NO: 174301 - protein, 29 aa, Artificial Sequence
  Description of Artificial Sequence: Synthetic peptide
QESEIASTNPVGTEGYGVMAMDIQQHGDI

SEQ ID NO: 174302 - protein, 36 aa, Artificial Sequence
  Description of Artificial Sequence: Synthetic polypeptide
DEMEITTTNPVATEQYGTVPSATSGPVEFQHENLDD

SEQ ID NO: 174303 - protein, 30 aa, Artificial Sequence
  Description of Artificial Sequence: Synthetic polypeptide
QESEIASTNPVGTEGYGVMAKRTLQHGDIW

SEQ ID NO: 174304 - protein, 35 aa, Artificial Sequence
  Description of Artificial Sequence: Synthetic polypeptide
DEGEICTTNPVAYEQWGSCVYSDELNDGQHRNQGK

SEQ ID NO: 174305 - protein, 35 aa, Artificial Sequence
  Description of Artificial Sequence: Synthetic polypeptide
DEMEITTTNPVATEQYGTVCSATSGTPVEFEVNDE

SEQ ID NO: 174306 - protein, 36 aa, Artificial Sequence
  Description of Artificial Sequence: Synthetic polypeptide
DEMEITTTNPVATEQYGTVCSATSGPVEWFQHENED

SEQ ID NO: 174307 - protein, 38 aa, Artificial Sequence
  Description of Artificial Sequence: Synthetic polypeptide
DEEEIRTTNPVATEQYGSVPVLGIADMTIVEPEQEGTP

SEQ ID NO: 174308 - protein, 35 aa, Artificial Sequence
  Description of Artificial Sequence: Synthetic polypeptide
DEMEITTTNPVATEQYGTVCSATSGPVESQHEILD

SEQ ID NO: 174309 - protein, 34 aa, Artificial Sequence
  Description of Artificial Sequence: Synthetic polypeptide
NETEIRTTNPVAYEQWGVVVHTDNHNQQQHQGPD

SEQ ID NO: 174310 - protein, 32 aa, Artificial Sequence
  Description of Artificial Sequence: Synthetic polypeptide
DENAIRHTNPVSTEPYGTISMEDIQQQQNGNH

SEQ ID NO: 174311 - protein, 36 aa, Artificial Sequence
  Description of Artificial Sequence: Synthetic polypeptide
DEEEIRTTNPVATEQYGSVPVLCMGEIQVPSSEQEA

SEQ ID NO: 174312 - protein, 36 aa, Artificial Sequence
  Description of Artificial Sequence: Synthetic polypeptide
DEEEIATTNPMATEQYGSVPPCVTQNDHTQGQPVDS

SEQ ID NO: 174313 - protein, 35 aa, Artificial Sequence
  Description of Artificial Sequence: Synthetic polypeptide
DEMEITTTNPVATEQYGTVCSATSGPVEFSHENDG

SEQ ID NO: 174314 - protein, 36 aa, Artificial Sequence
  Description of Artificial Sequence: Synthetic polypeptide
DEMEITTTNPVATEQYGTVCSATSGPVEFQSENIDI

SEQ ID NO: 174315 - protein, 35 aa, Artificial Sequence
  Description of Artificial Sequence: Synthetic polypeptide
DEGEICTTNPVAYEQWGSCVYSDEWNDGQHGTQGQ

SEQ ID NO: 174316 - protein, 38 aa, Artificial Sequence
  Description of Artificial Sequence: Synthetic polypeptide
DEAEIRATNPVATEQYGSVCYSDWNNLQDERQSETQQN

SEQ ID NO: 174317 - protein, 35 aa, Artificial Sequence
  Description of Artificial Sequence: Synthetic polypeptide
DEEEIACTNPVATEQYGSACSPVDGNHNPDAMGEN

SEQ ID NO: 174318 - protein, 36 aa, Artificial Sequence
  Description of Artificial Sequence: Synthetic polypeptide
DEEEIRATNPVATEQWGGCVAINNHDEEPAGMENAR

SEQ ID NO: 174319 - protein, 33 aa, Artificial Sequence
  Description of Artificial Sequence: Synthetic polypeptide
DEHEIRTTNPVAYESWGVVSGGNMGNTQGDSGQ

SEQ ID NO: 174320 - protein, 37 aa, Artificial Sequence
  Description of Artificial Sequence: Synthetic polypeptide
MEEEIRTTNPVATEQYGSVESVSMAYQDEEEHEANEV

SEQ ID NO: 174321 - protein, 39 aa, Artificial Sequence
  Description of Artificial Sequence: Synthetic polypeptide
DEEEIRTTNPVATEQYGVVSTVVTVTNNQQGTTEDEEED

SEQ ID NO: 174322 - protein, 35 aa, Artificial Sequence
  Description of Artificial Sequence: Synthetic polypeptide
DENEIATTNPVATEQYGSICAAANNLPLDSKEGEN

SEQ ID NO: 174323 - protein, 39 aa, Artificial Sequence
  Description of Artificial Sequence: Synthetic polypeptide
MEEEIRTTNPVATEQYGSVDTDIMDNGDNQSTTGGGQNN

SEQ ID NO: 174324 - protein, 32 aa, Artificial Sequence
  Description of Artificial Sequence: Synthetic polypeptide
DENAIRTTNPESTEPYGTISMIDIQVQQNGNH

SEQ ID NO: 174325 - protein, 39 aa, Artificial Sequence
  Description of Artificial Sequence: Synthetic polypeptide
DEEEIRTTNPVATEQYGSQIVAWSVNDEEQNNEPEINIV

SEQ ID NO: 174326 - protein, 38 aa, Artificial Sequence
  Description of Artificial Sequence: Synthetic polypeptide
DEEEIRTTNPVATEQYGSQIVGTCGIPLDEVNISDEDI

SEQ ID NO: 174327 - protein, 39 aa, Artificial Sequence
  Description of Artificial Sequence: Synthetic polypeptide
DEEEIRTTNPVATEQYGVVSTVVTVVNNQQGTEEQEEED

SEQ ID NO: 174328 - protein, 35 aa, Artificial Sequence
  Description of Artificial Sequence: Synthetic polypeptide
DEMEICTTNPVATEQYGSVYQDWTNHNDPSIVTGT

SEQ ID NO: 174329 - protein, 38 aa, Artificial Sequence
  Description of Artificial Sequence: Synthetic polypeptide
QEEEIRTTNPVATEQYGSVVGSGQDDEEQDGEGVNEGT

SEQ ID NO: 174330 - protein, 34 aa, Artificial Sequence
  Description of Artificial Sequence: Synthetic polypeptide
DEMEIRTTNPVATDQYGSVPPMYWNENSSEQQEF

SEQ ID NO: 174331 - protein, 35 aa, Artificial Sequence
  Description of Artificial Sequence: Synthetic polypeptide
DEMEIRTTNPVATDQYGSVPPMYWLENSSENQQEM

SEQ ID NO: 174332 - protein, 35 aa, Artificial Sequence
  Description of Artificial Sequence: Synthetic polypeptide
DEHEIATTNPIAYEQYGSVAITPHLITGAGDGNDD

SEQ ID NO: 174333 - protein, 33 aa, Artificial Sequence
  Description of Artificial Sequence: Synthetic polypeptide
DENEICTTNPVATEQWGNCVRSEVEMNIAEDEA

SEQ ID NO: 174334 - protein, 38 aa, Artificial Sequence
  Description of Artificial Sequence: Synthetic polypeptide
DCEEIRGTNPVATEQYGSSVSPTPALNAQQEISPNSNG

SEQ ID NO: 174335 - protein, 39 aa, Artificial Sequence
  Description of Artificial Sequence: Synthetic polypeptide
DEEEIRTTNPVATEQYGSWAIYTIPNTQNSVRENVELGA

SEQ ID NO: 174336 - protein, 36 aa, Artificial Sequence
  Description of Artificial Sequence: Synthetic polypeptide
DENEICTTNPVATEQYGNVFTWTYNPQTQFADNQIM

SEQ ID NO: 174337 - protein, 37 aa, Artificial Sequence
  Description of Artificial Sequence: Synthetic polypeptide
DEEEIGTTNPVAYETYGISLVACTNNLSGTRSTDNVD

SEQ ID NO: 174338 - protein, 37 aa, Artificial Sequence
  Description of Artificial Sequence: Synthetic polypeptide
DEEEIACTNPVATEQYGSACSAVGNDQNDSGNGEMTH

SEQ ID NO: 174339 - protein, 36 aa, Artificial Sequence
  Description of Artificial Sequence: Synthetic polypeptide
DEEEIRTTNPVATEQYGTVTFISPEEEVPEGEVPEI

SEQ ID NO: 174340 - protein, 37 aa, Artificial Sequence
  Description of Artificial Sequence: Synthetic polypeptide
DEGEIATTNPVATEQYGSVCAATMHGEQDSMGGSDRH

SEQ ID NO: 174341 - protein, 37 aa, Artificial Sequence
  Description of Artificial Sequence: Synthetic polypeptide
DEEEIACTNPVATEQYGSACSGANPHLAEAEMGNGNS

SEQ ID NO: 174342 - protein, 34 aa, Artificial Sequence
  Description of Artificial Sequence: Synthetic polypeptide
DEHEIATTNPIATEQWGSIVPTWWDQHDHDQGKM

SEQ ID NO: 174343 - protein, 37 aa, Artificial Sequence
  Description of Artificial Sequence: Synthetic polypeptide
DEEEIRTTNPVATEQYGSVLQVAGEEQIENTEEANIM

SEQ ID NO: 174344 - protein, 35 aa, Artificial Sequence
  Description of Artificial Sequence: Synthetic polypeptide
DEEEIATTNPVATEQWGCWNATGNPLEPAPMENHN

SEQ ID NO: 174345 - protein, 34 aa, Artificial Sequence
  Description of Artificial Sequence: Synthetic polypeptide
DEGEIATTNPVATEQYGSVCAATMGPEEMMMPEG

SEQ ID NO: 174346 - protein, 37 aa, Artificial Sequence
  Description of Artificial Sequence: Synthetic polypeptide
DEEEIATTNPVATEQYGSVCAMSNDGPQEHQDGTEAE

SEQ ID NO: 174347 - protein, 40 aa, Artificial Sequence
  Description of Artificial Sequence: Synthetic polypeptide
DEEEIRTTNPVATEQYGTVTNLQSGTIGTNNTNNQEVGNV

SEQ ID NO: 174348 - protein, 37 aa, Artificial Sequence
  Description of Artificial Sequence: Synthetic polypeptide
MEEEIRTTNPVATEQYGSVIGPTNHLDGMPVLEIEDT

SEQ ID NO: 174349 - protein, 39 aa, Artificial Sequence
  Description of Artificial Sequence: Synthetic polypeptide
DEEEIRTTNPVATEQYGVVSTTNNNDQQGTEQLGTEESD

SEQ ID NO: 174350 - protein, 34 aa, Artificial Sequence
  Description of Artificial Sequence: Synthetic polypeptide
MENEIRTTNPVATEQYGSCYFPLNDDIEDLNDQQ

SEQ ID NO: 174351 - protein, 33 aa, Artificial Sequence
  Description of Artificial Sequence: Synthetic polypeptide
DEHEIRTTNPVAYMQWGAAPTWEGDQNMQGNDS

SEQ ID NO: 174352 - protein, 32 aa, Artificial Sequence
  Description of Artificial Sequence: Synthetic polypeptide
DENEIATVNPVSTEPYGTISMEDIQQQQNGNQ

SEQ ID NO: 174353 - protein, 37 aa, Artificial Sequence
  Description of Artificial Sequence: Synthetic polypeptide
DEEEIRTTNPVATEQYGSGSVPHMVTVEVAANHQTQH

SEQ ID NO: 174354 - protein, 32 aa, Artificial Sequence
  Description of Artificial Sequence: Synthetic polypeptide
DENEIATVNPVSTEPYGTISMEDIQQQQNGNH

SEQ ID NO: 174355 - protein, 36 aa, Artificial Sequence
  Description of Artificial Sequence: Synthetic polypeptide
DEGEIATTNPVATEQYGSVCAHNHPEAPDNQMENNH

SEQ ID NO: 174356 - protein, 38 aa, Artificial Sequence
  Description of Artificial Sequence: Synthetic polypeptide
QEEEIRTTNPVATEQYGSVVNPSTLEGPEMGQGENEDG

SEQ ID NO: 174357 - protein, 32 aa, Artificial Sequence
  Description of Artificial Sequence: Synthetic polypeptide
QEEEIATTNPVATEQYGTACSAEDVPEHEEED

SEQ ID NO: 174358 - protein, 32 aa, Artificial Sequence
  Description of Artificial Sequence: Synthetic polypeptide
QEGEIAPTNPVSTEPYGTVSMEDIQQQQNGNH

SEQ ID NO: 174359 - protein, 37 aa, Artificial Sequence
  Description of Artificial Sequence: Synthetic polypeptide
DEEEIRTTNPVATEQYGSVGYYLMEGEEQMIMIAEEL

SEQ ID NO: 174360 - protein, 32 aa, Artificial Sequence
  Description of Artificial Sequence: Synthetic polypeptide
CENEIATTNPVAYEPYGKVSCIGHLSQHITEG

SEQ ID NO: 174361 - protein, 37 aa, Artificial Sequence
  Description of Artificial Sequence: Synthetic polypeptide
DEEEIACTNPVATEQYGSACSAANPGPLDSMIGNDTQ

SEQ ID NO: 174362 - protein, 37 aa, Artificial Sequence
  Description of Artificial Sequence: Synthetic polypeptide
DDEEIRATNPVATEAYGDVSDGQSNTLQMRNGGQDGQ

SEQ ID NO: 174363 - protein, 33 aa, Artificial Sequence
  Description of Artificial Sequence: Synthetic polypeptide
QEEEIRCTNPTAYECWGSVYGENDDMHRNGDNM

SEQ ID NO: 174364 - protein, 36 aa, Artificial Sequence
  Description of Artificial Sequence: Synthetic polypeptide
DEGEIATTNPVATEQYGSVCAGNGGLADAPGDEMAM

SEQ ID NO: 174365 - protein, 33 aa, Artificial Sequence
  Description of Artificial Sequence: Synthetic polypeptide
QAHEIATTNPVATEQYGSVCATPQLDINHDTMD

SEQ ID NO: 174366 - protein, 35 aa, Artificial Sequence
  Description of Artificial Sequence: Synthetic polypeptide
MENEIRTTNPVATEQYGCCVWVPANLETANEPDDQ

SEQ ID NO: 174367 - protein, 36 aa, Artificial Sequence
  Description of Artificial Sequence: Synthetic polypeptide
DENAICTTNPVATEQYGSVFTWTYNPSTQFEDNQIM

SEQ ID NO: 174368 - protein, 35 aa, Artificial Sequence
  Description of Artificial Sequence: Synthetic polypeptide
DEHEIATTNPVATECYGSVCQTLDIQDQGHQQGTG

SEQ ID NO: 174369 - protein, 32 aa, Artificial Sequence
  Description of Artificial Sequence: Synthetic polypeptide
DENEIATTNPVSTEPYGVCYMEDIQQQQNGNH

SEQ ID NO: 174370 - protein, 37 aa, Artificial Sequence
  Description of Artificial Sequence: Synthetic polypeptide
DEEEIRTTNPVATEQYGSVGYYLDNGEEQMIPFAEEL

SEQ ID NO: 174371 - protein, 34 aa, Artificial Sequence
  Description of Artificial Sequence: Synthetic polypeptide
DEEEIATTNPVATEQWGCVAANHSGDPAMNPAEN

SEQ ID NO: 174372 - protein, 37 aa, Artificial Sequence
  Description of Artificial Sequence: Synthetic polypeptide
DEEEIGTTNPVAYEDYGINLVACTMNLSQTRSTDNVD

SEQ ID NO: 174373 - protein, 37 aa, Artificial Sequence
  Description of Artificial Sequence: Synthetic polypeptide
DEMEIRTTNPVATEQYGSSYEWTNMYHELMTPQEESQ

SEQ ID NO: 174374 - protein, 34 aa, Artificial Sequence
  Description of Artificial Sequence: Synthetic polypeptide
DEMEIATTNPVAYEPYGTVCSATDGPDEHEGNDT

SEQ ID NO: 174375 - protein, 35 aa, Artificial Sequence
  Description of Artificial Sequence: Synthetic polypeptide
DEMEIATTNPVAYEHWGSVCSGTDNQDRNDGGQEQ

SEQ ID NO: 174376 - protein, 41 aa, Artificial Sequence
  Description of Artificial Sequence: Synthetic polypeptide
DEEEIRTTNPVATEQYGTVSTVNLQYGNNAMEQGTNNATDD

SEQ ID NO: 174377 - protein, 36 aa, Artificial Sequence
  Description of Artificial Sequence: Synthetic polypeptide
MENEIRTTNPVATEQYGCCWSQDVSEADEIGSNGMK

SEQ ID NO: 174378 - protein, 35 aa, Artificial Sequence
  Description of Artificial Sequence: Synthetic polypeptide
DEHEIATTNPVATEHYGSVCQTLDIQDQGHQGTSG

SEQ ID NO: 174379 - protein, 39 aa, Artificial Sequence
  Description of Artificial Sequence: Synthetic polypeptide
DEEEIRTTNPVATEQYGVVSTVVVTQAGNNDEEETNTEE

SEQ ID NO: 174380 - protein, 37 aa, Artificial Sequence
  Description of Artificial Sequence: Synthetic polypeptide
DEEEIRTTNPVATEQYGSVGYYLMFGEEQMIMHEEEL

SEQ ID NO: 174381 - protein, 34 aa, Artificial Sequence
  Description of Artificial Sequence: Synthetic polypeptide
DEMEIVTTNPIATEQWGTTVWSATEGPEEPEGND

SEQ ID NO: 174382 - protein, 36 aa, Artificial Sequence
  Description of Artificial Sequence: Synthetic polypeptide
DEAEICTTNPVATEQYGSVIYAVWLETEGNHMHQQE

SEQ ID NO: 174383 - protein, 39 aa, Artificial Sequence
  Description of Artificial Sequence: Synthetic polypeptide
QEEEIRTTNPVATEQYGSVVNSQTLENGPEMGQGENEEG

SEQ ID NO: 174384 - protein, 40 aa, Artificial Sequence
  Description of Artificial Sequence: Synthetic polypeptide
DEEEIRTTNPVATEQYGVVSTVVSTTNNQQQGTEEEEEET

SEQ ID NO: 174385 - protein, 38 aa, Artificial Sequence
  Description of Artificial Sequence: Synthetic polypeptide
QEEEIRTTNPVATEQYGSVVNSFTTEGPEMGQGENEEG

SEQ ID NO: 174386 - protein, 38 aa, Artificial Sequence
  Description of Artificial Sequence: Synthetic polypeptide
QEEEIRTTNPVATEQYGSVVNPTTPIGPEMGQGGNEEE

SEQ ID NO: 174387 - protein, 37 aa, Artificial Sequence
  Description of Artificial Sequence: Synthetic polypeptide
NEEEIRTTNPVATEQYGSGISTVVNADENENTEETDT

SEQ ID NO: 174388 - protein, 34 aa, Artificial Sequence
  Description of Artificial Sequence: Synthetic polypeptide
DEMEIVTTNPIATEQWGTTVCSATEGPVEPEGND

SEQ ID NO: 174389 - protein, 36 aa, Artificial Sequence
  Description of Artificial Sequence: Synthetic polypeptide
DENEIATTNPVATEQYGSACAATNPHEAEAPGGNMH

SEQ ID NO: 174390 - protein, 37 aa, Artificial Sequence
  Description of Artificial Sequence: Synthetic polypeptide
DEEEIRTTNPVATEQYGSVGYYLMNGEEQIIMIEEEL

SEQ ID NO: 174391 - protein, 36 aa, Artificial Sequence
  Description of Artificial Sequence: Synthetic polypeptide
NEEAEIATTNPVAYEQWGSVCSTWNDHQDLDGHDQQ

SEQ ID NO: 174392 - protein, 36 aa, Artificial Sequence
  Description of Artificial Sequence: Synthetic polypeptide
DENEIATTNPVATEQYGSACAATNPQEADSSMGHSM

SEQ ID NO: 174393 - protein, 37 aa, Artificial Sequence
  Description of Artificial Sequence: Synthetic polypeptide
DEAEIATTNPVATEQYGSVCAANNGVLPEADGGNADQ

SEQ ID NO: 174394 - protein, 36 aa, Artificial Sequence
  Description of Artificial Sequence: Synthetic polypeptide
DAEEIATTNPVAYEQYGSVCAAANVLMQEAEHANDS

SEQ ID NO: 174395 - protein, 32 aa, Artificial Sequence
  Description of Artificial Sequence: Synthetic polypeptide
DENEIATTNPVSTEPYGVCYCEDGQQHQQGNH

SEQ ID NO: 174396 - protein, 35 aa, Artificial Sequence
  Description of Artificial Sequence: Synthetic polypeptide
DDECIRTTNPVATEQYGCVCSTGEHNQNFVSDTQA

SEQ ID NO: 174397 - protein, 38 aa, Artificial Sequence
  Description of Artificial Sequence: Synthetic polypeptide
DEGEIATTNPVATEQYGSVCAMTNGELTNPDDGMEGRM

SEQ ID NO: 174398 - protein, 36 aa, Artificial Sequence
  Description of Artificial Sequence: Synthetic polypeptide
DEGEIATTNPVATEQYGSVCAMNNGGTEAGDVNNAQ

SEQ ID NO: 174399 - protein, 38 aa, Artificial Sequence
  Description of Artificial Sequence: Synthetic polypeptide
DEMEIRTTNPVATEQYGSSVSCSGILPEELMNGNEEVF

SEQ ID NO: 174400 - protein, 35 aa, Artificial Sequence
  Description of Artificial Sequence: Synthetic polypeptide
DEHEIATTNPVATEHYGSVCQTLDIQDQGHQQSDG

SEQ ID NO: 174401 - protein, 34 aa, Artificial Sequence
  Description of Artificial Sequence: Synthetic polypeptide
DEHEIRTTNPVAYMQWGTVPTWEHDQHQGLNGDP

SEQ ID NO: 174402 - protein, 35 aa, Artificial Sequence
  Description of Artificial Sequence: Synthetic polypeptide
DEHEIATTNPVATEHYGSVCQTLDIQDQGHQQGQN

SEQ ID NO: 174403 - protein, 37 aa, Artificial Sequence
  Description of Artificial Sequence: Synthetic polypeptide
DENEIATTNPVATEQYGSACAATNPQEAGDSPMGHRM

SEQ ID NO: 174404 - protein, 41 aa, Artificial Sequence
  Description of Artificial Sequence: Synthetic polypeptide
DEEEIRTTNPVATEQYGTVSTVNLQYGNNTGEQGTNNNTED

SEQ ID NO: 174405 - protein, 33 aa, Artificial Sequence
  Description of Artificial Sequence: Synthetic polypeptide
DENEIATTNPVSTEPYGYTISMEDIQQQQNGNH

SEQ ID NO: 174406 - protein, 34 aa, Artificial Sequence
  Description of Artificial Sequence: Synthetic polypeptide
MENEIRTTNPVATEQYGCCWVQDESEDEIGSNMK

SEQ ID NO: 174407 - protein, 32 aa, Artificial Sequence
  Description of Artificial Sequence: Synthetic polypeptide
CENEIATTNPVAYEPYGKVSGIGGLSQHETEG

SEQ ID NO: 174408 - protein, 36 aa, Artificial Sequence
  Description of Artificial Sequence: Synthetic polypeptide
DEAEIATTNPVAYEQWGSVCVNENDQIQQDGQDNVR

SEQ ID NO: 174409 - protein, 37 aa, Artificial Sequence
  Description of Artificial Sequence: Synthetic polypeptide
DEGEIATTNPVATEQYGSVCADHNHPLENGAPMENVH

SEQ ID NO: 174410 - protein, 35 aa, Artificial Sequence
  Description of Artificial Sequence: Synthetic polypeptide
QAHEIATTNPVAYEQYGSVSANNDLQDSGDGMAIN

SEQ ID NO: 174411 - protein, 37 aa, Artificial Sequence
  Description of Artificial Sequence: Synthetic polypeptide
DEECVRTTNPIAYEQYGCEVVSCDNLSQQTPGGNQRD

SEQ ID NO: 174412 - protein, 37 aa, Artificial Sequence
  Description of Artificial Sequence: Synthetic polypeptide
MENEIRTTNPVATEQYGEVMVMSSAELEQYRPQNHDG

SEQ ID NO: 174413 - protein, 37 aa, Artificial Sequence
  Description of Artificial Sequence: Synthetic polypeptide
DEIEIRTTNPVATEQYGSVYVPSIAEVEPNTLNLFAQ

SEQ ID NO: 174414 - protein, 32 aa, Artificial Sequence
  Description of Artificial Sequence: Synthetic polypeptide
CEGEIAPTNPCSYEQYGKVSCNLSGSGGTNHN

SEQ ID NO: 174415 - protein, 36 aa, Artificial Sequence
  Description of Artificial Sequence: Synthetic polypeptide
DEEEIRTTNPVATEQYGSVYVAIEEDIENTEEDTDM

SEQ ID NO: 174416 - protein, 36 aa, Artificial Sequence
  Description of Artificial Sequence: Synthetic polypeptide
DEEEIRTTNPVATEQYGSVYVAIEEHIETTEEDNDM

SEQ ID NO: 174417 - protein, 36 aa, Artificial Sequence
  Description of Artificial Sequence: Synthetic polypeptide
MEEEIRTTNPVATEQYGSVSLLMTADEHAEMMSDTT

SEQ ID NO: 174418 - protein, 37 aa, Artificial Sequence
  Description of Artificial Sequence: Synthetic polypeptide
DCEEIRGTNPVATEQYGSSSLTPALNAQQEASQESNG

SEQ ID NO: 174419 - protein, 37 aa, Artificial Sequence
  Description of Artificial Sequence: Synthetic polypeptide
DCEEIRGTNPVATEQYGSSSLTPDLSAQQEISPNSNG

SEQ ID NO: 174420 - protein, 35 aa, Artificial Sequence
  Description of Artificial Sequence: Synthetic polypeptide
DENEIATTNPVATEQYGSACSAAPQEVNDDGMGDD

SEQ ID NO: 174421 - protein, 36 aa, Artificial Sequence
  Description of Artificial Sequence: Synthetic polypeptide
DEHEIRTTNPVAYECWGSVYWTNPNDHQGGQGNNSP

SEQ ID NO: 174422 - protein, 36 aa, Artificial Sequence
  Description of Artificial Sequence: Synthetic polypeptide
DDEEIRTTNPVATEFYGTVVNDTVGQIEEGGGNNGQ

SEQ ID NO: 174423 - protein, 36 aa, Artificial Sequence
  Description of Artificial Sequence: Synthetic polypeptide
DEGEIATTNPVATEQYGSVCADHNHPEENGMPMENT

SEQ ID NO: 174424 - protein, 37 aa, Artificial Sequence
  Description of Artificial Sequence: Synthetic polypeptide
DEHEIATTNPVATEAWGISVRTWNDDQQDRRQSEENR

SEQ ID NO: 174425 - protein, 38 aa, Artificial Sequence
  Description of Artificial Sequence: Synthetic polypeptide
QEEEIRTTNPVATEQYGSVVMSTTPEGPEMGQGENEEG

SEQ ID NO: 174426 - protein, 35 aa, Artificial Sequence
  Description of Artificial Sequence: Synthetic polypeptide
DEEEIGTTNPVAYEQYGCVCSWEDHNQENMGSDQS

SEQ ID NO: 174427 - protein, 35 aa, Artificial Sequence
  Description of Artificial Sequence: Synthetic polypeptide
DEHEIATTNPVAYEQWGSVTGDNGNQQGAGRNGGT

SEQ ID NO: 174428 - protein, 35 aa, Artificial Sequence
  Description of Artificial Sequence: Synthetic polypeptide
DEEEIATTNPVATEQWGCVAGTAGLEATAHGEMTP

SEQ ID NO: 174429 - protein, 36 aa, Artificial Sequence
  Description of Artificial Sequence: Synthetic polypeptide
MENEIRTTNPVATEQYGEVVMSSAELEQTRPQTADG

SEQ ID NO: 174430 - protein, 35 aa, Artificial Sequence
  Description of Artificial Sequence: Synthetic polypeptide
DEHEIATTNPVAYEQWGSVTGGNGGNQGAGQNGYD

SEQ ID NO: 174431 - protein, 36 aa, Artificial Sequence
  Description of Artificial Sequence: Synthetic polypeptide
DEAEIATTNPVAYEQWGSVCVNENDQQQQGQDNVRV

SEQ ID NO: 174432 - protein, 34 aa, Artificial Sequence
  Description of Artificial Sequence: Synthetic polypeptide
NEEAEIATTNPVAYEQWGSVVIVNGNDLHGTNMQ

SEQ ID NO: 174433 - protein, 40 aa, Artificial Sequence
  Description of Artificial Sequence: Synthetic polypeptide
DEEEIRTTNPVATEQYGTVSTVVVSVTNNATEQGSVNQDD

SEQ ID NO: 174434 - protein, 37 aa, Artificial Sequence
  Description of Artificial Sequence: Synthetic polypeptide
DCEEIRGTNPVATEQYGSSSLTPALNAQNVISPNSNG

SEQ ID NO: 174435 - protein, 37 aa, Artificial Sequence
  Description of Artificial Sequence: Synthetic polypeptide
DEEEIACTNPVATEQYGSACSAANPLIAEAEMGNGNF

SEQ ID NO: 174436 - protein, 38 aa, Artificial Sequence
  Description of Artificial Sequence: Synthetic polypeptide
QEEEIRTTNPVATEQYGSVISPTYPMLQQMQQSVEPEV

SEQ ID NO: 174437 - protein, 39 aa, Artificial Sequence
  Description of Artificial Sequence: Synthetic polypeptide
DEEEIRTTNPVATEQYGVVSTVVVNQAGNNDTEETNTED

SEQ ID NO: 174438 - protein, 37 aa, Artificial Sequence
  Description of Artificial Sequence: Synthetic polypeptide
DEMEIATTNPVATEQYGCVCSNTMEDNAEHFGSENQA

SEQ ID NO: 174439 - protein, 36 aa, Artificial Sequence
  Description of Artificial Sequence: Synthetic polypeptide
DENEIATTNPVATEQYGSACATNPELGNEHQDDQAH

SEQ ID NO: 174440 - protein, 38 aa, Artificial Sequence
  Description of Artificial Sequence: Synthetic polypeptide
DEEEIRTTNPVATEQYGSVQCMWYNMDGVQLAVLHGQE

SEQ ID NO: 174441 - protein, 36 aa, Artificial Sequence
  Description of Artificial Sequence: Synthetic polypeptide
DEEEIACTNPVATEQYGSACSAANPPAEAEMGNGAF

SEQ ID NO: 174442 - protein, 39 aa, Artificial Sequence
  Description of Artificial Sequence: Synthetic polypeptide
DEEEIRTTNPVATEQYGVVSTVVSTQQAGTEAGTNQQQD

SEQ ID NO: 174443 - protein, 36 aa, Artificial Sequence
  Description of Artificial Sequence: Synthetic polypeptide
DEAEICTTNPVATEMWGVVSHTNNNLDDRQNGAGDH

SEQ ID NO: 174444 - protein, 35 aa, Artificial Sequence
  Description of Artificial Sequence: Synthetic polypeptide
QAHEIATTNPVAYEQYGSVAATANLPQDSMINHGN

SEQ ID NO: 174445 - protein, 37 aa, Artificial Sequence
  Description of Artificial Sequence: Synthetic polypeptide
DEEEIACTNPVATEQYGSACSAANPPLAEAEIGNIMD

SEQ ID NO: 174446 - protein, 36 aa, Artificial Sequence
  Description of Artificial Sequence: Synthetic polypeptide
DENEIATTNPVATEQYGSACSAANPLAEAEMSNMFE

SEQ ID NO: 174447 - protein, 33 aa, Artificial Sequence
  Description of Artificial Sequence: Synthetic polypeptide
QAHEIATTNPVAYEQYGSVCAGVNGLNGDNSDM

SEQ ID NO: 174448 - protein, 38 aa, Artificial Sequence
  Description of Artificial Sequence: Synthetic polypeptide
DEMEIRTTNPVATEQYGSTVYSWDSMMQATFTEGLNGH

SEQ ID NO: 174449 - protein, 37 aa, Artificial Sequence
  Description of Artificial Sequence: Synthetic polypeptide
DEMEIRTTNPVATEQYGSTYSTDSMNQATFTEILNGS

SEQ ID NO: 174450 - protein, 36 aa, Artificial Sequence
  Description of Artificial Sequence: Synthetic polypeptide
NEDEIRTTNPVAYEQWGSVCSTTENHDQNDTQNGGA

SEQ ID NO: 174451 - protein, 37 aa, Artificial Sequence
  Description of Artificial Sequence: Synthetic polypeptide
DCEEIRGTNPVATEQYGSSSLTPALNAQDEISPEENG

SEQ ID NO: 174452 - protein, 34 aa, Artificial Sequence
  Description of Artificial Sequence: Synthetic polypeptide
DEEEIATTNPVAYAPWGTSVSATADLGQHDIAQM

SEQ ID NO: 174453 - protein, 37 aa, Artificial Sequence
  Description of Artificial Sequence: Synthetic polypeptide
DCEEIRGTNPVATEQYGSSSLTPALNAQEEISPNSNT

SEQ ID NO: 174454 - protein, 38 aa, Artificial Sequence
  Description of Artificial Sequence: Synthetic polypeptide
MENEIRTTNPVATEQYGEIMVMSSAENLEQRYPQNDDG

SEQ ID NO: 174455 - protein, 37 aa, Artificial Sequence
  Description of Artificial Sequence: Synthetic polypeptide
DEGEIATTNPVATEQYGSVCADHNHPLENGMPMENAV

SEQ ID NO: 174456 - protein, 36 aa, Artificial Sequence
  Description of Artificial Sequence: Synthetic polypeptide
MENEIRTTNPVATEQYGEVMVMCSAELESPRPQNDG

SEQ ID NO: 174457 - protein, 32 aa, Artificial Sequence
  Description of Artificial Sequence: Synthetic polypeptide
CENEIATTNPVAYEPYGKVSIIGHLSQHEQEI

SEQ ID NO: 174458 - protein, 37 aa, Artificial Sequence
  Description of Artificial Sequence: Synthetic polypeptide
DEEEIRTTNPVATEQYGSVYVAIEAEQIENTEEDNVM

SEQ ID NO: 174459 - protein, 33 aa, Artificial Sequence
  Description of Artificial Sequence: Synthetic polypeptide
DEAEIATTNPVAYERWGEVACSNLQEDQGHSTQ

SEQ ID NO: 174460 - protein, 34 aa, Artificial Sequence
  Description of Artificial Sequence: Synthetic polypeptide
AENEIACTNPVATEQYGCSCSWENDNQEYFGSDQ

SEQ ID NO: 174461 - protein, 37 aa, Artificial Sequence
  Description of Artificial Sequence: Synthetic polypeptide
HSEEIRTTNPVATEQYGSVGILTVNTEEHRTLAGPSS

SEQ ID NO: 174462 - protein, 31 aa, Artificial Sequence
  Description of Artificial Sequence: Synthetic polypeptide
DDSVVASTNPVSTEGYGNVAANTIQSRVGQR

SEQ ID NO: 174463 - protein, 35 aa, Artificial Sequence
  Description of Artificial Sequence: Synthetic polypeptide
CEEEIRTTNPVATEFYGQVDLIMNGEGQDNDGGII

SEQ ID NO: 174464 - protein, 36 aa, Artificial Sequence
  Description of Artificial Sequence: Synthetic polypeptide
DEEEISTTNPVATEQYGQCVCSNSEHNQENSGSDQL

SEQ ID NO: 174465 - protein, 35 aa, Artificial Sequence
  Description of Artificial Sequence: Synthetic polypeptide
DETEIRTTNPVATEQYGATVCSNADGWEEPKGPYI

SEQ ID NO: 174466 - protein, 35 aa, Artificial Sequence
  Description of Artificial Sequence: Synthetic polypeptide
DETEIRTTNPVATEQYGATVWANAEDWEEPEGEDI

SEQ ID NO: 174467 - protein, 37 aa, Artificial Sequence
  Description of Artificial Sequence: Synthetic polypeptide
DETEIRTTNPVATEQYGAVDIDTNMNLEVTGGGQDIV

SEQ ID NO: 174468 - protein, 37 aa, Artificial Sequence
  Description of Artificial Sequence: Synthetic polypeptide
DETEIRTTNPVATEQYGAVIFGSGDQGGQEGGGNIMG

SEQ ID NO: 174469 - protein, 36 aa, Artificial Sequence
  Description of Artificial Sequence: Synthetic polypeptide
SENEIRTTNPVATEQYGCVITATDNDIVRDNSPQQV

SEQ ID NO: 174470 - protein, 32 aa, Artificial Sequence
  Description of Artificial Sequence: Synthetic polypeptide
DDSEVASTNPVSTEGYGNVAANHTIQERVGQR

SEQ ID NO: 174471 - protein, 36 aa, Artificial Sequence
  Description of Artificial Sequence: Synthetic polypeptide
SENEIRTTNPVATEQYGCVITATDNDIQIDNSPQQS

SEQ ID NO: 174472 - protein, 32 aa, Artificial Sequence
  Description of Artificial Sequence: Synthetic polypeptide
DDSEVASTNPVSTEGYGNVAANHTIQSRVGQR

SEQ ID NO: 174473 - protein, 32 aa, Artificial Sequence
  Description of Artificial Sequence: Synthetic polypeptide
AEQEIATTNPVATTQWGMVRTWDQHQQDQNDG

SEQ ID NO: 174474 - protein, 35 aa, Artificial Sequence
  Description of Artificial Sequence: Synthetic polypeptide
CEEEIRTTNPVATEFYGQVDDIMNGEGVDDQGGGG

SEQ ID NO: 174475 - protein, 36 aa, Artificial Sequence
  Description of Artificial Sequence: Synthetic polypeptide
DETEIRTTNPVATEQYGDVVVDDEFNFGQGEGDEEL

SEQ ID NO: 174476 - protein, 33 aa, Artificial Sequence
  Description of Artificial Sequence: Synthetic polypeptide
DENEIRTTNPVSTEPYGTISMEDKIQQQQNGHH

SEQ ID NO: 174477 - protein, 32 aa, Artificial Sequence
  Description of Artificial Sequence: Synthetic polypeptide
DDSEVASTNPVSTEGYGNVAANHTIQSRVGTR

SEQ ID NO: 174478 - protein, 31 aa, Artificial Sequence
  Description of Artificial Sequence: Synthetic polypeptide
DDSEVASTNPVSTEGYGNVAANIIDDRVGQR

SEQ ID NO: 174479 - protein, 39 aa, Artificial Sequence
  Description of Artificial Sequence: Synthetic polypeptide
DETEIRTTNPVATEQYGSFVTNSTFQNYCELEQAVVPTQ

SEQ ID NO: 174480 - protein, 35 aa, Artificial Sequence
  Description of Artificial Sequence: Synthetic polypeptide
SENEIRTTNPVATEQYGCCYTTHVLEQMTPPEDNI

SEQ ID NO: 174481 - protein, 35 aa, Artificial Sequence
  Description of Artificial Sequence: Synthetic polypeptide
SENEIRTTNPVATEQYGCCSTTLVLEQMTPPEDSI

SEQ ID NO: 174482 - protein, 35 aa, Artificial Sequence
  Description of Artificial Sequence: Synthetic polypeptide
SENEIRTTNPVATEQYGCCSTTHVLEQLTDPEDSI

SEQ ID NO: 174483 - protein, 33 aa, Artificial Sequence
  Description of Artificial Sequence: Synthetic polypeptide
SENEIRTTNPVATEQWGKLWSSEVLQMNIPEDA

SEQ ID NO: 174484 - protein, 35 aa, Artificial Sequence
  Description of Artificial Sequence: Synthetic polypeptide
AEQEIATTNPVATEQYGCVAANNGDTANAMIGNEE

SEQ ID NO: 174485 - protein, 37 aa, Artificial Sequence
  Description of Artificial Sequence: Synthetic polypeptide
VEDEIRTTNPVATEFYGSVVVMTDNDNDQQRIINGDD

SEQ ID NO: 174486 - protein, 31 aa, Artificial Sequence
  Description of Artificial Sequence: Synthetic polypeptide
DDSVVASTNPVSTEGYGNVAANTIQSRVGFR

SEQ ID NO: 174487 - protein, 34 aa, Artificial Sequence
  Description of Artificial Sequence: Synthetic polypeptide
SENEIRTTNPVATEQYGCVWIPIELQPNSEEPHD

SEQ ID NO: 174488 - protein, 32 aa, Artificial Sequence
  Description of Artificial Sequence: Synthetic polypeptide
AEQEIACTNPVAYEQWGEYYTIENDQQGAGER

SEQ ID NO: 174489 - protein, 34 aa, Artificial Sequence
  Description of Artificial Sequence: Synthetic polypeptide
DETEIRTTNPVATEQYGATTANAEDWAEHKGPYI

SEQ ID NO: 174490 - protein, 35 aa, Artificial Sequence
  Description of Artificial Sequence: Synthetic polypeptide
DESEIRTTNPVATECWGSFGECINEPEAREGENGW

SEQ ID NO: 174491 - protein, 36 aa, Artificial Sequence
  Description of Artificial Sequence: Synthetic polypeptide
DETEIRTTNPVATEQWGSTTSANAEDWPAMRKGPPV

SEQ ID NO: 174492 - protein, 36 aa, Artificial Sequence
  Description of Artificial Sequence: Synthetic polypeptide
DETEIRTTNPVATEQWGSTTSANAEDWPNMRKGPPV

SEQ ID NO: 174493 - protein, 36 aa, Artificial Sequence
  Description of Artificial Sequence: Synthetic polypeptide
DETEIRTTNPVATEQWGSTTSANAPDWPNMRKGPPV

SEQ ID NO: 174494 - protein, 36 aa, Artificial Sequence
  Description of Artificial Sequence: Synthetic polypeptide
DETEIRTTNPVATEQWGSTTSSTAPAGNMPNGMPPV

SEQ ID NO: 174495 - protein, 35 aa, Artificial Sequence
  Description of Artificial Sequence: Synthetic polypeptide
DETEIRTTNPVATEQWGSTTWANAEAWAERNGPYV

SEQ ID NO: 174496 - protein, 38 aa, Artificial Sequence
  Description of Artificial Sequence: Synthetic polypeptide
DEEEIRTTNPVAYEQYGQSVCSQLNDLLDAQSDQISKL

SEQ ID NO: 174497 - protein, 32 aa, Artificial Sequence
  Description of Artificial Sequence: Synthetic polypeptide
DDSEVASTNPVSTEGYGNVAANGTIQSRVGQR

SEQ ID NO: 174498 - protein, 36 aa, Artificial Sequence
  Description of Artificial Sequence: Synthetic polypeptide
DEAEIRTVNPVATEQYGCVCSNTGEHNQYFNSQTQS

SEQ ID NO: 174499 - protein, 37 aa, Artificial Sequence
  Description of Artificial Sequence: Synthetic polypeptide
DECTICTTNPVATEQYGSVTVVVTTNQNQIGIGTNGE

SEQ ID NO: 174500 - protein, 37 aa, Artificial Sequence
  Description of Artificial Sequence: Synthetic polypeptide
SENEIRTTNPVATEQYGSFVSSSLVDTQHEGKIEKFG

SEQ ID NO: 174501 - protein, 35 aa, Artificial Sequence
  Description of Artificial Sequence: Synthetic polypeptide
DETEIRTTNPVATEQWGSTTWANTEAWAERNGPYV

SEQ ID NO: 174502 - protein, 37 aa, Artificial Sequence
  Description of Artificial Sequence: Synthetic polypeptide
DECTICTTNPVATEQYGSVTVVVTTNNQQIGIGNNNL

SEQ ID NO: 174503 - protein, 37 aa, Artificial Sequence
  Description of Artificial Sequence: Synthetic polypeptide
SENEIRTTNPVATEQYGSFVSSSLTDTQEEGGIEKFP

SEQ ID NO: 174504 - protein, 35 aa, Artificial Sequence
  Description of Artificial Sequence: Synthetic polypeptide
CEEEIRTTNPVATEFYGQVNDIMNGEGQDNDGGGI

SEQ ID NO: 174505 - protein, 37 aa, Artificial Sequence
  Description of Artificial Sequence: Synthetic polypeptide
DECTICTTNPVATEQYGSVTVVVTTNLQNGIGTETGD

SEQ ID NO: 174506 - protein, 35 aa, Artificial Sequence
  Description of Artificial Sequence: Synthetic polypeptide
DETEIRTTNPVATEQWGSTTWATAPDWNEPNGPYV

SEQ ID NO: 174507 - protein, 36 aa, Artificial Sequence
  Description of Artificial Sequence: Synthetic polypeptide
DETEIRTTNPVATEQWGSTTWSTAPAGNMPNGMPPV

SEQ ID NO: 174508 - protein, 36 aa, Artificial Sequence
  Description of Artificial Sequence: Synthetic polypeptide
DETEIRTTNPVATEQWGSTTWSTAPDGNMPNGMPPV

SEQ ID NO: 174509 - protein, 35 aa, Artificial Sequence
  Description of Artificial Sequence: Synthetic polypeptide
SENEIRTTNPVATEQYGSCFCNEHEENRPEDSQRE

SEQ ID NO: 174510 - protein, 34 aa, Artificial Sequence
  Description of Artificial Sequence: Synthetic polypeptide
SENEIRTTNPVATEQYGSCCNEHDENRPEDSQRE

SEQ ID NO: 174511 - protein, 34 aa, Artificial Sequence
  Description of Artificial Sequence: Synthetic polypeptide
DETEIRTTNPVATEQWGSTWANAEDWAEPEGEYI

SEQ ID NO: 174512 - protein, 34 aa, Artificial Sequence
  Description of Artificial Sequence: Synthetic polypeptide
DETEIRTTNPVATEQWGSTWANAEDWAEPEGPYI

SEQ ID NO: 174513 - protein, 31 aa, Artificial Sequence
  Description of Artificial Sequence: Synthetic polypeptide
DDSEVASTNPVSTEGYGNVAANHIQSRVGQV

SEQ ID NO: 174514 - protein, 37 aa, Artificial Sequence
  Description of Artificial Sequence: Synthetic polypeptide
AEDEICTTNPVATEAYGVVSTVVTEQQGNLQTGNETM

SEQ ID NO: 174515 - protein, 38 aa, Artificial Sequence
  Description of Artificial Sequence: Synthetic polypeptide
DETEIRTTNPVATEQYGAIMWSTINFIQQNGEEGNGND

SEQ ID NO: 174516 - protein, 34 aa, Artificial Sequence
  Description of Artificial Sequence: Synthetic polypeptide
DESEIRTTNPVATECWGSFGCINEPEAREGEKGN

SEQ ID NO: 174517 - protein, 36 aa, Artificial Sequence
  Description of Artificial Sequence: Synthetic polypeptide
DEEEIRTTNPVATEQYGAVPPTLAAQAEFEISLDQE

SEQ ID NO: 174518 - protein, 37 aa, Artificial Sequence
  Description of Artificial Sequence: Synthetic polypeptide
DETEIRTTNPVATEQYGSTTSSTAPAGPNMPNGMPPV

SEQ ID NO: 174519 - protein, 35 aa, Artificial Sequence
  Description of Artificial Sequence: Synthetic polypeptide
DETEIRTTNPVATEQYGSTTWANTEDWAEHKGEYI

SEQ ID NO: 174520 - protein, 36 aa, Artificial Sequence
  Description of Artificial Sequence: Synthetic polypeptide
AEPEIRTTNPVATEQYGSTSYTGWNEFFMNDLDQEG

SEQ ID NO: 174521 - protein, 38 aa, Artificial Sequence
  Description of Artificial Sequence: Synthetic polypeptide
DEEEISTTNPVATEQYGQCVCSNTGEDNQENFGSENQG

SEQ ID NO: 174522 - protein, 35 aa, Artificial Sequence
  Description of Artificial Sequence: Synthetic polypeptide
CEEEIRTTNPVATEFYGQVDDIMNGEGQTDNGGGG

SEQ ID NO: 174523 - protein, 32 aa, Artificial Sequence
  Description of Artificial Sequence: Synthetic polypeptide
DDSEVASTNPVSTEGYGNVAANNTIQSRVGMR

SEQ ID NO: 174524 - protein, 35 aa, Artificial Sequence
  Description of Artificial Sequence: Synthetic polypeptide
AEPEIRTTNPVATEEYGCCWYNIGVDSQRGMNIQE

SEQ ID NO: 174525 - protein, 34 aa, Artificial Sequence
  Description of Artificial Sequence: Synthetic polypeptide
AEPEIRTTNPVATEEYGCCWYNIDVSQQGMNIQE

SEQ ID NO: 174526 - protein, 34 aa, Artificial Sequence
  Description of Artificial Sequence: Synthetic polypeptide
AEPEIRTTNPVATEEWGCCWYNIGVFQRGDNIQE

SEQ ID NO: 174527 - protein, 36 aa, Artificial Sequence
  Description of Artificial Sequence: Synthetic polypeptide
DECTICTTNPVATEQWGSVSTTNQGNNSEQGTNTDA

SEQ ID NO: 174528 - protein, 38 aa, Artificial Sequence
  Description of Artificial Sequence: Synthetic polypeptide
AEDEICTTNPVATEAYGSVTTVSTEEIGTNLQIGNTEM

SEQ ID NO: 174529 - protein, 35 aa, Artificial Sequence
  Description of Artificial Sequence: Synthetic polypeptide
AEPEIATTNPVATEQYGSVLMANVEVLINDQSTDV

SEQ ID NO: 174530 - protein, 34 aa, Artificial Sequence
  Description of Artificial Sequence: Synthetic polypeptide
DENEIRTTNPVSTEPYGTISMEDIQQQQNGMNAH

SEQ ID NO: 174531 - protein, 34 aa, Artificial Sequence
  Description of Artificial Sequence: Synthetic polypeptide
DEAEISTTNGVAYCQYGCVCSTEELNQYFGSDQA

SEQ ID NO: 174532 - protein, 33 aa, Artificial Sequence
  Description of Artificial Sequence: Synthetic polypeptide
DEAEISTTNGVAYCQYGCVCSTEHQEHFGSDQS

SEQ ID NO: 174533 - protein, 34 aa, Artificial Sequence
  Description of Artificial Sequence: Synthetic polypeptide
DENEIRTTNPVSTEPYGTISMEDIQQQQNGLNIH

SEQ ID NO: 174534 - protein, 33 aa, Artificial Sequence
  Description of Artificial Sequence: Synthetic polypeptide
DENEIRTTNPVSTEPYGTISMEDIQQQQNFANH

SEQ ID NO: 174535 - protein, 33 aa, Artificial Sequence
  Description of Artificial Sequence: Synthetic polypeptide
DENEIRTTNPVSTEPYGTISMEDIQQQQNENTH

SEQ ID NO: 174536 - protein, 37 aa, Artificial Sequence
  Description of Artificial Sequence: Synthetic polypeptide
DEEEISTTNPVATEQYGQCVCSNTGEHNQSSNSNNQE

SEQ ID NO: 174537 - protein, 38 aa, Artificial Sequence
  Description of Artificial Sequence: Synthetic polypeptide
DEEEISTTNPVATEQYGQCVCSNTGENNAENFGSENQS

SEQ ID NO: 174538 - protein, 32 aa, Artificial Sequence
  Description of Artificial Sequence: Synthetic polypeptide
DDSEVASTNPVSTEGYGNVAANNTIQSRVGQR

SEQ ID NO: 174539 - protein, 37 aa, Artificial Sequence
  Description of Artificial Sequence: Synthetic polypeptide
DETEIRTTNPVATEQYGSVVDIGDNNEEGETNEGGET

SEQ ID NO: 174540 - protein, 38 aa, Artificial Sequence
  Description of Artificial Sequence: Synthetic polypeptide
DETEIRTTNPVATEQYGSVVGSGQDDEEQDGEGTGNND

SEQ ID NO: 174541 - protein, 38 aa, Artificial Sequence
  Description of Artificial Sequence: Synthetic polypeptide
DETEIRTTNPVATEQYGSVVGSGQTDEEDDGEVQNNGD

SEQ ID NO: 174542 - protein, 38 aa, Artificial Sequence
  Description of Artificial Sequence: Synthetic polypeptide
DETEIRTTNPVATEQYGSVVMSVNDNNTGGGQTGQVGQ

SEQ ID NO: 174543 - protein, 38 aa, Artificial Sequence
  Description of Artificial Sequence: Synthetic polypeptide
DETEIRTTNPVATEQYGSVVSTGDDNNEEDEEGEGGET

SEQ ID NO: 174544 - protein, 38 aa, Artificial Sequence
  Description of Artificial Sequence: Synthetic polypeptide
DETEIRTTNPVATEQYGSVVSTGGQNNEEGEEEEGGET

SEQ ID NO: 174545 - protein, 34 aa, Artificial Sequence
  Description of Artificial Sequence: Synthetic polypeptide
AEQEEIATTNPVAYEQWGSVTTGGNAGEHQGKDE

SEQ ID NO: 174546 - protein, 37 aa, Artificial Sequence
  Description of Artificial Sequence: Synthetic polypeptide
DETEIRTTNPVATEQYGSTTSSTAPAGPNMRNGMPPV

SEQ ID NO: 174547 - protein, 31 aa, Artificial Sequence
  Description of Artificial Sequence: Synthetic polypeptide
DDSEVASTNPVSTEGYGNVAANNIQSRVGQQ

SEQ ID NO: 174548 - protein, 34 aa, Artificial Sequence
  Description of Artificial Sequence: Synthetic polypeptide
DENEIRTTNPVSTEPYGTISMEDIQQQQNGNNHC

SEQ ID NO: 174549 - protein, 35 aa, Artificial Sequence
  Description of Artificial Sequence: Synthetic polypeptide
DETEIRTTNPVATEQYGSTTWANTEDWEEHKGEDI

SEQ ID NO: 174550 - protein, 35 aa, Artificial Sequence
  Description of Artificial Sequence: Synthetic polypeptide
DETEIRTTNPVATEQYGSTTWANTEDWEEHKGEYI

SEQ ID NO: 174551 - protein, 36 aa, Artificial Sequence
  Description of Artificial Sequence: Synthetic polypeptide
TNEAEIATTNPVAYEQWGSVSHTNNGLDQGGDEGDH

SEQ ID NO: 174552 - protein, 32 aa, Artificial Sequence
  Description of Artificial Sequence: Synthetic polypeptide
AEQEIACTNPVAYEQWGEACSIENDQHGDGER

SEQ ID NO: 174553 - protein, 34 aa, Artificial Sequence
  Description of Artificial Sequence: Synthetic polypeptide
DETEIRTTNPVATEQYGSTWAAAEDWADPEGEDI

SEQ ID NO: 174554 - protein, 37 aa, Artificial Sequence
  Description of Artificial Sequence: Synthetic polypeptide
DEEEIRTTNPVATEQYGAVMSDMNNFNEENGGGQTGI

SEQ ID NO: 174555 - protein, 31 aa, Artificial Sequence
  Description of Artificial Sequence: Synthetic polypeptide
DDSTVASTNPVSTEGYGNVAANTIQSRVGQR

SEQ ID NO: 174556 - protein, 32 aa, Artificial Sequence
  Description of Artificial Sequence: Synthetic polypeptide
DDSEVASTNPVSTEGYGNVAANITIQDRVGQR

SEQ ID NO: 174557 - protein, 37 aa, Artificial Sequence
  Description of Artificial Sequence: Synthetic polypeptide
DETEIRTTNPVATEQYGSVAETTPNGAMNGFEGSQQE

SEQ ID NO: 174558 - protein, 33 aa, Artificial Sequence
  Description of Artificial Sequence: Synthetic polypeptide
DENEIRTTNPVSTEPYGTISMEDIQQQQNWNHN

SEQ ID NO: 174559 - protein, 35 aa, Artificial Sequence
  Description of Artificial Sequence: Synthetic polypeptide
CEEEIRATNPVATDQYGVVTMQNGDNGQRFIDNGQ

SEQ ID NO: 174560 - protein, 32 aa, Artificial Sequence
  Description of Artificial Sequence: Synthetic polypeptide
DDSEVASTNPVSTEGYGNVAANITIQSRVGQR

SEQ ID NO: 174561 - protein, 33 aa, Artificial Sequence
  Description of Artificial Sequence: Synthetic polypeptide
DENEIRTTNPVSTEPYGTISMEDIQQQQNTNHY

SEQ ID NO: 174562 - protein, 33 aa, Artificial Sequence
  Description of Artificial Sequence: Synthetic polypeptide
DDSEVASTNPVSTEGYGNVAANLTGIQSRVGQR

SEQ ID NO: 174563 - protein, 38 aa, Artificial Sequence
  Description of Artificial Sequence: Synthetic polypeptide
DETEIRTTNPVATEQYGSVNYDGPGNLDTGGNNDNEDA

SEQ ID NO: 174564 - protein, 37 aa, Artificial Sequence
  Description of Artificial Sequence: Synthetic polypeptide
DETEIRTTNPVATEQYGSVNYDGPGNLDTNENENEQI

SEQ ID NO: 174565 - protein, 36 aa, Artificial Sequence
  Description of Artificial Sequence: Synthetic polypeptide
DEEEISTTNPVATEQYGQCVCSNTEHNQENFSSEQF

SEQ ID NO: 174566 - protein, 33 aa, Artificial Sequence
  Description of Artificial Sequence: Synthetic polypeptide
DENEIRTTNPVSTEPYGTISMEDIQQQQNHNHM

SEQ ID NO: 174567 - protein, 33 aa, Artificial Sequence
  Description of Artificial Sequence: Synthetic polypeptide
DENEIRTTNPVSTEPYGTISMEDIQQQQNGWYH

SEQ ID NO: 174568 - protein, 33 aa, Artificial Sequence
  Description of Artificial Sequence: Synthetic polypeptide
DENEIRTTNPVSTEPYGTISMEDIQQQQNGWHC

SEQ ID NO: 174569 - protein, 32 aa, Artificial Sequence
  Description of Artificial Sequence: Synthetic polypeptide
DDSEVASTNPVSTEGYGNVAANMIQSRVGDQR

SEQ ID NO: 174570 - protein, 32 aa, Artificial Sequence
  Description of Artificial Sequence: Synthetic polypeptide
DDSEVASTNPVSTEGYGNVAANMTIQSRVGQR

SEQ ID NO: 174571 - protein, 33 aa, Artificial Sequence
  Description of Artificial Sequence: Synthetic polypeptide
DENEIRTTNPVSTEPYGTISMEDIQQQQNGPPH

SEQ ID NO: 174572 - protein, 34 aa, Artificial Sequence
  Description of Artificial Sequence: Synthetic polypeptide
DENEIRTTNPVSTEPYGTISMEDIQQQQNGNSHS

SEQ ID NO: 174573 - protein, 34 aa, Artificial Sequence
  Description of Artificial Sequence: Synthetic polypeptide
DENEIRTTNPVSTEPYGTISMEDIQQQQNGNPHA

SEQ ID NO: 174574 - protein, 34 aa, Artificial Sequence
  Description of Artificial Sequence: Synthetic polypeptide
DENEIRTTNPVSTEPYGTISMEDIQQQQNGNLHT

SEQ ID NO: 174575 - protein, 33 aa, Artificial Sequence
  Description of Artificial Sequence: Synthetic polypeptide
DENEIRTTNPVSTEPYGTISMEDQIQQQQNGSH

SEQ ID NO: 174576 - protein, 32 aa, Artificial Sequence
  Description of Artificial Sequence: Synthetic polypeptide
DETEIRTTNPVATEQWGDTWSNEIWMEAKEDA

SEQ ID NO: 174577 - protein, 36 aa, Artificial Sequence
  Description of Artificial Sequence: Synthetic polypeptide
DEDEIRTTNPCAYEQWGSVYCGEGNGLPQDGHGSNE

SEQ ID NO: 174578 - protein, 36 aa, Artificial Sequence
  Description of Artificial Sequence: Synthetic polypeptide
DEEEIRTTNPVSTEAYGSVNTFRYHLTQTNEVQQTK

SEQ ID NO: 174579 - protein, 33 aa, Artificial Sequence
  Description of Artificial Sequence: Synthetic polypeptide
SENEIRTTNPVSTEPYGTISSMEDIQQQHNGNH

SEQ ID NO: 174580 - protein, 33 aa, Artificial Sequence
  Description of Artificial Sequence: Synthetic polypeptide
SENEIRTTNPVSTEPYGTISMEDIIQQQQNGNH

SEQ ID NO: 174581 - protein, 34 aa, Artificial Sequence
  Description of Artificial Sequence: Synthetic polypeptide
DENEIRTTNPVSTEPYGTISMEDYIQQQQNGNIH

SEQ ID NO: 174582 - protein, 34 aa, Artificial Sequence
  Description of Artificial Sequence: Synthetic polypeptide
DENEIRTTNPVSTEPYGTISMEDYIQQQQNGLNH

SEQ ID NO: 174583 - protein, 34 aa, Artificial Sequence
  Description of Artificial Sequence: Synthetic polypeptide
DETEIRTTNPVATECYGATWANEEDWAEPKGGYR

SEQ ID NO: 174584 - protein, 34 aa, Artificial Sequence
  Description of Artificial Sequence: Synthetic polypeptide
DENEIRTTNPVSTEPYGTISMEDYIQQQQNGENH

SEQ ID NO: 174585 - protein, 33 aa, Artificial Sequence
  Description of Artificial Sequence: Synthetic polypeptide
DETEIRTTNPVATECYGAVANDEDWAEPKGPYI

SEQ ID NO: 174586 - protein, 33 aa, Artificial Sequence
  Description of Artificial Sequence: Synthetic polypeptide
DENEIRTTNPVSTEPYGTISMEDWIQQQQNANH

SEQ ID NO: 174587 - protein, 37 aa, Artificial Sequence
  Description of Artificial Sequence: Synthetic polypeptide
DETEIRTTNPVATECYGSTTSSNTPDGPNMRKGMNYI

SEQ ID NO: 174588 - protein, 37 aa, Artificial Sequence
  Description of Artificial Sequence: Synthetic polypeptide
DETEIRTTNPVATECYGSTTSSNTPDGPNMRKGMNYV

SEQ ID NO: 174589 - protein, 36 aa, Artificial Sequence
  Description of Artificial Sequence: Synthetic polypeptide
TNAEIATTNPVATEQYGSVAWTDNHQQQDRQGGDSP

SEQ ID NO: 174590 - protein, 37 aa, Artificial Sequence
  Description of Artificial Sequence: Synthetic polypeptide
DEEEISTTNPVATEQYGQCVCSDWGNHNQNFNSDNQP

SEQ ID NO: 174591 - protein, 34 aa, Artificial Sequence
  Description of Artificial Sequence: Synthetic polypeptide
DEEEIRTTNPVSTEAYGIVSTYFYHEEETEQQTK

SEQ ID NO: 174592 - protein, 34 aa, Artificial Sequence
  Description of Artificial Sequence: Synthetic polypeptide
DEEEIRTTNPVSTEAYGIVSTFDHHETETEQQMK

SEQ ID NO: 174593 - protein, 32 aa, Artificial Sequence
  Description of Artificial Sequence: Synthetic polypeptide
SENEIRTTNPVSCEPYGTISMEDIQQQQNGNH

SEQ ID NO: 174594 - protein, 35 aa, Artificial Sequence
  Description of Artificial Sequence: Synthetic polypeptide
DEEEIRTTNPVSTEAYGIVSTFDEHETETEGQQTK

SEQ ID NO: 174595 - protein, 35 aa, Artificial Sequence
  Description of Artificial Sequence: Synthetic polypeptide
SENEIRTTNPVATEQYGVVFSTMAATEEGTQASPG

SEQ ID NO: 174596 - protein, 32 aa, Artificial Sequence
  Description of Artificial Sequence: Synthetic polypeptide
DDSEVASTNPVSTEGYGNVAANETIQSRVGQR

SEQ ID NO: 174597 - protein, 35 aa, Artificial Sequence
  Description of Artificial Sequence: Synthetic polypeptide
DEEEISTTNPCATEQYGCVCPWGEDQENFGSNTQA

SEQ ID NO: 174598 - protein, 35 aa, Artificial Sequence
  Description of Artificial Sequence: Synthetic polypeptide
AEREIRTTNPVATEQYGCVCSNWEEHQNFGSETQS

SEQ ID NO: 174599 - protein, 31 aa, Artificial Sequence
  Description of Artificial Sequence: Synthetic polypeptide
DDSEVASTNPVSTEGYGNVAANFIQSRVGQG

SEQ ID NO: 174600 - protein, 34 aa, Artificial Sequence
  Description of Artificial Sequence: Synthetic polypeptide
DETEIRTTNPVATECYGTTTCAATEGWVAFKGND

SEQ ID NO: 174601 - protein, 34 aa, Artificial Sequence
  Description of Artificial Sequence: Synthetic polypeptide
DETEIRTTNPVATECYGTTTCAATEGWVAFKGNI

SEQ ID NO: 174602 - protein, 35 aa, Artificial Sequence
  Description of Artificial Sequence: Synthetic polypeptide
DESEIRTVNPVATECWGSVWSCIDEPDDREGENYG

SEQ ID NO: 174603 - protein, 35 aa, Artificial Sequence
  Description of Artificial Sequence: Synthetic polypeptide
DETEIRTTNPVATECWGSTWSTAEDWPNEPNGPYI

SEQ ID NO: 174604 - protein, 36 aa, Artificial Sequence
  Description of Artificial Sequence: Synthetic polypeptide
DEEEISTTNPVATEQYGQCVCSMWEDNQNFNSDNQA

SEQ ID NO: 174605 - protein, 35 aa, Artificial Sequence
  Description of Artificial Sequence: Synthetic polypeptide
TNAEIATTNPVATEHYGSVCQTNDQQDNRGQDDET

SEQ ID NO: 174606 - protein, 38 aa, Artificial Sequence
  Description of Artificial Sequence: Synthetic polypeptide
DEEEIRTTNPVATEQYGCVCSTSPAAHNAEYSGSDPVS

SEQ ID NO: 174607 - protein, 36 aa, Artificial Sequence
  Description of Artificial Sequence: Synthetic polypeptide
SEQEIATTNPVATEQYGSVSATDTENEDHQGLEDEN

SEQ ID NO: 174608 - protein, 35 aa, Artificial Sequence
  Description of Artificial Sequence: Synthetic polypeptide
DETEIRTTNPVATECWGATVWSNAENWPQEPEGPI

SEQ ID NO: 174609 - protein, 34 aa, Artificial Sequence
  Description of Artificial Sequence: Synthetic polypeptide
DETEIRTTNPVATECWGATVWSNTDWEEHKGPDL

SEQ ID NO: 174610 - protein, 34 aa, Artificial Sequence
  Description of Artificial Sequence: Synthetic polypeptide
DETEIRTTNPVATECWGATVWSNTDWEEHKGPYI

SEQ ID NO: 174611 - protein, 35 aa, Artificial Sequence
  Description of Artificial Sequence: Synthetic polypeptide
SEQEIATTNPVATEQYGSVSAPDLNEDFQGLEDED

SEQ ID NO: 174612 - protein, 35 aa, Artificial Sequence
  Description of Artificial Sequence: Synthetic polypeptide
SEQEIATTNPVATEQYGSVSAMDLNEDHQELEDEN

SEQ ID NO: 174613 - protein, 33 aa, Artificial Sequence
  Description of Artificial Sequence: Synthetic polypeptide
DETEIRTTNPVATECWGATWANAEDWQDPKGPI

SEQ ID NO: 174614 - protein, 34 aa, Artificial Sequence
  Description of Artificial Sequence: Synthetic polypeptide
DETEIRTTNPVATECWGATWANAINEPAERKGNI

SEQ ID NO: 174615 - protein, 36 aa, Artificial Sequence
  Description of Artificial Sequence: Synthetic polypeptide
SEQEIATTNPVATEQYGSVASATDLNEDHQGLEMEN

SEQ ID NO: 174616 - protein, 33 aa, Artificial Sequence
  Description of Artificial Sequence: Synthetic polypeptide
DETEIRTTNPVATECWGATWANSETWAEPGPYI

SEQ ID NO: 174617 - protein, 32 aa, Artificial Sequence
  Description of Artificial Sequence: Synthetic polypeptide
DETEIRTTNPVATECWGATWANSETWAPGPYI

SEQ ID NO: 174618 - protein, 36 aa, Artificial Sequence
  Description of Artificial Sequence: Synthetic polypeptide
SEQEIATTNPVATEQYGSNVSAMDLNEDHQGLENEN

SEQ ID NO: 174619 - protein, 37 aa, Artificial Sequence
  Description of Artificial Sequence: Synthetic polypeptide
SEQEIATTNPVATEQYGSACAATNPQEAGDSGMGNRM

SEQ ID NO: 174620 - protein, 36 aa, Artificial Sequence
  Description of Artificial Sequence: Synthetic polypeptide
SEQEIATTNPVATEKYGSTVSCTGLSEDHEGGENLE

SEQ ID NO: 174621 - protein, 33 aa, Artificial Sequence
  Description of Artificial Sequence: Synthetic polypeptide
VEDEVATTNPVAYEQWGSTAVAWEHMDRRVGNR

SEQ ID NO: 174622 - protein, 32 aa, Artificial Sequence
  Description of Artificial Sequence: Synthetic polypeptide
DETEIRTTNPVATECWGAVAAEIWMEPAGPYA

SEQ ID NO: 174623 - protein, 33 aa, Artificial Sequence
  Description of Artificial Sequence: Synthetic polypeptide
DENEIRTTNPVSTEPYGTISMEVIQQQQNVESH

SEQ ID NO: 174624 - protein, 35 aa, Artificial Sequence
  Description of Artificial Sequence: Synthetic polypeptide
DETEIRTTNPVATECWGAVSATAEAGPNMRKGPPV

SEQ ID NO: 174625 - protein, 39 aa, Artificial Sequence
  Description of Artificial Sequence: Synthetic polypeptide
DEEEIRTTNPVATEAYGVVSTVVNQQNGTNDEQGSTDDD

SEQ ID NO: 174626 - protein, 32 aa, Artificial Sequence
  Description of Artificial Sequence: Synthetic polypeptide
DETEIRTTNPVATECWGAVWSNADEAEAAEPA

SEQ ID NO: 174627 - protein, 34 aa, Artificial Sequence
  Description of Artificial Sequence: Synthetic polypeptide
VEDEVATTNPVAYEQWGSICSTWEHLDQPGGANI

SEQ ID NO: 174628 - protein, 32 aa, Artificial Sequence
  Description of Artificial Sequence: Synthetic polypeptide
DETEIRTTNPVATECWGDVWSNADEAEAAEPA

SEQ ID NO: 174629 - protein, 32 aa, Artificial Sequence
  Description of Artificial Sequence: Synthetic polypeptide
DETEIRTTNPVATECWGDVWSNEDEAEAAEPA

SEQ ID NO: 174630 - protein, 34 aa, Artificial Sequence
  Description of Artificial Sequence: Synthetic polypeptide
DETEIRTTNPVATECWGSFGPCINEPEARETRNG

SEQ ID NO: 174631 - protein, 35 aa, Artificial Sequence
  Description of Artificial Sequence: Synthetic polypeptide
DETEIRTTNPVATECWGSTTSANAEDWNMRKGPYI

SEQ ID NO: 174632 - protein, 36 aa, Artificial Sequence
  Description of Artificial Sequence: Synthetic polypeptide
DEDEIRTTNPCAYEQWGSVYCGENNGLQDEHGMNGT

SEQ ID NO: 174633 - protein, 36 aa, Artificial Sequence
  Description of Artificial Sequence: Synthetic polypeptide
CEEEIRTTNPVATEFYGVVINDNLNGEGQTNEGEDT

SEQ ID NO: 174634 - protein, 37 aa, Artificial Sequence
  Description of Artificial Sequence: Synthetic polypeptide
DEEEISTTNPVATEQYGQCVCSMWEEHNQHFGSDNQA

SEQ ID NO: 174635 - protein, 36 aa, Artificial Sequence
  Description of Artificial Sequence: Synthetic polypeptide
DETEIRTTNPVATEGYGMVDGVGNLNIVEGENGEIE

SEQ ID NO: 174636 - protein, 33 aa, Artificial Sequence
  Description of Artificial Sequence: Synthetic polypeptide
DETEIRTTNPVATEQWGATTWPNAEVWAEHGEI

SEQ ID NO: 174637 - protein, 33 aa, Artificial Sequence
  Description of Artificial Sequence: Synthetic polypeptide
DETEIRTTNPVATEQWGATTWPNEEVWAEHGEI

SEQ ID NO: 174638 - protein, 35 aa, Artificial Sequence
  Description of Artificial Sequence: Synthetic polypeptide
DEDEIRTTNPCAYEQWGSVYCGENGLQDGHGGQME

SEQ ID NO: 174639 - protein, 32 aa, Artificial Sequence
  Description of Artificial Sequence: Synthetic polypeptide
DEAEIRTTNPVSTEPYGVCYYEDGQQQQNGDH

SEQ ID NO: 174640 - protein, 37 aa, Artificial Sequence
  Description of Artificial Sequence: Synthetic polypeptide
VEDEIRTTNPVATEQYGSCGSVTTGDNGLGGEQEDID

SEQ ID NO: 174641 - protein, 37 aa, Artificial Sequence
  Description of Artificial Sequence: Synthetic polypeptide
DETEIRTTNPVATEQWGATVSANTEAGPNERNGMPPV

SEQ ID NO: 174642 - protein, 37 aa, Artificial Sequence
  Description of Artificial Sequence: Synthetic polypeptide
DETEIRTTNPVATEQWGATVSSNTEAGPNERNGMNPV

SEQ ID NO: 174643 - protein, 37 aa, Artificial Sequence
  Description of Artificial Sequence: Synthetic polypeptide
DETEIRTTNPVATEQWGATVSSNTEAGPNERNGMPPV

SEQ ID NO: 174644 - protein, 35 aa, Artificial Sequence
  Description of Artificial Sequence: Synthetic polypeptide
DEDEIRTTNPCAYEQWGSVYCGENGLHDGHGSQND

SEQ ID NO: 174645 - protein, 33 aa, Artificial Sequence
  Description of Artificial Sequence: Synthetic polypeptide
DETEIRTTNPVATEQWGATWAATDWAEPEGPDL

SEQ ID NO: 174646 - protein, 33 aa, Artificial Sequence
  Description of Artificial Sequence: Synthetic polypeptide
DETEIRTTNPVATEQWGATWAATDWEEHEGEDL

SEQ ID NO: 174647 - protein, 33 aa, Artificial Sequence
  Description of Artificial Sequence: Synthetic polypeptide
DETEIRTTNPVATEQWGATWAATDWEEPEGEDL

SEQ ID NO: 174648 - protein, 33 aa, Artificial Sequence
  Description of Artificial Sequence: Synthetic polypeptide
DETEIRTTNPVATEQWGATWAATDWEEPEGPDL

SEQ ID NO: 174649 - protein, 35 aa, Artificial Sequence
  Description of Artificial Sequence: Synthetic polypeptide
SENEIRTTNPVATEQYGSISCNEHVDEDRPEDSQQ

SEQ ID NO: 174650 - protein, 36 aa, Artificial Sequence
  Description of Artificial Sequence: Synthetic polypeptide
SENEIRTTNPVATEQYGSGFCNEHDRENRPEDSQEE

SEQ ID NO: 174651 - protein, 35 aa, Artificial Sequence
  Description of Artificial Sequence: Synthetic polypeptide
DEAEIRTTNPVSTEQWGSCYTFDNHQNGGGKQGTN

SEQ ID NO: 174652 - protein, 33 aa, Artificial Sequence
  Description of Artificial Sequence: Synthetic polypeptide
DENEIRTTNPVSTEPYGTISMEDQIQQQQNHNH

SEQ ID NO: 174653 - protein, 32 aa, Artificial Sequence
  Description of Artificial Sequence: Synthetic polypeptide
DDSEVASTNPVSTEGYGNVAANGIQSRVGQRI

SEQ ID NO: 174654 - protein, 33 aa, Artificial Sequence
  Description of Artificial Sequence: Synthetic polypeptide
DETEIRTTNPVATEQWGDTTWSNEIEMNAAGPA

SEQ ID NO: 174655 - protein, 33 aa, Artificial Sequence
  Description of Artificial Sequence: Synthetic polypeptide
DETEIRTTNPVATEQWGDTTWSNEIEMNPAGPA

SEQ ID NO: 174656 - protein, 32 aa, Artificial Sequence
  Description of Artificial Sequence: Synthetic polypeptide
DDSEVASTNPVSTEGYGNVAANGIQSRVGQRY

SEQ ID NO: 174657 - protein, 33 aa, Artificial Sequence
  Description of Artificial Sequence: Synthetic polypeptide
DETEIRTTNPVATEQWGDTWSNAIWAEAKGDYA

SEQ ID NO: 174658 - protein, 35 aa, Artificial Sequence
  Description of Artificial Sequence: Synthetic polypeptide
DEDEIRTTNPCAYEQWGSVYCGENGEQDGHGSTNE

SEQ ID NO: 174659 - protein, 32 aa, Artificial Sequence
  Description of Artificial Sequence: Synthetic polypeptide
DETEIRTTNPVATEQWGDTWSNEIEMEAKEDA

SEQ ID NO: 174660 - protein, 33 aa, Artificial Sequence
  Description of Artificial Sequence: Synthetic polypeptide
DETEIRTTNPVATEQWGDTWSNEIWAEAKGDYA

SEQ ID NO: 174661 - protein, 31 aa, Artificial Sequence
  Description of Artificial Sequence: Synthetic polypeptide
DDSEVASTNPVSTEGYGNVAANGIQSFEGQR

SEQ ID NO: 174662 - protein, 37 aa, Artificial Sequence
  Description of Artificial Sequence: Synthetic polypeptide
DECTICTTNPVATEQYGVVSTVTNNNQQQGNGTNVDQ

SEQ ID NO: 174663 - protein, 36 aa, Artificial Sequence
  Description of Artificial Sequence: Synthetic polypeptide
SENEIRTTNPVATEQYGSVFYPSADYDNNGFENNMM

SEQ ID NO: 174664 - protein, 36 aa, Artificial Sequence
  Description of Artificial Sequence: Synthetic polypeptide
SENEIRTTNPVATEQYGSVFYPTADMDENGFELNMV

SEQ ID NO: 174665 - protein, 34 aa, Artificial Sequence
  Description of Artificial Sequence: Synthetic polypeptide
DETEIRTTNPVATEGYGMVDIGNEGNMEGGEGQE

SEQ ID NO: 174666 - protein, 35 aa, Artificial Sequence
  Description of Artificial Sequence: Synthetic polypeptide
DETEIRTTNPVATEGYGMVVDIGNEGNMEGGEGNI

SEQ ID NO: 174667 - protein, 37 aa, Artificial Sequence
  Description of Artificial Sequence: Synthetic polypeptide
DEEEISTTNPVATEQYGQCVCSMWEHNQENFGSQNQS

SEQ ID NO: 174668 - protein, 36 aa, Artificial Sequence
  Description of Artificial Sequence: Synthetic polypeptide
SENEIRTTNPVATEQYGSVSITEMQFQTESIQESGP

SEQ ID NO: 174669 - protein, 38 aa, Artificial Sequence
  Description of Artificial Sequence: Synthetic polypeptide
DEEEIRTTNPVATEQYGCVCSTTGEDHNAEFFNSDNQS

SEQ ID NO: 174670 - protein, 38 aa, Artificial Sequence
  Description of Artificial Sequence: Synthetic polypeptide
DEEEIRTTNPVATEQYGCVCSTTGEDHNQENFMSDNQS

SEQ ID NO: 174671 - protein, 38 aa, Artificial Sequence
  Description of Artificial Sequence: Synthetic polypeptide
DEEEIRTTNPVATEQYGCVCSTTGEDHNQENFNSDPQS

SEQ ID NO: 174672 - protein, 35 aa, Artificial Sequence
  Description of Artificial Sequence: Synthetic polypeptide
SENEIRTTNPVATEQYGSVMYPVDDMNNGFENEMV

SEQ ID NO: 174673 - protein, 36 aa, Artificial Sequence
  Description of Artificial Sequence: Synthetic polypeptide
SENEIRTTNPVATEQYGSVMYPTADMNNGFEDNNME

SEQ ID NO: 174674 - protein, 32 aa, Artificial Sequence
  Description of Artificial Sequence: Synthetic polypeptide
DDSEVASTNPVSTEGYGNVAANFTIQSRVGQR

SEQ ID NO: 174675 - protein, 36 aa, Artificial Sequence
  Description of Artificial Sequence: Synthetic polypeptide
DEDEIRTTNPCAYEQWGSVYCGENGLQDGHGGSQNE

SEQ ID NO: 174676 - protein, 36 aa, Artificial Sequence
  Description of Artificial Sequence: Synthetic polypeptide
SENEIRTTNPVATEQYGSVFYPTVDMDNNGFENNMW

SEQ ID NO: 174677 - protein, 38 aa, Artificial Sequence
  Description of Artificial Sequence: Synthetic polypeptide
DEEEISTTNPVATEQYGQCVCSNTNEHEQEGFGSDTQS

SEQ ID NO: 174678 - protein, 32 aa, Artificial Sequence
  Description of Artificial Sequence: Synthetic polypeptide
DDSEVASTNPVSTEGYGNVAANGIFQSRVGQR

SEQ ID NO: 174679 - protein, 33 aa, Artificial Sequence
  Description of Artificial Sequence: Synthetic polypeptide
DETEIRTTNPVATEPWGTTISNAEDWQEPNGPI

SEQ ID NO: 174680 - protein, 34 aa, Artificial Sequence
  Description of Artificial Sequence: Synthetic polypeptide
DETEIRTTNPVATEPWGTTIWANAEDWAQPNGNI

SEQ ID NO: 174681 - protein, 33 aa, Artificial Sequence
  Description of Artificial Sequence: Synthetic polypeptide
DETEIRTTNPVATEPWGTTTSNAEDWQEPNGPI

SEQ ID NO: 174682 - protein, 34 aa, Artificial Sequence
  Description of Artificial Sequence: Synthetic polypeptide
DENEIRTTNPVSTEPYGTISMEDRIQQQQNGNTH

SEQ ID NO: 174683 - protein, 34 aa, Artificial Sequence
  Description of Artificial Sequence: Synthetic polypeptide
DENEIRTTNPVSTEPYGTISMEDRIQQQQNGNHA

SEQ ID NO: 174684 - protein, 33 aa, Artificial Sequence
  Description of Artificial Sequence: Synthetic polypeptide
DETEIRTTNPVATEQWGATSNAEDEAEAAGDYI

SEQ ID NO: 174685 - protein, 31 aa, Artificial Sequence
  Description of Artificial Sequence: Synthetic polypeptide
DDSEVASTNPVSTEGYGNVAANGIQNRVGQT

SEQ ID NO: 174686 - protein, 33 aa, Artificial Sequence
  Description of Artificial Sequence: Synthetic polypeptide
DETEIRTTNPVATEQWGATSNAEDEAEAKGDYI

SEQ ID NO: 174687 - protein, 33 aa, Artificial Sequence
  Description of Artificial Sequence: Synthetic polypeptide
DETEIRTTNPVATEQWGATSNAEDEAEAKGPYI

SEQ ID NO: 174688 - protein, 36 aa, Artificial Sequence
  Description of Artificial Sequence: Synthetic polypeptide
SENEIRTTNPVATEQYGSVFYPTADMDNNGFEMNMT

SEQ ID NO: 174689 - protein, 36 aa, Artificial Sequence
  Description of Artificial Sequence: Synthetic polypeptide
DETEIRTTNPVATEQWGATTSATTPDWPNERNGNPV

SEQ ID NO: 174690 - protein, 36 aa, Artificial Sequence
  Description of Artificial Sequence: Synthetic polypeptide
SENEIRTTNPVATEQYGSVFYPTADMDINGFENNMS

SEQ ID NO: 174691 - protein, 33 aa, Artificial Sequence
  Description of Artificial Sequence: Synthetic polypeptide
DETEIRTTNPVATEPWGTTISNAEDIQEPNGPI

SEQ ID NO: 174692 - protein, 38 aa, Artificial Sequence
  Description of Artificial Sequence: Synthetic polypeptide
DEEEIRTTNPVATEQYGCVCSTSGEDHNAENFNSDNQA

SEQ ID NO: 174693 - protein, 37 aa, Artificial Sequence
  Description of Artificial Sequence: Synthetic polypeptide
DETEIRTTNPVATEQYGSVVTTGDNVENGETGEGGET

SEQ ID NO: 174694 - protein, 32 aa, Artificial Sequence
  Description of Artificial Sequence: Synthetic polypeptide
DDSEVASTNPVSTEGYGNVAANPTDQSRVGQR

SEQ ID NO: 174695 - protein, 38 aa, Artificial Sequence
  Description of Artificial Sequence: Synthetic polypeptide
AEDEICTTNPVATEAYGSVATVSTEEIGTNLQIGNEED

SEQ ID NO: 174696 - protein, 37 aa, Artificial Sequence
  Description of Artificial Sequence: Synthetic polypeptide
DEEEIRTTNPVATEQYGCVCSWEEDHNAENFNSDNQA

SEQ ID NO: 174697 - protein, 37 aa, Artificial Sequence
  Description of Artificial Sequence: Synthetic polypeptide
DEEEIRTTNPVATEQYGCVCSWEEDHNAENFNSDTQS

SEQ ID NO: 174698 - protein, 37 aa, Artificial Sequence
  Description of Artificial Sequence: Synthetic polypeptide
DEEEIRTTNPVATEQYGCVCSWEEDHNAENSNSENQL

SEQ ID NO: 174699 - protein, 37 aa, Artificial Sequence
  Description of Artificial Sequence: Synthetic polypeptide
DEEEIRTTNPVATEQYGCVCSWEEDHNQEHFNSDTQS

SEQ ID NO: 174700 - protein, 37 aa, Artificial Sequence
  Description of Artificial Sequence: Synthetic polypeptide
DEEEIRTTNPVATEQYGCVCSWEEDHNQENFISDNQA

SEQ ID NO: 174701 - protein, 35 aa, Artificial Sequence
  Description of Artificial Sequence: Synthetic polypeptide
DEQAEIATTNPVAYEQWGSCSATEDNNDHQGDGSD

SEQ ID NO: 174702 - protein, 37 aa, Artificial Sequence
  Description of Artificial Sequence: Synthetic polypeptide
DEEEIRTTNPVATEQYGCVCSWEEDHNTENFGSDTQS

SEQ ID NO: 174703 - protein, 37 aa, Artificial Sequence
  Description of Artificial Sequence: Synthetic polypeptide
DEEEIRTTNPVATEQYGCVCSWEEDHNTENFGSETQA

SEQ ID NO: 174704 - protein, 37 aa, Artificial Sequence
  Description of Artificial Sequence: Synthetic polypeptide
DEEEIRTTNPVATEQYGCVCSWEEDPNQENFNSENQA

SEQ ID NO: 174705 - protein, 37 aa, Artificial Sequence
  Description of Artificial Sequence: Synthetic polypeptide
TNEEIRTTNPVATEQYGSVEPTDVLAEETYGNGDFET

SEQ ID NO: 174706 - protein, 36 aa, Artificial Sequence
  Description of Artificial Sequence: Synthetic polypeptide
SEGEIRTTNPVATEQYGSSCYSSLNLNFEESIQNDL

SEQ ID NO: 174707 - protein, 34 aa, Artificial Sequence
  Description of Artificial Sequence: Synthetic polypeptide
DEDEIRTTNPVATEQWGTVVTVVIGTNADEEDED

SEQ ID NO: 174708 - protein, 32 aa, Artificial Sequence
  Description of Artificial Sequence: Synthetic polypeptide
DDSEVASTNPVSTEGYGNVAANTHIQSRVGQR

SEQ ID NO: 174709 - protein, 31 aa, Artificial Sequence
  Description of Artificial Sequence: Synthetic polypeptide
DDSEVASTNPVSTEGYGNVAANTHQSQVGQR

SEQ ID NO: 174710 - protein, 34 aa, Artificial Sequence
  Description of Artificial Sequence: Synthetic polypeptide
DEQEIATTNPVAYECWGCTSTNPNQGNAGENDDM

SEQ ID NO: 174711 - protein, 34 aa, Artificial Sequence
  Description of Artificial Sequence: Synthetic polypeptide
DEQAEIATTNPVAYEQWGSTSTNPNGNGMGQGDP

SEQ ID NO: 174712 - protein, 32 aa, Artificial Sequence
  Description of Artificial Sequence: Synthetic polypeptide
AEEEIASVNPVCTEQYGVVCSSNHASFGSQQS

SEQ ID NO: 174713 - protein, 32 aa, Artificial Sequence
  Description of Artificial Sequence: Synthetic polypeptide
DETEISTTNPVSMEPYGTISMEDIQQQQNGNH

SEQ ID NO: 174714 - protein, 33 aa, Artificial Sequence
  Description of Artificial Sequence: Synthetic polypeptide
VEDEIATVNPVATEQWGCVAGNGLADMPGGDNH

SEQ ID NO: 174715 - protein, 38 aa, Artificial Sequence
  Description of Artificial Sequence: Synthetic polypeptide
AEDEICTTNPVATEAYGSVATVSNEEIGTNLQTGNEEM

SEQ ID NO: 174716 - protein, 35 aa, Artificial Sequence
  Description of Artificial Sequence: Synthetic polypeptide
DEQAEIATTNPVAYEQWGSTSTNPNGNGMGQNDSA

SEQ ID NO: 174717 - protein, 36 aa, Artificial Sequence
  Description of Artificial Sequence: Synthetic polypeptide
DEEEIRTTNPVATEQYGCVCSWEEHNQENFISDFQS

SEQ ID NO: 174718 - protein, 36 aa, Artificial Sequence
  Description of Artificial Sequence: Synthetic polypeptide
DEEEIRTTNPVATEQYGCVCSWEEHNQENFISETQA

SEQ ID NO: 174719 - protein, 35 aa, Artificial Sequence
  Description of Artificial Sequence: Synthetic polypeptide
DEQEIATTNPVAYECWGSVATGNMLGDAQGMNAEV

SEQ ID NO: 174720 - protein, 36 aa, Artificial Sequence
  Description of Artificial Sequence: Synthetic polypeptide
DEDEIRTTNPVATEQWGTVVTNQQEATNVATEDGSI

SEQ ID NO: 174721 - protein, 36 aa, Artificial Sequence
  Description of Artificial Sequence: Synthetic polypeptide
DEEEISTTNPVATEQYGQCVCSNWGEDQENFNSDQS

SEQ ID NO: 174722 - protein, 36 aa, Artificial Sequence
  Description of Artificial Sequence: Synthetic polypeptide
DEDEIRTTNPVATEQWGTVVTEQQRTTNVATEDGAQ

SEQ ID NO: 174723 - protein, 33 aa, Artificial Sequence
  Description of Artificial Sequence: Synthetic polypeptide
DETEIRTTNPVSTEPYGATWANAEDIAQPNGPI

SEQ ID NO: 174724 - protein, 36 aa, Artificial Sequence
  Description of Artificial Sequence: Synthetic polypeptide
DEDEIRTTNPVATEQWGTVVSTEQAGTNVATEDGAT

SEQ ID NO: 174725 - protein, 39 aa, Artificial Sequence
  Description of Artificial Sequence: Synthetic polypeptide
DEEEIRTTNPVATEAYGTVTTGQSGTISTNTQMQEIGNT

SEQ ID NO: 174726 - protein, 36 aa, Artificial Sequence
  Description of Artificial Sequence: Synthetic polypeptide
DEDEIRTTNPVATEQWGTVVSTEQQGTNVATEGGAV

SEQ ID NO: 174727 - protein, 39 aa, Artificial Sequence
  Description of Artificial Sequence: Synthetic polypeptide
DEEEIRTTNPVATEAYGTVTTGQSGTISTNTQQQEVGNP

SEQ ID NO: 174728 - protein, 33 aa, Artificial Sequence
  Description of Artificial Sequence: Synthetic polypeptide
DETEIRTTNPVAYERWGVVYMENDHQGHNNQGH

SEQ ID NO: 174729 - protein, 36 aa, Artificial Sequence
  Description of Artificial Sequence: Synthetic polypeptide
DEDEIRTTNPVATEQWGTVVSTEQQSATNVATEEGS

SEQ ID NO: 174730 - protein, 37 aa, Artificial Sequence
  Description of Artificial Sequence: Synthetic polypeptide
DEDEIRTTNPVATEQWGTVVSTNQQQATNVATEDGSQ

SEQ ID NO: 174731 - protein, 36 aa, Artificial Sequence
  Description of Artificial Sequence: Synthetic polypeptide
DEDEIRTTNPVATEQWGTVVSTQQQSATNVATEDGQ

SEQ ID NO: 174732 - protein, 32 aa, Artificial Sequence
  Description of Artificial Sequence: Synthetic polypeptide
SEMEIACTNPCSYEQYGCVCSWNLQSFNSDQM

SEQ ID NO: 174733 - protein, 32 aa, Artificial Sequence
  Description of Artificial Sequence: Synthetic polypeptide
DETEIRTTNPVGTECWGATTANAETLAPKGDI

SEQ ID NO: 174734 - protein, 33 aa, Artificial Sequence
  Description of Artificial Sequence: Synthetic polypeptide
SEMEIACTNPCSYEQYGCVCSWNLNQSFGSDRA

SEQ ID NO: 174735 - protein, 37 aa, Artificial Sequence
  Description of Artificial Sequence: Synthetic polypeptide
DEDEIRTTNPVATEQWGTVVSVEQQSATNVATEDGSE

SEQ ID NO: 174736 - protein, 32 aa, Artificial Sequence
  Description of Artificial Sequence: Synthetic polypeptide
SEMEIACTNPCSYEQYGCVCSWNLNQESGSEQ

SEQ ID NO: 174737 - protein, 34 aa, Artificial Sequence
  Description of Artificial Sequence: Synthetic polypeptide
CEDEIATTNPVAYEQYGSCSTGPALNNGMLDGMN

SEQ ID NO: 174738 - protein, 34 aa, Artificial Sequence
  Description of Artificial Sequence: Synthetic polypeptide
DESEIRTTNPVSTEPYGTTIPSMEDISQQQNGNH

SEQ ID NO: 174739 - protein, 31 aa, Artificial Sequence
  Description of Artificial Sequence: Synthetic polypeptide
SEMEIACTNPCSYEQYGCVCSWNHQSFGSQA

SEQ ID NO: 174740 - protein, 31 aa, Artificial Sequence
  Description of Artificial Sequence: Synthetic polypeptide
SEMEIACTNPCSYEQYGCVCSWNDQSGSEQF

SEQ ID NO: 174741 - protein, 33 aa, Artificial Sequence
  Description of Artificial Sequence: Synthetic polypeptide
DESEIRTTNPVSTEPYGTISRMEDIQQQQNPNH

SEQ ID NO: 174742 - protein, 36 aa, Artificial Sequence
  Description of Artificial Sequence: Synthetic polypeptide
DEAAEIATTNPVAYEQYGTVATSNGGMQNGGDRGEQ

SEQ ID NO: 174743 - protein, 32 aa, Artificial Sequence
  Description of Artificial Sequence: Synthetic polypeptide
VEDEIATVNPVATEQWGCVAGNNGLADAGGDH

SEQ ID NO: 174744 - protein, 33 aa, Artificial Sequence
  Description of Artificial Sequence: Synthetic polypeptide
DETEIRTTNPVSTEPYGAIWANMEDIAQQNGPI

SEQ ID NO: 174745 - protein, 34 aa, Artificial Sequence
  Description of Artificial Sequence: Synthetic polypeptide
DESEIRTTNPVSTEPYGTISMEDEHSQQQNGNNH

SEQ ID NO: 174746 - protein, 34 aa, Artificial Sequence
  Description of Artificial Sequence: Synthetic polypeptide
DEQAEIATTNPVAYEQWGSCSATDNNDHEGREDL

SEQ ID NO: 174747 - protein, 33 aa, Artificial Sequence
  Description of Artificial Sequence: Synthetic polypeptide
DETEIRTTNPVSTEPYGATWAMEDIQQQPNGNI

SEQ ID NO: 174748 - protein, 33 aa, Artificial Sequence
  Description of Artificial Sequence: Synthetic polypeptide
DETEIRTTNPVSTEPYGATWANAEDIAQPKGPI

SEQ ID NO: 174749 - protein, 33 aa, Artificial Sequence
  Description of Artificial Sequence: Synthetic polypeptide
DETEIRTTNPVSTEPYGATWANMEDIAQQNGPI

SEQ ID NO: 174750 - protein, 32 aa, Artificial Sequence
  Description of Artificial Sequence: Synthetic polypeptide
DDSEVASTNPVSTEGYGNVAANTGIQSRVGQR

SEQ ID NO: 174751 - protein, 37 aa, Artificial Sequence
  Description of Artificial Sequence: Synthetic polypeptide
DEEEISTTNPVATEQYGQCVCSNWGEDQENSGSDNQL

SEQ ID NO: 174752 - protein, 33 aa, Artificial Sequence
  Description of Artificial Sequence: Synthetic polypeptide
DETEIVTTNPIATEQWGTTCSATEDPVAFKGND

SEQ ID NO: 174753 - protein, 37 aa, Artificial Sequence
  Description of Artificial Sequence: Synthetic polypeptide
SEESIRTTNPVAYEQYYQSVNSNTNDLLQPRSIEKHS

SEQ ID NO: 174754 - protein, 35 aa, Artificial Sequence
  Description of Artificial Sequence: Synthetic polypeptide
DESEIRTTNPVATECWGCVCSWMNENQENFGSQQS

SEQ ID NO: 174755 - protein, 34 aa, Artificial Sequence
  Description of Artificial Sequence: Synthetic polypeptide
DEQEIATTNPVAYEGWGSVCVGTDNQDRDQGQEL

SEQ ID NO: 174756 - protein, 35 aa, Artificial Sequence
  Description of Artificial Sequence: Synthetic polypeptide
DEEEIRTTNPLAYEPYGKVPVYCENEIFRTGGNND

SEQ ID NO: 174757 - protein, 36 aa, Artificial Sequence
  Description of Artificial Sequence: Synthetic polypeptide
DEQCIATTNPVAYECYGSVACTENELSQASVNGNMK

SEQ ID NO: 174758 - protein, 34 aa, Artificial Sequence
  Description of Artificial Sequence: Synthetic polypeptide
DEQEIATTNPVAYEGWGSVCVGTDNQDRGGGMEL

SEQ ID NO: 174759 - protein, 34 aa, Artificial Sequence
  Description of Artificial Sequence: Synthetic polypeptide
DEQEIATTNPVAYEGWGSVCVGTDSQDRDGGSEL

SEQ ID NO: 174760 - protein, 37 aa, Artificial Sequence
  Description of Artificial Sequence: Synthetic polypeptide
DEEEISTTNPVATEQYGQCVCSNWGELNQESFGSEQP

SEQ ID NO: 174761 - protein, 32 aa, Artificial Sequence
  Description of Artificial Sequence: Synthetic polypeptide
DDSEVASTNPVSTEGYGNVAANTIEQSRVGQR

SEQ ID NO: 174762 - protein, 37 aa, Artificial Sequence
  Description of Artificial Sequence: Synthetic polypeptide
DEEEIRTTNPVATEQYGCVCSWEPDHNEENFNSDNQA

SEQ ID NO: 174763 - protein, 37 aa, Artificial Sequence
  Description of Artificial Sequence: Synthetic polypeptide
AEDEICATNPVATEQYGVVSTVVQNNLLQLNGNDEDD

SEQ ID NO: 174764 - protein, 34 aa, Artificial Sequence
  Description of Artificial Sequence: Synthetic polypeptide
DETGIRTTNPCATEQWGSRSVANETTVQENNTDV

SEQ ID NO: 174765 - protein, 38 aa, Artificial Sequence
  Description of Artificial Sequence: Synthetic polypeptide
DEEEIRTTNPVATEQYGAVAPPTPVNEQQQVAMENQEI

SEQ ID NO: 174766 - protein, 33 aa, Artificial Sequence
  Description of Artificial Sequence: Synthetic polypeptide
DESEIRTTNPVSTEPWGCIAPNDQQQQQQRGDK

SEQ ID NO: 174767 - protein, 32 aa, Artificial Sequence
  Description of Artificial Sequence: Synthetic polypeptide
AEEEIASVNPVCTEQYGVVCSSEHQSFGSDQG

SEQ ID NO: 174768 - protein, 35 aa, Artificial Sequence
  Description of Artificial Sequence: Synthetic polypeptide
DECEIRTTNPVATEQYGSCSPDEDIEFSDNLISKF

SEQ ID NO: 174769 - protein, 34 aa, Artificial Sequence
  Description of Artificial Sequence: Synthetic polypeptide
DETGIRTTNPCATEQWGSRVSVANETVQENDTDV

SEQ ID NO: 174770 - protein, 33 aa, Artificial Sequence
  Description of Artificial Sequence: Synthetic polypeptide
DESEIRTTNPVATECWGAVANAIDWPAEREGPI

SEQ ID NO: 174771 - protein, 34 aa, Artificial Sequence
  Description of Artificial Sequence: Synthetic polypeptide
DEQEIATTNPVAYEPVWGQSVAQNDGLQTDGITN

SEQ ID NO: 174772 - protein, 38 aa, Artificial Sequence
  Description of Artificial Sequence: Synthetic polypeptide
DEDEIRTTNPVATEQWGVTVVSTNQQRTTNVATEDGTQ

SEQ ID NO: 174773 - protein, 37 aa, Artificial Sequence
  Description of Artificial Sequence: Synthetic polypeptide
DEEEIRTTNPVATEQYGCVCSWGEDDNQENFNSNTQS

SEQ ID NO: 174774 - protein, 37 aa, Artificial Sequence
  Description of Artificial Sequence: Synthetic polypeptide
DEEEIRTTNPVATEQYGCVCSWGEDHEQENFGSDTQA

SEQ ID NO: 174775 - protein, 37 aa, Artificial Sequence
  Description of Artificial Sequence: Synthetic polypeptide
DEEEIRTTNPVATEQYGCVCSWGEDHEQEYFNSDNQS

SEQ ID NO: 174776 - protein, 36 aa, Artificial Sequence
  Description of Artificial Sequence: Synthetic polypeptide
DEEEIRTTNPVATEQYGCVCSWGEDHNANFNSETQS

SEQ ID NO: 174777 - protein, 37 aa, Artificial Sequence
  Description of Artificial Sequence: Synthetic polypeptide
DEEEIRTTNPVATEQYGCVCSWGEDHNEENFNSDTQS

SEQ ID NO: 174778 - protein, 33 aa, Artificial Sequence
  Description of Artificial Sequence: Synthetic polypeptide
DESEIRTTNPVSTEPWGTISCMEDISQQQNGNH

SEQ ID NO: 174779 - protein, 38 aa, Artificial Sequence
  Description of Artificial Sequence: Synthetic polypeptide
SEGEICTTNPVATEAYGSVYTNSTEGIGTNLQQGNEEM

SEQ ID NO: 174780 - protein, 31 aa, Artificial Sequence
  Description of Artificial Sequence: Synthetic polypeptide
DDSEVASTNPVSTEGYGNVAANTIDSRVGQR

SEQ ID NO: 174781 - protein, 35 aa, Artificial Sequence
  Description of Artificial Sequence: Synthetic polypeptide
DESEIRTTNPVSTEPYGITVISMEDISQQQTGGNH

SEQ ID NO: 174782 - protein, 35 aa, Artificial Sequence
  Description of Artificial Sequence: Synthetic polypeptide
DEQEIATTNPVAYECWGSVATGNMLGDAQGMNNSE

SEQ ID NO: 174783 - protein, 35 aa, Artificial Sequence
  Description of Artificial Sequence: Synthetic polypeptide
DEQAIRCTNPVATEQYGSCFISTELTLIEGGQISP

SEQ ID NO: 174784 - protein, 34 aa, Artificial Sequence
  Description of Artificial Sequence: Synthetic polypeptide
DETEIVTTNPIATEQWGTTVCSATDGPVEFKGNI

SEQ ID NO: 174785 - protein, 35 aa, Artificial Sequence
  Description of Artificial Sequence: Synthetic polypeptide
DEQEIATTNPVAYECWGSVATGNMLGDAQGQNGKE

SEQ ID NO: 174786 - protein, 37 aa, Artificial Sequence
  Description of Artificial Sequence: Synthetic polypeptide
SEGEIATTNPVATEQWGSVSMSGDTPTNNDDQMGNQM

SEQ ID NO: 174787 - protein, 35 aa, Artificial Sequence
  Description of Artificial Sequence: Synthetic polypeptide
DEQEIATTNPVAYECWGSVATTGNMLGDAQGMNHQ

SEQ ID NO: 174788 - protein, 35 aa, Artificial Sequence
  Description of Artificial Sequence: Synthetic polypeptide
DEQEIATTNPVAYECWGSVCPTDNQDQPTGLDNHP

SEQ ID NO: 174789 - protein, 37 aa, Artificial Sequence
  Description of Artificial Sequence: Synthetic polypeptide
DEEEIRTTNPVATEQYGCVCSWEEPHNQENFNSENQL

SEQ ID NO: 174790 - protein, 31 aa, Artificial Sequence
  Description of Artificial Sequence: Synthetic polypeptide
DDSEVASTNPVSTEGYGNVAANTIAERVGQR

SEQ ID NO: 174791 - protein, 32 aa, Artificial Sequence
  Description of Artificial Sequence: Synthetic polypeptide
DETEIVTTNPVATECWGTVWSAADDWAPEGPI

SEQ ID NO: 174792 - protein, 33 aa, Artificial Sequence
  Description of Artificial Sequence: Synthetic polypeptide
DETEIVTTNPVATECYGATCSATDDPEFEGPYD

SEQ ID NO: 174793 - protein, 33 aa, Artificial Sequence
  Description of Artificial Sequence: Synthetic polypeptide
DETEIVTTNPVATECYGATCSNTDDPEFEGPYD

SEQ ID NO: 174794 - protein, 33 aa, Artificial Sequence
  Description of Artificial Sequence: Synthetic polypeptide
DETEIVTTNPVATECYGATCSNTDDPEFKGPYD

SEQ ID NO: 174795 - protein, 32 aa, Artificial Sequence
  Description of Artificial Sequence: Synthetic polypeptide
DDSEVASTNPVSTEGYGNVAANTIAQSRVGQR

SEQ ID NO: 174796 - protein, 34 aa, Artificial Sequence
  Description of Artificial Sequence: Synthetic polypeptide
DETEIVTTNPVATECYGTTTCSATDGPVEFEGND

SEQ ID NO: 174797 - protein, 37 aa, Artificial Sequence
  Description of Artificial Sequence: Synthetic polypeptide
AEDEICATNPVATEQYGVVSTVVVQNQLQLNGNDEDD

SEQ ID NO: 174798 - protein, 37 aa, Artificial Sequence
  Description of Artificial Sequence: Synthetic polypeptide
AEDEICATNPVATEQYGVVSTVVVNNLLQLNGNDEDD

SEQ ID NO: 174799 - protein, 30 aa, Artificial Sequence
  Description of Artificial Sequence: Synthetic polypeptide
SEGEIACTNPVGTAGWGGVSASATLQHGDS

SEQ ID NO: 174800 - protein, 31 aa, Artificial Sequence
  Description of Artificial Sequence: Synthetic polypeptide
DDSEVASTNPVSTEGYGNVAANTIASRVGQR

SEQ ID NO: 174801 - protein, 34 aa, Artificial Sequence
  Description of Artificial Sequence: Synthetic polypeptide
DETEIVTTNPVATEQYGTVCAAADDWVAFEGNYD

SEQ ID NO: 174802 - protein, 34 aa, Artificial Sequence
  Description of Artificial Sequence: Synthetic polypeptide
DETEIVTTNPVATEQYGTVCAAADDWVAFEGNYI

SEQ ID NO: 174803 - protein, 34 aa, Artificial Sequence
  Description of Artificial Sequence: Synthetic polypeptide
DEQEIATTNPVAYEEWGSVTGENENDRGNMGNDS

SEQ ID NO: 174804 - protein, 35 aa, Artificial Sequence
  Description of Artificial Sequence: Synthetic polypeptide
DEQAIRTTNPVATEQYGLSFISQTLTSIEGSQISP

SEQ ID NO: 174805 - protein, 37 aa, Artificial Sequence
  Description of Artificial Sequence: Synthetic polypeptide
DEEEIRTTNPVATEQYGAVDIDTNMNVEEEGGGQDTV

SEQ ID NO: 174806 - protein, 33 aa, Artificial Sequence
  Description of Artificial Sequence: Synthetic polypeptide
DESEIRTTNPVATECWGDVSCIIEPMNAEGEDG

SEQ ID NO: 174807 - protein, 32 aa, Artificial Sequence
  Description of Artificial Sequence: Synthetic polypeptide
DDSEVASTNPVSTEGYGNVAANTIDQSRVGQR

SEQ ID NO: 174808 - protein, 36 aa, Artificial Sequence
  Description of Artificial Sequence: Synthetic polypeptide
DEDEIRTTNPVATEQWGTVTTVQQRTTNVATEDGAD

SEQ ID NO: 174809 - protein, 33 aa, Artificial Sequence
  Description of Artificial Sequence: Synthetic polypeptide
DENEIRTTNPVSTEPYGTISMEDCQQPQSGEHV

SEQ ID NO: 174810 - protein, 35 aa, Artificial Sequence
  Description of Artificial Sequence: Synthetic polypeptide
DEDEIRTTNPVATEQWGTVSTVTIGTNAGEEDEDE

SEQ ID NO: 174811 - protein, 37 aa, Artificial Sequence
  Description of Artificial Sequence: Synthetic polypeptide
DEEEIRTTNPVATEQYGAVGAPPHQYVAQRFMQANEI

SEQ ID NO: 174812 - protein, 32 aa, Artificial Sequence
  Description of Artificial Sequence: Synthetic polypeptide
DDSEVASTNPVSTEGYGNVAANSTIQSRVGQR

SEQ ID NO: 174813 - protein, 31 aa, Artificial Sequence
  Description of Artificial Sequence: Synthetic polypeptide
DDSEVASTNPVSTEGYGNVAANTAFSRVGQR

SEQ ID NO: 174814 - protein, 33 aa, Artificial Sequence
  Description of Artificial Sequence: Synthetic polypeptide
SENEIATTNPVATEGYGCVCSWGELNQHFISEQ

SEQ ID NO: 174815 - protein, 32 aa, Artificial Sequence
  Description of Artificial Sequence: Synthetic polypeptide
DDSEVASTNPVSTEGYGNVAANTAIQSRVGQR

SEQ ID NO: 174816 - protein, 33 aa, Artificial Sequence
  Description of Artificial Sequence: Synthetic polypeptide
SENEIATTNPVATEGYGCVCSWELNQHFISQLA

SEQ ID NO: 174817 - protein, 31 aa, Artificial Sequence
  Description of Artificial Sequence: Synthetic polypeptide
DDSEVASTNPVSTEGYGNVAANTAQSRVGQF

SEQ ID NO: 174818 - protein, 36 aa, Artificial Sequence
  Description of Artificial Sequence: Synthetic polypeptide
DEQEIATTNPVATESYGSTVSCQLLSEDHEGGENLH

SEQ ID NO: 174819 - protein, 32 aa, Artificial Sequence
  Description of Artificial Sequence: Synthetic polypeptide
SENEIATTNPVATEGYGCVCSWEHNQHESEQA

SEQ ID NO: 174820 - protein, 38 aa, Artificial Sequence
  Description of Artificial Sequence: Synthetic polypeptide
AEDEICTTNPVATEAYGSVSTVVTTQQGNNLQTGNETM

SEQ ID NO: 174821 - protein, 32 aa, Artificial Sequence
  Description of Artificial Sequence: Synthetic polypeptide
SENEIATTNPVATEGYGCVCSWEEHQHESELA

SEQ ID NO: 174822 - protein, 33 aa, Artificial Sequence
  Description of Artificial Sequence: Synthetic polypeptide
AEEEIASVNPVCTEQYGVVCSWNDPQSFGSQQA

SEQ ID NO: 174823 - protein, 32 aa, Artificial Sequence
  Description of Artificial Sequence: Synthetic polypeptide
DDSEVASTNPVSTEGYGNVAANTDIQSRVGQR

SEQ ID NO: 174824 - protein, 33 aa, Artificial Sequence
  Description of Artificial Sequence: Synthetic polypeptide
DESEIRTTNPVSYEPYGTISMEDISGQQNGGNH

SEQ ID NO: 174825 - protein, 38 aa, Artificial Sequence
  Description of Artificial Sequence: Synthetic polypeptide
AEDEICTTNPVATEAYGSVSTVVTQQAGNLQTGNNETM

SEQ ID NO: 174826 - protein, 38 aa, Artificial Sequence
  Description of Artificial Sequence: Synthetic polypeptide
AEDEICTTNPVATEAYGSVSTVVTNQAGTNLQTGNETM

SEQ ID NO: 174827 - protein, 37 aa, Artificial Sequence
  Description of Artificial Sequence: Synthetic polypeptide
DEEEISTTNPVATEQYGQCVCSNWEHDQEGFISDNQA

SEQ ID NO: 174828 - protein, 33 aa, Artificial Sequence
  Description of Artificial Sequence: Synthetic polypeptide
AEEEIASVNPVCTEQYGVVCSWELQESFGSQQM

SEQ ID NO: 174829 - protein, 35 aa, Artificial Sequence
  Description of Artificial Sequence: Synthetic polypeptide
DEQEIATTNPVATEQWGSVSAVGDLEADTPGGETN

SEQ ID NO: 174830 - protein, 38 aa, Artificial Sequence
  Description of Artificial Sequence: Synthetic polypeptide
AEDEICTTNPVATEAYGSVSTVVTEQQGNNLQLGNETM

SEQ ID NO: 174831 - protein, 38 aa, Artificial Sequence
  Description of Artificial Sequence: Synthetic polypeptide
AEDEICTTNPVATEAYGSVSTVVTEQNGTNLQQGNETM

SEQ ID NO: 174832 - protein, 33 aa, Artificial Sequence
  Description of Artificial Sequence: Synthetic polypeptide
VEDEIATVNPVATEQYGCVAGTGLPATAAGGEH

SEQ ID NO: 174833 - protein, 31 aa, Artificial Sequence
  Description of Artificial Sequence: Synthetic polypeptide
DDSSVASTNPVSTEGYGNVAVNTIQSRVGQR

SEQ ID NO: 174834 - protein, 37 aa, Artificial Sequence
  Description of Artificial Sequence: Synthetic polypeptide
DEEEISTTNPVATEQYGQCVCSNWEHNQEYFGSDNQS

SEQ ID NO: 174835 - protein, 32 aa, Artificial Sequence
  Description of Artificial Sequence: Synthetic polypeptide
DDSEVASTNPVSTEGYGNVAANTDQSRVGQRT

SEQ ID NO: 174836 - protein, 37 aa, Artificial Sequence
  Description of Artificial Sequence: Synthetic polypeptide
DEEEISTTNPVATEQYGQCVCSNWEGHQEGFGSENQP

SEQ ID NO: 174837 - protein, 37 aa, Artificial Sequence
  Description of Artificial Sequence: Synthetic polypeptide
DESEIRTTNPVATECWGHSVSCINTEPQDHEGENTGY

SEQ ID NO: 174838 - protein, 35 aa, Artificial Sequence
  Description of Artificial Sequence: Synthetic polypeptide
DESEIRTTNPVATECWGMHCWTMNEQQRGQDGHSN

SEQ ID NO: 174839 - protein, 31 aa, Artificial Sequence
  Description of Artificial Sequence: Synthetic polypeptide
DDSEVASTNPVSTEGYGNVAANQIQSRVGQA

SEQ ID NO: 174840 - protein, 32 aa, Artificial Sequence
  Description of Artificial Sequence: Synthetic polypeptide
DDSEVASTNPVSTEGYGNVAANPTEQSRVGQR

SEQ ID NO: 174841 - protein, 38 aa, Artificial Sequence
  Description of Artificial Sequence: Synthetic polypeptide
DEEEIRTTNPVATEQYGCVCSTWEEDHDAENFNSDNQS

SEQ ID NO: 174842 - protein, 37 aa, Artificial Sequence
  Description of Artificial Sequence: Synthetic polypeptide
DETEIRTTNPVATEQYGSVYMWTYDWLMETTQSNQVH

SEQ ID NO: 174843 - protein, 37 aa, Artificial Sequence
  Description of Artificial Sequence: Synthetic polypeptide
DETEIRTTNPVATEQYGSVYTAGDSNEEGETGEGGIT

SEQ ID NO: 174844 - protein, 37 aa, Artificial Sequence
  Description of Artificial Sequence: Synthetic polypeptide
DETEIRTTNPVATEQYGSVYTTGDSNEEGEDGEEGET

SEQ ID NO: 174845 - protein, 37 aa, Artificial Sequence
  Description of Artificial Sequence: Synthetic polypeptide
DETEIRTTNPVATEQYGSVYTTGGSNEEGETGEGGEL

SEQ ID NO: 174846 - protein, 36 aa, Artificial Sequence
  Description of Artificial Sequence: Synthetic polypeptide
DETEIRTTNPVATEQYGSYGGTDDDDEGEGQNNGQD

SEQ ID NO: 174847 - protein, 34 aa, Artificial Sequence
  Description of Artificial Sequence: Synthetic polypeptide
DETEIRTTNPVATEQYGTTCANADDWAEFEGPYD

SEQ ID NO: 174848 - protein, 34 aa, Artificial Sequence
  Description of Artificial Sequence: Synthetic polypeptide
DETEIRTTNPVATEQYGTTCANADGWAEFEGPYD

SEQ ID NO: 174849 - protein, 34 aa, Artificial Sequence
  Description of Artificial Sequence: Synthetic polypeptide
DETEIRTTNPVATEQYGTTCANAEDWAEFEGPYD

SEQ ID NO: 174850 - protein, 35 aa, Artificial Sequence
  Description of Artificial Sequence: Synthetic polypeptide
DETEIRTTNPVATEQYGTTVCSAADGWEEPKGPYI

SEQ ID NO: 174851 - protein, 35 aa, Artificial Sequence
  Description of Artificial Sequence: Synthetic polypeptide
DETEIRTTNPVATEQYGTTVCSNADGWEEPKGPYI

SEQ ID NO: 174852 - protein, 35 aa, Artificial Sequence
  Description of Artificial Sequence: Synthetic polypeptide
DEDEIRTTNPVATEPWGVVCFTNEDQHHQGGTSHI

SEQ ID NO: 174853 - protein, 38 aa, Artificial Sequence
  Description of Artificial Sequence: Synthetic polypeptide
DEEEIRTTNPVATEQYGCVCSTWEEDHNIENFNSDNQS

SEQ ID NO: 174854 - protein, 38 aa, Artificial Sequence
  Description of Artificial Sequence: Synthetic polypeptide
DEEEIRTTNPVATEQYGCVCSTWEEDHNQENFNSDTQA

SEQ ID NO: 174855 - protein, 38 aa, Artificial Sequence
  Description of Artificial Sequence: Synthetic polypeptide
DEEEIRTTNPVATEQYGAVLRICSVTEEEHQTQPENTT

SEQ ID NO: 174856 - protein, 33 aa, Artificial Sequence
  Description of Artificial Sequence: Synthetic polypeptide
AENEIVCTNPVATEQYGTACSAEDNPVEFEGGR

SEQ ID NO: 174857 - protein, 37 aa, Artificial Sequence
  Description of Artificial Sequence: Synthetic polypeptide
DEEEIRTTNPVATEQYGAVLGTCVTEEEHQTQPENTT

SEQ ID NO: 174858 - protein, 38 aa, Artificial Sequence
  Description of Artificial Sequence: Synthetic polypeptide
DEEEIRTTNPVATEQYGCVCSTWGEDHNAENFNSDNQS

SEQ ID NO: 174859 - protein, 38 aa, Artificial Sequence
  Description of Artificial Sequence: Synthetic polypeptide
DEEEIRTTNPVATEQYGCVCSTWGEDHNEENFNSETQG

SEQ ID NO: 174860 - protein, 38 aa, Artificial Sequence
  Description of Artificial Sequence: Synthetic polypeptide
DEEEIRTTNPVATEQYGCVCSTWGEDHNIENFNSENQA

SEQ ID NO: 174861 - protein, 36 aa, Artificial Sequence
  Description of Artificial Sequence: Synthetic polypeptide
SENEIRATNPVATEQYGSVMYPTDDMNNGFEGNNMV

SEQ ID NO: 174862 - protein, 38 aa, Artificial Sequence
  Description of Artificial Sequence: Synthetic polypeptide
DEEEIRTTNPVATEQYGCVCSTWGEDHNQENFNSQNQS

SEQ ID NO: 174863 - protein, 33 aa, Artificial Sequence
  Description of Artificial Sequence: Synthetic polypeptide
DDSEVASTNPVSTEGYGNVAANPTIQSRVGNQR

SEQ ID NO: 174864 - protein, 32 aa, Artificial Sequence
  Description of Artificial Sequence: Synthetic polypeptide
DDSEVASTNPVSTEGYGNVAANPTIQSRVGQR

SEQ ID NO: 174865 - protein, 32 aa, Artificial Sequence
  Description of Artificial Sequence: Synthetic polypeptide
DDSEVASTNPVSTEGYGNVAANQTIQSRVGQR

SEQ ID NO: 174866 - protein, 38 aa, Artificial Sequence
  Description of Artificial Sequence: Synthetic polypeptide
AEDEICTTNPVATEAYGSVSTVVTEQIGSNLQLGNETM

SEQ ID NO: 174867 - protein, 36 aa, Artificial Sequence
  Description of Artificial Sequence: Synthetic polypeptide
TNEEIATTNPVAYEQWGSVSHTLNGLDQGGPGGDMM

SEQ ID NO: 174868 - protein, 34 aa, Artificial Sequence
  Description of Artificial Sequence: Synthetic polypeptide
DEAAEIATTNPVAYERWGSVTGGNLQDHSGGGTS

SEQ ID NO: 174869 - protein, 32 aa, Artificial Sequence
  Description of Artificial Sequence: Synthetic polypeptide
VEDEIATVNPVATEQWGCVAGTGLATAGGEDH

SEQ ID NO: 174870 - protein, 36 aa, Artificial Sequence
  Description of Artificial Sequence: Synthetic polypeptide
DEDEIRTTNPVATEQWGTVSTAQQQATNVATEDGTQ

SEQ ID NO: 174871 - protein, 33 aa, Artificial Sequence
  Description of Artificial Sequence: Synthetic polypeptide
AENEIRTTNPVSTEPYGTISMEDIQQQQNGNHE

SEQ ID NO: 174872 - protein, 36 aa, Artificial Sequence
  Description of Artificial Sequence: Synthetic polypeptide
DEDEIRTTNPVATEQWGTVSTDQQATTNVATEDGSQ

SEQ ID NO: 174873 - protein, 36 aa, Artificial Sequence
  Description of Artificial Sequence: Synthetic polypeptide
DEDEIRTTNPVATEQWGTVSTDQQGTTNVATEDGAE

SEQ ID NO: 174874 - protein, 32 aa, Artificial Sequence
  Description of Artificial Sequence: Synthetic polypeptide
AENEIRTTNPVSTEPYGTISMEDIQQQQNGDH

SEQ ID NO: 174875 - protein, 32 aa, Artificial Sequence
  Description of Artificial Sequence: Synthetic polypeptide
AENEIRTTNPVSTEPYGTISMEDIQQQQNGAH

SEQ ID NO: 174876 - protein, 34 aa, Artificial Sequence
  Description of Artificial Sequence: Synthetic polypeptide
DENEIRTTNPVSTEPYGTISMEDHIQQQQNGNAH

SEQ ID NO: 174877 - protein, 35 aa, Artificial Sequence
  Description of Artificial Sequence: Synthetic polypeptide
DESEIRTTNPVSTEPYGTVISVMEDISQQQNGGNH

SEQ ID NO: 174878 - protein, 33 aa, Artificial Sequence
  Description of Artificial Sequence: Synthetic polypeptide
AEEEIASVNPVCTEQYGVVCSWALNQSFNSNQA

SEQ ID NO: 174879 - protein, 33 aa, Artificial Sequence
  Description of Artificial Sequence: Synthetic polypeptide
DENEIRTTNPVSTEPYGTISMEDGIQQQQNGHH

SEQ ID NO: 174880 - protein, 32 aa, Artificial Sequence
  Description of Artificial Sequence: Synthetic polypeptide
DDSEVASTNPVSTEGYGNVAANTFIQSRVGQR

SEQ ID NO: 174881 - protein, 36 aa, Artificial Sequence
  Description of Artificial Sequence: Synthetic polypeptide
DEDEIRTTNPVATEQWGTVSTEQIRTTNVATEDGVQ

SEQ ID NO: 174882 - protein, 36 aa, Artificial Sequence
  Description of Artificial Sequence: Synthetic polypeptide
DEDEIRTTNPVATEQWGTVSTEQQATTNVATEGGAS

SEQ ID NO: 174883 - protein, 32 aa, Artificial Sequence
  Description of Artificial Sequence: Synthetic polypeptide
VEDEIATVNPVATEQWGCVAGTGDADAGGNHH

SEQ ID NO: 174884 - protein, 31 aa, Artificial Sequence
  Description of Artificial Sequence: Synthetic polypeptide
DDSEVASTNPVSTEGYGNVAANTFQSRVGQV

SEQ ID NO: 174885 - protein, 33 aa, Artificial Sequence
  Description of Artificial Sequence: Synthetic polypeptide
SEMEIRCTNPVATEQYGCVCEWEHNQHFGSDQA

SEQ ID NO: 174886 - protein, 36 aa, Artificial Sequence
  Description of Artificial Sequence: Synthetic polypeptide
DEDEIRTTNPVATEQWGTVSTEQQNTTNVATEDGAY

SEQ ID NO: 174887 - protein, 35 aa, Artificial Sequence
  Description of Artificial Sequence: Synthetic polypeptide
DETEIRTTNPVAYEQWGVVVHTDNHNQQQFGQGDD

SEQ ID NO: 174888 - protein, 35 aa, Artificial Sequence
  Description of Artificial Sequence: Synthetic polypeptide
DETEIRTTNPVAYEQWGVVVHTDNHQQQQGGQGED

SEQ ID NO: 174889 - protein, 36 aa, Artificial Sequence
  Description of Artificial Sequence: Synthetic polypeptide
DEDEIRTTNPVATEQWGTVSTEQQQATNVATEEGST

SEQ ID NO: 174890 - protein, 33 aa, Artificial Sequence
  Description of Artificial Sequence: Synthetic polypeptide
DENEIRTTNPVSTEPYGTISMEDDIQQQQNHNH

SEQ ID NO: 174891 - protein, 36 aa, Artificial Sequence
  Description of Artificial Sequence: Synthetic polypeptide
DEEEIRTTNPLAYEPYGSVPVYCVNEIFRTGGNNKH

SEQ ID NO: 174892 - protein, 35 aa, Artificial Sequence
  Description of Artificial Sequence: Synthetic polypeptide
DEEEIRTTNPLAYEPYGSVPVYCANEIFHTGGNND

SEQ ID NO: 174893 - protein, 34 aa, Artificial Sequence
  Description of Artificial Sequence: Synthetic polypeptide
AEEEIASVNPVCTEQYGVVCSTWELNQSFGSEQA

SEQ ID NO: 174894 - protein, 36 aa, Artificial Sequence
  Description of Artificial Sequence: Synthetic polypeptide
DEDEIRTTNPVATEQWGTVATEQQQGTNVATEDGAT

SEQ ID NO: 174895 - protein, 36 aa, Artificial Sequence
  Description of Artificial Sequence: Synthetic polypeptide
DEDEIRTTNPVATEQWGSVTSAANNLDDATTPPDEE

SEQ ID NO: 174896 - protein, 34 aa, Artificial Sequence
  Description of Artificial Sequence: Synthetic polypeptide
DESEIRTTNPVATECWGGSFGCINEPEAREFENG

SEQ ID NO: 174897 - protein, 34 aa, Artificial Sequence
  Description of Artificial Sequence: Synthetic polypeptide
SEMEIRTTNPVATEQYGSSYFCTVEGMGTEDVEQ

SEQ ID NO: 174898 - protein, 37 aa, Artificial Sequence
  Description of Artificial Sequence: Synthetic polypeptide
AEDEICTTNPVATEAYGSVSTVVTEQIGNGQTGNETM

SEQ ID NO: 174899 - protein, 34 aa, Artificial Sequence
  Description of Artificial Sequence: Synthetic polypeptide
DETEIRTTNPVAYECWGCVSGGEGEERNNMNGNQ

SEQ ID NO: 174900 - protein, 35 aa, Artificial Sequence
  Description of Artificial Sequence: Synthetic polypeptide
DETEIRTTNPVAYECWGCVSGGNGEEERNNMNGNA

SEQ ID NO: 174901 - protein, 35 aa, Artificial Sequence
  Description of Artificial Sequence: Synthetic polypeptide
DETEIRTTNPVAYECWGCVTGGGNMGNQRGEGDRR

SEQ ID NO: 174902 - protein, 34 aa, Artificial Sequence
  Description of Artificial Sequence: Synthetic polypeptide
DETEIRTTNPVAYECWGTVYQINENQDRQMQNTG

SEQ ID NO: 174903 - protein, 35 aa, Artificial Sequence
  Description of Artificial Sequence: Synthetic polypeptide
SENEEIATTNPVAYEPWGSVCSGWNDHGGGGNNQR

SEQ ID NO: 174904 - protein, 38 aa, Artificial Sequence
  Description of Artificial Sequence: Synthetic polypeptide
DEEEIRTTNPVATEQYGCVCSVSGEDPNQENFISDNQS

SEQ ID NO: 174905 - protein, 38 aa, Artificial Sequence
  Description of Artificial Sequence: Synthetic polypeptide
AEDEICTTNPVATEAYGSVSTVVTEQAGNNLQTGNNTM

SEQ ID NO: 174906 - protein, 32 aa, Artificial Sequence
  Description of Artificial Sequence: Synthetic polypeptide
DDSEVASTNPVSTEGYGNVAANTEIQSRVGQR

SEQ ID NO: 174907 - protein, 35 aa, Artificial Sequence
  Description of Artificial Sequence: Synthetic polypeptide
SEMEIRTTNPVATEQYGSVSCLPHEQMEISMEEQN

SEQ ID NO: 174908 - protein, 33 aa, Artificial Sequence
  Description of Artificial Sequence: Synthetic polypeptide
DENEIRTTNPVSTEPYGTISMEDIQIQQNNNHW

SEQ ID NO: 174909 - protein, 35 aa, Artificial Sequence
  Description of Artificial Sequence: Synthetic polypeptide
SEMEIRTTNPVATEQYGSTSYPCTWNGMGTEDVEQ

SEQ ID NO: 174910 - protein, 32 aa, Artificial Sequence
  Description of Artificial Sequence: Synthetic polypeptide
DDSEVASTNPVSTEGYGNVAANPIQSRVGWQR

SEQ ID NO: 174911 - protein, 32 aa, Artificial Sequence
  Description of Artificial Sequence: Synthetic polypeptide
AEEEIASVNPVCTEQYGVVCSWELASFGSQQA

SEQ ID NO: 174912 - protein, 34 aa, Artificial Sequence
  Description of Artificial Sequence: Synthetic polypeptide
SEMEIRTTNPVATEQYGSSYPCTYIGMGTEDVEQ

SEQ ID NO: 174913 - protein, 35 aa, Artificial Sequence
  Description of Artificial Sequence: Synthetic polypeptide
DEAEISTTNPVATEGYGCVCSTGELNAEYFGSDQS

SEQ ID NO: 174914 - protein, 34 aa, Artificial Sequence
  Description of Artificial Sequence: Synthetic polypeptide
DETEIRTTNPVAYEQWGEVMWTEHDNRGGGTGDP

SEQ ID NO: 174915 - protein, 35 aa, Artificial Sequence
  Description of Artificial Sequence: Synthetic polypeptide
SEMEIRTTNPVATEQYGSSYPCTMEGLQGTEDVEQ

SEQ ID NO: 174916 - protein, 34 aa, Artificial Sequence
  Description of Artificial Sequence: Synthetic polypeptide
DETEIRTTNPVAYEQWGGVYTIEIDGMNQAEDDA

SEQ ID NO: 174917 - protein, 32 aa, Artificial Sequence
  Description of Artificial Sequence: Synthetic polypeptide
DDSEVASTNPVSTEGYGNVAANTEPQSRVGQR

SEQ ID NO: 174918 - protein, 33 aa, Artificial Sequence
  Description of Artificial Sequence: Synthetic polypeptide
DESEIRTTNPVSTEPYGVCYCEDGQQQQEGNHG

SEQ ID NO: 174919 - protein, 38 aa, Artificial Sequence
  Description of Artificial Sequence: Synthetic polypeptide
AEDEICTTNPVATEAYGSVSTVVTEQAGNLQAGTNETM

SEQ ID NO: 174920 - protein, 34 aa, Artificial Sequence
  Description of Artificial Sequence: Synthetic polypeptide
SEMEIRTTNPVATEQYGSSYPCINEYQGTEDVEQ

SEQ ID NO: 174921 - protein, 34 aa, Artificial Sequence
  Description of Artificial Sequence: Synthetic polypeptide
DENEIRTTNPVSTEPYGTISMEDIIQQQQNGNHV

SEQ ID NO: 174922 - protein, 33 aa, Artificial Sequence
  Description of Artificial Sequence: Synthetic polypeptide
DETEIRTTNPVAYEQWGSVCVMWEHQEQDMHQF

SEQ ID NO: 174923 - protein, 34 aa, Artificial Sequence
  Description of Artificial Sequence: Synthetic polypeptide
DEDEIRTTNPVATEQWGSCAAGDALGQHPDAQAE

SEQ ID NO: 174924 - protein, 34 aa, Artificial Sequence
  Description of Artificial Sequence: Synthetic polypeptide
DETEIRTTNPVAYEKWGEVASGENQGNHGNGNAD

SEQ ID NO: 174925 - protein, 37 aa, Artificial Sequence
  Description of Artificial Sequence: Synthetic polypeptide
DEEEIRTTNPVATEQYGCVCSWGEDHNIENFNSDTQS

SEQ ID NO: 174926 - protein, 35 aa, Artificial Sequence
  Description of Artificial Sequence: Synthetic polypeptide
DETEIRTTNPVATECWGATVWANAEDEQEREGPYI

SEQ ID NO: 174927 - protein, 39 aa, Artificial Sequence
  Description of Artificial Sequence: Synthetic polypeptide
DEEEIRTTNPVATEAYGVVSTVVNQQLQQGTEQGTEESE

SEQ ID NO: 174928 - protein, 36 aa, Artificial Sequence
  Description of Artificial Sequence: Synthetic polypeptide
DEEEISTTNPVATEQYGCVCSWGEDNQEFFNSDNQS

SEQ ID NO: 174929 - protein, 37 aa, Artificial Sequence
  Description of Artificial Sequence: Synthetic polypeptide
DEEEIRTTNPVATEAYGRVYTPTTMAGPNMRNGMNPV

SEQ ID NO: 174930 - protein, 36 aa, Artificial Sequence
  Description of Artificial Sequence: Synthetic polypeptide
DEEEISTTNPVATEQYGCVCSWGEDNQENFNSDNQA

SEQ ID NO: 174931 - protein, 36 aa, Artificial Sequence
  Description of Artificial Sequence: Synthetic polypeptide
DEEEISTTNPVATEQYGCVCSWGEDNQENFNSDTQS

SEQ ID NO: 174932 - protein, 34 aa, Artificial Sequence
  Description of Artificial Sequence: Synthetic polypeptide
CEEEIATTNPVAYEQYGSCATGPAPNNGMLDQMN

SEQ ID NO: 174933 - protein, 38 aa, Artificial Sequence
  Description of Artificial Sequence: Synthetic polypeptide
AEDEIRTTNPVATEQYGVVSTVTNLQLQLQQNATTNVD

SEQ ID NO: 174934 - protein, 34 aa, Artificial Sequence
  Description of Artificial Sequence: Synthetic polypeptide
DEDEIACTNPVATEQYGSCSAGNNPDENGMDMEH

SEQ ID NO: 174935 - protein, 35 aa, Artificial Sequence
  Description of Artificial Sequence: Synthetic polypeptide
SQEEIRTTNPVATEQWGCVCSWGELNQENFNSDQA

SEQ ID NO: 174936 - protein, 36 aa, Artificial Sequence
  Description of Artificial Sequence: Synthetic polypeptide
DEEEIRTTNPVAYEQYGQSASPVANQAASVREVELY

SEQ ID NO: 174937 - protein, 39 aa, Artificial Sequence
  Description of Artificial Sequence: Synthetic polypeptide
DEEEIRTTNPVATEAYGVVSTVQNNQAGTEAGTTTNEDE

SEQ ID NO: 174938 - protein, 35 aa, Artificial Sequence
  Description of Artificial Sequence: Synthetic polypeptide
DEAEIRTTNPVAYEQWGVVYMSPNPGEQPQDGGQK

SEQ ID NO: 174939 - protein, 35 aa, Artificial Sequence
  Description of Artificial Sequence: Synthetic polypeptide
DEAEIRTTNPVAYEQWGVVYMTDQEDNRQGQNGHA

SEQ ID NO: 174940 - protein, 33 aa, Artificial Sequence
  Description of Artificial Sequence: Synthetic polypeptide
DETEIRTTNPIATECYGATVANAEDWQEPKGEI

SEQ ID NO: 174941 - protein, 33 aa, Artificial Sequence
  Description of Artificial Sequence: Synthetic polypeptide
DETEIRTTNPIATECYGATVANAEDWQEPKGPI

SEQ ID NO: 174942 - protein, 36 aa, Artificial Sequence
  Description of Artificial Sequence: Synthetic polypeptide
DEEEISTTNPCATEQYGQCVCPTEHNQENFGSDNQA

SEQ ID NO: 174943 - protein, 36 aa, Artificial Sequence
  Description of Artificial Sequence: Synthetic polypeptide
SQEEIRTTNPVATEQWGCVCSTTGELNQENFGSDQA

SEQ ID NO: 174944 - protein, 40 aa, Artificial Sequence
  Description of Artificial Sequence: Synthetic polypeptide
DEEEIRTTNPVATEQYGSVSTVVVVVNNNNTEQGSNNQDD

SEQ ID NO: 174945 - protein, 37 aa, Artificial Sequence
  Description of Artificial Sequence: Synthetic polypeptide
DEEEISTTNPVATEQYGCVCSWGEDTNQENFNSQNQS

SEQ ID NO: 174946 - protein, 32 aa, Artificial Sequence
  Description of Artificial Sequence: Synthetic polypeptide
DETEIRTTNPIATECYGATWANEDWAEHKGPI

SEQ ID NO: 174947 - protein, 37 aa, Artificial Sequence
  Description of Artificial Sequence: Synthetic polypeptide
CEEEIRTTNPVATEQYGCVCSMTGEHNQEGFGSDTQS

SEQ ID NO: 174948 - protein, 37 aa, Artificial Sequence
  Description of Artificial Sequence: Synthetic polypeptide
DEEEISTTNPVATEQYGCVCSWGEGHNQENFGSDNQS

SEQ ID NO: 174949 - protein, 32 aa, Artificial Sequence
  Description of Artificial Sequence: Synthetic polypeptide
DETEIRTTNPIATECYGAVWSNEECWAEHEEI

SEQ ID NO: 174950 - protein, 36 aa, Artificial Sequence
  Description of Artificial Sequence: Synthetic polypeptide
DEEEIRTTNPVAYEQYGQSASVANQAAVVNVNVEEY

SEQ ID NO: 174951 - protein, 32 aa, Artificial Sequence
  Description of Artificial Sequence: Synthetic polypeptide
DETEIRTTNPIATECYGAVWSNEEDWAEHEEI

SEQ ID NO: 174952 - protein, 35 aa, Artificial Sequence
  Description of Artificial Sequence: Synthetic polypeptide
SQEEIRTTNPVATEQWGCVCSSGETNQENFGSDQA

SEQ ID NO: 174953 - protein, 35 aa, Artificial Sequence
  Description of Artificial Sequence: Synthetic polypeptide
DEEEISTTNPVATEQYGCVCSWGEDIENFNSDTQS

SEQ ID NO: 174954 - protein, 34 aa, Artificial Sequence
  Description of Artificial Sequence: Synthetic polypeptide
DENEIRTTNPVSTEPYGTISNMEDIQQQQNGNGH

SEQ ID NO: 174955 - protein, 36 aa, Artificial Sequence
  Description of Artificial Sequence: Synthetic polypeptide
DEEEISTTNPVATEQYGCVCSWGEDHNQNSNSDNQS

SEQ ID NO: 174956 - protein, 36 aa, Artificial Sequence
  Description of Artificial Sequence: Synthetic polypeptide
DEEEISTTNPVATEQYGCVCSWGEDHNQNFISDNQG

SEQ ID NO: 174957 - protein, 37 aa, Artificial Sequence
  Description of Artificial Sequence: Synthetic polypeptide
DEEEIRTTNPVAYEQYGQCVCSWPDHNQENFGSENQA

SEQ ID NO: 174958 - protein, 32 aa, Artificial Sequence
  Description of Artificial Sequence: Synthetic polypeptide
DDSEVASTNPVSTEGYGNVAANDIDQDREGQR

SEQ ID NO: 174959 - protein, 31 aa, Artificial Sequence
  Description of Artificial Sequence: Synthetic polypeptide
DDSEVASTNPVSTEGYGNVAANDIQDRVGQL

SEQ ID NO: 174960 - protein, 35 aa, Artificial Sequence
  Description of Artificial Sequence: Synthetic polypeptide
CEEEIATTNPVAYEQYGSPCATGPALNNGMLDQGN

SEQ ID NO: 174961 - protein, 31 aa, Artificial Sequence
  Description of Artificial Sequence: Synthetic polypeptide
DDSEVASTNPVSTEGYGNVAANDIQSREGQQ

SEQ ID NO: 174962 - protein, 33 aa, Artificial Sequence
  Description of Artificial Sequence: Synthetic polypeptide
DETEIRTTNPIATECWGTVCANADDWAPKGNYD

SEQ ID NO: 174963 - protein, 36 aa, Artificial Sequence
  Description of Artificial Sequence: Synthetic polypeptide
DEEEISTTNPVATEQYGCVCSWGEDHNQEGFGSDQS

SEQ ID NO: 174964 - protein, 36 aa, Artificial Sequence
  Description of Artificial Sequence: Synthetic polypeptide
DEPEIRTTNPVATEQYGSVQVAGEEQKENTEEANIM

SEQ ID NO: 174965 - protein, 30 aa, Artificial Sequence
  Description of Artificial Sequence: Synthetic polypeptide
YDSEIASVNPVSTEGYGNVAADNIQSSGQR

SEQ ID NO: 174966 - protein, 35 aa, Artificial Sequence
  Description of Artificial Sequence: Synthetic polypeptide
DEDEIACTNPVATEQYGSVCAMTTGGADSIGNENT

SEQ ID NO: 174967 - protein, 37 aa, Artificial Sequence
  Description of Artificial Sequence: Synthetic polypeptide
DEEEISTTNPVATEQYGCVCSWGEDHNQEGFISDNQA

SEQ ID NO: 174968 - protein, 37 aa, Artificial Sequence
  Description of Artificial Sequence: Synthetic polypeptide
DEEEISTTNPVATEQYGCVCSWGEDHNQEGFNSENQA

SEQ ID NO: 174969 - protein, 38 aa, Artificial Sequence
  Description of Artificial Sequence: Synthetic polypeptide
DEEEIRTTNPVAYEQYGQMVCSQLNDLLQADSGQITKN

SEQ ID NO: 174970 - protein, 34 aa, Artificial Sequence
  Description of Artificial Sequence: Synthetic polypeptide
DEAEIRTTNPVAYEQWGVVTGGNAGNQGETNDDT

SEQ ID NO: 174971 - protein, 37 aa, Artificial Sequence
  Description of Artificial Sequence: Synthetic polypeptide
DEEEIRTTNPVATEQYGAVVDGFTQDDTNQDGGDTDS

SEQ ID NO: 174972 - protein, 36 aa, Artificial Sequence
  Description of Artificial Sequence: Synthetic polypeptide
DEEEIRTTNPVAYEQYGQSAASVANQAASVREVEEY

SEQ ID NO: 174973 - protein, 35 aa, Artificial Sequence
  Description of Artificial Sequence: Synthetic polypeptide
DEDEIACTNPVATEQYGSVCAATMHGENTMDQDDR

SEQ ID NO: 174974 - protein, 34 aa, Artificial Sequence
  Description of Artificial Sequence: Synthetic polypeptide
CEEEIATTNPVAYEQYGSCATTAALTNNDLDQAN

SEQ ID NO: 174975 - protein, 35 aa, Artificial Sequence
  Description of Artificial Sequence: Synthetic polypeptide
DEDEIACTNPVATEQYGSVCAATMHGENTADGGDL

SEQ ID NO: 174976 - protein, 36 aa, Artificial Sequence
  Description of Artificial Sequence: Synthetic polypeptide
DEEEISTTNPVATEQYGCVCSWGEDHNQENFNSDQS

SEQ ID NO: 174977 - protein, 36 aa, Artificial Sequence
  Description of Artificial Sequence: Synthetic polypeptide
DEDEIACTNPVATEQYGSVCAATENLAGTPGAEDAM

SEQ ID NO: 174978 - protein, 35 aa, Artificial Sequence
  Description of Artificial Sequence: Synthetic polypeptide
DEDEIACTNPVATEQYGSVCAATANEEMMGMPTEG

SEQ ID NO: 174979 - protein, 36 aa, Artificial Sequence
  Description of Artificial Sequence: Synthetic polypeptide
DEEEISTTNPVATEQYGCVCSWGEDHNQNFGSDPQS

SEQ ID NO: 174980 - protein, 36 aa, Artificial Sequence
  Description of Artificial Sequence: Synthetic polypeptide
DEEEISTTNPVATEQYGCVCSWGEDHNQNFGSDTQA

SEQ ID NO: 174981 - protein, 36 aa, Artificial Sequence
  Description of Artificial Sequence: Synthetic polypeptide
DEEEISTTNPVATEQYGCVCSWGEDHNQNFGSDTQL

SEQ ID NO: 174982 - protein, 36 aa, Artificial Sequence
  Description of Artificial Sequence: Synthetic polypeptide
DEEEISTTNPVATEQYGCVCSWGEDHNQNFNSDTQA

SEQ ID NO: 174983 - protein, 32 aa, Artificial Sequence
  Description of Artificial Sequence: Synthetic polypeptide
DDSEVASTNPVSTEGYGNVAANDCIQSRVGQR

SEQ ID NO: 174984 - protein, 34 aa, Artificial Sequence
  Description of Artificial Sequence: Synthetic polypeptide
DEDEIACTNPVATEQYGCVAGTNSHPEPDMDIRA

SEQ ID NO: 174985 - protein, 35 aa, Artificial Sequence
  Description of Artificial Sequence: Synthetic polypeptide
SQEEIRTTNPVATEQWGCVCSNWEDNQENFGSNQA

SEQ ID NO: 174986 - protein, 35 aa, Artificial Sequence
  Description of Artificial Sequence: Synthetic polypeptide
DEEEISTTNPVATEQYGCVCSWGEHNASFNSETQP

SEQ ID NO: 174987 - protein, 36 aa, Artificial Sequence
  Description of Artificial Sequence: Synthetic polypeptide
DEEEISTTNPVATEQYGCVCSWGEHNEENFNSETQG

SEQ ID NO: 174988 - protein, 37 aa, Artificial Sequence
  Description of Artificial Sequence: Synthetic polypeptide
AEEEIRTTNPVATEQYGSVQPAALPDDIQMIEPANIL

SEQ ID NO: 174989 - protein, 39 aa, Artificial Sequence
  Description of Artificial Sequence: Synthetic polypeptide
DEEEIRTTNPVATEAYGVVSTVTNGNLQQGTEQGTTEEN

SEQ ID NO: 174990 - protein, 35 aa, Artificial Sequence
  Description of Artificial Sequence: Synthetic polypeptide
DEEEISTTNPVATEQYGCVCSWGEHNENFNSETQA

SEQ ID NO: 174991 - protein, 35 aa, Artificial Sequence
  Description of Artificial Sequence: Synthetic polypeptide
DEEEISTTNPVATEQYGCVCSWGEHNEYFNSDTQS

SEQ ID NO: 174992 - protein, 39 aa, Artificial Sequence
  Description of Artificial Sequence: Synthetic polypeptide
DEEEIRTTNPVATEAYGVVSTVTNGQAGTEQGTVTNEDE

SEQ ID NO: 174993 - protein, 39 aa, Artificial Sequence
  Description of Artificial Sequence: Synthetic polypeptide
DEEEIRTTNPVATEAYGVVSTVTNLALQQGTEQGTTEEE

SEQ ID NO: 174994 - protein, 35 aa, Artificial Sequence
  Description of Artificial Sequence: Synthetic polypeptide
SQAEIRTTNPVATEQYGSCSAPNEHNTLESQNTSQ

SEQ ID NO: 174995 - protein, 37 aa, Artificial Sequence
  Description of Artificial Sequence: Synthetic polypeptide
DEEEIRTTNPVAYEQYGQSATSVTNQAASTREVEVEY

SEQ ID NO: 174996 - protein, 37 aa, Artificial Sequence
  Description of Artificial Sequence: Synthetic polypeptide
DEEEIRTTNPVAYEQYGQSAVFVANQAASVRVNVEEY

SEQ ID NO: 174997 - protein, 34 aa, Artificial Sequence
  Description of Artificial Sequence: Synthetic polypeptide
SQAEIRTTNPVATEQYGMCCSPMALQHSGQDSKQ

SEQ ID NO: 174998 - protein, 36 aa, Artificial Sequence
  Description of Artificial Sequence: Synthetic polypeptide
DEEEISTTNPVATEQYGCVCSWGEHNIENFISDNQL

SEQ ID NO: 174999 - protein, 39 aa, Artificial Sequence
  Description of Artificial Sequence: Synthetic polypeptide
DEEEIRTTNPVATEAYGVVSTVTNLNLQQGTEQGTEDED

SEQ ID NO: 175000 - protein, 34 aa, Artificial Sequence
  Description of Artificial Sequence: Synthetic polypeptide
SQAEIRTTNPVATEQYGMCCSASVLQHSGQDSKN

SEQ ID NO: 175001 - protein, 36 aa, Artificial Sequence
  Description of Artificial Sequence: Synthetic polypeptide
DEEEISTTNPVATEQYGCVCSWGEHNIENFISDNQS

SEQ ID NO: 175002 - protein, 36 aa, Artificial Sequence
  Description of Artificial Sequence: Synthetic polypeptide
DEEEISTTNPVATEQYGCVCSWGEHNIENFISENQS

SEQ ID NO: 175003 - protein, 36 aa, Artificial Sequence
  Description of Artificial Sequence: Synthetic polypeptide
DEEEISTTNPVATEQYGCVCSWGEHNQEFFFSDNQS

SEQ ID NO: 175004 - protein, 36 aa, Artificial Sequence
  Description of Artificial Sequence: Synthetic polypeptide
DEEEISTTNPVATEQYGCVCSWGEHNQEFFGSDTQA

SEQ ID NO: 175005 - protein, 36 aa, Artificial Sequence
  Description of Artificial Sequence: Synthetic polypeptide
DEEEISTTNPVATEQYGCVCSWGEHNQEHFGSETQS

SEQ ID NO: 175006 - protein, 36 aa, Artificial Sequence
  Description of Artificial Sequence: Synthetic polypeptide
DEEEISTTNPVATEQYGCVCSWGEHNQENFGSDTQT

SEQ ID NO: 175007 - protein, 34 aa, Artificial Sequence
  Description of Artificial Sequence: Synthetic polypeptide
SQAEIRTTNPVATEQYGCCSAENEHQLESQNTSQ

SEQ ID NO: 175008 - protein, 39 aa, Artificial Sequence
  Description of Artificial Sequence: Synthetic polypeptide
DEEEIRTTNPVATEAYGVVSTVTNLNNQQGTEQGTDEEE

SEQ ID NO: 175009 - protein, 37 aa, Artificial Sequence
  Description of Artificial Sequence: Synthetic polypeptide
AEEEIRTTNPVATEQYGSVQPAAVPLDIQMIEPMNLL

SEQ ID NO: 175010 - protein, 39 aa, Artificial Sequence
  Description of Artificial Sequence: Synthetic polypeptide
DEEEIRTTNPVATEAYGVVSTVTNLNQQQGTEQGTEESE

SEQ ID NO: 175011 - protein, 39 aa, Artificial Sequence
  Description of Artificial Sequence: Synthetic polypeptide
DEEEIRTTNPVATEAYGVVSTVTNDNLQAGTEQGTEEED

SEQ ID NO: 175012 - protein, 35 aa, Artificial Sequence
  Description of Artificial Sequence: Synthetic polypeptide
DETEIRTTNPIATECYGSTTWANAEDLAERKGPYI

SEQ ID NO: 175013 - protein, 36 aa, Artificial Sequence
  Description of Artificial Sequence: Synthetic polypeptide
DEEEISTTNPVATEQYGCVCSWGEHNAESFNSENQA

SEQ ID NO: 175014 - protein, 36 aa, Artificial Sequence
  Description of Artificial Sequence: Synthetic polypeptide
DEEEISTTNPVATEQYGCVCSWGEHNAENFNSETQA

SEQ ID NO: 175015 - protein, 35 aa, Artificial Sequence
  Description of Artificial Sequence: Synthetic polypeptide
DETEIRTTNPIATECYGSTTWSNAEDLAERKGPYI

SEQ ID NO: 175016 - protein, 33 aa, Artificial Sequence
  Description of Artificial Sequence: Synthetic polypeptide
DENEIRTTNPVSTEPYGTISNMEDIQQQQNGMH

SEQ ID NO: 175017 - protein, 35 aa, Artificial Sequence
  Description of Artificial Sequence: Synthetic polypeptide
DEEEISTTNPVATEQYGCVCSWGEHDAEGFISEQS

SEQ ID NO: 175018 - protein, 34 aa, Artificial Sequence
  Description of Artificial Sequence: Synthetic polypeptide
DEAEIRTTNPVAYEQYGCICSTEHNENFPSQTQS

SEQ ID NO: 175019 - protein, 34 aa, Artificial Sequence
  Description of Artificial Sequence: Synthetic polypeptide
DEAEIRTTNPVAYEQYGCICSTEHNTENFPSDQA

SEQ ID NO: 175020 - protein, 32 aa, Artificial Sequence
  Description of Artificial Sequence: Synthetic polypeptide
YEDEIRCTNPAATEAYGVVVSEGGMGGEGNET

SEQ ID NO: 175021 - protein, 32 aa, Artificial Sequence
  Description of Artificial Sequence: Synthetic polypeptide
SQEEIRTTNPVATEHWGTYSFNETEVFINAKT

SEQ ID NO: 175022 - protein, 34 aa, Artificial Sequence
  Description of Artificial Sequence: Synthetic polypeptide
CEEEIATTNPVAYEQYGSCAATAALTQNHLDQAN

SEQ ID NO: 175023 - protein, 36 aa, Artificial Sequence
  Description of Artificial Sequence: Synthetic polypeptide
TETPIRSTNPVAYEHYGQSVVVSTNYEWTQSVGNRN

SEQ ID NO: 175024 - protein, 32 aa, Artificial Sequence
  Description of Artificial Sequence: Synthetic polypeptide
SQEEIRTTNPVATECWGTYSSWNETEVIINKT

SEQ ID NO: 175025 - protein, 35 aa, Artificial Sequence
  Description of Artificial Sequence: Synthetic polypeptide
DEAEIRTTNPVAYEQYGCICSTGEHNENFPSNNQA

SEQ ID NO: 175026 - protein, 36 aa, Artificial Sequence
  Description of Artificial Sequence: Synthetic polypeptide
DEEEISTTNPVATEQYGCVCSWGEHFQENFNSDNQA

SEQ ID NO: 175027 - protein, 34 aa, Artificial Sequence
  Description of Artificial Sequence: Synthetic polypeptide
DEAEIRTTNPVAYEQYGCICSTGEHNINFPSDQA

SEQ ID NO: 175028 - protein, 36 aa, Artificial Sequence
  Description of Artificial Sequence: Synthetic polypeptide
DESEITTTNPVATEQYGTGVCSATSGPVEFQHENID

SEQ ID NO: 175029 - protein, 35 aa, Artificial Sequence
  Description of Artificial Sequence: Synthetic polypeptide
YEDEIRGTNPVATEFWGIVSAANGEGQRGQQEGND

SEQ ID NO: 175030 - protein, 33 aa, Artificial Sequence
  Description of Artificial Sequence: Synthetic polypeptide
YEDEIRGTNPVATEGWGSVSAGMEGEDGEGENG

SEQ ID NO: 175031 - protein, 35 aa, Artificial Sequence
  Description of Artificial Sequence: Synthetic polypeptide
DEAEIRTTNPVAYEQYGCICSTSELNEENFPSDQA

SEQ ID NO: 175032 - protein, 35 aa, Artificial Sequence
  Description of Artificial Sequence: Synthetic polypeptide
DEEEISTTNPVATEQYGCVCSWGEHIENFFSETQS

SEQ ID NO: 175033 - protein, 36 aa, Artificial Sequence
  Description of Artificial Sequence: Synthetic polypeptide
DEEEISTTNPVATEQYGCVCSWGEHNAENFISDNQL

SEQ ID NO: 175034 - protein, 36 aa, Artificial Sequence
  Description of Artificial Sequence: Synthetic polypeptide
DEEEISTTNPVATEQYGCVCSWGEHNAENFISDNQS

SEQ ID NO: 175035 - protein, 36 aa, Artificial Sequence
  Description of Artificial Sequence: Synthetic polypeptide
DEEEISTTNPVATEQYGCVCSWGEHNAENFNSDNQA

SEQ ID NO: 175036 - protein, 37 aa, Artificial Sequence
  Description of Artificial Sequence: Synthetic polypeptide
DEEEIRTTNPVATEQYGCVCSMWGEDHQEFFGSDTQS

SEQ ID NO: 175037 - protein, 36 aa, Artificial Sequence
  Description of Artificial Sequence: Synthetic polypeptide
DEEEISTTNPVATEQYGCVCSWGEHNAENFNSDNQS

SEQ ID NO: 175038 - protein, 36 aa, Artificial Sequence
  Description of Artificial Sequence: Synthetic polypeptide
DEEEISTTNPVATEQYGCVCSWGEHNAENFNSDTQS

SEQ ID NO: 175039 - protein, 33 aa, Artificial Sequence
  Description of Artificial Sequence: Synthetic polypeptide
DEAEIRTTNPVAYEQYGCICSWEHEENFPSQQA

SEQ ID NO: 175040 - protein, 36 aa, Artificial Sequence
  Description of Artificial Sequence: Synthetic polypeptide
DEEEISTTNPVATEQYGCVCSWGEHNAENFNSQTQS

SEQ ID NO: 175041 - protein, 36 aa, Artificial Sequence
  Description of Artificial Sequence: Synthetic polypeptide
DEEEIRTTNPVAYEQYGQCVCSWMPDHNQNFGSQQN

SEQ ID NO: 175042 - protein, 37 aa, Artificial Sequence
  Description of Artificial Sequence: Synthetic polypeptide
CEEEIATTNPVAYEQYGSVAAITNNEEAPGNQMEGRM

SEQ ID NO: 175043 - protein, 38 aa, Artificial Sequence
  Description of Artificial Sequence: Synthetic polypeptide
AEDEIRTTNPVATEQYGVVSTVTNQQGNQQQNGTTNVD

SEQ ID NO: 175044 - protein, 34 aa, Artificial Sequence
  Description of Artificial Sequence: Synthetic polypeptide
DEDEIATTNPVATAQWGGCCATGAGQTQMGNDRN

SEQ ID NO: 175045 - protein, 35 aa, Artificial Sequence
  Description of Artificial Sequence: Synthetic polypeptide
DEDEIATTNPVATAQWGGCCATGAALQVQMGNDRN

SEQ ID NO: 175046 - protein, 32 aa, Artificial Sequence
  Description of Artificial Sequence: Synthetic polypeptide
AEDEIRTTNPVAYEQWGCVTGNINDVGQGDSP

SEQ ID NO: 175047 - protein, 37 aa, Artificial Sequence
  Description of Artificial Sequence: Synthetic polypeptide
AEEEIRTTNPVATEQYGQCVCSSGEHNQENFGSENQP

SEQ ID NO: 175048 - protein, 36 aa, Artificial Sequence
  Description of Artificial Sequence: Synthetic polypeptide
DEEEISTTNPVATEQYGCVCSWEEDHNAENFNSDQS

SEQ ID NO: 175049 - protein, 35 aa, Artificial Sequence
  Description of Artificial Sequence: Synthetic polypeptide
SSEEIRTTNPAATDAYGSVVSTEGQGIQGGQGNGQ

SEQ ID NO: 175050 - protein, 34 aa, Artificial Sequence
  Description of Artificial Sequence: Synthetic polypeptide
AEDEIRTTNPVAYEHWGCFSWINDEQRRNGIKNE

SEQ ID NO: 175051 - protein, 34 aa, Artificial Sequence
  Description of Artificial Sequence: Synthetic polypeptide
DEDEIATTNPVATAQWGGCCAAGALQQMGGNDRN

SEQ ID NO: 175052 - protein, 38 aa, Artificial Sequence
  Description of Artificial Sequence: Synthetic polypeptide
AEDEIRTTNPVATEQYGVVSTVVNNTQQLDQGTNVATE

SEQ ID NO: 175053 - protein, 37 aa, Artificial Sequence
  Description of Artificial Sequence: Synthetic polypeptide
HSEEIRTTNPVATEQYGSVTILTVNTEEHRSLAGPVS

SEQ ID NO: 175054 - protein, 36 aa, Artificial Sequence
  Description of Artificial Sequence: Synthetic polypeptide
AEEEIRTTNPVATEQYGQCVCSTGEHQENFISDTQM

SEQ ID NO: 175055 - protein, 36 aa, Artificial Sequence
  Description of Artificial Sequence: Synthetic polypeptide
DEAEIRTTNPVAYEQWGSVCVNENNQQQDGQDNVQM

SEQ ID NO: 175056 - protein, 36 aa, Artificial Sequence
  Description of Artificial Sequence: Synthetic polypeptide
DEEEISTTNPVATEQYGCVCSWEEDHNQNFISDNQP

SEQ ID NO: 175057 - protein, 34 aa, Artificial Sequence
  Description of Artificial Sequence: Synthetic polypeptide
DEAEIRTTNPVAYEQWGSVCYMNDNHDMGGGQMM

SEQ ID NO: 175058 - protein, 35 aa, Artificial Sequence
  Description of Artificial Sequence: Synthetic polypeptide
DEAEIRTTNPVAYEQWGSVCYMNDNHDRGGGGPIT

SEQ ID NO: 175059 - protein, 35 aa, Artificial Sequence
  Description of Artificial Sequence: Synthetic polypeptide
SSEEIATTNPVAYHQYGSVVNSVWHSQERGGINGQ

SEQ ID NO: 175060 - protein, 35 aa, Artificial Sequence
  Description of Artificial Sequence: Synthetic polypeptide
SSEEIATTNPVAYHQYGSVVHSCVHSQERGGDNFQ

SEQ ID NO: 175061 - protein, 34 aa, Artificial Sequence
  Description of Artificial Sequence: Synthetic polypeptide
SSEEIATTNPVAYHQYGSVVHCVHSQERGGMNSQ

SEQ ID NO: 175062 - protein, 34 aa, Artificial Sequence
  Description of Artificial Sequence: Synthetic polypeptide
SSEEIATTNPVAYHQYGSVVHCAHSQERGGINMQ

SEQ ID NO: 175063 - protein, 34 aa, Artificial Sequence
  Description of Artificial Sequence: Synthetic polypeptide
SSEEIATTNPVAYHQYGSTVHCPHSQERGGINFQ

SEQ ID NO: 175064 - protein, 35 aa, Artificial Sequence
  Description of Artificial Sequence: Synthetic polypeptide
DEAEIRTTNPVAYEQWGSVCYNQDNDDQLTGGGTQ

SEQ ID NO: 175065 - protein, 34 aa, Artificial Sequence
  Description of Artificial Sequence: Synthetic polypeptide
SSEEIATTNPVAYHHYGSVVSCVHSQARGGVNFQ

SEQ ID NO: 175066 - protein, 36 aa, Artificial Sequence
  Description of Artificial Sequence: Synthetic polypeptide
DEEEISTTNPVATEQYGCVCSWEEDHQEYFNSDNQD

SEQ ID NO: 175067 - protein, 36 aa, Artificial Sequence
  Description of Artificial Sequence: Synthetic polypeptide
DEEEISTTNPVATEQYGCVCSWEEDNQESFNSETQP

SEQ ID NO: 175068 - protein, 36 aa, Artificial Sequence
  Description of Artificial Sequence: Synthetic polypeptide
DEEEISTTNPVATEQYGCVCSWEEHDAEGFISDNQS

SEQ ID NO: 175069 - protein, 36 aa, Artificial Sequence
  Description of Artificial Sequence: Synthetic polypeptide
DEEEISTTNPVATEQYGCVCSWEEDHFQENFGSEFA

SEQ ID NO: 175070 - protein, 35 aa, Artificial Sequence
  Description of Artificial Sequence: Synthetic polypeptide
DEEEISTTNPVATEQYGCVCSWEEHEEYFISDNQA

SEQ ID NO: 175071 - protein, 36 aa, Artificial Sequence
  Description of Artificial Sequence: Synthetic polypeptide
DEEEISTTNPVATEQYGCVCSWEEDHDQEGFISDQA

SEQ ID NO: 175072 - protein, 34 aa, Artificial Sequence
  Description of Artificial Sequence: Synthetic polypeptide
SSEEIRTTNPVATCQYGCVCSWMEHNANFGSDQA

SEQ ID NO: 175073 - protein, 37 aa, Artificial Sequence
  Description of Artificial Sequence: Synthetic polypeptide
DEEEISTTNPVATEQYGCVCSTWGEHNQEHFNSDTQS

SEQ ID NO: 175074 - protein, 37 aa, Artificial Sequence
  Description of Artificial Sequence: Synthetic polypeptide
DEEEISTTNPVATEQYGCVCSTWGEHNQENFGSDTQS

SEQ ID NO: 175075 - protein, 37 aa, Artificial Sequence
  Description of Artificial Sequence: Synthetic polypeptide
DEEEISTTNPVATEQYGCVCSTWGEHNQENFGSEFQP

SEQ ID NO: 175076 - protein, 37 aa, Artificial Sequence
  Description of Artificial Sequence: Synthetic polypeptide
DEEEISTTNPVATEQYGCVCSTWGEHNQENFISDNQA

SEQ ID NO: 175077 - protein, 37 aa, Artificial Sequence
  Description of Artificial Sequence: Synthetic polypeptide
DEEEISTTNPVATEQYGCVCSTWGEHNQESFISENQP

SEQ ID NO: 175078 - protein, 35 aa, Artificial Sequence
  Description of Artificial Sequence: Synthetic polypeptide
DEAEIRTTNPVAYEQWGSVAWNNDQGQHQGGQSMN

SEQ ID NO: 175079 - protein, 37 aa, Artificial Sequence
  Description of Artificial Sequence: Synthetic polypeptide
DEEEISTTNPVATEQYGCVCSTWGEHNQESFNSDTQS

SEQ ID NO: 175080 - protein, 30 aa, Artificial Sequence
  Description of Artificial Sequence: Synthetic polypeptide
DETEIRTTNPIATECWGETAAVWAEPGEYI

SEQ ID NO: 175081 - protein, 37 aa, Artificial Sequence
  Description of Artificial Sequence: Synthetic polypeptide
AEEEIRTTNPVATEQYGQCVCSNTNDNAENFNSDFQA

SEQ ID NO: 175082 - protein, 32 aa, Artificial Sequence
  Description of Artificial Sequence: Synthetic polypeptide
DETEIRTTNPIATECWGETTANAEDWQPGPYK

SEQ ID NO: 175083 - protein, 36 aa, Artificial Sequence
  Description of Artificial Sequence: Synthetic polypeptide
DEEEISTTNPVATEQYGCVCSTWGPHAENFNSETQS

SEQ ID NO: 175084 - protein, 37 aa, Artificial Sequence
  Description of Artificial Sequence: Synthetic polypeptide
DEEEIRTTNPVAYEQWGSVSGGLPANGGNMQNGMGDV

SEQ ID NO: 175085 - protein, 38 aa, Artificial Sequence
  Description of Artificial Sequence: Synthetic polypeptide
DEEEIRTTNPVAYEQWGSVSGGLEANGGNMRNGMGDVR

SEQ ID NO: 175086 - protein, 36 aa, Artificial Sequence
  Description of Artificial Sequence: Synthetic polypeptide
DEAEIRTTNPVAYEQWGSVAWNNDQGQHQGGTNNQS

SEQ ID NO: 175087 - protein, 36 aa, Artificial Sequence
  Description of Artificial Sequence: Synthetic polypeptide
DEAEIRTTNPVAYEQWGSVCQNDDNDDQHGQGGNTH

SEQ ID NO: 175088 - protein, 36 aa, Artificial Sequence
  Description of Artificial Sequence: Synthetic polypeptide
DEEEISTTNPVATEQYGCVCSWEAHFQENFGSETQS

SEQ ID NO: 175089 - protein, 36 aa, Artificial Sequence
  Description of Artificial Sequence: Synthetic polypeptide
DEEEISTTNPVATEQYGCVCSWEDHNQEFFNSDNQA

SEQ ID NO: 175090 - protein, 36 aa, Artificial Sequence
  Description of Artificial Sequence: Synthetic polypeptide
DEEEISTTNPVATEQYGCVCSWEDHNQENFGSDTQS

SEQ ID NO: 175091 - protein, 36 aa, Artificial Sequence
  Description of Artificial Sequence: Synthetic polypeptide
DEEEISTTNPVATEQYGCVCSWEDHNQENFMSENQS

SEQ ID NO: 175092 - protein, 34 aa, Artificial Sequence
  Description of Artificial Sequence: Synthetic polypeptide
DEDEIATTNPVATAQWGGCVAASGANDDTRQNED

SEQ ID NO: 175093 - protein, 36 aa, Artificial Sequence
  Description of Artificial Sequence: Synthetic polypeptide
DEEEISTTNPVATEQYGCVCSWEDHNQENFNSDTQS

SEQ ID NO: 175094 - protein, 36 aa, Artificial Sequence
  Description of Artificial Sequence: Synthetic polypeptide
DEEEIRTTNPVAYEQYGQCVCSWMEDPNQGFGSQQS

SEQ ID NO: 175095 - protein, 34 aa, Artificial Sequence
  Description of Artificial Sequence: Synthetic polypeptide
DEDEIATTNPVATAQWGGCCATGALQQMGQMDRN

SEQ ID NO: 175096 - protein, 35 aa, Artificial Sequence
  Description of Artificial Sequence: Synthetic polypeptide
AEEEIRTTNPVATEQYGQCVCSSEHNENFNSDTQS

SEQ ID NO: 175097 - protein, 34 aa, Artificial Sequence
  Description of Artificial Sequence: Synthetic polypeptide
DEDEIATTNPVATAQWGGCCATGALQHQMNNDRN

SEQ ID NO: 175098 - protein, 38 aa, Artificial Sequence
  Description of Artificial Sequence: Synthetic polypeptide
DEEEIRTTNPVAYEQWGSVSGGEPQNGPNMRNGGGKEG

SEQ ID NO: 175099 - protein, 36 aa, Artificial Sequence
  Description of Artificial Sequence: Synthetic polypeptide
DEEEISTTNPVATEQYGCVCSWEEHNAENFGSDTQS

SEQ ID NO: 175100 - protein, 36 aa, Artificial Sequence
  Description of Artificial Sequence: Synthetic polypeptide
DEEEISTTNPVATEQYGCVCSWEEHNAENFNSDNQA

SEQ ID NO: 175101 - protein, 36 aa, Artificial Sequence
  Description of Artificial Sequence: Synthetic polypeptide
DEEEISTTNPVATEQYGCVCSWEEHNAENFNSDNQS

SEQ ID NO: 175102 - protein, 36 aa, Artificial Sequence
  Description of Artificial Sequence: Synthetic polypeptide
AEEEIRTTNPVATEQYGQCVCSWGEHNQFFNSDFQS

SEQ ID NO: 175103 - protein, 36 aa, Artificial Sequence
  Description of Artificial Sequence: Synthetic polypeptide
AEEEIRTTNPVATEQYGQCVCSWGEHNQNFNSDNQA

SEQ ID NO: 175104 - protein, 35 aa, Artificial Sequence
  Description of Artificial Sequence: Synthetic polypeptide
DETEIRTTNPIATECWGSTTWSNCIDEPQERKGNI

SEQ ID NO: 175105 - protein, 36 aa, Artificial Sequence
  Description of Artificial Sequence: Synthetic polypeptide
DETEIRTTNPIATECWGSTVWSNCIDEPQERKGENG

SEQ ID NO: 175106 - protein, 37 aa, Artificial Sequence
  Description of Artificial Sequence: Synthetic polypeptide
DEAEIRTTNPVAYEQWGSVSGGEPANGPNMRNGMNPG

SEQ ID NO: 175107 - protein, 32 aa, Artificial Sequence
  Description of Artificial Sequence: Synthetic polypeptide
DETEIRTTNPIATECWGSTWANAEDWAEPGPI

SEQ ID NO: 175108 - protein, 37 aa, Artificial Sequence
  Description of Artificial Sequence: Synthetic polypeptide
DEEEIRTTNPVAYEQWGSVSGGEPPNGPNMREGGGTQ

SEQ ID NO: 175109 - protein, 32 aa, Artificial Sequence
  Description of Artificial Sequence: Synthetic polypeptide
DETEIRTTNPIATECWGSTWSNAEDWAEPGPI

SEQ ID NO: 175110 - protein, 32 aa, Artificial Sequence
  Description of Artificial Sequence: Synthetic polypeptide
DETEIRTTNPIATECWGSTWSNEDWAEPKGPI

SEQ ID NO: 175111 - protein, 35 aa, Artificial Sequence
  Description of Artificial Sequence: Synthetic polypeptide
DENEIRTTNPVSTEPYGTISNWEDHNQEQFGSNQS

SEQ ID NO: 175112 - protein, 34 aa, Artificial Sequence
  Description of Artificial Sequence: Synthetic polypeptide
DETEIRTTNPIATECWGSVWANAEDWAERKGPYI

SEQ ID NO: 175113 - protein, 34 aa, Artificial Sequence
  Description of Artificial Sequence: Synthetic polypeptide
DETEIRTTNPIATECWGSVWANAENWMEPKGPYR

SEQ ID NO: 175114 - protein, 37 aa, Artificial Sequence
  Description of Artificial Sequence: Synthetic polypeptide
DEEEIRTTNPVAYEQWGSVSGGEPGNGGNMRNDMNPM

SEQ ID NO: 175115 - protein, 36 aa, Artificial Sequence
  Description of Artificial Sequence: Synthetic polypeptide
DEEEISTTNPVATEQYGCVCSWGEAHNQENFNSEQS

SEQ ID NO: 175116 - protein, 36 aa, Artificial Sequence
  Description of Artificial Sequence: Synthetic polypeptide
DEEEISTTNPVATEQYGCVCSWGEDDEQNFNSDFQA

SEQ ID NO: 175117 - protein, 37 aa, Artificial Sequence
  Description of Artificial Sequence: Synthetic polypeptide
DEEEISTTNPVATEQYGCVCSWGEDDNQEFFGSENQS

SEQ ID NO: 175118 - protein, 37 aa, Artificial Sequence
  Description of Artificial Sequence: Synthetic polypeptide
DEAEIRTTNPVAYEQWGSVSGGEPGNGGNRRNGQNMV

SEQ ID NO: 175119 - protein, 35 aa, Artificial Sequence
  Description of Artificial Sequence: Synthetic polypeptide
DEEEISTTNPVATEQYGCVCSWGEDHAENFGSEQS

SEQ ID NO: 175120 - protein, 37 aa, Artificial Sequence
  Description of Artificial Sequence: Synthetic polypeptide
CEEEIRTTNPVATEQYGCVCSNTGEDNQENFNSDTQA

SEQ ID NO: 175121 - protein, 31 aa, Artificial Sequence
  Description of Artificial Sequence: Synthetic polypeptide
DDSEVASTNPVSTEGYGNVAANCIQSRVGQK

SEQ ID NO: 175122 - protein, 36 aa, Artificial Sequence
  Description of Artificial Sequence: Synthetic polypeptide
DEEEISTTNPVATEQYGCVCSWGEDHEQHFGSDTQS

SEQ ID NO: 175123 - protein, 37 aa, Artificial Sequence
  Description of Artificial Sequence: Synthetic polypeptide
DEPEIRTTNPVATEQYGSVPDWYVSTEMPIIVQNVKE

SEQ ID NO: 175124 - protein, 33 aa, Artificial Sequence
  Description of Artificial Sequence: Synthetic polypeptide
DETEIRTTNPIATECWGTTVWSNAEGPAFKGND

SEQ ID NO: 175125 - protein, 34 aa, Artificial Sequence
  Description of Artificial Sequence: Synthetic polypeptide
DESEIVTTNPVATECYGTVSACIGEPEDFEGENG

SEQ ID NO: 175126 - protein, 34 aa, Artificial Sequence
  Description of Artificial Sequence: Synthetic polypeptide
DESEIVTTNPVATECYGTVSACDGEPEDFEGENG

SEQ ID NO: 175127 - protein, 36 aa, Artificial Sequence
  Description of Artificial Sequence: Synthetic polypeptide
DEDEIACTNPVAYEQYGSVCSANPALEEHQGDNQDD

SEQ ID NO: 175128 - protein, 32 aa, Artificial Sequence
  Description of Artificial Sequence: Synthetic polypeptide
WENEIATTNPVSTEPYGTISMEDIQQQQNGNH

SEQ ID NO: 175129 - protein, 35 aa, Artificial Sequence
  Description of Artificial Sequence: Synthetic polypeptide
DETEIRTTNPIATECWGSTTSANTPDWNMRKGNYI

SEQ ID NO: 175130 - protein, 36 aa, Artificial Sequence
  Description of Artificial Sequence: Synthetic polypeptide
DEAEIRTTNPVAYEQWGSVSGGEPAGGNMRNGMNDV

SEQ ID NO: 175131 - protein, 36 aa, Artificial Sequence
  Description of Artificial Sequence: Synthetic polypeptide
DEEEISTTNPVATEQYGCVCSWEEHNAENFNSDTQA

SEQ ID NO: 175132 - protein, 36 aa, Artificial Sequence
  Description of Artificial Sequence: Synthetic polypeptide
DEEEISTTNPVATEQYGCVCSWEEHNIENFNSDNQA

SEQ ID NO: 175133 - protein, 36 aa, Artificial Sequence
  Description of Artificial Sequence: Synthetic polypeptide
DEEEISTTNPVATEQYGCVCSWEEHNQEAFNSDTQS

SEQ ID NO: 175134 - protein, 37 aa, Artificial Sequence
  Description of Artificial Sequence: Synthetic polypeptide
AEEEIRTTNPVATEQYGQCVCSTTGEHNQENFGSEQP

SEQ ID NO: 175135 - protein, 35 aa, Artificial Sequence
  Description of Artificial Sequence: Synthetic polypeptide
SQGEIRTTNPVATEQYGSVWMPTVNDIIDNDSQIY

SEQ ID NO: 175136 - protein, 35 aa, Artificial Sequence
  Description of Artificial Sequence: Synthetic polypeptide
DEAEIRTTNPVAYEQWGSVCYTQDNDDGHTGGGTT

SEQ ID NO: 175137 - protein, 35 aa, Artificial Sequence
  Description of Artificial Sequence: Synthetic polypeptide
DEEEIRTTNPVSTEQYGCVCGWGEHNQGFISQNQA

SEQ ID NO: 175138 - protein, 36 aa, Artificial Sequence
  Description of Artificial Sequence: Synthetic polypeptide
DEAEIRTTNPVAYEQWGSVCYTQDNDDQHTGGGTQS

SEQ ID NO: 175139 - protein, 36 aa, Artificial Sequence
  Description of Artificial Sequence: Synthetic polypeptide
DEEEISTTNPVATEQYGCVCSWEEHNQEHFNSDNQA

SEQ ID NO: 175140 - protein, 36 aa, Artificial Sequence
  Description of Artificial Sequence: Synthetic polypeptide
DEEEISTTNPVATEQYGCVCSWEEHNQEHFNSQTQA

SEQ ID NO: 175141 - protein, 36 aa, Artificial Sequence
  Description of Artificial Sequence: Synthetic polypeptide
DEEEISTTNPVATEQYGCVCSWEEHNQENFGSDTQP

SEQ ID NO: 175142 - protein, 35 aa, Artificial Sequence
  Description of Artificial Sequence: Synthetic polypeptide
DEEEISTTNPVATEQYGCVCSWEEHNQENFISDQA

SEQ ID NO: 175143 - protein, 36 aa, Artificial Sequence
  Description of Artificial Sequence: Synthetic polypeptide
DEEEISTTNPVATEQYGCVCSWGEHNQENFISENQA

SEQ ID NO: 175144 - protein, 36 aa, Artificial Sequence
  Description of Artificial Sequence: Synthetic polypeptide
DEAEIRTTNPVAYEQWGSVCYTQDNDDQLTMGGGGD

SEQ ID NO: 175145 - protein, 34 aa, Artificial Sequence
  Description of Artificial Sequence: Synthetic polypeptide
SQEEISTTNPVATEQWGCVCSWEHNQENFGSNQA

SEQ ID NO: 175146 - protein, 34 aa, Artificial Sequence
  Description of Artificial Sequence: Synthetic polypeptide
SQEEISTTNPVATEQWGCVCSTGEDNANFGSDQA

SEQ ID NO: 175147 - protein, 36 aa, Artificial Sequence
  Description of Artificial Sequence: Synthetic polypeptide
DEEEISTTNPVATEQYGCVCSWEEHNQEYFNSDNQS

SEQ ID NO: 175148 - protein, 36 aa, Artificial Sequence
  Description of Artificial Sequence: Synthetic polypeptide
DEEEISTTNPVATEQYGCVCSWEEHNQEYFNSETQS

SEQ ID NO: 175149 - protein, 36 aa, Artificial Sequence
  Description of Artificial Sequence: Synthetic polypeptide
DEEEIRTTNPVSTEQYGCVCGTWGEHNQGFNSQTQS

SEQ ID NO: 175150 - protein, 37 aa, Artificial Sequence
  Description of Artificial Sequence: Synthetic polypeptide
SQEEIRTTNPVATEQYGSVNSATGDEENQEGQDTDKI

SEQ ID NO: 175151 - protein, 36 aa, Artificial Sequence
  Description of Artificial Sequence: Synthetic polypeptide
DEEEISTTNPVATEQYGCVCSWEEHNTENFGSDTQS

SEQ ID NO: 175152 - protein, 33 aa, Artificial Sequence
  Description of Artificial Sequence: Synthetic polypeptide
DENEIRTTNPVSTEPYGTISPMEDIQQQQNGYH

SEQ ID NO: 175153 - protein, 33 aa, Artificial Sequence
  Description of Artificial Sequence: Synthetic polypeptide
DETEIRTTNPIATECWGSTSNTEDWADHKGEDI

SEQ ID NO: 175154 - protein, 33 aa, Artificial Sequence
  Description of Artificial Sequence: Synthetic polypeptide
DETEIRTTNPIATECWGSTSNTEDWADHKGPYI

SEQ ID NO: 175155 - protein, 33 aa, Artificial Sequence
  Description of Artificial Sequence: Synthetic polypeptide
DETEIRTTNPIATECWGSTSNTEDWAEHKGPYI

SEQ ID NO: 175156 - protein, 33 aa, Artificial Sequence
  Description of Artificial Sequence: Synthetic polypeptide
DETEIRTTNPIATECWGSTSNTEDWAEPKGPYI

SEQ ID NO: 175157 - protein, 36 aa, Artificial Sequence
  Description of Artificial Sequence: Synthetic polypeptide
DEEEISTTNPVATEQYGCVCSWEEHNQEYFNSDNQM

SEQ ID NO: 175158 - protein, 38 aa, Artificial Sequence
  Description of Artificial Sequence: Synthetic polypeptide
DEEEIRTTNPVATEQYGCVCSTSGEDDNIENFNSDTQA

SEQ ID NO: 175159 - protein, 32 aa, Artificial Sequence
  Description of Artificial Sequence: Synthetic polypeptide
DETEIRTTNPIATEPWGATAMEDIQEQKGNYH

SEQ ID NO: 175160 - protein, 39 aa, Artificial Sequence
  Description of Artificial Sequence: Synthetic polypeptide
DEEEIRTTNPVATEAYGVVSTVTNLQLQQGTEQGTEEQE

SEQ ID NO: 175161 - protein, 36 aa, Artificial Sequence
  Description of Artificial Sequence: Synthetic polypeptide
SESEIRTTNPVATEQYGASAVVATVDHLKEGEEDQE

SEQ ID NO: 175162 - protein, 36 aa, Artificial Sequence
  Description of Artificial Sequence: Synthetic polypeptide
SESEIRTTNPVATEQYGASACVATVNHTGEGEEDQE

SEQ ID NO: 175163 - protein, 35 aa, Artificial Sequence
  Description of Artificial Sequence: Synthetic polypeptide
CEAEISTTNPVATEQYGCVCSTWEDHQNFNSDNQA

SEQ ID NO: 175164 - protein, 34 aa, Artificial Sequence
  Description of Artificial Sequence: Synthetic polypeptide
DENEIRTTNPVSTEPYGTISMMEDIQQQQNGNSH

SEQ ID NO: 175165 - protein, 34 aa, Artificial Sequence
  Description of Artificial Sequence: Synthetic polypeptide
DENEIRTTNPVSTEPYGTISMMEDIQQQQNGINH

SEQ ID NO: 175166 - protein, 32 aa, Artificial Sequence
  Description of Artificial Sequence: Synthetic polypeptide
AESCIACTNPVAYEGYGNASCENLSQRVGGYS

SEQ ID NO: 175167 - protein, 31 aa, Artificial Sequence
  Description of Artificial Sequence: Synthetic polypeptide
AESCIACTNPVAYEGYGEASCENLSQTVGTS

SEQ ID NO: 175168 - protein, 38 aa, Artificial Sequence
  Description of Artificial Sequence: Synthetic polypeptide
DEEEIRTTNPVATEAYGVVSTVVATQGNQDEGTNVATE

SEQ ID NO: 175169 - protein, 32 aa, Artificial Sequence
  Description of Artificial Sequence: Synthetic polypeptide
AESCIAATNPVAYEGYGEASCENLSQRVGGQS

SEQ ID NO: 175170 - protein, 37 aa, Artificial Sequence
  Description of Artificial Sequence: Synthetic polypeptide
DEEEISTTNPVATEQYGCVTSTWGAHNAEHFNSDPVA

SEQ ID NO: 175171 - protein, 39 aa, Artificial Sequence
  Description of Artificial Sequence: Synthetic polypeptide
DEEEIRTTNPVATEAYGVVSTVVNDNLQQGTEQGTEEDE

SEQ ID NO: 175172 - protein, 37 aa, Artificial Sequence
  Description of Artificial Sequence: Synthetic polypeptide
DEEEISTTNPVATEQYGCVTSTWPAHNAENFGSDPVF

SEQ ID NO: 175173 - protein, 34 aa, Artificial Sequence
  Description of Artificial Sequence: Synthetic polypeptide
DETEIRTTNPVATEAYGVVDGGETEGDEDDGGEI

SEQ ID NO: 175174 - protein, 34 aa, Artificial Sequence
  Description of Artificial Sequence: Synthetic polypeptide
DENEIRTTNPVSTEPYGTISMIDIQVQQNGGNHY

SEQ ID NO: 175175 - protein, 39 aa, Artificial Sequence
  Description of Artificial Sequence: Synthetic polypeptide
DEEEIRTTNPVATEAYGVVSTVVNLGLQQGTEQGTEEEE

SEQ ID NO: 175176 - protein, 33 aa, Artificial Sequence
  Description of Artificial Sequence: Synthetic polypeptide
DENEIRTTNPVSTEPYGTISMIDIQVQQNGEVH

SEQ ID NO: 175177 - protein, 30 aa, Artificial Sequence
  Description of Artificial Sequence: Synthetic polypeptide
CEEEIATTNPVAYEPWGEAYMVEQHDEGEG

SEQ ID NO: 175178 - protein, 33 aa, Artificial Sequence
  Description of Artificial Sequence: Synthetic polypeptide
DETEIRTTNPVATECWGAIWSNAEDWQEPKGPI

SEQ ID NO: 175179 - protein, 36 aa, Artificial Sequence
  Description of Artificial Sequence: Synthetic polypeptide
DEDCIRTTNPVATEQWGSVATGNMESIYNAGGNNYN

SEQ ID NO: 175180 - protein, 33 aa, Artificial Sequence
  Description of Artificial Sequence: Synthetic polypeptide
DETEIRTTNPVATECWGATACIDWPQDREGEPG

SEQ ID NO: 175181 - protein, 31 aa, Artificial Sequence
  Description of Artificial Sequence: Synthetic polypeptide
DDSEIRSTNPVSTEPYGTIAMEDIQQQNGQR

SEQ ID NO: 175182 - protein, 37 aa, Artificial Sequence
  Description of Artificial Sequence: Synthetic polypeptide
DEDCIRTTNPVATEQWGSQVACTGNMESDNNEGNNRN

SEQ ID NO: 175183 - protein, 33 aa, Artificial Sequence
  Description of Artificial Sequence: Synthetic polypeptide
CEEEIATTNPVAYAPWGTSVSATADLGQHDIAT

SEQ ID NO: 175184 - protein, 35 aa, Artificial Sequence
  Description of Artificial Sequence: Synthetic polypeptide
DEEEISTTNPCATEQYGCVCQWGNHNQNFGSDTAS

SEQ ID NO: 175185 - protein, 35 aa, Artificial Sequence
  Description of Artificial Sequence: Synthetic polypeptide
CEEEIATTNPVATESYGCVAATAGGQTAEGPNENA

SEQ ID NO: 175186 - protein, 35 aa, Artificial Sequence
  Description of Artificial Sequence: Synthetic polypeptide
AESDEIATTNPVAYEQWGSVSTGGNAGEHQGGDEM

SEQ ID NO: 175187 - protein, 35 aa, Artificial Sequence
  Description of Artificial Sequence: Synthetic polypeptide
DESEIRTTNPVATECWGSTWANCINEPAERKGENI

SEQ ID NO: 175188 - protein, 36 aa, Artificial Sequence
  Description of Artificial Sequence: Synthetic polypeptide
DEEEIRTTNPVATCQYGQCVCSNWGEHQENFGSEQS

SEQ ID NO: 175189 - protein, 35 aa, Artificial Sequence
  Description of Artificial Sequence: Synthetic polypeptide
AESDEIATTNPVAYEQWGSVSTGGNAGEHQKGSDE

SEQ ID NO: 175190 - protein, 34 aa, Artificial Sequence
  Description of Artificial Sequence: Synthetic polypeptide
VEDEVATTNPVAYEQWGSTCSTWEHVDQREGAND

SEQ ID NO: 175191 - protein, 37 aa, Artificial Sequence
  Description of Artificial Sequence: Synthetic polypeptide
DEDEAEIATTNPVAYEPWGSVYCTDNHQQTQQGGNRD

SEQ ID NO: 175192 - protein, 34 aa, Artificial Sequence
  Description of Artificial Sequence: Synthetic polypeptide
SETAEIACTNPVATEQWGCVATNLQDGAEGGPGN

SEQ ID NO: 175193 - protein, 36 aa, Artificial Sequence
  Description of Artificial Sequence: Synthetic polypeptide
DDSEIRTTNPVATEQYGCVNNWDTSYQERFFDNNQE

SEQ ID NO: 175194 - protein, 35 aa, Artificial Sequence
  Description of Artificial Sequence: Synthetic polypeptide
DDSEIRTTNPVATEQYGACVCSANTVEEDQTEDQQ

SEQ ID NO: 175195 - protein, 35 aa, Artificial Sequence
  Description of Artificial Sequence: Synthetic polypeptide
DESEISTTNPVATEQYGCVCSMWEEHQSFNSQNQS

SEQ ID NO: 175196 - protein, 36 aa, Artificial Sequence
  Description of Artificial Sequence: Synthetic polypeptide
DEEEIRTTNPVATDFYGVVDNDDENQGQDDDENGNA

SEQ ID NO: 175197 - protein, 38 aa, Artificial Sequence
  Description of Artificial Sequence: Synthetic polypeptide
DEEEIRTTNPVATDFYGSVVMSGMFNNLTIGEGENDDI

SEQ ID NO: 175198 - protein, 36 aa, Artificial Sequence
  Description of Artificial Sequence: Synthetic polypeptide
CEEEIATTNPVAYEQWGSVCSTNPAQQEHQDGTEMK

SEQ ID NO: 175199 - protein, 33 aa, Artificial Sequence
  Description of Artificial Sequence: Synthetic polypeptide
DETEIRTTNPISTEPYGTTISMEDIQQQQNGNI

SEQ ID NO: 175200 - protein, 37 aa, Artificial Sequence
  Description of Artificial Sequence: Synthetic polypeptide
DEEEIRTTNPVATDFYGSVVMSGMFNNEQGEGEDDIQ

SEQ ID NO: 175201 - protein, 37 aa, Artificial Sequence
  Description of Artificial Sequence: Synthetic polypeptide
DEEEIRTTNPVATDFYGSVVMLGMFENLQGEGQDDIQ

SEQ ID NO: 175202 - protein, 31 aa, Artificial Sequence
  Description of Artificial Sequence: Synthetic polypeptide
DDSEVASTNPVSTEGYGNVAANEIQSGTGQR

SEQ ID NO: 175203 - protein, 34 aa, Artificial Sequence
  Description of Artificial Sequence: Synthetic polypeptide
SESEIRTTNPVAYECWGTVYRINENQDRDGENNG

SEQ ID NO: 175204 - protein, 35 aa, Artificial Sequence
  Description of Artificial Sequence: Synthetic polypeptide
AESEEIATTNPVAYEQWGWVSTGGNAGEHQNGTDE

SEQ ID NO: 175205 - protein, 36 aa, Artificial Sequence
  Description of Artificial Sequence: Synthetic polypeptide
DETEIRTTNPVAFECYGVVIDGQGNGLQEGGNGDGE

SEQ ID NO: 175206 - protein, 37 aa, Artificial Sequence
  Description of Artificial Sequence: Synthetic polypeptide
DETEIRTTNPVAFEQYGSVIDGPANGLGEGGQGGEGE

SEQ ID NO: 175207 - protein, 35 aa, Artificial Sequence
  Description of Artificial Sequence: Synthetic polypeptide
AESEEIATTNPVAYEQWGWVSTGGNAGEHQGQGGE

SEQ ID NO: 175208 - protein, 35 aa, Artificial Sequence
  Description of Artificial Sequence: Synthetic polypeptide
AESEEIATTNPVAYEQWGWVSTGGNAGEGQDGGDE

SEQ ID NO: 175209 - protein, 36 aa, Artificial Sequence
  Description of Artificial Sequence: Synthetic polypeptide
AESEEIATTNPVAYEQWGSVSTNGGNAGEHQGGTDE

SEQ ID NO: 175210 - protein, 35 aa, Artificial Sequence
  Description of Artificial Sequence: Synthetic polypeptide
AESEEIATTNPVAYEQWGSVSTGGNAGEHQIDTDE

SEQ ID NO: 175211 - protein, 35 aa, Artificial Sequence
  Description of Artificial Sequence: Synthetic polypeptide
AESEEIATTNPVAYEQWGSVSTGGNAGEHQGMTDQ

SEQ ID NO: 175212 - protein, 34 aa, Artificial Sequence
  Description of Artificial Sequence: Synthetic polypeptide
AESEEIATTNPVAYEQWGSVATGGNAGEHQGQDE

SEQ ID NO: 175213 - protein, 36 aa, Artificial Sequence
  Description of Artificial Sequence: Synthetic polypeptide
SESEIRTTNPVATEQYGSVTHCMPWVENTEEGNQIQ

SEQ ID NO: 175214 - protein, 38 aa, Artificial Sequence
  Description of Artificial Sequence: Synthetic polypeptide
DEEEIRTTNPVATEAYGVVSTVVANNNDEQGATNQNED

SEQ ID NO: 175215 - protein, 34 aa, Artificial Sequence
  Description of Artificial Sequence: Synthetic polypeptide
AESDEIATTNPVAYEQWGSVSTGGNAGEHQGTDM

SEQ ID NO: 175216 - protein, 32 aa, Artificial Sequence
  Description of Artificial Sequence: Synthetic polypeptide
DETEIRTTNPISTEPWGTTISMEDWQEQKGNH

SEQ ID NO: 175217 - protein, 33 aa, Artificial Sequence
  Description of Artificial Sequence: Synthetic polypeptide
DETEIRTTNPVATECWGATAWSNANWAPKGGYI

SEQ ID NO: 175218 - protein, 31 aa, Artificial Sequence
  Description of Artificial Sequence: Synthetic polypeptide
DETEIRTTNPVATECWGATSNEIEMEAAEDA

SEQ ID NO: 175219 - protein, 33 aa, Artificial Sequence
  Description of Artificial Sequence: Synthetic polypeptide
SESEEIATTNPVAYEQWGSVCYNTDGGHTGMQA

SEQ ID NO: 175220 - protein, 35 aa, Artificial Sequence
  Description of Artificial Sequence: Synthetic polypeptide
DESEIRTTNPVATECWGSTANCIDWPQEREGENYG

SEQ ID NO: 175221 - protein, 37 aa, Artificial Sequence
  Description of Artificial Sequence: Synthetic polypeptide
CEEEIRTTNPVATEQYGAVVDLMVQGELQTGQDNGGN

SEQ ID NO: 175222 - protein, 33 aa, Artificial Sequence
  Description of Artificial Sequence: Synthetic polypeptide
SESCIRTTNPVAYEQWGCYVGEQQNDQDGQNSG

SEQ ID NO: 175223 - protein, 37 aa, Artificial Sequence
  Description of Artificial Sequence: Synthetic polypeptide
DEEEIRTTNPVATEQYGCVCSMWEEAHNQENFNSDQS

SEQ ID NO: 175224 - protein, 34 aa, Artificial Sequence
  Description of Artificial Sequence: Synthetic polypeptide
DEAEIRTTNPVAYERWGVVYMTDQEDNRQGNGGA

SEQ ID NO: 175225 - protein, 35 aa, Artificial Sequence
  Description of Artificial Sequence: Synthetic polypeptide
DEDCIATTNPVATAQWGSVSGTEHGPLASGGGNMT

SEQ ID NO: 175226 - protein, 36 aa, Artificial Sequence
  Description of Artificial Sequence: Synthetic polypeptide
DEEEISTTNPVATEQYGQCVCGSEDHNQNFNSDTQS

SEQ ID NO: 175227 - protein, 34 aa, Artificial Sequence
  Description of Artificial Sequence: Synthetic polypeptide
DEAEIRTTNPVAYESWGEVAWTDNQQDQQGQHDQ

SEQ ID NO: 175228 - protein, 35 aa, Artificial Sequence
  Description of Artificial Sequence: Synthetic polypeptide
SEQVITTTNPVATEQYGSVSATDLNEDHQGLEDEN

SEQ ID NO: 175229 - protein, 37 aa, Artificial Sequence
  Description of Artificial Sequence: Synthetic polypeptide
DEEEISTTNPVATEQYGQCVCGSGEDHNQENFGSNQS

SEQ ID NO: 175230 - protein, 35 aa, Artificial Sequence
  Description of Artificial Sequence: Synthetic polypeptide
SEQEVSTTNPVATEQYGSVSATDLNEDHQGLEDEN

SEQ ID NO: 175231 - protein, 36 aa, Artificial Sequence
  Description of Artificial Sequence: Synthetic polypeptide
DEEEISTTNPVATEQYGQCVCGSGEDNQENFNSEQS

SEQ ID NO: 175232 - protein, 36 aa, Artificial Sequence
  Description of Artificial Sequence: Synthetic polypeptide
DEEEISTTNPVATEQYGQCVCGSGEHNQNFGSDTQA

SEQ ID NO: 175233 - protein, 37 aa, Artificial Sequence
  Description of Artificial Sequence: Synthetic polypeptide
DEEEISTTNPVATEQYGQCVCGSGNHNQENFNSDNQS

SEQ ID NO: 175234 - protein, 34 aa, Artificial Sequence
  Description of Artificial Sequence: Synthetic polypeptide
DESEISTTNPVATAHWGSVCTWEDQQRQEHGMTS

SEQ ID NO: 175235 - protein, 35 aa, Artificial Sequence
  Description of Artificial Sequence: Synthetic polypeptide
DEEEISTTNPVATEQYGQCVCGWEHNQNFNSETQP

SEQ ID NO: 175236 - protein, 35 aa, Artificial Sequence
  Description of Artificial Sequence: Synthetic polypeptide
DEAEIRTTNPVAYESWGEVCSNDNDDQAGQQGNEH

SEQ ID NO: 175237 - protein, 33 aa, Artificial Sequence
  Description of Artificial Sequence: Synthetic polypeptide
DEAEIRTTNPVAYESWGEVTGGNGNQGEQNDDH

SEQ ID NO: 175238 - protein, 33 aa, Artificial Sequence
  Description of Artificial Sequence: Synthetic polypeptide
DETEIRTTNPVATECWGATTWSNANWAPKGGYI

SEQ ID NO: 175239 - protein, 37 aa, Artificial Sequence
  Description of Artificial Sequence: Synthetic polypeptide
DEEEIRTTNPVATEQYGCVCSMWEDHNQEYFNSENQS

SEQ ID NO: 175240 - protein, 39 aa, Artificial Sequence
  Description of Artificial Sequence: Synthetic polypeptide
DEEEIRTTNPVAYEQYGQSVCSEYLNDLWDAQSGQILKN

SEQ ID NO: 175241 - protein, 37 aa, Artificial Sequence
  Description of Artificial Sequence: Synthetic polypeptide
DEEEIRTTNPVATEQYGCVCSMWEDHNAENFNSDNQP

SEQ ID NO: 175242 - protein, 36 aa, Artificial Sequence
  Description of Artificial Sequence: Synthetic polypeptide
DEEEISTTNPVATEQYGQCVCPWGEHNQNFGSDNQS

SEQ ID NO: 175243 - protein, 38 aa, Artificial Sequence
  Description of Artificial Sequence: Synthetic polypeptide
DEEEIRTTNPVAYEQYGQSVCSLLNDLLQAQSEQITKN

SEQ ID NO: 175244 - protein, 35 aa, Artificial Sequence
  Description of Artificial Sequence: Synthetic polypeptide
DESEIRTTNPVATECWGSTANCIDWPQERKGENYG

SEQ ID NO: 175245 - protein, 33 aa, Artificial Sequence
  Description of Artificial Sequence: Synthetic polypeptide
DETEIRTTNPVATECWGATCSNTDDPEFKGPYD

SEQ ID NO: 175246 - protein, 35 aa, Artificial Sequence
  Description of Artificial Sequence: Synthetic polypeptide
DEDCIATTNPVATEQWGSVANGNMESIYNGGNNRN

SEQ ID NO: 175247 - protein, 35 aa, Artificial Sequence
  Description of Artificial Sequence: Synthetic polypeptide
DEDCIATVNPVATEAYGKVPSCDNEPSERGGNNRR

SEQ ID NO: 175248 - protein, 32 aa, Artificial Sequence
  Description of Artificial Sequence: Synthetic polypeptide
DETEIRTTNPVATECWGATTAAECLAEPGPYI

SEQ ID NO: 175249 - protein, 37 aa, Artificial Sequence
  Description of Artificial Sequence: Synthetic polypeptide
DEEEIRTTNPVATEQYGCVCSMWEEHNAENFNSDPQS

SEQ ID NO: 175250 - protein, 38 aa, Artificial Sequence
  Description of Artificial Sequence: Synthetic polypeptide
DEEEIRTTNPVAFEQYGSVTVNSTGGDPGQEEQGEGGI

SEQ ID NO: 175251 - protein, 37 aa, Artificial Sequence
  Description of Artificial Sequence: Synthetic polypeptide
DEEEIRTTNPVAFEQYGQVVNGGQGNDTDQQIGIRGG

SEQ ID NO: 175252 - protein, 32 aa, Artificial Sequence
  Description of Artificial Sequence: Synthetic polypeptide
DDSEVASTNPVSTEGYGNVAANEIQSRVGQRN

SEQ ID NO: 175253 - protein, 37 aa, Artificial Sequence
  Description of Artificial Sequence: Synthetic polypeptide
DEEEISTTNPVATEQYGQCSCSWNEHNQENFGSDTQA

SEQ ID NO: 175254 - protein, 37 aa, Artificial Sequence
  Description of Artificial Sequence: Synthetic polypeptide
DEEEIRTTNPVAFEQYGDVVTGGQTDDGDQQIGIRGG

SEQ ID NO: 175255 - protein, 33 aa, Artificial Sequence
  Description of Artificial Sequence: Synthetic polypeptide
VEDEVATTNPVAYEQWGSTCSTWEHGDQRVQND

SEQ ID NO: 175256 - protein, 38 aa, Artificial Sequence
  Description of Artificial Sequence: Synthetic polypeptide
DEEEIRTTNPVAFEQYGDVGVTGQGNDNMDQRGIMTGQ

SEQ ID NO: 175257 - protein, 32 aa, Artificial Sequence
  Description of Artificial Sequence: Synthetic polypeptide
DDSEVASTNPVSTEGYGNVAANETIQSRNGQR

SEQ ID NO: 175258 - protein, 37 aa, Artificial Sequence
  Description of Artificial Sequence: Synthetic polypeptide
DEEEISTTNPVATEQYGQCVCGNSGEHNQNFQSDNQS

SEQ ID NO: 175259 - protein, 39 aa, Artificial Sequence
  Description of Artificial Sequence: Synthetic polypeptide
DEEEIRTTNPVAYEQYGQSVCSAQLNDLLDAQSGQITKG

SEQ ID NO: 175260 - protein, 36 aa, Artificial Sequence
  Description of Artificial Sequence: Synthetic polypeptide
SESEIATTNPVATEQYGTVVSATGGEPSENFNGGND

SEQ ID NO: 175261 - protein, 39 aa, Artificial Sequence
  Description of Artificial Sequence: Synthetic polypeptide
DEEEIRTTNPVAYEQYGQSVCSERLNDCLDAQSGQILEN

SEQ ID NO: 175262 - protein, 33 aa, Artificial Sequence
  Description of Artificial Sequence: Synthetic polypeptide
DETEIRTTNPVATECWGATTWANADWQEPKGPI

SEQ ID NO: 175263 - protein, 35 aa, Artificial Sequence
  Description of Artificial Sequence: Synthetic polypeptide
DESEIRTTNPVATECWGSTVACIDWPQDRKGEPYG

SEQ ID NO: 175264 - protein, 39 aa, Artificial Sequence
  Description of Artificial Sequence: Synthetic polypeptide
DEEEIRTTNPVAYEQYGQSVCSERLNDDLDAQSGQIKKN

SEQ ID NO: 175265 - protein, 35 aa, Artificial Sequence
  Description of Artificial Sequence: Synthetic polypeptide
DESEIRTTNPVATECWGSTVACIDEPQDRKGEPYG

SEQ ID NO: 175266 - protein, 39 aa, Artificial Sequence
  Description of Artificial Sequence: Synthetic polypeptide
DEEEIRTTNPVATEAYGVVSTVVNQALQQGTEQGTEDED

SEQ ID NO: 175267 - protein, 34 aa, Artificial Sequence
  Description of Artificial Sequence: Synthetic polypeptide
DESEIRTTNPVATECWGSTTANCIDWQEPEGPYI

SEQ ID NO: 175268 - protein, 34 aa, Artificial Sequence
  Description of Artificial Sequence: Synthetic polypeptide
DESEIRTTNPVATECWGSTTANCIDEQEPEGPYI

SEQ ID NO: 175269 - protein, 34 aa, Artificial Sequence
  Description of Artificial Sequence: Synthetic polypeptide
DESEIRTTNPVATECWGSTTANCIDEQDPEGPYI

SEQ ID NO: 175270 - protein, 35 aa, Artificial Sequence
  Description of Artificial Sequence: Synthetic polypeptide
DEEEIRTVNPVATEQYGSVPPPLLEEVPMMPLEQG

SEQ ID NO: 175271 - protein, 34 aa, Artificial Sequence
  Description of Artificial Sequence: Synthetic polypeptide
DEAEIRTTNPVAYERWGCVCPTNNDQMDTGDEEP

SEQ ID NO: 175272 - protein, 34 aa, Artificial Sequence
  Description of Artificial Sequence: Synthetic polypeptide
DESEIRTTNPVATECWGSTSNCIDEPQDPEGPYI

SEQ ID NO: 175273 - protein, 36 aa, Artificial Sequence
  Description of Artificial Sequence: Synthetic polypeptide
DEEEIRTTNPTAVEQYGSVSQSVKHSDETPMGSDRN

SEQ ID NO: 175274 - protein, 36 aa, Artificial Sequence
  Description of Artificial Sequence: Synthetic polypeptide
DEDEIRTTNPVATDAYGAVVNQTNNGLGQRFDEEMQ

SEQ ID NO: 175275 - protein, 37 aa, Artificial Sequence
  Description of Artificial Sequence: Synthetic polypeptide
DEEEIRTTNPVATDQYGSVCTPLAFVFEGTFEDEGFE

SEQ ID NO: 175276 - protein, 38 aa, Artificial Sequence
  Description of Artificial Sequence: Synthetic polypeptide
AEDEIRATNPVATEQYGVVSTTNQQALQQLQQGTNQQM

SEQ ID NO: 175277 - protein, 31 aa, Artificial Sequence
  Description of Artificial Sequence: Synthetic polypeptide
DETEIRTTNPIATEQWGATAWPEVWAHKGPK

SEQ ID NO: 175278 - protein, 33 aa, Artificial Sequence
  Description of Artificial Sequence: Synthetic polypeptide
SNEEIRTTNPVATEQWGCVALLNTATEGVQAPP

SEQ ID NO: 175279 - protein, 36 aa, Artificial Sequence
  Description of Artificial Sequence: Synthetic polypeptide
DEEEISTTNPVATEQYGCVCSWGEHNQESFNSDNQF

SEQ ID NO: 175280 - protein, 36 aa, Artificial Sequence
  Description of Artificial Sequence: Synthetic polypeptide
DEEEISTTNPVATEQYGCVCSWGEHNQESFNSDTQA

SEQ ID NO: 175281 - protein, 38 aa, Artificial Sequence
  Description of Artificial Sequence: Synthetic polypeptide
SMEEIRTTNPVATEQYGSVMYPTFDDMNNNGLEELNMR

SEQ ID NO: 175282 - protein, 39 aa, Artificial Sequence
  Description of Artificial Sequence: Synthetic polypeptide
DEEEIRTTNPVATEAYGVVSTVTNQNLQQGTEQGTEEEE

SEQ ID NO: 175283 - protein, 38 aa, Artificial Sequence
  Description of Artificial Sequence: Synthetic polypeptide
DEEEIRTTNPVATEQYGCVCSMWGEDHNQENFGSENQS

SEQ ID NO: 175284 - protein, 36 aa, Artificial Sequence
  Description of Artificial Sequence: Synthetic polypeptide
DEEEISTTNPVATEQYGCVCSWGEHNQEYFNSETQS

SEQ ID NO: 175285 - protein, 33 aa, Artificial Sequence
  Description of Artificial Sequence: Synthetic polypeptide
SEYEISCTNPVATEQYGCVCETEHNQHFGSDQM

SEQ ID NO: 175286 - protein, 34 aa, Artificial Sequence
  Description of Artificial Sequence: Synthetic polypeptide
SEYEIRTTNPVATEQYGCMTTSVWETTRPENKEA

SEQ ID NO: 175287 - protein, 34 aa, Artificial Sequence
  Description of Artificial Sequence: Synthetic polypeptide
SEYEIRTTNPVATEQYGCMNTSVTETTRPEVKEA

SEQ ID NO: 175288 - protein, 35 aa, Artificial Sequence
  Description of Artificial Sequence: Synthetic polypeptide
SEYEIRTTNPVATEQYGCMNTSVFETTRIPENKEA

SEQ ID NO: 175289 - protein, 35 aa, Artificial Sequence
  Description of Artificial Sequence: Synthetic polypeptide
DEEEISTTNPVATEQYGCVCSWGEHQEHFFSDTQG

SEQ ID NO: 175290 - protein, 35 aa, Artificial Sequence
  Description of Artificial Sequence: Synthetic polypeptide
DEEEISTTNPVATEQYGCVCSWGEHQEHFPSDTQS

SEQ ID NO: 175291 - protein, 35 aa, Artificial Sequence
  Description of Artificial Sequence: Synthetic polypeptide
SEYEIRMTNPVATEQYGTVETVNLDEEHIGSTQQE

SEQ ID NO: 175292 - protein, 35 aa, Artificial Sequence
  Description of Artificial Sequence: Synthetic polypeptide
SEYEIRMTNPVATEQYGSVETVNGMDEEHIGSTQQ

SEQ ID NO: 175293 - protein, 36 aa, Artificial Sequence
  Description of Artificial Sequence: Synthetic polypeptide
SEYEIRMTNPVATEQYGSVEDTVNLTEEHIGSTQQP

SEQ ID NO: 175294 - protein, 35 aa, Artificial Sequence
  Description of Artificial Sequence: Synthetic polypeptide
DEEEIRTTNPVATEAYGDVVDGFNGEDFENDDEQA

SEQ ID NO: 175295 - protein, 35 aa, Artificial Sequence
  Description of Artificial Sequence: Synthetic polypeptide
DETEIRTTNPIATEQWGATVWATAEDGAERKGNYV

SEQ ID NO: 175296 - protein, 34 aa, Artificial Sequence
  Description of Artificial Sequence: Synthetic polypeptide
DETEIRTTNPIATEQWGATWANAEAGNERNGPYI

SEQ ID NO: 175297 - protein, 32 aa, Artificial Sequence
  Description of Artificial Sequence: Synthetic polypeptide
DETEIRTTNPIATEQWGATWSNADWAPKGPYI

SEQ ID NO: 175298 - protein, 35 aa, Artificial Sequence
  Description of Artificial Sequence: Synthetic polypeptide
DETEIRTTNPIATEQWGAVWATAEDGPAERKGNYV

SEQ ID NO: 175299 - protein, 35 aa, Artificial Sequence
  Description of Artificial Sequence: Synthetic polypeptide
DETEIRTTNPIATEQWGAVWATAEDGPNERKGNYV

SEQ ID NO: 175300 - protein, 32 aa, Artificial Sequence
  Description of Artificial Sequence: Synthetic polypeptide
DDSEVASTNPVSTEGYGNVAANDTIQYRVGQR

SEQ ID NO: 175301 - protein, 39 aa, Artificial Sequence
  Description of Artificial Sequence: Synthetic polypeptide
DEEEIRTTNPVATEAYGVVSTVTNQQLQAGTEQGTEDEE

SEQ ID NO: 175302 - protein, 36 aa, Artificial Sequence
  Description of Artificial Sequence: Synthetic polypeptide
DEEEISTTNPVATEQYGCVCSWGEHNQENSISENQE

SEQ ID NO: 175303 - protein, 32 aa, Artificial Sequence
  Description of Artificial Sequence: Synthetic polypeptide
DETEIRTTNPIATEQWGDVWAAIEANPKGPYI

SEQ ID NO: 175304 - protein, 33 aa, Artificial Sequence
  Description of Artificial Sequence: Synthetic polypeptide
DETEIRTTNPIATEPYGTTWAAEDIQQQQKGNH

SEQ ID NO: 175305 - protein, 39 aa, Artificial Sequence
  Description of Artificial Sequence: Synthetic polypeptide
DEEEIRTTNPVATEAYGVVSTVTNQALQQGTEQGTEEQD

SEQ ID NO: 175306 - protein, 35 aa, Artificial Sequence
  Description of Artificial Sequence: Synthetic polypeptide
DEEEISTTNPVATEQYGCVCSWGEHNQENFISEQD

SEQ ID NO: 175307 - protein, 36 aa, Artificial Sequence
  Description of Artificial Sequence: Synthetic polypeptide
SNGEIRTTNPVATEQYGCCWSPTINLLEEERENQNE

SEQ ID NO: 175308 - protein, 36 aa, Artificial Sequence
  Description of Artificial Sequence: Synthetic polypeptide
DEEEISTTNPVATEQYGCVCSWGEHNQENFNSDNQS

SEQ ID NO: 175309 - protein, 33 aa, Artificial Sequence
  Description of Artificial Sequence: Synthetic polypeptide
DESEISTTNPVAYEQWGMTCVTDNDDQRQAQKW

SEQ ID NO: 175310 - protein, 36 aa, Artificial Sequence
  Description of Artificial Sequence: Synthetic polypeptide
DEDEIATTNPVAYEQYGSVCAANPALQEHGIDLTAM

SEQ ID NO: 175311 - protein, 37 aa, Artificial Sequence
  Description of Artificial Sequence: Synthetic polypeptide
AEEEIRTTNPVATEQYGSVQPAAVPMDILMIEPGNIL

SEQ ID NO: 175312 - protein, 33 aa, Artificial Sequence
  Description of Artificial Sequence: Synthetic polypeptide
DESEISTTNPVAYEQWGMTCVTDNDDQEQAQRH

SEQ ID NO: 175313 - protein, 39 aa, Artificial Sequence
  Description of Artificial Sequence: Synthetic polypeptide
DEEEIRTTNPVATEAYGVVSTVTNNQAGTEAGSVSNQVD

SEQ ID NO: 175314 - protein, 31 aa, Artificial Sequence
  Description of Artificial Sequence: Synthetic polypeptide
DDSEVASTNPVSTEGWGNVAANDIQDRVGQR

SEQ ID NO: 175315 - protein, 34 aa, Artificial Sequence
  Description of Artificial Sequence: Synthetic polypeptide
DEDEIACTNPVATEQWGCVAGTNGLAVAMDNGML

SEQ ID NO: 175316 - protein, 36 aa, Artificial Sequence
  Description of Artificial Sequence: Synthetic polypeptide
SNEEIRTTNPVATEQYGSSCSPTALSVETTIENQDN

SEQ ID NO: 175317 - protein, 38 aa, Artificial Sequence
  Description of Artificial Sequence: Synthetic polypeptide
AEEEIRTTNPVATEQYGSVQSVEMNNTEQEGMAPPELI

SEQ ID NO: 175318 - protein, 39 aa, Artificial Sequence
  Description of Artificial Sequence: Synthetic polypeptide
DEEEIRTTNPVATEAYGVVSTVTNNQAGTEAGTVTNQVE

SEQ ID NO: 175319 - protein, 32 aa, Artificial Sequence
  Description of Artificial Sequence: Synthetic polypeptide
DDSEVASTNPVSTEGYGNVAANDTIQSRVGQR

SEQ ID NO: 175320 - protein, 36 aa, Artificial Sequence
  Description of Artificial Sequence: Synthetic polypeptide
AEEEIRTTNPVATEQYGSVQVAIEQQIENTEEDNDM

SEQ ID NO: 175321 - protein, 36 aa, Artificial Sequence
  Description of Artificial Sequence: Synthetic polypeptide
DEEEISTTNPVATEQYGCVCSWGEHNQENFNSDTAA

SEQ ID NO: 175322 - protein, 34 aa, Artificial Sequence
  Description of Artificial Sequence: Synthetic polypeptide
SNEEIRTTNPVATEQWGCVSSLANTYTEGVQQPP

SEQ ID NO: 175323 - protein, 34 aa, Artificial Sequence
  Description of Artificial Sequence: Synthetic polypeptide
DETEIRTTNPIATEPYGAIWSNMEDWQEPKGNYI

SEQ ID NO: 175324 - protein, 34 aa, Artificial Sequence
  Description of Artificial Sequence: Synthetic polypeptide
DESEISTTNPVAYEQWGMTCVIDNDDQRQADQRH

SEQ ID NO: 175325 - protein, 36 aa, Artificial Sequence
  Description of Artificial Sequence: Synthetic polypeptide
DEEEISTTNPVATEQYGCVCSWGEHNQENFNSDTQA

SEQ ID NO: 175326 - protein, 39 aa, Artificial Sequence
  Description of Artificial Sequence: Synthetic polypeptide
DEEEIRTTNPVATEAYGVVSTVTNNQLQQGTEQGTEEED

SEQ ID NO: 175327 - protein, 33 aa, Artificial Sequence
  Description of Artificial Sequence: Synthetic polypeptide
DETEIRTTNPIATEPYGATTWAMEDWAQQKGNI

SEQ ID NO: 175328 - protein, 33 aa, Artificial Sequence
  Description of Artificial Sequence: Synthetic polypeptide
YEECIRTTNPVAYEQWGQSVVNIVHSSDNGGNI

SEQ ID NO: 175329 - protein, 35 aa, Artificial Sequence
  Description of Artificial Sequence: Synthetic polypeptide
SNEEIRTTNPVATEQWGCVSLLNTYTGEGVQNNPP

SEQ ID NO: 175330 - protein, 34 aa, Artificial Sequence
  Description of Artificial Sequence: Synthetic polypeptide
DESEISTTNPVAYEHWGISVSCNNSSSDRHGGMV

SEQ ID NO: 175331 - protein, 36 aa, Artificial Sequence
  Description of Artificial Sequence: Synthetic polypeptide
DEEEISTTNPVATEQYGCVCSWGEHNQENFNSENQS

SEQ ID NO: 175332 - protein, 32 aa, Artificial Sequence
  Description of Artificial Sequence: Synthetic polypeptide
DETEIRTTNPIATEQWGDVWAEIEANPKEPYA

SEQ ID NO: 175333 - protein, 37 aa, Artificial Sequence
  Description of Artificial Sequence: Synthetic polypeptide
DEEEIRTTNPVATEQYGCVCSMWGEDHNIENFGSEQA

SEQ ID NO: 175334 - protein, 32 aa, Artificial Sequence
  Description of Artificial Sequence: Synthetic polypeptide
DETEIRTTNPIATEQWGDVWAEIEANPKEPYI

SEQ ID NO: 175335 - protein, 36 aa, Artificial Sequence
  Description of Artificial Sequence: Synthetic polypeptide
DEEEISTTNPVATEQYGCVCSWPPHNQENFNSDNQS

SEQ ID NO: 175336 - protein, 32 aa, Artificial Sequence
  Description of Artificial Sequence: Synthetic polypeptide
SEVEIATTNPVAYEGWGSVVCNDQGDTGGFEA

SEQ ID NO: 175337 - protein, 39 aa, Artificial Sequence
  Description of Artificial Sequence: Synthetic polypeptide
DEEEIRTTNPVATEAYGVVSTVTNSNLQAGTEQGTEEQE

SEQ ID NO: 175338 - protein, 39 aa, Artificial Sequence
  Description of Artificial Sequence: Synthetic polypeptide
DEEEIRTTNPVATEAYGVVSTVTNTQAGTEAGVVTNEDE

SEQ ID NO: 175339 - protein, 35 aa, Artificial Sequence
  Description of Artificial Sequence: Synthetic polypeptide
SEVEIATTNPVATEQYGSISATDLNEDHQGLEDEN

SEQ ID NO: 175340 - protein, 35 aa, Artificial Sequence
  Description of Artificial Sequence: Synthetic polypeptide
CEEEIATTNPVAYEQYGSACSADHLNEAKIGNENE

SEQ ID NO: 175341 - protein, 35 aa, Artificial Sequence
  Description of Artificial Sequence: Synthetic polypeptide
DEEEISTTNPVATEQYGCVCYWGEHNQENFNSDQS

SEQ ID NO: 175342 - protein, 35 aa, Artificial Sequence
  Description of Artificial Sequence: Synthetic polypeptide
SEVEIATTNPVATEQWGSVSGENPNPEANGSENAW

SEQ ID NO: 175343 - protein, 36 aa, Artificial Sequence
  Description of Artificial Sequence: Synthetic polypeptide
SEVEIATTNPVATEIYGSVCSNWNDGQDRQGGGTEH

SEQ ID NO: 175344 - protein, 38 aa, Artificial Sequence
  Description of Artificial Sequence: Synthetic polypeptide
DEEEIRTTNPVATEQYGCVCSMWGEDHNAENFGSENQS

SEQ ID NO: 175345 - protein, 33 aa, Artificial Sequence
  Description of Artificial Sequence: Synthetic polypeptide
DDSEIRTTNPVSTEPYGTISAMEDIQQSQNGNH

SEQ ID NO: 175346 - protein, 34 aa, Artificial Sequence
  Description of Artificial Sequence: Synthetic polypeptide
DESEIRTTNPVATECWGSVFGCINEPEAREFELG

SEQ ID NO: 175347 - protein, 36 aa, Artificial Sequence
  Description of Artificial Sequence: Synthetic polypeptide
TEWEIRTTNPVATEQYGSVPNCESSENSGIVTNYSG

SEQ ID NO: 175348 - protein, 32 aa, Artificial Sequence
  Description of Artificial Sequence: Synthetic polypeptide
SETEIRTTNPIATECWGATTANADWAPKGNYR

SEQ ID NO: 175349 - protein, 35 aa, Artificial Sequence
  Description of Artificial Sequence: Synthetic polypeptide
DEEEISTTNPCATEQYGCVCSWMEHNAEYFGSDQS

SEQ ID NO: 175350 - protein, 34 aa, Artificial Sequence
  Description of Artificial Sequence: Synthetic polypeptide
DEEEIRTTNPVAYEQWGSVCAAANGDDSEHVDDS

SEQ ID NO: 175351 - protein, 34 aa, Artificial Sequence
  Description of Artificial Sequence: Synthetic polypeptide
DDSEIRTTNPVATEQYGVVWMENMMEETGTEVGQ

SEQ ID NO: 175352 - protein, 32 aa, Artificial Sequence
  Description of Artificial Sequence: Synthetic polypeptide
DETEIRTTNPISTECWGAVWANCEDLAPKGTI

SEQ ID NO: 175353 - protein, 36 aa, Artificial Sequence
  Description of Artificial Sequence: Synthetic polypeptide
AEDEIRCTNPVATEPYGSTVPSCTPALSVDPGGNPS

SEQ ID NO: 175354 - protein, 36 aa, Artificial Sequence
  Description of Artificial Sequence: Synthetic polypeptide
DEEEIRTTNPVATDQYGVMGNGNDNDQDGGNEDDGE

SEQ ID NO: 175355 - protein, 36 aa, Artificial Sequence
  Description of Artificial Sequence: Synthetic polypeptide
DEEEIRTTNPVATDQYGSVVMNGFNGGGFDEHTGGD

SEQ ID NO: 175356 - protein, 34 aa, Artificial Sequence
  Description of Artificial Sequence: Synthetic polypeptide
DEDEIATTNPVAYEQYGSVCAGGAQESPGDQLAK

SEQ ID NO: 175357 - protein, 38 aa, Artificial Sequence
  Description of Artificial Sequence: Synthetic polypeptide
AEDEIRATNPVATEQYGVVSTTNQQQLLQLQQGTNQQL

SEQ ID NO: 175358 - protein, 31 aa, Artificial Sequence
  Description of Artificial Sequence: Synthetic polypeptide
CEEEIATTNPVAYEQYGEAPEVEHSQHETEA

SEQ ID NO: 175359 - protein, 35 aa, Artificial Sequence
  Description of Artificial Sequence: Synthetic polypeptide
SETEIACTNPVATEQYGSVYCTWNDQHHQGHGGQH

SEQ ID NO: 175360 - protein, 34 aa, Artificial Sequence
  Description of Artificial Sequence: Synthetic polypeptide
DEACIKTTNPMAYECYGSLVACTNGSQRSTDNVN

SEQ ID NO: 175361 - protein, 37 aa, Artificial Sequence
  Description of Artificial Sequence: Synthetic polypeptide
DEEEIRTTNPVAYEQWGSVSGGDPANGGNMRNGMGDA

SEQ ID NO: 175362 - protein, 36 aa, Artificial Sequence
  Description of Artificial Sequence: Synthetic polypeptide
DEEEIRTTNPVAYEQWGSVSGGEPADPNMRNGGGSV

SEQ ID NO: 175363 - protein, 37 aa, Artificial Sequence
  Description of Artificial Sequence: Synthetic polypeptide
DEEEIRTTNPVAYEQWGSVSGGEPAGGGNMRNGDGMV

SEQ ID NO: 175364 - protein, 32 aa, Artificial Sequence
  Description of Artificial Sequence: Synthetic polypeptide
DETEIRTTNPIATEQWGDVWAEIEANPKGPYI

SEQ ID NO: 175365 - protein, 32 aa, Artificial Sequence
  Description of Artificial Sequence: Synthetic polypeptide
DETEIRTTNPIATEQWGDVWAEIEMNAKEPYA

SEQ ID NO: 175366 - protein, 39 aa, Artificial Sequence
  Description of Artificial Sequence: Synthetic polypeptide
DEEEIRTTNPVATEAYGVVSTVTNQQLQQGTEQGTDEEQ

SEQ ID NO: 175367 - protein, 30 aa, Artificial Sequence
  Description of Artificial Sequence: Synthetic polypeptide
DETEIRTTNPIATEQWGEAWPEVWAHKEEK

SEQ ID NO: 175368 - protein, 36 aa, Artificial Sequence
  Description of Artificial Sequence: Synthetic polypeptide
DEEEISTTNPVATEQYGCVCSWGPDHNINFNSENQS

SEQ ID NO: 175369 - protein, 36 aa, Artificial Sequence
  Description of Artificial Sequence: Synthetic polypeptide
DEEEISTTNPVATEQYGCVCSWGPHNAENFNSEFQG

SEQ ID NO: 175370 - protein, 33 aa, Artificial Sequence
  Description of Artificial Sequence: Synthetic polypeptide
SEYEIRCTNPVATEQYGCVCEWEEHQHFGSDQA

SEQ ID NO: 175371 - protein, 32 aa, Artificial Sequence
  Description of Artificial Sequence: Synthetic polypeptide
DETEIRTTNPIATEQWGSTAAADWAEHEGEYL

SEQ ID NO: 175372 - protein, 35 aa, Artificial Sequence
  Description of Artificial Sequence: Synthetic polypeptide
DETEIRTTNPIATEQWGSTSANAPDGPNMPNGNYV

SEQ ID NO: 175373 - protein, 35 aa, Artificial Sequence
  Description of Artificial Sequence: Synthetic polypeptide
DETEIRTTNPIATEQWGSTSANAPDGPNMPNGPYV

SEQ ID NO: 175374 - protein, 39 aa, Artificial Sequence
  Description of Artificial Sequence: Synthetic polypeptide
DEEEIRTTNPVATEAYGVVSTVTNQQLQQGTEQGTEEGS

SEQ ID NO: 175375 - protein, 39 aa, Artificial Sequence
  Description of Artificial Sequence: Synthetic polypeptide
DEEEIRTTNPVATEAYGVVSTVTNQQLQQGTEQGTTEDE

SEQ ID NO: 175376 - protein, 39 aa, Artificial Sequence
  Description of Artificial Sequence: Synthetic polypeptide
DEEEIRTTNPVATEAYGVVSTVTNLQLQAGTEQGTDEEE

SEQ ID NO: 175377 - protein, 38 aa, Artificial Sequence
  Description of Artificial Sequence: Synthetic polypeptide
DEEEIRTTNPVATEAYGVVSTVTNQQNTATEQGTEEEE

SEQ ID NO: 175378 - protein, 36 aa, Artificial Sequence
  Description of Artificial Sequence: Synthetic polypeptide
DETEIRTTNPIATEQWGSVWATAEDGPNERKGMNYV

SEQ ID NO: 175379 - protein, 34 aa, Artificial Sequence
  Description of Artificial Sequence: Synthetic polypeptide
SEYEIRCTNPVATEQYGCVCETGEDNQHFNSDQA

SEQ ID NO: 175380 - protein, 35 aa, Artificial Sequence
  Description of Artificial Sequence: Synthetic polypeptide
DETEIRTTNPIATEQYGATAWANAEDWQEPKGGYR

SEQ ID NO: 175381 - protein, 36 aa, Artificial Sequence
  Description of Artificial Sequence: Synthetic polypeptide
DEEEISTTNPVATEQYGCVCSWMEHNQENFNSDTQA

SEQ ID NO: 175382 - protein, 34 aa, Artificial Sequence
  Description of Artificial Sequence: Synthetic polypeptide
DETEIRTTNPIATEQYGATTWANADLEEHKGPDI

SEQ ID NO: 175383 - protein, 34 aa, Artificial Sequence
  Description of Artificial Sequence: Synthetic polypeptide
DETEIRTTNPIATEQYGATTWANADLEEHKGPDL

SEQ ID NO: 175384 - protein, 33 aa, Artificial Sequence
  Description of Artificial Sequence: Synthetic polypeptide
DETEIRTTNPIATEQYGETAWANEENWAEPGGI

SEQ ID NO: 175385 - protein, 32 aa, Artificial Sequence
  Description of Artificial Sequence: Synthetic polypeptide
DDSEVASTNPVSTEGYGNVAANEGIQSREGQR

SEQ ID NO: 175386 - protein, 34 aa, Artificial Sequence
  Description of Artificial Sequence: Synthetic polypeptide
SEYEIRCTNPVATEQYGCVCENWEHNQHFNSDQA

SEQ ID NO: 175387 - protein, 37 aa, Artificial Sequence
  Description of Artificial Sequence: Synthetic polypeptide
DEEEIRTTNPVAYEQWGSVSGGEPAGPNMQNGGGGVS

SEQ ID NO: 175388 - protein, 34 aa, Artificial Sequence
  Description of Artificial Sequence: Synthetic polypeptide
SEYEIRCTNPVATEQYGCVCENTEDNQHFNSDQS

SEQ ID NO: 175389 - protein, 33 aa, Artificial Sequence
  Description of Artificial Sequence: Synthetic polypeptide
SEYEIRCTNPVATEGYGCVCETEHQEHFGSDQS

SEQ ID NO: 175390 - protein, 36 aa, Artificial Sequence
  Description of Artificial Sequence: Synthetic polypeptide
DEEEISTTNPVATEQYGCVCSWMEDHNAENFNSEQA

SEQ ID NO: 175391 - protein, 37 aa, Artificial Sequence
  Description of Artificial Sequence: Synthetic polypeptide
DEEEISTTNPVATEQYGCVCSTWGEHNQEHFNSDTQL

SEQ ID NO: 175392 - protein, 37 aa, Artificial Sequence
  Description of Artificial Sequence: Synthetic polypeptide
DEEEIRTTNPVATEQYGCVCSWGEDHNQEFFNSDNQS

SEQ ID NO: 175393 - protein, 36 aa, Artificial Sequence
  Description of Artificial Sequence: Synthetic polypeptide
DETNEIATTNPVAYECWGSVYCTDNHQIQQQGGNRD

SEQ ID NO: 175394 - protein, 35 aa, Artificial Sequence
  Description of Artificial Sequence: Synthetic polypeptide
DEEEIRTTNPEATEQYGCVCPTWGEDAENFGSDQS

SEQ ID NO: 175395 - protein, 39 aa, Artificial Sequence
  Description of Artificial Sequence: Synthetic polypeptide
CEEEIRTTNPVATEQYGFSAVSSTTPAGPNMRNGMNPVH

SEQ ID NO: 175396 - protein, 37 aa, Artificial Sequence
  Description of Artificial Sequence: Synthetic polypeptide
DEEEIRTTNPEATEQYGCVCPTTGEHNAEYFGSDNQA

SEQ ID NO: 175397 - protein, 37 aa, Artificial Sequence
  Description of Artificial Sequence: Synthetic polypeptide
DEEEIRTTNPVAYEQWGEVSGGNPANGPNMRNGGGSV

SEQ ID NO: 175398 - protein, 36 aa, Artificial Sequence
  Description of Artificial Sequence: Synthetic polypeptide
DEVEIRTTNPVATEGYGSVMGQFVGEQENGNGGGQE

SEQ ID NO: 175399 - protein, 35 aa, Artificial Sequence
  Description of Artificial Sequence: Synthetic polypeptide
DEEEIRTTNPEATEQYGCVCPTGEHAENFGSDTQS

SEQ ID NO: 175400 - protein, 34 aa, Artificial Sequence
  Description of Artificial Sequence: Synthetic polypeptide
DEVEIRTTNPVATEGYGSVVLDGMGGEDIEQEGF

SEQ ID NO: 175401 - protein, 36 aa, Artificial Sequence
  Description of Artificial Sequence: Synthetic polypeptide
DEVEIRTTNPVATEGYGSVVYDNIIQGGQGEEDEQG

SEQ ID NO: 175402 - protein, 32 aa, Artificial Sequence
  Description of Artificial Sequence: Synthetic polypeptide
DDSEIATTNPVSTEGYGNVAANTIQSHVGQDL

SEQ ID NO: 175403 - protein, 30 aa, Artificial Sequence
  Description of Artificial Sequence: Synthetic polypeptide
DDSEIATTNPVSTEGYGNAANTCQSHVGEK

SEQ ID NO: 175404 - protein, 36 aa, Artificial Sequence
  Description of Artificial Sequence: Synthetic polypeptide
DEEEIRTTNPEATEQYGCVCPSGEHNAEYFNSDNQA

SEQ ID NO: 175405 - protein, 31 aa, Artificial Sequence
  Description of Artificial Sequence: Synthetic polypeptide
DDSEIATTNPVSTEGYGNAAANTCQSHVGEK

SEQ ID NO: 175406 - protein, 39 aa, Artificial Sequence
  Description of Artificial Sequence: Synthetic polypeptide
DEDEIRTTNPVATEQYGVVSVTVVTNQQQGNQQGTTQDE

SEQ ID NO: 175407 - protein, 37 aa, Artificial Sequence
  Description of Artificial Sequence: Synthetic polypeptide
DECEICTTNPVAVEQYGSVSTTVTTNNNEQGSTNVTD

SEQ ID NO: 175408 - protein, 35 aa, Artificial Sequence
  Description of Artificial Sequence: Synthetic polypeptide
DEACIRTTNPVATEQYGCVCSWGEENIENFGSDQS

SEQ ID NO: 175409 - protein, 40 aa, Artificial Sequence
  Description of Artificial Sequence: Synthetic polypeptide
DEEEIRTTNPVATEAYGVVSTVVSTNNQAIGTNQQGTDDG

SEQ ID NO: 175410 - protein, 32 aa, Artificial Sequence
  Description of Artificial Sequence: Synthetic polypeptide
DDSEVASTNPVSTEGYGNVAANTIQMRNGMQR

SEQ ID NO: 175411 - protein, 36 aa, Artificial Sequence
  Description of Artificial Sequence: Synthetic polypeptide
DEEEIRTTNPEATCQYGCVCPTSGEDNQNFGSDNQS

SEQ ID NO: 175412 - protein, 37 aa, Artificial Sequence
  Description of Artificial Sequence: Synthetic polypeptide
DECEICTTNPVAVEQYGSVSTTVTNNNEQGSTNNVED

SEQ ID NO: 175413 - protein, 35 aa, Artificial Sequence
  Description of Artificial Sequence: Synthetic polypeptide
DEEEIRTTNPEATCQYGCVCPNTGEDNQYFGSDQA

SEQ ID NO: 175414 - protein, 35 aa, Artificial Sequence
  Description of Artificial Sequence: Synthetic polypeptide
AEDEICATNPVATEQYGVVAVVNANLQQQGEGNDD

SEQ ID NO: 175415 - protein, 32 aa, Artificial Sequence
  Description of Artificial Sequence: Synthetic polypeptide
DDSEVASTNPVSTEGYGNVAANTIQMRVGQRI

SEQ ID NO: 175416 - protein, 36 aa, Artificial Sequence
  Description of Artificial Sequence: Synthetic polypeptide
CEEEIRTTNPVATEQYGQCVCSNSEHNQENFGSDQA

SEQ ID NO: 175417 - protein, 37 aa, Artificial Sequence
  Description of Artificial Sequence: Synthetic polypeptide
CEEEIRTTNPVATEQYGQCVCSNTGEHDQENFGSDQF

SEQ ID NO: 175418 - protein, 35 aa, Artificial Sequence
  Description of Artificial Sequence: Synthetic polypeptide
DEEEIRTTNPCAYYEPYGSCAGTNHMNAGQPGEAM

SEQ ID NO: 175419 - protein, 35 aa, Artificial Sequence
  Description of Artificial Sequence: Synthetic polypeptide
DEEEIRTTNPEATEQYGCVCPTWGEHANFGSDTQS

SEQ ID NO: 175420 - protein, 33 aa, Artificial Sequence
  Description of Artificial Sequence: Synthetic polypeptide
DDSEIASTNPVSTEPYGTVSAMEDIQQSQNGNR

SEQ ID NO: 175421 - protein, 37 aa, Artificial Sequence
  Description of Artificial Sequence: Synthetic polypeptide
DEAEIRTTNPVATEQYGSTIPWTPPTEENQHQSENPQ

SEQ ID NO: 175422 - protein, 37 aa, Artificial Sequence
  Description of Artificial Sequence: Synthetic polypeptide
DEAEIRTTNPVATEQYGSTIPWTPPWEENLHSQFEMQ

SEQ ID NO: 175423 - protein, 37 aa, Artificial Sequence
  Description of Artificial Sequence: Synthetic polypeptide
DEVEIRSTNPVATEQYGSVITDNNAGNDEGENGGNNG

SEQ ID NO: 175424 - protein, 37 aa, Artificial Sequence
  Description of Artificial Sequence: Synthetic polypeptide
DEEEIRTTNPFATEQYGSVCHITPGPLVFIDKGDEPP

SEQ ID NO: 175425 - protein, 35 aa, Artificial Sequence
  Description of Artificial Sequence: Synthetic polypeptide
DEVEIRSTNPVATESYGSVITDNNAGNDEGEGGEG

SEQ ID NO: 175426 - protein, 39 aa, Artificial Sequence
  Description of Artificial Sequence: Synthetic polypeptide
DEDEIRTTNPVATEQYGVVSTVVNQAGNQQGIGTNQDED

SEQ ID NO: 175427 - protein, 39 aa, Artificial Sequence
  Description of Artificial Sequence: Synthetic polypeptide
DEDEIRTTNPVATEQYGVVSTVVNQNNNQQGIGTNTDED

SEQ ID NO: 175428 - protein, 38 aa, Artificial Sequence
  Description of Artificial Sequence: Synthetic polypeptide
DEDEIRTTNPVATEQYGVVSTVVNTNDEAGNNNQDEDE

SEQ ID NO: 175429 - protein, 34 aa, Artificial Sequence
  Description of Artificial Sequence: Synthetic polypeptide
DENEIRTTNPVAYEQWGGVYTIEGEKMNQAEDAR

SEQ ID NO: 175430 - protein, 34 aa, Artificial Sequence
  Description of Artificial Sequence: Synthetic polypeptide
DENEIRTTNPVAYEQWGDVVSCEQESMNAAEGDA

SEQ ID NO: 175431 - protein, 38 aa, Artificial Sequence
  Description of Artificial Sequence: Synthetic polypeptide
DEDEIRTTNPVATEQYGVVSTVVNTQNMGTEQGTTESG

SEQ ID NO: 175432 - protein, 32 aa, Artificial Sequence
  Description of Artificial Sequence: Synthetic polypeptide
DENEIRTTNPVAYEQWGDMSEIEMNAAEDPAF

SEQ ID NO: 175433 - protein, 38 aa, Artificial Sequence
  Description of Artificial Sequence: Synthetic polypeptide
SEEEIRTTNPVATEQYGSVVDSVVNGFGNENDQDEGGG

SEQ ID NO: 175434 - protein, 38 aa, Artificial Sequence
  Description of Artificial Sequence: Synthetic polypeptide
SEEEIRTTNPVATEQYGSVTYPTFDDMNNNGLEEMNME

SEQ ID NO: 175435 - protein, 35 aa, Artificial Sequence
  Description of Artificial Sequence: Synthetic polypeptide
DEEEIRTTNPVAYEQWGHNTVYYWDEQQTRPTGHE

SEQ ID NO: 175436 - protein, 34 aa, Artificial Sequence
  Description of Artificial Sequence: Synthetic polypeptide
DEEEIRTTNPVAYEQWGHNNVYYWEEQQHTPRGE

SEQ ID NO: 175437 - protein, 35 aa, Artificial Sequence
  Description of Artificial Sequence: Synthetic polypeptide
DEQEIATTNPVAYEQWGSVSGQGPPQQETPDGSNH

SEQ ID NO: 175438 - protein, 31 aa, Artificial Sequence
  Description of Artificial Sequence: Synthetic polypeptide
DDSEVASTNPVSTEGYGNVAANTIQGQMGQR

SEQ ID NO: 175439 - protein, 36 aa, Artificial Sequence
  Description of Artificial Sequence: Synthetic polypeptide
DEVEIRTTNPVATECYGSVDDGGNDDEGEGEGNNNQ

SEQ ID NO: 175440 - protein, 36 aa, Artificial Sequence
  Description of Artificial Sequence: Synthetic polypeptide
DEEEIRTTNPEATEQYGQCVCPTGEHNANFGSDTQS

SEQ ID NO: 175441 - protein, 37 aa, Artificial Sequence
  Description of Artificial Sequence: Synthetic polypeptide
DEDEIRTTNPVATEQYGVVSTVVTTTNTTEQGSTDDD

SEQ ID NO: 175442 - protein, 34 aa, Artificial Sequence
  Description of Artificial Sequence: Synthetic polypeptide
VEDEIATTNPVAYEQYGSVCAATGLAAPAENDNH

SEQ ID NO: 175443 - protein, 37 aa, Artificial Sequence
  Description of Artificial Sequence: Synthetic polypeptide
DEDEIRTTNPVATEQYGVVSTVVVNNQNEEEEEEEDD

SEQ ID NO: 175444 - protein, 37 aa, Artificial Sequence
  Description of Artificial Sequence: Synthetic polypeptide
CEEEIRTTNPVATEQYGDVVQDNTIGQQNIGGEDNQG

SEQ ID NO: 175445 - protein, 32 aa, Artificial Sequence
  Description of Artificial Sequence: Synthetic polypeptide
DDSEIATTNPVSTEGYGTVCSANDTPEFVGQD

SEQ ID NO: 175446 - protein, 38 aa, Artificial Sequence
  Description of Artificial Sequence: Synthetic polypeptide
DEDEIRTTNPVATEQYGVVSTVVVNQQNENEEEEEEDD

SEQ ID NO: 175447 - protein, 38 aa, Artificial Sequence
  Description of Artificial Sequence: Synthetic polypeptide
DEDEIRTTNPVATEQYGVVSTVVVTNDEAGNNQEDEDE

SEQ ID NO: 175448 - protein, 36 aa, Artificial Sequence
  Description of Artificial Sequence: Synthetic polypeptide
DEVEIRTTNPVATECYGSVVNNVDNNGEMTQGEGQG

SEQ ID NO: 175449 - protein, 37 aa, Artificial Sequence
  Description of Artificial Sequence: Synthetic polypeptide
DECEICTTNPVAVEQYGSVSTVVTNNAEQGSTNNVED

SEQ ID NO: 175450 - protein, 33 aa, Artificial Sequence
  Description of Artificial Sequence: Synthetic polypeptide
DDSEIASTNPVSTEPYGTVSAMEDIQQQQNGNR

SEQ ID NO: 175451 - protein, 33 aa, Artificial Sequence
  Description of Artificial Sequence: Synthetic polypeptide
DDSEIASTNPVSTEPYGNVSAMEDIQQSRVGQR

SEQ ID NO: 175452 - protein, 35 aa, Artificial Sequence
  Description of Artificial Sequence: Synthetic polypeptide
DENEIRTTNPVATEQYGVVVMNGFNGEGGFEETYG

SEQ ID NO: 175453 - protein, 34 aa, Artificial Sequence
  Description of Artificial Sequence: Synthetic polypeptide
DEEEIRTTNPCAYEPYGSTCAGTNHMNPSQGEAM

SEQ ID NO: 175454 - protein, 35 aa, Artificial Sequence
  Description of Artificial Sequence: Synthetic polypeptide
DENEIRTTNPVATEQYGVVVLNGFNGEGGFDETDL

SEQ ID NO: 175455 - protein, 38 aa, Artificial Sequence
  Description of Artificial Sequence: Synthetic polypeptide
DEEEIRTTNPVATEQYGCVCSMTGEDHNQENFGSDTQA

SEQ ID NO: 175456 - protein, 36 aa, Artificial Sequence
  Description of Artificial Sequence: Synthetic polypeptide
DEDEIRTTNPVAYDQYGSVQQCTGNQSTWTGTKNGV

SEQ ID NO: 175457 - protein, 37 aa, Artificial Sequence
  Description of Artificial Sequence: Synthetic polypeptide
DEEEIRTTNPCAYEPYGSPCAASGNLGQATPGDNSAM

SEQ ID NO: 175458 - protein, 35 aa, Artificial Sequence
  Description of Artificial Sequence: Synthetic polypeptide
DEDEIRTTNPVAYDRYGSVQCTGNQSIWTGTKNGV

SEQ ID NO: 175459 - protein, 36 aa, Artificial Sequence
  Description of Artificial Sequence: Synthetic polypeptide
DENEIRTTNPVATEQYGVVVLNGFNGEGGFDENTED

SEQ ID NO: 175460 - protein, 37 aa, Artificial Sequence
  Description of Artificial Sequence: Synthetic polypeptide
DENEIRTTNPVATEQYGVVVDDNFNVGLGEGDGENEG

SEQ ID NO: 175461 - protein, 36 aa, Artificial Sequence
  Description of Artificial Sequence: Synthetic polypeptide
DENEIRTTNPVATEQYGVVTTVWLPDEQEVLQIDEI

SEQ ID NO: 175462 - protein, 34 aa, Artificial Sequence
  Description of Artificial Sequence: Synthetic polypeptide
DEDEIRTTNPVAYECWGCSYPNPQPDNRDMGDAR

SEQ ID NO: 175463 - protein, 35 aa, Artificial Sequence
  Description of Artificial Sequence: Synthetic polypeptide
DEDEIRTTNPVAYECWGCVASDGNMGNEDRGEGRR

SEQ ID NO: 175464 - protein, 35 aa, Artificial Sequence
  Description of Artificial Sequence: Synthetic polypeptide
DEDEIRTTNPVAYECWGCVASDGNMGNERGEGIRN

SEQ ID NO: 175465 - protein, 35 aa, Artificial Sequence
  Description of Artificial Sequence: Synthetic polypeptide
DEDEIRTTNPVAYECWGCVASEGGNMGNDRGEGRR

SEQ ID NO: 175466 - protein, 35 aa, Artificial Sequence
  Description of Artificial Sequence: Synthetic polypeptide
DEDEIRTTNPVAYECWGCVASMGGNMGNQRGEGMM

SEQ ID NO: 175467 - protein, 31 aa, Artificial Sequence
  Description of Artificial Sequence: Synthetic polypeptide
DDSEIASTNPVSTEGYGNVAANTIQSRAEQA

SEQ ID NO: 175468 - protein, 35 aa, Artificial Sequence
  Description of Artificial Sequence: Synthetic polypeptide
DEAEIRTTNPVATEQYGSTFYTWLPMESESIEDQM

SEQ ID NO: 175469 - protein, 31 aa, Artificial Sequence
  Description of Artificial Sequence: Synthetic polypeptide
DDSEIASTNPVSTEGYGNVAANTIQSHVGEL

SEQ ID NO: 175470 - protein, 34 aa, Artificial Sequence
  Description of Artificial Sequence: Synthetic polypeptide
DEDEIRTTNPVAYECWGCVSGGNGEDERNMNGAD

SEQ ID NO: 175471 - protein, 34 aa, Artificial Sequence
  Description of Artificial Sequence: Synthetic polypeptide
DEAEIRTTNPVATEQYGSTCEGTPDHIEESEEQG

SEQ ID NO: 175472 - protein, 38 aa, Artificial Sequence
  Description of Artificial Sequence: Synthetic polypeptide
DEAEIRTTNPVATEQYGSSVSCSGWLDEELMNGNEEVF

SEQ ID NO: 175473 - protein, 34 aa, Artificial Sequence
  Description of Artificial Sequence: Synthetic polypeptide
DEDEIRTTNPVAYECWGSVAWNDNAEQNGGGGDM

SEQ ID NO: 175474 - protein, 34 aa, Artificial Sequence
  Description of Artificial Sequence: Synthetic polypeptide
DEDEIRTTNPVAYECWGSVAWTDDGDDRGGGQQM

SEQ ID NO: 175475 - protein, 35 aa, Artificial Sequence
  Description of Artificial Sequence: Synthetic polypeptide
DEDEIRTTNPVAYECWGSVAWTDDGQDQRGGGEQI

SEQ ID NO: 175476 - protein, 34 aa, Artificial Sequence
  Description of Artificial Sequence: Synthetic polypeptide
DEDEIRTTNPVAYECWGSVAWTDDRDNDRGGGQS

SEQ ID NO: 175477 - protein, 36 aa, Artificial Sequence
  Description of Artificial Sequence: Synthetic polypeptide
DENEIRTTNPVATEQYGVVVNMNGFNGEDGQLENTD

SEQ ID NO: 175478 - protein, 35 aa, Artificial Sequence
  Description of Artificial Sequence: Synthetic polypeptide
DEVEIRTTNPVATEQYGIVVDGPGGGNDDQNEQDG

SEQ ID NO: 175479 - protein, 35 aa, Artificial Sequence
  Description of Artificial Sequence: Synthetic polypeptide
DEQEIATTNPVAYEQWGSVTGGNENDQIGNMGNQN

SEQ ID NO: 175480 - protein, 37 aa, Artificial Sequence
  Description of Artificial Sequence: Synthetic polypeptide
DENEIRTTNPVATEQYGVVWSDTVDALNVGEGGMQQF

SEQ ID NO: 175481 - protein, 32 aa, Artificial Sequence
  Description of Artificial Sequence: Synthetic polypeptide
DDSEVASTNPVSTEGYGNVAANTIQMRVGQRT

SEQ ID NO: 175482 - protein, 36 aa, Artificial Sequence
  Description of Artificial Sequence: Synthetic polypeptide
DEVEIRTTNPVATEQYGQVVDDNGGEGNDDQNEQDG

SEQ ID NO: 175483 - protein, 31 aa, Artificial Sequence
  Description of Artificial Sequence: Synthetic polypeptide
DDSEVASTNPVSTEGYGNVAANTIQNDTGQR

SEQ ID NO: 175484 - protein, 36 aa, Artificial Sequence
  Description of Artificial Sequence: Synthetic polypeptide
CEEEIRTTNPVATEQYGQCVCSSGEHNQNFNSDNQE

SEQ ID NO: 175485 - protein, 36 aa, Artificial Sequence
  Description of Artificial Sequence: Synthetic polypeptide
DEVEIRTTNPVATEQYGSFNSEANPDDEGSGQEEEG

SEQ ID NO: 175486 - protein, 33 aa, Artificial Sequence
  Description of Artificial Sequence: Synthetic polypeptide
DDSEIASTNPVSTEPYGNVSAMEDIQQSQVGNR

SEQ ID NO: 175487 - protein, 37 aa, Artificial Sequence
  Description of Artificial Sequence: Synthetic polypeptide
CEEEIRTTNPVATEQYGQCVCSSGELNQENFNSDNQD

SEQ ID NO: 175488 - protein, 36 aa, Artificial Sequence
  Description of Artificial Sequence: Synthetic polypeptide
DENEIRTTNPVATEVYGSVVVNGDDEGQGEQGQEED

SEQ ID NO: 175489 - protein, 36 aa, Artificial Sequence
  Description of Artificial Sequence: Synthetic polypeptide
DENEIRTTNPVATEVYGSVVVNDDGEGQEEQGTEED

SEQ ID NO: 175490 - protein, 36 aa, Artificial Sequence
  Description of Artificial Sequence: Synthetic polypeptide
DENEIRTTNPVATEVYGSVVVNADDEGQEEQGDEED

SEQ ID NO: 175491 - protein, 37 aa, Artificial Sequence
  Description of Artificial Sequence: Synthetic polypeptide
DENEIRTTNPVATEVYGSVSVNTDGGEDQEEQGQEED

SEQ ID NO: 175492 - protein, 37 aa, Artificial Sequence
  Description of Artificial Sequence: Synthetic polypeptide
DENEIRTTNPVATEVYGSVSVNADGNEGQEEQGVEED

SEQ ID NO: 175493 - protein, 34 aa, Artificial Sequence
  Description of Artificial Sequence: Synthetic polypeptide
DEAEISTTNPVATEQYGCLFTATDDPVEFEGNKQ

SEQ ID NO: 175494 - protein, 35 aa, Artificial Sequence
  Description of Artificial Sequence: Synthetic polypeptide
DEAEISTTNPVATEQYGCSCSWGEHNAENFGSDQS

SEQ ID NO: 175495 - protein, 32 aa, Artificial Sequence
  Description of Artificial Sequence: Synthetic polypeptide
DDSEIASTNPVSTEGYGNVWAAATIQSRVGQR

SEQ ID NO: 175496 - protein, 37 aa, Artificial Sequence
  Description of Artificial Sequence: Synthetic polypeptide
DEAEIRTTNPVATEQYGSTIPWTNPLEENLHFQIEMQ

SEQ ID NO: 175497 - protein, 31 aa, Artificial Sequence
  Description of Artificial Sequence: Synthetic polypeptide
DDSEIASTNPVSTEGYGNVSAECIQSRVEQL

SEQ ID NO: 175498 - protein, 38 aa, Artificial Sequence
  Description of Artificial Sequence: Synthetic polypeptide
CEEEIRTTNPVATEQYGQCVCSTGEDHEQEYFGSDNQA

SEQ ID NO: 175499 - protein, 35 aa, Artificial Sequence
  Description of Artificial Sequence: Synthetic polypeptide
DENEIRTTNPVATETYGSVFVMDVSSEEDIGSTQE

SEQ ID NO: 175500 - protein, 35 aa, Artificial Sequence
  Description of Artificial Sequence: Synthetic polypeptide
DEQEIATTNPVAYEQWGSVTGENENDSRGNMGGQI

SEQ ID NO: 175501 - protein, 37 aa, Artificial Sequence
  Description of Artificial Sequence: Synthetic polypeptide
DEVEIRTTNPVATEQYGSVLGDGDNDDEGEGEGNNIA

SEQ ID NO: 175502 - protein, 36 aa, Artificial Sequence
  Description of Artificial Sequence: Synthetic polypeptide
DENEIRTTNPVATESYGSVSMGGMNDDEGGGQDDGI

SEQ ID NO: 175503 - protein, 38 aa, Artificial Sequence
  Description of Artificial Sequence: Synthetic polypeptide
DEVEIRTTNPVATEQYGSVNFDENDNDEGQTDDEGNDQ

SEQ ID NO: 175504 - protein, 34 aa, Artificial Sequence
  Description of Artificial Sequence: Synthetic polypeptide
DEDEIRTTNPVATTQYGVVAVNQAGTEQGSVTDE

SEQ ID NO: 175505 - protein, 37 aa, Artificial Sequence
  Description of Artificial Sequence: Synthetic polypeptide
DENEIRTTNPVATEQYGVVYTDTMNTIGMGGNEGNNG

SEQ ID NO: 175506 - protein, 36 aa, Artificial Sequence
  Description of Artificial Sequence: Synthetic polypeptide
DENEIRTTNPVATEQYGVVVVMNGFNGEGGFDENID

SEQ ID NO: 175507 - protein, 36 aa, Artificial Sequence
  Description of Artificial Sequence: Synthetic polypeptide
DEVEIRATNPVATEQYGSVVDFDNNEGQDEMEGEIA

SEQ ID NO: 175508 - protein, 38 aa, Artificial Sequence
  Description of Artificial Sequence: Synthetic polypeptide
DEDEIRTTNPVATEQYGVVSTVVNNQQNNNEEEEEQDE

SEQ ID NO: 175509 - protein, 38 aa, Artificial Sequence
  Description of Artificial Sequence: Synthetic polypeptide
DEDEIRTTNPVATEQYGVVSTVVNNQQNNEEEEEDEEE

SEQ ID NO: 175510 - protein, 40 aa, Artificial Sequence
  Description of Artificial Sequence: Synthetic polypeptide
DEDEIRTTNPVATEQYGVVSTVNTGNNQLQGIGTNNQDED

SEQ ID NO: 175511 - protein, 33 aa, Artificial Sequence
  Description of Artificial Sequence: Synthetic polypeptide
DENEIRTTNPVSFEPYGTISMIDIQVQQNGNIH

SEQ ID NO: 175512 - protein, 33 aa, Artificial Sequence
  Description of Artificial Sequence: Synthetic polypeptide
DEVEIATTNPVAYERWGCTYSTQNPGNDNDKRE

SEQ ID NO: 175513 - protein, 34 aa, Artificial Sequence
  Description of Artificial Sequence: Synthetic polypeptide
DEVEIATTNPVAYERWGCVYNTNVQGDLPGGDRE

SEQ ID NO: 175514 - protein, 33 aa, Artificial Sequence
  Description of Artificial Sequence: Synthetic polypeptide
DENEIRTTNPVSCEPYGTISMEDIQQQQNGNWH

SEQ ID NO: 175515 - protein, 36 aa, Artificial Sequence
  Description of Artificial Sequence: Synthetic polypeptide
DEEEISTTNPVATEQYGQCVCSWGEPQENFNSDTQI

SEQ ID NO: 175516 - protein, 35 aa, Artificial Sequence
  Description of Artificial Sequence: Synthetic polypeptide
DEVEIATTNPVAYERWGSVCSTTDNHDRQGGQEEN

SEQ ID NO: 175517 - protein, 35 aa, Artificial Sequence
  Description of Artificial Sequence: Synthetic polypeptide
DEVEIATTNPVAYERWGSVSGGNADDSRNDGNGNS

SEQ ID NO: 175518 - protein, 35 aa, Artificial Sequence
  Description of Artificial Sequence: Synthetic polypeptide
DEVEIATTNPVAYERWGSVSGGNTDDSRNNGNGNP

SEQ ID NO: 175519 - protein, 32 aa, Artificial Sequence
  Description of Artificial Sequence: Synthetic polypeptide
DENEIRTTNPVSCEPYGTIFMEDIQQQQNGNH

SEQ ID NO: 175520 - protein, 37 aa, Artificial Sequence
  Description of Artificial Sequence: Synthetic polypeptide
DEEEISTTNPVATEQYGQCVCSWGETNAEFFNSETQS

SEQ ID NO: 175521 - protein, 37 aa, Artificial Sequence
  Description of Artificial Sequence: Synthetic polypeptide
DEEEISTTNPVATEQYGQCVCSWGETNQEHFNSDNQA

SEQ ID NO: 175522 - protein, 34 aa, Artificial Sequence
  Description of Artificial Sequence: Synthetic polypeptide
DESEIRTTNPVATCGYGCVCSNTEHNQYFTSDQA

SEQ ID NO: 175523 - protein, 38 aa, Artificial Sequence
  Description of Artificial Sequence: Synthetic polypeptide
DEDEIRTTNPVATEQYGVVSTVTNDQNEGTEQGTTESG

SEQ ID NO: 175524 - protein, 38 aa, Artificial Sequence
  Description of Artificial Sequence: Synthetic polypeptide
DEDEIRTTNPVATEQYGVVSTVTNEQQGGTEQGTTESG

SEQ ID NO: 175525 - protein, 34 aa, Artificial Sequence
  Description of Artificial Sequence: Synthetic polypeptide
DEQEIATTNPVAYEQWGSTCSATDNNDHQGEEDI

SEQ ID NO: 175526 - protein, 35 aa, Artificial Sequence
  Description of Artificial Sequence: Synthetic polypeptide
SEEEIRTTNPVATESWGSVFHNENDIHERNGDQSG

SEQ ID NO: 175527 - protein, 36 aa, Artificial Sequence
  Description of Artificial Sequence: Synthetic polypeptide
DEAEIRTTNPVATEQYGSTVLMACAEVESRQQEDRI

SEQ ID NO: 175528 - protein, 36 aa, Artificial Sequence
  Description of Artificial Sequence: Synthetic polypeptide
DEAEIRTTNPVATEQYGSTSSWAQWDLVDSLQDEYG

SEQ ID NO: 175529 - protein, 33 aa, Artificial Sequence
  Description of Artificial Sequence: Synthetic polypeptide
DEVEIATTNPVAYESWGSVCYNNDEQDQDNQES

SEQ ID NO: 175530 - protein, 35 aa, Artificial Sequence
  Description of Artificial Sequence: Synthetic polypeptide
SEEEIRTTNPVATESWGSVFHNENDGHERQGQDQN

SEQ ID NO: 175531 - protein, 34 aa, Artificial Sequence
  Description of Artificial Sequence: Synthetic polypeptide
DEQEIATTNPVAYEQWGSTCSATDNVNDHEGGDL

SEQ ID NO: 175532 - protein, 39 aa, Artificial Sequence
  Description of Artificial Sequence: Synthetic polypeptide
DEDEIRTTNPVATEQYGVVSTVTNNNLQQGIGTTDEDED

SEQ ID NO: 175533 - protein, 35 aa, Artificial Sequence
  Description of Artificial Sequence: Synthetic polypeptide
SEEEIRTTNPVATESWGAVFWNENDDHQKQRGDQS

SEQ ID NO: 175534 - protein, 38 aa, Artificial Sequence
  Description of Artificial Sequence: Synthetic polypeptide
DEDEIRTTNPVATEQYGVVSTVTNNQQMGTEQGTTEEG

SEQ ID NO: 175535 - protein, 37 aa, Artificial Sequence
  Description of Artificial Sequence: Synthetic polypeptide
CEEEIRTTNPVATDQYGVVSILIATGDEDQSGNGDGD

SEQ ID NO: 175536 - protein, 34 aa, Artificial Sequence
  Description of Artificial Sequence: Synthetic polypeptide
DEVEICTTNPMAYETYGSVPTPDPQHVSGENFMG

SEQ ID NO: 175537 - protein, 34 aa, Artificial Sequence
  Description of Artificial Sequence: Synthetic polypeptide
AEDEICATNPVATEQYGVVAVVNENLQQGEGEDT

SEQ ID NO: 175538 - protein, 33 aa, Artificial Sequence
  Description of Artificial Sequence: Synthetic polypeptide
DENEIRTTNPVSHEPYGTISMEDIQQQQNGNHN

SEQ ID NO: 175539 - protein, 34 aa, Artificial Sequence
  Description of Artificial Sequence: Synthetic polypeptide
DEQEIATTNPVAYEQWGSCSPTDNNEHNDDRDDT

SEQ ID NO: 175540 - protein, 35 aa, Artificial Sequence
  Description of Artificial Sequence: Synthetic polypeptide
AEDEICATNPVATEQYGVVAVVVEQNLQQGEGNDD

SEQ ID NO: 175541 - protein, 33 aa, Artificial Sequence
  Description of Artificial Sequence: Synthetic polypeptide
DENEIRTTNPVSMEPYGTISMEDIQQQQNGNVH

SEQ ID NO: 175542 - protein, 34 aa, Artificial Sequence
  Description of Artificial Sequence: Synthetic polypeptide
DESEIRTTNPVATCHYGQCVCSTEHQEYFTSDQS

SEQ ID NO: 175543 - protein, 37 aa, Artificial Sequence
  Description of Artificial Sequence: Synthetic polypeptide
DEVEIATTNPVAYEQYGTVCSYTDGLNEEMQRDTNES

SEQ ID NO: 175544 - protein, 37 aa, Artificial Sequence
  Description of Artificial Sequence: Synthetic polypeptide
DEVEIATTNPVAYEQYGTVCSYTDGLNEEMQRGQSES

SEQ ID NO: 175545 - protein, 36 aa, Artificial Sequence
  Description of Artificial Sequence: Synthetic polypeptide
DEVEIATTNPVAYEQYGTVCSYTDGLPEDHDEGNDS

SEQ ID NO: 175546 - protein, 30 aa, Artificial Sequence
  Description of Artificial Sequence: Synthetic polypeptide
DDSEVRTTNPVSTEQWGNVSEIEMNAAEDA

SEQ ID NO: 175547 - protein, 35 aa, Artificial Sequence
  Description of Artificial Sequence: Synthetic polypeptide
DEQEIATTNPVAYEQWGSCSPTDNNNEHQDDRDDE

SEQ ID NO: 175548 - protein, 33 aa, Artificial Sequence
  Description of Artificial Sequence: Synthetic polypeptide
DESEIRTTNPVATCHYGCVCSWEHNQYFISDQA

SEQ ID NO: 175549 - protein, 36 aa, Artificial Sequence
  Description of Artificial Sequence: Synthetic polypeptide
DEVEIATTNPVAYEQYGTVCSYTDGPPEDQHGNTDE

SEQ ID NO: 175550 - protein, 36 aa, Artificial Sequence
  Description of Artificial Sequence: Synthetic polypeptide
DEEEISTTNPVATEQYGQCVCSWGEHNQNFNSQTQS

SEQ ID NO: 175551 - protein, 35 aa, Artificial Sequence
  Description of Artificial Sequence: Synthetic polypeptide
DEQEIATTNPVAYEQWGSCSPTEDNNEHQGDRDDP

SEQ ID NO: 175552 - protein, 39 aa, Artificial Sequence
  Description of Artificial Sequence: Synthetic polypeptide
DEDEIRTTNPVATEQYGVVSTVNNQQGNQQGIGTNQDEE

SEQ ID NO: 175553 - protein, 36 aa, Artificial Sequence
  Description of Artificial Sequence: Synthetic polypeptide
DEEEISTTNPVATEQYGQCVCSWGEHNQNFQSDTQS

SEQ ID NO: 175554 - protein, 35 aa, Artificial Sequence
  Description of Artificial Sequence: Synthetic polypeptide
DEQEIATTNPVAYEQWGSCSPTHDNNEHQDDRDDH

SEQ ID NO: 175555 - protein, 34 aa, Artificial Sequence
  Description of Artificial Sequence: Synthetic polypeptide
DEEEIRTTNPIATECWGAVWANTPAGAEPNGPPV

SEQ ID NO: 175556 - protein, 36 aa, Artificial Sequence
  Description of Artificial Sequence: Synthetic polypeptide
DEEEIRTTNPIATECWGAVSATTPDGPAERKGMNPV

SEQ ID NO: 175557 - protein, 36 aa, Artificial Sequence
  Description of Artificial Sequence: Synthetic polypeptide
DEEEISTTNPVATEQYGQCVCSWGEHNQYFGSETQS

SEQ ID NO: 175558 - protein, 35 aa, Artificial Sequence
  Description of Artificial Sequence: Synthetic polypeptide
DEQEIATTNPVAYEQWGSCSPTNDNNEHQDMRDDP

SEQ ID NO: 175559 - protein, 35 aa, Artificial Sequence
  Description of Artificial Sequence: Synthetic polypeptide
DESEIRTTNPVATCHYGCVCSTGEHNQYFNSDNQA

SEQ ID NO: 175560 - protein, 35 aa, Artificial Sequence
  Description of Artificial Sequence: Synthetic polypeptide
DESEIRTTNPVATCHYGCVCSTGEHNQYFISNTQA

SEQ ID NO: 175561 - protein, 40 aa, Artificial Sequence
  Description of Artificial Sequence: Synthetic polypeptide
DEDEIRTTNPVATEQYGVVSTVNQGNNQLQGIGTTNQDEE

SEQ ID NO: 175562 - protein, 39 aa, Artificial Sequence
  Description of Artificial Sequence: Synthetic polypeptide
DEDEIRTTNPVATEQYGVVSTVNQGNQEQGIGTTNQNED

SEQ ID NO: 175563 - protein, 31 aa, Artificial Sequence
  Description of Artificial Sequence: Synthetic polypeptide
DDSEVRTTNPVSTEQWGNVSAEIEMNAAGDA

SEQ ID NO: 175564 - protein, 36 aa, Artificial Sequence
  Description of Artificial Sequence: Synthetic polypeptide
VEDEIATTNPVAYEQYGSVCATNPQLNPDDQTGGTA

SEQ ID NO: 175565 - protein, 36 aa, Artificial Sequence
  Description of Artificial Sequence: Synthetic polypeptide
SEEEIRTTNPVATESWGAVFWNENDDHEKQREGFSR

SEQ ID NO: 175566 - protein, 37 aa, Artificial Sequence
  Description of Artificial Sequence: Synthetic polypeptide
DEEEIRTTNPVATEQWGYSNQAASNELPHERVGQGFV

SEQ ID NO: 175567 - protein, 35 aa, Artificial Sequence
  Description of Artificial Sequence: Synthetic polypeptide
CEEEIRTTNPTAVEQYGSVWTVKHSSETIMGSDRE

SEQ ID NO: 175568 - protein, 36 aa, Artificial Sequence
  Description of Artificial Sequence: Synthetic polypeptide
DEEEISTTNPVATEQYGQCVCSWMEHNQNFNSDTQT

SEQ ID NO: 175569 - protein, 36 aa, Artificial Sequence
  Description of Artificial Sequence: Synthetic polypeptide
DEQEIATTNPVAYEQWGSVAWSIEDNQQNHNGEGRD

SEQ ID NO: 175570 - protein, 37 aa, Artificial Sequence
  Description of Artificial Sequence: Synthetic polypeptide
DEDEIRTTNPVATEQYGVVSTVVNNNANEEEEEENED

SEQ ID NO: 175571 - protein, 31 aa, Artificial Sequence
  Description of Artificial Sequence: Synthetic polypeptide
DDSEIRSTNPVSTEGYGTIAMEDIQQQNGQR

SEQ ID NO: 175572 - protein, 36 aa, Artificial Sequence
  Description of Artificial Sequence: Synthetic polypeptide
DEEEISTTNPVATEQYGQCYCSNSGEHTENFNSDQS

SEQ ID NO: 175573 - protein, 36 aa, Artificial Sequence
  Description of Artificial Sequence: Synthetic polypeptide
DEEEIRTTNPVGTEQYGCVCSSEDHNAENFNSDNQA

SEQ ID NO: 175574 - protein, 35 aa, Artificial Sequence
  Description of Artificial Sequence: Synthetic polypeptide
DEQEIATTNPVAYEQWGSVCPTFEDRTERDGGDRM

SEQ ID NO: 175575 - protein, 36 aa, Artificial Sequence
  Description of Artificial Sequence: Synthetic polypeptide
DECEICTTNPVAYECWGSVATGNGPLQDDRQQNGSK

SEQ ID NO: 175576 - protein, 35 aa, Artificial Sequence
  Description of Artificial Sequence: Synthetic polypeptide
DEVEIHTTNPVATEQYGTVVNTTDGDDEEGEGGNI

SEQ ID NO: 175577 - protein, 36 aa, Artificial Sequence
  Description of Artificial Sequence: Synthetic polypeptide
DEVEIHTTNPVATEQYGTVVSATDGDDEEGEDGNAI

SEQ ID NO: 175578 - protein, 37 aa, Artificial Sequence
  Description of Artificial Sequence: Synthetic polypeptide
DEVEIHTTNPVATEQYGTVVSATDGDDEENGEGGNIA

SEQ ID NO: 175579 - protein, 39 aa, Artificial Sequence
  Description of Artificial Sequence: Synthetic polypeptide
DEDEIRTTNPVATEQYGVVSTVVNNQNGNQQAIGTTESG

SEQ ID NO: 175580 - protein, 38 aa, Artificial Sequence
  Description of Artificial Sequence: Synthetic polypeptide
DEDEIRTTNPVATEQYGVVSTVVNNQQGEEEEEEDEET

SEQ ID NO: 175581 - protein, 36 aa, Artificial Sequence
  Description of Artificial Sequence: Synthetic polypeptide
DEVEIKTTNPVATEFYGTVVSATDGDDNEGEGGNGQ

SEQ ID NO: 175582 - protein, 37 aa, Artificial Sequence
  Description of Artificial Sequence: Synthetic polypeptide
DEVEIKTTNPVATEGYGSVVDGPDGTNEGQTGGQNGF

SEQ ID NO: 175583 - protein, 36 aa, Artificial Sequence
  Description of Artificial Sequence: Synthetic polypeptide
DEVEIKTTNPVATEQYGAVVNSVGNSGEFTNDEGQG

SEQ ID NO: 175584 - protein, 37 aa, Artificial Sequence
  Description of Artificial Sequence: Synthetic polypeptide
SEEEIRTTNPVATEQYGSVWYMTFDDMNNNGLELNME

SEQ ID NO: 175585 - protein, 32 aa, Artificial Sequence
  Description of Artificial Sequence: Synthetic polypeptide
DEEEIRTTNPIATECWGATTANAEDWAPGPYK

SEQ ID NO: 175586 - protein, 34 aa, Artificial Sequence
  Description of Artificial Sequence: Synthetic polypeptide
DENEIRTTNPVAYEQWGMVYSIEIEMNQAEGDAP

SEQ ID NO: 175587 - protein, 34 aa, Artificial Sequence
  Description of Artificial Sequence: Synthetic polypeptide
DESEIRTTNPVASECWGSFCGCINEPEAREGENG

SEQ ID NO: 175588 - protein, 35 aa, Artificial Sequence
  Description of Artificial Sequence: Synthetic polypeptide
DEVEIKTTNPVATEQYGTVVNATDGDDEEGEGGND

SEQ ID NO: 175589 - protein, 36 aa, Artificial Sequence
  Description of Artificial Sequence: Synthetic polypeptide
DEEEIRTTNPVGTEQYGCVCSNSEEDHNANFGSDQA

SEQ ID NO: 175590 - protein, 37 aa, Artificial Sequence
  Description of Artificial Sequence: Synthetic polypeptide
DEEEIRTTNPVAYEQYGQCVCSNWEDDNQNSGSDNQS

SEQ ID NO: 175591 - protein, 37 aa, Artificial Sequence
  Description of Artificial Sequence: Synthetic polypeptide
DEDEIRTTNPVATEQYGVVSTVVNNQQNEEEEEEEED

SEQ ID NO: 175592 - protein, 38 aa, Artificial Sequence
  Description of Artificial Sequence: Synthetic polypeptide
DEDEIRTTNPVATEQYGVVSTVVNNQQNEEEGTEEEDE

SEQ ID NO: 175593 - protein, 40 aa, Artificial Sequence
  Description of Artificial Sequence: Synthetic polypeptide
DEDEIRTTNPVATEQYGVVSTVVNGNNNLQGIGTNNQDED

SEQ ID NO: 175594 - protein, 38 aa, Artificial Sequence
  Description of Artificial Sequence: Synthetic polypeptide
DEDEIRTTNPVATEQYGVVSTVVNAQQGEEEEEEETDE

SEQ ID NO: 175595 - protein, 32 aa, Artificial Sequence
  Description of Artificial Sequence: Synthetic polypeptide
DEEEIRTTNPIATECWGATTWAEEDWARGPYI

SEQ ID NO: 175596 - protein, 37 aa, Artificial Sequence
  Description of Artificial Sequence: Synthetic polypeptide
DEEEIRTTNPVGTEQYGCVCSSGEDDNAENFGSDNQA

SEQ ID NO: 175597 - protein, 37 aa, Artificial Sequence
  Description of Artificial Sequence: Synthetic polypeptide
DEEEISTTNPVATEQYGQCVCSWGETNTENFNSDTQA

SEQ ID NO: 175598 - protein, 36 aa, Artificial Sequence
  Description of Artificial Sequence: Synthetic polypeptide
DEEEIRTTNPVATEQYGCVSGHIIDHSVGSMQEFEQ

SEQ ID NO: 175599 - protein, 32 aa, Artificial Sequence
  Description of Artificial Sequence: Synthetic polypeptide
DDSEVASTNPVSTEGYGNVAANTIQFRVGEQR

SEQ ID NO: 175600 - protein, 38 aa, Artificial Sequence
  Description of Artificial Sequence: Synthetic polypeptide
SEEEIRTTNPVATEQYGVVVIMTNPDGPNMQEGENDGD

SEQ ID NO: 175601 - protein, 38 aa, Artificial Sequence
  Description of Artificial Sequence: Synthetic polypeptide
DEDEIRTTNPVATEQYGVVSTVTNTQAGGTEQGTTEEG

SEQ ID NO: 175602 - protein, 38 aa, Artificial Sequence
  Description of Artificial Sequence: Synthetic polypeptide
DEDEIRTTNPVATEQYGVVSTVTNTQNIGTEQGSTESG

SEQ ID NO: 175603 - protein, 38 aa, Artificial Sequence
  Description of Artificial Sequence: Synthetic polypeptide
DEDEIRTTNPVATEQYGVVSTVTNTQQQGTEQGTTEEN

SEQ ID NO: 175604 - protein, 35 aa, Artificial Sequence
  Description of Artificial Sequence: Synthetic polypeptide
DEQEIATTNPVAYEQWGSTCSTTDNNDHQKDDGDP

SEQ ID NO: 175605 - protein, 35 aa, Artificial Sequence
  Description of Artificial Sequence: Synthetic polypeptide
SEEEIRTTNPVATEQYGVVTVTMAATEEGTQASPG

SEQ ID NO: 175606 - protein, 36 aa, Artificial Sequence
  Description of Artificial Sequence: Synthetic polypeptide
SEEEIRTTNPVATEQYGVISYTLKEMHQESLQDETQ

SEQ ID NO: 175607 - protein, 35 aa, Artificial Sequence
  Description of Artificial Sequence: Synthetic polypeptide
SEEEIRTTNPVATEQYGVISYCLIEMHQEDQDETQ

SEQ ID NO: 175608 - protein, 37 aa, Artificial Sequence
  Description of Artificial Sequence: Synthetic polypeptide
DEEEISTTNPVATEQYGQCVCSWGPHNEENFGSDNQY

SEQ ID NO: 175609 - protein, 35 aa, Artificial Sequence
  Description of Artificial Sequence: Synthetic polypeptide
DEDEIRTTNPVAYECWGSVAWTDNEEQNGGGDQMG

SEQ ID NO: 175610 - protein, 37 aa, Artificial Sequence
  Description of Artificial Sequence: Synthetic polypeptide
SEEEIRTTNPVATEQYGVCGSVTDGDTGQGGEQEGEI

SEQ ID NO: 175611 - protein, 35 aa, Artificial Sequence
  Description of Artificial Sequence: Synthetic polypeptide
DECEICTTNPVAYEQWGSVCSGEGNQTTNGTNGMQ

SEQ ID NO: 175612 - protein, 32 aa, Artificial Sequence
  Description of Artificial Sequence: Synthetic polypeptide
DEEEIRTTNPIATECWGATTWANANWAEPGPI

SEQ ID NO: 175613 - protein, 35 aa, Artificial Sequence
  Description of Artificial Sequence: Synthetic polypeptide
DEQEIATTNPVAYEQWGSTCSVTDNNDHQGNDDDY

SEQ ID NO: 175614 - protein, 35 aa, Artificial Sequence
  Description of Artificial Sequence: Synthetic polypeptide
DEQEIATTNPVAYEQWGSTCSVTDNNDQVGDESDT

SEQ ID NO: 175615 - protein, 34 aa, Artificial Sequence
  Description of Artificial Sequence: Synthetic polypeptide
DECEICTTNPVAYEQWGSVCPNDHNHNNGHDNNE

SEQ ID NO: 175616 - protein, 38 aa, Artificial Sequence
  Description of Artificial Sequence: Synthetic polypeptide
CEEEIRTTNPVATEQYGDVSVGFNTNGQQNIGGEDTQG

SEQ ID NO: 175617 - protein, 34 aa, Artificial Sequence
  Description of Artificial Sequence: Synthetic polypeptide
DECEICTTNPVAYEQWGMISHTDNHQQERRKDSD

SEQ ID NO: 175618 - protein, 32 aa, Artificial Sequence
  Description of Artificial Sequence: Synthetic polypeptide
DEEEIRTTNPIATECWGATTWANADWAEPGPI

SEQ ID NO: 175619 - protein, 35 aa, Artificial Sequence
  Description of Artificial Sequence: Synthetic polypeptide
DEQEIATTNPVAYEQWGSTCVVTDNNDQVGDEDDS

SEQ ID NO: 175620 - protein, 35 aa, Artificial Sequence
  Description of Artificial Sequence: Synthetic polypeptide
DEEEISTTNPVATEQYGQCVCSWMEHNINFNSDQS

SEQ ID NO: 175621 - protein, 38 aa, Artificial Sequence
  Description of Artificial Sequence: Synthetic polypeptide
DEEEIRTTNPVATEQWGYANVAAMNELQIQRPGQGVFV

SEQ ID NO: 175622 - protein, 37 aa, Artificial Sequence
  Description of Artificial Sequence: Synthetic polypeptide
SEEEIRTTNPVATEQYGSVYYPTFDDMNNNGLELNMA

SEQ ID NO: 175623 - protein, 32 aa, Artificial Sequence
  Description of Artificial Sequence: Synthetic polypeptide
DEEEISSVNPCATEPYGDVASMEICYVDGENV

SEQ ID NO: 175624 - protein, 37 aa, Artificial Sequence
  Description of Artificial Sequence: Synthetic polypeptide
SEEEIRTTNPVATESYGSVMSNGFENLVPDEGGDQQE

SEQ ID NO: 175625 - protein, 38 aa, Artificial Sequence
  Description of Artificial Sequence: Synthetic polypeptide
DEAEIRTTNPVATEQYGSSVSCSGMMLEELHNGNEEVF

SEQ ID NO: 175626 - protein, 37 aa, Artificial Sequence
  Description of Artificial Sequence: Synthetic polypeptide
DENEIRTTNPVATEQYGVVMSNNDNQTGGGQTGQTGD

SEQ ID NO: 175627 - protein, 38 aa, Artificial Sequence
  Description of Artificial Sequence: Synthetic polypeptide
DEEEIRTTNPCATEQYGVVSTVNGNQAGTEQGTTEEGQ

SEQ ID NO: 175628 - protein, 37 aa, Artificial Sequence
  Description of Artificial Sequence: Synthetic polypeptide
CEEEIRTTNPVATEQYGSVNEPTYGQMLQAQEQAELT

SEQ ID NO: 175629 - protein, 37 aa, Artificial Sequence
  Description of Artificial Sequence: Synthetic polypeptide
CEEEIRTTNPVATEQYGSVNEPTYVEMLQAQEQPELS

SEQ ID NO: 175630 - protein, 36 aa, Artificial Sequence
  Description of Artificial Sequence: Synthetic polypeptide
CEEEIRTTNPVATEQYGSVPADGMGGEGNVGGEDGA

SEQ ID NO: 175631 - protein, 36 aa, Artificial Sequence
  Description of Artificial Sequence: Synthetic polypeptide
DEAEIRTTNPVATEQYGSNVWHEVSQANTVEDEEQN

SEQ ID NO: 175632 - protein, 38 aa, Artificial Sequence
  Description of Artificial Sequence: Synthetic polypeptide
DEEEIRTTNPCATEQYGVVSTVNGEAGNDEQGTTEEGS

SEQ ID NO: 175633 - protein, 39 aa, Artificial Sequence
  Description of Artificial Sequence: Synthetic polypeptide
DEAEIRTTNPVATEQYGSNIVTWSVNDEEQNNEPEINRF

SEQ ID NO: 175634 - protein, 38 aa, Artificial Sequence
  Description of Artificial Sequence: Synthetic polypeptide
DEEEIRTTNPCATEQYGVVSTVNGDQAGTEQGTTEAGS

SEQ ID NO: 175635 - protein, 39 aa, Artificial Sequence
  Description of Artificial Sequence: Synthetic polypeptide
DEEEIRTTNPCATEQYGVVSTVNGDQAGNQEQGTTEAGA

SEQ ID NO: 175636 - protein, 34 aa, Artificial Sequence
  Description of Artificial Sequence: Synthetic polypeptide
DEWEIRTTNPVATECWGSFGPCINIPEARETENG

SEQ ID NO: 175637 - protein, 38 aa, Artificial Sequence
  Description of Artificial Sequence: Synthetic polypeptide
CEEEIRTTNPVATEQYGSVQCKESAELQPDFALAFENG

SEQ ID NO: 175638 - protein, 38 aa, Artificial Sequence
  Description of Artificial Sequence: Synthetic polypeptide
DEEEIRTTNPCATEQYGVVSTVNDEQGNTEQGTTEAGQ

SEQ ID NO: 175639 - protein, 39 aa, Artificial Sequence
  Description of Artificial Sequence: Synthetic polypeptide
DEEEIRTTNPVATEAYGVVSTVVVTNQQAGTNQQGTDDE

SEQ ID NO: 175640 - protein, 38 aa, Artificial Sequence
  Description of Artificial Sequence: Synthetic polypeptide
CEEEIRTTNPVATEQYGSVQCKESAELQPDFLLVPENG

SEQ ID NO: 175641 - protein, 37 aa, Artificial Sequence
  Description of Artificial Sequence: Synthetic polypeptide
CEEEIRTTNPVATEQYGSVQCVESAELQPDFLLFESG

SEQ ID NO: 175642 - protein, 37 aa, Artificial Sequence
  Description of Artificial Sequence: Synthetic polypeptide
DEAEIRTTNPVATEQYGSLYWSETYPINDLEINMDQE

SEQ ID NO: 175643 - protein, 38 aa, Artificial Sequence
  Description of Artificial Sequence: Synthetic polypeptide
DEEEIRTTNPCATEQYGVVSTVNDEAGNSEQGTTETGQ

SEQ ID NO: 175644 - protein, 38 aa, Artificial Sequence
  Description of Artificial Sequence: Synthetic polypeptide
DEAEIRTTNPVATEQYGSLVSCSGILVEELMNGNEEVF

SEQ ID NO: 175645 - protein, 35 aa, Artificial Sequence
  Description of Artificial Sequence: Synthetic polypeptide
DEAEIRTTNPVATEQYGSLLMAMAEVESRQQEDRQ

SEQ ID NO: 175646 - protein, 36 aa, Artificial Sequence
  Description of Artificial Sequence: Synthetic polypeptide
DEAEIRTTNPVATEQYGSLIWTYTAMINDLEINDQE

SEQ ID NO: 175647 - protein, 39 aa, Artificial Sequence
  Description of Artificial Sequence: Synthetic polypeptide
DEEEIRTTNPCATEQYGVVSTVNAVQAGNSEQGTTEYGQ

SEQ ID NO: 175648 - protein, 34 aa, Artificial Sequence
  Description of Artificial Sequence: Synthetic polypeptide
DEWEIRTTNPVAYESYGSVCCQGGHSHTEGGERL

SEQ ID NO: 175649 - protein, 37 aa, Artificial Sequence
  Description of Artificial Sequence: Synthetic polypeptide
DEEEIRTTNPVGTEQWGSVSGTANEPGGEAGGDIMAM

SEQ ID NO: 175650 - protein, 38 aa, Artificial Sequence
  Description of Artificial Sequence: Synthetic polypeptide
DEEEIRTTNPVATEAYGVVSTYGNTDIGTTSISTTGNT

SEQ ID NO: 175651 - protein, 33 aa, Artificial Sequence
  Description of Artificial Sequence: Synthetic polypeptide
DESEIRTTNPIATEGYGATTWANATLAEPGDYI

SEQ ID NO: 175652 - protein, 34 aa, Artificial Sequence
  Description of Artificial Sequence: Synthetic polypeptide
VEDEIATTNPVAYEQYGSVCAAGGPDNDDNDNRN

SEQ ID NO: 175653 - protein, 37 aa, Artificial Sequence
  Description of Artificial Sequence: Synthetic polypeptide
DEEEIRTTNPVGTEQWGSVSGTAIEPGNETGGDIMAM

SEQ ID NO: 175654 - protein, 37 aa, Artificial Sequence
  Description of Artificial Sequence: Synthetic polypeptide
SEEEIRTTNPVATEQYGSVQSITTSLAEITMESTQLQ

SEQ ID NO: 175655 - protein, 37 aa, Artificial Sequence
  Description of Artificial Sequence: Synthetic polypeptide
SEEEIRTTNPVATEQYGSVQWITMGEEQPEPGEVPEI

SEQ ID NO: 175656 - protein, 37 aa, Artificial Sequence
  Description of Artificial Sequence: Synthetic polypeptide
DEEEIRTTNPCATEQYGVVSVVSNNQAGTEQGTTDDD

SEQ ID NO: 175657 - protein, 34 aa, Artificial Sequence
  Description of Artificial Sequence: Synthetic polypeptide
DEEEISTTNPVAYEEWGSTVASQPELSQTEPDED

SEQ ID NO: 175658 - protein, 38 aa, Artificial Sequence
  Description of Artificial Sequence: Synthetic polypeptide
DEAEIRTTNPVATEQYGSQVISWDIQDEETGNLSSIED

SEQ ID NO: 175659 - protein, 38 aa, Artificial Sequence
  Description of Artificial Sequence: Synthetic polypeptide
CEEEIRTTNPVATEQYGSVMGNMDENGGQNQGGNAEGV

SEQ ID NO: 175660 - protein, 37 aa, Artificial Sequence
  Description of Artificial Sequence: Synthetic polypeptide
DEEEIRTTNPVGTEQWGSVSGTAVELGGEMGGDIDAM

SEQ ID NO: 175661 - protein, 38 aa, Artificial Sequence
  Description of Artificial Sequence: Synthetic polypeptide
DEAEIRTTNPVATEQYGSQVISDIHDENTDGNLSPIED

SEQ ID NO: 175662 - protein, 35 aa, Artificial Sequence
  Description of Artificial Sequence: Synthetic polypeptide
DEAEIRTTNPVATEQYGSNYTWPLMESMESIEDQM

SEQ ID NO: 175663 - protein, 35 aa, Artificial Sequence
  Description of Artificial Sequence: Synthetic polypeptide
DEVEIVTTNPVATEQYGTVVNATDGDDEEGEGNET

SEQ ID NO: 175664 - protein, 35 aa, Artificial Sequence
  Description of Artificial Sequence: Synthetic polypeptide
DEQEIATTNPVAYEQYGEVPSCTDALSEDHEGEDL

SEQ ID NO: 175665 - protein, 35 aa, Artificial Sequence
  Description of Artificial Sequence: Synthetic polypeptide
DEVEIVTTNPVATEQYGTVVSATDGDDEEDEGGQI

SEQ ID NO: 175666 - protein, 37 aa, Artificial Sequence
  Description of Artificial Sequence: Synthetic polypeptide
DEEEIRTTNPVGTEQWGSVSGTAVAGGGERGGDIEAM

SEQ ID NO: 175667 - protein, 38 aa, Artificial Sequence
  Description of Artificial Sequence: Synthetic polypeptide
DEEEIRTTNPVATEAYGVVSTVVVTNNDQQGTQEQDED

SEQ ID NO: 175668 - protein, 35 aa, Artificial Sequence
  Description of Artificial Sequence: Synthetic polypeptide
DEVEIVTTNPVATEQYGTVVSATDGDDEEGEGGTE

SEQ ID NO: 175669 - protein, 36 aa, Artificial Sequence
  Description of Artificial Sequence: Synthetic polypeptide
DEVEIVTTNPVATEQYGTVVSATDGDDEEGEGNNGE

SEQ ID NO: 175670 - protein, 36 aa, Artificial Sequence
  Description of Artificial Sequence: Synthetic polypeptide
DEVEIVTTNPVATEQYGTVVSATDGDDEEGEGNNIN

SEQ ID NO: 175671 - protein, 36 aa, Artificial Sequence
  Description of Artificial Sequence: Synthetic polypeptide
DEVEIVTTNPVATEQYGTVVSATDGDDEEGEGNNTT

SEQ ID NO: 175672 - protein, 37 aa, Artificial Sequence
  Description of Artificial Sequence: Synthetic polypeptide
CEEEIRTTNPVATEQYGSVNEPENGQMLQAQEQPELS

SEQ ID NO: 175673 - protein, 36 aa, Artificial Sequence
  Description of Artificial Sequence: Synthetic polypeptide
DEVEIVTTNPVATEQYGTVVSATDGDDEEGMGNGTE

SEQ ID NO: 175674 - protein, 36 aa, Artificial Sequence
  Description of Artificial Sequence: Synthetic polypeptide
DEVEIVTTNPVATEQYGTVVSVTDGDDEEGEGNNDL

SEQ ID NO: 175675 - protein, 35 aa, Artificial Sequence
  Description of Artificial Sequence: Synthetic polypeptide
DEVEIVTTNPVATEQYGTVVTATDGDDEEGNGNGD

SEQ ID NO: 175676 - protein, 37 aa, Artificial Sequence
  Description of Artificial Sequence: Synthetic polypeptide
CEEEIRTTNPVATEQYGSVNEPTIGQMLQAQEPPELM

SEQ ID NO: 175677 - protein, 38 aa, Artificial Sequence
  Description of Artificial Sequence: Synthetic polypeptide
DEEEIRTTNPVATEAYGVVSTVVVTNNNQQAENDEETD

SEQ ID NO: 175678 - protein, 34 aa, Artificial Sequence
  Description of Artificial Sequence: Synthetic polypeptide
DEVSIATTNPVAYDPWGIMVPSCTAEHSQRGNRP

SEQ ID NO: 175679 - protein, 33 aa, Artificial Sequence
  Description of Artificial Sequence: Synthetic polypeptide
DEVSIATTNPVAYDPWGMVPSCQAEHSQRGNRC

SEQ ID NO: 175680 - protein, 39 aa, Artificial Sequence
  Description of Artificial Sequence: Synthetic polypeptide
DEEEIRTTNPCATEQYGVVSTVNNDQAGNSEQGTTEAGQ

SEQ ID NO: 175681 - protein, 33 aa, Artificial Sequence
  Description of Artificial Sequence: Synthetic polypeptide
DEVTICTTNPVATEFYGQVVDINGLEGGGDDED

SEQ ID NO: 175682 - protein, 36 aa, Artificial Sequence
  Description of Artificial Sequence: Synthetic polypeptide
DECEICTTNPVATTQYGVVSTTLGLQQGTEQGTTDV

SEQ ID NO: 175683 - protein, 36 aa, Artificial Sequence
  Description of Artificial Sequence: Synthetic polypeptide
DEQEIATTNPVATEQWGSVSATGDPGDEDHQGGEDN

SEQ ID NO: 175684 - protein, 34 aa, Artificial Sequence
  Description of Artificial Sequence: Synthetic polypeptide
DEYEEATTNPVAYEPWGSVATGGNTGNAGNDQQR

SEQ ID NO: 175685 - protein, 36 aa, Artificial Sequence
  Description of Artificial Sequence: Synthetic polypeptide
DEAEIRTTNPVATEQYGSLIWSYRVPINDLEINDQE

SEQ ID NO: 175686 - protein, 36 aa, Artificial Sequence
  Description of Artificial Sequence: Synthetic polypeptide
DEEEIRTTNPCATEQYGSYASPAHEEQVSLYTVENS

SEQ ID NO: 175687 - protein, 37 aa, Artificial Sequence
  Description of Artificial Sequence: Synthetic polypeptide
DEEEIRTTNPCATEQYGSYASPADQEQVSRYTVVENS

SEQ ID NO: 175688 - protein, 37 aa, Artificial Sequence
  Description of Artificial Sequence: Synthetic polypeptide
SEEEIRTTNPVATEQYGSVGDLGQNQVNINEMGNGNG

SEQ ID NO: 175689 - protein, 37 aa, Artificial Sequence
  Description of Artificial Sequence: Synthetic polypeptide
SEEEIRTTNPVATEQYGSVFYPTFDDMNNNPLELNMI

SEQ ID NO: 175690 - protein, 37 aa, Artificial Sequence
  Description of Artificial Sequence: Synthetic polypeptide
DEAEIRTTNPVATEQYGSLIWSYMQMINDLEQNMDQE

SEQ ID NO: 175691 - protein, 37 aa, Artificial Sequence
  Description of Artificial Sequence: Synthetic polypeptide
SEEEIRTTNPVATEQYGSVESVSMAGQDETEHEAGEV

SEQ ID NO: 175692 - protein, 36 aa, Artificial Sequence
  Description of Artificial Sequence: Synthetic polypeptide
DEAEIRTTNPVATEQYGSLIWPYTAPNNDLEINDQE

SEQ ID NO: 175693 - protein, 35 aa, Artificial Sequence
  Description of Artificial Sequence: Synthetic polypeptide
DEAEIRTTNPVATEQYGSLIWPAAPINDLEINDQE

SEQ ID NO: 175694 - protein, 36 aa, Artificial Sequence
  Description of Artificial Sequence: Synthetic polypeptide
DEEEIRTTNPVATEQWGTNCAGTMGPLAHQMDNSAA

SEQ ID NO: 175695 - protein, 37 aa, Artificial Sequence
  Description of Artificial Sequence: Synthetic polypeptide
SEEEIRTTNPVATEQYGSVDYPTEDDMNNGFEQNNMV

SEQ ID NO: 175696 - protein, 34 aa, Artificial Sequence
  Description of Artificial Sequence: Synthetic polypeptide
DEQEIATTNPVAYEQYGSTVCAMANNEQDATLTD

SEQ ID NO: 175697 - protein, 37 aa, Artificial Sequence
  Description of Artificial Sequence: Synthetic polypeptide
DEEEIRTTNPCATEQYGSVSPVSLSGILGIPQEEMDE

SEQ ID NO: 175698 - protein, 37 aa, Artificial Sequence
  Description of Artificial Sequence: Synthetic polypeptide
DEAEIRTTNPVATEQYGSLIPWTPPLEENQHYQSERQ

SEQ ID NO: 175699 - protein, 37 aa, Artificial Sequence
  Description of Artificial Sequence: Synthetic polypeptide
DEYEIGTTNPVATEQYGSVVSVTGGQTGQEEMGQGTI

SEQ ID NO: 175700 - protein, 36 aa, Artificial Sequence
  Description of Artificial Sequence: Synthetic polypeptide
DEYEIGTTNPVATEQYGSVVVVAVANAGMEGGGNGG

SEQ ID NO: 175701 - protein, 36 aa, Artificial Sequence
  Description of Artificial Sequence: Synthetic polypeptide
DEAEIRTTNPVATEQYGSLIPWTPPLDENQHQSEPQ

SEQ ID NO: 175702 - protein, 37 aa, Artificial Sequence
  Description of Artificial Sequence: Synthetic polypeptide
CEEEIRTTNPVATEQYGSVVDLMVQGEQQGITDNGGN

SEQ ID NO: 175703 - protein, 38 aa, Artificial Sequence
  Description of Artificial Sequence: Synthetic polypeptide
CEEEIRTTNPVATEQYGSVVEDFNDGQGQEDEGNEFEE

SEQ ID NO: 175704 - protein, 35 aa, Artificial Sequence
  Description of Artificial Sequence: Synthetic polypeptide
SEEEIRTTNPVATEQYGSVCAAGPDGFATMGDEEG

SEQ ID NO: 175705 - protein, 37 aa, Artificial Sequence
  Description of Artificial Sequence: Synthetic polypeptide
CEEEIATTNPVATEQYGSVCAMNNGVLPEDDGGNPDQ

SEQ ID NO: 175706 - protein, 38 aa, Artificial Sequence
  Description of Artificial Sequence: Synthetic polypeptide
DEEEIRTTNPCATEQYGSVPLVNISLQDEAGQHQATQC

SEQ ID NO: 175707 - protein, 35 aa, Artificial Sequence
  Description of Artificial Sequence: Synthetic polypeptide
DEEEIRTTNPCATEQYGSVPEPPWGIWETSVVVEN

SEQ ID NO: 175708 - protein, 36 aa, Artificial Sequence
  Description of Artificial Sequence: Synthetic polypeptide
DEEEIRTTNPCATEQYGSVPEPLWHIEEHCVVVNNT

SEQ ID NO: 175709 - protein, 37 aa, Artificial Sequence
  Description of Artificial Sequence: Synthetic polypeptide
CEEEIRTTNPVATEQYGSVVNDTPGVEEGQGQGQEQQ

SEQ ID NO: 175710 - protein, 34 aa, Artificial Sequence
  Description of Artificial Sequence: Synthetic polypeptide
DESEIRTTNPIATECWGSVWAAIDWPAEREGENG

SEQ ID NO: 175711 - protein, 39 aa, Artificial Sequence
  Description of Artificial Sequence: Synthetic polypeptide
DEEEIRTTNPCATEQYGVVSTVNASQAGNVEQGTTEAGQ

SEQ ID NO: 175712 - protein, 36 aa, Artificial Sequence
  Description of Artificial Sequence: Synthetic polypeptide
DESEIRTTNPVATEQYGSSYEGNMYHILMTPQEELQ

SEQ ID NO: 175713 - protein, 38 aa, Artificial Sequence
  Description of Artificial Sequence: Synthetic polypeptide
SEEEIRTTNPVATEQYGSVMTPTFDDMNNNGLEELNML

SEQ ID NO: 175714 - protein, 37 aa, Artificial Sequence
  Description of Artificial Sequence: Synthetic polypeptide
DEAEIRTTNPVATEQYGSLIWSYTYIINDEEINMDQE

SEQ ID NO: 175715 - protein, 37 aa, Artificial Sequence
  Description of Artificial Sequence: Synthetic polypeptide
DEAEIRTTNPVATEQYGSLIWSYTYEINDLEINHDQE

SEQ ID NO: 175716 - protein, 37 aa, Artificial Sequence
  Description of Artificial Sequence: Synthetic polypeptide
DEAEIRTTNPVATEQYGSLIWSYTHPINNLEINIDQE

SEQ ID NO: 175717 - protein, 37 aa, Artificial Sequence
  Description of Artificial Sequence: Synthetic polypeptide
DEAEIRTTNPVATEQYGSLIWSYTHPINDLEINDQQE

SEQ ID NO: 175718 - protein, 37 aa, Artificial Sequence
  Description of Artificial Sequence: Synthetic polypeptide
DEAEIRTTNPVATEQYGSLIWSYTHPANDLEINMDQE

SEQ ID NO: 175719 - protein, 35 aa, Artificial Sequence
  Description of Artificial Sequence: Synthetic polypeptide
DEYEIATTNPVAYECWGSVATGGNTGNAGPNDQQR

SEQ ID NO: 175720 - protein, 35 aa, Artificial Sequence
  Description of Artificial Sequence: Synthetic polypeptide
DEYEIATTNPVAYEEWGSVATGGGNTGNAGNDQQR

SEQ ID NO: 175721 - protein, 35 aa, Artificial Sequence
  Description of Artificial Sequence: Synthetic polypeptide
DEYEIATTNPVAYEEWGSVATGGNTGNAGNDGQRE

SEQ ID NO: 175722 - protein, 34 aa, Artificial Sequence
  Description of Artificial Sequence: Synthetic polypeptide
DEYEIATTNPVAYEEWGSVATGGNTGNAGNDNNV

SEQ ID NO: 175723 - protein, 37 aa, Artificial Sequence
  Description of Artificial Sequence: Synthetic polypeptide
SEEEIRTTNPVATEQYGSVNMQTTGDDQEDEFQNEGQ

SEQ ID NO: 175724 - protein, 39 aa, Artificial Sequence
  Description of Artificial Sequence: Synthetic polypeptide
DEEEIRTTNPCATEQYGVVSTTNAQQAGNSEQGTTEAGQ

SEQ ID NO: 175725 - protein, 34 aa, Artificial Sequence
  Description of Artificial Sequence: Synthetic polypeptide
DEYEIATTNPVAYMQWGSVPTWEKDIQDGQGNDS

SEQ ID NO: 175726 - protein, 37 aa, Artificial Sequence
  Description of Artificial Sequence: Synthetic polypeptide
DEAEIRTTNPVATEQYGSLIWSYTAPINTLEINMDQE

SEQ ID NO: 175727 - protein, 37 aa, Artificial Sequence
  Description of Artificial Sequence: Synthetic polypeptide
DEAEIRTTNPVATEQYGSLIWSYTAPINDLEINMEQE

SEQ ID NO: 175728 - protein, 37 aa, Artificial Sequence
  Description of Artificial Sequence: Synthetic polypeptide
DEEEIRTTNPVGTEQWGSVSGPAGELGGERGGDIEAM

SEQ ID NO: 175729 - protein, 37 aa, Artificial Sequence
  Description of Artificial Sequence: Synthetic polypeptide
DEEEIRTTNPCATEQYGVVSSVVVNQAGTEQGNNNDE

SEQ ID NO: 175730 - protein, 37 aa, Artificial Sequence
  Description of Artificial Sequence: Synthetic polypeptide
DEAEIRTTNPVATEQYGSLIWSYTAPINDLEINDLQY

SEQ ID NO: 175731 - protein, 37 aa, Artificial Sequence
  Description of Artificial Sequence: Synthetic polypeptide
DEAEIRTTNPVATEQYGSLIWSYTAPHINNLEINDQE

SEQ ID NO: 175732 - protein, 38 aa, Artificial Sequence
  Description of Artificial Sequence: Synthetic polypeptide
SEEEIRTTNPVATEQYGSVMYPTFDDMVNNGLEEVNME

SEQ ID NO: 175733 - protein, 34 aa, Artificial Sequence
  Description of Artificial Sequence: Synthetic polypeptide
DEYEICTVNPVAYEAYGKVFTNELSTEFVGNNHA

SEQ ID NO: 175734 - protein, 37 aa, Artificial Sequence
  Description of Artificial Sequence: Synthetic polypeptide
DEAEIRTTNPVATEQYGSLIWSYTAPGENDLEINDQE

SEQ ID NO: 175735 - protein, 35 aa, Artificial Sequence
  Description of Artificial Sequence: Synthetic polypeptide
DEYEICTVNPVAYETYGKVSCTNELSTMFVGNNHA

SEQ ID NO: 175736 - protein, 35 aa, Artificial Sequence
  Description of Artificial Sequence: Synthetic polypeptide
DESEIRTTNPIATECWGSVWANAIDWPAERKGNYG

SEQ ID NO: 175737 - protein, 32 aa, Artificial Sequence
  Description of Artificial Sequence: Synthetic polypeptide
DDSEVASTNPVSTEGYGNVAANTIQNRVGERH

SEQ ID NO: 175738 - protein, 37 aa, Artificial Sequence
  Description of Artificial Sequence: Synthetic polypeptide
SEEEIRTTNPVATEQYGSVMYPTFDDMDNNGLELNMG

SEQ ID NO: 175739 - protein, 37 aa, Artificial Sequence
  Description of Artificial Sequence: Synthetic polypeptide
SEEEIRTTNPVATEQYGSVIDGQSNIEGQEGGGEGGG

SEQ ID NO: 175740 - protein, 34 aa, Artificial Sequence
  Description of Artificial Sequence: Synthetic polypeptide
DEQEIATTNPVAYEQYGCVAANNNLADTPGGDPV

SEQ ID NO: 175741 - protein, 36 aa, Artificial Sequence
  Description of Artificial Sequence: Synthetic polypeptide
DECEICTTNPVATTQYGVVSTTLLLQQGTEQGTTDG

SEQ ID NO: 175742 - protein, 37 aa, Artificial Sequence
  Description of Artificial Sequence: Synthetic polypeptide
DECEICTTNPVATTQYGVVSTTNANLQQGTEQGTTDY

SEQ ID NO: 175743 - protein, 37 aa, Artificial Sequence
  Description of Artificial Sequence: Synthetic polypeptide
DENEIRTTNPVATEQYGTVTTVWLDKDEGENLQYDEI

SEQ ID NO: 175744 - protein, 36 aa, Artificial Sequence
  Description of Artificial Sequence: Synthetic polypeptide
DENEIRTTNPVATEQYGTVTTVWCPDEGEYLQIDEI

SEQ ID NO: 175745 - protein, 37 aa, Artificial Sequence
  Description of Artificial Sequence: Synthetic polypeptide
DENEIRTTNPVATEQYGTVTTVWCPADEQENLQIDEI

SEQ ID NO: 175746 - protein, 36 aa, Artificial Sequence
  Description of Artificial Sequence: Synthetic polypeptide
DENEIRTTNPVATEQYGTVTTTWLPDEQENDQIDEI

SEQ ID NO: 175747 - protein, 35 aa, Artificial Sequence
  Description of Artificial Sequence: Synthetic polypeptide
DEDEIRTTNPVAYEKWGEVAMGETNQGNHGNGNGR

SEQ ID NO: 175748 - protein, 36 aa, Artificial Sequence
  Description of Artificial Sequence: Synthetic polypeptide
DENEIRTTNPVATEQYGTVTFVWLPDEGENLQSDEI

SEQ ID NO: 175749 - protein, 36 aa, Artificial Sequence
  Description of Artificial Sequence: Synthetic polypeptide
CEEEIRTTNPVATEQYGQCVCSWMEHNQNFNSDNQS

SEQ ID NO: 175750 - protein, 38 aa, Artificial Sequence
  Description of Artificial Sequence: Synthetic polypeptide
DEAEIRTTNPVATEQYGSSVSCSGILCEEIMNGNEEMF

SEQ ID NO: 175751 - protein, 31 aa, Artificial Sequence
  Description of Artificial Sequence: Synthetic polypeptide
DDSEIASTNPVSTEGYGNAAANTCQSHVGER

SEQ ID NO: 175752 - protein, 35 aa, Artificial Sequence
  Description of Artificial Sequence: Synthetic polypeptide
DEQEIATTNPVAYEQWGSVVCNAAMPREDREDGNT

SEQ ID NO: 175753 - protein, 38 aa, Artificial Sequence
  Description of Artificial Sequence: Synthetic polypeptide
DEAEIRTTNPVATEQYGSSVGCSGILCEELGNGNEEVF

SEQ ID NO: 175754 - protein, 36 aa, Artificial Sequence
  Description of Artificial Sequence: Synthetic polypeptide
DENEIRTTNPVATEQYGTVPTVWLPDEGEGLQIDEI

SEQ ID NO: 175755 - protein, 37 aa, Artificial Sequence
  Description of Artificial Sequence: Synthetic polypeptide
DEAEIRTTNPVATEQYGSSNSPGWNSLEFGEFEQQVE

SEQ ID NO: 175756 - protein, 37 aa, Artificial Sequence
  Description of Artificial Sequence: Synthetic polypeptide
DENEIRTTNPVATEQYGTTVTTVWLPDEGENLQFDEI

SEQ ID NO: 175757 - protein, 35 aa, Artificial Sequence
  Description of Artificial Sequence: Synthetic polypeptide
DEDEIRTTNPVAYEQWGCVCADNNDQMDEGGNQAP

SEQ ID NO: 175758 - protein, 36 aa, Artificial Sequence
  Description of Artificial Sequence: Synthetic polypeptide
DENEIRTTNPVATEQYGTQVTVWLPDEQENLQIDEG

SEQ ID NO: 175759 - protein, 35 aa, Artificial Sequence
  Description of Artificial Sequence: Synthetic polypeptide
DEAEIRTTNPVATEQYGSSCPNAVNGAAESEGQEM

SEQ ID NO: 175760 - protein, 36 aa, Artificial Sequence
  Description of Artificial Sequence: Synthetic polypeptide
DENEIRTTNPVATEQYGTFTTVWLPDEQENLQIDEF

SEQ ID NO: 175761 - protein, 36 aa, Artificial Sequence
  Description of Artificial Sequence: Synthetic polypeptide
DENEIRTTNPVATEQYGTCVTVWQPDEQENLQIDEI

SEQ ID NO: 175762 - protein, 35 aa, Artificial Sequence
  Description of Artificial Sequence: Synthetic polypeptide
DENEIRTTNPVATEQYGSYYSQVIAQGIEAEIQDF

SEQ ID NO: 175763 - protein, 32 aa, Artificial Sequence
  Description of Artificial Sequence: Synthetic polypeptide
DDSEVASTNPVSTEGYGNVAANTIQNRVGADR

SEQ ID NO: 175764 - protein, 38 aa, Artificial Sequence
  Description of Artificial Sequence: Synthetic polypeptide
DENEIRTTNPVATEQYGSYVSCSGIMREELMNGNEEVF

SEQ ID NO: 175765 - protein, 35 aa, Artificial Sequence
  Description of Artificial Sequence: Synthetic polypeptide
DENEIRTTNPVATEQYGSYSQVPALGIELEIVQDF

SEQ ID NO: 175766 - protein, 35 aa, Artificial Sequence
  Description of Artificial Sequence: Synthetic polypeptide
DENEIRTTNPVATEQYGSYSQVIAQGIELEIKQDD

SEQ ID NO: 175767 - protein, 37 aa, Artificial Sequence
  Description of Artificial Sequence: Synthetic polypeptide
DENEIRTTNPVATEQYGSWTMDTGDNEQFGEEATQDS

SEQ ID NO: 175768 - protein, 37 aa, Artificial Sequence
  Description of Artificial Sequence: Synthetic polypeptide
DEDEIRTTNPVAYEHWGEVCSYTDLNEQDEQRGDNHP

SEQ ID NO: 175769 - protein, 33 aa, Artificial Sequence
  Description of Artificial Sequence: Synthetic polypeptide
DEQEIATTNPVAYEQWGTVSGGNGNEAGGEGML

SEQ ID NO: 175770 - protein, 34 aa, Artificial Sequence
  Description of Artificial Sequence: Synthetic polypeptide
DEQEIATTNPVAYEQWGSVVCNAAMPREDREDDS

SEQ ID NO: 175771 - protein, 36 aa, Artificial Sequence
  Description of Artificial Sequence: Synthetic polypeptide
DENEIRTTNPVATEQYGTVTTVWLPDEQENTQIIEI

SEQ ID NO: 175772 - protein, 35 aa, Artificial Sequence
  Description of Artificial Sequence: Synthetic polypeptide
DENEIRTTNPVATEQYGVVMGQVNMTDIGGEGGQI

SEQ ID NO: 175773 - protein, 36 aa, Artificial Sequence
  Description of Artificial Sequence: Synthetic polypeptide
DEQEIATTNPVAYEQWGSVTGGNENDQQGNMGNQQR

SEQ ID NO: 175774 - protein, 35 aa, Artificial Sequence
  Description of Artificial Sequence: Synthetic polypeptide
DEQEIATTNPVAYEQWGSVTGGNQNDQQGNMGNQV

SEQ ID NO: 175775 - protein, 38 aa, Artificial Sequence
  Description of Artificial Sequence: Synthetic polypeptide
DEEEIRTTNPVATEQYGCVCSMTGEDHNQEHFNSETQA

SEQ ID NO: 175776 - protein, 34 aa, Artificial Sequence
  Description of Artificial Sequence: Synthetic polypeptide
DESEIRTTNPVADECWGSFGCINEPEAREGENGS

SEQ ID NO: 175777 - protein, 34 aa, Artificial Sequence
  Description of Artificial Sequence: Synthetic polypeptide
DEQEIATTNPVAYEQWGSVVCNAAMPLDEDAEDR

SEQ ID NO: 175778 - protein, 37 aa, Artificial Sequence
  Description of Artificial Sequence: Synthetic polypeptide
DENEIRTTNPVATEQYGTVVTVWLPDEPFENLQIDEI

SEQ ID NO: 175779 - protein, 37 aa, Artificial Sequence
  Description of Artificial Sequence: Synthetic polypeptide
DENEIRTTNPVATEQYGTVVTVWLGFDEQENLQIDEI

SEQ ID NO: 175780 - protein, 36 aa, Artificial Sequence
  Description of Artificial Sequence: Synthetic polypeptide
DENEIRTTNPVATEQYGTVVTVWEPLEQENDQIDEI

SEQ ID NO: 175781 - protein, 36 aa, Artificial Sequence
  Description of Artificial Sequence: Synthetic polypeptide
DEDEIRTTNPVAYECWGSVYCTDNDQKTGQGNHGQP

SEQ ID NO: 175782 - protein, 33 aa, Artificial Sequence
  Description of Artificial Sequence: Synthetic polypeptide
DEEEIRTTNPCAYEPYGATCAGTNHMNAQGEAM

SEQ ID NO: 175783 - protein, 37 aa, Artificial Sequence
  Description of Artificial Sequence: Synthetic polypeptide
CEEEIRTTNPVATEQYGQCVCSWGEHNQEGFNSETQS

SEQ ID NO: 175784 - protein, 38 aa, Artificial Sequence
  Description of Artificial Sequence: Synthetic polypeptide
DEEEIRTTNPVATEQYGCVCSMTGEDHNIENFISDNQA

SEQ ID NO: 175785 - protein, 34 aa, Artificial Sequence
  Description of Artificial Sequence: Synthetic polypeptide
AENEIACTNPVATEQYGQCSCSWELNQHFGSDQA

SEQ ID NO: 175786 - protein, 32 aa, Artificial Sequence
  Description of Artificial Sequence: Synthetic polypeptide
DDSEIASTNPVSTEGYGNVAANETIQSRVGQI

SEQ ID NO: 175787 - protein, 32 aa, Artificial Sequence
  Description of Artificial Sequence: Synthetic polypeptide
DDSEIASTNPVSTEGYGNVAANETIQSRVGQH

SEQ ID NO: 175788 - protein, 32 aa, Artificial Sequence
  Description of Artificial Sequence: Synthetic polypeptide
DDSEIASTNPVSTEGYGNVAANETIQSRKGQI

SEQ ID NO: 175789 - protein, 32 aa, Artificial Sequence
  Description of Artificial Sequence: Synthetic polypeptide
DDSEIASTNPVSTEGYGNVAANDTIQSRVGQD

SEQ ID NO: 175790 - protein, 32 aa, Artificial Sequence
  Description of Artificial Sequence: Synthetic polypeptide
DDSEIASTNPVSTEGYGNVAAMETIQSRVGQR

SEQ ID NO: 175791 - protein, 35 aa, Artificial Sequence
  Description of Artificial Sequence: Synthetic polypeptide
DEDEIRTTNPVAYECWGSVYYVDVQEQQGNERGPN

SEQ ID NO: 175792 - protein, 36 aa, Artificial Sequence
  Description of Artificial Sequence: Synthetic polypeptide
CEEEIRTTNPVATEQYGQCVCSWGEHQEYFNSQPQS

SEQ ID NO: 175793 - protein, 35 aa, Artificial Sequence
  Description of Artificial Sequence: Synthetic polypeptide
DEDEIRTTNPVAYECWGTVCSNDNHDQPGQGGNVH

SEQ ID NO: 175794 - protein, 34 aa, Artificial Sequence
  Description of Artificial Sequence: Synthetic polypeptide
DEDEIRTTNPVAYECWGVCSTNPLPGMNEGGDSQ

SEQ ID NO: 175795 - protein, 35 aa, Artificial Sequence
  Description of Artificial Sequence: Synthetic polypeptide
DEDEIRTTNPVAYEEWGCVCPNNNDQMDTGDNREP

SEQ ID NO: 175796 - protein, 37 aa, Artificial Sequence
  Description of Artificial Sequence: Synthetic polypeptide
DENEIRTTNPVATEQYGTVTTVWLPVDEWENLQIDEI

SEQ ID NO: 175797 - protein, 38 aa, Artificial Sequence
  Description of Artificial Sequence: Synthetic polypeptide
DEEEIRTTNPVATEQYGCVCSMTGEDHNAENFNSETQS

SEQ ID NO: 175798 - protein, 37 aa, Artificial Sequence
  Description of Artificial Sequence: Synthetic polypeptide
DENEIRTTNPVATEQYGSVYVWIENEQQENTEEDTDM

SEQ ID NO: 175799 - protein, 37 aa, Artificial Sequence
  Description of Artificial Sequence: Synthetic polypeptide
DENEIRTTNPVATEQYGSVYVTWNPSIQTESSEEHTQ

SEQ ID NO: 175800 - protein, 36 aa, Artificial Sequence
  Description of Artificial Sequence: Synthetic polypeptide
DENEIRTTNPVATEQYGSVYVAITEQQENTEPDTDM

SEQ ID NO: 175801 - protein, 34 aa, Artificial Sequence
  Description of Artificial Sequence: Synthetic polypeptide
DDSEIASTNPVATEQYGTVCSANDTIVESFVGQR

SEQ ID NO: 175802 - protein, 34 aa, Artificial Sequence
  Description of Artificial Sequence: Synthetic polypeptide
DDSEIASTNPVATEQYGTVCSANDGIVESFVGQR

SEQ ID NO: 175803 - protein, 38 aa, Artificial Sequence
  Description of Artificial Sequence: Synthetic polypeptide
DENEIRTTNPVATEQYGSVWSPTSNAEGTTEEGEDMDI

SEQ ID NO: 175804 - protein, 37 aa, Artificial Sequence
  Description of Artificial Sequence: Synthetic polypeptide
DENEIRTTNPVATEQYGSVWSFTPDMHNSRIEVSFED

SEQ ID NO: 175805 - protein, 37 aa, Artificial Sequence
  Description of Artificial Sequence: Synthetic polypeptide
DENEIRTTNPVATEQYGSVVTTPEGMHNSRQEVSFED

SEQ ID NO: 175806 - protein, 39 aa, Artificial Sequence
  Description of Artificial Sequence: Synthetic polypeptide
DEVEIRTTNPVATEQYGSYIVTWSVNDEEQNNEPEINRV

SEQ ID NO: 175807 - protein, 37 aa, Artificial Sequence
  Description of Artificial Sequence: Synthetic polypeptide
DENEIRTTNPVATEQYGSVVTTPDMMHNSRQEVSFQD

SEQ ID NO: 175808 - protein, 37 aa, Artificial Sequence
  Description of Artificial Sequence: Synthetic polypeptide
DENEIRTTNPVATEQYGSVVQLGINEGQGTNNQDEDQ

SEQ ID NO: 175809 - protein, 36 aa, Artificial Sequence
  Description of Artificial Sequence: Synthetic polypeptide
DEVEIRTTNPVATEQYGVVGDGGNDDEGEGEGNAIA

SEQ ID NO: 175810 - protein, 37 aa, Artificial Sequence
  Description of Artificial Sequence: Synthetic polypeptide
DENEIRTTNPVATEQYGSVVMGTPIEMDVNDGDGQST

SEQ ID NO: 175811 - protein, 36 aa, Artificial Sequence
  Description of Artificial Sequence: Synthetic polypeptide
DENEIRTTNPVATEQYGSVVIDGMFGQEGDQEEDDG

SEQ ID NO: 175812 - protein, 37 aa, Artificial Sequence
  Description of Artificial Sequence: Synthetic polypeptide
DEDEIRTTNPVAYEQWGSVCSTDNGGNQGQQGGKGPN

SEQ ID NO: 175813 - protein, 37 aa, Artificial Sequence
  Description of Artificial Sequence: Synthetic polypeptide
DEVEIRTTNPVATEQYGVVVVDDGENVQGQGDGNEEG

SEQ ID NO: 175814 - protein, 37 aa, Artificial Sequence
  Description of Artificial Sequence: Synthetic polypeptide
DENEIRTTNPVATEQYGSVVDITNVNFDDEGEQDAEE

SEQ ID NO: 175815 - protein, 36 aa, Artificial Sequence
  Description of Artificial Sequence: Synthetic polypeptide
DENEIRTTNPVATEQYGSVTYQTDEEDIPQSIEEVP

SEQ ID NO: 175816 - protein, 36 aa, Artificial Sequence
  Description of Artificial Sequence: Synthetic polypeptide
DEEEISTTNPVATEQYGVVCSNWGEDHQNFGSDTQP

SEQ ID NO: 175817 - protein, 35 aa, Artificial Sequence
  Description of Artificial Sequence: Synthetic polypeptide
DEVEIRTTNPVATESYGSVIDVGNNGESGEGGGQE

SEQ ID NO: 175818 - protein, 37 aa, Artificial Sequence
  Description of Artificial Sequence: Synthetic polypeptide
DENEIRTTNPVATEQYGSVSWPENWNEEIPNGHQIVN

SEQ ID NO: 175819 - protein, 37 aa, Artificial Sequence
  Description of Artificial Sequence: Synthetic polypeptide
CEEEIRTTNPVATEQYGSVISIDQDIGQGQGGEGAGV

SEQ ID NO: 175820 - protein, 37 aa, Artificial Sequence
  Description of Artificial Sequence: Synthetic polypeptide
DEEEIRTTNPVATEQYGSVSVYNFTEPASIEMIELVQ

SEQ ID NO: 175821 - protein, 38 aa, Artificial Sequence
  Description of Artificial Sequence: Synthetic polypeptide
DEAEIRTTNPVATEQYGSQVISWDQNDEETGNLSPIED

SEQ ID NO: 175822 - protein, 37 aa, Artificial Sequence
  Description of Artificial Sequence: Synthetic polypeptide
CEEEIRTTNPVATEQYGSVMGMDENGGQNQGDGAEGV

SEQ ID NO: 175823 - protein, 34 aa, Artificial Sequence
  Description of Artificial Sequence: Synthetic polypeptide
DEVEISTTNPVATDQYGVVSTGDEGGGGQGEETV

SEQ ID NO: 175824 - protein, 33 aa, Artificial Sequence
  Description of Artificial Sequence: Synthetic polypeptide
DDSEIASTNPVATEGYGNVCSANTIVESFVGQR

SEQ ID NO: 175825 - protein, 35 aa, Artificial Sequence
  Description of Artificial Sequence: Synthetic polypeptide
DEVEISTTNPVATEQYGCVCSNSGEHEQNFGSDQS

SEQ ID NO: 175826 - protein, 37 aa, Artificial Sequence
  Description of Artificial Sequence: Synthetic polypeptide
DEVEIRTTNPVATEQYGSVVFDNDNDNGQTDDEDNDN

SEQ ID NO: 175827 - protein, 37 aa, Artificial Sequence
  Description of Artificial Sequence: Synthetic polypeptide
DEVEIRTTNPVATEQYGSVVFDNDNDEGQTDDEDNAE

SEQ ID NO: 175828 - protein, 37 aa, Artificial Sequence
  Description of Artificial Sequence: Synthetic polypeptide
CEEEIRTTNPVATEQYGSIQCGESAELQPDFLLFENG

SEQ ID NO: 175829 - protein, 36 aa, Artificial Sequence
  Description of Artificial Sequence: Synthetic polypeptide
DEVEIRTTNPVATEQYGSVVDLMVNTGQEEQQTEGD

SEQ ID NO: 175830 - protein, 36 aa, Artificial Sequence
  Description of Artificial Sequence: Synthetic polypeptide
DENEIRTTNPVATEQYGSVYTWPSMIQTESSEEHTA

SEQ ID NO: 175831 - protein, 36 aa, Artificial Sequence
  Description of Artificial Sequence: Synthetic polypeptide
DEDEIRTTNPVAYEQWGSVAGTGAPGEQEQGQGNEH

SEQ ID NO: 175832 - protein, 35 aa, Artificial Sequence
  Description of Artificial Sequence: Synthetic polypeptide
DEDEIRTTNPVAYEQWGSVAGTLAPGEEQGQGGDQ

SEQ ID NO: 175833 - protein, 37 aa, Artificial Sequence
  Description of Artificial Sequence: Synthetic polypeptide
DENEIRTTNPVATEQYGSVYTTWNPMWQQESSEEHTQ

SEQ ID NO: 175834 - protein, 31 aa, Artificial Sequence
  Description of Artificial Sequence: Synthetic polypeptide
DDSEIASTNPVSTEGYGEVAAEVCQSRVEQR

SEQ ID NO: 175835 - protein, 37 aa, Artificial Sequence
  Description of Artificial Sequence: Synthetic polypeptide
DENEIRTTNPVATEQYGSVYTTWNPMFQTESSEEHTF

SEQ ID NO: 175836 - protein, 36 aa, Artificial Sequence
  Description of Artificial Sequence: Synthetic polypeptide
DEQEIATTNPVATEQWGSVSATGDPGEDHQGDEDNQ

SEQ ID NO: 175837 - protein, 37 aa, Artificial Sequence
  Description of Artificial Sequence: Synthetic polypeptide
DENEIRTTNPVATEQYGSVYTTPNPMIQTESSEEHKQ

SEQ ID NO: 175838 - protein, 36 aa, Artificial Sequence
  Description of Artificial Sequence: Synthetic polypeptide
DENEIRTTNPVATEQYGSVYTPMSDMTQTETMQIDM

SEQ ID NO: 175839 - protein, 37 aa, Artificial Sequence
  Description of Artificial Sequence: Synthetic polypeptide
CEEEIRTTNPVATEQYGQVVDNTDLNDEQGEDGQGTN

SEQ ID NO: 175840 - protein, 37 aa, Artificial Sequence
  Description of Artificial Sequence: Synthetic polypeptide
DENEIRTTNPVATEQYGSVYSESPLELAMSFDENQFP

SEQ ID NO: 175841 - protein, 38 aa, Artificial Sequence
  Description of Artificial Sequence: Synthetic polypeptide
DENEIRTTNPVATEQYGSVYSESMNELAMASFDENQEE

SEQ ID NO: 175842 - protein, 35 aa, Artificial Sequence
  Description of Artificial Sequence: Synthetic polypeptide
DEDEIRTTNPVAYECWGSVCFTNEDEDDRNGGDQH

SEQ ID NO: 175843 - protein, 35 aa, Artificial Sequence
  Description of Artificial Sequence: Synthetic polypeptide
DENEIRTTNPVATEQYGSVYPTWCADETIEDQKFI

SEQ ID NO: 175844 - protein, 37 aa, Artificial Sequence
  Description of Artificial Sequence: Synthetic polypeptide
DENEIRTTNPVATEQYGSVYNTWNPMIQTETSEEHTQ

SEQ ID NO: 175845 - protein, 36 aa, Artificial Sequence
  Description of Artificial Sequence: Synthetic polypeptide
DENEIRTTNPVATEQYGSVYEFITEQQENTEEDTDM

SEQ ID NO: 175846 - protein, 36 aa, Artificial Sequence
  Description of Artificial Sequence: Synthetic polypeptide
DENEIRTTNPVATEQYGSVYEAIEEQEENTEEDTDM

SEQ ID NO: 175847 - protein, 36 aa, Artificial Sequence
  Description of Artificial Sequence: Synthetic polypeptide
DENEIRTTNPVATEQYGSVYATWNMIVTESSMEDTA

SEQ ID NO: 175848 - protein, 34 aa, Artificial Sequence
  Description of Artificial Sequence: Synthetic polypeptide
DDSEIASTNPVSTECYGNVSANITEPQDREGEQR

SEQ ID NO: 175849 - protein, 39 aa, Artificial Sequence
  Description of Artificial Sequence: Synthetic polypeptide
DEEEIRTTNPVATEAYGVVSTVVVNQLQQGTEQGTEEEE

SEQ ID NO: 175850 - protein, 38 aa, Artificial Sequence
  Description of Artificial Sequence: Synthetic polypeptide
DEEEIRTTNPVATEAYGVVSTVVVTNEQQGTEEEEEED

SEQ ID NO: 175851 - protein, 37 aa, Artificial Sequence
  Description of Artificial Sequence: Synthetic polypeptide
DEVEIRTTNPVATEQYGSVVDFDNDEGQNEQGGEIAG

SEQ ID NO: 175852 - protein, 37 aa, Artificial Sequence
  Description of Artificial Sequence: Synthetic polypeptide
DEVEIRTTNPVATEQYGSVVDFDNEEGQDEQGGEIAI

SEQ ID NO: 175853 - protein, 37 aa, Artificial Sequence
  Description of Artificial Sequence: Synthetic polypeptide
DEVEIRTTNPVATEQYGSVVDFDNNEFQDEQEGEIAT

SEQ ID NO: 175854 - protein, 37 aa, Artificial Sequence
  Description of Artificial Sequence: Synthetic polypeptide
DEVEIRTTNPVATEQYGSVVDFDNNEGQDEQGGETDT

SEQ ID NO: 175855 - protein, 37 aa, Artificial Sequence
  Description of Artificial Sequence: Synthetic polypeptide
DEVEIRTTNPVATEQYGSVVDFLNGEGQDEQTGEMAD

SEQ ID NO: 175856 - protein, 37 aa, Artificial Sequence
  Description of Artificial Sequence: Synthetic polypeptide
DEDEIRTTNPVAYEQWGSVCSNDNHDDQPGQGGNAEH

SEQ ID NO: 175857 - protein, 37 aa, Artificial Sequence
  Description of Artificial Sequence: Synthetic polypeptide
DEEEIRTTNPVATEQYGCVCSWGEDHNQEFFNSDTQE

SEQ ID NO: 175858 - protein, 33 aa, Artificial Sequence
  Description of Artificial Sequence: Synthetic polypeptide
DENEIRTTNPVSSEPYGTISMEDIQQQQNGNHM

SEQ ID NO: 175859 - protein, 39 aa, Artificial Sequence
  Description of Artificial Sequence: Synthetic polypeptide
DEDEIRTTNPVATEQYGVVSTVNNQGNNQQGIGTNQDED

SEQ ID NO: 175860 - protein, 34 aa, Artificial Sequence
  Description of Artificial Sequence: Synthetic polypeptide
TNSEIATTNPVAYEQWGSVYSDNGNHQDEGQSNH

SEQ ID NO: 175861 - protein, 33 aa, Artificial Sequence
  Description of Artificial Sequence: Synthetic polypeptide
DENEIRTTNPVSTEPYGTCSMEDIQQQQNGKGH

SEQ ID NO: 175862 - protein, 33 aa, Artificial Sequence
  Description of Artificial Sequence: Synthetic polypeptide
DENEIRTTNPVSTEPYGTCIPEDIEIQPNGVNH

SEQ ID NO: 175863 - protein, 34 aa, Artificial Sequence
  Description of Artificial Sequence: Synthetic polypeptide
DENEIRTTNPVSTEPYGTAISMEDIQQQQNGNHM

SEQ ID NO: 175864 - protein, 35 aa, Artificial Sequence
  Description of Artificial Sequence: Synthetic polypeptide
DEVEIATTNPVATEFYGSVNATGDGEDQEGGEDGD

SEQ ID NO: 175865 - protein, 37 aa, Artificial Sequence
  Description of Artificial Sequence: Synthetic polypeptide
DEAEIRTTNPVATEQYGSVCPYPGNLLEANIGDEYQE

SEQ ID NO: 175866 - protein, 34 aa, Artificial Sequence
  Description of Artificial Sequence: Synthetic polypeptide
DENEIRTTNPVSTEPYGRTISMEDCIQQQQNGNH

SEQ ID NO: 175867 - protein, 33 aa, Artificial Sequence
  Description of Artificial Sequence: Synthetic polypeptide
DENEIRTTNPVSTEPYGRTCFEEDIQQQVNGNH

SEQ ID NO: 175868 - protein, 34 aa, Artificial Sequence
  Description of Artificial Sequence: Synthetic polypeptide
DENEIRTTNPVSTEPYGQTISWEEINQEQFGSDQ

SEQ ID NO: 175869 - protein, 35 aa, Artificial Sequence
  Description of Artificial Sequence: Synthetic polypeptide
DEQEIATTNPVAYEQWGEVSTTNAGNQNIDHQNQE

SEQ ID NO: 175870 - protein, 34 aa, Artificial Sequence
  Description of Artificial Sequence: Synthetic polypeptide
DENEIRTTNPVSTEPYGQTIGSMEDIQQQQNGNH

SEQ ID NO: 175871 - protein, 33 aa, Artificial Sequence
  Description of Artificial Sequence: Synthetic polypeptide
DENEIRTTNPVSTEPYGQTICMEDIQQQQNGNH

SEQ ID NO: 175872 - protein, 35 aa, Artificial Sequence
  Description of Artificial Sequence: Synthetic polypeptide
SEEEISTTNPVATEQYGCVCGTMAHNQENFGSDQA

SEQ ID NO: 175873 - protein, 35 aa, Artificial Sequence
  Description of Artificial Sequence: Synthetic polypeptide
DDSPIRTTNPCAYEAYGKVSTMNMHQQRAVGNNPV

SEQ ID NO: 175874 - protein, 35 aa, Artificial Sequence
  Description of Artificial Sequence: Synthetic polypeptide
SEEEISTTNPVATEQYGCVCGTGADNQENFGSDQS

SEQ ID NO: 175875 - protein, 35 aa, Artificial Sequence
  Description of Artificial Sequence: Synthetic polypeptide
SEEEISTTNPVATEQYGCVCGNWGAHNQNFGSDQA

SEQ ID NO: 175876 - protein, 35 aa, Artificial Sequence
  Description of Artificial Sequence: Synthetic polypeptide
SEEEISTTNPVATEGYGCVCSNTGNHAYFGSDTQA

SEQ ID NO: 175877 - protein, 33 aa, Artificial Sequence
  Description of Artificial Sequence: Synthetic polypeptide
DENEIRTTNPVSTEPYGNTISMEDIQQQQNSNH

SEQ ID NO: 175878 - protein, 36 aa, Artificial Sequence
  Description of Artificial Sequence: Synthetic polypeptide
DEVEIATTNPVATEPYGEVVHTDNKNDQRQGMGDSE

SEQ ID NO: 175879 - protein, 35 aa, Artificial Sequence
  Description of Artificial Sequence: Synthetic polypeptide
TNTEIATTNPVATESYGCVATGNGLNDTERGGDER

SEQ ID NO: 175880 - protein, 31 aa, Artificial Sequence
  Description of Artificial Sequence: Synthetic polypeptide
DDSNVASTNPVSTEGYGNVAANTIQSRVGQR

SEQ ID NO: 175881 - protein, 33 aa, Artificial Sequence
  Description of Artificial Sequence: Synthetic polypeptide
DEVEIATTNPVATEQWGCVAGEGEANAAEDNAW

SEQ ID NO: 175882 - protein, 33 aa, Artificial Sequence
  Description of Artificial Sequence: Synthetic polypeptide
DEVEIATTNPVATEQWGCVAGEGEEANAASDNA

SEQ ID NO: 175883 - protein, 33 aa, Artificial Sequence
  Description of Artificial Sequence: Synthetic polypeptide
SEEEISCTNPCATEQYGCVCSWEPNANFGSDQS

SEQ ID NO: 175884 - protein, 34 aa, Artificial Sequence
  Description of Artificial Sequence: Synthetic polypeptide
DENEIRTTNPVSTEPYGMTISIMEDIQQQQNGNH

SEQ ID NO: 175885 - protein, 36 aa, Artificial Sequence
  Description of Artificial Sequence: Synthetic polypeptide
DEVEIATTNPVATECWGVVSKTNNPLDDRQNGHGDH

SEQ ID NO: 175886 - protein, 37 aa, Artificial Sequence
  Description of Artificial Sequence: Synthetic polypeptide
DEEEIRTTNPVATEQYGANVQPITMMMELDQNNTQVH

SEQ ID NO: 175887 - protein, 36 aa, Artificial Sequence
  Description of Artificial Sequence: Synthetic polypeptide
DEVEIATTNPVATECWGSVCFTNWDQQDQQRGGTDG

SEQ ID NO: 175888 - protein, 36 aa, Artificial Sequence
  Description of Artificial Sequence: Synthetic polypeptide
DEVEIATTNPVATECWGSVCFTNWDQQDGGRGGTDT

SEQ ID NO: 175889 - protein, 33 aa, Artificial Sequence
  Description of Artificial Sequence: Synthetic polypeptide
DENEIRTTNPVSTEPYGTIHSMEDIQQQQNGDH

SEQ ID NO: 175890 - protein, 34 aa, Artificial Sequence
  Description of Artificial Sequence: Synthetic polypeptide
DEQEIATTNPVAYEQWGCVAANTNLAATPAGDPW

SEQ ID NO: 175891 - protein, 37 aa, Artificial Sequence
  Description of Artificial Sequence: Synthetic polypeptide
DEQEIATTNPVATEQWGSVSATGDPLDEDHQGGEEHK

SEQ ID NO: 175892 - protein, 33 aa, Artificial Sequence
  Description of Artificial Sequence: Synthetic polypeptide
DENEIRTTNPVSTEPYGTIGSMEDIQQQQNCNH

SEQ ID NO: 175893 - protein, 34 aa, Artificial Sequence
  Description of Artificial Sequence: Synthetic polypeptide
DEQEIATTNPVAYEQWGCVAANTNLATPAGDTPM

SEQ ID NO: 175894 - protein, 34 aa, Artificial Sequence
  Description of Artificial Sequence: Synthetic polypeptide
DENEIRTTNPVSTEPYGTIFTMEDPQQPQSGQNE

SEQ ID NO: 175895 - protein, 33 aa, Artificial Sequence
  Description of Artificial Sequence: Synthetic polypeptide
DENEIRTTNPVSTEPYGTIFMEDIQQQQNGKNH

SEQ ID NO: 175896 - protein, 39 aa, Artificial Sequence
  Description of Artificial Sequence: Synthetic polypeptide
DEEEIRTTNPVATEAYGVVSTVVSNNNQAGTNQQGTDDE

SEQ ID NO: 175897 - protein, 34 aa, Artificial Sequence
  Description of Artificial Sequence: Synthetic polypeptide
DENEIRTTNPVSTEPYGTICSWEADQQEQFGNQS

SEQ ID NO: 175898 - protein, 34 aa, Artificial Sequence
  Description of Artificial Sequence: Synthetic polypeptide
DENEIRTTNPVSTEPYGTICSLMEDGQQQQNGNH

SEQ ID NO: 175899 - protein, 33 aa, Artificial Sequence
  Description of Artificial Sequence: Synthetic polypeptide
DENEIRTTNPVSTEPYGTICMEDIQQQQNGFNH

SEQ ID NO: 175900 - protein, 34 aa, Artificial Sequence
  Description of Artificial Sequence: Synthetic polypeptide
DENEIRTTNPVSTEPYGTIASMEDIQQQQNGNPH

SEQ ID NO: 175901 - protein, 34 aa, Artificial Sequence
  Description of Artificial Sequence: Synthetic polypeptide
DENEIRTTNPVSTEPYGTIASMEDIQQQQNGENH

SEQ ID NO: 175902 - protein, 37 aa, Artificial Sequence
  Description of Artificial Sequence: Synthetic polypeptide
DEDEIRTTNPVATEQYGSVCAMNNGNLEPGRDVPDAA

SEQ ID NO: 175903 - protein, 32 aa, Artificial Sequence
  Description of Artificial Sequence: Synthetic polypeptide
DENEIRTTNPVSTEPYGTIAMEDIQQQQNGQH

SEQ ID NO: 175904 - protein, 34 aa, Artificial Sequence
  Description of Artificial Sequence: Synthetic polypeptide
DEVEIATTNPVATDQYGDVSTGDEGGGGQGEEAD

SEQ ID NO: 175905 - protein, 32 aa, Artificial Sequence
  Description of Artificial Sequence: Synthetic polypeptide
DENEIRTTNPVSTEPYGTIAMEDIQQQQNGDH

SEQ ID NO: 175906 - protein, 34 aa, Artificial Sequence
  Description of Artificial Sequence: Synthetic polypeptide
DENEIRTTNPVSTEPYGTGIGSMEDIQQQQNGNH

SEQ ID NO: 175907 - protein, 38 aa, Artificial Sequence
  Description of Artificial Sequence: Synthetic polypeptide
DEDEIRTTNPVATEQYGSVCSAANPAAPAAHGGDNEAM

SEQ ID NO: 175908 - protein, 38 aa, Artificial Sequence
  Description of Artificial Sequence: Synthetic polypeptide
DEDEIRTTNPVATEQYGSVCSADNPAGGTAHQIDNEAM

SEQ ID NO: 175909 - protein, 35 aa, Artificial Sequence
  Description of Artificial Sequence: Synthetic polypeptide
DEVEIATTNPVATDQYGVVSTGDEGGNGQGEVTTD

SEQ ID NO: 175910 - protein, 35 aa, Artificial Sequence
  Description of Artificial Sequence: Synthetic polypeptide
DEQEIATTNPVAYEQWGETCSPTDNLDHQGDDGDY

SEQ ID NO: 175911 - protein, 37 aa, Artificial Sequence
  Description of Artificial Sequence: Synthetic polypeptide
DEDEIRTTNPVATEQYGSVPATTDAGTNQGNGMEPVN

SEQ ID NO: 175912 - protein, 35 aa, Artificial Sequence
  Description of Artificial Sequence: Synthetic polypeptide
DEVEIATTNPVATECWGMHCWTMNEQQRGNDNNSD

SEQ ID NO: 175913 - protein, 35 aa, Artificial Sequence
  Description of Artificial Sequence: Synthetic polypeptide
DEVEIATTNPVATECWGSVCFTNEDMQDGQAGGTD

SEQ ID NO: 175914 - protein, 36 aa, Artificial Sequence
  Description of Artificial Sequence: Synthetic polypeptide
VEDEIATTNPVAYEQYGSVCSTNPEQQEHQDGTAMK

SEQ ID NO: 175915 - protein, 35 aa, Artificial Sequence
  Description of Artificial Sequence: Synthetic polypeptide
SEEEISTTNPVATEQYGCVCSTGEHNTNFNSETQN

SEQ ID NO: 175916 - protein, 36 aa, Artificial Sequence
  Description of Artificial Sequence: Synthetic polypeptide
DEEEISTTNPVATEQYGQCVCSTEMHQENFISDTQA

SEQ ID NO: 175917 - protein, 35 aa, Artificial Sequence
  Description of Artificial Sequence: Synthetic polypeptide
DEACIRTTNPVATEQYGCVCEWEPNQEYFGSNNQA

SEQ ID NO: 175918 - protein, 39 aa, Artificial Sequence
  Description of Artificial Sequence: Synthetic polypeptide
DEDEIRTTNPVATEQYGSVSTVNNNNNQQGIGTTDEDED

SEQ ID NO: 175919 - protein, 34 aa, Artificial Sequence
  Description of Artificial Sequence: Synthetic polypeptide
DENEIRTTNPVSTEPYGATISSMEDIQQQQNGNH

SEQ ID NO: 175920 - protein, 34 aa, Artificial Sequence
  Description of Artificial Sequence: Synthetic polypeptide
DENEIRTTNPVSTEPYGATISNMEDIQAQPKGNH

SEQ ID NO: 175921 - protein, 33 aa, Artificial Sequence
  Description of Artificial Sequence: Synthetic polypeptide
DENEIRTTNPVSTEPYGATISMEDIQQQQNGVH

SEQ ID NO: 175922 - protein, 34 aa, Artificial Sequence
  Description of Artificial Sequence: Synthetic polypeptide
DENEIRTTNPVSTEPYGATISMEDIQQQQNGNHP

SEQ ID NO: 175923 - protein, 39 aa, Artificial Sequence
  Description of Artificial Sequence: Synthetic polypeptide
DEDEIRTTNPVATEQYGSVSTVTNNDQQLLGSEQGTVTE

SEQ ID NO: 175924 - protein, 33 aa, Artificial Sequence
  Description of Artificial Sequence: Synthetic polypeptide
DENEIRTTNPVSTEPYGAIWAMEDIQQQPNGNI

SEQ ID NO: 175925 - protein, 33 aa, Artificial Sequence
  Description of Artificial Sequence: Synthetic polypeptide
DENEIRTTNPVSTEPYGAIWAMEDIQQQPNGNH

SEQ ID NO: 175926 - protein, 38 aa, Artificial Sequence
  Description of Artificial Sequence: Synthetic polypeptide
DEEEIRTTNPVATEQYGAIMWDETINFIQQTGGEGNIT

SEQ ID NO: 175927 - protein, 32 aa, Artificial Sequence
  Description of Artificial Sequence: Synthetic polypeptide
DENEIRTTNPVSTEPYGAIWAMEDIQQPNGPI

SEQ ID NO: 175928 - protein, 36 aa, Artificial Sequence
  Description of Artificial Sequence: Synthetic polypeptide
DEDEIRTTNPVATEQYGSVVYDGMFGQGGEQEEDDG

SEQ ID NO: 175929 - protein, 37 aa, Artificial Sequence
  Description of Artificial Sequence: Synthetic polypeptide
DEDEIRTTNPVATEQYGSVYYWTYDDLNETHQSNQVH

SEQ ID NO: 175930 - protein, 37 aa, Artificial Sequence
  Description of Artificial Sequence: Synthetic polypeptide
DEDEIRTTNPVATEQYGTVSTVVNNQNNEEEEEEEEQ

SEQ ID NO: 175931 - protein, 36 aa, Artificial Sequence
  Description of Artificial Sequence: Synthetic polypeptide
DEDEIRTTNPVATEQYGTVTTVWLPDEGEHLQIDEI

SEQ ID NO: 175932 - protein, 36 aa, Artificial Sequence
  Description of Artificial Sequence: Synthetic polypeptide
DEDEIRTTNPVATEQYGVVATTQQQQQIGTTEEGSE

SEQ ID NO: 175933 - protein, 33 aa, Artificial Sequence
  Description of Artificial Sequence: Synthetic polypeptide
DENEIRTTNPVSTEPWGTTWSMEDIQAEPKGNH

SEQ ID NO: 175934 - protein, 38 aa, Artificial Sequence
  Description of Artificial Sequence: Synthetic polypeptide
DEEEISTTNPVATEQYGQCVCSTGEWHNQEGFGSDNQS

SEQ ID NO: 175935 - protein, 39 aa, Artificial Sequence
  Description of Artificial Sequence: Synthetic polypeptide
DEDEIRTTNPVATEQYGVVSTSNNGNLLQGIGTTTQDEQ

SEQ ID NO: 175936 - protein, 33 aa, Artificial Sequence
  Description of Artificial Sequence: Synthetic polypeptide
DENEIRTTNPVSTEPWGTISMEDWIQQQQNGNH

SEQ ID NO: 175937 - protein, 34 aa, Artificial Sequence
  Description of Artificial Sequence: Synthetic polypeptide
DEACIRTTNPVATEQYGCVCEWMEPNQYFGSQQS

SEQ ID NO: 175938 - protein, 36 aa, Artificial Sequence
  Description of Artificial Sequence: Synthetic polypeptide
DEEEISTTNPVATEQYGQCVCSTTEDAENFGSEFQG

SEQ ID NO: 175939 - protein, 35 aa, Artificial Sequence
  Description of Artificial Sequence: Synthetic polypeptide
DEEEISTTNPCATEQYGCVCPNTEDQENFGSDTQA

SEQ ID NO: 175940 - protein, 37 aa, Artificial Sequence
  Description of Artificial Sequence: Synthetic polypeptide
DEEEISTTNPVATEQYGQCVCSTWEDNQENFNSDNQS

SEQ ID NO: 175941 - protein, 39 aa, Artificial Sequence
  Description of Artificial Sequence: Synthetic polypeptide
DEDEIRTTNPVATEQYGVVSTSNNGNNLNGIGTTNQDEQ

SEQ ID NO: 175942 - protein, 36 aa, Artificial Sequence
  Description of Artificial Sequence: Synthetic polypeptide
DEEEIRTTNPVATEQYGAICPAQAVTEERNLVEMED

SEQ ID NO: 175943 - protein, 39 aa, Artificial Sequence
  Description of Artificial Sequence: Synthetic polypeptide
DEEEIRTTNPVATEQYGAIMWDSTINFIQQNGEEGFGNI

SEQ ID NO: 175944 - protein, 32 aa, Artificial Sequence
  Description of Artificial Sequence: Synthetic polypeptide
DDSEVASTNPVSTEGYGNVAANTIIQSRVGQR

SEQ ID NO: 175945 - protein, 35 aa, Artificial Sequence
  Description of Artificial Sequence: Synthetic polypeptide
CEDEIATTNPVAYEQYGSVAAIANNDTQPDNGNNH

SEQ ID NO: 175946 - protein, 34 aa, Artificial Sequence
  Description of Artificial Sequence: Synthetic polypeptide
DENEIRTTNPVSTEPYGCISMEDTIQQPQSGEEH

SEQ ID NO: 175947 - protein, 36 aa, Artificial Sequence
  Description of Artificial Sequence: Synthetic polypeptide
SEEEIRTTNPVTTEHWGSVYCWMPNDQDSQRQGGNS

SEQ ID NO: 175948 - protein, 37 aa, Artificial Sequence
  Description of Artificial Sequence: Synthetic polypeptide
DEEEISTTNPVATEQYGQCVCSTGEDHNANFGSDPQS

SEQ ID NO: 175949 - protein, 31 aa, Artificial Sequence
  Description of Artificial Sequence: Synthetic polypeptide
DDSEVASTNPVSTEGYGNVAANTIISRVGAR

SEQ ID NO: 175950 - protein, 36 aa, Artificial Sequence
  Description of Artificial Sequence: Synthetic polypeptide
DEVEIATTNPVATEQYGCVAATTSGNPQAEAEPNHH

SEQ ID NO: 175951 - protein, 33 aa, Artificial Sequence
  Description of Artificial Sequence: Synthetic polypeptide
DENEIRTTNPVSTEPYGKTIAMEDIQQQQNGNH

SEQ ID NO: 175952 - protein, 34 aa, Artificial Sequence
  Description of Artificial Sequence: Synthetic polypeptide
DENEIRTTNPVSTEPYGKTHISMEDIQQQQNGNH

SEQ ID NO: 175953 - protein, 33 aa, Artificial Sequence
  Description of Artificial Sequence: Synthetic polypeptide
DENEIRTTNPVSTEPYGITIQMEDIQQQQNGNH

SEQ ID NO: 175954 - protein, 34 aa, Artificial Sequence
  Description of Artificial Sequence: Synthetic polypeptide
DENEIRTTNPVSTEPYGGISVEDINQQQNPEKHI

SEQ ID NO: 175955 - protein, 37 aa, Artificial Sequence
  Description of Artificial Sequence: Synthetic polypeptide
DEEEISTTNPVATEQYGQCVCSTGEDHQEYFGSETQA

SEQ ID NO: 175956 - protein, 34 aa, Artificial Sequence
  Description of Artificial Sequence: Synthetic polypeptide
DENEIRTTNPVSTEPYGETRISMEDIQQQQNGNS

SEQ ID NO: 175957 - protein, 38 aa, Artificial Sequence
  Description of Artificial Sequence: Synthetic polypeptide
DEEEISTTNPVATEQYGQCVCSTGEDLNQENFGSETQS

SEQ ID NO: 175958 - protein, 31 aa, Artificial Sequence
  Description of Artificial Sequence: Synthetic polypeptide
DDSEVASTNPVSTEGYGNVAANTIISRVGQR

SEQ ID NO: 175959 - protein, 31 aa, Artificial Sequence
  Description of Artificial Sequence: Synthetic polypeptide
DDSNVASTNPVSTEGYGNVAANEIQSRVGQR

SEQ ID NO: 175960 - protein, 36 aa, Artificial Sequence
  Description of Artificial Sequence: Synthetic polypeptide
DEEEISTTNPVATEQYGQCVCSTGEHEIENFNSDAP

SEQ ID NO: 175961 - protein, 32 aa, Artificial Sequence
  Description of Artificial Sequence: Synthetic polypeptide
TNTEIATTNPVAYEQWGSVAHMLDLNQQGDHN

SEQ ID NO: 175962 - protein, 35 aa, Artificial Sequence
  Description of Artificial Sequence: Synthetic polypeptide
DEDEIATTNPVAYEQYGSVCSAPALGQDHDDLTAA

SEQ ID NO: 175963 - protein, 34 aa, Artificial Sequence
  Description of Artificial Sequence: Synthetic polypeptide
DENEIRTTNPVSTEPYGCIWSMEDMQQPQSGENH

SEQ ID NO: 175964 - protein, 34 aa, Artificial Sequence
  Description of Artificial Sequence: Synthetic polypeptide
TPEDEVIATTNPVATESDGNLSTENLVHAGNSNS

SEQ ID NO: 175965 - protein, 31 aa, Artificial Sequence
  Description of Artificial Sequence: Synthetic polypeptide
DDSIVASTNPVSTEGYGNVAANTIQSRVGQR

SEQ ID NO: 175966 - protein, 32 aa, Artificial Sequence
  Description of Artificial Sequence: Synthetic polypeptide
DENEIRTTNPVSTEPYGCITMEDMQQPQSGEH

SEQ ID NO: 175967 - protein, 34 aa, Artificial Sequence
  Description of Artificial Sequence: Synthetic polypeptide
DENEIRTTNPVSTEPYGCISWEEIQQEQFGSNAA

SEQ ID NO: 175968 - protein, 34 aa, Artificial Sequence
  Description of Artificial Sequence: Synthetic polypeptide
DENEIRTTNPVSTEPYGCISWEEINQEQFGSDQS

SEQ ID NO: 175969 - protein, 36 aa, Artificial Sequence
  Description of Artificial Sequence: Synthetic polypeptide
DEVEIATTNPVATEQYGSVCAMNNGNLEPADIPNGA

SEQ ID NO: 175970 - protein, 35 aa, Artificial Sequence
  Description of Artificial Sequence: Synthetic polypeptide
CEDEIATTNPVAYEQYGSVAAIANNDTQDNGNNQE

SEQ ID NO: 175971 - protein, 34 aa, Artificial Sequence
  Description of Artificial Sequence: Synthetic polypeptide
DENEIRTTNPVSTEPYGCISMEDYIQQPQSGNHP

SEQ ID NO: 175972 - protein, 34 aa, Artificial Sequence
  Description of Artificial Sequence: Synthetic polypeptide
DENEIRTTNPVSTEPYGCISMEDMQFPQSGQNDH

SEQ ID NO: 175973 - protein, 34 aa, Artificial Sequence
  Description of Artificial Sequence: Synthetic polypeptide
DENEIRTTNPVSTEPYGTIHSMEDMIQQQQNGNH

SEQ ID NO: 175974 - protein, 35 aa, Artificial Sequence
  Description of Artificial Sequence: Synthetic polypeptide
DEVEIATTNPIATEQWGSIVPTLNWDQHEHGQDGH

SEQ ID NO: 175975 - protein, 36 aa, Artificial Sequence
  Description of Artificial Sequence: Synthetic polypeptide
DEDEIATTNPVAYEQYGSVCSANPALGQDHDDLAAM

SEQ ID NO: 175976 - protein, 34 aa, Artificial Sequence
  Description of Artificial Sequence: Synthetic polypeptide
DESEIRTTNPVATECWGATWANCINEPAERKGNI

SEQ ID NO: 175977 - protein, 38 aa, Artificial Sequence
  Description of Artificial Sequence: Synthetic polypeptide
DEEEISTTNPVATEQYGQCVCSNWNEHNQEGFNSQPQS

SEQ ID NO: 175978 - protein, 31 aa, Artificial Sequence
  Description of Artificial Sequence: Synthetic polypeptide
DDSSVASTNPVSTEGYGNVAANTIQSRVGQR

SEQ ID NO: 175979 - protein, 38 aa, Artificial Sequence
  Description of Artificial Sequence: Synthetic polypeptide
DEDEIRTTNPVATEQYGAIMWSTINFIQQVGEEGVGNI

SEQ ID NO: 175980 - protein, 39 aa, Artificial Sequence
  Description of Artificial Sequence: Synthetic polypeptide
DEEEIRTTNPVATEAYGVVSTVVNTNLQQGTEQGTEDSE

SEQ ID NO: 175981 - protein, 34 aa, Artificial Sequence
  Description of Artificial Sequence: Synthetic polypeptide
DENEIRTTNPVSTEPYGTISIMEDIQQQQNGNHK

SEQ ID NO: 175982 - protein, 34 aa, Artificial Sequence
  Description of Artificial Sequence: Synthetic polypeptide
DETSIATTNPTAYEQWGSYYSFDNDQQEAGDTNR

SEQ ID NO: 175983 - protein, 34 aa, Artificial Sequence
  Description of Artificial Sequence: Synthetic polypeptide
DETSIATTNPTAYEQWGSYYSFDNGDQQNGNDRN

SEQ ID NO: 175984 - protein, 39 aa, Artificial Sequence
  Description of Artificial Sequence: Synthetic polypeptide
DEEEIRTTNPVATEAYGVVSTVVNTNLQQGTEQGTEEED

SEQ ID NO: 175985 - protein, 33 aa, Artificial Sequence
  Description of Artificial Sequence: Synthetic polypeptide
DETSIATTNPTAYEQWGSYYSFDNGDRQSGNDV

SEQ ID NO: 175986 - protein, 34 aa, Artificial Sequence
  Description of Artificial Sequence: Synthetic polypeptide
DETSIATTNPTAYEQWGSYYSLFDNDQNERGNAQ

SEQ ID NO: 175987 - protein, 31 aa, Artificial Sequence
  Description of Artificial Sequence: Synthetic polypeptide
DDSEVASTNPVSTEGYGNVAANTIESRVGAR

SEQ ID NO: 175988 - protein, 33 aa, Artificial Sequence
  Description of Artificial Sequence: Synthetic polypeptide
DETSIATTNPTAYEQWGVYYSFDNDQNERGGAR

SEQ ID NO: 175989 - protein, 34 aa, Artificial Sequence
  Description of Artificial Sequence: Synthetic polypeptide
DENEIRTTNPVSTEPYGTISHMEDIQQQQNGNLH

SEQ ID NO: 175990 - protein, 36 aa, Artificial Sequence
  Description of Artificial Sequence: Synthetic polypeptide
DEAAEIATTNPVAYEQYGTVATENGGMQNGGQRGEA

SEQ ID NO: 175991 - protein, 34 aa, Artificial Sequence
  Description of Artificial Sequence: Synthetic polypeptide
DENEIRTTNPVSTEPYGTISHMEDIQQQQNGLNH

SEQ ID NO: 175992 - protein, 35 aa, Artificial Sequence
  Description of Artificial Sequence: Synthetic polypeptide
DEEEISTTNPCATEQYGCVCPTEHNQEYFNSNTQS

SEQ ID NO: 175993 - protein, 34 aa, Artificial Sequence
  Description of Artificial Sequence: Synthetic polypeptide
TNEEIRTTNPVAYECWGVVCSTWEQGDTGGGNTF

SEQ ID NO: 175994 - protein, 33 aa, Artificial Sequence
  Description of Artificial Sequence: Synthetic polypeptide
DENEIRTTNPVSTEPYGTISGMEDIQQQQNANH

SEQ ID NO: 175995 - protein, 34 aa, Artificial Sequence
  Description of Artificial Sequence: Synthetic polypeptide
DENEIRTTNPVSTEPYGTISFMEDIQQQQNGNMH

SEQ ID NO: 175996 - protein, 33 aa, Artificial Sequence
  Description of Artificial Sequence: Synthetic polypeptide
DENEIRTTNPVSTEPYGTISFMEDIQQQQNGKH

SEQ ID NO: 175997 - protein, 34 aa, Artificial Sequence
  Description of Artificial Sequence: Synthetic polypeptide
DETSICTTNPCATEQWGVVSTVVNNNQQGTTEGD

SEQ ID NO: 175998 - protein, 36 aa, Artificial Sequence
  Description of Artificial Sequence: Synthetic polypeptide
DEEEISTTNPVATEQYGQCVCSSEHNQENFGSDTQQ

SEQ ID NO: 175999 - protein, 36 aa, Artificial Sequence
  Description of Artificial Sequence: Synthetic polypeptide
DEEEISTTNPVATEQYGQCVCSSGEDDQNFGSDTQA

SEQ ID NO: 176000 - protein, 37 aa, Artificial Sequence
  Description of Artificial Sequence: Synthetic polypeptide
DEEEISTTNPCATEQYGCVCPNWMELNQENFGSDNQA

SEQ ID NO: 176001 - protein, 36 aa, Artificial Sequence
  Description of Artificial Sequence: Synthetic polypeptide
DEDEIRTTNPVATEQWGVVSTSQQQATNVATEDGSQ

SEQ ID NO: 176002 - protein, 36 aa, Artificial Sequence
  Description of Artificial Sequence: Synthetic polypeptide
DEEEISTTNPVATEQYGQCVCSSGEDNQNFNSQNQA

SEQ ID NO: 176003 - protein, 34 aa, Artificial Sequence
  Description of Artificial Sequence: Synthetic polypeptide
DESEIRTTNPVSTEPWGCIAPEDTGQQQQRGTNS

SEQ ID NO: 176004 - protein, 32 aa, Artificial Sequence
  Description of Artificial Sequence: Synthetic polypeptide
DETSIATTNPLTTAQWGSVAIANGLQSGDSEG

SEQ ID NO: 176005 - protein, 34 aa, Artificial Sequence
  Description of Artificial Sequence: Synthetic polypeptide
DETNEIATTNPVAYECWGSVYHPNNDNQFGGNEA

SEQ ID NO: 176006 - protein, 33 aa, Artificial Sequence
  Description of Artificial Sequence: Synthetic polypeptide
DETNEIATTNPVAYEQWGATSTNGNGNSGGDMS

SEQ ID NO: 176007 - protein, 35 aa, Artificial Sequence
  Description of Artificial Sequence: Synthetic polypeptide
SEEEVRTTNPVATEQYGQCVCSWGEHDQNINSDQS

SEQ ID NO: 176008 - protein, 34 aa, Artificial Sequence
  Description of Artificial Sequence: Synthetic polypeptide
DETNEIATTNPVAYEQWGSVPTGPMLGEDTGQEQ

SEQ ID NO: 176009 - protein, 36 aa, Artificial Sequence
  Description of Artificial Sequence: Synthetic polypeptide
DETNEIATTNPVAYEQYGTVATQNGGQQNGGQRGQS

SEQ ID NO: 176010 - protein, 37 aa, Artificial Sequence
  Description of Artificial Sequence: Synthetic polypeptide
DEEEIRTTNPVATEQYGCVCSWGEDHNQENFGSETQA

SEQ ID NO: 176011 - protein, 35 aa, Artificial Sequence
  Description of Artificial Sequence: Synthetic polypeptide
SEEEVRTTNPVATEQYGCVCSWGEHNQNFGSDTQS

SEQ ID NO: 176012 - protein, 36 aa, Artificial Sequence
  Description of Artificial Sequence: Synthetic polypeptide
DEEEIRTTNPVATEQYGCVCSWGEDHNQENFISEQA

SEQ ID NO: 176013 - protein, 37 aa, Artificial Sequence
  Description of Artificial Sequence: Synthetic polypeptide
DEEEIRTTNPVATEQYGCVCSWGEDHNQENFNSQNQS

SEQ ID NO: 176014 - protein, 36 aa, Artificial Sequence
  Description of Artificial Sequence: Synthetic polypeptide
SEEEVRTTNPVATEQYGCVCSNWEEHDQNIGSDNQS

SEQ ID NO: 176015 - protein, 36 aa, Artificial Sequence
  Description of Artificial Sequence: Synthetic polypeptide
DEDEIRTTNPVATEQWGVVATSQQRTTNVATEDGAQ

SEQ ID NO: 176016 - protein, 34 aa, Artificial Sequence
  Description of Artificial Sequence: Synthetic polypeptide
DETPIATTNPLAYEQFGAVSCWANQSQSAGGNNR

SEQ ID NO: 176017 - protein, 35 aa, Artificial Sequence
  Description of Artificial Sequence: Synthetic polypeptide
SEEEVRTTNPVATEQYGCVCSNTGEHDANIGSDQS

SEQ ID NO: 176018 - protein, 33 aa, Artificial Sequence
  Description of Artificial Sequence: Synthetic polypeptide
DENEIRTTNPVSTEPYGTISLMEDIQQQQNGAH

SEQ ID NO: 176019 - protein, 31 aa, Artificial Sequence
  Description of Artificial Sequence: Synthetic polypeptide
DDSEVASTNPVSTEGYGNVAANTIESREGQR

SEQ ID NO: 176020 - protein, 34 aa, Artificial Sequence
  Description of Artificial Sequence: Synthetic polypeptide
AEEEIASVNPVCTEQYGVVCSNWNLQESFGSQQA

SEQ ID NO: 176021 - protein, 36 aa, Artificial Sequence
  Description of Artificial Sequence: Synthetic polypeptide
DEEEIRTTNPVATEQYGCVCSWGEDHQEFFISDTQS

SEQ ID NO: 176022 - protein, 33 aa, Artificial Sequence
  Description of Artificial Sequence: Synthetic polypeptide
DENEIRTTNPVSTEPYGTISLEDIQQQQNGQIH

SEQ ID NO: 176023 - protein, 36 aa, Artificial Sequence
  Description of Artificial Sequence: Synthetic polypeptide
DEDEIATTNPVAYEQYGSVCIAANSLQPEPGMDIEQ

SEQ ID NO: 176024 - protein, 33 aa, Artificial Sequence
  Description of Artificial Sequence: Synthetic polypeptide
DENEIRTTNPVSTEPYGTISLEDIQQQQIGEEH

SEQ ID NO: 176025 - protein, 37 aa, Artificial Sequence
  Description of Artificial Sequence: Synthetic polypeptide
DETSEIATTNPVAYEQWGSVCYSNENDLQQGNGNEES

SEQ ID NO: 176026 - protein, 37 aa, Artificial Sequence
  Description of Artificial Sequence: Synthetic polypeptide
DETSEIATTNPVAYEQWGSVCYSNENDLQQGNGNGDH

SEQ ID NO: 176027 - protein, 36 aa, Artificial Sequence
  Description of Artificial Sequence: Synthetic polypeptide
DEEEISTTNPVATEQYGQCVCSNWMEHQGFGSDPQS

SEQ ID NO: 176028 - protein, 34 aa, Artificial Sequence
  Description of Artificial Sequence: Synthetic polypeptide
DETSIATTNPLAYEQFGSVPSCFAHQSQSGGNNR

SEQ ID NO: 176029 - protein, 32 aa, Artificial Sequence
  Description of Artificial Sequence: Synthetic polypeptide
DETSIATTNPLTTAQWGSVAIANGLQSGDSDD

SEQ ID NO: 176030 - protein, 38 aa, Artificial Sequence
  Description of Artificial Sequence: Synthetic polypeptide
DEEEIRTTNPVAYEQYGQSVHPEFWDALQSTSSIENRN

SEQ ID NO: 176031 - protein, 34 aa, Artificial Sequence
  Description of Artificial Sequence: Synthetic polypeptide
DENEIRTTNPVSTEPYGTISCMEHISQQQNGNNH

SEQ ID NO: 176032 - protein, 34 aa, Artificial Sequence
  Description of Artificial Sequence: Synthetic polypeptide
DENEIRTTNPVSTEPYGTISCMEDISQQQNVGNQ

SEQ ID NO: 176033 - protein, 34 aa, Artificial Sequence
  Description of Artificial Sequence: Synthetic polypeptide
DENEIRTTNPVSTEPYGTISCMEDISGQQNGGNH

SEQ ID NO: 176034 - protein, 32 aa, Artificial Sequence
  Description of Artificial Sequence: Synthetic polypeptide
VEDEIATVNPVATEQWGCVAGNGLADAGGGDH

SEQ ID NO: 176035 - protein, 36 aa, Artificial Sequence
  Description of Artificial Sequence: Synthetic polypeptide
DEEEISTTNPVATEQYGQCVCSSGEHNQFFNSDFQS

SEQ ID NO: 176036 - protein, 33 aa, Artificial Sequence
  Description of Artificial Sequence: Synthetic polypeptide
VEDEIATVNPVATEQWGCIVAGNGLADAPGGNH

SEQ ID NO: 176037 - protein, 37 aa, Artificial Sequence
  Description of Artificial Sequence: Synthetic polypeptide
DEEEISTTNPVATEQYGQCVCSSGELNQENFNSDNQL

SEQ ID NO: 176038 - protein, 34 aa, Artificial Sequence
  Description of Artificial Sequence: Synthetic polypeptide
DETVIQTTNPVAYEQWGCVAACTVNSSQRGGTGP

SEQ ID NO: 176039 - protein, 37 aa, Artificial Sequence
  Description of Artificial Sequence: Synthetic polypeptide
DEEEISTTNPVATEQYGQCVCSTEDHNQEHFGSETQS

SEQ ID NO: 176040 - protein, 33 aa, Artificial Sequence
  Description of Artificial Sequence: Synthetic polypeptide
DENEIRTTNPVSTEPYGTIMCMEDIQQQQNGNH

SEQ ID NO: 176041 - protein, 35 aa, Artificial Sequence
  Description of Artificial Sequence: Synthetic polypeptide
DETVIQTTNPVAYEQWGEVAACTVNPSQRGGTERK

SEQ ID NO: 176042 - protein, 37 aa, Artificial Sequence
  Description of Artificial Sequence: Synthetic polypeptide
DEEEISTTNPVATEQYGQCVCSTEDHNQENFGSQTQA

SEQ ID NO: 176043 - protein, 36 aa, Artificial Sequence
  Description of Artificial Sequence: Synthetic polypeptide
DEEEISTTNPCATEQYGCVCPNWEHNQENFGSNTQA

SEQ ID NO: 176044 - protein, 35 aa, Artificial Sequence
  Description of Artificial Sequence: Synthetic polypeptide
DETVIQTTNPVAYESWGCVAACTVNPSQRGGNERV

SEQ ID NO: 176045 - protein, 32 aa, Artificial Sequence
  Description of Artificial Sequence: Synthetic polypeptide
DDSEVASTNPVSTEGYGNVAANTIFQSRVGQR

SEQ ID NO: 176046 - protein, 33 aa, Artificial Sequence
  Description of Artificial Sequence: Synthetic polypeptide
DESEIRTTNPVATECWGATACIDWPQDREGEPG

SEQ ID NO: 176047 - protein, 31 aa, Artificial Sequence
  Description of Artificial Sequence: Synthetic polypeptide
DDSEVASTNPVSTEGYGNVAANTIFSRVGQR

SEQ ID NO: 176048 - protein, 35 aa, Artificial Sequence
  Description of Artificial Sequence: Synthetic polypeptide
DEVAEIATTNPVAYEGWGSVCSGTDNQDRDGGQEQ

SEQ ID NO: 176049 - protein, 33 aa, Artificial Sequence
  Description of Artificial Sequence: Synthetic polypeptide
TNHEIATTNPVAYECWGSVSGGLNDDRQNQGNH

SEQ ID NO: 176050 - protein, 32 aa, Artificial Sequence
  Description of Artificial Sequence: Synthetic polypeptide
DDSEVASTNPVSTEGYGNVAANTIGQSRVGQR

SEQ ID NO: 176051 - protein, 33 aa, Artificial Sequence
  Description of Artificial Sequence: Synthetic polypeptide
DENEIRTTNPVSTEPYGTIIYMEDIQQQQNGNH

SEQ ID NO: 176052 - protein, 31 aa, Artificial Sequence
  Description of Artificial Sequence: Synthetic polypeptide
DDSEVASTNPVSTEGYGNVAANTIGSRVGQR

SEQ ID NO: 176053 - protein, 35 aa, Artificial Sequence
  Description of Artificial Sequence: Synthetic polypeptide
SEEEISTTNPVATEQYGCVCSWGEHQENFNSDTQS

SEQ ID NO: 176054 - protein, 34 aa, Artificial Sequence
  Description of Artificial Sequence: Synthetic polypeptide
DENEIRTTNPVSTEPYGTIISRMIDIQVQQNGNH

SEQ ID NO: 176055 - protein, 33 aa, Artificial Sequence
  Description of Artificial Sequence: Synthetic polypeptide
DEVEIATTNPCAYEQWGSVYCTENDGDDHGGHD

SEQ ID NO: 176056 - protein, 32 aa, Artificial Sequence
  Description of Artificial Sequence: Synthetic polypeptide
DDSEVASTNPVSTEGYGNVAANTIHQSRVGQR

SEQ ID NO: 176057 - protein, 31 aa, Artificial Sequence
  Description of Artificial Sequence: Synthetic polypeptide
DDSEVASTNPVSTEGYGNVAANTIHSRVGQR

SEQ ID NO: 176058 - protein, 36 aa, Artificial Sequence
  Description of Artificial Sequence: Synthetic polypeptide
DEQEIATTNPVATEQWGSVSATGDPMNEDHQGDEDN

SEQ ID NO: 176059 - protein, 32 aa, Artificial Sequence
  Description of Artificial Sequence: Synthetic polypeptide
DDSEVASTNPVSTEGYGNVAANTIFQSRNGQR

SEQ ID NO: 176060 - protein, 35 aa, Artificial Sequence
  Description of Artificial Sequence: Synthetic polypeptide
DETVEIATTNPVAYECWGSVATGNMLGDAQGMNAE

SEQ ID NO: 176061 - protein, 36 aa, Artificial Sequence
  Description of Artificial Sequence: Synthetic polypeptide
DEEEIRTTNPVATEQYGCVCSWGEHNEENFISETQS

SEQ ID NO: 176062 - protein, 36 aa, Artificial Sequence
  Description of Artificial Sequence: Synthetic polypeptide
DEEEISTTNPVATEQYGQCVCSSGEHNQENFNSDQS

SEQ ID NO: 176063 - protein, 34 aa, Artificial Sequence
  Description of Artificial Sequence: Synthetic polypeptide
DENEIRTTNPVSTEPYGTISCMEDIQQQQNGNHD

SEQ ID NO: 176064 - protein, 34 aa, Artificial Sequence
  Description of Artificial Sequence: Synthetic polypeptide
DENEIRTTNPVSTEPYGTISCMEDIQQQQNGFNH

SEQ ID NO: 176065 - protein, 34 aa, Artificial Sequence
  Description of Artificial Sequence: Synthetic polypeptide
DENEIRTTNPVSTEPYGTISCMEDHSQQQNGTNH

SEQ ID NO: 176066 - protein, 34 aa, Artificial Sequence
  Description of Artificial Sequence: Synthetic polypeptide
DENEIRTTNPVSTEPYGTISCMEDEISQQQNGND

SEQ ID NO: 176067 - protein, 37 aa, Artificial Sequence
  Description of Artificial Sequence: Synthetic polypeptide
DEEEISTTNPVATEQYGQCVCSSGEDNTENFGSENQG

SEQ ID NO: 176068 - protein, 34 aa, Artificial Sequence
  Description of Artificial Sequence: Synthetic polypeptide
DENEIRTTNPVSTEPYGTISCEDISQQQNGGNND

SEQ ID NO: 176069 - protein, 33 aa, Artificial Sequence
  Description of Artificial Sequence: Synthetic polypeptide
AENEIRCTNPIATEQWGAAWANAEDLQPKGPYR

SEQ ID NO: 176070 - protein, 35 aa, Artificial Sequence
  Description of Artificial Sequence: Synthetic polypeptide
DEDEIRTTNPVATEQYGSACSAANNPDNTTPPDQG

SEQ ID NO: 176071 - protein, 33 aa, Artificial Sequence
  Description of Artificial Sequence: Synthetic polypeptide
DENEIRTTNPVSTEPYGTISAMEDIQQQQNSNH

SEQ ID NO: 176072 - protein, 36 aa, Artificial Sequence
  Description of Artificial Sequence: Synthetic polypeptide
DEEEISTTNPVATEQYGQCVCSSGEDQEFFNSDTQA

SEQ ID NO: 176073 - protein, 36 aa, Artificial Sequence
  Description of Artificial Sequence: Synthetic polypeptide
DEEEIRTTNPVATEQYGCVCSWGEHEQENFISDTQA

SEQ ID NO: 176074 - protein, 37 aa, Artificial Sequence
  Description of Artificial Sequence: Synthetic polypeptide
DEDEIRTTNPVATEQYGSCSATTPAGTNQGNGMEPVH

SEQ ID NO: 176075 - protein, 35 aa, Artificial Sequence
  Description of Artificial Sequence: Synthetic polypeptide
DEDEIATTNPVAYEQYGSVCSAPALGQEHDDLMAM

SEQ ID NO: 176076 - protein, 37 aa, Artificial Sequence
  Description of Artificial Sequence: Synthetic polypeptide
DEEEISTTNPVATEQYGQCVCSSGEHNAENFGSDNQS

SEQ ID NO: 176077 - protein, 33 aa, Artificial Sequence
  Description of Artificial Sequence: Synthetic polypeptide
DENEIRTTNPVSTEPYGTIQSMEDIQQQQNQNH

SEQ ID NO: 176078 - protein, 34 aa, Artificial Sequence
  Description of Artificial Sequence: Synthetic polypeptide
DENEIRTTNPVSTEPYGTIQSMEDFIQQQQNGNH

SEQ ID NO: 176079 - protein, 38 aa, Artificial Sequence
  Description of Artificial Sequence: Synthetic polypeptide
DEDEIRTTNPVATEQYGSVAATTPAQGTNQGNGMEPVM

SEQ ID NO: 176080 - protein, 34 aa, Artificial Sequence
  Description of Artificial Sequence: Synthetic polypeptide
DENEIRTTNPVSTEPYGTIPSMEDISQQQNGNNE

SEQ ID NO: 176081 - protein, 35 aa, Artificial Sequence
  Description of Artificial Sequence: Synthetic polypeptide
DESEIRTTNPVATECWGATVANAINWQEPKGENYG

SEQ ID NO: 176082 - protein, 33 aa, Artificial Sequence
  Description of Artificial Sequence: Synthetic polypeptide
VEDEIATVNPVATEQWGCVAGNGLADAPAGNPH

SEQ ID NO: 176083 - protein, 33 aa, Artificial Sequence
  Description of Artificial Sequence: Synthetic polypeptide
DENEIRTTNPVSTEPYGTINVEDIQQPQSGQEH

SEQ ID NO: 176084 - protein, 31 aa, Artificial Sequence
  Description of Artificial Sequence: Synthetic polypeptide
DDSEVASTNPVSTEGYGNVAANTIESRVGQR

SEQ ID NO: 176085 - protein, 33 aa, Artificial Sequence
  Description of Artificial Sequence: Synthetic polypeptide
DEQEIATTNPVAYEPYGETAAMANDQVSNDTRN

SEQ ID NO: 176086 - protein, 33 aa, Artificial Sequence
  Description of Artificial Sequence: Synthetic polypeptide
DENEIRTTNPVSTEPYGTINRMEDIQQQQNGNH

SEQ ID NO: 176087 - protein, 33 aa, Artificial Sequence
  Description of Artificial Sequence: Synthetic polypeptide
DENEIRTTNPVSTEPYGTINMEDISQQQNGVNH

SEQ ID NO: 176088 - protein, 33 aa, Artificial Sequence
  Description of Artificial Sequence: Synthetic polypeptide
DENEIRTTNPVSTEPYGTINMEDIQQQQNGNHH

SEQ ID NO: 176089 - protein, 35 aa, Artificial Sequence
  Description of Artificial Sequence: Synthetic polypeptide
DESEIRTTNPVATECWGATVANAINWQEPKGENYI

SEQ ID NO: 176090 - protein, 36 aa, Artificial Sequence
  Description of Artificial Sequence: Synthetic polypeptide
CEDEIRTTNPVATEQYGSVNDVNFNEGGQEDTTNGF

SEQ ID NO: 176091 - protein, 33 aa, Artificial Sequence
  Description of Artificial Sequence: Synthetic polypeptide
DENEIRTTNPVSTEPWGTISMEDIQQQQNGNYH

SEQ ID NO: 176092 - protein, 34 aa, Artificial Sequence
  Description of Artificial Sequence: Synthetic polypeptide
CEDEIATTNPVAYEQYGSVAIANNDTQDNHNNDV

SEQ ID NO: 176093 - protein, 35 aa, Artificial Sequence
  Description of Artificial Sequence: Synthetic polypeptide
DEEEISTTNPCATEQYGCVCGNWEHNQNFGSDTAS

SEQ ID NO: 176094 - protein, 37 aa, Artificial Sequence
  Description of Artificial Sequence: Synthetic polypeptide
DEEEISTTNPVATEQYGQCVCSWGEHDQEGFNSDTQA

SEQ ID NO: 176095 - protein, 36 aa, Artificial Sequence
  Description of Artificial Sequence: Synthetic polypeptide
DEEEISTTNPVATEQYGQCVCSWGEHFQENFGSDQA

SEQ ID NO: 176096 - protein, 35 aa, Artificial Sequence
  Description of Artificial Sequence: Synthetic polypeptide
CEDEIATTNPVAYEQYGSVSAANPSEEAGMSNDEN

SEQ ID NO: 176097 - protein, 37 aa, Artificial Sequence
  Description of Artificial Sequence: Synthetic polypeptide
DECEICTVNPVATEQYGSVSTTQQLQQGTEQGSTDGE

SEQ ID NO: 176098 - protein, 36 aa, Artificial Sequence
  Description of Artificial Sequence: Synthetic polypeptide
DESEIRTTNPVATDQYGSVVNDEDNNDQSEDNEEGD

SEQ ID NO: 176099 - protein, 37 aa, Artificial Sequence
  Description of Artificial Sequence: Synthetic polypeptide
AEDEICATNPVATEQYGVVSTTNQNNLQQLQGNDEDD

SEQ ID NO: 176100 - protein, 36 aa, Artificial Sequence
  Description of Artificial Sequence: Synthetic polypeptide
DEAEIRTTNPVATEQYGSVCEPEGCLEWGGPEPIQE

SEQ ID NO: 176101 - protein, 39 aa, Artificial Sequence
  Description of Artificial Sequence: Synthetic polypeptide
DEDEIRTTNPVATEQYGVVSTTVTNNQQQGNIIGTTEDE

SEQ ID NO: 176102 - protein, 34 aa, Artificial Sequence
  Description of Artificial Sequence: Synthetic polypeptide
DENEIRTTNPVSTEEYGTISWEDIQQEQFGSNQG

SEQ ID NO: 176103 - protein, 36 aa, Artificial Sequence
  Description of Artificial Sequence: Synthetic polypeptide
DESEIRTTNPVATDQYGSVVDLGDNNDQNEDNEEED

SEQ ID NO: 176104 - protein, 34 aa, Artificial Sequence
  Description of Artificial Sequence: Synthetic polypeptide
DEVEIATTNPVAYEQWGSVSGGNGNESGEGDGTY

SEQ ID NO: 176105 - protein, 39 aa, Artificial Sequence
  Description of Artificial Sequence: Synthetic polypeptide
DEDEIRTTNPVATEQYGVVSTTVVTNQQQGNQAGTTDDE

SEQ ID NO: 176106 - protein, 37 aa, Artificial Sequence
  Description of Artificial Sequence: Synthetic polypeptide
AEDEICATNPVATEQYGVVSTTNQNLQQQLLGNGEDD

SEQ ID NO: 176107 - protein, 36 aa, Artificial Sequence
  Description of Artificial Sequence: Synthetic polypeptide
AEDEICATNPVATEQYGVVSTTNQNLQQLQLNGEDD

SEQ ID NO: 176108 - protein, 32 aa, Artificial Sequence
  Description of Artificial Sequence: Synthetic polypeptide
DDSEVASTNPVSTEGYGNVAANTINQSRQGQR

SEQ ID NO: 176109 - protein, 33 aa, Artificial Sequence
  Description of Artificial Sequence: Synthetic polypeptide
DENEIRTTNPVSTEEYGTINSMECIQQNQNGKH

SEQ ID NO: 176110 - protein, 32 aa, Artificial Sequence
  Description of Artificial Sequence: Synthetic polypeptide
DDSEVASTNPVSTEGYGNVAANTINQSRVGQR

SEQ ID NO: 176111 - protein, 31 aa, Artificial Sequence
  Description of Artificial Sequence: Synthetic polypeptide
DDSEVASTNPVSTEGYGNVAANTINSRVGQR

SEQ ID NO: 176112 - protein, 34 aa, Artificial Sequence
  Description of Artificial Sequence: Synthetic polypeptide
DEQEIATTNPVAYEQWGSCSATDNNDHQADEDDM

SEQ ID NO: 176113 - protein, 34 aa, Artificial Sequence
  Description of Artificial Sequence: Synthetic polypeptide
DEQEIATTNPVAYEQWGSCSATDNNDHQGEEDDE

SEQ ID NO: 176114 - protein, 34 aa, Artificial Sequence
  Description of Artificial Sequence: Synthetic polypeptide
DEQEEATTNPVAYECWGSVATGNMLGDHQGMNNS

SEQ ID NO: 176115 - protein, 34 aa, Artificial Sequence
  Description of Artificial Sequence: Synthetic polypeptide
DEEEISTTNPCATEGYGCCCSTGELNAYFGSDQS

SEQ ID NO: 176116 - protein, 37 aa, Artificial Sequence
  Description of Artificial Sequence: Synthetic polypeptide
DEEEIRTTNPIATEQYGSTVSSTTPDGPAMPNGMPPV

SEQ ID NO: 176117 - protein, 37 aa, Artificial Sequence
  Description of Artificial Sequence: Synthetic polypeptide
DEEEISTTNPVATEQYGQCVCSWGEHNEENFGSDNQS

SEQ ID NO: 176118 - protein, 31 aa, Artificial Sequence
  Description of Artificial Sequence: Synthetic polypeptide
DDSEVASTNPVSTEGYGNVAANTIMSRVGQR

SEQ ID NO: 176119 - protein, 36 aa, Artificial Sequence
  Description of Artificial Sequence: Synthetic polypeptide
CEDEIRTTNPVATEFYGNVMGTNDQRVEDEIAGQTP

SEQ ID NO: 176120 - protein, 35 aa, Artificial Sequence
  Description of Artificial Sequence: Synthetic polypeptide
CEDEIATTNPVAYEQYGSVCSVNPQQEHQDGTFMK

SEQ ID NO: 176121 - protein, 35 aa, Artificial Sequence
  Description of Artificial Sequence: Synthetic polypeptide
DEVEIATTNPVAYEQWGSVCSTMDHDHPNGGRERS

SEQ ID NO: 176122 - protein, 37 aa, Artificial Sequence
  Description of Artificial Sequence: Synthetic polypeptide
AEDEICATNPVATEQYGVVSTVNEQNLQAGNGNDEDD

SEQ ID NO: 176123 - protein, 35 aa, Artificial Sequence
  Description of Artificial Sequence: Synthetic polypeptide
DEQEIATTNPVAYEQWGHNNVSYWNEIQHRPGTAS

SEQ ID NO: 176124 - protein, 34 aa, Artificial Sequence
  Description of Artificial Sequence: Synthetic polypeptide
SEEEIRTTNPVAYEAYGKVVHCTNHAGEPLVNGH

SEQ ID NO: 176125 - protein, 35 aa, Artificial Sequence
  Description of Artificial Sequence: Synthetic polypeptide
SEEEIRTTNPVAYEAYGKVVCHCTNHAGEPGGNLH

SEQ ID NO: 176126 - protein, 37 aa, Artificial Sequence
  Description of Artificial Sequence: Synthetic polypeptide
DEEEISTTNPVATEQYGQCVCSWEPHNEENFGSDNQA

SEQ ID NO: 176127 - protein, 32 aa, Artificial Sequence
  Description of Artificial Sequence: Synthetic polypeptide
DEVEIATTNPVAYEQWGHTVSKEIEMNGKEDP

SEQ ID NO: 176128 - protein, 35 aa, Artificial Sequence
  Description of Artificial Sequence: Synthetic polypeptide
DEEEISTTNPVATEQYGQCVCSWEPHQNFISEFQA

SEQ ID NO: 176129 - protein, 36 aa, Artificial Sequence
  Description of Artificial Sequence: Synthetic polypeptide
DEEEISTTNPVATEQYGQCVCSWESHFQENFGSEQA

SEQ ID NO: 176130 - protein, 35 aa, Artificial Sequence
  Description of Artificial Sequence: Synthetic polypeptide
DEEEISTTNPVATEQYGQCVCSWGEDAENFNSDQI

SEQ ID NO: 176131 - protein, 35 aa, Artificial Sequence
  Description of Artificial Sequence: Synthetic polypeptide
DEVEIATTNPVAYEQWGSTCSTTDNNDHQGDDGDY

SEQ ID NO: 176132 - protein, 35 aa, Artificial Sequence
  Description of Artificial Sequence: Synthetic polypeptide
SEEEIRTTNPVATEYWGSVFVNENDHHEGRGDQDE

SEQ ID NO: 176133 - protein, 37 aa, Artificial Sequence
  Description of Artificial Sequence: Synthetic polypeptide
DEEEIRTTNPVATEQYGCVCSWGPDHNQENFGSDTQS

SEQ ID NO: 176134 - protein, 37 aa, Artificial Sequence
  Description of Artificial Sequence: Synthetic polypeptide
DEEEISTTNPVATEQYGQCVCSWGEDHNANFGSENQS

SEQ ID NO: 176135 - protein, 35 aa, Artificial Sequence
  Description of Artificial Sequence: Synthetic polypeptide
DESEIRTTNPVATEAWGCVCSWMNENQENFISNQS

SEQ ID NO: 176136 - protein, 36 aa, Artificial Sequence
  Description of Artificial Sequence: Synthetic polypeptide
AEDEICATNPVATEQYGVVSTVEQNLQQLNGIGTDD

SEQ ID NO: 176137 - protein, 37 aa, Artificial Sequence
  Description of Artificial Sequence: Synthetic polypeptide
DEEEIRTTNPVGTEQYGQCVCSNSEDHNANFGSDNQA

SEQ ID NO: 176138 - protein, 36 aa, Artificial Sequence
  Description of Artificial Sequence: Synthetic polypeptide
AEDEICATNPVATEQYGVVSTVENQLQQLNGIGTDS

SEQ ID NO: 176139 - protein, 35 aa, Artificial Sequence
  Description of Artificial Sequence: Synthetic polypeptide
DEVEIATTNPVAYEQWGSVCQTFEDRNTRDGGSRQ

SEQ ID NO: 176140 - protein, 34 aa, Artificial Sequence
  Description of Artificial Sequence: Synthetic polypeptide
DEVEIATTNPVAYEQWGSVCQTFEDRTTDDGGSI

SEQ ID NO: 176141 - protein, 37 aa, Artificial Sequence
  Description of Artificial Sequence: Synthetic polypeptide
DEEEISTTNPVATEQYGQCVCSWGEDNQENFGSDNQS

SEQ ID NO: 176142 - protein, 37 aa, Artificial Sequence
  Description of Artificial Sequence: Synthetic polypeptide
DESEIRTTNPVATDVYGSVVDFTDDNEQEEGNEEDGD

SEQ ID NO: 176143 - protein, 34 aa, Artificial Sequence
  Description of Artificial Sequence: Synthetic polypeptide
DEQEIATTNPVAYEQWGSCSATDNHNDHEGGEDL

SEQ ID NO: 176144 - protein, 37 aa, Artificial Sequence
  Description of Artificial Sequence: Synthetic polypeptide
DECEICTVNPVATEQYGSVSTTQQQQNATEQGSTNTT

SEQ ID NO: 176145 - protein, 36 aa, Artificial Sequence
  Description of Artificial Sequence: Synthetic polypeptide
DEEEISTTNPVATEQYGQCVCSWGEDQENFGSEPQG

SEQ ID NO: 176146 - protein, 36 aa, Artificial Sequence
  Description of Artificial Sequence: Synthetic polypeptide
DEEEISTTNPVATEQYGQCVCSWGEDQENFNSNTQS

SEQ ID NO: 176147 - protein, 37 aa, Artificial Sequence
  Description of Artificial Sequence: Synthetic polypeptide
AEDEICATNPVATEQYGVVSTTNQNQLQQLLGNDEDD

SEQ ID NO: 176148 - protein, 34 aa, Artificial Sequence
  Description of Artificial Sequence: Synthetic polypeptide
AEEEIASVNPVCTEQYGCVCSWNPNQSFGSNTQA

SEQ ID NO: 176149 - protein, 36 aa, Artificial Sequence
  Description of Artificial Sequence: Synthetic polypeptide
TQEEIRGTNPVATDQYGSVTILTINGEAQNNSNVRI

SEQ ID NO: 176150 - protein, 37 aa, Artificial Sequence
  Description of Artificial Sequence: Synthetic polypeptide
DEEEISTTNPVATEQYGQCVCSWGEHNQEGFGSDNQS

SEQ ID NO: 176151 - protein, 35 aa, Artificial Sequence
  Description of Artificial Sequence: Synthetic polypeptide
DENEIRTTNPVSTEAYGTVCSGMEDQQQQQNGNMS

SEQ ID NO: 176152 - protein, 35 aa, Artificial Sequence
  Description of Artificial Sequence: Synthetic polypeptide
DENEIRTTNPVSTEAYGTISWEDINQEQFGSNNQS

SEQ ID NO: 176153 - protein, 33 aa, Artificial Sequence
  Description of Artificial Sequence: Synthetic polypeptide
DENEIRTTNPVSTEAYGTISMEDIQQQQNMNQH

SEQ ID NO: 176154 - protein, 37 aa, Artificial Sequence
  Description of Artificial Sequence: Synthetic polypeptide
DEEEISTTNPVATEQYGQCVCSWGEHNQENSGSDNQA

SEQ ID NO: 176155 - protein, 40 aa, Artificial Sequence
  Description of Artificial Sequence: Synthetic polypeptide
DEDEIRTTNPVATEQYGVVSTVNLGGNQLAGIGTTNQQED

SEQ ID NO: 176156 - protein, 36 aa, Artificial Sequence
  Description of Artificial Sequence: Synthetic polypeptide
DEEEISTTNPVATEQYGQCVCSWGEHNQESFGSDQA

SEQ ID NO: 176157 - protein, 40 aa, Artificial Sequence
  Description of Artificial Sequence: Synthetic polypeptide
DEDEIRTTNPVATEQYGVVSTVNLGNNNQQGIGTTNADTD

SEQ ID NO: 176158 - protein, 39 aa, Artificial Sequence
  Description of Artificial Sequence: Synthetic polypeptide
DEDEIRTTNPVATEQYGVVSTVNLNNNQQGIGTTQQGED

SEQ ID NO: 176159 - protein, 34 aa, Artificial Sequence
  Description of Artificial Sequence: Synthetic polypeptide
DEQEIATTNPVAYEQWGSCSATPDRNNDHQGEDD

SEQ ID NO: 176160 - protein, 36 aa, Artificial Sequence
  Description of Artificial Sequence: Synthetic polypeptide
CEDEIRTTNPVATEQYGDVVVGNTTDNAGEGGNEGN

SEQ ID NO: 176161 - protein, 36 aa, Artificial Sequence
  Description of Artificial Sequence: Synthetic polypeptide
DEEEISTTNPVATEQYGQCVCSWGEHNQEYFGSEQS

SEQ ID NO: 176162 - protein, 36 aa, Artificial Sequence
  Description of Artificial Sequence: Synthetic polypeptide
CEDEIRTTNPVATEQYGDVVVTGEQGEGQGDDNEDG

SEQ ID NO: 176163 - protein, 39 aa, Artificial Sequence
  Description of Artificial Sequence: Synthetic polypeptide
DEDEIRTTNPVATEQYGVVSTVNNGNGNLQLIGTTQDED

SEQ ID NO: 176164 - protein, 36 aa, Artificial Sequence
  Description of Artificial Sequence: Synthetic polypeptide
DEEEISTTNPVATEQYGQCVCSWGEHNQEYFNSDQA

SEQ ID NO: 176165 - protein, 37 aa, Artificial Sequence
  Description of Artificial Sequence: Synthetic polypeptide
DEQEIAATNPVATEQYGSTVPSCTALVSEDHEGGENL

SEQ ID NO: 176166 - protein, 36 aa, Artificial Sequence
  Description of Artificial Sequence: Synthetic polypeptide
DEEEISTTNPVATEQYGQCVCSWGEHNQNFGSDTQL

SEQ ID NO: 176167 - protein, 35 aa, Artificial Sequence
  Description of Artificial Sequence: Synthetic polypeptide
DEQEIATTNPVAYEQWGSCSPTDINNEHQGDRDDN

SEQ ID NO: 176168 - protein, 36 aa, Artificial Sequence
  Description of Artificial Sequence: Synthetic polypeptide
DEEEISTTNPVATEQYGQCVCSWGEHNQNFNSDTQA

SEQ ID NO: 176169 - protein, 35 aa, Artificial Sequence
  Description of Artificial Sequence: Synthetic polypeptide
DEQEIATTNPVAYEQWGSCSPTDNHNEVQDDRDDD

SEQ ID NO: 176170 - protein, 40 aa, Artificial Sequence
  Description of Artificial Sequence: Synthetic polypeptide
DEDEIRTTNPVATEQYGVVSTVNNNGNQLQGIGTTNQQED

SEQ ID NO: 176171 - protein, 36 aa, Artificial Sequence
  Description of Artificial Sequence: Synthetic polypeptide
DEEEISTTNPVATEQYGQCVCSWGEHNQNFNSQTQN

SEQ ID NO: 176172 - protein, 39 aa, Artificial Sequence
  Description of Artificial Sequence: Synthetic polypeptide
DEDEIRTTNPVATEQYGVVSTVNNNNNLQGIGTTVQDED

SEQ ID NO: 176173 - protein, 32 aa, Artificial Sequence
  Description of Artificial Sequence: Synthetic polypeptide
DEEEIRTTNPIATEQWGATANAEVWAHKGPYI

SEQ ID NO: 176174 - protein, 32 aa, Artificial Sequence
  Description of Artificial Sequence: Synthetic polypeptide
DENEIRTTNPVSTAPYGTIAMEDIQQQQNGNH

SEQ ID NO: 176175 - protein, 37 aa, Artificial Sequence
  Description of Artificial Sequence: Synthetic polypeptide
DEEEIRTTNPVATEQYGSVSPVIPAAVDMTPEVTNLD

SEQ ID NO: 176176 - protein, 34 aa, Artificial Sequence
  Description of Artificial Sequence: Synthetic polypeptide
DEQEIATTNPVAYEQWGSCSATNDNNDHQGDEDT

SEQ ID NO: 176177 - protein, 37 aa, Artificial Sequence
  Description of Artificial Sequence: Synthetic polypeptide
AEDEICATNPVATEQYGVVSTTNQLNLQQLQGNDEDD

SEQ ID NO: 176178 - protein, 34 aa, Artificial Sequence
  Description of Artificial Sequence: Synthetic polypeptide
DEQEIATTNPVAYEQWGSCSATNDNNDHERREDL

SEQ ID NO: 176179 - protein, 39 aa, Artificial Sequence
  Description of Artificial Sequence: Synthetic polypeptide
DEEEIRTTNPVATEQWGYSNVTATSGELQHQRPGQGMMV

SEQ ID NO: 176180 - protein, 37 aa, Artificial Sequence
  Description of Artificial Sequence: Synthetic polypeptide
AEDEICATNPVATEQYGVVSTTNQLNLQQLGGNGEDD

SEQ ID NO: 176181 - protein, 37 aa, Artificial Sequence
  Description of Artificial Sequence: Synthetic polypeptide
DEEEISTTNPVATEQYGQCVCSWGEHNQEGFNSDTQA

SEQ ID NO: 176182 - protein, 32 aa, Artificial Sequence
  Description of Artificial Sequence: Synthetic polypeptide
DDSEVASTNPVSTEGYGNVAANTIPQSRVGQR

SEQ ID NO: 176183 - protein, 34 aa, Artificial Sequence
  Description of Artificial Sequence: Synthetic polypeptide
DENEIRTTNPVSTECYGTTTSNMEDIQQQQNGNH

SEQ ID NO: 176184 - protein, 36 aa, Artificial Sequence
  Description of Artificial Sequence: Synthetic polypeptide
CEDEIRTTNPVATEFYGSVVGNTMDQNAGEGGNEDQ

SEQ ID NO: 176185 - protein, 37 aa, Artificial Sequence
  Description of Artificial Sequence: Synthetic polypeptide
CEDEIRTTNPVATEFYGSVVGNTNMDDQAGEGGGENE

SEQ ID NO: 176186 - protein, 31 aa, Artificial Sequence
  Description of Artificial Sequence: Synthetic polypeptide
DDSEVASTNPVSTEGYGNVAANTIPSRVGQR

SEQ ID NO: 176187 - protein, 35 aa, Artificial Sequence
  Description of Artificial Sequence: Synthetic polypeptide
DEVEIATTNPVAYEQWGSVTGGNENDQQNNMGNQP

SEQ ID NO: 176188 - protein, 40 aa, Artificial Sequence
  Description of Artificial Sequence: Synthetic polypeptide
DEDEIRTTNPVATEQYGVVSTVNGGNNNLQGIGTNNDDED

SEQ ID NO: 176189 - protein, 35 aa, Artificial Sequence
  Description of Artificial Sequence: Synthetic polypeptide
CEDEIRTTNPVATEFYGTVVGNTMDNAGEGGNEGQ

SEQ ID NO: 176190 - protein, 39 aa, Artificial Sequence
  Description of Artificial Sequence: Synthetic polypeptide
DEDEIRTTNPVATEQYGVVSTVNGGNNNQQGIGTTQNED

SEQ ID NO: 176191 - protein, 34 aa, Artificial Sequence
  Description of Artificial Sequence: Synthetic polypeptide
DEVEIATTNPVAYEQWGSVVCNAAMPREDRSDVD

SEQ ID NO: 176192 - protein, 36 aa, Artificial Sequence
  Description of Artificial Sequence: Synthetic polypeptide
DEVEIATTNPVAYEQWGSVVHTDNEHEQGQGGGGIR

SEQ ID NO: 176193 - protein, 37 aa, Artificial Sequence
  Description of Artificial Sequence: Synthetic polypeptide
DEEEISTTNPVATEQYGQCVCSWGEHNQENFGSENQS

SEQ ID NO: 176194 - protein, 38 aa, Artificial Sequence
  Description of Artificial Sequence: Synthetic polypeptide
DEDEIRTTNPVATEQYGVVSTVNGNGNNQGIGTTQDED

SEQ ID NO: 176195 - protein, 37 aa, Artificial Sequence
  Description of Artificial Sequence: Synthetic polypeptide
DEEEISTTNPVATEQYGQCVCSWGEHNQENFGSQNQG

SEQ ID NO: 176196 - protein, 36 aa, Artificial Sequence
  Description of Artificial Sequence: Synthetic polypeptide
DEEEIRTTNPVGTEQYGCVCSWGEDLNANFNSQTQM

SEQ ID NO: 176197 - protein, 39 aa, Artificial Sequence
  Description of Artificial Sequence: Synthetic polypeptide
DEDEIRTTNPVATEQYGVVSTVNGNNNQQGIGTTNQDED

SEQ ID NO: 176198 - protein, 36 aa, Artificial Sequence
  Description of Artificial Sequence: Synthetic polypeptide
CEDEIRTTNPVATEGYGSVVSTLTGDENQGEGQGQD

SEQ ID NO: 176199 - protein, 34 aa, Artificial Sequence
  Description of Artificial Sequence: Synthetic polypeptide
DEQEIATTNPVAYEQWGSCSATDNQNDHQGDADD

SEQ ID NO: 176200 - protein, 40 aa, Artificial Sequence
  Description of Artificial Sequence: Synthetic polypeptide
DEDEIRTTNPVATEQYGVVSTVNLGGNNQQGIGTTNQTED

SEQ ID NO: 176201 - protein, 34 aa, Artificial Sequence
  Description of Artificial Sequence: Synthetic polypeptide
DEVEIATTNPVAYEQWGVVCSTIDFEDGHQNTES

SEQ ID NO: 176202 - protein, 34 aa, Artificial Sequence
  Description of Artificial Sequence: Synthetic polypeptide
DEQEIATTNPVAYEQWGSCSATEDNNDHQGKSDD

SEQ ID NO: 176203 - protein, 35 aa, Artificial Sequence
  Description of Artificial Sequence: Synthetic polypeptide
DEQEIATTNPVAYEQWGSCSATEDNNDHQGQEDNH

SEQ ID NO: 176204 - protein, 34 aa, Artificial Sequence
  Description of Artificial Sequence: Synthetic polypeptide
DEQEIATTNPVAYEQWGSCSATEDNNDQQNDEDD

SEQ ID NO: 176205 - protein, 31 aa, Artificial Sequence
  Description of Artificial Sequence: Synthetic polypeptide
DDSEVASTNPVSTEGYGNVAANTIQDRVGQL

SEQ ID NO: 176206 - protein, 32 aa, Artificial Sequence
  Description of Artificial Sequence: Synthetic polypeptide
DEVEIATTNPVAYEQWGCVYNMDMNMNGGHGS

SEQ ID NO: 176207 - protein, 36 aa, Artificial Sequence
  Description of Artificial Sequence: Synthetic polypeptide
DEEEISTTNPVATEQYGQCVCSWEHDQEFFGSDTQA

SEQ ID NO: 176208 - protein, 37 aa, Artificial Sequence
  Description of Artificial Sequence: Synthetic polypeptide
DEEEISTTNPVATEQYGQCVCSWEETNQENFGSDTQA

SEQ ID NO: 176209 - protein, 39 aa, Artificial Sequence
  Description of Artificial Sequence: Synthetic polypeptide
DEDEIRTTNPVATEQYGVVSTSNNGNQEQGIGTTNQQEQ

SEQ ID NO: 176210 - protein, 37 aa, Artificial Sequence
  Description of Artificial Sequence: Synthetic polypeptide
DECEICTVNPVATEQYGVVSTTNQQQNNGQGNNEDED

SEQ ID NO: 176211 - protein, 36 aa, Artificial Sequence
  Description of Artificial Sequence: Synthetic polypeptide
DEVEIATTNPVATEWWGSVCSTWEQNQQPDGHGDGG

SEQ ID NO: 176212 - protein, 38 aa, Artificial Sequence
  Description of Artificial Sequence: Synthetic polypeptide
DEEEISTTNPVATEQYGQCVCSTWGEHNQENFGSDNAS

SEQ ID NO: 176213 - protein, 33 aa, Artificial Sequence
  Description of Artificial Sequence: Synthetic polypeptide
DENEIRTTNPVSTEPWGTISAGEDGQQQQNGNH

SEQ ID NO: 176214 - protein, 33 aa, Artificial Sequence
  Description of Artificial Sequence: Synthetic polypeptide
DENEIRTTNPVSTEPWGTIRSMEDIQQQQNGNH

SEQ ID NO: 176215 - protein, 37 aa, Artificial Sequence
  Description of Artificial Sequence: Synthetic polypeptide
AEDEICATNPVATEQYGVVSTVNQNNLQAGNGNDEDD

SEQ ID NO: 176216 - protein, 33 aa, Artificial Sequence
  Description of Artificial Sequence: Synthetic polypeptide
DENEIRTTNPVSTEPWGTICSMEWGQQQQNGNH

SEQ ID NO: 176217 - protein, 33 aa, Artificial Sequence
  Description of Artificial Sequence: Synthetic polypeptide
AENEIATTNPVATEGYGCVCSWALQEHFESELS

SEQ ID NO: 176218 - protein, 37 aa, Artificial Sequence
  Description of Artificial Sequence: Synthetic polypeptide
AEDEICATNPVATEQYGVVSTVNQNLLQQLQGNGEDD

SEQ ID NO: 176219 - protein, 33 aa, Artificial Sequence
  Description of Artificial Sequence: Synthetic polypeptide
AENEIATTNPVATEGYGCVCSWALNQHFSSEQS

SEQ ID NO: 176220 - protein, 33 aa, Artificial Sequence
  Description of Artificial Sequence: Synthetic polypeptide
DENEIRTTNPVSTEPWGTCSYMEDHQQQQNGNH

SEQ ID NO: 176221 - protein, 38 aa, Artificial Sequence
  Description of Artificial Sequence: Synthetic polypeptide
DEEEISTTNPVATEQYGQCVCSTWGEHNQENFGSDNQS

SEQ ID NO: 176222 - protein, 34 aa, Artificial Sequence
  Description of Artificial Sequence: Synthetic polypeptide
AENEIATTNPVATEGYGCVCSTWELQHFISETLA

SEQ ID NO: 176223 - protein, 37 aa, Artificial Sequence
  Description of Artificial Sequence: Synthetic polypeptide
DEEEISTTNPVATEQYGQCVCSTWGEHNQENFGSQQL

SEQ ID NO: 176224 - protein, 39 aa, Artificial Sequence
  Description of Artificial Sequence: Synthetic polypeptide
DEDEIRTTNPVATEQYGVVSTSNNNNQLQGIGTTQQGEQ

SEQ ID NO: 176225 - protein, 37 aa, Artificial Sequence
  Description of Artificial Sequence: Synthetic polypeptide
AEDEICATNPVATEQYGVVSTVNQNLLQQLQGNDEDD

SEQ ID NO: 176226 - protein, 35 aa, Artificial Sequence
  Description of Artificial Sequence: Synthetic polypeptide
DEQDEIATTNPVAYECWGSVATGNMLGDAQGMNPD

SEQ ID NO: 176227 - protein, 37 aa, Artificial Sequence
  Description of Artificial Sequence: Synthetic polypeptide
DEEEISTTNPVATEQYGQCVCSTWGEHNQNFGSDTQS

SEQ ID NO: 176228 - protein, 31 aa, Artificial Sequence
  Description of Artificial Sequence: Synthetic polypeptide
DDSEVASTNPVSTEGYGNVAANTIMNRVGQR

SEQ ID NO: 176229 - protein, 37 aa, Artificial Sequence
  Description of Artificial Sequence: Synthetic polypeptide
DECEICTVNPVATEQYGVVSTTNNLQQGTEQGTTDDD

SEQ ID NO: 176230 - protein, 37 aa, Artificial Sequence
  Description of Artificial Sequence: Synthetic polypeptide
DECEICTVNPVATEQYGVVSTTNNLLQGTEQGSTTDD

SEQ ID NO: 176231 - protein, 36 aa, Artificial Sequence
  Description of Artificial Sequence: Synthetic polypeptide
DEEEISTTNPVATEQYGQCVCSWEDDNQENFGSEQS

SEQ ID NO: 176232 - protein, 35 aa, Artificial Sequence
  Description of Artificial Sequence: Synthetic polypeptide
DEEEISTTNPVATEQYGQCVCSWEDHNANFNSDQS

SEQ ID NO: 176233 - protein, 39 aa, Artificial Sequence
  Description of Artificial Sequence: Synthetic polypeptide
DEDEIRTTNPVATEQYGVVSTSNNNQNLQGIGTTEQGEQ

SEQ ID NO: 176234 - protein, 37 aa, Artificial Sequence
  Description of Artificial Sequence: Synthetic polypeptide
AEDEICATNPVATEQYGVVSTVNQNNLQALNGNQEDT

SEQ ID NO: 176235 - protein, 33 aa, Artificial Sequence
  Description of Artificial Sequence: Synthetic polypeptide
DENEIRTTNPVSTEPWGATISMEDWQQQNGNYI

SEQ ID NO: 176236 - protein, 37 aa, Artificial Sequence
  Description of Artificial Sequence: Synthetic polypeptide
DEEEISTTNPVATEQYGQCVCSTWGEHNAENFGSEQS

SEQ ID NO: 176237 - protein, 37 aa, Artificial Sequence
  Description of Artificial Sequence: Synthetic polypeptide
DECEICTVNPVATEQYGVVSTTQAQQQLQQGNNQDED

SEQ ID NO: 176238 - protein, 33 aa, Artificial Sequence
  Description of Artificial Sequence: Synthetic polypeptide
DENEIRTTNPVSTEPWGTISMEDIQQQQNGNNH

SEQ ID NO: 176239 - protein, 36 aa, Artificial Sequence
  Description of Artificial Sequence: Synthetic polypeptide
DEEEISTTNPCATEQYGCVCGWGELNQENFGSDNQA

SEQ ID NO: 176240 - protein, 36 aa, Artificial Sequence
  Description of Artificial Sequence: Synthetic polypeptide
DEVEIATTNPVATEQYGTVVSATDGDDEEGEGGNIL

SEQ ID NO: 176241 - protein, 34 aa, Artificial Sequence
  Description of Artificial Sequence: Synthetic polypeptide
CEDEIATTNPVAYEQYGSVAIANNDTQDNPDNNT

SEQ ID NO: 176242 - protein, 39 aa, Artificial Sequence
  Description of Artificial Sequence: Synthetic polypeptide
DEDEIRTTNPVATEQYGVVSTSNNGNNLQGIGTTTQGEQ

SEQ ID NO: 176243 - protein, 34 aa, Artificial Sequence
  Description of Artificial Sequence: Synthetic polypeptide
CEDEIATTNPVAYEQYGSVAIANNDTQPDNGEGM

SEQ ID NO: 176244 - protein, 38 aa, Artificial Sequence
  Description of Artificial Sequence: Synthetic polypeptide
DEEEIRTTNPVATEQYGAFVIGTTIIDEQQRGQSEDSD

SEQ ID NO: 176245 - protein, 36 aa, Artificial Sequence
  Description of Artificial Sequence: Synthetic polypeptide
AEDEICATNPVATEQYGVVSTVVQNLQQLNGIGTDQ

SEQ ID NO: 176246 - protein, 39 aa, Artificial Sequence
  Description of Artificial Sequence: Synthetic polypeptide
DEEEIRTTNPVATEQYGSVSTVVSTQQAGTEQGGTTTDD

SEQ ID NO: 176247 - protein, 40 aa, Artificial Sequence
  Description of Artificial Sequence: Synthetic polypeptide
DEDEIRTTNPVATEQYGVVSTSNNGNNQLQGIGTTEQNED

SEQ ID NO: 176248 - protein, 36 aa, Artificial Sequence
  Description of Artificial Sequence: Synthetic polypeptide
SEEEIRTTNPVAYEQWGYYWSDQRNDDLQRQDERQR

SEQ ID NO: 176249 - protein, 37 aa, Artificial Sequence
  Description of Artificial Sequence: Synthetic polypeptide
AEDEICATNPVATEQYGVVSTVVNNQLQQLNGNQEDD

SEQ ID NO: 176250 - protein, 37 aa, Artificial Sequence
  Description of Artificial Sequence: Synthetic polypeptide
AEDEICATNPVATEQYGVVSTVNQNQLQQLQGNGTDD

SEQ ID NO: 176251 - protein, 36 aa, Artificial Sequence
  Description of Artificial Sequence: Synthetic polypeptide
DECEIGTTNPVATEFYGSVSTTGDQGEDQEGGEDGD

SEQ ID NO: 176252 - protein, 36 aa, Artificial Sequence
  Description of Artificial Sequence: Synthetic polypeptide
DECEIGTTNPVATEFYGSVSITGDTGENQEGGEDGD

SEQ ID NO: 176253 - protein, 33 aa, Artificial Sequence
  Description of Artificial Sequence: Synthetic polypeptide
AENEIATTNPVATEGYGCVCSWGALQHFESELA

SEQ ID NO: 176254 - protein, 32 aa, Artificial Sequence
  Description of Artificial Sequence: Synthetic polypeptide
AENEIATTNPVATEGYGCVCSWETQHFISELA

SEQ ID NO: 176255 - protein, 33 aa, Artificial Sequence
  Description of Artificial Sequence: Synthetic polypeptide
AENEIATTNPVATEGYGCVCSWETNQHFISEQS

SEQ ID NO: 176256 - protein, 40 aa, Artificial Sequence
  Description of Artificial Sequence: Synthetic polypeptide
DEDEIRTTNPVATEQYGVVSTSNNGNNQLQGIGTTNQEEQ

SEQ ID NO: 176257 - protein, 36 aa, Artificial Sequence
  Description of Artificial Sequence: Synthetic polypeptide
DEVEIATTNPVATEVWGSVCFTNEDATDGQRGGTDS

SEQ ID NO: 176258 - protein, 33 aa, Artificial Sequence
  Description of Artificial Sequence: Synthetic polypeptide
DENEIRTTNPVSTEPWGTISMEDEQQQQNGENH

SEQ ID NO: 176259 - protein, 37 aa, Artificial Sequence
  Description of Artificial Sequence: Synthetic polypeptide
AEDEICATNPVATEQYGVVSTVNQNNLQQLNGNGEDD

SEQ ID NO: 176260 - protein, 37 aa, Artificial Sequence
  Description of Artificial Sequence: Synthetic polypeptide
DECEICTVNPVATEQYGVVSTVQNQQNATEQGTTNTQ

SEQ ID NO: 176261 - protein, 37 aa, Artificial Sequence
  Description of Artificial Sequence: Synthetic polypeptide
DECEICTVNPVATEQYGVVSTVQNLQQGTEQGSTDTD

SEQ ID NO: 176262 - protein, 31 aa, Artificial Sequence
  Description of Artificial Sequence: Synthetic polypeptide
DDSHVASTNPVSTEVYGTVAANTIQSRVGQR

SEQ ID NO: 176263 - protein, 32 aa, Artificial Sequence
  Description of Artificial Sequence: Synthetic polypeptide
AENEIATTNPVATEGYGCVCSWEDQHISETLA

SEQ ID NO: 176264 - protein, 33 aa, Artificial Sequence
  Description of Artificial Sequence: Synthetic polypeptide
DENEIRTTNPVSTEPWGAISMEDWQQQQNGNYI

SEQ ID NO: 176265 - protein, 31 aa, Artificial Sequence
  Description of Artificial Sequence: Synthetic polypeptide
DENEIRTTNPVSTEPWGAIAMEDIQQQNGPH

SEQ ID NO: 176266 - protein, 32 aa, Artificial Sequence
  Description of Artificial Sequence: Synthetic polypeptide
DENEIRTTNPVSTEPFGTISDEDIQQQQNGHH

SEQ ID NO: 176267 - protein, 40 aa, Artificial Sequence
  Description of Artificial Sequence: Synthetic polypeptide
DEDEIRTTNPVATEQYGVVSTTNNGENLLQGIGTTNQEED

SEQ ID NO: 176268 - protein, 39 aa, Artificial Sequence
  Description of Artificial Sequence: Synthetic polypeptide
DEDEIRTTNPVATEQYGVVSTTNNGGNQQGIGTTNQEEE

SEQ ID NO: 176269 - protein, 39 aa, Artificial Sequence
  Description of Artificial Sequence: Synthetic polypeptide
DEDEIRTTNPVATEQYGVVSTTNNGNDNQGIGTTNQEED

SEQ ID NO: 176270 - protein, 40 aa, Artificial Sequence
  Description of Artificial Sequence: Synthetic polypeptide
DEDEIRTTNPVATEQYGVVSTTNNGNNNLQGIGTTNQEEE

SEQ ID NO: 176271 - protein, 37 aa, Artificial Sequence
  Description of Artificial Sequence: Synthetic polypeptide
AEDEICATNPVATEQYGVVSTVNGNPLQAGNGNGEDD

SEQ ID NO: 176272 - protein, 40 aa, Artificial Sequence
  Description of Artificial Sequence: Synthetic polypeptide
DEDEIRTTNPVATEQYGVVSTTNNGQNLLQGIGTTNAEEE

SEQ ID NO: 176273 - protein, 40 aa, Artificial Sequence
  Description of Artificial Sequence: Synthetic polypeptide
DEDEIRTTNPVATEQYGVVSTTNNGQNLLQGIGTTNEEND

SEQ ID NO: 176274 - protein, 40 aa, Artificial Sequence
  Description of Artificial Sequence: Synthetic polypeptide
DEDEIRTTNPVATEQYGVVSTTNNGQNQLQGIGTNNQDED

SEQ ID NO: 176275 - protein, 39 aa, Artificial Sequence
  Description of Artificial Sequence: Synthetic polypeptide
DEDEIRTTNPVATEQYGVVSTTNNGTNLQGIGTTTEEED

SEQ ID NO: 176276 - protein, 40 aa, Artificial Sequence
  Description of Artificial Sequence: Synthetic polypeptide
DEDEIRTTNPVATEQYGVVSTTNNLGNQLQGIGTTNQEEE

SEQ ID NO: 176277 - protein, 33 aa, Artificial Sequence
  Description of Artificial Sequence: Synthetic polypeptide
DEVEIATTNPVAYEHWGEVYSGDHDLDRNEGDA

SEQ ID NO: 176278 - protein, 40 aa, Artificial Sequence
  Description of Artificial Sequence: Synthetic polypeptide
DEDEIRTTNPVATEQYGVVSTTNNLQNLLQGIGTTNQDED

SEQ ID NO: 176279 - protein, 34 aa, Artificial Sequence
  Description of Artificial Sequence: Synthetic polypeptide
DENEIRTTNPVSTEGYGTISDQEDIQDQGNGNDQ

SEQ ID NO: 176280 - protein, 37 aa, Artificial Sequence
  Description of Artificial Sequence: Synthetic polypeptide
DEEEISTTNPVATEQYGQCVCSWEEHNQEYFGSDNQL

SEQ ID NO: 176281 - protein, 34 aa, Artificial Sequence
  Description of Artificial Sequence: Synthetic polypeptide
DENEIRTTNPVSTEGYGTISAQEDGIQQDGNGNG

SEQ ID NO: 176282 - protein, 37 aa, Artificial Sequence
  Description of Artificial Sequence: Synthetic polypeptide
DECEICTVNPVATEQYGSVSTVQQQQGNTEQGSTDTQ

SEQ ID NO: 176283 - protein, 37 aa, Artificial Sequence
  Description of Artificial Sequence: Synthetic polypeptide
AEDEICATNPVATEQYGVVSTVNEQQLQAGNGNDEDD

SEQ ID NO: 176284 - protein, 33 aa, Artificial Sequence
  Description of Artificial Sequence: Synthetic polypeptide
DENEIRTTNPVSTEGYGTINQEDIQQQQNGNTA

SEQ ID NO: 176285 - protein, 34 aa, Artificial Sequence
  Description of Artificial Sequence: Synthetic polypeptide
DENEIRTTNPVSTEGYGTICSWEEINQEQFGDQM

SEQ ID NO: 176286 - protein, 33 aa, Artificial Sequence
  Description of Artificial Sequence: Synthetic polypeptide
DENEIRTTNPVSTEGYGTICSWEDINQEQFNDQ

SEQ ID NO: 176287 - protein, 31 aa, Artificial Sequence
  Description of Artificial Sequence: Synthetic polypeptide
DDSEVASTNPVSTEGYGNVAANTIMSRGGQR

SEQ ID NO: 176288 - protein, 34 aa, Artificial Sequence
  Description of Artificial Sequence: Synthetic polypeptide
DENEIRTTNPVSTEGYGTICSWEDHNQEQFGDQS

SEQ ID NO: 176289 - protein, 40 aa, Artificial Sequence
  Description of Artificial Sequence: Synthetic polypeptide
DEDEIRTTNPVATEQYGVVSTTNQGGNNLQGIGTTNQNED

SEQ ID NO: 176290 - protein, 34 aa, Artificial Sequence
  Description of Artificial Sequence: Synthetic polypeptide
DENEIRTTNPVSTEGYGTICSWEDHNAEQFGSDQ

SEQ ID NO: 176291 - protein, 32 aa, Artificial Sequence
  Description of Artificial Sequence: Synthetic polypeptide
DEVEIATTNPVAYEQWGCSWTNHMMDEDGGTI

SEQ ID NO: 176292 - protein, 34 aa, Artificial Sequence
  Description of Artificial Sequence: Synthetic polypeptide
DEVEIATTNPVAYEEWGCVYCTNQDQHDDHRGMV

SEQ ID NO: 176293 - protein, 35 aa, Artificial Sequence
  Description of Artificial Sequence: Synthetic polypeptide
DEVEIATTNPVAYEEWGCVYCTNLDQQHDDERGGV

SEQ ID NO: 176294 - protein, 40 aa, Artificial Sequence
  Description of Artificial Sequence: Synthetic polypeptide
DEDEIRTTNPVATEQYGVVSTTNLGNNNQQGIGTNNQDED

SEQ ID NO: 176295 - protein, 35 aa, Artificial Sequence
  Description of Artificial Sequence: Synthetic polypeptide
SEEEIRTTNPVAYEQWGHNNVSYWEEQQHRNGGSH

SEQ ID NO: 176296 - protein, 32 aa, Artificial Sequence
  Description of Artificial Sequence: Synthetic polypeptide
DENEIRTTNPVSTEPFGTIFMEDIQQQQNGNH

SEQ ID NO: 176297 - protein, 38 aa, Artificial Sequence
  Description of Artificial Sequence: Synthetic polypeptide
DEEEIRTTNPVATEQYGSVSQPSPAYGPNMQNNMQDVV

SEQ ID NO: 176298 - protein, 34 aa, Artificial Sequence
  Description of Artificial Sequence: Synthetic polypeptide
DENEIRTTNPVSTEHYGTISMEDWIQQQQNGSNH

SEQ ID NO: 176299 - protein, 32 aa, Artificial Sequence
  Description of Artificial Sequence: Synthetic polypeptide
DDSEVVSTNPVATEGYGTVCAATGIVEREGQR

SEQ ID NO: 176300 - protein, 34 aa, Artificial Sequence
  Description of Artificial Sequence: Synthetic polypeptide
DEVEIATTNPVAYAPQWGQSVAQNDGLQTDGITN

SEQ ID NO: 176301 - protein, 37 aa, Artificial Sequence
  Description of Artificial Sequence: Synthetic polypeptide
AEDEICATNPVATEQYGVVSTVNNNNLQQLQGNGEDD

SEQ ID NO: 176302 - protein, 33 aa, Artificial Sequence
  Description of Artificial Sequence: Synthetic polypeptide
SEEEIRTTNPVAYEQWGHVYWIDIDVVRGMGHE

SEQ ID NO: 176303 - protein, 35 aa, Artificial Sequence
  Description of Artificial Sequence: Synthetic polypeptide
DENEIRTTNPVSTEGYGTIVSDQEDIGQQQNGNDG

SEQ ID NO: 176304 - protein, 39 aa, Artificial Sequence
  Description of Artificial Sequence: Synthetic polypeptide
DEDEIRTTNPVATEQYGVVSTSNQGNLQQGIGTTQQGEQ

SEQ ID NO: 176305 - protein, 40 aa, Artificial Sequence
  Description of Artificial Sequence: Synthetic polypeptide
DEDEIRTTNPVATEQYGVVSTSNQGNNNLQGIGTTTQNED

SEQ ID NO: 176306 - protein, 34 aa, Artificial Sequence
  Description of Artificial Sequence: Synthetic polypeptide
DENEIRTTNPVSTEGYGTISWEDIQQEQSGSNNQ

SEQ ID NO: 176307 - protein, 34 aa, Artificial Sequence
  Description of Artificial Sequence: Synthetic polypeptide
SEEEIRTTNPVAYEQWGHVYWIDIDHQRGMGHTT

SEQ ID NO: 176308 - protein, 39 aa, Artificial Sequence
  Description of Artificial Sequence: Synthetic polypeptide
DEDEIRTTNPVATEQYGVVSTSNNGNNLQGIGTTEQGEE

SEQ ID NO: 176309 - protein, 37 aa, Artificial Sequence
  Description of Artificial Sequence: Synthetic polypeptide
DEEEISTTNPVATEQYGQCVCSWEEDHNQNFGSDNQA

SEQ ID NO: 176310 - protein, 37 aa, Artificial Sequence
  Description of Artificial Sequence: Synthetic polypeptide
AEDEICATNPVATEQYGVVSTVNGTNLQAGNQNGEDD

SEQ ID NO: 176311 - protein, 35 aa, Artificial Sequence
  Description of Artificial Sequence: Synthetic polypeptide
DEEEISTTNPVATEQYGQCVCSWEEHANFISEFQA

SEQ ID NO: 176312 - protein, 32 aa, Artificial Sequence
  Description of Artificial Sequence: Synthetic polypeptide
DDSEVASTNPVSTEGYGNVAANTIMQSRVGQR

SEQ ID NO: 176313 - protein, 34 aa, Artificial Sequence
  Description of Artificial Sequence: Synthetic polypeptide
DEVEIATTNPVAYECWGSVYIAENDGQQDGGGNP

SEQ ID NO: 176314 - protein, 34 aa, Artificial Sequence
  Description of Artificial Sequence: Synthetic polypeptide
DEVEIATTNPVAYECWGSVYIAENDIQQDGDNGP

SEQ ID NO: 176315 - protein, 36 aa, Artificial Sequence
  Description of Artificial Sequence: Synthetic polypeptide
DEEEISTTNPVATEQYGQCVCSWEEHNQEFFGSEQA

SEQ ID NO: 176316 - protein, 35 aa, Artificial Sequence
  Description of Artificial Sequence: Synthetic polypeptide
SEEEIRTTNPVAYEQWGHNNVSYWEEQQHRPGGTQ

SEQ ID NO: 176317 - protein, 34 aa, Artificial Sequence
  Description of Artificial Sequence: Synthetic polypeptide
DEVEIATTNPVAYECWGSVYIAENDQQQGGFNNP

SEQ ID NO: 176318 - protein, 35 aa, Artificial Sequence
  Description of Artificial Sequence: Synthetic polypeptide
SEEEIRTTNPVAYEQWGHNNVSYWEEQQHRPGDAH

SEQ ID NO: 176319 - protein, 34 aa, Artificial Sequence
  Description of Artificial Sequence: Synthetic polypeptide
DEVEIATTNPVAYECWGSVYIAENDTQQDGGNDD

SEQ ID NO: 176320 - protein, 34 aa, Artificial Sequence
  Description of Artificial Sequence: Synthetic polypeptide
DEVEIATTNPVAYECWGSVYIAETDDQQDGGNGI

SEQ ID NO: 176321 - protein, 35 aa, Artificial Sequence
  Description of Artificial Sequence: Synthetic polypeptide
DEVEIATTNPVAYECWGVVCSTDNGNQEQDGDGRR

SEQ ID NO: 176322 - protein, 34 aa, Artificial Sequence
  Description of Artificial Sequence: Synthetic polypeptide
DENEIRTTNPVSTEGYGTISWEDHQQEQFGGNQS

SEQ ID NO: 176323 - protein, 37 aa, Artificial Sequence
  Description of Artificial Sequence: Synthetic polypeptide
DEAEIRTTNPVATEQYGSLFWSYTAPINDLEINDDQE

SEQ ID NO: 176324 - protein, 34 aa, Artificial Sequence
  Description of Artificial Sequence: Synthetic polypeptide
DEDEIATTNPVATAQWGGCVASGANDDTRHNEDA

SEQ ID NO: 176325 - protein, 37 aa, Artificial Sequence
  Description of Artificial Sequence: Synthetic polypeptide
DEEEISTTNPVATEQYGCVCSTWGEHNAENFNSDTQS

SEQ ID NO: 176326 - protein, 38 aa, Artificial Sequence
  Description of Artificial Sequence: Synthetic polypeptide
DESEIRTTNPVATECYGSVVSNMNLVGDDQDQNDDDGD

SEQ ID NO: 176327 - protein, 33 aa, Artificial Sequence
  Description of Artificial Sequence: Synthetic polypeptide
CEDEIACTNPVAYEQYGSVAATHLTGTPDGSEN

SEQ ID NO: 176328 - protein, 37 aa, Artificial Sequence
  Description of Artificial Sequence: Synthetic polypeptide
DEEEIRTTNPVATEQYGCVCSNWEEHNQEYFNSDTQS

SEQ ID NO: 176329 - protein, 34 aa, Artificial Sequence
  Description of Artificial Sequence: Synthetic polypeptide
DETEIATTNPVATEQWGCVAGTGQPDNQMGGELH

SEQ ID NO: 176330 - protein, 30 aa, Artificial Sequence
  Description of Artificial Sequence: Synthetic polypeptide
DETEIATTNPVATEQWGEAPEEVWAEHEPK

SEQ ID NO: 176331 - protein, 30 aa, Artificial Sequence
  Description of Artificial Sequence: Synthetic polypeptide
DETEIATTNPVATEQWGETPEEVWAEHEPK

SEQ ID NO: 176332 - protein, 36 aa, Artificial Sequence
  Description of Artificial Sequence: Synthetic polypeptide
VEEEIRTTNPVATEQYGSVIVDDGEFLEMEGDGEEE

SEQ ID NO: 176333 - protein, 38 aa, Artificial Sequence
  Description of Artificial Sequence: Synthetic polypeptide
DEEEIRTTNPVATEQYGCSCSTWGEDDNAENFNSDTQS

SEQ ID NO: 176334 - protein, 35 aa, Artificial Sequence
  Description of Artificial Sequence: Synthetic polypeptide
DETEIATTNPVATEQWGHCNVAATNGLPAGAPGGP

SEQ ID NO: 176335 - protein, 34 aa, Artificial Sequence
  Description of Artificial Sequence: Synthetic polypeptide
DETEIATTNPVATEQWGNVAGPPEPGQEHNNQRE

SEQ ID NO: 176336 - protein, 34 aa, Artificial Sequence
  Description of Artificial Sequence: Synthetic polypeptide
DETEIATTNPVATEQWGNVAGSGNPANPNPGAQP

SEQ ID NO: 176337 - protein, 33 aa, Artificial Sequence
  Description of Artificial Sequence: Synthetic polypeptide
DENEIRTTNPVSYEPYPGTISMEDIQAQQNGNH

SEQ ID NO: 176338 - protein, 35 aa, Artificial Sequence
  Description of Artificial Sequence: Synthetic polypeptide
DETEIATTNPVATEQWGSVAGPAGEPGQEHNNQRE

SEQ ID NO: 176339 - protein, 37 aa, Artificial Sequence
  Description of Artificial Sequence: Synthetic polypeptide
DEEEIRTTNPVATEQYGCVCSNWEEHNTENFGSDTQS

SEQ ID NO: 176340 - protein, 34 aa, Artificial Sequence
  Description of Artificial Sequence: Synthetic polypeptide
DENEIRTTNPVSYEPYGTVISMEDMHSQQQNGNH

SEQ ID NO: 176341 - protein, 34 aa, Artificial Sequence
  Description of Artificial Sequence: Synthetic polypeptide
DENEIRTTNPVSYEPYGTVISMEDISQQQTGGNH

SEQ ID NO: 176342 - protein, 35 aa, Artificial Sequence
  Description of Artificial Sequence: Synthetic polypeptide
DETEIATTNPVATEQWGSVAITNAPEPTGDGDSEM

SEQ ID NO: 176343 - protein, 36 aa, Artificial Sequence
  Description of Artificial Sequence: Synthetic polypeptide
DEEEIRTTNPVATEQYGCVCSNWEEHQEFFISDTQS

SEQ ID NO: 176344 - protein, 35 aa, Artificial Sequence
  Description of Artificial Sequence: Synthetic polypeptide
DENEIRTTNPVSYEPYGTVIPSMNDISQQQNGGNH

SEQ ID NO: 176345 - protein, 35 aa, Artificial Sequence
  Description of Artificial Sequence: Synthetic polypeptide
DEQEIATTNPVATEQYGCSSAANTHGPEAGNMENN

SEQ ID NO: 176346 - protein, 33 aa, Artificial Sequence
  Description of Artificial Sequence: Synthetic polypeptide
DENEIRTTNPVSYEPYGTISMEHEISQQQNGNH

SEQ ID NO: 176347 - protein, 33 aa, Artificial Sequence
  Description of Artificial Sequence: Synthetic polypeptide
DENEIRTTNPVSYEPYGTISMEDISQQQNGNND

SEQ ID NO: 176348 - protein, 37 aa, Artificial Sequence
  Description of Artificial Sequence: Synthetic polypeptide
DETEIATTNPVATEQWGSVSAQATPGNQTAGNPNIEN

SEQ ID NO: 176349 - protein, 33 aa, Artificial Sequence
  Description of Artificial Sequence: Synthetic polypeptide
DENEIRTTNPVSYEPYGTISMEDIQQQQNGNHF

SEQ ID NO: 176350 - protein, 35 aa, Artificial Sequence
  Description of Artificial Sequence: Synthetic polypeptide
DEDEIATTNPVAYEQWGSITSAAGTLQRQTPNVEG

SEQ ID NO: 176351 - protein, 37 aa, Artificial Sequence
  Description of Artificial Sequence: Synthetic polypeptide
DEEEIRTTNPVATEQYGCVCSNWEEHNQEHFNSDPQS

SEQ ID NO: 176352 - protein, 33 aa, Artificial Sequence
  Description of Artificial Sequence: Synthetic polypeptide
DENEIRTTNPVSYEPYGTISCMEDISQQQNGNQ

SEQ ID NO: 176353 - protein, 37 aa, Artificial Sequence
  Description of Artificial Sequence: Synthetic polypeptide
DEEEISTTNPVATEQYGCVCSNSGEDHNANFGSENQS

SEQ ID NO: 176354 - protein, 37 aa, Artificial Sequence
  Description of Artificial Sequence: Synthetic polypeptide
DEEEIRTTNPVATEQYGCVCSNWEEHNQEFFISDNQY

SEQ ID NO: 176355 - protein, 36 aa, Artificial Sequence
  Description of Artificial Sequence: Synthetic polypeptide
DEEEIRTTNPVATEQYGCSCSWMEDDNQENFDSEQS

SEQ ID NO: 176356 - protein, 38 aa, Artificial Sequence
  Description of Artificial Sequence: Synthetic polypeptide
DEEEIRTTNPVATEQYGCVCSNWEEDHNQEFFGSDNQS

SEQ ID NO: 176357 - protein, 36 aa, Artificial Sequence
  Description of Artificial Sequence: Synthetic polypeptide
DEEEIRTTNPVATEQYGCSCSWGEDPNQNFDSQTQS

SEQ ID NO: 176358 - protein, 37 aa, Artificial Sequence
  Description of Artificial Sequence: Synthetic polypeptide
DEEEIRTTNPVATEQYGCSCSWGAPHNQENFNSDNQA

SEQ ID NO: 176359 - protein, 38 aa, Artificial Sequence
  Description of Artificial Sequence: Synthetic polypeptide
DEEEIRTTNPVATEQYGCVCSNWEEDHNQENFGSENQF

SEQ ID NO: 176360 - protein, 33 aa, Artificial Sequence
  Description of Artificial Sequence: Synthetic polypeptide
DENEIRYTNPVSTEPYGTISMEDIQQQQNGNIH

SEQ ID NO: 176361 - protein, 37 aa, Artificial Sequence
  Description of Artificial Sequence: Synthetic polypeptide
DEEEIRTTNPVATEQYGCVCSNWEEDHNQENFNSQQA

SEQ ID NO: 176362 - protein, 36 aa, Artificial Sequence
  Description of Artificial Sequence: Synthetic polypeptide
DETEIATTNPVATECYGTVAATWNDGDERNGGGGRR

SEQ ID NO: 176363 - protein, 37 aa, Artificial Sequence
  Description of Artificial Sequence: Synthetic polypeptide
DEEEIRTTNPVATEQYGCVCSNWEEDNEENFNSDTQS

SEQ ID NO: 176364 - protein, 33 aa, Artificial Sequence
  Description of Artificial Sequence: Synthetic polypeptide
DENEIRTVNPVSTEPYGTISMEDKIQQQQNGNH

SEQ ID NO: 176365 - protein, 33 aa, Artificial Sequence
  Description of Artificial Sequence: Synthetic polypeptide
DENEIRTVNPVSTEPYGTISMEDIQQQQNGNMH

SEQ ID NO: 176366 - protein, 32 aa, Artificial Sequence
  Description of Artificial Sequence: Synthetic polypeptide
DENEIRTVNPVSTEPYGTISMEDIQQQQNGLH

SEQ ID NO: 176367 - protein, 33 aa, Artificial Sequence
  Description of Artificial Sequence: Synthetic polypeptide
DENEIRTVNPVSTEPYGTISGMEDIQQQQNGNH

SEQ ID NO: 176368 - protein, 31 aa, Artificial Sequence
  Description of Artificial Sequence: Synthetic polypeptide
AESEIASTNPVGTEGYGVSCGSELQHGSDQS

SEQ ID NO: 176369 - protein, 30 aa, Artificial Sequence
  Description of Artificial Sequence: Synthetic polypeptide
TESEIASTNPVGYERYGVCASTLSQHGGDI

SEQ ID NO: 176370 - protein, 36 aa, Artificial Sequence
  Description of Artificial Sequence: Synthetic polypeptide
DEEEIRTTNPVATEQYGCVCSNWEEHAEHFNSDTQT

SEQ ID NO: 176371 - protein, 30 aa, Artificial Sequence
  Description of Artificial Sequence: Synthetic polypeptide
DETEIATTNPVATEQWGATPEEDWAEHEPK

SEQ ID NO: 176372 - protein, 36 aa, Artificial Sequence
  Description of Artificial Sequence: Synthetic polypeptide
DEEEIRTTNPVATEQYGCVCSNWEEHDQENFISDQA

SEQ ID NO: 176373 - protein, 30 aa, Artificial Sequence
  Description of Artificial Sequence: Synthetic polypeptide
DETEIATTNPVATEQWGATPEEVWAEHEPK

SEQ ID NO: 176374 - protein, 37 aa, Artificial Sequence
  Description of Artificial Sequence: Synthetic polypeptide
DEEEIRTTNPVATEQYGCVCSNWEEHNAEGFNSDNQT

SEQ ID NO: 176375 - protein, 37 aa, Artificial Sequence
  Description of Artificial Sequence: Synthetic polypeptide
DEEEIRTTNPVATEQYGCVCSNWEEHNAENFGSETQS

SEQ ID NO: 176376 - protein, 35 aa, Artificial Sequence
  Description of Artificial Sequence: Synthetic polypeptide
DEAEIRTTNPVATEQYGSVICYHDPTPEIDMEDPL

SEQ ID NO: 176377 - protein, 37 aa, Artificial Sequence
  Description of Artificial Sequence: Synthetic polypeptide
DEEEIRTTNPVATEQYGCVCSNWEEHNAENFNSDTQA

SEQ ID NO: 176378 - protein, 33 aa, Artificial Sequence
  Description of Artificial Sequence: Synthetic polypeptide
DEDEIATTNPVAYEQWGSVCAAANGLLSEVDDS

SEQ ID NO: 176379 - protein, 37 aa, Artificial Sequence
  Description of Artificial Sequence: Synthetic polypeptide
DEEEIRTTNPVATEQYGCVCSNWEEHNQEFFGSDTQA

SEQ ID NO: 176380 - protein, 33 aa, Artificial Sequence
  Description of Artificial Sequence: Synthetic polypeptide
DETEIATTNPVATEQWGCVAGEGEMNAASDNAW

SEQ ID NO: 176381 - protein, 31 aa, Artificial Sequence
  Description of Artificial Sequence: Synthetic polypeptide
TESEIASTNPVGYEGYGVVCASTLSQPGGDI

SEQ ID NO: 176382 - protein, 36 aa, Artificial Sequence
  Description of Artificial Sequence: Synthetic polypeptide
DEEEISTTNPVATEQYGCVCSNSGEDNQENFNSDQM

SEQ ID NO: 176383 - protein, 36 aa, Artificial Sequence
  Description of Artificial Sequence: Synthetic polypeptide
DEEEISTTNPVATEQYGCVCSNSGEDNQFFNSDNQP

SEQ ID NO: 176384 - protein, 36 aa, Artificial Sequence
  Description of Artificial Sequence: Synthetic polypeptide
DEEEISTTNPVATEQYGCVCSNSGEHNQEYFGSDQS

SEQ ID NO: 176385 - protein, 35 aa, Artificial Sequence
  Description of Artificial Sequence: Synthetic polypeptide
DETEIATTNPVATEQYGCSAANGLGATMPGGEPRQ

SEQ ID NO: 176386 - protein, 35 aa, Artificial Sequence
  Description of Artificial Sequence: Synthetic polypeptide
DETEIATTNPVATEQYGCVAANGDGATMPPGDPRH

SEQ ID NO: 176387 - protein, 35 aa, Artificial Sequence
  Description of Artificial Sequence: Synthetic polypeptide
CEEEIRTTNPVATEQYGCVCSWEEHAENFNSDTQD

SEQ ID NO: 176388 - protein, 36 aa, Artificial Sequence
  Description of Artificial Sequence: Synthetic polypeptide
DEEEISTTNPVATEQYGCVCSNSGEHNQGFGSDTQA

SEQ ID NO: 176389 - protein, 36 aa, Artificial Sequence
  Description of Artificial Sequence: Synthetic polypeptide
DEEEISTTNPVATEQYGCVCSNSGEHNQHFNSDTQL

SEQ ID NO: 176390 - protein, 35 aa, Artificial Sequence
  Description of Artificial Sequence: Synthetic polypeptide
DETEIATTNPVATEQYGCVAANNGLEATMNPEDNH

SEQ ID NO: 176391 - protein, 34 aa, Artificial Sequence
  Description of Artificial Sequence: Synthetic polypeptide
DETEIATTNPVATEQYGCVAANPPDATMPPGEHH

SEQ ID NO: 176392 - protein, 36 aa, Artificial Sequence
  Description of Artificial Sequence: Synthetic polypeptide
DEEEISTTNPVATEQYGCVCSNSGEHNQNFPSDNQS

SEQ ID NO: 176393 - protein, 36 aa, Artificial Sequence
  Description of Artificial Sequence: Synthetic polypeptide
DEEEISTTNPVATEQYGCVCSNSMEHNQEHFNSDQD

SEQ ID NO: 176394 - protein, 32 aa, Artificial Sequence
  Description of Artificial Sequence: Synthetic polypeptide
DENNIRATNPVSTEPYGTISMEDIQQQQNGNH

SEQ ID NO: 176395 - protein, 37 aa, Artificial Sequence
  Description of Artificial Sequence: Synthetic polypeptide
DEEEISTTNPVATEQYGCVCSNSNEHNQENFMSDNQS

SEQ ID NO: 176396 - protein, 36 aa, Artificial Sequence
  Description of Artificial Sequence: Synthetic polypeptide
DETEIATTNPVATEQYGSACAANPIEEDTGGDNDRP

SEQ ID NO: 176397 - protein, 36 aa, Artificial Sequence
  Description of Artificial Sequence: Synthetic polypeptide
DETEIATTNPVATEQYGSACAATNGEAPDTQMGTFM

SEQ ID NO: 176398 - protein, 37 aa, Artificial Sequence
  Description of Artificial Sequence: Synthetic polypeptide
DETEIATTNPVATEQYGSACAATNHQEAGDSGMGNHM

SEQ ID NO: 176399 - protein, 37 aa, Artificial Sequence
  Description of Artificial Sequence: Synthetic polypeptide
DETEIATTNPVATEQYGSACAATNPQEAGASGMGNKM

SEQ ID NO: 176400 - protein, 36 aa, Artificial Sequence
  Description of Artificial Sequence: Synthetic polypeptide
DETEIATTNPVATEQYGSACPMNHNGPLDSGEGNHH

SEQ ID NO: 176401 - protein, 38 aa, Artificial Sequence
  Description of Artificial Sequence: Synthetic polypeptide
DEEEIRTTNPVAYEQYGESVCPSVNDELFSRVEEPLVV

SEQ ID NO: 176402 - protein, 37 aa, Artificial Sequence
  Description of Artificial Sequence: Synthetic polypeptide
DETEIATTNPVATEQYGSACSAANPGPLDSMIGNDID

SEQ ID NO: 176403 - protein, 36 aa, Artificial Sequence
  Description of Artificial Sequence: Synthetic polypeptide
DETEIATTNPVATEQYGSACSANPAPADAEIGNDTA

SEQ ID NO: 176404 - protein, 36 aa, Artificial Sequence
  Description of Artificial Sequence: Synthetic polypeptide
DETEIATTNPVATEQYGSACSANPNLQDSPDEQAGE

SEQ ID NO: 176405 - protein, 37 aa, Artificial Sequence
  Description of Artificial Sequence: Synthetic polypeptide
DETEIATTNPVATEQYGSACSATNPQEVNDDGMGDDH

SEQ ID NO: 176406 - protein, 36 aa, Artificial Sequence
  Description of Artificial Sequence: Synthetic polypeptide
DETEIATTNPVATEQYGSTACAGANPDLPLGSEGNH

SEQ ID NO: 176407 - protein, 36 aa, Artificial Sequence
  Description of Artificial Sequence: Synthetic polypeptide
DETEIATTNPVATEQYGSTCAANNNEEAPDNQEGNH

SEQ ID NO: 176408 - protein, 34 aa, Artificial Sequence
  Description of Artificial Sequence: Synthetic polypeptide
DETEIATTNPVATEQYGSTVAAAEDWADHKGEYL

SEQ ID NO: 176409 - protein, 36 aa, Artificial Sequence
  Description of Artificial Sequence: Synthetic polypeptide
DEEEIRTTNPVAYEQYGQCVCSSMEDHNQHFGSEQA

SEQ ID NO: 176410 - protein, 34 aa, Artificial Sequence
  Description of Artificial Sequence: Synthetic polypeptide
DEDEIATTNPVAYEQWGSIITSAANQLDSNNPPP

SEQ ID NO: 176411 - protein, 34 aa, Artificial Sequence
  Description of Artificial Sequence: Synthetic polypeptide
CEDEIATTNPVATEMWGSVAMNLENPADQTEGDN

SEQ ID NO: 176412 - protein, 36 aa, Artificial Sequence
  Description of Artificial Sequence: Synthetic polypeptide
DEEEISTTNPVATEQYGCVCSNSGEHNQENGGSDQS

SEQ ID NO: 176413 - protein, 35 aa, Artificial Sequence
  Description of Artificial Sequence: Synthetic polypeptide
DEEEISTTNPVATEQYGCVCSNSGEDTEFFGSEQG

SEQ ID NO: 176414 - protein, 36 aa, Artificial Sequence
  Description of Artificial Sequence: Synthetic polypeptide
TEEEIRTTNPVATEQYGSVSPYVSKAQWMHVEHPPI

SEQ ID NO: 176415 - protein, 32 aa, Artificial Sequence
  Description of Artificial Sequence: Synthetic polypeptide
DDSEVAPTNPVSTEGYGNVAANQTIQSRVGQR

SEQ ID NO: 176416 - protein, 37 aa, Artificial Sequence
  Description of Artificial Sequence: Synthetic polypeptide
DEEEISTTNPVATEQYGCVCSNSGEHNAEFFGSDNQA

SEQ ID NO: 176417 - protein, 34 aa, Artificial Sequence
  Description of Artificial Sequence: Synthetic polypeptide
DETEIATTNPVATEQWGSVSGEGPGIANAGHDHI

SEQ ID NO: 176418 - protein, 32 aa, Artificial Sequence
  Description of Artificial Sequence: Synthetic polypeptide
DENEIRTTNPVSYEPWGTCSHEDIQQQQNGNH

SEQ ID NO: 176419 - protein, 38 aa, Artificial Sequence
  Description of Artificial Sequence: Synthetic polypeptide
VEEEIRTTNPVATEQYGSVMSGINFDIEGEIAGENGDV

SEQ ID NO: 176420 - protein, 35 aa, Artificial Sequence
  Description of Artificial Sequence: Synthetic polypeptide
CEDEIACTNPVAYEQYGSVCSTNPQQEHQDGTEMK

SEQ ID NO: 176421 - protein, 35 aa, Artificial Sequence
  Description of Artificial Sequence: Synthetic polypeptide
DEEEISTTNPEATEQYGCVCPSGEDNAENFGSDQS

SEQ ID NO: 176422 - protein, 37 aa, Artificial Sequence
  Description of Artificial Sequence: Synthetic polypeptide
DEEEISTTNPVATEQYGCVCSNSGEHNAENGNSDNQL

SEQ ID NO: 176423 - protein, 36 aa, Artificial Sequence
  Description of Artificial Sequence: Synthetic polypeptide
TEEEIRTTNPVATEQYGSVSPDVSMKAGMHYEHPPI

SEQ ID NO: 176424 - protein, 36 aa, Artificial Sequence
  Description of Artificial Sequence: Synthetic polypeptide
CEEEIRTTNPVATEQYGCVCSWEEHNEEHFNSDTQA

SEQ ID NO: 176425 - protein, 36 aa, Artificial Sequence
  Description of Artificial Sequence: Synthetic polypeptide
DEEEISTTNPVATEQYGCVCSNSGEHNANFGSETQS

SEQ ID NO: 176426 - protein, 35 aa, Artificial Sequence
  Description of Artificial Sequence: Synthetic polypeptide
DEEEISTTNPVATEQYGCVCSNSGEHNEGFLSEQA

SEQ ID NO: 176427 - protein, 38 aa, Artificial Sequence
  Description of Artificial Sequence: Synthetic polypeptide
DEEEIRTTNPVATEAYGVVSTTNQNQNDEQGTTDEEED

SEQ ID NO: 176428 - protein, 35 aa, Artificial Sequence
  Description of Artificial Sequence: Synthetic polypeptide
DETEIATTNPVATEQWGSVVAGNNPTQPDNLEGAP

SEQ ID NO: 176429 - protein, 33 aa, Artificial Sequence
  Description of Artificial Sequence: Synthetic polypeptide
DESEVRSTNPVSTEGYGNVAANNIPQSRVGEQG

SEQ ID NO: 176430 - protein, 36 aa, Artificial Sequence
  Description of Artificial Sequence: Synthetic polypeptide
TEEEIRTTNPVATEQYGSVSPDVSKAGAMHFEHPPI

SEQ ID NO: 176431 - protein, 36 aa, Artificial Sequence
  Description of Artificial Sequence: Synthetic polypeptide
TEEEIRTTNPVATEQYGSVSPDVSCKAQMHSEHPPI

SEQ ID NO: 176432 - protein, 37 aa, Artificial Sequence
  Description of Artificial Sequence: Synthetic polypeptide
DEEEISTTNPVATEQYGCVCSNSGEHNQENFGSDNQA

SEQ ID NO: 176433 - protein, 37 aa, Artificial Sequence
  Description of Artificial Sequence: Synthetic polypeptide
DEEEISTTNPVATEQYGCVCSNSGEHNQENFGSDNQI

SEQ ID NO: 176434 - protein, 35 aa, Artificial Sequence
  Description of Artificial Sequence: Synthetic polypeptide
DENNEIATTNPVAYEQYGTVCCTENDQDDQGDQGQ

SEQ ID NO: 176435 - protein, 37 aa, Artificial Sequence
  Description of Artificial Sequence: Synthetic polypeptide
DEEEIRTTNPVAYEQYGQCVCSSGNDDNQEYFNSQQS

SEQ ID NO: 176436 - protein, 34 aa, Artificial Sequence
  Description of Artificial Sequence: Synthetic polypeptide
DETEIATTNPVATEQYGATTSNAEDLEDHEGEYL

SEQ ID NO: 176437 - protein, 35 aa, Artificial Sequence
  Description of Artificial Sequence: Synthetic polypeptide
CEDEIATTNPVATEMWGSVAHAQPTNPGNQTEGNN

SEQ ID NO: 176438 - protein, 36 aa, Artificial Sequence
  Description of Artificial Sequence: Synthetic polypeptide
DETEIATTNPVATEQYGAVCQTNDQGQQQQGDGEHE

SEQ ID NO: 176439 - protein, 36 aa, Artificial Sequence
  Description of Artificial Sequence: Synthetic polypeptide
DETEIATTNPVATECWGVVSKTNNPLDDRQNGDGDS

SEQ ID NO: 176440 - protein, 33 aa, Artificial Sequence
  Description of Artificial Sequence: Synthetic polypeptide
DETEIATTNPVATECWGAVWSATDWEEHKGPDL

SEQ ID NO: 176441 - protein, 32 aa, Artificial Sequence
  Description of Artificial Sequence: Synthetic polypeptide
DETEIATTNPVATECWGATWANEEDWARGPYI

SEQ ID NO: 176442 - protein, 34 aa, Artificial Sequence
  Description of Artificial Sequence: Synthetic polypeptide
AEEEICTTNPVATEQYGVVATVVEGVEQGEDEDE

SEQ ID NO: 176443 - protein, 39 aa, Artificial Sequence
  Description of Artificial Sequence: Synthetic polypeptide
DEEEIRTTNPVATEAYGTVSTQYGNSEAGTTSEQTTGNT

SEQ ID NO: 176444 - protein, 39 aa, Artificial Sequence
  Description of Artificial Sequence: Synthetic polypeptide
DEEEIRTTNPVATEAYGTVSTQYGNSDTITTSIQTTGNT

SEQ ID NO: 176445 - protein, 38 aa, Artificial Sequence
  Description of Artificial Sequence: Synthetic polypeptide
DEAEIRTTNPVATEQYGSVVSMSGIMLEELFNGNEEVN

SEQ ID NO: 176446 - protein, 38 aa, Artificial Sequence
  Description of Artificial Sequence: Synthetic polypeptide
DEAEIRTTNPVATEQYGSVVSPSSIMLEELFNGNEEPF

SEQ ID NO: 176447 - protein, 36 aa, Artificial Sequence
  Description of Artificial Sequence: Synthetic polypeptide
DEEEISTTNPVATEQYGCVCSMWEHNAEHFNSDNQS

SEQ ID NO: 176448 - protein, 32 aa, Artificial Sequence
  Description of Artificial Sequence: Synthetic polypeptide
TESEIASTNPVGTENYGVIASTELSQSTGGTI

SEQ ID NO: 176449 - protein, 39 aa, Artificial Sequence
  Description of Artificial Sequence: Synthetic polypeptide
DEEEIRTTNPVATEAYGTVSTQAGNSEAGTVSIQTTGNT

SEQ ID NO: 176450 - protein, 34 aa, Artificial Sequence
  Description of Artificial Sequence: Synthetic polypeptide
DESEIRTTNPVATEGWGCVCSWMYENQENFGSDQ

SEQ ID NO: 176451 - protein, 39 aa, Artificial Sequence
  Description of Artificial Sequence: Synthetic polypeptide
DEEEIRTTNPVATEAYGTVSTNGNSTQIGTTSISTTNNT

SEQ ID NO: 176452 - protein, 36 aa, Artificial Sequence
  Description of Artificial Sequence: Synthetic polypeptide
AEEEICTTNPVATEQYGVVATVVNTGEQQGTEDEEE

SEQ ID NO: 176453 - protein, 37 aa, Artificial Sequence
  Description of Artificial Sequence: Synthetic polypeptide
DEEEIRTTNPVAYEQYGQCVCSNWGEHNQNFGSENQF

SEQ ID NO: 176454 - protein, 35 aa, Artificial Sequence
  Description of Artificial Sequence: Synthetic polypeptide
DESEIRTTNPVATEGWGCVCSWMNDNQEYSGSDQA

SEQ ID NO: 176455 - protein, 36 aa, Artificial Sequence
  Description of Artificial Sequence: Synthetic polypeptide
DEEEISTTNPVATEQYGCVCSMWEHNQENFNSDNIA

SEQ ID NO: 176456 - protein, 34 aa, Artificial Sequence
  Description of Artificial Sequence: Synthetic polypeptide
DESEIRTTNPVATEGWGCVCSWMEPNQDHFGSDQ

SEQ ID NO: 176457 - protein, 31 aa, Artificial Sequence
  Description of Artificial Sequence: Synthetic polypeptide
TESEIASTNPVGTEPYGVMACSTLSQHGGDI

SEQ ID NO: 176458 - protein, 34 aa, Artificial Sequence
  Description of Artificial Sequence: Synthetic polypeptide
DETEIATTNPIATEQWGATWSNEENWQEPKGPYR

SEQ ID NO: 176459 - protein, 37 aa, Artificial Sequence
  Description of Artificial Sequence: Synthetic polypeptide
TEEEIRTTNPVATEQYGSYVISPDVSVAQMHGVHPPI

SEQ ID NO: 176460 - protein, 38 aa, Artificial Sequence
  Description of Artificial Sequence: Synthetic polypeptide
TEEEIRTTNPVATEQYGSYVEPTVDNSPEASEGMENIL

SEQ ID NO: 176461 - protein, 36 aa, Artificial Sequence
  Description of Artificial Sequence: Synthetic polypeptide
TEEEIRTTNPVATEQYGSYIHNTSLEDHNGESDEQC

SEQ ID NO: 176462 - protein, 37 aa, Artificial Sequence
  Description of Artificial Sequence: Synthetic polypeptide
DEEEISTTNPVATEQYGCVCSMWEMHEQENFGSDNQA

SEQ ID NO: 176463 - protein, 36 aa, Artificial Sequence
  Description of Artificial Sequence: Synthetic polypeptide
TEEEIRTTNPVATEQYGSVYPLMDGEEQMIMNAEEL

SEQ ID NO: 176464 - protein, 33 aa, Artificial Sequence
  Description of Artificial Sequence: Synthetic polypeptide
DENIIRTTNPVSTEPYGTISWMEDIQQQQNGNH

SEQ ID NO: 176465 - protein, 38 aa, Artificial Sequence
  Description of Artificial Sequence: Synthetic polypeptide
DEEEIRTTNPVAYEQYGQCVCSNWENDDNQNFGSDNQS

SEQ ID NO: 176466 - protein, 35 aa, Artificial Sequence
  Description of Artificial Sequence: Synthetic polypeptide
DESEIRTTNPVATEGWGCVCSWMEENQERFGSDQF

SEQ ID NO: 176467 - protein, 35 aa, Artificial Sequence
  Description of Artificial Sequence: Synthetic polypeptide
DETEIATTNPIATECYGSTVWSNTEDLEEHKGPYI

SEQ ID NO: 176468 - protein, 30 aa, Artificial Sequence
  Description of Artificial Sequence: Synthetic polypeptide
DETEIATTNPIATEQYGEAWPEVWAHKEEK

SEQ ID NO: 176469 - protein, 35 aa, Artificial Sequence
  Description of Artificial Sequence: Synthetic polypeptide
DETEIATTNPIATECYGSTVWSNTEDLEEHKGEYI

SEQ ID NO: 176470 - protein, 38 aa, Artificial Sequence
  Description of Artificial Sequence: Synthetic polypeptide
DEEEIRTTNPVATEAYGTVSTSGNSEIGTTSISTEGNT

SEQ ID NO: 176471 - protein, 37 aa, Artificial Sequence
  Description of Artificial Sequence: Synthetic polypeptide
VEEEIRTTNPVATEQYGDVVYSDGILGGQEEQGGELT

SEQ ID NO: 176472 - protein, 37 aa, Artificial Sequence
  Description of Artificial Sequence: Synthetic polypeptide
AEEEICTTNPVATEQYGVVATVNNQQGNQQGTEDEEQ

SEQ ID NO: 176473 - protein, 38 aa, Artificial Sequence
  Description of Artificial Sequence: Synthetic polypeptide
DEDEIRTTNPVATEAYGVVSTNGNQQQSAEQGTTNTDD

SEQ ID NO: 176474 - protein, 36 aa, Artificial Sequence
  Description of Artificial Sequence: Synthetic polypeptide
CEEEIRTTNPVATEQYGCVCSWEEHNEENFISDNQG

SEQ ID NO: 176475 - protein, 36 aa, Artificial Sequence
  Description of Artificial Sequence: Synthetic polypeptide
DEEEISTTNPVATEQYGCVCSMTGEHNQNFISDTQN

SEQ ID NO: 176476 - protein, 36 aa, Artificial Sequence
  Description of Artificial Sequence: Synthetic polypeptide
TEEEIRTTNPVATESYGSVDNDENDQGQENQGGEEI

SEQ ID NO: 176477 - protein, 35 aa, Artificial Sequence
  Description of Artificial Sequence: Synthetic polypeptide
DEEEIRTTNPVSYEQWGSCYTIDNHGQNGGGDTGS

SEQ ID NO: 176478 - protein, 31 aa, Artificial Sequence
  Description of Artificial Sequence: Synthetic polypeptide
DETEIATTNPIATECWGVMWASEDWQEHGPI

SEQ ID NO: 176479 - protein, 39 aa, Artificial Sequence
  Description of Artificial Sequence: Synthetic polypeptide
DEDEIRTTNPVATEAYGSVSVTVTNLQQSAEQGTTTTTD

SEQ ID NO: 176480 - protein, 37 aa, Artificial Sequence
  Description of Artificial Sequence: Synthetic polypeptide
AEEEICTTNPVATEQYGVVATVNQQQGEQQGTNDETE

SEQ ID NO: 176481 - protein, 37 aa, Artificial Sequence
  Description of Artificial Sequence: Synthetic polypeptide
AEEEICTTNPVATEQYGVVATVNQQQGNQQGTEDEDE

SEQ ID NO: 176482 - protein, 38 aa, Artificial Sequence
  Description of Artificial Sequence: Synthetic polypeptide
DEAEIRTTNPVATEQYGSVVSDSSIMSEELFNGNEEVF

SEQ ID NO: 176483 - protein, 35 aa, Artificial Sequence
  Description of Artificial Sequence: Synthetic polypeptide
AEEEICTTNPVATEQYGVVATVQEQVGEQGEDEEE

SEQ ID NO: 176484 - protein, 35 aa, Artificial Sequence
  Description of Artificial Sequence: Synthetic polypeptide
AEEEICTTNPVATEQYGVVATVQQQVAEQGTEESE

SEQ ID NO: 176485 - protein, 34 aa, Artificial Sequence
  Description of Artificial Sequence: Synthetic polypeptide
AEEEICTTNPVATEQYGVVATVTEGVEQGEDEEQ

SEQ ID NO: 176486 - protein, 32 aa, Artificial Sequence
  Description of Artificial Sequence: Synthetic polypeptide
TESEIASTNPVGTEHYGVIASTELSQVTGGDI

SEQ ID NO: 176487 - protein, 37 aa, Artificial Sequence
  Description of Artificial Sequence: Synthetic polypeptide
DEEEISTTNPVATEQYGCVCSMTMEDHQEYFGSDTQS

SEQ ID NO: 176488 - protein, 37 aa, Artificial Sequence
  Description of Artificial Sequence: Synthetic polypeptide
DEEEISTTNPVATEQYGCVCSMTMEHNQENFGSDTQG

SEQ ID NO: 176489 - protein, 35 aa, Artificial Sequence
  Description of Artificial Sequence: Synthetic polypeptide
AEEEICTTNPVATEQYGVVATVTEQGAEQGEETEE

SEQ ID NO: 176490 - protein, 35 aa, Artificial Sequence
  Description of Artificial Sequence: Synthetic polypeptide
AEEEICTTNPVATEQYGVVATVTEQVAEQGEEEGE

SEQ ID NO: 176491 - protein, 35 aa, Artificial Sequence
  Description of Artificial Sequence: Synthetic polypeptide
DESEIRTTNPVATEGWGQCVCSWMEENQEYFGSNQ

SEQ ID NO: 176492 - protein, 33 aa, Artificial Sequence
  Description of Artificial Sequence: Synthetic polypeptide
DETEIATTNPIATECYGATWANEEDLAEPKGPR

SEQ ID NO: 176493 - protein, 33 aa, Artificial Sequence
  Description of Artificial Sequence: Synthetic polypeptide
DENHIRTTNPVSTEPYGTIFSMEDIQQQQNGNH

SEQ ID NO: 176494 - protein, 33 aa, Artificial Sequence
  Description of Artificial Sequence: Synthetic polypeptide
DETEIATTNPIATECYGAVWANCDLAEPKGTYI

SEQ ID NO: 176495 - protein, 33 aa, Artificial Sequence
  Description of Artificial Sequence: Synthetic polypeptide
DETEIATTNPIATECYGAVWANCNLAEPKGTYI

SEQ ID NO: 176496 - protein, 37 aa, Artificial Sequence
  Description of Artificial Sequence: Synthetic polypeptide
VEEEIRTTNPVATEQYGSIGSVTDGDTGQGGEQEGIE

SEQ ID NO: 176497 - protein, 35 aa, Artificial Sequence
  Description of Artificial Sequence: Synthetic polypeptide
DESEIRTTNPVATEGWGCVCSWMEENQEHFGSNQG

SEQ ID NO: 176498 - protein, 37 aa, Artificial Sequence
  Description of Artificial Sequence: Synthetic polypeptide
DEEEISTTNPVATEQYGCVCSMWGEDNQENFGSDNQS

SEQ ID NO: 176499 - protein, 36 aa, Artificial Sequence
  Description of Artificial Sequence: Synthetic polypeptide
VEEEIRTTNPVATEQYGSVDDGNQTGEFTGGGEQGE

SEQ ID NO: 176500 - protein, 39 aa, Artificial Sequence
  Description of Artificial Sequence: Synthetic polypeptide
DEEEIRTTNPVATEAYGTVSTNGNQGTIGTTSISTTGNT

SEQ ID NO: 176501 - protein, 34 aa, Artificial Sequence
  Description of Artificial Sequence: Synthetic polypeptide
DETEIATTNPVATAQWGCVAGTNGLEATANGEFD

SEQ ID NO: 176502 - protein, 37 aa, Artificial Sequence
  Description of Artificial Sequence: Synthetic polypeptide
VEEEIRTTNPVATEQYGSVIEPRVSMQSLGVELNHEI

SEQ ID NO: 176503 - protein, 34 aa, Artificial Sequence
  Description of Artificial Sequence: Synthetic polypeptide
DEQEIATTNPVATEQYGSTVANAEDWADHEGEYL

SEQ ID NO: 176504 - protein, 37 aa, Artificial Sequence
  Description of Artificial Sequence: Synthetic polypeptide
DEEEISTTNPVATEQYGCVCSNSEEHNEENFGSQNQA

SEQ ID NO: 176505 - protein, 36 aa, Artificial Sequence
  Description of Artificial Sequence: Synthetic polypeptide
VEEEIRTTNPVATEQYGSVIEPRVSMSLGVELSPEL

SEQ ID NO: 176506 - protein, 37 aa, Artificial Sequence
  Description of Artificial Sequence: Synthetic polypeptide
DEEEIRTTNPVATEQYGCVCSNWEDHNAENFNSDNQS

SEQ ID NO: 176507 - protein, 33 aa, Artificial Sequence
  Description of Artificial Sequence: Synthetic polypeptide
DETEIATTNPVATAQWGSVAAGHLFTPNPMGFE

SEQ ID NO: 176508 - protein, 32 aa, Artificial Sequence
  Description of Artificial Sequence: Synthetic polypeptide
DENEISTCNPVSTEPYGTISMEDIQQQQNGNH

SEQ ID NO: 176509 - protein, 37 aa, Artificial Sequence
  Description of Artificial Sequence: Synthetic polypeptide
DEEEIRTTNPVATEQYGCVCSNWEDHNQENFNSDNQA

SEQ ID NO: 176510 - protein, 37 aa, Artificial Sequence
  Description of Artificial Sequence: Synthetic polypeptide
DEEEISTTNPVATEQYGCVCSNSEEHNQENFGSDNQS

SEQ ID NO: 176511 - protein, 36 aa, Artificial Sequence
  Description of Artificial Sequence: Synthetic polypeptide
DESEIRTTNPVATEFYGSVDVQGLNIEGQGNEEDIS

SEQ ID NO: 176512 - protein, 33 aa, Artificial Sequence
  Description of Artificial Sequence: Synthetic polypeptide
DETEIATTNPVATAQWGSVSMSGNGGVPPPQFH

SEQ ID NO: 176513 - protein, 36 aa, Artificial Sequence
  Description of Artificial Sequence: Synthetic polypeptide
DEEEIRTTNPVATEQYGCVCSNWEEDAENFGSQTQA

SEQ ID NO: 176514 - protein, 37 aa, Artificial Sequence
  Description of Artificial Sequence: Synthetic polypeptide
DEEEIRTTNPVATEQYGCVCSNWEEDDQENFNSETQP

SEQ ID NO: 176515 - protein, 36 aa, Artificial Sequence
  Description of Artificial Sequence: Synthetic polypeptide
DESEIRTTNPVATEFYGNVVVDGTNEQNFGEEGEMN

SEQ ID NO: 176516 - protein, 38 aa, Artificial Sequence
  Description of Artificial Sequence: Synthetic polypeptide
VEEEIRTTNPVATEQYGSVINCWVNEGQNPRQGELEAL

SEQ ID NO: 176517 - protein, 38 aa, Artificial Sequence
  Description of Artificial Sequence: Synthetic polypeptide
DEEEIRTTNPVATEQYGCVCSNWEEDHNEENFGSDNQA

SEQ ID NO: 176518 - protein, 36 aa, Artificial Sequence
  Description of Artificial Sequence: Synthetic polypeptide
DEEEISTTNPVATEQYGCVCSNSEHNEEGFLSENQA

SEQ ID NO: 176519 - protein, 35 aa, Artificial Sequence
  Description of Artificial Sequence: Synthetic polypeptide
DETEIATTNPVATASWGSVSVANNGPLDHGGENAG

SEQ ID NO: 176520 - protein, 37 aa, Artificial Sequence
  Description of Artificial Sequence: Synthetic polypeptide
DEEEIRTTNPVAYEQYGQCVCSSGADHNQYFGSQNQA

SEQ ID NO: 176521 - protein, 36 aa, Artificial Sequence
  Description of Artificial Sequence: Synthetic polypeptide
DETEIATTNPVATEAWGISVRTWNDDDQDDRRMNTL

SEQ ID NO: 176522 - protein, 36 aa, Artificial Sequence
  Description of Artificial Sequence: Synthetic polypeptide
DEEEISTTNPVATEQYGCVCSNSEHNQEFFNSDTQE

SEQ ID NO: 176523 - protein, 37 aa, Artificial Sequence
  Description of Artificial Sequence: Synthetic polypeptide
DEQEIATTNPVATEQYGSTVSCTAYVSEDHEGGENLE

SEQ ID NO: 176524 - protein, 30 aa, Artificial Sequence
  Description of Artificial Sequence: Synthetic polypeptide
TESEIASTNPVGYEGYGVMPASTLSQHGDI

SEQ ID NO: 176525 - protein, 37 aa, Artificial Sequence
  Description of Artificial Sequence: Synthetic polypeptide
DEEEISTTNPVATEQYGCVCSNSEEDNQENFGSENQS

SEQ ID NO: 176526 - protein, 36 aa, Artificial Sequence
  Description of Artificial Sequence: Synthetic polypeptide
VEEEIRTTNPVATEQYGSVIEPRVPMSLGVEMNAEL

SEQ ID NO: 176527 - protein, 33 aa, Artificial Sequence
  Description of Artificial Sequence: Synthetic polypeptide
DETEIATTNPVATAFWGSVSGPNEPADTAGGEG

SEQ ID NO: 176528 - protein, 36 aa, Artificial Sequence
  Description of Artificial Sequence: Synthetic polypeptide
DEEEISTTNPVATEQYGCVCSMWMEDHANFGSDNQS

SEQ ID NO: 176529 - protein, 36 aa, Artificial Sequence
  Description of Artificial Sequence: Synthetic polypeptide
DEEEISTTNPVATEQYGCVCSMWGEHNAENFGSEQS

SEQ ID NO: 176530 - protein, 38 aa, Artificial Sequence
  Description of Artificial Sequence: Synthetic polypeptide
TEEEIRTTNPVATEQYGSVVSIDQDTGGQGQGGETATV

SEQ ID NO: 176531 - protein, 35 aa, Artificial Sequence
  Description of Artificial Sequence: Synthetic polypeptide
DESEIRTTNPVATEGWGCVCSWGNENQEYSNSDQA

SEQ ID NO: 176532 - protein, 35 aa, Artificial Sequence
  Description of Artificial Sequence: Synthetic polypeptide
DESEIRTTNPVATEGWGCVCSWGNENQDYFGSEQP

SEQ ID NO: 176533 - protein, 38 aa, Artificial Sequence
  Description of Artificial Sequence: Synthetic polypeptide
TEEEIRTTNPVATEQYGSVVNVTDNIAGGNLEGGEEEI

SEQ ID NO: 176534 - protein, 38 aa, Artificial Sequence
  Description of Artificial Sequence: Synthetic polypeptide
TEEEIRTTNPVATEQYGSVVNSTTPTGPEMGQGENEEG

SEQ ID NO: 176535 - protein, 33 aa, Artificial Sequence
  Description of Artificial Sequence: Synthetic polypeptide
DESEVRTTNPVSTEGYGTISAMEDIQQSQVGQR

SEQ ID NO: 176536 - protein, 39 aa, Artificial Sequence
  Description of Artificial Sequence: Synthetic polypeptide
DEDEIRTTNPVATEAYGSVSTTNNNNQESAEQGTTNVTD

SEQ ID NO: 176537 - protein, 37 aa, Artificial Sequence
  Description of Artificial Sequence: Synthetic polypeptide
TEEEIRTTNPVATEQYGSVVGDFNNDGQEEQGEGEQA

SEQ ID NO: 176538 - protein, 36 aa, Artificial Sequence
  Description of Artificial Sequence: Synthetic polypeptide
TEEEIRTTNPVATEQYGSVVCMPANLPNVAEVTDEF

SEQ ID NO: 176539 - protein, 36 aa, Artificial Sequence
  Description of Artificial Sequence: Synthetic polypeptide
DEEEISTTNPVATEQYGCVCSMWGEHNQEHFNSDQG

SEQ ID NO: 176540 - protein, 34 aa, Artificial Sequence
  Description of Artificial Sequence: Synthetic polypeptide
DEDEIATTNPVAYEQYGSVATPHGTGAPGGSMDN

SEQ ID NO: 176541 - protein, 34 aa, Artificial Sequence
  Description of Artificial Sequence: Synthetic polypeptide
DETEIATTNPVATEQYGSTVAAAEDWADHKGPYL

SEQ ID NO: 176542 - protein, 32 aa, Artificial Sequence
  Description of Artificial Sequence: Synthetic polypeptide
DETEIATTNPICTECWGAVWANDDLQEPKGPI

SEQ ID NO: 176543 - protein, 35 aa, Artificial Sequence
  Description of Artificial Sequence: Synthetic polypeptide
DESEIRTTNPVATEGWGCVCSWGEENQEHFGSNTQ

SEQ ID NO: 176544 - protein, 31 aa, Artificial Sequence
  Description of Artificial Sequence: Synthetic polypeptide
TESEIASTNPVGYEGYGVIASTLSQHTGDNI

SEQ ID NO: 176545 - protein, 31 aa, Artificial Sequence
  Description of Artificial Sequence: Synthetic polypeptide
DETEIATTNPICTECYGVTWSNADWQESGPQ

SEQ ID NO: 176546 - protein, 36 aa, Artificial Sequence
  Description of Artificial Sequence: Synthetic polypeptide
DEEEIRTTNPVSTETYGSVSEMVYTAQKTEEVGELN

SEQ ID NO: 176547 - protein, 36 aa, Artificial Sequence
  Description of Artificial Sequence: Synthetic polypeptide
TEEEIRTTNPVATEQYGSVTLPFVLQQPVISSEQVL

SEQ ID NO: 176548 - protein, 37 aa, Artificial Sequence
  Description of Artificial Sequence: Synthetic polypeptide
AEEEICTTNPVATEQYGVVSTVNQQQGEQQGTEDEME

SEQ ID NO: 176549 - protein, 37 aa, Artificial Sequence
  Description of Artificial Sequence: Synthetic polypeptide
DEEEIRTTNPVAYEQYGQCVCSNWMEDLNQGFGSQQA

SEQ ID NO: 176550 - protein, 37 aa, Artificial Sequence
  Description of Artificial Sequence: Synthetic polypeptide
AEEEICTTNPVATEQYGVVSTVVEQAGTEQGTEDEER

SEQ ID NO: 176551 - protein, 35 aa, Artificial Sequence
  Description of Artificial Sequence: Synthetic polypeptide
DESEIRTTNPVATEGWGCVCSNWGNENQEYFGSEQ

SEQ ID NO: 176552 - protein, 37 aa, Artificial Sequence
  Description of Artificial Sequence: Synthetic polypeptide
DEEEIRTTNPVATEQYGCSCSWPEDHNQEYFNSDNQS

SEQ ID NO: 176553 - protein, 37 aa, Artificial Sequence
  Description of Artificial Sequence: Synthetic polypeptide
DEEEIRTTNPVATEQYGCSCSWPEDHNQEHFDSENQS

SEQ ID NO: 176554 - protein, 36 aa, Artificial Sequence
  Description of Artificial Sequence: Synthetic polypeptide
DEEEISTTNPVATEQYGCVCSMWGPHQENFGSDTQS

SEQ ID NO: 176555 - protein, 37 aa, Artificial Sequence
  Description of Artificial Sequence: Synthetic polypeptide
AEEEICTTNPVATEQYGVVSTVNNQQGEQQGTEDEED

SEQ ID NO: 176556 - protein, 36 aa, Artificial Sequence
  Description of Artificial Sequence: Synthetic polypeptide
AEEEICTTNPVATEQYGVVATVNNQQGEQQGTEDET

SEQ ID NO: 176557 - protein, 34 aa, Artificial Sequence
  Description of Artificial Sequence: Synthetic polypeptide
DETEIATTNPVATEQYGSTVANAEDWADHEGEYL

SEQ ID NO: 176558 - protein, 33 aa, Artificial Sequence
  Description of Artificial Sequence: Synthetic polypeptide
DEDEIATTNPVAYEQWGMTATNGLEQGDHDDSS

SEQ ID NO: 176559 - protein, 37 aa, Artificial Sequence
  Description of Artificial Sequence: Synthetic polypeptide
AEEEIRATNPCATEQYGVVSTNNNQQGNQQIGTNNVD

SEQ ID NO: 176560 - protein, 34 aa, Artificial Sequence
  Description of Artificial Sequence: Synthetic polypeptide
DETEIATTNPVAYEQWGSVSQGPPQGETPDGSEN

SEQ ID NO: 176561 - protein, 37 aa, Artificial Sequence
  Description of Artificial Sequence: Synthetic polypeptide
AEEEIRATNPCATEQYGVVSTVNDQAGNQQIGTNATD

SEQ ID NO: 176562 - protein, 37 aa, Artificial Sequence
  Description of Artificial Sequence: Synthetic polypeptide
DEEEISTTNPVATEQYGCVCSNTGEHNIENFNSDNAP

SEQ ID NO: 176563 - protein, 39 aa, Artificial Sequence
  Description of Artificial Sequence: Synthetic polypeptide
DEEEIRTTNPVATEAYGVVSTTNQQQGNNNNQNGTEQGS

SEQ ID NO: 176564 - protein, 35 aa, Artificial Sequence
  Description of Artificial Sequence: Synthetic polypeptide
DENEIRTTNPVSTEPYGTVISCMEDEHSQQQNGNH

SEQ ID NO: 176565 - protein, 32 aa, Artificial Sequence
  Description of Artificial Sequence: Synthetic polypeptide
DDSEVASTNPVSTEGYGDVAANTIQSRVGQQR

SEQ ID NO: 176566 - protein, 32 aa, Artificial Sequence
  Description of Artificial Sequence: Synthetic polypeptide
AESEIACTNPVAYEQWGEYYTIINDQQSGGER

SEQ ID NO: 176567 - protein, 34 aa, Artificial Sequence
  Description of Artificial Sequence: Synthetic polypeptide
DENEIRTTNPVSTEPYGTVCSGMEDQQQQQNDNS

SEQ ID NO: 176568 - protein, 36 aa, Artificial Sequence
  Description of Artificial Sequence: Synthetic polypeptide
DEQEIATTNPVATEQYGSVCAANNGDENGMDINEND

SEQ ID NO: 176569 - protein, 34 aa, Artificial Sequence
  Description of Artificial Sequence: Synthetic polypeptide
DENEIRTTNPVSTEPYGTTTSNMEDIQAQPKGNH

SEQ ID NO: 176570 - protein, 33 aa, Artificial Sequence
  Description of Artificial Sequence: Synthetic polypeptide
DENEIRTTNPVSTEPYGTTSMEDWIQAQANGTH

SEQ ID NO: 176571 - protein, 33 aa, Artificial Sequence
  Description of Artificial Sequence: Synthetic polypeptide
DENEIRTTNPVSTEPYGTTSMEDWDQQQQNDDH

SEQ ID NO: 176572 - protein, 34 aa, Artificial Sequence
  Description of Artificial Sequence: Synthetic polypeptide
DETEIATTNPVAYEQWGSVVCNAAMPREDREDGE

SEQ ID NO: 176573 - protein, 34 aa, Artificial Sequence
  Description of Artificial Sequence: Synthetic polypeptide
DENEIRTTNPVSTEPYGTTSMEDWDQAQQNGNNH

SEQ ID NO: 176574 - protein, 33 aa, Artificial Sequence
  Description of Artificial Sequence: Synthetic polypeptide
DETEIATTNPVAYEQWGTICATDNDETDDNGNH

SEQ ID NO: 176575 - protein, 34 aa, Artificial Sequence
  Description of Artificial Sequence: Synthetic polypeptide
DETEIATTNPVAYEQWGVVVHTDNHNQQQGQIPD

SEQ ID NO: 176576 - protein, 32 aa, Artificial Sequence
  Description of Artificial Sequence: Synthetic polypeptide
AESEIACTNPVAYEGYGQASCEGNLSQTVGGD

SEQ ID NO: 176577 - protein, 36 aa, Artificial Sequence
  Description of Artificial Sequence: Synthetic polypeptide
TEEEIRTTNPVATEQYGSVGDFGNDGQENDDQDLQT

SEQ ID NO: 176578 - protein, 36 aa, Artificial Sequence
  Description of Artificial Sequence: Synthetic polypeptide
DEQEIATTNPVATEQYGSVCAANNGDENGMDINENP

SEQ ID NO: 176579 - protein, 39 aa, Artificial Sequence
  Description of Artificial Sequence: Synthetic polypeptide
DEEEIRTTNPVATEAYGVVSTTNQQQGNNQEQIGTEQGA

SEQ ID NO: 176580 - protein, 36 aa, Artificial Sequence
  Description of Artificial Sequence: Synthetic polypeptide
DETEIATTNPVAYEQYGSVAAITNGEEAPDNQEGLM

SEQ ID NO: 176581 - protein, 37 aa, Artificial Sequence
  Description of Artificial Sequence: Synthetic polypeptide
DETEIATTNPVAYEQYGSVAAITNNEEAPGNQMEGNV

SEQ ID NO: 176582 - protein, 37 aa, Artificial Sequence
  Description of Artificial Sequence: Synthetic polypeptide
AEEEIRATNPCATEQYGVVSTVNDQNGNQQIGTNNDD

SEQ ID NO: 176583 - protein, 33 aa, Artificial Sequence
  Description of Artificial Sequence: Synthetic polypeptide
DENEIRTTNPVSTEPYGTTSMEDGQAQTNPNHK

SEQ ID NO: 176584 - protein, 35 aa, Artificial Sequence
  Description of Artificial Sequence: Synthetic polypeptide
DETEIATTNPVAYEQWGSVSQGNPQEDTPGGDVEN

SEQ ID NO: 176585 - protein, 35 aa, Artificial Sequence
  Description of Artificial Sequence: Synthetic polypeptide
DETEIATTNPVAYEQYGSVAGTNGVTTAENPNEKT

SEQ ID NO: 176586 - protein, 38 aa, Artificial Sequence
  Description of Artificial Sequence: Synthetic polypeptide
DEAEIRTTNPVATEQYGSVCSVTAPNTHTTGQGLEVES

SEQ ID NO: 176587 - protein, 36 aa, Artificial Sequence
  Description of Artificial Sequence: Synthetic polypeptide
TEEEIRTTNPVATEQYGSVIGPMMENGVTETVPNNT

SEQ ID NO: 176588 - protein, 37 aa, Artificial Sequence
  Description of Artificial Sequence: Synthetic polypeptide
DEEEIRTTNPVATEQYGCVCSNWGEDHNQEFFGSDQA

SEQ ID NO: 176589 - protein, 33 aa, Artificial Sequence
  Description of Artificial Sequence: Synthetic polypeptide
DETEIATTNPVAYEPWGSVPTQPMLGEDHNGEQ

SEQ ID NO: 176590 - protein, 33 aa, Artificial Sequence
  Description of Artificial Sequence: Synthetic polypeptide
DETEIATTNPVAYEPYGEVAAMANDQVSNDTEN

SEQ ID NO: 176591 - protein, 35 aa, Artificial Sequence
  Description of Artificial Sequence: Synthetic polypeptide
DETEIATTNPVAYEPYGSTSAGNNDEPAQKAEGNK

SEQ ID NO: 176592 - protein, 34 aa, Artificial Sequence
  Description of Artificial Sequence: Synthetic polypeptide
DETEIATTNPVAYEPYGSVSAAANAEPVQTMPTS

SEQ ID NO: 176593 - protein, 36 aa, Artificial Sequence
  Description of Artificial Sequence: Synthetic polypeptide
DEEEISTTNPVATEQYGCVCSNTGEDNQNFISETQE

SEQ ID NO: 176594 - protein, 38 aa, Artificial Sequence
  Description of Artificial Sequence: Synthetic polypeptide
DEEEIRTTNPVATEQYGCVCSNWGEDHNQEGFNSDTQE

SEQ ID NO: 176595 - protein, 31 aa, Artificial Sequence
  Description of Artificial Sequence: Synthetic polypeptide
DDSEVASTNPVSTEGYGDVAANTIDSRVGQR

SEQ ID NO: 176596 - protein, 35 aa, Artificial Sequence
  Description of Artificial Sequence: Synthetic polypeptide
DETEIATTNPVAYEQWGCVSGGPNGNQGEGMNGDD

SEQ ID NO: 176597 - protein, 37 aa, Artificial Sequence
  Description of Artificial Sequence: Synthetic polypeptide
DEEEIRTTNPVATEQYGCVCSNWGEDHNQEHFNSDQS

SEQ ID NO: 176598 - protein, 31 aa, Artificial Sequence
  Description of Artificial Sequence: Synthetic polypeptide
DESEVATTNPVSTEGYGEAAAETCQSRVGQK

SEQ ID NO: 176599 - protein, 38 aa, Artificial Sequence
  Description of Artificial Sequence: Synthetic polypeptide
DEEEIRTTNPVATEQYGCVCSNWGEDHNQENFGSDNQA

SEQ ID NO: 176600 - protein, 34 aa, Artificial Sequence
  Description of Artificial Sequence: Synthetic polypeptide
DENEIRTTNPVSTEPYGVISDEQQIQQQQNGNHA

SEQ ID NO: 176601 - protein, 37 aa, Artificial Sequence
  Description of Artificial Sequence: Synthetic polypeptide
DEEEIRTTNPVATEQYGCVCSNWGEDHNQENFGSDQA

SEQ ID NO: 176602 - protein, 34 aa, Artificial Sequence
  Description of Artificial Sequence: Synthetic polypeptide
DEDEIATTNPVAYEPYGSFVAMNDTQDNNNTPDE

SEQ ID NO: 176603 - protein, 36 aa, Artificial Sequence
  Description of Artificial Sequence: Synthetic polypeptide
TEEEIRTTNPVATEQYGSVMLPFLLQQMVISSEQEL

SEQ ID NO: 176604 - protein, 33 aa, Artificial Sequence
  Description of Artificial Sequence: Synthetic polypeptide
DENEIRTTNPVSTEPYGVICWMEDIQQQQNGNH

SEQ ID NO: 176605 - protein, 33 aa, Artificial Sequence
  Description of Artificial Sequence: Synthetic polypeptide
DEDEIATTNPVAYEPYGHTVAAMANDQVSNDTN

SEQ ID NO: 176606 - protein, 33 aa, Artificial Sequence
  Description of Artificial Sequence: Synthetic polypeptide
DEDEIATTNPVAYEPYGEVAAMANDTVSNDTVR

SEQ ID NO: 176607 - protein, 35 aa, Artificial Sequence
  Description of Artificial Sequence: Synthetic polypeptide
DETEIATTNPVAYEQWGSVCAAANGLQEAEHANDS

SEQ ID NO: 176608 - protein, 33 aa, Artificial Sequence
  Description of Artificial Sequence: Synthetic polypeptide
DEDEIATTNPVAYEPYGEVAAMANDQVSNDGTT

SEQ ID NO: 176609 - protein, 35 aa, Artificial Sequence
  Description of Artificial Sequence: Synthetic polypeptide
DETEIATTNPVAYEQWGSVPTTGPMLGEDQRQTEP

SEQ ID NO: 176610 - protein, 37 aa, Artificial Sequence
  Description of Artificial Sequence: Synthetic polypeptide
TEEEIRTTNPVATEQYGSVIGPTNNLDPMPVLEIEDT

SEQ ID NO: 176611 - protein, 35 aa, Artificial Sequence
  Description of Artificial Sequence: Synthetic polypeptide
DETEIATTNPVAYEQWGSVSGGNGNESGQVGDGTS

SEQ ID NO: 176612 - protein, 36 aa, Artificial Sequence
  Description of Artificial Sequence: Synthetic polypeptide
DETEIATTNPVAYEQWGSVSGGNLGNTAGEQDTGRN

SEQ ID NO: 176613 - protein, 35 aa, Artificial Sequence
  Description of Artificial Sequence: Synthetic polypeptide
DETEIATTNPVAYEQWGSVSGQGPPQQAAPDGSNH

SEQ ID NO: 176614 - protein, 31 aa, Artificial Sequence
  Description of Artificial Sequence: Synthetic polypeptide
DDSEVASTNPVSTEGYGDVAANIIQSRAGQA

SEQ ID NO: 176615 - protein, 34 aa, Artificial Sequence
  Description of Artificial Sequence: Synthetic polypeptide
DENEIRTTNPVSTEPYGTTPSGEDPGQNQGNGNH

SEQ ID NO: 176616 - protein, 37 aa, Artificial Sequence
  Description of Artificial Sequence: Synthetic polypeptide
TEEEIRTTNPVATEQYGSVEMLPFLLQQPVINSEQVL

SEQ ID NO: 176617 - protein, 33 aa, Artificial Sequence
  Description of Artificial Sequence: Synthetic polypeptide
DEDEIATTNPVAYEPYGETAAMANAQVSNDTVR

SEQ ID NO: 176618 - protein, 34 aa, Artificial Sequence
  Description of Artificial Sequence: Synthetic polypeptide
DENEIRTTNPVSTEPYGTMIISMEDIQQQQNGNH

SEQ ID NO: 176619 - protein, 36 aa, Artificial Sequence
  Description of Artificial Sequence: Synthetic polypeptide
VEEEIRTTNPVATEQYGSVSLSPPLIMVPMPEEQLM

SEQ ID NO: 176620 - protein, 32 aa, Artificial Sequence
  Description of Artificial Sequence: Synthetic polypeptide
DEDEIATTNPVAYEPWGSVYIGDNDDQQDTEP

SEQ ID NO: 176621 - protein, 32 aa, Artificial Sequence
  Description of Artificial Sequence: Synthetic polypeptide
AESEIACTNPVAYEGYGEASCENISQRVGGDI

SEQ ID NO: 176622 - protein, 32 aa, Artificial Sequence
  Description of Artificial Sequence: Synthetic polypeptide
AESEIACTNPVAYEGYGEASCENFSQRDVGGD

SEQ ID NO: 176623 - protein, 33 aa, Artificial Sequence
  Description of Artificial Sequence: Synthetic polypeptide
AESEIACTNPVAYEGYGEASCEGNLSQRVGGSK

SEQ ID NO: 176624 - protein, 32 aa, Artificial Sequence
  Description of Artificial Sequence: Synthetic polypeptide
AESEIACTNPVAYEGYGEAPSCENLSQTVGMD

SEQ ID NO: 176625 - protein, 32 aa, Artificial Sequence
  Description of Artificial Sequence: Synthetic polypeptide
AESEIACTNPVAYEGYGEAFCENLSQRVGGTS

SEQ ID NO: 176626 - protein, 37 aa, Artificial Sequence
  Description of Artificial Sequence: Synthetic polypeptide
AEEEIRATNPCATEQYGVVSTVNNQLGNQQIGTEGED

SEQ ID NO: 176627 - protein, 37 aa, Artificial Sequence
  Description of Artificial Sequence: Synthetic polypeptide
DEEEIRTTNPVATEQYGCVCSNWGEDHNQGFNSDTQS

SEQ ID NO: 176628 - protein, 36 aa, Artificial Sequence
  Description of Artificial Sequence: Synthetic polypeptide
DEQEIATTNPVATEQYGSVCAAQNGDEQGMDINNSN

SEQ ID NO: 176629 - protein, 37 aa, Artificial Sequence
  Description of Artificial Sequence: Synthetic polypeptide
TEEEIRTTNPVATEQYGSVCETTPNGAMNGFEGSQQV

SEQ ID NO: 176630 - protein, 33 aa, Artificial Sequence
  Description of Artificial Sequence: Synthetic polypeptide
AESEIACTNPVAYEEYGEASCENLSQRPVGGSC

SEQ ID NO: 176631 - protein, 34 aa, Artificial Sequence
  Description of Artificial Sequence: Synthetic polypeptide
DENEIRTTNPVSTEPYGTLSMEDVIQTQSNGVNH

SEQ ID NO: 176632 - protein, 33 aa, Artificial Sequence
  Description of Artificial Sequence: Synthetic polypeptide
DENEIRTTNPVSTEPYGTIYMEDAIQQQQNGNH

SEQ ID NO: 176633 - protein, 34 aa, Artificial Sequence
  Description of Artificial Sequence: Synthetic polypeptide
DENEIRTTNPVSTEPYGTIWSMADQIQQQQNGNH

SEQ ID NO: 176634 - protein, 36 aa, Artificial Sequence
  Description of Artificial Sequence: Synthetic polypeptide
DETEICTTNPVAYECWGSVATGNGPLQDDRQQMGTD

SEQ ID NO: 176635 - protein, 34 aa, Artificial Sequence
  Description of Artificial Sequence: Synthetic polypeptide
DEQEIATTNPVATEQYGSVCAATAGEEMMMPEEG

SEQ ID NO: 176636 - protein, 34 aa, Artificial Sequence
  Description of Artificial Sequence: Synthetic polypeptide
DENEIRTTNPVSTEPYGTIWANMEDIQQQPNGNH

SEQ ID NO: 176637 - protein, 33 aa, Artificial Sequence
  Description of Artificial Sequence: Synthetic polypeptide
DENEIRTTNPVSTEPYGTIWAMEDIQQQPNGNH

SEQ ID NO: 176638 - protein, 32 aa, Artificial Sequence
  Description of Artificial Sequence: Synthetic polypeptide
DENEIRTTNPVSTEPYGTIWAMEDIQQQNGPI

SEQ ID NO: 176639 - protein, 36 aa, Artificial Sequence
  Description of Artificial Sequence: Synthetic polypeptide
DEEEISTTNPVATEQYGCVCSNTGEHNQNFISQTQS

SEQ ID NO: 176640 - protein, 32 aa, Artificial Sequence
  Description of Artificial Sequence: Synthetic polypeptide
DENEIRTTNPVSTEPYGTIWAMEDIQQPNGPI

SEQ ID NO: 176641 - protein, 34 aa, Artificial Sequence
  Description of Artificial Sequence: Synthetic polypeptide
DENEIRTTNPVSTEPYGTIVSVEDIQQQQNGIDH

SEQ ID NO: 176642 - protein, 33 aa, Artificial Sequence
  Description of Artificial Sequence: Synthetic polypeptide
DETEIATVNPIATEQWGVTVWSNAENWQPKGPI

SEQ ID NO: 176643 - protein, 37 aa, Artificial Sequence
  Description of Artificial Sequence: Synthetic polypeptide
AEEEIRATNPCATEQYGVVSTVNDQQGNQQIGTNNVE

SEQ ID NO: 176644 - protein, 33 aa, Artificial Sequence
  Description of Artificial Sequence: Synthetic polypeptide
DENEIRTTNPVSTEPYGTMISMEDIQQQQNGQH

SEQ ID NO: 176645 - protein, 39 aa, Artificial Sequence
  Description of Artificial Sequence: Synthetic polypeptide
DEEEIRTTNPVATEAYGVVSTTNQQQGNNQLQNATEQGS

SEQ ID NO: 176646 - protein, 34 aa, Artificial Sequence
  Description of Artificial Sequence: Synthetic polypeptide
DENEIRTTNPVSTEPYGTTISMEDISQQMNGGNH

SEQ ID NO: 176647 - protein, 33 aa, Artificial Sequence
  Description of Artificial Sequence: Synthetic polypeptide
DENEIRTTNPVSTEPYGTTISMEDIQQQQNTNH

SEQ ID NO: 176648 - protein, 37 aa, Artificial Sequence
  Description of Artificial Sequence: Synthetic polypeptide
DETEIATTNPVAYEQYGSVCQAANVLDQMAGEHANDS

SEQ ID NO: 176649 - protein, 36 aa, Artificial Sequence
  Description of Artificial Sequence: Synthetic polypeptide
DETEIATTNPVAYEQYGSVCQAANVLDQMAPEANDW

SEQ ID NO: 176650 - protein, 37 aa, Artificial Sequence
  Description of Artificial Sequence: Synthetic polypeptide
DEEEISTTNPVATEQYGCVCSNTGEHNQENFGSDTQS

SEQ ID NO: 176651 - protein, 34 aa, Artificial Sequence
  Description of Artificial Sequence: Synthetic polypeptide
DENEIRTTNPVSTEPYGTTISMEDHSQQQNVGNH

SEQ ID NO: 176652 - protein, 34 aa, Artificial Sequence
  Description of Artificial Sequence: Synthetic polypeptide
DENEIRTTNPVSTEPYGTTISMEDHSQQQNGNNH

SEQ ID NO: 176653 - protein, 37 aa, Artificial Sequence
  Description of Artificial Sequence: Synthetic polypeptide
DEEEISTTNPVATEQYGCVCSNTGEHNQENFNSNTQS

SEQ ID NO: 176654 - protein, 35 aa, Artificial Sequence
  Description of Artificial Sequence: Synthetic polypeptide
DETEIATTNPVAYEQYGSVSAGPPQQAAPGDSFEN

SEQ ID NO: 176655 - protein, 32 aa, Artificial Sequence
  Description of Artificial Sequence: Synthetic polypeptide
AESEIACTNPVAYEGYGNAPSCENLSQTVGGV

SEQ ID NO: 176656 - protein, 36 aa, Artificial Sequence
  Description of Artificial Sequence: Synthetic polypeptide
TEEEIRTTNPVATEQYGSVCWPTEDMQTEEVLEVVH

SEQ ID NO: 176657 - protein, 32 aa, Artificial Sequence
  Description of Artificial Sequence: Synthetic polypeptide
AESEIACTNPVAYEGYGETSCENLSQNTVGGD

SEQ ID NO: 176658 - protein, 37 aa, Artificial Sequence
  Description of Artificial Sequence: Synthetic polypeptide
AEEEIRATNPCATEQYGVVSTVNNQAGNQQIGTTDED

SEQ ID NO: 176659 - protein, 37 aa, Artificial Sequence
  Description of Artificial Sequence: Synthetic polypeptide
AEEEIRATNPCATEQYGVVSTVNNQAGNQQQGTNGVD

SEQ ID NO: 176660 - protein, 39 aa, Artificial Sequence
  Description of Artificial Sequence: Synthetic polypeptide
DEEEIRTTNPVATEAYGVVSTTNQQQGNNQLNIGTEQGS

SEQ ID NO: 176661 - protein, 34 aa, Artificial Sequence
  Description of Artificial Sequence: Synthetic polypeptide
DENEIRTTNPVSTEPYGTQISMEDIQQQQNGNNH

SEQ ID NO: 176662 - protein, 35 aa, Artificial Sequence
  Description of Artificial Sequence: Synthetic polypeptide
DETEIATTNPVAYERWGSVCSQTDNHNRDGGQEEQ

SEQ ID NO: 176663 - protein, 35 aa, Artificial Sequence
  Description of Artificial Sequence: Synthetic polypeptide
DETEIATTNPVAYERWGSVSGGNADDSRNGGNNNS

SEQ ID NO: 176664 - protein, 33 aa, Artificial Sequence
  Description of Artificial Sequence: Synthetic polypeptide
DENEIRTTNPVSTEPYGTQIPEDIEIEQNGVNQ

SEQ ID NO: 176665 - protein, 32 aa, Artificial Sequence
  Description of Artificial Sequence: Synthetic polypeptide
AESEIACTNPVAYEGYGEASCENNLSQPVGGS

SEQ ID NO: 176666 - protein, 33 aa, Artificial Sequence
  Description of Artificial Sequence: Synthetic polypeptide
DETEIATTNPVAYERWGVCATNLLPGDHGNNGL

SEQ ID NO: 176667 - protein, 32 aa, Artificial Sequence
  Description of Artificial Sequence: Synthetic polypeptide
DETEIATTNPVAYERWGVCATNMPGDHGNNNL

SEQ ID NO: 176668 - protein, 37 aa, Artificial Sequence
  Description of Artificial Sequence: Synthetic polypeptide
TEEEIRTTNPVATEQYGSVCSNTEDMDTEEVLEAVPP

SEQ ID NO: 176669 - protein, 37 aa, Artificial Sequence
  Description of Artificial Sequence: Synthetic polypeptide
TEEEIRTTNPVATEQYGSVCSNDEDMQTEEVLEVLVH

SEQ ID NO: 176670 - protein, 37 aa, Artificial Sequence
  Description of Artificial Sequence: Synthetic polypeptide
AEEEIRATNPCATEQYGVVSTVNNQGGNQQIGTNLED

SEQ ID NO: 176671 - protein, 36 aa, Artificial Sequence
  Description of Artificial Sequence: Synthetic polypeptide
DEQEIATTNPVATEQYGSVCAANNGDENGMDINNQV

SEQ ID NO: 176672 - protein, 34 aa, Artificial Sequence
  Description of Artificial Sequence: Synthetic polypeptide
DENEIRTTNPVSTEPYGVTISLMEDIQQQQNGNH

SEQ ID NO: 176673 - protein, 35 aa, Artificial Sequence
  Description of Artificial Sequence: Synthetic polypeptide
DETEIATTNPVAYEHWGEVASGDHNMDRGGGGNGR

SEQ ID NO: 176674 - protein, 35 aa, Artificial Sequence
  Description of Artificial Sequence: Synthetic polypeptide
TESEIRTTNPVATECWGSVVSCGHEFSQDMEGQNG

SEQ ID NO: 176675 - protein, 33 aa, Artificial Sequence
  Description of Artificial Sequence: Synthetic polypeptide
DENEIRTTNPVSTLPYGTISIMEDIQQQQNGNH

SEQ ID NO: 176676 - protein, 33 aa, Artificial Sequence
  Description of Artificial Sequence: Synthetic polypeptide
DENEIRTTNPVSTLPYGTIASMEDIQQQQNGNH

SEQ ID NO: 176677 - protein, 37 aa, Artificial Sequence
  Description of Artificial Sequence: Synthetic polypeptide
DEEEIRTTNPVATEQYGCVCSNWGEDDNQENFNSEQA

SEQ ID NO: 176678 - protein, 33 aa, Artificial Sequence
  Description of Artificial Sequence: Synthetic polypeptide
DENEIRTTNPVSTHPYGTISMIDIQVQQNGNHI

SEQ ID NO: 176679 - protein, 37 aa, Artificial Sequence
  Description of Artificial Sequence: Synthetic polypeptide
DEEEIRTTNPVATEQYGCVCSNWGEDDQENFNSDNQS

SEQ ID NO: 176680 - protein, 35 aa, Artificial Sequence
  Description of Artificial Sequence: Synthetic polypeptide
DETEIATTNPVATEQYGSVCAAMHGPADSGENNHN

SEQ ID NO: 176681 - protein, 34 aa, Artificial Sequence
  Description of Artificial Sequence: Synthetic polypeptide
DENEIRTTNPVSTEYYGTICSWEAINQEQFGSDQ

SEQ ID NO: 176682 - protein, 35 aa, Artificial Sequence
  Description of Artificial Sequence: Synthetic polypeptide
DEDEIRTTNPVATEAWGVVVTVVNSEQGTNTEQGS

SEQ ID NO: 176683 - protein, 37 aa, Artificial Sequence
  Description of Artificial Sequence: Synthetic polypeptide
DEEEIRTTNPVATEQYGCVCSNWGEDFQENFNSEFQA

SEQ ID NO: 176684 - protein, 37 aa, Artificial Sequence
  Description of Artificial Sequence: Synthetic polypeptide
DEEEIRTTNPVATEQYGCVCSNWGEDHDQENFGSEQD

SEQ ID NO: 176685 - protein, 35 aa, Artificial Sequence
  Description of Artificial Sequence: Synthetic polypeptide
DETEIATTNPVATEQYGSVCAANMHDEATIDGEQH

SEQ ID NO: 176686 - protein, 35 aa, Artificial Sequence
  Description of Artificial Sequence: Synthetic polypeptide
DETEIATTNPVATEQYGSVCAANNGDENGMDIADQ

SEQ ID NO: 176687 - protein, 36 aa, Artificial Sequence
  Description of Artificial Sequence: Synthetic polypeptide
DETEIATTNPVATEQYGSVCAANNGDENGMDIAEDR

SEQ ID NO: 176688 - protein, 37 aa, Artificial Sequence
  Description of Artificial Sequence: Synthetic polypeptide
DEEEIRTTNPVATEQYGCVCSNWGEDHDQNFGSETQN

SEQ ID NO: 176689 - protein, 36 aa, Artificial Sequence
  Description of Artificial Sequence: Synthetic polypeptide
DETEIATTNPVATEQYGSVCAANNGDENGMDIEGRP

SEQ ID NO: 176690 - protein, 36 aa, Artificial Sequence
  Description of Artificial Sequence: Synthetic polypeptide
DETEIATTNPVATEQYGSVCAANNGDENGMDIEHNW

SEQ ID NO: 176691 - protein, 35 aa, Artificial Sequence
  Description of Artificial Sequence: Synthetic polypeptide
DETEIATTNPVATEQYGSVCAANNGDENGMDIEQH

SEQ ID NO: 176692 - protein, 38 aa, Artificial Sequence
  Description of Artificial Sequence: Synthetic polypeptide
DEEEIRTTNPVATEQYGCVCSNWGEDHEQENFGSDNQA

SEQ ID NO: 176693 - protein, 36 aa, Artificial Sequence
  Description of Artificial Sequence: Synthetic polypeptide
DETEIATTNPVATEQYGSVCAANNGDENGMDIGENL

SEQ ID NO: 176694 - protein, 32 aa, Artificial Sequence
  Description of Artificial Sequence: Synthetic polypeptide
DESEVRSTNPIATECWGNVWAANDWQSRKGQI

SEQ ID NO: 176695 - protein, 37 aa, Artificial Sequence
  Description of Artificial Sequence: Synthetic polypeptide
DEEEIRTTNPVATEQYGCVCSNWGEDHETENFNSDQQ

SEQ ID NO: 176696 - protein, 35 aa, Artificial Sequence
  Description of Artificial Sequence: Synthetic polypeptide
DETEIATTNPVATEQYGSVCAANNGDENGMDIIHE

SEQ ID NO: 176697 - protein, 35 aa, Artificial Sequence
  Description of Artificial Sequence: Synthetic polypeptide
DETEIATTNPVATEQYGSVCAANNGDENGMDIMEN

SEQ ID NO: 176698 - protein, 31 aa, Artificial Sequence
  Description of Artificial Sequence: Synthetic polypeptide
DDSEVASTNPVSTEGYGCVGNSTIQSRMGQQ

SEQ ID NO: 176699 - protein, 36 aa, Artificial Sequence
  Description of Artificial Sequence: Synthetic polypeptide
VEEEIRTTNPVATEQYGSVQVAGEEQIENTHEANIM

SEQ ID NO: 176700 - protein, 33 aa, Artificial Sequence
  Description of Artificial Sequence: Synthetic polypeptide
DENEIRTTNPVSTLPYGTISMEDIQQQQNGNSH

SEQ ID NO: 176701 - protein, 36 aa, Artificial Sequence
  Description of Artificial Sequence: Synthetic polypeptide
DETEIATTNPVATEQYGSVCAANNGDENGMDINEHW

SEQ ID NO: 176702 - protein, 36 aa, Artificial Sequence
  Description of Artificial Sequence: Synthetic polypeptide
DETEIATTNPVATEQYGSVCAADNGDEQGMDINNTN

SEQ ID NO: 176703 - protein, 36 aa, Artificial Sequence
  Description of Artificial Sequence: Synthetic polypeptide
DETEIATTNPVATEQYGSVCAADNGDEDGMDINDNH

SEQ ID NO: 176704 - protein, 36 aa, Artificial Sequence
  Description of Artificial Sequence: Synthetic polypeptide
DETEIATTNPVATEQYGSTVCAASHPSEGMGGNPPA

SEQ ID NO: 176705 - protein, 33 aa, Artificial Sequence
  Description of Artificial Sequence: Synthetic polypeptide
DENEIRTTNPVSVEPYGTISMEDIQQQQNGPNH

SEQ ID NO: 176706 - protein, 37 aa, Artificial Sequence
  Description of Artificial Sequence: Synthetic polypeptide
DEEEIRTTNPVATEQYGCVCSNWEPHNQENFNSDTQL

SEQ ID NO: 176707 - protein, 32 aa, Artificial Sequence
  Description of Artificial Sequence: Synthetic polypeptide
DENEIRTTNPVSTYPYGTISMEGIQQQQNGSH

SEQ ID NO: 176708 - protein, 33 aa, Artificial Sequence
  Description of Artificial Sequence: Synthetic polypeptide
DENEIRTTNPVSTTPYGTISMEDRIQQQQNGNH

SEQ ID NO: 176709 - protein, 37 aa, Artificial Sequence
  Description of Artificial Sequence: Synthetic polypeptide
DEEEISTTNPVATEQYGCVCSNTEEHNTESFGSETQS

SEQ ID NO: 176710 - protein, 33 aa, Artificial Sequence
  Description of Artificial Sequence: Synthetic polypeptide
DENEIRTTNPVSTSPYGTISMEDIQQQQNGNHF

SEQ ID NO: 176711 - protein, 32 aa, Artificial Sequence
  Description of Artificial Sequence: Synthetic polypeptide
DENEIRTTNPVSTSPYGTISMEDIQQQQNANH

SEQ ID NO: 176712 - protein, 37 aa, Artificial Sequence
  Description of Artificial Sequence: Synthetic polypeptide
DEEEISTTNPVATEQYGCVCSNTEELNAENFNSDTQD

SEQ ID NO: 176713 - protein, 33 aa, Artificial Sequence
  Description of Artificial Sequence: Synthetic polypeptide
DENEIRTTNPVSTSPYGTISHMEDIQQQMNGNH

SEQ ID NO: 176714 - protein, 31 aa, Artificial Sequence
  Description of Artificial Sequence: Synthetic polypeptide
DDSEVASTNPVSTEGYGCVFTSTIQERMGQQ

SEQ ID NO: 176715 - protein, 36 aa, Artificial Sequence
  Description of Artificial Sequence: Synthetic polypeptide
DEEEISTTNPVATEQYGCVCSNTEHEIENFGSDTQQ

SEQ ID NO: 176716 - protein, 33 aa, Artificial Sequence
  Description of Artificial Sequence: Synthetic polypeptide
DENEIRTTNPVSTRPYGTISMEDIQQQQNGRNH

SEQ ID NO: 176717 - protein, 35 aa, Artificial Sequence
  Description of Artificial Sequence: Synthetic polypeptide
CEDEIATTNPVATEQWGSVSAANPSEEAGMENDEN

SEQ ID NO: 176718 - protein, 33 aa, Artificial Sequence
  Description of Artificial Sequence: Synthetic polypeptide
DENEIRTTNPVSTRPYGTISMEDIQQQQNGNHK

SEQ ID NO: 176719 - protein, 33 aa, Artificial Sequence
  Description of Artificial Sequence: Synthetic polypeptide
DENEIRTTNPVSTRPYGTISMEDIQQQQNGHNH

SEQ ID NO: 176720 - protein, 32 aa, Artificial Sequence
  Description of Artificial Sequence: Synthetic polypeptide
DENEIRTTNPVSTQPYGTISMEDIQQQQNPNH

SEQ ID NO: 176721 - protein, 32 aa, Artificial Sequence
  Description of Artificial Sequence: Synthetic polypeptide
DENEIRTTNPVSTQPYGTISMEDIQQQQNLNH

SEQ ID NO: 176722 - protein, 33 aa, Artificial Sequence
  Description of Artificial Sequence: Synthetic polypeptide
DENEIRTTNPVSTQPYGTISMEDIQQQQNGNHF

SEQ ID NO: 176723 - protein, 36 aa, Artificial Sequence
  Description of Artificial Sequence: Synthetic polypeptide
DETEIATTNPVATEQYGSVCAADNGDEAGMDIDDRM

SEQ ID NO: 176724 - protein, 35 aa, Artificial Sequence
  Description of Artificial Sequence: Synthetic polypeptide
DETEIATTNPVATEQYGSVCAADNGDEAGMDIDHF

SEQ ID NO: 176725 - protein, 35 aa, Artificial Sequence
  Description of Artificial Sequence: Synthetic polypeptide
DETEIATTNPVATEQYGSVCAADNGDEAGMDIDHN

SEQ ID NO: 176726 - protein, 35 aa, Artificial Sequence
  Description of Artificial Sequence: Synthetic polypeptide
DETEIATTNPVATEQYGSVCAADNGDEDGMDIADK

SEQ ID NO: 176727 - protein, 35 aa, Artificial Sequence
  Description of Artificial Sequence: Synthetic polypeptide
DETEIATTNPVATEQYGSVCAADNGDEDGMDIDGH

SEQ ID NO: 176728 - protein, 36 aa, Artificial Sequence
  Description of Artificial Sequence: Synthetic polypeptide
DETEIATTNPVATEQYGSVCAADNGDEDGMDINANP

SEQ ID NO: 176729 - protein, 32 aa, Artificial Sequence
  Description of Artificial Sequence: Synthetic polypeptide
DENEIRTTNPVSTMPYGTISMEDIQQQQNGQH

SEQ ID NO: 176730 - protein, 37 aa, Artificial Sequence
  Description of Artificial Sequence: Synthetic polypeptide
DETEIATTNPVATEQYGSVCAANNGDENGMDINESDR

SEQ ID NO: 176731 - protein, 36 aa, Artificial Sequence
  Description of Artificial Sequence: Synthetic polypeptide
DETEIATTNPVATEQYGSVCAANNGDENGMDINNNY

SEQ ID NO: 176732 - protein, 36 aa, Artificial Sequence
  Description of Artificial Sequence: Synthetic polypeptide
DETEIATTNPVATEQYGSVCAANNGDENGMDINSND

SEQ ID NO: 176733 - protein, 37 aa, Artificial Sequence
  Description of Artificial Sequence: Synthetic polypeptide
DETEIATTNPVATEQYGSVSSTGEPGINPRDGMEKVN

SEQ ID NO: 176734 - protein, 30 aa, Artificial Sequence
  Description of Artificial Sequence: Synthetic polypeptide
AESEIASTNPVGTEGWGVAASTLQHGDGIS

SEQ ID NO: 176735 - protein, 29 aa, Artificial Sequence
  Description of Artificial Sequence: Synthetic peptide
AESEIASTNPVGTEGWGVAAATLQHGDTI

SEQ ID NO: 176736 - protein, 37 aa, Artificial Sequence
  Description of Artificial Sequence: Synthetic polypeptide
DEEEIRTTNPVATEQYGCVCSNWGEDHNEENFNSDQS

SEQ ID NO: 176737 - protein, 32 aa, Artificial Sequence
  Description of Artificial Sequence: Synthetic polypeptide
DDSEVASTNPVSTEGYGCVGTWTIQSRIGSQR

SEQ ID NO: 176738 - protein, 35 aa, Artificial Sequence
  Description of Artificial Sequence: Synthetic polypeptide
DEDEIATTNPVAYEQWGCVAANNGLQAAPDGANNH

SEQ ID NO: 176739 - protein, 39 aa, Artificial Sequence
  Description of Artificial Sequence: Synthetic polypeptide
DEEEIRTTNPVAYEQYGESFVSPSVNDELFVRVNVPLVD

SEQ ID NO: 176740 - protein, 33 aa, Artificial Sequence
  Description of Artificial Sequence: Synthetic polypeptide
DENNIRTTNPVSTEPYGTIFSMEDIQQQQNGNH

SEQ ID NO: 176741 - protein, 38 aa, Artificial Sequence
  Description of Artificial Sequence: Synthetic polypeptide
DEEEIRTTNPVATEQYGCVCSNWGEDHNIENFGSDNQS

SEQ ID NO: 176742 - protein, 37 aa, Artificial Sequence
  Description of Artificial Sequence: Synthetic polypeptide
DESEIRTTNPVATEQYGSVIECTWPMEQEEINQQDGP

SEQ ID NO: 176743 - protein, 32 aa, Artificial Sequence
  Description of Artificial Sequence: Synthetic polypeptide
DDSEVASTNPVSTEGYGCVTANSTIQERMGQR

SEQ ID NO: 176744 - protein, 38 aa, Artificial Sequence
  Description of Artificial Sequence: Synthetic polypeptide
DEEEIRTTNPVAYEQYGESFVSPSVNDELFVGVGEPVD

SEQ ID NO: 176745 - protein, 32 aa, Artificial Sequence
  Description of Artificial Sequence: Synthetic polypeptide
DESEVATTNPVSTEGYGTIAANTIQQSRVGQH

SEQ ID NO: 176746 - protein, 36 aa, Artificial Sequence
  Description of Artificial Sequence: Synthetic polypeptide
DETEIATTNPVATEQYGTVCSATGGEPSEFEGGNDY

SEQ ID NO: 176747 - protein, 37 aa, Artificial Sequence
  Description of Artificial Sequence: Synthetic polypeptide
DESEIRTTNPVATEQYGSVIECTYPMENEEYNQDDGA

SEQ ID NO: 176748 - protein, 32 aa, Artificial Sequence
  Description of Artificial Sequence: Synthetic polypeptide
DENEIRTTNPVSTEPYMTISMEDIQQQQNINH

SEQ ID NO: 176749 - protein, 37 aa, Artificial Sequence
  Description of Artificial Sequence: Synthetic polypeptide
DEEEISTTNPVATEQYGCVCSNTGEDHNAENFGSDQL

SEQ ID NO: 176750 - protein, 37 aa, Artificial Sequence
  Description of Artificial Sequence: Synthetic polypeptide
DEEEISTTNPVATEQYGCVCSNTGEDNAENFNSDFQA

SEQ ID NO: 176751 - protein, 35 aa, Artificial Sequence
  Description of Artificial Sequence: Synthetic polypeptide
DEDEIRTTNPVATEAWGVVTVVVNNNNQDEGENGT

SEQ ID NO: 176752 - protein, 37 aa, Artificial Sequence
  Description of Artificial Sequence: Synthetic polypeptide
DEEEISTTNPVATEQYGCVCSNTGEDNQEHFNSDTQS

SEQ ID NO: 176753 - protein, 31 aa, Artificial Sequence
  Description of Artificial Sequence: Synthetic polypeptide
AESEIACTNPVAYERYGEASCENLSSTVGGV

SEQ ID NO: 176754 - protein, 33 aa, Artificial Sequence
  Description of Artificial Sequence: Synthetic polypeptide
DENEIRTTNPVSTEPYGYTIWMEDIQQQQNGNH

SEQ ID NO: 176755 - protein, 33 aa, Artificial Sequence
  Description of Artificial Sequence: Synthetic polypeptide
DENEIRTTNPVSTEPYGYTISMEDIQQQQNGDH

SEQ ID NO: 176756 - protein, 36 aa, Artificial Sequence
  Description of Artificial Sequence: Synthetic polypeptide
DEEEISTTNPVATEQYGCVCSNTGEDNQENFISDQA

SEQ ID NO: 176757 - protein, 37 aa, Artificial Sequence
  Description of Artificial Sequence: Synthetic polypeptide
TEEEIRTTNPVATEQYGSVNSTTPTGPEMGQGEEEET

SEQ ID NO: 176758 - protein, 37 aa, Artificial Sequence
  Description of Artificial Sequence: Synthetic polypeptide
DETEIATTNPVATEQYGSVPMIINDLQDQQGQQGGSD

SEQ ID NO: 176759 - protein, 36 aa, Artificial Sequence
  Description of Artificial Sequence: Synthetic polypeptide
DESEIRTTNPVATEQYGSVIECGWPMEQEEYNQEDG

SEQ ID NO: 176760 - protein, 36 aa, Artificial Sequence
  Description of Artificial Sequence: Synthetic polypeptide
DETEIATTNPVATEQYGSVCSAPALGQDHQDDQDAE

SEQ ID NO: 176761 - protein, 35 aa, Artificial Sequence
  Description of Artificial Sequence: Synthetic polypeptide
DETEIATTNPVATEQYGSVCGGGNHNPADSMGQFP

SEQ ID NO: 176762 - protein, 35 aa, Artificial Sequence
  Description of Artificial Sequence: Synthetic polypeptide
DETEIATTNPVATEQYGSVCAANNGDENGMDIQEV

SEQ ID NO: 176763 - protein, 37 aa, Artificial Sequence
  Description of Artificial Sequence: Synthetic polypeptide
TEEEIRTTNPVATEQYGSVRSPSETIKEQDYALVQEE

SEQ ID NO: 176764 - protein, 35 aa, Artificial Sequence
  Description of Artificial Sequence: Synthetic polypeptide
DETEIATTNPVATEQYGSVCAANNGDENGMDIYDN

SEQ ID NO: 176765 - protein, 34 aa, Artificial Sequence
  Description of Artificial Sequence: Synthetic polypeptide
DEDEIATTNPVAYEQWGEVSGGPGNQQGEHNGES

SEQ ID NO: 176766 - protein, 36 aa, Artificial Sequence
  Description of Artificial Sequence: Synthetic polypeptide
TEEEIRTTNPVATEQYGSVQVAVDEQIENTEEAYIT

SEQ ID NO: 176767 - protein, 34 aa, Artificial Sequence
  Description of Artificial Sequence: Synthetic polypeptide
DEDEIATTNPVAYEQWGETYYTTNQQRNGEDDSN

SEQ ID NO: 176768 - protein, 36 aa, Artificial Sequence
  Description of Artificial Sequence: Synthetic polypeptide
DEEEISTTNPVATEQYGCVCSNTEHNQENFISDTQQ

SEQ ID NO: 176769 - protein, 36 aa, Artificial Sequence
  Description of Artificial Sequence: Synthetic polypeptide
DETEIATTNPVATEQYGSVCAANNGDEQGMDIQNNN

SEQ ID NO: 176770 - protein, 36 aa, Artificial Sequence
  Description of Artificial Sequence: Synthetic polypeptide
DETEIATTNPVATEQYGSVCAANNGDETGMDINNSN

SEQ ID NO: 176771 - protein, 36 aa, Artificial Sequence
  Description of Artificial Sequence: Synthetic polypeptide
DETEIATTNPVATEQYGSVCAANNGLEATDSGGSDM

SEQ ID NO: 176772 - protein, 37 aa, Artificial Sequence
  Description of Artificial Sequence: Synthetic polypeptide
TEEEIRTTNPVATEQYGSVQGNMDELAIQDEHQLFSQ

SEQ ID NO: 176773 - protein, 35 aa, Artificial Sequence
  Description of Artificial Sequence: Synthetic polypeptide
DETEIATTNPVATEQYGSVCAANNGPDENGMDIIF

SEQ ID NO: 176774 - protein, 32 aa, Artificial Sequence
  Description of Artificial Sequence: Synthetic polypeptide
DEDEIATTNPVAYEQWGMTNTNGNQGDHDDSS

SEQ ID NO: 176775 - protein, 36 aa, Artificial Sequence
  Description of Artificial Sequence: Synthetic polypeptide
DEDEIRTTNPVATEAWGVVVTVVNNEQGTNVEQGNT

SEQ ID NO: 176776 - protein, 35 aa, Artificial Sequence
  Description of Artificial Sequence: Synthetic polypeptide
DENEIRTTNPVSTEVYGTVQTSPEDIEIQQNGNNH

SEQ ID NO: 176777 - protein, 37 aa, Artificial Sequence
  Description of Artificial Sequence: Synthetic polypeptide
DEEEIRTTNPVATEQYGCVCSNWGEDHNAENFNSDQS

SEQ ID NO: 176778 - protein, 35 aa, Artificial Sequence
  Description of Artificial Sequence: Synthetic polypeptide
DETEIATTNPVATEQYGSVCAATMHGEAIDPEDRH

SEQ ID NO: 176779 - protein, 36 aa, Artificial Sequence
  Description of Artificial Sequence: Synthetic polypeptide
DETEIATTNPVATEQYGSVCAAVNGDENGMDIEDNN

SEQ ID NO: 176780 - protein, 34 aa, Artificial Sequence
  Description of Artificial Sequence: Synthetic polypeptide
DENEIRTTNPVSTEVYGTISMEFIQQQQNGNNHF

SEQ ID NO: 176781 - protein, 36 aa, Artificial Sequence
  Description of Artificial Sequence: Synthetic polypeptide
DEEEIRTTNPVATEQYGCSCSNWPEDDNQNFDSEQS

SEQ ID NO: 176782 - protein, 35 aa, Artificial Sequence
  Description of Artificial Sequence: Synthetic polypeptide
DEDEIATTNPVAYEQYGSVATTADIGTEHMNNNED

SEQ ID NO: 176783 - protein, 37 aa, Artificial Sequence
  Description of Artificial Sequence: Synthetic polypeptide
DETEIATTNPVATEQYGSVCAMNNGNLEPGADIDNDA

SEQ ID NO: 176784 - protein, 36 aa, Artificial Sequence
  Description of Artificial Sequence: Synthetic polypeptide
TESEIRTTNPVATEAWGSVVSCGHEFSQDREGNNGW

SEQ ID NO: 176785 - protein, 37 aa, Artificial Sequence
  Description of Artificial Sequence: Synthetic polypeptide
DETEIATTNPVATEQYGSVCAMTNPDLPADGSDGGDP

SEQ ID NO: 176786 - protein, 36 aa, Artificial Sequence
  Description of Artificial Sequence: Synthetic polypeptide
DEEEIRTTNPVATEQYGCVCSNWGEDHNAFFNSEQP

SEQ ID NO: 176787 - protein, 36 aa, Artificial Sequence
  Description of Artificial Sequence: Synthetic polypeptide
DETEIATTNPVATEQYGSVCANMNNEEAPDNQENNH

SEQ ID NO: 176788 - protein, 36 aa, Artificial Sequence
  Description of Artificial Sequence: Synthetic polypeptide
TESEIRTTNPVATEAWGSVTSCGHEPSQDREGENGW

SEQ ID NO: 176789 - protein, 37 aa, Artificial Sequence
  Description of Artificial Sequence: Synthetic polypeptide
DEEEIRTTNPVATEQYGCVCSNWGEDHNQNFISENQF

SEQ ID NO: 176790 - protein, 33 aa, Artificial Sequence
  Description of Artificial Sequence: Synthetic polypeptide
TESEIASTNPVGTEGYGVTASTELSQSTGGDNI

SEQ ID NO: 176791 - protein, 36 aa, Artificial Sequence
  Description of Artificial Sequence: Synthetic polypeptide
DEEEISTTNPVATEQYGCVCSMTGEHNQENFPSDQP

SEQ ID NO: 176792 - protein, 35 aa, Artificial Sequence
  Description of Artificial Sequence: Synthetic polypeptide
DESQEIATTNPVAYEQWGSVSGGNGNESGEGDGTR

SEQ ID NO: 176793 - protein, 33 aa, Artificial Sequence
  Description of Artificial Sequence: Synthetic polypeptide
AEEEIATTNPVATEQYGCACPWPDNQHFNSEQA

SEQ ID NO: 176794 - protein, 30 aa, Artificial Sequence
  Description of Artificial Sequence: Synthetic polypeptide
TESEIASTNPVGTEGWGVAASTLDQHGDAI

SEQ ID NO: 176795 - protein, 32 aa, Artificial Sequence
  Description of Artificial Sequence: Synthetic polypeptide
DETEIACTNPIATECYGETWSNAEDLQPGPYI

SEQ ID NO: 176796 - protein, 33 aa, Artificial Sequence
  Description of Artificial Sequence: Synthetic polypeptide
TEHEICTTNPVAYEPYGQSVSLANASMRVTSEE

SEQ ID NO: 176797 - protein, 32 aa, Artificial Sequence
  Description of Artificial Sequence: Synthetic polypeptide
TEHEIASVNPVCYEPYGVTVSINLSQSGGQNQ

SEQ ID NO: 176798 - protein, 35 aa, Artificial Sequence
  Description of Artificial Sequence: Synthetic polypeptide
DEQEIATTNPVATEQYGCVCSNTDPEEHFGSEDQS

SEQ ID NO: 176799 - protein, 37 aa, Artificial Sequence
  Description of Artificial Sequence: Synthetic polypeptide
DEEEISTTNPVATEGYGCVCSNTGEHNAENFGSENQG

SEQ ID NO: 176800 - protein, 33 aa, Artificial Sequence
  Description of Artificial Sequence: Synthetic polypeptide
DETEIACTNPVATAQWGSVAAGHLFTPNPMGER

SEQ ID NO: 176801 - protein, 36 aa, Artificial Sequence
  Description of Artificial Sequence: Synthetic polypeptide
DEEEISTTNPVATEGYGCVCSNTGEHNQESFGSDQS

SEQ ID NO: 176802 - protein, 35 aa, Artificial Sequence
  Description of Artificial Sequence: Synthetic polypeptide
DEDEIATTNPVAYEQYGSVAATAHHAQTANPPNNN

SEQ ID NO: 176803 - protein, 37 aa, Artificial Sequence
  Description of Artificial Sequence: Synthetic polypeptide
TEGEIRTTNPVATEQYGSSSTHPNEMEYLESQNEEEL

SEQ ID NO: 176804 - protein, 35 aa, Artificial Sequence
  Description of Artificial Sequence: Synthetic polypeptide
DEDEIATTNPVAYEQYGSVAATAHHAEQTADPPGN

SEQ ID NO: 176805 - protein, 35 aa, Artificial Sequence
  Description of Artificial Sequence: Synthetic polypeptide
TEGEIRTTNPVATEQYGSIHHTLLEDHNDESDEQG

SEQ ID NO: 176806 - protein, 35 aa, Artificial Sequence
  Description of Artificial Sequence: Synthetic polypeptide
AEEEIATTNPVATEQYGCSCGNSEDNQEHFNSEQS

SEQ ID NO: 176807 - protein, 35 aa, Artificial Sequence
  Description of Artificial Sequence: Synthetic polypeptide
DETEIACTNPVATAQWGSVSVSGNPLENTGGNEEA

SEQ ID NO: 176808 - protein, 37 aa, Artificial Sequence
  Description of Artificial Sequence: Synthetic polypeptide
DEDEIATTNPVAYEQYGSVAAITNNEEAPGNQMETRM

SEQ ID NO: 176809 - protein, 35 aa, Artificial Sequence
  Description of Artificial Sequence: Synthetic polypeptide
DEEEISTTNPVATEGYGCVCSNWEEHNQNFNSDQS

SEQ ID NO: 176810 - protein, 36 aa, Artificial Sequence
  Description of Artificial Sequence: Synthetic polypeptide
DETEIACTNPVATAQWGSVSVSGTPNENTRGVEESR

SEQ ID NO: 176811 - protein, 31 aa, Artificial Sequence
  Description of Artificial Sequence: Synthetic polypeptide
DDSEVASTNPVSTEGYGCVAAEDIQSRMGQR

SEQ ID NO: 176812 - protein, 36 aa, Artificial Sequence
  Description of Artificial Sequence: Synthetic polypeptide
DEDEIATTNPVAYEQYGSVAACPYNPLATGTNGSVE

SEQ ID NO: 176813 - protein, 34 aa, Artificial Sequence
  Description of Artificial Sequence: Synthetic polypeptide
TEGEIAPTNPCSYEQYGITVSCCNELSQSGTNRG

SEQ ID NO: 176814 - protein, 37 aa, Artificial Sequence
  Description of Artificial Sequence: Synthetic polypeptide
DEEEIRTTNPVATEQYGCVCSNSGELNQENFISDTQS

SEQ ID NO: 176815 - protein, 35 aa, Artificial Sequence
  Description of Artificial Sequence: Synthetic polypeptide
DEDEIATTNPVAYEQYGSVAACPVPLATGTNGSEG

SEQ ID NO: 176816 - protein, 31 aa, Artificial Sequence
  Description of Artificial Sequence: Synthetic polypeptide
DENEVASTNPVSTEGYGNAAAETIQSRVGQR

SEQ ID NO: 176817 - protein, 37 aa, Artificial Sequence
  Description of Artificial Sequence: Synthetic polypeptide
DEEEIRTTNPVATEQYGCVCSNSGEHNQEYFNSDNQS

SEQ ID NO: 176818 - protein, 38 aa, Artificial Sequence
  Description of Artificial Sequence: Synthetic polypeptide
VEEEICTTNPVATEQYGSVSGNNTNGGEGQNEDQDEDD

SEQ ID NO: 176819 - protein, 37 aa, Artificial Sequence
  Description of Artificial Sequence: Synthetic polypeptide
DEEEIRTTNPVATEQYGCVCSNSGEHNQEYFNSDNQA

SEQ ID NO: 176820 - protein, 37 aa, Artificial Sequence
  Description of Artificial Sequence: Synthetic polypeptide
DEEEIRTTNPVATEQYGCVCSNSGEHNQENFSSDNQS

SEQ ID NO: 176821 - protein, 37 aa, Artificial Sequence
  Description of Artificial Sequence: Synthetic polypeptide
DEEEIRTTNPVATEQYGCVCSNSGEHNAENFNSDNQA

SEQ ID NO: 176822 - protein, 37 aa, Artificial Sequence
  Description of Artificial Sequence: Synthetic polypeptide
DEEEIRTTNPVATEQYGCVCSNSGEHNAENFNSDTQS

SEQ ID NO: 176823 - protein, 33 aa, Artificial Sequence
  Description of Artificial Sequence: Synthetic polypeptide
DETCIRTTNPCATEQFGCVCSWEHNQSFGSDQA

SEQ ID NO: 176824 - protein, 37 aa, Artificial Sequence
  Description of Artificial Sequence: Synthetic polypeptide
DEEEIRTTNPVATEQYGCVCSNSGEHNAENFNSNNQS

SEQ ID NO: 176825 - protein, 37 aa, Artificial Sequence
  Description of Artificial Sequence: Synthetic polypeptide
DEEEIRTTNPVATEQYGCVCSNSGEHNAENFNSQFQS

SEQ ID NO: 176826 - protein, 35 aa, Artificial Sequence
  Description of Artificial Sequence: Synthetic polypeptide
DEEEISTTNPVATEGYGCVCFTGEHNTYGGSDTQS

SEQ ID NO: 176827 - protein, 32 aa, Artificial Sequence
  Description of Artificial Sequence: Synthetic polypeptide
DENEISTTNPVSCEPYGTISMEDIQQQQNGNH

SEQ ID NO: 176828 - protein, 37 aa, Artificial Sequence
  Description of Artificial Sequence: Synthetic polypeptide
DEEEIRTTNPVATEQYGCVCSNSGEHNQEHFNSDTQD

SEQ ID NO: 176829 - protein, 37 aa, Artificial Sequence
  Description of Artificial Sequence: Synthetic polypeptide
DEEEIRTTNPVATEQYGCVCSNSGEHNQENFGSDTQA

SEQ ID NO: 176830 - protein, 37 aa, Artificial Sequence
  Description of Artificial Sequence: Synthetic polypeptide
DEEEIRTTNPVATEQYGCVCSNSGEHNQENFGSDTQG

SEQ ID NO: 176831 - protein, 32 aa, Artificial Sequence
  Description of Artificial Sequence: Synthetic polypeptide
DDSEVASTNPVSTEGYGAVAANTIIQSRVGQR

SEQ ID NO: 176832 - protein, 35 aa, Artificial Sequence
  Description of Artificial Sequence: Synthetic polypeptide
DEEEIRTVNPVATEGYGCVCSWEEHNAENFNSQQS

SEQ ID NO: 176833 - protein, 35 aa, Artificial Sequence
  Description of Artificial Sequence: Synthetic polypeptide
AESEIATTNPVATEQYGVVPCWDNHGQDRQGGGAD

SEQ ID NO: 176834 - protein, 36 aa, Artificial Sequence
  Description of Artificial Sequence: Synthetic polypeptide
DEEEIRTTNPVATEQYGCVCSNSGEHNQENFISEQP

SEQ ID NO: 176835 - protein, 33 aa, Artificial Sequence
  Description of Artificial Sequence: Synthetic polypeptide
DETCISTTNPLATEQFGCVCSWGELQSFGSDQA

SEQ ID NO: 176836 - protein, 35 aa, Artificial Sequence
  Description of Artificial Sequence: Synthetic polypeptide
DEEEISTTNPVATEGYGCVCGNWGEHQNFGSETQP

SEQ ID NO: 176837 - protein, 32 aa, Artificial Sequence
  Description of Artificial Sequence: Synthetic polypeptide
TEMEIACTNPCSYEQYGCVCSWNLQSSGSEQS

SEQ ID NO: 176838 - protein, 32 aa, Artificial Sequence
  Description of Artificial Sequence: Synthetic polypeptide
TEMEIACTNPCSYEQYGCVCSWGNLNQSGSEQ

SEQ ID NO: 176839 - protein, 34 aa, Artificial Sequence
  Description of Artificial Sequence: Synthetic polypeptide
DETDEIATTNPVAYERWGSVYITDGDQRNGDQQS

SEQ ID NO: 176840 - protein, 34 aa, Artificial Sequence
  Description of Artificial Sequence: Synthetic polypeptide
DEDEIATTNPVAYEQYGSVAGNGGVTTAENPNSK

SEQ ID NO: 176841 - protein, 33 aa, Artificial Sequence
  Description of Artificial Sequence: Synthetic polypeptide
DENETRTTNPVSTEPYGTISMEDIQQQQNGNHQ

SEQ ID NO: 176842 - protein, 37 aa, Artificial Sequence
  Description of Artificial Sequence: Synthetic polypeptide
DEEEIRTTNPVATEQYGCVCSNSGEHNQENFNSQTQS

SEQ ID NO: 176843 - protein, 33 aa, Artificial Sequence
  Description of Artificial Sequence: Synthetic polypeptide
TESEIACTNPVAYEGYGESCSCENLSQAVGGDD

SEQ ID NO: 176844 - protein, 33 aa, Artificial Sequence
  Description of Artificial Sequence: Synthetic polypeptide
DENETRTTNPVSTEPYGTISMEDIQQQQNGWNH

SEQ ID NO: 176845 - protein, 39 aa, Artificial Sequence
  Description of Artificial Sequence: Synthetic polypeptide
DEEEIRTTNPVATEAYGVVSTTNGQQGNNQNQQGTEQGS

SEQ ID NO: 176846 - protein, 37 aa, Artificial Sequence
  Description of Artificial Sequence: Synthetic polypeptide
DEEEIRTTNPVATEQYGCVCSNSGEHNQENSNSDNQY

SEQ ID NO: 176847 - protein, 32 aa, Artificial Sequence
  Description of Artificial Sequence: Synthetic polypeptide
CEDEIACTNPVATEQYGCVAGTGLAANPHQDD

SEQ ID NO: 176848 - protein, 31 aa, Artificial Sequence
  Description of Artificial Sequence: Synthetic polypeptide
DDSEVASTNPVSTEGYGCVAANTIQSRVGQW

SEQ ID NO: 176849 - protein, 33 aa, Artificial Sequence
  Description of Artificial Sequence: Synthetic polypeptide
DESPIKTTNPVATECWGSFGCINEPEAREGENG

SEQ ID NO: 176850 - protein, 32 aa, Artificial Sequence
  Description of Artificial Sequence: Synthetic polypeptide
DDSEVASTNPVSTEGYGCVANSTIQSRMGSQR

SEQ ID NO: 176851 - protein, 36 aa, Artificial Sequence
  Description of Artificial Sequence: Synthetic polypeptide
DEEEISTTNPVATEGYGCVCSSGEHNQENFGSDNQS

SEQ ID NO: 176852 - protein, 36 aa, Artificial Sequence
  Description of Artificial Sequence: Synthetic polypeptide
DEEEISTTNPVATEGYGCVCSTEDHNQENFGSETQA

SEQ ID NO: 176853 - protein, 39 aa, Artificial Sequence
  Description of Artificial Sequence: Synthetic polypeptide
DEEEIRTTNPVATEAYGTVTNLQSGTISTNTTNQEQGNV

SEQ ID NO: 176854 - protein, 37 aa, Artificial Sequence
  Description of Artificial Sequence: Synthetic polypeptide
DEEEIRTTNPVATEQYGCVCSNSPEHNQEFFNSDNQS

SEQ ID NO: 176855 - protein, 36 aa, Artificial Sequence
  Description of Artificial Sequence: Synthetic polypeptide
DEEEISTTNPVATEGYGCVCSTGEDHNQENFGSEQS

SEQ ID NO: 176856 - protein, 34 aa, Artificial Sequence
  Description of Artificial Sequence: Synthetic polypeptide
TEESIATTNPVAYECWGSVATTNLGGNDTQGDGR

SEQ ID NO: 176857 - protein, 39 aa, Artificial Sequence
  Description of Artificial Sequence: Synthetic polypeptide
DEEEIRTTNPVATEAYGTVTNLQSGTISTNTQNGEQGNN

SEQ ID NO: 176858 - protein, 39 aa, Artificial Sequence
  Description of Artificial Sequence: Synthetic polypeptide
DEEEIRTTNPVATEAYGTVTNLQSGTISTNTQGQEQGNA

SEQ ID NO: 176859 - protein, 34 aa, Artificial Sequence
  Description of Artificial Sequence: Synthetic polypeptide
DETEIACTNPVATEQWGSVSATGDPMADTGGEDN

SEQ ID NO: 176860 - protein, 39 aa, Artificial Sequence
  Description of Artificial Sequence: Synthetic polypeptide
DEEEIRTTNPVATEAYGTVTNLQSGTISTNTNNQEGTNV

SEQ ID NO: 176861 - protein, 31 aa, Artificial Sequence
  Description of Artificial Sequence: Synthetic polypeptide
CEDEIACTNPVATEQWGCVAGTGDAMMEKRN

SEQ ID NO: 176862 - protein, 35 aa, Artificial Sequence
  Description of Artificial Sequence: Synthetic polypeptide
DEEEIRTTNPVATEQYGCTCSMWEEHNQSIISDQS

SEQ ID NO: 176863 - protein, 31 aa, Artificial Sequence
  Description of Artificial Sequence: Synthetic polypeptide
CEDEIACTNPVATEQWGCVAGTGDAMDMEGR

SEQ ID NO: 176864 - protein, 36 aa, Artificial Sequence
  Description of Artificial Sequence: Synthetic polypeptide
DEEEISTTNPVATEGYGCVCSWEEHNQENFGSENQS

SEQ ID NO: 176865 - protein, 32 aa, Artificial Sequence
  Description of Artificial Sequence: Synthetic polypeptide
DDSEVASTNPVSTEGYGCVANWTINQNRFGQR

SEQ ID NO: 176866 - protein, 35 aa, Artificial Sequence
  Description of Artificial Sequence: Synthetic polypeptide
DEEEISTTNPVATEGYGCVCSWEHNQENFNSNNQS

SEQ ID NO: 176867 - protein, 38 aa, Artificial Sequence
  Description of Artificial Sequence: Synthetic polypeptide
VEEEIRTTNPVATDQYGSVNMNLIMQEGLQEENGSAEQ

SEQ ID NO: 176868 - protein, 30 aa, Artificial Sequence
  Description of Artificial Sequence: Synthetic polypeptide
TESEIASTNPVGTEGWGVCAPTDLQHPGDI

SEQ ID NO: 176869 - protein, 35 aa, Artificial Sequence
  Description of Artificial Sequence: Synthetic polypeptide
DEEEISTTNPVATEGYGCVCSWGEHNANFNSENQA

SEQ ID NO: 176870 - protein, 34 aa, Artificial Sequence
  Description of Artificial Sequence: Synthetic polypeptide
DEEEISTTNPVATEGYGCVCSWGEHNINFNSDQS

SEQ ID NO: 176871 - protein, 31 aa, Artificial Sequence
  Description of Artificial Sequence: Synthetic polypeptide
DDSEVASTNPVSTEGWGNVAANTIQSRVGQR

SEQ ID NO: 176872 - protein, 36 aa, Artificial Sequence
  Description of Artificial Sequence: Synthetic polypeptide
CEEEIRTTNPVATEQYGCVCSWMEDHQENFNSDPQS

SEQ ID NO: 176873 - protein, 36 aa, Artificial Sequence
  Description of Artificial Sequence: Synthetic polypeptide
DEEEISTTNPVATEGYGCVCSWGEHNQENFGSENQD

SEQ ID NO: 176874 - protein, 35 aa, Artificial Sequence
  Description of Artificial Sequence: Synthetic polypeptide
DEDEIATTNPVAYEQYGSCASGHGDNTAGGDNMHM

SEQ ID NO: 176875 - protein, 31 aa, Artificial Sequence
  Description of Artificial Sequence: Synthetic polypeptide
DDSEVASTNPVSTEGYGCVANNTIQEHMGQR

SEQ ID NO: 176876 - protein, 36 aa, Artificial Sequence
  Description of Artificial Sequence: Synthetic polypeptide
VEEEIGTTNPVATEQYGSVSLSPWLTMVSLPEEELE

SEQ ID NO: 176877 - protein, 35 aa, Artificial Sequence
  Description of Artificial Sequence: Synthetic polypeptide
DEEEISTTNPVATEGYGCVCSSGEHNAENFNSEQS

SEQ ID NO: 176878 - protein, 33 aa, Artificial Sequence
  Description of Artificial Sequence: Synthetic polypeptide
AEEEIATTNPVATEQYGCSCPWYDNQHFMSEQS

SEQ ID NO: 176879 - protein, 34 aa, Artificial Sequence
  Description of Artificial Sequence: Synthetic polypeptide
TEGEEIATTNPVAYEQWGVVAWTDNQETDQHGSS

SEQ ID NO: 176880 - protein, 31 aa, Artificial Sequence
  Description of Artificial Sequence: Synthetic polypeptide
DDSEVASTNPVSTEGYGCVAAVTIQSRVGQR

SEQ ID NO: 176881 - protein, 34 aa, Artificial Sequence
  Description of Artificial Sequence: Synthetic polypeptide
TEGCIRTTNPSAYEQYGTTVSCTQNVSQLSPGDN

SEQ ID NO: 176882 - protein, 31 aa, Artificial Sequence
  Description of Artificial Sequence: Synthetic polypeptide
TEGCIASVNPVCYEQWGVVSINELSQSGGNQ

SEQ ID NO: 176883 - protein, 35 aa, Artificial Sequence
  Description of Artificial Sequence: Synthetic polypeptide
AEEEIATTNPVATEQYGCSCPNSEDNAEHFNSEQA

SEQ ID NO: 176884 - protein, 35 aa, Artificial Sequence
  Description of Artificial Sequence: Synthetic polypeptide
TEGAEIATTNPVAYEQWGSVSKMNGDDQQRGGDAP

SEQ ID NO: 176885 - protein, 34 aa, Artificial Sequence
  Description of Artificial Sequence: Synthetic polypeptide
DETEIACTNPVATEQWGCVAGTGQLQNPMGGTLH

SEQ ID NO: 176886 - protein, 35 aa, Artificial Sequence
  Description of Artificial Sequence: Synthetic polypeptide
CEDEIACTNPVATEQYGSACSAPNLQDSPDENANE

SEQ ID NO: 176887 - protein, 36 aa, Artificial Sequence
  Description of Artificial Sequence: Synthetic polypeptide
TEGAEIATTNPVAYEQWGSVCSTDNGERMEGGNNGI

SEQ ID NO: 176888 - protein, 31 aa, Artificial Sequence
  Description of Artificial Sequence: Synthetic polypeptide
DDSEVASTNPVSTEGYGCVADWEIQERVGQR

SEQ ID NO: 176889 - protein, 38 aa, Artificial Sequence
  Description of Artificial Sequence: Synthetic polypeptide
DEEEIRTTNPVATEAYGVVSTTNGEQGNNNNQGTEQGQ

SEQ ID NO: 176890 - protein, 33 aa, Artificial Sequence
  Description of Artificial Sequence: Synthetic polypeptide
TEFEICTTNPVAYEPYGESVSCDNASMRVTSEE

SEQ ID NO: 176891 - protein, 31 aa, Artificial Sequence
  Description of Artificial Sequence: Synthetic polypeptide
DDSEVASTNPVSTEGYGCVADWTIQVRSGQR

SEQ ID NO: 176892 - protein, 35 aa, Artificial Sequence
  Description of Artificial Sequence: Synthetic polypeptide
AEEEIATTNPVATEQYGCSCPSGEDNAEHFNSEQF

SEQ ID NO: 176893 - protein, 35 aa, Artificial Sequence
  Description of Artificial Sequence: Synthetic polypeptide
AEEEIATTNPVATEQYGCSCPSGEGDNQEHFNSEQ

SEQ ID NO: 176894 - protein, 34 aa, Artificial Sequence
  Description of Artificial Sequence: Synthetic polypeptide
AEEEIATTNPVATEQYGCSCPTSEDQEHFSSEQS

SEQ ID NO: 176895 - protein, 32 aa, Artificial Sequence
  Description of Artificial Sequence: Synthetic polypeptide
DDSEVASTNPVSTEGYGCVAENVTIQSRVGER

SEQ ID NO: 176896 - protein, 30 aa, Artificial Sequence
  Description of Artificial Sequence: Synthetic polypeptide
TESEIASTNPVGTEGWGVCAPTDLQHGDGS

SEQ ID NO: 176897 - protein, 35 aa, Artificial Sequence
  Description of Artificial Sequence: Synthetic polypeptide
DEEEISTTNPVATEGYGCVCSNWGEHQNFISDNQI

SEQ ID NO: 176898 - protein, 36 aa, Artificial Sequence
  Description of Artificial Sequence: Synthetic polypeptide
DEDEIATTNPVAYEQYGSVAACPNGLAEGTNGGSVG

SEQ ID NO: 176899 - protein, 37 aa, Artificial Sequence
  Description of Artificial Sequence: Synthetic polypeptide
DEEEIRTTNPVATEQYGCVCSNSMEHEAENFNSDNQS

SEQ ID NO: 176900 - protein, 31 aa, Artificial Sequence
  Description of Artificial Sequence: Synthetic polypeptide
TESEIASTNPVGTEGWGVCAPTDLQHGDNAE

SEQ ID NO: 176901 - protein, 33 aa, Artificial Sequence
  Description of Artificial Sequence: Synthetic polypeptide
AEEEIATTNPVATEQYGCSCPWGADNQHISEQS

SEQ ID NO: 176902 - protein, 34 aa, Artificial Sequence
  Description of Artificial Sequence: Synthetic polypeptide
AEEEIATTNPVATEQYGCSCPWMEDNQNFNSEQA

SEQ ID NO: 176903 - protein, 36 aa, Artificial Sequence
  Description of Artificial Sequence: Synthetic polypeptide
DEQEIATTNPVATEQYGCVVAANGSLPPDSQENGRM

SEQ ID NO: 176904 - protein, 37 aa, Artificial Sequence
  Description of Artificial Sequence: Synthetic polypeptide
VEEEIRSTNPVATEQYGSVNMTFGEADQQTGGENGDT

SEQ ID NO: 176905 - protein, 36 aa, Artificial Sequence
  Description of Artificial Sequence: Synthetic polypeptide
DETCEIATTNPVAYEQYGTVATSNGGMQNGGQRGEA

SEQ ID NO: 176906 - protein, 31 aa, Artificial Sequence
  Description of Artificial Sequence: Synthetic polypeptide
DETAVRTTNPLATYQFGSISCMHAEGPNGNI

SEQ ID NO: 176907 - protein, 33 aa, Artificial Sequence
  Description of Artificial Sequence: Synthetic polypeptide
DETAVRTTNPLATEQFGASVSSCMHAEGPNGNI

SEQ ID NO: 176908 - protein, 36 aa, Artificial Sequence
  Description of Artificial Sequence: Synthetic polypeptide
DEEEIRTVNPVATEQYGCVCSSGEDHNQEYFNSQQA

SEQ ID NO: 176909 - protein, 35 aa, Artificial Sequence
  Description of Artificial Sequence: Synthetic polypeptide
DESTIETTNPVATEQYGDIVVGIMNNDQGGGGNDQ

SEQ ID NO: 176910 - protein, 35 aa, Artificial Sequence
  Description of Artificial Sequence: Synthetic polypeptide
DEQEIATTNPVATEQYGCVAANGDGTGTHGGDPRQ

SEQ ID NO: 176911 - protein, 34 aa, Artificial Sequence
  Description of Artificial Sequence: Synthetic polypeptide
DEQEIATTNPVATEQYGCVAANGDPATMPMGDTH

SEQ ID NO: 176912 - protein, 34 aa, Artificial Sequence
  Description of Artificial Sequence: Synthetic polypeptide
AETEEIATTNPVAYEQWGTVSTGGNAGEHQGTDE

SEQ ID NO: 176913 - protein, 34 aa, Artificial Sequence
  Description of Artificial Sequence: Synthetic polypeptide
AETDEIATTNPVAYERWGSVYITDNDQRNGDIEL

SEQ ID NO: 176914 - protein, 37 aa, Artificial Sequence
  Description of Artificial Sequence: Synthetic polypeptide
DEEEIRTTNPVATEQYGCVCSNSGEDHNAENFNSEQS

SEQ ID NO: 176915 - protein, 35 aa, Artificial Sequence
  Description of Artificial Sequence: Synthetic polypeptide
DESTIRTTNPVATEQYGDIVVGIMNNDQGGGDQDL

SEQ ID NO: 176916 - protein, 36 aa, Artificial Sequence
  Description of Artificial Sequence: Synthetic polypeptide
DESTIRTTNPVATEQYGDIVVGIMNNDQGGNGDNDQ

SEQ ID NO: 176917 - protein, 36 aa, Artificial Sequence
  Description of Artificial Sequence: Synthetic polypeptide
DESTIRTTNPVATEQYGDIVVGQNMNNDQGGGDNDQ

SEQ ID NO: 176918 - protein, 34 aa, Artificial Sequence
  Description of Artificial Sequence: Synthetic polypeptide
DEQEIATTNPVATEQYGCVAANGDATAPMGDPHH

SEQ ID NO: 176919 - protein, 34 aa, Artificial Sequence
  Description of Artificial Sequence: Synthetic polypeptide
DEQEIATTNPVATEQYGCVAANGDATAPAGDTHW

SEQ ID NO: 176920 - protein, 35 aa, Artificial Sequence
  Description of Artificial Sequence: Synthetic polypeptide
TEPSDEIATTNPVAYEQWGEVTTGNQQDRDGDNQG

SEQ ID NO: 176921 - protein, 35 aa, Artificial Sequence
  Description of Artificial Sequence: Synthetic polypeptide
TESCSEIATTNPVAYEQWGSVSWGDNLQHQDGTDV

SEQ ID NO: 176922 - protein, 34 aa, Artificial Sequence
  Description of Artificial Sequence: Synthetic polypeptide
TEPDEIATTNPVAYEQWGVVATGSQQDRNGDNEP

SEQ ID NO: 176923 - protein, 35 aa, Artificial Sequence
  Description of Artificial Sequence: Synthetic polypeptide
DEQEIATTNPVATEQYGCVAANNGDADTGGGDPRN

SEQ ID NO: 176924 - protein, 37 aa, Artificial Sequence
  Description of Artificial Sequence: Synthetic polypeptide
DEAEIRTTNPVATEQYGSVNNTIEPWLMEGGMGEVSL

SEQ ID NO: 176925 - protein, 37 aa, Artificial Sequence
  Description of Artificial Sequence: Synthetic polypeptide
DEAEIRTTNPVATEQYGSVNNTEEPLVEGGMGEVMSL

SEQ ID NO: 176926 - protein, 37 aa, Artificial Sequence
  Description of Artificial Sequence: Synthetic polypeptide
DEAEIRTTNPVATEQYGSVNNPIETLWEGGWSEINSG

SEQ ID NO: 176927 - protein, 34 aa, Artificial Sequence
  Description of Artificial Sequence: Synthetic polypeptide
TENEIRTTNPVSTEPYGTVISMEDMISQQQNGNH

SEQ ID NO: 176928 - protein, 36 aa, Artificial Sequence
  Description of Artificial Sequence: Synthetic polypeptide
DEAEIRTTNPVATEQYGSVNNPEETLWIGGDSEISG

SEQ ID NO: 176929 - protein, 34 aa, Artificial Sequence
  Description of Artificial Sequence: Synthetic polypeptide
DESSIATTNPTAYEQWGSYYSFDNDLKRSNGDSR

SEQ ID NO: 176930 - protein, 37 aa, Artificial Sequence
  Description of Artificial Sequence: Synthetic polypeptide
DEDEIRTTNPVATEGYGMVSNNDEFQEIFTDDGNQGE

SEQ ID NO: 176931 - protein, 36 aa, Artificial Sequence
  Description of Artificial Sequence: Synthetic polypeptide
DEAEIRTTNPVATEQYGSVNNIEPILWEGGSEEGSL

SEQ ID NO: 176932 - protein, 35 aa, Artificial Sequence
  Description of Artificial Sequence: Synthetic polypeptide
DEQEIATTNPVATEQYGCVAANNGDTANAMITNEH

SEQ ID NO: 176933 - protein, 33 aa, Artificial Sequence
  Description of Artificial Sequence: Synthetic polypeptide
AETEIACTNPVATEQWGATAANAEDWQERGPYR

SEQ ID NO: 176934 - protein, 37 aa, Artificial Sequence
  Description of Artificial Sequence: Synthetic polypeptide
TENEIRTTNPVATEQYGSVPNCESNELSQIAVTNYEP

SEQ ID NO: 176935 - protein, 36 aa, Artificial Sequence
  Description of Artificial Sequence: Synthetic polypeptide
VEEEIATTNPVATEQYGSACSADNPLPAEAPIGDHG

SEQ ID NO: 176936 - protein, 35 aa, Artificial Sequence
  Description of Artificial Sequence: Synthetic polypeptide
DESTICTTNPVATEFYGQYSVDINGLEQGEGAQED

SEQ ID NO: 176937 - protein, 30 aa, Artificial Sequence
  Description of Artificial Sequence: Synthetic polypeptide
CEDEIACTNPVATEQWGCVAGTGQDAMMED

SEQ ID NO: 176938 - protein, 33 aa, Artificial Sequence
  Description of Artificial Sequence: Synthetic polypeptide
CEDEIACTNPVATEQWGCVAGTGLEAAGMNFMD

SEQ ID NO: 176939 - protein, 37 aa, Artificial Sequence
  Description of Artificial Sequence: Synthetic polypeptide
DEEEIRTVNPVATEQYGCVCSTWEEHNAENFNSQNQS

SEQ ID NO: 176940 - protein, 34 aa, Artificial Sequence
  Description of Artificial Sequence: Synthetic polypeptide
DEQEIATTNPVATEQYGCVAANGDATMTMGEPHN

SEQ ID NO: 176941 - protein, 33 aa, Artificial Sequence
  Description of Artificial Sequence: Synthetic polypeptide
DESSIATTNPVAYEGWGSVATTNLGGDTQGDGG

SEQ ID NO: 176942 - protein, 33 aa, Artificial Sequence
  Description of Artificial Sequence: Synthetic polypeptide
DESSIATTNPVAYECWGSVYNWMNDVAREGHNN

SEQ ID NO: 176943 - protein, 33 aa, Artificial Sequence
  Description of Artificial Sequence: Synthetic polypeptide
DENELRTTNPVSTEPYGTISMEDPIQQQTNGNH

SEQ ID NO: 176944 - protein, 36 aa, Artificial Sequence
  Description of Artificial Sequence: Synthetic polypeptide
VEEEIATTNPVATEQWGSVSGEGGPGENTASGNMES

SEQ ID NO: 176945 - protein, 32 aa, Artificial Sequence
  Description of Artificial Sequence: Synthetic polypeptide
AETEIACTNPVATEQWGEAANAEDWQERGPYR

SEQ ID NO: 176946 - protein, 32 aa, Artificial Sequence
  Description of Artificial Sequence: Synthetic polypeptide
DENEIYTTNPVSTEPYGTISMEDIQQQQNVNH

SEQ ID NO: 176947 - protein, 34 aa, Artificial Sequence
  Description of Artificial Sequence: Synthetic polypeptide
DEQEIATTNPVATEQYGCVAANGDATMPMGDPLN

SEQ ID NO: 176948 - protein, 35 aa, Artificial Sequence
  Description of Artificial Sequence: Synthetic polypeptide
TEQNEIATTNPVAYEHWGSVATGDLGDHQGGNGQR

SEQ ID NO: 176949 - protein, 38 aa, Artificial Sequence
  Description of Artificial Sequence: Synthetic polypeptide
TEQEIRTTNPVATEQYGSVVMSVNDNNTGGGQTGQNGD

SEQ ID NO: 176950 - protein, 32 aa, Artificial Sequence
  Description of Artificial Sequence: Synthetic polypeptide
DENEIYTTNPVSTEPYGTISMEDIQQQQNGEH

SEQ ID NO: 176951 - protein, 35 aa, Artificial Sequence
  Description of Artificial Sequence: Synthetic polypeptide
DESTEIATTNPVAYEQWGSVSGPNTGNQGGMGGDD

SEQ ID NO: 176952 - protein, 36 aa, Artificial Sequence
  Description of Artificial Sequence: Synthetic polypeptide
DEDEIRTTNPVATEFYGVVSTDQGQDQTDEGGQGGI

SEQ ID NO: 176953 - protein, 35 aa, Artificial Sequence
  Description of Artificial Sequence: Synthetic polypeptide
TESCIRTTNPVATECWGSVVSCGHEQSQDREGENG

SEQ ID NO: 176954 - protein, 34 aa, Artificial Sequence
  Description of Artificial Sequence: Synthetic polypeptide
DEQEIATTNPVATEQYGCVAANGDEAMPGGDPHM

SEQ ID NO: 176955 - protein, 37 aa, Artificial Sequence
  Description of Artificial Sequence: Synthetic polypeptide
VEEEIATTNPVATEQWGSVSMSGDTPTNNDDGMGNHD

SEQ ID NO: 176956 - protein, 36 aa, Artificial Sequence
  Description of Artificial Sequence: Synthetic polypeptide
VEEEIATTNPVATEQWGSVSMSGDTPTNNDDLENDM

SEQ ID NO: 176957 - protein, 32 aa, Artificial Sequence
  Description of Artificial Sequence: Synthetic polypeptide
TEQEICTTNPVAYEPYGQSVSWGASMRVTSEE

SEQ ID NO: 176958 - protein, 33 aa, Artificial Sequence
  Description of Artificial Sequence: Synthetic polypeptide
TESCIRTTNPVAYEEYGTTVSCSQNVSQSSGEN

SEQ ID NO: 176959 - protein, 35 aa, Artificial Sequence
  Description of Artificial Sequence: Synthetic polypeptide
DEQEIATTNPVATEQYGCVAANGDEATMPGGDPRH

SEQ ID NO: 176960 - protein, 34 aa, Artificial Sequence
  Description of Artificial Sequence: Synthetic polypeptide
DESTICTTNPVATEFYGQYSVDINGLEGQGDDED

SEQ ID NO: 176961 - protein, 36 aa, Artificial Sequence
  Description of Artificial Sequence: Synthetic polypeptide
DESTICTTNPVATEFYGQYSVDINGLEQGDGDDNDD

SEQ ID NO: 176962 - protein, 35 aa, Artificial Sequence
  Description of Artificial Sequence: Synthetic polypeptide
DESTICTTNPVATEFYGQYSVDINGLEQGEGDEEF

SEQ ID NO: 176963 - protein, 38 aa, Artificial Sequence
  Description of Artificial Sequence: Synthetic polypeptide
DEAEIRTTNPVATEQYGSVNGTAINEYHDSRSEENFEE

SEQ ID NO: 176964 - protein, 34 aa, Artificial Sequence
  Description of Artificial Sequence: Synthetic polypeptide
DENEIVTTNPVATEQYGTVCSAEDIEVENAEEDA

SEQ ID NO: 176965 - protein, 35 aa, Artificial Sequence
  Description of Artificial Sequence: Synthetic polypeptide
DEQEIATTNPVATEQYGCVAANNGDVTTDDGNTEN

SEQ ID NO: 176966 - protein, 37 aa, Artificial Sequence
  Description of Artificial Sequence: Synthetic polypeptide
DEEEIRTTNPVATEQYGCVCSNSGEDHNQEFFGSDQE

SEQ ID NO: 176967 - protein, 36 aa, Artificial Sequence
  Description of Artificial Sequence: Synthetic polypeptide
DETAEIATTNPVAYEQYGSVAITNHEEQTGELGEQM

SEQ ID NO: 176968 - protein, 37 aa, Artificial Sequence
  Description of Artificial Sequence: Synthetic polypeptide
DETAEIATTNPVAYEQYGSVAITNHLEQTGELDGEQN

SEQ ID NO: 176969 - protein, 36 aa, Artificial Sequence
  Description of Artificial Sequence: Synthetic polypeptide
CEEEIRTTNPVATEQYGCVCSWGEHNQENFNSETQA

SEQ ID NO: 176970 - protein, 37 aa, Artificial Sequence
  Description of Artificial Sequence: Synthetic polypeptide
DEEEIRTTNPVATEQYGCVCSNSGEDHNQEGFGSDQA

SEQ ID NO: 176971 - protein, 33 aa, Artificial Sequence
  Description of Artificial Sequence: Synthetic polypeptide
TENEIATTNPVATEGYGCVCSWELQEHFSSELA

SEQ ID NO: 176972 - protein, 35 aa, Artificial Sequence
  Description of Artificial Sequence: Synthetic polypeptide
DETAEIATTNPVAYEQYGSVATPHGQGSPMGQLMD

SEQ ID NO: 176973 - protein, 33 aa, Artificial Sequence
  Description of Artificial Sequence: Synthetic polypeptide
TENEIATTNPVATEGYGCVCSWELNQEHFISEL

SEQ ID NO: 176974 - protein, 34 aa, Artificial Sequence
  Description of Artificial Sequence: Synthetic polypeptide
DEDEIATTNPVAYEQYGSVAITHGTGAPGGSMSN

SEQ ID NO: 176975 - protein, 38 aa, Artificial Sequence
  Description of Artificial Sequence: Synthetic polypeptide
DEEEIRTTNPVATEQYGCVCSNSGEDHNQENFGSENQA

SEQ ID NO: 176976 - protein, 38 aa, Artificial Sequence
  Description of Artificial Sequence: Synthetic polypeptide
DEEEIRTTNPVATEQYGCVCSNSGEDHNQENFGSENQS

SEQ ID NO: 176977 - protein, 38 aa, Artificial Sequence
  Description of Artificial Sequence: Synthetic polypeptide
DEEEIRTTNPVATEQYGCVCSNSGEDHNQENFGSQNQS

SEQ ID NO: 176978 - protein, 35 aa, Artificial Sequence
  Description of Artificial Sequence: Synthetic polypeptide
DEQEIATTNPVATEQYGCVAANSGNPQAEMEPEGH

SEQ ID NO: 176979 - protein, 37 aa, Artificial Sequence
  Description of Artificial Sequence: Synthetic polypeptide
DEEEIRTTNPVATEQYGCVCSNSGEDHNQNFISDNQS

SEQ ID NO: 176980 - protein, 37 aa, Artificial Sequence
  Description of Artificial Sequence: Synthetic polypeptide
DEEEIRTTNPVATEQYGCVCSNSGEDHQEFFGSDTQD

SEQ ID NO: 176981 - protein, 37 aa, Artificial Sequence
  Description of Artificial Sequence: Synthetic polypeptide
DEEEIRTTNPVATEQYGCVCSNSGEDINQENFNSDQS

SEQ ID NO: 176982 - protein, 37 aa, Artificial Sequence
  Description of Artificial Sequence: Synthetic polypeptide
DEEEIRTTNPVATEQYGCVCSNSGEDNQENFNSDNQY

SEQ ID NO: 176983 - protein, 34 aa, Artificial Sequence
  Description of Artificial Sequence: Synthetic polypeptide
DENEISTTNPVSTEPYGTISWEDINQEQFGSNQS

SEQ ID NO: 176984 - protein, 33 aa, Artificial Sequence
  Description of Artificial Sequence: Synthetic polypeptide
DENEISTTNPVSTEPYGTISMEDIQQQQNGNNH

SEQ ID NO: 176985 - protein, 33 aa, Artificial Sequence
  Description of Artificial Sequence: Synthetic polypeptide
DENEISTTNPVSTEPYGTISCDEDIQQQQNGNH

SEQ ID NO: 176986 - protein, 31 aa, Artificial Sequence
  Description of Artificial Sequence: Synthetic polypeptide
DENENATTNPVAYEQWGTVSKEIEMNGKEDG

SEQ ID NO: 176987 - protein, 36 aa, Artificial Sequence
  Description of Artificial Sequence: Synthetic polypeptide
TENEIATTNPTATEIYGSVCSNWNDGQDRQDGGEER

SEQ ID NO: 176988 - protein, 37 aa, Artificial Sequence
  Description of Artificial Sequence: Synthetic polypeptide
DEEEIRTTNPVATEQYGCVCSNSGEHDQENFNSDNQA

SEQ ID NO: 176989 - protein, 35 aa, Artificial Sequence
  Description of Artificial Sequence: Synthetic polypeptide
DEQEIATTNPVATEQYGCVAANTNGGEATMNPEVH

SEQ ID NO: 176990 - protein, 37 aa, Artificial Sequence
  Description of Artificial Sequence: Synthetic polypeptide
DEEEIRTTNPVATEQYGCVCSNSGEHNAEGFNSDNQS

SEQ ID NO: 176991 - protein, 37 aa, Artificial Sequence
  Description of Artificial Sequence: Synthetic polypeptide
DEEEIRTTNPVATEQYGCVCSNSGEDHNIENFGSDQS

SEQ ID NO: 176992 - protein, 38 aa, Artificial Sequence
  Description of Artificial Sequence: Synthetic polypeptide
DEEEIRTTNPVATEQYGCVCSNSGEDHNEENFGSDNQA

SEQ ID NO: 176993 - protein, 33 aa, Artificial Sequence
  Description of Artificial Sequence: Synthetic polypeptide
DESSIAATNPVAYDPWGMVPSCTAEHSQRGGNR

SEQ ID NO: 176994 - protein, 32 aa, Artificial Sequence
  Description of Artificial Sequence: Synthetic polypeptide
DDSEVACTNPVSTEPYGNVCYNTDQQSRVGQR

SEQ ID NO: 176995 - protein, 36 aa, Artificial Sequence
  Description of Artificial Sequence: Synthetic polypeptide
TENEIRTTNPVATEQYGHVPNCASNELSQIVTNYEG

SEQ ID NO: 176996 - protein, 36 aa, Artificial Sequence
  Description of Artificial Sequence: Synthetic polypeptide
CEEEIRTTNPVATEQYGCVCSWGEDHNEEHFNSDQE

SEQ ID NO: 176997 - protein, 36 aa, Artificial Sequence
  Description of Artificial Sequence: Synthetic polypeptide
CEEEIRTTNPVATEQYGCVCSWGEDHNQEFFGSDQS

SEQ ID NO: 176998 - protein, 37 aa, Artificial Sequence
  Description of Artificial Sequence: Synthetic polypeptide
DEAEIRTTNPVATEQYGSVMVTAANQMDTGYSEEMES

SEQ ID NO: 176999 - protein, 35 aa, Artificial Sequence
  Description of Artificial Sequence: Synthetic polypeptide
DEEEISTTNPVATEEYGCVCSWEEHNQNFNSDTQS

SEQ ID NO: 177000 - protein, 37 aa, Artificial Sequence
  Description of Artificial Sequence: Synthetic polypeptide
DEAEIRTTNPVATEQYGSVMVTAANCEDTGYSEEVES

SEQ ID NO: 177001 - protein, 36 aa, Artificial Sequence
  Description of Artificial Sequence: Synthetic polypeptide
DEAEIRTTNPVATEQYGSVLMAMVAEVESRQQEDRI

SEQ ID NO: 177002 - protein, 36 aa, Artificial Sequence
  Description of Artificial Sequence: Synthetic polypeptide
CEEEIRTTNPVATEQYGCVCSWGEHNQEHFNSDNQG

SEQ ID NO: 177003 - protein, 35 aa, Artificial Sequence
  Description of Artificial Sequence: Synthetic polypeptide
DEAEIRTTNPVATEQYGSVLDDMAEVESRQQEDSI

SEQ ID NO: 177004 - protein, 36 aa, Artificial Sequence
  Description of Artificial Sequence: Synthetic polypeptide
DEAEIRTTNPVATEQYGSVLDAMAEVESRSQQEDHI

SEQ ID NO: 177005 - protein, 32 aa, Artificial Sequence
  Description of Artificial Sequence: Synthetic polypeptide
DENEIVTTNPVATEQWGTVCSEIEVENAEEDA

SEQ ID NO: 177006 - protein, 33 aa, Artificial Sequence
  Description of Artificial Sequence: Synthetic polypeptide
TENEIRTTNPVATECWGKVPSEIESMNAAEGDA

SEQ ID NO: 177007 - protein, 36 aa, Artificial Sequence
  Description of Artificial Sequence: Synthetic polypeptide
DEDEIATTNPVAYEQYGSACSVANDLQNHADENGHH

SEQ ID NO: 177008 - protein, 33 aa, Artificial Sequence
  Description of Artificial Sequence: Synthetic polypeptide
DETAEIACTNPVAYEQYGSVAAHFQTSGGGLDE

SEQ ID NO: 177009 - protein, 35 aa, Artificial Sequence
  Description of Artificial Sequence: Synthetic polypeptide
AEEEIATTNPVATEGYGSVCAATGEEADSGDNNHM

SEQ ID NO: 177010 - protein, 35 aa, Artificial Sequence
  Description of Artificial Sequence: Synthetic polypeptide
DEQEIATTNPVATEQYGCVAANNGGVTTDDGNMEQ

SEQ ID NO: 177011 - protein, 32 aa, Artificial Sequence
  Description of Artificial Sequence: Synthetic polypeptide
TENEIATTNPVAYEQWGYCQEDLKRGMDERGK

SEQ ID NO: 177012 - protein, 35 aa, Artificial Sequence
  Description of Artificial Sequence: Synthetic polypeptide
DEEEISTTNPVATEAYGCVCSNWGEHQENFNSDQS

SEQ ID NO: 177013 - protein, 32 aa, Artificial Sequence
  Description of Artificial Sequence: Synthetic polypeptide
TENEIATTNPVAYEQWGGVYSIEIEMNQREDL

SEQ ID NO: 177014 - protein, 36 aa, Artificial Sequence
  Description of Artificial Sequence: Synthetic polypeptide
DEQEIATTNPVATEQYGCVAANSGNPQAEAEPNNHH

SEQ ID NO: 177015 - protein, 36 aa, Artificial Sequence
  Description of Artificial Sequence: Synthetic polypeptide
DESEIRTTNPVATEQYGDVVVDDFNFGQGEGDEHET

SEQ ID NO: 177016 - protein, 34 aa, Artificial Sequence
  Description of Artificial Sequence: Synthetic polypeptide
DETAEIATTNPVAYECWGSVYHPNNDTQHGGNVA

SEQ ID NO: 177017 - protein, 32 aa, Artificial Sequence
  Description of Artificial Sequence: Synthetic polypeptide
TENEIATTNPVAYEQWGCLSCDEHDDRQNGSR

SEQ ID NO: 177018 - protein, 35 aa, Artificial Sequence
  Description of Artificial Sequence: Synthetic polypeptide
DETAEIATTNPVAYEQWGAVSGPNSGNQGGMNGDQ

SEQ ID NO: 177019 - protein, 34 aa, Artificial Sequence
  Description of Artificial Sequence: Synthetic polypeptide
DETAEIATTNPVAYEQWGCVCHNNDQMDTGGNAP

SEQ ID NO: 177020 - protein, 37 aa, Artificial Sequence
  Description of Artificial Sequence: Synthetic polypeptide
DESEIRTTNPVATEQYGDVTVNDGDEEGQNEGENVEE

SEQ ID NO: 177021 - protein, 34 aa, Artificial Sequence
  Description of Artificial Sequence: Synthetic polypeptide
DENEIVTTNPVATEQWGTVCSATDGPVENFEGDD

SEQ ID NO: 177022 - protein, 37 aa, Artificial Sequence
  Description of Artificial Sequence: Synthetic polypeptide
DEEEISTTNPVATEQYGCVCSMTGEHNQEYFGSETQS

SEQ ID NO: 177023 - protein, 36 aa, Artificial Sequence
  Description of Artificial Sequence: Synthetic polypeptide
DEDEIATTNPVAYEQYGSACSANPALQAHGDDLAAM

SEQ ID NO: 177024 - protein, 35 aa, Artificial Sequence
  Description of Artificial Sequence: Synthetic polypeptide
DENEISTTNPVATEQYGQCVCSSEHNANFNSDNQA

SEQ ID NO: 177025 - protein, 31 aa, Artificial Sequence
  Description of Artificial Sequence: Synthetic polypeptide
DENEVRTTNPVATEQWGDVAAEIEMNAAEDA

SEQ ID NO: 177026 - protein, 32 aa, Artificial Sequence
  Description of Artificial Sequence: Synthetic polypeptide
DETEIASVNPIATEQWGVTVSNAENWQSKGPI

SEQ ID NO: 177027 - protein, 36 aa, Artificial Sequence
  Description of Artificial Sequence: Synthetic polypeptide
DEEEIRTTNPVTTEHWGVVYCWEPNDQDSQRQGGNS

SEQ ID NO: 177028 - protein, 36 aa, Artificial Sequence
  Description of Artificial Sequence: Synthetic polypeptide
AEEEICTTNPVATEQYGVVATTNEQQGTQQGTEDEE

SEQ ID NO: 177029 - protein, 35 aa, Artificial Sequence
  Description of Artificial Sequence: Synthetic polypeptide
AEEEICTTNPVATEQYGVVATVAEQGTEQGEEDEG

SEQ ID NO: 177030 - protein, 35 aa, Artificial Sequence
  Description of Artificial Sequence: Synthetic polypeptide
AEEEICTTNPVATEQYGVVATVAEQSAEQGEEEEG

SEQ ID NO: 177031 - protein, 35 aa, Artificial Sequence
  Description of Artificial Sequence: Synthetic polypeptide
AEEEICTTNPVATEQYGVVATVAEQVAEQGEEEGN

SEQ ID NO: 177032 - protein, 35 aa, Artificial Sequence
  Description of Artificial Sequence: Synthetic polypeptide
AEEEICTTNPVATEQYGVVATVAEQVTEQGTEEEM

SEQ ID NO: 177033 - protein, 36 aa, Artificial Sequence
  Description of Artificial Sequence: Synthetic polypeptide
DEEEIRTTNPVTTEHWGSVYCWMPNDQDDQRQGGES

SEQ ID NO: 177034 - protein, 35 aa, Artificial Sequence
  Description of Artificial Sequence: Synthetic polypeptide
AEEEICTTNPVATEQYGVVATVANQVAEQGEEEEE

SEQ ID NO: 177035 - protein, 37 aa, Artificial Sequence
  Description of Artificial Sequence: Synthetic polypeptide
DETEIATTNPCATEQYGCVAWTDNGLQQQQGGGNTNI

SEQ ID NO: 177036 - protein, 32 aa, Artificial Sequence
  Description of Artificial Sequence: Synthetic polypeptide
DENEVRTTNPVSTEPYGTISMEDCQQQQNGTH

SEQ ID NO: 177037 - protein, 34 aa, Artificial Sequence
  Description of Artificial Sequence: Synthetic polypeptide
AEEEICTTNPVATEQYGVVATVEGVEQGEEDEET

SEQ ID NO: 177038 - protein, 36 aa, Artificial Sequence
  Description of Artificial Sequence: Synthetic polypeptide
TEEEIRTTNPVAYEPYGSTVNVESNEIGPTNGGNNR

SEQ ID NO: 177039 - protein, 38 aa, Artificial Sequence
  Description of Artificial Sequence: Synthetic polypeptide
DEDEIRTTNPVATEAYGVVSTVTNLQQSAEQGTTTTDD

SEQ ID NO: 177040 - protein, 36 aa, Artificial Sequence
  Description of Artificial Sequence: Synthetic polypeptide
VEEEIRTTNPVATEQYGDVGVNVDDPGQPGEGGQSG

SEQ ID NO: 177041 - protein, 36 aa, Artificial Sequence
  Description of Artificial Sequence: Synthetic polypeptide
DEEEISTTNPVATEQYGCVCGWGEHNQENFGSDNQA

SEQ ID NO: 177042 - protein, 34 aa, Artificial Sequence
  Description of Artificial Sequence: Synthetic polypeptide
DEDEIATTNPVAYEQWGTICAATAGQLPDSGQNR

SEQ ID NO: 177043 - protein, 34 aa, Artificial Sequence
  Description of Artificial Sequence: Synthetic polypeptide
DEDEIATTNPVAYEQWGTICAASAGELPDSGSNR

SEQ ID NO: 177044 - protein, 38 aa, Artificial Sequence
  Description of Artificial Sequence: Synthetic polypeptide
DEEEIRTTNPVATEAYGTVSTVGNQDIGTTSISTEGNT

SEQ ID NO: 177045 - protein, 36 aa, Artificial Sequence
  Description of Artificial Sequence: Synthetic polypeptide
AEEEICTTNPVATEQYGVVATVEQQGNQQGTEDEET

SEQ ID NO: 177046 - protein, 34 aa, Artificial Sequence
  Description of Artificial Sequence: Synthetic polypeptide
AEEEICTTNPVATEQYGVVATVEQVAEEQEEEEE

SEQ ID NO: 177047 - protein, 39 aa, Artificial Sequence
  Description of Artificial Sequence: Synthetic polypeptide
DEDEIRTTNPVATEAYGVVSTVSTNQQQSAEQGTTNTTD

SEQ ID NO: 177048 - protein, 36 aa, Artificial Sequence
  Description of Artificial Sequence: Synthetic polypeptide
CEDEIACTNPVATEQYGSVCAPVGNDLNTQDGDERE

SEQ ID NO: 177049 - protein, 38 aa, Artificial Sequence
  Description of Artificial Sequence: Synthetic polypeptide
DEDEIRTTNPVATEAYGVVSTVNNNQQGNQQETTEEDT

SEQ ID NO: 177050 - protein, 34 aa, Artificial Sequence
  Description of Artificial Sequence: Synthetic polypeptide
VEEEIACTNPVATEQYGSCAAGNGDGREHQNDPE

SEQ ID NO: 177051 - protein, 36 aa, Artificial Sequence
  Description of Artificial Sequence: Synthetic polypeptide
VEEEIRTTNPVATEQYGDVVGVGNMTTNGFGGEEGG

SEQ ID NO: 177052 - protein, 37 aa, Artificial Sequence
  Description of Artificial Sequence: Synthetic polypeptide
DEDEIRTTNPVATEAYGVVSTVVNNQQNQQTGTTEDE

SEQ ID NO: 177053 - protein, 36 aa, Artificial Sequence
  Description of Artificial Sequence: Synthetic polypeptide
DEEEISTTNPVATEQYGCVCGTGPHNQENFNSETQA

SEQ ID NO: 177054 - protein, 34 aa, Artificial Sequence
  Description of Artificial Sequence: Synthetic polypeptide
DEQEIATTNPVATEQYGCTAANENGLTADIGGDQ

SEQ ID NO: 177055 - protein, 36 aa, Artificial Sequence
  Description of Artificial Sequence: Synthetic polypeptide
TEEEIRTTNPVAYEQYGIQVASTTGNEWSVAGTEFV

SEQ ID NO: 177056 - protein, 32 aa, Artificial Sequence
  Description of Artificial Sequence: Synthetic polypeptide
TESEIASTNPVGTEGYGVIFSTELSQSTGGDL

SEQ ID NO: 177057 - protein, 36 aa, Artificial Sequence
  Description of Artificial Sequence: Synthetic polypeptide
DEEEISTTNPVATEQYGCVCGNWGEHNENFGSNNQS

SEQ ID NO: 177058 - protein, 36 aa, Artificial Sequence
  Description of Artificial Sequence: Synthetic polypeptide
DETEIACTNPVAYEQYGSVCAANDLPQEHQDGNEAE

SEQ ID NO: 177059 - protein, 37 aa, Artificial Sequence
  Description of Artificial Sequence: Synthetic polypeptide
DEEEISTTNPVATEQYGCVCGNWGEHNQEFFGSDNQA

SEQ ID NO: 177060 - protein, 34 aa, Artificial Sequence
  Description of Artificial Sequence: Synthetic polypeptide
AEEEICTTNPVATEQYGVVATEQVAEQGEEEEDT

SEQ ID NO: 177061 - protein, 31 aa, Artificial Sequence
  Description of Artificial Sequence: Synthetic polypeptide
DETEIAPTNPCASECYGAVWACENWQEPGPI

SEQ ID NO: 177062 - protein, 35 aa, Artificial Sequence
  Description of Artificial Sequence: Synthetic polypeptide
DENEISTTNPVATEGYGQCVCSTEPQENFNSDNQS

SEQ ID NO: 177063 - protein, 34 aa, Artificial Sequence
  Description of Artificial Sequence: Synthetic polypeptide
DEEEIRTTNPVTYEHWGSAYCMWNDQDNRQGKDL

SEQ ID NO: 177064 - protein, 34 aa, Artificial Sequence
  Description of Artificial Sequence: Synthetic polypeptide
DESNEIATTNPVAYEAWGVCSNTNDHHGQGGNQT

SEQ ID NO: 177065 - protein, 32 aa, Artificial Sequence
  Description of Artificial Sequence: Synthetic polypeptide
DETEIAPTNPCATECYGAVWAAENWQEPGPYI

SEQ ID NO: 177066 - protein, 31 aa, Artificial Sequence
  Description of Artificial Sequence: Synthetic polypeptide
DETEIAPTNPIASECWGAVSCEDLASKGPYR

SEQ ID NO: 177067 - protein, 30 aa, Artificial Sequence
  Description of Artificial Sequence: Synthetic polypeptide
DENEVATTNPVATEGWGNVSNIEMNAAEDA

SEQ ID NO: 177068 - protein, 31 aa, Artificial Sequence
  Description of Artificial Sequence: Synthetic polypeptide
DENEVRSTNPVATEQWGDVAAEIEMNAAEDR

SEQ ID NO: 177069 - protein, 31 aa, Artificial Sequence
  Description of Artificial Sequence: Synthetic polypeptide
DENEVRSTNPVATEQWGDVAAEIEMSAAEDR

SEQ ID NO: 177070 - protein, 38 aa, Artificial Sequence
  Description of Artificial Sequence: Synthetic polypeptide
DESEIRTTNPVATEIYGSVVSNMNLVGDDEDQEDDDGN

SEQ ID NO: 177071 - protein, 37 aa, Artificial Sequence
  Description of Artificial Sequence: Synthetic polypeptide
DEDEIRTTNPVATEAYGVVSTVVSNNQQQQIGTTTTE

SEQ ID NO: 177072 - protein, 36 aa, Artificial Sequence
  Description of Artificial Sequence: Synthetic polypeptide
DEEEISTTNPVATEQYGCVCGNWGEHNQHFNSENQP

SEQ ID NO: 177073 - protein, 32 aa, Artificial Sequence
  Description of Artificial Sequence: Synthetic polypeptide
DETEIAPTNPIATECYGAVWAAENWQEPGPYI

SEQ ID NO: 177074 - protein, 36 aa, Artificial Sequence
  Description of Artificial Sequence: Synthetic polypeptide
DEEEISTTNPVATEQYGCVCGNWGEHNQNFGSETQA

SEQ ID NO: 177075 - protein, 35 aa, Artificial Sequence
  Description of Artificial Sequence: Synthetic polypeptide
TEEEIRTTNPVAYEQWGCYVWDIDDHLQKGGMHQR

SEQ ID NO: 177076 - protein, 35 aa, Artificial Sequence
  Description of Artificial Sequence: Synthetic polypeptide
TEEEIRTTNPVAYEQWGCYVWDIDDHLERGMHQRM

SEQ ID NO: 177077 - protein, 35 aa, Artificial Sequence
  Description of Artificial Sequence: Synthetic polypeptide
TEEEIRTTNPVAYEPYRGQSVSINEGSTSMPGAPF

SEQ ID NO: 177078 - protein, 36 aa, Artificial Sequence
  Description of Artificial Sequence: Synthetic polypeptide
TEEEIRTTNPVAYEPYGTVVSLTANIDQTPGGSSEK

SEQ ID NO: 177079 - protein, 35 aa, Artificial Sequence
  Description of Artificial Sequence: Synthetic polypeptide
AEEEICTTNPVATEQYGVVATTAEQGAEQGEEDED

SEQ ID NO: 177080 - protein, 37 aa, Artificial Sequence
  Description of Artificial Sequence: Synthetic polypeptide
VEEEIRTTNPVATEQYGAVCTTNDGNGNDLEGEFEQI

SEQ ID NO: 177081 - protein, 32 aa, Artificial Sequence
  Description of Artificial Sequence: Synthetic polypeptide
DETEIATTNPIASECWGAVSNCEDLASKGPYR

SEQ ID NO: 177082 - protein, 32 aa, Artificial Sequence
  Description of Artificial Sequence: Synthetic polypeptide
DETEIATTNPIATECWGATANSEDLQEPGDYI

SEQ ID NO: 177083 - protein, 38 aa, Artificial Sequence
  Description of Artificial Sequence: Synthetic polypeptide
DEAEIRTTNPVATEQYGSVTWSPVNWLENPNTWEEMGN

SEQ ID NO: 177084 - protein, 36 aa, Artificial Sequence
  Description of Artificial Sequence: Synthetic polypeptide
VEEEIRTTNPVATEQYGDVVNGFGTTQDQEGGDEMT

SEQ ID NO: 177085 - protein, 36 aa, Artificial Sequence
  Description of Artificial Sequence: Synthetic polypeptide
VEEEIRTTNPVATEQYGDVVNGFGVTQDQGGGDEQT

SEQ ID NO: 177086 - protein, 35 aa, Artificial Sequence
  Description of Artificial Sequence: Synthetic polypeptide
DEEEISTTNPVATEQYGCVCSDWGEHNQGFISEQS

SEQ ID NO: 177087 - protein, 36 aa, Artificial Sequence
  Description of Artificial Sequence: Synthetic polypeptide
DEEEISTTNPVATEQYGCVCSDWGEHNTESFNSDQP

SEQ ID NO: 177088 - protein, 37 aa, Artificial Sequence
  Description of Artificial Sequence: Synthetic polypeptide
DEEEISTTNPVATEQYGCVCSDWGETNQENFNSDNQS

SEQ ID NO: 177089 - protein, 36 aa, Artificial Sequence
  Description of Artificial Sequence: Synthetic polypeptide
DEEEISTTNPVATEQYGCVCSDWMEHQENFGSETQP

SEQ ID NO: 177090 - protein, 32 aa, Artificial Sequence
  Description of Artificial Sequence: Synthetic polypeptide
DENGIRTTNPVSTEPYGTISMEDEQQQQNGYH

SEQ ID NO: 177091 - protein, 36 aa, Artificial Sequence
  Description of Artificial Sequence: Synthetic polypeptide
VEEEIRTTNPVATEQYGDVVQGFGTQGDQEGGDEQT

SEQ ID NO: 177092 - protein, 34 aa, Artificial Sequence
  Description of Artificial Sequence: Synthetic polypeptide
DEDEIATTNPVAYEQWGSVTGGPGNQQGEHNESA

SEQ ID NO: 177093 - protein, 39 aa, Artificial Sequence
  Description of Artificial Sequence: Synthetic polypeptide
DEEEIRTTNPVATEAYGVVSTTNNQQGNNQLQEGTEQGS

SEQ ID NO: 177094 - protein, 36 aa, Artificial Sequence
  Description of Artificial Sequence: Synthetic polypeptide
VEEEIRTTNPVATEQYGDVVTGIQNDGQEDDEQQEF

SEQ ID NO: 177095 - protein, 36 aa, Artificial Sequence
  Description of Artificial Sequence: Synthetic polypeptide
DEEEISTTNPVATEQYGCVCSMSGEHQEHFGSETQA

SEQ ID NO: 177096 - protein, 37 aa, Artificial Sequence
  Description of Artificial Sequence: Synthetic polypeptide
DEEEISTTNPVATEQYGCVCSMTEDHEQENFGSDTQQ

SEQ ID NO: 177097 - protein, 37 aa, Artificial Sequence
  Description of Artificial Sequence: Synthetic polypeptide
DEEEISTTNPVATEQYGCVCSMTEDHNQENFISDNQA

SEQ ID NO: 177098 - protein, 37 aa, Artificial Sequence
  Description of Artificial Sequence: Synthetic polypeptide
DEEEISTTNPVATEQYGCVCSMTEEDHNQNFGSDFQI

SEQ ID NO: 177099 - protein, 36 aa, Artificial Sequence
  Description of Artificial Sequence: Synthetic polypeptide
DEEEISTTNPVATEQYGCVCSMTEHEAENFGSDPQS

SEQ ID NO: 177100 - protein, 37 aa, Artificial Sequence
  Description of Artificial Sequence: Synthetic polypeptide
DEEEISTTNPVATEQYGCVCSMTGEDHNQNFGSDTQA

SEQ ID NO: 177101 - protein, 34 aa, Artificial Sequence
  Description of Artificial Sequence: Synthetic polypeptide
DEEEIRTTNPVSYEQYGCVCGWGEHNQGFNSQQS

SEQ ID NO: 177102 - protein, 37 aa, Artificial Sequence
  Description of Artificial Sequence: Synthetic polypeptide
DEEEISTTNPVATEQYGCVCSMTGEEHNQNFGSDTQA

SEQ ID NO: 177103 - protein, 37 aa, Artificial Sequence
  Description of Artificial Sequence: Synthetic polypeptide
DEEEISTTNPVATEQYGCVCSMTGEHNAEGFGSDTQS

SEQ ID NO: 177104 - protein, 37 aa, Artificial Sequence
  Description of Artificial Sequence: Synthetic polypeptide
DEEEISTTNPVATEQYGCVCSMTGEHNAENFGSDTQN

SEQ ID NO: 177105 - protein, 37 aa, Artificial Sequence
  Description of Artificial Sequence: Synthetic polypeptide
AEEEICTTNPVATEQYGVVATVNLQQGTQQGTEDEEN

SEQ ID NO: 177106 - protein, 36 aa, Artificial Sequence
  Description of Artificial Sequence: Synthetic polypeptide
DEEEISTTNPVATEQYGCVCSMTGEHNANFISDTQA

SEQ ID NO: 177107 - protein, 37 aa, Artificial Sequence
  Description of Artificial Sequence: Synthetic polypeptide
DEEEISTTNPVATEQYGCVCSMTGEHNQENFISDNQA

SEQ ID NO: 177108 - protein, 32 aa, Artificial Sequence
  Description of Artificial Sequence: Synthetic polypeptide
DETEIATTNPIATECWGATTWSNADLQEPGPI

SEQ ID NO: 177109 - protein, 35 aa, Artificial Sequence
  Description of Artificial Sequence: Synthetic polypeptide
VEEEIRTTNPVATEQYGDVVNGFGGQDNEGGDEQT

SEQ ID NO: 177110 - protein, 37 aa, Artificial Sequence
  Description of Artificial Sequence: Synthetic polypeptide
AEEEICTTNPVATEQYGVVATVNLQQGEQQGTTEDEE

SEQ ID NO: 177111 - protein, 32 aa, Artificial Sequence
  Description of Artificial Sequence: Synthetic polypeptide
TESEIASTNPVGTEGYGVTAETELSQHGGDNI

SEQ ID NO: 177112 - protein, 35 aa, Artificial Sequence
  Description of Artificial Sequence: Synthetic polypeptide
DEEEISTTNPVATEQYGCVCQNWGEHNANFNSEQP

SEQ ID NO: 177113 - protein, 37 aa, Artificial Sequence
  Description of Artificial Sequence: Synthetic polypeptide
DEAEIRTTNPVATEQYGSVTWSPVLWLEDPNTWEVGN

SEQ ID NO: 177114 - protein, 34 aa, Artificial Sequence
  Description of Artificial Sequence: Synthetic polypeptide
AEEEICTTNPVATEQYGVVATVEVGENQNEEEED

SEQ ID NO: 177115 - protein, 36 aa, Artificial Sequence
  Description of Artificial Sequence: Synthetic polypeptide
CEDEIACTNPVATEQYGSVCSTNPQPQEHQDGTEMQ

SEQ ID NO: 177116 - protein, 36 aa, Artificial Sequence
  Description of Artificial Sequence: Synthetic polypeptide
DEEEISTTNPVATEQYGCVCQNWMEHNQENFNSEQS

SEQ ID NO: 177117 - protein, 36 aa, Artificial Sequence
  Description of Artificial Sequence: Synthetic polypeptide
DEEEISTTNPVATEQYGCVCQTWEHNQENFNSENQP

SEQ ID NO: 177118 - protein, 31 aa, Artificial Sequence
  Description of Artificial Sequence: Synthetic polypeptide
TESEIASTNPVGTEGYGVMACSGTLQHGGDI

SEQ ID NO: 177119 - protein, 36 aa, Artificial Sequence
  Description of Artificial Sequence: Synthetic polypeptide
VEEEIRTTNPVATEQYGDVVNGFGTQDQEGGQEQTE

SEQ ID NO: 177120 - protein, 35 aa, Artificial Sequence
  Description of Artificial Sequence: Synthetic polypeptide
DEEEISTTNPVATEQYGCVCQWGEHNQENFGSEQS

SEQ ID NO: 177121 - protein, 35 aa, Artificial Sequence
  Description of Artificial Sequence: Synthetic polypeptide
DEEEISTTNPVATEQYGCVCQWGEHNQNFNSEFQP

SEQ ID NO: 177122 - protein, 31 aa, Artificial Sequence
  Description of Artificial Sequence: Synthetic polypeptide
DDSEVACTNPVSTEGYGNVADWTIQERFGQR

SEQ ID NO: 177123 - protein, 36 aa, Artificial Sequence
  Description of Artificial Sequence: Synthetic polypeptide
AEEEICTTNPVATEQYGVVATVLEQGAEQGTEEDEE

SEQ ID NO: 177124 - protein, 35 aa, Artificial Sequence
  Description of Artificial Sequence: Synthetic polypeptide
AEEEICTTNPVATEQYGVVATVLEVGEQGTEDEEE

SEQ ID NO: 177125 - protein, 36 aa, Artificial Sequence
  Description of Artificial Sequence: Synthetic polypeptide
VEEEIRTTNPVATEQYGDVVNGFGTQDQEGQDEQTQ

SEQ ID NO: 177126 - protein, 36 aa, Artificial Sequence
  Description of Artificial Sequence: Synthetic polypeptide
DEEEISTTNPVATEQYGCVCSDSGEDNQNFSSDNQS

SEQ ID NO: 177127 - protein, 36 aa, Artificial Sequence
  Description of Artificial Sequence: Synthetic polypeptide
DEEEISTTNPVATEQYGCVCSDTGEDHANFGSDTQA

SEQ ID NO: 177128 - protein, 37 aa, Artificial Sequence
  Description of Artificial Sequence: Synthetic polypeptide
DEEEISTTNPVATEQYGCVCSDTGEHNAENFISDNQA

SEQ ID NO: 177129 - protein, 39 aa, Artificial Sequence
  Description of Artificial Sequence: Synthetic polypeptide
DEEEIRTTNPVATEAYGTVSTVGNLDEIGTTSISTTGNT

SEQ ID NO: 177130 - protein, 37 aa, Artificial Sequence
  Description of Artificial Sequence: Synthetic polypeptide
DEEEISTTNPVATEQYGCVCSDWEEHNAEGFGSENQS

SEQ ID NO: 177131 - protein, 36 aa, Artificial Sequence
  Description of Artificial Sequence: Synthetic polypeptide
DEEEISTTNPVATEQYGCVCSDWEEHNTENFGSDQP

SEQ ID NO: 177132 - protein, 37 aa, Artificial Sequence
  Description of Artificial Sequence: Synthetic polypeptide
DESEIRTTNPVATEGYGSVVSDGMEGFTNGEGDQIGD

SEQ ID NO: 177133 - protein, 36 aa, Artificial Sequence
  Description of Artificial Sequence: Synthetic polypeptide
AEEEICTTNPVATEQYGVVATVNEQQGEEQGTEDEE

SEQ ID NO: 177134 - protein, 37 aa, Artificial Sequence
  Description of Artificial Sequence: Synthetic polypeptide
AEEEICTTNPVATEQYGVVATVNLQQGEQQGTEDEEE

SEQ ID NO: 177135 - protein, 36 aa, Artificial Sequence
  Description of Artificial Sequence: Synthetic polypeptide
VEEEIRTTNPVATEQYGDVVNGFGTQDQTEGGDETT

SEQ ID NO: 177136 - protein, 37 aa, Artificial Sequence
  Description of Artificial Sequence: Synthetic polypeptide
AEEEICTTNPVATEQYGVVATVNLQQGEQQGTEDGEG

SEQ ID NO: 177137 - protein, 37 aa, Artificial Sequence
  Description of Artificial Sequence: Synthetic polypeptide
AEEEICTTNPVATEQYGVVATVNLQQGEQQGTEEEEQ

SEQ ID NO: 177138 - protein, 35 aa, Artificial Sequence
  Description of Artificial Sequence: Synthetic polypeptide
DEDEIATTNPVAYEQWGTVCAANAGGLPDSGPNRT

SEQ ID NO: 177139 - protein, 35 aa, Artificial Sequence
  Description of Artificial Sequence: Synthetic polypeptide
DETEIACTNPVAYEQYGSCAQGPLTNPDAQTGGRM

SEQ ID NO: 177140 - protein, 39 aa, Artificial Sequence
  Description of Artificial Sequence: Synthetic polypeptide
AEEEICTTNPVATEQYGTVSVTNNLEQGTEQGSTTDQND

SEQ ID NO: 177141 - protein, 34 aa, Artificial Sequence
  Description of Artificial Sequence: Synthetic polypeptide
TEEEISTTNPVAYEQYGIQVSTTGSEWSVAGTEF

SEQ ID NO: 177142 - protein, 35 aa, Artificial Sequence
  Description of Artificial Sequence: Synthetic polypeptide
TEEEISTTNPVAYEQWGSTVLSTPELSQTHEDQED

SEQ ID NO: 177143 - protein, 34 aa, Artificial Sequence
  Description of Artificial Sequence: Synthetic polypeptide
TEEEISTTNPVAYEQWGSTVASTPEPSQATEPED

SEQ ID NO: 177144 - protein, 39 aa, Artificial Sequence
  Description of Artificial Sequence: Synthetic polypeptide
DEEEIRTTNPVATEAYGTVTNLQSGTISTNGQNQEGGNV

SEQ ID NO: 177145 - protein, 35 aa, Artificial Sequence
  Description of Artificial Sequence: Synthetic polypeptide
DEDEIATTNPVAYEQYGSVATPAHQGADSDGPADE

SEQ ID NO: 177146 - protein, 39 aa, Artificial Sequence
  Description of Artificial Sequence: Synthetic polypeptide
DEEEIRTTNPVATEAYGTVTNLQSGTIGTNTQNSEGGNV

SEQ ID NO: 177147 - protein, 36 aa, Artificial Sequence
  Description of Artificial Sequence: Synthetic polypeptide
TEEEISTTNPVATEQYGCVCSWMEHNQENFGSDNQF

SEQ ID NO: 177148 - protein, 37 aa, Artificial Sequence
  Description of Artificial Sequence: Synthetic polypeptide
DEQEIATTNPVATEQYGSACAATNPQEAGDSGMENTM

SEQ ID NO: 177149 - protein, 37 aa, Artificial Sequence
  Description of Artificial Sequence: Synthetic polypeptide
DEQEIATTNPVATEQYGSACAATNPQEAGDSPMGNFM

SEQ ID NO: 177150 - protein, 36 aa, Artificial Sequence
  Description of Artificial Sequence: Synthetic polypeptide
DETEIACTNPVATEQYGSACSVGNDQNDSGNGEWTH

SEQ ID NO: 177151 - protein, 39 aa, Artificial Sequence
  Description of Artificial Sequence: Synthetic polypeptide
DEEEIRTTNPVATEAYGTVTNLQSGTIGTNTNNQEQGNN

SEQ ID NO: 177152 - protein, 39 aa, Artificial Sequence
  Description of Artificial Sequence: Synthetic polypeptide
DEEEIRTTNPVATEAYGTVTNLQSGSISTNTQNQEVGNV

SEQ ID NO: 177153 - protein, 38 aa, Artificial Sequence
  Description of Artificial Sequence: Synthetic polypeptide
DEEEIRTTNPVATEAYGTVSTYNNSDIGTTSISTEGNT

SEQ ID NO: 177154 - protein, 39 aa, Artificial Sequence
  Description of Artificial Sequence: Synthetic polypeptide
DEEEIRTTNPVATEAYGTVSTYNGNSQIGTTSISTTGNT

SEQ ID NO: 177155 - protein, 38 aa, Artificial Sequence
  Description of Artificial Sequence: Synthetic polypeptide
DEEEIRTTNPVATEAYGTVSTYGNSDIGTTTISTTANT

SEQ ID NO: 177156 - protein, 35 aa, Artificial Sequence
  Description of Artificial Sequence: Synthetic polypeptide
DEQEIATTNPVATEQYGSACAPVPAEGQNHQDMMM

SEQ ID NO: 177157 - protein, 36 aa, Artificial Sequence
  Description of Artificial Sequence: Synthetic polypeptide
DEQEIATTNPVATEQYGSACATNPDEEGTHQDNDQP

SEQ ID NO: 177158 - protein, 36 aa, Artificial Sequence
  Description of Artificial Sequence: Synthetic polypeptide
DEEEISTTNPVATEQYGCAVCSNSEHNQENFGSDQS

SEQ ID NO: 177159 - protein, 38 aa, Artificial Sequence
  Description of Artificial Sequence: Synthetic polypeptide
DEEEIRTTNPVATEAYGTVSTVGNSEIGTTSISTTANT

SEQ ID NO: 177160 - protein, 36 aa, Artificial Sequence
  Description of Artificial Sequence: Synthetic polypeptide
VEEEIRTTNPVATEGYGCTGSIMNDIGDQRGDEGQG

SEQ ID NO: 177161 - protein, 37 aa, Artificial Sequence
  Description of Artificial Sequence: Synthetic polypeptide
DEQEIATTNPVATEQYGSACSANHPGPLDSMGGNDNS

SEQ ID NO: 177162 - protein, 35 aa, Artificial Sequence
  Description of Artificial Sequence: Synthetic polypeptide
DETEIACTNPVATEQYGSCAQGPITNPDAQTGGEM

SEQ ID NO: 177163 - protein, 34 aa, Artificial Sequence
  Description of Artificial Sequence: Synthetic polypeptide
DETEIACTNPVATEQYGSCAQGPPNPDAQAGGWT

SEQ ID NO: 177164 - protein, 36 aa, Artificial Sequence
  Description of Artificial Sequence: Synthetic polypeptide
DEEEISTTNPVATEQYGCAVCSWEHNQENFNSDTQS

SEQ ID NO: 177165 - protein, 36 aa, Artificial Sequence
  Description of Artificial Sequence: Synthetic polypeptide
DEEEISTTNPVATEQYGCAVCSWGEHNAENFNSDQS

SEQ ID NO: 177166 - protein, 35 aa, Artificial Sequence
  Description of Artificial Sequence: Synthetic polypeptide
DEEEISTTNPVATEQFGQCVCSWMYLNANFGSDQS

SEQ ID NO: 177167 - protein, 36 aa, Artificial Sequence
  Description of Artificial Sequence: Synthetic polypeptide
DETEIACTNPVATEQYGSCASGNPLFDNQEPEEGTE

SEQ ID NO: 177168 - protein, 33 aa, Artificial Sequence
  Description of Artificial Sequence: Synthetic polypeptide
DEDEIATTNPVAYEQYGCVAANNGPTAAPDGAP

SEQ ID NO: 177169 - protein, 35 aa, Artificial Sequence
  Description of Artificial Sequence: Synthetic polypeptide
DEEEIRTTNPVATEQYGCTCSMWEEHNASINSDQA

SEQ ID NO: 177170 - protein, 35 aa, Artificial Sequence
  Description of Artificial Sequence: Synthetic polypeptide
DEDEIATTNPVAYEQYGSACSANPALQAHEDLTAM

SEQ ID NO: 177171 - protein, 33 aa, Artificial Sequence
  Description of Artificial Sequence: Synthetic polypeptide
DETEIACTNPVATEQYGETTWSEEDLAEPKGGI

SEQ ID NO: 177172 - protein, 35 aa, Artificial Sequence
  Description of Artificial Sequence: Synthetic polypeptide
DEEEISTTNPVATEGYGCVCSWGEHNQENFNSDQA

SEQ ID NO: 177173 - protein, 35 aa, Artificial Sequence
  Description of Artificial Sequence: Synthetic polypeptide
DEEEISTTNPVATEGYGCVCSWGEHNQNFNSDNQD

SEQ ID NO: 177174 - protein, 35 aa, Artificial Sequence
  Description of Artificial Sequence: Synthetic polypeptide
DETEIACTNPVATEQYGSACAANHLQTAENPNDNE

SEQ ID NO: 177175 - protein, 36 aa, Artificial Sequence
  Description of Artificial Sequence: Synthetic polypeptide
DEEEISTTNPVATEGYGICVCSTVEHNQENFISNQA

SEQ ID NO: 177176 - protein, 35 aa, Artificial Sequence
  Description of Artificial Sequence: Synthetic polypeptide
DETEIACTNPVATEQYGSACAANPQQEHQDGNAMQ

SEQ ID NO: 177177 - protein, 35 aa, Artificial Sequence
  Description of Artificial Sequence: Synthetic polypeptide
DETEIACTNPVATEQYGSACAANPQQEHQDGNQHN

SEQ ID NO: 177178 - protein, 35 aa, Artificial Sequence
  Description of Artificial Sequence: Synthetic polypeptide
DETEIACTNPVATEQYGSACAANPQQEHQDGTENQ

SEQ ID NO: 177179 - protein, 38 aa, Artificial Sequence
  Description of Artificial Sequence: Synthetic polypeptide
VEEEIRTTNPVATDQYGSVNMNLIMQNQGQEENGQAAG

SEQ ID NO: 177180 - protein, 29 aa, Artificial Sequence
  Description of Artificial Sequence: Synthetic peptide
TESEIASTNPVGTEGWGVCAPTDNQHGDA

SEQ ID NO: 177181 - protein, 36 aa, Artificial Sequence
  Description of Artificial Sequence: Synthetic polypeptide
VEEEIRTTNPVATDQYGVVNDNSIGQNGGQGENNTQ

SEQ ID NO: 177182 - protein, 39 aa, Artificial Sequence
  Description of Artificial Sequence: Synthetic polypeptide
DEEEIRTTNPVATEAYGTVTNLQSGTISTNNQNQEVGNM

SEQ ID NO: 177183 - protein, 37 aa, Artificial Sequence
  Description of Artificial Sequence: Synthetic polypeptide
DEAEIRTTNPVATEQYGSVSVTYDVSPTERPQFEQYQ

SEQ ID NO: 177184 - protein, 33 aa, Artificial Sequence
  Description of Artificial Sequence: Synthetic polypeptide
AEEEIATTNPVATEQYGCYCPWVDNQEHNSEQA

SEQ ID NO: 177185 - protein, 36 aa, Artificial Sequence
  Description of Artificial Sequence: Synthetic polypeptide
DETEIACTNPVATEQYGSACATNPELQEHQDDNEAG

SEQ ID NO: 177186 - protein, 35 aa, Artificial Sequence
  Description of Artificial Sequence: Synthetic polypeptide
DEEEISTTNPVATEGYGQCVCGSGEHNQNFNSDQS

SEQ ID NO: 177187 - protein, 32 aa, Artificial Sequence
  Description of Artificial Sequence: Synthetic polypeptide
AEEEIATTNPVATEQYGEICPWEDNQHNSEQA

SEQ ID NO: 177188 - protein, 37 aa, Artificial Sequence
  Description of Artificial Sequence: Synthetic polypeptide
DEEEIRTTNPVATEQYGCVCSNTEEHNQENFPSDTQA

SEQ ID NO: 177189 - protein, 32 aa, Artificial Sequence
  Description of Artificial Sequence: Synthetic polypeptide
AEEEIATTNPVATEQYGEYCPWEDNQHESEQG

SEQ ID NO: 177190 - protein, 32 aa, Artificial Sequence
  Description of Artificial Sequence: Synthetic polypeptide
TESEIASTNPVGTEGYGKIASTELSQSTGGVI

SEQ ID NO: 177191 - protein, 36 aa, Artificial Sequence
  Description of Artificial Sequence: Synthetic polypeptide
DETEIACTNPVATEQYGSACSAANPLDDTATGNDAE

SEQ ID NO: 177192 - protein, 35 aa, Artificial Sequence
  Description of Artificial Sequence: Synthetic polypeptide
TEEGICTTNPVSYEQYGSVSCLNESNDRPVGNNAP

SEQ ID NO: 177193 - protein, 39 aa, Artificial Sequence
  Description of Artificial Sequence: Synthetic polypeptide
DEEEIRTTNPVATEAYGTVTNLQSGTISTNLQNQEQGTN

SEQ ID NO: 177194 - protein, 36 aa, Artificial Sequence
  Description of Artificial Sequence: Synthetic polypeptide
AEEEIATTNPVATEQYGSVCAAGPLGEATMGDNSGM

SEQ ID NO: 177195 - protein, 35 aa, Artificial Sequence
  Description of Artificial Sequence: Synthetic polypeptide
DEEEISTTNPVATEGYGQCVCSWEHNQNFISENQS

SEQ ID NO: 177196 - protein, 37 aa, Artificial Sequence
  Description of Artificial Sequence: Synthetic polypeptide
TEEEIRTTNPVAYEYWGHKTVSYTNALSHERPGGNFV

SEQ ID NO: 177197 - protein, 37 aa, Artificial Sequence
  Description of Artificial Sequence: Synthetic polypeptide
DEQEIATTNPVATEQYGSACSANPPGPLDSMGGNDMQ

SEQ ID NO: 177198 - protein, 36 aa, Artificial Sequence
  Description of Artificial Sequence: Synthetic polypeptide
DEEEISTTNPVATEQYGCAVCSWGEHNTGFNSDNQS

SEQ ID NO: 177199 - protein, 30 aa, Artificial Sequence
  Description of Artificial Sequence: Synthetic polypeptide
AEEEIATTNPVAYEQWGEAYYVEQPEEEEE

SEQ ID NO: 177200 - protein, 37 aa, Artificial Sequence
  Description of Artificial Sequence: Synthetic polypeptide
DEDEIRTTNPVATEAYGVVSTVVTNNQQQQAGTTTDE

SEQ ID NO: 177201 - protein, 36 aa, Artificial Sequence
  Description of Artificial Sequence: Synthetic polypeptide
VEEEIRTTNPVATEGYGSVSIVGDGDGQGEEEGGDT

SEQ ID NO: 177202 - protein, 35 aa, Artificial Sequence
  Description of Artificial Sequence: Synthetic polypeptide
DETEIACTNPVATEQYGSVCAATGIAPGEQMEGRH

SEQ ID NO: 177203 - protein, 36 aa, Artificial Sequence
  Description of Artificial Sequence: Synthetic polypeptide
DEEEISTTNPVATEQYGCSCSWGEPHNQYFISDNQS

SEQ ID NO: 177204 - protein, 35 aa, Artificial Sequence
  Description of Artificial Sequence: Synthetic polypeptide
DEEEISTTNPVATEQYGCSCSWPEDPNQNFDSDQS

SEQ ID NO: 177205 - protein, 37 aa, Artificial Sequence
  Description of Artificial Sequence: Synthetic polypeptide
DEEEIRTTNPVATEQYGCVCSNTGEHEQEYFISDTQS

SEQ ID NO: 177206 - protein, 39 aa, Artificial Sequence
  Description of Artificial Sequence: Synthetic polypeptide
DEEEIRTTNPVAYEQYGISVCSEWLNDLLDAQSGQIFKN

SEQ ID NO: 177207 - protein, 36 aa, Artificial Sequence
  Description of Artificial Sequence: Synthetic polypeptide
DEEEISTTNPVATEQYGCTCSMSEEDNQENIGSDQS

SEQ ID NO: 177208 - protein, 35 aa, Artificial Sequence
  Description of Artificial Sequence: Synthetic polypeptide
DETEIACTNPVATEQYGSVCAPGNLENNDDLGAQA

SEQ ID NO: 177209 - protein, 37 aa, Artificial Sequence
  Description of Artificial Sequence: Synthetic polypeptide
DETEIACTNPVATEQYGSVCSPTEHGILDSMDGNAGE

SEQ ID NO: 177210 - protein, 34 aa, Artificial Sequence
  Description of Artificial Sequence: Synthetic polypeptide
DENEISTTNPVATEQWGCVCSSPEANAFISDNAA

SEQ ID NO: 177211 - protein, 34 aa, Artificial Sequence
  Description of Artificial Sequence: Synthetic polypeptide
AEEEIATTNPVAYEQYGCSCPSEDNQEHFNSEQF

SEQ ID NO: 177212 - protein, 37 aa, Artificial Sequence
  Description of Artificial Sequence: Synthetic polypeptide
DEAEIRTTNPVATEQYGSVTHTTEDHNDQENYEEDGT

SEQ ID NO: 177213 - protein, 36 aa, Artificial Sequence
  Description of Artificial Sequence: Synthetic polypeptide
DETEIACTNPVATEQYGSVSAIWPAGTNQGNPMEGV

SEQ ID NO: 177214 - protein, 33 aa, Artificial Sequence
  Description of Artificial Sequence: Synthetic polypeptide
DENEISTTNPVATEQWGCVCSSPEANAFESDAF

SEQ ID NO: 177215 - protein, 36 aa, Artificial Sequence
  Description of Artificial Sequence: Synthetic polypeptide
DEEEISTTNPVATEQYGCTCSMWEEHNQEYIGSNQS

SEQ ID NO: 177216 - protein, 31 aa, Artificial Sequence
  Description of Artificial Sequence: Synthetic polypeptide
DDSEVASTNPVSTEGYGCVATWTIQNNVGQR

SEQ ID NO: 177217 - protein, 31 aa, Artificial Sequence
  Description of Artificial Sequence: Synthetic polypeptide
DDSEVASTNPVSTEGYGCVATWTIQNRIGQA

SEQ ID NO: 177218 - protein, 31 aa, Artificial Sequence
  Description of Artificial Sequence: Synthetic polypeptide
DDSEVASTNPVSTEGYGCVAYNTIQNNFGQR

SEQ ID NO: 177219 - protein, 37 aa, Artificial Sequence
  Description of Artificial Sequence: Synthetic polypeptide
DEEEISTTNPVATEQYGCTCSTWGEHNAENFGSDNQS

SEQ ID NO: 177220 - protein, 36 aa, Artificial Sequence
  Description of Artificial Sequence: Synthetic polypeptide
DEEEISTTNPVATEQYGCTCSWMEHNQENFGSDNQS

SEQ ID NO: 177221 - protein, 36 aa, Artificial Sequence
  Description of Artificial Sequence: Synthetic polypeptide
VEEEIRTTNPVATEGYGSVVGQQDNNGQEEMEGGVN

SEQ ID NO: 177222 - protein, 36 aa, Artificial Sequence
  Description of Artificial Sequence: Synthetic polypeptide
DEEEISTTNPVATEQYGCTCSWNEHNQENFNSDNQA

SEQ ID NO: 177223 - protein, 34 aa, Artificial Sequence
  Description of Artificial Sequence: Synthetic polypeptide
DESNEIATTNPVAYEQWGVCSTDQGDQPNGNNEA

SEQ ID NO: 177224 - protein, 30 aa, Artificial Sequence
  Description of Artificial Sequence: Synthetic polypeptide
AEEEIATTNPVAYEQWGEAYMVEQHEEDGS

SEQ ID NO: 177225 - protein, 34 aa, Artificial Sequence
  Description of Artificial Sequence: Synthetic polypeptide
DETEIACTNPVATEQYGSVCAADNGDEAMDINHL

SEQ ID NO: 177226 - protein, 33 aa, Artificial Sequence
  Description of Artificial Sequence: Synthetic polypeptide
DETEIACTNPVATEQYGSVCAADNGDEAMDIDN

SEQ ID NO: 177227 - protein, 30 aa, Artificial Sequence
  Description of Artificial Sequence: Synthetic polypeptide
DENEVATTNPVATEGWGDVSNIEMNAAEDA

SEQ ID NO: 177228 - protein, 36 aa, Artificial Sequence
  Description of Artificial Sequence: Synthetic polypeptide
AEEEIATTNPVATEQYGVVPCWDNHGQDRQGGGDAG

SEQ ID NO: 177229 - protein, 36 aa, Artificial Sequence
  Description of Artificial Sequence: Synthetic polypeptide
DEEEISTTNPVATEQYGCAVCSWGEHTEGFGSDNQA

SEQ ID NO: 177230 - protein, 35 aa, Artificial Sequence
  Description of Artificial Sequence: Synthetic polypeptide
DETEIACTNPVATEQYGSCPATNPEAPGNQMEGTP

SEQ ID NO: 177231 - protein, 37 aa, Artificial Sequence
  Description of Artificial Sequence: Synthetic polypeptide
DEQEIATTNPVATEQYGSACSANPPGPLDSMGGQDNH

SEQ ID NO: 177232 - protein, 36 aa, Artificial Sequence
  Description of Artificial Sequence: Synthetic polypeptide
DEEEISTTNPVATEQYGCIVCSNWEEHNTNFNSEQS

SEQ ID NO: 177233 - protein, 35 aa, Artificial Sequence
  Description of Artificial Sequence: Synthetic polypeptide
DEDEIATTNPVAYEQWGVVSGGNGLNQPDHPNNGS

SEQ ID NO: 177234 - protein, 37 aa, Artificial Sequence
  Description of Artificial Sequence: Synthetic polypeptide
DEEEISTTNPVATEQYGCIVCSTEDHNTENFNSENQA

SEQ ID NO: 177235 - protein, 37 aa, Artificial Sequence
  Description of Artificial Sequence: Synthetic polypeptide
DEEEISTTNPVATEQYGCIVCSTEEHNTENFNSETQA

SEQ ID NO: 177236 - protein, 36 aa, Artificial Sequence
  Description of Artificial Sequence: Synthetic polypeptide
DEEEISTTNPVATEQYGCIVCSTGEDHNTNFNSEQS

SEQ ID NO: 177237 - protein, 37 aa, Artificial Sequence
  Description of Artificial Sequence: Synthetic polypeptide
DEEEISTTNPVATEQYGCIVCSTSGEHNTENFNSEQA

SEQ ID NO: 177238 - protein, 35 aa, Artificial Sequence
  Description of Artificial Sequence: Synthetic polypeptide
DETEIACTNPVATEQYGSVAATEVLEAGEQAEEAD

SEQ ID NO: 177239 - protein, 32 aa, Artificial Sequence
  Description of Artificial Sequence: Synthetic polypeptide
DDSEVASTNPVSTEGYGCVATSTIQERMGQRS

SEQ ID NO: 177240 - protein, 32 aa, Artificial Sequence
  Description of Artificial Sequence: Synthetic polypeptide
AEEEIATTNPVATEQYGCYCPWADNQHESEQA

SEQ ID NO: 177241 - protein, 35 aa, Artificial Sequence
  Description of Artificial Sequence: Synthetic polypeptide
DETEIACTNPVATEQYGSVANPGNGPADSGEGGRD

SEQ ID NO: 177242 - protein, 37 aa, Artificial Sequence
  Description of Artificial Sequence: Synthetic polypeptide
DEEEIRTTNPVATEQYGCVCSNTGEDHNQENFLSDQS

SEQ ID NO: 177243 - protein, 38 aa, Artificial Sequence
  Description of Artificial Sequence: Synthetic polypeptide
DEEEIRTTNPVATEQYGCVCSNTGEDHNQENFNSDTQG

SEQ ID NO: 177244 - protein, 36 aa, Artificial Sequence
  Description of Artificial Sequence: Synthetic polypeptide
DEEEIRTTNPVATEQYGCTCSMWEEDNAEYFGSDQS

SEQ ID NO: 177245 - protein, 36 aa, Artificial Sequence
  Description of Artificial Sequence: Synthetic polypeptide
DEEEISTTNPVATEQYGCQVCSNSGEDQENFGSDQS

SEQ ID NO: 177246 - protein, 36 aa, Artificial Sequence
  Description of Artificial Sequence: Synthetic polypeptide
DENEISTTNPVATEQYGCVCSTWGEHNAENFNSDQS

SEQ ID NO: 177247 - protein, 37 aa, Artificial Sequence
  Description of Artificial Sequence: Synthetic polypeptide
DEEEISTTNPVATEQYGCQVCSNWGEHNQNFGSDNQS

SEQ ID NO: 177248 - protein, 37 aa, Artificial Sequence
  Description of Artificial Sequence: Synthetic polypeptide
DEDEIRTTNPVATEAYGVVSTVVTNQQNQQQGETTTD

SEQ ID NO: 177249 - protein, 37 aa, Artificial Sequence
  Description of Artificial Sequence: Synthetic polypeptide
DEEEISTTNPVATEQYGCQVCSTGEDHNQENFGSEQS

SEQ ID NO: 177250 - protein, 35 aa, Artificial Sequence
  Description of Artificial Sequence: Synthetic polypeptide
AEEEIATTNPVAYEGWGSVCSGTDNQDRPDGGQEA

SEQ ID NO: 177251 - protein, 36 aa, Artificial Sequence
  Description of Artificial Sequence: Synthetic polypeptide
DENEISTTNPVATEQYGCVCQSGEHNQENFGSENQS

SEQ ID NO: 177252 - protein, 34 aa, Artificial Sequence
  Description of Artificial Sequence: Synthetic polypeptide
DENEISTTNPVATEQWGQKVPSEGASMNAAEGDA

SEQ ID NO: 177253 - protein, 36 aa, Artificial Sequence
  Description of Artificial Sequence: Synthetic polypeptide
DETEIACTNPVATEQYGSVCAADNGDEAGMDINNRH

SEQ ID NO: 177254 - protein, 36 aa, Artificial Sequence
  Description of Artificial Sequence: Synthetic polypeptide
DETEIACTNPVATEQYGSVATANMTPGATGNPEGAD

SEQ ID NO: 177255 - protein, 37 aa, Artificial Sequence
  Description of Artificial Sequence: Synthetic polypeptide
DEEEISTTNPVATEQYGCVCSTWGEHNAENFNSENQA

SEQ ID NO: 177256 - protein, 35 aa, Artificial Sequence
  Description of Artificial Sequence: Synthetic polypeptide
DETEICTTNPVAYEQWGSVSGGLGNTAGELDGGQS

SEQ ID NO: 177257 - protein, 34 aa, Artificial Sequence
  Description of Artificial Sequence: Synthetic polypeptide
DENEIRTTNPVSTEPYGTITVEDWIQQPQSGNHN

SEQ ID NO: 177258 - protein, 36 aa, Artificial Sequence
  Description of Artificial Sequence: Synthetic polypeptide
DEPEIATTNPVAYEQYGTVATENGGQQQNGGQRGEA

SEQ ID NO: 177259 - protein, 35 aa, Artificial Sequence
  Description of Artificial Sequence: Synthetic polypeptide
AEECIATVNPVATECYGSVVCIDNNDERRQGTNQR

SEQ ID NO: 177260 - protein, 37 aa, Artificial Sequence
  Description of Artificial Sequence: Synthetic polypeptide
DEEEIRTTNPVSTEQYGSVMTPWNQEEQIQQVMQPQI

SEQ ID NO: 177261 - protein, 37 aa, Artificial Sequence
  Description of Artificial Sequence: Synthetic polypeptide
DEEEIRTTNPVATEQYGSVSTTMEMFMPPVSEEMDMP

SEQ ID NO: 177262 - protein, 37 aa, Artificial Sequence
  Description of Artificial Sequence: Synthetic polypeptide
DEEEIRTTNPVATEQYGCVCSTEEDHNQENFMSETQS

SEQ ID NO: 177263 - protein, 36 aa, Artificial Sequence
  Description of Artificial Sequence: Synthetic polypeptide
DEEEISTTNPVATEQYGCVCSSPEHNQENFNSDTQS

SEQ ID NO: 177264 - protein, 34 aa, Artificial Sequence
  Description of Artificial Sequence: Synthetic polypeptide
TEECISTTNPVATEQYGCVCSTGELNAYFLSDQS

SEQ ID NO: 177265 - protein, 36 aa, Artificial Sequence
  Description of Artificial Sequence: Synthetic polypeptide
DEEEIRTTNPVAYEQYGCVCSSGEHNQEFFNSEFQS

SEQ ID NO: 177266 - protein, 36 aa, Artificial Sequence
  Description of Artificial Sequence: Synthetic polypeptide
DEEEISTTNPVATEQYGCVCSTEEHNQENFPSDTQS

SEQ ID NO: 177267 - protein, 36 aa, Artificial Sequence
  Description of Artificial Sequence: Synthetic polypeptide
DEEEIRTTNPVAYEQYGCVCSNWGEHNQNFGSETQS

SEQ ID NO: 177268 - protein, 36 aa, Artificial Sequence
  Description of Artificial Sequence: Synthetic polypeptide
DEPEIGTTNPVATEFYGSVVSATGDGEDQIGGEDGD

SEQ ID NO: 177269 - protein, 36 aa, Artificial Sequence
  Description of Artificial Sequence: Synthetic polypeptide
DEEEIRTTNPVAYEQYGCVCSNWGEHNQENFNSDQA

SEQ ID NO: 177270 - protein, 31 aa, Artificial Sequence
  Description of Artificial Sequence: Synthetic polypeptide
DESEVASTNPISTEGYGNVAAETIQSRVGQR

SEQ ID NO: 177271 - protein, 36 aa, Artificial Sequence
  Description of Artificial Sequence: Synthetic polypeptide
DEPEIQTTNPVATEFYGSVSATGDGEENLEGTEDGD

SEQ ID NO: 177272 - protein, 33 aa, Artificial Sequence
  Description of Artificial Sequence: Synthetic polypeptide
DEDEIATTNPVATEQWGGCCAGTGHQNAEGPMI

SEQ ID NO: 177273 - protein, 36 aa, Artificial Sequence
  Description of Artificial Sequence: Synthetic polypeptide
DEEEISTTNPVATEQYGCVCSTEEPNQENFFSETQS

SEQ ID NO: 177274 - protein, 38 aa, Artificial Sequence
  Description of Artificial Sequence: Synthetic polypeptide
DEPEIRGTNPVATEQYGSVANTNMQVGPGQIGQGNEEN

SEQ ID NO: 177275 - protein, 35 aa, Artificial Sequence
  Description of Artificial Sequence: Synthetic polypeptide
DEEEIRTTNPVAYEQYGCVCSNWGEHAEFFNSNQP

SEQ ID NO: 177276 - protein, 36 aa, Artificial Sequence
  Description of Artificial Sequence: Synthetic polypeptide
AEEEIRTTNPVATEEYGQCSCSSGELNQENFGSDQS

SEQ ID NO: 177277 - protein, 33 aa, Artificial Sequence
  Description of Artificial Sequence: Synthetic polypeptide
DEDEIATTNPVATEQWGGCCAGTGHQNAEGGQN

SEQ ID NO: 177278 - protein, 34 aa, Artificial Sequence
  Description of Artificial Sequence: Synthetic polypeptide
DEDEIATTNPVATEQWGGCCAGTGHQAEGQPMNS

SEQ ID NO: 177279 - protein, 32 aa, Artificial Sequence
  Description of Artificial Sequence: Synthetic polypeptide
VEEEIACTNPVATEQWGCVAGNGLINNMMTDD

SEQ ID NO: 177280 - protein, 37 aa, Artificial Sequence
  Description of Artificial Sequence: Synthetic polypeptide
AEEEIRTTNPVATEGYGCVCSTWMEHNQENFGSDNQS

SEQ ID NO: 177281 - protein, 35 aa, Artificial Sequence
  Description of Artificial Sequence: Synthetic polypeptide
AEEEIRTTNPVATEGYGCVCSWGEHNDEFFGSDQS

SEQ ID NO: 177282 - protein, 36 aa, Artificial Sequence
  Description of Artificial Sequence: Synthetic polypeptide
CEEEIRTTNPVATEQYGCVCSSGEHNQENFGSDFQA

SEQ ID NO: 177283 - protein, 31 aa, Artificial Sequence
  Description of Artificial Sequence: Synthetic polypeptide
DDSEVASTNPVSTEGYGNVAADTIQSRVGQR

SEQ ID NO: 177284 - protein, 36 aa, Artificial Sequence
  Description of Artificial Sequence: Synthetic polypeptide
DEEEIRTTNPVAYEQYGCVCSNWEHNQENFNSDNQS

SEQ ID NO: 177285 - protein, 31 aa, Artificial Sequence
  Description of Artificial Sequence: Synthetic polypeptide
DDSEVASTNPCSTENYGNVAVNTIQSRVGQR

SEQ ID NO: 177286 - protein, 39 aa, Artificial Sequence
  Description of Artificial Sequence: Synthetic polypeptide
DEEEIRTTNPVATEAYGSVVVVVTNNNNNNQQQGTNEEN

SEQ ID NO: 177287 - protein, 34 aa, Artificial Sequence
  Description of Artificial Sequence: Synthetic polypeptide
TEEEIASVNPVCYEPYGVTVSTINLSQSAQGPNV

SEQ ID NO: 177288 - protein, 37 aa, Artificial Sequence
  Description of Artificial Sequence: Synthetic polypeptide
DEDEIRTTNPVATEAWGSVSTVVNNTEQGTNNNQNGE

SEQ ID NO: 177289 - protein, 36 aa, Artificial Sequence
  Description of Artificial Sequence: Synthetic polypeptide
DEDEIATTNPVATEQWGSVAIMGNLENPADQTEGDN

SEQ ID NO: 177290 - protein, 38 aa, Artificial Sequence
  Description of Artificial Sequence: Synthetic polypeptide
DEAEIRTTNPVATEQYGSVPYGTYEMPNNWREEDINDG

SEQ ID NO: 177291 - protein, 37 aa, Artificial Sequence
  Description of Artificial Sequence: Synthetic polypeptide
DEEEIRTTNPVATEQYGSVSTTMFMVMPPVSEEPDMT

SEQ ID NO: 177292 - protein, 37 aa, Artificial Sequence
  Description of Artificial Sequence: Synthetic polypeptide
DEDEIATTNPVATEQWGHSVSANGDMGEDHQGGEDNH

SEQ ID NO: 177293 - protein, 32 aa, Artificial Sequence
  Description of Artificial Sequence: Synthetic polypeptide
TEEEIASVNPVCYEPYGVTVSINDSQSGTNNQ

SEQ ID NO: 177294 - protein, 33 aa, Artificial Sequence
  Description of Artificial Sequence: Synthetic polypeptide
DEDEIATTNPVATEQWGHNCAANNGPEPDQGND

SEQ ID NO: 177295 - protein, 32 aa, Artificial Sequence
  Description of Artificial Sequence: Synthetic polypeptide
VEEEIACTNPVATEQWGCVAGTGDLINMMTDD

SEQ ID NO: 177296 - protein, 35 aa, Artificial Sequence
  Description of Artificial Sequence: Synthetic polypeptide
DEPEIATTNPVAYEQWGSCSPTLDNNEHQDDRDDP

SEQ ID NO: 177297 - protein, 34 aa, Artificial Sequence
  Description of Artificial Sequence: Synthetic polypeptide
DESEVASTNPVATEGYGNVAATPTIPQMRVGQPR

SEQ ID NO: 177298 - protein, 33 aa, Artificial Sequence
  Description of Artificial Sequence: Synthetic polypeptide
TEEEIASVNPVCYEPYGKTVSIPNLSQSGGNNV
